United States Patent 7,250,496 (BIOINFORMATICALLY DETECTABLE GROUP OF NOVEL REGULATORY GENES AND USES THEREOF) - sequence listing, part 4

SEQ ID NO: 103520 - RNA, 21 nt, Human
cgacaucagcugcuccaccag

SEQ ID NO: 103521 - RNA, 24 nt, Human
cgccccgggcccccgccccuccgc

SEQ ID NO: 103522 - RNA, 23 nt, Human
cgccgcccucugggcaccaucua

SEQ ID NO: 103523 - RNA, 22 nt, Human
cgccuacucucaaggucuucug

SEQ ID NO: 103524 - RNA, 25 nt, Human
cgggcccccucccgggccccugccg

SEQ ID NO: 103525 - RNA, 23 nt, Human
cucagcccuucaagagcuggggu

SEQ ID NO: 103526 - RNA, 22 nt, Human
cuccagucccccgucucugcac

SEQ ID NO: 103527 - RNA, 21 nt, Human
cucccacccccagcaggccac

SEQ ID NO: 103528 - RNA, 25 nt, Human
cucccgccucccugcacggccucca

SEQ ID NO: 103529 - RNA, 23 nt, Human
cucccgggccccugccgccgccc

SEQ ID NO: 103530 - RNA, 24 nt, Human
cucccucuaucucccucccccucc

SEQ ID NO: 103531 - RNA, 19 nt, Human
cugcacagaccacccccca

SEQ ID NO: 103532 - RNA, 20 nt, Human
cugccgccucccgccgcucc

SEQ ID NO: 103533 - RNA, 19 nt, Human
cugcuccaccagcacccca

SEQ ID NO: 103534 - RNA, 19 nt, Human
cuggccccgccgcucgggc

SEQ ID NO: 103535 - RNA, 18 nt, Human
cuucaagagcuggggucc

SEQ ID NO: 103536 - RNA, 18 nt, Human
cuucccacccuacccuuc

SEQ ID NO: 103537 - RNA, 20 nt, Human
cuugggcuggccccgccgcu

SEQ ID NO: 103538 - RNA, 25 nt, Human
gaccccuguuuccaagaccaacccc

SEQ ID NO: 103539 - RNA, 19 nt, Human
gagcaggaggcugccuugg

SEQ ID NO: 103540 - RNA, 22 nt, Human
gaggaggggaaccccagagagg

SEQ ID NO: 103541 - RNA, 26 nt, Human
gaggcaguggcaccuacauucugggu

SEQ ID NO: 103542 - RNA, 24 nt, Human
gauccuguaaacauaggaggcagu

SEQ ID NO: 103543 - RNA, 18 nt, Human
gcaccuacauucuggguc

SEQ ID NO: 103544 - RNA, 21 nt, Human
gcaccugucacacgcaugcuc

SEQ ID NO: 103545 - RNA, 24 nt, Human
gccgccccgggcccccgccccucc

SEQ ID NO: 103546 - RNA, 18 nt, Human
gccgccucccgccgcucc

SEQ ID NO: 103547 - RNA, 18 nt, Human
gccugucucuccgcaccc

SEQ ID NO: 103548 - RNA, 20 nt, Human
gcucgggcccccucccgggc

SEQ ID NO: 103549 - RNA, 21 nt, Human
gcucgggcccccucccgggcc

SEQ ID NO: 103550 - RNA, 18 nt, Human
gcugaccuucggccuggg

SEQ ID NO: 103551 - RNA, 22 nt, Human
gcugaccuucggccugggagac

SEQ ID NO: 103552 - RNA, 19 nt, Human
ggagacagggaagccuugc

SEQ ID NO: 103553 - RNA, 19 nt, Human
ggaguggaacggagucacu

SEQ ID NO: 103554 - RNA, 19 nt, Human
gggaauaaaggaggagugg

SEQ ID NO: 103555 - RNA, 19 nt, Human
gggcccccgccccuccgcc

SEQ ID NO: 103556 - RNA, 18 nt, Human
ggggaaccccagagaggg

SEQ ID NO: 103557 - RNA, 24 nt, Human
gggggcagugucagggaaucaaau

SEQ ID NO: 103558 - RNA, 19 nt, Human
ggguggugggugaggaggu

SEQ ID NO: 103559 - RNA, 21 nt, Human
guccuucucgguaaggagagu

SEQ ID NO: 103560 - RNA, 20 nt, Human
gucugcacagaccacccccc

SEQ ID NO: 103561 - RNA, 21 nt, Human
guuacaaagguacaaaacgua

SEQ ID NO: 103562 - RNA, 24 nt, Human
uaaacaguaacaaaauuuuaaagu

SEQ ID NO: 103563 - RNA, 22 nt, Human
uaaacauaggaggcaguggcac

SEQ ID NO: 103564 - RNA, 18 nt, Human
uaaggagaguuugggucc

SEQ ID NO: 103565 - RNA, 18 nt, Human
uaagggaauaaaggagga

SEQ ID NO: 103566 - RNA, 25 nt, Human
uaauaaacacacacauccaccagga

SEQ ID NO: 103567 - RNA, 21 nt, Human
uagaggcccgagccccucccc

SEQ ID NO: 103568 - RNA, 22 nt, Human
uaucucccucccccucccagcc

SEQ ID NO: 103569 - RNA, 26 nt, Human
ucaaaccccccaggagaccggguguc

SEQ ID NO: 103570 - RNA, 19 nt, Human
ucagcccuucaagagcugg

SEQ ID NO: 103571 - RNA, 22 nt, Human
ucaguccuaggucauaaggcag

SEQ ID NO: 103572 - RNA, 21 nt, Human
uccaagaccaacccccagccc

SEQ ID NO: 103573 - RNA, 21 nt, Human
uccacauaauaaacacacaca

SEQ ID NO: 103574 - RNA, 24 nt, Human
uccacauaauaaacacacacaucc

SEQ ID NO: 103575 - RNA, 18 nt, Human
uccaccagcaccccacag

SEQ ID NO: 103576 - RNA, 20 nt, Human
uccagucagggaaguagaau

SEQ ID NO: 103577 - RNA, 18 nt, Human
ucccacccuacccuucgg

SEQ ID NO: 103578 - RNA, 20 nt, Human
ucccagcccagccucaaacc

SEQ ID NO: 103579 - RNA, 22 nt, Human
ucccagcccagccucaaacccc

SEQ ID NO: 103580 - RNA, 19 nt, Human
ucccccgucucugcaccug

SEQ ID NO: 103581 - RNA, 22 nt, Human
ucccccgucucugcaccuguca

SEQ ID NO: 103582 - RNA, 20 nt, Human
uccccgacgcugcugccgcc

SEQ ID NO: 103583 - RNA, 22 nt, Human
ucccgggccccugccgccgccc

SEQ ID NO: 103584 - RNA, 19 nt, Human
ucccucuaucucccucccc

SEQ ID NO: 103585 - RNA, 23 nt, Human
ucccugcacggccuccaccgccc

SEQ ID NO: 103586 - RNA, 21 nt, Human
uccucugucgcccucagcugu

SEQ ID NO: 103587 - RNA, 21 nt, Human
uccuguaaacauaggaggcag

SEQ ID NO: 103588 - RNA, 26 nt, Human
ucgggcccccucccgggccccugccg

SEQ ID NO: 103589 - RNA, 26 nt, Human
ucuacgaaaccuaggacauaguaaag

SEQ ID NO: 103590 - RNA, 20 nt, Human
ucuccgcacccccgccgccc

SEQ ID NO: 103591 - RNA, 22 nt, Human
ucucuccgcacccccgccgccc

SEQ ID NO: 103592 - RNA, 18 nt, Human
ucugaguccaccccagga

SEQ ID NO: 103593 - RNA, 25 nt, Human
ucuguaaacacgacaucagcugcuc

SEQ ID NO: 103594 - RNA, 20 nt, Human
ugaacagggucguaacaguc

SEQ ID NO: 103595 - RNA, 22 nt, Human
ugacgauacucagaucaacuug

SEQ ID NO: 103596 - RNA, 26 nt, Human
ugacgauacucagaucaacuuggggg

SEQ ID NO: 103597 - RNA, 20 nt, Human
ugacuagaggcccgagcccc

SEQ ID NO: 103598 - RNA, 24 nt, Human
ugagcaagcccccaugaggaaguc

SEQ ID NO: 103599 - RNA, 23 nt, Human
ugcacagaccaccccccagcccu

SEQ ID NO: 103600 - RNA, 18 nt, Human
ugccgccucccgccgcuc

SEQ ID NO: 103601 - RNA, 18 nt, Human
uggaauagggggaggaag

SEQ ID NO: 103602 - RNA, 20 nt, Human
uggacagcagacaaaauagc

SEQ ID NO: 103603 - RNA, 18 nt, Human
uggagccucagcccugcc

SEQ ID NO: 103604 - RNA, 18 nt, Human
uggcaccacagacaacuu

SEQ ID NO: 103605 - RNA, 18 nt, Human
uggcaccuacauucuggg

SEQ ID NO: 103606 - RNA, 21 nt, Human
uggcagggacuccacauaaua

SEQ ID NO: 103607 - RNA, 21 nt, Human
ugggccccugacgauacucag

SEQ ID NO: 103608 - RNA, 19 nt, Human
ugggcuggaggaggggaac

SEQ ID NO: 103609 - RNA, 20 nt, Human
uggggguggaauagggggag

SEQ ID NO: 103610 - RNA, 19 nt, Human
ugggguggugggugaggag

SEQ ID NO: 103611 - RNA, 19 nt, Human
ugggguggugggugaggag

SEQ ID NO: 103612 - RNA, 24 nt, Human
uguaaacaaaguguaaaacucaaa

SEQ ID NO: 103613 - RNA, 30 nt, Human
ugucacacgcaugcucacagaugcacaugg

SEQ ID NO: 103614 - RNA, 20 nt, Human
ugucccacccaucugagucc

SEQ ID NO: 103615 - RNA, 23 nt, Human
uguuaaacgggacucaaggcuga

SEQ ID NO: 103616 - RNA, 24 nt, Human
uuagaaaaccccucaagauggcca

SEQ ID NO: 103617 - RNA, 25 nt, Human
uucaagcagggggcagugucaggga

SEQ ID NO: 103618 - RNA, 18 nt, Human
uuccaagaccaaccccca

SEQ ID NO: 103619 - RNA, 21 nt, Human
uuggccuuuggagcauucaau

SEQ ID NO: 103620 - RNA, 23 nt, Human
uuuccaagaccaacccccagccc

SEQ ID NO: 103621 - RNA, 21 nt, Human
uuugcucaccuucccacccua

SEQ ID NO: 103622 - RNA, 22 nt, Human
aaauucuccaaguuagaauuuc

SEQ ID NO: 103623 - RNA, 21 nt, Human
aaguaaccagaacaucaaagc

SEQ ID NO: 103624 - RNA, 22 nt, Human
aaugcccagccuuccaggcaac

SEQ ID NO: 103625 - RNA, 20 nt, Human
acaaaaauacccauaaaagc

SEQ ID NO: 103626 - RNA, 19 nt, Human
acacauccguugacaagca

SEQ ID NO: 103627 - RNA, 21 nt, Human
acccauaaaagcaucgaaaau

SEQ ID NO: 103628 - RNA, 22 nt, Human
accucuguuacagaggaaaguc

SEQ ID NO: 103629 - RNA, 19 nt, Human
agaacaucaaagcuuacag

SEQ ID NO: 103630 - RNA, 22 nt, Human
agacagcaaaguccagacagca

SEQ ID NO: 103631 - RNA, 19 nt, Human
agacagcaucgcagaaucc

SEQ ID NO: 103632 - RNA, 20 nt, Human
agagacagcaaaguccagac

SEQ ID NO: 103633 - RNA, 25 nt, Human
agccggugcuuggcagaaguccgcg

SEQ ID NO: 103634 - RNA, 20 nt, Human
auuacagaaagagcuaaaau

SEQ ID NO: 103635 - RNA, 24 nt, Human
caaaaauacccauaaaagcaucga

SEQ ID NO: 103636 - RNA, 19 nt, Human
caaaauccucaaauaguca

SEQ ID NO: 103637 - RNA, 22 nt, Human
caggcaacugcucaaagugguc

SEQ ID NO: 103638 - RNA, 26 nt, Human
ccacagcaaaucugauguuguccgga

SEQ ID NO: 103639 - RNA, 21 nt, Human
cccauaccacagcaaaucuga

SEQ ID NO: 103640 - RNA, 21 nt, Human
cuaauggugaggcuacucuga

SEQ ID NO: 103641 - RNA, 20 nt, Human
gacaggaauuuacuagaagu

SEQ ID NO: 103642 - RNA, 19 nt, Human
gagaguccccgguaucauc

SEQ ID NO: 103643 - RNA, 20 nt, Human
gaguaacucacaaacuaaag

SEQ ID NO: 103644 - RNA, 19 nt, Human
gcagagggugcuggcgccc

SEQ ID NO: 103645 - RNA, 20 nt, Human
ggagaguccccgguaucauc

SEQ ID NO: 103646 - RNA, 22 nt, Human
uaaaaaauguaaauauuacaga

SEQ ID NO: 103647 - RNA, 22 nt, Human
uaaauauuacagaaagagcuaa

SEQ ID NO: 103648 - RNA, 21 nt, Human
uacccauaaaagcaucgaaaa

SEQ ID NO: 103649 - RNA, 18 nt, Human
uaccucuguuacagagga

SEQ ID NO: 103650 - RNA, 23 nt, Human
uaccucuguuacagaggaaaguc

SEQ ID NO: 103651 - RNA, 19 nt, Human
uacucugaagggcagaggu

SEQ ID NO: 103652 - RNA, 22 nt, Human
uauuaccucuguuacagaggaa

SEQ ID NO: 103653 - RNA, 23 nt, Human
uccagacagcaucgcagaaucca

SEQ ID NO: 103654 - RNA, 19 nt, Human
uccaggcaacugcucaaag

SEQ ID NO: 103655 - RNA, 20 nt, Human
ucccacggcuccugcucggg

SEQ ID NO: 103656 - RNA, 19 nt, Human
ucccauaccacagcaaauc

SEQ ID NO: 103657 - RNA, 23 nt, Human
ucccuuauguguaaaauaaaagu

SEQ ID NO: 103658 - RNA, 23 nt, Human
ucucauauauuaccucuguuaca

SEQ ID NO: 103659 - RNA, 18 nt, Human
ucucccauaccacagcaa

SEQ ID NO: 103660 - RNA, 24 nt, Human
ucuccuucucaaaaaaaagaaaaa

SEQ ID NO: 103661 - RNA, 20 nt, Human
ucucuacaaagaaacuacaa

SEQ ID NO: 103662 - RNA, 25 nt, Human
ucucucuacaaagaaacuacaaaaa

SEQ ID NO: 103663 - RNA, 23 nt, Human
ucuucuaugauuuacaagaguug

SEQ ID NO: 103664 - RNA, 20 nt, Human
ugaaaagcuacacauccguu

SEQ ID NO: 103665 - RNA, 23 nt, Human
ugccggguccgggagcgaaaggc

SEQ ID NO: 103666 - RNA, 24 nt, Human
uuacagguuuucuauucaucccca

SEQ ID NO: 103667 - RNA, 20 nt, Human
uucaaaauccucaaauaguc

SEQ ID NO: 103668 - RNA, 27 nt, Human
uuccaggcaacugcucaaaguggucuu

SEQ ID NO: 103669 - RNA, 18 nt, Human
aaaacguucacccccaca

SEQ ID NO: 103670 - RNA, 19 nt, Human
aaccaggcgaugagcaagc

SEQ ID NO: 103671 - RNA, 18 nt, Human
aagcaggcucaggagccc

SEQ ID NO: 103672 - RNA, 20 nt, Human
aagucacauggacagggcca

SEQ ID NO: 103673 - RNA, 20 nt, Human
accaggcgaugagcaagccc

SEQ ID NO: 103674 - RNA, 19 nt, Human
acccccacaaaaggggagu

SEQ ID NO: 103675 - RNA, 23 nt, Human
agagggaggagaggcauggggcc

SEQ ID NO: 103676 - RNA, 23 nt, Human
agcccagggccaaauggggagga

SEQ ID NO: 103677 - RNA, 19 nt, Human
aggcagaagcaggcucagg

SEQ ID NO: 103678 - RNA, 20 nt, Human
aggcagaagcaggcucagga

SEQ ID NO: 103679 - RNA, 20 nt, Human
aggcggccuggggggugggg

SEQ ID NO: 103680 - RNA, 22 nt, Human
agggagacagcuuguuggucuu

SEQ ID NO: 103681 - RNA, 18 nt, Human
agggaggagaggcauggg

SEQ ID NO: 103682 - RNA, 26 nt, Human
caaggcggccuggggggugggggugg

SEQ ID NO: 103683 - RNA, 22 nt, Human
cacccgccccaccugguccccu

SEQ ID NO: 103684 - RNA, 21 nt, Human
cagccccaggccccucugccc

SEQ ID NO: 103685 - RNA, 21 nt, Human
cagcgggugcccagagagucc

SEQ ID NO: 103686 - RNA, 19 nt, Human
caggaccaggggaagcauu

SEQ ID NO: 103687 - RNA, 27 nt, Human
caggagcccgcagugaguuaaacugug

SEQ ID NO: 103688 - RNA, 24 nt, Human
ccaaauggggaggaaagaggauuc

SEQ ID NO: 103689 - RNA, 18 nt, Human
ccaccaaagaccugacgu

SEQ ID NO: 103690 - RNA, 20 nt, Human
ccagggccaaauggggagga

SEQ ID NO: 103691 - RNA, 28 nt, Human
cccacccgccccaccugguccccugagc

SEQ ID NO: 103692 - RNA, 21 nt, Human
ccccaccugguccccugagcc

SEQ ID NO: 103693 - RNA, 21 nt, Human
cccccacaaaaggggagugga

SEQ ID NO: 103694 - RNA, 18 nt, Human
ccccugagcccagggcca

SEQ ID NO: 103695 - RNA, 24 nt, Human
ccccugagcccagggccaaauggg

SEQ ID NO: 103696 - RNA, 24 nt, Human
ccuccagggcccaucccuggcugc

SEQ ID NO: 103697 - RNA, 18 nt, Human
ccuucccagaauggcuuu

SEQ ID NO: 103698 - RNA, 23 nt, Human
ccuugcagggggccuaggcugga

SEQ ID NO: 103699 - RNA, 19 nt, Human
cgcagguccggauucuccu

SEQ ID NO: 103700 - RNA, 20 nt, Human
cuaugcgcagcgccuucucc

SEQ ID NO: 103701 - RNA, 26 nt, Human
cucagccccgggcccggccgagguga

SEQ ID NO: 103702 - RNA, 22 nt, Human
cuccucggcuaugcgcagcgcc

SEQ ID NO: 103703 - RNA, 22 nt, Human
cucugggcccagccccaggccc

SEQ ID NO: 103704 - RNA, 23 nt, Human
cugcacucuggcuccaugcacag

SEQ ID NO: 103705 - RNA, 23 nt, Human
cuggaugauccgugacuucuccc

SEQ ID NO: 103706 - RNA, 21 nt, Human
gacuggggagguggaaggucc

SEQ ID NO: 103707 - RNA, 19 nt, Human
gaggcugaccucagccccg

SEQ ID NO: 103708 - RNA, 18 nt, Human
gcauggggccugcagcug

SEQ ID NO: 103709 - RNA, 19 nt, Human
gcccagccccaggccccuc

SEQ ID NO: 103710 - RNA, 24 nt, Human
gccccgggcccggccgaggugacc

SEQ ID NO: 103711 - RNA, 19 nt, Human
gcgcccuugguuacuucca

SEQ ID NO: 103712 - RNA, 21 nt, Human
gcuccgacgccaggauggcgc

SEQ ID NO: 103713 - RNA, 24 nt, Human
gcugaccucagccccgggcccggc

SEQ ID NO: 103714 - RNA, 22 nt, Human
gcugcugugguuaguccacuga

SEQ ID NO: 103715 - RNA, 21 nt, Human
ggacagggccagagaaaggga

SEQ ID NO: 103716 - RNA, 20 nt, Human
ggacuggggagguggaaagc

SEQ ID NO: 103717 - RNA, 22 nt, Human
ggagcccuucccagaauggcuu

SEQ ID NO: 103718 - RNA, 21 nt, Human
ggauggcagaggggagaggca

SEQ ID NO: 103719 - RNA, 18 nt, Human
ggauggggcccugccaga

SEQ ID NO: 103720 - RNA, 20 nt, Human
ggcagguggaggccaccccg

SEQ ID NO: 103721 - RNA, 19 nt, Human
ggcccagccccaggccccu

SEQ ID NO: 103722 - RNA, 18 nt, Human
ggccgaggugaccgggcc

SEQ ID NO: 103723 - RNA, 23 nt, Human
ggccuaggcuggaccuucuucug

SEQ ID NO: 103724 - RNA, 19 nt, Human
ggggaggaaagaggauucu

SEQ ID NO: 103725 - RNA, 20 nt, Human
ggggggugggggugggggcu

SEQ ID NO: 103726 - RNA, 18 nt, Human
gggggugggggugggggc

SEQ ID NO: 103727 - RNA, 21 nt, Human
gggggugggggugggggcugc

SEQ ID NO: 103728 - RNA, 19 nt, Human
ggggugggggcugccagcc

SEQ ID NO: 103729 - RNA, 18 nt, Human
ggggugggggugggggcu

SEQ ID NO: 103730 - RNA, 23 nt, Human
gggugggggcugccagccuugca

SEQ ID NO: 103731 - RNA, 23 nt, Human
ggugcccagagaguccucugccc

SEQ ID NO: 103732 - RNA, 23 nt, Human
uagcaccggacagcuccccaccc

SEQ ID NO: 103733 - RNA, 21 nt, Human
ucaaggcggccuggggggugg

SEQ ID NO: 103734 - RNA, 21 nt, Human
ucagccccgggcccggccgag

SEQ ID NO: 103735 - RNA, 19 nt, Human
uccaugcacagcgggugcc

SEQ ID NO: 103736 - RNA, 25 nt, Human
uccaugcacagcgggugcccagaga

SEQ ID NO: 103737 - RNA, 22 nt, Human
ucccagaauggcuuuggggucc

SEQ ID NO: 103738 - RNA, 30 nt, Human
ucccagaauggcuuugggguccccccaccc

SEQ ID NO: 103739 - RNA, 26 nt, Human
uccccugagcccagggccaaaugggg

SEQ ID NO: 103740 - RNA, 20 nt, Human
ucccuggcugcugcuguggu

SEQ ID NO: 103741 - RNA, 22 nt, Human
ucucaaggcggccuggggggug

SEQ ID NO: 103742 - RNA, 24 nt, Human
ucuccggccgggaaccuccagggc

SEQ ID NO: 103743 - RNA, 25 nt, Human
ucuccggccgggaaccuccagggcc

SEQ ID NO: 103744 - RNA, 21 nt, Human
ucugcuggaaccaggcgauga

SEQ ID NO: 103745 - RNA, 24 nt, Human
ucuugcggcagguggaggccaccc

SEQ ID NO: 103746 - RNA, 22 nt, Human
ugccaaucuagguugggggcac

SEQ ID NO: 103747 - RNA, 25 nt, Human
ugcccagagaguccucugcccuggg

SEQ ID NO: 103748 - RNA, 19 nt, Human
ugcccugggguggugcugc

SEQ ID NO: 103749 - RNA, 21 nt, Human
ugcccuugaccggcaggccgg

SEQ ID NO: 103750 - RNA, 19 nt, Human
ugcugcugugguuagucca

SEQ ID NO: 103751 - RNA, 30 nt, Human
uggaaaccuccaaucuggaaagaaaaccaa

SEQ ID NO: 103752 - RNA, 24 nt, Human
uggaaagaaaaccaagggccaaag

SEQ ID NO: 103753 - RNA, 25 nt, Human
uggaaagcaggcagaagcaggcuca

SEQ ID NO: 103754 - RNA, 22 nt, Human
uggacagggccagagaaaggga

SEQ ID NO: 103755 - RNA, 20 nt, Human
uggacucugggcccagcccc

SEQ ID NO: 103756 - RNA, 21 nt, Human
uggauggcagaggggagaggc

SEQ ID NO: 103757 - RNA, 21 nt, Human
uggcagaggggagaggcacuc

SEQ ID NO: 103758 - RNA, 24 nt, Human
uggcagaggggagaggcacucucc

SEQ ID NO: 103759 - RNA, 18 nt, Human
uggggaggaaagaggauu

SEQ ID NO: 103760 - RNA, 20 nt, Human
ugggggcugccagccuugca

SEQ ID NO: 103761 - RNA, 19 nt, Human
ugggggguggggguggggg

SEQ ID NO: 103762 - RNA, 19 nt, Human
ugggggguggggguggggg

SEQ ID NO: 103763 - RNA, 19 nt, Human
ugugguuaguccacugagg

SEQ ID NO: 103764 - RNA, 28 nt, Human
uugcagggggccuaggcuggaccuucuu

SEQ ID NO: 103765 - RNA, 22 nt, Human
agcaagaaacgaaucgccggaa

SEQ ID NO: 103766 - RNA, 20 nt, Human
aggccgcggccaagcaauaa

SEQ ID NO: 103767 - RNA, 19 nt, Human
cacaaguaauuacaaagac

SEQ ID NO: 103768 - RNA, 22 nt, Human
cacacggaccacagcuccagga

SEQ ID NO: 103769 - RNA, 18 nt, Human
cacagcuccaggaagccg

SEQ ID NO: 103770 - RNA, 19 nt, Human
cauauauacauacauauau

SEQ ID NO: 103771 - RNA, 21 nt, Human
ccacacggaccacagcuccag

SEQ ID NO: 103772 - RNA, 22 nt, Human
ccacacggaccacagcuccagg

SEQ ID NO: 103773 - RNA, 27 nt, Human
ccacagcuccaggaagccgagcaagaa

SEQ ID NO: 103774 - RNA, 18 nt, Human
uacauauacauauauaca

SEQ ID NO: 103775 - RNA, 26 nt, Human
uacauauacauauauacauacauaua

SEQ ID NO: 103776 - RNA, 24 nt, Human
uacauauauacauacauauauuua

SEQ ID NO: 103777 - RNA, 19 nt, Human
uauacaaacuguuuuuaca

SEQ ID NO: 103778 - RNA, 24 nt, Human
uauacauauauacauacauauauu

SEQ ID NO: 103779 - RNA, 21 nt, Human
uauuccaacuauacaaacugu

SEQ ID NO: 103780 - RNA, 19 nt, Human
uuacacaaaacugaauaaa

SEQ ID NO: 103781 - RNA, 19 nt, Human
aacaaagucauuuccaaau

SEQ ID NO: 103782 - RNA, 20 nt, Human
aagcugcacuacaacaucau

SEQ ID NO: 103783 - RNA, 21 nt, Human
auaaacaaagucauuuccaaa

SEQ ID NO: 103784 - RNA, 19 nt, Human
auugaaauuaagcugcacu

SEQ ID NO: 103785 - RNA, 23 nt, Human
caaaauggccaggacccuccgcg

SEQ ID NO: 103786 - RNA, 21 nt, Human
caaaguaaagacugaauugaa

SEQ ID NO: 103787 - RNA, 19 nt, Human
caccaaaauggccaggacc

SEQ ID NO: 103788 - RNA, 23 nt, Human
caggcugaacuggucccaccaaa

SEQ ID NO: 103789 - RNA, 20 nt, Human
cccuccgcggccggcacuuc

SEQ ID NO: 103790 - RNA, 21 nt, Human
ccgcggccggcacuucagggc

SEQ ID NO: 103791 - RNA, 26 nt, Human
cugcacuacaacaucauuaccaggga

SEQ ID NO: 103792 - RNA, 24 nt, Human
uaaggaaugcuggaucuccagaga

SEQ ID NO: 103793 - RNA, 24 nt, Human
uacaacaucauuaccagggauaga

SEQ ID NO: 103794 - RNA, 19 nt, Human
uaccacaaugcauucauuu

SEQ ID NO: 103795 - RNA, 22 nt, Human
uaccagggauagacacauaaac

SEQ ID NO: 103796 - RNA, 25 nt, Human
ucccaccaaaauggccaggacccuc

SEQ ID NO: 103797 - RNA, 21 nt, Human
ucccuuaucuuucaacucuag

SEQ ID NO: 103798 - RNA, 28 nt, Human
ucccuuaucuuucaacucuaguggcaaa

SEQ ID NO: 103799 - RNA, 22 nt, Human
uccgcggccggcacuucagggc

SEQ ID NO: 103800 - RNA, 23 nt, Human
aaaaaagcacaacgacagacgca

SEQ ID NO: 103801 - RNA, 24 nt, Human
aaaaacagaaaaaagcacaacgac

SEQ ID NO: 103802 - RNA, 19 nt, Human
aaacacauacccacacaca

SEQ ID NO: 103803 - RNA, 21 nt, Human
aaacagaaaaaagcacaacga

SEQ ID NO: 103804 - RNA, 23 nt, Human
aaacagaaaaaagcacaacgaca

SEQ ID NO: 103805 - RNA, 19 nt, Human
aacacauacccacacacac

SEQ ID NO: 103806 - RNA, 23 nt, Human
aauucccgauacaaaacuauucc

SEQ ID NO: 103807 - RNA, 24 nt, Human
aauuggucuaaaaacagaaaaaag

SEQ ID NO: 103808 - RNA, 24 nt, Human
acaaaacuauuccaugccucauac

SEQ ID NO: 103809 - RNA, 24 nt, Human
acagaaaaaagcacaacgacagac

SEQ ID NO: 103810 - RNA, 18 nt, Human
acauacccacacacacau

SEQ ID NO: 103811 - RNA, 21 nt, Human
agaaaaaagcacaacgacaga

SEQ ID NO: 103812 - RNA, 18 nt, Human
agcacaacgacagacgca

SEQ ID NO: 103813 - RNA, 22 nt, Human
auaaagcaugcccugacuaaag

SEQ ID NO: 103814 - RNA, 23 nt, Human
auacccacacacacauauguaca

SEQ ID NO: 103815 - RNA, 20 nt, Human
auuagaagaauaaaaugugu

SEQ ID NO: 103816 - RNA, 23 nt, Human
auuuuauuagaaaacaaaggcua

SEQ ID NO: 103817 - RNA, 24 nt, Human
cacauacaaacagagauugugaua

SEQ ID NO: 103818 - RNA, 19 nt, Human
cagagauugugauauagug

SEQ ID NO: 103819 - RNA, 21 nt, Human
cagauagaauaucauaaagca

SEQ ID NO: 103820 - RNA, 18 nt, Human
caguagaggaauggcaau

SEQ ID NO: 103821 - RNA, 19 nt, Human
cccacauacaaacagagau

SEQ ID NO: 103822 - RNA, 18 nt, Human
gaagccugcagcccucac

SEQ ID NO: 103823 - RNA, 18 nt, Human
gcaguagaggaauggcaa

SEQ ID NO: 103824 - RNA, 19 nt, Human
guaagagaaagauaaacac

SEQ ID NO: 103825 - RNA, 28 nt, Human
uaaaaaauuggucuaaaaacagaaaaaa

SEQ ID NO: 103826 - RNA, 21 nt, Human
uaaaaacagaaaaaagcacaa

SEQ ID NO: 103827 - RNA, 20 nt, Human
uaaacacauacccacacaca

SEQ ID NO: 103828 - RNA, 22 nt, Human
uaaacacauacccacacacaca

SEQ ID NO: 103829 - RNA, 22 nt, Human
uaaacacuccuacauguauaug

SEQ ID NO: 103830 - RNA, 26 nt, Human
uaacaugcuuuuccuucauuuuacuc

SEQ ID NO: 103831 - RNA, 22 nt, Human
uaagcaaagaugucuaaaacag

SEQ ID NO: 103832 - RNA, 19 nt, Human
uacgacaaugcuuaccaag

SEQ ID NO: 103833 - RNA, 20 nt, Human
uagaauaucauaaagcaaaa

SEQ ID NO: 103834 - RNA, 26 nt, Human
ucaauaccuacacaugggagaucuaa

SEQ ID NO: 103835 - RNA, 26 nt, Human
ugacuaaagagaaguccuguaggcac

SEQ ID NO: 103836 - RNA, 23 nt, Human
ugcacauuuuccuuaaaaacaca

SEQ ID NO: 103837 - RNA, 21 nt, Human
ugccuucuuuauuacuccaac

SEQ ID NO: 103838 - RNA, 21 nt, Human
ugucuaaaacagauuguaaga

SEQ ID NO: 103839 - RNA, 24 nt, Human
uguucugccuucuuuauuacucca

SEQ ID NO: 103840 - RNA, 23 nt, Human
uucaaugacuggcaccucccagg

SEQ ID NO: 103841 - RNA, 19 nt, Human
uucuaaggaauuguuuucu

SEQ ID NO: 103842 - RNA, 20 nt, Human
uuggucuaaaaacagaaaaa

SEQ ID NO: 103843 - RNA, 22 nt, Human
uuuuuuuuuuuuuuuuuuacag

SEQ ID NO: 103844 - RNA, 20 nt, Human
aaaaaaagaaaaaaaaaccu

SEQ ID NO: 103845 - RNA, 22 nt, Human
aaaaaaagaaaaaaaaaccuag

SEQ ID NO: 103846 - RNA, 20 nt, Human
aaaaaagaaaugcuaaaaaa

SEQ ID NO: 103847 - RNA, 20 nt, Human
aaaacaacaggacccugugg

SEQ ID NO: 103848 - RNA, 24 nt, Human
aaaagaaaauauacaucuuaagga

SEQ ID NO: 103849 - RNA, 25 nt, Human
aaaauaaaaaagaaaugcuaaaaaa

SEQ ID NO: 103850 - RNA, 21 nt, Human
aaaauagggcuuuguccuuau

SEQ ID NO: 103851 - RNA, 19 nt, Human
aaacaaaacaacaggaccc

SEQ ID NO: 103852 - RNA, 20 nt, Human
aaagaaacugauggaaaaau

SEQ ID NO: 103853 - RNA, 22 nt, Human
aaagugcaaaauauguuacaga

SEQ ID NO: 103854 - RNA, 26 nt, Human
aacuccuugcuucuuuuaaaaacucc

SEQ ID NO: 103855 - RNA, 25 nt, Human
aacucggagaaaaacauuacaaccu

SEQ ID NO: 103856 - RNA, 22 nt, Human
aagacaaaaugcuugcauacaa

SEQ ID NO: 103857 - RNA, 23 nt, Human
aagauguacuucucuacuggcuu

SEQ ID NO: 103858 - RNA, 22 nt, Human
aauucauagcaucuaccaccac

SEQ ID NO: 103859 - RNA, 19 nt, Human
acaaugacagugcaaucag

SEQ ID NO: 103860 - RNA, 26 nt, Human
acagggaagagaccacaccuuuacuu

SEQ ID NO: 103861 - RNA, 18 nt, Human
acgaugagacacacacac

SEQ ID NO: 103862 - RNA, 23 nt, Human
acuacagcagcacauagagccug

SEQ ID NO: 103863 - RNA, 18 nt, Human
acuagccccuggcuccau

SEQ ID NO: 103864 - RNA, 20 nt, Human
agacaaaaugcuugcauaca

SEQ ID NO: 103865 - RNA, 22 nt, Human
agacaaaaugcuugcauacaau

SEQ ID NO: 103866 - RNA, 19 nt, Human
agacacacacacaagaaga

SEQ ID NO: 103867 - RNA, 22 nt, Human
agccaccaacaaugagcucaaa

SEQ ID NO: 103868 - RNA, 26 nt, Human
agcccccaaauguauaguaaaccacc

SEQ ID NO: 103869 - RNA, 18 nt, Human
aguaacccaaugucuucu

SEQ ID NO: 103870 - RNA, 23 nt, Human
aucaaacaaaacaacaggacccu

SEQ ID NO: 103871 - RNA, 21 nt, Human
auucauagcaucuaccaccac

SEQ ID NO: 103872 - RNA, 18 nt, Human
caaaacucaccagacaau

SEQ ID NO: 103873 - RNA, 21 nt, Human
caaaacucaccagacaaucca

SEQ ID NO: 103874 - RNA, 24 nt, Human
caaaaguauagucagaaauucuga

SEQ ID NO: 103875 - RNA, 20 nt, Human
caaacaaaacaacaggaccc

SEQ ID NO: 103876 - RNA, 22 nt, Human
caacuagccccuggcuccauaa

SEQ ID NO: 103877 - RNA, 22 nt, Human
caauaggcacaaaaggccuggu

SEQ ID NO: 103878 - RNA, 20 nt, Human
caaugagcucaaacguagug

SEQ ID NO: 103879 - RNA, 30 nt, Human
cacauaccucuuuauuucauaaaaauauaa

SEQ ID NO: 103880 - RNA, 20 nt, Human
caccaaauauuaauuuccac

SEQ ID NO: 103881 - RNA, 22 nt, Human
cagccaccaacaaugagcucag

SEQ ID NO: 103882 - RNA, 20 nt, Human
caggacauuuaacuccuugc

SEQ ID NO: 103883 - RNA, 20 nt, Human
caggacccuguggugaugaa

SEQ ID NO: 103884 - RNA, 19 nt, Human
cagguaaaaacucuagaua

SEQ ID NO: 103885 - RNA, 22 nt, Human
cauacaaugacagugcaaucag

SEQ ID NO: 103886 - RNA, 21 nt, Human
cauugucugucaggaaauuca

SEQ ID NO: 103887 - RNA, 20 nt, Human
ccaacuagccccuggcucca

SEQ ID NO: 103888 - RNA, 23 nt, Human
ccaagaccuccaggucucaauuc

SEQ ID NO: 103889 - RNA, 21 nt, Human
ccaauuuuaaagaaacugaug

SEQ ID NO: 103890 - RNA, 27 nt, Human
cccaaauguauaguaaaccaccaacua

SEQ ID NO: 103891 - RNA, 22 nt, Human
ccggaggcgccaggccuccucu

SEQ ID NO: 103892 - RNA, 18 nt, Human
ccggcgucucucccagcc

SEQ ID NO: 103893 - RNA, 18 nt, Human
ccggcgucucucccagcc

SEQ ID NO: 103894 - RNA, 19 nt, Human
ccggcgucucucccagccu

SEQ ID NO: 103895 - RNA, 18 nt, Human
ccuccucuuucccggucc

SEQ ID NO: 103896 - RNA, 25 nt, Human
ccuuuacuuaaaaaaagaaaaaaag

SEQ ID NO: 103897 - RNA, 21 nt, Human
cuaaguaacccaaugucuucu

SEQ ID NO: 103898 - RNA, 31 nt, Human
cuacaauaaauucuccccccuuuuucaauuu

SEQ ID NO: 103899 - RNA, 18 nt, Human
cuauuuuaucaccccaaa

SEQ ID NO: 103900 - RNA, 20 nt, Human
cucagcgccggcgucucucc

SEQ ID NO: 103901 - RNA, 24 nt, Human
cucccagccuugggcgcucggucc

SEQ ID NO: 103902 - RNA, 20 nt, Human
cuggucauuaaaagaaaaua

SEQ ID NO: 103903 - RNA, 24 nt, Human
cuguguacacaaccucuccaaugc

SEQ ID NO: 103904 - RNA, 21 nt, Human
cuuucuuuucccuaagguaga

SEQ ID NO: 103905 - RNA, 20 nt, Human
gaaaaaagacaaaaugcuug

SEQ ID NO: 103906 - RNA, 23 nt, Human
gcgccggcgucucucccagccuu

SEQ ID NO: 103907 - RNA, 22 nt, Human
ggaaaaaugcuuccccuaacau

SEQ ID NO: 103908 - RNA, 20 nt, Human
ggaaagaaaauaagauucuu

SEQ ID NO: 103909 - RNA, 24 nt, Human
gguagaacuucuguaaaccuaaaa

SEQ ID NO: 103910 - RNA, 19 nt, Human
guacagggaagagaccaca

SEQ ID NO: 103911 - RNA, 23 nt, Human
guagaacuucuguaaaccuaaaa

SEQ ID NO: 103912 - RNA, 18 nt, Human
guauaguaaaccaccaac

SEQ ID NO: 103913 - RNA, 24 nt, Human
guuguucagaauagaaagggaaac

SEQ ID NO: 103914 - RNA, 24 nt, Human
uaaaaaaaaaaaacuuagcuacau

SEQ ID NO: 103915 - RNA, 26 nt, Human
uaaaaaaaucuaaaaaucaaacaaaa

SEQ ID NO: 103916 - RNA, 25 nt, Human
uaaaagaaaauauacaucuuaagga

SEQ ID NO: 103917 - RNA, 20 nt, Human
uaacacuauaaauauuaaua

SEQ ID NO: 103918 - RNA, 19 nt, Human
uaacccaaugucuucuuac

SEQ ID NO: 103919 - RNA, 22 nt, Human
uaaguacagggaagagaccaca

SEQ ID NO: 103920 - RNA, 18 nt, Human
uacaagguuucucaaagu

SEQ ID NO: 103921 - RNA, 19 nt, Human
uacauucagucacauauau

SEQ ID NO: 103922 - RNA, 24 nt, Human
uacuuaaaaaaagaaaaaaaaacc

SEQ ID NO: 103923 - RNA, 18 nt, Human
uagauacuuuuccacugu

SEQ ID NO: 103924 - RNA, 21 nt, Human
uagccccuggcuccauaaugg

SEQ ID NO: 103925 - RNA, 20 nt, Human
uaggcacaaaaggccugguu

SEQ ID NO: 103926 - RNA, 20 nt, Human
uaguaaaccaccaacuagcc

SEQ ID NO: 103927 - RNA, 20 nt, Human
uagugccaccuauuucauaa

SEQ ID NO: 103928 - RNA, 19 nt, Human
uaucucauacccaugguga

SEQ ID NO: 103929 - RNA, 19 nt, Human
ucaaaauaaaugagauguc

SEQ ID NO: 103930 - RNA, 18 nt, Human
ucaaacguagugaaucug

SEQ ID NO: 103931 - RNA, 21 nt, Human
ucaauuuacuucccuuucuuu

SEQ ID NO: 103932 - RNA, 24 nt, Human
ucacuacagcagcacauagagccu

SEQ ID NO: 103933 - RNA, 24 nt, Human
ucaguagcugaucuuuauguggaa

SEQ ID NO: 103934 - RNA, 18 nt, Human
ucauaaacuguccugcag

SEQ ID NO: 103935 - RNA, 22 nt, Human
uccacauaccucuuuauuucaa

SEQ ID NO: 103936 - RNA, 26 nt, Human
uccacuguccaacaucaccaaauauu

SEQ ID NO: 103937 - RNA, 20 nt, Human
uccccuaacaugaacuaugg

SEQ ID NO: 103938 - RNA, 23 nt, Human
uccguauuuuacaaugaagaaaa

SEQ ID NO: 103939 - RNA, 24 nt, Human
ucucauacccauggugaacuauuu

SEQ ID NO: 103940 - RNA, 19 nt, Human
ugaaaaaagacaaaaugcu

SEQ ID NO: 103941 - RNA, 28 nt, Human
ugaaaaaagacaaaaugcuugcauacaa

SEQ ID NO: 103942 - RNA, 21 nt, Human
ugaaaaauaaaaaagaaaugc

SEQ ID NO: 103943 - RNA, 18 nt, Human
ugaccaccuaaguaaccc

SEQ ID NO: 103944 - RNA, 22 nt, Human
ugaccagguagcccccaaaugu

SEQ ID NO: 103945 - RNA, 20 nt, Human
ugcauacaaugacagugcag

SEQ ID NO: 103946 - RNA, 19 nt, Human
ugcuuuaccugcuuaagcc

SEQ ID NO: 103947 - RNA, 23 nt, Human
ugcuuuaccugcuuaagccuugc

SEQ ID NO: 103948 - RNA, 23 nt, Human
ugggaagcucagcgccggcgucu

SEQ ID NO: 103949 - RNA, 19 nt, Human
ugugcuuuuuaaaaauucu

SEQ ID NO: 103950 - RNA, 19 nt, Human
uguggcugguuuucuaaca

SEQ ID NO: 103951 - RNA, 22 nt, Human
uguucagaauagaaagggaaac

SEQ ID NO: 103952 - RNA, 18 nt, Human
uuaaaaugagugaaaguc

SEQ ID NO: 103953 - RNA, 20 nt, Human
uuaaaugccuaagcauagac

SEQ ID NO: 103954 - RNA, 21 nt, Human
uuagcagccaccaacaaugag

SEQ ID NO: 103955 - RNA, 23 nt, Human
uuauuucauaaaaauauaaauau

SEQ ID NO: 103956 - RNA, 21 nt, Human
uucccuaagguagaacuucug

SEQ ID NO: 103957 - RNA, 22 nt, Human
uucugacaacucggagaaaaac

SEQ ID NO: 103958 - RNA, 19 nt, Human
uuggaguuacacauaaaga

SEQ ID NO: 103959 - RNA, 19 nt, Human
uuucuuaacaagugguuuc

SEQ ID NO: 103960 - RNA, 21 nt, Human
uuuggaguuacacauaaagau

SEQ ID NO: 103961 - RNA, 25 nt, Human
aaaacagaaagauaaagggacagag

SEQ ID NO: 103962 - RNA, 24 nt, Human
aaacagaaagauaaagggacagag

SEQ ID NO: 103963 - RNA, 19 nt, Human
aaagggacagagaaaaaga

SEQ ID NO: 103964 - RNA, 19 nt, Human
aacuguggaucuguccagg

SEQ ID NO: 103965 - RNA, 19 nt, Human
aagaagugaaacagagaca

SEQ ID NO: 103966 - RNA, 22 nt, Human
aagaagugaaacagagacagac

SEQ ID NO: 103967 - RNA, 18 nt, Human
aagacagacagacacggg

SEQ ID NO: 103968 - RNA, 25 nt, Human
aagacagacagacacgggaacacaa

SEQ ID NO: 103969 - RNA, 19 nt, Human
aagagcucccuccccguga

SEQ ID NO: 103970 - RNA, 18 nt, Human
aagcucagccaagagcuc

SEQ ID NO: 103971 - RNA, 18 nt, Human
aaggacagagagagagag

SEQ ID NO: 103972 - RNA, 20 nt, Human
acacuccccucccccugcca

SEQ ID NO: 103973 - RNA, 21 nt, Human
acagacaaaaacagaaagaua

SEQ ID NO: 103974 - RNA, 18 nt, Human
accacacagagacccaga

SEQ ID NO: 103975 - RNA, 24 nt, Human
agacagacacuccgggacaggaca

SEQ ID NO: 103976 - RNA, 25 nt, Human
agacagacagacacgggaacacaag

SEQ ID NO: 103977 - RNA, 19 nt, Human
agacuggaaggaaggcuga

SEQ ID NO: 103978 - RNA, 19 nt, Human
agagagaaagacagaggga

SEQ ID NO: 103979 - RNA, 19 nt, Human
agagagagaaagacagagg

SEQ ID NO: 103980 - RNA, 20 nt, Human
agccagggccugggggagcc

SEQ ID NO: 103981 - RNA, 19 nt, Human
agggacaggagagccagug

SEQ ID NO: 103982 - RNA, 21 nt, Human
agggggcucccuuccggcagg

SEQ ID NO: 103983 - RNA, 20 nt, Human
agguauggcuuugcaccugu

SEQ ID NO: 103984 - RNA, 19 nt, Human
aguuucccaugcacccccc

SEQ ID NO: 103985 - RNA, 22 nt, Human
aguuuguugggaggagcagggg

SEQ ID NO: 103986 - RNA, 23 nt, Human
aguuuguugggaggagcaggggg

SEQ ID NO: 103987 - RNA, 21 nt, Human
auaaggggugucugaacagaa

SEQ ID NO: 103988 - RNA, 23 nt, Human
auacagccagggccugggggagc

SEQ ID NO: 103989 - RNA, 25 nt, Human
caaaaacagaaagauaaagggacag

SEQ ID NO: 103990 - RNA, 21 nt, Human
caaguuccugacuuaugccca

SEQ ID NO: 103991 - RNA, 18 nt, Human
caaugacuccuccuccuu

SEQ ID NO: 103992 - RNA, 19 nt, Human
cacacagccccgacccaca

SEQ ID NO: 103993 - RNA, 23 nt, Human
cacacagccccgacccacacagc

SEQ ID NO: 103994 - RNA, 19 nt, Human
cacagaucacacccacccg

SEQ ID NO: 103995 - RNA, 23 nt, Human
cacagccccgacccacacagccc

SEQ ID NO: 103996 - RNA, 19 nt, Human
caccagagccccgaccccu

SEQ ID NO: 103997 - RNA, 21 nt, Human
cacccggggcugccacgcccc

SEQ ID NO: 103998 - RNA, 19 nt, Human
caccuggacagaguuggga

SEQ ID NO: 103999 - RNA, 18 nt, Human
cacgcccccucuguccac

SEQ ID NO: 104000 - RNA, 24 nt, Human
cacgcccccucuguccacacagcc

SEQ ID NO: 104001 - RNA, 20 nt, Human
cacuccccucccccugccag

SEQ ID NO: 104002 - RNA, 22 nt, Human
cagaaaccgaccuaggacacag

SEQ ID NO: 104003 - RNA, 18 nt, Human
cagaaagauaaagggaca

SEQ ID NO: 104004 - RNA, 19 nt, Human
cagcacccgcuuucugcug

SEQ ID NO: 104005 - RNA, 20 nt, Human
cagcugggcacccccacaac

SEQ ID NO: 104006 - RNA, 19 nt, Human
caggacacgaguuccuaac

SEQ ID NO: 104007 - RNA, 18 nt, Human
caugcaccccccgcuggc

SEQ ID NO: 104008 - RNA, 21 nt, Human
ccacacagagacccagaucac

SEQ ID NO: 104009 - RNA, 19 nt, Human
ccacaccagagccccgacc

SEQ ID NO: 104010 - RNA, 18 nt, Human
ccacgcccccucugucca

SEQ ID NO: 104011 - RNA, 27 nt, Human
ccagcggagaccacacagagacccaga

SEQ ID NO: 104012 - RNA, 18 nt, Human
cccaaauuggggaagggg

SEQ ID NO: 104013 - RNA, 21 nt, Human
cccacaacacccugacaggca

SEQ ID NO: 104014 - RNA, 18 nt, Human
cccagacuggaaggaagg

SEQ ID NO: 104015 - RNA, 18 nt, Human
cccaugcugcagucagga

SEQ ID NO: 104016 - RNA, 19 nt, Human
cccaugcugcagucaggau

SEQ ID NO: 104017 - RNA, 22 nt, Human
ccccaaagcgcagcucucagcc

SEQ ID NO: 104018 - RNA, 21 nt, Human
ccccacucagcccagacugga

SEQ ID NO: 104019 - RNA, 20 nt, Human
ccccagggccucacgccucu

SEQ ID NO: 104020 - RNA, 22 nt, Human
ccccagggccucacgccucuga

SEQ ID NO: 104021 - RNA, 19 nt, Human
cccccaccuccugcagccg

SEQ ID NO: 104022 - RNA, 21 nt, Human
cccccaccuccugcagccgug

SEQ ID NO: 104023 - RNA, 18 nt, Human
cccccggccccuccucug

SEQ ID NO: 104024 - RNA, 27 nt, Human
cccccucuguccacacagccccgaccc

SEQ ID NO: 104025 - RNA, 19 nt, Human
ccccguauggcaagagagu

SEQ ID NO: 104026 - RNA, 19 nt, Human
ccccugcugccucccaccc

SEQ ID NO: 104027 - RNA, 22 nt, Human
cccgacccacacagcccagcac

SEQ ID NO: 104028 - RNA, 21 nt, Human
cccggccccuccucugggacc

SEQ ID NO: 104029 - RNA, 18 nt, Human
cccggggcugccacgccc

SEQ ID NO: 104030 - RNA, 19 nt, Human
cccugggugggucugaggc

SEQ ID NO: 104031 - RNA, 21 nt, Human
ccgaccccuggcccagagcgc

SEQ ID NO: 104032 - RNA, 19 nt, Human
ccucacacuccccuccccc

SEQ ID NO: 104033 - RNA, 21 nt, Human
ccucacacuccccucccccug

SEQ ID NO: 104034 - RNA, 19 nt, Human
ccucccaccccugccgggg

SEQ ID NO: 104035 - RNA, 18 nt, Human
ccuccuccuuagugggca

SEQ ID NO: 104036 - RNA, 19 nt, Human
ccucuguccacacagcccc

SEQ ID NO: 104037 - RNA, 21 nt, Human
ccugacccccguauggcaaga

SEQ ID NO: 104038 - RNA, 18 nt, Human
ccugcugggucuuggggc

SEQ ID NO: 104039 - RNA, 23 nt, Human
cgggaaauggcugcccacucucu

SEQ ID NO: 104040 - RNA, 21 nt, Human
cuacacgugacuccugacccc

SEQ ID NO: 104041 - RNA, 19 nt, Human
cucacacuccccucccccu

SEQ ID NO: 104042 - RNA, 22 nt, Human
cucacacuccccucccccugcc

SEQ ID NO: 104043 - RNA, 23 nt, Human
cucacacuccccucccccugcca

SEQ ID NO: 104044 - RNA, 21 nt, Human
cucagggucugacaggcagcu

SEQ ID NO: 104045 - RNA, 21 nt, Human
cucccacagcuccggccaggc

SEQ ID NO: 104046 - RNA, 18 nt, Human
cucccaccccugccgggg

SEQ ID NO: 104047 - RNA, 20 nt, Human
cucgcaaacagccuggcccc

SEQ ID NO: 104048 - RNA, 25 nt, Human
cugaccccugcugccucccaccccu

SEQ ID NO: 104049 - RNA, 24 nt, Human
cugcugccucccaccccugccggg

SEQ ID NO: 104050 - RNA, 18 nt, Human
cuggccccuggccccugg

SEQ ID NO: 104051 - RNA, 24 nt, Human
cugggcuggucucgcaaacagccu

SEQ ID NO: 104052 - RNA, 23 nt, Human
cugggggaggguggacaggggcu

SEQ ID NO: 104053 - RNA, 18 nt, Human
cugggucuuggggcugag

SEQ ID NO: 104054 - RNA, 21 nt, Human
cuuccagcggcggaauccuag

SEQ ID NO: 104055 - RNA, 19 nt, Human
gacagugaacccggugggg

SEQ ID NO: 104056 - RNA, 23 nt, Human
gacccagaucacagggacaggag

SEQ ID NO: 104057 - RNA, 20 nt, Human
gacucugugugucugugugu

SEQ ID NO: 104058 - RNA, 19 nt, Human
gagccacaccagagccccg

SEQ ID NO: 104059 - RNA, 21 nt, Human
gagccccgaccccuggcccag

SEQ ID NO: 104060 - RNA, 20 nt, Human
gagugugugugacucugugu

SEQ ID NO: 104061 - RNA, 22 nt, Human
gauaaagggacagagaaaaaga

SEQ ID NO: 104062 - RNA, 21 nt, Human
gccaggcgggcugcguaugcc

SEQ ID NO: 104063 - RNA, 23 nt, Human
gcccagguauggcuuugcaccug

SEQ ID NO: 104064 - RNA, 22 nt, Human
gcuuccagcggcggaauccuag

SEQ ID NO: 104065 - RNA, 18 nt, Human
ggacagugaacccggugg

SEQ ID NO: 104066 - RNA, 18 nt, Human
ggaccccccacucagccc

SEQ ID NO: 104067 - RNA, 20 nt, Human
ggaggagcagggggcucccu

SEQ ID NO: 104068 - RNA, 23 nt, Human
ggaggcuggggaggccccugggg

SEQ ID NO: 104069 - RNA, 18 nt, Human
ggaguuuguugggaggag

SEQ ID NO: 104070 - RNA, 21 nt, Human
gggaacacaagaagugaaaca

SEQ ID NO: 104071 - RNA, 25 nt, Human
gggacaggacacgaguuccuaacac

SEQ ID NO: 104072 - RNA, 21 nt, Human
gggaggccccugggggagggu

SEQ ID NO: 104073 - RNA, 23 nt, Human
gggcaggccucagacgccugcug

SEQ ID NO: 104074 - RNA, 21 nt, Human
ggggaaggggaagccucccgg

SEQ ID NO: 104075 - RNA, 20 nt, Human
gggggaggguggacaggggc

SEQ ID NO: 104076 - RNA, 18 nt, Human
gucuguguguaugugugu

SEQ ID NO: 104077 - RNA, 21 nt, Human
guggggugcaguuucccaugc

SEQ ID NO: 104078 - RNA, 20 nt, Human
gugugagugugugugacucu

SEQ ID NO: 104079 - RNA, 19 nt, Human
gugugugugagugugugug

SEQ ID NO: 104080 - RNA, 19 nt, Human
uagaagcucagccaagagc

SEQ ID NO: 104081 - RNA, 21 nt, Human
uagaagcucagccaagagcuc

SEQ ID NO: 104082 - RNA, 24 nt, Human
uaucaaaaaguccccaaauugggg

SEQ ID NO: 104083 - RNA, 20 nt, Human
uauguguguguguaugucug

SEQ ID NO: 104084 - RNA, 28 nt, Human
ucacacccacccggggcugccacgcccc

SEQ ID NO: 104085 - RNA, 19 nt, Human
ucccacagcuccggccagg

SEQ ID NO: 104086 - RNA, 24 nt, Human
uccccaaagcgcagcucucagccc

SEQ ID NO: 104087 - RNA, 19 nt, Human
uccccaaauuggggaaggg

SEQ ID NO: 104088 - RNA, 23 nt, Human
uccccgugagcugagugcuccuc

SEQ ID NO: 104089 - RNA, 20 nt, Human
uccggcagggccccagggcc

SEQ ID NO: 104090 - RNA, 27 nt, Human
ucucgcaaacagccuggccccuggccc

SEQ ID NO: 104091 - RNA, 18 nt, Human
ucugacaggcagcugggc

SEQ ID NO: 104092 - RNA, 18 nt, Human
ucuguguguaugugugug

SEQ ID NO: 104093 - RNA, 20 nt, Human
ucuguuuccucacacucccc

SEQ ID NO: 104094 - RNA, 20 nt, Human
ugaaaggguggugguccucc

SEQ ID NO: 104095 - RNA, 24 nt, Human
ugaaaggguggugguccucccaag

SEQ ID NO: 104096 - RNA, 24 nt, Human
ugaccccugcugccucccaccccu

SEQ ID NO: 104097 - RNA, 23 nt, Human
ugacucugugugucuguguguaa

SEQ ID NO: 104098 - RNA, 20 nt, Human
ugaggugggggaaggggaag

SEQ ID NO: 104099 - RNA, 22 nt, Human
ugagugugugugacucugugug

SEQ ID NO: 104100 - RNA, 22 nt, Human
ugcccaucucuccagccccaca

SEQ ID NO: 104101 - RNA, 23 nt, Human
ugcugggucuuggggcugaggac

SEQ ID NO: 104102 - RNA, 21 nt, Human
uggaccccccacucagcccag

SEQ ID NO: 104103 - RNA, 21 nt, Human
uggagagggaggcuggggagg

SEQ ID NO: 104104 - RNA, 24 nt, Human
uggagagggaggcuggggaggccc

SEQ ID NO: 104105 - RNA, 23 nt, Human
uggcaagagagugagguggggga

SEQ ID NO: 104106 - RNA, 18 nt, Human
uggccaacacacacacuu

SEQ ID NO: 104107 - RNA, 22 nt, Human
uggggaggccccugggggaggg

SEQ ID NO: 104108 - RNA, 23 nt, Human
uggggaggggaugauaaugaugg

SEQ ID NO: 104109 - RNA, 21 nt, Human
uggggcccccggccccuccuc

SEQ ID NO: 104110 - RNA, 22 nt, Human
ugggggaaggggaagccucccg

SEQ ID NO: 104111 - RNA, 23 nt, Human
ugggggaggguggacaggggcuc

SEQ ID NO: 104112 - RNA, 21 nt, Human
ugggucuuggggcugaggacu

SEQ ID NO: 104113 - RNA, 21 nt, Human
ugucuguguguaugugugugu

SEQ ID NO: 104114 - RNA, 19 nt, Human
ugugagugugugugacucu

SEQ ID NO: 104115 - RNA, 18 nt, Human
ugugucucccccaccucc

SEQ ID NO: 104116 - RNA, 21 nt, Human
ugugucucccccaccuccugc

SEQ ID NO: 104117 - RNA, 25 nt, Human
ugugugagugugugugacucugugu

SEQ ID NO: 104118 - RNA, 26 nt, Human
ugugugagugugugugacucugugug

SEQ ID NO: 104119 - RNA, 19 nt, Human
uguguguaugugugugugu

SEQ ID NO: 104120 - RNA, 20 nt, Human
uguguguaugugugugugua

SEQ ID NO: 104121 - RNA, 19 nt, Human
uguguguguguaugucugc

SEQ ID NO: 104122 - RNA, 18 nt, Human
uguucuggaguuuguugg

SEQ ID NO: 104123 - RNA, 19 nt, Human
uguucuggaguuuguuggg

SEQ ID NO: 104124 - RNA, 20 nt, Human
uguucuggaguuuguuggga

SEQ ID NO: 104125 - RNA, 20 nt, Human
uguugggaggagcagggggc

SEQ ID NO: 104126 - RNA, 21 nt, Human
uguugggaggagcagggggcu

SEQ ID NO: 104127 - RNA, 18 nt, Human
uucccaugcaccccccgc

SEQ ID NO: 104128 - RNA, 19 nt, Human
uuggagguuuuugagccca

SEQ ID NO: 104129 - RNA, 18 nt, Human
uuguugggaggagcaggg

SEQ ID NO: 104130 - RNA, 25 nt, Human
uuuuaguucuguuuccucacacucc

SEQ ID NO: 104131 - RNA, 21 nt, Human
aaaaaaaaaaaggcucagcca

SEQ ID NO: 104132 - RNA, 21 nt, Human
aaaaaaaugcagugcugaaac

SEQ ID NO: 104133 - RNA, 24 nt, Human
aaaaaugcagugcugaaacaucac

SEQ ID NO: 104134 - RNA, 19 nt, Human
aaacaucacaggauguuuc

SEQ ID NO: 104135 - RNA, 18 nt, Human
aagagguguuuugccugg

SEQ ID NO: 104136 - RNA, 20 nt, Human
agacaaauagaaccuuuaau

SEQ ID NO: 104137 - RNA, 18 nt, Human
agaccuaggcugaagaag

SEQ ID NO: 104138 - RNA, 24 nt, Human
agaggaagagguguuuugccuggg

SEQ ID NO: 104139 - RNA, 23 nt, Human
agagguguuuugccuggguuuug

SEQ ID NO: 104140 - RNA, 21 nt, Human
agauuuuaagcaaaauucaaa

SEQ ID NO: 104141 - RNA, 19 nt, Human
aggcugaagaaguaacaca

SEQ ID NO: 104142 - RNA, 23 nt, Human
augguacaggcaaaguaaacuac

SEQ ID NO: 104143 - RNA, 25 nt, Human
auuaacugugguuaaagugguauca

SEQ ID NO: 104144 - RNA, 21 nt, Human
caaaagcugaaauuaacugug

SEQ ID NO: 104145 - RNA, 23 nt, Human
cacugcaucuugauuaaaaaaac

SEQ ID NO: 104146 - RNA, 19 nt, Human
cagugcugaaacaucacag

SEQ ID NO: 104147 - RNA, 24 nt, Human
cauaugcaacuauucccauaugua

SEQ ID NO: 104148 - RNA, 19 nt, Human
cauauguacuauguacaag

SEQ ID NO: 104149 - RNA, 20 nt, Human
cccauaugcaacuauuccca

SEQ ID NO: 104150 - RNA, 21 nt, Human
cggaaggggaaagaccuaggc

SEQ ID NO: 104151 - RNA, 18 nt, Human
gguaucaauggcccaaaa

SEQ ID NO: 104152 - RNA, 23 nt, Human
uaaaaaaaaaaaggcucagccac

SEQ ID NO: 104153 - RNA, 18 nt, Human
uaaacuacaguggaguuu

SEQ ID NO: 104154 - RNA, 23 nt, Human
uaaauaaagagggccuuaaguac

SEQ ID NO: 104155 - RNA, 21 nt, Human
uacaguggaguuucagaaucu

SEQ ID NO: 104156 - RNA, 20 nt, Human
uaugcaguuaaaaucacugu

SEQ ID NO: 104157 - RNA, 24 nt, Human
ucaaacaguccaacuaugacugaa

SEQ ID NO: 104158 - RNA, 23 nt, Human
uccaaagaguucggggucuagca

SEQ ID NO: 104159 - RNA, 21 nt, Human
uccaacuaugacugagaaaca

SEQ ID NO: 104160 - RNA, 23 nt, Human
uccucucuuuccugccaaaagcu

SEQ ID NO: 104161 - RNA, 18 nt, Human
ucucaguucacugcaucu

SEQ ID NO: 104162 - RNA, 24 nt, Human
ugaaacaucacaggauguuuccuc

SEQ ID NO: 104163 - RNA, 19 nt, Human
ugaagaaguaacacaugca

SEQ ID NO: 104164 - RNA, 18 nt, Human
ugagaaggcugcucagag

SEQ ID NO: 104165 - RNA, 23 nt, Human
ugauuaaaaaaaccaugugacau

SEQ ID NO: 104166 - RNA, 24 nt, Human
uggauaaccucugccuccaaagag

SEQ ID NO: 104167 - RNA, 23 nt, Human
uggccacaugggagaaaaguucu

SEQ ID NO: 104168 - RNA, 24 nt, Human
ugguacaggcaaaguaaacuacag

SEQ ID NO: 104169 - RNA, 22 nt, Human
uguggauaaccucugccuccaa

SEQ ID NO: 104170 - RNA, 26 nt, Human
uuaaaaaaaaaaaggcucagccacau

SEQ ID NO: 104171 - RNA, 21 nt, Human
uucccauaugcaacuauuccc

SEQ ID NO: 104172 - RNA, 23 nt, Human
uuccugccaaaagcugaaauuaa

SEQ ID NO: 104173 - RNA, 21 nt, Human
uuugccaagccucuuguggau

SEQ ID NO: 104174 - RNA, 18 nt, Human
aaagcccucuggggcugg

SEQ ID NO: 104175 - RNA, 24 nt, Human
aacaaaaaucacguucuccccaaa

SEQ ID NO: 104176 - RNA, 24 nt, Human
aagacagcacccuuacuaaagacc

SEQ ID NO: 104177 - RNA, 22 nt, Human
aagcaaaugcaauuugccucau

SEQ ID NO: 104178 - RNA, 19 nt, Human
aaggucucaggagcuggac

SEQ ID NO: 104179 - RNA, 22 nt, Human
accacaccuccucuccaacccu

SEQ ID NO: 104180 - RNA, 28 nt, Human
accacaccuccucuccaacccucagcca

SEQ ID NO: 104181 - RNA, 18 nt, Human
acccucccagccugggau

SEQ ID NO: 104182 - RNA, 18 nt, Human
accuccucuccaacccuc

SEQ ID NO: 104183 - RNA, 21 nt, Human
accuccucuccaacccucagc

SEQ ID NO: 104184 - RNA, 19 nt, Human
acuccgccgccagggccgg

SEQ ID NO: 104185 - RNA, 23 nt, Human
agacggcagaccggcggacagca

SEQ ID NO: 104186 - RNA, 24 nt, Human
agccaccucuugccaaacaucuga

SEQ ID NO: 104187 - RNA, 24 nt, Human
agcgauacuucagcaggguccuga

SEQ ID NO: 104188 - RNA, 23 nt, Human
aggcccacaggucccuagguagc

SEQ ID NO: 104189 - RNA, 22 nt, Human
agggagaggggaaacacggcuc

SEQ ID NO: 104190 - RNA, 23 nt, Human
agggauuggagcuagggaugagg

SEQ ID NO: 104191 - RNA, 18 nt, Human
agggauuggccccaggcu

SEQ ID NO: 104192 - RNA, 22 nt, Human
aggggcgggggggcggcagagc

SEQ ID NO: 104193 - RNA, 21 nt, Human
aggggggucgguuucagcaaa

SEQ ID NO: 104194 - RNA, 25 nt, Human
aggugccagagcucgccaacgggcu

SEQ ID NO: 104195 - RNA, 22 nt, Human
agucagugggcugagauaacaa

SEQ ID NO: 104196 - RNA, 20 nt, Human
agugcucagccaccucuugc

SEQ ID NO: 104197 - RNA, 19 nt, Human
augaaggagguggugaagu

SEQ ID NO: 104198 - RNA, 25 nt, Human
augaggcaggacacaucuggucccu

SEQ ID NO: 104199 - RNA, 21 nt, Human
caaaaaccgagaagcgaaugc

SEQ ID NO: 104200 - RNA, 19 nt, Human
caaagccaaaggcccggaa

SEQ ID NO: 104201 - RNA, 19 nt, Human
caaccagaauccccgguca

SEQ ID NO: 104202 - RNA, 20 nt, Human
caaccagaauccccggucac

SEQ ID NO: 104203 - RNA, 19 nt, Human
caacccucagccagaggaa

SEQ ID NO: 104204 - RNA, 20 nt, Human
cacaccuccucuccaacccu

SEQ ID NO: 104205 - RNA, 30 nt, Human
caccagcagcagcauguuuuauugcaaccc

SEQ ID NO: 104206 - RNA, 22 nt, Human
cacccgccgaccuggggcuccu

SEQ ID NO: 104207 - RNA, 23 nt, Human
caccuccucuccaacccucagcc

SEQ ID NO: 104208 - RNA, 23 nt, Human
cacuuuggucuugucaccgaggg

SEQ ID NO: 104209 - RNA, 21 nt, Human
cagagcucgccaacgggcuuc

SEQ ID NO: 104210 - RNA, 21 nt, Human
cagaggcaagcccucagcucu

SEQ ID NO: 104211 - RNA, 18 nt, Human
cagcaagaagcugaggca

SEQ ID NO: 104212 - RNA, 19 nt, Human
cagcacccuuacuaaagac

SEQ ID NO: 104213 - RNA, 24 nt, Human
cagcacccuuacuaaagaccaaca

SEQ ID NO: 104214 - RNA, 22 nt, Human
cagcauguuuuauugcaaccag

SEQ ID NO: 104215 - RNA, 22 nt, Human
cagcugacugggcagggauugg

SEQ ID NO: 104216 - RNA, 22 nt, Human
cagcugcgccuggagaaggcgg

SEQ ID NO: 104217 - RNA, 23 nt, Human
caggacacaucuggucccugaca

SEQ ID NO: 104218 - RNA, 19 nt, Human
caggauuucugccaacaac

SEQ ID NO: 104219 - RNA, 22 nt, Human
caggucccuagguagccagagg

SEQ ID NO: 104220 - RNA, 19 nt, Human
cagucagggcauccaacgg

SEQ ID NO: 104221 - RNA, 22 nt, Human
caguggcugagcccuguggcca

SEQ ID NO: 104222 - RNA, 18 nt, Human
ccaaaggacggcaaacuc

SEQ ID NO: 104223 - RNA, 18 nt, Human
ccaagcccaccccagugc

SEQ ID NO: 104224 - RNA, 24 nt, Human
ccaccugggaccccagccuaggca

SEQ ID NO: 104225 - RNA, 21 nt, Human
ccaggacacagggagcgaggg

SEQ ID NO: 104226 - RNA, 23 nt, Human
ccaggaugcaaagccaaaggccc

SEQ ID NO: 104227 - RNA, 24 nt, Human
ccaugccacuucaaccuccucuug

SEQ ID NO: 104228 - RNA, 19 nt, Human
cccaaaggacggcaaacuc

SEQ ID NO: 104229 - RNA, 18 nt, Human
cccaggauuucugccaac

SEQ ID NO: 104230 - RNA, 23 nt, Human
ccccaaaggacggcaaacucuuc

SEQ ID NO: 104231 - RNA, 27 nt, Human
ccccaccagaccccagcugacugggca

SEQ ID NO: 104232 - RNA, 26 nt, Human
cccccagucagggcauccaacggggc

SEQ ID NO: 104233 - RNA, 22 nt, Human
ccccguccaggaugcaaagcca

SEQ ID NO: 104234 - RNA, 22 nt, Human
cccucuggggcuggggucucca

SEQ ID NO: 104235 - RNA, 23 nt, Human
cccucuggggcuggggucuccag

SEQ ID NO: 104236 - RNA, 19 nt, Human
ccgccgaccuggggcuccu

SEQ ID NO: 104237 - RNA, 21 nt, Human
ccucacccucccagccuggga

SEQ ID NO: 104238 - RNA, 22 nt, Human
ccucccagccugggauugcggc

SEQ ID NO: 104239 - RNA, 22 nt, Human
ccugcccugcccacguggagag

SEQ ID NO: 104240 - RNA, 27 nt, Human
ccugcugagaccacaccuccucuccaa

SEQ ID NO: 104241 - RNA, 18 nt, Human
ccugggaacacccgccga

SEQ ID NO: 104242 - RNA, 19 nt, Human
cgaacaaaguuggcccaag

SEQ ID NO: 104243 - RNA, 21 nt, Human
cgaccuggggcuccugggugc

SEQ ID NO: 104244 - RNA, 21 nt, Human
cgccaccagcagcagcauguu

SEQ ID NO: 104245 - RNA, 18 nt, Human
cgccaggacacagggagc

SEQ ID NO: 104246 - RNA, 18 nt, Human
cgccugggcugacuucag

SEQ ID NO: 104247 - RNA, 21 nt, Human
cgcgcagacggcagaccggcg

SEQ ID NO: 104248 - RNA, 19 nt, Human
cgcggcgccucacccuccc

SEQ ID NO: 104249 - RNA, 23 nt, Human
cggaggggccaugacccaugaca

SEQ ID NO: 104250 - RNA, 21 nt, Human
cggcagagcgcggcgccucac

SEQ ID NO: 104251 - RNA, 18 nt, Human
cuaccuuccuacuuuugc

SEQ ID NO: 104252 - RNA, 25 nt, Human
cucgccaacgggcuucuggcuacag

SEQ ID NO: 104253 - RNA, 18 nt, Human
cugaaucaaugucacagc

SEQ ID NO: 104254 - RNA, 19 nt, Human
cugagaccacaccuccucu

SEQ ID NO: 104255 - RNA, 20 nt, Human
cuggcugggccccaccuggg

SEQ ID NO: 104256 - RNA, 24 nt, Human
cugggaccccagccuaggcagccu

SEQ ID NO: 104257 - RNA, 24 nt, Human
cugggccccaccugggaccccagc

SEQ ID NO: 104258 - RNA, 19 nt, Human
cugggugccuaacagagcc

SEQ ID NO: 104259 - RNA, 20 nt, Human
cugucugugugcuccuggcu

SEQ ID NO: 104260 - RNA, 21 nt, Human
cugugcccugucucuuccccu

SEQ ID NO: 104261 - RNA, 20 nt, Human
cugugugcuccuggcugugg

SEQ ID NO: 104262 - RNA, 21 nt, Human
cuuggcacagugccaagccca

SEQ ID NO: 104263 - RNA, 20 nt, Human
gaagaaggaguauugugaug

SEQ ID NO: 104264 - RNA, 18 nt, Human
gcaaagccuucacccagg

SEQ ID NO: 104265 - RNA, 20 nt, Human
gcaaagccuucacccagggg

SEQ ID NO: 104266 - RNA, 20 nt, Human
gcaccccucugggugauucc

SEQ ID NO: 104267 - RNA, 22 nt, Human
gccacuucaaccuccucuugaa

SEQ ID NO: 104268 - RNA, 18 nt, Human
gccagcugugcccugucu

SEQ ID NO: 104269 - RNA, 20 nt, Human
gccccaccugggaccccagc

SEQ ID NO: 104270 - RNA, 21 nt, Human
gccuggagaaggcggcugaga

SEQ ID NO: 104271 - RNA, 18 nt, Human
gcgggugggacugggcuu

SEQ ID NO: 104272 - RNA, 21 nt, Human
gcgggugggacugggcuuucg

SEQ ID NO: 104273 - RNA, 22 nt, Human
gcucaguggcugagcccugugg

SEQ ID NO: 104274 - RNA, 24 nt, Human
gcugagcccuguggccagcugugc

SEQ ID NO: 104275 - RNA, 24 nt, Human
ggaccccagccuaggcagccucga

SEQ ID NO: 104276 - RNA, 19 nt, Human
ggcggcagagcgcggcgcc

SEQ ID NO: 104277 - RNA, 19 nt, Human
ggcugagcccuguggccag

SEQ ID NO: 104278 - RNA, 22 nt, Human
gggagcuccagagucggguggc

SEQ ID NO: 104279 - RNA, 21 nt, Human
gggcuccugggugccuaacag

SEQ ID NO: 104280 - RNA, 21 nt, Human
gggugccuaacagagccaggc

SEQ ID NO: 104281 - RNA, 19 nt, Human
ggguuuauuguugaaggag

SEQ ID NO: 104282 - RNA, 20 nt, Human
gguuggaggcacagaucuuc

SEQ ID NO: 104283 - RNA, 20 nt, Human
guccaggugccccaagaugc

SEQ ID NO: 104284 - RNA, 21 nt, Human
guccaggugccccaagaugcu

SEQ ID NO: 104285 - RNA, 20 nt, Human
gucugugugcuccuggcugu

SEQ ID NO: 104286 - RNA, 21 nt, Human
gugagcagcagugcacuuugg

SEQ ID NO: 104287 - RNA, 18 nt, Human
uaacucggugcacagcga

SEQ ID NO: 104288 - RNA, 19 nt, Human
uacagugugggggcacgaa

SEQ ID NO: 104289 - RNA, 21 nt, Human
uacgacauucuugagggcaag

SEQ ID NO: 104290 - RNA, 21 nt, Human
uagccagaggguguucacgcc

SEQ ID NO: 104291 - RNA, 25 nt, Human
ucacagcaacacuugguuugcuccu

SEQ ID NO: 104292 - RNA, 20 nt, Human
ucacguucuccccaaaggac

SEQ ID NO: 104293 - RNA, 21 nt, Human
ucagaggaaagcgauggggcc

SEQ ID NO: 104294 - RNA, 23 nt, Human
uccagggcugaggagcgugaggc

SEQ ID NO: 104295 - RNA, 24 nt, Human
ucccaggauuucugccaacaacuc

SEQ ID NO: 104296 - RNA, 21 nt, Human
ucccuagguagccagagggug

SEQ ID NO: 104297 - RNA, 19 nt, Human
uccgggaggaaaccugggg

SEQ ID NO: 104298 - RNA, 19 nt, Human
uccuccacaaagcccucug

SEQ ID NO: 104299 - RNA, 22 nt, Human
uccuggcugggccccaccuggg

SEQ ID NO: 104300 - RNA, 24 nt, Human
uccuggcugggccccaccugggac

SEQ ID NO: 104301 - RNA, 21 nt, Human
ucgccaacgggcuucuggcua

SEQ ID NO: 104302 - RNA, 24 nt, Human
ucuccagaggcaagcccucagcuc

SEQ ID NO: 104303 - RNA, 24 nt, Human
ucugaaucaaugucacagcaacac

SEQ ID NO: 104304 - RNA, 18 nt, Human
ucugccaacaacucuacc

SEQ ID NO: 104305 - RNA, 20 nt, Human
ugaagaaugggagcuccaga

SEQ ID NO: 104306 - RNA, 21 nt, Human
ugaaucaaugucacagcaacc

SEQ ID NO: 104307 - RNA, 23 nt, Human
ugacuucaggauguguccaugug

SEQ ID NO: 104308 - RNA, 19 nt, Human
ugaguucaaugaagcucaa

SEQ ID NO: 104309 - RNA, 18 nt, Human
ugaguugggguccucccc

SEQ ID NO: 104310 - RNA, 22 nt, Human
ugcaaagccaaaggcccggaac

SEQ ID NO: 104311 - RNA, 24 nt, Human
ugcaaagccaaaggcccggaacag

SEQ ID NO: 104312 - RNA, 28 nt, Human
ugcacuuuggucuugucaccgguucccc

SEQ ID NO: 104313 - RNA, 19 nt, Human
ugccagagcucgccaacgg

SEQ ID NO: 104314 - RNA, 20 nt, Human
ugccccaagaugcucagggc

SEQ ID NO: 104315 - RNA, 21 nt, Human
ugccuccgggaggaaaccugg

SEQ ID NO: 104316 - RNA, 19 nt, Human
ugcggcuacuggacacgag

SEQ ID NO: 104317 - RNA, 21 nt, Human
ugcucaguggcugagcccugu

SEQ ID NO: 104318 - RNA, 21 nt, Human
ugcugguuggaggcacagauc

SEQ ID NO: 104319 - RNA, 19 nt, Human
uggcaaaccuguaggugug

SEQ ID NO: 104320 - RNA, 23 nt, Human
uggcaaaccuguaggugugcgga

SEQ ID NO: 104321 - RNA, 23 nt, Human
uggcacagugccaagcccacccc

SEQ ID NO: 104322 - RNA, 21 nt, Human
uggcggcagcaagaagcugag

SEQ ID NO: 104323 - RNA, 24 nt, Human
uggcgggugggacugggcuuucgg

SEQ ID NO: 104324 - RNA, 18 nt, Human
uggcugggccccaccugg

SEQ ID NO: 104325 - RNA, 20 nt, Human
ugggaccccagccuaggcag

SEQ ID NO: 104326 - RNA, 23 nt, Human
ugggaccccagccuaggcagccu

SEQ ID NO: 104327 - RNA, 21 nt, Human
ugggcagggauuggccccagg

SEQ ID NO: 104328 - RNA, 21 nt, Human
uggggcaaagggacagggagc

SEQ ID NO: 104329 - RNA, 21 nt, Human
ugugagcagcagugcacuuug

SEQ ID NO: 104330 - RNA, 26 nt, Human
uugaaugcaaagaucucaggguuuau

SEQ ID NO: 104331 - RNA, 19 nt, Human
uugcuaaggaucagacagg

SEQ ID NO: 104332 - RNA, 20 nt, Human
uuuuuuuuuuuuuuuuuugg

SEQ ID NO: 104333 - RNA, 20 nt, Human
aaaacccccaggguggacaa

SEQ ID NO: 104334 - RNA, 18 nt, Human
aaaagaacguugcccaca

SEQ ID NO: 104335 - RNA, 19 nt, Human
aaacaucacagcacuucac

SEQ ID NO: 104336 - RNA, 21 nt, Human
aaagcccacccagaggaaucc

SEQ ID NO: 104337 - RNA, 19 nt, Human
aaaucacuggaugccucca

SEQ ID NO: 104338 - RNA, 23 nt, Human
aaauugcccucacccugaaccca

SEQ ID NO: 104339 - RNA, 19 nt, Human
aaccacgaaagagugggaa

SEQ ID NO: 104340 - RNA, 23 nt, Human
aagcagcccaaggcaaaaccuca

SEQ ID NO: 104341 - RNA, 20 nt, Human
aaggagcuggggaccugagg

SEQ ID NO: 104342 - RNA, 18 nt, Human
aaggguggcacacacacc

SEQ ID NO: 104343 - RNA, 20 nt, Human
aaugcugucaacacaaacaa

SEQ ID NO: 104344 - RNA, 21 nt, Human
accacugugggggucauuuuc

SEQ ID NO: 104345 - RNA, 21 nt, Human
accccagaaacccacaagcag

SEQ ID NO: 104346 - RNA, 21 nt, Human
accccgccucucuccagccac

SEQ ID NO: 104347 - RNA, 20 nt, Human
accgcaaccacaucacagug

SEQ ID NO: 104348 - RNA, 20 nt, Human
accuaccccgccucucucca

SEQ ID NO: 104349 - RNA, 21 nt, Human
accuaccccgccucucuccag

SEQ ID NO: 104350 - RNA, 26 nt, Human
accucccugccuuccaccccagaaac

SEQ ID NO: 104351 - RNA, 22 nt, Human
acgcauccucaacagagaaacc

SEQ ID NO: 104352 - RNA, 20 nt, Human
agaaccccaucaggacagga

SEQ ID NO: 104353 - RNA, 19 nt, Human
agaagagacacagaggggc

SEQ ID NO: 104354 - RNA, 21 nt, Human
agacaagcaagcauuuuggaa

SEQ ID NO: 104355 - RNA, 24 nt, Human
agaccauuacacacagcuucccaa

SEQ ID NO: 104356 - RNA, 19 nt, Human
agagaagccagggugggcc

SEQ ID NO: 104357 - RNA, 21 nt, Human
agagagguggggugguccugg

SEQ ID NO: 104358 - RNA, 22 nt, Human
agagcaaaaagggaaacccucu

SEQ ID NO: 104359 - RNA, 22 nt, Human
agagcgcgcucaagggcaggug

SEQ ID NO: 104360 - RNA, 21 nt, Human
agaggaaaaacccccagggug

SEQ ID NO: 104361 - RNA, 23 nt, Human
agagugagucccgggacaggagu

SEQ ID NO: 104362 - RNA, 24 nt, Human
agcauuccaugggauaucgagggg

SEQ ID NO: 104363 - RNA, 29 nt, Human
agccacuggaccagccuguccccaucagg

SEQ ID NO: 104364 - RNA, 18 nt, Human
agcuggggaccugagggc

SEQ ID NO: 104365 - RNA, 21 nt, Human
aggaaaaacccccagggugga

SEQ ID NO: 104366 - RNA, 23 nt, Human
aggaaggcgccugaugagaccgu

SEQ ID NO: 104367 - RNA, 20 nt, Human
aggagccaccugccaaagcc

SEQ ID NO: 104368 - RNA, 28 nt, Human
aggcaaugcggcguugggucgggccccc

SEQ ID NO: 104369 - RNA, 20 nt, Human
agguaaaagagacaagcaag

SEQ ID NO: 104370 - RNA, 21 nt, Human
aucauucuauauuuucaugcu

SEQ ID NO: 104371 - RNA, 19 nt, Human
augcggcguugggucccaa

SEQ ID NO: 104372 - RNA, 21 nt, Human
caaaagaacguugcccacagg

SEQ ID NO: 104373 - RNA, 21 nt, Human
caaguaggugaguggaccaaa

SEQ ID NO: 104374 - RNA, 23 nt, Human
caaucugccagcucucugggaau

SEQ ID NO: 104375 - RNA, 21 nt, Human
cacaccuucccccaagcccag

SEQ ID NO: 104376 - RNA, 22 nt, Human
cacagaacaagauacuaaccac

SEQ ID NO: 104377 - RNA, 22 nt, Human
cacagccucaaucuccaacacu

SEQ ID NO: 104378 - RNA, 20 nt, Human
cacauccccagaggacagag

SEQ ID NO: 104379 - RNA, 24 nt, Human
caccaaagccacuggaccagccug

SEQ ID NO: 104380 - RNA, 21 nt, Human
caccaguuuuaaugcugagga

SEQ ID NO: 104381 - RNA, 22 nt, Human
caccccuuccaccagcagggcc

SEQ ID NO: 104382 - RNA, 22 nt, Human
cacccugaacccacuuggcaac

SEQ ID NO: 104383 - RNA, 21 nt, Human
cacgcauccucaacagagaaa

SEQ ID NO: 104384 - RNA, 20 nt, Human
cacuggaccagccugucccu

SEQ ID NO: 104385 - RNA, 20 nt, Human
cacuggaccagccugucccu

SEQ ID NO: 104386 - RNA, 21 nt, Human
cacuggcugccugggggaagu

SEQ ID NO: 104387 - RNA, 20 nt, Human
cagaaacccacaagcagcuc

SEQ ID NO: 104388 - RNA, 18 nt, Human
cagaaccaucaugucccc

SEQ ID NO: 104389 - RNA, 24 nt, Human
cagaaccaucauguccccuuagga

SEQ ID NO: 104390 - RNA, 18 nt, Human
cagagaaaccuacauaua

SEQ ID NO: 104391 - RNA, 20 nt, Human
cagagaaauugagcuuacaa

SEQ ID NO: 104392 - RNA, 25 nt, Human
cagauacacaccuucccccaagccc

SEQ ID NO: 104393 - RNA, 23 nt, Human
cagcaagagaggugggguggucc

SEQ ID NO: 104394 - RNA, 24 nt, Human
cagcaaugagaagaagaaaaccaa

SEQ ID NO: 104395 - RNA, 20 nt, Human
cagcagugccagauacaggc

SEQ ID NO: 104396 - RNA, 21 nt, Human
cagccccuacaggaccuagag

SEQ ID NO: 104397 - RNA, 24 nt, Human
cagccucaaucuccaacacugaaa

SEQ ID NO: 104398 - RNA, 23 nt, Human
cagcgacaggucucccucccagg

SEQ ID NO: 104399 - RNA, 23 nt, Human
cagcuucccaaaucuguagcccu

SEQ ID NO: 104400 - RNA, 21 nt, Human
cagggaccuggucauccuucc

SEQ ID NO: 104401 - RNA, 24 nt, Human
ccaaucacagaacaagauacuaac

SEQ ID NO: 104402 - RNA, 23 nt, Human
ccaccccagaaacccacaagcag

SEQ ID NO: 104403 - RNA, 20 nt, Human
ccacuggaccagccuguccc

SEQ ID NO: 104404 - RNA, 18 nt, Human
ccagggaccuggucaucc

SEQ ID NO: 104405 - RNA, 19 nt, Human
ccagucccgcucucugcuu

SEQ ID NO: 104406 - RNA, 23 nt, Human
ccauccagggccccagaggagcc

SEQ ID NO: 104407 - RNA, 26 nt, Human
cccacaagcagcucuggggacacugg

SEQ ID NO: 104408 - RNA, 18 nt, Human
ccccacccccccaguccc

SEQ ID NO: 104409 - RNA, 19 nt, Human
cccccacccccccaguccc

SEQ ID NO: 104410 - RNA, 20 nt, Human
cccccagucccgcucucugc

SEQ ID NO: 104411 - RNA, 24 nt, Human
cccccuaagcaucugaccauucau

SEQ ID NO: 104412 - RNA, 18 nt, Human
cccgcucucugcuuucuc

SEQ ID NO: 104413 - RNA, 19 nt, Human
cccuuuccuggccagagga

SEQ ID NO: 104414 - RNA, 19 nt, Human
ccgccucucuccagccacc

SEQ ID NO: 104415 - RNA, 18 nt, Human
ccuacagagaccgcaacc

SEQ ID NO: 104416 - RNA, 19 nt, Human
ccuacagagaccgcaacca

SEQ ID NO: 104417 - RNA, 20 nt, Human
ccuacagagaccgcaaccac

SEQ ID NO: 104418 - RNA, 23 nt, Human
ccucccugccuuccaccccagaa

SEQ ID NO: 104419 - RNA, 19 nt, Human
ccugccuaccuaccccgcc

SEQ ID NO: 104420 - RNA, 21 nt, Human
ccugguggagccugugcaggc

SEQ ID NO: 104421 - RNA, 23 nt, Human
ccuuccaccccagaaacccacaa

SEQ ID NO: 104422 - RNA, 18 nt, Human
cgacaggucucccuccca

SEQ ID NO: 104423 - RNA, 22 nt, Human
cguggggcagcugaccuugcug

SEQ ID NO: 104424 - RNA, 21 nt, Human
cuauagcucugagccgacauc

SEQ ID NO: 104425 - RNA, 24 nt, Human
cucaacuagagggcauccaaggcc

SEQ ID NO: 104426 - RNA, 21 nt, Human
cucacagccaagccuuguguc

SEQ ID NO: 104427 - RNA, 21 nt, Human
cucgcacacagucgaugcccu

SEQ ID NO: 104428 - RNA, 18 nt, Human
cucugaugcuggguuuca

SEQ ID NO: 104429 - RNA, 18 nt, Human
cucuugggcucccagguu

SEQ ID NO: 104430 - RNA, 24 nt, Human
cugcccaacacacuccaggccagg

SEQ ID NO: 104431 - RNA, 18 nt, Human
cuggaccagccugucccu

SEQ ID NO: 104432 - RNA, 18 nt, Human
cuggguuucaucccugca

SEQ ID NO: 104433 - RNA, 23 nt, Human
cuuccaaucuguagguucuccug

SEQ ID NO: 104434 - RNA, 22 nt, Human
cuuccaccccagaaacccacaa

SEQ ID NO: 104435 - RNA, 21 nt, Human
cuuggcucaaaagaacguugc

SEQ ID NO: 104436 - RNA, 23 nt, Human
cuugggccaccccccacagagaa

SEQ ID NO: 104437 - RNA, 23 nt, Human
gaaaucacuggaugccuccaccu

SEQ ID NO: 104438 - RNA, 21 nt, Human
gaacccacuuggcaacgggga

SEQ ID NO: 104439 - RNA, 22 nt, Human
gacaagcaagcauuuuggaaug

SEQ ID NO: 104440 - RNA, 20 nt, Human
gacaucaauggaggcagcaa

SEQ ID NO: 104441 - RNA, 20 nt, Human
gaccccucagccuccacagg

SEQ ID NO: 104442 - RNA, 23 nt, Human
gagaagccagggugggccaaaug

SEQ ID NO: 104443 - RNA, 19 nt, Human
gagaagucuuggcucaaaa

SEQ ID NO: 104444 - RNA, 22 nt, Human
gagagguggggugguccuggca

SEQ ID NO: 104445 - RNA, 20 nt, Human
gagccagggacgcccugccu

SEQ ID NO: 104446 - RNA, 20 nt, Human
gagccugugcaggccugagc

SEQ ID NO: 104447 - RNA, 18 nt, Human
gaggaugcugucauccaa

SEQ ID NO: 104448 - RNA, 25 nt, Human
gagggcucagggcccaccacuggcu

SEQ ID NO: 104449 - RNA, 20 nt, Human
gaggggucccaaagaagaag

SEQ ID NO: 104450 - RNA, 21 nt, Human
gcacauccccagaggacagag

SEQ ID NO: 104451 - RNA, 22 nt, Human
gccagaggagcacaaaugcccc

SEQ ID NO: 104452 - RNA, 19 nt, Human
gcccccacccccccagucc

SEQ ID NO: 104453 - RNA, 18 nt, Human
gccucaccccuuccacca

SEQ ID NO: 104454 - RNA, 18 nt, Human
gcugucauccaagggcau

SEQ ID NO: 104455 - RNA, 18 nt, Human
ggaaaggguccaagucag

SEQ ID NO: 104456 - RNA, 20 nt, Human
ggaacacgcauccucaacag

SEQ ID NO: 104457 - RNA, 19 nt, Human
ggacagauacacaccuucc

SEQ ID NO: 104458 - RNA, 22 nt, Human
ggacagauacacaccuuccccc

SEQ ID NO: 104459 - RNA, 20 nt, Human
ggaccaaaccccugcaugcu

SEQ ID NO: 104460 - RNA, 20 nt, Human
ggagcuggggaccugagggc

SEQ ID NO: 104461 - RNA, 21 nt, Human
ggaugcugucauccaagggca

SEQ ID NO: 104462 - RNA, 23 nt, Human
ggcacagccucaaucuccaacac

SEQ ID NO: 104463 - RNA, 21 nt, Human
ggcagcuuggauggacucugu

SEQ ID NO: 104464 - RNA, 19 nt, Human
gggaccugagggcucaggg

SEQ ID NO: 104465 - RNA, 23 nt, Human
ggggcagcugaccuugcuggggu

SEQ ID NO: 104466 - RNA, 27 nt, Human
ggguaggggcuugugacucagucuuug

SEQ ID NO: 104467 - RNA, 20 nt, Human
gguaggggcuugugacucag

SEQ ID NO: 104468 - RNA, 26 nt, Human
ggucauuccuuuaugacugagagucg

SEQ ID NO: 104469 - RNA, 20 nt, Human
ggucucccucccagaacccc

SEQ ID NO: 104470 - RNA, 19 nt, Human
gguggagugugcccaaucu

SEQ ID NO: 104471 - RNA, 22 nt, Human
guacuugaagcccccacccccc

SEQ ID NO: 104472 - RNA, 21 nt, Human
guugcaccucccugccuucca

SEQ ID NO: 104473 - RNA, 20 nt, Human
uaaaauguugcaguggccuc

SEQ ID NO: 104474 - RNA, 22 nt, Human
uaaagcaacuaggcugagguca

SEQ ID NO: 104475 - RNA, 20 nt, Human
uaaccacagcaaggaagggg

SEQ ID NO: 104476 - RNA, 20 nt, Human
uaauuuagccaguaacagcc

SEQ ID NO: 104477 - RNA, 24 nt, Human
uacaaauugcccucacccugaacc

SEQ ID NO: 104478 - RNA, 20 nt, Human
uagagacaucaauggaggca

SEQ ID NO: 104479 - RNA, 23 nt, Human
uagagggcauccaaggccuggug

SEQ ID NO: 104480 - RNA, 19 nt, Human
uagcucugagccgacaucc

SEQ ID NO: 104481 - RNA, 19 nt, Human
uaggagccaccugccaaag

SEQ ID NO: 104482 - RNA, 24 nt, Human
uagucaacauugcuaaccaaucac

SEQ ID NO: 104483 - RNA, 18 nt, Human
ucacugggagucaugugc

SEQ ID NO: 104484 - RNA, 19 nt, Human
ucagcaaugagaagaagaa

SEQ ID NO: 104485 - RNA, 24 nt, Human
uccacaucaggugugggcugcuuc

SEQ ID NO: 104486 - RNA, 18 nt, Human
uccaugggauaucgaggg

SEQ ID NO: 104487 - RNA, 20 nt, Human
ucccaaggaucaguggggag

SEQ ID NO: 104488 - RNA, 26 nt, Human
ucccccgaccccucagccuccacagg

SEQ ID NO: 104489 - RNA, 19 nt, Human
ucuccagccaccugcuccc

SEQ ID NO: 104490 - RNA, 24 nt, Human
ucuccagccaccugcuccccaccu

SEQ ID NO: 104491 - RNA, 21 nt, Human
ucuguuuucuucccccgaccc

SEQ ID NO: 104492 - RNA, 19 nt, Human
ugaaaagcaacuugaaggc

SEQ ID NO: 104493 - RNA, 20 nt, Human
ugaaacaaacgguuuauucc

SEQ ID NO: 104494 - RNA, 26 nt, Human
ugaaacaaacgguuuauuccuaaugc

SEQ ID NO: 104495 - RNA, 22 nt, Human
ugacaagcaccuggccaaaggu

SEQ ID NO: 104496 - RNA, 21 nt, Human
ugaccauucauugcaaaagca

SEQ ID NO: 104497 - RNA, 24 nt, Human
ugacuaccuccacagagaucaccu

SEQ ID NO: 104498 - RNA, 22 nt, Human
ugagaagaagaaaaccaauuuc

SEQ ID NO: 104499 - RNA, 22 nt, Human
ugagagcgcgcucaagggcagg

SEQ ID NO: 104500 - RNA, 18 nt, Human
ugagguaaaagagacaag

SEQ ID NO: 104501 - RNA, 18 nt, Human
ugaguggaccaaaccccu

SEQ ID NO: 104502 - RNA, 21 nt, Human
ugauggggauaaaauguugca

SEQ ID NO: 104503 - RNA, 22 nt, Human
ugcccaacacacuccaggccag

SEQ ID NO: 104504 - RNA, 21 nt, Human
ugccucaccccuuccaccagc

SEQ ID NO: 104505 - RNA, 21 nt, Human
ugcuggggucugguggagugu

SEQ ID NO: 104506 - RNA, 21 nt, Human
uggaagguuugcugaaaaccu

SEQ ID NO: 104507 - RNA, 25 nt, Human
uggaaugauggggauaaaauguugc

SEQ ID NO: 104508 - RNA, 22 nt, Human
uggagccuucucagagcucagc

SEQ ID NO: 104509 - RNA, 24 nt, Human
uggcaacggggagaugaccugguu

SEQ ID NO: 104510 - RNA, 24 nt, Human
uggcucaaaagaacguugcccaca

SEQ ID NO: 104511 - RNA, 23 nt, Human
uggcugaaaagcaacuugaaggc

SEQ ID NO: 104512 - RNA, 29 nt, Human
uggcugaaaagcaacuugaaggcuagaac

SEQ ID NO: 104513 - RNA, 21 nt, Human
uggcugugacacguguggaga

SEQ ID NO: 104514 - RNA, 20 nt, Human
ugggcucccagguucauccc

SEQ ID NO: 104515 - RNA, 19 nt, Human
uggggauaaaauguugcag

SEQ ID NO: 104516 - RNA, 24 nt, Human
uggggauaaaauguugcaguggcc

SEQ ID NO: 104517 - RNA, 22 nt, Human
ugggggucauuuucugccucug

SEQ ID NO: 104518 - RNA, 21 nt, Human
uggguucauuuuccuucagag

SEQ ID NO: 104519 - RNA, 20 nt, Human
uguaaccucaugaaagcugu

SEQ ID NO: 104520 - RNA, 18 nt, Human
uguagcccuuuucuguaa

SEQ ID NO: 104521 - RNA, 25 nt, Human
ugucacgcacuuuaaaaccagacuc

SEQ ID NO: 104522 - RNA, 24 nt, Human
uuagcagagaugcuccaugucuug

SEQ ID NO: 104523 - RNA, 19 nt, Human
uucaaguaggugaguggac

SEQ ID NO: 104524 - RNA, 31 nt, Human
uucacaaauggaggcgcccucaccaaagccc

SEQ ID NO: 104525 - RNA, 24 nt, Human
uucaucaguucaccaguuuuaaug

SEQ ID NO: 104526 - RNA, 25 nt, Human
uucauggcaggcaaaagauggguuc

SEQ ID NO: 104527 - RNA, 22 nt, Human
uucccccgaccccucagccucc

SEQ ID NO: 104528 - RNA, 23 nt, Human
uuccuucagaggaaaaaccccca

SEQ ID NO: 104529 - RNA, 19 nt, Human
uugcuuuuuagagaagcca

SEQ ID NO: 104530 - RNA, 18 nt, Human
uuucauaggcauuucucu

SEQ ID NO: 104531 - RNA, 20 nt, Human
uuugcugaaaaccucucuga

SEQ ID NO: 104532 - RNA, 21 nt, Human
accaaagaagugacaaaggga

SEQ ID NO: 104533 - RNA, 21 nt, Human
acccagagagucacuuuagcu

SEQ ID NO: 104534 - RNA, 23 nt, Human
agagucacuuuagcuucugaacc

SEQ ID NO: 104535 - RNA, 19 nt, Human
aggcaacccagagagucac

SEQ ID NO: 104536 - RNA, 23 nt, Human
agugaauagucaaaauugcacaa

SEQ ID NO: 104537 - RNA, 19 nt, Human
aucuagacaaauuaugggg

SEQ ID NO: 104538 - RNA, 20 nt, Human
caaaauggaagcaggcaacc

SEQ ID NO: 104539 - RNA, 18 nt, Human
caccaaagaagugacaaa

SEQ ID NO: 104540 - RNA, 24 nt, Human
caccaaagaagugacaaagggaac

SEQ ID NO: 104541 - RNA, 21 nt, Human
cacccuguuuuccuucaaacu

SEQ ID NO: 104542 - RNA, 22 nt, Human
cagaucaacagaugaacagcaa

SEQ ID NO: 104543 - RNA, 22 nt, Human
cagccgcuguccucuaagguuu

SEQ ID NO: 104544 - RNA, 20 nt, Human
ccaaaacucacauuacaagc

SEQ ID NO: 104545 - RNA, 22 nt, Human
ccagaagcuguccugccuccag

SEQ ID NO: 104546 - RNA, 21 nt, Human
ccagaucaacagaugaacagc

SEQ ID NO: 104547 - RNA, 31 nt, Human
cccuagauaaacccaugguggacaauuuacc

SEQ ID NO: 104548 - RNA, 22 nt, Human
ccuccagaucaacagaugaaca

SEQ ID NO: 104549 - RNA, 23 nt, Human
ccucuaagguuucacaaaaugga

SEQ ID NO: 104550 - RNA, 19 nt, Human
cuguccugccuccagauca

SEQ ID NO: 104551 - RNA, 19 nt, Human
gcacaacguacuaccaccc

SEQ ID NO: 104552 - RNA, 23 nt, Human
ggcccuuuguuuaaccucaugug

SEQ ID NO: 104553 - RNA, 21 nt, Human
ggugagggggugaagaaggga

SEQ ID NO: 104554 - RNA, 25 nt, Human
gucccagaagcuguccugccuccag

SEQ ID NO: 104555 - RNA, 22 nt, Human
uagauaaacccaugguggacaa

SEQ ID NO: 104556 - RNA, 22 nt, Human
uauaagauuaucuguccugaga

SEQ ID NO: 104557 - RNA, 24 nt, Human
ucacaaaauggaagcaggcaaccc

SEQ ID NO: 104558 - RNA, 19 nt, Human
uccguaaguuuguaagugg

SEQ ID NO: 104559 - RNA, 24 nt, Human
ucuaagguuucacaaaauggaagc

SEQ ID NO: 104560 - RNA, 19 nt, Human
ucuguagcccagguauaca

SEQ ID NO: 104561 - RNA, 20 nt, Human
ugaacuagagauauggaaau

SEQ ID NO: 104562 - RNA, 23 nt, Human
ugaagcaagauaauuuaagacca

SEQ ID NO: 104563 - RNA, 19 nt, Human
ugcacaacguacuaccacc

SEQ ID NO: 104564 - RNA, 23 nt, Human
ugcacaacguacuaccacccaag

SEQ ID NO: 104565 - RNA, 20 nt, Human
uucacaaaauggaagcaggc

SEQ ID NO: 104566 - RNA, 22 nt, Human
uugcacaacguacuaccaccca

SEQ ID NO: 104567 - RNA, 19 nt, Human
aaucuccaucuccguacuc

SEQ ID NO: 104568 - RNA, 21 nt, Human
acccaacuuccaccacgcugg

SEQ ID NO: 104569 - RNA, 19 nt, Human
acuuccaccacgcuggagg

SEQ ID NO: 104570 - RNA, 18 nt, Human
aggauagggaggaguugg

SEQ ID NO: 104571 - RNA, 22 nt, Human
aggauagggaggaguugggagc

SEQ ID NO: 104572 - RNA, 20 nt, Human
aggcucuuccgggcagcagg

SEQ ID NO: 104573 - RNA, 24 nt, Human
ccaaucuccaucuccguacuccua

SEQ ID NO: 104574 - RNA, 24 nt, Human
cccagcccccacggaacaugaggc

SEQ ID NO: 104575 - RNA, 21 nt, Human
cccccacggaacaugaggcuc

SEQ ID NO: 104576 - RNA, 22 nt, Human
cccgagccguucagccuggagc

SEQ ID NO: 104577 - RNA, 19 nt, Human
ccuggccccagagauucac

SEQ ID NO: 104578 - RNA, 18 nt, Human
cuuccgggcagcaggguc

SEQ ID NO: 104579 - RNA, 18 nt, Human
gcagugguguguaagugg

SEQ ID NO: 104580 - RNA, 22 nt, Human
uaaguggcccgagccguucagc

SEQ ID NO: 104581 - RNA, 24 nt, Human
uaggauagggaggaguugggagcc

SEQ ID NO: 104582 - RNA, 22 nt, Human
ugaggcucuuccgggcagcagg

SEQ ID NO: 104583 - RNA, 23 nt, Human
ugccagugggccuuuaggauagg

SEQ ID NO: 104584 - RNA, 21 nt, Human
ugcuugccuucugcuacaagc

SEQ ID NO: 104585 - RNA, 21 nt, Human
uguguaaguggcccgagccgu

SEQ ID NO: 104586 - RNA, 23 nt, Human
aaaaauacaggcucccccacaac

SEQ ID NO: 104587 - RNA, 22 nt, Human
aaaagaucaaaagcaguuuggg

SEQ ID NO: 104588 - RNA, 22 nt, Human
aacauuccauuuauacacagaa

SEQ ID NO: 104589 - RNA, 22 nt, Human
aagaggaaucaaaagaucaaaa

SEQ ID NO: 104590 - RNA, 24 nt, Human
aaggaaaauccagggggugggggg

SEQ ID NO: 104591 - RNA, 21 nt, Human
aaggccagaaccgucaaggga

SEQ ID NO: 104592 - RNA, 19 nt, Human
aagggcagguguggggcug

SEQ ID NO: 104593 - RNA, 21 nt, Human
aaggucccuuacugguccugc

SEQ ID NO: 104594 - RNA, 24 nt, Human
aggaaaauccaggggguggggggu

SEQ ID NO: 104595 - RNA, 23 nt, Human
caagaggaaucaaaagaucaaaa

SEQ ID NO: 104596 - RNA, 23 nt, Human
cacagaacuaaacagacaagcac

SEQ ID NO: 104597 - RNA, 26 nt, Human
cacagaacuaaacagacaagcacaga

SEQ ID NO: 104598 - RNA, 23 nt, Human
cacagagucacuauugcgguuag

SEQ ID NO: 104599 - RNA, 22 nt, Human
cagacaagcacagagucacuau

SEQ ID NO: 104600 - RNA, 20 nt, Human
cagcaugggaagggggagga

SEQ ID NO: 104601 - RNA, 18 nt, Human
ccaggggguggggggucu

SEQ ID NO: 104602 - RNA, 20 nt, Human
cccccagccccuccggucug

SEQ ID NO: 104603 - RNA, 21 nt, Human
cccccugcugggaucccccca

SEQ ID NO: 104604 - RNA, 20 nt, Human
ccuccggucuggcaggaagg

SEQ ID NO: 104605 - RNA, 22 nt, Human
cgaaaaggagagggcaccgaga

SEQ ID NO: 104606 - RNA, 22 nt, Human
cuggggggaacuuggucugcuu

SEQ ID NO: 104607 - RNA, 18 nt, Human
gagaggaaccagccggca

SEQ ID NO: 104608 - RNA, 19 nt, Human
ggaagggggaggaccaggu

SEQ ID NO: 104609 - RNA, 19 nt, Human
ggcaacuggggugaaggga

SEQ ID NO: 104610 - RNA, 20 nt, Human
ggcaggaagggggcagccug

SEQ ID NO: 104611 - RNA, 18 nt, Human
gggaggaccaggugggga

SEQ ID NO: 104612 - RNA, 21 nt, Human
gggggaggaccagguggggaa

SEQ ID NO: 104613 - RNA, 22 nt, Human
ggggggucuguuuggcaacugg

SEQ ID NO: 104614 - RNA, 19 nt, Human
gggucuguuuggcaacugg

SEQ ID NO: 104615 - RNA, 23 nt, Human
ggucuggcaggaagggggcagcc

SEQ ID NO: 104616 - RNA, 19 nt, Human
uacacagaacuaaacagac

SEQ ID NO: 104617 - RNA, 23 nt, Human
uacaggcucccccacaacugggg

SEQ ID NO: 104618 - RNA, 18 nt, Human
uccaggcagggggccaga

SEQ ID NO: 104619 - RNA, 19 nt, Human
uccaggggguggggggucu

SEQ ID NO: 104620 - RNA, 21 nt, Human
uccccccagccccuccggucu

SEQ ID NO: 104621 - RNA, 21 nt, Human
uccugcuuccaugaguagccg

SEQ ID NO: 104622 - RNA, 18 nt, Human
ucuggcaggaagggggca

SEQ ID NO: 104623 - RNA, 20 nt, Human
ugaccaggggaaaagggaga

SEQ ID NO: 104624 - RNA, 23 nt, Human
uggagggagaaggaaaauccagg

SEQ ID NO: 104625 - RNA, 24 nt, Human
uggcaggaagggggcagccugcaa

SEQ ID NO: 104626 - RNA, 24 nt, Human
ugggaaggccagaaccgucaaggg

SEQ ID NO: 104627 - RNA, 18 nt, Human
ugggauccccccagcccc

SEQ ID NO: 104628 - RNA, 20 nt, Human
uggggugccuggggggaacu

SEQ ID NO: 104629 - RNA, 25 nt, Human
uggggugccuggggggaacuugguc

SEQ ID NO: 104630 - RNA, 22 nt, Human
uguuaaaaaaaauacaggcucc

SEQ ID NO: 104631 - RNA, 23 nt, Human
uguuuggcaacuggggugaaggg

SEQ ID NO: 104632 - RNA, 24 nt, Human
uguuuggcaacuggggugaaggga

SEQ ID NO: 104633 - RNA, 20 nt, Human
uuggcagcaugggaaggggg

SEQ ID NO: 104634 - RNA, 24 nt, Human
aaaaggaauacaagcuuauauaaa

SEQ ID NO: 104635 - RNA, 19 nt, Human
aaaauacagcauuguaaua

SEQ ID NO: 104636 - RNA, 24 nt, Human
aaauuaacgaguuucacuagacaa

SEQ ID NO: 104637 - RNA, 21 nt, Human
aacagucagacuggugguacc

SEQ ID NO: 104638 - RNA, 21 nt, Human
aagaagggcuguccugugaca

SEQ ID NO: 104639 - RNA, 20 nt, Human
aagcuccuaaugccaaagac

SEQ ID NO: 104640 - RNA, 23 nt, Human
acaguaauaaauauaaugcaguc

SEQ ID NO: 104641 - RNA, 22 nt, Human
auaaaacagaagcauauaaaac

SEQ ID NO: 104642 - RNA, 21 nt, Human
auauuucauaaaaauacuagu

SEQ ID NO: 104643 - RNA, 19 nt, Human
aucagccccaaggcuuccc

SEQ ID NO: 104644 - RNA, 22 nt, Human
auggaaacagucagacuggugg

SEQ ID NO: 104645 - RNA, 20 nt, Human
caaaauuauaaaacagaagc

SEQ ID NO: 104646 - RNA, 24 nt, Human
caaacaauauaguuguguuucuaa

SEQ ID NO: 104647 - RNA, 26 nt, Human
caaauguuucuuuuuuaaaaaaaaac

SEQ ID NO: 104648 - RNA, 25 nt, Human
cacaaaauuauaaaacagaagcaua

SEQ ID NO: 104649 - RNA, 18 nt, Human
cacuuucuggaguuggga

SEQ ID NO: 104650 - RNA, 23 nt, Human
cagaagcauauaaaacuaauuca

SEQ ID NO: 104651 - RNA, 22 nt, Human
cagcugugggcaacaacucgau

SEQ ID NO: 104652 - RNA, 25 nt, Human
caguaauaaauauaaugcagucuuc

SEQ ID NO: 104653 - RNA, 21 nt, Human
cagucuugugguuccuguggu

SEQ ID NO: 104654 - RNA, 20 nt, Human
cagugugucucucauucucu

SEQ ID NO: 104655 - RNA, 21 nt, Human
cccacagugcccauggccuau

SEQ ID NO: 104656 - RNA, 22 nt, Human
cccacagugcccauggccuauc

SEQ ID NO: 104657 - RNA, 19 nt, Human
cccauaucaguguccucaa

SEQ ID NO: 104658 - RNA, 24 nt, Human
ccccaaggcuucccuccagaccaa

SEQ ID NO: 104659 - RNA, 20 nt, Human
cccuccagaccaaaagguga

SEQ ID NO: 104660 - RNA, 19 nt, Human
ccgcugaaguuuccaguua

SEQ ID NO: 104661 - RNA, 22 nt, Human
ccugccgcucaacccuuuuucu

SEQ ID NO: 104662 - RNA, 18 nt, Human
cgcuggggucccugcuag

SEQ ID NO: 104663 - RNA, 24 nt, Human
cucugggugccugccgcucaaccc

SEQ ID NO: 104664 - RNA, 25 nt, Human
cugaaaacauaccaccaucaaccua

SEQ ID NO: 104665 - RNA, 18 nt, Human
cuuucccagguaagggau

SEQ ID NO: 104666 - RNA, 20 nt, Human
cuuucuggaguugggaaaag

SEQ ID NO: 104667 - RNA, 21 nt, Human
gcuccuaaugccaaagaccua

SEQ ID NO: 104668 - RNA, 25 nt, Human
guaauucauaaucauucuuuuaaaa

SEQ ID NO: 104669 - RNA, 21 nt, Human
gucaguuuggaguugagaagg

SEQ ID NO: 104670 - RNA, 25 nt, Human
uaaaaaaaaacuuaauucauccuug

SEQ ID NO: 104671 - RNA, 21 nt, Human
uaaaacagaagcauauaaaac

SEQ ID NO: 104672 - RNA, 21 nt, Human
uaaaccgcugaaguuuccagu

SEQ ID NO: 104673 - RNA, 18 nt, Human
uaacagcccuuucccagg

SEQ ID NO: 104674 - RNA, 24 nt, Human
uaacauacuuuuccagcuaaacuc

SEQ ID NO: 104675 - RNA, 25 nt, Human
uaagcugaucaacuaggcugauuga

SEQ ID NO: 104676 - RNA, 21 nt, Human
uaccaucuucuucagaacugc

SEQ ID NO: 104677 - RNA, 24 nt, Human
uaccaucuucuucagaacugcauc

SEQ ID NO: 104678 - RNA, 20 nt, Human
uacuugcuuggaaaugagau

SEQ ID NO: 104679 - RNA, 24 nt, Human
uagacaauaagcugaucaacuagg

SEQ ID NO: 104680 - RNA, 20 nt, Human
uauugugauuaucugaaaua

SEQ ID NO: 104681 - RNA, 21 nt, Human
ucaacuaggcugauugacauu

SEQ ID NO: 104682 - RNA, 21 nt, Human
ucaauuccccuuaccaaaugu

SEQ ID NO: 104683 - RNA, 18 nt, Human
uccacgagcuccaauucc

SEQ ID NO: 104684 - RNA, 20 nt, Human
uccaugaggugacuguccca

SEQ ID NO: 104685 - RNA, 24 nt, Human
ucccaugucaacauuuaugcugcu

SEQ ID NO: 104686 - RNA, 20 nt, Human
uccccugugaaagauuauaa

SEQ ID NO: 104687 - RNA, 23 nt, Human
uccuuguuuucugaggcagaggu

SEQ ID NO: 104688 - RNA, 18 nt, Human
ucuggaguugggaaaagg

SEQ ID NO: 104689 - RNA, 23 nt, Human
ucugugagcuugucacuuucugg

SEQ ID NO: 104690 - RNA, 25 nt, Human
ugaaguacauacaucuagccugaaa

SEQ ID NO: 104691 - RNA, 18 nt, Human
ugagaaggcaguguaccc

SEQ ID NO: 104692 - RNA, 24 nt, Human
ugagcaaaugucccaugucaacau

SEQ ID NO: 104693 - RNA, 18 nt, Human
ugaggugacugucccacg

SEQ ID NO: 104694 - RNA, 23 nt, Human
ugccauaaaaagucaauauuuca

SEQ ID NO: 104695 - RNA, 20 nt, Human
ugggaaucauacagcugugg

SEQ ID NO: 104696 - RNA, 24 nt, Human
uguauugugauuaucugaaauauu

SEQ ID NO: 104697 - RNA, 18 nt, Human
ugucacuuucuggaguug

SEQ ID NO: 104698 - RNA, 23 nt, Human
ugugcagucuugugguuccugug

SEQ ID NO: 104699 - RNA, 23 nt, Human
uucacaaaauuauaaaacagaag

SEQ ID NO: 104700 - RNA, 22 nt, Human
uuuccaggaucuggaaguucuc

SEQ ID NO: 104701 - RNA, 19 nt, Human
uuugaaguaccuuucacac

SEQ ID NO: 104702 - RNA, 21 nt, Human
uuugaugugcagucuuguggu

SEQ ID NO: 104703 - RNA, 22 nt, Human
uuuucaggaaaaucuggcuugc

SEQ ID NO: 104704 - RNA, 19 nt, Human
uuuuccagcuaaacucuag

SEQ ID NO: 104705 - RNA, 21 nt, Human
aaaaggagaguuuuaucucac

SEQ ID NO: 104706 - RNA, 19 nt, Human
aagccauaaacacuaaaca

SEQ ID NO: 104707 - RNA, 23 nt, Human
cauuccaaaugaaaagaacuaga

SEQ ID NO: 104708 - RNA, 18 nt, Human
cgcuccuuucucugggcu

SEQ ID NO: 104709 - RNA, 18 nt, Human
gcgcuccuuucucugggc

SEQ ID NO: 104710 - RNA, 20 nt, Human
uaaggaaaaggagaguuuua

SEQ ID NO: 104711 - RNA, 23 nt, Human
uaggauaaggaggaaggcaguaa

SEQ ID NO: 104712 - RNA, 22 nt, Human
aagagguagacaaggccagggg

SEQ ID NO: 104713 - RNA, 18 nt, Human
accucagagacucagucg

SEQ ID NO: 104714 - RNA, 24 nt, Human
agggaguaggguguaggaaggccu

SEQ ID NO: 104715 - RNA, 21 nt, Human
cacagggaguaggguguagga

SEQ ID NO: 104716 - RNA, 21 nt, Human
cagcggagcgccccagcccuc

SEQ ID NO: 104717 - RNA, 20 nt, Human
ccccagcccucuccucucac

SEQ ID NO: 104718 - RNA, 22 nt, Human
ccuauggugggguccugggagc

SEQ ID NO: 104719 - RNA, 22 nt, Human
ccucgggguugugggggcggca

SEQ ID NO: 104720 - RNA, 18 nt, Human
cgaggcuggaggcacagg

SEQ ID NO: 104721 - RNA, 19 nt, Human
cugccucguguaccuggcu

SEQ ID NO: 104722 - RNA, 23 nt, Human
gaggcggagaccacggugaagug

SEQ ID NO: 104723 - RNA, 23 nt, Human
gcggagcgccccagcccucuccu

SEQ ID NO: 104724 - RNA, 23 nt, Human
ggacuagucgaggcuggaggcac

SEQ ID NO: 104725 - RNA, 22 nt, Human
ggaggugauaggaugcuggggu

SEQ ID NO: 104726 - RNA, 25 nt, Human
gggcaagagguagacaaggccaggg

SEQ ID NO: 104727 - RNA, 23 nt, Human
ggguccugggagccaggaggagg

SEQ ID NO: 104728 - RNA, 19 nt, Human
uccugggagccaggaggag

SEQ ID NO: 104729 - RNA, 20 nt, Human
uccugggagccaggaggagg

SEQ ID NO: 104730 - RNA, 19 nt, Human
ucgaggcuggaggcacagg

SEQ ID NO: 104731 - RNA, 18 nt, Human
ucucacugguccagcgcc

SEQ ID NO: 104732 - RNA, 24 nt, Human
ugccuauggugggguccugggagc

SEQ ID NO: 104733 - RNA, 22 nt, Human
ugccucguguaccuggcuuuau

SEQ ID NO: 104734 - RNA, 21 nt, Human
uggcuuuauaccucgggguug

SEQ ID NO: 104735 - RNA, 21 nt, Human
ugggagccaggaggaggccgu

SEQ ID NO: 104736 - RNA, 21 nt, Human
ugggguccugggagccaggag

SEQ ID NO: 104737 - RNA, 22 nt, Human
uggugggguccugggagccagg

SEQ ID NO: 104738 - RNA, 22 nt, Human
aaggaugcggccucacccagag

SEQ ID NO: 104739 - RNA, 22 nt, Human
acaaguguuucugcacauucuu

SEQ ID NO: 104740 - RNA, 24 nt, Human
acacaaguguuucugcacauucuu

SEQ ID NO: 104741 - RNA, 20 nt, Human
acaccguccggaggaggugc

SEQ ID NO: 104742 - RNA, 21 nt, Human
acagagggcagcagccccaca

SEQ ID NO: 104743 - RNA, 19 nt, Human
accguccggaggaggugcu

SEQ ID NO: 104744 - RNA, 19 nt, Human
accugcgcaccccagcagc

SEQ ID NO: 104745 - RNA, 19 nt, Human
acuucacaaauggaaggcu

SEQ ID NO: 104746 - RNA, 23 nt, Human
agacagaggugcuggggaggggg

SEQ ID NO: 104747 - RNA, 21 nt, Human
agaggaggacggagccggagg

SEQ ID NO: 104748 - RNA, 18 nt, Human
agccaggaauccaagggg

SEQ ID NO: 104749 - RNA, 24 nt, Human
agcgcauggcagacagaggugcug

SEQ ID NO: 104750 - RNA, 18 nt, Human
agcugggggccugaguac

SEQ ID NO: 104751 - RNA, 21 nt, Human
agcuucgggcucccagguggc

SEQ ID NO: 104752 - RNA, 25 nt, Human
aggaacacagagggcagccgguacc

SEQ ID NO: 104753 - RNA, 24 nt, Human
aggugaucaacccaugucuggagc

SEQ ID NO: 104754 - RNA, 22 nt, Human
aucaacccaugucuggagcuag

SEQ ID NO: 104755 - RNA, 24 nt, Human
augagccuguuuguggcuucugug

SEQ ID NO: 104756 - RNA, 19 nt, Human
augccuccaccagcaagau

SEQ ID NO: 104757 - RNA, 21 nt, Human
cacagcggaaccaccaggggc

SEQ ID NO: 104758 - RNA, 20 nt, Human
caccccagcagccuuccgcc

SEQ ID NO: 104759 - RNA, 19 nt, Human
cagacugggggguccaagg

SEQ ID NO: 104760 - RNA, 23 nt, Human
cagagagacagggacaggccaca

SEQ ID NO: 104761 - RNA, 23 nt, Human
cagcagccccacagcggaaccac

SEQ ID NO: 104762 - RNA, 19 nt, Human
cagcggggcucugcaggcu

SEQ ID NO: 104763 - RNA, 25 nt, Human
caggaacgccgcauuugcuggcuuu

SEQ ID NO: 104764 - RNA, 19 nt, Human
caggaauccaaggggccuu

SEQ ID NO: 104765 - RNA, 22 nt, Human
caggcccucgugccccagaugg

SEQ ID NO: 104766 - RNA, 22 nt, Human
caggcgcaggcgcaggcagcgg

SEQ ID NO: 104767 - RNA, 24 nt, Human
caggguggccacagacuggggggu

SEQ ID NO: 104768 - RNA, 19 nt, Human
caggugcugccuugcugga

SEQ ID NO: 104769 - RNA, 22 nt, Human
caucauuguccccagccaggaa

SEQ ID NO: 104770 - RNA, 21 nt, Human
caugucuggagcuagcucuuc

SEQ ID NO: 104771 - RNA, 23 nt, Human
ccagaggaggacggagccggagg

SEQ ID NO: 104772 - RNA, 26 nt, Human
ccagcagccuuccgcccuccgccugg

SEQ ID NO: 104773 - RNA, 21 nt, Human
ccagcccaggcccucgugccc

SEQ ID NO: 104774 - RNA, 22 nt, Human
ccagcccaggcccucgugcccc

SEQ ID NO: 104775 - RNA, 18 nt, Human
ccaggcccgguguggaug

SEQ ID NO: 104776 - RNA, 22 nt, Human
ccaggcccucgugccccagaug

SEQ ID NO: 104777 - RNA, 23 nt, Human
cccacagcggaaccaccaggggc

SEQ ID NO: 104778 - RNA, 19 nt, Human
cccacaugggccuugaagg

SEQ ID NO: 104779 - RNA, 21 nt, Human
cccagcagccuuccgcccucc

SEQ ID NO: 104780 - RNA, 19 nt, Human
cccagccaggaauccaagg

SEQ ID NO: 104781 - RNA, 24 nt, Human
cccagguggcugggagggccaggg

SEQ ID NO: 104782 - RNA, 24 nt, Human
ccccagcagccuuccgcccuccgc

SEQ ID NO: 104783 - RNA, 18 nt, Human
cccccuccagcguggaga

SEQ ID NO: 104784 - RNA, 27 nt, Human
cccgcauccacccaaugccaggccuca

SEQ ID NO: 104785 - RNA, 19 nt, Human
cccgccguggggccggggc

SEQ ID NO: 104786 - RNA, 19 nt, Human
ccggggccgggggcggagg

SEQ ID NO: 104787 - RNA, 20 nt, Human
ccucagggccaagagggcuc

SEQ ID NO: 104788 - RNA, 21 nt, Human
ccuuccgcccuccgccugggc

SEQ ID NO: 104789 - RNA, 21 nt, Human
ccuugcuggagggccagggcu

SEQ ID NO: 104790 - RNA, 23 nt, Human
cgcagcccaagaguagggacugg

SEQ ID NO: 104791 - RNA, 18 nt, Human
cgcaggcgcaggcgcagg

SEQ ID NO: 104792 - RNA, 25 nt, Human
cgccccuggcugcugaugcggagcc

SEQ ID NO: 104793 - RNA, 25 nt, Human
cggagccggaggcggagggggccca

SEQ ID NO: 104794 - RNA, 20 nt, Human
cggcaaggacuggagggaag

SEQ ID NO: 104795 - RNA, 20 nt, Human
cucccagguggcugggaggg

SEQ ID NO: 104796 - RNA, 19 nt, Human
cugcugaugcggagccuca

SEQ ID NO: 104797 - RNA, 18 nt, Human
cuggagggccagggcucu

SEQ ID NO: 104798 - RNA, 19 nt, Human
cuggggagggggccacagg

SEQ ID NO: 104799 - RNA, 19 nt, Human
gacagcuggcugguugagg

SEQ ID NO: 104800 - RNA, 24 nt, Human
gacagcuggcugguugaggguauc

SEQ ID NO: 104801 - RNA, 21 nt, Human
gagccgaaagcccccgagggu

SEQ ID NO: 104802 - RNA, 18 nt, Human
gagggggccagaggagga

SEQ ID NO: 104803 - RNA, 20 nt, Human
gcacggggggagcccugggg

SEQ ID NO: 104804 - RNA, 20 nt, Human
gcccaccugcgcaccccagc

SEQ ID NO: 104805 - RNA, 19 nt, Human
gcgcggggccuucuggaag

SEQ ID NO: 104806 - RNA, 22 nt, Human
ggagccgaaagcccccgagggu

SEQ ID NO: 104807 - RNA, 21 nt, Human
ggccacagacuggggggucca

SEQ ID NO: 104808 - RNA, 23 nt, Human
ggccacagggcacuucacaaaug

SEQ ID NO: 104809 - RNA, 18 nt, Human
ggcccgguguggaugcug

SEQ ID NO: 104810 - RNA, 19 nt, Human
ggcggagggggccagagga

SEQ ID NO: 104811 - RNA, 25 nt, Human
ggcggccgggagaacggcgcaggcg

SEQ ID NO: 104812 - RNA, 22 nt, Human
gggcagcagccccacagcggaa

SEQ ID NO: 104813 - RNA, 25 nt, Human
gggccggggccgggggcggaggggg

SEQ ID NO: 104814 - RNA, 18 nt, Human
gguguagggacagaagga

SEQ ID NO: 104815 - RNA, 20 nt, Human
guccggaggaggugcuaagg

SEQ ID NO: 104816 - RNA, 21 nt, Human
gugcugccuugcuggagggcc

SEQ ID NO: 104817 - RNA, 21 nt, Human
gugcuggggagggggccacag

SEQ ID NO: 104818 - RNA, 24 nt, Human
gugcuggggagggggccacagggc

SEQ ID NO: 104819 - RNA, 18 nt, Human
uacuuuugacagcuggcu

SEQ ID NO: 104820 - RNA, 18 nt, Human
ucagagagacagggacag

SEQ ID NO: 104821 - RNA, 19 nt, Human
ucaggguagccugggagga

SEQ ID NO: 104822 - RNA, 18 nt, Human
uccuggcaggccccccuc

SEQ ID NO: 104823 - RNA, 22 nt, Human
ucugcacauucuucaggguggc

SEQ ID NO: 104824 - RNA, 19 nt, Human
ugacagcuggcugguugag

SEQ ID NO: 104825 - RNA, 26 nt, Human
ugacagcuggcugguugaggguaucc

SEQ ID NO: 104826 - RNA, 19 nt, Human
ugagaaacgcacagcccac

SEQ ID NO: 104827 - RNA, 21 nt, Human
ugaguacguagcgccaggccc

SEQ ID NO: 104828 - RNA, 22 nt, Human
ugcggcaaggacuggagggaag

SEQ ID NO: 104829 - RNA, 20 nt, Human
ugcuggggagggggccacag

SEQ ID NO: 104830 - RNA, 19 nt, Human
uggaagccaccgaguuccg

SEQ ID NO: 104831 - RNA, 22 nt, Human
uggaaggcugucagagagacag

SEQ ID NO: 104832 - RNA, 23 nt, Human
uggaugcuggggagaaucaucag

SEQ ID NO: 104833 - RNA, 19 nt, Human
uggcugggagggccagggg

SEQ ID NO: 104834 - RNA, 23 nt, Human
uggcugggagggccaggggugca

SEQ ID NO: 104835 - RNA, 18 nt, Human
uggcugguugaggguauc

SEQ ID NO: 104836 - RNA, 22 nt, Human
ugggaggaagaagcgcauggca

SEQ ID NO: 104837 - RNA, 24 nt, Human
ugggagggccaggggugcacaggu

SEQ ID NO: 104838 - RNA, 22 nt, Human
ugggccacggccagcccgcauc

SEQ ID NO: 104839 - RNA, 24 nt, Human
ugggccacggccagcccgcaucca

SEQ ID NO: 104840 - RNA, 21 nt, Human
uggggagggggccacagggca

SEQ ID NO: 104841 - RNA, 20 nt, Human
ugggggguccaaggagcagg

SEQ ID NO: 104842 - RNA, 21 nt, Human
ugggguggggagacgcgagcg

SEQ ID NO: 104843 - RNA, 25 nt, Human
uggucaggaccaggucacagcuugg

SEQ ID NO: 104844 - RNA, 21 nt, Human
ugguugaggguaucugcucac

SEQ ID NO: 104845 - RNA, 18 nt, Human
uguggugaggacugggcc

SEQ ID NO: 104846 - RNA, 18 nt, Human
uguuuguggcuucugugg

SEQ ID NO: 104847 - RNA, 18 nt, Human
uucuccagccuagcaggg

SEQ ID NO: 104848 - RNA, 18 nt, Human
aaacaguauguaaauuac

SEQ ID NO: 104849 - RNA, 20 nt, Human
acaaacaguauguaaauuac

SEQ ID NO: 104850 - RNA, 22 nt, Human
acuaagaauaccaagaacacaa

SEQ ID NO: 104851 - RNA, 20 nt, Human
agaacacuuugaaacauaga

SEQ ID NO: 104852 - RNA, 19 nt, Human
agagucagaagucaacacc

SEQ ID NO: 104853 - RNA, 18 nt, Human
augcaggauucaaggcua

SEQ ID NO: 104854 - RNA, 18 nt, Human
cuaagaauaccaagaaca

SEQ ID NO: 104855 - RNA, 26 nt, Human
gaaaauuccuuauucuacaaacaagu

SEQ ID NO: 104856 - RNA, 23 nt, Human
uaaaaaaauauauagcucaggug

SEQ ID NO: 104857 - RNA, 22 nt, Human
uaagaagguacuauaauucuug

SEQ ID NO: 104858 - RNA, 24 nt, Human
uacaaacaaguccuuuuagagaua

SEQ ID NO: 104859 - RNA, 20 nt, Human
uaugccagugaugaaugucu

SEQ ID NO: 104860 - RNA, 23 nt, Human
uaugguuuuuuuuccuuuuuaaa

SEQ ID NO: 104861 - RNA, 23 nt, Human
uccuuauucuacaaacaaguccu

SEQ ID NO: 104862 - RNA, 20 nt, Human
ucuuuuagccagguuuuaga

SEQ ID NO: 104863 - RNA, 21 nt, Human
ugagcuagacuaagaauacca

SEQ ID NO: 104864 - RNA, 18 nt, Human
uuaaagcacgaauaacau

SEQ ID NO: 104865 - RNA, 23 nt, Human
uuagagucagaagucaacaccau

SEQ ID NO: 104866 - RNA, 23 nt, Human
uuuuuaugguuuuuuuuccuuuu

SEQ ID NO: 104867 - RNA, 21 nt, Human
aaaaaaaggcauuuugcuaac

SEQ ID NO: 104868 - RNA, 19 nt, Human
aaacaugacuuggguaaac

SEQ ID NO: 104869 - RNA, 19 nt, Human
aaacauuuuaaaagaaaau

SEQ ID NO: 104870 - RNA, 23 nt, Human
aaacuacugagaauaaacaaugu

SEQ ID NO: 104871 - RNA, 19 nt, Human
aaagaaaaaagcauuuugg

SEQ ID NO: 104872 - RNA, 24 nt, Human
aaauaaaaccagugaacaucaaaa

SEQ ID NO: 104873 - RNA, 20 nt, Human
aaccaaguagaucucaugaa

SEQ ID NO: 104874 - RNA, 18 nt, Human
aagcauuuugggggaaac

SEQ ID NO: 104875 - RNA, 21 nt, Human
aagguuucuuaaggggaggcu

SEQ ID NO: 104876 - RNA, 23 nt, Human
acagagucuucaauuccaaaaga

SEQ ID NO: 104877 - RNA, 18 nt, Human
acuaugcaauacaaagcu

SEQ ID NO: 104878 - RNA, 23 nt, Human
agaaaaaagcauuuugggggaaa

SEQ ID NO: 104879 - RNA, 20 nt, Human
agcaagaaauacaauuacaa

SEQ ID NO: 104880 - RNA, 22 nt, Human
agccguggugggcacggcagcc

SEQ ID NO: 104881 - RNA, 18 nt, Human
aggaaaacauuuuaaaag

SEQ ID NO: 104882 - RNA, 23 nt, Human
aggcaauguuugauuucuuaccc

SEQ ID NO: 104883 - RNA, 23 nt, Human
aggcggagcgcggugcagaccug

SEQ ID NO: 104884 - RNA, 22 nt, Human
aggcuuuaaaaauucuccuuug

SEQ ID NO: 104885 - RNA, 20 nt, Human
auugcugugugucuucaggc

SEQ ID NO: 104886 - RNA, 21 nt, Human
caacgcgcagcccuagcgagc

SEQ ID NO: 104887 - RNA, 18 nt, Human
caagaaagaaaaccucau

SEQ ID NO: 104888 - RNA, 26 nt, Human
caauuuagaaaaccggguaauugcug

SEQ ID NO: 104889 - RNA, 21 nt, Human
cacaacuauugacuauacaga

SEQ ID NO: 104890 - RNA, 18 nt, Human
cacauacaacaugcauug

SEQ ID NO: 104891 - RNA, 20 nt, Human
cagaccugggcgcgcagccc

SEQ ID NO: 104892 - RNA, 19 nt, Human
cagagucuucaauuccaaa

SEQ ID NO: 104893 - RNA, 24 nt, Human
caguuaauaguaacuugguggcac

SEQ ID NO: 104894 - RNA, 22 nt, Human
ccagaaauucucaaucuauugg

SEQ ID NO: 104895 - RNA, 23 nt, Human
cccgccgccuuccccacgccccu

SEQ ID NO: 104896 - RNA, 19 nt, Human
ccgccgccuuccccacgcc

SEQ ID NO: 104897 - RNA, 20 nt, Human
ccgccgccuuccccacgccc

SEQ ID NO: 104898 - RNA, 23 nt, Human
ccucccgccgccuuccccacgcc

SEQ ID NO: 104899 - RNA, 21 nt, Human
cgcagcccuagcgagcccagc

SEQ ID NO: 104900 - RNA, 23 nt, Human
cgccccucccucgagguaauucg

SEQ ID NO: 104901 - RNA, 22 nt, Human
cgcgugcgcaagucugcgcgcg

SEQ ID NO: 104902 - RNA, 21 nt, Human
cggcuucagcugcggcgcccc

SEQ ID NO: 104903 - RNA, 22 nt, Human
cgguucaccggcuccggggcgg

SEQ ID NO: 104904 - RNA, 25 nt, Human
cugcaucauucucuucacaguucac

SEQ ID NO: 104905 - RNA, 21 nt, Human
cugcggcgcccccgcuggccc

SEQ ID NO: 104906 - RNA, 19 nt, Human
cuggcccaacgcgcagccc

SEQ ID NO: 104907 - RNA, 18 nt, Human
cuguaauaugcuucccaa

SEQ ID NO: 104908 - RNA, 24 nt, Human
cuucaugauucugaagaaaccacc

SEQ ID NO: 104909 - RNA, 18 nt, Human
gaaaauguguuuuaccuc

SEQ ID NO: 104910 - RNA, 23 nt, Human
gcagaccugggcgcgcagcccug

SEQ ID NO: 104911 - RNA, 21 nt, Human
gccccucccucgagguaauuc

SEQ ID NO: 104912 - RNA, 19 nt, Human
gcggagcgcggugcagacc

SEQ ID NO: 104913 - RNA, 19 nt, Human
gcggcgcccccgcuggccc

SEQ ID NO: 104914 - RNA, 23 nt, Human
ggcaauuuaaaauaaaaccagug

SEQ ID NO: 104915 - RNA, 18 nt, Human
ggcuuuaaaaauucuccu

SEQ ID NO: 104916 - RNA, 21 nt, Human
gguuuuguuuuuuuguuuuug

SEQ ID NO: 104917 - RNA, 19 nt, Human
gugcgcaagucugcgcgcg

SEQ ID NO: 104918 - RNA, 22 nt, Human
uaaaauaaaaccagugaacauc

SEQ ID NO: 104919 - RNA, 18 nt, Human
uaaaccaaguagaucuca

SEQ ID NO: 104920 - RNA, 22 nt, Human
uaauauguuggaugcccucccu

SEQ ID NO: 104921 - RNA, 21 nt, Human
uacaauucaaaccuauccuuu

SEQ ID NO: 104922 - RNA, 24 nt, Human
uacagagaaaaagauggagcaaau

SEQ ID NO: 104923 - RNA, 18 nt, Human
uacagagucuucaauucc

SEQ ID NO: 104924 - RNA, 19 nt, Human
uacaggguacuugaaauca

SEQ ID NO: 104925 - RNA, 19 nt, Human
uagcagucuauuaaaaaca

SEQ ID NO: 104926 - RNA, 22 nt, Human
uagcuguuuuaccugauucugg

SEQ ID NO: 104927 - RNA, 23 nt, Human
ucugaaacagacuuccuuuuuug

SEQ ID NO: 104928 - RNA, 22 nt, Human
ugaaauaagcaugacagaagua

SEQ ID NO: 104929 - RNA, 20 nt, Human
ugacuauacagagucuucaa

SEQ ID NO: 104930 - RNA, 20 nt, Human
ugauuucuuacccaucacuc

SEQ ID NO: 104931 - RNA, 25 nt, Human
uggacaaaaaccaagaaagaaaacc

SEQ ID NO: 104932 - RNA, 25 nt, Human
uggcaacgggacagguuauuggguu

SEQ ID NO: 104933 - RNA, 18 nt, Human
uggcacauacaacaugca

SEQ ID NO: 104934 - RNA, 22 nt, Human
ugggcauuaugguauaagucau

SEQ ID NO: 104935 - RNA, 25 nt, Human
uguuuuaccugauucugguuuuguu

SEQ ID NO: 104936 - RNA, 21 nt, Human
uucuguaauaugcuucccaaa

SEQ ID NO: 104937 - RNA, 22 nt, Human
uugcugaagaauuaaaauauuu

SEQ ID NO: 104938 - RNA, 20 nt, Human
uuggaagguagucuaggagc

SEQ ID NO: 104939 - RNA, 21 nt, Human
uuggaugcccucccuacuuug

SEQ ID NO: 104940 - RNA, 18 nt, Human
uuguuuuuuagcauccag

SEQ ID NO: 104941 - RNA, 19 nt, Human
uuuuguuuguuuuuguuuu

SEQ ID NO: 104942 - RNA, 21 nt, Human
uuuuguuuuuuuguuuguuuu

SEQ ID NO: 104943 - RNA, 22 nt, Human
uuuuuguuuguuuuuguuuuuu

SEQ ID NO: 104944 - RNA, 22 nt, Human
uuuuuguuuuuguuuuuuuguu

SEQ ID NO: 104945 - RNA, 20 nt, Human
uuuuuguuuuuuuguuuguu

SEQ ID NO: 104946 - RNA, 18 nt, Human
aagaggagcuggagggug

SEQ ID NO: 104947 - RNA, 19 nt, Human
aagcaagggguggggcaag

SEQ ID NO: 104948 - RNA, 23 nt, Human
aagcaccgaugaccugcuagaac

SEQ ID NO: 104949 - RNA, 22 nt, Human
agaggaaggaugauccugggag

SEQ ID NO: 104950 - RNA, 22 nt, Human
aggaagaaauugcagcauggga

SEQ ID NO: 104951 - RNA, 21 nt, Human
aggaaggaugauccugggagg

SEQ ID NO: 104952 - RNA, 21 nt, Human
aggaaggaugauccugggagg

SEQ ID NO: 104953 - RNA, 19 nt, Human
agggguggggcaaggaucu

SEQ ID NO: 104954 - RNA, 19 nt, Human
caccaggacuggcuggguc

SEQ ID NO: 104955 - RNA, 20 nt, Human
cacugcuggguggagcuggg

SEQ ID NO: 104956 - RNA, 23 nt, Human
cagaggccagucaccaggacugg

SEQ ID NO: 104957 - RNA, 25 nt, Human
caggaagaaauugcagcaugggaag

SEQ ID NO: 104958 - RNA, 18 nt, Human
caggacgugucuaggugu

SEQ ID NO: 104959 - RNA, 18 nt, Human
cauccugaugaccaaccu

SEQ ID NO: 104960 - RNA, 23 nt, Human
ccaggacacugcuggguggagcu

SEQ ID NO: 104961 - RNA, 21 nt, Human
cccccugccaggacgugucua

SEQ ID NO: 104962 - RNA, 21 nt, Human
ccuggggccggggcugggggc

SEQ ID NO: 104963 - RNA, 18 nt, Human
cgagccagcuccuacgug

SEQ ID NO: 104964 - RNA, 22 nt, Human
cgagccagcuccuacguggagc

SEQ ID NO: 104965 - RNA, 23 nt, Human
cgccuggggccggggcugggggc

SEQ ID NO: 104966 - RNA, 24 nt, Human
cgcgggcagcggcgaguccuaggc

SEQ ID NO: 104967 - RNA, 18 nt, Human
cuuggggggggggggggg

SEQ ID NO: 104968 - RNA, 21 nt, Human
gacacugcuggguggagcugg

SEQ ID NO: 104969 - RNA, 18 nt, Human
gaggagcuggaggguggg

SEQ ID NO: 104970 - RNA, 18 nt, Human
gauccugggaggguggcc

SEQ ID NO: 104971 - RNA, 23 nt, Human
gcagcggcggcggggcgcgggca

SEQ ID NO: 104972 - RNA, 20 nt, Human
gcccgaggcccccugccagg

SEQ ID NO: 104973 - RNA, 21 nt, Human
gcucagccuuccuucucccca

SEQ ID NO: 104974 - RNA, 25 nt, Human
ggagaggcucagccuuccuucuccc

SEQ ID NO: 104975 - RNA, 23 nt, Human
ggaggguggggaaggcaugaagg

SEQ ID NO: 104976 - RNA, 21 nt, Human
ggcggcggggcgcgggcagcg

SEQ ID NO: 104977 - RNA, 23 nt, Human
ggcuguggggagaagguaugggu

SEQ ID NO: 104978 - RNA, 19 nt, Human
gggcagcagcggcggcggg

SEQ ID NO: 104979 - RNA, 21 nt, Human
gggcagcagcggcggcggggc

SEQ ID NO: 104980 - RNA, 22 nt, Human
gggcagcagcggcggcggggcg

SEQ ID NO: 104981 - RNA, 18 nt, Human
gggccggggcugggggca

SEQ ID NO: 104982 - RNA, 18 nt, Human
ggggcuggcagaguuggg

SEQ ID NO: 104983 - RNA, 18 nt, Human
ggggcugggggcagcagc

SEQ ID NO: 104984 - RNA, 18 nt, Human
ggucaguagucucuccgg

SEQ ID NO: 104985 - RNA, 19 nt, Human
guggagugcccgaggcccc

SEQ ID NO: 104986 - RNA, 19 nt, Human
uaguggagugcccgaggcc

SEQ ID NO: 104987 - RNA, 24 nt, Human
ucaggaagaaauugcagcauggga

SEQ ID NO: 104988 - RNA, 18 nt, Human
uccccaggacacugcugg

SEQ ID NO: 104989 - RNA, 22 nt, Human
uccugggaggguggccauccug

SEQ ID NO: 104990 - RNA, 21 nt, Human
ucuccgguggaaggcagaggc

SEQ ID NO: 104991 - RNA, 18 nt, Human
ugauccugggaggguggc

SEQ ID NO: 104992 - RNA, 19 nt, Human
ugauccugggaggguggcc

SEQ ID NO: 104993 - RNA, 18 nt, Human
ugcaucagcagaggcugu

SEQ ID NO: 104994 - RNA, 19 nt, Human
ugcuggguggagcuggguu

SEQ ID NO: 104995 - RNA, 23 nt, Human
uggaagcaagggguggggcaagg

SEQ ID NO: 104996 - RNA, 18 nt, Human
uggaaggcagaggccagu

SEQ ID NO: 104997 - RNA, 23 nt, Human
uggaaggcagaggccagucacca

SEQ ID NO: 104998 - RNA, 24 nt, Human
uggcaggugggggcuggcagaguu

SEQ ID NO: 104999 - RNA, 21 nt, Human
ugggaggguggccauccugau

SEQ ID NO: 105000 - RNA, 19 nt, Human
uggggaaggcaugaaggcu

SEQ ID NO: 105001 - RNA, 22 nt, Human
ugggggcagcagcggcggcggg

SEQ ID NO: 105002 - RNA, 23 nt, Human
ugggggcagcagcggcggcgggg

SEQ ID NO: 105003 - RNA, 20 nt, Human
ugggggcuggcagaguuggg

SEQ ID NO: 105004 - RNA, 19 nt, Human
ugggggggggggggggguc

SEQ ID NO: 105005 - RNA, 18 nt, Human
uggguggagcuggguugg

SEQ ID NO: 105006 - RNA, 22 nt, Human
uggguggagcuggguugguagu

SEQ ID NO: 105007 - RNA, 20 nt, Human
ugguucugauugacuugggg

SEQ ID NO: 105008 - RNA, 25 nt, Human
ugugguucugauugacuuggggggg

SEQ ID NO: 105009 - RNA, 18 nt, Human
acccgaauuuccagaggu

SEQ ID NO: 105010 - RNA, 18 nt, Human
agaggcuggguuugggag

SEQ ID NO: 105011 - RNA, 20 nt, Human
agccggaagggguggggggc

SEQ ID NO: 105012 - RNA, 19 nt, Human
aggucggacucuaaaagau

SEQ ID NO: 105013 - RNA, 19 nt, Human
aggucggacucuaaaagau

SEQ ID NO: 105014 - RNA, 25 nt, Human
agguguggaccugcucuccccggag

SEQ ID NO: 105015 - RNA, 23 nt, Human
agguguggaccugcucuccucgg

SEQ ID NO: 105016 - RNA, 19 nt, Human
cacccgaauuuccagaggu

SEQ ID NO: 105017 - RNA, 23 nt, Human
cagccuggguucccggcagggcc

SEQ ID NO: 105018 - RNA, 22 nt, Human
caggagugugggcgggggugug

SEQ ID NO: 105019 - RNA, 19 nt, Human
cagggccuccgacgucgcc

SEQ ID NO: 105020 - RNA, 21 nt, Human
ccucugccggaaugcuaggcu

SEQ ID NO: 105021 - RNA, 21 nt, Human
ccucugccggaaugcuaggcu

SEQ ID NO: 105022 - RNA, 19 nt, Human
ccuggguucccggcagggc

SEQ ID NO: 105023 - RNA, 23 nt, Human
cgcccggguccccgcggccaccc

SEQ ID NO: 105024 - RNA, 21 nt, Human
cucggcucugcugccucggcc

SEQ ID NO: 105025 - RNA, 21 nt, Human
cucggcucugcugccucggcc

SEQ ID NO: 105026 - RNA, 24 nt, Human
cuggugcagggaugcagaggugug

SEQ ID NO: 105027 - RNA, 24 nt, Human
cuggugcagggaugcagaggugug

SEQ ID NO: 105028 - RNA, 23 nt, Human
gaggugaaaccuaguggcaggag

SEQ ID NO: 105029 - RNA, 20 nt, Human
gccggaaugcuaggcuccua

SEQ ID NO: 105030 - RNA, 21 nt, Human
gccguuuuucuuccucugccg

SEQ ID NO: 105031 - RNA, 21 nt, Human
gccguuuuucuuccucugccg

SEQ ID NO: 105032 - RNA, 22 nt, Human
gcgggggugugagccggaaggg

SEQ ID NO: 105033 - RNA, 22 nt, Human
gggcgugucgcagcgcgggggu

SEQ ID NO: 105034 - RNA, 20 nt, Human
ggggugggggcugcagccug

SEQ ID NO: 105035 - RNA, 19 nt, Human
guggacauuuccagagguc

SEQ ID NO: 105036 - RNA, 20 nt, Human
guucccggcagggccuccga

SEQ ID NO: 105037 - RNA, 25 nt, Human
uccuacuccuuucucaaagccucaa

SEQ ID NO: 105038 - RNA, 19 nt, Human
uccucggcucugcugccuc

SEQ ID NO: 105039 - RNA, 19 nt, Human
ucuccucggcucugcugcc

SEQ ID NO: 105040 - RNA, 20 nt, Human
ugggggcugcagccuggguu

SEQ ID NO: 105041 - RNA, 24 nt, Human
uggggggcgugucgcagcgcgggg

SEQ ID NO: 105042 - RNA, 23 nt, Human
uggugcagggaugcagaggugug

SEQ ID NO: 105043 - RNA, 23 nt, Human
uggugcagggaugcagaggugug

SEQ ID NO: 105044 - RNA, 20 nt, Human
aaaagaggaaaaggauucug

SEQ ID NO: 105045 - RNA, 24 nt, Human
aacacucugucccucccucaaucc

SEQ ID NO: 105046 - RNA, 24 nt, Human
aacccuccacccucucuccccacc

SEQ ID NO: 105047 - RNA, 27 nt, Human
aagccagggccaaccaggaccauggaa

SEQ ID NO: 105048 - RNA, 20 nt, Human
aaucacuuuuuucuugguca

SEQ ID NO: 105049 - RNA, 26 nt, Human
acaaaaccccaggggggagggaacgc

SEQ ID NO: 105050 - RNA, 24 nt, Human
acaggaaaggggcacaugacuaga

SEQ ID NO: 105051 - RNA, 19 nt, Human
acccucucuccccacccca

SEQ ID NO: 105052 - RNA, 23 nt, Human
agagugggcacaaaaccccaggg

SEQ ID NO: 105053 - RNA, 22 nt, Human
aggaaggaaaagaggaaaagga

SEQ ID NO: 105054 - RNA, 19 nt, Human
aggacuagucucuggcccu

SEQ ID NO: 105055 - RNA, 18 nt, Human
aggagaagaagcgaccac

SEQ ID NO: 105056 - RNA, 21 nt, Human
aggcaggaacugacacagugc

SEQ ID NO: 105057 - RNA, 24 nt, Human
aguugcuguuuccaucucaggacu

SEQ ID NO: 105058 - RNA, 27 nt, Human
caaauauuuggcuuauaguugcccaca

SEQ ID NO: 105059 - RNA, 21 nt, Human
caccccauacccugcucugcu

SEQ ID NO: 105060 - RNA, 20 nt, Human
cacccucucuccccacccca

SEQ ID NO: 105061 - RNA, 25 nt, Human
cacucugucccucccucaauccccc

SEQ ID NO: 105062 - RNA, 20 nt, Human
cagaagccaggcccucagag

SEQ ID NO: 105063 - RNA, 22 nt, Human
cagagagugggcacaaaacccc

SEQ ID NO: 105064 - RNA, 22 nt, Human
caucauggacuccucuuuugga

SEQ ID NO: 105065 - RNA, 21 nt, Human
ccaggaaaauuccaaagagga

SEQ ID NO: 105066 - RNA, 22 nt, Human
cccacagccauguagcucugcu

SEQ ID NO: 105067 - RNA, 26 nt, Human
cccauggacaccuguucugagccaaa

SEQ ID NO: 105068 - RNA, 23 nt, Human
ccccccuuuauucuguagguccc

SEQ ID NO: 105069 - RNA, 24 nt, Human
cccucaaucccccaccuccuuuca

SEQ ID NO: 105070 - RNA, 18 nt, Human
cccucucuccccacccca

SEQ ID NO: 105071 - RNA, 21 nt, Human
cccuguccaucccccccuuua

SEQ ID NO: 105072 - RNA, 22 nt, Human
ccuucuauauaaaggacccuaa

SEQ ID NO: 105073 - RNA, 18 nt, Human
cgcugccaucugcagcug

SEQ ID NO: 105074 - RNA, 20 nt, Human
cuccaacacucugucccucc

SEQ ID NO: 105075 - RNA, 20 nt, Human
cuccacccucucuccccacc

SEQ ID NO: 105076 - RNA, 19 nt, Human
cucuccccaccccauaccc

SEQ ID NO: 105077 - RNA, 21 nt, Human
cucuccccaccccauacccug

SEQ ID NO: 105078 - RNA, 18 nt, Human
cucucucucucucucucu

SEQ ID NO: 105079 - RNA, 26 nt, Human
cucugccuccaucauggacuccucuu

SEQ ID NO: 105080 - RNA, 24 nt, Human
cucugucccucccucaauccccca

SEQ ID NO: 105081 - RNA, 21 nt, Human
cugcacguuccucugggcgug

SEQ ID NO: 105082 - RNA, 22 nt, Human
cugcugucuuccuccaagaucu

SEQ ID NO: 105083 - RNA, 24 nt, Human
cuguacaaguugcuguuccgucgc

SEQ ID NO: 105084 - RNA, 21 nt, Human
gaaauuucuccaacuuuuaac

SEQ ID NO: 105085 - RNA, 19 nt, Human
gaaggaaaagaggaaaagg

SEQ ID NO: 105086 - RNA, 24 nt, Human
gacaggaaaggggcacaugacuag

SEQ ID NO: 105087 - RNA, 21 nt, Human
gagaggcccgcugccaucugc

SEQ ID NO: 105088 - RNA, 23 nt, Human
gaggaaggaaaagaggaaaagga

SEQ ID NO: 105089 - RNA, 18 nt, Human
gaggaggaaggaaaagag

SEQ ID NO: 105090 - RNA, 18 nt, Human
gcaaagccagggccaacc

SEQ ID NO: 105091 - RNA, 22 nt, Human
ggacagaagccaggcccucaga

SEQ ID NO: 105092 - RNA, 18 nt, Human
ggaugauguacugugaaa

SEQ ID NO: 105093 - RNA, 19 nt, Human
gggacaggaaaggggcaca

SEQ ID NO: 105094 - RNA, 19 nt, Human
uaaaaaaaucaaaacuaua

SEQ ID NO: 105095 - RNA, 19 nt, Human
uaaaacccuccacccucuc

SEQ ID NO: 105096 - RNA, 23 nt, Human
uaccucugccuccaucauggacu

SEQ ID NO: 105097 - RNA, 21 nt, Human
uaggucccaggaaaauuccaa

SEQ ID NO: 105098 - RNA, 22 nt, Human
uaguaggcaaagccagggccaa

SEQ ID NO: 105099 - RNA, 18 nt, Human
ucacugcuucccuguucu

SEQ ID NO: 105100 - RNA, 26 nt, Human
uccaacacucugucccucccucaauc

SEQ ID NO: 105101 - RNA, 22 nt, Human
ucccucaaucccccaccuccuu

SEQ ID NO: 105102 - RNA, 19 nt, Human
ucugcagcugucacugcuu

SEQ ID NO: 105103 - RNA, 19 nt, Human
ucugcucugcccagagugg

SEQ ID NO: 105104 - RNA, 24 nt, Human
ucugcugucuuccuccaagaucuu

SEQ ID NO: 105105 - RNA, 26 nt, Human
ucuuaugacuguaccauuuguuugcc

SEQ ID NO: 105106 - RNA, 20 nt, Human
ucuuugcgauuccaggccgg

SEQ ID NO: 105107 - RNA, 22 nt, Human
ugaaaacccccuguccaucccc

SEQ ID NO: 105108 - RNA, 20 nt, Human
ugacacagugcucagggcug

SEQ ID NO: 105109 - RNA, 20 nt, Human
ugcagaucgucuucucucca

SEQ ID NO: 105110 - RNA, 18 nt, Human
ugcagcugucacugcuuc

SEQ ID NO: 105111 - RNA, 24 nt, Human
ugcuuugugcuucugggagaauca

SEQ ID NO: 105112 - RNA, 25 nt, Human
uggaauccuuaacaaauccaaggag

SEQ ID NO: 105113 - RNA, 19 nt, Human
uggggagaggcccgcugcc

SEQ ID NO: 105114 - RNA, 21 nt, Human
uuaaaugucaaugccaaaaug

SEQ ID NO: 105115 - RNA, 19 nt, Human
uuccaaagaggaggaagga

SEQ ID NO: 105116 - RNA, 18 nt, Human
uuccuccaagaucuuaca

SEQ ID NO: 105117 - RNA, 21 nt, Human
uucuccaacuuuuaacccugg

SEQ ID NO: 105118 - RNA, 19 nt, Human
uuuauaaaacccuccaccc

SEQ ID NO: 105119 - RNA, 26 nt, Human
uuuauaaaacccuccacccucucucc

SEQ ID NO: 105120 - RNA, 22 nt, Human
uuugaaaacccccuguccaucc

SEQ ID NO: 105121 - RNA, 21 nt, Human
uuuuuugucccauggacaccu

SEQ ID NO: 105122 - RNA, 24 nt, Human
uuuuuuuuuuuuuuuuucuauuuu

SEQ ID NO: 105123 - RNA, 20 nt, Human
acauuugggccagaauagca

SEQ ID NO: 105124 - RNA, 22 nt, Human
agaaauuaaugaaugacuccaa

SEQ ID NO: 105125 - RNA, 21 nt, Human
agaagugauucaucucuggcu

SEQ ID NO: 105126 - RNA, 26 nt, Human
aggcacugugcugagugcugaaaaug

SEQ ID NO: 105127 - RNA, 18 nt, Human
aggcagaucagcccagga

SEQ ID NO: 105128 - RNA, 21 nt, Human
aguauucagucaucuuuaauc

SEQ ID NO: 105129 - RNA, 18 nt, Human
auagcauauacugagacc

SEQ ID NO: 105130 - RNA, 21 nt, Human
auuagcccuugggccuugacc

SEQ ID NO: 105131 - RNA, 24 nt, Human
auuucaguuucucuuuugcaauua

SEQ ID NO: 105132 - RNA, 20 nt, Human
cacaaagaaaagcaaaggac

SEQ ID NO: 105133 - RNA, 18 nt, Human
cagaucagcccaggaauu

SEQ ID NO: 105134 - RNA, 24 nt, Human
cagcuccacagaagaauauaugau

SEQ ID NO: 105135 - RNA, 18 nt, Human
caggggaaauggaaaggc

SEQ ID NO: 105136 - RNA, 21 nt, Human
caguuacaaguacucagccaa

SEQ ID NO: 105137 - RNA, 24 nt, Human
caucagaacaagaauucuaauucc

SEQ ID NO: 105138 - RNA, 21 nt, Human
caucucuggcuuuugcagggg

SEQ ID NO: 105139 - RNA, 18 nt, Human
caugacuaaagcuguucu

SEQ ID NO: 105140 - RNA, 23 nt, Human
cauucaaagauaauacuucauac

SEQ ID NO: 105141 - RNA, 20 nt, Human
ccuauuuuauagugagugac

SEQ ID NO: 105142 - RNA, 21 nt, Human
cuuuauaguuauacuggugcc

SEQ ID NO: 105143 - RNA, 22 nt, Human
gaaaagcacauugucauuuuca

SEQ ID NO: 105144 - RNA, 23 nt, Human
gacucaaaaagaggaaaugguag

SEQ ID NO: 105145 - RNA, 24 nt, Human
gagaagugauucaucucuggcuuu

SEQ ID NO: 105146 - RNA, 23 nt, Human
gggaaauggaaaggcucaaaaac

SEQ ID NO: 105147 - RNA, 24 nt, Human
uaauugccagggccuuuugucaau

SEQ ID NO: 105148 - RNA, 21 nt, Human
uaauuuguuuugaucuaaaaa

SEQ ID NO: 105149 - RNA, 22 nt, Human
uaccagaagaaugugaaccuca

SEQ ID NO: 105150 - RNA, 20 nt, Human
uagaagaaucugagacuaug

SEQ ID NO: 105151 - RNA, 23 nt, Human
uauagugagugacaugaaaguca

SEQ ID NO: 105152 - RNA, 22 nt, Human
uauuccuucucccaguauucca

SEQ ID NO: 105153 - RNA, 20 nt, Human
ucaaagauaauacuucauac

SEQ ID NO: 105154 - RNA, 21 nt, Human
ucagaacauucaaugcuuucu

SEQ ID NO: 105155 - RNA, 20 nt, Human
ucagccaaacauagcucauc

SEQ ID NO: 105156 - RNA, 18 nt, Human
ucaguuccuucucagcua

SEQ ID NO: 105157 - RNA, 21 nt, Human
ucaguuccuucucagcuagug

SEQ ID NO: 105158 - RNA, 21 nt, Human
uccaauuuaagugacucaaaa

SEQ ID NO: 105159 - RNA, 26 nt, Human
uccaugacuaaagcuguucucaggac

SEQ ID NO: 105160 - RNA, 25 nt, Human
ucuaaaaaguacaaauuuaucucau

SEQ ID NO: 105161 - RNA, 20 nt, Human
ugaaaguuauuccuucuccc

SEQ ID NO: 105162 - RNA, 19 nt, Human
ugaaugacuccaaguaaaa

SEQ ID NO: 105163 - RNA, 23 nt, Human
ugaaugacuccaaguaaaaagaa

SEQ ID NO: 105164 - RNA, 18 nt, Human
ugacaugaaagucaacua

SEQ ID NO: 105165 - RNA, 19 nt, Human
ugacauugugagauacaca

SEQ ID NO: 105166 - RNA, 20 nt, Human
ugagugcugaaaauguggua

SEQ ID NO: 105167 - RNA, 18 nt, Human
ugaucagaacauucaaug

SEQ ID NO: 105168 - RNA, 18 nt, Human
ugcaggggaaauggaaag

SEQ ID NO: 105169 - RNA, 21 nt, Human
ugcuuucuacauaaacucugg

SEQ ID NO: 105170 - RNA, 23 nt, Human
ugguaaggacagacagcacuccu

SEQ ID NO: 105171 - RNA, 19 nt, Human
uuaacacaaagaaaagcaa

SEQ ID NO: 105172 - RNA, 22 nt, Human
uucaaugcuuucuacauaaacu

SEQ ID NO: 105173 - RNA, 22 nt, Human
uucaucucuggcuuuugcaggg

SEQ ID NO: 105174 - RNA, 24 nt, Human
uucaucucuggcuuuugcagggga

SEQ ID NO: 105175 - RNA, 18 nt, Human
uuccaaaucacggggaag

SEQ ID NO: 105176 - RNA, 22 nt, Human
uuugcaggggaaauggaaaggc

SEQ ID NO: 105177 - RNA, 21 nt, Human
uuugucaacuuuucucuggga

SEQ ID NO: 105178 - RNA, 19 nt, Human
uuugugaaaguuauuccuu

SEQ ID NO: 105179 - RNA, 24 nt, Human
uuuuaaguuuauuuugugaaaguu

SEQ ID NO: 105180 - RNA, 18 nt, Human
aaaaaggcauaauagauc

SEQ ID NO: 105181 - RNA, 18 nt, Human
aaaaauucacagaugaau

SEQ ID NO: 105182 - RNA, 23 nt, Human
aagaaaacaaaaaaaaguacuac

SEQ ID NO: 105183 - RNA, 24 nt, Human
aagaaaacaaaaaaaaguacuaca

SEQ ID NO: 105184 - RNA, 19 nt, Human
aaggcauaauagaucacaa

SEQ ID NO: 105185 - RNA, 21 nt, Human
accuugcauccuggaaagaag

SEQ ID NO: 105186 - RNA, 22 nt, Human
auuuacagccauuuuuuuugua

SEQ ID NO: 105187 - RNA, 18 nt, Human
caccuuuugcucuaaaga

SEQ ID NO: 105188 - RNA, 26 nt, Human
cagcauaauccuuaaauauaaaaaua

SEQ ID NO: 105189 - RNA, 27 nt, Human
cagugcagcauaauccuuaaauauaaa

SEQ ID NO: 105190 - RNA, 23 nt, Human
gaaaugaacaaaguccuugagug

SEQ ID NO: 105191 - RNA, 22 nt, Human
gcauccuggaaagaaguaacaa

SEQ ID NO: 105192 - RNA, 24 nt, Human
uaaaguaaaauauaaaucuuccca

SEQ ID NO: 105193 - RNA, 19 nt, Human
uaguacagugcagcauaau

SEQ ID NO: 105194 - RNA, 20 nt, Human
ucacagaugaauuuucuuca

SEQ ID NO: 105195 - RNA, 20 nt, Human
uccagaaagacgaaguauca

SEQ ID NO: 105196 - RNA, 19 nt, Human
ucccuguaauaguaaacau

SEQ ID NO: 105197 - RNA, 21 nt, Human
uccuugaguguuuuucuuuau

SEQ ID NO: 105198 - RNA, 24 nt, Human
ucuucccaguuuaaaagaugaaua

SEQ ID NO: 105199 - RNA, 20 nt, Human
ugaacaaaguccuugagugu

SEQ ID NO: 105200 - RNA, 23 nt, Human
ugacuuaaaaacaguuuuaucca

SEQ ID NO: 105201 - RNA, 22 nt, Human
uuaaaguaaaauauaaaucuuc

SEQ ID NO: 105202 - RNA, 21 nt, Human
uuccugaaacaugaucacagg

SEQ ID NO: 105203 - RNA, 25 nt, Human
uuuaugauauauggcuaaaagaaaa

SEQ ID NO: 105204 - RNA, 25 nt, Human
uuucaagucauguaaggcaauuacu

SEQ ID NO: 105205 - RNA, 24 nt, Human
uuuccauuucuuuaaaaaagaaaa

SEQ ID NO: 105206 - RNA, 21 nt, Human
uuuuuuuuuuuuuuguaagga

SEQ ID NO: 105207 - RNA, 22 nt, Human
uuuuuuuuuuuuuuuuguaagg

SEQ ID NO: 105208 - RNA, 18 nt, Human
uuuuuuuuuuuuuuuuug

SEQ ID NO: 105209 - RNA, 19 nt, Human
uuuuuuuuuuuuuuuuugu

SEQ ID NO: 105210 - RNA, 22 nt, Human
aaaaaaaaaaaaaggagagaga

SEQ ID NO: 105211 - RNA, 22 nt, Human
aaaaaaaaaaaaggagagagag

SEQ ID NO: 105212 - RNA, 22 nt, Human
aaaaagacccaaaaacaacuuu

SEQ ID NO: 105213 - RNA, 19 nt, Human
aaaacaaaacauaaaaccu

SEQ ID NO: 105214 - RNA, 24 nt, Human
aaaacagacuaacgcaauugggua

SEQ ID NO: 105215 - RNA, 18 nt, Human
aaaagacccaaaaacaac

SEQ ID NO: 105216 - RNA, 24 nt, Human
aaaaggaacauuauguaaagagga

SEQ ID NO: 105217 - RNA, 21 nt, Human
aaacaacgaccugggcucuca

SEQ ID NO: 105218 - RNA, 22 nt, Human
aaacagguccgaaagaaaaaaa

SEQ ID NO: 105219 - RNA, 26 nt, Human
aaagaaaaaaaaccucauuaggagag

SEQ ID NO: 105220 - RNA, 22 nt, Human
aaagaagaagagagaguggggg

SEQ ID NO: 105221 - RNA, 20 nt, Human
aaauaaccugcaacucauaa

SEQ ID NO: 105222 - RNA, 23 nt, Human
aaauauccagcacccaacaaggu

SEQ ID NO: 105223 - RNA, 19 nt, Human
aaaugugcucccuaugacc

SEQ ID NO: 105224 - RNA, 19 nt, Human
aacaaggcacgaaaagaaa

SEQ ID NO: 105225 - RNA, 21 nt, Human
aacaauaaacccacagaucca

SEQ ID NO: 105226 - RNA, 18 nt, Human
aagaaagcuccuaaaagc

SEQ ID NO: 105227 - RNA, 18 nt, Human
aagaagaagagagagugg

SEQ ID NO: 105228 - RNA, 23 nt, Human
aagaugcccacuggguccagaca

SEQ ID NO: 105229 - RNA, 22 nt, Human
aagcaauaauuaauacuaaaac

SEQ ID NO: 105230 - RNA, 28 nt, Human
aagcacugaaagaaacuguaaagccaaa

SEQ ID NO: 105231 - RNA, 24 nt, Human
aagcuggaaaaaacaacgaccugg

SEQ ID NO: 105232 - RNA, 20 nt, Human
aagggugggagcgaggggca

SEQ ID NO: 105233 - RNA, 22 nt, Human
aaguacacuggaugggccucac

SEQ ID NO: 105234 - RNA, 25 nt, Human
aauacuaaaacagguccgaaagaaa

SEQ ID NO: 105235 - RNA, 19 nt, Human
acaaaaauggaggugcgcc

SEQ ID NO: 105236 - RNA, 19 nt, Human
acaaaaauuacuaggcaca

SEQ ID NO: 105237 - RNA, 25 nt, Human
acacagaacauauauaaaaagaccc

SEQ ID NO: 105238 - RNA, 19 nt, Human
acaccaaggcacaucauaa

SEQ ID NO: 105239 - RNA, 19 nt, Human
accaaggaaaaauacacca

SEQ ID NO: 105240 - RNA, 25 nt, Human
accccacaacucaggugauguacca

SEQ ID NO: 105241 - RNA, 23 nt, Human
accucuucacuagauuuccucaa

SEQ ID NO: 105242 - RNA, 20 nt, Human
acuaggcacagaaagcacca

SEQ ID NO: 105243 - RNA, 21 nt, Human
agaaaaaauauuugaagaaga

SEQ ID NO: 105244 - RNA, 18 nt, Human
agacaaggacaucaaaac

SEQ ID NO: 105245 - RNA, 20 nt, Human
agaccugaaaaaggaaacug

SEQ ID NO: 105246 - RNA, 21 nt, Human
agagaagggugggagcgaggg

SEQ ID NO: 105247 - RNA, 23 nt, Human
agauaaaaccucuuuagcucucc

SEQ ID NO: 105248 - RNA, 21 nt, Human
agcaagaccugaaaaaggaaa

SEQ ID NO: 105249 - RNA, 22 nt, Human
agcacaagaaaccaaggaaaaa

SEQ ID NO: 105250 - RNA, 21 nt, Human
agcaccaggggagcaagaccc

SEQ ID NO: 105251 - RNA, 23 nt, Human
agcacccaacaagguaaauguua

SEQ ID NO: 105252 - RNA, 22 nt, Human
agcagagcgcgcucucucuaag

SEQ ID NO: 105253 - RNA, 19 nt, Human
aggaauacagaaauaucca

SEQ ID NO: 105254 - RNA, 23 nt, Human
aggcaaaaggaaagugacaucaa

SEQ ID NO: 105255 - RNA, 22 nt, Human
aggcacgaaaagaaagcuccua

SEQ ID NO: 105256 - RNA, 20 nt, Human
aggcagggggcuacgggggc

SEQ ID NO: 105257 - RNA, 26 nt, Human
aucaucagcccagggaaaaccaaagc

SEQ ID NO: 105258 - RNA, 23 nt, Human
aucuccaaagaagaagagagagu

SEQ ID NO: 105259 - RNA, 18 nt, Human
caaaaaaaaaaaaaggag

SEQ ID NO: 105260 - RNA, 20 nt, Human
caaaaaaauaaagcaauaau

SEQ ID NO: 105261 - RNA, 22 nt, Human
caaaaacaaagcacgacuuuga

SEQ ID NO: 105262 - RNA, 23 nt, Human
caaaugacgcacaucaucagccc

SEQ ID NO: 105263 - RNA, 22 nt, Human
caacaaggcacgaaaagaaagc

SEQ ID NO: 105264 - RNA, 21 nt, Human
caacagaauacaagugagcug

SEQ ID NO: 105265 - RNA, 22 nt, Human
caagcacaagaaaccaaggaaa

SEQ ID NO: 105266 - RNA, 27 nt, Human
caagcacaagaaaccaaggaaaaauac

SEQ ID NO: 105267 - RNA, 26 nt, Human
caauaaacccacagauccaagaaguu

SEQ ID NO: 105268 - RNA, 18 nt, Human
cacagagcuuaauaauuu

SEQ ID NO: 105269 - RNA, 21 nt, Human
caccccuucaucuccaccaaa

SEQ ID NO: 105270 - RNA, 21 nt, Human
cacugaaagaguuuaucacca

SEQ ID NO: 105271 - RNA, 22 nt, Human
cagaaaaaauauuugaagaaga

SEQ ID NO: 105272 - RNA, 19 nt, Human
cagcacccaacaagguaaa

SEQ ID NO: 105273 - RNA, 24 nt, Human
cagcacccaacaagguaaauguua

SEQ ID NO: 105274 - RNA, 18 nt, Human
cagggaaaaccaaagcug

SEQ ID NO: 105275 - RNA, 24 nt, Human
caggugauguaccauagacccacc

SEQ ID NO: 105276 - RNA, 20 nt, Human
ccaaauaaccugcaacucau

SEQ ID NO: 105277 - RNA, 20 nt, Human
ccaacaaggcacgaaaagaa

SEQ ID NO: 105278 - RNA, 22 nt, Human
ccagaaaacaaaacauaaaacc

SEQ ID NO: 105279 - RNA, 23 nt, Human
ccagaauacuuacaggaauacag

SEQ ID NO: 105280 - RNA, 24 nt, Human
ccagcagaaaaaguccuucaggcc

SEQ ID NO: 105281 - RNA, 26 nt, Human
cccaaaaaaagguucgaaucgacccc

SEQ ID NO: 105282 - RNA, 19 nt, Human
cccacuguaaauucaaggu

SEQ ID NO: 105283 - RNA, 21 nt, Human
cccagaaaacaaaacauaaaa

SEQ ID NO: 105284 - RNA, 26 nt, Human
cccagggaaaaccaaagcugcuauga

SEQ ID NO: 105285 - RNA, 19 nt, Human
cccccugaggcugcccgaa

SEQ ID NO: 105286 - RNA, 21 nt, Human
ccuauaaccaagacaugggau

SEQ ID NO: 105287 - RNA, 20 nt, Human
ccucaaaagacggcagaaaa

SEQ ID NO: 105288 - RNA, 19 nt, Human
ccuccuucccagcucugag

SEQ ID NO: 105289 - RNA, 21 nt, Human
ccugcaaaacagacuaacgca

SEQ ID NO: 105290 - RNA, 26 nt, Human
cgaaaaauaaauaaaauaacccucaa

SEQ ID NO: 105291 - RNA, 21 nt, Human
cgagguggcagcuacucagcu

SEQ ID NO: 105292 - RNA, 21 nt, Human
cuacauuuaccccacaacuca

SEQ ID NO: 105293 - RNA, 23 nt, Human
cucagguauuccugcaaaacaga

SEQ ID NO: 105294 - RNA, 22 nt, Human
cuccaaagaagaagagagagug

SEQ ID NO: 105295 - RNA, 18 nt, Human
cuccaccaaaaaaaaaaa

SEQ ID NO: 105296 - RNA, 22 nt, Human
cuccaccaaaaaaaaaaaaagg

SEQ ID NO: 105297 - RNA, 19 nt, Human
cuccuaaaagcugcuuuuc

SEQ ID NO: 105298 - RNA, 24 nt, Human
cugcuuccaaauaaccugcaacuc

SEQ ID NO: 105299 - RNA, 19 nt, Human
cugcuucuuuccaacaagg

SEQ ID NO: 105300 - RNA, 19 nt, Human
gaaagaaaaaaaaccucau

SEQ ID NO: 105301 - RNA, 18 nt, Human
gaacuugaagagguagca

SEQ ID NO: 105302 - RNA, 19 nt, Human
gacaauagagaaggguggg

SEQ ID NO: 105303 - RNA, 22 nt, Human
gagacaacuucaagcaagcuaa

SEQ ID NO: 105304 - RNA, 19 nt, Human
gcagcuucagaagacuuug

SEQ ID NO: 105305 - RNA, 19 nt, Human
gccauggcuucuaagcugg

SEQ ID NO: 105306 - RNA, 19 nt, Human
gcgaccucuucacuagauu

SEQ ID NO: 105307 - RNA, 19 nt, Human
ggaaaaaacaacgaccugg

SEQ ID NO: 105308 - RNA, 27 nt, Human
ggaaaaccaaagcugcuaugagguuaa

SEQ ID NO: 105309 - RNA, 24 nt, Human
ggaauacagaaauauccagcaccc

SEQ ID NO: 105310 - RNA, 22 nt, Human
ggcaagaugcccacugggucca

SEQ ID NO: 105311 - RNA, 18 nt, Human
ggggaaucuguguuugcu

SEQ ID NO: 105312 - RNA, 23 nt, Human
gugaaaugugcucccuaugaccc

SEQ ID NO: 105313 - RNA, 23 nt, Human
uaaaaauaaaggcaaaauccucc

SEQ ID NO: 105314 - RNA, 27 nt, Human
uaaaacagguccgaaagaaaaaaaacc

SEQ ID NO: 105315 - RNA, 22 nt, Human
uaaaagcugcuuuucucccaaa

SEQ ID NO: 105316 - RNA, 25 nt, Human
uaaaaggaacauuauguaaagagga

SEQ ID NO: 105317 - RNA, 21 nt, Human
uaaacccacagauccaagaag

SEQ ID NO: 105318 - RNA, 24 nt, Human
uaaagccaaaaauguauacacuca

SEQ ID NO: 105319 - RNA, 19 nt, Human
uaaauacauucauguauac

SEQ ID NO: 105320 - RNA, 21 nt, Human
uaacagcaagaccugaaaaag

SEQ ID NO: 105321 - RNA, 19 nt, Human
uaacuggucaaaaaaauaa

SEQ ID NO: 105322 - RNA, 24 nt, Human
uacaaacacugaaagaguuuauca

SEQ ID NO: 105323 - RNA, 21 nt, Human
uaccagaucuuccaaaaacaa

SEQ ID NO: 105324 - RNA, 19 nt, Human
uacccagccucagguauuc

SEQ ID NO: 105325 - RNA, 19 nt, Human
uagaacuacaauguauaaa

SEQ ID NO: 105326 - RNA, 18 nt, Human
uagagccuccuucccagc

SEQ ID NO: 105327 - RNA, 28 nt, Human
uauaaaaagacccaaaaacaacuuuccg

SEQ ID NO: 105328 - RNA, 25 nt, Human
uauggaaacaauaaacccacagauc

SEQ ID NO: 105329 - RNA, 21 nt, Human
uauguuaacuggucaaaaaaa

SEQ ID NO: 105330 - RNA, 19 nt, Human
ucagaaaaaauauuugaag

SEQ ID NO: 105331 - RNA, 21 nt, Human
ucaggcaaaaggaaagugaca

SEQ ID NO: 105332 - RNA, 26 nt, Human
ucaucuccaccaaaaaaaaaaaaagg

SEQ ID NO: 105333 - RNA, 20 nt, Human
uccaagcacaagaaaccaag

SEQ ID NO: 105334 - RNA, 19 nt, Human
uccacagugaaacagaaag

SEQ ID NO: 105335 - RNA, 19 nt, Human
uccaccaaaaaaaaaaaaa

SEQ ID NO: 105336 - RNA, 21 nt, Human
ucccacuguaaauucaaggua

SEQ ID NO: 105337 - RNA, 21 nt, Human
uccuaaaagcugcuuuucucc

SEQ ID NO: 105338 - RNA, 19 nt, Human
ucucccuggacuugcuacu

SEQ ID NO: 105339 - RNA, 21 nt, Human
ucucuauaaauuacccagccu

SEQ ID NO: 105340 - RNA, 19 nt, Human
ucuuuccaacaaggcacga

SEQ ID NO: 105341 - RNA, 23 nt, Human
ugaaaaaggaaacugcuuccaaa

SEQ ID NO: 105342 - RNA, 26 nt, Human
ugaaaugugcucccuaugacccagaa

SEQ ID NO: 105343 - RNA, 27 nt, Human
ugacacguuuauaugaaauuuucccaa

SEQ ID NO: 105344 - RNA, 20 nt, Human
ugcaaaacagacuaacgcaa

SEQ ID NO: 105345 - RNA, 24 nt, Human
uggaaacaauaaacccacagaucc

SEQ ID NO: 105346 - RNA, 22 nt, Human
ugggcucucaguacggcugcuu

SEQ ID NO: 105347 - RNA, 22 nt, Human
ugggcugguacccaucucggga

SEQ ID NO: 105348 - RNA, 19 nt, Human
uggguagagugcaaugagg

SEQ ID NO: 105349 - RNA, 24 nt, Human
uggucaaaaaaauaaagcaauaau

SEQ ID NO: 105350 - RNA, 21 nt, Human
uguaccauagacccaccccuu

SEQ ID NO: 105351 - RNA, 20 nt, Human
uguggcugacacaugcaugg

SEQ ID NO: 105352 - RNA, 21 nt, Human
uuagggaaaguugcguaaagu

SEQ ID NO: 105353 - RNA, 23 nt, Human
uuccaaaaacaaagcacgacuuu

SEQ ID NO: 105354 - RNA, 18 nt, Human
uuccugcacaggugaaau

SEQ ID NO: 105355 - RNA, 24 nt, Human
uucgcagacaaggacaucaaaacc

SEQ ID NO: 105356 - RNA, 23 nt, Human
uucuaagcuggaaaaaacaacga

SEQ ID NO: 105357 - RNA, 25 nt, Human
uugaaauuaggaaauacagauaaaa

SEQ ID NO: 105358 - RNA, 23 nt, Human
uugacacucucuacauuuacccc

SEQ ID NO: 105359 - RNA, 24 nt, Human
uuuaaaagucaacagaauacaagu

SEQ ID NO: 105360 - RNA, 24 nt, Human
aagauaucauuuuagaacggaaug

SEQ ID NO: 105361 - RNA, 27 nt, Human
aaggagguuaauucacaguuuacagac

SEQ ID NO: 105362 - RNA, 22 nt, Human
aauauuccuccucccaaguagc

SEQ ID NO: 105363 - RNA, 22 nt, Human
acacaggagaaagucuccacaa

SEQ ID NO: 105364 - RNA, 27 nt, Human
acacaggagaaagucuccacaauuacc

SEQ ID NO: 105365 - RNA, 20 nt, Human
acccuuuguuucccgaucuc

SEQ ID NO: 105366 - RNA, 23 nt, Human
aggagguuaauucacaguuuaca

SEQ ID NO: 105367 - RNA, 19 nt, Human
aucuauacgcaguauggga

SEQ ID NO: 105368 - RNA, 19 nt, Human
aucucacccuucaccucca

SEQ ID NO: 105369 - RNA, 21 nt, Human
cacaggagaaagucuccacaa

SEQ ID NO: 105370 - RNA, 25 nt, Human
ccuaaauauuccuccucccaaguag

SEQ ID NO: 105371 - RNA, 22 nt, Human
ccucuuuuucuuuugaugaucc

SEQ ID NO: 105372 - RNA, 19 nt, Human
uaaguugaaagaauuuaua

SEQ ID NO: 105373 - RNA, 24 nt, Human
uaccuaaauauuccuccucccaag

SEQ ID NO: 105374 - RNA, 23 nt, Human
uauuccuccucccaaguagccua

SEQ ID NO: 105375 - RNA, 21 nt, Human
ucacaguuuacagacuuagca

SEQ ID NO: 105376 - RNA, 22 nt, Human
ucccaaguagccuaaaaccuac

SEQ ID NO: 105377 - RNA, 26 nt, Human
ucccugcucccuuugggaacuagggg

SEQ ID NO: 105378 - RNA, 23 nt, Human
uccucccaaguagccuaaaaccu

SEQ ID NO: 105379 - RNA, 25 nt, Human
ugcucccuuugggaacuagggggcc

SEQ ID NO: 105380 - RNA, 23 nt, Human
ugugguagauuugcaaaaauguc

SEQ ID NO: 105381 - RNA, 18 nt, Human
uuagaacggaauguggua

SEQ ID NO: 105382 - RNA, 23 nt, Human
uucccgaucucacccuucaccuc

SEQ ID NO: 105383 - RNA, 23 nt, Human
aaaacacaaaauaaaccaacaaa

SEQ ID NO: 105384 - RNA, 24 nt, Human
aaaaggagaaaagaaaacacaaaa

SEQ ID NO: 105385 - RNA, 21 nt, Human
acacaaaauaaaccaacaaaa

SEQ ID NO: 105386 - RNA, 25 nt, Human
acucugaauaccccccaaaaaggag

SEQ ID NO: 105387 - RNA, 27 nt, Human
acugccccucacucccuccccuccccc

SEQ ID NO: 105388 - RNA, 22 nt, Human
agaaaagaaaacacaaaauaaa

SEQ ID NO: 105389 - RNA, 23 nt, Human
agcccacucugaauaccccccaa

SEQ ID NO: 105390 - RNA, 20 nt, Human
agccuggcaggaacccacaa

SEQ ID NO: 105391 - RNA, 21 nt, Human
aggaggaaaaaauucagauca

SEQ ID NO: 105392 - RNA, 23 nt, Human
augccaacagagguagcuguguc

SEQ ID NO: 105393 - RNA, 20 nt, Human
ccaaaaaggagaaaagaaaa

SEQ ID NO: 105394 - RNA, 24 nt, Human
ccaaaaaggagaaaagaaaacaca

SEQ ID NO: 105395 - RNA, 21 nt, Human
ccacucugaauaccccccaaa

SEQ ID NO: 105396 - RNA, 18 nt, Human
ccagcccgccagcuccug

SEQ ID NO: 105397 - RNA, 22 nt, Human
cccacucugaauaccccccaaa

SEQ ID NO: 105398 - RNA, 24 nt, Human
cccaggggcccagcccacucugaa

SEQ ID NO: 105399 - RNA, 22 nt, Human
ccccaaaaaggagaaaagaaaa

SEQ ID NO: 105400 - RNA, 19 nt, Human
cccucacucccuccccucc

SEQ ID NO: 105401 - RNA, 23 nt, Human
cccucacucccuccccuccccca

SEQ ID NO: 105402 - RNA, 22 nt, Human
cccuuccgcucccggccaggga

SEQ ID NO: 105403 - RNA, 20 nt, Human
ccucacucccuccccucccc

SEQ ID NO: 105404 - RNA, 24 nt, Human
ccucacucccuccccucccccagg

SEQ ID NO: 105405 - RNA, 18 nt, Human
ccugguauuaaaaagaug

SEQ ID NO: 105406 - RNA, 22 nt, Human
cgcccaggggcccagcccacuc

SEQ ID NO: 105407 - RNA, 19 nt, Human
cucacucccuccccucccc

SEQ ID NO: 105408 - RNA, 18 nt, Human
cugcugcaugucucuucu

SEQ ID NO: 105409 - RNA, 19 nt, Human
cugcugcaugucucuucug

SEQ ID NO: 105410 - RNA, 19 nt, Human
cuuuugguuuuuuccuuuu

SEQ ID NO: 105411 - RNA, 20 nt, Human
gaaggccagcccgccagcuc

SEQ ID NO: 105412 - RNA, 20 nt, Human
gagaaagugaggaaggucac

SEQ ID NO: 105413 - RNA, 20 nt, Human
gaggaaggucacugcucagc

SEQ ID NO: 105414 - RNA, 24 nt, Human
gagggucucucaggcccccagggg

SEQ ID NO: 105415 - RNA, 18 nt, Human
ggacaagagaaagugagg

SEQ ID NO: 105416 - RNA, 23 nt, Human
ggcaccacugccccucacucccu

SEQ ID NO: 105417 - RNA, 18 nt, Human
ggggagaagcugggacaa

SEQ ID NO: 105418 - RNA, 22 nt, Human
uaaaaagaugccaacagaggua

SEQ ID NO: 105419 - RNA, 26 nt, Human
uaaaccaacaaaauaaaaccaaaagg

SEQ ID NO: 105420 - RNA, 22 nt, Human
ucaagccuggcaggaacccaca

SEQ ID NO: 105421 - RNA, 23 nt, Human
uccacuuuauuucauuuagccgc

SEQ ID NO: 105422 - RNA, 18 nt, Human
ucccccagugcacugggg

SEQ ID NO: 105423 - RNA, 20 nt, Human
ucucucaggcccccagggga

SEQ ID NO: 105424 - RNA, 20 nt, Human
ucugaauaccccccaaaaag

SEQ ID NO: 105425 - RNA, 23 nt, Human
ugaauaccccccaaaaaggagaa

SEQ ID NO: 105426 - RNA, 18 nt, Human
ugcaugucucuucugcag

SEQ ID NO: 105427 - RNA, 21 nt, Human
uggcgccagcgcuacugcugc

SEQ ID NO: 105428 - RNA, 22 nt, Human
ugggcagaaggaaggugagggu

SEQ ID NO: 105429 - RNA, 23 nt, Human
ugggcagaaggaaggugaggguc

SEQ ID NO: 105430 - RNA, 19 nt, Human
uggggagaagccagggucc

SEQ ID NO: 105431 - RNA, 21 nt, Human
uguaacaggcguuacaguggg

SEQ ID NO: 105432 - RNA, 19 nt, Human
uuacaguggggagaagcca

SEQ ID NO: 105433 - RNA, 22 nt, Human
uucaagccuggcaggaacccac

SEQ ID NO: 105434 - RNA, 22 nt, Human
uuccuuuacaacauggaagaug

SEQ ID NO: 105435 - RNA, 19 nt, Human
uuuuuccuuuuuuuuuuuu

SEQ ID NO: 105436 - RNA, 21 nt, Human
uuuuuuuuuuuuuuccacuuu

SEQ ID NO: 105437 - RNA, 24 nt, Human
aaaagcuggaaaacucaugucccc

SEQ ID NO: 105438 - RNA, 23 nt, Human
aauucugcccuccucaggcccca

SEQ ID NO: 105439 - RNA, 25 nt, Human
agaaauauguacuuuuugaauuaaa

SEQ ID NO: 105440 - RNA, 24 nt, Human
auaaaaaugagauacguguguaua

SEQ ID NO: 105441 - RNA, 20 nt, Human
auagguauuauuuguaugcc

SEQ ID NO: 105442 - RNA, 20 nt, Human
auucuauucauccuuucccc

SEQ ID NO: 105443 - RNA, 23 nt, Human
caacauggaagaaauauguacuu

SEQ ID NO: 105444 - RNA, 22 nt, Human
caaucgccacucccaagcacac

SEQ ID NO: 105445 - RNA, 18 nt, Human
cacuauauucaccaggau

SEQ ID NO: 105446 - RNA, 20 nt, Human
ccccugaaacuugguuucca

SEQ ID NO: 105447 - RNA, 21 nt, Human
cccuccucaggccccagagga

SEQ ID NO: 105448 - RNA, 25 nt, Human
gaacaaacaaaauaaauuggaagau

SEQ ID NO: 105449 - RNA, 23 nt, Human
gacuccaccgagcaccucggcau

SEQ ID NO: 105450 - RNA, 19 nt, Human
ucacaaucgccacucccaa

SEQ ID NO: 105451 - RNA, 20 nt, Human
ucugcccuccucaggcccca

SEQ ID NO: 105452 - RNA, 20 nt, Human
ugaaacuugguuuccaccag

SEQ ID NO: 105453 - RNA, 23 nt, Human
ugaugaggugggagacaaaugcu

SEQ ID NO: 105454 - RNA, 18 nt, Human
uggaaaacucaugucccc

SEQ ID NO: 105455 - RNA, 18 nt, Human
uggauaaacagggaagug

SEQ ID NO: 105456 - RNA, 22 nt, Human
ugggagacaaaugcuuuccggc

SEQ ID NO: 105457 - RNA, 21 nt, Human
uguaugccgaacaaacaaaau

SEQ ID NO: 105458 - RNA, 26 nt, Human
uucuauucauccuuuccccaaaguuu

SEQ ID NO: 105459 - RNA, 24 nt, Human
uugcaggacaggauaaucuucucu

SEQ ID NO: 105460 - RNA, 21 nt, Human
uuuuuuuuuuuuuuuuugcaa

SEQ ID NO: 105461 - RNA, 27 nt, Human
uuuuuuuuuuuuuuuuuuuuuuugggg

SEQ ID NO: 105462 - RNA, 19 nt, Human
aaaaaaacagacucaaaga

SEQ ID NO: 105463 - RNA, 22 nt, Human
aaaacagacucaaagaaaagaa

SEQ ID NO: 105464 - RNA, 19 nt, Human
auaaaaaaacagacucaaa

SEQ ID NO: 105465 - RNA, 24 nt, Human
auaaaaaaacagacucaaagaaaa

SEQ ID NO: 105466 - RNA, 21 nt, Human
cucaaagaaaagaaagaugac

SEQ ID NO: 105467 - RNA, 22 nt, Human
uaaaaaaacagacucaaagaaa

SEQ ID NO: 105468 - RNA, 25 nt, Human
uaaaauacaaacuauaaaaaaacag

SEQ ID NO: 105469 - RNA, 22 nt, Human
aaaccaaaccccaaacaagaaa

SEQ ID NO: 105470 - RNA, 25 nt, Human
aaagaaagaaaaccaaaccccaaac

SEQ ID NO: 105471 - RNA, 21 nt, Human
aaauggucguaaguucaaaac

SEQ ID NO: 105472 - RNA, 18 nt, Human
aacaagaaaaaagaaaaa

SEQ ID NO: 105473 - RNA, 21 nt, Human
aaccaaaccccaaacaagaaa

SEQ ID NO: 105474 - RNA, 18 nt, Human
aagaaaaccaaaccccaa

SEQ ID NO: 105475 - RNA, 26 nt, Human
aagaaaagaaagaaaaccaaacccca

SEQ ID NO: 105476 - RNA, 19 nt, Human
aagaaagaaaaccaaaccc

SEQ ID NO: 105477 - RNA, 21 nt, Human
aagcaucgaggacugguggcc

SEQ ID NO: 105478 - RNA, 22 nt, Human
acagaaaaagaucuguaccauu

SEQ ID NO: 105479 - RNA, 24 nt, Human
acaugcugaaaccaaauggucgua

SEQ ID NO: 105480 - RNA, 19 nt, Human
acccgaugcgcaugaacag

SEQ ID NO: 105481 - RNA, 22 nt, Human
acgcuggacucgcggguggccc

SEQ ID NO: 105482 - RNA, 19 nt, Human
acuuugcccacgugccuuc

SEQ ID NO: 105483 - RNA, 18 nt, Human
agaaaaccaaaccccaaa

SEQ ID NO: 105484 - RNA, 20 nt, Human
agaugccuggugccacaagc

SEQ ID NO: 105485 - RNA, 21 nt, Human
aggaaaagaaaagaaagaaaa

SEQ ID NO: 105486 - RNA, 22 nt, Human
aguuuuuuuuuuuuuuucacuu

SEQ ID NO: 105487 - RNA, 19 nt, Human
auaaaaggaaaagaaaaga

SEQ ID NO: 105488 - RNA, 19 nt, Human
caaacaagaaaaaagaaaa

SEQ ID NO: 105489 - RNA, 22 nt, Human
caaaccccaaacaagaaaaaag

SEQ ID NO: 105490 - RNA, 23 nt, Human
caaccugacuuuuuaaaccuaag

SEQ ID NO: 105491 - RNA, 20 nt, Human
cagaaaaagaucuguaccau

SEQ ID NO: 105492 - RNA, 24 nt, Human
cagaauucaaugauuagcaacauc

SEQ ID NO: 105493 - RNA, 25 nt, Human
caguuuucucucucucuccgggccc

SEQ ID NO: 105494 - RNA, 24 nt, Human
ccaaacaagaaaaaagaaaaaaaa

SEQ ID NO: 105495 - RNA, 25 nt, Human
cccaaacaagaaaaaagaaaaaaaa

SEQ ID NO: 105496 - RNA, 19 nt, Human
cccacgugccuucuaggug

SEQ ID NO: 105497 - RNA, 19 nt, Human
cccccccgcugcuucucgc

SEQ ID NO: 105498 - RNA, 22 nt, Human
ccccccgcugcuucucgcggcc

SEQ ID NO: 105499 - RNA, 19 nt, Human
ccccgccgccgcucgugcc

SEQ ID NO: 105500 - RNA, 22 nt, Human
ccccgccgccgcucgugccgaa

SEQ ID NO: 105501 - RNA, 23 nt, Human
cccgccgccgcucgugccgaauu

SEQ ID NO: 105502 - RNA, 18 nt, Human
cccggggucgacccaccc

SEQ ID NO: 105503 - RNA, 21 nt, Human
cgcggguggccccgccgccgc

SEQ ID NO: 105504 - RNA, 22 nt, Human
cgcucgugccgaauucccgggg

SEQ ID NO: 105505 - RNA, 20 nt, Human
cucugugcucgccgugugac

SEQ ID NO: 105506 - RNA, 19 nt, Human
cuucgaucgccugcccccc

SEQ ID NO: 105507 - RNA, 21 nt, Human
gaucuguaccauuauuuccuu

SEQ ID NO: 105508 - RNA, 24 nt, Human
gccuggugccacaagcuugggucu

SEQ ID NO: 105509 - RNA, 18 nt, Human
guccaaaacaaagaagag

SEQ ID NO: 105510 - RNA, 18 nt, Human
gugcgugcacagggccaa

SEQ ID NO: 105511 - RNA, 21 nt, Human
gugugugugugugugugugug

SEQ ID NO: 105512 - RNA, 21 nt, Human
gugugugugugugugugugug

SEQ ID NO: 105513 - RNA, 21 nt, Human
gugugugugugugugugugug

SEQ ID NO: 105514 - RNA, 21 nt, Human
gugugugugugugugugugug

SEQ ID NO: 105515 - RNA, 23 nt, Human
guuuuuuuuuuuuuuucacuugg

SEQ ID NO: 105516 - RNA, 24 nt, Human
guuuuuuuuuuuuuuucacuugga

SEQ ID NO: 105517 - RNA, 22 nt, Human
uaauagagaacagaauucaaug

SEQ ID NO: 105518 - RNA, 21 nt, Human
uagacagaaaaagaucuguac

SEQ ID NO: 105519 - RNA, 25 nt, Human
uagcaacaucacuaaaaauuuaccc

SEQ ID NO: 105520 - RNA, 21 nt, Human
uccaaaacaaagaagaggggg

SEQ ID NO: 105521 - RNA, 20 nt, Human
uccaguggcuuuccuggcac

SEQ ID NO: 105522 - RNA, 27 nt, Human
uccuucgugugugugugugugugugug

SEQ ID NO: 105523 - RNA, 18 nt, Human
ucgcggguggccccgccg

SEQ ID NO: 105524 - RNA, 24 nt, Human
ucgcggguggccccgccgccgcuc

SEQ ID NO: 105525 - RNA, 21 nt, Human
ugaguucuauggcuucaaucu

SEQ ID NO: 105526 - RNA, 22 nt, Human
ugccacaaaucauuagaaaucu

SEQ ID NO: 105527 - RNA, 25 nt, Human
uggcaccaucagaugccuggugcca

SEQ ID NO: 105528 - RNA, 18 nt, Human
ugugugcgugcgugcaca

SEQ ID NO: 105529 - RNA, 19 nt, Human
ugugugugugugcgugcgu

SEQ ID NO: 105530 - RNA, 20 nt, Human
ugugugugugugcgugcgug

SEQ ID NO: 105531 - RNA, 22 nt, Human
ugugugugugugcgugcgugca

SEQ ID NO: 105532 - RNA, 18 nt, Human
ugugugugugugugugug

SEQ ID NO: 105533 - RNA, 18 nt, Human
ugugugugugugugugug

SEQ ID NO: 105534 - RNA, 18 nt, Human
ugugugugugugugugug

SEQ ID NO: 105535 - RNA, 18 nt, Human
ugugugugugugugugug

SEQ ID NO: 105536 - RNA, 18 nt, Human
ugugugugugugugugug

SEQ ID NO: 105537 - RNA, 18 nt, Human
ugugugugugugugugug

SEQ ID NO: 105538 - RNA, 18 nt, Human
ugugugugugugugugug

SEQ ID NO: 105539 - RNA, 18 nt, Human
ugugugugugugugugug

SEQ ID NO: 105540 - RNA, 18 nt, Human
ugugugugugugugugug

SEQ ID NO: 105541 - RNA, 18 nt, Human
ugugugugugugugugug

SEQ ID NO: 105542 - RNA, 18 nt, Human
ugugugugugugugugug

SEQ ID NO: 105543 - RNA, 19 nt, Human
ugugugugugugugugugc

SEQ ID NO: 105544 - RNA, 21 nt, Human
ugugugugugugugugugugc

SEQ ID NO: 105545 - RNA, 24 nt, Human
ugugugugugugugugugugcgug

SEQ ID NO: 105546 - RNA, 21 nt, Human
ugugugugugugugugugugu

SEQ ID NO: 105547 - RNA, 21 nt, Human
ugugugugugugugugugugu

SEQ ID NO: 105548 - RNA, 21 nt, Human
ugugugugugugugugugugu

SEQ ID NO: 105549 - RNA, 21 nt, Human
ugugugugugugugugugugu

SEQ ID NO: 105550 - RNA, 21 nt, Human
ugugugugugugugugugugu

SEQ ID NO: 105551 - RNA, 21 nt, Human
ugugugugugugugugugugu

SEQ ID NO: 105552 - RNA, 21 nt, Human
ugugugugugugugugugugu

SEQ ID NO: 105553 - RNA, 21 nt, Human
ugugugugugugugugugugu

SEQ ID NO: 105554 - RNA, 21 nt, Human
ugugugugugugugugugugu

SEQ ID NO: 105555 - RNA, 21 nt, Human
ugugugugugugugugugugu

SEQ ID NO: 105556 - RNA, 21 nt, Human
ugugugugugugugugugugu

SEQ ID NO: 105557 - RNA, 21 nt, Human
ugugugugugugugugugugu

SEQ ID NO: 105558 - RNA, 21 nt, Human
ugugugugugugugugugugu

SEQ ID NO: 105559 - RNA, 21 nt, Human
ugugugugugugugugugugu

SEQ ID NO: 105560 - RNA, 21 nt, Human
ugugugugugugugugugugu

SEQ ID NO: 105561 - RNA, 21 nt, Human
ugugugugugugugugugugu

SEQ ID NO: 105562 - RNA, 21 nt, Human
ugugugugugugugugugugu

SEQ ID NO: 105563 - RNA, 21 nt, Human
ugugugugugugugugugugu

SEQ ID NO: 105564 - RNA, 21 nt, Human
ugugugugugugugugugugu

SEQ ID NO: 105565 - RNA, 21 nt, Human
ugugugugugugugugugugu

SEQ ID NO: 105566 - RNA, 22 nt, Human
ugugugugugugugugugugug

SEQ ID NO: 105567 - RNA, 22 nt, Human
ugugugugugugugugugugug

SEQ ID NO: 105568 - RNA, 22 nt, Human
ugugugugugugugugugugug

SEQ ID NO: 105569 - RNA, 22 nt, Human
ugugugugugugugugugugug

SEQ ID NO: 105570 - RNA, 22 nt, Human
ugugugugugugugugugugug

SEQ ID NO: 105571 - RNA, 22 nt, Human
ugugugugugugugugugugug

SEQ ID NO: 105572 - RNA, 23 nt, Human
uuagaaaucuccugacaugcuga

SEQ ID NO: 105573 - RNA, 19 nt, Human
uucaggcuuauggcuuuug

SEQ ID NO: 105574 - RNA, 21 nt, Human
uuccaguggcuuuccuggcac

SEQ ID NO: 105575 - RNA, 20 nt, Human
uuguuuuccccaucaguuuu

SEQ ID NO: 105576 - RNA, 18 nt, Human
uuuuuuuuuuuuucacuu

SEQ ID NO: 105577 - RNA, 19 nt, Human
uuuuuuuuuuuuucacuug

SEQ ID NO: 105578 - RNA, 19 nt, Human
aaaaggucagaaguuauug

SEQ ID NO: 105579 - RNA, 21 nt, Human
aagcuccccugcacggggcuc

SEQ ID NO: 105580 - RNA, 18 nt, Human
acugcaguggcaggagcg

SEQ ID NO: 105581 - RNA, 18 nt, Human
agcuccccugcacggggc

SEQ ID NO: 105582 - RNA, 19 nt, Human
aggaaagagcccagaacag

SEQ ID NO: 105583 - RNA, 21 nt, Human
aggaguucucagcuuucacca

SEQ ID NO: 105584 - RNA, 23 nt, Human
aguggauaggauggaggaaggga

SEQ ID NO: 105585 - RNA, 22 nt, Human
cagagccagggccacagggugc

SEQ ID NO: 105586 - RNA, 19 nt, Human
cagcagagccagggccaca

SEQ ID NO: 105587 - RNA, 18 nt, Human
cccuggggccagcccugc

SEQ ID NO: 105588 - RNA, 18 nt, Human
ccucccgcaagcuccccu

SEQ ID NO: 105589 - RNA, 22 nt, Human
cggcuggacuggcggccggggu

SEQ ID NO: 105590 - RNA, 20 nt, Human
cguccgggccaucuggccag

SEQ ID NO: 105591 - RNA, 21 nt, Human
cugccaaggggacagcagagc

SEQ ID NO: 105592 - RNA, 19 nt, Human
cuggccaggaccugccaag

SEQ ID NO: 105593 - RNA, 19 nt, Human
gacccgggcgccgagcagc

SEQ ID NO: 105594 - RNA, 18 nt, Human
gagucaggaguaggagac

SEQ ID NO: 105595 - RNA, 18 nt, Human
gauggaggaagggaaacu

SEQ ID NO: 105596 - RNA, 18 nt, Human
ggccggggucgggcugcg

SEQ ID NO: 105597 - RNA, 18 nt, Human
ggccugggcuugggcagg

SEQ ID NO: 105598 - RNA, 19 nt, Human
gucaggaguaggagacaag

SEQ ID NO: 105599 - RNA, 22 nt, Human
gugcccuggggccagcccugcc

SEQ ID NO: 105600 - RNA, 18 nt, Human
uagaaagcugccuguguu

SEQ ID NO: 105601 - RNA, 20 nt, Human
ucagagaaggaaucgucaau

SEQ ID NO: 105602 - RNA, 22 nt, Human
uccagggcagguaggagucagg

SEQ ID NO: 105603 - RNA, 21 nt, Human
ucugucggucgauccucccgc

SEQ ID NO: 105604 - RNA, 22 nt, Human
ugcaaaggauguuccagggcag

SEQ ID NO: 105605 - RNA, 22 nt, Human
uggcggccggggucgggcugcg

SEQ ID NO: 105606 - RNA, 23 nt, Human
uggcggccggggucgggcugcgg

SEQ ID NO: 105607 - RNA, 20 nt, Human
uggggccagcccugccagcc

SEQ ID NO: 105608 - RNA, 22 nt, Human
uggggccagcccugccagccgg

SEQ ID NO: 105609 - RNA, 22 nt, Human
uggggccgggcaccuaggcacc

SEQ ID NO: 105610 - RNA, 22 nt, Human
uuccagggcagguaggagucag

SEQ ID NO: 105611 - RNA, 22 nt, Human
aggcgcgauggagcggccccgg

SEQ ID NO: 105612 - RNA, 20 nt, Human
agugaaguggugaaaaacaa

SEQ ID NO: 105613 - RNA, 22 nt, Human
cagugcccaccgcuccaaugac

SEQ ID NO: 105614 - RNA, 18 nt, Human
ggaccggagaagcgaggc

SEQ ID NO: 105615 - RNA, 23 nt, Human
ggcugcuucuuaacagugcccac

SEQ ID NO: 105616 - RNA, 21 nt, Human
uaacagugcccaccgcuccaa

SEQ ID NO: 105617 - RNA, 19 nt, Human
uaguaaguucuacuuucug

SEQ ID NO: 105618 - RNA, 18 nt, Human
ucaugugauggcugcuuc

SEQ ID NO: 105619 - RNA, 21 nt, Human
ucuuaacagugcccaccgcuc

SEQ ID NO: 105620 - RNA, 21 nt, Human
ugaaaaacagaucaugugaug

SEQ ID NO: 105621 - RNA, 22 nt, Human
ugaaguggugaaaaacagauca

SEQ ID NO: 105622 - RNA, 22 nt, Human
ugaaguggugaaaaacagauca

SEQ ID NO: 105623 - RNA, 25 nt, Human
ugacagaaauuaaagacaauuccaa

SEQ ID NO: 105624 - RNA, 23 nt, Human
ugcagaaaagaauaugcuacaag

SEQ ID NO: 105625 - RNA, 22 nt, Human
uuaaagacaauuccaauugugu

SEQ ID NO: 105626 - RNA, 19 nt, Human
aacauggcggccuucaucu

SEQ ID NO: 105627 - RNA, 30 nt, Human
aacccagaagagaugggggaggugaguccc

SEQ ID NO: 105628 - RNA, 18 nt, Human
agacagggccucuucccc

SEQ ID NO: 105629 - RNA, 20 nt, Human
agaccaaagcaaagcgccaa

SEQ ID NO: 105630 - RNA, 23 nt, Human
agagaugggggaggugaguccag

SEQ ID NO: 105631 - RNA, 21 nt, Human
agaggaaggaacccagaagag

SEQ ID NO: 105632 - RNA, 19 nt, Human
agccagagggggacggggc

SEQ ID NO: 105633 - RNA, 21 nt, Human
agcgccaacacacuguuaaac

SEQ ID NO: 105634 - RNA, 23 nt, Human
aggagggcuagggggcagggagu

SEQ ID NO: 105635 - RNA, 21 nt, Human
agggcaggguguggccucuuc

SEQ ID NO: 105636 - RNA, 19 nt, Human
auauaccugucccacucca

SEQ ID NO: 105637 - RNA, 25 nt, Human
caaagcaaagcgccaacacacuguu

SEQ ID NO: 105638 - RNA, 22 nt, Human
cacagccccaucccuaccucuc

SEQ ID NO: 105639 - RNA, 18 nt, Human
cauaggccccaagggagg

SEQ ID NO: 105640 - RNA, 21 nt, Human
ccacagccccaucccuaccuc

SEQ ID NO: 105641 - RNA, 21 nt, Human
cccacagccccaucccuaccu

SEQ ID NO: 105642 - RNA, 22 nt, Human
cccacagccccaucccuaccuc

SEQ ID NO: 105643 - RNA, 18 nt, Human
cccaggcccuguacuucc

SEQ ID NO: 105644 - RNA, 21 nt, Human
ccggccagcuggagccagagg

SEQ ID NO: 105645 - RNA, 22 nt, Human
ccucacuauccccacagcccca

SEQ ID NO: 105646 - RNA, 21 nt, Human
ccuucaucucugcaagcucag

SEQ ID NO: 105647 - RNA, 19 nt, Human
ccuugcccacggcuccugg

SEQ ID NO: 105648 - RNA, 21 nt, Human
cucaaagauagaccaaagcaa

SEQ ID NO: 105649 - RNA, 23 nt, Human
cucagaggaaggaacccagaaga

SEQ ID NO: 105650 - RNA, 19 nt, Human
cucuuccccaggcccugua

SEQ ID NO: 105651 - RNA, 26 nt, Human
cugcaagcucaggggucccaaggcuc

SEQ ID NO: 105652 - RNA, 19 nt, Human
gaccaaagcaaagcgccaa

SEQ ID NO: 105653 - RNA, 23 nt, Human
gccagcuggagccagagggggac

SEQ ID NO: 105654 - RNA, 22 nt, Human
ggcaggguguggccucuucccu

SEQ ID NO: 105655 - RNA, 21 nt, Human
ggcuccuggugccagcuaccu

SEQ ID NO: 105656 - RNA, 21 nt, Human
gggaggugaguccaguggguc

SEQ ID NO: 105657 - RNA, 24 nt, Human
ggggacggggcauccuuggccccc

SEQ ID NO: 105658 - RNA, 21 nt, Human
gggggaggugaguccaguggg

SEQ ID NO: 105659 - RNA, 22 nt, Human
ggguguggccucuucccuugcc

SEQ ID NO: 105660 - RNA, 25 nt, Human
uaccuagacagggccucuuccccag

SEQ ID NO: 105661 - RNA, 19 nt, Human
uaggauguuuggcuccuug

SEQ ID NO: 105662 - RNA, 18 nt, Human
ucaaagauagaccaaagc

SEQ ID NO: 105663 - RNA, 18 nt, Human
ucaucucugcaagcucag

SEQ ID NO: 105664 - RNA, 26 nt, Human
ucccaaggcucagaggaaggaacccc

SEQ ID NO: 105665 - RNA, 19 nt, Human
uccccacagccccaucccu

SEQ ID NO: 105666 - RNA, 18 nt, Human
uccccaggcccuguacuu

SEQ ID NO: 105667 - RNA, 21 nt, Human
ucccuugccaggcuuggggau

SEQ ID NO: 105668 - RNA, 19 nt, Human
ucucugcaagcucaggggu

SEQ ID NO: 105669 - RNA, 21 nt, Human
ucuggcugcagcagagcaggg

SEQ ID NO: 105670 - RNA, 22 nt, Human
ucuuacauugcgaugccucacu

SEQ ID NO: 105671 - RNA, 22 nt, Human
ucuuguaggauguuuggcuccu

SEQ ID NO: 105672 - RNA, 22 nt, Human
ugccucacuauccccacagccc

SEQ ID NO: 105673 - RNA, 23 nt, Human
ugggggaggugaguccagugggu

SEQ ID NO: 105674 - RNA, 23 nt, Human
uuaaucaucaacaaguguguacu

SEQ ID NO: 105675 - RNA, 19 nt, Human
uucaagcuggcuuugcagg

SEQ ID NO: 105676 - RNA, 23 nt, Human
uuggcccccgugcugugugcaga

SEQ ID NO: 105677 - RNA, 24 nt, Human
uuggugauagagcuugccaaaaug

SEQ ID NO: 105678 - RNA, 22 nt, Human
aaaaaaaaaaaaaaaacaaaaa

SEQ ID NO: 105679 - RNA, 25 nt, Human
aaaaaaaaaaaaaaaacaaaaacaa

SEQ ID NO: 105680 - RNA, 26 nt, Human
aaaaaaaaaaaacaaaaacaaaaaag

SEQ ID NO: 105681 - RNA, 23 nt, Human
aaaaaaaaacaaaaacaaaaaaa

SEQ ID NO: 105682 - RNA, 26 nt, Human
aaaaaaaacaaaaacaaaaaaaacac

SEQ ID NO: 105683 - RNA, 24 nt, Human
aaaaaaacaaaaacaaaaaaaaca

SEQ ID NO: 105684 - RNA, 28 nt, Human
aaaaaaacaaaaacaaaaaaaacaccac

SEQ ID NO: 105685 - RNA, 19 nt, Human
aaaaugcacacuuagaaca

SEQ ID NO: 105686 - RNA, 19 nt, Human
aaacaaaaaaaacaccaca

SEQ ID NO: 105687 - RNA, 25 nt, Human
aaacaaaaacaaaaaaaacaccaca

SEQ ID NO: 105688 - RNA, 21 nt, Human
aaagauugacaaaaaugcaca

SEQ ID NO: 105689 - RNA, 22 nt, Human
aacaugcgguuauuuaaaaaaa

SEQ ID NO: 105690 - RNA, 24 nt, Human
aauacauaacagaaaagagcacaa

SEQ ID NO: 105691 - RNA, 18 nt, Human
acauaacagaaaagagca

SEQ ID NO: 105692 - RNA, 20 nt, Human
acauaacagaaaagagcaca

SEQ ID NO: 105693 - RNA, 19 nt, Human
agaaaagagcacaauaacu

SEQ ID NO: 105694 - RNA, 22 nt, Human
agaaaagagcacaauaacuuaa

SEQ ID NO: 105695 - RNA, 24 nt, Human
agaaaagagcacaauaacuuaagu

SEQ ID NO: 105696 - RNA, 22 nt, Human
caaaaacaaaaaaaacaccaca

SEQ ID NO: 105697 - RNA, 21 nt, Human
cacuuagaacaugcgguuauu

SEQ ID NO: 105698 - RNA, 22 nt, Human
caggagagcaccaagcaaggca

SEQ ID NO: 105699 - RNA, 18 nt, Human
caucuguaugaaauaacu

SEQ ID NO: 105700 - RNA, 18 nt, Human
ccgccaccgccgccgcca

SEQ ID NO: 105701 - RNA, 20 nt, Human
ccggcgggcgaggcggcgga

SEQ ID NO: 105702 - RNA, 24 nt, Human
gcaauaacaacaacacaaugucaa

SEQ ID NO: 105703 - RNA, 21 nt, Human
gccggcuccgaggccgcggag

SEQ ID NO: 105704 - RNA, 24 nt, Human
gcuacagaggggauggggucugga

SEQ ID NO: 105705 - RNA, 23 nt, Human
ggagagcaccaagcaaggcacca

SEQ ID NO: 105706 - RNA, 20 nt, Human
ggggauggggucuggaccgu

SEQ ID NO: 105707 - RNA, 25 nt, Human
ggguuggcgccgggguaccggcggg

SEQ ID NO: 105708 - RNA, 21 nt, Human
gguuauuuaaaaaaaaaaaaa

SEQ ID NO: 105709 - RNA, 22 nt, Human
uacauaacagaaaagagcacaa

SEQ ID NO: 105710 - RNA, 21 nt, Human
ucaccaccaggagagcaccaa

SEQ ID NO: 105711 - RNA, 28 nt, Human
ucagaauacauaacagaaaagagcacaa

SEQ ID NO: 105712 - RNA, 18 nt, Human
uccccugcccaaagggcc

SEQ ID NO: 105713 - RNA, 22 nt, Human
uccgagcuccccugcccaaagg

SEQ ID NO: 105714 - RNA, 18 nt, Human
ucgccgccaccgccgccg

SEQ ID NO: 105715 - RNA, 21 nt, Human
ucgccgccaccgccgccgcca

SEQ ID NO: 105716 - RNA, 21 nt, Human
ucgcugucggcugucucggcu

SEQ ID NO: 105717 - RNA, 19 nt, Human
ugagccuccgagcuccccu

SEQ ID NO: 105718 - RNA, 25 nt, Human
ugagccuccgagcuccccugcccaa

SEQ ID NO: 105719 - RNA, 18 nt, Human
uguagaaccaauguuaug

SEQ ID NO: 105720 - RNA, 19 nt, Human
uuggaaagacaacauacuu

SEQ ID NO: 105721 - RNA, 19 nt, Human
ccuuauaauugcugcugcu

SEQ ID NO: 105722 - RNA, 21 nt, Human
ucuaacauuucucaaacaguc

SEQ ID NO: 105723 - RNA, 21 nt, Human
ugagaccagucagaauuucca

SEQ ID NO: 105724 - RNA, 26 nt, Human
aagcacugaaguugcagguccuagcu

SEQ ID NO: 105725 - RNA, 24 nt, Human
cagaagcacugaaguugcaggucc

SEQ ID NO: 105726 - RNA, 18 nt, Human
gaaggagguccaaaacag

SEQ ID NO: 105727 - RNA, 24 nt, Human
gcauucaucauauauaaccacuuc

SEQ ID NO: 105728 - RNA, 27 nt, Human
uaucccagaagcacugaaagguccuuc

SEQ ID NO: 105729 - RNA, 18 nt, Human
uccaguuaucccagaagc

SEQ ID NO: 105730 - RNA, 21 nt, Human
ugaaggagguccaaaacagca

SEQ ID NO: 105731 - RNA, 22 nt, Human
ugaaguugcagguccuagcugu

SEQ ID NO: 105732 - RNA, 19 nt, Human
uggugacaacugcugauga

SEQ ID NO: 105733 - RNA, 21 nt, Human
aaacaacagaaaguuccuuca

SEQ ID NO: 105734 - RNA, 23 nt, Human
aaacacccaggauuacuagaacc

SEQ ID NO: 105735 - RNA, 20 nt, Human
aaaccaaugacauagacccc

SEQ ID NO: 105736 - RNA, 19 nt, Human
aacaacagaaaguuccuuc

SEQ ID NO: 105737 - RNA, 24 nt, Human
aagaaauaaugcagcuacaggagc

SEQ ID NO: 105738 - RNA, 19 nt, Human
acccaggacgcagaggcgg

SEQ ID NO: 105739 - RNA, 19 nt, Human
acuacccaggacgcagagg

SEQ ID NO: 105740 - RNA, 18 nt, Human
agcacagacuacccagga

SEQ ID NO: 105741 - RNA, 18 nt, Human
aggcggugcaggcgcagg

SEQ ID NO: 105742 - RNA, 19 nt, Human
aguccaggcgcuccuccca

SEQ ID NO: 105743 - RNA, 20 nt, Human
aucagcccgccgcacccaca

SEQ ID NO: 105744 - RNA, 24 nt, Human
caaaaacaacagaaaguuccuuca

SEQ ID NO: 105745 - RNA, 25 nt, Human
caacagaaaguuccuucacuuuaau

SEQ ID NO: 105746 - RNA, 19 nt, Human
caagaaauaaugcagcuac

SEQ ID NO: 105747 - RNA, 22 nt, Human
cacauuuugcuuuugcuggaaa

SEQ ID NO: 105748 - RNA, 22 nt, Human
caccucaucagcccgccgcacc

SEQ ID NO: 105749 - RNA, 23 nt, Human
ccaaaagcaaagucacaacaggc

SEQ ID NO: 105750 - RNA, 18 nt, Human
ccaaugacauagacccca

SEQ ID NO: 105751 - RNA, 19 nt, Human
ccaaugacauagaccccaa

SEQ ID NO: 105752 - RNA, 30 nt, Human
cccgcgaguccaggcgcuccucccaggcgg

SEQ ID NO: 105753 - RNA, 19 nt, Human
ccugcgaggcaggaggcuu

SEQ ID NO: 105754 - RNA, 18 nt, Human
cgcgcaccgggcccaggg

SEQ ID NO: 105755 - RNA, 19 nt, Human
cuacaaaaacaacagaaag

SEQ ID NO: 105756 - RNA, 22 nt, Human
gaagaacuaagagaaaccagaa

SEQ ID NO: 105757 - RNA, 19 nt, Human
gagcaaauuaaauuacuau

SEQ ID NO: 105758 - RNA, 20 nt, Human
gagcgugcgcgcgggaggag

SEQ ID NO: 105759 - RNA, 19 nt, Human
gcaccgggcccagggagcc

SEQ ID NO: 105760 - RNA, 23 nt, Human
gcaucagaaaccaaugacauaga

SEQ ID NO: 105761 - RNA, 18 nt, Human
gcgcggagcgugcgcgcg

SEQ ID NO: 105762 - RNA, 24 nt, Human
ggagcgugcgcgcgggaggaggua

SEQ ID NO: 105763 - RNA, 22 nt, Human
ggauuacaagcacagacuaccc

SEQ ID NO: 105764 - RNA, 19 nt, Human
ggcgccggcgcccggggag

SEQ ID NO: 105765 - RNA, 23 nt, Human
uaaucaagaaauaaugcagcuac

SEQ ID NO: 105766 - RNA, 24 nt, Human
uaaugcagcuacaggagcaaauua

SEQ ID NO: 105767 - RNA, 18 nt, Human
uagaaccagaaagcgugu

SEQ ID NO: 105768 - RNA, 28 nt, Human
uagaccccaaaagcaaagucacaacagg

SEQ ID NO: 105769 - RNA, 21 nt, Human
uagggggcuaaucaugcaaua

SEQ ID NO: 105770 - RNA, 25 nt, Human
uaugguaauguaacagccagaggug

SEQ ID NO: 105771 - RNA, 25 nt, Human
uauuaaaguaacaaaucugaaaacc

SEQ ID NO: 105772 - RNA, 19 nt, Human
ucaucuguaaaacauuucu

SEQ ID NO: 105773 - RNA, 22 nt, Human
uccuucaucuguaaaacauuuc

SEQ ID NO: 105774 - RNA, 21 nt, Human
ugaguuucucugaacgugaua

SEQ ID NO: 105775 - RNA, 20 nt, Human
ugcuggauuacaagcacaga

SEQ ID NO: 105776 - RNA, 20 nt, Human
uggggcgugcugggggcgcc

SEQ ID NO: 105777 - RNA, 24 nt, Human
ugggggcgccggcgcccggggagg

SEQ ID NO: 105778 - RNA, 25 nt, Human
uugccagauagggggcuaaucaugc

SEQ ID NO: 105779 - RNA, 21 nt, Human
uuugcuuuugcuggaaagaaa

SEQ ID NO: 105780 - RNA, 19 nt, Human
aaccugaggggcuucccuc

SEQ ID NO: 105781 - RNA, 18 nt, Human
acgccgccgccgcugccc

SEQ ID NO: 105782 - RNA, 24 nt, Human
agcccauggcaaaguccuggggac

SEQ ID NO: 105783 - RNA, 21 nt, Human
aggcacagcaaaagacccaac

SEQ ID NO: 105784 - RNA, 23 nt, Human
cacagcaaaagacccaaccugag

SEQ ID NO: 105785 - RNA, 22 nt, Human
cacccuuguucucacguggagg

SEQ ID NO: 105786 - RNA, 22 nt, Human
cagccuccgcggcccccagccc

SEQ ID NO: 105787 - RNA, 18 nt, Human
cagcgauccucugcaguc

SEQ ID NO: 105788 - RNA, 23 nt, Human
ccagacauacauaggaggcacag

SEQ ID NO: 105789 - RNA, 20 nt, Human
cccauggcaaaguccugggg

SEQ ID NO: 105790 - RNA, 20 nt, Human
ccccucgcgucgcugcucgc

SEQ ID NO: 105791 - RNA, 23 nt, Human
cccucaccuucacccuuguucuc

SEQ ID NO: 105792 - RNA, 18 nt, Human
ccgccgccgcugcccucg

SEQ ID NO: 105793 - RNA, 19 nt, Human
ccgccgcugcccucgcccc

SEQ ID NO: 105794 - RNA, 20 nt, Human
ccgccgcugcccucgcccgg

SEQ ID NO: 105795 - RNA, 25 nt, Human
ccgcgcgccccucgcgucgcugcuc

SEQ ID NO: 105796 - RNA, 18 nt, Human
ccgcugcccucgcccggc

SEQ ID NO: 105797 - RNA, 20 nt, Human
cgccgccgccgcugcccucg

SEQ ID NO: 105798 - RNA, 22 nt, Human
cuccaccagaugacgcgcugcc

SEQ ID NO: 105799 - RNA, 24 nt, Human
gauggugcugggccauucagcuca

SEQ ID NO: 105800 - RNA, 22 nt, Human
gcgcagaaagcaccagccuccg

SEQ ID NO: 105801 - RNA, 21 nt, Human
ggggacgcgcagaaagcacca

SEQ ID NO: 105802 - RNA, 18 nt, Human
ucaaugauaauacugcau

SEQ ID NO: 105803 - RNA, 19 nt, Human
ucagcgauccucugcaguc

SEQ ID NO: 105804 - RNA, 19 nt, Human
uggaaaacaaaucaagugg

SEQ ID NO: 105805 - RNA, 20 nt, Human
uggaaaacaaaucaaguggu

SEQ ID NO: 105806 - RNA, 21 nt, Human
uugauggugcugggccauuca

SEQ ID NO: 105807 - RNA, 18 nt, Human
uuuguggucagcuuuuuc

SEQ ID NO: 105808 - RNA, 20 nt, Human
agcuccuccgggagcagcgg

SEQ ID NO: 105809 - RNA, 25 nt, Human
aggagggaaggagggagggaaggaa

SEQ ID NO: 105810 - RNA, 22 nt, Human
ccuccgggagcagcggcgccag

SEQ ID NO: 105811 - RNA, 20 nt, Human
cgccgugccgggagcuccuc

SEQ ID NO: 105812 - RNA, 19 nt, Human
cgggagcagcggcgccaga

SEQ ID NO: 105813 - RNA, 22 nt, Human
gagcagcggcgccagaagagac

SEQ ID NO: 105814 - RNA, 20 nt, Human
gagggaaggagggagggaag

SEQ ID NO: 105815 - RNA, 21 nt, Human
ggagggaaggagggagggaag

SEQ ID NO: 105816 - RNA, 22 nt, Human
ggcgacaggagggaaggaggga

SEQ ID NO: 105817 - RNA, 23 nt, Human
aaacaaggaguccaaagcccgga

SEQ ID NO: 105818 - RNA, 22 nt, Human
aagaggggucuguaggguccuc

SEQ ID NO: 105819 - RNA, 20 nt, Human
acaggagagaaccugcuggc

SEQ ID NO: 105820 - RNA, 18 nt, Human
accagggcacccaauuug

SEQ ID NO: 105821 - RNA, 21 nt, Human
acccaggguccugggaagcca

SEQ ID NO: 105822 - RNA, 22 nt, Human
agaaaaaccaguuccccggggg

SEQ ID NO: 105823 - RNA, 24 nt, Human
agaaagggaaagagagggagggag

SEQ ID NO: 105824 - RNA, 21 nt, Human
agagagggagggaggaaaggg

SEQ ID NO: 105825 - RNA, 18 nt, Human
agagggagggaggaaagg

SEQ ID NO: 105826 - RNA, 22 nt, Human
agcagggcccuggggcugagga

SEQ ID NO: 105827 - RNA, 19 nt, Human
aggaagggaggggagcugg

SEQ ID NO: 105828 - RNA, 22 nt, Human
aggaagggaggggagcuggagg

SEQ ID NO: 105829 - RNA, 21 nt, Human
aggagggagggacugaggcuu

SEQ ID NO: 105830 - RNA, 19 nt, Human
aggcaggcagcaugcggga

SEQ ID NO: 105831 - RNA, 23 nt, Human
aggcugggccuggagauccgggu

SEQ ID NO: 105832 - RNA, 22 nt, Human
agggaggaaagggagaaaagga

SEQ ID NO: 105833 - RNA, 20 nt, Human
aggugguggcugugagccag

SEQ ID NO: 105834 - RNA, 24 nt, Human
aggugguggcugugagccaggagg

SEQ ID NO: 105835 - RNA, 19 nt, Human
aguaugccuagggcccagg

SEQ ID NO: 105836 - RNA, 22 nt, Human
agucaggacaccuggcuccugg

SEQ ID NO: 105837 - RNA, 21 nt, Human
auccggguggcugggaggcca

SEQ ID NO: 105838 - RNA, 20 nt, Human
cacacuugacucccacuccc

SEQ ID NO: 105839 - RNA, 22 nt, Human
cagccccacugccucccugggg

SEQ ID NO: 105840 - RNA, 22 nt, Human
cagccccugcccucuucccacc

SEQ ID NO: 105841 - RNA, 21 nt, Human
cagccuuagcggggagggaga

SEQ ID NO: 105842 - RNA, 22 nt, Human
caggacaccuggcuccuggucc

SEQ ID NO: 105843 - RNA, 19 nt, Human
cagggccggaggcaggcag

SEQ ID NO: 105844 - RNA, 22 nt, Human
caggggaaagucaucaccacgg

SEQ ID NO: 105845 - RNA, 21 nt, Human
cagggggcaccaucucacacc

SEQ ID NO: 105846 - RNA, 22 nt, Human
caucuggcuuuucucccagcgg

SEQ ID NO: 105847 - RNA, 18 nt, Human
ccagcagggaacagaaaa

SEQ ID NO: 105848 - RNA, 22 nt, Human
ccaguucaguuucuggcugugc

SEQ ID NO: 105849 - RNA, 24 nt, Human
cccacugccucccugggggccugc

SEQ ID NO: 105850 - RNA, 18 nt, Human
cccaggugggcgggcucu

SEQ ID NO: 105851 - RNA, 24 nt, Human
ccccacugccucccugggggccug

SEQ ID NO: 105852 - RNA, 21 nt, Human
ccccagcucccugucaucugg

SEQ ID NO: 105853 - RNA, 18 nt, Human
ccccagggggcaccaucu

SEQ ID NO: 105854 - RNA, 22 nt, Human
cccccuggcacgccagccuuag

SEQ ID NO: 105855 - RNA, 23 nt, Human
ccccuccuucaccagggcaccca

SEQ ID NO: 105856 - RNA, 22 nt, Human
cccuggggcugaggaugcagcc

SEQ ID NO: 105857 - RNA, 19 nt, Human
ccuggagauccggguggcu

SEQ ID NO: 105858 - RNA, 19 nt, Human
ccuggcacgccagccuuag

SEQ ID NO: 105859 - RNA, 24 nt, Human
ccuggcccgcccugcuggcuccug

SEQ ID NO: 105860 - RNA, 22 nt, Human
ccugugcuggcagcgggagagg

SEQ ID NO: 105861 - RNA, 26 nt, Human
ccuuccagugucauugucuugcugau

SEQ ID NO: 105862 - RNA, 21 nt, Human
cgcuacagggcuuccucaggg

SEQ ID NO: 105863 - RNA, 19 nt, Human
cggggacugggguggaggg

SEQ ID NO: 105864 - RNA, 24 nt, Human
cggggacugggguggagggaugca

SEQ ID NO: 105865 - RNA, 24 nt, Human
cuccugguccuguugcugccucgg

SEQ ID NO: 105866 - RNA, 19 nt, Human
cugccuaaaggcaaacaag

SEQ ID NO: 105867 - RNA, 24 nt, Human
cuggcugggccaggccuguguggg

SEQ ID NO: 105868 - RNA, 20 nt, Human
gacccaggguccugggaagc

SEQ ID NO: 105869 - RNA, 21 nt, Human
gagagggagggaggaaaggga

SEQ ID NO: 105870 - RNA, 22 nt, Human
gaggaugcagccccugcccucu

SEQ ID NO: 105871 - RNA, 19 nt, Human
gaggcaggcagcaugcggg

SEQ ID NO: 105872 - RNA, 20 nt, Human
gaggcaggcagcaugcggga

SEQ ID NO: 105873 - RNA, 19 nt, Human
gaggcuucucuggggcagg

SEQ ID NO: 105874 - RNA, 20 nt, Human
gagggagaaagggaaagaga

SEQ ID NO: 105875 - RNA, 21 nt, Human
gaguaugccuagggcccaggu

SEQ ID NO: 105876 - RNA, 20 nt, Human
gauagcaggcacacuugacu

SEQ ID NO: 105877 - RNA, 22 nt, Human
gcaaacaaggaguccaaagccc

SEQ ID NO: 105878 - RNA, 19 nt, Human
gcagggcccuggggcugag

SEQ ID NO: 105879 - RNA, 25 nt, Human
gcagggccggaggcaggcagcaugc

SEQ ID NO: 105880 - RNA, 20 nt, Human
gccucccugggggccugcgg

SEQ ID NO: 105881 - RNA, 18 nt, Human
gcugggccaggccugugu

SEQ ID NO: 105882 - RNA, 18 nt, Human
ggaaagggagaaaaggaa

SEQ ID NO: 105883 - RNA, 20 nt, Human
ggacugggguggagggaugc

SEQ ID NO: 105884 - RNA, 23 nt, Human
ggagaguaugccuagggcccagg

SEQ ID NO: 105885 - RNA, 25 nt, Human
ggagauccggguggcugggaggcca

SEQ ID NO: 105886 - RNA, 22 nt, Human
gggaagccaggugaggccugag

SEQ ID NO: 105887 - RNA, 27 nt, Human
gggagaaaaggaagggaggggagcugg

SEQ ID NO: 105888 - RNA, 18 nt, Human
gggagcugcgcccugugc

SEQ ID NO: 105889 - RNA, 26 nt, Human
gggccggaggcaggcagcaugcggga

SEQ ID NO: 105890 - RNA, 24 nt, Human
gggcugcccaggaaggugacccag

SEQ ID NO: 105891 - RNA, 18 nt, Human
ggguuggagagccccuuc

SEQ ID NO: 105892 - RNA, 22 nt, Human
guccugggaagccaggugaggc

SEQ ID NO: 105893 - RNA, 18 nt, Human
uaggguccucagccccac

SEQ ID NO: 105894 - RNA, 22 nt, Human
uagguucuggagugugcccccc

SEQ ID NO: 105895 - RNA, 23 nt, Human
ucccagcggccaguucaguuucu

SEQ ID NO: 105896 - RNA, 19 nt, Human
uccccggguuucccucccc

SEQ ID NO: 105897 - RNA, 18 nt, Human
ucccugggggccugcggc

SEQ ID NO: 105898 - RNA, 22 nt, Human
ucucacaccgcaaucugggccg

SEQ ID NO: 105899 - RNA, 20 nt, Human
ucuccagggacccaaacacc

SEQ ID NO: 105900 - RNA, 26 nt, Human
ucuccagggacccaaacaccuggcuc

SEQ ID NO: 105901 - RNA, 23 nt, Human
ucucccagcggccaguucaguuu

SEQ ID NO: 105902 - RNA, 22 nt, Human
ucucugggcugcccaggaaggu

SEQ ID NO: 105903 - RNA, 18 nt, Human
ucuggagugugccccccu

SEQ ID NO: 105904 - RNA, 19 nt, Human
ucuggagugugccccccuc

SEQ ID NO: 105905 - RNA, 22 nt, Human
ugaaaggaaagaacauuugggg

SEQ ID NO: 105906 - RNA, 20 nt, Human
ugaagagcgcauucccaccc

SEQ ID NO: 105907 - RNA, 26 nt, Human
ugaagaggggucuguaggguccucaa

SEQ ID NO: 105908 - RNA, 22 nt, Human
ugagccaggagggagggacuga

SEQ ID NO: 105909 - RNA, 19 nt, Human
ugaggcuucucuggggcag

SEQ ID NO: 105910 - RNA, 23 nt, Human
ugaggcuucucuggggcaggggg

SEQ ID NO: 105911 - RNA, 22 nt, Human
ugauuggcaugucccacccccu

SEQ ID NO: 105912 - RNA, 21 nt, Human
ugcagccccugcccucuuccc

SEQ ID NO: 105913 - RNA, 21 nt, Human
uggaaaguuggcagggucucu

SEQ ID NO: 105914 - RNA, 20 nt, Human
uggagugugccccccuccuu

SEQ ID NO: 105915 - RNA, 18 nt, Human
uggauagcaggcacacuu

SEQ ID NO: 105916 - RNA, 18 nt, Human
uggcuagguggggcuggg

SEQ ID NO: 105917 - RNA, 20 nt, Human
uggcuccugacuuccugccu

SEQ ID NO: 105918 - RNA, 22 nt, Human
uggcugugagccaggagggagg

SEQ ID NO: 105919 - RNA, 19 nt, Human
ugggaauagcgaagucugg

SEQ ID NO: 105920 - RNA, 19 nt, Human
ugggaggccaugcaugggu

SEQ ID NO: 105921 - RNA, 25 nt, Human
uggggcagggccggaggcaggcagc

SEQ ID NO: 105922 - RNA, 21 nt, Human
uggggccaggcugggccugga

SEQ ID NO: 105923 - RNA, 21 nt, Human
ugggguuggagagccccuucc

SEQ ID NO: 105924 - RNA, 24 nt, Human
ugggguuggagagccccuuccucc

SEQ ID NO: 105925 - RNA, 23 nt, Human
ugucauugucuugcugaugcuug

SEQ ID NO: 105926 - RNA, 28 nt, Human
ugucccacccccuggcacgccagccuua

SEQ ID NO: 105927 - RNA, 22 nt, Human
ugugacuagccaagccggaccc

SEQ ID NO: 105928 - RNA, 19 nt, Human
uucccggggacuggggugg

SEQ ID NO: 105929 - RNA, 24 nt, Human
uucccggggacugggguggaggga

SEQ ID NO: 105930 - RNA, 20 nt, Human
uuccuccaggcacgcuacag

SEQ ID NO: 105931 - RNA, 20 nt, Human
aagcucagcucauuuucugc

SEQ ID NO: 105932 - RNA, 18 nt, Human
aaucuuccucuccugccc

SEQ ID NO: 105933 - RNA, 18 nt, Human
agacaaaucuuccucucc

SEQ ID NO: 105934 - RNA, 26 nt, Human
agacagcagaacuaaagggagaagca

SEQ ID NO: 105935 - RNA, 21 nt, Human
agcaaguagacaaaucuuccu

SEQ ID NO: 105936 - RNA, 24 nt, Human
aggguucacucuucagggagacag

SEQ ID NO: 105937 - RNA, 20 nt, Human
augaaaacacuucaaggcca

SEQ ID NO: 105938 - RNA, 18 nt, Human
ccagggcagagugguggc

SEQ ID NO: 105939 - RNA, 19 nt, Human
ggaccagggcagaguggug

SEQ ID NO: 105940 - RNA, 20 nt, Human
gggagacagcagaacuaaag

SEQ ID NO: 105941 - RNA, 21 nt, Human
guucacucuucagggagacag

SEQ ID NO: 105942 - RNA, 20 nt, Human
uaaacuuacauaaagguaaa

SEQ ID NO: 105943 - RNA, 21 nt, Human
uauggaauauaacacguuuga

SEQ ID NO: 105944 - RNA, 21 nt, Human
aagcccugcaaagcagccacc

SEQ ID NO: 105945 - RNA, 20 nt, Human
agcaguggggagagacuggg

SEQ ID NO: 105946 - RNA, 23 nt, Human
aggagcaguggggagagacuggc

SEQ ID NO: 105947 - RNA, 19 nt, Human
aggucucuggaugugaggc

SEQ ID NO: 105948 - RNA, 23 nt, Human
caaacaauucugucccuccaaga

SEQ ID NO: 105949 - RNA, 23 nt, Human
caaagcagccaccuaggaaggaa

SEQ ID NO: 105950 - RNA, 25 nt, Human
caaagcagccaccuaggaaggaaga

SEQ ID NO: 105951 - RNA, 21 nt, Human
caauacccagcacaaacaauu

SEQ ID NO: 105952 - RNA, 20 nt, Human
cacaaacaauucugucccuc

SEQ ID NO: 105953 - RNA, 25 nt, Human
cacgcuuacuuuauugagucaggga

SEQ ID NO: 105954 - RNA, 23 nt, Human
cagcacaaacaauucugucccuc

SEQ ID NO: 105955 - RNA, 18 nt, Human
caggaaaugcagcaguac

SEQ ID NO: 105956 - RNA, 19 nt, Human
cccaaagaccagcaaccac

SEQ ID NO: 105957 - RNA, 23 nt, Human
cccacugagagcuccaauaccca

SEQ ID NO: 105958 - RNA, 19 nt, Human
cccugagccccucagcagg

SEQ ID NO: 105959 - RNA, 22 nt, Human
ccuuuaguuaggguguguagac

SEQ ID NO: 105960 - RNA, 20 nt, Human
cuaggaaggaagacaggaaa

SEQ ID NO: 105961 - RNA, 24 nt, Human
cuccaauacccagcacaaacaauu

SEQ ID NO: 105962 - RNA, 18 nt, Human
cuccccacugagagcucc

SEQ ID NO: 105963 - RNA, 23 nt, Human
cuggaggagcuguggcugcagca

SEQ ID NO: 105964 - RNA, 23 nt, Human
cuuguggauugugaagucaagug

SEQ ID NO: 105965 - RNA, 20 nt, Human
gacuguacucugugaucuug

SEQ ID NO: 105966 - RNA, 19 nt, Human
gagcaguggggagagacug

SEQ ID NO: 105967 - RNA, 20 nt, Human
gagcaguggggagagacugg

SEQ ID NO: 105968 - RNA, 25 nt, Human
gcccuggcacugcaagagcgggggc

SEQ ID NO: 105969 - RNA, 26 nt, Human
gcuagguacacgcuuacuucccaugg

SEQ ID NO: 105970 - RNA, 22 nt, Human
ggaagacaggaaaugcagcagu

SEQ ID NO: 105971 - RNA, 18 nt, Human
ggagcuguggcugcagca

SEQ ID NO: 105972 - RNA, 18 nt, Human
ggccguggcugucccuuu

SEQ ID NO: 105973 - RNA, 20 nt, Human
ggccuuuguagaguuccucu

SEQ ID NO: 105974 - RNA, 22 nt, Human
uacucugugaucuuggccuuug

SEQ ID NO: 105975 - RNA, 27 nt, Human
uaggaaggaagacaggaaaugcagcag

SEQ ID NO: 105976 - RNA, 19 nt, Human
ucccuuguggauugugaag

SEQ ID NO: 105977 - RNA, 18 nt, Human
uccuggccagaccuaggg

SEQ ID NO: 105978 - RNA, 23 nt, Human
ucuguagggccuccugcucugga

SEQ ID NO: 105979 - RNA, 28 nt, Human
ugagagcuccaauacccagcacaaacaa

SEQ ID NO: 105980 - RNA, 22 nt, Human
uggcacugcaagagcgggggca

SEQ ID NO: 105981 - RNA, 22 nt, Human
uggccagaccuagggcaaaauu

SEQ ID NO: 105982 - RNA, 18 nt, Human
uggcccaaagaccagcaa

SEQ ID NO: 105983 - RNA, 21 nt, Human
uuggccguggcugucccuuuc

SEQ ID NO: 105984 - RNA, 22 nt, Human
uuuuuuuuuuuuuuuugcuagg

SEQ ID NO: 105985 - RNA, 20 nt, Human
uuuuuuuuuuuuuuuuugcu

SEQ ID NO: 105986 - RNA, 20 nt, Human
uuuuuuuuuuuuuuuuuugg

SEQ ID NO: 105987 - RNA, 25 nt, Human
aaagcccuuccacauccaagaaccc

SEQ ID NO: 105988 - RNA, 22 nt, Human
aacauuguucaaagcccuucca

SEQ ID NO: 105989 - RNA, 18 nt, Human
aaccauccaucccucccc

SEQ ID NO: 105990 - RNA, 20 nt, Human
aaggaaggagaggaaugacg

SEQ ID NO: 105991 - RNA, 19 nt, Human
acagaggcugaagagugag

SEQ ID NO: 105992 - RNA, 24 nt, Human
acaucaggugcaggccugccuccc

SEQ ID NO: 105993 - RNA, 21 nt, Human
acccugcaaacucggacagac

SEQ ID NO: 105994 - RNA, 20 nt, Human
accucaccuggcucuccaac

SEQ ID NO: 105995 - RNA, 19 nt, Human
agagguggguuuuccuggg

SEQ ID NO: 105996 - RNA, 18 nt, Human
agauucugggcagcugac

SEQ ID NO: 105997 - RNA, 21 nt, Human
agcccagccaccuguauccaa

SEQ ID NO: 105998 - RNA, 20 nt, Human
agcccaggcagcccagcaca

SEQ ID NO: 105999 - RNA, 21 nt, Human
agccugacuuagagagaccuc

SEQ ID NO: 106000 - RNA, 21 nt, Human
auauggagccccugcaggcca

SEQ ID NO: 106001 - RNA, 22 nt, Human
augcagagaaccagccuggcuu

SEQ ID NO: 106002 - RNA, 25 nt, Human
caagcgauucugcaggugaaaccca

SEQ ID NO: 106003 - RNA, 18 nt, Human
cacugaggacagcccagg

SEQ ID NO: 106004 - RNA, 22 nt, Human
cagaagaaaacaggucauugaa

SEQ ID NO: 106005 - RNA, 21 nt, Human
cagacuccaaacuucaacccc

SEQ ID NO: 106006 - RNA, 26 nt, Human
cagcccagcacaagcgauucugcagg

SEQ ID NO: 106007 - RNA, 20 nt, Human
cagccugacuuagagagacc

SEQ ID NO: 106008 - RNA, 19 nt, Human
cagcucagcacccugcaaa

SEQ ID NO: 106009 - RNA, 26 nt, Human
caucuccaaaucuaaacauuguucaa

SEQ ID NO: 106010 - RNA, 20 nt, Human
cauggcucucagcucugcca

SEQ ID NO: 106011 - RNA, 19 nt, Human
cauggucaaacagaggcug

SEQ ID NO: 106012 - RNA, 21 nt, Human
ccacaucaggugcaggccugc

SEQ ID NO: 106013 - RNA, 19 nt, Human
ccaccuguauccaaccauc

SEQ ID NO: 106014 - RNA, 24 nt, Human
ccaucccuccccgguagggaagau

SEQ ID NO: 106015 - RNA, 20 nt, Human
cccagccugacuuagagaga

SEQ ID NO: 106016 - RNA, 19 nt, Human
ccccaggaggggaugaggg

SEQ ID NO: 106017 - RNA, 21 nt, Human
ccccaggaggggaugagggcu

SEQ ID NO: 106018 - RNA, 22 nt, Human
ccccugcuggaccauacagcuc

SEQ ID NO: 106019 - RNA, 18 nt, Human
cccgcuuccuccccuucc

SEQ ID NO: 106020 - RNA, 23 nt, Human
ccgaaccugugguuacagaagaa

SEQ ID NO: 106021 - RNA, 22 nt, Human
ccucaccuggcuguucucccug

SEQ ID NO: 106022 - RNA, 20 nt, Human
ccucccaccucaccuggcug

SEQ ID NO: 106023 - RNA, 21 nt, Human
ccuccccuuccggaagagccc

SEQ ID NO: 106024 - RNA, 24 nt, Human
ccucccgcuuccuccccuuccgga

SEQ ID NO: 106025 - RNA, 25 nt, Human
ccugcaaacucggacagacuccaaa

SEQ ID NO: 106026 - RNA, 20 nt, Human
ccuggaggcucaaaugugcu

SEQ ID NO: 106027 - RNA, 21 nt, Human
ccugugguuacagaagaaaac

SEQ ID NO: 106028 - RNA, 20 nt, Human
cuccaaccucccaccucacc

SEQ ID NO: 106029 - RNA, 19 nt, Human
cucccaccucaccuggcug

SEQ ID NO: 106030 - RNA, 19 nt, Human
cucucagcucugccagacc

SEQ ID NO: 106031 - RNA, 18 nt, Human
cugaagagugaggguuua

SEQ ID NO: 106032 - RNA, 22 nt, Human
cugcagagagguggguuuuccu

SEQ ID NO: 106033 - RNA, 22 nt, Human
cuggauucugugaggauucugc

SEQ ID NO: 106034 - RNA, 18 nt, Human
cuggccccaggaggggau

SEQ ID NO: 106035 - RNA, 19 nt, Human
cuguucucccuggcacuuu

SEQ ID NO: 106036 - RNA, 18 nt, Human
gacaaaagucaccccaga

SEQ ID NO: 106037 - RNA, 20 nt, Human
gaccauguccccagcagagc

SEQ ID NO: 106038 - RNA, 21 nt, Human
gagccauuuugcagcaaggaa

SEQ ID NO: 106039 - RNA, 19 nt, Human
gaggucaggucagggcuuu

SEQ ID NO: 106040 - RNA, 21 nt, Human
gaggucaggucagggcuuugc

SEQ ID NO: 106041 - RNA, 21 nt, Human
gcccuuccacauccaagaacc

SEQ ID NO: 106042 - RNA, 21 nt, Human
ggagaagccuggaggcucaaa

SEQ ID NO: 106043 - RNA, 19 nt, Human
ggagauucugggcagcuga

SEQ ID NO: 106044 - RNA, 23 nt, Human
gggcucaucuccaaaucuaaaca

SEQ ID NO: 106045 - RNA, 21 nt, Human
ggggacagcugggcaagcucu

SEQ ID NO: 106046 - RNA, 19 nt, Human
gucaccccagaaauagagu

SEQ ID NO: 106047 - RNA, 18 nt, Human
gucgagcagaagacuuac

SEQ ID NO: 106048 - RNA, 23 nt, Human
gugcaggccugccucccgcuucc

SEQ ID NO: 106049 - RNA, 23 nt, Human
uacagcucagcacccugcaaacu

SEQ ID NO: 106050 - RNA, 21 nt, Human
uccaagaacccuccccuuugc

SEQ ID NO: 106051 - RNA, 22 nt, Human
uccaagaacccuccccuuugcc

SEQ ID NO: 106052 - RNA, 19 nt, Human
uccacaucaggugcaggcc

SEQ ID NO: 106053 - RNA, 19 nt, Human
uccacauccaagaacccuc

SEQ ID NO: 106054 - RNA, 21 nt, Human
uccccgguagggaagaucugc

SEQ ID NO: 106055 - RNA, 21 nt, Human
uccccuuugcccugggagcca

SEQ ID NO: 106056 - RNA, 19 nt, Human
uccggaagagcccuuauua

SEQ ID NO: 106057 - RNA, 22 nt, Human
uccugggggccggcuggugcag

SEQ ID NO: 106058 - RNA, 22 nt, Human
ucuccaaccucccaccucaccu

SEQ ID NO: 106059 - RNA, 23 nt, Human
ucucccuggcacuuugggcucau

SEQ ID NO: 106060 - RNA, 19 nt, Human
ugaaacccaagccuggccc

SEQ ID NO: 106061 - RNA, 21 nt, Human
ugacuuagagagaccucaccu

SEQ ID NO: 106062 - RNA, 20 nt, Human
ugagaggcauuuggcuuccc

SEQ ID NO: 106063 - RNA, 22 nt, Human
ugagaggcauuuggcuucccgg

SEQ ID NO: 106064 - RNA, 24 nt, Human
ugcagcaaggaaggagaggaauga

SEQ ID NO: 106065 - RNA, 23 nt, Human
ugcaggugaaacccaagccuggc

SEQ ID NO: 106066 - RNA, 24 nt, Human
uggaccauacagcucagcacccug

SEQ ID NO: 106067 - RNA, 23 nt, Human
uggagccccugcaggccauggcu

SEQ ID NO: 106068 - RNA, 20 nt, Human
uggcagguacagaauagagc

SEQ ID NO: 106069 - RNA, 24 nt, Human
uggcuuggagauucugggcagcug

SEQ ID NO: 106070 - RNA, 20 nt, Human
uggggcuguccagcucuggc

SEQ ID NO: 106071 - RNA, 18 nt, Human
uucauggucaaacagagg

SEQ ID NO: 106072 - RNA, 22 nt, Human
uuccagauggauggaauagccc

SEQ ID NO: 106073 - RNA, 23 nt, Human
uuccuggggcuguccagcucugg

SEQ ID NO: 106074 - RNA, 21 nt, Human
uugcaccauggaccauguccc

SEQ ID NO: 106075 - RNA, 20 nt, Human
uugggcucaucuccaaaucu

SEQ ID NO: 106076 - RNA, 21 nt, Human
aaaaacuagugagacaagauu

SEQ ID NO: 106077 - RNA, 19 nt, Human
aaauacucuugacauuuuu

SEQ ID NO: 106078 - RNA, 24 nt, Human
aacaauggagacauucuugguuau

SEQ ID NO: 106079 - RNA, 22 nt, Human
aaccucgaaaugccaaaaacaa

SEQ ID NO: 106080 - RNA, 18 nt, Human
aagcagccuccuccugcc

SEQ ID NO: 106081 - RNA, 18 nt, Human
aaugcaugguaagaaaug

SEQ ID NO: 106082 - RNA, 22 nt, Human
acaaugcacaggauacccccau

SEQ ID NO: 106083 - RNA, 24 nt, Human
acccaguuuaugguguacuaagac

SEQ ID NO: 106084 - RNA, 26 nt, Human
acccucaccagacaccaaauuugcug

SEQ ID NO: 106085 - RNA, 19 nt, Human
accuuggaccucccaaccu

SEQ ID NO: 106086 - RNA, 19 nt, Human
agaccccacagagauagcu

SEQ ID NO: 106087 - RNA, 19 nt, Human
agauagaagguggggccuu

SEQ ID NO: 106088 - RNA, 27 nt, Human
agcuagaaggcacccuuucuccccugg

SEQ ID NO: 106089 - RNA, 23 nt, Human
aggaagcagccuccuccugcccu

SEQ ID NO: 106090 - RNA, 20 nt, Human
agguggggccuuggaaaggu

SEQ ID NO: 106091 - RNA, 18 nt, Human
aguaaaccucgaaaugcc

SEQ ID NO: 106092 - RNA, 23 nt, Human
auaaguaaaccucgaaaugccaa

SEQ ID NO: 106093 - RNA, 22 nt, Human
caaaauguccguagugcuaagg

SEQ ID NO: 106094 - RNA, 20 nt, Human
caaccuccaaaacugagaag

SEQ ID NO: 106095 - RNA, 21 nt, Human
cacagcuagaaggcacccuuu

SEQ ID NO: 106096 - RNA, 23 nt, Human
cacauauuuauccagcccaaaau

SEQ ID NO: 106097 - RNA, 18 nt, Human
cacccuuugaggaagagg

SEQ ID NO: 106098 - RNA, 23 nt, Human
cagacaccaaauuugcuggugcc

SEQ ID NO: 106099 - RNA, 18 nt, Human
caggaaaaacuagugaga

SEQ ID NO: 106100 - RNA, 23 nt, Human
caguaaagaacgagaaaugcaug

SEQ ID NO: 106101 - RNA, 24 nt, Human
caguuuuguuucaacaacuaaaag

SEQ ID NO: 106102 - RNA, 19 nt, Human
cauauuuauccagcccaaa

SEQ ID NO: 106103 - RNA, 20 nt, Human
caugggggcucugcucucau

SEQ ID NO: 106104 - RNA, 21 nt, Human
ccaaauuugcuggugccuuga

SEQ ID NO: 106105 - RNA, 19 nt, Human
ccccgcgcggcuccagcgc

SEQ ID NO: 106106 - RNA, 18 nt, Human
ccgcuucgccgccgcugg

SEQ ID NO: 106107 - RNA, 18 nt, Human
ccuccaaaacugagaagu

SEQ ID NO: 106108 - RNA, 21 nt, Human
ccuccuccugcccugacacaa

SEQ ID NO: 106109 - RNA, 21 nt, Human
ccucgaaaugccaaaaacaaa

SEQ ID NO: 106110 - RNA, 28 nt, Human
cgcggcggucgcagagacggccucuccc

SEQ ID NO: 106111 - RNA, 20 nt, Human
cggcggucgcagagacggcc

SEQ ID NO: 106112 - RNA, 22 nt, Human
cggucgggagcgggcgcggcgg

SEQ ID NO: 106113 - RNA, 22 nt, Human
cgugcgggcggagacgcgcggg

SEQ ID NO: 106114 - RNA, 19 nt, Human
cuccagcgcagaccccaga

SEQ ID NO: 106115 - RNA, 22 nt, Human
cugugguccaaauguguccucc

SEQ ID NO: 106116 - RNA, 21 nt, Human
cuugaccuuggaccucccaac

SEQ ID NO: 106117 - RNA, 21 nt, Human
cuuugaggaagaggacccuca

SEQ ID NO: 106118 - RNA, 21 nt, Human
gagaucuguagugauaacuga

SEQ ID NO: 106119 - RNA, 18 nt, Human
gaggacacagcuagaagg

SEQ ID NO: 106120 - RNA, 18 nt, Human
gcacaggaaaaacuagug

SEQ ID NO: 106121 - RNA, 20 nt, Human
gcggacccggacggucggga

SEQ ID NO: 106122 - RNA, 20 nt, Human
ggccgggcuggccgcggacc

SEQ ID NO: 106123 - RNA, 18 nt, Human
ggcggagacgcgcggggc

SEQ ID NO: 106124 - RNA, 19 nt, Human
ggcugguggccgggcuggc

SEQ ID NO: 106125 - RNA, 27 nt, Human
uaaagcaauguuucucaaccaggggcc

SEQ ID NO: 106126 - RNA, 19 nt, Human
uaaauguucauuuaucggu

SEQ ID NO: 106127 - RNA, 22 nt, Human
uaacagaaaguacguucuuacu

SEQ ID NO: 106128 - RNA, 22 nt, Human
uaagaaauggguaacgaugggg

SEQ ID NO: 106129 - RNA, 21 nt, Human
uacaaugcacaggauaccccc

SEQ ID NO: 106130 - RNA, 19 nt, Human
uagcuugauaacagaaagu

SEQ ID NO: 106131 - RNA, 25 nt, Human
uagcuugauaacagaaaguacguuc

SEQ ID NO: 106132 - RNA, 24 nt, Human
uaggaagcagccuccuccugcccu

SEQ ID NO: 106133 - RNA, 19 nt, Human
ucaccagacaccaaauuug

SEQ ID NO: 106134 - RNA, 22 nt, Human
ucaguggugaugaucacguuaa

SEQ ID NO: 106135 - RNA, 23 nt, Human
ucauauguugaaaccuauuccca

SEQ ID NO: 106136 - RNA, 18 nt, Human
ucuccgcuucgccgccgc

SEQ ID NO: 106137 - RNA, 24 nt, Human
ugaagaagcaagguaugucauugg

SEQ ID NO: 106138 - RNA, 18 nt, Human
ugaaugacuuuucauauu

SEQ ID NO: 106139 - RNA, 22 nt, Human
ugaccuuggaccucccaaccuc

SEQ ID NO: 106140 - RNA, 21 nt, Human
ugagacaagauucaaacaguc

SEQ ID NO: 106141 - RNA, 19 nt, Human
ugaggacacagcuagaagg

SEQ ID NO: 106142 - RNA, 24 nt, Human
ugccuugaccuuggaccucccaac

SEQ ID NO: 106143 - RNA, 24 nt, Human
ugguccaaauguguccucccccaa

SEQ ID NO: 106144 - RNA, 20 nt, Human
ugugaaucaucugucagugg

SEQ ID NO: 106145 - RNA, 18 nt, Human
uugaggaagaggacccuc

SEQ ID NO: 106146 - RNA, 20 nt, Human
uugcacaggaaaaacuagug

SEQ ID NO: 106147 - RNA, 18 nt, Human
uugcuggugccuugaccu

SEQ ID NO: 106148 - RNA, 18 nt, Human
uuguuucaacaacuaaaa

SEQ ID NO: 106149 - RNA, 26 nt, Human
uuuagacccaguaaagaacgagaaau

SEQ ID NO: 106150 - RNA, 26 nt, Human
uuugcaauucuguccauuuuauuuuu

SEQ ID NO: 106151 - RNA, 23 nt, Human
uuuuuuuuuuuuuuuuugcaauu

SEQ ID NO: 106152 - RNA, 20 nt, Human
uuuuuuuuuuuuuuuuuugg

SEQ ID NO: 106153 - RNA, 21 nt, Human
aaagccauccuggccccgccc

SEQ ID NO: 106154 - RNA, 19 nt, Human
aacacagaaguaccccagg

SEQ ID NO: 106155 - RNA, 25 nt, Human
aagcagcuccacacucggucucccc

SEQ ID NO: 106156 - RNA, 26 nt, Human
aagcagcuccacacucggucucccca

SEQ ID NO: 106157 - RNA, 24 nt, Human
acagaacaggaaggaaaauuuggc

SEQ ID NO: 106158 - RNA, 25 nt, Human
acagaacaggaaggaaaauuuggca

SEQ ID NO: 106159 - RNA, 25 nt, Human
accagcuccccacagcuacuguagc

SEQ ID NO: 106160 - RNA, 23 nt, Human
acgcagagcccaaccccaucccc

SEQ ID NO: 106161 - RNA, 19 nt, Human
acuccguggcgcggccccg

SEQ ID NO: 106162 - RNA, 24 nt, Human
agagcccaaccccauccccacccc

SEQ ID NO: 106163 - RNA, 21 nt, Human
agcaggaaguccuucuucccg

SEQ ID NO: 106164 - RNA, 21 nt, Human
agcuacuguagcaggaagucc

SEQ ID NO: 106165 - RNA, 21 nt, Human
aggagagcucggcucggggac

SEQ ID NO: 106166 - RNA, 21 nt, Human
aggaugcccccaccagcuccc

SEQ ID NO: 106167 - RNA, 21 nt, Human
aggccucccucaccucuggag

SEQ ID NO: 106168 - RNA, 21 nt, Human
agggagcgccgggcuguggac

SEQ ID NO: 106169 - RNA, 22 nt, Human
agguggagguccucaaggaugc

SEQ ID NO: 106170 - RNA, 22 nt, Human
aguccuucuucccgaacccaga

SEQ ID NO: 106171 - RNA, 19 nt, Human
caaacguguggccccacag

SEQ ID NO: 106172 - RNA, 20 nt, Human
caacuggaagcagcuccaca

SEQ ID NO: 106173 - RNA, 21 nt, Human
caacuggaagcagcuccacac

SEQ ID NO: 106174 - RNA, 20 nt, Human
caccucugcuccaagccacu

SEQ ID NO: 106175 - RNA, 23 nt, Human
cacggcagccccaggccacgcag

SEQ ID NO: 106176 - RNA, 25 nt, Human
cacuagccccccguggagcccuggc

SEQ ID NO: 106177 - RNA, 22 nt, Human
cacucagcaggaggcuuccuuc

SEQ ID NO: 106178 - RNA, 20 nt, Human
cagacacagaacaggaagga

SEQ ID NO: 106179 - RNA, 24 nt, Human
cagggagaagccagcccggcccca

SEQ ID NO: 106180 - RNA, 19 nt, Human
caggggcugaagccacuag

SEQ ID NO: 106181 - RNA, 18 nt, Human
caugggccuguguggaaa

SEQ ID NO: 106182 - RNA, 19 nt, Human
cauucgggaccuucccagc

SEQ ID NO: 106183 - RNA, 20 nt, Human
ccaaccccauccccaccccu

SEQ ID NO: 106184 - RNA, 24 nt, Human
cccaaccccauccccaccccuggc

SEQ ID NO: 106185 - RNA, 24 nt, Human
cccacagaguccagggagaagcca

SEQ ID NO: 106186 - RNA, 19 nt, Human
ccccacagaguccagggag

SEQ ID NO: 106187 - RNA, 24 nt, Human
ccccaccagcuccccacagcuacu

SEQ ID NO: 106188 - RNA, 19 nt, Human
ccccagaggccgugucccc

SEQ ID NO: 106189 - RNA, 19 nt, Human
ccccaggccacgcaggcuc

SEQ ID NO: 106190 - RNA, 24 nt, Human
ccccaggggcugaagccacuagcc

SEQ ID NO: 106191 - RNA, 23 nt, Human
ccccauccccaccccuggcugga

SEQ ID NO: 106192 - RNA, 23 nt, Human
cccccguggagcccuggccaccu

SEQ ID NO: 106193 - RNA, 19 nt, Human
ccccgccgcuucgaggccc

SEQ ID NO: 106194 - RNA, 19 nt, Human
ccccucuuggcccuuggaa

SEQ ID NO: 106195 - RNA, 19 nt, Human
ccccuggggacaauggggg

SEQ ID NO: 106196 - RNA, 18 nt, Human
cccgccucagccggcugg

SEQ ID NO: 106197 - RNA, 21 nt, Human
cccggcccugcccgccucagc

SEQ ID NO: 106198 - RNA, 22 nt, Human
cccgugcgcgcccaacuucaug

SEQ ID NO: 106199 - RNA, 23 nt, Human
cccuggcccuacgccuggaaggc

SEQ ID NO: 106200 - RNA, 19 nt, Human
ccuccugacgagacccugg

SEQ ID NO: 106201 - RNA, 20 nt, Human
ccugacgagacccuggccca

SEQ ID NO: 106202 - RNA, 23 nt, Human
ccugacgagacccuggcccagga

SEQ ID NO: 106203 - RNA, 19 nt, Human
ccugcaggggugaggcugu

SEQ ID NO: 106204 - RNA, 21 nt, Human
ccuggccaccugccagagccc

SEQ ID NO: 106205 - RNA, 22 nt, Human
ccuggccaccugccagagcccu

SEQ ID NO: 106206 - RNA, 18 nt, Human
ccuggccccgccccucuu

SEQ ID NO: 106207 - RNA, 21 nt, Human
ccuggccccgccccucuuggc

SEQ ID NO: 106208 - RNA, 19 nt, Human
ccuggcccuacgccuggaa

SEQ ID NO: 106209 - RNA, 21 nt, Human
cgcagagcccaaccccauccc

SEQ ID NO: 106210 - RNA, 18 nt, Human
cgcggccccgcccggccc

SEQ ID NO: 106211 - RNA, 18 nt, Human
cggcagggagcgccgggc

SEQ ID NO: 106212 - RNA, 21 nt, Human
cggcagggagcgccgggcugu

SEQ ID NO: 106213 - RNA, 24 nt, Human
cggcauuucuggggcacucggcau

SEQ ID NO: 106214 - RNA, 21 nt, Human
cggccccgcccggcccugccc

SEQ ID NO: 106215 - RNA, 18 nt, Human
cucaaggaugcccccacc

SEQ ID NO: 106216 - RNA, 22 nt, Human
cucccucaccucuggauaccgc

SEQ ID NO: 106217 - RNA, 19 nt, Human
cugaagccacuagcccccc

SEQ ID NO: 106218 - RNA, 21 nt, Human
cugcgcagggggagagcugga

SEQ ID NO: 106219 - RNA, 20 nt, Human
gaacccagagcccagggcgg

SEQ ID NO: 106220 - RNA, 19 nt, Human
gacucagugggacgcagag

SEQ ID NO: 106221 - RNA, 21 nt, Human
gagcccuggcccuacgccugg

SEQ ID NO: 106222 - RNA, 19 nt, Human
gaguccagggagaagccag

SEQ ID NO: 106223 - RNA, 22 nt, Human
gccauccuggccccgccccucu

SEQ ID NO: 106224 - RNA, 23 nt, Human
gccccaggccacgcaggcucccg

SEQ ID NO: 106225 - RNA, 19 nt, Human
gccuggaaacauuucaggc

SEQ ID NO: 106226 - RNA, 19 nt, Human
gcggcggcgcggcagggag

SEQ ID NO: 106227 - RNA, 21 nt, Human
gcuggccccgugcacggcagc

SEQ ID NO: 106228 - RNA, 22 nt, Human
gcugugcccaucccaaggggga

SEQ ID NO: 106229 - RNA, 21 nt, Human
ggagggcaugggccugugugg

SEQ ID NO: 106230 - RNA, 18 nt, Human
ggauggggucugggggca

SEQ ID NO: 106231 - RNA, 20 nt, Human
ggccccgccccucuuggccc

SEQ ID NO: 106232 - RNA, 22 nt, Human
ggccuguguggaaaccccaggg

SEQ ID NO: 106233 - RNA, 24 nt, Human
gggagaagccagcccggccccagg

SEQ ID NO: 106234 - RNA, 23 nt, Human
gggcacucggcaugccggguucc

SEQ ID NO: 106235 - RNA, 20 nt, Human
ggggcgcggugcggcggcgg

SEQ ID NO: 106236 - RNA, 21 nt, Human
gguagaaggcggcgaccccca

SEQ ID NO: 106237 - RNA, 24 nt, Human
gugaggcugugcugagcucugccu

SEQ ID NO: 106238 - RNA, 18 nt, Human
gugcggcggcggcgcggc

SEQ ID NO: 106239 - RNA, 24 nt, Human
guggggcgcggugcggcggcggcg

SEQ ID NO: 106240 - RNA, 21 nt, Human
ucaauuauucauucugcucuc

SEQ ID NO: 106241 - RNA, 23 nt, Human
ucacucacaggcaggggaaaagc

SEQ ID NO: 106242 - RNA, 18 nt, Human
uccacacucggucucccc

SEQ ID NO: 106243 - RNA, 23 nt, Human
uccacacucggucuccccagagg

SEQ ID NO: 106244 - RNA, 21 nt, Human
uccccagaggccguguccccg

SEQ ID NO: 106245 - RNA, 19 nt, Human
uccccgccgcuucgaggcc

SEQ ID NO: 106246 - RNA, 22 nt, Human
uccccgccgcuucgaggcccgu

SEQ ID NO: 106247 - RNA, 18 nt, Human
ucccgcgccucgcgggcc

SEQ ID NO: 106248 - RNA, 20 nt, Human
ucccugacucccaugaggcc

SEQ ID NO: 106249 - RNA, 21 nt, Human
uccugggggaaccagggccca

SEQ ID NO: 106250 - RNA, 22 nt, Human
ucuccagacucgcuggggcuuc

SEQ ID NO: 106251 - RNA, 24 nt, Human
ugcaggggugaggcugugcugagc

SEQ ID NO: 106252 - RNA, 21 nt, Human
ugccaggacggagggcauggg

SEQ ID NO: 106253 - RNA, 25 nt, Human
ugccaggacggagggcaugggccug

SEQ ID NO: 106254 - RNA, 19 nt, Human
ugcccccaccagcucccca

SEQ ID NO: 106255 - RNA, 21 nt, Human
uggaaggcagaguccuggucu

SEQ ID NO: 106256 - RNA, 22 nt, Human
uggagcccuggccaccugccag

SEQ ID NO: 106257 - RNA, 18 nt, Human
uggauggggucugggggc

SEQ ID NO: 106258 - RNA, 22 nt, Human
uggcaaacguguggccccacag

SEQ ID NO: 106259 - RNA, 23 nt, Human
uggccccgugcacggcagcccca

SEQ ID NO: 106260 - RNA, 22 nt, Human
uggcuggauggggucugggggc

SEQ ID NO: 106261 - RNA, 24 nt, Human
ugggccuguguggaaaccccaggg

SEQ ID NO: 106262 - RNA, 22 nt, Human
uggggcaggcugugcccauccc

SEQ ID NO: 106263 - RNA, 18 nt, Human
uuccugacugucuccucc

SEQ ID NO: 106264 - RNA, 20 nt, Human
uucgaggcccgugcgcgccc

SEQ ID NO: 106265 - RNA, 18 nt, Human
aaagugcugggauuacag

SEQ ID NO: 106266 - RNA, 19 nt, Human
aaagugcugggauuacagg

SEQ ID NO: 106267 - RNA, 19 nt, Human
aaagugcugggauuacagg

SEQ ID NO: 106268 - RNA, 21 nt, Human
aaagugcugggauuacaggug

SEQ ID NO: 106269 - RNA, 22 nt, Human
aaagugcugggauuacaggugu

SEQ ID NO: 106270 - RNA, 23 nt, Human
aaagugcugggauuacaggugug

SEQ ID NO: 106271 - RNA, 24 nt, Human
aaagugcugggauuacagguguga

SEQ ID NO: 106272 - RNA, 25 nt, Human
aaauacaacuggaauucuccagcac

SEQ ID NO: 106273 - RNA, 24 nt, Human
aaaucagucuucaaauacaacugg

SEQ ID NO: 106274 - RNA, 18 nt, Human
aagugcugggauuacagg

SEQ ID NO: 106275 - RNA, 19 nt, Human
aagugcugggauuacaggu

SEQ ID NO: 106276 - RNA, 26 nt, Human
aagugcugggauuacaggugugagcc

SEQ ID NO: 106277 - RNA, 18 nt, Human
agaaaaguuuuaaaauca

SEQ ID NO: 106278 - RNA, 23 nt, Human
agacaaaacgagggcagacgcag

SEQ ID NO: 106279 - RNA, 23 nt, Human
aggugugagccaccgugcccggc

SEQ ID NO: 106280 - RNA, 21 nt, Human
caaaacgagggcagacgcagc

SEQ ID NO: 106281 - RNA, 26 nt, Human
cagcagccucagccuagcagcuucug

SEQ ID NO: 106282 - RNA, 23 nt, Human
cccgcgcgggaccgcgggcagcc

SEQ ID NO: 106283 - RNA, 19 nt, Human
cgagggcagacgcagcaga

SEQ ID NO: 106284 - RNA, 20 nt, Human
cgccgggacagcagccucag

SEQ ID NO: 106285 - RNA, 18 nt, Human
gauuacaggugugagcca

SEQ ID NO: 106286 - RNA, 21 nt, Human
gauuacaggugugagccaccg

SEQ ID NO: 106287 - RNA, 24 nt, Human
gauuacaggugugagccaccgugc

SEQ ID NO: 106288 - RNA, 21 nt, Human
gcuccgcgccacagcucccgc

SEQ ID NO: 106289 - RNA, 23 nt, Human
uacaggugugagccaccgugccc

SEQ ID NO: 106290 - RNA, 23 nt, Human
uagauuuuucacuaguccaguuc

SEQ ID NO: 106291 - RNA, 20 nt, Human
uaucaaguagucagcuuuuu

SEQ ID NO: 106292 - RNA, 18 nt, Human
ucagucccuugggaggcu

SEQ ID NO: 106293 - RNA, 18 nt, Human
ucagugaguacaggaaag

SEQ ID NO: 106294 - RNA, 22 nt, Human
ugaguacaggaaaguuuacaua

SEQ ID NO: 106295 - RNA, 21 nt, Human
ugcagaaaaguuuuaaaauca

SEQ ID NO: 106296 - RNA, 19 nt, Human
ugccaggauacaaauacua

SEQ ID NO: 106297 - RNA, 24 nt, Human
ugcugggauuacaggugugagcca

SEQ ID NO: 106298 - RNA, 18 nt, Human
ugggauuacaggugugag

SEQ ID NO: 106299 - RNA, 21 nt, Human
ugggauuacaggugugagcca

SEQ ID NO: 106300 - RNA, 22 nt, Human
ugggauuacaggugugagccac

SEQ ID NO: 106301 - RNA, 23 nt, Human
ugggauuacaggugugagccacc

SEQ ID NO: 106302 - RNA, 23 nt, Human
ugggauuacaggugugagccacc

SEQ ID NO: 106303 - RNA, 24 nt, Human
ugggauuacaggugugagccaccg

SEQ ID NO: 106304 - RNA, 24 nt, Human
uguguguuaacuaaauguauacuu

SEQ ID NO: 106305 - RNA, 19 nt, Human
uuauauuaaagauuagcug

SEQ ID NO: 106306 - RNA, 21 nt, Human
uuucauaauuuuauaggugcc

SEQ ID NO: 106307 - RNA, 24 nt, Human
uuugccaggauacaaauacuagau

SEQ ID NO: 106308 - RNA, 23 nt, Human
aaaauaaaaaguugaauugcaga

SEQ ID NO: 106309 - RNA, 18 nt, Human
aaagugcugagauucuac

SEQ ID NO: 106310 - RNA, 20 nt, Human
aaagugcugagauucuacua

SEQ ID NO: 106311 - RNA, 24 nt, Human
aacacgacugacagccagaaggga

SEQ ID NO: 106312 - RNA, 26 nt, Human
aaccguaagcaacacgacugacagcc

SEQ ID NO: 106313 - RNA, 20 nt, Human
aagcaaaaagcaaauguuga

SEQ ID NO: 106314 - RNA, 29 nt, Human
aagcaaaaagcaaauguugaagggacccc

SEQ ID NO: 106315 - RNA, 21 nt, Human
agaaaccguaagcaacacgac

SEQ ID NO: 106316 - RNA, 18 nt, Human
caaagugcugagauucua

SEQ ID NO: 106317 - RNA, 21 nt, Human
caaaucucgccaagccaaagg

SEQ ID NO: 106318 - RNA, 19 nt, Human
cacaagcaaaaagcaaaug

SEQ ID NO: 106319 - RNA, 22 nt, Human
cacccccaaaucucgccaagcc

SEQ ID NO: 106320 - RNA, 18 nt, Human
caucaagcuguuucucuc

SEQ ID NO: 106321 - RNA, 22 nt, Human
ccaagccaaaggccuugcccau

SEQ ID NO: 106322 - RNA, 22 nt, Human
ccccaaaucucgccaagccaaa

SEQ ID NO: 106323 - RNA, 19 nt, Human
cccgggccugcgccugcgg

SEQ ID NO: 106324 - RNA, 22 nt, Human
ccgaugguacggaugugccaag

SEQ ID NO: 106325 - RNA, 23 nt, Human
ccuaaaguaacaaagaaaccgua

SEQ ID NO: 106326 - RNA, 20 nt, Human
cuacuaccuaaaguaacaaa

SEQ ID NO: 106327 - RNA, 18 nt, Human
cucggcugucgcccgggc

SEQ ID NO: 106328 - RNA, 20 nt, Human
cucggcugucgcccgggccu

SEQ ID NO: 106329 - RNA, 19 nt, Human
gcacccccaaaucucgcca

SEQ ID NO: 106330 - RNA, 22 nt, Human
gguggugaggagccauggggag

SEQ ID NO: 106331 - RNA, 25 nt, Human
uaaaguaacaaagaaaccguaagca

SEQ ID NO: 106332 - RNA, 24 nt, Human
uaagagguuuuuaguuuuuguuuu

SEQ ID NO: 106333 - RNA, 22 nt, Human
uaccuaaaguaacaaagaaacc

SEQ ID NO: 106334 - RNA, 21 nt, Human
uagcacccccaaaucucgcca

SEQ ID NO: 106335 - RNA, 18 nt, Human
uccaggcagugggcuaau

SEQ ID NO: 106336 - RNA, 19 nt, Human
ugacagccagaagggaaca

SEQ ID NO: 106337 - RNA, 23 nt, Human
ugagaauaugaaacaaagugcug

SEQ ID NO: 106338 - RNA, 22 nt, Human
ugaguuuuccacauguacagaa

SEQ ID NO: 106339 - RNA, 23 nt, Human
ugggcaaaaugacuacucagugg

SEQ ID NO: 106340 - RNA, 23 nt, Human
uguccuggauuagcacccccaaa

SEQ ID NO: 106341 - RNA, 18 nt, Human
uuccacauguacagaacc

SEQ ID NO: 106342 - RNA, 18 nt, Human
uugaauugcagaaaagcu

SEQ ID NO: 106343 - RNA, 24 nt, Human
aacucucacuucaacuggcagggg

SEQ ID NO: 106344 - RNA, 21 nt, Human
accauggccacaaacugccag

SEQ ID NO: 106345 - RNA, 22 nt, Human
acccaaaggggcauuugguggg

SEQ ID NO: 106346 - RNA, 19 nt, Human
accccagccacuuccugga

SEQ ID NO: 106347 - RNA, 24 nt, Human
caacccuccagucuucaaggaaag

SEQ ID NO: 106348 - RNA, 20 nt, Human
cacagcccgguuuggaccau

SEQ ID NO: 106349 - RNA, 24 nt, Human
cagaaacgaaauaagaggcccaga

SEQ ID NO: 106350 - RNA, 23 nt, Human
caucgauaaaucgccgcagauca

SEQ ID NO: 106351 - RNA, 20 nt, Human
ccacaggaagaggcggucca

SEQ ID NO: 106352 - RNA, 24 nt, Human
ccaccacacuaaggaugacugaga

SEQ ID NO: 106353 - RNA, 18 nt, Human
ccggaagcagggccacag

SEQ ID NO: 106354 - RNA, 19 nt, Human
ccucccguagcuccggaag

SEQ ID NO: 106355 - RNA, 22 nt, Human
cucccguagcuccggaagcagg

SEQ ID NO: 106356 - RNA, 19 nt, Human
cuggcagggggccuggguc

SEQ ID NO: 106357 - RNA, 24 nt, Human
gaagaacagugagggggcuccggc

SEQ ID NO: 106358 - RNA, 21 nt, Human
gaggcagagaaggauagggcu

SEQ ID NO: 106359 - RNA, 21 nt, Human
gcguccaggaagaugacuagg

SEQ ID NO: 106360 - RNA, 21 nt, Human
gggcauuuggugggugugggg

SEQ ID NO: 106361 - RNA, 18 nt, Human
ggggucuggagggggcaa

SEQ ID NO: 106362 - RNA, 18 nt, Human
ggguguggggugagcggu

SEQ ID NO: 106363 - RNA, 20 nt, Human
ggucuggagggggcaagugg

SEQ ID NO: 106364 - RNA, 23 nt, Human
uaaaucgccgcagaucaggggca

SEQ ID NO: 106365 - RNA, 19 nt, Human
uaccauggccacaaacugc

SEQ ID NO: 106366 - RNA, 19 nt, Human
ucaaggaaaggggucugga

SEQ ID NO: 106367 - RNA, 22 nt, Human
ucaaggaaaggggucuggaggg

SEQ ID NO: 106368 - RNA, 18 nt, Human
uccacuaccauggccaca

SEQ ID NO: 106369 - RNA, 22 nt, Human
uccaggaagaugacuagggucc

SEQ ID NO: 106370 - RNA, 18 nt, Human
ucgugguccuccuguucc

SEQ ID NO: 106371 - RNA, 21 nt, Human
ugaaauauucaucuguucccc

SEQ ID NO: 106372 - RNA, 22 nt, Human
ugaaauauucaucuguuccccg

SEQ ID NO: 106373 - RNA, 18 nt, Human
ugagggggcuccggcauc

SEQ ID NO: 106374 - RNA, 19 nt, Human
ugccaguccuccuucagcg

SEQ ID NO: 106375 - RNA, 25 nt, Human
ugccaguccuccuucagcgcaucgu

SEQ ID NO: 106376 - RNA, 21 nt, Human
uggggugagcgguggugcagg

SEQ ID NO: 106377 - RNA, 21 nt, Human
ugggucucaacccuccagucu

SEQ ID NO: 106378 - RNA, 19 nt, Human
ugguggguguggggugagc

SEQ ID NO: 106379 - RNA, 21 nt, Human
ugucgagcgauguagcugaua

SEQ ID NO: 106380 - RNA, 21 nt, Human
aagccgcgcccgccuggagcu

SEQ ID NO: 106381 - RNA, 19 nt, Human
acucguccauccuccaccc

SEQ ID NO: 106382 - RNA, 19 nt, Human
agagcagccaaaacaaagc

SEQ ID NO: 106383 - RNA, 23 nt, Human
agccuugcuccccuccucaacac

SEQ ID NO: 106384 - RNA, 20 nt, Human
agcuaccauugugucaggcc

SEQ ID NO: 106385 - RNA, 21 nt, Human
agcuccugcccuuccaccccu

SEQ ID NO: 106386 - RNA, 20 nt, Human
aggauggaucugugggggca

SEQ ID NO: 106387 - RNA, 18 nt, Human
auggagaugaggaagggc

SEQ ID NO: 106388 - RNA, 28 nt, Human
caaaacaaagcaguugguccagccucca

SEQ ID NO: 106389 - RNA, 21 nt, Human
caaggggcugugggacugagc

SEQ ID NO: 106390 - RNA, 24 nt, Human
cagcagacaauccuguccccuucc

SEQ ID NO: 106391 - RNA, 18 nt, Human
cagcgccccucuuccugg

SEQ ID NO: 106392 - RNA, 20 nt, Human
caggccucucucuuccccuc

SEQ ID NO: 106393 - RNA, 20 nt, Human
caggugucaggucacaccca

SEQ ID NO: 106394 - RNA, 21 nt, Human
ccccucuuccugguagcucac

SEQ ID NO: 106395 - RNA, 21 nt, Human
ccuccacccaacacuacugug

SEQ ID NO: 106396 - RNA, 18 nt, Human
ccuccagguuggagcugc

SEQ ID NO: 106397 - RNA, 19 nt, Human
ccuccucaacacuauugcc

SEQ ID NO: 106398 - RNA, 18 nt, Human
ccuguccccuuccuggcc

SEQ ID NO: 106399 - RNA, 18 nt, Human
ccuuguccuauaccccuc

SEQ ID NO: 106400 - RNA, 21 nt, Human
cgaggagaaaccagcuucuug

SEQ ID NO: 106401 - RNA, 22 nt, Human
cgccccucuuccugguagcuca

SEQ ID NO: 106402 - RNA, 19 nt, Human
cuacugugcagcagagggu

SEQ ID NO: 106403 - RNA, 20 nt, Human
cuauaccccucuucucccau

SEQ ID NO: 106404 - RNA, 18 nt, Human
cucguccauccuccaccc

SEQ ID NO: 106405 - RNA, 19 nt, Human
cucugccaucucugucuuc

SEQ ID NO: 106406 - RNA, 18 nt, Human
cugaagccgcgcccgccu

SEQ ID NO: 106407 - RNA, 18 nt, Human
cugaagccgcgcccgccu

SEQ ID NO: 106408 - RNA, 23 nt, Human
cuggagcaggucucuggaucccu

SEQ ID NO: 106409 - RNA, 25 nt, Human
cuggagcaggucucuggaucccuua

SEQ ID NO: 106410 - RNA, 22 nt, Human
cuuccuggccccuugcccguca

SEQ ID NO: 106411 - RNA, 20 nt, Human
cuucuugccuauccugguau

SEQ ID NO: 106412 - RNA, 22 nt, Human
cuugcuccccuccucaacacua

SEQ ID NO: 106413 - RNA, 18 nt, Human
cuuuuccggcugcucuuc

SEQ ID NO: 106414 - RNA, 21 nt, Human
gagcaggcggaggcuuuuccg

SEQ ID NO: 106415 - RNA, 25 nt, Human
gagcugcuguguguggauggaggcc

SEQ ID NO: 106416 - RNA, 23 nt, Human
gaggguggcagggugaaagagca

SEQ ID NO: 106417 - RNA, 19 nt, Human
gcccacccaguccagcugc

SEQ ID NO: 106418 - RNA, 19 nt, Human
gcuccugcccuuccacccc

SEQ ID NO: 106419 - RNA, 18 nt, Human
ggaggcuuuuccggcugc

SEQ ID NO: 106420 - RNA, 21 nt, Human
gggcagcgccccucuuccugg

SEQ ID NO: 106421 - RNA, 18 nt, Human
ggggaaagaggaucugga

SEQ ID NO: 106422 - RNA, 23 nt, Human
gggggaggagggacuccagauga

SEQ ID NO: 106423 - RNA, 21 nt, Human
gguggugccggccgccgcggu

SEQ ID NO: 106424 - RNA, 22 nt, Human
gucaggucacacccaggccucu

SEQ ID NO: 106425 - RNA, 19 nt, Human
guggugccggccgccgcgg

SEQ ID NO: 106426 - RNA, 20 nt, Human
gugguuccugggccucaggg

SEQ ID NO: 106427 - RNA, 27 nt, Human
ucccuuagaagcaaggggcugugggac

SEQ ID NO: 106428 - RNA, 19 nt, Human
uccggcugcucuuccaggg

SEQ ID NO: 106429 - RNA, 21 nt, Human
uccuauaccccucuucuccca

SEQ ID NO: 106430 - RNA, 19 nt, Human
uccugggccucagggagcc

SEQ ID NO: 106431 - RNA, 24 nt, Human
ucucucuuccccucccuucagagc

SEQ ID NO: 106432 - RNA, 18 nt, Human
ucugucuuccacuuagca

SEQ ID NO: 106433 - RNA, 23 nt, Human
ugagcuggaagccucccccaggg

SEQ ID NO: 106434 - RNA, 22 nt, Human
ugccggccgccgcggugguucc

SEQ ID NO: 106435 - RNA, 24 nt, Human
ugccucgccuacaccggcuggagc

SEQ ID NO: 106436 - RNA, 23 nt, Human
uggagagcagccaaaacaaagca

SEQ ID NO: 106437 - RNA, 23 nt, Human
uggagcaggucucuggaucccuu

SEQ ID NO: 106438 - RNA, 23 nt, Human
uggagcuggguccagguggugcc

SEQ ID NO: 106439 - RNA, 21 nt, Human
uggauggaggcgugggggagg

SEQ ID NO: 106440 - RNA, 22 nt, Human
uggccccuugcccgucacuccu

SEQ ID NO: 106441 - RNA, 20 nt, Human
uggggcccggcuaaacccua

SEQ ID NO: 106442 - RNA, 21 nt, Human
uggggcccggcuaaacccuac

SEQ ID NO: 106443 - RNA, 19 nt, Human
ugggggaggagggacucca

SEQ ID NO: 106444 - RNA, 20 nt, Human
uguguguggauggaggcgug

SEQ ID NO: 106445 - RNA, 21 nt, Human
uuagaagcaaggggcuguggg

SEQ ID NO: 106446 - RNA, 20 nt, Human
uuuuccggcugcucuuccag

SEQ ID NO: 106447 - RNA, 18 nt, Human
aacccaagaggacagcaa

SEQ ID NO: 106448 - RNA, 22 nt, Human
aagaaaauacagggguucaaaa

SEQ ID NO: 106449 - RNA, 22 nt, Human
uucaaaauccgaaguggaaccc

SEQ ID NO: 106450 - RNA, 19 nt, Human
aaaugccaagccucugagc

SEQ ID NO: 106451 - RNA, 24 nt, Human
aagaggaagaagguucagguagaa

SEQ ID NO: 106452 - RNA, 22 nt, Human
aagugcccacccggccacucac

SEQ ID NO: 106453 - RNA, 26 nt, Human
aagugcccacccggccacucacaucc

SEQ ID NO: 106454 - RNA, 18 nt, Human
acagcccaggcccccauc

SEQ ID NO: 106455 - RNA, 19 nt, Human
agaagauagggaaggccag

SEQ ID NO: 106456 - RNA, 18 nt, Human
agaaugauugggugguua

SEQ ID NO: 106457 - RNA, 23 nt, Human
agagauggugauggagaggcagg

SEQ ID NO: 106458 - RNA, 24 nt, Human
agcacuuugggaggccgaggcagg

SEQ ID NO: 106459 - RNA, 21 nt, Human
agccuggccaacaaaaauaca

SEQ ID NO: 106460 - RNA, 24 nt, Human
agccugggcgauauagcaagacuc

SEQ ID NO: 106461 - RNA, 19 nt, Human
agcugggcacgguggcggc

SEQ ID NO: 106462 - RNA, 22 nt, Human
aggcaggagaaucacuugagcc

SEQ ID NO: 106463 - RNA, 24 nt, Human
aggcaggagaaucacuugagccug

SEQ ID NO: 106464 - RNA, 24 nt, Human
aggcaggguaacgugacuguaggg

SEQ ID NO: 106465 - RNA, 26 nt, Human
aggcaggugggucaucugaggucagg

SEQ ID NO: 106466 - RNA, 22 nt, Human
aggcauaguggcucacaccugu

SEQ ID NO: 106467 - RNA, 24 nt, Human
aggcauaguggcucacaccuguaa

SEQ ID NO: 106468 - RNA, 21 nt, Human
aggccgaggcaggugggucau

SEQ ID NO: 106469 - RNA, 22 nt, Human
aggccgaggcaggugggucauc

SEQ ID NO: 106470 - RNA, 24 nt, Human
agguucaggcaggagaaucacuug

SEQ ID NO: 106471 - RNA, 24 nt, Human
aguggcucacaccuguaaucccag

SEQ ID NO: 106472 - RNA, 18 nt, Human
aucuagaagugugugagg

SEQ ID NO: 106473 - RNA, 18 nt, Human
auggcaaaugccaagccu

SEQ ID NO: 106474 - RNA, 26 nt, Human
auggugauggagaggcaggccggcac

SEQ ID NO: 106475 - RNA, 22 nt, Human
caaagugcccacccggccacuc

SEQ ID NO: 106476 - RNA, 21 nt, Human
caacccagaaagaagcagcaa

SEQ ID NO: 106477 - RNA, 19 nt, Human
caagccucugagcugggaa

SEQ ID NO: 106478 - RNA, 24 nt, Human
cacaccuguaaucccagcacuuug

SEQ ID NO: 106479 - RNA, 22 nt, Human
cacauccucucaccccacaacc

SEQ ID NO: 106480 - RNA, 28 nt, Human
cacccggccacucacauccucucacccc

SEQ ID NO: 106481 - RNA, 24 nt, Human
cacccgugagccgcgcggucgagu

SEQ ID NO: 106482 - RNA, 23 nt, Human
caccuguaaucccagcacuuugg

SEQ ID NO: 106483 - RNA, 24 nt, Human
caccuguaaucccagcacuuuggg

SEQ ID NO: 106484 - RNA, 24 nt, Human
cagcacuuugggaggccgaggcag

SEQ ID NO: 106485 - RNA, 26 nt, Human
cagcacuuugggaggccgaggcaggu

SEQ ID NO: 106486 - RNA, 19 nt, Human
cagccgccgcgacguccgc

SEQ ID NO: 106487 - RNA, 24 nt, Human
caggugggucaucugaggucagga

SEQ ID NO: 106488 - RNA, 21 nt, Human
cauccucucaccccacaaccc

SEQ ID NO: 106489 - RNA, 20 nt, Human
ccacucacauccucucaccc

SEQ ID NO: 106490 - RNA, 24 nt, Human
ccagaaagaagcagcaaagugccc

SEQ ID NO: 106491 - RNA, 19 nt, Human
ccccacaacccagggggcc

SEQ ID NO: 106492 - RNA, 23 nt, Human
ccucucaccccacaacccagggg

SEQ ID NO: 106493 - RNA, 21 nt, Human
cgaaaucagccuggccaacaa

SEQ ID NO: 106494 - RNA, 18 nt, Human
cgaggcaggugggucauc

SEQ ID NO: 106495 - RNA, 24 nt, Human
cgaggcaggugggucaucugaggu

SEQ ID NO: 106496 - RNA, 26 nt, Human
cgaggcaggugggucaucugagguca

SEQ ID NO: 106497 - RNA, 19 nt, Human
cggggccggguggcagccg

SEQ ID NO: 106498 - RNA, 22 nt, Human
cucacaccuguaaucccagcac

SEQ ID NO: 106499 - RNA, 24 nt, Human
cucacaccuguaaucccagcacuu

SEQ ID NO: 106500 - RNA, 21 nt, Human
cucaccccacaacccaggggg

SEQ ID NO: 106501 - RNA, 19 nt, Human
cugggggaagaggaagaag

SEQ ID NO: 106502 - RNA, 20 nt, Human
cuguaaucccagcuacuugg

SEQ ID NO: 106503 - RNA, 21 nt, Human
cuguaaucccagcuacuuggg

SEQ ID NO: 106504 - RNA, 23 nt, Human
cuguuccacggcuugggcugguu

SEQ ID NO: 106505 - RNA, 20 nt, Human
gaaagagcuugggaagcccu

SEQ ID NO: 106506 - RNA, 18 nt, Human
gaacuggacaaggggaag

SEQ ID NO: 106507 - RNA, 23 nt, Human
gaagcucccuccuacuggggcuu

SEQ ID NO: 106508 - RNA, 24 nt, Human
gaaggccaggcauaguggcucaca

SEQ ID NO: 106509 - RNA, 22 nt, Human
gacaaggggaaguggagagaga

SEQ ID NO: 106510 - RNA, 23 nt, Human
gacuccguuuaaaagaaaaaaaa

SEQ ID NO: 106511 - RNA, 22 nt, Human
gaggcugcuuuagaaugauugg

SEQ ID NO: 106512 - RNA, 19 nt, Human
gcccugacugauguggcug

SEQ ID NO: 106513 - RNA, 20 nt, Human
gccggguggcagccgccgcg

SEQ ID NO: 106514 - RNA, 20 nt, Human
gcggcuuucuguaaucccag

SEQ ID NO: 106515 - RNA, 22 nt, Human
gcugguuugaugggguugaugg

SEQ ID NO: 106516 - RNA, 21 nt, Human
gcuugggaagcccugggggaa

SEQ ID NO: 106517 - RNA, 21 nt, Human
ggccggguggcagccgccgcg

SEQ ID NO: 106518 - RNA, 21 nt, Human
ggcggcuuucuguaaucccag

SEQ ID NO: 106519 - RNA, 22 nt, Human
gggaagaggaagaagguucagg

SEQ ID NO: 106520 - RNA, 24 nt, Human
gggaagcccugggggaagaggaag

SEQ ID NO: 106521 - RNA, 22 nt, Human
gggaaggccucucagaggaggu

SEQ ID NO: 106522 - RNA, 18 nt, Human
gggaaguggagagagaug

SEQ ID NO: 106523 - RNA, 22 nt, Human
gggggaagaggaagaagguuca

SEQ ID NO: 106524 - RNA, 21 nt, Human
gguagaagauagggaaggcca

SEQ ID NO: 106525 - RNA, 24 nt, Human
ggucaucugaggucaggaguucga

SEQ ID NO: 106526 - RNA, 23 nt, Human
ggucgagugagcgccgguccugg

SEQ ID NO: 106527 - RNA, 18 nt, Human
ggugcagggaaggaagac

SEQ ID NO: 106528 - RNA, 24 nt, Human
gguggcggcuuucuguaaucccag

SEQ ID NO: 106529 - RNA, 19 nt, Human
gugggucaucugaggucag

SEQ ID NO: 106530 - RNA, 22 nt, Human
uaaaagaaaaaaaaaaagauga

SEQ ID NO: 106531 - RNA, 22 nt, Human
uaacgugacuguagggaggcug

SEQ ID NO: 106532 - RNA, 28 nt, Human
uagcaagacuccguuuaaaagaaaaaaa

SEQ ID NO: 106533 - RNA, 24 nt, Human
uaguggcucacaccuguaauccca

SEQ ID NO: 106534 - RNA, 23 nt, Human
ucacauccucucaccccacaacc

SEQ ID NO: 106535 - RNA, 19 nt, Human
ucacuugagccugggcgau

SEQ ID NO: 106536 - RNA, 20 nt, Human
ucaggcaggagaaucacuug

SEQ ID NO: 106537 - RNA, 24 nt, Human
ucaggcaggagaaucacuugagcc

SEQ ID NO: 106538 - RNA, 22 nt, Human
ucaucugaggucaggaguucga

SEQ ID NO: 106539 - RNA, 22 nt, Human
uccguuuaaaagaaaaaaaaaa

SEQ ID NO: 106540 - RNA, 23 nt, Human
uccguuuaaaagaaaaaaaaaaa

SEQ ID NO: 106541 - RNA, 22 nt, Human
ucggccacaacccagaaagaag

SEQ ID NO: 106542 - RNA, 19 nt, Human
ucucaccccacaacccagg

SEQ ID NO: 106543 - RNA, 20 nt, Human
ucucaccccacaacccaggg

SEQ ID NO: 106544 - RNA, 18 nt, Human
ucugaagcucccuccuac

SEQ ID NO: 106545 - RNA, 19 nt, Human
ugauauggcaaaugccaag

SEQ ID NO: 106546 - RNA, 23 nt, Human
uggaaagagcuugggaagcccug

SEQ ID NO: 106547 - RNA, 25 nt, Human
uggaaagagcuugggaagcccuggg

SEQ ID NO: 106548 - RNA, 21 nt, Human
uggcggcuuucuguaauccca

SEQ ID NO: 106549 - RNA, 21 nt, Human
uggcucacaccuguaauccca

SEQ ID NO: 106550 - RNA, 24 nt, Human
uggcucacaccuguaaucccagca

SEQ ID NO: 106551 - RNA, 19 nt, Human
ugggaagaaucuagaagug

SEQ ID NO: 106552 - RNA, 22 nt, Human
ugggaggccgaggcaggugggu

SEQ ID NO: 106553 - RNA, 24 nt, Human
ugggaggccgaggcagguggguca

SEQ ID NO: 106554 - RNA, 22 nt, Human
uggggucacagggcacccguga

SEQ ID NO: 106555 - RNA, 23 nt, Human
ugggucaucugaggucaggaguu

SEQ ID NO: 106556 - RNA, 24 nt, Human
ugggucaucugaggucaggaguuc

SEQ ID NO: 106557 - RNA, 25 nt, Human
ugucugaagcucccuccuacugggg

SEQ ID NO: 106558 - RNA, 18 nt, Human
uguggcuguggaaagagc

SEQ ID NO: 106559 - RNA, 18 nt, Human
uguggcuguggaaagagc

SEQ ID NO: 106560 - RNA, 18 nt, Human
uuagcugggcacgguggc

SEQ ID NO: 106561 - RNA, 23 nt, Human
uuuaaaagaaaaaaaaaaagaug

SEQ ID NO: 106562 - RNA, 24 nt, Human
uuucuguaaucccagcuacuuggg

SEQ ID NO: 106563 - RNA, 18 nt, Human
agccucagggcuaggagu

SEQ ID NO: 106564 - RNA, 19 nt, Human
ccucagggcuaggaguggg

SEQ ID NO: 106565 - RNA, 24 nt, Human
ucugaggggcacgagccucagggc

SEQ ID NO: 106566 - RNA, 23 nt, Human
uggccccugucuugauuucaggg

SEQ ID NO: 106567 - RNA, 19 nt, Human
uggcugcucccucccuucc

SEQ ID NO: 106568 - RNA, 23 nt, Human
uguggcuccucucucagacccug

SEQ ID NO: 106569 - RNA, 21 nt, Human
uuagggacuguggcuccucuc

SEQ ID NO: 106570 - RNA, 20 nt, Human
aacccuuuccuccugcugac

SEQ ID NO: 106571 - RNA, 24 nt, Human
aaccuagaagaaaugacucccgag

SEQ ID NO: 106572 - RNA, 19 nt, Human
aaguucacaaacugcagau

SEQ ID NO: 106573 - RNA, 22 nt, Human
accagggaagaagaggguuucc

SEQ ID NO: 106574 - RNA, 23 nt, Human
acccgcuccagcagagccagacc

SEQ ID NO: 106575 - RNA, 28 nt, Human
acccuucuccucccuccccccucccccc

SEQ ID NO: 106576 - RNA, 20 nt, Human
acgccagggaacgggcacac

SEQ ID NO: 106577 - RNA, 23 nt, Human
acugcagauugaucagcaggggg

SEQ ID NO: 106578 - RNA, 22 nt, Human
agcaaguaacccuucuccuccc

SEQ ID NO: 106579 - RNA, 21 nt, Human
agcccucacucuccacgcccc

SEQ ID NO: 106580 - RNA, 24 nt, Human
agccuaugugaacccuuuccuccu

SEQ ID NO: 106581 - RNA, 20 nt, Human
aggcagagagagccuccagg

SEQ ID NO: 106582 - RNA, 26 nt, Human
aggcagagagagccuccagggugggg

SEQ ID NO: 106583 - RNA, 27 nt, Human
aggcagagagagccuccagggugggga

SEQ ID NO: 106584 - RNA, 22 nt, Human
agggaagaagaggguuuccugg

SEQ ID NO: 106585 - RNA, 23 nt, Human
aggguggggaagaaaggggcagg

SEQ ID NO: 106586 - RNA, 18 nt, Human
augaagggcaguccuugc

SEQ ID NO: 106587 - RNA, 23 nt, Human
auucccgaccccccucuccucuu

SEQ ID NO: 106588 - RNA, 27 nt, Human
caaaacauuccccccauucccgacccc

SEQ ID NO: 106589 - RNA, 19 nt, Human
caaaaucaauuuccuacug

SEQ ID NO: 106590 - RNA, 25 nt, Human
caagaaaaccuagaagaaaugacug

SEQ ID NO: 106591 - RNA, 22 nt, Human
caaguccugcaaaggggucucc

SEQ ID NO: 106592 - RNA, 22 nt, Human
cagagucccguggggcugagcc

SEQ ID NO: 106593 - RNA, 22 nt, Human
cagcagagccagaccagggaag

SEQ ID NO: 106594 - RNA, 19 nt, Human
ccaggguggggaagaaagg

SEQ ID NO: 106595 - RNA, 20 nt, Human
cccacccgcuccagcagagc

SEQ ID NO: 106596 - RNA, 22 nt, Human
cccacccgcuccagcagagcca

SEQ ID NO: 106597 - RNA, 22 nt, Human
cccccaaacuccagggaaugga

SEQ ID NO: 106598 - RNA, 18 nt, Human
cccccauucccgaccccc

SEQ ID NO: 106599 - RNA, 19 nt, Human
cccgcagccaaaacauucc

SEQ ID NO: 106600 - RNA, 18 nt, Human
cccugugugcaaguccug

SEQ ID NO: 106601 - RNA, 28 nt, Human
cccuucuccucccuccccccuccccccu

SEQ ID NO: 106602 - RNA, 22 nt, Human
ccuaugugaacccuuuccuccu

SEQ ID NO: 106603 - RNA, 23 nt, Human
ccucccuccccccuccccccucc

SEQ ID NO: 106604 - RNA, 19 nt, Human
ccuccugcugaccccugga

SEQ ID NO: 106605 - RNA, 18 nt, Human
ccuggcuacagccucccu

SEQ ID NO: 106606 - RNA, 26 nt, Human
cgaccccccucuccucuucuagcccc

SEQ ID NO: 106607 - RNA, 25 nt, Human
cggccaggccuacacacgccaggga

SEQ ID NO: 106608 - RNA, 19 nt, Human
cucacaagcuggcagccac

SEQ ID NO: 106609 - RNA, 23 nt, Human
cucagccuuaaaccugugggccg

SEQ ID NO: 106610 - RNA, 21 nt, Human
cugagccuuagaaaggcuggg

SEQ ID NO: 106611 - RNA, 19 nt, Human
cugggaggucagcaaggcu

SEQ ID NO: 106612 - RNA, 21 nt, Human
cugugugcaaguccugcaaag

SEQ ID NO: 106613 - RNA, 28 nt, Human
gaaaaccuagaagaaaugacuguggaag

SEQ ID NO: 106614 - RNA, 21 nt, Human
gaacgggcacacaccauucuu

SEQ ID NO: 106615 - RNA, 19 nt, Human
gaagaaaggggcagggugg

SEQ ID NO: 106616 - RNA, 18 nt, Human
gaggucagcaaggcugaa

SEQ ID NO: 106617 - RNA, 21 nt, Human
ggaagacuggcaccugagagc

SEQ ID NO: 106618 - RNA, 24 nt, Human
ggccaggccuacacacgccaggga

SEQ ID NO: 106619 - RNA, 26 nt, Human
gggaagaaaggggcagggugggcugg

SEQ ID NO: 106620 - RNA, 21 nt, Human
gggaagaagaggguuuccugg

SEQ ID NO: 106621 - RNA, 19 nt, Human
gggaugggcagugcugggc

SEQ ID NO: 106622 - RNA, 21 nt, Human
gggugggaugggcagugcugg

SEQ ID NO: 106623 - RNA, 20 nt, Human
gguggggaagaaaggggcag

SEQ ID NO: 106624 - RNA, 19 nt, Human
gugcugggccaagaaaacc

SEQ ID NO: 106625 - RNA, 23 nt, Human
uaacccuucuccucccucccccc

SEQ ID NO: 106626 - RNA, 19 nt, Human
ucagccuuaaaccuguggg

SEQ ID NO: 106627 - RNA, 24 nt, Human
uccccccauucccgaccccccucu

SEQ ID NO: 106628 - RNA, 18 nt, Human
uccccccuccccccuccc

SEQ ID NO: 106629 - RNA, 18 nt, Human
ucccgaccccccucuccu

SEQ ID NO: 106630 - RNA, 21 nt, Human
ugaaugaagggcaguccuugc

SEQ ID NO: 106631 - RNA, 27 nt, Human
ugagcagcaaguaacccuucuccuccc

SEQ ID NO: 106632 - RNA, 18 nt, Human
ugagccuuagaaaggcug

SEQ ID NO: 106633 - RNA, 20 nt, Human
ugagggccaccagcacugaa

SEQ ID NO: 106634 - RNA, 21 nt, Human
ugagggccaccagcacugaag

SEQ ID NO: 106635 - RNA, 19 nt, Human
ugccgugguggcggcagcc

SEQ ID NO: 106636 - RNA, 20 nt, Human
ugccgugguggcggcagccu

SEQ ID NO: 106637 - RNA, 20 nt, Human
ugccgugguggcggcagccu

SEQ ID NO: 106638 - RNA, 22 nt, Human
ugcggccaggccuacacacgcc

SEQ ID NO: 106639 - RNA, 21 nt, Human
uggcaccugagagccuaugug

SEQ ID NO: 106640 - RNA, 19 nt, Human
ugggaugggcagugcuggg

SEQ ID NO: 106641 - RNA, 24 nt, Human
ugugaaguucacaaacugcagauu

SEQ ID NO: 106642 - RNA, 20 nt, Human
uuccccgguggagggaggga

SEQ ID NO: 106643 - RNA, 26 nt, Human
uuuaaugauuccccuucccccaaacu

SEQ ID NO: 106644 - RNA, 18 nt, Human
accugguuuguggcagcu

SEQ ID NO: 106645 - RNA, 20 nt, Human
acgccgcugccgccgccgcg

SEQ ID NO: 106646 - RNA, 18 nt, Human
ccgcugccgccgccgcgu

SEQ ID NO: 106647 - RNA, 20 nt, Human
cgagcagucuuucaccacug

SEQ ID NO: 106648 - RNA, 22 nt, Human
cgccgcgcacucccccucuccc

SEQ ID NO: 106649 - RNA, 18 nt, Human
cgccgcugccgccgccgc

SEQ ID NO: 106650 - RNA, 21 nt, Human
gagaaccccgagccgacgccg

SEQ ID NO: 106651 - RNA, 22 nt, Human
gccgacgccgcugccgccgccg

SEQ ID NO: 106652 - RNA, 20 nt, Human
guuuguggcagcugcggccg

SEQ ID NO: 106653 - RNA, 18 nt, Human
ucccggagaaccccgagc

SEQ ID NO: 106654 - RNA, 18 nt, Human
ucucccggagaaccccga

SEQ ID NO: 106655 - RNA, 22 nt, Human
ugaaacaaauauucuuagaaca

SEQ ID NO: 106656 - RNA, 18 nt, Human
uguggcagcugcggccgc

SEQ ID NO: 106657 - RNA, 19 nt, Human
aaacagaaacagguccacg

SEQ ID NO: 106658 - RNA, 22 nt, Human
aaacagguccacguucaccuca

SEQ ID NO: 106659 - RNA, 23 nt, Human
aaaccgacaccuugcgccucccg

SEQ ID NO: 106660 - RNA, 18 nt, Human
aaagucuucuuccaacca

SEQ ID NO: 106661 - RNA, 22 nt, Human
aagcuggggaguccacagccac

SEQ ID NO: 106662 - RNA, 24 nt, Human
aaggacacgaagaugaggugggag

SEQ ID NO: 106663 - RNA, 22 nt, Human
aagggcgggcaggagggggcag

SEQ ID NO: 106664 - RNA, 20 nt, Human
aaggggcagaagggaguggg

SEQ ID NO: 106665 - RNA, 21 nt, Human
aaggggcagaagggagugggg

SEQ ID NO: 106666 - RNA, 28 nt, Human
acagacagcaucaccacagacuggaaac

SEQ ID NO: 106667 - RNA, 19 nt, Human
acagacuggaaacagaaac

SEQ ID NO: 106668 - RNA, 23 nt, Human
accacagacuggaaacagaaaca

SEQ ID NO: 106669 - RNA, 21 nt, Human
accccgagaucaaucagaagc

SEQ ID NO: 106670 - RNA, 21 nt, Human
acucuuuuuuuuucuuuuugg

SEQ ID NO: 106671 - RNA, 22 nt, Human
acucuuuuuuuuucuuuuuggc

SEQ ID NO: 106672 - RNA, 25 nt, Human
acugauccacucuuuuuuuuucuuu

SEQ ID NO: 106673 - RNA, 22 nt, Human
acuggaaacagaaacaggucca

SEQ ID NO: 106674 - RNA, 19 nt, Human
agaagggaguggggugagc

SEQ ID NO: 106675 - RNA, 23 nt, Human
agacaaaaaaggggcagaaggga

SEQ ID NO: 106676 - RNA, 26 nt, Human
agacagacagacagcaucaccacaga

SEQ ID NO: 106677 - RNA, 22 nt, Human
agacagacagcaucaccacaga

SEQ ID NO: 106678 - RNA, 22 nt, Human
agacccggccuccaggucgaaa

SEQ ID NO: 106679 - RNA, 20 nt, Human
agacuggaaacagaaacagg

SEQ ID NO: 106680 - RNA, 23 nt, Human
agagacaaaaaaggggcagaagg

SEQ ID NO: 106681 - RNA, 21 nt, Human
agaugaggugggagagggagg

SEQ ID NO: 106682 - RNA, 25 nt, Human
agccagugcggcagcccuguggcca

SEQ ID NO: 106683 - RNA, 21 nt, Human
aggcaagggcgggcaggaggg

SEQ ID NO: 106684 - RNA, 19 nt, Human
aggcagggauggggaaagg

SEQ ID NO: 106685 - RNA, 23 nt, Human
agggaguggggugagcugggggc

SEQ ID NO: 106686 - RNA, 26 nt, Human
agggaguggggugagcugggggcagg

SEQ ID NO: 106687 - RNA, 18 nt, Human
aggugggagagggagggg

SEQ ID NO: 106688 - RNA, 19 nt, Human
aggugggagagggaggggu

SEQ ID NO: 106689 - RNA, 23 nt, Human
auggggcugcuucuccaaggggu

SEQ ID NO: 106690 - RNA, 21 nt, Human
caaccacaccgaagugacacc

SEQ ID NO: 106691 - RNA, 18 nt, Human
caagggcgggcaggaggg

SEQ ID NO: 106692 - RNA, 27 nt, Human
caagugguccucuuguuuguauccucu

SEQ ID NO: 106693 - RNA, 23 nt, Human
caccacagacuggaaacagaaac

SEQ ID NO: 106694 - RNA, 18 nt, Human
cacucuuuuauuuacaga

SEQ ID NO: 106695 - RNA, 22 nt, Human
cagaagggaguggggugagcug

SEQ ID NO: 106696 - RNA, 23 nt, Human
cagacagacagacagcaucacca

SEQ ID NO: 106697 - RNA, 19 nt, Human
caggaaggacacgaagaug

SEQ ID NO: 106698 - RNA, 20 nt, Human
caguuaaaaacgguccauuu

SEQ ID NO: 106699 - RNA, 22 nt, Human
ccaagcuggggaguccacagcc

SEQ ID NO: 106700 - RNA, 22 nt, Human
ccacagccaccagcgucuccag

SEQ ID NO: 106701 - RNA, 22 nt, Human
ccaccagcgucuccaggcccag

SEQ ID NO: 106702 - RNA, 23 nt, Human
ccaugugucugaauggggugggg

SEQ ID NO: 106703 - RNA, 20 nt, Human
ccccacccgcaccgcccggg

SEQ ID NO: 106704 - RNA, 18 nt, Human
cccgcccccacccgcacc

SEQ ID NO: 106705 - RNA, 25 nt, Human
cccgcggguggcggcggcggcagca

SEQ ID NO: 106706 - RNA, 26 nt, Human
ccgaccacucacccauucaaaagcuu

SEQ ID NO: 106707 - RNA, 22 nt, Human
ccgagaucaaucagaagcucau

SEQ ID NO: 106708 - RNA, 25 nt, Human
ccgcacagagacccaacaacgucac

SEQ ID NO: 106709 - RNA, 23 nt, Human
ccuccaggucgaaagggcgccuc

SEQ ID NO: 106710 - RNA, 18 nt, Human
ccucccgcccccacccgc

SEQ ID NO: 106711 - RNA, 21 nt, Human
ccucccgcccccacccgcacc

SEQ ID NO: 106712 - RNA, 20 nt, Human
cgagaucaaucagaagcuca

SEQ ID NO: 106713 - RNA, 21 nt, Human
cgcacagagacccaacaucca

SEQ ID NO: 106714 - RNA, 26 nt, Human
cgggucuggaguagggucgccgggga

SEQ ID NO: 106715 - RNA, 21 nt, Human
cuagauacccgaccacucacc

SEQ ID NO: 106716 - RNA, 26 nt, Human
cuccaaggggugaggucaaagaggga

SEQ ID NO: 106717 - RNA, 20 nt, Human
cuccgccucccgcgcccucc

SEQ ID NO: 106718 - RNA, 18 nt, Human
cugaaugggguggggggg

SEQ ID NO: 106719 - RNA, 19 nt, Human
cugaauggggugggggggg

SEQ ID NO: 106720 - RNA, 22 nt, Human
cugauccacucuuuuuuuuucu

SEQ ID NO: 106721 - RNA, 19 nt, Human
gaaacagaaacagguccac

SEQ ID NO: 106722 - RNA, 19 nt, Human
gagcugggggcaggaagga

SEQ ID NO: 106723 - RNA, 18 nt, Human
gaugaggugggagaggga

SEQ ID NO: 106724 - RNA, 21 nt, Human
gcgcccagcgccggcuccauc

SEQ ID NO: 106725 - RNA, 24 nt, Human
gcgccuccgggaaugcagcugggg

SEQ ID NO: 106726 - RNA, 21 nt, Human
gcggcagcagccgcggcggca

SEQ ID NO: 106727 - RNA, 20 nt, Human
gcucuaaggggggaaauggg

SEQ ID NO: 106728 - RNA, 20 nt, Human
gcugcuucuccaagggguga

SEQ ID NO: 106729 - RNA, 21 nt, Human
ggaguggggugagcugggggc

SEQ ID NO: 106730 - RNA, 22 nt, Human
ggcagaagggaguggggugagc

SEQ ID NO: 106731 - RNA, 19 nt, Human
ggcaggaggcagggauggg

SEQ ID NO: 106732 - RNA, 22 nt, Human
ggccacgagacucagacagaca

SEQ ID NO: 106733 - RNA, 18 nt, Human
ggcggcggcggcagcagc

SEQ ID NO: 106734 - RNA, 19 nt, Human
ggcggcggcggcagcagcc

SEQ ID NO: 106735 - RNA, 18 nt, Human
ggcgggcaggagggggca

SEQ ID NO: 106736 - RNA, 20 nt, Human
ggcugggcaccuucaugggg

SEQ ID NO: 106737 - RNA, 18 nt, Human
gggaaugcagcuggggag

SEQ ID NO: 106738 - RNA, 22 nt, Human
gggauggggaaaggauggacac

SEQ ID NO: 106739 - RNA, 27 nt, Human
gggcagaagggaguggggugagcuggg

SEQ ID NO: 106740 - RNA, 22 nt, Human
gggcaggaggcagggaugggga

SEQ ID NO: 106741 - RNA, 18 nt, Human
gggggggcgggacccuac

SEQ ID NO: 106742 - RNA, 19 nt, Human
uacuucaggcgcccucugc

SEQ ID NO: 106743 - RNA, 19 nt, Human
uaguaagacagugcaaaaa

SEQ ID NO: 106744 - RNA, 23 nt, Human
uaguaagacagugcaaaaacuag

SEQ ID NO: 106745 - RNA, 24 nt, Human
ucacaguaaaaaccugcuguccga

SEQ ID NO: 106746 - RNA, 20 nt, Human
ucaccucacaguaaaaaccu

SEQ ID NO: 106747 - RNA, 23 nt, Human
ucaggggcaggaggcagggaugg

SEQ ID NO: 106748 - RNA, 22 nt, Human
uccaaccacaccgaagugacac

SEQ ID NO: 106749 - RNA, 22 nt, Human
uccaggucgaaagggcgccucc

SEQ ID NO: 106750 - RNA, 19 nt, Human
ucccgcccccacccgcacc

SEQ ID NO: 106751 - RNA, 19 nt, Human
ugaauaguaagacagugca

SEQ ID NO: 106752 - RNA, 19 nt, Human
ugaggugggagagggaggg

SEQ ID NO: 106753 - RNA, 19 nt, Human
ugccccagugauucccguc

SEQ ID NO: 106754 - RNA, 22 nt, Human
ugcgccucccgcccccacccgc

SEQ ID NO: 106755 - RNA, 24 nt, Human
ugcgccucccgcccccacccgcac

SEQ ID NO: 106756 - RNA, 23 nt, Human
uggaccccgagaucaaucagaag

SEQ ID NO: 106757 - RNA, 26 nt, Human
uggaccccgagaucaaucagaagcuc

SEQ ID NO: 106758 - RNA, 22 nt, Human
uggcagucccagccagugcggc

SEQ ID NO: 106759 - RNA, 21 nt, Human
uggccagcagacccggccucc

SEQ ID NO: 106760 - RNA, 24 nt, Human
ugggcaccuucauggggcugcuuc

SEQ ID NO: 106761 - RNA, 20 nt, Human
ugucugaauggggugggggg

SEQ ID NO: 106762 - RNA, 19 nt, Human
ugugcguguguggaugugu

SEQ ID NO: 106763 - RNA, 18 nt, Human
uguguaaauguggugcuu

SEQ ID NO: 106764 - RNA, 22 nt, Human
uucaaaagcuugagaagucgcc

SEQ ID NO: 106765 - RNA, 26 nt, Human
uucaauuucaauguucauuuagcaaa

SEQ ID NO: 106766 - RNA, 20 nt, Human
uuuacagaaaacacagauaa

SEQ ID NO: 106767 - RNA, 28 nt, Human
uuuuuuucuuuuuggcacaaagaaauau

SEQ ID NO: 106768 - RNA, 20 nt, Human
aacguucaagucuugccuuu

SEQ ID NO: 106769 - RNA, 18 nt, Human
aagaagaagaggggcacc

SEQ ID NO: 106770 - RNA, 20 nt, Human
acagcaagugugugugugau

SEQ ID NO: 106771 - RNA, 19 nt, Human
acaggguaagaaauaggag

SEQ ID NO: 106772 - RNA, 28 nt, Human
agaaauaggagaaagaggaccgguaccc

SEQ ID NO: 106773 - RNA, 19 nt, Human
agaauaugugggcuuccuc

SEQ ID NO: 106774 - RNA, 23 nt, Human
aggacaagagaaggcaaagaaga

SEQ ID NO: 106775 - RNA, 21 nt, Human
aggagaaagaggacaagagaa

SEQ ID NO: 106776 - RNA, 23 nt, Human
aggcagcccugcagcccgggaag

SEQ ID NO: 106777 - RNA, 22 nt, Human
auggggcuuuuuguuucuggac

SEQ ID NO: 106778 - RNA, 23 nt, Human
caaaauggaaggcagguggagga

SEQ ID NO: 106779 - RNA, 20 nt, Human
caagagaaggcaaagaagaa

SEQ ID NO: 106780 - RNA, 24 nt, Human
cacauguaaccuuugcuuuuuaca

SEQ ID NO: 106781 - RNA, 20 nt, Human
caccacagggaaucaggucu

SEQ ID NO: 106782 - RNA, 22 nt, Human
cacccccacccccacauccaaa

SEQ ID NO: 106783 - RNA, 18 nt, Human
cacuuccccuuucuccac

SEQ ID NO: 106784 - RNA, 24 nt, Human
cagcccgggaaggggacgcagcgg

SEQ ID NO: 106785 - RNA, 23 nt, Human
ccacuuccccuuucuccaccccc

SEQ ID NO: 106786 - RNA, 22 nt, Human
cccacauccaaauuacucuuaa

SEQ ID NO: 106787 - RNA, 19 nt, Human
ccccagcgcccaaggcugg

SEQ ID NO: 106788 - RNA, 21 nt, Human
cccccacccccacauccaaau

SEQ ID NO: 106789 - RNA, 25 nt, Human
cccccacccccacauccaaauuacu

SEQ ID NO: 106790 - RNA, 24 nt, Human
ccccggaucaccgccccucgggag

SEQ ID NO: 106791 - RNA, 18 nt, Human
ccccuuucuccaccccca

SEQ ID NO: 106792 - RNA, 21 nt, Human
ccccuuucuccacccccaccc

SEQ ID NO: 106793 - RNA, 18 nt, Human
cccugcagcccgggaagg

SEQ ID NO: 106794 - RNA, 24 nt, Human
ccgcccggcggacuguccggcugu

SEQ ID NO: 106795 - RNA, 22 nt, Human
ccgcgacuccgaggcgggcgcg

SEQ ID NO: 106796 - RNA, 19 nt, Human
ccgggaaggggacgcagcg

SEQ ID NO: 106797 - RNA, 18 nt, Human
ccguuugagucuggacug

SEQ ID NO: 106798 - RNA, 21 nt, Human
ccugcagcccgggaaggggac

SEQ ID NO: 106799 - RNA, 25 nt, Human
ccuugaaaugcacugacucaaaaca

SEQ ID NO: 106800 - RNA, 24 nt, Human
cgcagcgggcuggcugcuggcgcc

SEQ ID NO: 106801 - RNA, 19 nt, Human
cggccccggaucaccgccc

SEQ ID NO: 106802 - RNA, 23 nt, Human
cggcggcgcggcggaggcagccc

SEQ ID NO: 106803 - RNA, 19 nt, Human
cucaaaacauugacagcaa

SEQ ID NO: 106804 - RNA, 19 nt, Human
cuguuccuugaaaugcacu

SEQ ID NO: 106805 - RNA, 18 nt, Human
cuuucuccacccccaccc

SEQ ID NO: 106806 - RNA, 22 nt, Human
gacaagagaaggcaaagaagaa

SEQ ID NO: 106807 - RNA, 20 nt, Human
gacaggguaagaaauaggag

SEQ ID NO: 106808 - RNA, 21 nt, Human
gaccacuuccccuuucuccac

SEQ ID NO: 106809 - RNA, 21 nt, Human
gaggacaagagaaggcaaaga

SEQ ID NO: 106810 - RNA, 23 nt, Human
gaggcgggcgcggcggcuggucc

SEQ ID NO: 106811 - RNA, 18 nt, Human
gcggcggaggcagcccug

SEQ ID NO: 106812 - RNA, 23 nt, Human
ggcuguuccuugaaaugcacuga

SEQ ID NO: 106813 - RNA, 21 nt, Human
ggguaagaaauaggagaaaga

SEQ ID NO: 106814 - RNA, 24 nt, Human
ggguaagaaauaggagaaagagga

SEQ ID NO: 106815 - RNA, 22 nt, Human
ggguaggaccuggagccgaggg

SEQ ID NO: 106816 - RNA, 22 nt, Human
guaaacaagauuuggguuacug

SEQ ID NO: 106817 - RNA, 21 nt, Human
uaacauguucacagauaccac

SEQ ID NO: 106818 - RNA, 25 nt, Human
uaagaaauaggagaaagaggacaaa

SEQ ID NO: 106819 - RNA, 24 nt, Human
uaccacgaauauuuuguaaacaag

SEQ ID NO: 106820 - RNA, 18 nt, Human
uaggaccuggagccgagg

SEQ ID NO: 106821 - RNA, 21 nt, Human
uagggguguguauuuuguggc

SEQ ID NO: 106822 - RNA, 26 nt, Human
uaugugggcuuccuccguuugagucu

SEQ ID NO: 106823 - RNA, 18 nt, Human
ucacauguaaccuuugcu

SEQ ID NO: 106824 - RNA, 22 nt, Human
uccacccccacccccacaucca

SEQ ID NO: 106825 - RNA, 21 nt, Human
ucccauggcagcggcuccggg

SEQ ID NO: 106826 - RNA, 23 nt, Human
ucuccacccccacccccacaucc

SEQ ID NO: 106827 - RNA, 20 nt, Human
ugaaaugcacugacucaaaa

SEQ ID NO: 106828 - RNA, 22 nt, Human
ugacucaaaacauugacagcaa

SEQ ID NO: 106829 - RNA, 21 nt, Human
ugugggcuuccuccguuugag

SEQ ID NO: 106830 - RNA, 19 nt, Human
uuaauacucacauguaacc

SEQ ID NO: 106831 - RNA, 25 nt, Human
uucaaaauggaaggcagguggagga

SEQ ID NO: 106832 - RNA, 20 nt, Human
uuccccuuucuccacccccc

SEQ ID NO: 106833 - RNA, 24 nt, Human
uugacagcaagugugugugugauu

SEQ ID NO: 106834 - RNA, 24 nt, Human
aaaaugcugggauuacaggcauga

SEQ ID NO: 106835 - RNA, 26 nt, Human
aaaugcugggauuacaggcaugagcc

SEQ ID NO: 106836 - RNA, 21 nt, Human
aacgcugaucacaaauccaug

SEQ ID NO: 106837 - RNA, 24 nt, Human
aaguagcugggauuacaggagugu

SEQ ID NO: 106838 - RNA, 26 nt, Human
aaguagcugggauuacaggagugugc

SEQ ID NO: 106839 - RNA, 25 nt, Human
aagugauucucccaccucagccucc

SEQ ID NO: 106840 - RNA, 18 nt, Human
acagagucuccagaagac

SEQ ID NO: 106841 - RNA, 20 nt, Human
accacagcucagcggcugcu

SEQ ID NO: 106842 - RNA, 24 nt, Human
acccaagcuagggugcaguggcau

SEQ ID NO: 106843 - RNA, 25 nt, Human
acccgccucagccucucaaaaugcu

SEQ ID NO: 106844 - RNA, 22 nt, Human
accugcuuccccaugcgcccca

SEQ ID NO: 106845 - RNA, 21 nt, Human
acgccggacuaauuuuugcau

SEQ ID NO: 106846 - RNA, 24 nt, Human
acuauguuggccaggcugguuuug

SEQ ID NO: 106847 - RNA, 20 nt, Human
acugcaaccuccaccuuugg

SEQ ID NO: 106848 - RNA, 21 nt, Human
acugcaaccuccaccuuugga

SEQ ID NO: 106849 - RNA, 24 nt, Human
agaaacgugcaguccuugccuacu

SEQ ID NO: 106850 - RNA, 25 nt, Human
agaagacucaaaggaaaaccgagaa

SEQ ID NO: 106851 - RNA, 18 nt, Human
agagaggggguuucacua

SEQ ID NO: 106852 - RNA, 19 nt, Human
agccaccgcacccggccug

SEQ ID NO: 106853 - RNA, 20 nt, Human
aggagagaaagaaacgugca

SEQ ID NO: 106854 - RNA, 21 nt, Human
aggagagaaagaaacgugcag

SEQ ID NO: 106855 - RNA, 24 nt, Human
aggcagcuccagaagacucaaagg

SEQ ID NO: 106856 - RNA, 24 nt, Human
aggcugguuuugaauccugaccuc

SEQ ID NO: 106857 - RNA, 18 nt, Human
aggggguuucacuauguu

SEQ ID NO: 106858 - RNA, 24 nt, Human
aggggguuucacuauguuggccag

SEQ ID NO: 106859 - RNA, 22 nt, Human
agguaggggcaagaguugcuuu

SEQ ID NO: 106860 - RNA, 24 nt, Human
aggugauccacccgccucagccuc

SEQ ID NO: 106861 - RNA, 24 nt, Human
agugauucucccaccucagccucc

SEQ ID NO: 106862 - RNA, 24 nt, Human
aguggcaugauuucagcuuacugc

SEQ ID NO: 106863 - RNA, 19 nt, Human
auuacaggagugugccacc

SEQ ID NO: 106864 - RNA, 23 nt, Human
caaaaugcugggauuacaggcau

SEQ ID NO: 106865 - RNA, 24 nt, Human
caaaaugcugggauuacaggcaug

SEQ ID NO: 106866 - RNA, 20 nt, Human
caagugauucucccaccuca

SEQ ID NO: 106867 - RNA, 22 nt, Human
caagugauucucccaccucagc

SEQ ID NO: 106868 - RNA, 23 nt, Human
cacaaauccaugggagaugucuc

SEQ ID NO: 106869 - RNA, 21 nt, Human
cacagagucuccagaagacca

SEQ ID NO: 106870 - RNA, 25 nt, Human
caccacagcucagcggcugcuucug

SEQ ID NO: 106871 - RNA, 23 nt, Human
cacccgccucagccucucaaaau

SEQ ID NO: 106872 - RNA, 18 nt, Human
caccgcacccggccuggc

SEQ ID NO: 106873 - RNA, 24 nt, Human
caccucagccuccuaaguagcugg

SEQ ID NO: 106874 - RNA, 21 nt, Human
cacuauguuggccaggcuggu

SEQ ID NO: 106875 - RNA, 24 nt, Human
cacuauguuggccaggcugguuuu

SEQ ID NO: 106876 - RNA, 22 nt, Human
cagaagacucaaaggaaaaccg

SEQ ID NO: 106877 - RNA, 20 nt, Human
ccaccacgccggacuaauuu

SEQ ID NO: 106878 - RNA, 19 nt, Human
ccacccgccucagccucuc

SEQ ID NO: 106879 - RNA, 19 nt, Human
ccagaggucuucuuaaggu

SEQ ID NO: 106880 - RNA, 23 nt, Human
cccaccucagccuccuaaguagc

SEQ ID NO: 106881 - RNA, 23 nt, Human
ccgccucagccucucaaaaugcu

SEQ ID NO: 106882 - RNA, 23 nt, Human
ccuaaguagcugggauuacagga

SEQ ID NO: 106883 - RNA, 22 nt, Human
ccugaccucaggugauccaccc

SEQ ID NO: 106884 - RNA, 23 nt, Human
ccugaccucaggugauccacccg

SEQ ID NO: 106885 - RNA, 23 nt, Human
cgagaaucaggagagaaagaaac

SEQ ID NO: 106886 - RNA, 24 nt, Human
cgccucagccucucaaaaugcugg

SEQ ID NO: 106887 - RNA, 24 nt, Human
cucaaaaugcugggauuacaggca

SEQ ID NO: 106888 - RNA, 23 nt, Human
cucagccuccuaaguagcuggga

SEQ ID NO: 106889 - RNA, 22 nt, Human
cucccaccucagccuccuaagu

SEQ ID NO: 106890 - RNA, 22 nt, Human
cucuaugccacacagagucucc

SEQ ID NO: 106891 - RNA, 23 nt, Human
cugcaaccuccaccuuuggaguc

SEQ ID NO: 106892 - RNA, 21 nt, Human
cugcaacgcugaucacaaauc

SEQ ID NO: 106893 - RNA, 18 nt, Human
cuucugcugcagccucag

SEQ ID NO: 106894 - RNA, 19 nt, Human
gaagaccaguuccucacug

SEQ ID NO: 106895 - RNA, 24 nt, Human
gaccucaggugauccacccgccuc

SEQ ID NO: 106896 - RNA, 20 nt, Human
gagaugucucgacaucugug

SEQ ID NO: 106897 - RNA, 22 nt, Human
gaggggguuucacuauguuggc

SEQ ID NO: 106898 - RNA, 18 nt, Human
gagucuccagaagaccag

SEQ ID NO: 106899 - RNA, 22 nt, Human
gaguuuugcuuugccacccaag

SEQ ID NO: 106900 - RNA, 21 nt, Human
gaugagaaggcagcuccagaa

SEQ ID NO: 106901 - RNA, 18 nt, Human
gauuacaggagugugcca

SEQ ID NO: 106902 - RNA, 18 nt, Human
gauuacaggcaugagcca

SEQ ID NO: 106903 - RNA, 22 nt, Human
gauuacaggcaugagccaccgc

SEQ ID NO: 106904 - RNA, 23 nt, Human
gauuacaggcaugagccaccgca

SEQ ID NO: 106905 - RNA, 21 nt, Human
gcaaccuccaccuuuggaguc

SEQ ID NO: 106906 - RNA, 21 nt, Human
gcccagaagagguaggggcaa

SEQ ID NO: 106907 - RNA, 20 nt, Human
gcuccagaagacucaaagga

SEQ ID NO: 106908 - RNA, 19 nt, Human
gcugcagccucaggucucc

SEQ ID NO: 106909 - RNA, 22 nt, Human
gcugguuuugaauccugaccuc

SEQ ID NO: 106910 - RNA, 19 nt, Human
ggaaagccagaggucuucu

SEQ ID NO: 106911 - RNA, 25 nt, Human
ggagcuuucguuccucuccugguag

SEQ ID NO: 106912 - RNA, 22 nt, Human
ggauuacaggcaugagccaccg

SEQ ID NO: 106913 - RNA, 21 nt, Human
ggcuggucccguugaucacgg

SEQ ID NO: 106914 - RNA, 24 nt, Human
ggggguuucacuauguuggccagg

SEQ ID NO: 106915 - RNA, 18 nt, Human
gggguuucacuauguugg

SEQ ID NO: 106916 - RNA, 22 nt, Human
gggguuucacuauguuggccag

SEQ ID NO: 106917 - RNA, 23 nt, Human
gggguuucacuauguuggccagg

SEQ ID NO: 106918 - RNA, 22 nt, Human
gggugcaguggcaugauuucag

SEQ ID NO: 106919 - RNA, 22 nt, Human
ggguuucacuauguuggccagg

SEQ ID NO: 106920 - RNA, 23 nt, Human
ggugcaguggcaugauuucagcu

SEQ ID NO: 106921 - RNA, 22 nt, Human
gugauccacccgccucagccuc

SEQ ID NO: 106922 - RNA, 24 nt, Human
gugauucucccaccucagccuccu

SEQ ID NO: 106923 - RNA, 20 nt, Human
gugcaguggcaugauuucag

SEQ ID NO: 106924 - RNA, 26 nt, Human
uaaggugguugaaucacucuaugcca

SEQ ID NO: 106925 - RNA, 24 nt, Human
uaauuuuugcauuuuuaguagaga

SEQ ID NO: 106926 - RNA, 23 nt, Human
uacaggcaugagccaccgcaccc

SEQ ID NO: 106927 - RNA, 22 nt, Human
uagagaggggguuucacuaugu

SEQ ID NO: 106928 - RNA, 23 nt, Human
uagggugcaguggcaugauuuca

SEQ ID NO: 106929 - RNA, 24 nt, Human
uagggugcaguggcaugauuucag

SEQ ID NO: 106930 - RNA, 24 nt, Human
uaguagagaggggguuucacuaug

SEQ ID NO: 106931 - RNA, 24 nt, Human
uauguuggccaggcugguuuugaa

SEQ ID NO: 106932 - RNA, 23 nt, Human
ucaaaaugcugggauuacaggca

SEQ ID NO: 106933 - RNA, 24 nt, Human
ucaaaaugcugggauuacaggcau

SEQ ID NO: 106934 - RNA, 22 nt, Human
ucacuauguuggccaggcuggu

SEQ ID NO: 106935 - RNA, 22 nt, Human
ucaggagagaaagaaacgugca

SEQ ID NO: 106936 - RNA, 23 nt, Human
uccaagugauucucccaccucag

SEQ ID NO: 106937 - RNA, 24 nt, Human
uccaagugauucucccaccucagc

SEQ ID NO: 106938 - RNA, 18 nt, Human
uccugguaggcagcaaca

SEQ ID NO: 106939 - RNA, 25 nt, Human
ucgacaucuguguuccaggaaagcc

SEQ ID NO: 106940 - RNA, 26 nt, Human
ucuaugccacacagagucuccagaag

SEQ ID NO: 106941 - RNA, 24 nt, Human
ucucaaaaugcugggauuacaggc

SEQ ID NO: 106942 - RNA, 21 nt, Human
ugaccucaggugauccacccg

SEQ ID NO: 106943 - RNA, 24 nt, Human
ugaccucaggugauccacccgccu

SEQ ID NO: 106944 - RNA, 21 nt, Human
ugagaaggcagcuccagaaga

SEQ ID NO: 106945 - RNA, 20 nt, Human
ugauucucccaccucagccu

SEQ ID NO: 106946 - RNA, 23 nt, Human
ugcagucgccuccugggccuggc

SEQ ID NO: 106947 - RNA, 21 nt, Human
ugcaguggcaugauuucagcu

SEQ ID NO: 106948 - RNA, 24 nt, Human
uggaguccaagugauucucccacc

SEQ ID NO: 106949 - RNA, 23 nt, Human
uggccaggcugguuuugaauccu

SEQ ID NO: 106950 - RNA, 22 nt, Human
ugggauuacaggagugugccac

SEQ ID NO: 106951 - RNA, 24 nt, Human
ugggauuacaggagugugccacca

SEQ ID NO: 106952 - RNA, 18 nt, Human
ugggauuacaggcaugag

SEQ ID NO: 106953 - RNA, 19 nt, Human
ugggauuacaggcaugagc

SEQ ID NO: 106954 - RNA, 21 nt, Human
ugggauuacaggcaugagcca

SEQ ID NO: 106955 - RNA, 22 nt, Human
ugggauuacaggcaugagccac

SEQ ID NO: 106956 - RNA, 23 nt, Human
ugggauuacaggcaugagccacc

SEQ ID NO: 106957 - RNA, 24 nt, Human
ugggauuacaggcaugagccaccg

SEQ ID NO: 106958 - RNA, 24 nt, Human
ugggauuacaggcaugagccaccg

SEQ ID NO: 106959 - RNA, 19 nt, Human
ugguaggcagcaacaauau

SEQ ID NO: 106960 - RNA, 18 nt, Human
uuacugcaaccuccaccu

SEQ ID NO: 106961 - RNA, 22 nt, Human
uuacugcaaccuccaccuuugg

SEQ ID NO: 106962 - RNA, 23 nt, Human
uuacugcaaccuccaccuuugga

SEQ ID NO: 106963 - RNA, 18 nt, Human
uuaguagagaggggguuu

SEQ ID NO: 106964 - RNA, 21 nt, Human
uuaguagagaggggguuucac

SEQ ID NO: 106965 - RNA, 24 nt, Human
uuaguagagaggggguuucacuau

SEQ ID NO: 106966 - RNA, 24 nt, Human
uugauaguagggaccugcuucccc

SEQ ID NO: 106967 - RNA, 22 nt, Human
uugcuuugccacccaagcuagg

SEQ ID NO: 106968 - RNA, 24 nt, Human
uuucacuauguuggccaggcuggu

SEQ ID NO: 106969 - RNA, 18 nt, Human
uuuugcuuugccacccaa

SEQ ID NO: 106970 - RNA, 24 nt, Human
uuuuuaguagagaggggguuucac

SEQ ID NO: 106971 - RNA, 20 nt, Human
uuuuugcauuuuuaguagag

SEQ ID NO: 106972 - RNA, 23 nt, Human
uuuuuuuuuuuuuuuuuuuucgg

SEQ ID NO: 106973 - RNA, 23 nt, Human
aaaccuggaaggaaccuaaaaug

SEQ ID NO: 106974 - RNA, 21 nt, Human
aacacaguucccagaccagcu

SEQ ID NO: 106975 - RNA, 21 nt, Human
aacgcugaucacaaauccaug

SEQ ID NO: 106976 - RNA, 21 nt, Human
aagagagaaagaaacgugcag

SEQ ID NO: 106977 - RNA, 20 nt, Human
aagcaaaggagcagcacgca

SEQ ID NO: 106978 - RNA, 25 nt, Human
aagcagaaaaugccagaucucccuu

SEQ ID NO: 106979 - RNA, 18 nt, Human
aagccugaugaguuccac

SEQ ID NO: 106980 - RNA, 23 nt, Human
aaggaccaagggaagacaguucc

SEQ ID NO: 106981 - RNA, 21 nt, Human
aauccagguucccccaaucug

SEQ ID NO: 106982 - RNA, 24 nt, Human
acaagaacaaagacauucucuaag

SEQ ID NO: 106983 - RNA, 23 nt, Human
acccagagcaaaagcucucuccu

SEQ ID NO: 106984 - RNA, 22 nt, Human
acccaggaugaggaucagaagc

SEQ ID NO: 106985 - RNA, 19 nt, Human
acccugugcccagaggagg

SEQ ID NO: 106986 - RNA, 18 nt, Human
accucuuggcaagccuga

SEQ ID NO: 106987 - RNA, 19 nt, Human
acucaguuuccccaccucu

SEQ ID NO: 106988 - RNA, 20 nt, Human
agaaacgugcaguccuugcc

SEQ ID NO: 106989 - RNA, 20 nt, Human
agacaguuccagcccagagc

SEQ ID NO: 106990 - RNA, 19 nt, Human
agaucucccuugcccugcu

SEQ ID NO: 106991 - RNA, 28 nt, Human
agcccagagccauuucccuuccaaccuc

SEQ ID NO: 106992 - RNA, 23 nt, Human
agccuucucuccuccuaccuuuc

SEQ ID NO: 106993 - RNA, 19 nt, Human
aggaucagaagcuagugac

SEQ ID NO: 106994 - RNA, 23 nt, Human
aggcaauuaagaagcagaaagug

SEQ ID NO: 106995 - RNA, 26 nt, Human
aggccuggaccagaaggaccaaggga

SEQ ID NO: 106996 - RNA, 26 nt, Human
aggcggagguccgaagcaaaggagca

SEQ ID NO: 106997 - RNA, 24 nt, Human
agguacaguggcucaugccuguaa

SEQ ID NO: 106998 - RNA, 24 nt, Human
agugccucuccacucccagccagu

SEQ ID NO: 106999 - RNA, 19 nt, Human
aguggcucaugccuguaau

SEQ ID NO: 107000 - RNA, 23 nt, Human
auaggaaaaucugacccuucuca

SEQ ID NO: 107001 - RNA, 24 nt, Human
auccugagugauguuggcugccug

SEQ ID NO: 107002 - RNA, 19 nt, Human
caacacaguucccagacca

SEQ ID NO: 107003 - RNA, 18 nt, Human
caacgcugaucacaaauc

SEQ ID NO: 107004 - RNA, 24 nt, Human
caagaacaaagacauucucuaagc

SEQ ID NO: 107005 - RNA, 23 nt, Human
caagaaucaagagagaaagaaac

SEQ ID NO: 107006 - RNA, 23 nt, Human
caagccugaugaguuccacuccc

SEQ ID NO: 107007 - RNA, 24 nt, Human
caaggccuggaccagaaggaccaa

SEQ ID NO: 107008 - RNA, 24 nt, Human
caaguccuuucacuuccgaguuuu

SEQ ID NO: 107009 - RNA, 19 nt, Human
caaucuguggccacaccca

SEQ ID NO: 107010 - RNA, 23 nt, Human
cacaauccagguucccccaaucu

SEQ ID NO: 107011 - RNA, 18 nt, Human
caccagaaggagagaguu

SEQ ID NO: 107012 - RNA, 21 nt, Human
caccugaacaagaacaaagac

SEQ ID NO: 107013 - RNA, 19 nt, Human
cacguaaagcagaaaaugc

SEQ ID NO: 107014 - RNA, 21 nt, Human
cacuuuguuacuuuucauuga

SEQ ID NO: 107015 - RNA, 23 nt, Human
cagagcaaaagcucucuccuccc

SEQ ID NO: 107016 - RNA, 25 nt, Human
cagagcaaaagcucucuccucccuu

SEQ ID NO: 107017 - RNA, 19 nt, Human
cagaggugguaccagaggc

SEQ ID NO: 107018 - RNA, 20 nt, Human
cagcaggcuggccugggcuu

SEQ ID NO: 107019 - RNA, 23 nt, Human
cagcaggcuggccugggcuuucu

SEQ ID NO: 107020 - RNA, 21 nt, Human
cagccaacacaguucccagac

SEQ ID NO: 107021 - RNA, 24 nt, Human
cagccuucucuccuccuaccuuuc

SEQ ID NO: 107022 - RNA, 23 nt, Human
cagguucucuucagguggaggaa

SEQ ID NO: 107023 - RNA, 19 nt, Human
ccaccugaacaagaacaaa

SEQ ID NO: 107024 - RNA, 20 nt, Human
ccagaaggaccaagggaaga

SEQ ID NO: 107025 - RNA, 21 nt, Human
ccagcccuccccagccuucuc

SEQ ID NO: 107026 - RNA, 22 nt, Human
cccaaucuguggccacacccag

SEQ ID NO: 107027 - RNA, 19 nt, Human
ccccagcccccucugcacc

SEQ ID NO: 107028 - RNA, 23 nt, Human
cccccaaucuguggccacaccca

SEQ ID NO: 107029 - RNA, 19 nt, Human
cccccucuugcucugccac

SEQ ID NO: 107030 - RNA, 21 nt, Human
ccccgcugacgggcacaccug

SEQ ID NO: 107031 - RNA, 18 nt, Human
cccgagcugcagcggcac

SEQ ID NO: 107032 - RNA, 21 nt, Human
cccuggacucagcaaaggcuc

SEQ ID NO: 107033 - RNA, 23 nt, Human
ccuauccacuggagacccagagc

SEQ ID NO: 107034 - RNA, 19 nt, Human
ccucccuucauccuccuuc

SEQ ID NO: 107035 - RNA, 20 nt, Human
ccuccuaccuuucccacuua

SEQ ID NO: 107036 - RNA, 21 nt, Human
ccuccuuccaggcuuguccag

SEQ ID NO: 107037 - RNA, 23 nt, Human
ccucuaucucucagcuguguccc

SEQ ID NO: 107038 - RNA, 23 nt, Human
ccucucucccuggacucagcaaa

SEQ ID NO: 107039 - RNA, 20 nt, Human
ccugugugcauauguaugug

SEQ ID NO: 107040 - RNA, 24 nt, Human
ccuucucuccuccuaccuuuccca

SEQ ID NO: 107041 - RNA, 24 nt, Human
ccuuuacuaagccccuuugccccc

SEQ ID NO: 107042 - RNA, 21 nt, Human
cgcacacccugugcccagagg

SEQ ID NO: 107043 - RNA, 19 nt, Human
cuaaacccucuacacaucc

SEQ ID NO: 107044 - RNA, 22 nt, Human
cucaugccuguaauccacucuu

SEQ ID NO: 107045 - RNA, 23 nt, Human
cuccccgcugacgggcacaccug

SEQ ID NO: 107046 - RNA, 26 nt, Human
cucccuggacucagcaaaggcuccca

SEQ ID NO: 107047 - RNA, 25 nt, Human
cuccucuaucucucagcuguguccc

SEQ ID NO: 107048 - RNA, 20 nt, Human
cucuccuccuaccuuuccca

SEQ ID NO: 107049 - RNA, 20 nt, Human
cucugcaccaugcacucucc

SEQ ID NO: 107050 - RNA, 19 nt, Human
cucuguguuccaaugugac

SEQ ID NO: 107051 - RNA, 21 nt, Human
cucuucccuaaagcaauuaaa

SEQ ID NO: 107052 - RNA, 19 nt, Human
cucuucuuuuaaacaugua

SEQ ID NO: 107053 - RNA, 24 nt, Human
cugauccugcuuucccccucuugc

SEQ ID NO: 107054 - RNA, 21 nt, Human
cugcaccaugcacucuccucc

SEQ ID NO: 107055 - RNA, 21 nt, Human
cuggccucgcucauaugucuu

SEQ ID NO: 107056 - RNA, 20 nt, Human
cugggugagcccugggacuc

SEQ ID NO: 107057 - RNA, 24 nt, Human
cuguccagggcugcugggagagcu

SEQ ID NO: 107058 - RNA, 20 nt, Human
cugugugcauauguauguga

SEQ ID NO: 107059 - RNA, 20 nt, Human
cuuccaggcuuguccagcau

SEQ ID NO: 107060 - RNA, 24 nt, Human
cuugaguaggagccaagucaucug

SEQ ID NO: 107061 - RNA, 21 nt, Human
cuugcugcccagcccucccca

SEQ ID NO: 107062 - RNA, 24 nt, Human
cuuggccgcagugcugggcucagc

SEQ ID NO: 107063 - RNA, 24 nt, Human
cuuguccagcaugauaaacucugg

SEQ ID NO: 107064 - RNA, 22 nt, Human
gaacaagaacaaagacauucuc

SEQ ID NO: 107065 - RNA, 18 nt, Human
gaccccugaacucuccuu

SEQ ID NO: 107066 - RNA, 22 nt, Human
gagaaggcagcuccagaggacu

SEQ ID NO: 107067 - RNA, 23 nt, Human
gaguaggagccaagucaucugaa

SEQ ID NO: 107068 - RNA, 23 nt, Human
gaguuccacuccccgcugacggg

SEQ ID NO: 107069 - RNA, 21 nt, Human
gaucagcuggagcuggcuggu

SEQ ID NO: 107070 - RNA, 18 nt, Human
gauccugcuuucccccuc

SEQ ID NO: 107071 - RNA, 22 nt, Human
gcagcuccagaggacucaaagg

SEQ ID NO: 107072 - RNA, 24 nt, Human
gcagguucucuucagguggaggaa

SEQ ID NO: 107073 - RNA, 20 nt, Human
gccagguacaguggcucaug

SEQ ID NO: 107074 - RNA, 20 nt, Human
gcccagcccuccccagccuu

SEQ ID NO: 107075 - RNA, 19 nt, Human
gccugggcuuucucccggg

SEQ ID NO: 107076 - RNA, 20 nt, Human
gccuguaauccacucuuaag

SEQ ID NO: 107077 - RNA, 18 nt, Human
gcuccagaggacucaaag

SEQ ID NO: 107078 - RNA, 22 nt, Human
ggaaagcagaggcgucagcuca

SEQ ID NO: 107079 - RNA, 18 nt, Human
ggaccccugaacucuccu

SEQ ID NO: 107080 - RNA, 23 nt, Human
ggagguguggcucacaggcaggg

SEQ ID NO: 107081 - RNA, 21 nt, Human
ggccugggcuuucucccgggc

SEQ ID NO: 107082 - RNA, 22 nt, Human
gggaagacaguuccagcccaga

SEQ ID NO: 107083 - RNA, 18 nt, Human
gggcagaggcggaggucc

SEQ ID NO: 107084 - RNA, 18 nt, Human
guccagcaggcuggccug

SEQ ID NO: 107085 - RNA, 19 nt, Human
guuccaagccaucacuuug

SEQ ID NO: 107086 - RNA, 18 nt, Human
uaaaggcacgauauaaac

SEQ ID NO: 107087 - RNA, 22 nt, Human
uaaagucuucgacuuggccgca

SEQ ID NO: 107088 - RNA, 22 nt, Human
uaacagggucagaaguucuguu

SEQ ID NO: 107089 - RNA, 18 nt, Human
uaagacaguguuccaagc

SEQ ID NO: 107090 - RNA, 20 nt, Human
uaccacaaacuccuugguca

SEQ ID NO: 107091 - RNA, 20 nt, Human
uagaagguagccgaaguggc

SEQ ID NO: 107092 - RNA, 27 nt, Human
uagagguuccucagcaccccaaagcuu

SEQ ID NO: 107093 - RNA, 18 nt, Human
uaggagccaagucaucug

SEQ ID NO: 107094 - RNA, 20 nt, Human
uaggagguguggcucacagg

SEQ ID NO: 107095 - RNA, 21 nt, Human
uauaaccaccugaacaagaac

SEQ ID NO: 107096 - RNA, 23 nt, Human
uauuuuguuauaaccaccugaac

SEQ ID NO: 107097 - RNA, 22 nt, Human
ucaagagagaaagaaacgugca

SEQ ID NO: 107098 - RNA, 23 nt, Human
ucacuggacacaacccuugacuc

SEQ ID NO: 107099 - RNA, 23 nt, Human
ucacugugccuggcuugcugccc

SEQ ID NO: 107100 - RNA, 23 nt, Human
ucacuuccgaguuuugccccguc

SEQ ID NO: 107101 - RNA, 21 nt, Human
ucagcuucaaggcuaaugugc

SEQ ID NO: 107102 - RNA, 21 nt, Human
uccaaggccuggaccagaagg

SEQ ID NO: 107103 - RNA, 21 nt, Human
uccaaugugacuuggguucau

SEQ ID NO: 107104 - RNA, 25 nt, Human
uccacaauccagguucccccaaucu

SEQ ID NO: 107105 - RNA, 18 nt, Human
uccagcaggcuggccugg

SEQ ID NO: 107106 - RNA, 22 nt, Human
ucccaaacgucguccucgugcc

SEQ ID NO: 107107 - RNA, 18 nt, Human
ucccacuuauugccuccu

SEQ ID NO: 107108 - RNA, 18 nt, Human
uccucagcaccccaaagc

SEQ ID NO: 107109 - RNA, 23 nt, Human
uccugagcucgggacuaaacccu

SEQ ID NO: 107110 - RNA, 24 nt, Human
uccuguugcaucagcuuccucucg

SEQ ID NO: 107111 - RNA, 22 nt, Human
ucucaagugguggacucaguuu

SEQ ID NO: 107112 - RNA, 22 nt, Human
ucucccuggacucagcaaaggc

SEQ ID NO: 107113 - RNA, 19 nt, Human
ucuccgugcgccccagccc

SEQ ID NO: 107114 - RNA, 20 nt, Human
ucucucagcugugucccugg

SEQ ID NO: 107115 - RNA, 22 nt, Human
ucugacccuucucacccaggag

SEQ ID NO: 107116 - RNA, 22 nt, Human
ucugcccgagcugcagcggcac

SEQ ID NO: 107117 - RNA, 19 nt, Human
ucugcuuuccuccaaggcc

SEQ ID NO: 107118 - RNA, 20 nt, Human
ucuugcucugccacucacug

SEQ ID NO: 107119 - RNA, 19 nt, Human
ugaacaagaacaaagacau

SEQ ID NO: 107120 - RNA, 21 nt, Human
ugaacaagaacaaagacauuc

SEQ ID NO: 107121 - RNA, 23 nt, Human
ugaacgcacacccugugcccaga

SEQ ID NO: 107122 - RNA, 22 nt, Human
ugacgggcacaccugccuucca

SEQ ID NO: 107123 - RNA, 22 nt, Human
ugacuuggguucauuuaugugg

SEQ ID NO: 107124 - RNA, 21 nt, Human
ugagaaggcagcuccagagga

SEQ ID NO: 107125 - RNA, 23 nt, Human
ugauuuucagcugaaggcaauua

SEQ ID NO: 107126 - RNA, 21 nt, Human
ugcaggaaaaguucagguuuc

SEQ ID NO: 107127 - RNA, 19 nt, Human
ugccagaucucccuugccc

SEQ ID NO: 107128 - RNA, 22 nt, Human
ugccagaucucccuugcccugc

SEQ ID NO: 107129 - RNA, 21 nt, Human
ugcccagaggaggaggggcaa

SEQ ID NO: 107130 - RNA, 22 nt, Human
ugcccccagagcuaggaggugu

SEQ ID NO: 107131 - RNA, 18 nt, Human
ugccuacuuggggagggg

SEQ ID NO: 107132 - RNA, 18 nt, Human
ugccuccuuccaggcuug

SEQ ID NO: 107133 - RNA, 19 nt, Human
ugccuccuuccaggcuugg

SEQ ID NO: 107134 - RNA, 19 nt, Human
uggcucaugccuguaaucc

SEQ ID NO: 107135 - RNA, 20 nt, Human
uggcucaugccuguaaucca

SEQ ID NO: 107136 - RNA, 22 nt, Human
uggcugcgugcggaucagcugg

SEQ ID NO: 107137 - RNA, 18 nt, Human
uggcuugcugcccagccc

SEQ ID NO: 107138 - RNA, 21 nt, Human
ugugcauauguaugugaugua

SEQ ID NO: 107139 - RNA, 18 nt, Human
ugugugcauauguaugug

SEQ ID NO: 107140 - RNA, 19 nt, Human
ugugugccugugugcauau

SEQ ID NO: 107141 - RNA, 24 nt, Human
ugugugccugugugcauauguaug

SEQ ID NO: 107142 - RNA, 23 nt, Human
uguuccaaugugacuuggguuca

SEQ ID NO: 107143 - RNA, 19 nt, Human
uuaaaggggaagaaagccc

SEQ ID NO: 107144 - RNA, 24 nt, Human
uuccugagcucgggacuaaacccu

SEQ ID NO: 107145 - RNA, 21 nt, Human
uugccaugugugccugugugc

SEQ ID NO: 107146 - RNA, 23 nt, Human
uuuacuaagccccuuugccccca

SEQ ID NO: 107147 - RNA, 24 nt, Human
uuugcccccagagcuaggaggugu

SEQ ID NO: 107148 - RNA, 18 nt, Human
uuuuuuuuuuuuuuucug

SEQ ID NO: 107149 - RNA, 19 nt, Human
aacuaaagcucuuccuauu

SEQ ID NO: 107150 - RNA, 20 nt, Human
acucugagagugugacagau

SEQ ID NO: 107151 - RNA, 21 nt, Human
auggcuccagcaguggcaggu

SEQ ID NO: 107152 - RNA, 19 nt, Human
auugauguuuucguccaga

SEQ ID NO: 107153 - RNA, 19 nt, Human
caagucccagacucugaga

SEQ ID NO: 107154 - RNA, 23 nt, Human
cagguuaaaaacaauacugccca

SEQ ID NO: 107155 - RNA, 22 nt, Human
caucucaaccaaugcguccguu

SEQ ID NO: 107156 - RNA, 20 nt, Human
cccacagcgcugcuucucca

SEQ ID NO: 107157 - RNA, 21 nt, Human
ccuuacuggaaacuucaucuc

SEQ ID NO: 107158 - RNA, 22 nt, Human
cgcugcuucuccagugcugggg

SEQ ID NO: 107159 - RNA, 22 nt, Human
cuggaaacuucaucucaaccaa

SEQ ID NO: 107160 - RNA, 21 nt, Human
cuuacuggaaacuucaucuca

SEQ ID NO: 107161 - RNA, 21 nt, Human
gagagugugacagauugcccc

SEQ ID NO: 107162 - RNA, 23 nt, Human
gcucagcagaauugcacagcagu

SEQ ID NO: 107163 - RNA, 20 nt, Human
gcuccagcaguggcagguuc

SEQ ID NO: 107164 - RNA, 20 nt, Human
gucagguuaaaaacaauacu

SEQ ID NO: 107165 - RNA, 25 nt, Human
guccagacaccugcuggugugaaag

SEQ ID NO: 107166 - RNA, 20 nt, Human
uaaauauccacauugcacug

SEQ ID NO: 107167 - RNA, 25 nt, Human
uauuuuacagccauaaauauccaca

SEQ ID NO: 107168 - RNA, 21 nt, Human
ucauuaggguuuucccagccc

SEQ ID NO: 107169 - RNA, 18 nt, Human
uccgugccggggacaggg

SEQ ID NO: 107170 - RNA, 22 nt, Human
ugauguuuucguccagacaccu

SEQ ID NO: 107171 - RNA, 19 nt, Human
ugauuacaaaaacgccaga

SEQ ID NO: 107172 - RNA, 23 nt, Human
ugccuuguugaaauggcuccagc

SEQ ID NO: 107173 - RNA, 21 nt, Human
ugugacagauugcccccacag

SEQ ID NO: 107174 - RNA, 27 nt, Human
uuaaaguaaaaguguguuucaguucau

SEQ ID NO: 107175 - RNA, 20 nt, Human
uucagccugggaacuaaagc

SEQ ID NO: 107176 - RNA, 18 nt, Human
uucccagcccagggagaa

SEQ ID NO: 107177 - RNA, 21 nt, Human
uuuuuuuuuuuuuuuuucauu

SEQ ID NO: 107178 - RNA, 21 nt, Human
acgcagggggaggugggggcg

SEQ ID NO: 107179 - RNA, 21 nt, Human
acgcagggggaggugggggcg

SEQ ID NO: 107180 - RNA, 18 nt, Human
acuccaggcuuccgcggc

SEQ ID NO: 107181 - RNA, 18 nt, Human
acuccaggcuuccgcggc

SEQ ID NO: 107182 - RNA, 21 nt, Human
agaggcuccccguuccgccgg

SEQ ID NO: 107183 - RNA, 18 nt, Human
cagggggaggugggggcg

SEQ ID NO: 107184 - RNA, 18 nt, Human
cagggggaggugggggcg

SEQ ID NO: 107185 - RNA, 19 nt, Human
ccgcccacuccaggcuucc

SEQ ID NO: 107186 - RNA, 20 nt, Human
ccgcgcgcgucugcguaccg

SEQ ID NO: 107187 - RNA, 20 nt, Human
ccgcgcgcgucugcguaccg

SEQ ID NO: 107188 - RNA, 22 nt, Human
ccucucaggggcugguaaaagu

SEQ ID NO: 107189 - RNA, 18 nt, Human
cuccaggcuuccgcggcc

SEQ ID NO: 107190 - RNA, 18 nt, Human
cuccaggcuuccgcggcc

SEQ ID NO: 107191 - RNA, 24 nt, Human
cuccuccugguccucucaggggcu

SEQ ID NO: 107192 - RNA, 24 nt, Human
cuccuccugguccucucaggggcu

SEQ ID NO: 107193 - RNA, 21 nt, Human
cucugcacuucuacccaaguc

SEQ ID NO: 107194 - RNA, 21 nt, Human
cucugcacuucuacccaaguc

SEQ ID NO: 107195 - RNA, 24 nt, Human
cugaaggccucaugucaaaggcgg

SEQ ID NO: 107196 - RNA, 24 nt, Human
cugaaggccucaugucaaaggcgg

SEQ ID NO: 107197 - RNA, 19 nt, Human
cuguccaaagucgagguag

SEQ ID NO: 107198 - RNA, 21 nt, Human
gaccugggucgccccggaaac

SEQ ID NO: 107199 - RNA, 21 nt, Human
gaccugggucgccccggaaac

SEQ ID NO: 107200 - RNA, 20 nt, Human
ggaggugggggcgggcagag

SEQ ID NO: 107201 - RNA, 20 nt, Human
ggaggugggggcgggcagag

SEQ ID NO: 107202 - RNA, 18 nt, Human
ggggaggugggggcgggc

SEQ ID NO: 107203 - RNA, 21 nt, Human
gugagccaaguuaaaugaagg

SEQ ID NO: 107204 - RNA, 21 nt, Human
gugagccaaguuaaaugaagg

SEQ ID NO: 107205 - RNA, 20 nt, Human
guggcucugcacuucuaccc

SEQ ID NO: 107206 - RNA, 20 nt, Human
guggcucugcacuucuaccc

SEQ ID NO: 107207 - RNA, 22 nt, Human
uaccgcccacuccaggcuuccg

SEQ ID NO: 107208 - RNA, 22 nt, Human
ucaaggaugcuccuccuggucc

SEQ ID NO: 107209 - RNA, 22 nt, Human
ucaaggaugcuccuccuggucc

SEQ ID NO: 107210 - RNA, 19 nt, Human
ucaugucaaaggcggggaa

SEQ ID NO: 107211 - RNA, 19 nt, Human
ucaugucaaaggcggggaa

SEQ ID NO: 107212 - RNA, 18 nt, Human
ugaaggucaaggaugcuc

SEQ ID NO: 107213 - RNA, 18 nt, Human
ugaaggucaaggaugcuc

SEQ ID NO: 107214 - RNA, 21 nt, Human
uuuuuuuuuuuuuuucauguu

SEQ ID NO: 107215 - RNA, 22 nt, Human
aaacagaaagaaaaaaagggac

SEQ ID NO: 107216 - RNA, 24 nt, Human
aaacagaaagaaaaaaaugucaca

SEQ ID NO: 107217 - RNA, 20 nt, Human
aacauggcaaaacugugucu

SEQ ID NO: 107218 - RNA, 20 nt, Human
aaguugagguaggagaauug

SEQ ID NO: 107219 - RNA, 24 nt, Human
aauugauugaacccgggaggugga

SEQ ID NO: 107220 - RNA, 19 nt, Human
acacagcaagacuccaucu

SEQ ID NO: 107221 - RNA, 20 nt, Human
acacagcaagacuccaucuc

SEQ ID NO: 107222 - RNA, 24 nt, Human
acacagcaagacuccaucucaaaa

SEQ ID NO: 107223 - RNA, 21 nt, Human
acauggcaaaacugugucucu

SEQ ID NO: 107224 - RNA, 24 nt, Human
acccgggagguggaggcugcagug

SEQ ID NO: 107225 - RNA, 23 nt, Human
accugagcugaggaauucaagac

SEQ ID NO: 107226 - RNA, 22 nt, Human
acgccacugcacuccagccuag

SEQ ID NO: 107227 - RNA, 24 nt, Human
acgccacugcacuccagccuaggc

SEQ ID NO: 107228 - RNA, 19 nt, Human
acugcacuccagccuaggc

SEQ ID NO: 107229 - RNA, 23 nt, Human
acugcacuccagccuaggcgaca

SEQ ID NO: 107230 - RNA, 26 nt, Human
acugcacuccagccuaggcgacacag

SEQ ID NO: 107231 - RNA, 22 nt, Human
agaauugauugaacccgggagg

SEQ ID NO: 107232 - RNA, 19 nt, Human
agaggccaaggcaggcagu

SEQ ID NO: 107233 - RNA, 24 nt, Human
agccuaggcgacacagcaagacuc

SEQ ID NO: 107234 - RNA, 18 nt, Human
agccuggccaacauggca

SEQ ID NO: 107235 - RNA, 19 nt, Human
agggaccggagaacacugg

SEQ ID NO: 107236 - RNA, 24 nt, Human
agguaggagaauugauugaacccg

SEQ ID NO: 107237 - RNA, 19 nt, Human
agguggaggcugcagugag

SEQ ID NO: 107238 - RNA, 24 nt, Human
agguggaggcugcagugagccaag

SEQ ID NO: 107239 - RNA, 24 nt, Human
aguggcucacgccuguaaucccag

SEQ ID NO: 107240 - RNA, 21 nt, Human
aucaccugagcugaggaauuc

SEQ ID NO: 107241 - RNA, 23 nt, Human
aucacgccacugcacuccagccu

SEQ ID NO: 107242 - RNA, 22 nt, Human
aucccagcacuuugagaggcca

SEQ ID NO: 107243 - RNA, 21 nt, Human
augcaaacaaauccauaaaca

SEQ ID NO: 107244 - RNA, 18 nt, Human
caacaacacccgaugcug

SEQ ID NO: 107245 - RNA, 24 nt, Human
caacauggcaaaacugugucucua

SEQ ID NO: 107246 - RNA, 21 nt, Human
caagacuccaucucaaaaaaa

SEQ ID NO: 107247 - RNA, 24 nt, Human
caagaucacgccacugcacuccag

SEQ ID NO: 107248 - RNA, 22 nt, Human
caagcucucuucuccgacacuc

SEQ ID NO: 107249 - RNA, 23 nt, Human
caagcucucuucuccgacacucc

SEQ ID NO: 107250 - RNA, 24 nt, Human
caaggccgggcacaguggcucacg

SEQ ID NO: 107251 - RNA, 21 nt, Human
caccaaacagaaagaaaaaaa

SEQ ID NO: 107252 - RNA, 24 nt, Human
cacgccuguaaucccagcacuuug

SEQ ID NO: 107253 - RNA, 19 nt, Human
cacugcacuccagccuagg

SEQ ID NO: 107254 - RNA, 21 nt, Human
cacugcacuccagccuaggcg

SEQ ID NO: 107255 - RNA, 22 nt, Human
cacugcacuccagccuaggcga

SEQ ID NO: 107256 - RNA, 23 nt, Human
cacugcacuccagccuaggcgac

SEQ ID NO: 107257 - RNA, 25 nt, Human
cacugcacuccagccuaggcgacac

SEQ ID NO: 107258 - RNA, 20 nt, Human
cagaaagaaaaaaaugucac

SEQ ID NO: 107259 - RNA, 22 nt, Human
cagaaaguucuccuguuggcuc

SEQ ID NO: 107260 - RNA, 24 nt, Human
cagcacuuugagaggccaaggcag

SEQ ID NO: 107261 - RNA, 25 nt, Human
cagcacuuugagaggccaaggcagg

SEQ ID NO: 107262 - RNA, 26 nt, Human
ccaaacagaaagaaaaaaaugucaca

SEQ ID NO: 107263 - RNA, 19 nt, Human
ccacugcacuccagccuag

SEQ ID NO: 107264 - RNA, 20 nt, Human
ccacugcacuccagccuagg

SEQ ID NO: 107265 - RNA, 20 nt, Human
ccacugcacuccagccuagg

SEQ ID NO: 107266 - RNA, 21 nt, Human
ccacugcacuccagccuaggc

SEQ ID NO: 107267 - RNA, 23 nt, Human
ccacugcacuccagccuaggcga

SEQ ID NO: 107268 - RNA, 24 nt, Human
ccacugcacuccagccuaggcgac

SEQ ID NO: 107269 - RNA, 18 nt, Human
ccaggcagugaacacggc

SEQ ID NO: 107270 - RNA, 22 nt, Human
ccugagcugaggaauucaagac

SEQ ID NO: 107271 - RNA, 19 nt, Human
ccuguaaucccagcuacuc

SEQ ID NO: 107272 - RNA, 21 nt, Human
ccuguaaucccagcuacucag

SEQ ID NO: 107273 - RNA, 23 nt, Human
cgccuguaaucccagcacuuuga

SEQ ID NO: 107274 - RNA, 24 nt, Human
cgccuguaaucccagcuacucagg

SEQ ID NO: 107275 - RNA, 19 nt, Human
cggaaggaucacagagcug

SEQ ID NO: 107276 - RNA, 24 nt, Human
cgggagguggaggcugcagugagc

SEQ ID NO: 107277 - RNA, 22 nt, Human
cucacgccuguaaucccagcac

SEQ ID NO: 107278 - RNA, 24 nt, Human
cucacgccuguaaucccagcacuu

SEQ ID NO: 107279 - RNA, 19 nt, Human
cuccaucucaaaaaaaaaa

SEQ ID NO: 107280 - RNA, 24 nt, Human
cucuucacuauuccucaacuucag

SEQ ID NO: 107281 - RNA, 23 nt, Human
gaggaacauccucuaacugaggc

SEQ ID NO: 107282 - RNA, 18 nt, Human
gaggcugcagugagccaa

SEQ ID NO: 107283 - RNA, 19 nt, Human
gaggcugcagugagccaag

SEQ ID NO: 107284 - RNA, 19 nt, Human
gaucacagagcuguggucu

SEQ ID NO: 107285 - RNA, 21 nt, Human
gaucacagagcuguggucuug

SEQ ID NO: 107286 - RNA, 20 nt, Human
gccaagaucacgccacugca

SEQ ID NO: 107287 - RNA, 20 nt, Human
gcgggcgccuguaaucccag

SEQ ID NO: 107288 - RNA, 20 nt, Human
ggaggcugcagugagccaag

SEQ ID NO: 107289 - RNA, 24 nt, Human
ggaggcugcagugagccaagauca

SEQ ID NO: 107290 - RNA, 23 nt, Human
ggcacaguggcucacgccuguaa

SEQ ID NO: 107291 - RNA, 18 nt, Human
gggcacaguggcucacgc

SEQ ID NO: 107292 - RNA, 24 nt, Human
gguggcgggcgccuguaaucccag

SEQ ID NO: 107293 - RNA, 18 nt, Human
ggugugguggcgggcgcc

SEQ ID NO: 107294 - RNA, 23 nt, Human
ggugugguggcgggcgccuguaa

SEQ ID NO: 107295 - RNA, 19 nt, Human
gucucuacuaaaaguacaa

SEQ ID NO: 107296 - RNA, 19 nt, Human
uccacacuaagauaccagg

SEQ ID NO: 107297 - RNA, 23 nt, Human
uccucaacuucaguuuccucauc

SEQ ID NO: 107298 - RNA, 25 nt, Human
ucucaaaaaaaaaaaaguuagccaa

SEQ ID NO: 107299 - RNA, 21 nt, Human
ucucuacuaaaaguacaaaaa

SEQ ID NO: 107300 - RNA, 18 nt, Human
ugaacacggcacacagau

SEQ ID NO: 107301 - RNA, 24 nt, Human
ugagaggccaaggcaggcauauca

SEQ ID NO: 107302 - RNA, 26 nt, Human
ugagggcccccagcuggagggaccgg

SEQ ID NO: 107303 - RNA, 24 nt, Human
ugagguaggagaauugauugaacc

SEQ ID NO: 107304 - RNA, 18 nt, Human
ugagucuuuuuuaaaguc

SEQ ID NO: 107305 - RNA, 18 nt, Human
ugcaaacaaauccauaaa

SEQ ID NO: 107306 - RNA, 22 nt, Human
uggauggaucgcagcucucucc

SEQ ID NO: 107307 - RNA, 20 nt, Human
uggccuggauggaucgcagc

SEQ ID NO: 107308 - RNA, 24 nt, Human
uggcucacgccuguaaucccagca

SEQ ID NO: 107309 - RNA, 24 nt, Human
ugguggcgggcgccuguaauccca

SEQ ID NO: 107310 - RNA, 24 nt, Human
uguaaucccagcuacucaggaagu

SEQ ID NO: 107311 - RNA, 19 nt, Human
ugugguggcgggcgccugu

SEQ ID NO: 107312 - RNA, 24 nt, Human
uuagccaaaugcuuaccagaaagu

SEQ ID NO: 107313 - RNA, 18 nt, Human
uuaucaaaaacucaccaa

SEQ ID NO: 107314 - RNA, 21 nt, Human
uugaaaaguuagccaaggccg

SEQ ID NO: 107315 - RNA, 24 nt, Human
uugauugaacccgggagguggagg

SEQ ID NO: 107316 - RNA, 24 nt, Human
uuggacaaacucuucacuauuccu

SEQ ID NO: 107317 - RNA, 21 nt, Human
uuucaggguccuuaggcuucg

SEQ ID NO: 107318 - RNA, 18 nt, Human
aaacccaagacaccuugc

SEQ ID NO: 107319 - RNA, 23 nt, Human
aaacuagaagaugaaaacgaagg

SEQ ID NO: 107320 - RNA, 26 nt, Human
aaacuagaagaugaaaacgaaggcaa

SEQ ID NO: 107321 - RNA, 22 nt, Human
aaagaaccaaaauaaacccaag

SEQ ID NO: 107322 - RNA, 24 nt, Human
aacccaagacaccuugcugacacu

SEQ ID NO: 107323 - RNA, 23 nt, Human
aagaaccaaaauaaacccaagac

SEQ ID NO: 107324 - RNA, 22 nt, Human
aagacaccuugcugacacuucc

SEQ ID NO: 107325 - RNA, 25 nt, Human
acaaccaaaagaauuagcacaaccu

SEQ ID NO: 107326 - RNA, 22 nt, Human
acauugugauuauucugcacau

SEQ ID NO: 107327 - RNA, 22 nt, Human
acuuccccaccccuaaacaaac

SEQ ID NO: 107328 - RNA, 25 nt, Human
agaaaaauucaacuuuucacaacca

SEQ ID NO: 107329 - RNA, 20 nt, Human
cacaccucuaaaaccucaag

SEQ ID NO: 107330 - RNA, 23 nt, Human
caccuugcugacacuuccccacc

SEQ ID NO: 107331 - RNA, 24 nt, Human
cauucuguuaaguuucauucaacu

SEQ ID NO: 107332 - RNA, 21 nt, Human
ccaaaauaaacccaagacacu

SEQ ID NO: 107333 - RNA, 25 nt, Human
ccaccccuaaacaaacugaugacuc

SEQ ID NO: 107334 - RNA, 21 nt, Human
cccuaaacaaacugaugacuc

SEQ ID NO: 107335 - RNA, 20 nt, Human
ccucaagacuucccuuuuuu

SEQ ID NO: 107336 - RNA, 18 nt, Human
ccuugcugacacuucccc

SEQ ID NO: 107337 - RNA, 20 nt, Human
ccuugcugacacuuccccac

SEQ ID NO: 107338 - RNA, 21 nt, Human
ccuugcugacacuuccccacc

SEQ ID NO: 107339 - RNA, 18 nt, Human
cuugcugacacuucccca

SEQ ID NO: 107340 - RNA, 22 nt, Human
gaaaacgaaggcaacagaaaaa

SEQ ID NO: 107341 - RNA, 21 nt, Human
gacacuuccccaccccuaaac

SEQ ID NO: 107342 - RNA, 18 nt, Human
gacuaguuaccuaaucca

SEQ ID NO: 107343 - RNA, 21 nt, Human
gaguuuaauuacagaaaaggc

SEQ ID NO: 107344 - RNA, 18 nt, Human
ggacugggcggggggggc

SEQ ID NO: 107345 - RNA, 26 nt, Human
ggaggcggcccggcuccgcuuccucg

SEQ ID NO: 107346 - RNA, 20 nt, Human
ggcccggcuccgcuuccucg

SEQ ID NO: 107347 - RNA, 21 nt, Human
ggggggcauugaggagaauuu

SEQ ID NO: 107348 - RNA, 24 nt, Human
uaaagaaccaaaauaaacccaaga

SEQ ID NO: 107349 - RNA, 25 nt, Human
uaaagaaccaaaauaaacccaagac

SEQ ID NO: 107350 - RNA, 19 nt, Human
uagaagaugaaaacgaagg

SEQ ID NO: 107351 - RNA, 26 nt, Human
uaucacacagguauguuuauucaaca

SEQ ID NO: 107352 - RNA, 20 nt, Human
uaugacuaguuaccuaaucc

SEQ ID NO: 107353 - RNA, 21 nt, Human
uccccaccccuaaacaaacug

SEQ ID NO: 107354 - RNA, 23 nt, Human
ugaaacauaauucacaccucuaa

SEQ ID NO: 107355 - RNA, 24 nt, Human
ugaaacauaauucacaccucuaaa

SEQ ID NO: 107356 - RNA, 22 nt, Human
ugaaaguuuguaaacuguauuu

SEQ ID NO: 107357 - RNA, 23 nt, Human
ugaugaaacauaauucacaccuc

SEQ ID NO: 107358 - RNA, 24 nt, Human
uuaaaauagacaaacuagaagaug

SEQ ID NO: 107359 - RNA, 25 nt, Human
uuaaaguaagagauuaaaaacucau

SEQ ID NO: 107360 - RNA, 24 nt, Human
uuagcacaaccuuagaaauaauuu

SEQ ID NO: 107361 - RNA, 27 nt, Human
uucaacacugucuuuugaaaauggacc

SEQ ID NO: 107362 - RNA, 25 nt, Human
uucacaaccaaaagaauuagcacaa

SEQ ID NO: 107363 - RNA, 21 nt, Human
uucuaaauaaaucuuuuuaaa

SEQ ID NO: 107364 - RNA, 23 nt, Human
uuuuuccugcuucauuuaaccuu

SEQ ID NO: 107365 - RNA, 20 nt, Human
aaaaaccagggcugagagug

SEQ ID NO: 107366 - RNA, 24 nt, Human
aaaaaucaguggaagagaaaagac

SEQ ID NO: 107367 - RNA, 18 nt, Human
aaccagcacccccucuuc

SEQ ID NO: 107368 - RNA, 25 nt, Human
aagaaccagagaagccagggcagag

SEQ ID NO: 107369 - RNA, 23 nt, Human
aaugaagccacaugcggccuggg

SEQ ID NO: 107370 - RNA, 24 nt, Human
acagcacaggcacuccccccgggg

SEQ ID NO: 107371 - RNA, 22 nt, Human
acaggcacuccccccggggccu

SEQ ID NO: 107372 - RNA, 25 nt, Human
accaaccccaaggagaagggaacgc

SEQ ID NO: 107373 - RNA, 20 nt, Human
accagagaagccagggcaga

SEQ ID NO: 107374 - RNA, 21 nt, Human
agaauaaauaaauaaauagug

SEQ ID NO: 107375 - RNA, 20 nt, Human
agacacaggcucugcugggg

SEQ ID NO: 107376 - RNA, 22 nt, Human
agcagucuaaaacuuuguuccc

SEQ ID NO: 107377 - RNA, 19 nt, Human
agccagggcagaguugggg

SEQ ID NO: 107378 - RNA, 23 nt, Human
agcgaguggaggucugggcccag

SEQ ID NO: 107379 - RNA, 18 nt, Human
agcgcagcagucuaaaac

SEQ ID NO: 107380 - RNA, 19 nt, Human
aggcuccggcugcauuuuc

SEQ ID NO: 107381 - RNA, 21 nt, Human
agguaauaaagguauaauguc

SEQ ID NO: 107382 - RNA, 23 nt, Human
agugcccauacaguucagguggc

SEQ ID NO: 107383 - RNA, 23 nt, Human
caaguugugugacaccuccccuc

SEQ ID NO: 107384 - RNA, 18 nt, Human
cacaugcggccugggggc

SEQ ID NO: 107385 - RNA, 18 nt, Human
caccaaacuguucuuugc

SEQ ID NO: 107386 - RNA, 22 nt, Human
cacccccucuuccugacagcac

SEQ ID NO: 107387 - RNA, 23 nt, Human
cagaaacagaggcuggcugccag

SEQ ID NO: 107388 - RNA, 20 nt, Human
caggacauccaggauugccu

SEQ ID NO: 107389 - RNA, 20 nt, Human
caguggaagagaaaagacca

SEQ ID NO: 107390 - RNA, 22 nt, Human
cagugguggcccucaaaccagc

SEQ ID NO: 107391 - RNA, 19 nt, Human
ccacaugcggccugggggc

SEQ ID NO: 107392 - RNA, 18 nt, Human
ccagggcagaguuggggu

SEQ ID NO: 107393 - RNA, 23 nt, Human
ccaguagggguccuacccgaccc

SEQ ID NO: 107394 - RNA, 21 nt, Human
cccauacaguucagguggcca

SEQ ID NO: 107395 - RNA, 22 nt, Human
ccccauccucugacacauggcu

SEQ ID NO: 107396 - RNA, 22 nt, Human
ccccugacaccaaccccaagga

SEQ ID NO: 107397 - RNA, 25 nt, Human
cccugacaccaaccccaaggagaau

SEQ ID NO: 107398 - RNA, 19 nt, Human
ccuacccgacccuggggau

SEQ ID NO: 107399 - RNA, 22 nt, Human
ccuagccuggcuuaccccucaa

SEQ ID NO: 107400 - RNA, 21 nt, Human
ccuccaaguugugugacaccu

SEQ ID NO: 107401 - RNA, 18 nt, Human
ccucccagaaacagaggc

SEQ ID NO: 107402 - RNA, 21 nt, Human
ccucccagaaacagaggcugg

SEQ ID NO: 107403 - RNA, 22 nt, Human
ccucccagaaacagaggcuggc

SEQ ID NO: 107404 - RNA, 25 nt, Human
ccucccagaaacagaggcuggcugc

SEQ ID NO: 107405 - RNA, 21 nt, Human
ccugcgccacagugagaccag

SEQ ID NO: 107406 - RNA, 18 nt, Human
ccugggccagcugccaga

SEQ ID NO: 107407 - RNA, 24 nt, Human
ccuugcucuugcuggcucuuccug

SEQ ID NO: 107408 - RNA, 22 nt, Human
cucgccccugacaccaacccca

SEQ ID NO: 107409 - RNA, 23 nt, Human
cucgccccugacaccaaccccaa

SEQ ID NO: 107410 - RNA, 24 nt, Human
cuuuccacagggaagaaccagaga

SEQ ID NO: 107411 - RNA, 20 nt, Human
gaagccacaugcggccuggg

SEQ ID NO: 107412 - RNA, 23 nt, Human
gacacauucacagacgggugggu

SEQ ID NO: 107413 - RNA, 21 nt, Human
gacagugggggcccaagucca

SEQ ID NO: 107414 - RNA, 22 nt, Human
gagaauaaauaaauaaauagug

SEQ ID NO: 107415 - RNA, 21 nt, Human
gcaggaagcagaccuagcaga

SEQ ID NO: 107416 - RNA, 20 nt, Human
gccacaugcggccugggggc

SEQ ID NO: 107417 - RNA, 21 nt, Human
gcggcagcggcgacuccggag

SEQ ID NO: 107418 - RNA, 24 nt, Human
gcugggggcagaagagaguggaca

SEQ ID NO: 107419 - RNA, 19 nt, Human
ggagcgcgugcuggguagg

SEQ ID NO: 107420 - RNA, 23 nt, Human
ggcaggaagcagaccuagcagaa

SEQ ID NO: 107421 - RNA, 22 nt, Human
ggcaggcaagcgaguggagguc

SEQ ID NO: 107422 - RNA, 23 nt, Human
gggcaggaagcagaccuagcaga

SEQ ID NO: 107423 - RNA, 24 nt, Human
gggcaggaagcagaccuagcagaa

SEQ ID NO: 107424 - RNA, 22 nt, Human
gggcaggcaagcgaguggaggu

SEQ ID NO: 107425 - RNA, 19 nt, Human
gggcugauguccccuccag

SEQ ID NO: 107426 - RNA, 18 nt, Human
ggggacugaggcuccggc

SEQ ID NO: 107427 - RNA, 22 nt, Human
gggugagggugggcagauugcc

SEQ ID NO: 107428 - RNA, 19 nt, Human
gguaauaaagguauaaugu

SEQ ID NO: 107429 - RNA, 22 nt, Human
gugagacaagguccugccuguc

SEQ ID NO: 107430 - RNA, 24 nt, Human
gugcgacugggugagggugggcag

SEQ ID NO: 107431 - RNA, 26 nt, Human
guggacacauucacagacgggugggu

SEQ ID NO: 107432 - RNA, 24 nt, Human
uaaaauaaagagguaauaaaggua

SEQ ID NO: 107433 - RNA, 18 nt, Human
uacagaaaaaucagugga

SEQ ID NO: 107434 - RNA, 21 nt, Human
uaccccucaacaaggggucac

SEQ ID NO: 107435 - RNA, 19 nt, Human
uagguacaugugugugccc

SEQ ID NO: 107436 - RNA, 19 nt, Human
uaugcagauacagcucugu

SEQ ID NO: 107437 - RNA, 21 nt, Human
uccccgcggcagcggcgacuc

SEQ ID NO: 107438 - RNA, 18 nt, Human
ucccggggcgcgcgggcg

SEQ ID NO: 107439 - RNA, 20 nt, Human
uccuacccgacccuggggag

SEQ ID NO: 107440 - RNA, 21 nt, Human
ucuagguacaugugugugccc

SEQ ID NO: 107441 - RNA, 20 nt, Human
ucucuggacuaccagggcuc

SEQ ID NO: 107442 - RNA, 21 nt, Human
ugagacaagguccugccuguc

SEQ ID NO: 107443 - RNA, 19 nt, Human
ugagggggugagacacagg

SEQ ID NO: 107444 - RNA, 18 nt, Human
ugccuggaggagggacag

SEQ ID NO: 107445 - RNA, 21 nt, Human
ugccuggaggagggacagugg

SEQ ID NO: 107446 - RNA, 23 nt, Human
ugccuggaggagggacagugggg

SEQ ID NO: 107447 - RNA, 24 nt, Human
ugccuggaggagggacaguggggg

SEQ ID NO: 107448 - RNA, 21 nt, Human
uggcucgccccugacaccaac

SEQ ID NO: 107449 - RNA, 21 nt, Human
uggggcugauguccccuccag

SEQ ID NO: 107450 - RNA, 22 nt, Human
ugggggcagaagagaguggaca

SEQ ID NO: 107451 - RNA, 23 nt, Human
ugggggcagaagagaguggacac

SEQ ID NO: 107452 - RNA, 19 nt, Human
ugggguuggcucgccccug

SEQ ID NO: 107453 - RNA, 22 nt, Human
ugggucaguaccaggacauccc

SEQ ID NO: 107454 - RNA, 25 nt, Human
ugguguguucuagguacaugugugu

SEQ ID NO: 107455 - RNA, 22 nt, Human
ugguuccagcaagaugucucag

SEQ ID NO: 107456 - RNA, 23 nt, Human
uguguucuagguacaugugugug

SEQ ID NO: 107457 - RNA, 19 nt, Human
uugguuccagcaagauguc

SEQ ID NO: 107458 - RNA, 24 nt, Human
uugguuccagcaagaugucucagg

SEQ ID NO: 107459 - RNA, 23 nt, Human
uugugugacaccuccccucuccc

SEQ ID NO: 107460 - RNA, 23 nt, Human
uuuccacagggaagaaccagaga

SEQ ID NO: 107461 - RNA, 20 nt, Human
uuuuacaugaaaaagguauc

SEQ ID NO: 107462 - RNA, 22 nt, Human
uuuuuuacaugaaaaagguauc

SEQ ID NO: 107463 - RNA, 27 nt, Human
aaaaaaaaaaaaaaaaaaaggaaagaa

SEQ ID NO: 107464 - RNA, 28 nt, Human
aaaaaaaaaaaggaaagaaacaaagagg

SEQ ID NO: 107465 - RNA, 26 nt, Human
aaaaaaaaaaggaaagaaacaaagag

SEQ ID NO: 107466 - RNA, 22 nt, Human
aaaaaaaggaaagaaacaaaga

SEQ ID NO: 107467 - RNA, 20 nt, Human
aaaaaagaaaaaccaaccaa

SEQ ID NO: 107468 - RNA, 20 nt, Human
aaaaaagguaaugaagaaaa

SEQ ID NO: 107469 - RNA, 23 nt, Human
aaaaggaaagaaacaaagagaaa

SEQ ID NO: 107470 - RNA, 20 nt, Human
aaaaguuugugaaugcuuug

SEQ ID NO: 107471 - RNA, 24 nt, Human
aaagucacaguuucgugggguaga

SEQ ID NO: 107472 - RNA, 23 nt, Human
aacaaagugcaaagagaugacug

SEQ ID NO: 107473 - RNA, 22 nt, Human
aacaacaaaguucauuccucuc

SEQ ID NO: 107474 - RNA, 23 nt, Human
aacaacaaaguucauuccucuca

SEQ ID NO: 107475 - RNA, 18 nt, Human
aacaacacgccgucacag

SEQ ID NO: 107476 - RNA, 22 nt, Human
aacaggaacaaggaugaaccua

SEQ ID NO: 107477 - RNA, 23 nt, Human
aagagucguggaggacccaaagc

SEQ ID NO: 107478 - RNA, 19 nt, Human
aaguguugaaaaaugcacc

SEQ ID NO: 107479 - RNA, 18 nt, Human
aauuugcgcuggauuuca

SEQ ID NO: 107480 - RNA, 21 nt, Human
acagaugagacacacaauaua

SEQ ID NO: 107481 - RNA, 19 nt, Human
accccgagacccaggagug

SEQ ID NO: 107482 - RNA, 22 nt, Human
accccgagacccaggagugcug

SEQ ID NO: 107483 - RNA, 20 nt, Human
acuguggaccaagagacaaa

SEQ ID NO: 107484 - RNA, 22 nt, Human
agaaaaaccaaccaauccuagg

SEQ ID NO: 107485 - RNA, 22 nt, Human
agaaagcaguucacagaugaga

SEQ ID NO: 107486 - RNA, 22 nt, Human
agcaaacauucaaucaaaucug

SEQ ID NO: 107487 - RNA, 20 nt, Human
agcaggaaggagcugggaug

SEQ ID NO: 107488 - RNA, 26 nt, Human
agcuggaagaguugagcugcggcugc

SEQ ID NO: 107489 - RNA, 24 nt, Human
aggaaagaaacaaagagaaaaaaa

SEQ ID NO: 107490 - RNA, 20 nt, Human
aggccagguugcaaucugga

SEQ ID NO: 107491 - RNA, 21 nt, Human
agggaaaggcucauuuggaaa

SEQ ID NO: 107492 - RNA, 19 nt, Human
auaaaaggcaaugaaaaca

SEQ ID NO: 107493 - RNA, 19 nt, Human
auaaaguuucuuguaaaua

SEQ ID NO: 107494 - RNA, 18 nt, Human
caaaaguaaguguugaaa

SEQ ID NO: 107495 - RNA, 18 nt, Human
caagacugaaagacccau

SEQ ID NO: 107496 - RNA, 21 nt, Human
caagcaacacauaaaacgcca

SEQ ID NO: 107497 - RNA, 19 nt, Human
caagucacugccuccgagc

SEQ ID NO: 107498 - RNA, 22 nt, Human
cacacggagcuccccacccucc

SEQ ID NO: 107499 - RNA, 30 nt, Human
cacagcaggacauuugccaaaggagcuacc

SEQ ID NO: 107500 - RNA, 25 nt, Human
cacccuggggaaagcagggccaacu

SEQ ID NO: 107501 - RNA, 20 nt, Human
caccuaaggacuucccaacc

SEQ ID NO: 107502 - RNA, 25 nt, Human
cacugagugggagguggugguuugc

SEQ ID NO: 107503 - RNA, 24 nt, Human
cacuuagguuaagacacgagcagg

SEQ ID NO: 107504 - RNA, 23 nt, Human
cagaacucccgacgggccucuuc

SEQ ID NO: 107505 - RNA, 21 nt, Human
cagacccagugggagccgcac

SEQ ID NO: 107506 - RNA, 20 nt, Human
cagccaccugccccuccugg

SEQ ID NO: 107507 - RNA, 18 nt, Human
cauguucaccugcugcgg

SEQ ID NO: 107508 - RNA, 24 nt, Human
cauuuggaaagucacaguuucgug

SEQ ID NO: 107509 - RNA, 20 nt, Human
cccacagacuccaagcaaca

SEQ ID NO: 107510 - RNA, 24 nt, Human
ccccacccuccagugaagauggcu

SEQ ID NO: 107511 - RNA, 27 nt, Human
ccccgagacccaggagugcugggcucc

SEQ ID NO: 107512 - RNA, 20 nt, Human
cccgaccccgagacccagga

SEQ ID NO: 107513 - RNA, 21 nt, Human
cccgaccccgagacccaggag

SEQ ID NO: 107514 - RNA, 24 nt, Human
cccgagacccaggagugcugggcu

SEQ ID NO: 107515 - RNA, 18 nt, Human
cccggcggagauggucca

SEQ ID NO: 107516 - RNA, 19 nt, Human
cccgugcagccugcagggc

SEQ ID NO: 107517 - RNA, 22 nt, Human
cccgugcagccugcagggcugu

SEQ ID NO: 107518 - RNA, 21 nt, Human
cccuccccgaccccgagaccc

SEQ ID NO: 107519 - RNA, 21 nt, Human
ccgagcugaggccccgaugac

SEQ ID NO: 107520 - RNA, 21 nt, Human
ccggcggagaugguccacuuc

SEQ ID NO: 107521 - RNA, 21 nt, Human
ccuaagagucguggaggaccc

SEQ ID NO: 107522 - RNA, 22 nt, Human
ccucagccaccugccccuccug

SEQ ID NO: 107523 - RNA, 24 nt, Human
ccuccagugaagauggcuguccac

SEQ ID NO: 107524 - RNA, 19 nt, Human
ccucuuuuuuuuuuuacga

SEQ ID NO: 107525 - RNA, 22 nt, Human
cgaccccacagacuccaagcaa

SEQ ID NO: 107526 - RNA, 23 nt, Human
cgcagacccagugggagccgcac

SEQ ID NO: 107527 - RNA, 23 nt, Human
cgcuugagcuccaguuucugcuc

SEQ ID NO: 107528 - RNA, 19 nt, Human
cgugcagccugcagggcug

SEQ ID NO: 107529 - RNA, 24 nt, Human
cucaagaagcccauuucucaugga

SEQ ID NO: 107530 - RNA, 18 nt, Human
cucagccaccugccccuc

SEQ ID NO: 107531 - RNA, 23 nt, Human
cucagccaccugccccuccugga

SEQ ID NO: 107532 - RNA, 21 nt, Human
cuccccgaccccgagacccag

SEQ ID NO: 107533 - RNA, 18 nt, Human
cucugugagcuggcgcuu

SEQ ID NO: 107534 - RNA, 21 nt, Human
cugaaauccuucucuggucgu

SEQ ID NO: 107535 - RNA, 22 nt, Human
cugcaccuaaggacuucccaac

SEQ ID NO: 107536 - RNA, 21 nt, Human
cugccuccgagcugaggcccc

SEQ ID NO: 107537 - RNA, 22 nt, Human
cugcuguggucucuuccagcuc

SEQ ID NO: 107538 - RNA, 19 nt, Human
cugggcuccgagcaagucu

SEQ ID NO: 107539 - RNA, 19 nt, Human
cuuagguuaagacacgagc

SEQ ID NO: 107540 - RNA, 20 nt, Human
cuuugaaagaguaacaaagu

SEQ ID NO: 107541 - RNA, 22 nt, Human
gaacaggaacaaggaugaaccu

SEQ ID NO: 107542 - RNA, 19 nt, Human
gaagauggcuguccacaac

SEQ ID NO: 107543 - RNA, 21 nt, Human
gaagauggcuguccacaacua

SEQ ID NO: 107544 - RNA, 20 nt, Human
gaaguuuggaggggacacug

SEQ ID NO: 107545 - RNA, 19 nt, Human
gacugcagggaggugccca

SEQ ID NO: 107546 - RNA, 20 nt, Human
gagacccaggagugcugggc

SEQ ID NO: 107547 - RNA, 22 nt, Human
gagacccaggagugcugggcuc

SEQ ID NO: 107548 - RNA, 21 nt, Human
gagcuccaguuucugcuccuc

SEQ ID NO: 107549 - RNA, 21 nt, Human
gagcugcggcugcuuucucaa

SEQ ID NO: 107550 - RNA, 23 nt, Human
gcaccuaaggacuucccaacccu

SEQ ID NO: 107551 - RNA, 18 nt, Human
gcccagggcaggcaccgg

SEQ ID NO: 107552 - RNA, 24 nt, Human
gcgcuggauuucaucucuaugugc

SEQ ID NO: 107553 - RNA, 21 nt, Human
gcguuguccucggucagcugg

SEQ ID NO: 107554 - RNA, 20 nt, Human
gcugcuuucucaaacuuccu

SEQ ID NO: 107555 - RNA, 18 nt, Human
gcuuggguccccaucagc

SEQ ID NO: 107556 - RNA, 22 nt, Human
ggaaagggaucugaacugugga

SEQ ID NO: 107557 - RNA, 22 nt, Human
ggagagcuguagcucugugagc

SEQ ID NO: 107558 - RNA, 18 nt, Human
gggaaaggcucauuugga

SEQ ID NO: 107559 - RNA, 18 nt, Human
gggaagugugaaguuugg

SEQ ID NO: 107560 - RNA, 23 nt, Human
gggagagcuguagcucugugagc

SEQ ID NO: 107561 - RNA, 19 nt, Human
gggagaugacgcugggggg

SEQ ID NO: 107562 - RNA, 22 nt, Human
ggucagcugguuuagcugcucc

SEQ ID NO: 107563 - RNA, 18 nt, Human
guccacuucacuucgcag

SEQ ID NO: 107564 - RNA, 19 nt, Human
gugaagauggcuguccaca

SEQ ID NO: 107565 - RNA, 18 nt, Human
guggaccaagagacaaaa

SEQ ID NO: 107566 - RNA, 18 nt, Human
guggucucuuccagcucu

SEQ ID NO: 107567 - RNA, 19 nt, Human
guggucucuuccagcucug

SEQ ID NO: 107568 - RNA, 22 nt, Human
gugguggccaguuagucggcaa

SEQ ID NO: 107569 - RNA, 21 nt, Human
guugaguucagcguuguccuc

SEQ ID NO: 107570 - RNA, 24 nt, Human
uaaccauguuguaguuagcauccc

SEQ ID NO: 107571 - RNA, 24 nt, Human
uacacuaugccucgguggcaaaga

SEQ ID NO: 107572 - RNA, 18 nt, Human
uacaguacagcuguuacg

SEQ ID NO: 107573 - RNA, 21 nt, Human
uaccacauggagguuuguagg

SEQ ID NO: 107574 - RNA, 21 nt, Human
uacgaugucacccuggggaaa

SEQ ID NO: 107575 - RNA, 20 nt, Human
uacuguggaccaagagacaa

SEQ ID NO: 107576 - RNA, 18 nt, Human
uagaaaccaauucaauuu

SEQ ID NO: 107577 - RNA, 25 nt, Human
uagcuaauuaggauucuaaccaugu

SEQ ID NO: 107578 - RNA, 22 nt, Human
uaguguguuugguguuuuccug

SEQ ID NO: 107579 - RNA, 18 nt, Human
uauauccugcuggcaucu

SEQ ID NO: 107580 - RNA, 24 nt, Human
uauccugcuggcaucuuggugguc

SEQ ID NO: 107581 - RNA, 25 nt, Human
ucaacaacaaaguucauuccucuca

SEQ ID NO: 107582 - RNA, 22 nt, Human
ucacccuggggaaagcagggcc

SEQ ID NO: 107583 - RNA, 21 nt, Human
ucacugccuccgagcugaggc

SEQ ID NO: 107584 - RNA, 20 nt, Human
ucagcugguuuagcugcucc

SEQ ID NO: 107585 - RNA, 22 nt, Human
ucagugaccuuuccaaauacug

SEQ ID NO: 107586 - RNA, 24 nt, Human
ucagugaccuuuccaaauacugug

SEQ ID NO: 107587 - RNA, 23 nt, Human
uccccuccccgaccccgagaccc

SEQ ID NO: 107588 - RNA, 21 nt, Human
uccgcagacccagugggagcc

SEQ ID NO: 107589 - RNA, 21 nt, Human
ucugucuucgccuggcgaagc

SEQ ID NO: 107590 - RNA, 30 nt, Human
ucuguugucuuaaaaaaaaaaaaaaaaaaa

SEQ ID NO: 107591 - RNA, 22 nt, Human
ucuuccagcucugucuucgccu

SEQ ID NO: 107592 - RNA, 19 nt, Human
ugaaaugccaagacugaaa

SEQ ID NO: 107593 - RNA, 19 nt, Human
ugaaguuuggaggggacac

SEQ ID NO: 107594 - RNA, 18 nt, Human
ugaccgggacuguucuac

SEQ ID NO: 107595 - RNA, 19 nt, Human
ugaccgggacuguucuaca

SEQ ID NO: 107596 - RNA, 22 nt, Human
ugacugcagggaggugcccagg

SEQ ID NO: 107597 - RNA, 23 nt, Human
ugacugcagggaggugcccaggg

SEQ ID NO: 107598 - RNA, 23 nt, Human
ugagacacacaauauacauuuuc

SEQ ID NO: 107599 - RNA, 22 nt, Human
ugcaaagagaugacugcaggga

SEQ ID NO: 107600 - RNA, 20 nt, Human
ugcaggcagggaagugugaa

SEQ ID NO: 107601 - RNA, 21 nt, Human
ugcccagggcaggcaccgggc

SEQ ID NO: 107602 - RNA, 24 nt, Human
ugcccagggcaggcaccgggcgcu

SEQ ID NO: 107603 - RNA, 21 nt, Human
uggaaacgggucuaccuuuga

SEQ ID NO: 107604 - RNA, 21 nt, Human
uggaaagcgggaacagcaggc

SEQ ID NO: 107605 - RNA, 18 nt, Human
uggaggggacacugagug

SEQ ID NO: 107606 - RNA, 21 nt, Human
uggaggggacacugaguggga

SEQ ID NO: 107607 - RNA, 19 nt, Human
uggccccaagucacugccu

SEQ ID NO: 107608 - RNA, 19 nt, Human
uggcugagcacgugggcgc

SEQ ID NO: 107609 - RNA, 24 nt, Human
ugggaggggaagucgucaaggcca

SEQ ID NO: 107610 - RNA, 21 nt, Human
ugggccccgcugagccagagg

SEQ ID NO: 107611 - RNA, 21 nt, Human
uggggagaugacgcugggggg

SEQ ID NO: 107612 - RNA, 20 nt, Human
uggguccccaucagcagagu

SEQ ID NO: 107613 - RNA, 23 nt, Human
uggugggaggggaagucgucaag

SEQ ID NO: 107614 - RNA, 18 nt, Human
ugugaacagagucauccu

SEQ ID NO: 107615 - RNA, 21 nt, Human
uguguuugguguuuuccugca

SEQ ID NO: 107616 - RNA, 22 nt, Human
uguguuugguguuuuccugcag

SEQ ID NO: 107617 - RNA, 19 nt, Human
uucacagaugagacacacc

SEQ ID NO: 107618 - RNA, 21 nt, Human
uucaucucuaugugccgugag

SEQ ID NO: 107619 - RNA, 20 nt, Human
uucugcuguggucucuucca

SEQ ID NO: 107620 - RNA, 23 nt, Human
uugaaagaguaacaaagugcaaa

SEQ ID NO: 107621 - RNA, 23 nt, Human
uuucugcuccucgugcucuagac

SEQ ID NO: 107622 - RNA, 25 nt, Human
uuugcugaaauccuucucuggucgu

SEQ ID NO: 107623 - RNA, 22 nt, Human
aaaauuggaagcaauuacucua

SEQ ID NO: 107624 - RNA, 23 nt, Human
aaacugaggcggcgaugcccaaa

SEQ ID NO: 107625 - RNA, 20 nt, Human
aagauugaagcaagccauga

SEQ ID NO: 107626 - RNA, 21 nt, Human
aagcaggggaauuccuuaggu

SEQ ID NO: 107627 - RNA, 23 nt, Human
aagcgcggaaggcugggagggcu

SEQ ID NO: 107628 - RNA, 25 nt, Human
acaguaacaacaugcuguaccccaa

SEQ ID NO: 107629 - RNA, 23 nt, Human
acaugcuguaccccaaggaagac

SEQ ID NO: 107630 - RNA, 18 nt, Human
accccaaggaagacaagg

SEQ ID NO: 107631 - RNA, 21 nt, Human
accgcauucugcucuacgcgg

SEQ ID NO: 107632 - RNA, 20 nt, Human
acgcggugagcgccgggguc

SEQ ID NO: 107633 - RNA, 22 nt, Human
agauaucaaaagauugaagcaa

SEQ ID NO: 107634 - RNA, 25 nt, Human
agauaucaaaagauugaagcaagcc

SEQ ID NO: 107635 - RNA, 23 nt, Human
agccaugaaaccucugcgcggag

SEQ ID NO: 107636 - RNA, 19 nt, Human
aggaggggcagucaguggc

SEQ ID NO: 107637 - RNA, 19 nt, Human
aggcggcgaagacugaagc

SEQ ID NO: 107638 - RNA, 19 nt, Human
aggcgggcgaggaauggcu

SEQ ID NO: 107639 - RNA, 26 nt, Human
aucaaaagauugaagcaagccaugaa

SEQ ID NO: 107640 - RNA, 18 nt, Human
augcucaguguuuugcgg

SEQ ID NO: 107641 - RNA, 18 nt, Human
cagcguggccccgcccug

SEQ ID NO: 107642 - RNA, 26 nt, Human
caguaacaacaugcuguaccccaagg

SEQ ID NO: 107643 - RNA, 22 nt, Human
caugcgcacuggccuucaacca

SEQ ID NO: 107644 - RNA, 20 nt, Human
ccaauccgcgcucuccugcc

SEQ ID NO: 107645 - RNA, 19 nt, Human
ccagaacaggcggcgaaga

SEQ ID NO: 107646 - RNA, 19 nt, Human
ccccaaggaagacaaggag

SEQ ID NO: 107647 - RNA, 24 nt, Human
ccccaaggaagacaaggagaaccc

SEQ ID NO: 107648 - RNA, 20 nt, Human
ccccgcccugcccccugccu

SEQ ID NO: 107649 - RNA, 23 nt, Human
ccccgccuccugcuccgugccug

SEQ ID NO: 107650 - RNA, 22 nt, Human
ccccuggcaccucccccucccc

SEQ ID NO: 107651 - RNA, 23 nt, Human
cccuccgcugcaccucaagugau

SEQ ID NO: 107652 - RNA, 20 nt, Human
cccuggcaccucccccuccc

SEQ ID NO: 107653 - RNA, 24 nt, Human
ccgagcccgaggcggcggggagcc

SEQ ID NO: 107654 - RNA, 19 nt, Human
ccgcagccgccgccgccgc

SEQ ID NO: 107655 - RNA, 19 nt, Human
ccgcagccgccgccgccgc

SEQ ID NO: 107656 - RNA, 25 nt, Human
ccgcagccgccgccgccgcugcugc

SEQ ID NO: 107657 - RNA, 19 nt, Human
ccgcauucugcucuacgcg

SEQ ID NO: 107658 - RNA, 19 nt, Human
ccgccaaucgccgccgucc

SEQ ID NO: 107659 - RNA, 22 nt, Human
ccgccgccgccgcugcugcugc

SEQ ID NO: 107660 - RNA, 18 nt, Human
ccgcgcucuccugccagg

SEQ ID NO: 107661 - RNA, 19 nt, Human
ccucaagugauccugacuc

SEQ ID NO: 107662 - RNA, 21 nt, Human
ccugacucucauguccugccc

SEQ ID NO: 107663 - RNA, 23 nt, Human
ccugcuccgugccugaccaaucc

SEQ ID NO: 107664 - RNA, 18 nt, Human
ccuggcaccucccccucc

SEQ ID NO: 107665 - RNA, 21 nt, Human
ccuggcaccucccccucccca

SEQ ID NO: 107666 - RNA, 22 nt, Human
cgaggcggcggggagccagcac

SEQ ID NO: 107667 - RNA, 20 nt, Human
cgccaggaagagggcucucc

SEQ ID NO: 107668 - RNA, 19 nt, Human
cgccauggagcccgacggg

SEQ ID NO: 107669 - RNA, 18 nt, Human
cggcccgggaaaggacca

SEQ ID NO: 107670 - RNA, 25 nt, Human
cgggaaaggaccagaacaggcggcg

SEQ ID NO: 107671 - RNA, 19 nt, Human
cggggagccagcacgugug

SEQ ID NO: 107672 - RNA, 21 nt, Human
cggugagcgccggggucuucc

SEQ ID NO: 107673 - RNA, 21 nt, Human
cguggccccgcccugcccccu

SEQ ID NO: 107674 - RNA, 23 nt, Human
cucccuguucgcccuccgcugca

SEQ ID NO: 107675 - RNA, 29 nt, Human
cuccgugccugaccaauccgcgcucuccc

SEQ ID NO: 107676 - RNA, 23 nt, Human
cugacucucauguccugcccauc

SEQ ID NO: 107677 - RNA, 22 nt, Human
cugcugcugcugggcuaucagc

SEQ ID NO: 107678 - RNA, 24 nt, Human
gagccgagcccgaggcggcgggga

SEQ ID NO: 107679 - RNA, 24 nt, Human
gccaagcgccuuggcuucuguccu

SEQ ID NO: 107680 - RNA, 24 nt, Human
gcccaaaaauuggaagcaauuacu

SEQ ID NO: 107681 - RNA, 21 nt, Human
gcccaguccgcgaaggguaaa

SEQ ID NO: 107682 - RNA, 23 nt, Human
gcgaagcaccuaggccuggcccc

SEQ ID NO: 107683 - RNA, 25 nt, Human
ggaccagaacaggcggcgaagacug

SEQ ID NO: 107684 - RNA, 21 nt, Human
ggagagagccgagcccgaggg

SEQ ID NO: 107685 - RNA, 19 nt, Human
ggcgaagacugaagcccgg

SEQ ID NO: 107686 - RNA, 21 nt, Human
ggucaggagaaaagggccaug

SEQ ID NO: 107687 - RNA, 23 nt, Human
uaaaauggggucaggagaaaagg

SEQ ID NO: 107688 - RNA, 20 nt, Human
uaaccccuggcaccuccccc

SEQ ID NO: 107689 - RNA, 20 nt, Human
uaggaguggcaagagcucgc

SEQ ID NO: 107690 - RNA, 19 nt, Human
ucaauggcaaaggaaaaaa

SEQ ID NO: 107691 - RNA, 20 nt, Human
uccgccaaucgccgccgucc

SEQ ID NO: 107692 - RNA, 23 nt, Human
ugaagcaagccaugaaaccucug

SEQ ID NO: 107693 - RNA, 22 nt, Human
ugaccaauccgcgcucuccugc

SEQ ID NO: 107694 - RNA, 21 nt, Human
ugccugcagcgcgguccagcc

SEQ ID NO: 107695 - RNA, 25 nt, Human
ugcggaugccugcagcgcgguccag

SEQ ID NO: 107696 - RNA, 18 nt, Human
uguccugcccauccccaa

SEQ ID NO: 107697 - RNA, 23 nt, Human
ugugaucggacucccuguucgcc

SEQ ID NO: 107698 - RNA, 21 nt, Human
uguuagaaggcgggcgaggaa

SEQ ID NO: 107699 - RNA, 22 nt, Human
uucccggcucuggcaccagauc

SEQ ID NO: 107700 - RNA, 19 nt, Human
uugaagcaagccaugaaac

SEQ ID NO: 107701 - RNA, 19 nt, Human
aagcagcagggcugguguc

SEQ ID NO: 107702 - RNA, 21 nt, Human
agcaaggcuaagggcucgcca

SEQ ID NO: 107703 - RNA, 21 nt, Human
caaaaaaauaaacucuaccaa

SEQ ID NO: 107704 - RNA, 21 nt, Human
caaggcuaagggcucgccaga

SEQ ID NO: 107705 - RNA, 21 nt, Human
ccaagggugacggaagucucu

SEQ ID NO: 107706 - RNA, 21 nt, Human
ccaggcaauaaguuaggaagc

SEQ ID NO: 107707 - RNA, 19 nt, Human
gcagggcuggugucgggug

SEQ ID NO: 107708 - RNA, 22 nt, Human
gccgggcgggggcgggggcgcu

SEQ ID NO: 107709 - RNA, 26 nt, Human
ggcagcucccggagcgacgcaggccg

SEQ ID NO: 107710 - RNA, 19 nt, Human
ggccgggcgggggcggggg

SEQ ID NO: 107711 - RNA, 18 nt, Human
ggcggccgggcgggggcg

SEQ ID NO: 107712 - RNA, 18 nt, Human
ggcggcggcgggcgggcg

SEQ ID NO: 107713 - RNA, 18 nt, Human
ggcgggggcgcuccgucc

SEQ ID NO: 107714 - RNA, 20 nt, Human
ggcuggugucgggugugggc

SEQ ID NO: 107715 - RNA, 19 nt, Human
uaaacucuaccaaggguga

SEQ ID NO: 107716 - RNA, 24 nt, Human
ucccggagcgacgcaggccgaaca

SEQ ID NO: 107717 - RNA, 19 nt, Human
ucuacagcaaggcuaaggg

SEQ ID NO: 107718 - RNA, 24 nt, Human
ucucuacagcaaggcuaagggcuc

SEQ ID NO: 107719 - RNA, 25 nt, Human
aaaagaagaggacccugccagggag

SEQ ID NO: 107720 - RNA, 21 nt, Human
acucugagaaggguggagaga

SEQ ID NO: 107721 - RNA, 19 nt, Human
agaccuggcugggcugggc

SEQ ID NO: 107722 - RNA, 24 nt, Human
agaccuggcugggcugggcugaag

SEQ ID NO: 107723 - RNA, 18 nt, Human
agcccccaggugggacuc

SEQ ID NO: 107724 - RNA, 19 nt, Human
aggagaccuggcugggcug

SEQ ID NO: 107725 - RNA, 22 nt, Human
aggagaccuggcugggcugggc

SEQ ID NO: 107726 - RNA, 21 nt, Human
agugagggagcaggacucugg

SEQ ID NO: 107727 - RNA, 21 nt, Human
cagucgguggcaggugggcag

SEQ ID NO: 107728 - RNA, 19 nt, Human
ccgagugugcugggagcuc

SEQ ID NO: 107729 - RNA, 19 nt, Human
ccuggcugggcugggcuga

SEQ ID NO: 107730 - RNA, 22 nt, Human
cugggagcucuccauuaacuag

SEQ ID NO: 107731 - RNA, 25 nt, Human
gaaaagaagaggacccugccaggga

SEQ ID NO: 107732 - RNA, 20 nt, Human
gagcaggacucuggugggcc

SEQ ID NO: 107733 - RNA, 23 nt, Human
gcugggcugggcugaaggggggc

SEQ ID NO: 107734 - RNA, 22 nt, Human
gcugucuguauccuggagguga

SEQ ID NO: 107735 - RNA, 22 nt, Human
ggacucugggacagggggcggg

SEQ ID NO: 107736 - RNA, 24 nt, Human
ggcugggcugggcugaaggggggc

SEQ ID NO: 107737 - RNA, 18 nt, Human
ggggcugucuguauccug

SEQ ID NO: 107738 - RNA, 18 nt, Human
uaacuagagcuccugguu

SEQ ID NO: 107739 - RNA, 21 nt, Human
uaggagaccuggcugggcugg

SEQ ID NO: 107740 - RNA, 23 nt, Human
uaggagaccuggcugggcugggc

SEQ ID NO: 107741 - RNA, 18 nt, Human
uccagaggauggagccca

SEQ ID NO: 107742 - RNA, 19 nt, Human
ucccacuggcuggguucca

SEQ ID NO: 107743 - RNA, 21 nt, Human
ucugggaaaagaagaggaccc

SEQ ID NO: 107744 - RNA, 19 nt, Human
uggaacucugguugaaacu

SEQ ID NO: 107745 - RNA, 22 nt, Human
uggagacaaagcacaagcuccc

SEQ ID NO: 107746 - RNA, 20 nt, Human
uggcugggcugggcugaagg

SEQ ID NO: 107747 - RNA, 21 nt, Human
uggcugggcugggcugaaggg

SEQ ID NO: 107748 - RNA, 25 nt, Human
uggcugggcugggcugaaggggggc

SEQ ID NO: 107749 - RNA, 20 nt, Human
ugggcugggcugaagggggg

SEQ ID NO: 107750 - RNA, 21 nt, Human
ugggcugggcugaaggggggc

SEQ ID NO: 107751 - RNA, 23 nt, Human
ugggcugggcugaaggggggcug

SEQ ID NO: 107752 - RNA, 24 nt, Human
uggugggccaggcccucccacugg

SEQ ID NO: 107753 - RNA, 20 nt, Human
ugguugggguggagcucugg

SEQ ID NO: 107754 - RNA, 18 nt, Human
ugugcugggagcucucca

SEQ ID NO: 107755 - RNA, 19 nt, Human
ugugcugggagcucuccau

SEQ ID NO: 107756 - RNA, 24 nt, Human
uucauuggccagaauccagaggau

SEQ ID NO: 107757 - RNA, 22 nt, Human
uuuuuuuuuaaggccaccaaug

SEQ ID NO: 107758 - RNA, 18 nt, Human
uuuuuuuuuuuuaaggcc

SEQ ID NO: 107759 - RNA, 23 nt, Human
uuuuuuuuuuuuuuuuuuuaagg

SEQ ID NO: 107760 - RNA, 22 nt, Human
aacagggagggaggaugcaacc

SEQ ID NO: 107761 - RNA, 24 nt, Human
aagauccggaacagggagggagga

SEQ ID NO: 107762 - RNA, 18 nt, Human
aggcaggggaugcggggg

SEQ ID NO: 107763 - RNA, 19 nt, Human
aggcaggggaugcgggggc

SEQ ID NO: 107764 - RNA, 25 nt, Human
aggcugcagccgaaaugggggucgg

SEQ ID NO: 107765 - RNA, 20 nt, Human
aggcuggagccggaauggga

SEQ ID NO: 107766 - RNA, 23 nt, Human
ccggaacagggagggaggaugca

SEQ ID NO: 107767 - RNA, 22 nt, Human
cgcaagauaagauccggaacag

SEQ ID NO: 107768 - RNA, 18 nt, Human
cugcagccgaaauggggg

SEQ ID NO: 107769 - RNA, 22 nt, Human
cuugagucaucagcuggcgaug

SEQ ID NO: 107770 - RNA, 20 nt, Human
gagcaaguagaaugggccau

SEQ ID NO: 107771 - RNA, 18 nt, Human
gcgcuggcgcaagauaag

SEQ ID NO: 107772 - RNA, 21 nt, Human
ggaggcaggggaugcgggggc

SEQ ID NO: 107773 - RNA, 23 nt, Human
ugaggucuggcuacgggauccug

SEQ ID NO: 107774 - RNA, 23 nt, Human
ugggaaucuugagucaucagcug

SEQ ID NO: 107775 - RNA, 23 nt, Human
ugggccaucauuagaaugagcaa

SEQ ID NO: 107776 - RNA, 20 nt, Human
acuuggcuugugacuucugu

SEQ ID NO: 107777 - RNA, 22 nt, Human
aucuccccugguuccuccccaa

SEQ ID NO: 107778 - RNA, 19 nt, Human
cagaaaacuucccagucac

SEQ ID NO: 107779 - RNA, 21 nt, Human
cugguuccuccccaacccguu

SEQ ID NO: 107780 - RNA, 20 nt, Human
gaaaacuucccagucaccgg

SEQ ID NO: 107781 - RNA, 19 nt, Human
gacgguugacaucuccccu

SEQ ID NO: 107782 - RNA, 19 nt, Human
uaaagauaggcaggaucua

SEQ ID NO: 107783 - RNA, 24 nt, Human
ucucacuuggcuugugacuucugu

SEQ ID NO: 107784 - RNA, 20 nt, Human
ucuccccugguuccucccca

SEQ ID NO: 107785 - RNA, 22 nt, Human
ucuccccugguuccuccccaac

SEQ ID NO: 107786 - RNA, 24 nt, Human
ugaaaaguggccugcuggcuaugc

SEQ ID NO: 107787 - RNA, 20 nt, Human
aaaaaguuucagcagagaca

SEQ ID NO: 107788 - RNA, 20 nt, Human
aaaauaaagcaaacauggga

SEQ ID NO: 107789 - RNA, 19 nt, Human
aagcaaacaugggauuuuc

SEQ ID NO: 107790 - RNA, 21 nt, Human
aagcaaacaugggauuuucac

SEQ ID NO: 107791 - RNA, 21 nt, Human
acagaaaaagaguucaagcau

SEQ ID NO: 107792 - RNA, 20 nt, Human
accauacaguugaaaaaaac

SEQ ID NO: 107793 - RNA, 21 nt, Human
acuugcugauccucugagacu

SEQ ID NO: 107794 - RNA, 19 nt, Human
agcaaguaagagaaaguca

SEQ ID NO: 107795 - RNA, 21 nt, Human
aggccacaacaucugggauca

SEQ ID NO: 107796 - RNA, 21 nt, Human
agucaauacugauggccucca

SEQ ID NO: 107797 - RNA, 22 nt, Human
caaaaagguacuaaagaugaua

SEQ ID NO: 107798 - RNA, 23 nt, Human
caacaucugggaucaaggaacac

SEQ ID NO: 107799 - RNA, 19 nt, Human
cacaacaucugggaucaag

SEQ ID NO: 107800 - RNA, 21 nt, Human
cccaggccacaacaucuggga

SEQ ID NO: 107801 - RNA, 22 nt, Human
ccucugagacugcaucuuauag

SEQ ID NO: 107802 - RNA, 25 nt, Human
cuuauaguucauaaaaucugcuuug

SEQ ID NO: 107803 - RNA, 18 nt, Human
gaacacauuuugacuaaa

SEQ ID NO: 107804 - RNA, 19 nt, Human
gaguuucacagaaaaagag

SEQ ID NO: 107805 - RNA, 24 nt, Human
gggauuuucacaaaguuaagagcc

SEQ ID NO: 107806 - RNA, 22 nt, Human
gucacaacugagguacaacgac

SEQ ID NO: 107807 - RNA, 23 nt, Human
gucacaacugagguacaacgacu

SEQ ID NO: 107808 - RNA, 26 nt, Human
uaacauagaaauuuuauuacagcauu

SEQ ID NO: 107809 - RNA, 22 nt, Human
uacagcaaguaagagaaaguca

SEQ ID NO: 107810 - RNA, 21 nt, Human
uagaccauacaguugaaaaaa

SEQ ID NO: 107811 - RNA, 22 nt, Human
ucaagcauuagcgcaaacugcc

SEQ ID NO: 107812 - RNA, 18 nt, Human
ucacagaaaaagaguuca

SEQ ID NO: 107813 - RNA, 23 nt, Human
ucuuauaguucauaaaaucugcu

SEQ ID NO: 107814 - RNA, 20 nt, Human
ugaaaaaaacacagucucau

SEQ ID NO: 107815 - RNA, 18 nt, Human
ugaaaaaugugaauacau

SEQ ID NO: 107816 - RNA, 25 nt, Human
ugaaaccacugaaaaaugugaauac

SEQ ID NO: 107817 - RNA, 20 nt, Human
ugagccccaaaauguuuaac

SEQ ID NO: 107818 - RNA, 24 nt, Human
ugagguacaacgacuuguguuacu

SEQ ID NO: 107819 - RNA, 22 nt, Human
uggucauaccuuaaugaguuuc

SEQ ID NO: 107820 - RNA, 21 nt, Human
uugcugauccucugagacugc

SEQ ID NO: 107821 - RNA, 20 nt, Human
aaaacacccacaggcaccca

SEQ ID NO: 107822 - RNA, 19 nt, Human
aaaagacucuaacaacaua

SEQ ID NO: 107823 - RNA, 23 nt, Human
aaacacccacaggcacccaucca

SEQ ID NO: 107824 - RNA, 18 nt, Human
aaacagguuaaccaaauc

SEQ ID NO: 107825 - RNA, 19 nt, Human
aacaaaaaacaacuuacag

SEQ ID NO: 107826 - RNA, 18 nt, Human
aaccuuuaaggaacauuc

SEQ ID NO: 107827 - RNA, 20 nt, Human
aacgaaauaaaaacagcuuc

SEQ ID NO: 107828 - RNA, 20 nt, Human
aacgaaauugcauucuugug

SEQ ID NO: 107829 - RNA, 22 nt, Human
aagaagaacagauauuucccuc

SEQ ID NO: 107830 - RNA, 22 nt, Human
aagaagagauggauugugagga

SEQ ID NO: 107831 - RNA, 18 nt, Human
aagacacaccacauuugu

SEQ ID NO: 107832 - RNA, 21 nt, Human
aagaccacaaauaucuugcca

SEQ ID NO: 107833 - RNA, 21 nt, Human
aagcagauauguuuacaaaau

SEQ ID NO: 107834 - RNA, 18 nt, Human
aagcaggcuccugccagg

SEQ ID NO: 107835 - RNA, 18 nt, Human
aagccaaguaagaaucug

SEQ ID NO: 107836 - RNA, 23 nt, Human
aaucacagugaccaaaggauuug

SEQ ID NO: 107837 - RNA, 27 nt, Human
acaaagucagaaccagaccacggcccc

SEQ ID NO: 107838 - RNA, 18 nt, Human
acaagcaggcuccugcca

SEQ ID NO: 107839 - RNA, 24 nt, Human
acacagcaagguaccucauagucu

SEQ ID NO: 107840 - RNA, 24 nt, Human
accacaaauaucuugccauaaaaa

SEQ ID NO: 107841 - RNA, 20 nt, Human
agaccacaaauaucuugcca

SEQ ID NO: 107842 - RNA, 20 nt, Human
agaguucuaaacuaccucuc

SEQ ID NO: 107843 - RNA, 20 nt, Human
agcuucuuucccuuuucuuc

SEQ ID NO: 107844 - RNA, 21 nt, Human
aggcaaaaagaguauucaggg

SEQ ID NO: 107845 - RNA, 22 nt, Human
aguaaauacugaauaguuacaa

SEQ ID NO: 107846 - RNA, 21 nt, Human
augagacuaucaacuccccuu

SEQ ID NO: 107847 - RNA, 29 nt, Human
auggauugugaggaggaggaggaaaggag

SEQ ID NO: 107848 - RNA, 18 nt, Human
auuuucuccuuaaaagga

SEQ ID NO: 107849 - RNA, 24 nt, Human
caaaaaacaacuuacagacuucca

SEQ ID NO: 107850 - RNA, 21 nt, Human
caaauccaaaguacaauaaag

SEQ ID NO: 107851 - RNA, 26 nt, Human
caagaccacaaauaucuugccauaaa

SEQ ID NO: 107852 - RNA, 20 nt, Human
cacaagcaggcuccugccag

SEQ ID NO: 107853 - RNA, 21 nt, Human
cacacucaugcacacgaacua

SEQ ID NO: 107854 - RNA, 22 nt, Human
cacccacccugcacuuuggccc

SEQ ID NO: 107855 - RNA, 20 nt, Human
cacggccccgccccuuuaga

SEQ ID NO: 107856 - RNA, 19 nt, Human
cacuccacuauccugcuug

SEQ ID NO: 107857 - RNA, 23 nt, Human
cacuccacuauccugcuuguccu

SEQ ID NO: 107858 - RNA, 19 nt, Human
cagaaccagaccacggccc

SEQ ID NO: 107859 - RNA, 19 nt, Human
cagauaaaagacucuaaca

SEQ ID NO: 107860 - RNA, 27 nt, Human
cauuucuccucuguucacuuggguuuc

SEQ ID NO: 107861 - RNA, 22 nt, Human
ccaagcacaaaguguacaucau

SEQ ID NO: 107862 - RNA, 20 nt, Human
ccagagccuugaucggcaac

SEQ ID NO: 107863 - RNA, 24 nt, Human
ccagguauuaacaccuaacuuacu

SEQ ID NO: 107864 - RNA, 23 nt, Human
ccauccacacucaugcacacgaa

SEQ ID NO: 107865 - RNA, 21 nt, Human
cccaggagggcacaaaaacac

SEQ ID NO: 107866 - RNA, 19 nt, Human
cccucccuuucucacucca

SEQ ID NO: 107867 - RNA, 21 nt, Human
cccugaccagauaaaagacuc

SEQ ID NO: 107868 - RNA, 22 nt, Human
cgaaauaaaaacagcuucucga

SEQ ID NO: 107869 - RNA, 20 nt, Human
cuaaaaacacccacaggcac

SEQ ID NO: 107870 - RNA, 21 nt, Human
cuaaaaacacccacaggcacc

SEQ ID NO: 107871 - RNA, 26 nt, Human
cugccaggaggcagcuggggguucuu

SEQ ID NO: 107872 - RNA, 18 nt, Human
cuggaucaaaacaaaaac

SEQ ID NO: 107873 - RNA, 20 nt, Human
cuguguuuucucuggugucu

SEQ ID NO: 107874 - RNA, 23 nt, Human
cuugcccacaccagccucuccca

SEQ ID NO: 107875 - RNA, 27 nt, Human
cuuuugcuggaccugauuuggccuccu

SEQ ID NO: 107876 - RNA, 21 nt, Human
gaaaacagguuaaccaaaucc

SEQ ID NO: 107877 - RNA, 23 nt, Human
gaaucaucaguagugaguuuaaa

SEQ ID NO: 107878 - RNA, 21 nt, Human
gaccacggccccgccccuuua

SEQ ID NO: 107879 - RNA, 20 nt, Human
gacuauaaccacgauaaagg

SEQ ID NO: 107880 - RNA, 19 nt, Human
gagccggggugaggugggu

SEQ ID NO: 107881 - RNA, 21 nt, Human
gagccggggugagguggguuu

SEQ ID NO: 107882 - RNA, 18 nt, Human
gagggacaaagcagagga

SEQ ID NO: 107883 - RNA, 22 nt, Human
gcagcuggggguucuucuggcc

SEQ ID NO: 107884 - RNA, 24 nt, Human
gugguuuuacauuuucagcuucuu

SEQ ID NO: 107885 - RNA, 20 nt, Human
uaaaaacacccacaggcacc

SEQ ID NO: 107886 - RNA, 22 nt, Human
uaaaauaucucccgccuugaaa

SEQ ID NO: 107887 - RNA, 22 nt, Human
uaacuugcuuggguccgaacau

SEQ ID NO: 107888 - RNA, 23 nt, Human
uaagaagagauggauugugagga

SEQ ID NO: 107889 - RNA, 23 nt, Human
uaagcagacauaauacauaaugc

SEQ ID NO: 107890 - RNA, 18 nt, Human
uaauuuaggaaccuuggc

SEQ ID NO: 107891 - RNA, 24 nt, Human
uacaguaacaaaaaacaacuuaca

SEQ ID NO: 107892 - RNA, 19 nt, Human
uacauccccauuaaagcag

SEQ ID NO: 107893 - RNA, 19 nt, Human
uaccagguauuaacaccua

SEQ ID NO: 107894 - RNA, 21 nt, Human
uagaacauuauuggggugaaa

SEQ ID NO: 107895 - RNA, 22 nt, Human
uaggaaaagacuuucucagaag

SEQ ID NO: 107896 - RNA, 21 nt, Human
uaggcauuaacugaucacuua

SEQ ID NO: 107897 - RNA, 19 nt, Human
uagguuugagcagauugca

SEQ ID NO: 107898 - RNA, 20 nt, Human
uagucaucauuaucugcuau

SEQ ID NO: 107899 - RNA, 22 nt, Human
uauaaaggagaaaaagaaaaca

SEQ ID NO: 107900 - RNA, 22 nt, Human
ucaauccuaaguagccauugcc

SEQ ID NO: 107901 - RNA, 22 nt, Human
ucagcuucuuucccuuuucuuc

SEQ ID NO: 107902 - RNA, 19 nt, Human
uccacacaguggaaauuau

SEQ ID NO: 107903 - RNA, 20 nt, Human
uccccuuucauccuccuaca

SEQ ID NO: 107904 - RNA, 18 nt, Human
ucccuuacauuucuacca

SEQ ID NO: 107905 - RNA, 19 nt, Human
ucccuuuucuucucuccca

SEQ ID NO: 107906 - RNA, 24 nt, Human
uccuaaguagccauugccaguagg

SEQ ID NO: 107907 - RNA, 24 nt, Human
ucgaaugcagcacuaaaacagguc

SEQ ID NO: 107908 - RNA, 21 nt, Human
ucuaaaaacacccacaggcac

SEQ ID NO: 107909 - RNA, 19 nt, Human
ucucauuucuccucuguuc

SEQ ID NO: 107910 - RNA, 19 nt, Human
ucucugaaugccagagccu

SEQ ID NO: 107911 - RNA, 22 nt, Human
ugaaaucacagugaccaaagga

SEQ ID NO: 107912 - RNA, 18 nt, Human
ugaacagcuaauacauca

SEQ ID NO: 107913 - RNA, 18 nt, Human
ugagccaaaucugcacuu

SEQ ID NO: 107914 - RNA, 19 nt, Human
ugagcugacuauaaccacg

SEQ ID NO: 107915 - RNA, 18 nt, Human
ugaggaggaggaggaaag

SEQ ID NO: 107916 - RNA, 21 nt, Human
ugaggaggaggaggaaaggag

SEQ ID NO: 107917 - RNA, 21 nt, Human
ugccuuagcauuugugugcuu

SEQ ID NO: 107918 - RNA, 21 nt, Human
uggaagacacaccacauuugu

SEQ ID NO: 107919 - RNA, 19 nt, Human
uggaauggaaaugagcuga

SEQ ID NO: 107920 - RNA, 23 nt, Human
uggauugugaggaggaggaggaa

SEQ ID NO: 107921 - RNA, 25 nt, Human
uggcaaucucauuucuccucuguca

SEQ ID NO: 107922 - RNA, 21 nt, Human
uggccucuagguuuaagccuc

SEQ ID NO: 107923 - RNA, 20 nt, Human
uggcuaggaggcugagaaga

SEQ ID NO: 107924 - RNA, 26 nt, Human
uguauacaaaacacacacacuaugug

SEQ ID NO: 107925 - RNA, 22 nt, Human
uguuuuaggucugggacuuccu

SEQ ID NO: 107926 - RNA, 18 nt, Human
uuaagccaaguaagaauc

SEQ ID NO: 107927 - RNA, 24 nt, Human
uuaaggaacauucaauuuaaaaaa

SEQ ID NO: 107928 - RNA, 18 nt, Human
uuaauucccaccccuaug

SEQ ID NO: 107929 - RNA, 19 nt, Human
uuaguggcucucagaagca

SEQ ID NO: 107930 - RNA, 21 nt, Human
uucuccuuaaaaggacuuuau

SEQ ID NO: 107931 - RNA, 20 nt, Human
uuuacaaaauagggagugcu

SEQ ID NO: 107932 - RNA, 26 nt, Human
uuuccauauuacauaggacuuggcua

SEQ ID NO: 107933 - RNA, 21 nt, Human
uuucucagaagcaucagccug

SEQ ID NO: 107934 - RNA, 23 nt, Human
uuuggcauuauuuuaauagguau

SEQ ID NO: 107935 - RNA, 22 nt, Human
uuuggccucacccuccacccuc

SEQ ID NO: 107936 - RNA, 26 nt, Human
aaaagcaaaucuaaaaauucaaaaca

SEQ ID NO: 107937 - RNA, 23 nt, Human
aaacauccgagugaagaucucac

SEQ ID NO: 107938 - RNA, 24 nt, Human
aacacacacaacaccacacacaca

SEQ ID NO: 107939 - RNA, 19 nt, Human
aacagcaaagcaucagcaa

SEQ ID NO: 107940 - RNA, 21 nt, Human
aacauuuucuggcuucuauuc

SEQ ID NO: 107941 - RNA, 27 nt, Human
aaccacuucccaacaauuuuccugggg

SEQ ID NO: 107942 - RNA, 22 nt, Human
aaccagacuccaaaccucuagu

SEQ ID NO: 107943 - RNA, 19 nt, Human
aagaaacucauggauaacc

SEQ ID NO: 107944 - RNA, 19 nt, Human
aagaacacaaaguaacacc

SEQ ID NO: 107945 - RNA, 18 nt, Human
aagaauuuccauuuggcu

SEQ ID NO: 107946 - RNA, 25 nt, Human
aagaugccauuuaccagauuaacug

SEQ ID NO: 107947 - RNA, 20 nt, Human
aagcaucagcaacagcagcu

SEQ ID NO: 107948 - RNA, 19 nt, Human
aagggaccaaaauacugau

SEQ ID NO: 107949 - RNA, 18 nt, Human
aauaaagaaacucaugga

SEQ ID NO: 107950 - RNA, 20 nt, Human
aauccuguuuuucugcaauc

SEQ ID NO: 107951 - RNA, 24 nt, Human
aaucugaaucaccguguagcccag

SEQ ID NO: 107952 - RNA, 23 nt, Human
acacacacacacacacacacaca

SEQ ID NO: 107953 - RNA, 23 nt, Human
acacacacacacacacacacaca

SEQ ID NO: 107954 - RNA, 23 nt, Human
acacacacacacacacacacaca

SEQ ID NO: 107955 - RNA, 18 nt, Human
acaccccaccccaccccc

SEQ ID NO: 107956 - RNA, 20 nt, Human
acaggguuucgccaucucag

SEQ ID NO: 107957 - RNA, 22 nt, Human
acaggguuucgccaucucagca

SEQ ID NO: 107958 - RNA, 24 nt, Human
accacacacacacacacacacaca

SEQ ID NO: 107959 - RNA, 23 nt, Human
accacuucccaacaauuuuccug

SEQ ID NO: 107960 - RNA, 20 nt, Human
accauaaccacuucccaaca

SEQ ID NO: 107961 - RNA, 25 nt, Human
accguguagcccagagaugaggguc

SEQ ID NO: 107962 - RNA, 24 nt, Human
acugcagggcuuucugguaggagg

SEQ ID NO: 107963 - RNA, 21 nt, Human
agaaaaggcaggcccguggca

SEQ ID NO: 107964 - RNA, 19 nt, Human
agagcugaaaggcgucgug

SEQ ID NO: 107965 - RNA, 18 nt, Human
agagcuggaagaugagcg

SEQ ID NO: 107966 - RNA, 18 nt, Human
agaucgcuggagggaccc

SEQ ID NO: 107967 - RNA, 20 nt, Human
agcacccuggcuuuacuguu

SEQ ID NO: 107968 - RNA, 18 nt, Human
aggaccggcugcacccug

SEQ ID NO: 107969 - RNA, 19 nt, Human
aggaggaagagagacucua

SEQ ID NO: 107970 - RNA, 21 nt, Human
aggcaaggcagcugcagcugu

SEQ ID NO: 107971 - RNA, 19 nt, Human
aggcagagacaggcuuagg

SEQ ID NO: 107972 - RNA, 24 nt, Human
aggcagcugcagcugucagggucu

SEQ ID NO: 107973 - RNA, 21 nt, Human
agggggcgacggugggcucgg

SEQ ID NO: 107974 - RNA, 27 nt, Human
aggggguggggaaaggucucugagagg

SEQ ID NO: 107975 - RNA, 22 nt, Human
aggggucuguggaaaugauguu

SEQ ID NO: 107976 - RNA, 18 nt, Human
agggucagggcagagggg

SEQ ID NO: 107977 - RNA, 23 nt, Human
aguaggucucagaacacaacuua

SEQ ID NO: 107978 - RNA, 24 nt, Human
aucaccuuucguggugucagcugu

SEQ ID NO: 107979 - RNA, 18 nt, Human
caaacacacacaacacca

SEQ ID NO: 107980 - RNA, 22 nt, Human
caaacacacacaacaccacaca

SEQ ID NO: 107981 - RNA, 20 nt, Human
caagaucuguacuugugcuc

SEQ ID NO: 107982 - RNA, 19 nt, Human
caaggcaaggcagcugcag

SEQ ID NO: 107983 - RNA, 19 nt, Human
cacaaaguaacaccccacc

SEQ ID NO: 107984 - RNA, 26 nt, Human
cacaacaccacacacacacacacaca

SEQ ID NO: 107985 - RNA, 24 nt, Human
cacacacaacaccacacacacaca

SEQ ID NO: 107986 - RNA, 20 nt, Human
cacacacacacacacacaca

SEQ ID NO: 107987 - RNA, 20 nt, Human
cacacacacacacacacaca

SEQ ID NO: 107988 - RNA, 20 nt, Human
cacacacacacacacacaca

SEQ ID NO: 107989 - RNA, 20 nt, Human
cacacacacacacacacaca

SEQ ID NO: 107990 - RNA, 20 nt, Human
cacacacacacacacacaca

SEQ ID NO: 107991 - RNA, 20 nt, Human
cacacacacacacacacaca

SEQ ID NO: 107992 - RNA, 20 nt, Human
cacacacacacacacacaca

SEQ ID NO: 107993 - RNA, 20 nt, Human
cacacacacacacacacaca

SEQ ID NO: 107994 - RNA, 20 nt, Human
cacacacacacacacacaca

SEQ ID NO: 107995 - RNA, 22 nt, Human
cacacacacacacacacacaca

SEQ ID NO: 107996 - RNA, 22 nt, Human
cacacacacacacacacacaca

SEQ ID NO: 107997 - RNA, 22 nt, Human
cacacacacacacacacacaca

SEQ ID NO: 107998 - RNA, 22 nt, Human
cacacacacacacacacacaca

SEQ ID NO: 107999 - RNA, 22 nt, Human
cacacacacacacacacacaca

SEQ ID NO: 108000 - RNA, 18 nt, Human
cacacagaccauacgcac

SEQ ID NO: 108001 - RNA, 18 nt, Human
cacaggguuucgccaucu

SEQ ID NO: 108002 - RNA, 21 nt, Human
caccacacacacacacacaca

SEQ ID NO: 108003 - RNA, 23 nt, Human
caccacacacacacacacacaca

SEQ ID NO: 108004 - RNA, 23 nt, Human
caccccaccccacccccaaauau

SEQ ID NO: 108005 - RNA, 22 nt, Human
caccccacccccaaauauguua

SEQ ID NO: 108006 - RNA, 20 nt, Human
cagcagcuuggaggaagcag

SEQ ID NO: 108007 - RNA, 23 nt, Human
cagcagugagguaccacacaugu

SEQ ID NO: 108008 - RNA, 21 nt, Human
cagcaucauguauucccuucu

SEQ ID NO: 108009 - RNA, 23 nt, Human
caggggcccugcagggaggcggc

SEQ ID NO: 108010 - RNA, 21 nt, Human
caguauggcucuuuucuguuc

SEQ ID NO: 108011 - RNA, 21 nt, Human
ccacacacacacacacacaca

SEQ ID NO: 108012 - RNA, 21 nt, Human
ccacacagaccauacgcacaa

SEQ ID NO: 108013 - RNA, 19 nt, Human
ccagacccuggcugcaggg

SEQ ID NO: 108014 - RNA, 18 nt, Human
ccaucuucagacuguucu

SEQ ID NO: 108015 - RNA, 18 nt, Human
cccaccccacccccaaau

SEQ ID NO: 108016 - RNA, 22 nt, Human
cccaccccacccccaaauaugu

SEQ ID NO: 108017 - RNA, 23 nt, Human
cccacccccaaauauguuauuaa

SEQ ID NO: 108018 - RNA, 23 nt, Human
cccaugacaacaguguucccaag

SEQ ID NO: 108019 - RNA, 18 nt, Human
ccccaccccacccccaaa

SEQ ID NO: 108020 - RNA, 20 nt, Human
ccccaccccacccccaaaua

SEQ ID NO: 108021 - RNA, 24 nt, Human
ccccaugacaacaguguucccaag

SEQ ID NO: 108022 - RNA, 22 nt, Human
cccccaugacaacaguguuccc

SEQ ID NO: 108023 - RNA, 28 nt, Human
ccccgaggaccggcugcacccugcccag

SEQ ID NO: 108024 - RNA, 26 nt, Human
cccgcccagccccgcaguggagcagc

SEQ ID NO: 108025 - RNA, 23 nt, Human
cccguggcaucgccgcagguccg

SEQ ID NO: 108026 - RNA, 23 nt, Human
cccuggccaguccgguagacagg

SEQ ID NO: 108027 - RNA, 20 nt, Human
cccuucuuuccuuucugacc

SEQ ID NO: 108028 - RNA, 22 nt, Human
cccuucuuuccuuucugaccag

SEQ ID NO: 108029 - RNA, 23 nt, Human
cgacggugggcucggcgcccucc

SEQ ID NO: 108030 - RNA, 21 nt, Human
cgcacaaacacacacaacacc

SEQ ID NO: 108031 - RNA, 23 nt, Human
cgcacaaacacacacaacaccac

SEQ ID NO: 108032 - RNA, 26 nt, Human
cggcugcacccugcccagacccuggc

SEQ ID NO: 108033 - RNA, 18 nt, Human
cgucagaauacaucccau

SEQ ID NO: 108034 - RNA, 23 nt, Human
cguugguggcacucccagagcuu

SEQ ID NO: 108035 - RNA, 20 nt, Human
cuaagaugguaaagaugcca

SEQ ID NO: 108036 - RNA, 21 nt, Human
cucagaacacaacuuaaagau

SEQ ID NO: 108037 - RNA, 18 nt, Human
cucucuugagagcuggaa

SEQ ID NO: 108038 - RNA, 21 nt, Human
cucuggcacccagccucugcc

SEQ ID NO: 108039 - RNA, 23 nt, Human
cucuuaaucccacauuaaacuga

SEQ ID NO: 108040 - RNA, 18 nt, Human
cugcaccccacacacagg

SEQ ID NO: 108041 - RNA, 22 nt, Human
cugcagggcuuucugguaggag

SEQ ID NO: 108042 - RNA, 18 nt, Human
cugccaggcugggacugu

SEQ ID NO: 108043 - RNA, 18 nt, Human
cugcugaagugacugugg

SEQ ID NO: 108044 - RNA, 19 nt, Human
cugggcagccgaugaaggg

SEQ ID NO: 108045 - RNA, 22 nt, Human
cuuccaguaggacuucuuuugg

SEQ ID NO: 108046 - RNA, 20 nt, Human
cuucccaacaauuuuccugg

SEQ ID NO: 108047 - RNA, 24 nt, Human
cuuugaggggaggaaacaaguugg

SEQ ID NO: 108048 - RNA, 18 nt, Human
gaaagaaaaagacugaug

SEQ ID NO: 108049 - RNA, 24 nt, Human
gaacugccaucucaggcaucccua

SEQ ID NO: 108050 - RNA, 24 nt, Human
gacuugauucccauuuuuaguagg

SEQ ID NO: 108051 - RNA, 20 nt, Human
gagcugaaaggcgucgugcc

SEQ ID NO: 108052 - RNA, 19 nt, Human
gaggcaaagcugcugcaga

SEQ ID NO: 108053 - RNA, 18 nt, Human
gaggcagcagcuuggagg

SEQ ID NO: 108054 - RNA, 21 nt, Human
gagugaagaucucacacaacc

SEQ ID NO: 108055 - RNA, 21 nt, Human
gauugcauuaagaauuuccau

SEQ ID NO: 108056 - RNA, 26 nt, Human
gcacgcacaaacacacacaacaccac

SEQ ID NO: 108057 - RNA, 22 nt, Human
gcccagaagcccuucuuuccuu

SEQ ID NO: 108058 - RNA, 19 nt, Human
gccccgaggaccggcugca

SEQ ID NO: 108059 - RNA, 18 nt, Human
gccccgcaguggagcagc

SEQ ID NO: 108060 - RNA, 20 nt, Human
gcccuggccaguccgguaga

SEQ ID NO: 108061 - RNA, 19 nt, Human
gcucaaggagaaaggucuu

SEQ ID NO: 108062 - RNA, 21 nt, Human
ggaggaagaacacaaaguaac

SEQ ID NO: 108063 - RNA, 18 nt, Human
ggcagccgaugaaggggg

SEQ ID NO: 108064 - RNA, 19 nt, Human
ggcuuaggugcucugcucu

SEQ ID NO: 108065 - RNA, 20 nt, Human
ggcuuaggugcucugcucuu

SEQ ID NO: 108066 - RNA, 21 nt, Human
gggagucagcccgcccagccc

SEQ ID NO: 108067 - RNA, 21 nt, Human
gggcagccgaugaagggggug

SEQ ID NO: 108068 - RNA, 19 nt, Human
gggccuucauuuucagccc

SEQ ID NO: 108069 - RNA, 22 nt, Human
ggguggcagggaaagaaaaaga

SEQ ID NO: 108070 - RNA, 19 nt, Human
gguagacagggaggcagag

SEQ ID NO: 108071 - RNA, 21 nt, Human
ggugguggcggcaugcgaguc

SEQ ID NO: 108072 - RNA, 20 nt, Human
guauucuuccuggcuggcca

SEQ ID NO: 108073 - RNA, 19 nt, Human
gucucugagaggcaccacc

SEQ ID NO: 108074 - RNA, 21 nt, Human
gugaagaucucacacaaccuu

SEQ ID NO: 108075 - RNA, 23 nt, Human
uaacaccccaccccacccccaaa

SEQ ID NO: 108076 - RNA, 25 nt, Human
uaacugagaccauguuagaacugaa

SEQ ID NO: 108077 - RNA, 26 nt, Human
uacaaaguucuuauuugcuguccuuu

SEQ ID NO: 108078 - RNA, 23 nt, Human
uacagaaaagcuggaagggacca

SEQ ID NO: 108079 - RNA, 19 nt, Human
uacgcacaagaaaauaggc

SEQ ID NO: 108080 - RNA, 22 nt, Human
uagcacagugguugagaacuuc

SEQ ID NO: 108081 - RNA, 23 nt, Human
uaggaggacuccaagguguggua

SEQ ID NO: 108082 - RNA, 18 nt, Human
uaucuccuccucacaggc

SEQ ID NO: 108083 - RNA, 30 nt, Human
uaugacccuggaggcaaagcugcugcagag

SEQ ID NO: 108084 - RNA, 18 nt, Human
uauggaaaaaucaguuca

SEQ ID NO: 108085 - RNA, 25 nt, Human
ucaauaccaguaagauucuacagaa

SEQ ID NO: 108086 - RNA, 19 nt, Human
ucagaauacaucccauacg

SEQ ID NO: 108087 - RNA, 23 nt, Human
ucagagcaaacacuugaggcauc

SEQ ID NO: 108088 - RNA, 19 nt, Human
ucaggugggacugcagggc

SEQ ID NO: 108089 - RNA, 21 nt, Human
ucauguauucccuucuuuauu

SEQ ID NO: 108090 - RNA, 22 nt, Human
ucgccgcagguccgggaagcac

SEQ ID NO: 108091 - RNA, 21 nt, Human
ucgcugaggaggaagagagac

SEQ ID NO: 108092 - RNA, 21 nt, Human
ucgcuggagggacccagucgu

SEQ ID NO: 108093 - RNA, 23 nt, Human
ucuaacugcgacagacuuagagg

SEQ ID NO: 108094 - RNA, 19 nt, Human
ucuccuaacagcaaagcau

SEQ ID NO: 108095 - RNA, 18 nt, Human
ucucuaagucaggagacu

SEQ ID NO: 108096 - RNA, 24 nt, Human
ucucugagaggcaccaccgauugc

SEQ ID NO: 108097 - RNA, 19 nt, Human
ucugcacugcaauagcaaa

SEQ ID NO: 108098 - RNA, 21 nt, Human
ucugcaggcccagaagcccuu

SEQ ID NO: 108099 - RNA, 20 nt, Human
ucugcucuuuuguguucugu

SEQ ID NO: 108100 - RNA, 24 nt, Human
ucugcucuuuuguguucuguuuuu

SEQ ID NO: 108101 - RNA, 21 nt, Human
ucuugagagcuggaagaugag

SEQ ID NO: 108102 - RNA, 23 nt, Human
ucuuuggcucuucaguaaguucu

SEQ ID NO: 108103 - RNA, 18 nt, Human
ugaaggggguggggaaag

SEQ ID NO: 108104 - RNA, 18 nt, Human
ugacaagcaaaauuccca

SEQ ID NO: 108105 - RNA, 24 nt, Human
ugacuauuucaucaacagacauuc

SEQ ID NO: 108106 - RNA, 20 nt, Human
ugacugggcagccgaugaag

SEQ ID NO: 108107 - RNA, 22 nt, Human
ugacuguggaaaccccaguaac

SEQ ID NO: 108108 - RNA, 20 nt, Human
ugagaagucagaacuaagau

SEQ ID NO: 108109 - RNA, 25 nt, Human
ugaggcagagacacuaugcugucug

SEQ ID NO: 108110 - RNA, 20 nt, Human
ugaggggaggaaacaaguug

SEQ ID NO: 108111 - RNA, 24 nt, Human
ugagguaccacacauguguagggu

SEQ ID NO: 108112 - RNA, 18 nt, Human
ugauaaauaaaggguggc

SEQ ID NO: 108113 - RNA, 19 nt, Human
ugauguuaagaaucacgug

SEQ ID NO: 108114 - RNA, 22 nt, Human
ugcaauacaggccuugcuuccu

SEQ ID NO: 108115 - RNA, 18 nt, Human
ugcaggcccagaagcccu

SEQ ID NO: 108116 - RNA, 21 nt, Human
ugccccgaggaccggcugcac

SEQ ID NO: 108117 - RNA, 20 nt, Human
ugcuccuggagucuccuaac

SEQ ID NO: 108118 - RNA, 21 nt, Human
uggaagcucugggguagggac

SEQ ID NO: 108119 - RNA, 18 nt, Human
uggcagacagcggacgau

SEQ ID NO: 108120 - RNA, 19 nt, Human
uggcagacagcggacgauu

SEQ ID NO: 108121 - RNA, 21 nt, Human
uggcagagcccccaugacaac

SEQ ID NO: 108122 - RNA, 24 nt, Human
uggccaagcccaaaccgaucuaau

SEQ ID NO: 108123 - RNA, 20 nt, Human
ugggacugcagggcuuucug

SEQ ID NO: 108124 - RNA, 21 nt, Human
ugggccucgugaggagccccc

SEQ ID NO: 108125 - RNA, 21 nt, Human
ugguaggaggacuccaaggug

SEQ ID NO: 108126 - RNA, 21 nt, Human
ugguggcacucccagagcuuu

SEQ ID NO: 108127 - RNA, 20 nt, Human
uggugucagcugugaaaggg

SEQ ID NO: 108128 - RNA, 20 nt, Human
uguacaagacauguuucagu

SEQ ID NO: 108129 - RNA, 19 nt, Human
uguuucccggcuacauccc

SEQ ID NO: 108130 - RNA, 24 nt, Human
uuaccagauuaacugagaccaugu

SEQ ID NO: 108131 - RNA, 23 nt, Human
uuaggugcucugcucuuuugugu

SEQ ID NO: 108132 - RNA, 23 nt, Human
uucacaucaauaucacuucgaga

SEQ ID NO: 108133 - RNA, 20 nt, Human
uucagauugaggccaagaga

SEQ ID NO: 108134 - RNA, 19 nt, Human
uucccaacaauuuuccugg

SEQ ID NO: 108135 - RNA, 19 nt, Human
uuccuggagccauaugagc

SEQ ID NO: 108136 - RNA, 23 nt, Human
uucuggcuucuauucuugcuucg

SEQ ID NO: 108137 - RNA, 20 nt, Human
uugagagcuggaagaugagc

SEQ ID NO: 108138 - RNA, 18 nt, Human
uugcuccuggagucuccu

SEQ ID NO: 108139 - RNA, 21 nt, Human
uuguguucuguuuuucauugg

SEQ ID NO: 108140 - RNA, 20 nt, Human
uuucccggcuacaucccugg

SEQ ID NO: 108141 - RNA, 21 nt, Human
uuuucagauugaggccaagag

SEQ ID NO: 108142 - RNA, 23 nt, Human
uuuuccuggggaacuugaccggc

SEQ ID NO: 108143 - RNA, 21 nt, Human
aaaaaacaggcagaugauuug

SEQ ID NO: 108144 - RNA, 18 nt, Human
aaaaaagcaucauucaca

SEQ ID NO: 108145 - RNA, 21 nt, Human
aaaacgaaacgaaacaaaaaa

SEQ ID NO: 108146 - RNA, 22 nt, Human
aaaaugcuacugagaagaguug

SEQ ID NO: 108147 - RNA, 21 nt, Human
aaacaaaccaaaauaaacccu

SEQ ID NO: 108148 - RNA, 18 nt, Human
aaacagaagacggucaag

SEQ ID NO: 108149 - RNA, 21 nt, Human
aaacaguagcuuuuugugacc

SEQ ID NO: 108150 - RNA, 21 nt, Human
aaacauauccaaaggucauaa

SEQ ID NO: 108151 - RNA, 25 nt, Human
aaacgaaacgaaacaaaaaacuaaa

SEQ ID NO: 108152 - RNA, 19 nt, Human
aaacuaaaacugggaaaca

SEQ ID NO: 108153 - RNA, 21 nt, Human
aacaauggcaaacugcuuccc

SEQ ID NO: 108154 - RNA, 24 nt, Human
aacuaucauaaaaguuacaugcag

SEQ ID NO: 108155 - RNA, 21 nt, Human
aacugcuucccuaauagcuau

SEQ ID NO: 108156 - RNA, 22 nt, Human
aagaucaauaaccaauagacaa

SEQ ID NO: 108157 - RNA, 21 nt, Human
aagcaucauucacaacaaaga

SEQ ID NO: 108158 - RNA, 20 nt, Human
aagggaucauagaagggaca

SEQ ID NO: 108159 - RNA, 18 nt, Human
aaguaacagaaaaucacc

SEQ ID NO: 108160 - RNA, 21 nt, Human
aaguuacaugcagacugagga

SEQ ID NO: 108161 - RNA, 22 nt, Human
acaaaacgaaacgaaacaaaaa

SEQ ID NO: 108162 - RNA, 21 nt, Human
acaaaauucaagagaccacca

SEQ ID NO: 108163 - RNA, 18 nt, Human
acaaaguacaaacaugug

SEQ ID NO: 108164 - RNA, 21 nt, Human
acaacaaagauauaaacaaac

SEQ ID NO: 108165 - RNA, 24 nt, Human
acaacaguaagcauagaacuauaa

SEQ ID NO: 108166 - RNA, 24 nt, Human
acaauuucaugguaaaaggaaacc

SEQ ID NO: 108167 - RNA, 20 nt, Human
acagaagacggucaaggaca

SEQ ID NO: 108168 - RNA, 20 nt, Human
agacaaaguacaaacaugug

SEQ ID NO: 108169 - RNA, 22 nt, Human
agacaaaguacaaacaugugaa

SEQ ID NO: 108170 - RNA, 23 nt, Human
agacaaaguacaaacaugugaaa

SEQ ID NO: 108171 - RNA, 21 nt, Human
agagguagagaauuugagccc

SEQ ID NO: 108172 - RNA, 20 nt, Human
agauauaaacaaaccaaaau

SEQ ID NO: 108173 - RNA, 20 nt, Human
aguaauguuauguacaguuu

SEQ ID NO: 108174 - RNA, 23 nt, Human
aguagaaaacaaaauuguuacag

SEQ ID NO: 108175 - RNA, 25 nt, Human
auagacaauaucaguuuuacagaac

SEQ ID NO: 108176 - RNA, 22 nt, Human
caaaacgaaacgaaacaaaaaa

SEQ ID NO: 108177 - RNA, 20 nt, Human
caaaagacacuauaggcagc

SEQ ID NO: 108178 - RNA, 18 nt, Human
caaacggaguccagcugu

SEQ ID NO: 108179 - RNA, 20 nt, Human
caaaguacaaacaugugaaa

SEQ ID NO: 108180 - RNA, 24 nt, Human
caacaauggcaaacugcuucccua

SEQ ID NO: 108181 - RNA, 27 nt, Human
caccacugauacaagaccgucuaaagu

SEQ ID NO: 108182 - RNA, 26 nt, Human
caguaguuaaagcaguaucuuaaacc

SEQ ID NO: 108183 - RNA, 19 nt, Human
ccugccauuagaugccagg

SEQ ID NO: 108184 - RNA, 22 nt, Human
ccuuucuuuugagagaccuggu

SEQ ID NO: 108185 - RNA, 22 nt, Human
cuaaaaaguaacagaaaaucac

SEQ ID NO: 108186 - RNA, 23 nt, Human
cuaaaaaguaacagaaaaucacc

SEQ ID NO: 108187 - RNA, 24 nt, Human
cucugcaacaauggcaaacugcuu

SEQ ID NO: 108188 - RNA, 21 nt, Human
cugauacaagaccgucuaaag

SEQ ID NO: 108189 - RNA, 19 nt, Human
cugcaacaauggcaaacug

SEQ ID NO: 108190 - RNA, 22 nt, Human
cuguaauauauacaugcguaug

SEQ ID NO: 108191 - RNA, 19 nt, Human
gacaaaguacaaacaugug

SEQ ID NO: 108192 - RNA, 22 nt, Human
gagaggauauagagaaacuuuu

SEQ ID NO: 108193 - RNA, 20 nt, Human
ggaagacaaaguacaaacau

SEQ ID NO: 108194 - RNA, 22 nt, Human
ggaguccagcuguaguucaaau

SEQ ID NO: 108195 - RNA, 19 nt, Human
gugcagcuuucuuaaggga

SEQ ID NO: 108196 - RNA, 20 nt, Human
guuuuccaaaagacacuaua

SEQ ID NO: 108197 - RNA, 25 nt, Human
uaaaaaaaaguaaagaugagaaaac

SEQ ID NO: 108198 - RNA, 23 nt, Human
uaaaaaguaacagaaaaucaccc

SEQ ID NO: 108199 - RNA, 22 nt, Human
uaaaauaaaacugagugacuug

SEQ ID NO: 108200 - RNA, 24 nt, Human
uaaacaaaccaaaauaaacccugc

SEQ ID NO: 108201 - RNA, 18 nt, Human
uaaagcaguaucuuaaac

SEQ ID NO: 108202 - RNA, 20 nt, Human
uacaaaacgaaacgaaacaa

SEQ ID NO: 108203 - RNA, 18 nt, Human
uacaaacauauccaaagg

SEQ ID NO: 108204 - RNA, 23 nt, Human
uagaacagaaagaaaggggaaag

SEQ ID NO: 108205 - RNA, 26 nt, Human
uagagaauuugagcccauuauacaaa

SEQ ID NO: 108206 - RNA, 21 nt, Human
uagcuauauaccuuugauugu

SEQ ID NO: 108207 - RNA, 21 nt, Human
uauauacaugcguauguagcu

SEQ ID NO: 108208 - RNA, 22 nt, Human
uauaugcacaacaguaagcaua

SEQ ID NO: 108209 - RNA, 24 nt, Human
uauaugcacaacaguaagcauagu

SEQ ID NO: 108210 - RNA, 18 nt, Human
uaucaagaaaaaacaggc

SEQ ID NO: 108211 - RNA, 25 nt, Human
uaucaagaaaaaacaggcagaugau

SEQ ID NO: 108212 - RNA, 21 nt, Human
uaucaccaucacacaaacgga

SEQ ID NO: 108213 - RNA, 20 nt, Human
ucaacaguaguuaaagcagu

SEQ ID NO: 108214 - RNA, 22 nt, Human
ucuacuagcuuucauuuggaca

SEQ ID NO: 108215 - RNA, 18 nt, Human
ucuacuugguugucaaca

SEQ ID NO: 108216 - RNA, 22 nt, Human
ucugcaacaauggcaaacugcu

SEQ ID NO: 108217 - RNA, 21 nt, Human
ugacauguaucaccaucacac

SEQ ID NO: 108218 - RNA, 23 nt, Human
ugaggauaguccucuguuacaga

SEQ ID NO: 108219 - RNA, 23 nt, Human
ugauacgaaacaaaacucaaagu

SEQ ID NO: 108220 - RNA, 21 nt, Human
ugaugaggguggucuaucugu

SEQ ID NO: 108221 - RNA, 22 nt, Human
ugcuaaaaaguaacagaaaauc

SEQ ID NO: 108222 - RNA, 21 nt, Human
uggaaugaacaaauuaagggu

SEQ ID NO: 108223 - RNA, 22 nt, Human
uggaaugaacaaauuaagggug

SEQ ID NO: 108224 - RNA, 21 nt, Human
ugggaaacaauaguaaguucc

SEQ ID NO: 108225 - RNA, 21 nt, Human
ugggagagaauagcaggagga

SEQ ID NO: 108226 - RNA, 24 nt, Human
uguacaguuuuauugccaguauau

SEQ ID NO: 108227 - RNA, 22 nt, Human
ugugaaaugaugaauuaaauua

SEQ ID NO: 108228 - RNA, 25 nt, Human
uuaaaaaaaaguaaagaugagaaau

SEQ ID NO: 108229 - RNA, 23 nt, Human
uuaaagcuuuaagcauuccuguu

SEQ ID NO: 108230 - RNA, 22 nt, Human
uuaaggguguauuguauauagu

SEQ ID NO: 108231 - RNA, 22 nt, Human
uucaugguaaaaggaaaccagg

SEQ ID NO: 108232 - RNA, 21 nt, Human
aaaaaaaaaaaaaaaaggaaa

SEQ ID NO: 108233 - RNA, 25 nt, Human
aaaaaaaaaaaaaaggaaaccucac

SEQ ID NO: 108234 - RNA, 21 nt, Human
aaaaaaaaaaaggaaaccuca

SEQ ID NO: 108235 - RNA, 24 nt, Human
aaagagauguccagagcugugcag

SEQ ID NO: 108236 - RNA, 24 nt, Human
aggaaaagagauguccagagcugu

SEQ ID NO: 108237 - RNA, 22 nt, Human
aggaaggaucauuggcuggagu

SEQ ID NO: 108238 - RNA, 19 nt, Human
agggaauaauacuaggaaa

SEQ ID NO: 108239 - RNA, 24 nt, Human
cagugcuagaaacuucucaaagca

SEQ ID NO: 108240 - RNA, 19 nt, Human
cccaaguauuccaugaguu

SEQ ID NO: 108241 - RNA, 26 nt, Human
cugucucugauucccucagccggaga

SEQ ID NO: 108242 - RNA, 23 nt, Human
gacuucugccuccccugcgcucc

SEQ ID NO: 108243 - RNA, 19 nt, Human
gauuaugaaagaaggaagg

SEQ ID NO: 108244 - RNA, 22 nt, Human
gugcuagaaacuucucaaagca

SEQ ID NO: 108245 - RNA, 22 nt, Human
uaggaaaagagauguccagaga

SEQ ID NO: 108246 - RNA, 22 nt, Human
ugaaaucaguggccaauucagg

SEQ ID NO: 108247 - RNA, 21 nt, Human
ugauuaugaaagaaggaagga

SEQ ID NO: 108248 - RNA, 18 nt, Human
ugcaguagaaaucacugg

SEQ ID NO: 108249 - RNA, 21 nt, Human
uggccaauucagggaauaaua

SEQ ID NO: 108250 - RNA, 24 nt, Human
aacccacagauacccugggaaagg

SEQ ID NO: 108251 - RNA, 18 nt, Human
aagaggagaaggucagaa

SEQ ID NO: 108252 - RNA, 20 nt, Human
aaugcagaccccaacccugc

SEQ ID NO: 108253 - RNA, 18 nt, Human
accaaccugaaccacuuc

SEQ ID NO: 108254 - RNA, 18 nt, Human
agaagaggcaccguaaua

SEQ ID NO: 108255 - RNA, 27 nt, Human
agagaagaggcaccguaauacuggaag

SEQ ID NO: 108256 - RNA, 22 nt, Human
agcaggaggccaugagcgccuc

SEQ ID NO: 108257 - RNA, 21 nt, Human
agguguuggcauacagggcug

SEQ ID NO: 108258 - RNA, 19 nt, Human
aucaugcuguuagcuggcu

SEQ ID NO: 108259 - RNA, 18 nt, Human
augagcaggaguaaggau

SEQ ID NO: 108260 - RNA, 22 nt, Human
cacagauacccugggaaagggg

SEQ ID NO: 108261 - RNA, 22 nt, Human
caccccagaaaggcaugugugg

SEQ ID NO: 108262 - RNA, 23 nt, Human
cacccuacaccccaaaaugcuac

SEQ ID NO: 108263 - RNA, 23 nt, Human
caccguaauacuggaagacaauu

SEQ ID NO: 108264 - RNA, 25 nt, Human
caccuccaaugcagaccccaacccu

SEQ ID NO: 108265 - RNA, 19 nt, Human
cacuucacacucccucgag

SEQ ID NO: 108266 - RNA, 19 nt, Human
cagccuggcaacccacaga

SEQ ID NO: 108267 - RNA, 18 nt, Human
caguauuuucucuucugg

SEQ ID NO: 108268 - RNA, 23 nt, Human
ccaagugguaggcaagaagcagg

SEQ ID NO: 108269 - RNA, 21 nt, Human
ccaaugcagaccccaacccug

SEQ ID NO: 108270 - RNA, 20 nt, Human
ccagaaaggcauguguggug

SEQ ID NO: 108271 - RNA, 18 nt, Human
ccccaaaaugcuacugca

SEQ ID NO: 108272 - RNA, 18 nt, Human
ccccucaaccccugcccu

SEQ ID NO: 108273 - RNA, 20 nt, Human
ccccucaaccccugcccucc

SEQ ID NO: 108274 - RNA, 18 nt, Human
cccuacaccccaaaaugc

SEQ ID NO: 108275 - RNA, 22 nt, Human
ccggccgggugcggcuccucuc

SEQ ID NO: 108276 - RNA, 19 nt, Human
ccuacaccccaaaaugcua

SEQ ID NO: 108277 - RNA, 23 nt, Human
ccuccaaugcagaccccaacccu

SEQ ID NO: 108278 - RNA, 22 nt, Human
ccuccuccccagcucgguagac

SEQ ID NO: 108279 - RNA, 24 nt, Human
ccucugcaccaaccugaaccacuu

SEQ ID NO: 108280 - RNA, 22 nt, Human
ccuggcaacccacagauacccu

SEQ ID NO: 108281 - RNA, 19 nt, Human
cgaggcaagguccugaugc

SEQ ID NO: 108282 - RNA, 23 nt, Human
cgggugcggcuccucucccggag

SEQ ID NO: 108283 - RNA, 19 nt, Human
cucacaaagugggagcagg

SEQ ID NO: 108284 - RNA, 23 nt, Human
cucacagcuucugucuccuggcu

SEQ ID NO: 108285 - RNA, 19 nt, Human
cuccccagccuggcaaccc

SEQ ID NO: 108286 - RNA, 24 nt, Human
cucugcaccaaccugaaccacuuc

SEQ ID NO: 108287 - RNA, 19 nt, Human
cugaaccacuucacacucc

SEQ ID NO: 108288 - RNA, 20 nt, Human
cuggggggcagggccuuggg

SEQ ID NO: 108289 - RNA, 22 nt, Human
cuguaccuccuccccagcucgg

SEQ ID NO: 108290 - RNA, 18 nt, Human
gaaucucugagcugcaga

SEQ ID NO: 108291 - RNA, 18 nt, Human
gacuucugugugaaucuc

SEQ ID NO: 108292 - RNA, 22 nt, Human
gcaagaagcaggaggccaugag

SEQ ID NO: 108293 - RNA, 20 nt, Human
gcagggccuuggggagcugc

SEQ ID NO: 108294 - RNA, 21 nt, Human
gccgguccaggaaagggccag

SEQ ID NO: 108295 - RNA, 21 nt, Human
gccuacuguaccuccucccca

SEQ ID NO: 108296 - RNA, 24 nt, Human
ggagcgaagaggagaaggucagaa

SEQ ID NO: 108297 - RNA, 18 nt, Human
ggaggagacagggcugau

SEQ ID NO: 108298 - RNA, 20 nt, Human
ggagguggggaggagacagg

SEQ ID NO: 108299 - RNA, 19 nt, Human
ggcacuggccaagugguag

SEQ ID NO: 108300 - RNA, 22 nt, Human
ggcagggccuuggggagcugcc

SEQ ID NO: 108301 - RNA, 22 nt, Human
ggccccucaaccccugcccucc

SEQ ID NO: 108302 - RNA, 20 nt, Human
ggcugggugggcacuggcca

SEQ ID NO: 108303 - RNA, 22 nt, Human
gggcagggccuuggggagcugc

SEQ ID NO: 108304 - RNA, 19 nt, Human
gguggggaggagacagggc

SEQ ID NO: 108305 - RNA, 21 nt, Human
gugaaucucugagcugcagaa

SEQ ID NO: 108306 - RNA, 25 nt, Human
uaaauaaauauuaauacaacacacu

SEQ ID NO: 108307 - RNA, 19 nt, Human
uaagggagcaacacccauc

SEQ ID NO: 108308 - RNA, 19 nt, Human
uauuuucucuucugguuua

SEQ ID NO: 108309 - RNA, 23 nt, Human
uccaggaaagggccagaggcuca

SEQ ID NO: 108310 - RNA, 24 nt, Human
uccaggaaagggccagaggcucac

SEQ ID NO: 108311 - RNA, 18 nt, Human
ucuggucuggucuguccc

SEQ ID NO: 108312 - RNA, 20 nt, Human
ugaagugagaaaagaucaac

SEQ ID NO: 108313 - RNA, 19 nt, Human
ugaauuggauguauagagu

SEQ ID NO: 108314 - RNA, 21 nt, Human
ugagcgccucugcaccaaccu

SEQ ID NO: 108315 - RNA, 21 nt, Human
ugccaccauguuuguuuccug

SEQ ID NO: 108316 - RNA, 23 nt, Human
ugccaccauguuuguuuccugag

SEQ ID NO: 108317 - RNA, 23 nt, Human
ugccacccuacaccccaaaaugc

SEQ ID NO: 108318 - RNA, 19 nt, Human
uggccccucaaccccugcc

SEQ ID NO: 108319 - RNA, 21 nt, Human
uggccccucaaccccugcccu

SEQ ID NO: 108320 - RNA, 19 nt, Human
ugggagcaggguuugaagg

SEQ ID NO: 108321 - RNA, 20 nt, Human
ugggagguggggaggagaca

SEQ ID NO: 108322 - RNA, 18 nt, Human
uggggcaagcauuuuauu

SEQ ID NO: 108323 - RNA, 19 nt, Human
uggggccgggccggccggg

SEQ ID NO: 108324 - RNA, 21 nt, Human
uggggcuggggggcagggccu

SEQ ID NO: 108325 - RNA, 18 nt, Human
uggguggggcuggggggc

SEQ ID NO: 108326 - RNA, 20 nt, Human
uggguggggcuggggggcag

SEQ ID NO: 108327 - RNA, 18 nt, Human
ugguaggcaagaagcagg

SEQ ID NO: 108328 - RNA, 19 nt, Human
ugguugcccuccccagccu

SEQ ID NO: 108329 - RNA, 21 nt, Human
ugugaaucucugagcugcaga

SEQ ID NO: 108330 - RNA, 20 nt, Human
ugugcuuuggagacuccugg

SEQ ID NO: 108331 - RNA, 23 nt, Human
uuccuuggcaacaugaagucugg

SEQ ID NO: 108332 - RNA, 22 nt, Human
uugaagggggagcgaagaggag

SEQ ID NO: 108333 - RNA, 24 nt, Human
uuuuguuugccacucugugcuuug

SEQ ID NO: 108334 - RNA, 20 nt, Human
acccaguuguuuagcauuuu

SEQ ID NO: 108335 - RNA, 20 nt, Human
auucaauuauauuccacauc

SEQ ID NO: 108336 - RNA, 18 nt, Human
caaaaaaaggaugaauga

SEQ ID NO: 108337 - RNA, 28 nt, Human
ccagaugcuugacauaaccucaacaccc

SEQ ID NO: 108338 - RNA, 21 nt, Human
cccccuacaggaagucuaaaa

SEQ ID NO: 108339 - RNA, 21 nt, Human
cccccuacaggaagucuaaaa

SEQ ID NO: 108340 - RNA, 20 nt, Human
ccccuacaggaagucuaaaa

SEQ ID NO: 108341 - RNA, 27 nt, Human
ccucaacaccucuucaugcuccccuua

SEQ ID NO: 108342 - RNA, 23 nt, Human
cuuuaccauuauauauauacaga

SEQ ID NO: 108343 - RNA, 24 nt, Human
uaacccccugaccugauguguuuu

SEQ ID NO: 108344 - RNA, 23 nt, Human
uaaucaaaaaaaggaugaaugau

SEQ ID NO: 108345 - RNA, 21 nt, Human
uaucgcccccuacaggaaguc

SEQ ID NO: 108346 - RNA, 21 nt, Human
uaucgcccccuacaggaaguc

SEQ ID NO: 108347 - RNA, 24 nt, Human
uauuccacauccauuuguaccaaa

SEQ ID NO: 108348 - RNA, 25 nt, Human
ucaacaccucuucaugcuccccuua

SEQ ID NO: 108349 - RNA, 19 nt, Human
uccccuuaaacaagaaaau

SEQ ID NO: 108350 - RNA, 24 nt, Human
ugaaaauauagacacacguuucca

SEQ ID NO: 108351 - RNA, 24 nt, Human
ugauaacaauaucuuagucucaaa

SEQ ID NO: 108352 - RNA, 23 nt, Human
ugugccagaugcuugacauaacc

SEQ ID NO: 108353 - RNA, 27 nt, Human
uguuuuacuauugcucuugucuucaau

SEQ ID NO: 108354 - RNA, 19 nt, Human
uuccacauccauuuguacc

SEQ ID NO: 108355 - RNA, 21 nt, Human
aaaauagcaagagguaaagag

SEQ ID NO: 108356 - RNA, 22 nt, Human
aaacaagcaaccuguucugcac

SEQ ID NO: 108357 - RNA, 23 nt, Human
aagaaggaagacacuuuggauau

SEQ ID NO: 108358 - RNA, 21 nt, Human
acaaaauagcaagagguaaag

SEQ ID NO: 108359 - RNA, 20 nt, Human
acucacacugagccugcugc

SEQ ID NO: 108360 - RNA, 21 nt, Human
acugagccugcugcauacauu

SEQ ID NO: 108361 - RNA, 20 nt, Human
agcagugagauuucaucugu

SEQ ID NO: 108362 - RNA, 19 nt, Human
aguucacucacacugagcc

SEQ ID NO: 108363 - RNA, 24 nt, Human
caagcaaccuguucugcacagaua

SEQ ID NO: 108364 - RNA, 21 nt, Human
cacugguccgacuuuacccuu

SEQ ID NO: 108365 - RNA, 21 nt, Human
caguucacucacacugagccu

SEQ ID NO: 108366 - RNA, 21 nt, Human
cauugugucagguuuucaaua

SEQ ID NO: 108367 - RNA, 22 nt, Human
cauugugucagguuuucaauau

SEQ ID NO: 108368 - RNA, 24 nt, Human
cccaaaaagaauuguugaucuacc

SEQ ID NO: 108369 - RNA, 22 nt, Human
cuuagaaagcugcuuugauggg

SEQ ID NO: 108370 - RNA, 18 nt, Human
gaaaaaagaucucugagc

SEQ ID NO: 108371 - RNA, 21 nt, Human
gaagccuccaguucacucaca

SEQ ID NO: 108372 - RNA, 22 nt, Human
gccaaaguguaaggguuuucua

SEQ ID NO: 108373 - RNA, 22 nt, Human
guaaacaagcaaccuguucugc

SEQ ID NO: 108374 - RNA, 20 nt, Human
gucuuauaucuaagaaggaa

SEQ ID NO: 108375 - RNA, 22 nt, Human
uaaagagcuuugcauuaggggc

SEQ ID NO: 108376 - RNA, 23 nt, Human
uaacaaaauagcaagagguaaag

SEQ ID NO: 108377 - RNA, 23 nt, Human
uaacuaucauccauaauaaccaa

SEQ ID NO: 108378 - RNA, 24 nt, Human
uauaacaaaauagcaagagguaaa

SEQ ID NO: 108379 - RNA, 23 nt, Human
uaugaagagacaaagguaauacc

SEQ ID NO: 108380 - RNA, 21 nt, Human
uggaugcagaugguuucuucc

SEQ ID NO: 108381 - RNA, 19 nt, Human
uguacaaaaacucaaugca

SEQ ID NO: 108382 - RNA, 20 nt, Human
ugucagguuuucaauaugga

SEQ ID NO: 108383 - RNA, 23 nt, Human
uuguucauagccaaaguguaagg

SEQ ID NO: 108384 - RNA, 24 nt, Human
uuuguucauagccaaaguguaagg

SEQ ID NO: 108385 - RNA, 23 nt, Human
aaaauaccuugaguagaugccau

SEQ ID NO: 108386 - RNA, 23 nt, Human
aaaugcugaaaaucuucagagcu

SEQ ID NO: 108387 - RNA, 25 nt, Human
aagcagcuuuaucaaaaucuucuug

SEQ ID NO: 108388 - RNA, 21 nt, Human
aagguucugguuuaaauucaa

SEQ ID NO: 108389 - RNA, 22 nt, Human
aauagacaauaaguauaguaaa

SEQ ID NO: 108390 - RNA, 22 nt, Human
aaucaaugacaaaaaacaaaua

SEQ ID NO: 108391 - RNA, 27 nt, Human
aauguuuacuuauucuuauaauguagc

SEQ ID NO: 108392 - RNA, 24 nt, Human
acagagcuuuauucuguuguugac

SEQ ID NO: 108393 - RNA, 20 nt, Human
acaguaaacgacccuccaga

SEQ ID NO: 108394 - RNA, 22 nt, Human
acucauuuugauuaacauuuaa

SEQ ID NO: 108395 - RNA, 21 nt, Human
agaacaggaagaaacccuuga

SEQ ID NO: 108396 - RNA, 18 nt, Human
agcaaaacugucaaaugu

SEQ ID NO: 108397 - RNA, 18 nt, Human
aggggcaguccaugaaag

SEQ ID NO: 108398 - RNA, 19 nt, Human
auauuuuuuuccuuuugga

SEQ ID NO: 108399 - RNA, 22 nt, Human
augccaucauucuugacagaau

SEQ ID NO: 108400 - RNA, 22 nt, Human
caaaacuuucuacugaaccagg

SEQ ID NO: 108401 - RNA, 25 nt, Human
cagaccagaaguauuuauuaaagca

SEQ ID NO: 108402 - RNA, 22 nt, Human
cagaccgaauauuuaguucacc

SEQ ID NO: 108403 - RNA, 21 nt, Human
caugauuacaucccaugugcu

SEQ ID NO: 108404 - RNA, 19 nt, Human
cauuaggaggcacuccuga

SEQ ID NO: 108405 - RNA, 23 nt, Human
cauuucuaacuguacuauccacu

SEQ ID NO: 108406 - RNA, 22 nt, Human
ccaacccaaccaaggaucccuu

SEQ ID NO: 108407 - RNA, 18 nt, Human
ccagaacaggaagaaacc

SEQ ID NO: 108408 - RNA, 21 nt, Human
ccagaacaggaagaaacccuu

SEQ ID NO: 108409 - RNA, 22 nt, Human
ccaugugacaacaaaggaagua

SEQ ID NO: 108410 - RNA, 24 nt, Human
cccagaacaggaagaaacccuuga

SEQ ID NO: 108411 - RNA, 22 nt, Human
ccgaaaguacucugauuacucc

SEQ ID NO: 108412 - RNA, 19 nt, Human
ccucaaaagaugaacuucc

SEQ ID NO: 108413 - RNA, 21 nt, Human
ccucugaggugacauuggcuu

SEQ ID NO: 108414 - RNA, 21 nt, Human
ccugauacaguaaacgacccu

SEQ ID NO: 108415 - RNA, 21 nt, Human
ccugcgccauugucgcagagc

SEQ ID NO: 108416 - RNA, 23 nt, Human
ccuugaguagaugccaucauucu

SEQ ID NO: 108417 - RNA, 21 nt, Human
cuccagaggugagucugcuga

SEQ ID NO: 108418 - RNA, 24 nt, Human
cuccuuccacaucaucugugacuu

SEQ ID NO: 108419 - RNA, 25 nt, Human
cucuauuuuagaagguucugguuua

SEQ ID NO: 108420 - RNA, 21 nt, Human
cugagaaugauuaccauuagg

SEQ ID NO: 108421 - RNA, 19 nt, Human
cuguuguugacuuagccua

SEQ ID NO: 108422 - RNA, 18 nt, Human
cuucauuuucuauaaugg

SEQ ID NO: 108423 - RNA, 21 nt, Human
cuuucuacugaaccaggcucc

SEQ ID NO: 108424 - RNA, 20 nt, Human
gaaagagacggucuucugca

SEQ ID NO: 108425 - RNA, 20 nt, Human
gaaugcuggguuccugugga

SEQ ID NO: 108426 - RNA, 18 nt, Human
gagcaaugaaaauguagg

SEQ ID NO: 108427 - RNA, 19 nt, Human
gagcucaugauuacauccc

SEQ ID NO: 108428 - RNA, 21 nt, Human
gaggaccuugccaggggcagu

SEQ ID NO: 108429 - RNA, 19 nt, Human
gcaccugcgccauugucgc

SEQ ID NO: 108430 - RNA, 24 nt, Human
gguaagcacuuuuaaacuguaucu

SEQ ID NO: 108431 - RNA, 19 nt, Human
uaauuugaaucaaguacaa

SEQ ID NO: 108432 - RNA, 24 nt, Human
uagcaucagcacagaaauaauuuu

SEQ ID NO: 108433 - RNA, 18 nt, Human
ucaaguacaauucugcug

SEQ ID NO: 108434 - RNA, 25 nt, Human
ucaaguaccaaacagacuacacgcu

SEQ ID NO: 108435 - RNA, 19 nt, Human
ucaaugauaaaaaaacaaa

SEQ ID NO: 108436 - RNA, 18 nt, Human
uccaagugccugucucug

SEQ ID NO: 108437 - RNA, 20 nt, Human
uccaugaaaguugaauauga

SEQ ID NO: 108438 - RNA, 20 nt, Human
uccuguggaggaauaaaguu

SEQ ID NO: 108439 - RNA, 26 nt, Human
uccuuccacaucaucugugacuucag

SEQ ID NO: 108440 - RNA, 19 nt, Human
ucugcauucaugcuuccag

SEQ ID NO: 108441 - RNA, 20 nt, Human
ugaaaccucugaggugacau

SEQ ID NO: 108442 - RNA, 22 nt, Human
ugaaagcaucaauaaggccagu

SEQ ID NO: 108443 - RNA, 22 nt, Human
ugaaauccugcuuugagucccc

SEQ ID NO: 108444 - RNA, 22 nt, Human
ugaaauucugcugaaagcauca

SEQ ID NO: 108445 - RNA, 27 nt, Human
ugacaaaaaacaaauauaccacuuaua

SEQ ID NO: 108446 - RNA, 20 nt, Human
ugagguaguauauuuuuuuc

SEQ ID NO: 108447 - RNA, 20 nt, Human
ugauacaguaaacgacccuc

SEQ ID NO: 108448 - RNA, 19 nt, Human
ugcgccauugucgcagagc

SEQ ID NO: 108449 - RNA, 21 nt, Human
uggcuucauggauggcuugaa

SEQ ID NO: 108450 - RNA, 19 nt, Human
ugggagauaaaugcugaaa

SEQ ID NO: 108451 - RNA, 20 nt, Human
ugggcauaaaaacgaugucc

SEQ ID NO: 108452 - RNA, 19 nt, Human
uguaauaaaaaaugcgaua

SEQ ID NO: 108453 - RNA, 22 nt, Human
uuaaagcagcuuuaucaaaauc

SEQ ID NO: 108454 - RNA, 18 nt, Human
uuacagcuaauccaaaaa

SEQ ID NO: 108455 - RNA, 22 nt, Human
uuacugggagugugguagggcu

SEQ ID NO: 108456 - RNA, 22 nt, Human
uuacugggagugugguagggcu

SEQ ID NO: 108457 - RNA, 19 nt, Human
uucccagaacaggaagaaa

SEQ ID NO: 108458 - RNA, 22 nt, Human
uucgcugggauauucaaaguuu

SEQ ID NO: 108459 - RNA, 24 nt, Human
uugaaacuuagccucgaggucuac

SEQ ID NO: 108460 - RNA, 24 nt, Human
uugaagaauuauugcuggcuuuug

SEQ ID NO: 108461 - RNA, 24 nt, Human
uugccaaacugauugcagaaauau

SEQ ID NO: 108462 - RNA, 23 nt, Human
uugcuugugcaauguuugaaacc

SEQ ID NO: 108463 - RNA, 20 nt, Human
uuugaaaccucugaggugac

SEQ ID NO: 108464 - RNA, 22 nt, Human
uuugauuaacauuuaauaacuc

SEQ ID NO: 108465 - RNA, 19 nt, Human
cccccgagccccggccagg

SEQ ID NO: 108466 - RNA, 19 nt, Human
ccccggccaggccuuggcc

SEQ ID NO: 108467 - RNA, 24 nt, Human
cccgagccccggccaggccuuggc

SEQ ID NO: 108468 - RNA, 24 nt, Human
ccugcuugccccuguccuuccccc

SEQ ID NO: 108469 - RNA, 20 nt, Human
cggccaggccuuggccugcu

SEQ ID NO: 108470 - RNA, 22 nt, Human
gccuuggccugcuugccccugu

SEQ ID NO: 108471 - RNA, 25 nt, Human
gccuuggccugcuugccccuguccu

SEQ ID NO: 108472 - RNA, 22 nt, Human
guagcuccuuaagccucugcuc

SEQ ID NO: 108473 - RNA, 23 nt, Human
uaugaggaggucgugggaggggg

SEQ ID NO: 108474 - RNA, 21 nt, Human
uccuuaagccucugcucuugc

SEQ ID NO: 108475 - RNA, 19 nt, Human
uggccugcuugccccuguc

SEQ ID NO: 108476 - RNA, 18 nt, Human
uucccccaguguagcucc

SEQ ID NO: 108477 - RNA, 20 nt, Human
aaacugaauccaugcucuaa

SEQ ID NO: 108478 - RNA, 21 nt, Human
aacaacuccuccauuccacca

SEQ ID NO: 108479 - RNA, 22 nt, Human
aacagcacuuguauaucauagu

SEQ ID NO: 108480 - RNA, 22 nt, Human
aaccucaguaaaaucacaguac

SEQ ID NO: 108481 - RNA, 19 nt, Human
aagccugcacuaucaggca

SEQ ID NO: 108482 - RNA, 24 nt, Human
acacagcgaaaacuaucgcgauuu

SEQ ID NO: 108483 - RNA, 21 nt, Human
acccggucacauuauccauaa

SEQ ID NO: 108484 - RNA, 23 nt, Human
accucacuccuuuccuucucucu

SEQ ID NO: 108485 - RNA, 21 nt, Human
accuguuugaugagccuuugu

SEQ ID NO: 108486 - RNA, 22 nt, Human
agaaaggacugcuucaaaagga

SEQ ID NO: 108487 - RNA, 20 nt, Human
agagagagagaaauaaaggc

SEQ ID NO: 108488 - RNA, 21 nt, Human
agaggaaaacaaaaaagaaaa

SEQ ID NO: 108489 - RNA, 21 nt, Human
agccugacacagcgaaaacua

SEQ ID NO: 108490 - RNA, 18 nt, Human
agcucagagacauagcaa

SEQ ID NO: 108491 - RNA, 23 nt, Human
agcuccaccgaagaaagccugac

SEQ ID NO: 108492 - RNA, 18 nt, Human
aggugcucgaggacucug

SEQ ID NO: 108493 - RNA, 21 nt, Human
auuugcauaagacccggucac

SEQ ID NO: 108494 - RNA, 18 nt, Human
caacccaccacacccucc

SEQ ID NO: 108495 - RNA, 24 nt, Human
cacacccuccuugcucauuauucc

SEQ ID NO: 108496 - RNA, 20 nt, Human
caccacacccuccuugcuca

SEQ ID NO: 108497 - RNA, 24 nt, Human
cauccucagcugaaugcauccagu

SEQ ID NO: 108498 - RNA, 23 nt, Human
cccaaacaacuccuccauuccac

SEQ ID NO: 108499 - RNA, 19 nt, Human
ccccuuucccaguguucua

SEQ ID NO: 108500 - RNA, 23 nt, Human
cccuagagucaaccugcuucugc

SEQ ID NO: 108501 - RNA, 19 nt, Human
ccgggucagggccgguccg

SEQ ID NO: 108502 - RNA, 23 nt, Human
ccuagaaccuagcuacccucgga

SEQ ID NO: 108503 - RNA, 24 nt, Human
ccuccccaaacaacuccuccauuc

SEQ ID NO: 108504 - RNA, 19 nt, Human
ccuccuucaaacacgggag

SEQ ID NO: 108505 - RNA, 18 nt, Human
ccucuagaauagggcugu

SEQ ID NO: 108506 - RNA, 19 nt, Human
ccugcagccccuuucccaa

SEQ ID NO: 108507 - RNA, 22 nt, Human
ccuucucucuccuuucccuccc

SEQ ID NO: 108508 - RNA, 22 nt, Human
ccuucuugugaugaaaccucag

SEQ ID NO: 108509 - RNA, 21 nt, Human
cgaagaaagccugacacagcg

SEQ ID NO: 108510 - RNA, 21 nt, Human
cggaaccugcagccccuuucc

SEQ ID NO: 108511 - RNA, 20 nt, Human
cggagcuccaccgaagaaag

SEQ ID NO: 108512 - RNA, 21 nt, Human
cuagagucaaccugcuucugc

SEQ ID NO: 108513 - RNA, 23 nt, Human
cuguuuuuugcgcugccuuugga

SEQ ID NO: 108514 - RNA, 19 nt, Human
gagagagaaauaaaggcuc

SEQ ID NO: 108515 - RNA, 23 nt, Human
gagaggaaaacaaaaaagaaaac

SEQ ID NO: 108516 - RNA, 23 nt, Human
gcugccuuuggauucugcaucug

SEQ ID NO: 108517 - RNA, 21 nt, Human
ggcuguaugugucuugcaugu

SEQ ID NO: 108518 - RNA, 26 nt, Human
ggugcucgaggacucugcuccagagg

SEQ ID NO: 108519 - RNA, 25 nt, Human
guuucuucucucuccucaucuguga

SEQ ID NO: 108520 - RNA, 23 nt, Human
uaaaaauaaaaaucuccaaucuc

SEQ ID NO: 108521 - RNA, 22 nt, Human
uaaaagauaccugacguuuucu

SEQ ID NO: 108522 - RNA, 20 nt, Human
uaccucacuccuuuccuucu

SEQ ID NO: 108523 - RNA, 21 nt, Human
uauuguccuccuucaaacacg

SEQ ID NO: 108524 - RNA, 22 nt, Human
ucaacccaccacacccuccuug

SEQ ID NO: 108525 - RNA, 24 nt, Human
uccauaaagucugagaggaaaaca

SEQ ID NO: 108526 - RNA, 18 nt, Human
uccguuucuucucucucc

SEQ ID NO: 108527 - RNA, 20 nt, Human
uccuucaaacacgggagcaa

SEQ ID NO: 108528 - RNA, 24 nt, Human
ucugagaggaaaacaaaaaagaaa

SEQ ID NO: 108529 - RNA, 24 nt, Human
ugagagauuucguucucgcuuccu

SEQ ID NO: 108530 - RNA, 24 nt, Human
ugagaggaaaacaaaaaagaaaac

SEQ ID NO: 108531 - RNA, 23 nt, Human
ugcccaaaauuaaaaauaaaaau

SEQ ID NO: 108532 - RNA, 18 nt, Human
uggagaucccuagaguca

SEQ ID NO: 108533 - RNA, 23 nt, Human
uggagaucccuagagucaaccug

SEQ ID NO: 108534 - RNA, 20 nt, Human
ugugagcaaacaggccaggu

SEQ ID NO: 108535 - RNA, 23 nt, Human
uguuugaugagccuuuguuguga

SEQ ID NO: 108536 - RNA, 22 nt, Human
uuaaaaaaaggcaagaaccuug

SEQ ID NO: 108537 - RNA, 19 nt, Human
uucucuuuacugucaaagc

SEQ ID NO: 108538 - RNA, 23 nt, Human
uuuuguaaaggaggaaaaaaaag

SEQ ID NO: 108539 - RNA, 23 nt, Human
aaaaacggugaaaaagaaauagc

SEQ ID NO: 108540 - RNA, 19 nt, Human
aaagacuaaagagaaaggg

SEQ ID NO: 108541 - RNA, 20 nt, Human
aacacagcuugaaacucaua

SEQ ID NO: 108542 - RNA, 26 nt, Human
aacauagcagcaaaacuucaagaacc

SEQ ID NO: 108543 - RNA, 23 nt, Human
aagaaacaggacggucgugagcg

SEQ ID NO: 108544 - RNA, 20 nt, Human
aagcagacaugauaccugac

SEQ ID NO: 108545 - RNA, 20 nt, Human
aagcuuuuguuucugcuguc

SEQ ID NO: 108546 - RNA, 19 nt, Human
aaggaguaaaaguuucuug

SEQ ID NO: 108547 - RNA, 24 nt, Human
acagcacuauccagugacaaugag

SEQ ID NO: 108548 - RNA, 18 nt, Human
acaggagcaagaaacagg

SEQ ID NO: 108549 - RNA, 23 nt, Human
acauagcagcaaaacuucaagaa

SEQ ID NO: 108550 - RNA, 23 nt, Human
acccacaugcccccacagcagua

SEQ ID NO: 108551 - RNA, 18 nt, Human
agaaaagaccgaaauccu

SEQ ID NO: 108552 - RNA, 25 nt, Human
agaaacugauggauaagccagauaa

SEQ ID NO: 108553 - RNA, 22 nt, Human
agaaagcagacaugauaccuga

SEQ ID NO: 108554 - RNA, 18 nt, Human
agcaaaacuucaagaacc

SEQ ID NO: 108555 - RNA, 19 nt, Human
agcacgcuuauggcaggcu

SEQ ID NO: 108556 - RNA, 25 nt, Human
aggaagggacaaagacuaaagagaa

SEQ ID NO: 108557 - RNA, 18 nt, Human
aggagcaagaaacaggac

SEQ ID NO: 108558 - RNA, 18 nt, Human
aggcagaaacugacaagc

SEQ ID NO: 108559 - RNA, 22 nt, Human
aggcagggaggugugcgcgggg

SEQ ID NO: 108560 - RNA, 27 nt, Human
aggcagggaggugugcgcggggaggac

SEQ ID NO: 108561 - RNA, 21 nt, Human
agguaaaaacggugaaaaaga

SEQ ID NO: 108562 - RNA, 22 nt, Human
auuacaacuggauguuuugcau

SEQ ID NO: 108563 - RNA, 19 nt, Human
caaaguaagcgcaaauguc

SEQ ID NO: 108564 - RNA, 20 nt, Human
caacgcauaugccucauccu

SEQ ID NO: 108565 - RNA, 23 nt, Human
caacucugaggcaauaagccaga

SEQ ID NO: 108566 - RNA, 18 nt, Human
caccgcaguacuguaugc

SEQ ID NO: 108567 - RNA, 22 nt, Human
cacuguguucaaauuuaauuuc

SEQ ID NO: 108568 - RNA, 23 nt, Human
cacuguguucaaauuuaauuucu

SEQ ID NO: 108569 - RNA, 21 nt, Human
cagcaaaacuucaagaaccaa

SEQ ID NO: 108570 - RNA, 22 nt, Human
caggagcaagaaacaggacggu

SEQ ID NO: 108571 - RNA, 18 nt, Human
caguaacauagcagcaaa

SEQ ID NO: 108572 - RNA, 23 nt, Human
cauagcuuaauuccuucccgcag

SEQ ID NO: 108573 - RNA, 27 nt, Human
ccacagcaguagcaaacucauuaggaa

SEQ ID NO: 108574 - RNA, 22 nt, Human
cccccacagcaguagcaaacuc

SEQ ID NO: 108575 - RNA, 22 nt, Human
ccccuuugucuuuuggacucaa

SEQ ID NO: 108576 - RNA, 19 nt, Human
cccuggaagucccgggagg

SEQ ID NO: 108577 - RNA, 23 nt, Human
cccuuccucuucccacuuagaaa

SEQ ID NO: 108578 - RNA, 18 nt, Human
ccgaaaucuccugcuccu

SEQ ID NO: 108579 - RNA, 20 nt, Human
ccucucccuuccucuuccca

SEQ ID NO: 108580 - RNA, 19 nt, Human
ccuucuuccccgccuuucc

SEQ ID NO: 108581 - RNA, 20 nt, Human
cgccgugacaucaccaggag

SEQ ID NO: 108582 - RNA, 22 nt, Human
cgggguggggggaagacccugg

SEQ ID NO: 108583 - RNA, 22 nt, Human
cuauggcccauggaagugcuga

SEQ ID NO: 108584 - RNA, 23 nt, Human
cucaggguucuuauccccuaagg

SEQ ID NO: 108585 - RNA, 25 nt, Human
cuccacagccguaucugauaagacc

SEQ ID NO: 108586 - RNA, 23 nt, Human
cugagauaaaguuaaaacgcuac

SEQ ID NO: 108587 - RNA, 19 nt, Human
gacaaaagguaaaaacggu

SEQ ID NO: 108588 - RNA, 21 nt, Human
gacaaugagauugaaaaggau

SEQ ID NO: 108589 - RNA, 18 nt, Human
gacaguucaggaaccauc

SEQ ID NO: 108590 - RNA, 21 nt, Human
gacuaaagagaaagggcaagu

SEQ ID NO: 108591 - RNA, 20 nt, Human
gagaaaugauuucuucacac

SEQ ID NO: 108592 - RNA, 22 nt, Human
gagaagauaauggaacagauuu

SEQ ID NO: 108593 - RNA, 18 nt, Human
gagcagaaggaguaaaag

SEQ ID NO: 108594 - RNA, 18 nt, Human
gagcagaaggaguaaaag

SEQ ID NO: 108595 - RNA, 23 nt, Human
gaggcagaaacugacaagcucau

SEQ ID NO: 108596 - RNA, 27 nt, Human
gaggggcacuuagugaaaaggaaggga

SEQ ID NO: 108597 - RNA, 18 nt, Human
gagucagcauucaugcuc

SEQ ID NO: 108598 - RNA, 21 nt, Human
gauaauggaacagauuuagaa

SEQ ID NO: 108599 - RNA, 30 nt, Human
gcaaaacuucaagaaccaauaaauaaggag

SEQ ID NO: 108600 - RNA, 18 nt, Human
gcagaaaagaccgaaauc

SEQ ID NO: 108601 - RNA, 19 nt, Human
gcauacuugcagcuuucac

SEQ ID NO: 108602 - RNA, 23 nt, Human
gcauaugccucauccucuccaca

SEQ ID NO: 108603 - RNA, 18 nt, Human
ggcagggaggugugcgcg

SEQ ID NO: 108604 - RNA, 20 nt, Human
ggcauaccggcuauggccca

SEQ ID NO: 108605 - RNA, 22 nt, Human
ggccagaaacccucgcgcuggc

SEQ ID NO: 108606 - RNA, 20 nt, Human
gggacaaagacuaaagagaa

SEQ ID NO: 108607 - RNA, 20 nt, Human
gugacaucaccaggaggcgg

SEQ ID NO: 108608 - RNA, 21 nt, Human
gugcagcuugccuggccuucc

SEQ ID NO: 108609 - RNA, 25 nt, Human
uaacauagcagcaaaacuucaagaa

SEQ ID NO: 108610 - RNA, 23 nt, Human
uaagccagaggacaaaagguaaa

SEQ ID NO: 108611 - RNA, 21 nt, Human
uaaguuacaaacaucagccuu

SEQ ID NO: 108612 - RNA, 24 nt, Human
uacaaagaugcccagugcccaaau

SEQ ID NO: 108613 - RNA, 22 nt, Human
uacacagaucguaugguggacc

SEQ ID NO: 108614 - RNA, 22 nt, Human
uagaaagcagacaugauaccug

SEQ ID NO: 108615 - RNA, 19 nt, Human
uaggaaacacagcuugaaa

SEQ ID NO: 108616 - RNA, 19 nt, Human
uagggggagccacgugaca

SEQ ID NO: 108617 - RNA, 18 nt, Human
uaugccucauccucucca

SEQ ID NO: 108618 - RNA, 20 nt, Human
ucaauggauacaagcugagc

SEQ ID NO: 108619 - RNA, 23 nt, Human
ucacuguguucaaauuuaauuuc

SEQ ID NO: 108620 - RNA, 19 nt, Human
ucagaaacugauggauaag

SEQ ID NO: 108621 - RNA, 18 nt, Human
ucagcgcgacggcugcga

SEQ ID NO: 108622 - RNA, 21 nt, Human
ucaucauggcaggugccccug

SEQ ID NO: 108623 - RNA, 23 nt, Human
uccucgagcauccuuucuucagc

SEQ ID NO: 108624 - RNA, 19 nt, Human
uccugcuccuuuggguuga

SEQ ID NO: 108625 - RNA, 22 nt, Human
ugaaaaagaaauagcaacggga

SEQ ID NO: 108626 - RNA, 18 nt, Human
ugaaagcacgcuuauggc

SEQ ID NO: 108627 - RNA, 19 nt, Human
ugacaagcucauuugccuc

SEQ ID NO: 108628 - RNA, 23 nt, Human
ugacaugccgaugccccuuuguc

SEQ ID NO: 108629 - RNA, 20 nt, Human
ugagcagaaggaguaaaagu

SEQ ID NO: 108630 - RNA, 21 nt, Human
ugagcagaaggaguaaaaguu

SEQ ID NO: 108631 - RNA, 22 nt, Human
ugagcagaaggaguaaaaguuu

SEQ ID NO: 108632 - RNA, 18 nt, Human
ugagcggacccacuggca

SEQ ID NO: 108633 - RNA, 22 nt, Human
ugagcgucucuggggaagcuuu

SEQ ID NO: 108634 - RNA, 23 nt, Human
ugauacagcacuauccagugaca

SEQ ID NO: 108635 - RNA, 18 nt, Human
ugcagccgaaugcacacc

SEQ ID NO: 108636 - RNA, 19 nt, Human
ugcaugaucuuucauuggg

SEQ ID NO: 108637 - RNA, 23 nt, Human
ugcccagugcccaaauuggcuau

SEQ ID NO: 108638 - RNA, 19 nt, Human
ugcuacuugaaaaugaaag

SEQ ID NO: 108639 - RNA, 21 nt, Human
uggaagugcugagcugaucaa

SEQ ID NO: 108640 - RNA, 21 nt, Human
uggccgccccucaggcguuuc

SEQ ID NO: 108641 - RNA, 22 nt, Human
ugggaggagacacaccgcagua

SEQ ID NO: 108642 - RNA, 21 nt, Human
uggguagccuguuuggacucu

SEQ ID NO: 108643 - RNA, 18 nt, Human
uguccccaaugcaugauc

SEQ ID NO: 108644 - RNA, 20 nt, Human
uucuuccccgccuuuccaaa

SEQ ID NO: 108645 - RNA, 26 nt, Human
uugcuggguuuucuguuauuugcagc

SEQ ID NO: 108646 - RNA, 25 nt, Human
uuuacccacccacaugcccccacag

SEQ ID NO: 108647 - RNA, 20 nt, Human
uuuuuguuuuuaaagguuuc

SEQ ID NO: 108648 - RNA, 20 nt, Human
aaagagagacaggaguugau

SEQ ID NO: 108649 - RNA, 20 nt, Human
aaccauagcaaucuuauuua

SEQ ID NO: 108650 - RNA, 21 nt, Human
aagcaaauauaauuaaaccau

SEQ ID NO: 108651 - RNA, 22 nt, Human
aaggagguuggagcagcuuagg

SEQ ID NO: 108652 - RNA, 23 nt, Human
aaggauaacauuugaacugaauc

SEQ ID NO: 108653 - RNA, 25 nt, Human
acaacacacuaaugugacuucacca

SEQ ID NO: 108654 - RNA, 18 nt, Human
acaaggauaacauuugaa

SEQ ID NO: 108655 - RNA, 23 nt, Human
agacaaaaaggagguuggagcag

SEQ ID NO: 108656 - RNA, 19 nt, Human
agcagcauugucuuauaau

SEQ ID NO: 108657 - RNA, 20 nt, Human
aggaacauccauuacauuca

SEQ ID NO: 108658 - RNA, 19 nt, Human
agugacaguacaaagagag

SEQ ID NO: 108659 - RNA, 18 nt, Human
caaaaaggagguuggagc

SEQ ID NO: 108660 - RNA, 27 nt, Human
caaaagacaaaaaggagguuggagcag

SEQ ID NO: 108661 - RNA, 21 nt, Human
cacaaaaugaugaguggcuaa

SEQ ID NO: 108662 - RNA, 27 nt, Human
cagaaauuaaaauuaacauaaacauac

SEQ ID NO: 108663 - RNA, 23 nt, Human
cagucuagaaaauaccauuacuc

SEQ ID NO: 108664 - RNA, 22 nt, Human
cagugugaauggaaagcaacag

SEQ ID NO: 108665 - RNA, 20 nt, Human
cauccauuacauucagaggu

SEQ ID NO: 108666 - RNA, 25 nt, Human
ccaguaacaacaguuagaucccaaa

SEQ ID NO: 108667 - RNA, 19 nt, Human
ccguuaaacaacauaucca

SEQ ID NO: 108668 - RNA, 23 nt, Human
cuguaauguccuucccgcuuuac

SEQ ID NO: 108669 - RNA, 24 nt, Human
cuuucucugguuugaaaagcaaag

SEQ ID NO: 108670 - RNA, 23 nt, Human
gaaagagacaacacacuaaugug

SEQ ID NO: 108671 - RNA, 22 nt, Human
gaacugaaucuucacagucuag

SEQ ID NO: 108672 - RNA, 21 nt, Human
gaagaaccuauuccuccacca

SEQ ID NO: 108673 - RNA, 22 nt, Human
gagacaaaagggucaaaggcac

SEQ ID NO: 108674 - RNA, 19 nt, Human
gagcagcuuagguauuuca

SEQ ID NO: 108675 - RNA, 24 nt, Human
uaaaaagcaaauauaauuaaacca

SEQ ID NO: 108676 - RNA, 22 nt, Human
uaacaggaacaaggauaacauu

SEQ ID NO: 108677 - RNA, 22 nt, Human
uaacuuguaggaaagagacaac

SEQ ID NO: 108678 - RNA, 18 nt, Human
uacaaagagagacaggag

SEQ ID NO: 108679 - RNA, 20 nt, Human
uaccuucgucuuccaguaac

SEQ ID NO: 108680 - RNA, 18 nt, Human
uacucuuuuccuucuggc

SEQ ID NO: 108681 - RNA, 24 nt, Human
uagaagagauuaaccaaagcagca

SEQ ID NO: 108682 - RNA, 21 nt, Human
uauuguaacaggaacaaggau

SEQ ID NO: 108683 - RNA, 23 nt, Human
ucaggacgguuggaauuucucuu

SEQ ID NO: 108684 - RNA, 24 nt, Human
ucuggcuuuccuuucucugguuug

SEQ ID NO: 108685 - RNA, 19 nt, Human
ucugguaggaacauccauu

SEQ ID NO: 108686 - RNA, 19 nt, Human
ugagagugacaguacaaag

SEQ ID NO: 108687 - RNA, 23 nt, Human
uggaagccuaacuauaauuucuc

SEQ ID NO: 108688 - RNA, 23 nt, Human
uggagcagcuuagguauuucagu

SEQ ID NO: 108689 - RNA, 19 nt, Human
uguaacaggaacaaggaua

SEQ ID NO: 108690 - RNA, 18 nt, Human
ugugacuucaccauccaa

SEQ ID NO: 108691 - RNA, 19 nt, Human
ugugcaaugggaaaggauu

SEQ ID NO: 108692 - RNA, 23 nt, Human
uucaccauccaaauauggaaaau

SEQ ID NO: 108693 - RNA, 19 nt, Human
uuccuaauguaacaucaug

SEQ ID NO: 108694 - RNA, 19 nt, Human
aaaagaccuugaagcagcc

SEQ ID NO: 108695 - RNA, 23 nt, Human
aaacacaaaacaccacuucuuac

SEQ ID NO: 108696 - RNA, 19 nt, Human
aaacacaacaggaugugca

SEQ ID NO: 108697 - RNA, 20 nt, Human
aaacagaaaaaaggaagcug

SEQ ID NO: 108698 - RNA, 21 nt, Human
aaacagaaaaaaggaagcugc

SEQ ID NO: 108699 - RNA, 21 nt, Human
aagauccucugagcucugccu

SEQ ID NO: 108700 - RNA, 22 nt, Human
aagaucuggaccagcagagcca

SEQ ID NO: 108701 - RNA, 22 nt, Human
aagcacgucugccccagggaug

SEQ ID NO: 108702 - RNA, 22 nt, Human
aagcagaaacauuuagaaguca

SEQ ID NO: 108703 - RNA, 24 nt, Human
aagcagaaacauuuagaagucaaa

SEQ ID NO: 108704 - RNA, 21 nt, Human
aagcaucuuccccacgcaccc

SEQ ID NO: 108705 - RNA, 20 nt, Human
aagccagggccgggggccca

SEQ ID NO: 108706 - RNA, 18 nt, Human
aagcugcaauguuaagaa

SEQ ID NO: 108707 - RNA, 22 nt, Human
aagcuggagaugaaacacaaaa

SEQ ID NO: 108708 - RNA, 18 nt, Human
aaggacucucugaaauau

SEQ ID NO: 108709 - RNA, 20 nt, Human
aagggccucuguauguaagc

SEQ ID NO: 108710 - RNA, 25 nt, Human
aauggaggggccacaaucagcuaga

SEQ ID NO: 108711 - RNA, 24 nt, Human
acaaaauaucuggugacuuaaaca

SEQ ID NO: 108712 - RNA, 20 nt, Human
acacccucuuccucaaauag

SEQ ID NO: 108713 - RNA, 21 nt, Human
acagggagcaggaagugggaa

SEQ ID NO: 108714 - RNA, 21 nt, Human
accagagccucugcucacacc

SEQ ID NO: 108715 - RNA, 23 nt, Human
accagagccucugcucacaccca

SEQ ID NO: 108716 - RNA, 21 nt, Human
acugaggcgacugaucacugg

SEQ ID NO: 108717 - RNA, 18 nt, Human
agagagguguuugugaag

SEQ ID NO: 108718 - RNA, 20 nt, Human
agagcugugcugccagggcc

SEQ ID NO: 108719 - RNA, 21 nt, Human
agcacgucugccccagggaug

SEQ ID NO: 108720 - RNA, 20 nt, Human
agccccagccagcugugccc

SEQ ID NO: 108721 - RNA, 18 nt, Human
agccucagggcaggcggc

SEQ ID NO: 108722 - RNA, 22 nt, Human
agcuaacuuuggugggugaugc

SEQ ID NO: 108723 - RNA, 23 nt, Human
agcuggagaugaaacacaaaaca

SEQ ID NO: 108724 - RNA, 25 nt, Human
aggaagcaucuuccccacgcacccu

SEQ ID NO: 108725 - RNA, 22 nt, Human
aggacugaugcucaccccaggg

SEQ ID NO: 108726 - RNA, 21 nt, Human
aggagaaaaggaaaccacgug

SEQ ID NO: 108727 - RNA, 20 nt, Human
agggugggaacacagggagc

SEQ ID NO: 108728 - RNA, 25 nt, Human
auaagcaugaaugcccaaugcccag

SEQ ID NO: 108729 - RNA, 24 nt, Human
auaauucugcaucacaaaugccau

SEQ ID NO: 108730 - RNA, 21 nt, Human
aucacaaaugccauacagugg

SEQ ID NO: 108731 - RNA, 19 nt, Human
auggccaggaacacugcuc

SEQ ID NO: 108732 - RNA, 24 nt, Human
caaaaccacccccagggccucuga

SEQ ID NO: 108733 - RNA, 26 nt, Human
caaacaaacagugcaaacagaaaaaa

SEQ ID NO: 108734 - RNA, 22 nt, Human
caacacuggagggugggaacac

SEQ ID NO: 108735 - RNA, 19 nt, Human
caagcucugaacacugcca

SEQ ID NO: 108736 - RNA, 25 nt, Human
caagcuggagaugaaacacaaaaca

SEQ ID NO: 108737 - RNA, 26 nt, Human
caaggucccaaagccagggccggggg

SEQ ID NO: 108738 - RNA, 23 nt, Human
cacccucuuccucaaauaggcca

SEQ ID NO: 108739 - RNA, 24 nt, Human
cacccucuuccucaaauaggccaa

SEQ ID NO: 108740 - RNA, 18 nt, Human
caccggggcagccucagg

SEQ ID NO: 108741 - RNA, 23 nt, Human
cacgguuuuaaaaaaaacuaaac

SEQ ID NO: 108742 - RNA, 21 nt, Human
cacugccauaaaacacagcag

SEQ ID NO: 108743 - RNA, 25 nt, Human
cacugccauaaaacacagcagcagc

SEQ ID NO: 108744 - RNA, 18 nt, Human
cagaaaaguccaagcucu

SEQ ID NO: 108745 - RNA, 20 nt, Human
caggagagggugggcugggc

SEQ ID NO: 108746 - RNA, 24 nt, Human
cagggcaagaccagagccucugcu

SEQ ID NO: 108747 - RNA, 22 nt, Human
cagggccucugaccagcaaggu

SEQ ID NO: 108748 - RNA, 25 nt, Human
cauuccccagaguugagugaagcug

SEQ ID NO: 108749 - RNA, 23 nt, Human
ccaaagccagggccgggggccca

SEQ ID NO: 108750 - RNA, 24 nt, Human
ccaauaacauucaccggggcagcc

SEQ ID NO: 108751 - RNA, 25 nt, Human
ccacuucuuaccacccguaggcucc

SEQ ID NO: 108752 - RNA, 20 nt, Human
ccagagccucugcucacacc

SEQ ID NO: 108753 - RNA, 22 nt, Human
ccagagccucugcucacaccca

SEQ ID NO: 108754 - RNA, 24 nt, Human
ccagcccucgagaggccggggucc

SEQ ID NO: 108755 - RNA, 18 nt, Human
ccagggccaggugccgag

SEQ ID NO: 108756 - RNA, 28 nt, Human
ccagggccgggggcccauuggccccacu

SEQ ID NO: 108757 - RNA, 21 nt, Human
cccaaagccagggccgggggc

SEQ ID NO: 108758 - RNA, 18 nt, Human
cccagccagcugugcccg

SEQ ID NO: 108759 - RNA, 19 nt, Human
cccagggcugggccugaga

SEQ ID NO: 108760 - RNA, 19 nt, Human
ccccagccagcugugcccg

SEQ ID NO: 108761 - RNA, 19 nt, Human
ccccagggccucugaccag

SEQ ID NO: 108762 - RNA, 20 nt, Human
ccccagggccucugaccagc

SEQ ID NO: 108763 - RNA, 22 nt, Human
ccccagggccucugaccagcaa

SEQ ID NO: 108764 - RNA, 21 nt, Human
cccccagggccucugaccagc

SEQ ID NO: 108765 - RNA, 21 nt, Human
ccccggaacagccccagccag

SEQ ID NO: 108766 - RNA, 23 nt, Human
cccgugggcaaccuccacgguuu

SEQ ID NO: 108767 - RNA, 23 nt, Human
cccugcuuucagcuaacuuuggg

SEQ ID NO: 108768 - RNA, 22 nt, Human
ccgaugacucccggcuuucuga

SEQ ID NO: 108769 - RNA, 22 nt, Human
ccugcagggcguuagcucugcc

SEQ ID NO: 108770 - RNA, 19 nt, Human
ccugcgcuauuuccuggga

SEQ ID NO: 108771 - RNA, 20 nt, Human
ccuuuacugccacucuggac

SEQ ID NO: 108772 - RNA, 20 nt, Human
ccuuugcauggggccugggu

SEQ ID NO: 108773 - RNA, 21 nt, Human
cguaaaugaaggccaucuuga

SEQ ID NO: 108774 - RNA, 24 nt, Human
cgugaucaagcucugaacacugcc

SEQ ID NO: 108775 - RNA, 19 nt, Human
cuaaacguaaaugaaggcc

SEQ ID NO: 108776 - RNA, 20 nt, Human
cuaaacguaaaugaaggccc

SEQ ID NO: 108777 - RNA, 21 nt, Human
cuccugacuuggacaauuggc

SEQ ID NO: 108778 - RNA, 18 nt, Human
cugagcgcaagaucugga

SEQ ID NO: 108779 - RNA, 23 nt, Human
cugccauaaaacacagcagcagc

SEQ ID NO: 108780 - RNA, 18 nt, Human
cugcugggacugauacca

SEQ ID NO: 108781 - RNA, 21 nt, Human
cugcugggacugauaccaugu

SEQ ID NO: 108782 - RNA, 22 nt, Human
cuggcucugguggagccagggg

SEQ ID NO: 108783 - RNA, 22 nt, Human
cugugcugccagggccaggugc

SEQ ID NO: 108784 - RNA, 18 nt, Human
cuuggccaaggaggucgc

SEQ ID NO: 108785 - RNA, 24 nt, Human
cuuugcauggggccuggguuuggg

SEQ ID NO: 108786 - RNA, 21 nt, Human
gagagcugugcugccagggcc

SEQ ID NO: 108787 - RNA, 24 nt, Human
gagaggagaaaaggaaaccacgug

SEQ ID NO: 108788 - RNA, 20 nt, Human
gagccucugcucacacccag

SEQ ID NO: 108789 - RNA, 19 nt, Human
gagggugggaacacaggga

SEQ ID NO: 108790 - RNA, 18 nt, Human
gaugaaacacaaaacacc

SEQ ID NO: 108791 - RNA, 25 nt, Human
gaugacucccggcuuucugagugag

SEQ ID NO: 108792 - RNA, 18 nt, Human
gcaaagauggccaggaac

SEQ ID NO: 108793 - RNA, 22 nt, Human
gcaaaucaucccucagcacaag

SEQ ID NO: 108794 - RNA, 20 nt, Human
gcaccaggagagggugggcu

SEQ ID NO: 108795 - RNA, 21 nt, Human
gcaccaggagagggugggcug

SEQ ID NO: 108796 - RNA, 19 nt, Human
gccaagauccucugagcuc

SEQ ID NO: 108797 - RNA, 25 nt, Human
gccagcuccaggaaggggggaacgc

SEQ ID NO: 108798 - RNA, 21 nt, Human
gcccagaugcucacuuugggu

SEQ ID NO: 108799 - RNA, 19 nt, Human
gccccacucccugaucacc

SEQ ID NO: 108800 - RNA, 18 nt, Human
gccccagggaugccugcu

SEQ ID NO: 108801 - RNA, 19 nt, Human
gccccagggaugccugcug

SEQ ID NO: 108802 - RNA, 18 nt, Human
gcugccagggccaggugc

SEQ ID NO: 108803 - RNA, 18 nt, Human
gcuggcaggaagcaucuu

SEQ ID NO: 108804 - RNA, 22 nt, Human
gcuggcgaggccaccuugggcc

SEQ ID NO: 108805 - RNA, 20 nt, Human
gcugguuucuaauggacaga

SEQ ID NO: 108806 - RNA, 20 nt, Human
ggaagucagaaaaguccaag

SEQ ID NO: 108807 - RNA, 21 nt, Human
ggacagaaauggaaggagcga

SEQ ID NO: 108808 - RNA, 23 nt, Human
ggaguauuauccccauuucauaa

SEQ ID NO: 108809 - RNA, 19 nt, Human
ggccauggaacaccaagcu

SEQ ID NO: 108810 - RNA, 20 nt, Human
gggaagcagaaacauuuaga

SEQ ID NO: 108811 - RNA, 20 nt, Human
gggcagacacccucuuccuc

SEQ ID NO: 108812 - RNA, 19 nt, Human
gggcagccucagggcaggc

SEQ ID NO: 108813 - RNA, 21 nt, Human
gggcccauuggccccacuccc

SEQ ID NO: 108814 - RNA, 19 nt, Human
ggggagaggggacaaagga

SEQ ID NO: 108815 - RNA, 22 nt, Human
ggggcggggagaggggacaaag

SEQ ID NO: 108816 - RNA, 20 nt, Human
ggggugggccugugccaaca

SEQ ID NO: 108817 - RNA, 22 nt, Human
ggggugggccugugccaacacu

SEQ ID NO: 108818 - RNA, 18 nt, Human
guaaaugaaggccaucuu

SEQ ID NO: 108819 - RNA, 23 nt, Human
guauguaagcuugggacagcuag

SEQ ID NO: 108820 - RNA, 22 nt, Human
gucccaaauaagggaaggacuc

SEQ ID NO: 108821 - RNA, 19 nt, Human
gugaaaggcagacuuggcc

SEQ ID NO: 108822 - RNA, 23 nt, Human
gugaucaagcucugaacacugcc

SEQ ID NO: 108823 - RNA, 20 nt, Human
gugggugaugccaagauccu

SEQ ID NO: 108824 - RNA, 22 nt, Human
guuuuaaaaaaaacuaaacgua

SEQ ID NO: 108825 - RNA, 18 nt, Human
uaaaacacagcagcagcu

SEQ ID NO: 108826 - RNA, 21 nt, Human
uaagcaugaaugcccaaugcc

SEQ ID NO: 108827 - RNA, 23 nt, Human
uaauucugcaucacaaaugccau

SEQ ID NO: 108828 - RNA, 22 nt, Human
uagcuaacaucauacaaacaaa

SEQ ID NO: 108829 - RNA, 23 nt, Human
uaggaaaguagcaaagauggcca

SEQ ID NO: 108830 - RNA, 23 nt, Human
ucaaagcaauuuuggucagggag

SEQ ID NO: 108831 - RNA, 23 nt, Human
ucacaccauucuccugacuugga

SEQ ID NO: 108832 - RNA, 19 nt, Human
ucacacccaggagcagagu

SEQ ID NO: 108833 - RNA, 24 nt, Human
ucacaguugauuugucaugagugg

SEQ ID NO: 108834 - RNA, 19 nt, Human
ucagaaaaguccaagcucu

SEQ ID NO: 108835 - RNA, 24 nt, Human
ucagcuaacuuuggugggugaugc

SEQ ID NO: 108836 - RNA, 22 nt, Human
ucagcuagaaaagaccuugaag

SEQ ID NO: 108837 - RNA, 20 nt, Human
ucagggagauaagaaaaugg

SEQ ID NO: 108838 - RNA, 22 nt, Human
ucagugcauaauucugcaucac

SEQ ID NO: 108839 - RNA, 23 nt, Human
ucauacaaacaaacagugcaaac

SEQ ID NO: 108840 - RNA, 20 nt, Human
uccccacgcacccucccugc

SEQ ID NO: 108841 - RNA, 23 nt, Human
ucugaccagcaagguguccgaug

SEQ ID NO: 108842 - RNA, 21 nt, Human
ucugcagauggagagaaagcu

SEQ ID NO: 108843 - RNA, 18 nt, Human
ucugcucacacccaggag

SEQ ID NO: 108844 - RNA, 22 nt, Human
ucugguggagccaggggugggc

SEQ ID NO: 108845 - RNA, 22 nt, Human
ugaacacugccauaaaacacag

SEQ ID NO: 108846 - RNA, 18 nt, Human
ugaaugcccaaugcccag

SEQ ID NO: 108847 - RNA, 21 nt, Human
ugacaggugaucacaccauuc

SEQ ID NO: 108848 - RNA, 19 nt, Human
ugacgucacugaacgacag

SEQ ID NO: 108849 - RNA, 18 nt, Human
ugagcaugauuugccucc

SEQ ID NO: 108850 - RNA, 23 nt, Human
ugaucaagcucugaacacugcca

SEQ ID NO: 108851 - RNA, 20 nt, Human
ugauguccugcgcuauuucc

SEQ ID NO: 108852 - RNA, 20 nt, Human
ugauuugccuccccaggcag

SEQ ID NO: 108853 - RNA, 19 nt, Human
ugcaaacagaaaaaaggaa

SEQ ID NO: 108854 - RNA, 20 nt, Human
ugcaucacaaaugccauaca

SEQ ID NO: 108855 - RNA, 21 nt, Human
ugcccagaugcucacuuuggg

SEQ ID NO: 108856 - RNA, 19 nt, Human
ugccccggaacagccccag

SEQ ID NO: 108857 - RNA, 22 nt, Human
ugccuuggccaagucccucuca

SEQ ID NO: 108858 - RNA, 24 nt, Human
ugccuuggccaagucccucucaca

SEQ ID NO: 108859 - RNA, 20 nt, Human
ugcugggacugauaccaugu

SEQ ID NO: 108860 - RNA, 19 nt, Human
uggacaauuggcuuccuuc

SEQ ID NO: 108861 - RNA, 22 nt, Human
uggagggugggaacacagggag

SEQ ID NO: 108862 - RNA, 23 nt, Human
uggggaagucagaaaaguccaag

SEQ ID NO: 108863 - RNA, 18 nt, Human
ugggugauggggcugcua

SEQ ID NO: 108864 - RNA, 22 nt, Human
ugucccuuccagcugggaacug

SEQ ID NO: 108865 - RNA, 21 nt, Human
ugugaaaccuucaggcacgug

SEQ ID NO: 108866 - RNA, 23 nt, Human
ugugauguccugcgcuauuuccu

SEQ ID NO: 108867 - RNA, 21 nt, Human
uguuaggagucccaaauaagg

SEQ ID NO: 108868 - RNA, 23 nt, Human
uuagcuaacaucauacaaacaaa

SEQ ID NO: 108869 - RNA, 19 nt, Human
uugaagcagccccaucucu

SEQ ID NO: 108870 - RNA, 23 nt, Human
uugaagcagccccaucucuggag

SEQ ID NO: 108871 - RNA, 20 nt, Human
uugagaauuuucucagugcc

SEQ ID NO: 108872 - RNA, 23 nt, Human
uugcauggggccuggguuugggg

SEQ ID NO: 108873 - RNA, 23 nt, Human
uuggccccacucccugaucaccu

SEQ ID NO: 108874 - RNA, 20 nt, Human
uugggccucucgaaaggcuu

SEQ ID NO: 108875 - RNA, 20 nt, Human
aaaccuagacgaggagagug

SEQ ID NO: 108876 - RNA, 23 nt, Human
aagaaaccuagacgaggagagug

SEQ ID NO: 108877 - RNA, 19 nt, Human
acgcaggugccggcccugc

SEQ ID NO: 108878 - RNA, 20 nt, Human
agacccaacacacucggaca

SEQ ID NO: 108879 - RNA, 24 nt, Human
agcucccggggaggccccacuccc

SEQ ID NO: 108880 - RNA, 22 nt, Human
aggcagaggggcccuuccaggg

SEQ ID NO: 108881 - RNA, 22 nt, Human
aggcagggcugggcauggggcu

SEQ ID NO: 108882 - RNA, 22 nt, Human
aggcagggcuggguguggggcc

SEQ ID NO: 108883 - RNA, 20 nt, Human
aggcucagggaccaaggcag

SEQ ID NO: 108884 - RNA, 24 nt, Human
agggcagcaauuccacgcucugag

SEQ ID NO: 108885 - RNA, 20 nt, Human
agggugcucgccauugccac

SEQ ID NO: 108886 - RNA, 24 nt, Human
aguggaggcugggccugcgcaagg

SEQ ID NO: 108887 - RNA, 18 nt, Human
aguguccacagggcagca

SEQ ID NO: 108888 - RNA, 21 nt, Human
augaggccaagcagcucccaa

SEQ ID NO: 108889 - RNA, 21 nt, Human
caagcagcucccaagucucga

SEQ ID NO: 108890 - RNA, 22 nt, Human
cacacucggacaccuuggggcc

SEQ ID NO: 108891 - RNA, 20 nt, Human
cacagggcccgugagucacc

SEQ ID NO: 108892 - RNA, 21 nt, Human
caccugcgcuugguggcuggc

SEQ ID NO: 108893 - RNA, 22 nt, Human
cacgcacacgggcacaggcacg

SEQ ID NO: 108894 - RNA, 18 nt, Human
cacugaaguugccucugc

SEQ ID NO: 108895 - RNA, 18 nt, Human
cacugaaguugccucugc

SEQ ID NO: 108896 - RNA, 18 nt, Human
cacugcccacaacagggu

SEQ ID NO: 108897 - RNA, 18 nt, Human
cacugcuggggagcaugg

SEQ ID NO: 108898 - RNA, 19 nt, Human
cacugcuggggagcauggu

SEQ ID NO: 108899 - RNA, 26 nt, Human
cagacccaacacacucggacaccuug

SEQ ID NO: 108900 - RNA, 21 nt, Human
cagcucccaagucucgaagac

SEQ ID NO: 108901 - RNA, 20 nt, Human
caggcacgcaggugccggcc

SEQ ID NO: 108902 - RNA, 18 nt, Human
ccaagccggaugcaggcc

SEQ ID NO: 108903 - RNA, 19 nt, Human
ccaccggcccuucuagcug

SEQ ID NO: 108904 - RNA, 19 nt, Human
ccaccggcccuucuagcug

SEQ ID NO: 108905 - RNA, 19 nt, Human
ccacugcuggggagcaugg

SEQ ID NO: 108906 - RNA, 19 nt, Human
ccagacccagcccagccag

SEQ ID NO: 108907 - RNA, 20 nt, Human
cccagacuccaagcucuggg

SEQ ID NO: 108908 - RNA, 19 nt, Human
cccagccaguguccacagg

SEQ ID NO: 108909 - RNA, 28 nt, Human
cccaugugcuaggggaagaccggggucc

SEQ ID NO: 108910 - RNA, 21 nt, Human
cccauuaugggcagggcuggg

SEQ ID NO: 108911 - RNA, 24 nt, Human
ccccagacccagcccagccaggcc

SEQ ID NO: 108912 - RNA, 19 nt, Human
ccccccacggagggacccg

SEQ ID NO: 108913 - RNA, 19 nt, Human
ccccggugcccaccggccc

SEQ ID NO: 108914 - RNA, 18 nt, Human
cccggccccggugcccac

SEQ ID NO: 108915 - RNA, 20 nt, Human
cccggggaggccccacuccc

SEQ ID NO: 108916 - RNA, 21 nt, Human
cccucgaggccggggucccca

SEQ ID NO: 108917 - RNA, 20 nt, Human
ccgcacccagccccccacgg

SEQ ID NO: 108918 - RNA, 22 nt, Human
ccgugccucaggcccagggacc

SEQ ID NO: 108919 - RNA, 19 nt, Human
ccucaggcccagggaccac

SEQ ID NO: 108920 - RNA, 24 nt, Human
ccucaggcccagggaccacaggcc

SEQ ID NO: 108921 - RNA, 21 nt, Human
ccuccaaacccuggugcuacg

SEQ ID NO: 108922 - RNA, 20 nt, Human
ccucugccgccccgugaggg

SEQ ID NO: 108923 - RNA, 23 nt, Human
ccugugcugggccagguguccuc

SEQ ID NO: 108924 - RNA, 20 nt, Human
ccuguggcggccccagaccc

SEQ ID NO: 108925 - RNA, 23 nt, Human
ccuguggcggccccagacccagc

SEQ ID NO: 108926 - RNA, 18 nt, Human
cggggcagcagcaggggc

SEQ ID NO: 108927 - RNA, 21 nt, Human
cuagacgaggagaguggaggc

SEQ ID NO: 108928 - RNA, 20 nt, Human
cucauggcugaaaaugaggc

SEQ ID NO: 108929 - RNA, 18 nt, Human
cugaucccuggagguaaa

SEQ ID NO: 108930 - RNA, 19 nt, Human
cuguggcggccccagaccc

SEQ ID NO: 108931 - RNA, 22 nt, Human
gacccaacacacucggacaccu

SEQ ID NO: 108932 - RNA, 22 nt, Human
gaggucacacacacacagcuga

SEQ ID NO: 108933 - RNA, 20 nt, Human
gcagcaggggcaagggcucu

SEQ ID NO: 108934 - RNA, 20 nt, Human
gccccagacccagcccagcc

SEQ ID NO: 108935 - RNA, 24 nt, Human
gcccguguacccaagccggaugca

SEQ ID NO: 108936 - RNA, 20 nt, Human
gccgcacccagccccccacg

SEQ ID NO: 108937 - RNA, 18 nt, Human
gccuguggcggccccaga

SEQ ID NO: 108938 - RNA, 19 nt, Human
gcggccccagacccagccc

SEQ ID NO: 108939 - RNA, 24 nt, Human
gcucccaagucucgaagacuccac

SEQ ID NO: 108940 - RNA, 22 nt, Human
ggaaaugcagaagggccggggu

SEQ ID NO: 108941 - RNA, 19 nt, Human
gggaggccccacucccugg

SEQ ID NO: 108942 - RNA, 23 nt, Human
gggcagcagcaggggcaagggcu

SEQ ID NO: 108943 - RNA, 23 nt, Human
gggcauggggcucagggccuugg

SEQ ID NO: 108944 - RNA, 18 nt, Human
gggccuguggcggcccca

SEQ ID NO: 108945 - RNA, 19 nt, Human
uaacagggacacugaaguu

SEQ ID NO: 108946 - RNA, 19 nt, Human
uacccaagccggaugcagg

SEQ ID NO: 108947 - RNA, 21 nt, Human
uccacagggcagcaauuccac

SEQ ID NO: 108948 - RNA, 19 nt, Human
ucccaagucucgaagacuc

SEQ ID NO: 108949 - RNA, 21 nt, Human
ucccggggaggccccacuccc

SEQ ID NO: 108950 - RNA, 22 nt, Human
ucccggggaggccccacucccu

SEQ ID NO: 108951 - RNA, 21 nt, Human
uccgugccucaggcccaggga

SEQ ID NO: 108952 - RNA, 21 nt, Human
ucgcagccuccaaacccuggu

SEQ ID NO: 108953 - RNA, 26 nt, Human
ugaaaaugaggccaagcagcucccaa

SEQ ID NO: 108954 - RNA, 21 nt, Human
ugaggccggcaggagucuggc

SEQ ID NO: 108955 - RNA, 24 nt, Human
ugcccauuaugggcagggcugggc

SEQ ID NO: 108956 - RNA, 22 nt, Human
uggcccccgcugcaccugcgcu

SEQ ID NO: 108957 - RNA, 22 nt, Human
uggcggccccagacccagccca

SEQ ID NO: 108958 - RNA, 22 nt, Human
ugggggaccaaggcagggcugg

SEQ ID NO: 108959 - RNA, 20 nt, Human
ugggggcuucccggccccgg

SEQ ID NO: 108960 - RNA, 24 nt, Human
ugguggcgucagcucccggggagg

SEQ ID NO: 108961 - RNA, 22 nt, Human
uucagacccaacacacucggac

SEQ ID NO: 108962 - RNA, 23 nt, Human
uucucagcucucaacaucacagc

SEQ ID NO: 108963 - RNA, 19 nt, Human
uuuuucucagcucucaaca

SEQ ID NO: 108964 - RNA, 21 nt, Human
uuuuuuuuuuuuuugagagga

SEQ ID NO: 108965 - RNA, 22 nt, Human
uuuuuuuuuuuuuuuugagagg

SEQ ID NO: 108966 - RNA, 20 nt, Human
uuuuuuuuuuuuuuuuuugg

SEQ ID NO: 108967 - RNA, 22 nt, Human
cacacugugacgagcaaaccua

SEQ ID NO: 108968 - RNA, 19 nt, Human
ccacacugugacgagcaaa

SEQ ID NO: 108969 - RNA, 19 nt, Human
ccuagggcccugggcccag

SEQ ID NO: 108970 - RNA, 20 nt, Human
ccucugugggcagccgggcu

SEQ ID NO: 108971 - RNA, 23 nt, Human
cuacagcaccucugugggcagcc

SEQ ID NO: 108972 - RNA, 20 nt, Human
gaccuuuggcuuuagagccu

SEQ ID NO: 108973 - RNA, 24 nt, Human
gcaucuacagcaccucugugggca

SEQ ID NO: 108974 - RNA, 22 nt, Human
uagaccuuuggcuuuagagccu

SEQ ID NO: 108975 - RNA, 22 nt, Human
ucugugggcagccgggcagccc

SEQ ID NO: 108976 - RNA, 19 nt, Human
aaaccaaccccacugacca

SEQ ID NO: 108977 - RNA, 21 nt, Human
aaccccacugaccaaacuccc

SEQ ID NO: 108978 - RNA, 20 nt, Human
aagaccaaccagaaauguca

SEQ ID NO: 108979 - RNA, 22 nt, Human
aaucucaguuuuuguuucuuuc

SEQ ID NO: 108980 - RNA, 21 nt, Human
acaaaccaaccccacugacca

SEQ ID NO: 108981 - RNA, 22 nt, Human
acccuccugccuucccucuucu

SEQ ID NO: 108982 - RNA, 18 nt, Human
acgcugccacccuccugc

SEQ ID NO: 108983 - RNA, 28 nt, Human
acuaaaaauccacagcucauucccuccu

SEQ ID NO: 108984 - RNA, 18 nt, Human
agacauucaagaccaacc

SEQ ID NO: 108985 - RNA, 25 nt, Human
agacauucaagaccaaccagaaaug

SEQ ID NO: 108986 - RNA, 22 nt, Human
aggacggaguauuugagagaaa

SEQ ID NO: 108987 - RNA, 20 nt, Human
caaaccaaccccacugacca

SEQ ID NO: 108988 - RNA, 23 nt, Human
caaaccaaccccacugaccaaac

SEQ ID NO: 108989 - RNA, 25 nt, Human
caaccagaaaugucauuucugcacu

SEQ ID NO: 108990 - RNA, 24 nt, Human
caaccccacugaccaaacucccaa

SEQ ID NO: 108991 - RNA, 19 nt, Human
cagcagcccaggggagaag

SEQ ID NO: 108992 - RNA, 19 nt, Human
cagcccaggggagaagcag

SEQ ID NO: 108993 - RNA, 25 nt, Human
cagccgggcagcucccugggcccuc

SEQ ID NO: 108994 - RNA, 25 nt, Human
cagccgggcagcucccugggcccuc

SEQ ID NO: 108995 - RNA, 20 nt, Human
caggaucaagccuccccuuc

SEQ ID NO: 108996 - RNA, 24 nt, Human
caggaucaagccuccccuucccag

SEQ ID NO: 108997 - RNA, 21 nt, Human
caggcaugcagaaaaccucga

SEQ ID NO: 108998 - RNA, 23 nt, Human
cauucccuccugcgcccugaccc

SEQ ID NO: 108999 - RNA, 24 nt, Human
ccacagcucauucccuccugcgcc

SEQ ID NO: 109000 - RNA, 20 nt, Human
ccagaaaugucauuucugca

SEQ ID NO: 109001 - RNA, 18 nt, Human
ccagagcagacauucaag

SEQ ID NO: 109002 - RNA, 23 nt, Human
ccagagcagacauucaagaccaa

SEQ ID NO: 109003 - RNA, 18 nt, Human
ccagccggagcccuucau

SEQ ID NO: 109004 - RNA, 23 nt, Human
cccacagcagcccaggggagaag

SEQ ID NO: 109005 - RNA, 27 nt, Human
ccccacugaccaaacucccaagucacu

SEQ ID NO: 109006 - RNA, 20 nt, Human
cccgccggggacccagccca

SEQ ID NO: 109007 - RNA, 23 nt, Human
ccuccauugacagucccgccggg

SEQ ID NO: 109008 - RNA, 18 nt, Human
ccuccucugagccaccac

SEQ ID NO: 109009 - RNA, 25 nt, Human
ccuccugccuucccucuucugccaa

SEQ ID NO: 109010 - RNA, 20 nt, Human
ccucggggucacgccgcucc

SEQ ID NO: 109011 - RNA, 22 nt, Human
ccucggggucacgccgcuccuc

SEQ ID NO: 109012 - RNA, 23 nt, Human
ccucuuauuucccccucuguccc

SEQ ID NO: 109013 - RNA, 18 nt, Human
ccuggaucacaaaccaac

SEQ ID NO: 109014 - RNA, 25 nt, Human
cgaauaucugccauggaagagccuu

SEQ ID NO: 109015 - RNA, 22 nt, Human
cgcccugaccaccugcccacag

SEQ ID NO: 109016 - RNA, 24 nt, Human
cgccggggacccagcccacagcag

SEQ ID NO: 109017 - RNA, 27 nt, Human
cggagcccuucauuuaaguguagcccu

SEQ ID NO: 109018 - RNA, 21 nt, Human
cucccaugugcaagaggacuc

SEQ ID NO: 109019 - RNA, 24 nt, Human
cuccggguccauuggcuguucaca

SEQ ID NO: 109020 - RNA, 20 nt, Human
cucucggcuccggguccauu

SEQ ID NO: 109021 - RNA, 18 nt, Human
cugaccaccugcccacag

SEQ ID NO: 109022 - RNA, 19 nt, Human
cuggaaccccugccuccaa

SEQ ID NO: 109023 - RNA, 19 nt, Human
cuggagccuggcuggacuc

SEQ ID NO: 109024 - RNA, 24 nt, Human
gagcagacauucaagaccaaccag

SEQ ID NO: 109025 - RNA, 21 nt, Human
gagccaguuccgcaggacugg

SEQ ID NO: 109026 - RNA, 21 nt, Human
gagguggcuuggccagagcag

SEQ ID NO: 109027 - RNA, 22 nt, Human
gggacccagcccacagcagccc

SEQ ID NO: 109028 - RNA, 25 nt, Human
uaaaaacaaagcucuugcuggucuc

SEQ ID NO: 109029 - RNA, 24 nt, Human
uaaaaauccacagcucauucccuc

SEQ ID NO: 109030 - RNA, 21 nt, Human
uagcuagcaugagaggaggug

SEQ ID NO: 109031 - RNA, 23 nt, Human
uauaauaaauacaaaaacagaca

SEQ ID NO: 109032 - RNA, 22 nt, Human
ucaagaccaaccagaaauguca

SEQ ID NO: 109033 - RNA, 20 nt, Human
ucacacucacuucccugugu

SEQ ID NO: 109034 - RNA, 18 nt, Human
ucacauuauuuccuugga

SEQ ID NO: 109035 - RNA, 21 nt, Human
uccaggacggaguauuugaga

SEQ ID NO: 109036 - RNA, 20 nt, Human
ucccuguguccuggaacugc

SEQ ID NO: 109037 - RNA, 22 nt, Human
uccgcaagguuuauuccuggau

SEQ ID NO: 109038 - RNA, 21 nt, Human
uccuggaucacaaaccaaccc

SEQ ID NO: 109039 - RNA, 19 nt, Human
ucuccuccucuuauuuccc

SEQ ID NO: 109040 - RNA, 18 nt, Human
ugagagaaaauuguguag

SEQ ID NO: 109041 - RNA, 22 nt, Human
ugagaggagguggcuuggccag

SEQ ID NO: 109042 - RNA, 20 nt, Human
ugcacuuccaggcaugcaga

SEQ ID NO: 109043 - RNA, 18 nt, Human
ugccuaggccagccgggc

SEQ ID NO: 109044 - RNA, 18 nt, Human
ugccuaggccagccgggc

SEQ ID NO: 109045 - RNA, 21 nt, Human
uggaucacaaaccaaccccac

SEQ ID NO: 109046 - RNA, 23 nt, Human
uggaucacaaaccaaccccacug

SEQ ID NO: 109047 - RNA, 22 nt, Human
ugggcaucuccuuccuaacacg

SEQ ID NO: 109048 - RNA, 22 nt, Human
ugugcuggaaccccugccucca

SEQ ID NO: 109049 - RNA, 21 nt, Human
uguuucuuucuucuuccaaga

SEQ ID NO: 109050 - RNA, 19 nt, Human
uucacauuauuuccuugga

SEQ ID NO: 109051 - RNA, 20 nt, Human
uucacauuauuuccuuggau

SEQ ID NO: 109052 - RNA, 21 nt, Human
uugguauagagagcuuucucc

SEQ ID NO: 109053 - RNA, 20 nt, Human
aggcaggucagugcaagggc

SEQ ID NO: 109054 - RNA, 22 nt, Human
agggcugaguguguuucgggug

SEQ ID NO: 109055 - RNA, 24 nt, Human
caggucagugcaagggcugagugu

SEQ ID NO: 109056 - RNA, 31 nt, Human
cauaugcaaacacacccugaaacgugcagug

SEQ ID NO: 109057 - RNA, 23 nt, Human
gaagcaaccagccuccaaucaga

SEQ ID NO: 109058 - RNA, 23 nt, Human
gggcugaguguguuucggguggg

SEQ ID NO: 109059 - RNA, 18 nt, Human
uauccgaagcaaccagcc

SEQ ID NO: 109060 - RNA, 21 nt, Human
ucagugcaagggcugagugug

SEQ ID NO: 109061 - RNA, 23 nt, Human
aaguauuggcggucacccaggcc

SEQ ID NO: 109062 - RNA, 23 nt, Human
acugacucaccgacggcgcgcgc

SEQ ID NO: 109063 - RNA, 18 nt, Human
caaggcccgcuccaccgg

SEQ ID NO: 109064 - RNA, 19 nt, Human
caggccccgugcuccagaa

SEQ ID NO: 109065 - RNA, 19 nt, Human
cagguuggucccugggccc

SEQ ID NO: 109066 - RNA, 22 nt, Human
cccaggccccgugcuccagaag

SEQ ID NO: 109067 - RNA, 23 nt, Human
ccccgaagucgacugcccggccc

SEQ ID NO: 109068 - RNA, 22 nt, Human
cccgcaaagccguggcugcugg

SEQ ID NO: 109069 - RNA, 25 nt, Human
cccugggccccgaagucgacugccc

SEQ ID NO: 109070 - RNA, 19 nt, Human
ccggggccgcugggccugg

SEQ ID NO: 109071 - RNA, 18 nt, Human
ccuggcuucugggggugg

SEQ ID NO: 109072 - RNA, 19 nt, Human
ccuggcuucuggggguggg

SEQ ID NO: 109073 - RNA, 20 nt, Human
cgcgggggcuuccuggcuuc

SEQ ID NO: 109074 - RNA, 21 nt, Human
cggcccgauggggcucgacgg

SEQ ID NO: 109075 - RNA, 24 nt, Human
cucgcgguggugguggugguguuu

SEQ ID NO: 109076 - RNA, 22 nt, Human
cugcaccugccuguggcuuuga

SEQ ID NO: 109077 - RNA, 20 nt, Human
cuuccagggcugccgguccc

SEQ ID NO: 109078 - RNA, 20 nt, Human
cuucugggggugggcuggcc

SEQ ID NO: 109079 - RNA, 21 nt, Human
gagcaugggggcagcggcccg

SEQ ID NO: 109080 - RNA, 19 nt, Human
gaggggccggggccgcugg

SEQ ID NO: 109081 - RNA, 18 nt, Human
gcccgcaaagccguggcu

SEQ ID NO: 109082 - RNA, 18 nt, Human
gccgcggcaaggcccgcu

SEQ ID NO: 109083 - RNA, 20 nt, Human
gccuggugcgcgcuccagcu

SEQ ID NO: 109084 - RNA, 18 nt, Human
gcgcgggggcuuccuggc

SEQ ID NO: 109085 - RNA, 23 nt, Human
gcggucacccaggccccgugcuc

SEQ ID NO: 109086 - RNA, 24 nt, Human
ggcccgcaaagccguggcugcugg

SEQ ID NO: 109087 - RNA, 18 nt, Human
ggccuggcgggagcugcg

SEQ ID NO: 109088 - RNA, 20 nt, Human
ggcgggagcugcggcgcccc

SEQ ID NO: 109089 - RNA, 23 nt, Human
gggggcagcggcccgauggggcu

SEQ ID NO: 109090 - RNA, 20 nt, Human
gggggugggcuggccuccga

SEQ ID NO: 109091 - RNA, 22 nt, Human
gggugcggggagacgaggggcc

SEQ ID NO: 109092 - RNA, 22 nt, Human
ggguggcuccgggugcggggag

SEQ ID NO: 109093 - RNA, 19 nt, Human
gguggcuccgggugcgggg

SEQ ID NO: 109094 - RNA, 19 nt, Human
guggugguggugguggugg

SEQ ID NO: 109095 - RNA, 19 nt, Human
uccauacgcucucgccgcg

SEQ ID NO: 109096 - RNA, 20 nt, Human
uccauacgcucucgccgcgg

SEQ ID NO: 109097 - RNA, 24 nt, Human
uccuggcuucugggggugggcugg

SEQ ID NO: 109098 - RNA, 18 nt, Human
ucgcgguggugguggugg

SEQ ID NO: 109099 - RNA, 18 nt, Human
ugaaaaauaucaagugcc

SEQ ID NO: 109100 - RNA, 20 nt, Human
ugaaaaauaucaagugcccc

SEQ ID NO: 109101 - RNA, 21 nt, Human
ugagguuucacaguccaugca

SEQ ID NO: 109102 - RNA, 20 nt, Human
ugcaaaacgaaaggcuuuua

SEQ ID NO: 109103 - RNA, 20 nt, Human
ugcccagcgcgagcaugggg

SEQ ID NO: 109104 - RNA, 22 nt, Human
ugcccggcccgcaaagccgugg

SEQ ID NO: 109105 - RNA, 19 nt, Human
ugccggucccugcccagcg

SEQ ID NO: 109106 - RNA, 21 nt, Human
ugcgccugcaccugccugugg

SEQ ID NO: 109107 - RNA, 19 nt, Human
ugcuggggaagcugcccca

SEQ ID NO: 109108 - RNA, 18 nt, Human
uggcuccgggugcgggga

SEQ ID NO: 109109 - RNA, 19 nt, Human
uggcuccgggugcggggag

SEQ ID NO: 109110 - RNA, 21 nt, Human
ugggccccgaagucgacugcc

SEQ ID NO: 109111 - RNA, 22 nt, Human
ugggggcagcggcccgaugggg

SEQ ID NO: 109112 - RNA, 20 nt, Human
uggggucucccugcgucugu

SEQ ID NO: 109113 - RNA, 22 nt, Human
uggugguggugguggggucucc

SEQ ID NO: 109114 - RNA, 20 nt, Human
uggugguggugguggugguc

SEQ ID NO: 109115 - RNA, 19 nt, Human
uuggugguggugguggugg

SEQ ID NO: 109116 - RNA, 26 nt, Human
uuuuuuuuuuugcaaaacgaaaggcu

SEQ ID NO: 109117 - RNA, 18 nt, Human
uuuuuuuuuuuuuuuuug

SEQ ID NO: 109118 - RNA, 21 nt, Human
uuuuuuuuuuuuuuuuugcaa

SEQ ID NO: 109119 - RNA, 19 nt, Human
aacagcgccgcgcacagaa

SEQ ID NO: 109120 - RNA, 20 nt, Human
accauuuacuaagcagauuc

SEQ ID NO: 109121 - RNA, 20 nt, Human
acuaagcagauucuuagccu

SEQ ID NO: 109122 - RNA, 23 nt, Human
agccggacguuccgaggagccug

SEQ ID NO: 109123 - RNA, 18 nt, Human
aggaggggcccggccgug

SEQ ID NO: 109124 - RNA, 19 nt, Human
aggcaggagcggauccagg

SEQ ID NO: 109125 - RNA, 28 nt, Human
agggcagggccgggcuaguggcaggaga

SEQ ID NO: 109126 - RNA, 21 nt, Human
aguggcaggagaaggucagcu

SEQ ID NO: 109127 - RNA, 18 nt, Human
cagcagccaagaccccca

SEQ ID NO: 109128 - RNA, 20 nt, Human
cagcagccaagacccccagc

SEQ ID NO: 109129 - RNA, 18 nt, Human
cagccaagacccccagcg

SEQ ID NO: 109130 - RNA, 20 nt, Human
cauccgccccuccgaaguca

SEQ ID NO: 109131 - RNA, 23 nt, Human
ccaggagccgcgucggggcgcag

SEQ ID NO: 109132 - RNA, 24 nt, Human
cccccagcgucuuggaggggaagc

SEQ ID NO: 109133 - RNA, 18 nt, Human
cccgcagaacccccaagg

SEQ ID NO: 109134 - RNA, 21 nt, Human
cccgggcucugcauccgcccc

SEQ ID NO: 109135 - RNA, 18 nt, Human
ccgauggaguaaagacca

SEQ ID NO: 109136 - RNA, 20 nt, Human
ccuccgaagucagcaggagc

SEQ ID NO: 109137 - RNA, 19 nt, Human
ccucgcaggcguggcuggc

SEQ ID NO: 109138 - RNA, 18 nt, Human
ccugccgauggaguaaag

SEQ ID NO: 109139 - RNA, 18 nt, Human
cgaaggcccgcagaaccc

SEQ ID NO: 109140 - RNA, 23 nt, Human
cgaaggcccgcagaacccccaag

SEQ ID NO: 109141 - RNA, 23 nt, Human
cuggugccuuugcgcccgcgcuc

SEQ ID NO: 109142 - RNA, 24 nt, Human
gagccugcgcgccgcgcuacccgg

SEQ ID NO: 109143 - RNA, 24 nt, Human
gcacagaaaaggaaacuucauucc

SEQ ID NO: 109144 - RNA, 22 nt, Human
gccaagacccccagcgucuugg

SEQ ID NO: 109145 - RNA, 18 nt, Human
gcccugggcgggcccugg

SEQ ID NO: 109146 - RNA, 19 nt, Human
gcgcaggcaggagcggauc

SEQ ID NO: 109147 - RNA, 22 nt, Human
ggcaggaggggcccggccgugc

SEQ ID NO: 109148 - RNA, 20 nt, Human
gggcagggccgggcuagugg

SEQ ID NO: 109149 - RNA, 28 nt, Human
gggggccccgggcucugcauccgccccu

SEQ ID NO: 109150 - RNA, 18 nt, Human
uaaggcagcagccaagac

SEQ ID NO: 109151 - RNA, 22 nt, Human
ucaagcuccggugcccacaagc

SEQ ID NO: 109152 - RNA, 18 nt, Human
uccaggagccgcgucggg

SEQ ID NO: 109153 - RNA, 22 nt, Human
uccaggagccgcgucggggcgc

SEQ ID NO: 109154 - RNA, 21 nt, Human
ucccacucccgcccucucuca

SEQ ID NO: 109155 - RNA, 20 nt, Human
ucucucaagcuccggugccc

SEQ ID NO: 109156 - RNA, 24 nt, Human
uggagugagaccgggagguccagg

SEQ ID NO: 109157 - RNA, 18 nt, Human
uggcaggagaaggucagc

SEQ ID NO: 109158 - RNA, 19 nt, Human
uggcaggaggggcccggcc

SEQ ID NO: 109159 - RNA, 23 nt, Human
uggcaggaggggcccggccgugc

SEQ ID NO: 109160 - RNA, 20 nt, Human
uggucccugggcucgggccu

SEQ ID NO: 109161 - RNA, 20 nt, Human
uuacuaagcagauucuuagc

SEQ ID NO: 109162 - RNA, 20 nt, Human
uugcgcccgcgcucccggcu

SEQ ID NO: 109163 - RNA, 23 nt, Human
uuuuugagaguucaaaccauuua

SEQ ID NO: 109164 - RNA, 20 nt, Human
aaaaauccaaaaaauuagcc

SEQ ID NO: 109165 - RNA, 22 nt, Human
aaacauuuuaggggcauuccuu

SEQ ID NO: 109166 - RNA, 18 nt, Human
aacaagagggugaggugg

SEQ ID NO: 109167 - RNA, 19 nt, Human
aacauagugaaaccccauc

SEQ ID NO: 109168 - RNA, 20 nt, Human
aacauagugaaaccccaucu

SEQ ID NO: 109169 - RNA, 21 nt, Human
aacauagugaaaccccaucuc

SEQ ID NO: 109170 - RNA, 21 nt, Human
aacauagugaaaccccaucuc

SEQ ID NO: 109171 - RNA, 18 nt, Human
aauuagccaagcauggug

SEQ ID NO: 109172 - RNA, 18 nt, Human
accccaucucuacuaaaa

SEQ ID NO: 109173 - RNA, 24 nt, Human
accccaucucuacuaaaaauccaa

SEQ ID NO: 109174 - RNA, 18 nt, Human
agacagagguugcacuug

SEQ ID NO: 109175 - RNA, 24 nt, Human
agcacuuugggaggcugagguggg

SEQ ID NO: 109176 - RNA, 21 nt, Human
agccaagcaugguggcacacg

SEQ ID NO: 109177 - RNA, 22 nt, Human
agccuggccaacauagugaaac

SEQ ID NO: 109178 - RNA, 24 nt, Human
agccuggccaacauagugaaaccc

SEQ ID NO: 109179 - RNA, 23 nt, Human
aggaggcugaggcacgagaauca

SEQ ID NO: 109180 - RNA, 23 nt, Human
aggaguucaagacuagccuggcc

SEQ ID NO: 109181 - RNA, 26 nt, Human
aggccaggaguucaagacuagccugg

SEQ ID NO: 109182 - RNA, 20 nt, Human
aggcugaggugggcggauug

SEQ ID NO: 109183 - RNA, 24 nt, Human
agggaggaugggauuggcuucuuu

SEQ ID NO: 109184 - RNA, 24 nt, Human
agguguaguggcucgugccuauaa

SEQ ID NO: 109185 - RNA, 24 nt, Human
aguggcucgugccuauaaucucag

SEQ ID NO: 109186 - RNA, 24 nt, Human
caagacuagccuggccaacauagu

SEQ ID NO: 109187 - RNA, 20 nt, Human
caccgcacaccaugcagggu

SEQ ID NO: 109188 - RNA, 24 nt, Human
cacuugggagcagggugacugugg

SEQ ID NO: 109189 - RNA, 21 nt, Human
cagacagagguugcacuuggg

SEQ ID NO: 109190 - RNA, 24 nt, Human
cagcacuuugggaggcugaggugg

SEQ ID NO: 109191 - RNA, 20 nt, Human
cagggugacugugggaggca

SEQ ID NO: 109192 - RNA, 23 nt, Human
ccaugcagggucagacagagguu

SEQ ID NO: 109193 - RNA, 21 nt, Human
cccaucucuacuaaaaaucca

SEQ ID NO: 109194 - RNA, 23 nt, Human
ccuggccaacauagugaaacccc

SEQ ID NO: 109195 - RNA, 24 nt, Human
ccuggccaacauagugaaacccca

SEQ ID NO: 109196 - RNA, 24 nt, Human
cgucuguaauuucggcuacucagg

SEQ ID NO: 109197 - RNA, 20 nt, Human
cgugccuauaaucucagcac

SEQ ID NO: 109198 - RNA, 24 nt, Human
cgugccuauaaucucagcacuuug

SEQ ID NO: 109199 - RNA, 24 nt, Human
cucgugccuauaaucucagcacuu

SEQ ID NO: 109200 - RNA, 23 nt, Human
cuggccaacauagugaaacccca

SEQ ID NO: 109201 - RNA, 21 nt, Human
cuguaauuucggcuacucagg

SEQ ID NO: 109202 - RNA, 18 nt, Human
gacugugggaggcaggau

SEQ ID NO: 109203 - RNA, 24 nt, Human
gauugcuucaggccaggaguucaa

SEQ ID NO: 109204 - RNA, 24 nt, Human
gccaacauagugaaaccccaucuc

SEQ ID NO: 109205 - RNA, 19 nt, Human
ggagcagggugacuguggg

SEQ ID NO: 109206 - RNA, 19 nt, Human
ggaggcaggaucugcugua

SEQ ID NO: 109207 - RNA, 18 nt, Human
ggccagguguaguggcuc

SEQ ID NO: 109208 - RNA, 22 nt, Human
ggccugaggcaggagggcaccg

SEQ ID NO: 109209 - RNA, 20 nt, Human
gggaggcugaggugggcgga

SEQ ID NO: 109210 - RNA, 24 nt, Human
ggggugugguucuuucaaacaagc

SEQ ID NO: 109211 - RNA, 19 nt, Human
gugccuauaaucucagcac

SEQ ID NO: 109212 - RNA, 18 nt, Human
uaauaggugacagccugc

SEQ ID NO: 109213 - RNA, 24 nt, Human
uagccuggccaacauagugaaacc

SEQ ID NO: 109214 - RNA, 25 nt, Human
uaggggcauuccuuguacaaaacuu

SEQ ID NO: 109215 - RNA, 24 nt, Human
uaguggcucgugccuauaaucuca

SEQ ID NO: 109216 - RNA, 23 nt, Human
ucaggugggugcagaagcucuug

SEQ ID NO: 109217 - RNA, 19 nt, Human
uccaaaaaauuagccaagc

SEQ ID NO: 109218 - RNA, 21 nt, Human
ucucuacuaaaaauccaaaaa

SEQ ID NO: 109219 - RNA, 22 nt, Human
ucucuacuaaaaauccaaaaaa

SEQ ID NO: 109220 - RNA, 19 nt, Human
ugaaaccccaucucuacua

SEQ ID NO: 109221 - RNA, 18 nt, Human
ugacagccugcugaaaca

SEQ ID NO: 109222 - RNA, 19 nt, Human
ugaggcacgagaaucacug

SEQ ID NO: 109223 - RNA, 18 nt, Human
ugaggcaggagggcaccg

SEQ ID NO: 109224 - RNA, 22 nt, Human
ugagguggccccuuggcucuug

SEQ ID NO: 109225 - RNA, 24 nt, Human
ugaggugggcggauugcuucaggc

SEQ ID NO: 109226 - RNA, 26 nt, Human
ugaggugggcggauugcuucaggcca

SEQ ID NO: 109227 - RNA, 24 nt, Human
ugccuauaaucucagcacuuuggg

SEQ ID NO: 109228 - RNA, 24 nt, Human
uggccagguguaguggcucgugcc

SEQ ID NO: 109229 - RNA, 19 nt, Human
uggccccuuggcucuugag

SEQ ID NO: 109230 - RNA, 21 nt, Human
uggcucgugccuauaaucuca

SEQ ID NO: 109231 - RNA, 22 nt, Human
uggcucgugccuauaaucucag

SEQ ID NO: 109232 - RNA, 24 nt, Human
uggcucgugccuauaaucucagca

SEQ ID NO: 109233 - RNA, 19 nt, Human
ugggagcagggugacugug

SEQ ID NO: 109234 - RNA, 21 nt, Human
ugggaggcaggaucugcugua

SEQ ID NO: 109235 - RNA, 22 nt, Human
ugggaggcugaggugggcggau

SEQ ID NO: 109236 - RNA, 24 nt, Human
ugggaggcugaggugggcggauug

SEQ ID NO: 109237 - RNA, 19 nt, Human
uguaacaagagggugaggu

SEQ ID NO: 109238 - RNA, 21 nt, Human
uguaauaggugacagccugcu

SEQ ID NO: 109239 - RNA, 22 nt, Human
ugugggaggcaggaucugcugu

SEQ ID NO: 109240 - RNA, 21 nt, Human
uucaggccaggaguucaagac

SEQ ID NO: 109241 - RNA, 23 nt, Human
uugcuucaggccaggaguucaag

SEQ ID NO: 109242 - RNA, 18 nt, Human
uuuuuuuuuuuuuuuuug

SEQ ID NO: 109243 - RNA, 18 nt, Human
uuuuuuuuuuuuuuuuug

SEQ ID NO: 109244 - RNA, 23 nt, Human
aaaaaacaccaaaaauuagccug

SEQ ID NO: 109245 - RNA, 22 nt, Human
aaacccugucucuacuaaaaaa

SEQ ID NO: 109246 - RNA, 20 nt, Human
aacauggcaaaacccagucu

SEQ ID NO: 109247 - RNA, 23 nt, Human
aagagcgaaacucugucucaaaa

SEQ ID NO: 109248 - RNA, 24 nt, Human
aauugcuugaacccagggggcgga

SEQ ID NO: 109249 - RNA, 19 nt, Human
acaaaagagaaucucugag

SEQ ID NO: 109250 - RNA, 24 nt, Human
acaaagugagacccuaucucaaaa

SEQ ID NO: 109251 - RNA, 20 nt, Human
acaagagcgaaacucugucu

SEQ ID NO: 109252 - RNA, 21 nt, Human
acaagagcgaaacucugucuc

SEQ ID NO: 109253 - RNA, 18 nt, Human
acccugucucuacuaaaa

SEQ ID NO: 109254 - RNA, 24 nt, Human
accgacauggagaaacccugucuc

SEQ ID NO: 109255 - RNA, 24 nt, Human
accucagcuguuacucuuuucugu

SEQ ID NO: 109256 - RNA, 24 nt, Human
acgccuguaaucccagcacuuggg

SEQ ID NO: 109257 - RNA, 28 nt, Human
acucugucucaaaaaaaaaaaaaaaaaa

SEQ ID NO: 109258 - RNA, 18 nt, Human
acugcacuccagccuggg

SEQ ID NO: 109259 - RNA, 23 nt, Human
acugcacuccagccuggguaaca

SEQ ID NO: 109260 - RNA, 24 nt, Human
acuugaggucaggaguucgggacu

SEQ ID NO: 109261 - RNA, 20 nt, Human
agaaaacuuuccuaugagag

SEQ ID NO: 109262 - RNA, 21 nt, Human
agaauugcuugaacccagggg

SEQ ID NO: 109263 - RNA, 20 nt, Human
agauagcugcagugagucga

SEQ ID NO: 109264 - RNA, 23 nt, Human
agaucacuugaggucaggaguuc

SEQ ID NO: 109265 - RNA, 22 nt, Human
agccuggguaacaaagugagac

SEQ ID NO: 109266 - RNA, 19 nt, Human
agcugcagugagucgagau

SEQ ID NO: 109267 - RNA, 21 nt, Human
agcugcagugagucgagauug

SEQ ID NO: 109268 - RNA, 24 nt, Human
agcuuggucaacauggcaaaaccc

SEQ ID NO: 109269 - RNA, 26 nt, Human
aggcagaucacuugaggucaggaguu

SEQ ID NO: 109270 - RNA, 23 nt, Human
aggcaggagaauugcuugaaccc

SEQ ID NO: 109271 - RNA, 24 nt, Human
aggcaggagaauugcuugaaccca

SEQ ID NO: 109272 - RNA, 22 nt, Human
aggcaggcagaucacuugaggu

SEQ ID NO: 109273 - RNA, 26 nt, Human
aggcaggcagaucacuugaggucagg

SEQ ID NO: 109274 - RNA, 21 nt, Human
aggcugaggcaggagaauugc

SEQ ID NO: 109275 - RNA, 24 nt, Human
aggcugaggcaggagaauugcuug

SEQ ID NO: 109276 - RNA, 19 nt, Human
aggcugggugcaguggcuc

SEQ ID NO: 109277 - RNA, 20 nt, Human
aggcugggugcaguggcuca

SEQ ID NO: 109278 - RNA, 24 nt, Human
aggugugguggcucacaucuguaa

SEQ ID NO: 109279 - RNA, 24 nt, Human
aguggcucacgccuguaaucccag

SEQ ID NO: 109280 - RNA, 21 nt, Human
aucacuugaggucaggaguuc

SEQ ID NO: 109281 - RNA, 24 nt, Human
aucacuugaggucaggaguucggg

SEQ ID NO: 109282 - RNA, 22 nt, Human
aucccagcacuuugggaggcca

SEQ ID NO: 109283 - RNA, 24 nt, Human
aucgugccguugcacuccagccug

SEQ ID NO: 109284 - RNA, 24 nt, Human
auugugccacugcacuccagccug

SEQ ID NO: 109285 - RNA, 18 nt, Human
caaaagagaaucucugag

SEQ ID NO: 109286 - RNA, 23 nt, Human
caacaagagcgaaacucugucuc

SEQ ID NO: 109287 - RNA, 18 nt, Human
caacauggcaaaacccag

SEQ ID NO: 109288 - RNA, 25 nt, Human
caaggcgggcagaucacuuaagccc

SEQ ID NO: 109289 - RNA, 18 nt, Human
caagguaaaugccaaguc

SEQ ID NO: 109290 - RNA, 24 nt, Human
cacaucuguaaucccagcacuuug

SEQ ID NO: 109291 - RNA, 22 nt, Human
cacaugaggaaauauaguuuca

SEQ ID NO: 109292 - RNA, 20 nt, Human
caccuguagucccagcuacu

SEQ ID NO: 109293 - RNA, 22 nt, Human
caccuguagucccagcuacuug

SEQ ID NO: 109294 - RNA, 23 nt, Human
cacgccuguaaucccagcacuug

SEQ ID NO: 109295 - RNA, 24 nt, Human
cacuccagccugggcaacaagagc

SEQ ID NO: 109296 - RNA, 25 nt, Human
cacuccagccugggcaacaagagcg

SEQ ID NO: 109297 - RNA, 22 nt, Human
cacuccagccuggguaacaaag

SEQ ID NO: 109298 - RNA, 23 nt, Human
cacuccagccuggguaacaaagu

SEQ ID NO: 109299 - RNA, 24 nt, Human
cacuccagccuggguaacaaagug

SEQ ID NO: 109300 - RNA, 18 nt, Human
cacugcacuccagccugg

SEQ ID NO: 109301 - RNA, 19 nt, Human
cacugcacuccagccuggg

SEQ ID NO: 109302 - RNA, 19 nt, Human
cacugcacuccagccuggg

SEQ ID NO: 109303 - RNA, 22 nt, Human
cacugcacuccagccuggguaa

SEQ ID NO: 109304 - RNA, 23 nt, Human
cacugcacuccagccuggguaac

SEQ ID NO: 109305 - RNA, 24 nt, Human
cacugcacuccagccuggguaaca

SEQ ID NO: 109306 - RNA, 27 nt, Human
cagaucacuuaagcccaggaguuagag

SEQ ID NO: 109307 - RNA, 24 nt, Human
cagaucacuugaggucaggaguuc

SEQ ID NO: 109308 - RNA, 27 nt, Human
cagaucacuugaggucaggaguucggg

SEQ ID NO: 109309 - RNA, 23 nt, Human
cagcacuugggaggccgaggcag

SEQ ID NO: 109310 - RNA, 23 nt, Human
cagcacuugggaggccgaggcag

SEQ ID NO: 109311 - RNA, 24 nt, Human
cagcacuuugggaggccaaggcgg

SEQ ID NO: 109312 - RNA, 24 nt, Human
cagcuacuugggaggcugaggcag

SEQ ID NO: 109313 - RNA, 24 nt, Human
cagcuuggucaacauggcaaaacc

SEQ ID NO: 109314 - RNA, 25 nt, Human
caucacaaaacuaauaaaacauauu

SEQ ID NO: 109315 - RNA, 24 nt, Human
caucuguaaucccagcacuuuggg

SEQ ID NO: 109316 - RNA, 21 nt, Human
ccaagcucucuaaacauuuuc

SEQ ID NO: 109317 - RNA, 20 nt, Human
ccacugcacuccagccuggg

SEQ ID NO: 109318 - RNA, 20 nt, Human
ccacugcacuccagccuggg

SEQ ID NO: 109319 - RNA, 20 nt, Human
ccacugcacuccagccuggg

SEQ ID NO: 109320 - RNA, 22 nt, Human
ccacugcacuccagccugggua

SEQ ID NO: 109321 - RNA, 24 nt, Human
ccacugcacuccagccuggguaac

SEQ ID NO: 109322 - RNA, 20 nt, Human
ccguugcacuccagccuggg

SEQ ID NO: 109323 - RNA, 21 nt, Human
ccguugcacuccagccugggc

SEQ ID NO: 109324 - RNA, 22 nt, Human
ccguugcacuccagccugggca

SEQ ID NO: 109325 - RNA, 23 nt, Human
ccguugcacuccagccugggcaa

SEQ ID NO: 109326 - RNA, 24 nt, Human
ccguugcacuccagccugggcaac

SEQ ID NO: 109327 - RNA, 19 nt, Human
ccuaucucaaaaaaauaaa

SEQ ID NO: 109328 - RNA, 22 nt, Human
ccugauuccaugucuagggauc

SEQ ID NO: 109329 - RNA, 22 nt, Human
ccuguagucccagcuacuugag

SEQ ID NO: 109330 - RNA, 22 nt, Human
cgacauggagaaacccugucuc

SEQ ID NO: 109331 - RNA, 26 nt, Human
cgagaucgugccguugcacuccagcc

SEQ ID NO: 109332 - RNA, 20 nt, Human
cgaggcaggcagaucacuug

SEQ ID NO: 109333 - RNA, 26 nt, Human
cgaggcaggcagaucacuugagguca

SEQ ID NO: 109334 - RNA, 21 nt, Human
cguugcacuccagccugggca

SEQ ID NO: 109335 - RNA, 22 nt, Human
cguugcacuccagccugggcaa

SEQ ID NO: 109336 - RNA, 24 nt, Human
cguugcacuccagccugggcaaca

SEQ ID NO: 109337 - RNA, 24 nt, Human
cuaggcugggugcaguggcucacg

SEQ ID NO: 109338 - RNA, 18 nt, Human
cucaaaaaaaaaaaaaaa

SEQ ID NO: 109339 - RNA, 24 nt, Human
cucacaucuguaaucccagcacuu

SEQ ID NO: 109340 - RNA, 22 nt, Human
cucacgccuguaaucccagcac

SEQ ID NO: 109341 - RNA, 24 nt, Human
cucacgccuguaaucccagcacuu

SEQ ID NO: 109342 - RNA, 19 nt, Human
cucugucucaaaaaaaaaa

SEQ ID NO: 109343 - RNA, 22 nt, Human
cugcagugagucgagauugugc

SEQ ID NO: 109344 - RNA, 21 nt, Human
cuguaaucccagcuacuuggg

SEQ ID NO: 109345 - RNA, 23 nt, Human
cuugaccucagcuguuacucucc

SEQ ID NO: 109346 - RNA, 19 nt, Human
cuuuucuuucugcuccuga

SEQ ID NO: 109347 - RNA, 19 nt, Human
gaaacaacucugauagagc

SEQ ID NO: 109348 - RNA, 22 nt, Human
gaaacaacucugauagagccag

SEQ ID NO: 109349 - RNA, 23 nt, Human
gaaaucacagccucucccuucaa

SEQ ID NO: 109350 - RNA, 21 nt, Human
gacauggagaaacccugucuc

SEQ ID NO: 109351 - RNA, 21 nt, Human
gagaaacccugucucuacuaa

SEQ ID NO: 109352 - RNA, 23 nt, Human
gagaucgugccguugcacuccag

SEQ ID NO: 109353 - RNA, 23 nt, Human
gagauugugccacugcacuccag

SEQ ID NO: 109354 - RNA, 23 nt, Human
gagguugcggugagccgagaucg

SEQ ID NO: 109355 - RNA, 23 nt, Human
gaucacuugaggucaggaguucg

SEQ ID NO: 109356 - RNA, 24 nt, Human
gaucacuugaggucaggaguucgg

SEQ ID NO: 109357 - RNA, 30 nt, Human
gcaaaacccagucucuacaaaaaacaccag

SEQ ID NO: 109358 - RNA, 21 nt, Human
gcagaucacuugaggucagga

SEQ ID NO: 109359 - RNA, 22 nt, Human
gcaggagaauugcuugaaccca

SEQ ID NO: 109360 - RNA, 19 nt, Human
gccacugcacuccagccug

SEQ ID NO: 109361 - RNA, 24 nt, Human
gccacugcacuccagccuggguaa

SEQ ID NO: 109362 - RNA, 22 nt, Human
gccguugcacuccagccugggc

SEQ ID NO: 109363 - RNA, 24 nt, Human
gccguugcacuccagccugggcaa

SEQ ID NO: 109364 - RNA, 18 nt, Human
gccugacuguaaucccag

SEQ ID NO: 109365 - RNA, 22 nt, Human
gcucuuuucuuucugcuccuga

SEQ ID NO: 109366 - RNA, 21 nt, Human
ggagcucuuuucuuucugcuc

SEQ ID NO: 109367 - RNA, 20 nt, Human
ggagguugcggugagccgag

SEQ ID NO: 109368 - RNA, 22 nt, Human
ggagguugcggugagccgagau

SEQ ID NO: 109369 - RNA, 24 nt, Human
ggagguugcggugagccgagaucg

SEQ ID NO: 109370 - RNA, 19 nt, Human
ggccaggugugguggcuca

SEQ ID NO: 109371 - RNA, 21 nt, Human
ggccaggugugguggcucaca

SEQ ID NO: 109372 - RNA, 23 nt, Human
ggccaggugugguggcucacauc

SEQ ID NO: 109373 - RNA, 19 nt, Human
ggcggagguugcggugagc

SEQ ID NO: 109374 - RNA, 20 nt, Human
ggcggagguugcggugagcc

SEQ ID NO: 109375 - RNA, 23 nt, Human
ggcggagguugcggugagccgag

SEQ ID NO: 109376 - RNA, 21 nt, Human
ggcucacaucuguaaucccag

SEQ ID NO: 109377 - RNA, 24 nt, Human
gggcggagguugcggugagccgag

SEQ ID NO: 109378 - RNA, 27 nt, Human
ggggccaggugugguggcucacaucug

SEQ ID NO: 109379 - RNA, 24 nt, Human
gggugcaguggcucacgccuguaa

SEQ ID NO: 109380 - RNA, 24 nt, Human
gguggcaugcaccuguagucccag

SEQ ID NO: 109381 - RNA, 24 nt, Human
gguggcucacaucuguaaucccag

SEQ ID NO: 109382 - RNA, 24 nt, Human
gguggugccugacuguaaucccag

SEQ ID NO: 109383 - RNA, 21 nt, Human
guucuguuuucuguccuccuu

SEQ ID NO: 109384 - RNA, 24 nt, Human
guugcggugagccgagaucgugcc

SEQ ID NO: 109385 - RNA, 21 nt, Human
uaaaaacucaagcuuggcugc

SEQ ID NO: 109386 - RNA, 22 nt, Human
uaaaaagcagaaaacuuuccua

SEQ ID NO: 109387 - RNA, 19 nt, Human
uaaaauugcucugacugug

SEQ ID NO: 109388 - RNA, 23 nt, Human
uaacaaauuaagcuuaaguaguu

SEQ ID NO: 109389 - RNA, 23 nt, Human
uaagcccaggaguuagagaccag

SEQ ID NO: 109390 - RNA, 25 nt, Human
uacaaaaaacaccaaaaauuagccc

SEQ ID NO: 109391 - RNA, 26 nt, Human
uacaaaaaacaccaaaaauuagccug

SEQ ID NO: 109392 - RNA, 24 nt, Human
uacccugaccgacauggagaaacc

SEQ ID NO: 109393 - RNA, 18 nt, Human
uacugcuagaaguugagg

SEQ ID NO: 109394 - RNA, 23 nt, Human
uagcaccagugggaaaguaugaa

SEQ ID NO: 109395 - RNA, 20 nt, Human
uagccgggugugguggugcc

SEQ ID NO: 109396 - RNA, 22 nt, Human
ucaaaaaaaaaaaaaaaaaaaa

SEQ ID NO: 109397 - RNA, 23 nt, Human
ucaaaaaaaaaaaaaaaaaaaaa

SEQ ID NO: 109398 - RNA, 24 nt, Human
uccagccuggguaacaaagugaga

SEQ ID NO: 109399 - RNA, 18 nt, Human
uccuucuccacccuuccu

SEQ ID NO: 109400 - RNA, 23 nt, Human
ucgugccguugcacuccagccug

SEQ ID NO: 109401 - RNA, 24 nt, Human
ucucuacuaaaaaaauacaaaauu

SEQ ID NO: 109402 - RNA, 24 nt, Human
ucucucuccuucuccacccuuccc

SEQ ID NO: 109403 - RNA, 23 nt, Human
ucugucucaaaaaaaaaaaaaaa

SEQ ID NO: 109404 - RNA, 22 nt, Human
ucuguucuguuuucuguccucc

SEQ ID NO: 109405 - RNA, 24 nt, Human
ugaccgacauggagaaacccuguc

SEQ ID NO: 109406 - RNA, 23 nt, Human
ugacuguaaucccagcuacuugg

SEQ ID NO: 109407 - RNA, 24 nt, Human
ugacuguaaucccagcuacuuggg

SEQ ID NO: 109408 - RNA, 18 nt, Human
ugagagccccugaauaga

SEQ ID NO: 109409 - RNA, 22 nt, Human
ugagccgagaucgugccguugc

SEQ ID NO: 109410 - RNA, 24 nt, Human
ugaggcaggagaauugcuugaacc

SEQ ID NO: 109411 - RNA, 25 nt, Human
ugaggcaggagaauugcuugaaccc

SEQ ID NO: 109412 - RNA, 22 nt, Human
ugagucgagauugugccacugc

SEQ ID NO: 109413 - RNA, 18 nt, Human
ugauaaagaaaaaguagg

SEQ ID NO: 109414 - RNA, 24 nt, Human
ugcaccuguagucccagcuacuug

SEQ ID NO: 109415 - RNA, 19 nt, Human
ugcacuccagccugggcaa

SEQ ID NO: 109416 - RNA, 22 nt, Human
ugcacuccagccugggcaacaa

SEQ ID NO: 109417 - RNA, 18 nt, Human
uggaaauaaaaauagcac

SEQ ID NO: 109418 - RNA, 24 nt, Human
uggcaacacaccgugcacuucaau

SEQ ID NO: 109419 - RNA, 24 nt, Human
uggcaugguggcaugcaccuguag

SEQ ID NO: 109420 - RNA, 21 nt, Human
uggcucacaucuguaauccca

SEQ ID NO: 109421 - RNA, 22 nt, Human
uggcucacaucuguaaucccag

SEQ ID NO: 109422 - RNA, 24 nt, Human
uggcucacaucuguaaucccagca

SEQ ID NO: 109423 - RNA, 24 nt, Human
uggcucacgccuguaaucccagca

SEQ ID NO: 109424 - RNA, 22 nt, Human
ugggagcucuuuucuuucugcu

SEQ ID NO: 109425 - RNA, 24 nt, Human
ugggaggccaaggcgggcagauca

SEQ ID NO: 109426 - RNA, 20 nt, Human
ugggaggccgaggcaggcag

SEQ ID NO: 109427 - RNA, 24 nt, Human
ugggaggccgaggcaggcagauca

SEQ ID NO: 109428 - RNA, 19 nt, Human
ugggaggcugaggcaggag

SEQ ID NO: 109429 - RNA, 22 nt, Human
ugggaggcugaggcaggagaau

SEQ ID NO: 109430 - RNA, 22 nt, Human
uggggccaggugugguggcuca

SEQ ID NO: 109431 - RNA, 23 nt, Human
uggugaagauuuuuucccauuuu

SEQ ID NO: 109432 - RNA, 24 nt, Human
ugguggcaugcaccuguaguccca

SEQ ID NO: 109433 - RNA, 24 nt, Human
ugguggcucacaucuguaauccca

SEQ ID NO: 109434 - RNA, 24 nt, Human
ugguggugccugacuguaauccca

SEQ ID NO: 109435 - RNA, 22 nt, Human
uguaaaacaguacaucacaaaa

SEQ ID NO: 109436 - RNA, 24 nt, Human
uguggacaaaagagaaucucugag

SEQ ID NO: 109437 - RNA, 23 nt, Human
uuaauacuuguuccaaugagguu

SEQ ID NO: 109438 - RNA, 21 nt, Human
uuaauugauaaagaaaaagua

SEQ ID NO: 109439 - RNA, 23 nt, Human
uuagagaccagcuuggucaacau

SEQ ID NO: 109440 - RNA, 19 nt, Human
uuagccgggugugguggug

SEQ ID NO: 109441 - RNA, 20 nt, Human
uuagccgggugugguggugc

SEQ ID NO: 109442 - RNA, 19 nt, Human
uucacauauuaaucaacau

SEQ ID NO: 109443 - RNA, 24 nt, Human
uugaacccagggggcggagguugc

SEQ ID NO: 109444 - RNA, 23 nt, Human
uugcacuccagccugggcaacaa

SEQ ID NO: 109445 - RNA, 18 nt, Human
uugcggugagccgagauc

SEQ ID NO: 109446 - RNA, 21 nt, Human
uugcggugagccgagaucgug

SEQ ID NO: 109447 - RNA, 22 nt, Human
uugcggugagccgagaucgugc

SEQ ID NO: 109448 - RNA, 18 nt, Human
uugcuugaacccaggggg

SEQ ID NO: 109449 - RNA, 24 nt, Human
uugcuugaacccagggggcggagg

SEQ ID NO: 109450 - RNA, 21 nt, Human
uuggccaagcucucuaaacau

SEQ ID NO: 109451 - RNA, 19 nt, Human
uugggagcucuuuucuuuc

SEQ ID NO: 109452 - RNA, 25 nt, Human
uugggaggccgaggcaggcagauca

SEQ ID NO: 109453 - RNA, 23 nt, Human
uugggaggcugaggcaggagaau

SEQ ID NO: 109454 - RNA, 23 nt, Human
uugugccacugcacuccagccug

SEQ ID NO: 109455 - RNA, 23 nt, Human
agacagguacaaaacucgaacuu

SEQ ID NO: 109456 - RNA, 22 nt, Human
agcagcuuugugucaugucuug

SEQ ID NO: 109457 - RNA, 19 nt, Human
gauuuucugcuagcagcuu

SEQ ID NO: 109458 - RNA, 24 nt, Human
gcguuuugauuuucugcuagcagc

SEQ ID NO: 109459 - RNA, 18 nt, Human
uuugaaguggcuuuuaug

SEQ ID NO: 109460 - RNA, 18 nt, Human
uuuuuuuuuuuuuuuuug

SEQ ID NO: 109461 - RNA, 22 nt, Human
uuuuuuuuuuuuuuuuugccaa

SEQ ID NO: 109462 - RNA, 23 nt, Human
uuuuuuuuuuuuuuuuugccaau

SEQ ID NO: 109463 - RNA, 21 nt, Human
aaaaauacucaacaaauacag

SEQ ID NO: 109464 - RNA, 21 nt, Human
aaacuccagugguauacaguu

SEQ ID NO: 109465 - RNA, 21 nt, Human
aaagaagcucaguuucccaaa

SEQ ID NO: 109466 - RNA, 23 nt, Human
aaauccuccacaaaaugcuucuc

SEQ ID NO: 109467 - RNA, 21 nt, Human
aacacagucagagaacuugua

SEQ ID NO: 109468 - RNA, 18 nt, Human
aagcaacguucuuccuuc

SEQ ID NO: 109469 - RNA, 21 nt, Human
aaucauuggccagacgaccug

SEQ ID NO: 109470 - RNA, 19 nt, Human
aaucuugggggaaauuaaa

SEQ ID NO: 109471 - RNA, 21 nt, Human
aauuaagaccaagaaagggua

SEQ ID NO: 109472 - RNA, 18 nt, Human
accaagcagaguauauag

SEQ ID NO: 109473 - RNA, 22 nt, Human
accccaucucaaacacaaauua

SEQ ID NO: 109474 - RNA, 21 nt, Human
acuccccacucccaccccagg

SEQ ID NO: 109475 - RNA, 23 nt, Human
agaaagaagcucaguuucccaaa

SEQ ID NO: 109476 - RNA, 21 nt, Human
agccaauguuucccugagcag

SEQ ID NO: 109477 - RNA, 22 nt, Human
agcugaucuaggguggcucugc

SEQ ID NO: 109478 - RNA, 18 nt, Human
aucaguuagauuuugcua

SEQ ID NO: 109479 - RNA, 18 nt, Human
caaaacacaaaaggcauc

SEQ ID NO: 109480 - RNA, 20 nt, Human
caaacccugucaacagacua

SEQ ID NO: 109481 - RNA, 19 nt, Human
caaugugaugccaaucagu

SEQ ID NO: 109482 - RNA, 20 nt, Human
cagcacuaggagcccucccc

SEQ ID NO: 109483 - RNA, 21 nt, Human
caggcaggggccccgucuccu

SEQ ID NO: 109484 - RNA, 18 nt, Human
caggggccucuuucuccu

SEQ ID NO: 109485 - RNA, 22 nt, Human
ccaagcucagcacuaggagccc

SEQ ID NO: 109486 - RNA, 20 nt, Human
ccaauuuccaccccaucuca

SEQ ID NO: 109487 - RNA, 18 nt, Human
ccagugcagaagaaagaa

SEQ ID NO: 109488 - RNA, 18 nt, Human
cccacauauucccuaucu

SEQ ID NO: 109489 - RNA, 19 nt, Human
cccacucccaccccaggcc

SEQ ID NO: 109490 - RNA, 19 nt, Human
cccagaccucucuccauuc

SEQ ID NO: 109491 - RNA, 19 nt, Human
ccccaagaaauaccucuuc

SEQ ID NO: 109492 - RNA, 23 nt, Human
ccccaagacuugucuuccucuuu

SEQ ID NO: 109493 - RNA, 22 nt, Human
cccucuuccaccaugguaaucc

SEQ ID NO: 109494 - RNA, 18 nt, Human
ccgugcccccagccaaug

SEQ ID NO: 109495 - RNA, 19 nt, Human
ccuccacaaaaugcuucuc

SEQ ID NO: 109496 - RNA, 21 nt, Human
ccugucucaggugauuuccau

SEQ ID NO: 109497 - RNA, 21 nt, Human
ccuucucuuuuccuacucuuc

SEQ ID NO: 109498 - RNA, 19 nt, Human
ccuuggggucaguaggcug

SEQ ID NO: 109499 - RNA, 23 nt, Human
cgguagcacuuauccuuucccaa

SEQ ID NO: 109500 - RNA, 19 nt, Human
cuaagcuugcaaggaucca

SEQ ID NO: 109501 - RNA, 22 nt, Human
cuacuaauauaauuccaauuuc

SEQ ID NO: 109502 - RNA, 22 nt, Human
cuaugugcuuauuccgugcccc

SEQ ID NO: 109503 - RNA, 20 nt, Human
cucagcacuaggagcccucc

SEQ ID NO: 109504 - RNA, 23 nt, Human
cucccaaugaugaacuuaaacca

SEQ ID NO: 109505 - RNA, 20 nt, Human
cugagcagcccuucucuuuu

SEQ ID NO: 109506 - RNA, 21 nt, Human
cugagcagcccuucucuuuuc

SEQ ID NO: 109507 - RNA, 19 nt, Human
cuucaaaggggucuccaag

SEQ ID NO: 109508 - RNA, 18 nt, Human
cuuuuagaaccugcacag

SEQ ID NO: 109509 - RNA, 23 nt, Human
cuuuuuuuuuuuaaaagcaugcc

SEQ ID NO: 109510 - RNA, 19 nt, Human
gaacagagacgaagucaca

SEQ ID NO: 109511 - RNA, 19 nt, Human
gaagggaugaauauauugu

SEQ ID NO: 109512 - RNA, 21 nt, Human
gaucacauuuaucuaagcuug

SEQ ID NO: 109513 - RNA, 20 nt, Human
gaugaacuuaaaccaaaucc

SEQ ID NO: 109514 - RNA, 18 nt, Human
gcaucucuuuucucucuc

SEQ ID NO: 109515 - RNA, 21 nt, Human
gccauugggcuccuuuuagaa

SEQ ID NO: 109516 - RNA, 19 nt, Human
gguggccuaaugcuuggug

SEQ ID NO: 109517 - RNA, 24 nt, Human
gguuggauggggguuggcugaccu

SEQ ID NO: 109518 - RNA, 22 nt, Human
guaugugcuguacuuuggugac

SEQ ID NO: 109519 - RNA, 19 nt, Human
gugcuuagaguuucagcug

SEQ ID NO: 109520 - RNA, 23 nt, Human
uaaaacaaacccugucaacagac

SEQ ID NO: 109521 - RNA, 27 nt, Human
uaaaauaaaacaaacccugucaacaga

SEQ ID NO: 109522 - RNA, 25 nt, Human
uaaacaaugcugcuguccgugcugc

SEQ ID NO: 109523 - RNA, 21 nt, Human
uaaccagaaaacuccaguggu

SEQ ID NO: 109524 - RNA, 19 nt, Human
uaaggaaauuaagaccaag

SEQ ID NO: 109525 - RNA, 21 nt, Human
uaaguaaaagaaucauuggcc

SEQ ID NO: 109526 - RNA, 22 nt, Human
uacucaaaaccuucagagcaaa

SEQ ID NO: 109527 - RNA, 22 nt, Human
uaggagcccuccccaaggccaa

SEQ ID NO: 109528 - RNA, 22 nt, Human
uaguucagacugaggagagccu

SEQ ID NO: 109529 - RNA, 20 nt, Human
uauacagugauaaguuuuua

SEQ ID NO: 109530 - RNA, 19 nt, Human
uauccaaaauuuuaaaaau

SEQ ID NO: 109531 - RNA, 26 nt, Human
uaucuacuccccacucccaccccagg

SEQ ID NO: 109532 - RNA, 19 nt, Human
ucagagcaaaggaagccug

SEQ ID NO: 109533 - RNA, 21 nt, Human
ucagcacuaggagcccucccc

SEQ ID NO: 109534 - RNA, 22 nt, Human
ucagcacuaggagcccucccca

SEQ ID NO: 109535 - RNA, 21 nt, Human
ucagccuuucuucccuucuca

SEQ ID NO: 109536 - RNA, 24 nt, Human
ucaguaaggaaauuaagaccaaga

SEQ ID NO: 109537 - RNA, 23 nt, Human
uccaagaagguuccuauccugcc

SEQ ID NO: 109538 - RNA, 18 nt, Human
uccaccccaucucaaacc

SEQ ID NO: 109539 - RNA, 19 nt, Human
uccauuugacccugauguu

SEQ ID NO: 109540 - RNA, 25 nt, Human
ucccaaugaugaacuuaagguaccc

SEQ ID NO: 109541 - RNA, 22 nt, Human
uccccacucccaccccaggccc

SEQ ID NO: 109542 - RNA, 21 nt, Human
uccugcccagaccucucucca

SEQ ID NO: 109543 - RNA, 18 nt, Human
uccuuggggucaguaggc

SEQ ID NO: 109544 - RNA, 21 nt, Human
ucucugccuugguagcauccc

SEQ ID NO: 109545 - RNA, 26 nt, Human
ucugaggcuaaaauaaaacaaacccu

SEQ ID NO: 109546 - RNA, 21 nt, Human
ucuguugucugaguucugggg

SEQ ID NO: 109547 - RNA, 23 nt, Human
ucuuucucccuggaaggcuaggc

SEQ ID NO: 109548 - RNA, 19 nt, Human
ugacauguacagucauuac

SEQ ID NO: 109549 - RNA, 20 nt, Human
ugagcagcccuucucuuuuc

SEQ ID NO: 109550 - RNA, 21 nt, Human
ugagcagcccuucucuuuucc

SEQ ID NO: 109551 - RNA, 21 nt, Human
ugaguucuggggcuugccuuu

SEQ ID NO: 109552 - RNA, 20 nt, Human
ugcaaggauccaggaacucu

SEQ ID NO: 109553 - RNA, 19 nt, Human
ugccauugagauacauaga

SEQ ID NO: 109554 - RNA, 18 nt, Human
ugcugcuguccgugcugc

SEQ ID NO: 109555 - RNA, 24 nt, Human
ugcuuagaguuucagcugaucuag

SEQ ID NO: 109556 - RNA, 23 nt, Human
ugcuugguguggcaggcaggggc

SEQ ID NO: 109557 - RNA, 22 nt, Human
uggcuagcauccagucccccag

SEQ ID NO: 109558 - RNA, 20 nt, Human
ugguauacucugaggcuaaa

SEQ ID NO: 109559 - RNA, 27 nt, Human
ugguggccuaaugcuugguguggcagg

SEQ ID NO: 109560 - RNA, 19 nt, Human
ugugaaugggguucccuug

SEQ ID NO: 109561 - RNA, 23 nt, Human
uguggaguuaggaggggcaugug

SEQ ID NO: 109562 - RNA, 18 nt, Human
uguggccaaaugaacucc

SEQ ID NO: 109563 - RNA, 22 nt, Human
uguuuuaacaagaucauccugg

SEQ ID NO: 109564 - RNA, 20 nt, Human
uuauacauggucuuccuuau

SEQ ID NO: 109565 - RNA, 21 nt, Human
uucaguggcuugcuaaauuuu

SEQ ID NO: 109566 - RNA, 20 nt, Human
uucccugagcagcccuucuc

SEQ ID NO: 109567 - RNA, 20 nt, Human
uucccuucaagcaaguucug

SEQ ID NO: 109568 - RNA, 21 nt, Human
uugugcuuagaguuucagcug

SEQ ID NO: 109569 - RNA, 22 nt, Human
uuuccugucucaggugauuucc

SEQ ID NO: 109570 - RNA, 20 nt, Human
uuugacccugauguucccuu

SEQ ID NO: 109571 - RNA, 19 nt, Human
aaaaacuaaaaaccgcagu

SEQ ID NO: 109572 - RNA, 20 nt, Human
aaaaacuaaaaaccgcaguu

SEQ ID NO: 109573 - RNA, 21 nt, Human
aaacaggaaccaaacauggug

SEQ ID NO: 109574 - RNA, 22 nt, Human
aaaucuguuucagaucuuucuu

SEQ ID NO: 109575 - RNA, 23 nt, Human
aaccacaauaaaaacuaaaaacc

SEQ ID NO: 109576 - RNA, 19 nt, Human
accgcaguucacagaagcc

SEQ ID NO: 109577 - RNA, 23 nt, Human
aggcucuggcacaugaaaaaaug

SEQ ID NO: 109578 - RNA, 22 nt, Human
auggugguaaauuaccuccuuc

SEQ ID NO: 109579 - RNA, 25 nt, Human
cacuuuaugaaaaagugaaucaguc

SEQ ID NO: 109580 - RNA, 25 nt, Human
cagaccaccuaaauucuauggaccu

SEQ ID NO: 109581 - RNA, 19 nt, Human
cagaggcaccagauaggca

SEQ ID NO: 109582 - RNA, 20 nt, Human
cagauaggcacauauccuca

SEQ ID NO: 109583 - RNA, 23 nt, Human
caucuuauaaacaggaaccaaac

SEQ ID NO: 109584 - RNA, 20 nt, Human
cauggugguaaauuaccucc

SEQ ID NO: 109585 - RNA, 25 nt, Human
ccacaauaaaaacuaaaaaccgcag

SEQ ID NO: 109586 - RNA, 22 nt, Human
ccuccuuccuuucacucaacua

SEQ ID NO: 109587 - RNA, 21 nt, Human
cuaaaaaccgcaguucacaga

SEQ ID NO: 109588 - RNA, 21 nt, Human
gaaaaaaugcucaauaaaugc

SEQ ID NO: 109589 - RNA, 19 nt, Human
gggccuccaguacaggcuc

SEQ ID NO: 109590 - RNA, 21 nt, Human
gguaaauaauucuuuagcaac

SEQ ID NO: 109591 - RNA, 26 nt, Human
uaaaugcucacuuuaugaaaaaguga

SEQ ID NO: 109592 - RNA, 22 nt, Human
uaagaaccacaauaaaaacuaa

SEQ ID NO: 109593 - RNA, 24 nt, Human
uaagagagacucauguucucucca

SEQ ID NO: 109594 - RNA, 24 nt, Human
ucaauguacagaccaauucucuca

SEQ ID NO: 109595 - RNA, 20 nt, Human
ucucucauaaguagaauagu

SEQ ID NO: 109596 - RNA, 20 nt, Human
ugaaucagucaauguacaga

SEQ ID NO: 109597 - RNA, 21 nt, Human
ugacagaccaccuaaauucua

SEQ ID NO: 109598 - RNA, 20 nt, Human
ugacagauaccaauccaacc

SEQ ID NO: 109599 - RNA, 19 nt, Human
ugggggccuccaguacagg

SEQ ID NO: 109600 - RNA, 24 nt, Human
uuaaaacaucuuauaaacaggaac

SEQ ID NO: 109601 - RNA, 27 nt, Human
uuaaaacaucuuauaaacaggaaccaa

SEQ ID NO: 109602 - RNA, 21 nt, Human
cccguccucacucgccuugac

SEQ ID NO: 109603 - RNA, 24 nt, Human
cuccccguccucacucgccuugac

SEQ ID NO: 109604 - RNA, 18 nt, Human
gcagugacccacgcucuc

SEQ ID NO: 109605 - RNA, 18 nt, Human
gugacccacgcucucccc

SEQ ID NO: 109606 - RNA, 20 nt, Human
uggcaggaggggcagugacc

SEQ ID NO: 109607 - RNA, 21 nt, Human
uuuuuuuuuuuuuuuucccga

SEQ ID NO: 109608 - RNA, 23 nt, Human
uuuuuuuuuuuuuuuuuuucccg

SEQ ID NO: 109609 - RNA, 23 nt, Human
uuuuuuuuuuuuuuuuuuuuccc

SEQ ID NO: 109610 - RNA, 24 nt, Human
uuuuuuuuuuuuuuuuuuuuuccu

SEQ ID NO: 109611 - RNA, 24 nt, Human
aaauaaacauggcaauauaaaaau

SEQ ID NO: 109612 - RNA, 23 nt, Human
aaauguuaagaauuuacaaagcu

SEQ ID NO: 109613 - RNA, 21 nt, Human
agcuauguacuuaaugaacca

SEQ ID NO: 109614 - RNA, 24 nt, Human
aucacuuuacaauuacugaaaaag

SEQ ID NO: 109615 - RNA, 19 nt, Human
augaaccaaauuacccaaa

SEQ ID NO: 109616 - RNA, 24 nt, Human
uaaugaaccaaauuacccaaacaa

SEQ ID NO: 109617 - RNA, 18 nt, Human
uacagucuguaagaucuc

SEQ ID NO: 109618 - RNA, 24 nt, Human
ugaaccaaauuacccaaacaaaau

SEQ ID NO: 109619 - RNA, 24 nt, Human
uguaagaucucuucgagagagcug

SEQ ID NO: 109620 - RNA, 21 nt, Human
uguuaagaauuuacaaagcug

SEQ ID NO: 109621 - RNA, 18 nt, Human
aaaaagcaccaguguccu

SEQ ID NO: 109622 - RNA, 18 nt, Human
aaaaagcaccaguguccu

SEQ ID NO: 109623 - RNA, 21 nt, Human
aaagaugcaggggggcccagg

SEQ ID NO: 109624 - RNA, 21 nt, Human
aaagaugcaggggggcccagg

SEQ ID NO: 109625 - RNA, 20 nt, Human
aaggcugugaccagcccaac

SEQ ID NO: 109626 - RNA, 23 nt, Human
acaaagacuguacaaaauuccuu

SEQ ID NO: 109627 - RNA, 23 nt, Human
acaaagacuguacaaaauuccuu

SEQ ID NO: 109628 - RNA, 22 nt, Human
acagaauauuuucaggcuugag

SEQ ID NO: 109629 - RNA, 22 nt, Human
acaucacaaggcugugaccagc

SEQ ID NO: 109630 - RNA, 24 nt, Human
accccugcgauggucaacacauug

SEQ ID NO: 109631 - RNA, 19 nt, Human
acgaaaugcugcuccaccc

SEQ ID NO: 109632 - RNA, 24 nt, Human
acuccacacaucacaaggcuguga

SEQ ID NO: 109633 - RNA, 21 nt, Human
acugccaaagucuaccacccg

SEQ ID NO: 109634 - RNA, 21 nt, Human
agcccgaaggcgggcgaagaa

SEQ ID NO: 109635 - RNA, 19 nt, Human
agcugcuuccuuguacuuc

SEQ ID NO: 109636 - RNA, 18 nt, Human
aggaaaucgaaggugcua

SEQ ID NO: 109637 - RNA, 18 nt, Human
aggaaggagugaacucug

SEQ ID NO: 109638 - RNA, 18 nt, Human
aggaaggagugaacucug

SEQ ID NO: 109639 - RNA, 25 nt, Human
aggaggaaggagugaacucuggccg

SEQ ID NO: 109640 - RNA, 25 nt, Human
aggaggaaggagugaacucuggccg

SEQ ID NO: 109641 - RNA, 22 nt, Human
aggcccagaagcucaaaggaga

SEQ ID NO: 109642 - RNA, 22 nt, Human
aggcugugaccagcccaacuca

SEQ ID NO: 109643 - RNA, 26 nt, Human
agggauaggacccaagauccuuucca

SEQ ID NO: 109644 - RNA, 21 nt, Human
aggugcuaaggcccagaagcu

SEQ ID NO: 109645 - RNA, 23 nt, Human
augcagccuauacuccacacauc

SEQ ID NO: 109646 - RNA, 21 nt, Human
augcugcuccacccccccaac

SEQ ID NO: 109647 - RNA, 23 nt, Human
augcugcuccacccccccaaccc

SEQ ID NO: 109648 - RNA, 20 nt, Human
auuuucaggcuugaggucug

SEQ ID NO: 109649 - RNA, 18 nt, Human
cacaaggcugugaccagc

SEQ ID NO: 109650 - RNA, 21 nt, Human
cacauaguauucaaagaugau

SEQ ID NO: 109651 - RNA, 21 nt, Human
cacccccccaacccgggaccc

SEQ ID NO: 109652 - RNA, 19 nt, Human
cacguugaucucaagucga

SEQ ID NO: 109653 - RNA, 23 nt, Human
cacugcuauaaaagaugcagggg

SEQ ID NO: 109654 - RNA, 23 nt, Human
cacugcuauaaaagaugcagggg

SEQ ID NO: 109655 - RNA, 20 nt, Human
cacuugguggaugggguagg

SEQ ID NO: 109656 - RNA, 19 nt, Human
cagcccaacucaaggauga

SEQ ID NO: 109657 - RNA, 22 nt, Human
cagggcaacucgagccccaccc

SEQ ID NO: 109658 - RNA, 21 nt, Human
caggugaggguggaaacugug

SEQ ID NO: 109659 - RNA, 21 nt, Human
caggugaggguggaaacugug

SEQ ID NO: 109660 - RNA, 19 nt, Human
caucacaaggcugugacca

SEQ ID NO: 109661 - RNA, 21 nt, Human
caucccaauccaggcgacccc

SEQ ID NO: 109662 - RNA, 18 nt, Human
cauuguacaacucggccg

SEQ ID NO: 109663 - RNA, 22 nt, Human
ccacccccccaacccgggaccc

SEQ ID NO: 109664 - RNA, 19 nt, Human
ccccccaacccgggacccu

SEQ ID NO: 109665 - RNA, 25 nt, Human
cccccgcggcgacgaaaugcugcuc

SEQ ID NO: 109666 - RNA, 19 nt, Human
cccgugcgcuugucccaca

SEQ ID NO: 109667 - RNA, 20 nt, Human
cccgugcgcuugucccacag

SEQ ID NO: 109668 - RNA, 18 nt, Human
cgaaaugcugcuccaccc

SEQ ID NO: 109669 - RNA, 19 nt, Human
cgaaaugcugcuccacccc

SEQ ID NO: 109670 - RNA, 22 nt, Human
cgaaaugcugcuccaccccccc

SEQ ID NO: 109671 - RNA, 19 nt, Human
cgaagaaaggaugcugaag

SEQ ID NO: 109672 - RNA, 19 nt, Human
cgaaggugcuaaggcccag

SEQ ID NO: 109673 - RNA, 20 nt, Human
cgacuggagucccacaacuu

SEQ ID NO: 109674 - RNA, 20 nt, Human
cgcucaucucgcuucuucuc

SEQ ID NO: 109675 - RNA, 18 nt, Human
cggcccccauccaacucc

SEQ ID NO: 109676 - RNA, 18 nt, Human
cggcccccauccaacucc

SEQ ID NO: 109677 - RNA, 23 nt, Human
cuagaugcucucuguugucaugg

SEQ ID NO: 109678 - RNA, 19 nt, Human
cucaagucgagcugcuucc

SEQ ID NO: 109679 - RNA, 22 nt, Human
cucuucacacugcgcucaucuc

SEQ ID NO: 109680 - RNA, 20 nt, Human
cugauaucccgacuggaguc

SEQ ID NO: 109681 - RNA, 22 nt, Human
cugcggccggagucccggcacc

SEQ ID NO: 109682 - RNA, 18 nt, Human
cugcuccacccccccaac

SEQ ID NO: 109683 - RNA, 23 nt, Human
cuucacacugcgcucaucucgcu

SEQ ID NO: 109684 - RNA, 19 nt, Human
gaaaugcugcuccaccccc

SEQ ID NO: 109685 - RNA, 20 nt, Human
gagccccaccccugcgaugg

SEQ ID NO: 109686 - RNA, 23 nt, Human
gcacugccaaagucuaccacccg

SEQ ID NO: 109687 - RNA, 22 nt, Human
gcaggugaggguggaaacugug

SEQ ID NO: 109688 - RNA, 22 nt, Human
gcaggugaggguggaaacugug

SEQ ID NO: 109689 - RNA, 19 nt, Human
gcgcucaucucgcuucuuc

SEQ ID NO: 109690 - RNA, 19 nt, Human
gcggcgacgaaaugcugcu

SEQ ID NO: 109691 - RNA, 23 nt, Human
gcuggugguguuccucugccucu

SEQ ID NO: 109692 - RNA, 24 nt, Human
gcuggugguguuccucugccucug

SEQ ID NO: 109693 - RNA, 22 nt, Human
ggauaggacccaagauccuuuc

SEQ ID NO: 109694 - RNA, 21 nt, Human
ggcaacucgagccccaccccu

SEQ ID NO: 109695 - RNA, 22 nt, Human
ggccaugguagucaaaccaguc

SEQ ID NO: 109696 - RNA, 23 nt, Human
gucaaagguggcacugccaaagu

SEQ ID NO: 109697 - RNA, 18 nt, Human
gugcuauggugcucaugg

SEQ ID NO: 109698 - RNA, 21 nt, Human
uaaaaaagcaccaguguccug

SEQ ID NO: 109699 - RNA, 21 nt, Human
uaaaaaagcaccaguguccug

SEQ ID NO: 109700 - RNA, 23 nt, Human
uacaacucggccgaagguccccu

SEQ ID NO: 109701 - RNA, 24 nt, Human
uaccucacucggcccccauccaac

SEQ ID NO: 109702 - RNA, 24 nt, Human
uaccucacucggcccccauccaac

SEQ ID NO: 109703 - RNA, 27 nt, Human
uaccucacucggcccccauccaacucc

SEQ ID NO: 109704 - RNA, 27 nt, Human
uaccucacucggcccccauccaacucc

SEQ ID NO: 109705 - RNA, 22 nt, Human
uaggacccaagauccuuuccau

SEQ ID NO: 109706 - RNA, 25 nt, Human
ucagggucuuucucauugauuuucu

SEQ ID NO: 109707 - RNA, 22 nt, Human
uccacccccccaacccgggacc

SEQ ID NO: 109708 - RNA, 20 nt, Human
uccguaugagggggcaggug

SEQ ID NO: 109709 - RNA, 20 nt, Human
uccguaugagggggcaggug

SEQ ID NO: 109710 - RNA, 19 nt, Human
ucuaccacccgcacagcug

SEQ ID NO: 109711 - RNA, 21 nt, Human
ucuuugaggaaaucgaagguc

SEQ ID NO: 109712 - RNA, 22 nt, Human
ugaagugauagguacaaguucu

SEQ ID NO: 109713 - RNA, 22 nt, Human
ugaagugauagguacaaguucu

SEQ ID NO: 109714 - RNA, 21 nt, Human
ugaggguggaaacugugugga

SEQ ID NO: 109715 - RNA, 21 nt, Human
ugaggguggaaacugugugga

SEQ ID NO: 109716 - RNA, 27 nt, Human
ugaggucagauaccgccgcagcgguuu

SEQ ID NO: 109717 - RNA, 20 nt, Human
ugcaggggggcccagggccu

SEQ ID NO: 109718 - RNA, 20 nt, Human
ugcaggggggcccagggccu

SEQ ID NO: 109719 - RNA, 21 nt, Human
ugcggccggagucccggcacc

SEQ ID NO: 109720 - RNA, 19 nt, Human
ugcuauggugcucaugguc

SEQ ID NO: 109721 - RNA, 20 nt, Human
ugcuccacccccccaacccc

SEQ ID NO: 109722 - RNA, 20 nt, Human
uggaagagggugaaucccac

SEQ ID NO: 109723 - RNA, 27 nt, Human
uggaagagggugaaucccacauaguag

SEQ ID NO: 109724 - RNA, 24 nt, Human
uggaauaguauuauguacaaggca

SEQ ID NO: 109725 - RNA, 24 nt, Human
uggaauaguauuauguacaaggca

SEQ ID NO: 109726 - RNA, 20 nt, Human
uggagacaauggugcuaugg

SEQ ID NO: 109727 - RNA, 20 nt, Human
uggugcucauggucaaaggu

SEQ ID NO: 109728 - RNA, 28 nt, Human
uguacaaaauuccuuauaaaacaugggg

SEQ ID NO: 109729 - RNA, 28 nt, Human
uguacaaaauuccuuauaaaacaugggg

SEQ ID NO: 109730 - RNA, 19 nt, Human
ugucaugggucuggaagag

SEQ ID NO: 109731 - RNA, 21 nt, Human
uguugucuuugaggaaaucga

SEQ ID NO: 109732 - RNA, 25 nt, Human
uuccuuguacuucuccacauucuua

SEQ ID NO: 109733 - RNA, 23 nt, Human
uuucggaucauccgggaagggau

SEQ ID NO: 109734 - RNA, 22 nt, Human
aaagcauagcaucauuuaccaa

SEQ ID NO: 109735 - RNA, 19 nt, Human
aacagggcagaauaaggga

SEQ ID NO: 109736 - RNA, 25 nt, Human
aacuggccauuucaauacuaugugg

SEQ ID NO: 109737 - RNA, 19 nt, Human
aagaacaaauagcaaggaa

SEQ ID NO: 109738 - RNA, 19 nt, Human
aagaagaaacgagauggaa

SEQ ID NO: 109739 - RNA, 21 nt, Human
aaggcaggaguagggagaccu

SEQ ID NO: 109740 - RNA, 19 nt, Human
aagguaguagcagugggga

SEQ ID NO: 109741 - RNA, 23 nt, Human
aaguaaacuggccauuucaauac

SEQ ID NO: 109742 - RNA, 20 nt, Human
acaaugcuagagguaggcac

SEQ ID NO: 109743 - RNA, 21 nt, Human
acagagucuguauacaacccu

SEQ ID NO: 109744 - RNA, 25 nt, Human
agaaauugaugagagaggaagacaa

SEQ ID NO: 109745 - RNA, 23 nt, Human
agaacaaauagcaaggaagguuu

SEQ ID NO: 109746 - RNA, 21 nt, Human
agaagagcaaaaaucuacaaa

SEQ ID NO: 109747 - RNA, 19 nt, Human
agaaggugacuucugaacu

SEQ ID NO: 109748 - RNA, 18 nt, Human
agaccuggaagcuaagua

SEQ ID NO: 109749 - RNA, 18 nt, Human
agagaaguuaagaccugg

SEQ ID NO: 109750 - RNA, 18 nt, Human
agaguagucagagaaguu

SEQ ID NO: 109751 - RNA, 20 nt, Human
agaguuccuugggguuuggg

SEQ ID NO: 109752 - RNA, 26 nt, Human
agaguuccuugggguuuggggaggga

SEQ ID NO: 109753 - RNA, 18 nt, Human
aggaaucuaaggcaggag

SEQ ID NO: 109754 - RNA, 23 nt, Human
aggaaucuaaggcaggaguaggg

SEQ ID NO: 109755 - RNA, 19 nt, Human
aggaguagggagaccugag

SEQ ID NO: 109756 - RNA, 21 nt, Human
aggcaggaguagggagaccug

SEQ ID NO: 109757 - RNA, 21 nt, Human
agggagaggcauucaaaaaau

SEQ ID NO: 109758 - RNA, 21 nt, Human
aggguaggaaagaguaaacgg

SEQ ID NO: 109759 - RNA, 19 nt, Human
aggguuuucauccaagugg

SEQ ID NO: 109760 - RNA, 20 nt, Human
aggguuuucauccaaguggc

SEQ ID NO: 109761 - RNA, 26 nt, Human
agguaguagcaguggggauauaagug

SEQ ID NO: 109762 - RNA, 19 nt, Human
aguuacagcaucuuauuga

SEQ ID NO: 109763 - RNA, 21 nt, Human
auaaagcaaagauugagaagu

SEQ ID NO: 109764 - RNA, 23 nt, Human
augaagaagcagaaauugaugag

SEQ ID NO: 109765 - RNA, 20 nt, Human
caaaacauucacgaaagaag

SEQ ID NO: 109766 - RNA, 21 nt, Human
caacggucuuggaaaggaagg

SEQ ID NO: 109767 - RNA, 20 nt, Human
caacuccugagcuaggaccu

SEQ ID NO: 109768 - RNA, 22 nt, Human
cacgaaagaaggugacuucuga

SEQ ID NO: 109769 - RNA, 18 nt, Human
cagggcaggggacaagcc

SEQ ID NO: 109770 - RNA, 22 nt, Human
caucauuuaccaagaagaaacg

SEQ ID NO: 109771 - RNA, 20 nt, Human
ccaacuccugagcuaggacc

SEQ ID NO: 109772 - RNA, 21 nt, Human
ccaacuccugagcuaggaccu

SEQ ID NO: 109773 - RNA, 18 nt, Human
ccauaaagcaaagauuga

SEQ ID NO: 109774 - RNA, 19 nt, Human
cccuaaacuaagguaguag

SEQ ID NO: 109775 - RNA, 19 nt, Human
cccuuuggaaaagccugau

SEQ ID NO: 109776 - RNA, 19 nt, Human
ccuaaacuaagguaguagc

SEQ ID NO: 109777 - RNA, 20 nt, Human
ccuaaacuaagguaguagca

SEQ ID NO: 109778 - RNA, 19 nt, Human
ccucuaggcaccaacgguc

SEQ ID NO: 109779 - RNA, 19 nt, Human
ccugagcuaggaccuggga

SEQ ID NO: 109780 - RNA, 21 nt, Human
cgagauggaauuguuuggggu

SEQ ID NO: 109781 - RNA, 21 nt, Human
cuagagguaggcacagggggc

SEQ ID NO: 109782 - RNA, 23 nt, Human
cuccugagcuaggaccugggaac

SEQ ID NO: 109783 - RNA, 21 nt, Human
cuccuugcagugaauugggga

SEQ ID NO: 109784 - RNA, 20 nt, Human
gaacacaaaguuaaauagga

SEQ ID NO: 109785 - RNA, 18 nt, Human
gaagagcaaaaaucuaca

SEQ ID NO: 109786 - RNA, 22 nt, Human
gaaggucagcauuccaugaaga

SEQ ID NO: 109787 - RNA, 22 nt, Human
gacgaggaaacagccucaggga

SEQ ID NO: 109788 - RNA, 18 nt, Human
gaugucaggguaggaaag

SEQ ID NO: 109789 - RNA, 19 nt, Human
gcaagagugagaguuccuu

SEQ ID NO: 109790 - RNA, 24 nt, Human
ggaggaagggcguuaacaucugcc

SEQ ID NO: 109791 - RNA, 24 nt, Human
ggagucaagucaagcucaccgcau

SEQ ID NO: 109792 - RNA, 20 nt, Human
gggagggaggaggaaaaaug

SEQ ID NO: 109793 - RNA, 18 nt, Human
ggguuuggggagggagga

SEQ ID NO: 109794 - RNA, 23 nt, Human
guuggaaaaagcauagcaucauu

SEQ ID NO: 109795 - RNA, 23 nt, Human
uaaggagagggagugggcaacua

SEQ ID NO: 109796 - RNA, 19 nt, Human
uaccaagaagaaacgagau

SEQ ID NO: 109797 - RNA, 22 nt, Human
uacuuccaggugccaagcacug

SEQ ID NO: 109798 - RNA, 20 nt, Human
uaggaaagaguaaacgguga

SEQ ID NO: 109799 - RNA, 18 nt, Human
uaguccucuaggcaccaa

SEQ ID NO: 109800 - RNA, 21 nt, Human
uauagcccuaaacuaagguag

SEQ ID NO: 109801 - RNA, 20 nt, Human
uauuccacuuuauucccugg

SEQ ID NO: 109802 - RNA, 19 nt, Human
ucagccauaccaaaauaaa

SEQ ID NO: 109803 - RNA, 22 nt, Human
ugaacugccagcuucagggcag

SEQ ID NO: 109804 - RNA, 18 nt, Human
ugaagaagcagaaauuga

SEQ ID NO: 109805 - RNA, 21 nt, Human
ugagaagagcaaaaaucuaca

SEQ ID NO: 109806 - RNA, 23 nt, Human
ugagaagagcaaaaaucuacaaa

SEQ ID NO: 109807 - RNA, 28 nt, Human
ugccaagcacuguuaucaacauuauucc

SEQ ID NO: 109808 - RNA, 18 nt, Human
uggaaaggccauaaagca

SEQ ID NO: 109809 - RNA, 18 nt, Human
uggaagaugacuugggga

SEQ ID NO: 109810 - RNA, 18 nt, Human
uggagcaaugaaggucag

SEQ ID NO: 109811 - RNA, 21 nt, Human
uggccugaugggauuugcauu

SEQ ID NO: 109812 - RNA, 21 nt, Human
uggcuugguuggaaaaagcau

SEQ ID NO: 109813 - RNA, 25 nt, Human
ugggaacacaaaguuaaauaggaca

SEQ ID NO: 109814 - RNA, 20 nt, Human
ugggguugggaagguggacg

SEQ ID NO: 109815 - RNA, 21 nt, Human
uuaacagacgaggaaacagcc

SEQ ID NO: 109816 - RNA, 20 nt, Human
uuauugaggaaucuaaggca

SEQ ID NO: 109817 - RNA, 24 nt, Human
uucacacuuaacagacgaggaaac

SEQ ID NO: 109818 - RNA, 19 nt, Human
uucuggaugucaggguagg

SEQ ID NO: 109819 - RNA, 22 nt, Human
uuguggacugauaaagauauau

SEQ ID NO: 109820 - RNA, 22 nt, Human
uuugccaacuccugagcuagga

SEQ ID NO: 109821 - RNA, 21 nt, Human
agcccuucccuacucccagac

SEQ ID NO: 109822 - RNA, 21 nt, Human
cagggucauagaguguccaaa

SEQ ID NO: 109823 - RNA, 21 nt, Human
cagggucauagaguguccaaa

SEQ ID NO: 109824 - RNA, 21 nt, Human
caguucauggagggucucugg

SEQ ID NO: 109825 - RNA, 22 nt, Human
caugaugccaggaagaaacucc

SEQ ID NO: 109826 - RNA, 22 nt, Human
caugaugccaggaagaaacucc

SEQ ID NO: 109827 - RNA, 19 nt, Human
cccagaccugccgggaagg

SEQ ID NO: 109828 - RNA, 21 nt, Human
cccccugcaagggaaacaagg

SEQ ID NO: 109829 - RNA, 19 nt, Human
cccugcaaggaaacaaggc

SEQ ID NO: 109830 - RNA, 19 nt, Human
cggcauuuauucagaaggc

SEQ ID NO: 109831 - RNA, 24 nt, Human
cgggagggaugagggucugcgaca

SEQ ID NO: 109832 - RNA, 24 nt, Human
cgggagggaugagggucugcgaca

SEQ ID NO: 109833 - RNA, 19 nt, Human
gaccugucccucugcccac

SEQ ID NO: 109834 - RNA, 23 nt, Human
gcucccacgggagggaugagggu

SEQ ID NO: 109835 - RNA, 23 nt, Human
gcucccacgggagggaugagggu

SEQ ID NO: 109836 - RNA, 19 nt, Human
ggagacaauggcuggcccc

SEQ ID NO: 109837 - RNA, 19 nt, Human
ggagacaauggcuggcccc

SEQ ID NO: 109838 - RNA, 18 nt, Human
ggcauuuauucagaaggc

SEQ ID NO: 109839 - RNA, 21 nt, Human
ugccaggaagaaacuccccaa

SEQ ID NO: 109840 - RNA, 21 nt, Human
ugccaggaagaaacuccccaa

SEQ ID NO: 109841 - RNA, 19 nt, Human
uggagggucucuggggugg

SEQ ID NO: 109842 - RNA, 19 nt, Human
uggccccccugcaagggaa

SEQ ID NO: 109843 - RNA, 22 nt, Human
ugugaccugcguccugaggauc

SEQ ID NO: 109844 - RNA, 19 nt, Human
uucauggagggucucuggg

SEQ ID NO: 109845 - RNA, 21 nt, Human
aaaaagcaaucagcaggaaca

SEQ ID NO: 109846 - RNA, 24 nt, Human
aaaagccaccaccaaaaccaaaaa

SEQ ID NO: 109847 - RNA, 19 nt, Human
aaacacacacuccuuugcc

SEQ ID NO: 109848 - RNA, 24 nt, Human
aaagaacacaagccaguuacuagc

SEQ ID NO: 109849 - RNA, 20 nt, Human
aaagccaccaccaaaaccaa

SEQ ID NO: 109850 - RNA, 22 nt, Human
aaagccaccaccaaaaccaaaa

SEQ ID NO: 109851 - RNA, 23 nt, Human
aaagccaccaccaaaaccaaaaa

SEQ ID NO: 109852 - RNA, 19 nt, Human
aacaaugaagaagucagaa

SEQ ID NO: 109853 - RNA, 22 nt, Human
aacagaaacaaaaacacuccaa

SEQ ID NO: 109854 - RNA, 24 nt, Human
aacagaaacaaaaacacuccaaua

SEQ ID NO: 109855 - RNA, 20 nt, Human
aaccaagaucaccuaacucg

SEQ ID NO: 109856 - RNA, 19 nt, Human
aacugaaucacauaauugg

SEQ ID NO: 109857 - RNA, 20 nt, Human
aacuggcuucuucaaagacc

SEQ ID NO: 109858 - RNA, 22 nt, Human
aacuggcuucuucaaagaccug

SEQ ID NO: 109859 - RNA, 19 nt, Human
aagcaaucagcaggaacag

SEQ ID NO: 109860 - RNA, 19 nt, Human
aagccaccaccaaaaccaa

SEQ ID NO: 109861 - RNA, 21 nt, Human
aaguuagucuaaacuaaagca

SEQ ID NO: 109862 - RNA, 22 nt, Human
aauguaaucagacuauacuaaa

SEQ ID NO: 109863 - RNA, 19 nt, Human
aauucagucagcagaaccg

SEQ ID NO: 109864 - RNA, 23 nt, Human
acacuggauuugccacaucuaga

SEQ ID NO: 109865 - RNA, 23 nt, Human
acagcuguaaaaaaaaaaaaaaa

SEQ ID NO: 109866 - RNA, 19 nt, Human
acccugccccaaacacaca

SEQ ID NO: 109867 - RNA, 19 nt, Human
accuugaaagcuugucugg

SEQ ID NO: 109868 - RNA, 19 nt, Human
acuggucugaggaccacac

SEQ ID NO: 109869 - RNA, 19 nt, Human
agaaccgggguucaagacc

SEQ ID NO: 109870 - RNA, 19 nt, Human
agaagaaccgcugaagcac

SEQ ID NO: 109871 - RNA, 20 nt, Human
agaagugcaaccucuuccac

SEQ ID NO: 109872 - RNA, 19 nt, Human
agcugagggugcagggcug

SEQ ID NO: 109873 - RNA, 23 nt, Human
aggauauguagcuugugggggug

SEQ ID NO: 109874 - RNA, 24 nt, Human
aggcacaaauacugacuuaagucu

SEQ ID NO: 109875 - RNA, 22 nt, Human
agggugcagggcugggggugca

SEQ ID NO: 109876 - RNA, 19 nt, Human
aggugacuacaaaacccug

SEQ ID NO: 109877 - RNA, 22 nt, Human
aucaccuucucuucuuugacuc

SEQ ID NO: 109878 - RNA, 23 nt, Human
aucuguacuuauuuccucacaga

SEQ ID NO: 109879 - RNA, 23 nt, Human
caaaaccaaaaaucugucaccgg

SEQ ID NO: 109880 - RNA, 22 nt, Human
caaaagccaccaccaaaaccaa

SEQ ID NO: 109881 - RNA, 24 nt, Human
caaaagccaccaccaaaaccaaaa

SEQ ID NO: 109882 - RNA, 22 nt, Human
caaaauuaccaaggcuaaacug

SEQ ID NO: 109883 - RNA, 21 nt, Human
caacagaaacaaaaacacucc

SEQ ID NO: 109884 - RNA, 22 nt, Human
caacagaaacaaaaacacucca

SEQ ID NO: 109885 - RNA, 23 nt, Human
caacagaaacaaaaacacuccaa

SEQ ID NO: 109886 - RNA, 20 nt, Human
caaccucuuccacugcgcug

SEQ ID NO: 109887 - RNA, 20 nt, Human
cacaccauaucuaucuguag

SEQ ID NO: 109888 - RNA, 18 nt, Human
cacagaccaguaacaucu

SEQ ID NO: 109889 - RNA, 18 nt, Human
caccuccccgcgcccggc

SEQ ID NO: 109890 - RNA, 24 nt, Human
cacuccuuugcccacuugcugcuc

SEQ ID NO: 109891 - RNA, 21 nt, Human
cacuggaaagaaguuucugca

SEQ ID NO: 109892 - RNA, 24 nt, Human
cacuugcugcuccagguuuggggg

SEQ ID NO: 109893 - RNA, 22 nt, Human
caggaaacaaugaagaagucag

SEQ ID NO: 109894 - RNA, 21 nt, Human
caguaucuguacuuauuuccu

SEQ ID NO: 109895 - RNA, 21 nt, Human
cauaacagugguuaacacuga

SEQ ID NO: 109896 - RNA, 21 nt, Human
caucuagaagcacaaucacuc

SEQ ID NO: 109897 - RNA, 18 nt, Human
ccaaaaccaaaaaucugu

SEQ ID NO: 109898 - RNA, 21 nt, Human
ccaaacacacacuccuuugcc

SEQ ID NO: 109899 - RNA, 21 nt, Human
ccaaagguccuacauaacuga

SEQ ID NO: 109900 - RNA, 25 nt, Human
ccacaucuagaagcacaaucacucc

SEQ ID NO: 109901 - RNA, 21 nt, Human
ccaccaaaaccaaaaaucugu

SEQ ID NO: 109902 - RNA, 22 nt, Human
ccaccaccaaaaccaaaaaucu

SEQ ID NO: 109903 - RNA, 20 nt, Human
ccagagaaagaucacuuagc

SEQ ID NO: 109904 - RNA, 21 nt, Human
ccauaucagaaagaagagcuc

SEQ ID NO: 109905 - RNA, 24 nt, Human
cccaaacacacacuccuuugccca

SEQ ID NO: 109906 - RNA, 20 nt, Human
cccaaacgugucugcagcca

SEQ ID NO: 109907 - RNA, 22 nt, Human
cccaaacgugucugcagccaug

SEQ ID NO: 109908 - RNA, 22 nt, Human
cccaacaccgaacuuuuacccc

SEQ ID NO: 109909 - RNA, 19 nt, Human
cccaacagaaacaaaaaca

SEQ ID NO: 109910 - RNA, 20 nt, Human
cccaagauaagagggggaag

SEQ ID NO: 109911 - RNA, 18 nt, Human
ccccacacuugagccuag

SEQ ID NO: 109912 - RNA, 20 nt, Human
ccccacacuugagccuagcc

SEQ ID NO: 109913 - RNA, 25 nt, Human
ccccgguuagaagaaccgcugaagc

SEQ ID NO: 109914 - RNA, 18 nt, Human
ccccuaccgcuccccuca

SEQ ID NO: 109915 - RNA, 25 nt, Human
ccccucacaggcagguguuccuugc

SEQ ID NO: 109916 - RNA, 23 nt, Human
cccuaccgcuccccucacaggca

SEQ ID NO: 109917 - RNA, 22 nt, Human
cccugccccaaacacacacucc

SEQ ID NO: 109918 - RNA, 24 nt, Human
ccgaacuuuuaccccaucccacag

SEQ ID NO: 109919 - RNA, 21 nt, Human
ccuacauaacugauaugaacc

SEQ ID NO: 109920 - RNA, 21 nt, Human
ccuccccuaccgcuccccuca

SEQ ID NO: 109921 - RNA, 24 nt, Human
ccuguacuauagugcauccaauuc

SEQ ID NO: 109922 - RNA, 20 nt, Human
cgaccugggccagucauaac

SEQ ID NO: 109923 - RNA, 24 nt, Human
cgagugcugccgaaucuacccccu

SEQ ID NO: 109924 - RNA, 26 nt, Human
cgcgcccggcccgcggcggcuuccac

SEQ ID NO: 109925 - RNA, 25 nt, Human
cucaggaaguacuugaaaguugaaa

SEQ ID NO: 109926 - RNA, 23 nt, Human
cucccaacaccgaacuuuuaccc

SEQ ID NO: 109927 - RNA, 20 nt, Human
cuccccuaccgcuccccuca

SEQ ID NO: 109928 - RNA, 20 nt, Human
cugagagcugaaauguaaug

SEQ ID NO: 109929 - RNA, 18 nt, Human
cugggggugcagugagga

SEQ ID NO: 109930 - RNA, 21 nt, Human
cuuccacacuuugcaguccag

SEQ ID NO: 109931 - RNA, 21 nt, Human
cuucuucaaagaccugcccaa

SEQ ID NO: 109932 - RNA, 19 nt, Human
cuugcccaaaagccaccac

SEQ ID NO: 109933 - RNA, 18 nt, Human
cuuugcccacuugcugcu

SEQ ID NO: 109934 - RNA, 24 nt, Human
gaaaggcuaaggaauucacaaaag

SEQ ID NO: 109935 - RNA, 21 nt, Human
gaagugcaaccucuuccacug

SEQ ID NO: 109936 - RNA, 22 nt, Human
gaccaguaacaucugguuggca

SEQ ID NO: 109937 - RNA, 21 nt, Human
gagaagugcaaccucuuccac

SEQ ID NO: 109938 - RNA, 18 nt, Human
gcagugaggaagaaggga

SEQ ID NO: 109939 - RNA, 21 nt, Human
gggcugcauuuuaccauacgu

SEQ ID NO: 109940 - RNA, 23 nt, Human
guaaaaucacccccugaaaaaca

SEQ ID NO: 109941 - RNA, 23 nt, Human
guggccccacacuugagccuagc

SEQ ID NO: 109942 - RNA, 19 nt, Human
uacaggaaacaaugaagaa

SEQ ID NO: 109943 - RNA, 24 nt, Human
uaccuagcucuccuccguauacua

SEQ ID NO: 109944 - RNA, 23 nt, Human
uacuaaacuugguuccaaaaguu

SEQ ID NO: 109945 - RNA, 21 nt, Human
uagaagcacaaucacuccagu

SEQ ID NO: 109946 - RNA, 23 nt, Human
uagccagagaaagaucacuuagc

SEQ ID NO: 109947 - RNA, 25 nt, Human
uaggucaagaaaacaauggcaucaa

SEQ ID NO: 109948 - RNA, 25 nt, Human
uaggugacuacaaaacccccugaag

SEQ ID NO: 109949 - RNA, 21 nt, Human
ucaccuucucuucuuugacuc

SEQ ID NO: 109950 - RNA, 20 nt, Human
ucacugacuuccuugggccc

SEQ ID NO: 109951 - RNA, 20 nt, Human
ucacuggaaagaaguuucug

SEQ ID NO: 109952 - RNA, 19 nt, Human
ucacuucacuggaaagaag

SEQ ID NO: 109953 - RNA, 20 nt, Human
ucacuucacuggaaagaagu

SEQ ID NO: 109954 - RNA, 24 nt, Human
ucagcagaaccgggguucaagacc

SEQ ID NO: 109955 - RNA, 30 nt, Human
ucagcaggaacagcuguaaaaaaaaaaaaa

SEQ ID NO: 109956 - RNA, 23 nt, Human
ucagggccuugccauagucacuu

SEQ ID NO: 109957 - RNA, 24 nt, Human
uccaauuuuuuuaauuagacccaa

SEQ ID NO: 109958 - RNA, 18 nt, Human
uccccaagugcuuagugg

SEQ ID NO: 109959 - RNA, 19 nt, Human
uccucucucggagaagugc

SEQ ID NO: 109960 - RNA, 19 nt, Human
uccuugcccaaaagccacc

SEQ ID NO: 109961 - RNA, 20 nt, Human
ucuccauauuaacaaaggcu

SEQ ID NO: 109962 - RNA, 20 nt, Human
ucuccauauuaacaaaggcu

SEQ ID NO: 109963 - RNA, 22 nt, Human
ucucucggagaagugcaaccuc

SEQ ID NO: 109964 - RNA, 19 nt, Human
ucugguuggcaggcacugg

SEQ ID NO: 109965 - RNA, 20 nt, Human
ucuguaggacccugggucca

SEQ ID NO: 109966 - RNA, 22 nt, Human
ucuguaggacccuggguccaaa

SEQ ID NO: 109967 - RNA, 27 nt, Human
ugaagcacuaugcuaucagcuuaaaaa

SEQ ID NO: 109968 - RNA, 18 nt, Human
ugacuacaaaacccugga

SEQ ID NO: 109969 - RNA, 19 nt, Human
ugauuggagaaaaaagagc

SEQ ID NO: 109970 - RNA, 23 nt, Human
ugcccaaaagccaccaccaaaac

SEQ ID NO: 109971 - RNA, 20 nt, Human
ugcccaagauaagaggggga

SEQ ID NO: 109972 - RNA, 21 nt, Human
ugcccacuugcugcuccaggu

SEQ ID NO: 109973 - RNA, 18 nt, Human
uggagcugagggugcagg

SEQ ID NO: 109974 - RNA, 21 nt, Human
ugggggugcagugaggaagaa

SEQ ID NO: 109975 - RNA, 18 nt, Human
ugggggugucacugacuu

SEQ ID NO: 109976 - RNA, 24 nt, Human
uggugaucuuaacagaaaccuguc

SEQ ID NO: 109977 - RNA, 23 nt, Human
uuaaaaagcaaucagcaggaaca

SEQ ID NO: 109978 - RNA, 24 nt, Human
uuaaagcacagcuacuuggugauc

SEQ ID NO: 109979 - RNA, 22 nt, Human
uuaggugaauggaauguaauca

SEQ ID NO: 109980 - RNA, 20 nt, Human
uucacaaaaguaaaaucacc

SEQ ID NO: 109981 - RNA, 19 nt, Human
uucauuacuacuagcugga

SEQ ID NO: 109982 - RNA, 22 nt, Human
uuccaaaaucucagccagaaau

SEQ ID NO: 109983 - RNA, 23 nt, Human
uuccucacagaccaguaacaucu

SEQ ID NO: 109984 - RNA, 24 nt, Human
uuccuugggcccuccaggucucuu

SEQ ID NO: 109985 - RNA, 19 nt, Human
uugaaagcuugucuggcuc

SEQ ID NO: 109986 - RNA, 20 nt, Human
uugcugcuccagguuugggg

SEQ ID NO: 109987 - RNA, 24 nt, Human
uuggccaauauaguacgaauuuca

SEQ ID NO: 109988 - RNA, 27 nt, Human
uugugggaagagggagaacuacaggaa

SEQ ID NO: 109989 - RNA, 24 nt, Human
uuugccacaucuagaagcacaauc

SEQ ID NO: 109990 - RNA, 22 nt, Human
uuuuuuuuuuuuuuuuuacaag

SEQ ID NO: 109991 - RNA, 26 nt, Human
aaacacucuaaaacagaauccgaucc

SEQ ID NO: 109992 - RNA, 24 nt, Human
aaacagaaacuugacggaaauagu

SEQ ID NO: 109993 - RNA, 21 nt, Human
aagccucugggcccaguaccu

SEQ ID NO: 109994 - RNA, 21 nt, Human
aauaguagagucugaaaauga

SEQ ID NO: 109995 - RNA, 23 nt, Human
acacacacacacacacgaaucca

SEQ ID NO: 109996 - RNA, 25 nt, Human
acacacacacacacacgaauccacg

SEQ ID NO: 109997 - RNA, 27 nt, Human
acacacacacacacacgaauccacgca

SEQ ID NO: 109998 - RNA, 21 nt, Human
acacauauacaagacacacac

SEQ ID NO: 109999 - RNA, 24 nt, Human
acacauauacaagacacacacaca

SEQ ID NO: 110000 - RNA, 19 nt, Human
acaccagguccccuccugg

SEQ ID NO: 110001 - RNA, 22 nt, Human
accacugugacuuccugugggu

SEQ ID NO: 110002 - RNA, 18 nt, Human
accccaaccuacugaccu

SEQ ID NO: 110003 - RNA, 21 nt, Human
accccaaccuacugaccuacu

SEQ ID NO: 110004 - RNA, 20 nt, Human
acccucccacccagcagagc

SEQ ID NO: 110005 - RNA, 21 nt, Human
acgcacacgaggcacaccccc

SEQ ID NO: 110006 - RNA, 22 nt, Human
acucugcgcacacauauacaag

SEQ ID NO: 110007 - RNA, 21 nt, Human
agaacagacuagcccugagua

SEQ ID NO: 110008 - RNA, 21 nt, Human
agaggagggcaggggcccgga

SEQ ID NO: 110009 - RNA, 24 nt, Human
agaggagggcaggggcccggaucc

SEQ ID NO: 110010 - RNA, 20 nt, Human
agagggcagugacaggacag

SEQ ID NO: 110011 - RNA, 20 nt, Human
agcagggggacagagcuuug

SEQ ID NO: 110012 - RNA, 18 nt, Human
aggaagagaccgguucag

SEQ ID NO: 110013 - RNA, 22 nt, Human
aggacagagccacucaucuguc

SEQ ID NO: 110014 - RNA, 19 nt, Human
aggcaaagccucugggccc

SEQ ID NO: 110015 - RNA, 20 nt, Human
aggcagggagagggcaguga

SEQ ID NO: 110016 - RNA, 23 nt, Human
aggccccucggcccugccuuucc

SEQ ID NO: 110017 - RNA, 23 nt, Human
agguccccuccuggccucugccc

SEQ ID NO: 110018 - RNA, 21 nt, Human
aggugcagaggagggcagggg

SEQ ID NO: 110019 - RNA, 27 nt, Human
auauacaagacacacacacacacacgg

SEQ ID NO: 110020 - RNA, 24 nt, Human
auauacaagacacacacacacagg

SEQ ID NO: 110021 - RNA, 18 nt, Human
augcaggcgcucaaagcc

SEQ ID NO: 110022 - RNA, 23 nt, Human
augggccugagccugggcagggg

SEQ ID NO: 110023 - RNA, 23 nt, Human
caaagccucugggcccaguaccu

SEQ ID NO: 110024 - RNA, 18 nt, Human
caaaugaggcccagaaag

SEQ ID NO: 110025 - RNA, 24 nt, Human
caaauucccagcgcggggcgguuc

SEQ ID NO: 110026 - RNA, 19 nt, Human
caacagccacaguaggcug

SEQ ID NO: 110027 - RNA, 21 nt, Human
caaccccaaccuacugaccua

SEQ ID NO: 110028 - RNA, 20 nt, Human
caagacacacacacacacac

SEQ ID NO: 110029 - RNA, 20 nt, Human
caaggcaaagccucugggcc

SEQ ID NO: 110030 - RNA, 30 nt, Human
cacacauauacaagacacacacacacacag

SEQ ID NO: 110031 - RNA, 18 nt, Human
cacaguaggcugacguaa

SEQ ID NO: 110032 - RNA, 21 nt, Human
caccagguccccuccuggccu

SEQ ID NO: 110033 - RNA, 21 nt, Human
cacccaaggggugucagcaac

SEQ ID NO: 110034 - RNA, 22 nt, Human
caccccacccuccagcccccag

SEQ ID NO: 110035 - RNA, 23 nt, Human
cacccccccuacuccuguauuca

SEQ ID NO: 110036 - RNA, 19 nt, Human
cacucaucugucccaaagc

SEQ ID NO: 110037 - RNA, 19 nt, Human
cacucugucaaggcaaagc

SEQ ID NO: 110038 - RNA, 20 nt, Human
cagaaacacucuaaaacaga

SEQ ID NO: 110039 - RNA, 24 nt, Human
cagaaacacucuaaaacagaaucc

SEQ ID NO: 110040 - RNA, 26 nt, Human
cagaaacacucuaaaacagaauccga

SEQ ID NO: 110041 - RNA, 20 nt, Human
cagagccacucaucuguccc

SEQ ID NO: 110042 - RNA, 20 nt, Human
cagagccuggugccagggac

SEQ ID NO: 110043 - RNA, 23 nt, Human
cagaugcccuccauggcccaccc

SEQ ID NO: 110044 - RNA, 26 nt, Human
cagaugcccuccauggcccacccucc

SEQ ID NO: 110045 - RNA, 24 nt, Human
cagccacaguaggcugacguaacc

SEQ ID NO: 110046 - RNA, 19 nt, Human
cagcuccugggggccaggg

SEQ ID NO: 110047 - RNA, 20 nt, Human
cagcucggcugccccggcgg

SEQ ID NO: 110048 - RNA, 24 nt, Human
ccaaagcugcacccaagggguggu

SEQ ID NO: 110049 - RNA, 23 nt, Human
ccacccagcccucuccugcacgg

SEQ ID NO: 110050 - RNA, 22 nt, Human
ccauaccucaugggccugagcc

SEQ ID NO: 110051 - RNA, 19 nt, Human
cccacacccccccuacucc

SEQ ID NO: 110052 - RNA, 25 nt, Human
cccacacccccccuacuccuguauu

SEQ ID NO: 110053 - RNA, 27 nt, Human
cccacacccccccuacuccuguauuca

SEQ ID NO: 110054 - RNA, 22 nt, Human
cccacccuccagcccccaggaa

SEQ ID NO: 110055 - RNA, 24 nt, Human
ccccccacaggaaggguccuaggu

SEQ ID NO: 110056 - RNA, 22 nt, Human
ccccucggcccugccuuuccga

SEQ ID NO: 110057 - RNA, 19 nt, Human
cccgcaggccccucggccc

SEQ ID NO: 110058 - RNA, 19 nt, Human
cccggauccuggcccagaa

SEQ ID NO: 110059 - RNA, 22 nt, Human
cccuccuggccucugccccacc

SEQ ID NO: 110060 - RNA, 19 nt, Human
cccugaguagggagugugg

SEQ ID NO: 110061 - RNA, 18 nt, Human
ccgcaggccccucggccc

SEQ ID NO: 110062 - RNA, 23 nt, Human
ccgcaggccccucggcccugccu

SEQ ID NO: 110063 - RNA, 19 nt, Human
ccuacuccuguauucagau

SEQ ID NO: 110064 - RNA, 21 nt, Human
ccucaugggccugagccuggg

SEQ ID NO: 110065 - RNA, 19 nt, Human
ccucccuugaaacccuggg

SEQ ID NO: 110066 - RNA, 23 nt, Human
ccuccucccuugaaacccugggc

SEQ ID NO: 110067 - RNA, 23 nt, Human
ccucugggcccaguaccuuguaa

SEQ ID NO: 110068 - RNA, 21 nt, Human
ccugcaaagcuggaaugccag

SEQ ID NO: 110069 - RNA, 22 nt, Human
ccuggccucugccccacccagc

SEQ ID NO: 110070 - RNA, 23 nt, Human
ccuguggcuaggcugcccgaagc

SEQ ID NO: 110071 - RNA, 20 nt, Human
ccuuuggcaccccacccucc

SEQ ID NO: 110072 - RNA, 27 nt, Human
cgcacacauauacaagacacacacaca

SEQ ID NO: 110073 - RNA, 24 nt, Human
cuccauaccucaugggccugagcc

SEQ ID NO: 110074 - RNA, 24 nt, Human
cucccuugaaacccugggccacuc

SEQ ID NO: 110075 - RNA, 22 nt, Human
cuccuggccucugccccaccuu

SEQ ID NO: 110076 - RNA, 23 nt, Human
cugccccacccagcccucuccug

SEQ ID NO: 110077 - RNA, 22 nt, Human
cugccccgcaggccccucggcc

SEQ ID NO: 110078 - RNA, 22 nt, Human
cugcccgaagcacgugccgcag

SEQ ID NO: 110079 - RNA, 21 nt, Human
cugugacuuccuguggguccc

SEQ ID NO: 110080 - RNA, 25 nt, Human
cuugaaacccugggccacucuguca

SEQ ID NO: 110081 - RNA, 24 nt, Human
gaaacacucuaaaacagaauccga

SEQ ID NO: 110082 - RNA, 24 nt, Human
gaauccacgcacacgaggcacacc

SEQ ID NO: 110083 - RNA, 23 nt, Human
gcagaggagggcaggggcccgga

SEQ ID NO: 110084 - RNA, 20 nt, Human
gcccacccucccacccagcu

SEQ ID NO: 110085 - RNA, 21 nt, Human
gccuuuggcaccccacccucc

SEQ ID NO: 110086 - RNA, 26 nt, Human
ggaagaacagacuagcccugaguagg

SEQ ID NO: 110087 - RNA, 19 nt, Human
ggagcagggggacagagcu

SEQ ID NO: 110088 - RNA, 20 nt, Human
ggcaggggcccggauccugg

SEQ ID NO: 110089 - RNA, 18 nt, Human
ggccucugccccacccag

SEQ ID NO: 110090 - RNA, 24 nt, Human
gggacagagcuuuggguagaggag

SEQ ID NO: 110091 - RNA, 18 nt, Human
gggagagggcagugacag

SEQ ID NO: 110092 - RNA, 20 nt, Human
gggcaggggcccggauccug

SEQ ID NO: 110093 - RNA, 25 nt, Human
gggcaggggucuggagugcacauag

SEQ ID NO: 110094 - RNA, 23 nt, Human
gggccugagggaugagccaggug

SEQ ID NO: 110095 - RNA, 18 nt, Human
gggccuuuggcaccccac

SEQ ID NO: 110096 - RNA, 21 nt, Human
ggugcagaggagggcaggggc

SEQ ID NO: 110097 - RNA, 22 nt, Human
gugggucccuucccuucugucc

SEQ ID NO: 110098 - RNA, 23 nt, Human
guguggucaggugcagaggaggg

SEQ ID NO: 110099 - RNA, 20 nt, Human
uaauguagggucaggguggg

SEQ ID NO: 110100 - RNA, 24 nt, Human
uacacacccacacccccccuacuc

SEQ ID NO: 110101 - RNA, 19 nt, Human
uacuuugggaccacaggcc

SEQ ID NO: 110102 - RNA, 18 nt, Human
uagguagggggagguucc

SEQ ID NO: 110103 - RNA, 22 nt, Human
uccagcccccaggaaugcaggc

SEQ ID NO: 110104 - RNA, 19 nt, Human
ucccaaagcugcacccaag

SEQ ID NO: 110105 - RNA, 21 nt, Human
ucccacccagcagagcgccag

SEQ ID NO: 110106 - RNA, 22 nt, Human
ucccugacucuguagacccccc

SEQ ID NO: 110107 - RNA, 22 nt, Human
ucccugggcaccacugugacuu

SEQ ID NO: 110108 - RNA, 26 nt, Human
ucccugggcaccacugugacuuccug

SEQ ID NO: 110109 - RNA, 18 nt, Human
ucccuucccuucuguccc

SEQ ID NO: 110110 - RNA, 19 nt, Human
ucccuugaaacccugggcc

SEQ ID NO: 110111 - RNA, 20 nt, Human
ugacuuccugugggucccuu

SEQ ID NO: 110112 - RNA, 23 nt, Human
ugagccugggcaggggucuggag

SEQ ID NO: 110113 - RNA, 18 nt, Human
ugaugagaggagcucugg

SEQ ID NO: 110114 - RNA, 22 nt, Human
ugaugcacucugcgcacacaua

SEQ ID NO: 110115 - RNA, 24 nt, Human
ugccccacccagcccucuccugca

SEQ ID NO: 110116 - RNA, 24 nt, Human
ugcccgaagcacgugccgcaguuc

SEQ ID NO: 110117 - RNA, 19 nt, Human
uggaaugccaggggagugg

SEQ ID NO: 110118 - RNA, 19 nt, Human
uggagugggagcaggggga

SEQ ID NO: 110119 - RNA, 23 nt, Human
uggcaccccacccuccagccccc

SEQ ID NO: 110120 - RNA, 22 nt, Human
uggcccacccucccacccagca

SEQ ID NO: 110121 - RNA, 24 nt, Human
uggcccagaaacacucuaaaacag

SEQ ID NO: 110122 - RNA, 19 nt, Human
uggcuuuugcucagggccu

SEQ ID NO: 110123 - RNA, 22 nt, Human
ugggcaggugacacaccagguc

SEQ ID NO: 110124 - RNA, 20 nt, Human
uguaaaggcuuugaugagag

SEQ ID NO: 110125 - RNA, 21 nt, Human
ugucccugacucuguagaccc

SEQ ID NO: 110126 - RNA, 21 nt, Human
uuuuuuuuuuuggggcuguga

SEQ ID NO: 110127 - RNA, 23 nt, Human
uuuuuuuuuuuuuuuuuggggcu

SEQ ID NO: 110128 - RNA, 21 nt, Human
aaaagacuuucauuaacuuca

SEQ ID NO: 110129 - RNA, 21 nt, Human
aaacauggcgaaaggagcucu

SEQ ID NO: 110130 - RNA, 21 nt, Human
aacauggcgaaaggagcucuc

SEQ ID NO: 110131 - RNA, 19 nt, Human
agguaggaauuauaggccu

SEQ ID NO: 110132 - RNA, 19 nt, Human
caccacaccgcccgcccug

SEQ ID NO: 110133 - RNA, 20 nt, Human
cagcagacugguaaaacaug

SEQ ID NO: 110134 - RNA, 19 nt, Human
cagcagagugcggcaacac

SEQ ID NO: 110135 - RNA, 18 nt, Human
ccacauagaucugcuagc

SEQ ID NO: 110136 - RNA, 24 nt, Human
cccagacacagaaaguuuuagggu

SEQ ID NO: 110137 - RNA, 23 nt, Human
ccccgcagucuaccaagcuccug

SEQ ID NO: 110138 - RNA, 27 nt, Human
ccgcagucuaccaagcuccugugcauu

SEQ ID NO: 110139 - RNA, 24 nt, Human
ccuaagagguuauaacagcagacu

SEQ ID NO: 110140 - RNA, 23 nt, Human
cugguaaaacauggcgaaaggag

SEQ ID NO: 110141 - RNA, 25 nt, Human
gagcacagcaaugcgugcaccacac

SEQ ID NO: 110142 - RNA, 20 nt, Human
gaggguacccagacacagaa

SEQ ID NO: 110143 - RNA, 23 nt, Human
gcagcagagugcggcaacacagg

SEQ ID NO: 110144 - RNA, 23 nt, Human
gcuggaaauuaaaggauacaacc

SEQ ID NO: 110145 - RNA, 19 nt, Human
guaaaacauggcgaaagga

SEQ ID NO: 110146 - RNA, 20 nt, Human
uaaaggauacaaccuaagag

SEQ ID NO: 110147 - RNA, 24 nt, Human
uaaaggauacaaccuaagagguua

SEQ ID NO: 110148 - RNA, 24 nt, Human
ucaagguaggaauuauaggccuac

SEQ ID NO: 110149 - RNA, 21 nt, Human
ucaucaaguuaauaaagguca

SEQ ID NO: 110150 - RNA, 20 nt, Human
ugcggcaacacaggcccuga

SEQ ID NO: 110151 - RNA, 21 nt, Human
uggagcacagcaaugcgugca

SEQ ID NO: 110152 - RNA, 23 nt, Human
aaaaaaacuugugccccggaaaa

SEQ ID NO: 110153 - RNA, 20 nt, Human
aaaaauccauucccagcagc

SEQ ID NO: 110154 - RNA, 18 nt, Human
aaaacaaagcagcaaaga

SEQ ID NO: 110155 - RNA, 25 nt, Human
aaaagguacuaagguuucaaaacug

SEQ ID NO: 110156 - RNA, 18 nt, Human
aaacaaaaggaaaaacag

SEQ ID NO: 110157 - RNA, 19 nt, Human
aaacaaaaggaaaaacagg

SEQ ID NO: 110158 - RNA, 25 nt, Human
aaauaaaugaggcacaacucagaua

SEQ ID NO: 110159 - RNA, 22 nt, Human
aaauaacccugaaucauuucug

SEQ ID NO: 110160 - RNA, 25 nt, Human
aacagcaaagcagaggacagagaag

SEQ ID NO: 110161 - RNA, 26 nt, Human
aacuggcuuagcauuccccugaccuc

SEQ ID NO: 110162 - RNA, 21 nt, Human
aagcagcaaagaggcagcugg

SEQ ID NO: 110163 - RNA, 27 nt, Human
aaugacuucaagauggucgggaguuuc

SEQ ID NO: 110164 - RNA, 18 nt, Human
acaaagcagcaaagaggc

SEQ ID NO: 110165 - RNA, 20 nt, Human
acacauuuucuuuugagguc

SEQ ID NO: 110166 - RNA, 18 nt, Human
acacuacuguguuguaaa

SEQ ID NO: 110167 - RNA, 26 nt, Human
acagaacacuacuguguuguaaacaa

SEQ ID NO: 110168 - RNA, 19 nt, Human
acauuuguacuucuccuuu

SEQ ID NO: 110169 - RNA, 20 nt, Human
accaagucuacuggacuguc

SEQ ID NO: 110170 - RNA, 20 nt, Human
accuaaaauaaagcagugca

SEQ ID NO: 110171 - RNA, 20 nt, Human
acucaauacugcaucucaug

SEQ ID NO: 110172 - RNA, 20 nt, Human
agaagucuuaagaacuggcu

SEQ ID NO: 110173 - RNA, 18 nt, Human
agacauuuguacuucucc

SEQ ID NO: 110174 - RNA, 22 nt, Human
agcaaugguuaauucuaagcag

SEQ ID NO: 110175 - RNA, 19 nt, Human
agccaccuaaaauaaagca

SEQ ID NO: 110176 - RNA, 20 nt, Human
aggaaaacaaagcagcaaag

SEQ ID NO: 110177 - RNA, 23 nt, Human
aggaaaagaugagcugcgaagaa

SEQ ID NO: 110178 - RNA, 24 nt, Human
aggcacagaaccacuaaaaguuac

SEQ ID NO: 110179 - RNA, 21 nt, Human
agguacuaagguuucaaaacu

SEQ ID NO: 110180 - RNA, 21 nt, Human
agguguuucuauuugguaucu

SEQ ID NO: 110181 - RNA, 20 nt, Human
auaaaaucuguaaaauguuu

SEQ ID NO: 110182 - RNA, 26 nt, Human
auagauuugggauuuuaacuaacagc

SEQ ID NO: 110183 - RNA, 19 nt, Human
aucacagccaaaguaugaa

SEQ ID NO: 110184 - RNA, 22 nt, Human
augaaaugagggauauuucuga

SEQ ID NO: 110185 - RNA, 20 nt, Human
augacacugacacccacaug

SEQ ID NO: 110186 - RNA, 21 nt, Human
auucuuuuuccaucaaaaaau

SEQ ID NO: 110187 - RNA, 19 nt, Human
caaaucccaaaaguuaaaa

SEQ ID NO: 110188 - RNA, 21 nt, Human
caauaaauaaaugaggcacaa

SEQ ID NO: 110189 - RNA, 21 nt, Human
cagaauucuuugagcucaaaa

SEQ ID NO: 110190 - RNA, 21 nt, Human
caggaaacuauagguucaagg

SEQ ID NO: 110191 - RNA, 20 nt, Human
caggguggggggcgggauag

SEQ ID NO: 110192 - RNA, 20 nt, Human
cauagccaaaucccuacccc

SEQ ID NO: 110193 - RNA, 23 nt, Human
cauagccaaaucccuaccccuuc

SEQ ID NO: 110194 - RNA, 23 nt, Human
cauggcagugguauguccucugu

SEQ ID NO: 110195 - RNA, 19 nt, Human
ccacaugcuguuaaaaagg

SEQ ID NO: 110196 - RNA, 21 nt, Human
ccaguccaagagacugauagc

SEQ ID NO: 110197 - RNA, 24 nt, Human
cccacacaacauucugaaaguugg

SEQ ID NO: 110198 - RNA, 21 nt, Human
cccacaugcuguuaaaaaggu

SEQ ID NO: 110199 - RNA, 23 nt, Human
ccccugaccucuuuaccuagcaa

SEQ ID NO: 110200 - RNA, 21 nt, Human
ccuaugaucaccuccugcuuu

SEQ ID NO: 110201 - RNA, 19 nt, Human
ccucuccucccuuuccuca

SEQ ID NO: 110202 - RNA, 24 nt, Human
cggaaaagugaacagaacacuacu

SEQ ID NO: 110203 - RNA, 20 nt, Human
cuacuggacugucuucaugg

SEQ ID NO: 110204 - RNA, 18 nt, Human
cuagaacacucaauacug

SEQ ID NO: 110205 - RNA, 23 nt, Human
cucaauacugcaucucaugaaac

SEQ ID NO: 110206 - RNA, 22 nt, Human
cucuuccacuacuacgcuucag

SEQ ID NO: 110207 - RNA, 21 nt, Human
cugccaacuaauuccaggaac

SEQ ID NO: 110208 - RNA, 28 nt, Human
cuggaagguguuucuauuucccaauugg

SEQ ID NO: 110209 - RNA, 19 nt, Human
gaaauaauugaaggggcug

SEQ ID NO: 110210 - RNA, 19 nt, Human
gaauggcauaaggucaaga

SEQ ID NO: 110211 - RNA, 22 nt, Human
gagaaucaggaggaaaacaaag

SEQ ID NO: 110212 - RNA, 21 nt, Human
gaggcacagaaccacuaaaag

SEQ ID NO: 110213 - RNA, 21 nt, Human
gccauauuccacaacaucccc

SEQ ID NO: 110214 - RNA, 20 nt, Human
ggagagggguugggggaggg

SEQ ID NO: 110215 - RNA, 21 nt, Human
ggagagggguugggggagggg

SEQ ID NO: 110216 - RNA, 18 nt, Human
gggagagggguuggggga

SEQ ID NO: 110217 - RNA, 19 nt, Human
ggguugggggagggggucg

SEQ ID NO: 110218 - RNA, 18 nt, Human
gguugggggagggggucg

SEQ ID NO: 110219 - RNA, 25 nt, Human
guaaauucuuaaaugacuaaagaaa

SEQ ID NO: 110220 - RNA, 18 nt, Human
guacucacaguucaccau

SEQ ID NO: 110221 - RNA, 26 nt, Human
guagaauuuucugcagaaagacaaag

SEQ ID NO: 110222 - RNA, 22 nt, Human
guccucuccucccuuuccucag

SEQ ID NO: 110223 - RNA, 20 nt, Human
gugcucacaccuguaaggaa

SEQ ID NO: 110224 - RNA, 22 nt, Human
uaaauccguaucacuagguauu

SEQ ID NO: 110225 - RNA, 21 nt, Human
uaacagcaaagcagaggacag

SEQ ID NO: 110226 - RNA, 23 nt, Human
uaacagcaaagcagaggacagag

SEQ ID NO: 110227 - RNA, 21 nt, Human
uacacuuguccucuccucccu

SEQ ID NO: 110228 - RNA, 23 nt, Human
uacugauugauaucuagucacac

SEQ ID NO: 110229 - RNA, 23 nt, Human
uagaaaugaagaacagacacugc

SEQ ID NO: 110230 - RNA, 21 nt, Human
uagaacacucaauacugcauc

SEQ ID NO: 110231 - RNA, 23 nt, Human
uagaacacucaauacugcaucuc

SEQ ID NO: 110232 - RNA, 19 nt, Human
uagcuagaagagcuccuug

SEQ ID NO: 110233 - RNA, 21 nt, Human
uaggacaaugugaguaaacag

SEQ ID NO: 110234 - RNA, 22 nt, Human
uauagaaaugaagaacagacac

SEQ ID NO: 110235 - RNA, 22 nt, Human
uauauggaauggcauaagguca

SEQ ID NO: 110236 - RNA, 18 nt, Human
uauccaggcaccuaaaac

SEQ ID NO: 110237 - RNA, 21 nt, Human
uaugaacaaaaaaacuugugc

SEQ ID NO: 110238 - RNA, 22 nt, Human
ucagaauucuuugagcucaaaa

SEQ ID NO: 110239 - RNA, 22 nt, Human
ucaggaaaggugcucacaccug

SEQ ID NO: 110240 - RNA, 21 nt, Human
ucauggggcaggguggggggc

SEQ ID NO: 110241 - RNA, 24 nt, Human
ucauggggcaggguggggggcggg

SEQ ID NO: 110242 - RNA, 26 nt, Human
uccaagagacugauagcagucuucag

SEQ ID NO: 110243 - RNA, 23 nt, Human
uccucuguaacacuugauaagag

SEQ ID NO: 110244 - RNA, 20 nt, Human
ucugauucccuggaggucau

SEQ ID NO: 110245 - RNA, 19 nt, Human
ucuuuuucaacauuaaugu

SEQ ID NO: 110246 - RNA, 21 nt, Human
ugagacuugccaaguucuaaa

SEQ ID NO: 110247 - RNA, 23 nt, Human
ugcaaucaaaacucccagccacc

SEQ ID NO: 110248 - RNA, 18 nt, Human
ugccaaaggaaaucuuag

SEQ ID NO: 110249 - RNA, 21 nt, Human
ugccaacuaauuccaggaacu

SEQ ID NO: 110250 - RNA, 20 nt, Human
uggcuuagcauuccccugac

SEQ ID NO: 110251 - RNA, 18 nt, Human
uggggcaggguggggggc

SEQ ID NO: 110252 - RNA, 18 nt, Human
ugggggagggggucgcua

SEQ ID NO: 110253 - RNA, 21 nt, Human
ugguauguagaggacaggccu

SEQ ID NO: 110254 - RNA, 18 nt, Human
uguaaacaaaaggaaaaa

SEQ ID NO: 110255 - RNA, 22 nt, Human
uguacauaugcucagguacaua

SEQ ID NO: 110256 - RNA, 24 nt, Human
uguagugaaggcauagccaaaucc

SEQ ID NO: 110257 - RNA, 18 nt, Human
ugucaagagaggaagcac

SEQ ID NO: 110258 - RNA, 20 nt, Human
ugucagaauuucaggaaagg

SEQ ID NO: 110259 - RNA, 24 nt, Human
uguguacauaugcucagguacaua

SEQ ID NO: 110260 - RNA, 23 nt, Human
uuaauuacugauugauaucuagu

SEQ ID NO: 110261 - RNA, 24 nt, Human
uuacugauugauaucuagucacac

SEQ ID NO: 110262 - RNA, 21 nt, Human
uuagugccuuucugauucccu

SEQ ID NO: 110263 - RNA, 18 nt, Human
uucagacugacagaaaag

SEQ ID NO: 110264 - RNA, 21 nt, Human
uucauggggcagggugggggg

SEQ ID NO: 110265 - RNA, 25 nt, Human
uucauuauucagaaccuuuucuguu

SEQ ID NO: 110266 - RNA, 21 nt, Human
uuccaacuaugaacuauaaca

SEQ ID NO: 110267 - RNA, 21 nt, Human
uuccccucaaauaacccugaa

SEQ ID NO: 110268 - RNA, 21 nt, Human
uucucugccaacuaauuccag

SEQ ID NO: 110269 - RNA, 19 nt, Human
uucuucaggaaacuauagg

SEQ ID NO: 110270 - RNA, 21 nt, Human
uugaaugcucaaguuucaugg

SEQ ID NO: 110271 - RNA, 24 nt, Human
uuggcuauagaaaugaagaacaga

SEQ ID NO: 110272 - RNA, 24 nt, Human
uugggauuuuaacuaacagcuuug

SEQ ID NO: 110273 - RNA, 19 nt, Human
uuuguacuccuuggaucuu

SEQ ID NO: 110274 - RNA, 18 nt, Human
aagccucuggccccucca

SEQ ID NO: 110275 - RNA, 24 nt, Human
agaggccccuccaagcccagcaac

SEQ ID NO: 110276 - RNA, 19 nt, Human
agcagggcccagcuggggg

SEQ ID NO: 110277 - RNA, 25 nt, Human
agccucuggccccuccacaugauuc

SEQ ID NO: 110278 - RNA, 18 nt, Human
aggccccuccaagcccag

SEQ ID NO: 110279 - RNA, 18 nt, Human
caagaggccccuccaagc

SEQ ID NO: 110280 - RNA, 27 nt, Human
cagcaacaaggggugagcagggcccag

SEQ ID NO: 110281 - RNA, 22 nt, Human
ccaagcccagcaacaaggggug

SEQ ID NO: 110282 - RNA, 19 nt, Human
ccccuccacaugauucugg

SEQ ID NO: 110283 - RNA, 27 nt, Human
ccccugcaaauuaaaaguuccucaaga

SEQ ID NO: 110284 - RNA, 27 nt, Human
cgggcaccccugcaaauuaaaaguucc

SEQ ID NO: 110285 - RNA, 22 nt, Human
gcaagccucuggccccuccaca

SEQ ID NO: 110286 - RNA, 21 nt, Human
gggugagcagggcccagcugg

SEQ ID NO: 110287 - RNA, 21 nt, Human
uaaaaguuccucaagaggccc

SEQ ID NO: 110288 - RNA, 20 nt, Human
uaaaaucacagugucucagc

SEQ ID NO: 110289 - RNA, 25 nt, Human
uccaagcccagcaacaaggggugag

SEQ ID NO: 110290 - RNA, 22 nt, Human
uggcaagccucuggccccucca

SEQ ID NO: 110291 - RNA, 24 nt, Human
ugucucagcuggaaugccccgucc

SEQ ID NO: 110292 - RNA, 23 nt, Human
agaaaacagauaugcuggucaag

SEQ ID NO: 110293 - RNA, 19 nt, Human
aggaggccuuuaauuguga

SEQ ID NO: 110294 - RNA, 20 nt, Human
cagcccgggagaugcgcugg

SEQ ID NO: 110295 - RNA, 18 nt, Human
ccuacagcauucugggcu

SEQ ID NO: 110296 - RNA, 18 nt, Human
gagcgcaaucagaaaaca

SEQ ID NO: 110297 - RNA, 21 nt, Human
ggaggccuuuaauugugaaga

SEQ ID NO: 110298 - RNA, 24 nt, Human
gggcuaggugugggaguggguggg

SEQ ID NO: 110299 - RNA, 18 nt, Human
ggucaaggagguggccag

SEQ ID NO: 110300 - RNA, 19 nt, Human
gucaaggagguggccagcc

SEQ ID NO: 110301 - RNA, 23 nt, Human
gugagugggacagcugguguggg

SEQ ID NO: 110302 - RNA, 23 nt, Human
uaggugugggagugggugggcag

SEQ ID NO: 110303 - RNA, 18 nt, Human
ucugggcuagguguggga

SEQ ID NO: 110304 - RNA, 19 nt, Human
ugagugggacagcuggugu

SEQ ID NO: 110305 - RNA, 23 nt, Human
ugagugggacagcuggugugggu

SEQ ID NO: 110306 - RNA, 22 nt, Human
uggagcaggggagagaugcccc

SEQ ID NO: 110307 - RNA, 22 nt, Human
aaccaaccgacccaccgacacc

SEQ ID NO: 110308 - RNA, 22 nt, Human
aaccaaccgacccaccgacacc

SEQ ID NO: 110309 - RNA, 21 nt, Human
accgacccaccgacaccacgc

SEQ ID NO: 110310 - RNA, 18 nt, Human
acucuaaagacaaaaagg

SEQ ID NO: 110311 - RNA, 23 nt, Human
agacaaaaagguuugguccaaaa

SEQ ID NO: 110312 - RNA, 21 nt, Human
aggaaggaaacaugcaaucac

SEQ ID NO: 110313 - RNA, 22 nt, Human
aggaaggaaacaugcaaucaca

SEQ ID NO: 110314 - RNA, 23 nt, Human
aggaaggaaacaugcaaucacaa

SEQ ID NO: 110315 - RNA, 24 nt, Human
augacugugaagagcuucacugag

SEQ ID NO: 110316 - RNA, 19 nt, Human
caaccgacccaccgacacc

SEQ ID NO: 110317 - RNA, 19 nt, Human
caaccgacccaccgacacc

SEQ ID NO: 110318 - RNA, 24 nt, Human
cacaguugaaggaaggaaacaugc

SEQ ID NO: 110319 - RNA, 19 nt, Human
caccgacaccacagcggug

SEQ ID NO: 110320 - RNA, 21 nt, Human
caccgacaccacagcgguggc

SEQ ID NO: 110321 - RNA, 25 nt, Human
cacggacaccaacggugagacaaaa

SEQ ID NO: 110322 - RNA, 25 nt, Human
cacggacaccaacggugagacaaaa

SEQ ID NO: 110323 - RNA, 25 nt, Human
cacugaguaggauuaagauauugca

SEQ ID NO: 110324 - RNA, 21 nt, Human
cagggagaacacaguugaagg

SEQ ID NO: 110325 - RNA, 25 nt, Human
ccaaccgacccaccgacaccacagc

SEQ ID NO: 110326 - RNA, 19 nt, Human
ccacgcccggcagccaccg

SEQ ID NO: 110327 - RNA, 18 nt, Human
cccuuccucuuccuccuc

SEQ ID NO: 110328 - RNA, 20 nt, Human
ccuccccuuccucuuccucc

SEQ ID NO: 110329 - RNA, 18 nt, Human
ccuccucucccuccucuc

SEQ ID NO: 110330 - RNA, 18 nt, Human
ccucucugaaugccaggg

SEQ ID NO: 110331 - RNA, 21 nt, Human
cgacaccacgcccggcagcca

SEQ ID NO: 110332 - RNA, 21 nt, Human
cgacccaccgacaccacgccc

SEQ ID NO: 110333 - RNA, 27 nt, Human
cuccucucccuccucucugaaugccag

SEQ ID NO: 110334 - RNA, 25 nt, Human
cucuuccuccucucccuccucucug

SEQ ID NO: 110335 - RNA, 23 nt, Human
gacaccaacggugagacaaaaac

SEQ ID NO: 110336 - RNA, 23 nt, Human
gacaccaacggugagacaaaaac

SEQ ID NO: 110337 - RNA, 20 nt, Human
ggaagcuucccuccccuucc

SEQ ID NO: 110338 - RNA, 21 nt, Human
ucagaauaaugcacagaagca

SEQ ID NO: 110339 - RNA, 24 nt, Human
ucagaauaaugcacagaagcacag

SEQ ID NO: 110340 - RNA, 21 nt, Human
uccccuuccucuuccuccucu

SEQ ID NO: 110341 - RNA, 19 nt, Human
ucccuccccuuccucuucc

SEQ ID NO: 110342 - RNA, 26 nt, Human
uccucucccuccucucugaaugccag

SEQ ID NO: 110343 - RNA, 23 nt, Human
ugacugugaagagcuucacugag

SEQ ID NO: 110344 - RNA, 19 nt, Human
ugagacaaaaaccaaccga

SEQ ID NO: 110345 - RNA, 19 nt, Human
ugagacaaaaaccaaccga

SEQ ID NO: 110346 - RNA, 25 nt, Human
ugagacaaaaaccaaccgacccacc

SEQ ID NO: 110347 - RNA, 25 nt, Human
ugagacaaaaaccaaccgacccacc

SEQ ID NO: 110348 - RNA, 22 nt, Human
ugggaagcuucccuccccuucc

SEQ ID NO: 110349 - RNA, 20 nt, Human
uucccuccccuuccucuucc

SEQ ID NO: 110350 - RNA, 22 nt, Human
uuccuccucucccuccucuccc

SEQ ID NO: 110351 - RNA, 21 nt, Human
aagaaaaaaaauacaucagga

SEQ ID NO: 110352 - RNA, 18 nt, Human
aagaaaaaaaauacaucg

SEQ ID NO: 110353 - RNA, 18 nt, Human
aagcagcugcuccuccug

SEQ ID NO: 110354 - RNA, 20 nt, Human
agaaaaaaaauacaucagga

SEQ ID NO: 110355 - RNA, 23 nt, Human
agaaaaaaaauacaucaggaggg

SEQ ID NO: 110356 - RNA, 20 nt, Human
agccggcgucggcggggacg

SEQ ID NO: 110357 - RNA, 21 nt, Human
aggcgugauggggugagggcc

SEQ ID NO: 110358 - RNA, 20 nt, Human
agggagcgaggcgugauggg

SEQ ID NO: 110359 - RNA, 19 nt, Human
aucaggagggacagucaca

SEQ ID NO: 110360 - RNA, 21 nt, Human
caaagcagcugcuccuccugu

SEQ ID NO: 110361 - RNA, 23 nt, Human
caaagcagcugcuccuccugugc

SEQ ID NO: 110362 - RNA, 22 nt, Human
caagcccguccccgccgacgcc

SEQ ID NO: 110363 - RNA, 18 nt, Human
cacccgagccgcggggag

SEQ ID NO: 110364 - RNA, 22 nt, Human
caggagggagcgaggcgugaug

SEQ ID NO: 110365 - RNA, 21 nt, Human
caggcccagcccaugcucugu

SEQ ID NO: 110366 - RNA, 26 nt, Human
ccagcccaugcucuguggccaugcac

SEQ ID NO: 110367 - RNA, 27 nt, Human
cccagcccaugcucuguggccaugcac

SEQ ID NO: 110368 - RNA, 18 nt, Human
ccccgaccaaagcagcug

SEQ ID NO: 110369 - RNA, 22 nt, Human
cccgcgcugcguccggcggccg

SEQ ID NO: 110370 - RNA, 22 nt, Human
cccgcgcugcguccggcggccg

SEQ ID NO: 110371 - RNA, 24 nt, Human
cccgcgcugcguccggcggccgcg

SEQ ID NO: 110372 - RNA, 24 nt, Human
cccgcgcugcguccggcggccgcg

SEQ ID NO: 110373 - RNA, 20 nt, Human
ccgcgccugccccgcgcugc

SEQ ID NO: 110374 - RNA, 20 nt, Human
ccgcgccugccccgcgcugc

SEQ ID NO: 110375 - RNA, 22 nt, Human
ccucccagcgccuggagauggg

SEQ ID NO: 110376 - RNA, 18 nt, Human
cgaccaaagcagcugcuc

SEQ ID NO: 110377 - RNA, 19 nt, Human
cggcggccgcgacgcuguc

SEQ ID NO: 110378 - RNA, 19 nt, Human
cggcggccgcgacgcuguc

SEQ ID NO: 110379 - RNA, 18 nt, Human
cucggcucugcccgcgcc

SEQ ID NO: 110380 - RNA, 18 nt, Human
cucggcucugcccgcgcc

SEQ ID NO: 110381 - RNA, 22 nt, Human
gaccaaagcagcugcuccuccu

SEQ ID NO: 110382 - RNA, 19 nt, Human
gagccgcggggagccggcg

SEQ ID NO: 110383 - RNA, 22 nt, Human
gagccgggcccgguggcggaga

SEQ ID NO: 110384 - RNA, 22 nt, Human
gagucaacaacacacccuuuaa

SEQ ID NO: 110385 - RNA, 19 nt, Human
gaguggaauaggcuguggg

SEQ ID NO: 110386 - RNA, 21 nt, Human
gcagcugcuccuccugugccc

SEQ ID NO: 110387 - RNA, 24 nt, Human
ggaagugcgguccgcgccaagccc

SEQ ID NO: 110388 - RNA, 18 nt, Human
ggaggaguggaauaggcu

SEQ ID NO: 110389 - RNA, 24 nt, Human
ggcccagcccaugcucuguggcca

SEQ ID NO: 110390 - RNA, 21 nt, Human
gguagcagcugcugcgagucu

SEQ ID NO: 110391 - RNA, 21 nt, Human
guccgcgccaagcccgucccc

SEQ ID NO: 110392 - RNA, 22 nt, Human
uaagccaagaaaaaaaauacau

SEQ ID NO: 110393 - RNA, 23 nt, Human
uaagccaagaaaaaaaauacauc

SEQ ID NO: 110394 - RNA, 18 nt, Human
ucaggagggacagucaca

SEQ ID NO: 110395 - RNA, 20 nt, Human
ucaggagggacagucacaau

SEQ ID NO: 110396 - RNA, 22 nt, Human
ucaggagggacagucacaauug

SEQ ID NO: 110397 - RNA, 18 nt, Human
ugagaggaggcgugaggg

SEQ ID NO: 110398 - RNA, 24 nt, Human
ugagaggaggcgugaggggcugga

SEQ ID NO: 110399 - RNA, 20 nt, Human
ugaggggcuggaccagaggg

SEQ ID NO: 110400 - RNA, 21 nt, Human
ugaggggcuggaccagagggc

SEQ ID NO: 110401 - RNA, 23 nt, Human
ugaggggcuggaccagagggcca

SEQ ID NO: 110402 - RNA, 22 nt, Human
ugaguagacugagaggaggcgu

SEQ ID NO: 110403 - RNA, 18 nt, Human
ugcccaggcccagcccau

SEQ ID NO: 110404 - RNA, 21 nt, Human
ugcccaggcccagcccaugcu

SEQ ID NO: 110405 - RNA, 24 nt, Human
ugcccaggcccagcccaugcucug

SEQ ID NO: 110406 - RNA, 23 nt, Human
ugcgcucggcucugcccgcgccu

SEQ ID NO: 110407 - RNA, 23 nt, Human
ugcgcucggcucugcccgcgccu

SEQ ID NO: 110408 - RNA, 21 nt, Human
uggaauaggcuguggguagca

SEQ ID NO: 110409 - RNA, 23 nt, Human
uggguagcagcugcugcgagucu

SEQ ID NO: 110410 - RNA, 24 nt, Human
uguggccaugcaccuagcaggcac

SEQ ID NO: 110411 - RNA, 23 nt, Human
aaaaagcccaagugaauaaaaca

SEQ ID NO: 110412 - RNA, 22 nt, Human
aaacacacacaagauuggaauc

SEQ ID NO: 110413 - RNA, 20 nt, Human
aaacugaagaacagcaauau

SEQ ID NO: 110414 - RNA, 19 nt, Human
aaagagcucgggucggggg

SEQ ID NO: 110415 - RNA, 19 nt, Human
aacacguugccuguuuucc

SEQ ID NO: 110416 - RNA, 19 nt, Human
aacauuuuucaauaaucug

SEQ ID NO: 110417 - RNA, 22 nt, Human
acaaacaaaacugaagaacagc

SEQ ID NO: 110418 - RNA, 18 nt, Human
acugaagaacagcaauau

SEQ ID NO: 110419 - RNA, 20 nt, Human
agagggggaagaaaaaaagc

SEQ ID NO: 110420 - RNA, 24 nt, Human
agauuggaaucauggugcucuuug

SEQ ID NO: 110421 - RNA, 21 nt, Human
aggaaacuggcaggcagacga

SEQ ID NO: 110422 - RNA, 19 nt, Human
agggagaggaggagaaggg

SEQ ID NO: 110423 - RNA, 20 nt, Human
aguaauuucaaauuccacaa

SEQ ID NO: 110424 - RNA, 22 nt, Human
caaaaagaaguccuucaugaaa

SEQ ID NO: 110425 - RNA, 22 nt, Human
caaaacugaagaacagcaauau

SEQ ID NO: 110426 - RNA, 28 nt, Human
caagggagaggaggagaaggggaggggg

SEQ ID NO: 110427 - RNA, 22 nt, Human
cacaaacaaaacugaagaacag

SEQ ID NO: 110428 - RNA, 19 nt, Human
cacaacauaagggcaccug

SEQ ID NO: 110429 - RNA, 20 nt, Human
caggaaacuggcaggcagac

SEQ ID NO: 110430 - RNA, 22 nt, Human
cauugaaacuauuccccuucga

SEQ ID NO: 110431 - RNA, 28 nt, Human
ccacagaaaaagcacaggauacagcaca

SEQ ID NO: 110432 - RNA, 21 nt, Human
cccuucgaaaauaaauucuaa

SEQ ID NO: 110433 - RNA, 19 nt, Human
ccugcauagguuagagggc

SEQ ID NO: 110434 - RNA, 22 nt, Human
ccugucacuggggcugcggggc

SEQ ID NO: 110435 - RNA, 23 nt, Human
ccuuuuacgcucauuuaaaaauc

SEQ ID NO: 110436 - RNA, 23 nt, Human
cggggcaguggcugcccgggcuc

SEQ ID NO: 110437 - RNA, 24 nt, Human
cuccaagggagaggaggagaaggg

SEQ ID NO: 110438 - RNA, 18 nt, Human
cuccuccugucacugggg

SEQ ID NO: 110439 - RNA, 25 nt, Human
cugaagaacagcaauauuuuguuug

SEQ ID NO: 110440 - RNA, 22 nt, Human
gaaggggaggggggaggcugga

SEQ ID NO: 110441 - RNA, 23 nt, Human
gagcaguucuuuaaagaaagagg

SEQ ID NO: 110442 - RNA, 20 nt, Human
gauugaauauugagcaguuc

SEQ ID NO: 110443 - RNA, 19 nt, Human
ggaagaaaaaaagcccaag

SEQ ID NO: 110444 - RNA, 18 nt, Human
ggagaaggggagggggga

SEQ ID NO: 110445 - RNA, 21 nt, Human
ggagaggaggagaaggggagg

SEQ ID NO: 110446 - RNA, 22 nt, Human
ggagaggaggagaaggggaggg

SEQ ID NO: 110447 - RNA, 24 nt, Human
ggagaggaggagaaggggaggggg

SEQ ID NO: 110448 - RNA, 24 nt, Human
ggcaguggcugcccgggcucucca

SEQ ID NO: 110449 - RNA, 20 nt, Human
gggagaggaggagaagggga

SEQ ID NO: 110450 - RNA, 19 nt, Human
gggaggggggaggcugggc

SEQ ID NO: 110451 - RNA, 21 nt, Human
gggaggggggaggcugggcuc

SEQ ID NO: 110452 - RNA, 18 nt, Human
ggggaggggggaggcugg

SEQ ID NO: 110453 - RNA, 24 nt, Human
ggggaggggggaggcugggcucag

SEQ ID NO: 110454 - RNA, 20 nt, Human
ggggcaguggcugcccgggc

SEQ ID NO: 110455 - RNA, 19 nt, Human
uaaaacaccacaauaucca

SEQ ID NO: 110456 - RNA, 22 nt, Human
uaaaacaccacaauauccaaca

SEQ ID NO: 110457 - RNA, 19 nt, Human
uaacauaggugauccaagu

SEQ ID NO: 110458 - RNA, 22 nt, Human
uagaaacaaaaagaaguccuuc

SEQ ID NO: 110459 - RNA, 22 nt, Human
uauaguuagaaacaaaaagaag

SEQ ID NO: 110460 - RNA, 21 nt, Human
uccacaaacaaaacugaagaa

SEQ ID NO: 110461 - RNA, 20 nt, Human
uccuccugucacuggggcug

SEQ ID NO: 110462 - RNA, 21 nt, Human
ucggggguuauggucuccucc

SEQ ID NO: 110463 - RNA, 20 nt, Human
ugagaaguggguaaagacga

SEQ ID NO: 110464 - RNA, 23 nt, Human
ugcauaauggggaaaccugcaua

SEQ ID NO: 110465 - RNA, 22 nt, Human
uuuaaacacuacagagugcaaa

SEQ ID NO: 110466 - RNA, 23 nt, Human
uuugaauaaaacagauuuaaaug

SEQ ID NO: 110467 - RNA, 20 nt, Human
aaaagaaacugacuguccag

SEQ ID NO: 110468 - RNA, 24 nt, Human
aaucaaacacgagaggggcaggcc

SEQ ID NO: 110469 - RNA, 22 nt, Human
accuugcucagguacucccuca

SEQ ID NO: 110470 - RNA, 19 nt, Human
acgagaggggcaggcucug

SEQ ID NO: 110471 - RNA, 22 nt, Human
agcagcaggucauugaugagca

SEQ ID NO: 110472 - RNA, 23 nt, Human
agcagcaggucauugaugagcag

SEQ ID NO: 110473 - RNA, 23 nt, Human
agcugaugcuucuccagcugcug

SEQ ID NO: 110474 - RNA, 25 nt, Human
aggcaucgauagaugcccuuaagcc

SEQ ID NO: 110475 - RNA, 18 nt, Human
agggggcagcuccagcca

SEQ ID NO: 110476 - RNA, 20 nt, Human
aggugugccugcucugcagc

SEQ ID NO: 110477 - RNA, 24 nt, Human
auagaggaacaccagcucagccca

SEQ ID NO: 110478 - RNA, 23 nt, Human
aucaaacacgagaggggcaggcc

SEQ ID NO: 110479 - RNA, 18 nt, Human
augagguccgguaccucc

SEQ ID NO: 110480 - RNA, 19 nt, Human
auugcguccccugugcugc

SEQ ID NO: 110481 - RNA, 18 nt, Human
caacuucugggccagcuc

SEQ ID NO: 110482 - RNA, 26 nt, Human
caagcaccaugucugggcgaagcagg

SEQ ID NO: 110483 - RNA, 22 nt, Human
caccaggggcagcugaccugcc

SEQ ID NO: 110484 - RNA, 19 nt, Human
cagacucuccaaggcaucc

SEQ ID NO: 110485 - RNA, 18 nt, Human
cagcaagaucagcuccuc

SEQ ID NO: 110486 - RNA, 19 nt, Human
cagccucuacccuggccuc

SEQ ID NO: 110487 - RNA, 18 nt, Human
cagcuccagccagucgga

SEQ ID NO: 110488 - RNA, 21 nt, Human
caggaaccacugcagcaacuu

SEQ ID NO: 110489 - RNA, 22 nt, Human
caggcucugucacaugcuccuc

SEQ ID NO: 110490 - RNA, 19 nt, Human
ccacugcagcaacuucugg

SEQ ID NO: 110491 - RNA, 28 nt, Human
ccacugcagcaacuucuggggggcccuc

SEQ ID NO: 110492 - RNA, 24 nt, Human
ccccaggcucugggauggcucaga

SEQ ID NO: 110493 - RNA, 21 nt, Human
cccucagcaccuuugggaugu

SEQ ID NO: 110494 - RNA, 20 nt, Human
ccucaaaguagccacgaucc

SEQ ID NO: 110495 - RNA, 22 nt, Human
ccuccaaacaagacguguucau

SEQ ID NO: 110496 - RNA, 23 nt, Human
ccuccaggaaccacugcagcaac

SEQ ID NO: 110497 - RNA, 26 nt, Human
ccuccuuccaggccucaguggggugg

SEQ ID NO: 110498 - RNA, 23 nt, Human
ccucuacccuggccuccccaggc

SEQ ID NO: 110499 - RNA, 21 nt, Human
ccuuccaggccucaguggggu

SEQ ID NO: 110500 - RNA, 20 nt, Human
ccuugcucagguacucccuc

SEQ ID NO: 110501 - RNA, 24 nt, Human
cgccgucagccucuacccuggccu

SEQ ID NO: 110502 - RNA, 19 nt, Human
cggcggcggcagcggcagg

SEQ ID NO: 110503 - RNA, 21 nt, Human
cuaaagcuggucuugcgccgu

SEQ ID NO: 110504 - RNA, 23 nt, Human
cucaagcaccaugucugggcgaa

SEQ ID NO: 110505 - RNA, 19 nt, Human
cuccagcaucuucuguggc

SEQ ID NO: 110506 - RNA, 24 nt, Human
cuccaggaaccacugcagcaacuu

SEQ ID NO: 110507 - RNA, 25 nt, Human
cuccaggaaccacugcagcaacuuc

SEQ ID NO: 110508 - RNA, 19 nt, Human
cuccaggccagcucaagca

SEQ ID NO: 110509 - RNA, 18 nt, Human
cucuacccuggccucccc

SEQ ID NO: 110510 - RNA, 21 nt, Human
cucugcagcaugcugcauggc

SEQ ID NO: 110511 - RNA, 22 nt, Human
cugcagcaacuucugggccagc

SEQ ID NO: 110512 - RNA, 20 nt, Human
cuugccuuccuccaggaacc

SEQ ID NO: 110513 - RNA, 21 nt, Human
cuugccuuccuccaggaacca

SEQ ID NO: 110514 - RNA, 19 nt, Human
gaccucggcggcggcggcg

SEQ ID NO: 110515 - RNA, 18 nt, Human
gagcacagcauugucaua

SEQ ID NO: 110516 - RNA, 21 nt, Human
gaggaacaccagcucagccca

SEQ ID NO: 110517 - RNA, 19 nt, Human
gcagcaggucauugaugag

SEQ ID NO: 110518 - RNA, 19 nt, Human
gcauggccaaguccacgag

SEQ ID NO: 110519 - RNA, 29 nt, Human
gcgggaccucggcggcggcggcggcagcg

SEQ ID NO: 110520 - RNA, 18 nt, Human
ggagggggcagcuccagc

SEQ ID NO: 110521 - RNA, 25 nt, Human
ggcagggcuuagugcaaucagcugg

SEQ ID NO: 110522 - RNA, 19 nt, Human
ggccuggagggggcagcuc

SEQ ID NO: 110523 - RNA, 19 nt, Human
ggcucagagguugccguca

SEQ ID NO: 110524 - RNA, 22 nt, Human
gggaccucggcggcggcggcgg

SEQ ID NO: 110525 - RNA, 19 nt, Human
gggugaaagcaccagcagc

SEQ ID NO: 110526 - RNA, 26 nt, Human
ggucauagcaggugaagagacaagcu

SEQ ID NO: 110527 - RNA, 24 nt, Human
guccaggugugguccagccggggu

SEQ ID NO: 110528 - RNA, 18 nt, Human
guuguuguggcucuggac

SEQ ID NO: 110529 - RNA, 24 nt, Human
uaaugauguccuugaacugacccu

SEQ ID NO: 110530 - RNA, 21 nt, Human
uacccuggccuccccaggcuc

SEQ ID NO: 110531 - RNA, 24 nt, Human
uagaggaacaccagcucagcccac

SEQ ID NO: 110532 - RNA, 20 nt, Human
uauugcccuuguacagauaa

SEQ ID NO: 110533 - RNA, 24 nt, Human
ucacaugcuccucuugcuugcgca

SEQ ID NO: 110534 - RNA, 19 nt, Human
ucaccaggggcagcugacc

SEQ ID NO: 110535 - RNA, 21 nt, Human
ucagagguugccgucauuggg

SEQ ID NO: 110536 - RNA, 23 nt, Human
ucagcugaugcuucuccagcugc

SEQ ID NO: 110537 - RNA, 20 nt, Human
ucauacuccucguacuuguc

SEQ ID NO: 110538 - RNA, 19 nt, Human
uccaggccagcucaagcac

SEQ ID NO: 110539 - RNA, 23 nt, Human
ucccugccucccauugcgucccc

SEQ ID NO: 110540 - RNA, 23 nt, Human
uccuccucugucagcaggugguu

SEQ ID NO: 110541 - RNA, 24 nt, Human
uccuuggagaaguuaguaacucug

SEQ ID NO: 110542 - RNA, 20 nt, Human
ugaaaagaaacugacugucc

SEQ ID NO: 110543 - RNA, 21 nt, Human
ugaaagcaccagcagcagguc

SEQ ID NO: 110544 - RNA, 23 nt, Human
ugacacgggaccagaaaagcucc

SEQ ID NO: 110545 - RNA, 20 nt, Human
ugacuguccagguguggucc

SEQ ID NO: 110546 - RNA, 19 nt, Human
ugacuguccaggugugguu

SEQ ID NO: 110547 - RNA, 25 nt, Human
ugcaccugaacuccaucagcugaug

SEQ ID NO: 110548 - RNA, 21 nt, Human
ugcagcaacuucugggccagc

SEQ ID NO: 110549 - RNA, 18 nt, Human
ugcagguagggugggugg

SEQ ID NO: 110550 - RNA, 23 nt, Human
ugccaagaggcugagaguccuuu

SEQ ID NO: 110551 - RNA, 19 nt, Human
ugcuggagugacaugcucc

SEQ ID NO: 110552 - RNA, 19 nt, Human
uggagggggcagcuccagc

SEQ ID NO: 110553 - RNA, 18 nt, Human
uggaugaaguagggcaug

SEQ ID NO: 110554 - RNA, 21 nt, Human
uggcaaccuugguaaugaugu

SEQ ID NO: 110555 - RNA, 23 nt, Human
uggcaaccuugguaaugaugucc

SEQ ID NO: 110556 - RNA, 23 nt, Human
uggcaggggcugggcccacggca

SEQ ID NO: 110557 - RNA, 23 nt, Human
uggccuccccaggcucugggaug

SEQ ID NO: 110558 - RNA, 19 nt, Human
uggccuggagggggcagcu

SEQ ID NO: 110559 - RNA, 19 nt, Human
uggguggugacaacgccca

SEQ ID NO: 110560 - RNA, 21 nt, Human
uguacagauaggccgcaaugc

SEQ ID NO: 110561 - RNA, 19 nt, Human
ugucagcaggugguugagu

SEQ ID NO: 110562 - RNA, 19 nt, Human
ugucauaggcaucgauaga

SEQ ID NO: 110563 - RNA, 21 nt, Human
ugucauaggcaucgauagaug

SEQ ID NO: 110564 - RNA, 23 nt, Human
uuagugcaaucagcugggucuca

SEQ ID NO: 110565 - RNA, 24 nt, Human
uucagcaaaaauaaauauugucca

SEQ ID NO: 110566 - RNA, 23 nt, Human
uugcguccccugugcugcuggag

SEQ ID NO: 110567 - RNA, 19 nt, Human
uugcucagguacucccuca

SEQ ID NO: 110568 - RNA, 25 nt, Human
uuggagaaguuaguaacucugcagg

SEQ ID NO: 110569 - RNA, 23 nt, Human
agcucaucuuggggggagcugga

SEQ ID NO: 110570 - RNA, 20 nt, Human
cacgccucggucagcggcgg

SEQ ID NO: 110571 - RNA, 20 nt, Human
cccccguaaggugcaaaagc

SEQ ID NO: 110572 - RNA, 18 nt, Human
cgccucggucagcggcgg

SEQ ID NO: 110573 - RNA, 20 nt, Human
cuggggccugguuacuuggu

SEQ ID NO: 110574 - RNA, 24 nt, Human
gaauuccuuuuuuuuuuuuuuuuu

SEQ ID NO: 110575 - RNA, 18 nt, Human
gcagagcucucucugggg

SEQ ID NO: 110576 - RNA, 18 nt, Human
gcucaucuuggggggagc

SEQ ID NO: 110577 - RNA, 18 nt, Human
ggccuggaggcuggggcc

SEQ ID NO: 110578 - RNA, 19 nt, Human
ggccugguuacuuggugac

SEQ ID NO: 110579 - RNA, 21 nt, Human
ggcugcagcucaucuuggggg

SEQ ID NO: 110580 - RNA, 21 nt, Human
gggagcuggacucaagaugcc

SEQ ID NO: 110581 - RNA, 23 nt, Human
ggggggcugcagcucaucuuggg

SEQ ID NO: 110582 - RNA, 19 nt, Human
guucuucccaugagcagca

SEQ ID NO: 110583 - RNA, 18 nt, Human
uacuuggugacgugcaga

SEQ ID NO: 110584 - RNA, 18 nt, Human
ucccaugagcagcagagu

SEQ ID NO: 110585 - RNA, 18 nt, Human
uccuuuuuuuuuuuuuuu

SEQ ID NO: 110586 - RNA, 18 nt, Human
uccuuuuuuuuuuuuuuu

SEQ ID NO: 110587 - RNA, 23 nt, Human
ucucuggggggcugcagcucauc

SEQ ID NO: 110588 - RNA, 22 nt, Human
ucuguucuucccaugagcagca

SEQ ID NO: 110589 - RNA, 19 nt, Human
ugcagcucaucuugggggg

SEQ ID NO: 110590 - RNA, 18 nt, Human
ugggggccuggaggcugg

SEQ ID NO: 110591 - RNA, 23 nt, Human
uucuggagucuuugcacgccucg

SEQ ID NO: 110592 - RNA, 24 nt, Human
uuggugacgugcagagcucucucu

SEQ ID NO: 110593 - RNA, 24 nt, Human
uuuuuuuuuuuuuuuuuuuuucag

SEQ ID NO: 110594 - RNA, 20 nt, Human
ccagagaggcugccugagca

SEQ ID NO: 110595 - RNA, 18 nt, Human
aaaaaucuucccgccucu

SEQ ID NO: 110596 - RNA, 18 nt, Human
aaaaucuucccgccucuc

SEQ ID NO: 110597 - RNA, 26 nt, Human
aaacgacucacaaacacaggacuccg

SEQ ID NO: 110598 - RNA, 22 nt, Human
acacagcgagacucuguuaaaa

SEQ ID NO: 110599 - RNA, 23 nt, Human
accucccaacuacuugggccaag

SEQ ID NO: 110600 - RNA, 18 nt, Human
acugcacuccagccuggg

SEQ ID NO: 110601 - RNA, 21 nt, Human
acugcacuccagccuggguga

SEQ ID NO: 110602 - RNA, 24 nt, Human
acugcacuccagccugggugacag

SEQ ID NO: 110603 - RNA, 24 nt, Human
acugcaugcgugacuagaccagca

SEQ ID NO: 110604 - RNA, 20 nt, Human
agagcaccguccaaaauguc

SEQ ID NO: 110605 - RNA, 21 nt, Human
agauggugguugcagugagcc

SEQ ID NO: 110606 - RNA, 25 nt, Human
agcaguaaaaaccaaggcaucccca

SEQ ID NO: 110607 - RNA, 19 nt, Human
agccaacaccucccaacua

SEQ ID NO: 110608 - RNA, 23 nt, Human
agccaacaccucccaacuacuug

SEQ ID NO: 110609 - RNA, 24 nt, Human
agccuuggcaacacagcgagacuc

SEQ ID NO: 110610 - RNA, 22 nt, Human
auaguaguccuagcuccucagc

SEQ ID NO: 110611 - RNA, 24 nt, Human
aucgcagcacugcacuccagccug

SEQ ID NO: 110612 - RNA, 19 nt, Human
caacacagcgagacucugu

SEQ ID NO: 110613 - RNA, 25 nt, Human
caacacugcaugcgugacuagacca

SEQ ID NO: 110614 - RNA, 22 nt, Human
caccauggaguaggcgaugggg

SEQ ID NO: 110615 - RNA, 19 nt, Human
caccguccaaaaugucagc

SEQ ID NO: 110616 - RNA, 20 nt, Human
cacuccagccugggugacag

SEQ ID NO: 110617 - RNA, 20 nt, Human
cacuccagccugggugacag

SEQ ID NO: 110618 - RNA, 20 nt, Human
cacuccagccugggugacag

SEQ ID NO: 110619 - RNA, 19 nt, Human
cacugcacuccagccuggg

SEQ ID NO: 110620 - RNA, 19 nt, Human
cacugcacuccagccuggg

SEQ ID NO: 110621 - RNA, 19 nt, Human
cacugcacuccagccuggg

SEQ ID NO: 110622 - RNA, 20 nt, Human
cacugcacuccagccugggu

SEQ ID NO: 110623 - RNA, 21 nt, Human
cacugcacuccagccugggug

SEQ ID NO: 110624 - RNA, 22 nt, Human
cacugcacuccagccuggguga

SEQ ID NO: 110625 - RNA, 23 nt, Human
cacugcacuccagccugggugac

SEQ ID NO: 110626 - RNA, 24 nt, Human
cacugcacuccagccugggugaca

SEQ ID NO: 110627 - RNA, 25 nt, Human
cacugcacuccagccugggugacag

SEQ ID NO: 110628 - RNA, 19 nt, Human
cagccaacaccucccaacu

SEQ ID NO: 110629 - RNA, 18 nt, Human
cagccacacugggaacga

SEQ ID NO: 110630 - RNA, 22 nt, Human
cagcgagacucuguuaaaaauu

SEQ ID NO: 110631 - RNA, 23 nt, Human
caggugccaucccaaccugcuuc

SEQ ID NO: 110632 - RNA, 18 nt, Human
caucaucugcugcaggcc

SEQ ID NO: 110633 - RNA, 21 nt, Human
cauccccaacacugcaugcgu

SEQ ID NO: 110634 - RNA, 23 nt, Human
ccagcgccugcaacuuguccagg

SEQ ID NO: 110635 - RNA, 22 nt, Human
cccaacacugcaugcgugacua

SEQ ID NO: 110636 - RNA, 26 nt, Human
cccauaguaguccuagcuccucagcu

SEQ ID NO: 110637 - RNA, 23 nt, Human
ccccaacacugcaugcgugacua

SEQ ID NO: 110638 - RNA, 21 nt, Human
ccggagcccagugccugggcc

SEQ ID NO: 110639 - RNA, 22 nt, Human
ccucaacuugcaccaguccaca

SEQ ID NO: 110640 - RNA, 21 nt, Human
ccuccucgcccaaguccuguu

SEQ ID NO: 110641 - RNA, 19 nt, Human
ccucuggguggccucagcc

SEQ ID NO: 110642 - RNA, 22 nt, Human
ccugcaacuuguccagguuguc

SEQ ID NO: 110643 - RNA, 23 nt, Human
ccugcacuccagccuuggcaaca

SEQ ID NO: 110644 - RNA, 19 nt, Human
ccugcacuccagccuuggg

SEQ ID NO: 110645 - RNA, 18 nt, Human
ccugcagcaccuucucgg

SEQ ID NO: 110646 - RNA, 23 nt, Human
cgacugucuauaacccugggaac

SEQ ID NO: 110647 - RNA, 21 nt, Human
cgccaggacgaugacaugguc

SEQ ID NO: 110648 - RNA, 24 nt, Human
cgcccaaguccuguuucuccuccu

SEQ ID NO: 110649 - RNA, 24 nt, Human
cgcggccugcacuccagccuuggc

SEQ ID NO: 110650 - RNA, 20 nt, Human
cguugggaguaaaaggugcu

SEQ ID NO: 110651 - RNA, 23 nt, Human
cucaaaaaucuucccgccucucc

SEQ ID NO: 110652 - RNA, 20 nt, Human
cucagagcaguaaaaaccaa

SEQ ID NO: 110653 - RNA, 21 nt, Human
cuccggagcccagugccuggg

SEQ ID NO: 110654 - RNA, 19 nt, Human
cugggucagcuucaggcuc

SEQ ID NO: 110655 - RNA, 25 nt, Human
cugggugacagcgcaacacccuuuc

SEQ ID NO: 110656 - RNA, 21 nt, Human
cuucaugguccaucaucugcu

SEQ ID NO: 110657 - RNA, 19 nt, Human
cuucccgccucuccuggga

SEQ ID NO: 110658 - RNA, 20 nt, Human
gaaaagcaacucaggguggc

SEQ ID NO: 110659 - RNA, 21 nt, Human
gacuagaccagcaagaagucc

SEQ ID NO: 110660 - RNA, 22 nt, Human
gagaucgcggccugcacuccag

SEQ ID NO: 110661 - RNA, 20 nt, Human
gagccacaggaacuggggcg

SEQ ID NO: 110662 - RNA, 18 nt, Human
gauaaccuuccccauagg

SEQ ID NO: 110663 - RNA, 28 nt, Human
gcacugauaaccuuccccaaccggaggg

SEQ ID NO: 110664 - RNA, 18 nt, Human
gcacugcacuccagccug

SEQ ID NO: 110665 - RNA, 21 nt, Human
gcacugcacuccagccugggu

SEQ ID NO: 110666 - RNA, 24 nt, Human
gcacugcacuccagccugggugac

SEQ ID NO: 110667 - RNA, 19 nt, Human
gcagggacuacugagggcc

SEQ ID NO: 110668 - RNA, 22 nt, Human
gccacacugggaacgacugucu

SEQ ID NO: 110669 - RNA, 21 nt, Human
gccaggugccaucccaaccug

SEQ ID NO: 110670 - RNA, 23 nt, Human
gccgguccagucggccuggccuc

SEQ ID NO: 110671 - RNA, 24 nt, Human
gccuugggccaccagcagucuugc

SEQ ID NO: 110672 - RNA, 27 nt, Human
gcggccugcacuccagccuuggcaaca

SEQ ID NO: 110673 - RNA, 20 nt, Human
gcuucaggcucuucaggugc

SEQ ID NO: 110674 - RNA, 19 nt, Human
ggagcccagugccugggcc

SEQ ID NO: 110675 - RNA, 22 nt, Human
ggguccuuucauguccgauccc

SEQ ID NO: 110676 - RNA, 18 nt, Human
gguccagucggccuggcc

SEQ ID NO: 110677 - RNA, 24 nt, Human
ggugaucgcagcacugcacuccag

SEQ ID NO: 110678 - RNA, 23 nt, Human
ggugcugcucaaaaaucuucccg

SEQ ID NO: 110679 - RNA, 20 nt, Human
ggugguugcagugagccgag

SEQ ID NO: 110680 - RNA, 24 nt, Human
ggugguugcagugagccgagaucg

SEQ ID NO: 110681 - RNA, 21 nt, Human
gguugcagugagccgagaucg

SEQ ID NO: 110682 - RNA, 19 nt, Human
guugcagugagccgagauc

SEQ ID NO: 110683 - RNA, 25 nt, Human
uaaaguaucucaacaauucucagag

SEQ ID NO: 110684 - RNA, 23 nt, Human
uagauuuuccaacuacacaguuu

SEQ ID NO: 110685 - RNA, 21 nt, Human
uagcuccucagcuugagcccu

SEQ ID NO: 110686 - RNA, 24 nt, Human
uaggccuugggccaccagcagucu

SEQ ID NO: 110687 - RNA, 25 nt, Human
ucaaaaaucuucccgccucuccugg

SEQ ID NO: 110688 - RNA, 18 nt, Human
ucacaaacacaggacucc

SEQ ID NO: 110689 - RNA, 23 nt, Human
ucagcugaaaagcaacucagggu

SEQ ID NO: 110690 - RNA, 21 nt, Human
ucauuuucuucggcccauggg

SEQ ID NO: 110691 - RNA, 20 nt, Human
uccacauggcagcagggggc

SEQ ID NO: 110692 - RNA, 24 nt, Human
uccagaagggcguuugccagcgcc

SEQ ID NO: 110693 - RNA, 19 nt, Human
uccagccugggugacagcg

SEQ ID NO: 110694 - RNA, 19 nt, Human
ucccaacuacuugggccaa

SEQ ID NO: 110695 - RNA, 21 nt, Human
ucccaacuacuugggccaagu

SEQ ID NO: 110696 - RNA, 23 nt, Human
uccucauaguuuaucacuuccuu

SEQ ID NO: 110697 - RNA, 21 nt, Human
uccugggcgucgauccaccuc

SEQ ID NO: 110698 - RNA, 18 nt, Human
uccuuuuccagaagggcg

SEQ ID NO: 110699 - RNA, 20 nt, Human
ucgcagcacugcacuccagc

SEQ ID NO: 110700 - RNA, 18 nt, Human
ucggcccauggggcggcg

SEQ ID NO: 110701 - RNA, 19 nt, Human
ucucagagcaguaaaaacc

SEQ ID NO: 110702 - RNA, 18 nt, Human
ucugaaugcucugcugcc

SEQ ID NO: 110703 - RNA, 22 nt, Human
ucuguaggccuugggccaccag

SEQ ID NO: 110704 - RNA, 23 nt, Human
ucugugguacccauuccaagugg

SEQ ID NO: 110705 - RNA, 21 nt, Human
ugaaaagcaacucaggguggc

SEQ ID NO: 110706 - RNA, 21 nt, Human
ugacuagaccagcaagaaguc

SEQ ID NO: 110707 - RNA, 21 nt, Human
ugagccgagaucgcggccugc

SEQ ID NO: 110708 - RNA, 20 nt, Human
ugagcuggaugacagggccg

SEQ ID NO: 110709 - RNA, 19 nt, Human
ugaucgcagcacugcacuc

SEQ ID NO: 110710 - RNA, 20 nt, Human
ugcagagaaacuuaaaauca

SEQ ID NO: 110711 - RNA, 18 nt, Human
ugcagggacuacugaggg

SEQ ID NO: 110712 - RNA, 18 nt, Human
ugcccaugaggcccuccu

SEQ ID NO: 110713 - RNA, 18 nt, Human
ugcgccucagggaaggag

SEQ ID NO: 110714 - RNA, 21 nt, Human
ugcgugacuagaccagcaaga

SEQ ID NO: 110715 - RNA, 26 nt, Human
ugcucugcugccucuggguggccuca

SEQ ID NO: 110716 - RNA, 23 nt, Human
ugcugcucaaaaaucuucccggu

SEQ ID NO: 110717 - RNA, 20 nt, Human
uggaugacagggccgcugga

SEQ ID NO: 110718 - RNA, 21 nt, Human
uggaugacagggccgcuggag

SEQ ID NO: 110719 - RNA, 24 nt, Human
uggcaacacagcgagacucuguua

SEQ ID NO: 110720 - RNA, 20 nt, Human
uggcagcagggggcaguggu

SEQ ID NO: 110721 - RNA, 25 nt, Human
uggcagcagggggcaguggugaguc

SEQ ID NO: 110722 - RNA, 21 nt, Human
ugggaacgacugucuauaacc

SEQ ID NO: 110723 - RNA, 24 nt, Human
ugggagauggugguugcagugagc

SEQ ID NO: 110724 - RNA, 18 nt, Human
ugggcccgaugccaggug

SEQ ID NO: 110725 - RNA, 21 nt, Human
ugggucucuucggucuccucc

SEQ ID NO: 110726 - RNA, 19 nt, Human
uggugaguccuccggagcc

SEQ ID NO: 110727 - RNA, 19 nt, Human
uguccagguuguccugcag

SEQ ID NO: 110728 - RNA, 18 nt, Human
uguccgauccccuuagca

SEQ ID NO: 110729 - RNA, 23 nt, Human
ugugucuguaggccuugggccac

SEQ ID NO: 110730 - RNA, 19 nt, Human
uugcagugagccgagaucg

SEQ ID NO: 110731 - RNA, 20 nt, Human
uugcagugagccgagaucgc

SEQ ID NO: 110732 - RNA, 25 nt, Human
uugcagugagccgagaucgcggccu

SEQ ID NO: 110733 - RNA, 21 nt, Human
uuuuccaacuacacaguuuau

SEQ ID NO: 110734 - RNA, 20 nt, Human
aagcaguucugcuggagaga

SEQ ID NO: 110735 - RNA, 19 nt, Human
aaggucuuccugaggguuc

SEQ ID NO: 110736 - RNA, 19 nt, Human
acucuauuucuccuccccu

SEQ ID NO: 110737 - RNA, 24 nt, Human
agaaaaauccaagcaguucugcug

SEQ ID NO: 110738 - RNA, 19 nt, Human
agaagaaagggguuccagg

SEQ ID NO: 110739 - RNA, 22 nt, Human
aucaagaaguggacucuauuuc

SEQ ID NO: 110740 - RNA, 20 nt, Human
aucagcuucugcuaucauug

SEQ ID NO: 110741 - RNA, 23 nt, Human
auucaagaucccccucugaaccc

SEQ ID NO: 110742 - RNA, 22 nt, Human
caagaucccccucugaaccccc

SEQ ID NO: 110743 - RNA, 21 nt, Human
caccccuaucacccggaggcu

SEQ ID NO: 110744 - RNA, 20 nt, Human
cagaaagugguagaagugau

SEQ ID NO: 110745 - RNA, 19 nt, Human
cagcauaaaacacuguuca

SEQ ID NO: 110746 - RNA, 23 nt, Human
cagcauaaaacacuguucauccc

SEQ ID NO: 110747 - RNA, 19 nt, Human
cagcuggaacaccccuauc

SEQ ID NO: 110748 - RNA, 18 nt, Human
cccugacucgugccgaau

SEQ ID NO: 110749 - RNA, 22 nt, Human
cccugagccuccugguagaaaa

SEQ ID NO: 110750 - RNA, 19 nt, Human
cccugcuggccgccggggc

SEQ ID NO: 110751 - RNA, 22 nt, Human
ccggaaggucuuccugaggguu

SEQ ID NO: 110752 - RNA, 19 nt, Human
ccucccaucaagaagugga

SEQ ID NO: 110753 - RNA, 23 nt, Human
ccucugaacccccagagcgccgc

SEQ ID NO: 110754 - RNA, 19 nt, Human
ccugcucuguccugagcuc

SEQ ID NO: 110755 - RNA, 25 nt, Human
ccugugacugcaggccacucgaggc

SEQ ID NO: 110756 - RNA, 18 nt, Human
cggaaggucuuccugagg

SEQ ID NO: 110757 - RNA, 21 nt, Human
cucuggucucugcccggaagg

SEQ ID NO: 110758 - RNA, 21 nt, Human
cugaggguucccugugacugc

SEQ ID NO: 110759 - RNA, 22 nt, Human
cuguucaucccaugcaaaaugc

SEQ ID NO: 110760 - RNA, 23 nt, Human
gagguucuugccuugaucuucag

SEQ ID NO: 110761 - RNA, 24 nt, Human
gaugcuaaagagguucuugccuug

SEQ ID NO: 110762 - RNA, 20 nt, Human
gcagcuggaacaccccuauc

SEQ ID NO: 110763 - RNA, 18 nt, Human
gcuaguccaaggcuguau

SEQ ID NO: 110764 - RNA, 20 nt, Human
gcuucugcuaucauuguugc

SEQ ID NO: 110765 - RNA, 22 nt, Human
ggcugcuucccugacucgugcc

SEQ ID NO: 110766 - RNA, 22 nt, Human
guuccaggcccuagauucccag

SEQ ID NO: 110767 - RNA, 24 nt, Human
uagaucucuagaugccaucagcuu

SEQ ID NO: 110768 - RNA, 26 nt, Human
uagauucccagcauaaaacacuguuc

SEQ ID NO: 110769 - RNA, 23 nt, Human
ucacgccucccaucaagaagugg

SEQ ID NO: 110770 - RNA, 20 nt, Human
ucagucaaggcuggccuccc

SEQ ID NO: 110771 - RNA, 21 nt, Human
ucauucaagaucccccucuga

SEQ ID NO: 110772 - RNA, 23 nt, Human
uccacuagaagaaagggguucca

SEQ ID NO: 110773 - RNA, 24 nt, Human
ucccaugcaaaaugcagugaaaau

SEQ ID NO: 110774 - RNA, 18 nt, Human
ucccucuggucucugccc

SEQ ID NO: 110775 - RNA, 22 nt, Human
ucccugugacugcaggccacuc

SEQ ID NO: 110776 - RNA, 23 nt, Human
uccucuggcuguggcuguuugcc

SEQ ID NO: 110777 - RNA, 21 nt, Human
uccuugggugucccuggguug

SEQ ID NO: 110778 - RNA, 20 nt, Human
ucucuagaugccaucagcuu

SEQ ID NO: 110779 - RNA, 23 nt, Human
ugacugcaggccacucgaggcug

SEQ ID NO: 110780 - RNA, 19 nt, Human
ugagagaguccauugaggg

SEQ ID NO: 110781 - RNA, 21 nt, Human
ugcuggagagaugggcuuccc

SEQ ID NO: 110782 - RNA, 19 nt, Human
uggaacaccccuaucaccc

SEQ ID NO: 110783 - RNA, 20 nt, Human
uggcuguuugcccagaaagc

SEQ ID NO: 110784 - RNA, 22 nt, Human
uucaagaucccccucugaaccc

SEQ ID NO: 110785 - RNA, 22 nt, Human
uucugcuaucauuguugcagag

SEQ ID NO: 110786 - RNA, 20 nt, Human
aacucuguuacccagaggcc

SEQ ID NO: 110787 - RNA, 22 nt, Human
aacucuguuacccagaggcccu

SEQ ID NO: 110788 - RNA, 22 nt, Human
acagcuuuacagaaucauaauc

SEQ ID NO: 110789 - RNA, 18 nt, Human
accaggaggcggcccgcg

SEQ ID NO: 110790 - RNA, 23 nt, Human
acucuguuacccagaggcccuag

SEQ ID NO: 110791 - RNA, 24 nt, Human
auuaaaaaauaaaaaaucauacaa

SEQ ID NO: 110792 - RNA, 21 nt, Human
cacgccucgcacagagacugg

SEQ ID NO: 110793 - RNA, 25 nt, Human
cacucuuuuuuuuuuucagaagcca

SEQ ID NO: 110794 - RNA, 22 nt, Human
cagaaaacacugcggugcgaac

SEQ ID NO: 110795 - RNA, 19 nt, Human
caggaggcggcccgcgcug

SEQ ID NO: 110796 - RNA, 20 nt, Human
caggguggcgagaccccgcc

SEQ ID NO: 110797 - RNA, 26 nt, Human
caguacaaagaggccaauauguuaga

SEQ ID NO: 110798 - RNA, 20 nt, Human
ccagaggcccuagcaaccag

SEQ ID NO: 110799 - RNA, 25 nt, Human
ccuccagguaccacugaauacuuuu

SEQ ID NO: 110800 - RNA, 18 nt, Human
cugugugcuuaggugccc

SEQ ID NO: 110801 - RNA, 23 nt, Human
gcaaccaggaggcggcccgcgcu

SEQ ID NO: 110802 - RNA, 22 nt, Human
ggaaaugcguguucuagcuuuc

SEQ ID NO: 110803 - RNA, 22 nt, Human
ggaaauguaguguccgugaaaa

SEQ ID NO: 110804 - RNA, 22 nt, Human
uaaaaaauaaaaaaucauacaa

SEQ ID NO: 110805 - RNA, 19 nt, Human
uaagagguuacaguauaac

SEQ ID NO: 110806 - RNA, 20 nt, Human
uacaaagaggccaauauguu

SEQ ID NO: 110807 - RNA, 20 nt, Human
uccagggccgcagcgugaga

SEQ ID NO: 110808 - RNA, 22 nt, Human
ucugaacucuguuacccagagg

SEQ ID NO: 110809 - RNA, 20 nt, Human
ugguacuuaacgcgcgcgcg

SEQ ID NO: 110810 - RNA, 24 nt, Human
uguugcaugcugggcuauguaguu

SEQ ID NO: 110811 - RNA, 18 nt, Human
uuuuccaguacaaagagg

SEQ ID NO: 110812 - RNA, 23 nt, Human
uuuuuuuuucagaagccaauguu

SEQ ID NO: 110813 - RNA, 20 nt, Human
aaaguccagggucccuuggg

SEQ ID NO: 110814 - RNA, 24 nt, Human
aagaccccaggaggggacaaaaug

SEQ ID NO: 110815 - RNA, 19 nt, Human
acuccuggacccagggagu

SEQ ID NO: 110816 - RNA, 19 nt, Human
agaaggcagagccaagcug

SEQ ID NO: 110817 - RNA, 21 nt, Human
agagagcagcccgggagggag

SEQ ID NO: 110818 - RNA, 25 nt, Human
agagguauugcugacggcccgaggc

SEQ ID NO: 110819 - RNA, 19 nt, Human
agcagugccaggcuccugg

SEQ ID NO: 110820 - RNA, 18 nt, Human
aggcagagccaagcuggg

SEQ ID NO: 110821 - RNA, 21 nt, Human
agggagagagccgccugggcu

SEQ ID NO: 110822 - RNA, 18 nt, Human
agggucccuuggguggcg

SEQ ID NO: 110823 - RNA, 18 nt, Human
aucgacacacucagcaaa

SEQ ID NO: 110824 - RNA, 24 nt, Human
auggaagcagccgcauauucuaca

SEQ ID NO: 110825 - RNA, 22 nt, Human
auuaugguggcaaaggugcagg

SEQ ID NO: 110826 - RNA, 23 nt, Human
caaauggaagcagccgcauauuc

SEQ ID NO: 110827 - RNA, 21 nt, Human
caagaccccaggaggggacaa

SEQ ID NO: 110828 - RNA, 23 nt, Human
cacacugcagaaggcagagccaa

SEQ ID NO: 110829 - RNA, 19 nt, Human
cacaugugacacaugagga

SEQ ID NO: 110830 - RNA, 20 nt, Human
cacaugugacacaugaggau

SEQ ID NO: 110831 - RNA, 18 nt, Human
cacugcagaaggcagagc

SEQ ID NO: 110832 - RNA, 19 nt, Human
cagcacagggccuugaugg

SEQ ID NO: 110833 - RNA, 20 nt, Human
cagcacagggccuugaugga

SEQ ID NO: 110834 - RNA, 19 nt, Human
cagggagggcauccgggca

SEQ ID NO: 110835 - RNA, 19 nt, Human
cauccgggcacucagaggu

SEQ ID NO: 110836 - RNA, 19 nt, Human
ccagucccccagaggggcu

SEQ ID NO: 110837 - RNA, 22 nt, Human
ccagucccccagaggggcucug

SEQ ID NO: 110838 - RNA, 20 nt, Human
cccugucucaggucugaggc

SEQ ID NO: 110839 - RNA, 19 nt, Human
ccuguaacacgaaugucac

SEQ ID NO: 110840 - RNA, 21 nt, Human
ccuguaacacgaaugucaccu

SEQ ID NO: 110841 - RNA, 22 nt, Human
cgccugggcugaggccggugcu

SEQ ID NO: 110842 - RNA, 21 nt, Human
cgggcacagggaaaaggcuga

SEQ ID NO: 110843 - RNA, 21 nt, Human
cuaguggcuccucucaacccu

SEQ ID NO: 110844 - RNA, 20 nt, Human
cucaacccugacgucuggcc

SEQ ID NO: 110845 - RNA, 18 nt, Human
cucagagguauugcugac

SEQ ID NO: 110846 - RNA, 24 nt, Human
cugcuuccuuguccagcccugucu

SEQ ID NO: 110847 - RNA, 23 nt, Human
cuggagaaauggaagggugcagg

SEQ ID NO: 110848 - RNA, 26 nt, Human
cugggauggugcuaguggcuccucuc

SEQ ID NO: 110849 - RNA, 21 nt, Human
gcgaugcagccacuuccccac

SEQ ID NO: 110850 - RNA, 21 nt, Human
ggcaaaguccagggucccuug

SEQ ID NO: 110851 - RNA, 21 nt, Human
ggccggugcugacagcucugg

SEQ ID NO: 110852 - RNA, 18 nt, Human
gggaaaaggcugaaggag

SEQ ID NO: 110853 - RNA, 21 nt, Human
gggugcagggagggcauccgg

SEQ ID NO: 110854 - RNA, 23 nt, Human
gguacaggaagcucagggagaga

SEQ ID NO: 110855 - RNA, 21 nt, Human
gguggcgaugcagccacuucc

SEQ ID NO: 110856 - RNA, 21 nt, Human
guccagggucccuuggguggc

SEQ ID NO: 110857 - RNA, 20 nt, Human
uaguggcuccucucaacccu

SEQ ID NO: 110858 - RNA, 20 nt, Human
ucacaaaggauuccaggaga

SEQ ID NO: 110859 - RNA, 18 nt, Human
ucagcaaauggaagcagc

SEQ ID NO: 110860 - RNA, 19 nt, Human
uccagggucccuugggugg

SEQ ID NO: 110861 - RNA, 22 nt, Human
uccccacagcccacagcuucug

SEQ ID NO: 110862 - RNA, 21 nt, Human
ucccuuggguggcgaugcagc

SEQ ID NO: 110863 - RNA, 24 nt, Human
uccuggacccagggagugugggcc

SEQ ID NO: 110864 - RNA, 22 nt, Human
ucgggcacagggaaaaggcuga

SEQ ID NO: 110865 - RNA, 22 nt, Human
ucuacacuccuggacccaggga

SEQ ID NO: 110866 - RNA, 26 nt, Human
ucucccugugaaaacgguggaggaag

SEQ ID NO: 110867 - RNA, 23 nt, Human
ucugaggcuggagagggucaggg

SEQ ID NO: 110868 - RNA, 24 nt, Human
ucugaggcuggagagggucagggu

SEQ ID NO: 110869 - RNA, 20 nt, Human
ucugcuuuucuucugcucuc

SEQ ID NO: 110870 - RNA, 20 nt, Human
ucuggcaaaguccagggucc

SEQ ID NO: 110871 - RNA, 21 nt, Human
ugcagggagggcauccgggca

SEQ ID NO: 110872 - RNA, 24 nt, Human
uggagaaauggaagggugcaggga

SEQ ID NO: 110873 - RNA, 25 nt, Human
uggagagagcagcccgggagggagu

SEQ ID NO: 110874 - RNA, 21 nt, Human
uggcuucaguguguuacucac

SEQ ID NO: 110875 - RNA, 21 nt, Human
ugggauggugcuaguggcucc

SEQ ID NO: 110876 - RNA, 30 nt, Human
ugggccauuaugguggcaaaggugcagggg

SEQ ID NO: 110877 - RNA, 19 nt, Human
ugucucaggucugaggcug

SEQ ID NO: 110878 - RNA, 22 nt, Human
ugucucaggucugaggcuggag

SEQ ID NO: 110879 - RNA, 24 nt, Human
uuuuuggccuacacauugucauuu

SEQ ID NO: 110880 - RNA, 18 nt, Human
uuuuuuuuuuuuuuuuug

SEQ ID NO: 110881 - RNA, 22 nt, Human
uuuuuuuuuuuuuuuuuuuggc

SEQ ID NO: 110882 - RNA, 28 nt, Human
uuuuuuuuuuuuuuuuuuuuuuuggggg

SEQ ID NO: 110883 - RNA, 19 nt, Human
aaaaauaauaaacaugcug

SEQ ID NO: 110884 - RNA, 18 nt, Human
aaacaaacagggauauac

SEQ ID NO: 110885 - RNA, 19 nt, Human
aaauacaaaaauuagcugg

SEQ ID NO: 110886 - RNA, 20 nt, Human
aacauggugaaaucccaucu

SEQ ID NO: 110887 - RNA, 21 nt, Human
aacauggugaaaucccaucuc

SEQ ID NO: 110888 - RNA, 18 nt, Human
aaucgcuugaaucuggga

SEQ ID NO: 110889 - RNA, 18 nt, Human
acugcacuccagccuggg

SEQ ID NO: 110890 - RNA, 19 nt, Human
acugcacuccagccugggc

SEQ ID NO: 110891 - RNA, 25 nt, Human
acugcacuccagccugggcgaagag

SEQ ID NO: 110892 - RNA, 21 nt, Human
acugcagugagccgagaucgc

SEQ ID NO: 110893 - RNA, 24 nt, Human
acuuugggaggcugaggugggcag

SEQ ID NO: 110894 - RNA, 19 nt, Human
agaucaggaguucaagucc

SEQ ID NO: 110895 - RNA, 24 nt, Human
agcacuuugggaggcugagguggg

SEQ ID NO: 110896 - RNA, 23 nt, Human
agccugggcgaagagcgagacuc

SEQ ID NO: 110897 - RNA, 22 nt, Human
agcuggaaaucgcuugaaucug

SEQ ID NO: 110898 - RNA, 24 nt, Human
agcuuggccaacauggugaaaucc

SEQ ID NO: 110899 - RNA, 21 nt, Human
aggcugaggugggcagaucac

SEQ ID NO: 110900 - RNA, 24 nt, Human
aggcugaggugggcagaucacuug

SEQ ID NO: 110901 - RNA, 21 nt, Human
aggugaagacugcagugagcc

SEQ ID NO: 110902 - RNA, 24 nt, Human
aggugaagacugcagugagccgag

SEQ ID NO: 110903 - RNA, 22 nt, Human
aggugggcagaucacuugagau

SEQ ID NO: 110904 - RNA, 26 nt, Human
aggugggcagaucacuugagaucagg

SEQ ID NO: 110905 - RNA, 24 nt, Human
aucgcgccacugcacuccagccug

SEQ ID NO: 110906 - RNA, 24 nt, Human
caacauggugaaaucccaucucua

SEQ ID NO: 110907 - RNA, 20 nt, Human
caccaaagcacauuuuccuc

SEQ ID NO: 110908 - RNA, 23 nt, Human
cacuccagccugggcgaagagcg

SEQ ID NO: 110909 - RNA, 19 nt, Human
cacugcacuccagccuggg

SEQ ID NO: 110910 - RNA, 20 nt, Human
cacugcacuccagccugggc

SEQ ID NO: 110911 - RNA, 22 nt, Human
cacugcacuccagccugggcga

SEQ ID NO: 110912 - RNA, 23 nt, Human
cacugcacuccagccugggcgaa

SEQ ID NO: 110913 - RNA, 27 nt, Human
cacugcacuccagccugggcgaagagc

SEQ ID NO: 110914 - RNA, 27 nt, Human
cagaucacuugagaucaggaguucaag

SEQ ID NO: 110915 - RNA, 24 nt, Human
cagcacuuugggaggcugaggugg

SEQ ID NO: 110916 - RNA, 24 nt, Human
cagcuuggccaacauggugaaauc

SEQ ID NO: 110917 - RNA, 24 nt, Human
cauaucuguaauaccagcacuuug

SEQ ID NO: 110918 - RNA, 21 nt, Human
cauggaaaaauuucccaacug

SEQ ID NO: 110919 - RNA, 20 nt, Human
ccacugcacuccagccuggg

SEQ ID NO: 110920 - RNA, 21 nt, Human
ccacugcacuccagccugggc

SEQ ID NO: 110921 - RNA, 21 nt, Human
ccacugcacuccagccugggc

SEQ ID NO: 110922 - RNA, 22 nt, Human
ccacugcacuccagccugggcg

SEQ ID NO: 110923 - RNA, 23 nt, Human
ccacugcacuccagccugggcga

SEQ ID NO: 110924 - RNA, 22 nt, Human
cccaucucuacuaaaaauacaa

SEQ ID NO: 110925 - RNA, 21 nt, Human
ccugggcgaagagcgagacuc

SEQ ID NO: 110926 - RNA, 22 nt, Human
cugcagugagccgagaucgcgc

SEQ ID NO: 110927 - RNA, 23 nt, Human
cuuggccaacauggugaaauccc

SEQ ID NO: 110928 - RNA, 20 nt, Human
cuuugucuucuagaagugga

SEQ ID NO: 110929 - RNA, 21 nt, Human
gaaaauacagacacugacaag

SEQ ID NO: 110930 - RNA, 24 nt, Human
gaagacugcagugagccgagaucg

SEQ ID NO: 110931 - RNA, 23 nt, Human
gagaucgcgccacugcacuccag

SEQ ID NO: 110932 - RNA, 23 nt, Human
gaucacuugagaucaggaguuca

SEQ ID NO: 110933 - RNA, 24 nt, Human
gaucacuugagaucaggaguucaa

SEQ ID NO: 110934 - RNA, 24 nt, Human
gccaacauggugaaaucccaucuc

SEQ ID NO: 110935 - RNA, 22 nt, Human
gccacugcacuccagccugggc

SEQ ID NO: 110936 - RNA, 24 nt, Human
gccacugcacuccagccugggcga

SEQ ID NO: 110937 - RNA, 20 nt, Human
gccgagaucgcgccacugca

SEQ ID NO: 110938 - RNA, 18 nt, Human
gggaggugaagacugcag

SEQ ID NO: 110939 - RNA, 26 nt, Human
gggcagaucacuugagaucaggaguu

SEQ ID NO: 110940 - RNA, 20 nt, Human
ucacugguguauccaaacaa

SEQ ID NO: 110941 - RNA, 23 nt, Human
ucacuugagaucaggaguucaag

SEQ ID NO: 110942 - RNA, 21 nt, Human
ucaguugugaaaaaucccaag

SEQ ID NO: 110943 - RNA, 23 nt, Human
ucauaucuguaauaccagcacuu

SEQ ID NO: 110944 - RNA, 22 nt, Human
uccagccugggcgaagagcgag

SEQ ID NO: 110945 - RNA, 23 nt, Human
uccagccugggcgaagagcgaga

SEQ ID NO: 110946 - RNA, 23 nt, Human
ucgcgccacugcacuccagccug

SEQ ID NO: 110947 - RNA, 18 nt, Human
ucgcuugaaucugggagg

SEQ ID NO: 110948 - RNA, 19 nt, Human
ucucaguuacuucaaauac

SEQ ID NO: 110949 - RNA, 23 nt, Human
ucucuacuaaaaauacaaaaauu

SEQ ID NO: 110950 - RNA, 22 nt, Human
ugaaaaaucccaagauauaaag

SEQ ID NO: 110951 - RNA, 23 nt, Human
ugacaaguuaaucaguuuauauc

SEQ ID NO: 110952 - RNA, 22 nt, Human
ugagccgagaucgcgccacugc

SEQ ID NO: 110953 - RNA, 24 nt, Human
ugagcguaugugaaaaaaucagaa

SEQ ID NO: 110954 - RNA, 18 nt, Human
ugaggugggcagaucacu

SEQ ID NO: 110955 - RNA, 26 nt, Human
ugaggugggcagaucacuugagauca

SEQ ID NO: 110956 - RNA, 22 nt, Human
uggccaacauggugaaauccca

SEQ ID NO: 110957 - RNA, 24 nt, Human
uggccaacauggugaaaucccauc

SEQ ID NO: 110958 - RNA, 20 nt, Human
ugggaggcugaggugggcag

SEQ ID NO: 110959 - RNA, 24 nt, Human
ugggaggcugaggugggcagauca

SEQ ID NO: 110960 - RNA, 29 nt, Human
ugggaggugaagacugcagugacaacggu

SEQ ID NO: 110961 - RNA, 24 nt, Human
ugggaggugaagacugcagugagc

SEQ ID NO: 110962 - RNA, 24 nt, Human
ugggcagaucacuugagaucagga

SEQ ID NO: 110963 - RNA, 24 nt, Human
uugaaucugggaggugaagacugc

SEQ ID NO: 110964 - RNA, 23 nt, Human
uuggccaacauggugaaauccca

SEQ ID NO: 110965 - RNA, 25 nt, Human
uugggaggcugaggugggcagauca

SEQ ID NO: 110966 - RNA, 22 nt, Human
aaaaagccuaaaaacaccuugc

SEQ ID NO: 110967 - RNA, 25 nt, Human
aaaaagccuaaaaacaccuugcaga

SEQ ID NO: 110968 - RNA, 23 nt, Human
aaaacucucaguugucagcuuuu

SEQ ID NO: 110969 - RNA, 22 nt, Human
aaaagaggagagagaaaaagga

SEQ ID NO: 110970 - RNA, 25 nt, Human
aaaccuggcacuucacugggacuga

SEQ ID NO: 110971 - RNA, 22 nt, Human
aaagcuuugccuugggaugcaa

SEQ ID NO: 110972 - RNA, 18 nt, Human
aaaugaccucaaaugggg

SEQ ID NO: 110973 - RNA, 20 nt, Human
aagaaagaaaaaaggaaagg

SEQ ID NO: 110974 - RNA, 21 nt, Human
aagaaagaaaaaaggaaagga

SEQ ID NO: 110975 - RNA, 24 nt, Human
aagaaggaagaagaaagaaaaaag

SEQ ID NO: 110976 - RNA, 20 nt, Human
aagaggagagagaaaaagga

SEQ ID NO: 110977 - RNA, 21 nt, Human
aaggaaaggaagaagaaagga

SEQ ID NO: 110978 - RNA, 23 nt, Human
aaggaagaagaaagaaaaaagga

SEQ ID NO: 110979 - RNA, 23 nt, Human
aaggaagaagaaaggaaaaagga

SEQ ID NO: 110980 - RNA, 18 nt, Human
aaguuggacaggagaaag

SEQ ID NO: 110981 - RNA, 18 nt, Human
aauaggucaccuagggcc

SEQ ID NO: 110982 - RNA, 22 nt, Human
agaaaaaaggaaaggaagaaga

SEQ ID NO: 110983 - RNA, 19 nt, Human
agaaagaagaaagacucau

SEQ ID NO: 110984 - RNA, 20 nt, Human
agaaaggaaaaaggaaagaa

SEQ ID NO: 110985 - RNA, 21 nt, Human
agaagaaaggaaaaaggaaag

SEQ ID NO: 110986 - RNA, 18 nt, Human
agaaggaagaagaaagaa

SEQ ID NO: 110987 - RNA, 23 nt, Human
agcccugccuggugcaguguuuc

SEQ ID NO: 110988 - RNA, 22 nt, Human
aggaaaaaggaaagaaagaaga

SEQ ID NO: 110989 - RNA, 18 nt, Human
aggaaagaaagaagaaag

SEQ ID NO: 110990 - RNA, 21 nt, Human
aggaagaaagaaggaagaaga

SEQ ID NO: 110991 - RNA, 22 nt, Human
aggaagaagaaagaaaaaagga

SEQ ID NO: 110992 - RNA, 18 nt, Human
aggaagaagaaaggaaaa

SEQ ID NO: 110993 - RNA, 22 nt, Human
aggaagaagaaaggaaaaagga

SEQ ID NO: 110994 - RNA, 19 nt, Human
aggaggaaaagaggagaga

SEQ ID NO: 110995 - RNA, 20 nt, Human
agugaaggauggaauuugag

SEQ ID NO: 110996 - RNA, 22 nt, Human
caaucacggaacucaaaaauau

SEQ ID NO: 110997 - RNA, 18 nt, Human
caccuagggcccugacuc

SEQ ID NO: 110998 - RNA, 21 nt, Human
cacuucacugggacugagaca

SEQ ID NO: 110999 - RNA, 19 nt, Human
cagauuaagaaauaugccu

SEQ ID NO: 111000 - RNA, 19 nt, Human
ccauagcacucccaaaagc

SEQ ID NO: 111001 - RNA, 22 nt, Human
ccaugccacacagcugcggcca

SEQ ID NO: 111002 - RNA, 23 nt, Human
ccaugccacacagcugcggccac

SEQ ID NO: 111003 - RNA, 24 nt, Human
ccaugccacacagcugcggccaca

SEQ ID NO: 111004 - RNA, 21 nt, Human
cucucaggcagucacacagcu

SEQ ID NO: 111005 - RNA, 21 nt, Human
cugacucaagaauggaggaua

SEQ ID NO: 111006 - RNA, 19 nt, Human
cuguacauagcucuccucc

SEQ ID NO: 111007 - RNA, 19 nt, Human
gaaaaaggaagaaagaagg

SEQ ID NO: 111008 - RNA, 18 nt, Human
gaaaggaagaagaaagga

SEQ ID NO: 111009 - RNA, 18 nt, Human
gaagaagaaaggaaaaag

SEQ ID NO: 111010 - RNA, 23 nt, Human
gaaggaagaagaaagaaaaaagg

SEQ ID NO: 111011 - RNA, 20 nt, Human
gauaccuugcacuuugcaaa

SEQ ID NO: 111012 - RNA, 20 nt, Human
ggauuugcuucacagauuuu

SEQ ID NO: 111013 - RNA, 21 nt, Human
ggugaaguuggacaggagaaa

SEQ ID NO: 111014 - RNA, 22 nt, Human
uaaaaaaguaaugagaguccug

SEQ ID NO: 111015 - RNA, 24 nt, Human
uaaauaaucuuucauuuauaagaa

SEQ ID NO: 111016 - RNA, 27 nt, Human
uaagaaauaugccucaaaccggggccc

SEQ ID NO: 111017 - RNA, 21 nt, Human
uacaccauuccaaccuucaau

SEQ ID NO: 111018 - RNA, 23 nt, Human
uacaccauuccaaccuucaaucu

SEQ ID NO: 111019 - RNA, 24 nt, Human
uauguuguaccuucagcuuccugu

SEQ ID NO: 111020 - RNA, 24 nt, Human
ucaacccugaccaaguuccaugcc

SEQ ID NO: 111021 - RNA, 18 nt, Human
ucaagaauggaggauagg

SEQ ID NO: 111022 - RNA, 22 nt, Human
ucaaucuaaaaugcucucccug

SEQ ID NO: 111023 - RNA, 24 nt, Human
ucacaaucaaaccuggcacuucac

SEQ ID NO: 111024 - RNA, 21 nt, Human
ucacacagcuuucaaagggug

SEQ ID NO: 111025 - RNA, 18 nt, Human
uccaugccacacagcugc

SEQ ID NO: 111026 - RNA, 21 nt, Human
ucccaaaagccaggguuucua

SEQ ID NO: 111027 - RNA, 22 nt, Human
ucuaaaaugcucucccuguaca

SEQ ID NO: 111028 - RNA, 21 nt, Human
ucuucuaaaacucucaguugu

SEQ ID NO: 111029 - RNA, 19 nt, Human
ugaagcaggagacagaugc

SEQ ID NO: 111030 - RNA, 21 nt, Human
ugaaugggcaguuugcaaaga

SEQ ID NO: 111031 - RNA, 23 nt, Human
ugaaugggcaguuugcaaagaua

SEQ ID NO: 111032 - RNA, 20 nt, Human
ugacagucgacccugugaag

SEQ ID NO: 111033 - RNA, 21 nt, Human
ugacuaaauaaucuuucauuu

SEQ ID NO: 111034 - RNA, 18 nt, Human
ugagaaggaggggauguc

SEQ ID NO: 111035 - RNA, 20 nt, Human
ugagaaggaggggaugucuc

SEQ ID NO: 111036 - RNA, 22 nt, Human
ugagaaggaggggaugucucuu

SEQ ID NO: 111037 - RNA, 23 nt, Human
ugagccaaaagcuuugccuuggg

SEQ ID NO: 111038 - RNA, 21 nt, Human
ugccacacagcugcggccaca

SEQ ID NO: 111039 - RNA, 26 nt, Human
ugccauagcacucccaaaagccaggg

SEQ ID NO: 111040 - RNA, 22 nt, Human
ugggugaaugggcaguuugcaa

SEQ ID NO: 111041 - RNA, 19 nt, Human
uuaaaaagccuaaaaacac

SEQ ID NO: 111042 - RNA, 21 nt, Human
uucaaagggugaguagagcug

SEQ ID NO: 111043 - RNA, 18 nt, Human
uuccauaaaaaaguaaug

SEQ ID NO: 111044 - RNA, 18 nt, Human
uucuccuaacugagaugc

SEQ ID NO: 111045 - RNA, 23 nt, Human
uuuuuuuuuuuuuuuuuauuuuu

SEQ ID NO: 111046 - RNA, 24 nt, Human
aaagcacugggauuauaggcauga

SEQ ID NO: 111047 - RNA, 24 nt, Human
aaagcuucccauguauuggagccu

SEQ ID NO: 111048 - RNA, 21 nt, Human
acaaauuccugaggggaaacc

SEQ ID NO: 111049 - RNA, 25 nt, Human
aggaacagucaggaaaagguagggc

SEQ ID NO: 111050 - RNA, 20 nt, Human
aggcaugagccaccaugccc

SEQ ID NO: 111051 - RNA, 21 nt, Human
aggcaugagccaccaugcccg

SEQ ID NO: 111052 - RNA, 19 nt, Human
aggggcgcagcgggcgcug

SEQ ID NO: 111053 - RNA, 24 nt, Human
agguggggcgcuggggcgaggggc

SEQ ID NO: 111054 - RNA, 20 nt, Human
agugauccuccugcuucggc

SEQ ID NO: 111055 - RNA, 21 nt, Human
augaacuuuaaaaguggaaaa

SEQ ID NO: 111056 - RNA, 25 nt, Human
auuuuguucuuaaaaagaggaacag

SEQ ID NO: 111057 - RNA, 24 nt, Human
caaagcacugggauuauaggcaug

SEQ ID NO: 111058 - RNA, 24 nt, Human
cacacauucaauaacacuuuacuu

SEQ ID NO: 111059 - RNA, 18 nt, Human
cagccaggaauugcaggu

SEQ ID NO: 111060 - RNA, 19 nt, Human
cagccaggaauugcaggug

SEQ ID NO: 111061 - RNA, 23 nt, Human
cagugauccuccugcuucggcuu

SEQ ID NO: 111062 - RNA, 24 nt, Human
ccaaagcacugggauuauaggcau

SEQ ID NO: 111063 - RNA, 18 nt, Human
ccagccaggaauugcagg

SEQ ID NO: 111064 - RNA, 20 nt, Human
ccagugauccuccugcuucg

SEQ ID NO: 111065 - RNA, 22 nt, Human
cccaaagcacugggauuauagg

SEQ ID NO: 111066 - RNA, 21 nt, Human
cccaugaacuuuaaaagugga

SEQ ID NO: 111067 - RNA, 19 nt, Human
ccggcagugaaguauuuuc

SEQ ID NO: 111068 - RNA, 21 nt, Human
cgcgcgggauccgccucaccc

SEQ ID NO: 111069 - RNA, 22 nt, Human
cgcuauguugcccagucugcuc

SEQ ID NO: 111070 - RNA, 18 nt, Human
cuccagugauccuccugc

SEQ ID NO: 111071 - RNA, 23 nt, Human
gaaaccccacacauucaauaaca

SEQ ID NO: 111072 - RNA, 21 nt, Human
gauuauaggcaugagccacca

SEQ ID NO: 111073 - RNA, 24 nt, Human
gauuauaggcaugagccaccaugc

SEQ ID NO: 111074 - RNA, 19 nt, Human
gccgugggggaaggugggg

SEQ ID NO: 111075 - RNA, 24 nt, Human
gccugcuuagaugccaaccgccag

SEQ ID NO: 111076 - RNA, 18 nt, Human
gcucuccaacucuuggcc

SEQ ID NO: 111077 - RNA, 24 nt, Human
gcuucggcuucccaaagcacuggg

SEQ ID NO: 111078 - RNA, 24 nt, Human
ggauuauaggcaugagccaccaug

SEQ ID NO: 111079 - RNA, 19 nt, Human
ggccuccagugauccuccu

SEQ ID NO: 111080 - RNA, 19 nt, Human
gggcgcuggggacacaccu

SEQ ID NO: 111081 - RNA, 23 nt, Human
gggcgcuggggacacaccugcug

SEQ ID NO: 111082 - RNA, 24 nt, Human
uagaugccaaccgccagccaggaa

SEQ ID NO: 111083 - RNA, 21 nt, Human
ucacccaugaacuuuaaaagu

SEQ ID NO: 111084 - RNA, 19 nt, Human
ucagagcugcagccacuga

SEQ ID NO: 111085 - RNA, 24 nt, Human
ucccaaagcacugggauuauaggc

SEQ ID NO: 111086 - RNA, 23 nt, Human
ucgaacacuugaugcaacuuguc

SEQ ID NO: 111087 - RNA, 18 nt, Human
ucucgcuauguugcccag

SEQ ID NO: 111088 - RNA, 18 nt, Human
ucucgcuauguugcccag

SEQ ID NO: 111089 - RNA, 19 nt, Human
ucucgcuauguugcccagu

SEQ ID NO: 111090 - RNA, 22 nt, Human
ucucgcuauguugcccagucug

SEQ ID NO: 111091 - RNA, 23 nt, Human
ugaggucucgcuauguugcccag

SEQ ID NO: 111092 - RNA, 18 nt, Human
ugcuggaacugcgcgcgg

SEQ ID NO: 111093 - RNA, 20 nt, Human
uggccuccagugauccuccu

SEQ ID NO: 111094 - RNA, 24 nt, Human
uggccuccagugauccuccugcuu

SEQ ID NO: 111095 - RNA, 23 nt, Human
uggcgugcuggcgggacggucag

SEQ ID NO: 111096 - RNA, 18 nt, Human
ugggauuauaggcaugag

SEQ ID NO: 111097 - RNA, 22 nt, Human
ugggauuauaggcaugagccac

SEQ ID NO: 111098 - RNA, 23 nt, Human
ugggauuauaggcaugagccacc

SEQ ID NO: 111099 - RNA, 24 nt, Human
ugggauuauaggcaugagccacca

SEQ ID NO: 111100 - RNA, 25 nt, Human
ugggauuauaggcaugagccaccau

SEQ ID NO: 111101 - RNA, 23 nt, Human
uggggcgcuggggcgaggggcgc

SEQ ID NO: 111102 - RNA, 20 nt, Human
uguuagacaaauuccugagg

SEQ ID NO: 111103 - RNA, 22 nt, Human
uucccauguauuggagccucau

SEQ ID NO: 111104 - RNA, 23 nt, Human
aaaagaaaaagaauuugguggca

SEQ ID NO: 111105 - RNA, 21 nt, Human
aaacaagaaguuccaaucuga

SEQ ID NO: 111106 - RNA, 18 nt, Human
aaacaggauagcuugggg

SEQ ID NO: 111107 - RNA, 22 nt, Human
aaagaagaaauuaaacacaaua

SEQ ID NO: 111108 - RNA, 21 nt, Human
aaauagccucauuacacagac

SEQ ID NO: 111109 - RNA, 18 nt, Human
aaauccugaaaaaaccaa

SEQ ID NO: 111110 - RNA, 20 nt, Human
aauccugaaaaaaccaacca

SEQ ID NO: 111111 - RNA, 19 nt, Human
accacugcaugaaaucaca

SEQ ID NO: 111112 - RNA, 18 nt, Human
acuacaugcaaaaacggu

SEQ ID NO: 111113 - RNA, 23 nt, Human
aggaaagaaccaaaggaaaagga

SEQ ID NO: 111114 - RNA, 24 nt, Human
auaagugucacuuuagccuguauc

SEQ ID NO: 111115 - RNA, 22 nt, Human
aucuauguuguaggcuuuuugg

SEQ ID NO: 111116 - RNA, 19 nt, Human
auuacaggguguaaaggga

SEQ ID NO: 111117 - RNA, 18 nt, Human
caaugugauuuugccagu

SEQ ID NO: 111118 - RNA, 22 nt, Human
cacaauaaaaauuaagagaaaa

SEQ ID NO: 111119 - RNA, 21 nt, Human
cacuacaugcaaaaacgguga

SEQ ID NO: 111120 - RNA, 25 nt, Human
cacuacaugcaaaaacggugacucu

SEQ ID NO: 111121 - RNA, 22 nt, Human
caggggacuguuccaaaaauca

SEQ ID NO: 111122 - RNA, 21 nt, Human
cauauucccuuaaauccugaa

SEQ ID NO: 111123 - RNA, 20 nt, Human
ccuucagucccagcugcugg

SEQ ID NO: 111124 - RNA, 23 nt, Human
cggagaauagggauggcuuuuaa

SEQ ID NO: 111125 - RNA, 22 nt, Human
cggugacucuaucaaaugaugc

SEQ ID NO: 111126 - RNA, 18 nt, Human
cuaacacuacaugcaaaa

SEQ ID NO: 111127 - RNA, 23 nt, Human
cucauuacacagaacuugauguu

SEQ ID NO: 111128 - RNA, 24 nt, Human
cuuaaauccugaaaaaaccaacca

SEQ ID NO: 111129 - RNA, 22 nt, Human
cuucucauucagaaagcuucau

SEQ ID NO: 111130 - RNA, 19 nt, Human
cuugaauuuucuuagauuu

SEQ ID NO: 111131 - RNA, 19 nt, Human
gaaaagcauaaauugcaau

SEQ ID NO: 111132 - RNA, 24 nt, Human
gaaaauaacugccaggcgaaaagc

SEQ ID NO: 111133 - RNA, 19 nt, Human
gagcaagcuaauaaaacug

SEQ ID NO: 111134 - RNA, 19 nt, Human
gccuuuguagccuccucac

SEQ ID NO: 111135 - RNA, 20 nt, Human
gcuaauaaaacuggaaggaa

SEQ ID NO: 111136 - RNA, 22 nt, Human
uaaaccuagaacaauuagccag

SEQ ID NO: 111137 - RNA, 22 nt, Human
uaaauccugaaaaaaccaacca

SEQ ID NO: 111138 - RNA, 18 nt, Human
uagaaacuaagcuaggga

SEQ ID NO: 111139 - RNA, 24 nt, Human
uagaaagauuuaaaaagaaaaaga

SEQ ID NO: 111140 - RNA, 18 nt, Human
uagugaaucacaucacag

SEQ ID NO: 111141 - RNA, 19 nt, Human
uaucaaaugaugcaguuua

SEQ ID NO: 111142 - RNA, 24 nt, Human
uaucaaaugaugcaguuuauuaua

SEQ ID NO: 111143 - RNA, 24 nt, Human
uaucagaugcuucagcccuauucu

SEQ ID NO: 111144 - RNA, 24 nt, Human
uaugucaaucugacauguguagag

SEQ ID NO: 111145 - RNA, 21 nt, Human
uauuaucagaugcuucagccc

SEQ ID NO: 111146 - RNA, 21 nt, Human
uccaaaaaucagacuucucau

SEQ ID NO: 111147 - RNA, 22 nt, Human
uccucauuugaaugaaaauaau

SEQ ID NO: 111148 - RNA, 23 nt, Human
ucucaagggucccagcaugucgu

SEQ ID NO: 111149 - RNA, 22 nt, Human
ucuucaggggacuguuccaaaa

SEQ ID NO: 111150 - RNA, 19 nt, Human
ucuuugggggacuuggaaa

SEQ ID NO: 111151 - RNA, 20 nt, Human
ucuuugggggacuuggaaau

SEQ ID NO: 111152 - RNA, 22 nt, Human
ugaauaaauuacaggguguaaa

SEQ ID NO: 111153 - RNA, 20 nt, Human
ugaauguuuauuugcauuga

SEQ ID NO: 111154 - RNA, 23 nt, Human
ugcaaugugauuuugccaguuug

SEQ ID NO: 111155 - RNA, 25 nt, Human
ugccaaagaagaaauuaaacacaau

SEQ ID NO: 111156 - RNA, 26 nt, Human
ugccaaagaagaaauuaaacacaaua

SEQ ID NO: 111157 - RNA, 18 nt, Human
ugccgaccaacauugguc

SEQ ID NO: 111158 - RNA, 19 nt, Human
uggaaggaagagacaucau

SEQ ID NO: 111159 - RNA, 23 nt, Human
uggaaggaagagacaucaucagg

SEQ ID NO: 111160 - RNA, 20 nt, Human
ugggggacuuggaaauagcc

SEQ ID NO: 111161 - RNA, 22 nt, Human
uguaacagugaccaucuuuggg

SEQ ID NO: 111162 - RNA, 20 nt, Human
uuaaacaagaaguuccaauc

SEQ ID NO: 111163 - RNA, 19 nt, Human
uuaaauccugaaaaaacca

SEQ ID NO: 111164 - RNA, 23 nt, Human
uuaauaaucuucuuauuaccacu

SEQ ID NO: 111165 - RNA, 20 nt, Human
uuacaggguguaaagggaaa

SEQ ID NO: 111166 - RNA, 25 nt, Human
uuagugaaucacaucacagccaaga

SEQ ID NO: 111167 - RNA, 24 nt, Human
uucacucuuucugcauacaaacuc

SEQ ID NO: 111168 - RNA, 25 nt, Human
uugggggggaaaauaacugccaggc

SEQ ID NO: 111169 - RNA, 21 nt, Human
uuguagccuccucacagcaug

SEQ ID NO: 111170 - RNA, 20 nt, Human
uuugccaguuugcuaauucu

SEQ ID NO: 111171 - RNA, 22 nt, Human
uuuguccauauucccuuaaauc

SEQ ID NO: 111172 - RNA, 23 nt, Human
uuuguccuuuucuuuuccuauua

SEQ ID NO: 111173 - RNA, 21 nt, Human
uuuguuaaaacccucucagca

SEQ ID NO: 111174 - RNA, 21 nt, Human
uuuuuuuuagguaaaaaguga

SEQ ID NO: 111175 - RNA, 21 nt, Human
aagcccccagugaggcaccaa

SEQ ID NO: 111176 - RNA, 18 nt, Human
aaggaagggggaaggcca

SEQ ID NO: 111177 - RNA, 22 nt, Human
aagggccagagccugacaggca

SEQ ID NO: 111178 - RNA, 23 nt, Human
aagggccagagccugacaggcac

SEQ ID NO: 111179 - RNA, 19 nt, Human
aggagccagcgaagacaag

SEQ ID NO: 111180 - RNA, 20 nt, Human
aggagccagcgaagacaagc

SEQ ID NO: 111181 - RNA, 21 nt, Human
ccagagccugacaggcacagg

SEQ ID NO: 111182 - RNA, 22 nt, Human
cccaaagcccccagugaggcac

SEQ ID NO: 111183 - RNA, 27 nt, Human
ccccuggggcucacaucccaauaaaua

SEQ ID NO: 111184 - RNA, 18 nt, Human
cccugauucccuggggga

SEQ ID NO: 111185 - RNA, 21 nt, Human
ccucaggccuucagggcuugg

SEQ ID NO: 111186 - RNA, 27 nt, Human
cgcccccaacuccaguaaagcuggucc

SEQ ID NO: 111187 - RNA, 18 nt, Human
cuccaguaaagcuggucc

SEQ ID NO: 111188 - RNA, 19 nt, Human
cuggucccugauucccugg

SEQ ID NO: 111189 - RNA, 24 nt, Human
gcaccaaaggaagggggaaggcca

SEQ ID NO: 111190 - RNA, 21 nt, Human
gccagagccugacaggcacag

SEQ ID NO: 111191 - RNA, 23 nt, Human
gcccaaagcccccagugaggcac

SEQ ID NO: 111192 - RNA, 25 nt, Human
gccucaggccuucagggcuuggguc

SEQ ID NO: 111193 - RNA, 20 nt, Human
gggccagagccugacaggca

SEQ ID NO: 111194 - RNA, 21 nt, Human
gggggaaggccacaaaggcaa

SEQ ID NO: 111195 - RNA, 23 nt, Human
ggguaggagccagcgaagacaag

SEQ ID NO: 111196 - RNA, 22 nt, Human
ucaggccuucagggcuuggguc

SEQ ID NO: 111197 - RNA, 23 nt, Human
ugaggcaccaaaggaagggggag

SEQ ID NO: 111198 - RNA, 19 nt, Human
aaaaagaaagugcucucau

SEQ ID NO: 111199 - RNA, 24 nt, Human
acugcgggaaugggguggggggca

SEQ ID NO: 111200 - RNA, 22 nt, Human
aggguccccuuccccccaaugg

SEQ ID NO: 111201 - RNA, 21 nt, Human
augggccccccgccagucugc

SEQ ID NO: 111202 - RNA, 22 nt, Human
augggguggggggcaggccgag

SEQ ID NO: 111203 - RNA, 21 nt, Human
caaugggccccccgccagucu

SEQ ID NO: 111204 - RNA, 25 nt, Human
cacucuucccuccucacauguuuuu

SEQ ID NO: 111205 - RNA, 26 nt, Human
cagagcggaggguccccuucccccca

SEQ ID NO: 111206 - RNA, 19 nt, Human
cagccaagagcagcagcag

SEQ ID NO: 111207 - RNA, 27 nt, Human
cagccaagagcagcagcagccucccuu

SEQ ID NO: 111208 - RNA, 21 nt, Human
cauuacaaacgccacugucac

SEQ ID NO: 111209 - RNA, 21 nt, Human
ccagccaagagcagcagcagc

SEQ ID NO: 111210 - RNA, 24 nt, Human
ccagccaagagcagcagcagccuc

SEQ ID NO: 111211 - RNA, 23 nt, Human
ccagugaaauagaaaaaaaagaa

SEQ ID NO: 111212 - RNA, 19 nt, Human
cccacugcgggaauggggu

SEQ ID NO: 111213 - RNA, 23 nt, Human
ccccccgccagucugcucucucc

SEQ ID NO: 111214 - RNA, 24 nt, Human
cccccgccagucugcucucuccaa

SEQ ID NO: 111215 - RNA, 21 nt, Human
ccccgccagucugcucucucc

SEQ ID NO: 111216 - RNA, 20 nt, Human
cccuuggggggaaaacaggg

SEQ ID NO: 111217 - RNA, 24 nt, Human
ccggaggcgacccgggucucuucc

SEQ ID NO: 111218 - RNA, 18 nt, Human
cggcugggccuggcuggg

SEQ ID NO: 111219 - RNA, 23 nt, Human
cugacgcugagaacagaggcagc

SEQ ID NO: 111220 - RNA, 24 nt, Human
cuucugguccuggggguacccacu

SEQ ID NO: 111221 - RNA, 18 nt, Human
gagaacagaggcagcggc

SEQ ID NO: 111222 - RNA, 22 nt, Human
gagcagcagcagccucccuugg

SEQ ID NO: 111223 - RNA, 18 nt, Human
gaggaugccaugcaggga

SEQ ID NO: 111224 - RNA, 19 nt, Human
gagggaguggggggacagc

SEQ ID NO: 111225 - RNA, 18 nt, Human
gcucccacugcgggaaug

SEQ ID NO: 111226 - RNA, 20 nt, Human
ggacacccggcucuauguug

SEQ ID NO: 111227 - RNA, 21 nt, Human
ggccgagccugggcucugggg

SEQ ID NO: 111228 - RNA, 25 nt, Human
gggaaaacagggaaggccuuguggc

SEQ ID NO: 111229 - RNA, 20 nt, Human
gggaaugggguggggggcag

SEQ ID NO: 111230 - RNA, 19 nt, Human
gggcaggccgagccugggc

SEQ ID NO: 111231 - RNA, 19 nt, Human
gggccccccgccagucugc

SEQ ID NO: 111232 - RNA, 19 nt, Human
uagcacuacagagcggagg

SEQ ID NO: 111233 - RNA, 24 nt, Human
uccaaacucuaacccuguagaggu

SEQ ID NO: 111234 - RNA, 18 nt, Human
uccccccaaugggccccc

SEQ ID NO: 111235 - RNA, 19 nt, Human
uccuuugggcgcuguuggg

SEQ ID NO: 111236 - RNA, 18 nt, Human
ucggcugggccuggcugg

SEQ ID NO: 111237 - RNA, 22 nt, Human
ugagggaguggggggacagcug

SEQ ID NO: 111238 - RNA, 22 nt, Human
ugagggaguggggggacagcug

SEQ ID NO: 111239 - RNA, 22 nt, Human
ugcacacucuucccuccucaca

SEQ ID NO: 111240 - RNA, 20 nt, Human
ugcagggagagggggucggc

SEQ ID NO: 111241 - RNA, 18 nt, Human
ugcgggaauggggugggg

SEQ ID NO: 111242 - RNA, 19 nt, Human
ugcuccagugaaauagaaa

SEQ ID NO: 111243 - RNA, 24 nt, Human
ugcuccagugaaauagaaaaaaaa

SEQ ID NO: 111244 - RNA, 26 nt, Human
uggcggcacugacgcugagaacagag

SEQ ID NO: 111245 - RNA, 18 nt, Human
uggcuggguccagccaag

SEQ ID NO: 111246 - RNA, 19 nt, Human
uggcuggguccagccaaga

SEQ ID NO: 111247 - RNA, 20 nt, Human
ugggcucugggggcuuugcu

SEQ ID NO: 111248 - RNA, 21 nt, Human
uggggggcaggccgagccugg

SEQ ID NO: 111249 - RNA, 26 nt, Human
ugggucucugggcaugcaguuugcuc

SEQ ID NO: 111250 - RNA, 21 nt, Human
uuggggggaaaacagggaagg

SEQ ID NO: 111251 - RNA, 26 nt, Human
uuuacagccauuuauugugcuccagu

SEQ ID NO: 111252 - RNA, 22 nt, Human
uuuuacagccauuuauugugcu

SEQ ID NO: 111253 - RNA, 23 nt, Human
aaaaaaaaaaaaaaagaugaaaa

SEQ ID NO: 111254 - RNA, 25 nt, Human
aaaaaaaaaagaugaaaacacagaa

SEQ ID NO: 111255 - RNA, 23 nt, Human
aaaaaaaagaugaaaacacagaa

SEQ ID NO: 111256 - RNA, 18 nt, Human
aaaaacccaaaaacccag

SEQ ID NO: 111257 - RNA, 22 nt, Human
aaacccaaaaacccagauggga

SEQ ID NO: 111258 - RNA, 21 nt, Human
aaagaugaaaacacagaaaaa

SEQ ID NO: 111259 - RNA, 23 nt, Human
aacacagaaaaacccaaaaaccc

SEQ ID NO: 111260 - RNA, 19 nt, Human
aacauggggaaaccccauc

SEQ ID NO: 111261 - RNA, 20 nt, Human
aacauggggaaaccccaucu

SEQ ID NO: 111262 - RNA, 21 nt, Human
aacauggggaaaccccaucuc

SEQ ID NO: 111263 - RNA, 23 nt, Human
aaccacaacugaaaaaaaaaucu

SEQ ID NO: 111264 - RNA, 24 nt, Human
aaucgcuugagcccggaaggugga

SEQ ID NO: 111265 - RNA, 22 nt, Human
acacagaaaaacccaaaaaccc

SEQ ID NO: 111266 - RNA, 25 nt, Human
acacagaaaaacccaaaaacccaga

SEQ ID NO: 111267 - RNA, 20 nt, Human
acagaaaaacccaaaaaccc

SEQ ID NO: 111268 - RNA, 21 nt, Human
acagaaaaacccaaaaaccca

SEQ ID NO: 111269 - RNA, 24 nt, Human
accccaucucuacuaaaaauacaa

SEQ ID NO: 111270 - RNA, 18 nt, Human
accccuucccccacagcc

SEQ ID NO: 111271 - RNA, 21 nt, Human
acggcccucacuuucuccacc

SEQ ID NO: 111272 - RNA, 18 nt, Human
acugcacuccagccuggg

SEQ ID NO: 111273 - RNA, 23 nt, Human
acugcacuccagccugggcaaca

SEQ ID NO: 111274 - RNA, 19 nt, Human
acuuggcggggcauguggc

SEQ ID NO: 111275 - RNA, 21 nt, Human
agaaaaaaaaaaaaaaagaug

SEQ ID NO: 111276 - RNA, 21 nt, Human
agaaaaacccaaaaacccaga

SEQ ID NO: 111277 - RNA, 22 nt, Human
agauggcgccacugcacuccag

SEQ ID NO: 111278 - RNA, 24 nt, Human
agccuggccaacauggggaaaccc

SEQ ID NO: 111279 - RNA, 19 nt, Human
aggaggcugaggcuggaga

SEQ ID NO: 111280 - RNA, 22 nt, Human
aggcaaaggggaaaaaagcucu

SEQ ID NO: 111281 - RNA, 23 nt, Human
aggcaaccagaaaccgucgggga

SEQ ID NO: 111282 - RNA, 20 nt, Human
aggcgaggcaaccagaaacc

SEQ ID NO: 111283 - RNA, 21 nt, Human
aggcggaggcgggcggaucac

SEQ ID NO: 111284 - RNA, 28 nt, Human
aggcgggcggaucacaccugaggccagg

SEQ ID NO: 111285 - RNA, 24 nt, Human
aggcugaggcuggagaaucgcuug

SEQ ID NO: 111286 - RNA, 24 nt, Human
aggcuggagaaucgcuugagcccg

SEQ ID NO: 111287 - RNA, 23 nt, Human
agggggucaggcuuagccccaac

SEQ ID NO: 111288 - RNA, 18 nt, Human
agguggaggugcagugag

SEQ ID NO: 111289 - RNA, 23 nt, Human
agguggaggugcagugagccaag

SEQ ID NO: 111290 - RNA, 20 nt, Human
auggagcaguauaagcuggu

SEQ ID NO: 111291 - RNA, 24 nt, Human
auggcgccacugcacuccagccug

SEQ ID NO: 111292 - RNA, 21 nt, Human
auguggggagagagcgugcug

SEQ ID NO: 111293 - RNA, 22 nt, Human
caaaaacccagaugggaagacg

SEQ ID NO: 111294 - RNA, 23 nt, Human
cacaccuguaaucucagcgcuug

SEQ ID NO: 111295 - RNA, 21 nt, Human
cacagaaaaacccaaaaaccc

SEQ ID NO: 111296 - RNA, 24 nt, Human
cacagaaaaacccaaaaacccaga

SEQ ID NO: 111297 - RNA, 24 nt, Human
caccugcaguccuagcuacucagg

SEQ ID NO: 111298 - RNA, 22 nt, Human
caccuguaaucucagcgcuugg

SEQ ID NO: 111299 - RNA, 23 nt, Human
caccuguaaucucagcgcuuggg

SEQ ID NO: 111300 - RNA, 20 nt, Human
cacucacagacccuugguug

SEQ ID NO: 111301 - RNA, 18 nt, Human
cacugcacuccagccugg

SEQ ID NO: 111302 - RNA, 19 nt, Human
cacugcacuccagccuggg

SEQ ID NO: 111303 - RNA, 21 nt, Human
cacugcacuccagccugggca

SEQ ID NO: 111304 - RNA, 23 nt, Human
cacugcacuccagccugggcaac

SEQ ID NO: 111305 - RNA, 24 nt, Human
cacugcacuccagccugggcaaca

SEQ ID NO: 111306 - RNA, 26 nt, Human
cacugcacuccagccugggcaacaac

SEQ ID NO: 111307 - RNA, 18 nt, Human
cagaaaaacccaaaaacc

SEQ ID NO: 111308 - RNA, 18 nt, Human
cagaauuucacuuccuug

SEQ ID NO: 111309 - RNA, 24 nt, Human
cagcacugaacgggucaagaaaaa

SEQ ID NO: 111310 - RNA, 20 nt, Human
cagcagggacccucgcccua

SEQ ID NO: 111311 - RNA, 24 nt, Human
cagccuggccaacauggggaaacc

SEQ ID NO: 111312 - RNA, 20 nt, Human
cagggccccugggugggggg

SEQ ID NO: 111313 - RNA, 20 nt, Human
ccacugcacuccagccuggg

SEQ ID NO: 111314 - RNA, 20 nt, Human
ccacugcacuccagccuggg

SEQ ID NO: 111315 - RNA, 21 nt, Human
ccacugcacuccagccugggc

SEQ ID NO: 111316 - RNA, 23 nt, Human
ccacugcacuccagccugggcaa

SEQ ID NO: 111317 - RNA, 24 nt, Human
ccacugcacuccagccugggcaac

SEQ ID NO: 111318 - RNA, 20 nt, Human
ccaggaguucgagaccagcc

SEQ ID NO: 111319 - RNA, 18 nt, Human
cccacgcugacacucaca

SEQ ID NO: 111320 - RNA, 21 nt, Human
ccccuggguggggggucccug

SEQ ID NO: 111321 - RNA, 22 nt, Human
cccgguccccuuucccagggga

SEQ ID NO: 111322 - RNA, 19 nt, Human
cccucacuuucuccaccug

SEQ ID NO: 111323 - RNA, 22 nt, Human
ccugaggccaggaguucgagac

SEQ ID NO: 111324 - RNA, 24 nt, Human
ccuggccaacauggggaaacccca

SEQ ID NO: 111325 - RNA, 21 nt, Human
cgagaccagccuggccaacau

SEQ ID NO: 111326 - RNA, 24 nt, Human
cgccacugcacuccagccugggca

SEQ ID NO: 111327 - RNA, 20 nt, Human
cgcccuacacguauugggau

SEQ ID NO: 111328 - RNA, 22 nt, Human
cgcuuggggaggcggaggcggg

SEQ ID NO: 111329 - RNA, 27 nt, Human
cggaagguggaggugcagugacaacgg

SEQ ID NO: 111330 - RNA, 24 nt, Human
cggagcagggccccuggguggggg

SEQ ID NO: 111331 - RNA, 30 nt, Human
cggaggcgggcggaucacaccugaggccaa

SEQ ID NO: 111332 - RNA, 26 nt, Human
cggaucacaccugaggccaggaguuc

SEQ ID NO: 111333 - RNA, 21 nt, Human
cggcccgguccccuuucccag

SEQ ID NO: 111334 - RNA, 26 nt, Human
cgggcggaucacaccugaggccagga

SEQ ID NO: 111335 - RNA, 22 nt, Human
cggggagcauggagaggggguc

SEQ ID NO: 111336 - RNA, 22 nt, Human
cgggucaagaaaaaaaaaaaaa

SEQ ID NO: 111337 - RNA, 22 nt, Human
cuagcacucucuccacuguccu

SEQ ID NO: 111338 - RNA, 20 nt, Human
cucacaccuguaaucucagc

SEQ ID NO: 111339 - RNA, 24 nt, Human
cucacaccuguaaucucagcgcuu

SEQ ID NO: 111340 - RNA, 24 nt, Human
cugaacgggucaagaaaaaaaaaa

SEQ ID NO: 111341 - RNA, 21 nt, Human
cugcaguccuagcuacucagg

SEQ ID NO: 111342 - RNA, 23 nt, Human
cuuccuacaaacaaagguuuuau

SEQ ID NO: 111343 - RNA, 23 nt, Human
gaaaacacagaaaaacccaaaaa

SEQ ID NO: 111344 - RNA, 23 nt, Human
gaaaccacaaacugcucagcuga

SEQ ID NO: 111345 - RNA, 22 nt, Human
gagaccagccuggccaacaugg

SEQ ID NO: 111346 - RNA, 18 nt, Human
gaggcugaggcuggagaa

SEQ ID NO: 111347 - RNA, 18 nt, Human
gaggugcagugagccaag

SEQ ID NO: 111348 - RNA, 27 nt, Human
gaucacaccugaggccaggaguucgag

SEQ ID NO: 111349 - RNA, 20 nt, Human
gcauagaaaccacaaacugc

SEQ ID NO: 111350 - RNA, 24 nt, Human
gccaacauggggaaaccccaucuc

SEQ ID NO: 111351 - RNA, 22 nt, Human
gccacugcacuccagccugggc

SEQ ID NO: 111352 - RNA, 24 nt, Human
gccacugcacuccagccugggcaa

SEQ ID NO: 111353 - RNA, 21 nt, Human
gccugggcacgguggcucaca

SEQ ID NO: 111354 - RNA, 20 nt, Human
gcgaggcaaccagaaaccgg

SEQ ID NO: 111355 - RNA, 22 nt, Human
gcuuggggaggcggaggcgggc

SEQ ID NO: 111356 - RNA, 21 nt, Human
ggaagauggagcaguauaagc

SEQ ID NO: 111357 - RNA, 25 nt, Human
ggagcagggccccuggguggggggu

SEQ ID NO: 111358 - RNA, 19 nt, Human
ggaggugcagugagccaag

SEQ ID NO: 111359 - RNA, 23 nt, Human
ggaggugcagugagccaagaugg

SEQ ID NO: 111360 - RNA, 23 nt, Human
ggcacgguggcucacaccuguaa

SEQ ID NO: 111361 - RNA, 21 nt, Human
ggcucacaccuguaaucucag

SEQ ID NO: 111362 - RNA, 21 nt, Human
gggaaaccccaucucuacuaa

SEQ ID NO: 111363 - RNA, 23 nt, Human
gggcggggagcauggagaggggg

SEQ ID NO: 111364 - RNA, 21 nt, Human
gggcgugguggagcaccugca

SEQ ID NO: 111365 - RNA, 23 nt, Human
gggcuggggacuccuuaaaaccu

SEQ ID NO: 111366 - RNA, 18 nt, Human
ggggaggcggaggcgggc

SEQ ID NO: 111367 - RNA, 23 nt, Human
gguggcucacaccuguaaucuca

SEQ ID NO: 111368 - RNA, 24 nt, Human
gguggcucacaccuguaaucucag

SEQ ID NO: 111369 - RNA, 21 nt, Human
guccuugccccaccccugggg

SEQ ID NO: 111370 - RNA, 19 nt, Human
uagaaaccacaaacugcuc

SEQ ID NO: 111371 - RNA, 22 nt, Human
uagccgggcgugguggagcacc

SEQ ID NO: 111372 - RNA, 22 nt, Human
uaggcaaauccagucacuuggg

SEQ ID NO: 111373 - RNA, 18 nt, Human
ucaaggcaaaggggaaaa

SEQ ID NO: 111374 - RNA, 22 nt, Human
ucaaggcaaaggggaaaaaagc

SEQ ID NO: 111375 - RNA, 24 nt, Human
ucacaccugaggccaggaguucga

SEQ ID NO: 111376 - RNA, 19 nt, Human
ucacggagcagggccccug

SEQ ID NO: 111377 - RNA, 18 nt, Human
ucacggcccgguccccuu

SEQ ID NO: 111378 - RNA, 18 nt, Human
ucagaauuucacuuccuu

SEQ ID NO: 111379 - RNA, 19 nt, Human
ucagcugacaaaaggggga

SEQ ID NO: 111380 - RNA, 23 nt, Human
ucccacgcugacacucacagacc

SEQ ID NO: 111381 - RNA, 19 nt, Human
ucccccacagcccaguggc

SEQ ID NO: 111382 - RNA, 23 nt, Human
ucccugugcaguacuuggcgggg

SEQ ID NO: 111383 - RNA, 18 nt, Human
uccuaggcaaauccaguc

SEQ ID NO: 111384 - RNA, 24 nt, Human
ucgcuugagcccggaagguggagg

SEQ ID NO: 111385 - RNA, 23 nt, Human
ucucuacuaaaaauacaaaaauu

SEQ ID NO: 111386 - RNA, 21 nt, Human
ucuucccagcacagccugaau

SEQ ID NO: 111387 - RNA, 22 nt, Human
ugaaaacacagaaaaacccaaa

SEQ ID NO: 111388 - RNA, 24 nt, Human
ugaaaacacagaaaaacccaaaaa

SEQ ID NO: 111389 - RNA, 24 nt, Human
ugaaaacacagaaaaacccaaaaa

SEQ ID NO: 111390 - RNA, 25 nt, Human
ugaaaacacagaaaaacccaaaaac

SEQ ID NO: 111391 - RNA, 21 nt, Human
ugaccccuucccccacagccc

SEQ ID NO: 111392 - RNA, 23 nt, Human
ugaggccagagugaguuggggcg

SEQ ID NO: 111393 - RNA, 20 nt, Human
ugagggccugggcacggugg

SEQ ID NO: 111394 - RNA, 21 nt, Human
ugagggccugggcacgguggc

SEQ ID NO: 111395 - RNA, 22 nt, Human
ugagggccugggcacgguggcu

SEQ ID NO: 111396 - RNA, 20 nt, Human
ugcucagcugacaaaagggg

SEQ ID NO: 111397 - RNA, 21 nt, Human
uggcucacaccuguaaucuca

SEQ ID NO: 111398 - RNA, 24 nt, Human
uggcucacaccuguaaucucagcg

SEQ ID NO: 111399 - RNA, 24 nt, Human
uggggagagagcgugcugggagcc

SEQ ID NO: 111400 - RNA, 23 nt, Human
uggggcggggagcauggagaggg

SEQ ID NO: 111401 - RNA, 23 nt, Human
ugugccagcagggacccucgccc

SEQ ID NO: 111402 - RNA, 21 nt, Human
uguggccggggaagauggagc

SEQ ID NO: 111403 - RNA, 19 nt, Human
uguggggagagagcgugcu

SEQ ID NO: 111404 - RNA, 20 nt, Human
uuagccgggcgugguggagc

SEQ ID NO: 111405 - RNA, 23 nt, Human
uuagccgggcgugguggagcacc

SEQ ID NO: 111406 - RNA, 21 nt, Human
uucccagcacagccugaaugu

SEQ ID NO: 111407 - RNA, 22 nt, Human
uugugaauacuuccugaaacuu

SEQ ID NO: 111408 - RNA, 19 nt, Human
uuuccuagcacucucucca

SEQ ID NO: 111409 - RNA, 25 nt, Human
aaaauuagcaaacaauacuguagaa

SEQ ID NO: 111410 - RNA, 23 nt, Human
accacauuuagcaauaagcauga

SEQ ID NO: 111411 - RNA, 27 nt, Human
acuauugagggaagaggcagaaaaagg

SEQ ID NO: 111412 - RNA, 21 nt, Human
agaaaccagauacacuaaacu

SEQ ID NO: 111413 - RNA, 18 nt, Human
agauacacuaaacuguaa

SEQ ID NO: 111414 - RNA, 20 nt, Human
aggcagaaaaaggaaaaagg

SEQ ID NO: 111415 - RNA, 21 nt, Human
aggcagaaaaaggaaaaagga

SEQ ID NO: 111416 - RNA, 27 nt, Human
agggaagaggcagaaaaagggggaccc

SEQ ID NO: 111417 - RNA, 28 nt, Human
augcugcaucuuaaauuuaguuggcaaa

SEQ ID NO: 111418 - RNA, 21 nt, Human
caaacaauacuguagaaacau

SEQ ID NO: 111419 - RNA, 22 nt, Human
cagcgcugggguccggggucuc

SEQ ID NO: 111420 - RNA, 18 nt, Human
cgggcggcgggaagagac

SEQ ID NO: 111421 - RNA, 24 nt, Human
cuaaacuguaaaaaaaaaaaaaaa

SEQ ID NO: 111422 - RNA, 27 nt, Human
cuaaacuguaaaaaaaaaaaaaaaaaa

SEQ ID NO: 111423 - RNA, 23 nt, Human
cuuccauguagaaaccagauaca

SEQ ID NO: 111424 - RNA, 21 nt, Human
gagggaagaggcagaaaaagg

SEQ ID NO: 111425 - RNA, 20 nt, Human
gcgcugggguccggggucuc

SEQ ID NO: 111426 - RNA, 19 nt, Human
ggaagaggcagaaaaagga

SEQ ID NO: 111427 - RNA, 19 nt, Human
gggaagaggcagaaaaagg

SEQ ID NO: 111428 - RNA, 20 nt, Human
guauuccuuuuuacuucaua

SEQ ID NO: 111429 - RNA, 25 nt, Human
uaaaaacaaaggacuaaauacugag

SEQ ID NO: 111430 - RNA, 18 nt, Human
uaaacuguaaaaaaaaaa

SEQ ID NO: 111431 - RNA, 21 nt, Human
uaaauuucuaaaaugcugcau

SEQ ID NO: 111432 - RNA, 23 nt, Human
uaaauuucuaaaaugcugcaucu

SEQ ID NO: 111433 - RNA, 18 nt, Human
uccggggucucucgcacu

SEQ ID NO: 111434 - RNA, 19 nt, Human
ucgggcggcgggaagagac

SEQ ID NO: 111435 - RNA, 24 nt, Human
ugaauaaaaacaaaggacuaaaua

SEQ ID NO: 111436 - RNA, 22 nt, Human
uuaaaaauuagcaaacaauacu

SEQ ID NO: 111437 - RNA, 23 nt, Human
uuauugauuaugcuguaggauuu

SEQ ID NO: 111438 - RNA, 24 nt, Human
aaaaaaaaaaaaaaugucacaaaa

SEQ ID NO: 111439 - RNA, 27 nt, Human
aaaaaagacaaggagauggaaucaaag

SEQ ID NO: 111440 - RNA, 22 nt, Human
aaccuggaaguagggcucgggg

SEQ ID NO: 111441 - RNA, 21 nt, Human
aagcaaccggugggacuuggc

SEQ ID NO: 111442 - RNA, 24 nt, Human
aagcacuuuuguugagugacaacc

SEQ ID NO: 111443 - RNA, 24 nt, Human
aauagcaggacccugucucuaaaa

SEQ ID NO: 111444 - RNA, 22 nt, Human
aaucaaagcccagagguccucc

SEQ ID NO: 111445 - RNA, 25 nt, Human
acaaaacaaggaucaaacagagggc

SEQ ID NO: 111446 - RNA, 21 nt, Human
acacagacuaguguuagaaac

SEQ ID NO: 111447 - RNA, 27 nt, Human
acccgauuagcaaggcccuguuacuga

SEQ ID NO: 111448 - RNA, 18 nt, Human
acccugucucuaaaaaca

SEQ ID NO: 111449 - RNA, 18 nt, Human
acugcacuccagcuuggg

SEQ ID NO: 111450 - RNA, 18 nt, Human
acugcacuccagcuuggg

SEQ ID NO: 111451 - RNA, 24 nt, Human
acugcacuccagcuugggaaauag

SEQ ID NO: 111452 - RNA, 18 nt, Human
agaaaaaagacaaggaga

SEQ ID NO: 111453 - RNA, 24 nt, Human
agaaaccccuucccagaagcaacc

SEQ ID NO: 111454 - RNA, 30 nt, Human
agacaaggagauggaaucaaagcccagagg

SEQ ID NO: 111455 - RNA, 19 nt, Human
agagagcaggacuggagcu

SEQ ID NO: 111456 - RNA, 24 nt, Human
agagggcaguggagggcaccccag

SEQ ID NO: 111457 - RNA, 20 nt, Human
agcagcugggcugggcuggg

SEQ ID NO: 111458 - RNA, 23 nt, Human
agccccacugccuuuugccuccg

SEQ ID NO: 111459 - RNA, 21 nt, Human
agcuccuuuuucuacccuggu

SEQ ID NO: 111460 - RNA, 24 nt, Human
aggauugcuugagcccaggaguuc

SEQ ID NO: 111461 - RNA, 18 nt, Human
aggcccagaggccuccag

SEQ ID NO: 111462 - RNA, 18 nt, Human
agggggcagggacuuagg

SEQ ID NO: 111463 - RNA, 22 nt, Human
aguaaaaaaaaaaaaaaaaaaa

SEQ ID NO: 111464 - RNA, 19 nt, Human
aguccagccccuuccugga

SEQ ID NO: 111465 - RNA, 24 nt, Human
aucgcaccacugcacuccagcuug

SEQ ID NO: 111466 - RNA, 24 nt, Human
auugcuugagcccaggaguucgag

SEQ ID NO: 111467 - RNA, 24 nt, Human
caaagccaggauaguaacuuaaau

SEQ ID NO: 111468 - RNA, 23 nt, Human
caaagcccagagguccuccccuu

SEQ ID NO: 111469 - RNA, 20 nt, Human
cacaacccgagccucgugcc

SEQ ID NO: 111470 - RNA, 21 nt, Human
cacagcacacagacuaguguu

SEQ ID NO: 111471 - RNA, 22 nt, Human
caccauggaggcaagaugggcu

SEQ ID NO: 111472 - RNA, 18 nt, Human
cacccagcucugggcaga

SEQ ID NO: 111473 - RNA, 18 nt, Human
caccgucgccgccucugc

SEQ ID NO: 111474 - RNA, 21 nt, Human
cacuccagcuugggaaauagc

SEQ ID NO: 111475 - RNA, 18 nt, Human
cacugcacuccagcuugg

SEQ ID NO: 111476 - RNA, 19 nt, Human
cacugcacuccagcuuggg

SEQ ID NO: 111477 - RNA, 19 nt, Human
cacugcacuccagcuuggg

SEQ ID NO: 111478 - RNA, 26 nt, Human
cacugcacuccagcuugggaaauagc

SEQ ID NO: 111479 - RNA, 27 nt, Human
cacugcacuccagcuugggaaauagca

SEQ ID NO: 111480 - RNA, 18 nt, Human
cagaaccuggaaguaggg

SEQ ID NO: 111481 - RNA, 19 nt, Human
cagagcagcugggcugggc

SEQ ID NO: 111482 - RNA, 19 nt, Human
cagagguccuccccuucuc

SEQ ID NO: 111483 - RNA, 20 nt, Human
cagcugggcugggcuggggc

SEQ ID NO: 111484 - RNA, 26 nt, Human
caggaaccacagcacacaaccuucag

SEQ ID NO: 111485 - RNA, 24 nt, Human
caggacccugucucuaaaaacaaa

SEQ ID NO: 111486 - RNA, 20 nt, Human
cauggaggcaagaugggcug

SEQ ID NO: 111487 - RNA, 22 nt, Human
cauggaggcaagaugggcuggg

SEQ ID NO: 111488 - RNA, 18 nt, Human
ccaccgucgccgccucug

SEQ ID NO: 111489 - RNA, 22 nt, Human
ccaccgucgccgccucugccgg

SEQ ID NO: 111490 - RNA, 19 nt, Human
ccacugcacuccagcuugg

SEQ ID NO: 111491 - RNA, 20 nt, Human
ccacugcacuccagcuuggg

SEQ ID NO: 111492 - RNA, 23 nt, Human
ccacugcacuccagcuugggaaa

SEQ ID NO: 111493 - RNA, 26 nt, Human
ccacugcacuccagcuugggaaauag

SEQ ID NO: 111494 - RNA, 20 nt, Human
ccagaaccuggaaguagggc

SEQ ID NO: 111495 - RNA, 22 nt, Human
ccagagguccuccccuucucag

SEQ ID NO: 111496 - RNA, 19 nt, Human
ccagccucgucagcuuugg

SEQ ID NO: 111497 - RNA, 20 nt, Human
ccagccucgucagcuuugga

SEQ ID NO: 111498 - RNA, 21 nt, Human
ccagcgguggcacaacccgag

SEQ ID NO: 111499 - RNA, 22 nt, Human
ccaggaguucgaggcugcagug

SEQ ID NO: 111500 - RNA, 18 nt, Human
ccauggaggcaagauggg

SEQ ID NO: 111501 - RNA, 24 nt, Human
cccaccagccccuguuagaggagg

SEQ ID NO: 111502 - RNA, 22 nt, Human
cccacucacccagcucugggca

SEQ ID NO: 111503 - RNA, 21 nt, Human
cccagaggccuccagaggcac

SEQ ID NO: 111504 - RNA, 20 nt, Human
ccccaggaaccacagcacac

SEQ ID NO: 111505 - RNA, 24 nt, Human
ccccaggaaccacagcacacagac

SEQ ID NO: 111506 - RNA, 19 nt, Human
cccuggcuuggcccagccu

SEQ ID NO: 111507 - RNA, 25 nt, Human
cccugucucuaaaaacaaagaaaaa

SEQ ID NO: 111508 - RNA, 21 nt, Human
ccuccggucaguggguuuugc

SEQ ID NO: 111509 - RNA, 23 nt, Human
ccucuggccccgaucuccccauc

SEQ ID NO: 111510 - RNA, 22 nt, Human
ccugcccaccuuguguugggag

SEQ ID NO: 111511 - RNA, 22 nt, Human
cgcaccacugcacuccagcuug

SEQ ID NO: 111512 - RNA, 21 nt, Human
cgccucugccggcaccagcgc

SEQ ID NO: 111513 - RNA, 22 nt, Human
cgucgccgccucugccggcacc

SEQ ID NO: 111514 - RNA, 20 nt, Human
cguuucccucuccccuuccc

SEQ ID NO: 111515 - RNA, 18 nt, Human
cuccccauccacacagcg

SEQ ID NO: 111516 - RNA, 21 nt, Human
cucgggguucuggcuguggcc

SEQ ID NO: 111517 - RNA, 22 nt, Human
cucugggcagagcagcugggcu

SEQ ID NO: 111518 - RNA, 21 nt, Human
cucugugaccauggaaaacua

SEQ ID NO: 111519 - RNA, 22 nt, Human
cugcagugagccaugaucgcac

SEQ ID NO: 111520 - RNA, 20 nt, Human
cugccggcaccagcgcuccg

SEQ ID NO: 111521 - RNA, 20 nt, Human
cuggaaguagggcucggggu

SEQ ID NO: 111522 - RNA, 23 nt, Human
cuggccccgaucuccccauccac

SEQ ID NO: 111523 - RNA, 22 nt, Human
cuggcuguggccccaucccugg

SEQ ID NO: 111524 - RNA, 24 nt, Human
cugggcagagcagcugggcugggc

SEQ ID NO: 111525 - RNA, 26 nt, Human
cuucccagaagcaaccggugggacuu

SEQ ID NO: 111526 - RNA, 22 nt, Human
cuugagcccaggaguucgaggc

SEQ ID NO: 111527 - RNA, 19 nt, Human
cuuggcccagccucgucag

SEQ ID NO: 111528 - RNA, 19 nt, Human
gacccugucucuaaaaaca

SEQ ID NO: 111529 - RNA, 18 nt, Human
gagcccaggaguucgagg

SEQ ID NO: 111530 - RNA, 18 nt, Human
gaggcccagaggccucca

SEQ ID NO: 111531 - RNA, 21 nt, Human
gcaguggagggcaccccagga

SEQ ID NO: 111532 - RNA, 19 nt, Human
gccaugaucgcaccacugc

SEQ ID NO: 111533 - RNA, 22 nt, Human
ggaaaacuacccccagccccac

SEQ ID NO: 111534 - RNA, 24 nt, Human
ggaaaacuacccccagccccacug

SEQ ID NO: 111535 - RNA, 22 nt, Human
ggagauggaaucaaagcccaga

SEQ ID NO: 111536 - RNA, 23 nt, Human
ggaucacucaggaggauugcuug

SEQ ID NO: 111537 - RNA, 23 nt, Human
ggauugcuugagcccaggaguuc

SEQ ID NO: 111538 - RNA, 21 nt, Human
ggcaguggagggcaccccagg

SEQ ID NO: 111539 - RNA, 25 nt, Human
ggcccagaggccuccagaggcacca

SEQ ID NO: 111540 - RNA, 23 nt, Human
ggcucgggguucuggcuguggcc

SEQ ID NO: 111541 - RNA, 22 nt, Human
ggcuggggcugagcuaaccaga

SEQ ID NO: 111542 - RNA, 20 nt, Human
gggagggggcagggacuuag

SEQ ID NO: 111543 - RNA, 21 nt, Human
gggcacguuucccucuccccu

SEQ ID NO: 111544 - RNA, 25 nt, Human
gggcagggacuuaggaccaaaggug

SEQ ID NO: 111545 - RNA, 22 nt, Human
gggcuggggcugagcuaaccag

SEQ ID NO: 111546 - RNA, 18 nt, Human
ggggaagagggcggacag

SEQ ID NO: 111547 - RNA, 21 nt, Human
gguaaauagccccagccuucu

SEQ ID NO: 111548 - RNA, 21 nt, Human
gguagagagcaggacuggagc

SEQ ID NO: 111549 - RNA, 20 nt, Human
gguggcacaacccgagccuc

SEQ ID NO: 111550 - RNA, 24 nt, Human
guggagggcaccccaggaaccaca

SEQ ID NO: 111551 - RNA, 23 nt, Human
guggguuuugcggggcucugagg

SEQ ID NO: 111552 - RNA, 22 nt, Human
uacccugguaaauagccccagc

SEQ ID NO: 111553 - RNA, 19 nt, Human
uagaggaggcccagaggcc

SEQ ID NO: 111554 - RNA, 24 nt, Human
uagcaaggcccuguuacugaacag

SEQ ID NO: 111555 - RNA, 23 nt, Human
uaguguuagaaaccccuucccag

SEQ ID NO: 111556 - RNA, 24 nt, Human
ucaccaggguucugccucuggccc

SEQ ID NO: 111557 - RNA, 19 nt, Human
ucacucaggaggauugcuu

SEQ ID NO: 111558 - RNA, 22 nt, Human
ucaguggguuuugcggggcucu

SEQ ID NO: 111559 - RNA, 20 nt, Human
uccacacagcggagccaggc

SEQ ID NO: 111560 - RNA, 21 nt, Human
uccagaggcaccauggaggca

SEQ ID NO: 111561 - RNA, 20 nt, Human
ucccuggcuuggcccagccu

SEQ ID NO: 111562 - RNA, 22 nt, Human
uccuggagugaggcccccagcc

SEQ ID NO: 111563 - RNA, 23 nt, Human
ucgcaccacugcacuccagcuug

SEQ ID NO: 111564 - RNA, 24 nt, Human
ucgucagcuuugguccagguuccu

SEQ ID NO: 111565 - RNA, 19 nt, Human
ucuccccuucccuucuagg

SEQ ID NO: 111566 - RNA, 25 nt, Human
ucucugugaccauggaaaacuaccc

SEQ ID NO: 111567 - RNA, 19 nt, Human
ugaccauggaaaacuaccc

SEQ ID NO: 111568 - RNA, 20 nt, Human
ugagcauuagaggggaagag

SEQ ID NO: 111569 - RNA, 20 nt, Human
ugaguaaaaaaaaaaaaaaa

SEQ ID NO: 111570 - RNA, 22 nt, Human
ugcagugagccaugaucgcacc

SEQ ID NO: 111571 - RNA, 21 nt, Human
ugcccaccuuguguugggagc

SEQ ID NO: 111572 - RNA, 18 nt, Human
ugccucuggccccgaucu

SEQ ID NO: 111573 - RNA, 19 nt, Human
ugccuuuugccuccgguca

SEQ ID NO: 111574 - RNA, 19 nt, Human
ugcgcggagggacacggga

SEQ ID NO: 111575 - RNA, 22 nt, Human
ugcgcggagggacacgggaguc

SEQ ID NO: 111576 - RNA, 24 nt, Human
ugcgcggagggacacgggagucca

SEQ ID NO: 111577 - RNA, 21 nt, Human
uggaaucaaagcccagagguc

SEQ ID NO: 111578 - RNA, 19 nt, Human
uggaggcaagaugggcugg

SEQ ID NO: 111579 - RNA, 31 nt, Human
ugggaucacucaggaggauugcuugagcccc

SEQ ID NO: 111580 - RNA, 18 nt, Human
ugggcagagcagcugggc

SEQ ID NO: 111581 - RNA, 20 nt, Human
ugggcagagcagcugggcug

SEQ ID NO: 111582 - RNA, 23 nt, Human
ugggcagagcagcugggcugggc

SEQ ID NO: 111583 - RNA, 22 nt, Human
ugguaaauagccccagccuucu

SEQ ID NO: 111584 - RNA, 24 nt, Human
ugucucuaaaaacaaagaaaaaag

SEQ ID NO: 111585 - RNA, 19 nt, Human
uguuagaaaccccuuccca

SEQ ID NO: 111586 - RNA, 23 nt, Human
uguucugcuuucuucccuaguua

SEQ ID NO: 111587 - RNA, 20 nt, Human
uuccuggagugaggccccca

SEQ ID NO: 111588 - RNA, 22 nt, Human
uugcggggcucugaggugucuc

SEQ ID NO: 111589 - RNA, 24 nt, Human
uugcuugagcccaggaguucgagg

SEQ ID NO: 111590 - RNA, 21 nt, Human
uuggcccuuaccagccagggg

SEQ ID NO: 111591 - RNA, 18 nt, Human
uugguccagguuccugaa

SEQ ID NO: 111592 - RNA, 20 nt, Human
uugguccagguuccugaaug

SEQ ID NO: 111593 - RNA, 25 nt, Human
uuuuuuuuuuuuuuuuuuuuuuagg

SEQ ID NO: 111594 - RNA, 18 nt, Human
aaaaguaauaauguuaga

SEQ ID NO: 111595 - RNA, 22 nt, Human
aaacuaagcaaauaagugacau

SEQ ID NO: 111596 - RNA, 20 nt, Human
aacaagcacccauggcgcca

SEQ ID NO: 111597 - RNA, 22 nt, Human
aaccccggaagauuagcccaaa

SEQ ID NO: 111598 - RNA, 21 nt, Human
aaccuggaauauaggaacaca

SEQ ID NO: 111599 - RNA, 24 nt, Human
aagaaacucucccacccgaaaauu

SEQ ID NO: 111600 - RNA, 24 nt, Human
aagcaaauaagugacauguggcaa

SEQ ID NO: 111601 - RNA, 20 nt, Human
aagcacagauacagcauagc

SEQ ID NO: 111602 - RNA, 25 nt, Human
aaguuaaaaaaauauaaccaaggag

SEQ ID NO: 111603 - RNA, 25 nt, Human
acacucacacacaguauaauuuuac

SEQ ID NO: 111604 - RNA, 21 nt, Human
acccugagccuucaucugcac

SEQ ID NO: 111605 - RNA, 19 nt, Human
acgucaaugccaaguguau

SEQ ID NO: 111606 - RNA, 25 nt, Human
acuauaaaaucuacacugcauacgc

SEQ ID NO: 111607 - RNA, 24 nt, Human
agaauggaguuugaguaccuaaac

SEQ ID NO: 111608 - RNA, 24 nt, Human
agcagcuguguuuaucuucaugcu

SEQ ID NO: 111609 - RNA, 19 nt, Human
agcgcuacucauccagggc

SEQ ID NO: 111610 - RNA, 22 nt, Human
aggcaugaaaucuacuuaaacc

SEQ ID NO: 111611 - RNA, 19 nt, Human
agggagccagcaggcagau

SEQ ID NO: 111612 - RNA, 24 nt, Human
agguuccucuuggaggcagcccua

SEQ ID NO: 111613 - RNA, 18 nt, Human
auaaaauauacugugggc

SEQ ID NO: 111614 - RNA, 19 nt, Human
auagcuaaagacuaaagaa

SEQ ID NO: 111615 - RNA, 19 nt, Human
aucaccuuuucauugagca

SEQ ID NO: 111616 - RNA, 20 nt, Human
aucagagguuccucuuggag

SEQ ID NO: 111617 - RNA, 18 nt, Human
auggacaugaaauggcag

SEQ ID NO: 111618 - RNA, 25 nt, Human
auggcauuuuuccauggguucuucc

SEQ ID NO: 111619 - RNA, 18 nt, Human
augggguuaauuaaugag

SEQ ID NO: 111620 - RNA, 26 nt, Human
caacaaacaucuaacaauacaauauu

SEQ ID NO: 111621 - RNA, 23 nt, Human
caauuuaguaauacuugauccaa

SEQ ID NO: 111622 - RNA, 20 nt, Human
cagaaaccaaaguacucucc

SEQ ID NO: 111623 - RNA, 20 nt, Human
cagagcucuccguagucccc

SEQ ID NO: 111624 - RNA, 21 nt, Human
cagauagacuuaacucaaagu

SEQ ID NO: 111625 - RNA, 19 nt, Human
caggacaaaagacuggcaa

SEQ ID NO: 111626 - RNA, 21 nt, Human
caggcagauucaaggugugca

SEQ ID NO: 111627 - RNA, 23 nt, Human
caggcagauucaaggugugcaga

SEQ ID NO: 111628 - RNA, 19 nt, Human
cagggccuaauucucaucu

SEQ ID NO: 111629 - RNA, 21 nt, Human
cauagcugugaaaagagcauu

SEQ ID NO: 111630 - RNA, 19 nt, Human
ccacugcucaaacaucuga

SEQ ID NO: 111631 - RNA, 19 nt, Human
ccucuagcacccugagccu

SEQ ID NO: 111632 - RNA, 22 nt, Human
cgaaccccggaagauuagccca

SEQ ID NO: 111633 - RNA, 21 nt, Human
cggcucccugcagagcucucc

SEQ ID NO: 111634 - RNA, 22 nt, Human
cuaaacuauggaaacauuagca

SEQ ID NO: 111635 - RNA, 25 nt, Human
cucaaaaugacugagaaagugaccc

SEQ ID NO: 111636 - RNA, 25 nt, Human
cucaaaaugacugagaaagugaccc

SEQ ID NO: 111637 - RNA, 20 nt, Human
cucgagagcuagaaaucacc

SEQ ID NO: 111638 - RNA, 21 nt, Human
cugaagcuacauuuaauaaca

SEQ ID NO: 111639 - RNA, 25 nt, Human
cuggcaauaacacuacaaauacauc

SEQ ID NO: 111640 - RNA, 22 nt, Human
cugugcugccagggaggcauca

SEQ ID NO: 111641 - RNA, 24 nt, Human
cuucauagcugugaaaagagcauu

SEQ ID NO: 111642 - RNA, 24 nt, Human
cuuggcccgggcgggggccucggc

SEQ ID NO: 111643 - RNA, 22 nt, Human
gaaacucucccacccgaggcac

SEQ ID NO: 111644 - RNA, 22 nt, Human
gaaccccggaagauuagcccaa

SEQ ID NO: 111645 - RNA, 21 nt, Human
gaacugccccaucaggcugcu

SEQ ID NO: 111646 - RNA, 19 nt, Human
gauacuacggacaguuaca

SEQ ID NO: 111647 - RNA, 20 nt, Human
gaucuugaaagcacaacaca

SEQ ID NO: 111648 - RNA, 24 nt, Human
gccauugcccagcauuuaggagau

SEQ ID NO: 111649 - RNA, 18 nt, Human
ggcaaguacaucauccuc

SEQ ID NO: 111650 - RNA, 19 nt, Human
gggcaaguacaucauccuc

SEQ ID NO: 111651 - RNA, 24 nt, Human
ggugguugggccuauuuccugcag

SEQ ID NO: 111652 - RNA, 23 nt, Human
guaauagcuaaagacuaaagaaa

SEQ ID NO: 111653 - RNA, 19 nt, Human
gucacaguuuucucacuuu

SEQ ID NO: 111654 - RNA, 20 nt, Human
guguaggacagaugucuaca

SEQ ID NO: 111655 - RNA, 23 nt, Human
uaaacaaauauuaauagcacaua

SEQ ID NO: 111656 - RNA, 19 nt, Human
uaaaugcaaacuaaacccu

SEQ ID NO: 111657 - RNA, 22 nt, Human
uaaauuuuuaaguaugaaugaa

SEQ ID NO: 111658 - RNA, 24 nt, Human
uaacaguuacggacagaaacacac

SEQ ID NO: 111659 - RNA, 19 nt, Human
uaacucaaagugccagaga

SEQ ID NO: 111660 - RNA, 24 nt, Human
uaacuuguaaaaauggacaucucu

SEQ ID NO: 111661 - RNA, 19 nt, Human
uaagaugccacggcaaugu

SEQ ID NO: 111662 - RNA, 20 nt, Human
uaagcaccaaguuuagugcu

SEQ ID NO: 111663 - RNA, 20 nt, Human
uaaguuaacaguuuaauuac

SEQ ID NO: 111664 - RNA, 21 nt, Human
uaauagcacauaaacacugau

SEQ ID NO: 111665 - RNA, 24 nt, Human
uacgaaccccggaagauuagccca

SEQ ID NO: 111666 - RNA, 22 nt, Human
uacgguuauuucagugucaaaa

SEQ ID NO: 111667 - RNA, 22 nt, Human
uacuacggacaguuacauuuca

SEQ ID NO: 111668 - RNA, 23 nt, Human
uacuacggacaguuacauuucac

SEQ ID NO: 111669 - RNA, 23 nt, Human
uagaacagcuauaguccagaaga

SEQ ID NO: 111670 - RNA, 21 nt, Human
uagaauaucaauaagcaccaa

SEQ ID NO: 111671 - RNA, 22 nt, Human
uagaucuugaaagcacaacaca

SEQ ID NO: 111672 - RNA, 23 nt, Human
uagaucuugaaagcacaacacac

SEQ ID NO: 111673 - RNA, 22 nt, Human
uagcccaaaccuaccaagacag

SEQ ID NO: 111674 - RNA, 25 nt, Human
uaggccacugcucaaacaucugacu

SEQ ID NO: 111675 - RNA, 19 nt, Human
uagugacugacauauugcu

SEQ ID NO: 111676 - RNA, 22 nt, Human
uauaugauuuagaucuugaaag

SEQ ID NO: 111677 - RNA, 22 nt, Human
ucaccagauagaugccagcucu

SEQ ID NO: 111678 - RNA, 24 nt, Human
uccccugguccucgggacagaagc

SEQ ID NO: 111679 - RNA, 21 nt, Human
ucccuuggcccgggcgggggc

SEQ ID NO: 111680 - RNA, 24 nt, Human
uccuacgaaccccggaagauuagc

SEQ ID NO: 111681 - RNA, 20 nt, Human
uccucuagcacccugagccu

SEQ ID NO: 111682 - RNA, 21 nt, Human
uccuuagcccaaaccuaccaa

SEQ ID NO: 111683 - RNA, 21 nt, Human
ucuacacugcauacgcacaaa

SEQ ID NO: 111684 - RNA, 22 nt, Human
ucuuacuaauccucuagcaccc

SEQ ID NO: 111685 - RNA, 21 nt, Human
ugaaauggcagaaauuaauca

SEQ ID NO: 111686 - RNA, 22 nt, Human
ugacccacagggggcaaucccu

SEQ ID NO: 111687 - RNA, 24 nt, Human
ugacuuuuuagaaaccuauuuaca

SEQ ID NO: 111688 - RNA, 23 nt, Human
ugagaaagugacccacagggggc

SEQ ID NO: 111689 - RNA, 23 nt, Human
ugagaaagugacccacagggggc

SEQ ID NO: 111690 - RNA, 19 nt, Human
ugagauguuuucucuuuga

SEQ ID NO: 111691 - RNA, 22 nt, Human
ugauaaaaaaaaaaaugagcag

SEQ ID NO: 111692 - RNA, 18 nt, Human
ugauauggguggucucuu

SEQ ID NO: 111693 - RNA, 22 nt, Human
ugauccccaguaggccuaguac

SEQ ID NO: 111694 - RNA, 18 nt, Human
ugcaaacuaaacccuggu

SEQ ID NO: 111695 - RNA, 20 nt, Human
ugcaagagugcagcaagugg

SEQ ID NO: 111696 - RNA, 21 nt, Human
ugcaguuucaaaaaugaaccg

SEQ ID NO: 111697 - RNA, 19 nt, Human
ugugcaagagugcagcaag

SEQ ID NO: 111698 - RNA, 22 nt, Human
uuaaaccuggaauauaggaaca

SEQ ID NO: 111699 - RNA, 23 nt, Human
uuaaguagauucuucagcaauau

SEQ ID NO: 111700 - RNA, 20 nt, Human
uuaaucaacaggacaguaac

SEQ ID NO: 111701 - RNA, 24 nt, Human
uuaaugacugaagcuacauuuaau

SEQ ID NO: 111702 - RNA, 21 nt, Human
uuagacuuccaauuguguagc

SEQ ID NO: 111703 - RNA, 18 nt, Human
uuagccacaugggcuggg

SEQ ID NO: 111704 - RNA, 22 nt, Human
uucacuguaaaccccuggagaa

SEQ ID NO: 111705 - RNA, 30 nt, Human
uuggaugccugucauuauuuuuugcuaagg

SEQ ID NO: 111706 - RNA, 20 nt, Human
uuuccuacgaaccccggaag

SEQ ID NO: 111707 - RNA, 20 nt, Human
uuucuauauuacaauaggca

SEQ ID NO: 111708 - RNA, 21 nt, Human
uuugaagucuucaaauucuuc

SEQ ID NO: 111709 - RNA, 22 nt, Human
uuuuauggacaugaaauggcag

SEQ ID NO: 111710 - RNA, 24 nt, Human
uuuuuaucaacaagauuacaggaa

SEQ ID NO: 111711 - RNA, 23 nt, Human
agaaccgcccacuccccccaccc

SEQ ID NO: 111712 - RNA, 24 nt, Human
agaaccgcccacuccccccacccu

SEQ ID NO: 111713 - RNA, 21 nt, Human
agacaggaggcuggggcagga

SEQ ID NO: 111714 - RNA, 22 nt, Human
agacaggaggcuggggcaggag

SEQ ID NO: 111715 - RNA, 19 nt, Human
agacuagaagggacugaca

SEQ ID NO: 111716 - RNA, 25 nt, Human
aggcuccccucacgucccccaaggg

SEQ ID NO: 111717 - RNA, 20 nt, Human
agggguauacaaaacagggc

SEQ ID NO: 111718 - RNA, 19 nt, Human
cacccgggcuucgcgccgc

SEQ ID NO: 111719 - RNA, 21 nt, Human
cacgucccccaagggcuccug

SEQ ID NO: 111720 - RNA, 21 nt, Human
cagcccaaggggccaggguga

SEQ ID NO: 111721 - RNA, 19 nt, Human
cagcgagcgaggcagggag

SEQ ID NO: 111722 - RNA, 20 nt, Human
cccaagggcuccugggaguc

SEQ ID NO: 111723 - RNA, 24 nt, Human
ccccccacccuguauauacaucua

SEQ ID NO: 111724 - RNA, 24 nt, Human
ccgcccccggcagcgagcgaggca

SEQ ID NO: 111725 - RNA, 21 nt, Human
ccgcgccuuccgaccgccccc

SEQ ID NO: 111726 - RNA, 24 nt, Human
ccugcccgugugcaaaauagaaac

SEQ ID NO: 111727 - RNA, 18 nt, Human
cgcccacuccccccaccc

SEQ ID NO: 111728 - RNA, 19 nt, Human
cgcccucgggccacccggg

SEQ ID NO: 111729 - RNA, 19 nt, Human
cgcccucgggccacccggg

SEQ ID NO: 111730 - RNA, 21 nt, Human
cgccgcgccuuccgaccgccc

SEQ ID NO: 111731 - RNA, 19 nt, Human
cgccggaucccaccgccga

SEQ ID NO: 111732 - RNA, 22 nt, Human
cgccggggucuccacaaauugu

SEQ ID NO: 111733 - RNA, 20 nt, Human
cggcagcgagcgaggcaggg

SEQ ID NO: 111734 - RNA, 19 nt, Human
cuccggccuccugcuccuc

SEQ ID NO: 111735 - RNA, 19 nt, Human
cugaugguggcaacagaga

SEQ ID NO: 111736 - RNA, 24 nt, Human
cugcauggcccaccuccccugagg

SEQ ID NO: 111737 - RNA, 21 nt, Human
cugggcccccccagcaucagg

SEQ ID NO: 111738 - RNA, 23 nt, Human
cuuggugcggcagggcugggggg

SEQ ID NO: 111739 - RNA, 18 nt, Human
gaaggagggccagcuugg

SEQ ID NO: 111740 - RNA, 21 nt, Human
gacaggaggcuggggcaggag

SEQ ID NO: 111741 - RNA, 20 nt, Human
gaggcuggggcaggaggagg

SEQ ID NO: 111742 - RNA, 22 nt, Human
gcaccgcccgccggaucccacc

SEQ ID NO: 111743 - RNA, 24 nt, Human
gcccucgggccacccgggcuucgc

SEQ ID NO: 111744 - RNA, 22 nt, Human
gcgccgcgccuuccgaccgccc

SEQ ID NO: 111745 - RNA, 21 nt, Human
gcuccggccuccugcuccucu

SEQ ID NO: 111746 - RNA, 20 nt, Human
ggagcagggucaggggaggg

SEQ ID NO: 111747 - RNA, 21 nt, Human
ggagcagggucaggggagggg

SEQ ID NO: 111748 - RNA, 24 nt, Human
ggagggccagcuuggugcggcagg

SEQ ID NO: 111749 - RNA, 21 nt, Human
ggaggggacugaaaauugugg

SEQ ID NO: 111750 - RNA, 23 nt, Human
ggccagcuuggugcggcagggcu

SEQ ID NO: 111751 - RNA, 22 nt, Human
ggcccgggcccgccggggucuc

SEQ ID NO: 111752 - RNA, 19 nt, Human
ggcggcaggcccgggcccg

SEQ ID NO: 111753 - RNA, 19 nt, Human
gggagggggauggcugggc

SEQ ID NO: 111754 - RNA, 20 nt, Human
ggggagggggauggcugggc

SEQ ID NO: 111755 - RNA, 21 nt, Human
ggggggcggcaggcccgggcc

SEQ ID NO: 111756 - RNA, 20 nt, Human
ggugcucugcauguccucau

SEQ ID NO: 111757 - RNA, 23 nt, Human
uaaucugaugguggcaacagaga

SEQ ID NO: 111758 - RNA, 21 nt, Human
uacaaaacagggcagagggga

SEQ ID NO: 111759 - RNA, 20 nt, Human
uacugugggauaggagcagg

SEQ ID NO: 111760 - RNA, 19 nt, Human
uagaagggacugacagggc

SEQ ID NO: 111761 - RNA, 20 nt, Human
uagaagggacugacagggca

SEQ ID NO: 111762 - RNA, 20 nt, Human
uagacaggaggcuggggcag

SEQ ID NO: 111763 - RNA, 19 nt, Human
ucagacuagaagggacuga

SEQ ID NO: 111764 - RNA, 20 nt, Human
ucaggagcuuauaaucugau

SEQ ID NO: 111765 - RNA, 22 nt, Human
ucccccaagggcuccugggagu

SEQ ID NO: 111766 - RNA, 20 nt, Human
ucugaagagaaugcaaaagg

SEQ ID NO: 111767 - RNA, 23 nt, Human
ucugcaggugcucugcauguccc

SEQ ID NO: 111768 - RNA, 27 nt, Human
ugaaaauugugggugcuggggggaggg

SEQ ID NO: 111769 - RNA, 22 nt, Human
ugaaauggugacguuuaaugag

SEQ ID NO: 111770 - RNA, 25 nt, Human
ugacagggcauuaaauacuguggga

SEQ ID NO: 111771 - RNA, 19 nt, Human
ugagggaggaaggagggcc

SEQ ID NO: 111772 - RNA, 19 nt, Human
ugagggggucuuugguggg

SEQ ID NO: 111773 - RNA, 23 nt, Human
ugagucagacuagaagggacuga

SEQ ID NO: 111774 - RNA, 21 nt, Human
ugggugcuggggggaggggga

SEQ ID NO: 111775 - RNA, 18 nt, Human
uggugcggcagggcuggg

SEQ ID NO: 111776 - RNA, 21 nt, Human
uggugcggcagggcugggggg

SEQ ID NO: 111777 - RNA, 25 nt, Human
ugguggguggguuagcugcauggcc

SEQ ID NO: 111778 - RNA, 20 nt, Human
ugucugaagagaaugcaaaa

SEQ ID NO: 111779 - RNA, 23 nt, Human
ugucugaagagaaugcaaaaggu

SEQ ID NO: 111780 - RNA, 21 nt, Human
ugugcaaaauagaaaccgggg

SEQ ID NO: 111781 - RNA, 20 nt, Human
uucaaauacagcaaguuacc

SEQ ID NO: 111782 - RNA, 21 nt, Human
uugguggguggguuagcugca

SEQ ID NO: 111783 - RNA, 22 nt, Human
uugguggguggguuagcugcau

SEQ ID NO: 111784 - RNA, 21 nt, Human
uugugggugcuggggggaggg

SEQ ID NO: 111785 - RNA, 22 nt, Human
agccgcagaaauuggaaggaau

SEQ ID NO: 111786 - RNA, 19 nt, Human
caccuguucccugcuccug

SEQ ID NO: 111787 - RNA, 23 nt, Human
cucgccucggugcggcacagccg

SEQ ID NO: 111788 - RNA, 18 nt, Human
cugcuccugcucgccucg

SEQ ID NO: 111789 - RNA, 23 nt, Human
uagcucuauggcaguuggauaau

SEQ ID NO: 111790 - RNA, 21 nt, Human
uaggauggagccgcagaaauu

SEQ ID NO: 111791 - RNA, 26 nt, Human
uauggcaguuggauaauuuuaaacac

SEQ ID NO: 111792 - RNA, 19 nt, Human
ugggaugggaacagcagcu

SEQ ID NO: 111793 - RNA, 22 nt, Human
uguaaaucaguugaauaguuug

SEQ ID NO: 111794 - RNA, 26 nt, Human
uuccaaaaaagaauuuagcucuaugg

SEQ ID NO: 111795 - RNA, 18 nt, Human
aaugggucuuggaggggu

SEQ ID NO: 111796 - RNA, 20 nt, Human
accuccuacaaaaagggcac

SEQ ID NO: 111797 - RNA, 22 nt, Human
agcucuuggucccagggcuugc

SEQ ID NO: 111798 - RNA, 18 nt, Human
aggaccuggggcgagaga

SEQ ID NO: 111799 - RNA, 19 nt, Human
aggcgggagagcucuuggu

SEQ ID NO: 111800 - RNA, 26 nt, Human
aggcgggagagcucuuggucccaggg

SEQ ID NO: 111801 - RNA, 21 nt, Human
agggacugugcagaauggguc

SEQ ID NO: 111802 - RNA, 23 nt, Human
aguuaucggggacagcgucaggg

SEQ ID NO: 111803 - RNA, 23 nt, Human
aucaccccccucaaagcugaagg

SEQ ID NO: 111804 - RNA, 22 nt, Human
auguccgggcagagguggggau

SEQ ID NO: 111805 - RNA, 25 nt, Human
auuggccaucuccugcccaaacccu

SEQ ID NO: 111806 - RNA, 22 nt, Human
caagacaagcccuuuagucacc

SEQ ID NO: 111807 - RNA, 23 nt, Human
caagacaagcccuuuagucaccc

SEQ ID NO: 111808 - RNA, 25 nt, Human
caauaccaggacacaccagcaugaa

SEQ ID NO: 111809 - RNA, 21 nt, Human
caccccccucaaagcugaagg

SEQ ID NO: 111810 - RNA, 19 nt, Human
cacuucgcuccaguucuuc

SEQ ID NO: 111811 - RNA, 20 nt, Human
cagcaggaaggggcuggcug

SEQ ID NO: 111812 - RNA, 21 nt, Human
cagccuggaguaucacccccc

SEQ ID NO: 111813 - RNA, 23 nt, Human
caggaaggggcuggcuguguccg

SEQ ID NO: 111814 - RNA, 21 nt, Human
caggcucccagccucaggcau

SEQ ID NO: 111815 - RNA, 21 nt, Human
caucuccugcccaaacccugg

SEQ ID NO: 111816 - RNA, 23 nt, Human
ccaauaccaggacacaccagcau

SEQ ID NO: 111817 - RNA, 20 nt, Human
ccaccaagggcccuggccuc

SEQ ID NO: 111818 - RNA, 20 nt, Human
ccccaccaagacaagcccuu

SEQ ID NO: 111819 - RNA, 25 nt, Human
ccccucccaggcaggagugagucag

SEQ ID NO: 111820 - RNA, 24 nt, Human
cccuucuucccaugggccuguucc

SEQ ID NO: 111821 - RNA, 19 nt, Human
ccucccaggcaggagugag

SEQ ID NO: 111822 - RNA, 26 nt, Human
ccuccuacaaaaagggcacuguuuaa

SEQ ID NO: 111823 - RNA, 18 nt, Human
ccuggagggacugugcag

SEQ ID NO: 111824 - RNA, 19 nt, Human
ccugggagcaggcagggcc

SEQ ID NO: 111825 - RNA, 18 nt, Human
ccuucccagaaaccuccc

SEQ ID NO: 111826 - RNA, 22 nt, Human
cggaucuggccaggugguccua

SEQ ID NO: 111827 - RNA, 23 nt, Human
cgucaggguccuugcugcugcuc

SEQ ID NO: 111828 - RNA, 20 nt, Human
cugcauuccccucccaggca

SEQ ID NO: 111829 - RNA, 19 nt, Human
cuucaaccuguucaugucu

SEQ ID NO: 111830 - RNA, 23 nt, Human
gaagacauguuuuuaaaaccccc

SEQ ID NO: 111831 - RNA, 18 nt, Human
gaagagccucagcucagc

SEQ ID NO: 111832 - RNA, 21 nt, Human
gaccuggggcgagagaagggu

SEQ ID NO: 111833 - RNA, 23 nt, Human
gaggcugagaaaggaccuggggc

SEQ ID NO: 111834 - RNA, 18 nt, Human
gcagaaugggucuuggag

SEQ ID NO: 111835 - RNA, 21 nt, Human
gccccuuuccaccaagggccc

SEQ ID NO: 111836 - RNA, 18 nt, Human
gcccuggccucucaacuc

SEQ ID NO: 111837 - RNA, 24 nt, Human
gcccuggccucucaacucuuuuug

SEQ ID NO: 111838 - RNA, 21 nt, Human
ggaaaugcaagcaguccaagg

SEQ ID NO: 111839 - RNA, 18 nt, Human
ggagaaggcgggagagcu

SEQ ID NO: 111840 - RNA, 18 nt, Human
ggagcggaucuggccagg

SEQ ID NO: 111841 - RNA, 21 nt, Human
ggauguccgggcagagguggg

SEQ ID NO: 111842 - RNA, 21 nt, Human
ggcgcagagggagggguucca

SEQ ID NO: 111843 - RNA, 24 nt, Human
gggagaccccaccaagacaagccc

SEQ ID NO: 111844 - RNA, 24 nt, Human
gggcgcugguucucagccgcuugg

SEQ ID NO: 111845 - RNA, 24 nt, Human
gggguuuuuuuuuucaggaaagga

SEQ ID NO: 111846 - RNA, 22 nt, Human
gucugguguuccugccgggccu

SEQ ID NO: 111847 - RNA, 21 nt, Human
gugcagaaugggucuuggagg

SEQ ID NO: 111848 - RNA, 22 nt, Human
gugcagaaugggucuuggaggg

SEQ ID NO: 111849 - RNA, 24 nt, Human
uaaaacccccuucuucccaugggc

SEQ ID NO: 111850 - RNA, 18 nt, Human
uaucucagaccaaggcug

SEQ ID NO: 111851 - RNA, 20 nt, Human
ucaacucuuuuuggcuccca

SEQ ID NO: 111852 - RNA, 22 nt, Human
ucaggcucccagccucaggcau

SEQ ID NO: 111853 - RNA, 21 nt, Human
uccagcugcggcgcagaggga

SEQ ID NO: 111854 - RNA, 24 nt, Human
ucccaauaccaggacacaccagca

SEQ ID NO: 111855 - RNA, 19 nt, Human
ucccagagggccaucucug

SEQ ID NO: 111856 - RNA, 18 nt, Human
ucccagggcuugcccuuc

SEQ ID NO: 111857 - RNA, 19 nt, Human
ucccagggcuugcccuucu

SEQ ID NO: 111858 - RNA, 24 nt, Human
ucccaugggccuguuccuucccuc

SEQ ID NO: 111859 - RNA, 20 nt, Human
uccccucccaggcaggaguu

SEQ ID NO: 111860 - RNA, 20 nt, Human
uccgggcagagguggggauc

SEQ ID NO: 111861 - RNA, 18 nt, Human
ucggggacagcgucaggg

SEQ ID NO: 111862 - RNA, 22 nt, Human
ucuggcacagugucaggccacc

SEQ ID NO: 111863 - RNA, 25 nt, Human
ucuuccuuagacugaaggaugguga

SEQ ID NO: 111864 - RNA, 19 nt, Human
ugacagggucagguuggca

SEQ ID NO: 111865 - RNA, 21 nt, Human
ugacugcaggcagcacuggag

SEQ ID NO: 111866 - RNA, 22 nt, Human
ugcaagcaguccaaggccgucu

SEQ ID NO: 111867 - RNA, 22 nt, Human
ugcccuucuuccuuagacugaa

SEQ ID NO: 111868 - RNA, 24 nt, Human
uggagaggugggcgcaugauuggc

SEQ ID NO: 111869 - RNA, 20 nt, Human
uggaugcugcccgagucggu

SEQ ID NO: 111870 - RNA, 22 nt, Human
uggcacagugucaggccaccuu

SEQ ID NO: 111871 - RNA, 18 nt, Human
uggcagcaggaaggggcu

SEQ ID NO: 111872 - RNA, 20 nt, Human
uggcagcaggaaggggcugg

SEQ ID NO: 111873 - RNA, 21 nt, Human
uggccaggugguccuagguau

SEQ ID NO: 111874 - RNA, 22 nt, Human
uggcguccagcugcggcgcaga

SEQ ID NO: 111875 - RNA, 18 nt, Human
uggcuggggcagguggau

SEQ ID NO: 111876 - RNA, 27 nt, Human
ugggagagcagagucuggggcugguca

SEQ ID NO: 111877 - RNA, 22 nt, Human
ugggccuguuccuucccuccag

SEQ ID NO: 111878 - RNA, 21 nt, Human
uggggcugcaggucggggagg

SEQ ID NO: 111879 - RNA, 22 nt, Human
ugggucuuggaggggugggaga

SEQ ID NO: 111880 - RNA, 23 nt, Human
ugugcagaaugggucuuggaggg

SEQ ID NO: 111881 - RNA, 23 nt, Human
ugugcagaaugggucuuggaggg

SEQ ID NO: 111882 - RNA, 25 nt, Human
ugugcagaaugggucuuggaggggu

SEQ ID NO: 111883 - RNA, 24 nt, Human
uguuccuucccuccaggcagccua

SEQ ID NO: 111884 - RNA, 24 nt, Human
uuggggacagcccagcuggaggcu

SEQ ID NO: 111885 - RNA, 25 nt, Human
uuuaaagaaaauccuugcguggguu

SEQ ID NO: 111886 - RNA, 28 nt, Human
uuuuaaaacccccuucuucccaugggcc

SEQ ID NO: 111887 - RNA, 18 nt, Human
uuuuuuuuuuuuuggggg

SEQ ID NO: 111888 - RNA, 19 nt, Human
uuuuuuuuuuuuuuggggg

SEQ ID NO: 111889 - RNA, 20 nt, Human
uuuuuuuuuuuuuuuggggg

SEQ ID NO: 111890 - RNA, 22 nt, Human
uuuuuuuuuuuuuuuuuggggg

SEQ ID NO: 111891 - RNA, 18 nt, Human
aaaaaaacaugcauaauc

SEQ ID NO: 111892 - RNA, 20 nt, Human
aaaaagagagggucccuuaa

SEQ ID NO: 111893 - RNA, 25 nt, Human
aaacagaaugaagcuugaaaaucug

SEQ ID NO: 111894 - RNA, 24 nt, Human
aaacaucauucuucuaagccccac

SEQ ID NO: 111895 - RNA, 23 nt, Human
aacaucauucuucuaagccccac

SEQ ID NO: 111896 - RNA, 22 nt, Human
aacuaauucauggggcaaaguc

SEQ ID NO: 111897 - RNA, 20 nt, Human
aacucaggaacuaaaaagcc

SEQ ID NO: 111898 - RNA, 20 nt, Human
aagcacuuuuuuugguaacc

SEQ ID NO: 111899 - RNA, 21 nt, Human
aauaacaauggucauaugaaa

SEQ ID NO: 111900 - RNA, 18 nt, Human
aauugguaggaaagaggu

SEQ ID NO: 111901 - RNA, 25 nt, Human
acaugccacuccucuccaacaaaau

SEQ ID NO: 111902 - RNA, 19 nt, Human
agaaacaacaugaaacaau

SEQ ID NO: 111903 - RNA, 24 nt, Human
agauauauugcuagaaacaacaug

SEQ ID NO: 111904 - RNA, 20 nt, Human
agcauuugaauuaaaugaaa

SEQ ID NO: 111905 - RNA, 29 nt, Human
aggaaagagguaaaaaacugagggacccc

SEQ ID NO: 111906 - RNA, 26 nt, Human
aggaauaauugagagguacagauggc

SEQ ID NO: 111907 - RNA, 21 nt, Human
aggaauugaaagauaaauuuu

SEQ ID NO: 111908 - RNA, 21 nt, Human
agggucccuuaauggaauugg

SEQ ID NO: 111909 - RNA, 20 nt, Human
aguauaggaacauauaggaa

SEQ ID NO: 111910 - RNA, 20 nt, Human
agucugaaguauguaauaug

SEQ ID NO: 111911 - RNA, 21 nt, Human
aucucauggagauauauugcu

SEQ ID NO: 111912 - RNA, 18 nt, Human
augaaacaaagugcauau

SEQ ID NO: 111913 - RNA, 19 nt, Human
augaagcuugaaaaucugg

SEQ ID NO: 111914 - RNA, 20 nt, Human
cacacacaggaauugaaaga

SEQ ID NO: 111915 - RNA, 20 nt, Human
cacuccucuccaacaaaaua

SEQ ID NO: 111916 - RNA, 20 nt, Human
cacugcauuucaugaaagca

SEQ ID NO: 111917 - RNA, 20 nt, Human
cagcagcauugccuugguuc

SEQ ID NO: 111918 - RNA, 20 nt, Human
cauaggauacacacacagga

SEQ ID NO: 111919 - RNA, 21 nt, Human
cauccaaaaagagaggguccc

SEQ ID NO: 111920 - RNA, 23 nt, Human
ccaaaccaaacaucauucuucua

SEQ ID NO: 111921 - RNA, 20 nt, Human
cugaacuguuuucuaauucu

SEQ ID NO: 111922 - RNA, 23 nt, Human
cuucuaagccccacaguagcauu

SEQ ID NO: 111923 - RNA, 21 nt, Human
gaaaaguauaggaacauauag

SEQ ID NO: 111924 - RNA, 19 nt, Human
gaaagagguaaaaaacuga

SEQ ID NO: 111925 - RNA, 24 nt, Human
gaaugaaacagaaugaagcuugaa

SEQ ID NO: 111926 - RNA, 19 nt, Human
gagcaaucaucuugaaaau

SEQ ID NO: 111927 - RNA, 20 nt, Human
gagggauuauguggauuuug

SEQ ID NO: 111928 - RNA, 22 nt, Human
gcaauguugaaaacucaaucug

SEQ ID NO: 111929 - RNA, 21 nt, Human
ggaaagagguaaaaaacugau

SEQ ID NO: 111930 - RNA, 25 nt, Human
guugagauucaggucauuccugauu

SEQ ID NO: 111931 - RNA, 23 nt, Human
uaaaaaacugauuuugcaauguu

SEQ ID NO: 111932 - RNA, 18 nt, Human
uaaaaagccugccagacu

SEQ ID NO: 111933 - RNA, 18 nt, Human
uaaaaggauuuacuguuu

SEQ ID NO: 111934 - RNA, 21 nt, Human
uaagaguugaaaaaaacaugc

SEQ ID NO: 111935 - RNA, 21 nt, Human
uaagccccacaguagcauuuu

SEQ ID NO: 111936 - RNA, 19 nt, Human
uaauaaaaaggaguuaaua

SEQ ID NO: 111937 - RNA, 23 nt, Human
uaaucacugcauuucaugaaagc

SEQ ID NO: 111938 - RNA, 22 nt, Human
uacaacuaguuagcagcauacc

SEQ ID NO: 111939 - RNA, 28 nt, Human
uagaaaauaauacauacagauaaccauu

SEQ ID NO: 111940 - RNA, 19 nt, Human
uauacaguauaugcggacc

SEQ ID NO: 111941 - RNA, 20 nt, Human
uauacaguauaugcggaccu

SEQ ID NO: 111942 - RNA, 21 nt, Human
uaucugaacuguuuucuaauu

SEQ ID NO: 111943 - RNA, 22 nt, Human
uauugcuagaaacaacaugaag

SEQ ID NO: 111944 - RNA, 22 nt, Human
ucacugcauuucaugaaagcac

SEQ ID NO: 111945 - RNA, 19 nt, Human
ucuaagccccacaguagca

SEQ ID NO: 111946 - RNA, 22 nt, Human
ucuccugggagacaaaucuccg

SEQ ID NO: 111947 - RNA, 20 nt, Human
ucugaacuguuuucuaauuc

SEQ ID NO: 111948 - RNA, 20 nt, Human
ugaaaacucaaucugcugau

SEQ ID NO: 111949 - RNA, 18 nt, Human
ugaaauugguaggaaaga

SEQ ID NO: 111950 - RNA, 21 nt, Human
ugcccugucuccugggagaca

SEQ ID NO: 111951 - RNA, 19 nt, Human
uggaaauaugaacaaguuu

SEQ ID NO: 111952 - RNA, 20 nt, Human
uggaauauaacugaaugaaa

SEQ ID NO: 111953 - RNA, 21 nt, Human
uguaaaaagaaauucucaugc

SEQ ID NO: 111954 - RNA, 21 nt, Human
uguguacaugugagagugugu

SEQ ID NO: 111955 - RNA, 25 nt, Human
uguguguguacaugugagagugugu

SEQ ID NO: 111956 - RNA, 22 nt, Human
uguuuaauauuuggguugagau

SEQ ID NO: 111957 - RNA, 22 nt, Human
uuagcagcauaccaaaccaaac

SEQ ID NO: 111958 - RNA, 22 nt, Human
uucccacaucagacggcuccac

SEQ ID NO: 111959 - RNA, 24 nt, Human
uuugaaucacaugccacuccucuc

SEQ ID NO: 111960 - RNA, 20 nt, Human
aaaacagccuuugcuuucaa

SEQ ID NO: 111961 - RNA, 23 nt, Human
aaaggaagagaauguugggggcc

SEQ ID NO: 111962 - RNA, 19 nt, Human
aaauaauaaauuuccaucu

SEQ ID NO: 111963 - RNA, 19 nt, Human
aacaucgacauuugcuuca

SEQ ID NO: 111964 - RNA, 22 nt, Human
aaccagcaaugguaaaagggca

SEQ ID NO: 111965 - RNA, 22 nt, Human
aacuauaaaagaaaaagagcaa

SEQ ID NO: 111966 - RNA, 24 nt, Human
aagcaacagguaccagguuuguga

SEQ ID NO: 111967 - RNA, 19 nt, Human
aaguauaagaggcuugaaa

SEQ ID NO: 111968 - RNA, 23 nt, Human
aauaaaacagccuuugcuuucaa

SEQ ID NO: 111969 - RNA, 24 nt, Human
aauaagacagauaguaccuacaaa

SEQ ID NO: 111970 - RNA, 26 nt, Human
accaggugccaugcacucucccaugg

SEQ ID NO: 111971 - RNA, 21 nt, Human
accgccucuuaaccucuccca

SEQ ID NO: 111972 - RNA, 18 nt, Human
acugcguaagagcagggu

SEQ ID NO: 111973 - RNA, 24 nt, Human
agaaaaaaaauacccacguucuaa

SEQ ID NO: 111974 - RNA, 22 nt, Human
agaacaauagcaucuauaccuu

SEQ ID NO: 111975 - RNA, 25 nt, Human
agaacaauagcaucuauaccuucga

SEQ ID NO: 111976 - RNA, 19 nt, Human
agaacagauuccaucauag

SEQ ID NO: 111977 - RNA, 18 nt, Human
agagagaaaaaaguagga

SEQ ID NO: 111978 - RNA, 24 nt, Human
agaggaagagagaaaaaaguagga

SEQ ID NO: 111979 - RNA, 19 nt, Human
agaguuggaagaaagacuu

SEQ ID NO: 111980 - RNA, 27 nt, Human
aggguggugaaaagaaaaaaugggggg

SEQ ID NO: 111981 - RNA, 30 nt, Human
agucaccacgcucacugaaaaaauuuaaaa

SEQ ID NO: 111982 - RNA, 27 nt, Human
auagguucucuuugccccuuucuuuuc

SEQ ID NO: 111983 - RNA, 24 nt, Human
caacaaaauagcuuuuucaaccuc

SEQ ID NO: 111984 - RNA, 21 nt, Human
caaugguaaaagggcaucagg

SEQ ID NO: 111985 - RNA, 18 nt, Human
cacagaagauguuuccug

SEQ ID NO: 111986 - RNA, 22 nt, Human
cacagcacuaaccucugcaguc

SEQ ID NO: 111987 - RNA, 18 nt, Human
cacugagagcuugggcgg

SEQ ID NO: 111988 - RNA, 19 nt, Human
cagccaccaacuuucccug

SEQ ID NO: 111989 - RNA, 18 nt, Human
cauaaacgggccauuaaa

SEQ ID NO: 111990 - RNA, 25 nt, Human
cauuuuuuguauuauuuuguuuuga

SEQ ID NO: 111991 - RNA, 22 nt, Human
cccaagaaacugaugugcucca

SEQ ID NO: 111992 - RNA, 18 nt, Human
ccccagaugccagagagc

SEQ ID NO: 111993 - RNA, 19 nt, Human
ccccauuuguuuacaggaa

SEQ ID NO: 111994 - RNA, 23 nt, Human
ccucuuaaccucucccaggcaaa

SEQ ID NO: 111995 - RNA, 23 nt, Human
ccugugcccagcucucagccugc

SEQ ID NO: 111996 - RNA, 21 nt, Human
cguuugguuuccugucugaug

SEQ ID NO: 111997 - RNA, 23 nt, Human
cuccaagagcucgcugcggagau

SEQ ID NO: 111998 - RNA, 20 nt, Human
cucccgcuuccucuucuucc

SEQ ID NO: 111999 - RNA, 20 nt, Human
cucuuugccccuuucuuuuc

SEQ ID NO: 112000 - RNA, 18 nt, Human
cugaaacuuuaaaacagg

SEQ ID NO: 112001 - RNA, 18 nt, Human
cugaacacuugcauguuc

SEQ ID NO: 112002 - RNA, 26 nt, Human
cuucgaaaccgccucuuaaccucucc

SEQ ID NO: 112003 - RNA, 18 nt, Human
cuuguagaauucaaugaa

SEQ ID NO: 112004 - RNA, 24 nt, Human
cuuugccccuuucuuuuccgacuu

SEQ ID NO: 112005 - RNA, 23 nt, Human
gaaaaaaucuuuuguaacagcug

SEQ ID NO: 112006 - RNA, 22 nt, Human
gaaugugcucuguacuggugua

SEQ ID NO: 112007 - RNA, 18 nt, Human
gcgcuccaagagcucgcu

SEQ ID NO: 112008 - RNA, 23 nt, Human
gcucgcugcggagaugcaguccg

SEQ ID NO: 112009 - RNA, 18 nt, Human
ggccggcggcgcuccaag

SEQ ID NO: 112010 - RNA, 19 nt, Human
gguucaaauguguccguuu

SEQ ID NO: 112011 - RNA, 20 nt, Human
guaauucccuccucccuauc

SEQ ID NO: 112012 - RNA, 24 nt, Human
gucccuuucucuccucccuaguaa

SEQ ID NO: 112013 - RNA, 24 nt, Human
guccuauaugucuuaauugauggu

SEQ ID NO: 112014 - RNA, 18 nt, Human
gucucaagaauauuccau

SEQ ID NO: 112015 - RNA, 22 nt, Human
uaaaguaacuccuaaugguaau

SEQ ID NO: 112016 - RNA, 18 nt, Human
uaaccucugcagucaccu

SEQ ID NO: 112017 - RNA, 20 nt, Human
uagaaaagaacagauuccau

SEQ ID NO: 112018 - RNA, 24 nt, Human
uaggcuauccaaggagagaguugg

SEQ ID NO: 112019 - RNA, 18 nt, Human
uaggguucuugaagggag

SEQ ID NO: 112020 - RNA, 23 nt, Human
uaggugcauuagcuuuucucaag

SEQ ID NO: 112021 - RNA, 24 nt, Human
uauaaagaaauauuaaaaagguuu

SEQ ID NO: 112022 - RNA, 18 nt, Human
uauuucacaggggaugga

SEQ ID NO: 112023 - RNA, 19 nt, Human
ucaaucugguuucuaauau

SEQ ID NO: 112024 - RNA, 20 nt, Human
ucaaucugguuucuaauaua

SEQ ID NO: 112025 - RNA, 21 nt, Human
ucagucaggaaccccagaugc

SEQ ID NO: 112026 - RNA, 20 nt, Human
ucagucucaagaauauucca

SEQ ID NO: 112027 - RNA, 20 nt, Human
ucauagaaggaaagaaaagc

SEQ ID NO: 112028 - RNA, 18 nt, Human
ucccauagccaaguagcc

SEQ ID NO: 112029 - RNA, 22 nt, Human
ucccuaguaauucccuccuccc

SEQ ID NO: 112030 - RNA, 21 nt, Human
uccuggaccagcuuucuugag

SEQ ID NO: 112031 - RNA, 19 nt, Human
ucuauaccuucgaaaccgc

SEQ ID NO: 112032 - RNA, 22 nt, Human
ucuccuagcuuuucaaaacauc

SEQ ID NO: 112033 - RNA, 26 nt, Human
ucucuacucauuuugggaaaaaaggg

SEQ ID NO: 112034 - RNA, 18 nt, Human
ugacacaaccugaacacu

SEQ ID NO: 112035 - RNA, 21 nt, Human
ugagcaggugguugaaagcca

SEQ ID NO: 112036 - RNA, 18 nt, Human
ugaugauaaaugguagcc

SEQ ID NO: 112037 - RNA, 25 nt, Human
ugaugauaaaugguagccuuucugg

SEQ ID NO: 112038 - RNA, 19 nt, Human
ugccagagagcuggcauag

SEQ ID NO: 112039 - RNA, 19 nt, Human
ugcccuguuaccacggguc

SEQ ID NO: 112040 - RNA, 23 nt, Human
ugcuuuuucuugugccucugaau

SEQ ID NO: 112041 - RNA, 18 nt, Human
uggaaaaacacguggagu

SEQ ID NO: 112042 - RNA, 23 nt, Human
uggaaugugcucuguacuggugu

SEQ ID NO: 112043 - RNA, 18 nt, Human
uggcaggaaaaggagagg

SEQ ID NO: 112044 - RNA, 20 nt, Human
ugggaaaauugcucaacagg

SEQ ID NO: 112045 - RNA, 21 nt, Human
ugggggguuucaaauucagug

SEQ ID NO: 112046 - RNA, 19 nt, Human
ugucaaaugcagggcagua

SEQ ID NO: 112047 - RNA, 21 nt, Human
uuaaagcaaaauaagaaacgc

SEQ ID NO: 112048 - RNA, 21 nt, Human
uuagaaagugcuuauuaagua

SEQ ID NO: 112049 - RNA, 23 nt, Human
uuagcuuguagaauucaaugaaa

SEQ ID NO: 112050 - RNA, 25 nt, Human
uuaguuacuuaauacuuuauccacc

SEQ ID NO: 112051 - RNA, 23 nt, Human
uucaguguuguuuggaggcauga

SEQ ID NO: 112052 - RNA, 27 nt, Human
uucauguaacaagucucuuuuuuugag

SEQ ID NO: 112053 - RNA, 23 nt, Human
uuccucagaauggugggaucuca

SEQ ID NO: 112054 - RNA, 21 nt, Human
uuccugucugauggccacauu

SEQ ID NO: 112055 - RNA, 21 nt, Human
uugccccuuucuuuuccgacu

SEQ ID NO: 112056 - RNA, 19 nt, Human
uugcuucauacacagaaga

SEQ ID NO: 112057 - RNA, 21 nt, Human
uuguguuauuucacaggggau

SEQ ID NO: 112058 - RNA, 19 nt, Human
uuguucuguuaccuugacu

SEQ ID NO: 112059 - RNA, 24 nt, Human
uuuauccaccguuugguuuccugu

SEQ ID NO: 112060 - RNA, 23 nt, Human
uuuccugucugauggccacauug

SEQ ID NO: 112061 - RNA, 24 nt, Human
uuucuggaaauaauuuuuguguaa

SEQ ID NO: 112062 - RNA, 21 nt, Human
uuuuucuugugccucugaauu

SEQ ID NO: 112063 - RNA, 20 nt, Human
aaauauccacuugggucaaa

SEQ ID NO: 112064 - RNA, 19 nt, Human
acacuguaaauuguaacca

SEQ ID NO: 112065 - RNA, 22 nt, Human
agaaggcagcggcuuuaaagga

SEQ ID NO: 112066 - RNA, 20 nt, Human
agccaugauuaugaagccuc

SEQ ID NO: 112067 - RNA, 22 nt, Human
agugcuuauuugccuaaauggc

SEQ ID NO: 112068 - RNA, 19 nt, Human
auauaucuauauacauaua

SEQ ID NO: 112069 - RNA, 19 nt, Human
auucagugugauauuuuua

SEQ ID NO: 112070 - RNA, 20 nt, Human
cacacuggauccccuuguac

SEQ ID NO: 112071 - RNA, 18 nt, Human
cacuggauccccuuguac

SEQ ID NO: 112072 - RNA, 22 nt, Human
cagaaugguuagagaacgaaug

SEQ ID NO: 112073 - RNA, 24 nt, Human
cucacuagcaguuuuauugcuuaa

SEQ ID NO: 112074 - RNA, 19 nt, Human
cucuuuucauuuugcuuau

SEQ ID NO: 112075 - RNA, 22 nt, Human
cugcucacaccugcucgagauc

SEQ ID NO: 112076 - RNA, 20 nt, Human
uaaauggcuguugacauacu

SEQ ID NO: 112077 - RNA, 22 nt, Human
uaaguuucucuuuucauuuugc

SEQ ID NO: 112078 - RNA, 21 nt, Human
uacacuguaaauuguaaccag

SEQ ID NO: 112079 - RNA, 28 nt, Human
uacaggucuccuuucuauauccagauuu

SEQ ID NO: 112080 - RNA, 22 nt, Human
uaccugaaccauguuaaagagc

SEQ ID NO: 112081 - RNA, 18 nt, Human
uauaaaauuaaggagaga

SEQ ID NO: 112082 - RNA, 24 nt, Human
ucacaccugcucgagauccacccg

SEQ ID NO: 112083 - RNA, 18 nt, Human
ucgagauccacccggcug

SEQ ID NO: 112084 - RNA, 24 nt, Human
ucuaaguaucagauucuuuuauug

SEQ ID NO: 112085 - RNA, 21 nt, Human
ucugcaguuauuugaaauguc

SEQ ID NO: 112086 - RNA, 24 nt, Human
ucuuucaguugucaaaauguuacc

SEQ ID NO: 112087 - RNA, 19 nt, Human
ugaaaacacacuacaaaag

SEQ ID NO: 112088 - RNA, 20 nt, Human
ugaaaacacacuacaaaagc

SEQ ID NO: 112089 - RNA, 21 nt, Human
ugaaaacacacuacaaaagca

SEQ ID NO: 112090 - RNA, 23 nt, Human
ugagaauacaauuuacacacugg

SEQ ID NO: 112091 - RNA, 23 nt, Human
uucagugugauauuuuuagucau

SEQ ID NO: 112092 - RNA, 20 nt, Human
uuuccugaguuucuaagagc

SEQ ID NO: 112093 - RNA, 19 nt, Human
uagaagaaauaauguggua

SEQ ID NO: 112094 - RNA, 19 nt, Human
aagaagacccaaauacgcu

SEQ ID NO: 112095 - RNA, 18 nt, Human
aaucuaaccucgggaucu

SEQ ID NO: 112096 - RNA, 23 nt, Human
acgcugagagaagacgcaugggc

SEQ ID NO: 112097 - RNA, 23 nt, Human
agaagacccaaauacgcugagag

SEQ ID NO: 112098 - RNA, 20 nt, Human
aggaguucucuuuauuucag

SEQ ID NO: 112099 - RNA, 23 nt, Human
agugccaagauccaagcgagaaa

SEQ ID NO: 112100 - RNA, 19 nt, Human
caggcucagggagacgacu

SEQ ID NO: 112101 - RNA, 27 nt, Human
cauuccauuacagucgucacuuccaac

SEQ ID NO: 112102 - RNA, 27 nt, Human
cgagaaaacgcaggaggaugcgcagac

SEQ ID NO: 112103 - RNA, 20 nt, Human
cgcagccucuuuagaaagcc

SEQ ID NO: 112104 - RNA, 19 nt, Human
cuggaaguccaacucuucu

SEQ ID NO: 112105 - RNA, 24 nt, Human
gaaaacgcaggaggaugcgcagac

SEQ ID NO: 112106 - RNA, 22 nt, Human
gagaacagagucacuuucuccc

SEQ ID NO: 112107 - RNA, 18 nt, Human
gcgccggcuccugccaga

SEQ ID NO: 112108 - RNA, 24 nt, Human
ggcggccgcggccaccgccaguuu

SEQ ID NO: 112109 - RNA, 24 nt, Human
gggugacagcaggaucagaagcac

SEQ ID NO: 112110 - RNA, 22 nt, Human
gugacagcaggaucagaagcac

SEQ ID NO: 112111 - RNA, 20 nt, Human
uacuuuaaucauauuuuaga

SEQ ID NO: 112112 - RNA, 26 nt, Human
uauacaagacaucauuccauuacagu

SEQ ID NO: 112113 - RNA, 24 nt, Human
uccaagcgagaaaacgcaggagga

SEQ ID NO: 112114 - RNA, 19 nt, Human
ucuuaaaaacuaucuucca

SEQ ID NO: 112115 - RNA, 20 nt, Human
ugagagaagacgcaugggcg

SEQ ID NO: 112116 - RNA, 22 nt, Human
ugcucucacacacagugggagu

SEQ ID NO: 112117 - RNA, 18 nt, Human
uggaagcacuucuuugcu

SEQ ID NO: 112118 - RNA, 18 nt, Human
ugggcaaagaagacccaa

SEQ ID NO: 112119 - RNA, 18 nt, Human
uuccaacuacaggcucag

SEQ ID NO: 112120 - RNA, 25 nt, Human
aaaaaugacaggagaaaccgguacc

SEQ ID NO: 112121 - RNA, 22 nt, Human
aaaacuguacagauuuaaacaa

SEQ ID NO: 112122 - RNA, 21 nt, Human
aaaagaucaaaagacaagaac

SEQ ID NO: 112123 - RNA, 19 nt, Human
aaacacacacuaucauacc

SEQ ID NO: 112124 - RNA, 22 nt, Human
aaacacacacuaucauaccaug

SEQ ID NO: 112125 - RNA, 18 nt, Human
aaaguucuuugcacuacu

SEQ ID NO: 112126 - RNA, 22 nt, Human
aacaaauaaucauuuagcaaac

SEQ ID NO: 112127 - RNA, 23 nt, Human
aagaaaacacugauccuguaaca

SEQ ID NO: 112128 - RNA, 19 nt, Human
aauaaaagaucaaaagaca

SEQ ID NO: 112129 - RNA, 22 nt, Human
aauaaaagaucaaaagacaaga

SEQ ID NO: 112130 - RNA, 22 nt, Human
acaaucaggguaugcacccugc

SEQ ID NO: 112131 - RNA, 18 nt, Human
acaccccgacuucccagg

SEQ ID NO: 112132 - RNA, 23 nt, Human
acucaacuucaaaaaugacagga

SEQ ID NO: 112133 - RNA, 19 nt, Human
acugcuaaaaccaaaggca

SEQ ID NO: 112134 - RNA, 22 nt, Human
aggcaguguacagaaggcuggu

SEQ ID NO: 112135 - RNA, 21 nt, Human
aggggcacagaugcuggagcu

SEQ ID NO: 112136 - RNA, 19 nt, Human
augaagauacucauuaaag

SEQ ID NO: 112137 - RNA, 26 nt, Human
caaacacacacuaucauaccaugaag

SEQ ID NO: 112138 - RNA, 24 nt, Human
caaagaacugcuaaaaccaaaggc

SEQ ID NO: 112139 - RNA, 21 nt, Human
caaggggcacagaugcuggag

SEQ ID NO: 112140 - RNA, 23 nt, Human
caaucuacuccaaacucaacuuc

SEQ ID NO: 112141 - RNA, 20 nt, Human
cacagcacagccagcugaau

SEQ ID NO: 112142 - RNA, 24 nt, Human
cacuauuaccuacucagcacuuug

SEQ ID NO: 112143 - RNA, 23 nt, Human
cacucacaaacacacacuaucau

SEQ ID NO: 112144 - RNA, 22 nt, Human
caggcacccacugcaccaaaag

SEQ ID NO: 112145 - RNA, 22 nt, Human
ccagaaccccugacaaugucca

SEQ ID NO: 112146 - RNA, 22 nt, Human
ccccugacaauguccaccucua

SEQ ID NO: 112147 - RNA, 23 nt, Human
ccccugacaauguccaccucuag

SEQ ID NO: 112148 - RNA, 26 nt, Human
cccucuuaccuucuaccuucucaaaa

SEQ ID NO: 112149 - RNA, 20 nt, Human
ccggagcuuccaacacugcc

SEQ ID NO: 112150 - RNA, 24 nt, Human
ccucuuaccuucuaccuucucaaa

SEQ ID NO: 112151 - RNA, 18 nt, Human
ccugggccacuuccggga

SEQ ID NO: 112152 - RNA, 22 nt, Human
cgcccucgcggccuucagcagc

SEQ ID NO: 112153 - RNA, 24 nt, Human
cucaaucaagcaacguccaucacc

SEQ ID NO: 112154 - RNA, 22 nt, Human
cuccucuaugcgccaaauuuaa

SEQ ID NO: 112155 - RNA, 21 nt, Human
cuuccgggagaaccggagcuu

SEQ ID NO: 112156 - RNA, 21 nt, Human
cuuccuaauucauucauuuca

SEQ ID NO: 112157 - RNA, 20 nt, Human
gaagcaaccaaucuacucca

SEQ ID NO: 112158 - RNA, 22 nt, Human
gagaaccggagcuuccaacacu

SEQ ID NO: 112159 - RNA, 19 nt, Human
gaggaacacuacuccucag

SEQ ID NO: 112160 - RNA, 22 nt, Human
gauaguguuugucauccuuagg

SEQ ID NO: 112161 - RNA, 21 nt, Human
ggcaaaaccaauccaaucagg

SEQ ID NO: 112162 - RNA, 19 nt, Human
ggucccauuccagaacccc

SEQ ID NO: 112163 - RNA, 24 nt, Human
guaaauacaaucuuccuaauucau

SEQ ID NO: 112164 - RNA, 22 nt, Human
gugaacacuuaaaacuguacag

SEQ ID NO: 112165 - RNA, 21 nt, Human
guuugcugguaaaauguauuc

SEQ ID NO: 112166 - RNA, 24 nt, Human
uaaaagaucaaaagacaagaacca

SEQ ID NO: 112167 - RNA, 27 nt, Human
uaaaagaucaaaagacaagaaccaaug

SEQ ID NO: 112168 - RNA, 21 nt, Human
uaacaucagcggcaaaaccaa

SEQ ID NO: 112169 - RNA, 19 nt, Human
uaagaacacacuccgcucu

SEQ ID NO: 112170 - RNA, 22 nt, Human
uacaggcacccacugcaccaaa

SEQ ID NO: 112171 - RNA, 21 nt, Human
uaccuucuaccuucucaaaau

SEQ ID NO: 112172 - RNA, 20 nt, Human
uaucaccaaucacagauuaa

SEQ ID NO: 112173 - RNA, 19 nt, Human
ucacaaacacacacuauca

SEQ ID NO: 112174 - RNA, 18 nt, Human
uccacagcacagcacagc

SEQ ID NO: 112175 - RNA, 21 nt, Human
uccacagcacagcacagccag

SEQ ID NO: 112176 - RNA, 30 nt, Human
ucccagacagacauuuaggugcacagcccc

SEQ ID NO: 112177 - RNA, 19 nt, Human
ucuaccuucucaaaauaga

SEQ ID NO: 112178 - RNA, 18 nt, Human
ucucagccugcuccuccc

SEQ ID NO: 112179 - RNA, 18 nt, Human
ucugcagucagcacugag

SEQ ID NO: 112180 - RNA, 24 nt, Human
ugaaaaggaagugaccuguuacaa

SEQ ID NO: 112181 - RNA, 24 nt, Human
ugaaaguauauacacucuuuguau

SEQ ID NO: 112182 - RNA, 25 nt, Human
ugacaacaaucaggguaugcacccu

SEQ ID NO: 112183 - RNA, 25 nt, Human
ugaguuacaggcacccacugcacca

SEQ ID NO: 112184 - RNA, 22 nt, Human
ugauauggugugguaguuuuca

SEQ ID NO: 112185 - RNA, 20 nt, Human
ugcaagacuucucagccugc

SEQ ID NO: 112186 - RNA, 20 nt, Human
uggaaaauucauagauaugc

SEQ ID NO: 112187 - RNA, 21 nt, Human
uggaaaggcuauuaaaaauca

SEQ ID NO: 112188 - RNA, 21 nt, Human
uggaaugcucagugguuaaaa

SEQ ID NO: 112189 - RNA, 19 nt, Human
uguacagauuuaaacaaau

SEQ ID NO: 112190 - RNA, 19 nt, Human
ugugguucucggggacguu

SEQ ID NO: 112191 - RNA, 19 nt, Human
uguuugcuuuucaaagaac

SEQ ID NO: 112192 - RNA, 22 nt, Human
uuaaaaacagcaauuucuagcc

SEQ ID NO: 112193 - RNA, 19 nt, Human
uuaaagauacugcacguau

SEQ ID NO: 112194 - RNA, 21 nt, Human
uuaagacaccuuaauugguac

SEQ ID NO: 112195 - RNA, 21 nt, Human
uuaauugguacuucgcacuca

SEQ ID NO: 112196 - RNA, 25 nt, Human
uucacauuuauuaaaaacagcaauu

SEQ ID NO: 112197 - RNA, 23 nt, Human
uuggaaaggcuauuaaaaaucaa

SEQ ID NO: 112198 - RNA, 22 nt, Human
uuugaaaguauauacacucuuu

SEQ ID NO: 112199 - RNA, 19 nt, Human
uuuuugaacuaagaagcug

SEQ ID NO: 112200 - RNA, 22 nt, Human
uuuuuuuuuuuuuuuuuuuagg

SEQ ID NO: 112201 - RNA, 19 nt, Human
agaaagcuggccugggcug

SEQ ID NO: 112202 - RNA, 19 nt, Human
agggguagcuuguuugcug

SEQ ID NO: 112203 - RNA, 19 nt, Human
cagcuccuuggcuggggcc

SEQ ID NO: 112204 - RNA, 19 nt, Human
caugcagaaagcuggccug

SEQ ID NO: 112205 - RNA, 19 nt, Human
ccagagcaucaccuggcca

SEQ ID NO: 112206 - RNA, 21 nt, Human
ccccaagccagacagccucgc

SEQ ID NO: 112207 - RNA, 19 nt, Human
cccuuagggaacaggccug

SEQ ID NO: 112208 - RNA, 22 nt, Human
ccuaacugcuagguccccagau

SEQ ID NO: 112209 - RNA, 21 nt, Human
cucgcugccugccguggcuuu

SEQ ID NO: 112210 - RNA, 18 nt, Human
gguccagacuuuguuucu

SEQ ID NO: 112211 - RNA, 19 nt, Human
uaacugcuagguccccaga

SEQ ID NO: 112212 - RNA, 22 nt, Human
uagcuuguuugcuguaguguuu

SEQ ID NO: 112213 - RNA, 20 nt, Human
ucagggaucauaaacaucac

SEQ ID NO: 112214 - RNA, 21 nt, Human
ucccccaagccagacagccuc

SEQ ID NO: 112215 - RNA, 21 nt, Human
uccuuggcuggggccccuuag

SEQ ID NO: 112216 - RNA, 18 nt, Human
ucgcucagcuccuuggcu

SEQ ID NO: 112217 - RNA, 18 nt, Human
ugcugccagccguagaaa

SEQ ID NO: 112218 - RNA, 22 nt, Human
uggaguggguccagacuuuguu

SEQ ID NO: 112219 - RNA, 21 nt, Human
uggccugggcugcucgcugcc

SEQ ID NO: 112220 - RNA, 21 nt, Human
ugucuaggacuggcaggggua

SEQ ID NO: 112221 - RNA, 20 nt, Human
aggcaggguugggggaagca

SEQ ID NO: 112222 - RNA, 24 nt, Human
aggcaggguugggggaagcagggu

SEQ ID NO: 112223 - RNA, 19 nt, Human
agguggugauaacucaaca

SEQ ID NO: 112224 - RNA, 25 nt, Human
auaacuugaucauaucccuuuaaaa

SEQ ID NO: 112225 - RNA, 21 nt, Human
caaaguggagaugaacaaaga

SEQ ID NO: 112226 - RNA, 21 nt, Human
ccaggcccaccuggcgaacug

SEQ ID NO: 112227 - RNA, 26 nt, Human
cuggcgaacugacucucagcccgcgc

SEQ ID NO: 112228 - RNA, 21 nt, Human
gcaggguacauguuauaacuu

SEQ ID NO: 112229 - RNA, 23 nt, Human
gcagucuuuuggaguauguguuu

SEQ ID NO: 112230 - RNA, 18 nt, Human
ggaauugaaaggugguga

SEQ ID NO: 112231 - RNA, 22 nt, Human
ggaguauguguuuaacugccaa

SEQ ID NO: 112232 - RNA, 19 nt, Human
gggcaucaggauuuuaaaa

SEQ ID NO: 112233 - RNA, 23 nt, Human
guggagaugaacaaagauuucau

SEQ ID NO: 112234 - RNA, 19 nt, Human
uagauaguagcagucuuuu

SEQ ID NO: 112235 - RNA, 21 nt, Human
uaggaaauaccgaacaaucaa

SEQ ID NO: 112236 - RNA, 20 nt, Human
ucccuuuaaaagaagugggg

SEQ ID NO: 112237 - RNA, 22 nt, Human
ugggaaagacauuuuagccuug

SEQ ID NO: 112238 - RNA, 18 nt, Human
ugggcaucaggauuuuaa

SEQ ID NO: 112239 - RNA, 18 nt, Human
uuuggaaaccacugagcu

SEQ ID NO: 112240 - RNA, 23 nt, Human
aaauaacaaccaugagaaacuua

SEQ ID NO: 112241 - RNA, 24 nt, Human
aauguacacagucaaauauauaua

SEQ ID NO: 112242 - RNA, 22 nt, Human
acagaguggaauccacccuguu

SEQ ID NO: 112243 - RNA, 25 nt, Human
accacuuccccgcugcccucugcca

SEQ ID NO: 112244 - RNA, 20 nt, Human
agggcagcuauuuuggggac

SEQ ID NO: 112245 - RNA, 21 nt, Human
agggcagcuauuuuggggaca

SEQ ID NO: 112246 - RNA, 25 nt, Human
agguaaggagacauuuauuagguca

SEQ ID NO: 112247 - RNA, 26 nt, Human
agucagaguccaguuacaacauggug

SEQ ID NO: 112248 - RNA, 24 nt, Human
caaauaacaaccaugagaaacuua

SEQ ID NO: 112249 - RNA, 21 nt, Human
cacugccauauacaccaggag

SEQ ID NO: 112250 - RNA, 19 nt, Human
cacugcgaccacuuccccg

SEQ ID NO: 112251 - RNA, 20 nt, Human
caggaucuuaugcagcuugc

SEQ ID NO: 112252 - RNA, 21 nt, Human
ccaauguuugaguagaucauu

SEQ ID NO: 112253 - RNA, 18 nt, Human
ccagccgcgucuccagga

SEQ ID NO: 112254 - RNA, 20 nt, Human
ccgcugcccucugccauagc

SEQ ID NO: 112255 - RNA, 19 nt, Human
ccguuggcagccccggucg

SEQ ID NO: 112256 - RNA, 20 nt, Human
cgccgaggucccgccugccc

SEQ ID NO: 112257 - RNA, 21 nt, Human
cgucccgcccccugcugccac

SEQ ID NO: 112258 - RNA, 25 nt, Human
cgucccgcccccugcugccaccuca

SEQ ID NO: 112259 - RNA, 23 nt, Human
cuaaaguagaacagaaaggagau

SEQ ID NO: 112260 - RNA, 24 nt, Human
cucauuuguaauuuagggacuuac

SEQ ID NO: 112261 - RNA, 21 nt, Human
cugagaccaaaaaaaaaaaaa

SEQ ID NO: 112262 - RNA, 23 nt, Human
cuuccccgcugcccucugccaua

SEQ ID NO: 112263 - RNA, 21 nt, Human
cuugucguuguccagccgcgu

SEQ ID NO: 112264 - RNA, 20 nt, Human
gaguagaucauuguuucuuu

SEQ ID NO: 112265 - RNA, 18 nt, Human
gcagcuauuuuggggaca

SEQ ID NO: 112266 - RNA, 20 nt, Human
ggaaaaaacuaaaaauacag

SEQ ID NO: 112267 - RNA, 22 nt, Human
ggaggucauauuuugcuaacac

SEQ ID NO: 112268 - RNA, 19 nt, Human
ggucgcagacacugcgacc

SEQ ID NO: 112269 - RNA, 23 nt, Human
gucuaaagucagaguccaguuac

SEQ ID NO: 112270 - RNA, 23 nt, Human
uaaacaccaggcuuagacacagc

SEQ ID NO: 112271 - RNA, 18 nt, Human
uacacagucaaauauaua

SEQ ID NO: 112272 - RNA, 20 nt, Human
uacccaaauggauaacgauu

SEQ ID NO: 112273 - RNA, 21 nt, Human
uagaguagauacacagcaaua

SEQ ID NO: 112274 - RNA, 25 nt, Human
uaugacaaauacccaucuuuaaaca

SEQ ID NO: 112275 - RNA, 26 nt, Human
uaugacaaauacccaucuuuaaacac

SEQ ID NO: 112276 - RNA, 22 nt, Human
uauguaacacauacuaaucaaa

SEQ ID NO: 112277 - RNA, 21 nt, Human
ucaaagggaaaaaacuaaaaa

SEQ ID NO: 112278 - RNA, 24 nt, Human
ucaaagggaaaaaacuaaaaauac

SEQ ID NO: 112279 - RNA, 21 nt, Human
ucuuugguuugaacaccagau

SEQ ID NO: 112280 - RNA, 21 nt, Human
ugacaaauacccaucuuuaaa

SEQ ID NO: 112281 - RNA, 20 nt, Human
ugagaccaaaaaaaaaaaaa

SEQ ID NO: 112282 - RNA, 25 nt, Human
ugagaccaaaaaaaaaaaaauuauc

SEQ ID NO: 112283 - RNA, 20 nt, Human
ugaguagaucauuguuucuu

SEQ ID NO: 112284 - RNA, 20 nt, Human
ugauuuauacuuuauuuucu

SEQ ID NO: 112285 - RNA, 21 nt, Human
uggagucucucacugaguccu

SEQ ID NO: 112286 - RNA, 18 nt, Human
uggcaacuccuccucugg

SEQ ID NO: 112287 - RNA, 23 nt, Human
uguuacugagaccaaaaaaaaaa

SEQ ID NO: 112288 - RNA, 20 nt, Human
uuaaguuuuuuuuugcugac

SEQ ID NO: 112289 - RNA, 21 nt, Human
uuagguauaaacaauuauaaa

SEQ ID NO: 112290 - RNA, 21 nt, Human
uucaaagaauaaaaaauaacc

SEQ ID NO: 112291 - RNA, 20 nt, Human
uuccccgcugcccucugcca

SEQ ID NO: 112292 - RNA, 21 nt, Human
uuccuaauuccuugucguugu

SEQ ID NO: 112293 - RNA, 19 nt, Human
uuccugaauacagugaaaa

SEQ ID NO: 112294 - RNA, 22 nt, Human
uuccugaauacagugaaaacug

SEQ ID NO: 112295 - RNA, 19 nt, Human
uuccuugucguuguccagc

SEQ ID NO: 112296 - RNA, 21 nt, Human
uuuaaucuuccuaauagguaa

SEQ ID NO: 112297 - RNA, 18 nt, Human
uuuuauagauuuacuaga

SEQ ID NO: 112298 - RNA, 23 nt, Human
uuuuauagauuuacuagaaauua

SEQ ID NO: 112299 - RNA, 25 nt, Human
uuuucucucuccuuuuuuucuaauu

SEQ ID NO: 112300 - RNA, 24 nt, Human
aaagugcugggauuacaggcguga

SEQ ID NO: 112301 - RNA, 21 nt, Human
aaauggcucaagauucagggg

SEQ ID NO: 112302 - RNA, 20 nt, Human
aagucuuuuuuuuuuuuuuu

SEQ ID NO: 112303 - RNA, 19 nt, Human
aagugcugggauuacaggc

SEQ ID NO: 112304 - RNA, 19 nt, Human
aagugcugggauuacaggc

SEQ ID NO: 112305 - RNA, 26 nt, Human
aagugcugggauuacaggcgugagcc

SEQ ID NO: 112306 - RNA, 19 nt, Human
aaugccaacucuaaggcag

SEQ ID NO: 112307 - RNA, 18 nt, Human
acaugauguacugcccga

SEQ ID NO: 112308 - RNA, 24 nt, Human
accauguuggucaggcuggucucg

SEQ ID NO: 112309 - RNA, 22 nt, Human
accccagaaacgccaggacggg

SEQ ID NO: 112310 - RNA, 23 nt, Human
agaagcgagcgagccugcgagag

SEQ ID NO: 112311 - RNA, 23 nt, Human
aggaggaaauggcagcuuuccag

SEQ ID NO: 112312 - RNA, 23 nt, Human
aggccuggcguccagaacuuaag

SEQ ID NO: 112313 - RNA, 22 nt, Human
aggcuggucucgaacuccuggc

SEQ ID NO: 112314 - RNA, 18 nt, Human
agugcugggauuacaggc

SEQ ID NO: 112315 - RNA, 24 nt, Human
augauccaucuggcuuggccuccc

SEQ ID NO: 112316 - RNA, 21 nt, Human
augggguuucaccauguuggu

SEQ ID NO: 112317 - RNA, 24 nt, Human
augggguuucaccauguuggucag

SEQ ID NO: 112318 - RNA, 24 nt, Human
auuuuuguauuuuuaguagagaug

SEQ ID NO: 112319 - RNA, 24 nt, Human
caaagugcugggauuacaggcgug

SEQ ID NO: 112320 - RNA, 22 nt, Human
caagucuuuuuuuuuuuuuuuu

SEQ ID NO: 112321 - RNA, 21 nt, Human
caccauguuggucaggcuggu

SEQ ID NO: 112322 - RNA, 24 nt, Human
caccauguuggucaggcuggucuc

SEQ ID NO: 112323 - RNA, 22 nt, Human
cagcucgggcaauucauccccc

SEQ ID NO: 112324 - RNA, 22 nt, Human
caggacggguaacuugccccuu

SEQ ID NO: 112325 - RNA, 22 nt, Human
ccaaagugcugggauuacaggc

SEQ ID NO: 112326 - RNA, 22 nt, Human
ccaaagugcugggauuacaggc

SEQ ID NO: 112327 - RNA, 24 nt, Human
ccaaagugcugggauuacaggcgu

SEQ ID NO: 112328 - RNA, 19 nt, Human
ccacggugguggccaggcg

SEQ ID NO: 112329 - RNA, 21 nt, Human
ccccagaaacgccaggacggg

SEQ ID NO: 112330 - RNA, 19 nt, Human
ccccgcucagcgcacucag

SEQ ID NO: 112331 - RNA, 21 nt, Human
ccuggcuucaugauccaucug

SEQ ID NO: 112332 - RNA, 19 nt, Human
cgaaccccagaaacgccag

SEQ ID NO: 112333 - RNA, 20 nt, Human
cgaaccccagaaacgccagg

SEQ ID NO: 112334 - RNA, 22 nt, Human
cgagagcaccgaggcuagccuc

SEQ ID NO: 112335 - RNA, 20 nt, Human
cgaugugcuggagggugcgg

SEQ ID NO: 112336 - RNA, 24 nt, Human
cgggcggcaacggggaugcagaag

SEQ ID NO: 112337 - RNA, 18 nt, Human
cuccuggcuucaugaucc

SEQ ID NO: 112338 - RNA, 21 nt, Human
cuccuggcuucaugauccauc

SEQ ID NO: 112339 - RNA, 20 nt, Human
cugagcaaaucugugcuggu

SEQ ID NO: 112340 - RNA, 22 nt, Human
cuuggcagagugugggcucagc

SEQ ID NO: 112341 - RNA, 24 nt, Human
gacggggcaggccuuugcugaccu

SEQ ID NO: 112342 - RNA, 24 nt, Human
gagaugggguuucaccauguuggu

SEQ ID NO: 112343 - RNA, 18 nt, Human
gaggcgaaccccagaaac

SEQ ID NO: 112344 - RNA, 18 nt, Human
gauuacaggcgugagcca

SEQ ID NO: 112345 - RNA, 21 nt, Human
gauuacaggcgugagccaccg

SEQ ID NO: 112346 - RNA, 22 nt, Human
gauuacaggcgugagccaccgu

SEQ ID NO: 112347 - RNA, 19 nt, Human
gcagaagcgagcgagccug

SEQ ID NO: 112348 - RNA, 23 nt, Human
gcagaguccuccugagucacaaa

SEQ ID NO: 112349 - RNA, 22 nt, Human
gcccuggcucucuugguggucc

SEQ ID NO: 112350 - RNA, 23 nt, Human
gcccuggcucucuuggugguccg

SEQ ID NO: 112351 - RNA, 22 nt, Human
gcgaaccccagaaacgccagga

SEQ ID NO: 112352 - RNA, 23 nt, Human
gcgaaccccagaaacgccaggac

SEQ ID NO: 112353 - RNA, 18 nt, Human
gcugcaggcccagggcau

SEQ ID NO: 112354 - RNA, 18 nt, Human
gcuuggccucccaaagug

SEQ ID NO: 112355 - RNA, 19 nt, Human
ggcuggucucgaacuccug

SEQ ID NO: 112356 - RNA, 22 nt, Human
gggcggcaacggggaugcagaa

SEQ ID NO: 112357 - RNA, 22 nt, Human
gggguuucaccauguuggucag

SEQ ID NO: 112358 - RNA, 23 nt, Human
guagagaugggguuucaccaugu

SEQ ID NO: 112359 - RNA, 21 nt, Human
guggcucuggcgaucgagccc

SEQ ID NO: 112360 - RNA, 21 nt, Human
gugggcucagcucagggaucu

SEQ ID NO: 112361 - RNA, 20 nt, Human
uaagaguuggcuccgggcgg

SEQ ID NO: 112362 - RNA, 24 nt, Human
uaauuuuuguauuuuuaguagaga

SEQ ID NO: 112363 - RNA, 23 nt, Human
uacaggcgugagccaccgugacc

SEQ ID NO: 112364 - RNA, 22 nt, Human
uagagaugggguuucaccaugu

SEQ ID NO: 112365 - RNA, 20 nt, Human
uagccuccgaggcgaacccc

SEQ ID NO: 112366 - RNA, 24 nt, Human
uaguagagaugggguuucaccaug

SEQ ID NO: 112367 - RNA, 25 nt, Human
uaguagagaugggguuucaccaugu

SEQ ID NO: 112368 - RNA, 18 nt, Human
uagucgaugucaguggcc

SEQ ID NO: 112369 - RNA, 18 nt, Human
ucagcgcacucaguuugc

SEQ ID NO: 112370 - RNA, 24 nt, Human
ucccaaagugcugggauuacaggc

SEQ ID NO: 112371 - RNA, 24 nt, Human
uccucaggccuggucuucaguagc

SEQ ID NO: 112372 - RNA, 20 nt, Human
uccugagucacaaauggcuc

SEQ ID NO: 112373 - RNA, 19 nt, Human
ucucgaacuccuggcuuca

SEQ ID NO: 112374 - RNA, 18 nt, Human
ugagacagagucucgcuc

SEQ ID NO: 112375 - RNA, 22 nt, Human
ugagacagagucucgcucugcu

SEQ ID NO: 112376 - RNA, 19 nt, Human
ugagucgcgaaacagcagc

SEQ ID NO: 112377 - RNA, 22 nt, Human
ugccucaggccuggcguccaga

SEQ ID NO: 112378 - RNA, 24 nt, Human
ugcugggauuacaggcgugagcca

SEQ ID NO: 112379 - RNA, 20 nt, Human
ugcuuggcagagugugggcu

SEQ ID NO: 112380 - RNA, 23 nt, Human
uggcgaucgagcccagccaguug

SEQ ID NO: 112381 - RNA, 20 nt, Human
uggcuucaugauccaucugg

SEQ ID NO: 112382 - RNA, 23 nt, Human
uggcuuggccucccaaagugcug

SEQ ID NO: 112383 - RNA, 18 nt, Human
ugggauuacaggcgugag

SEQ ID NO: 112384 - RNA, 21 nt, Human
ugggauuacaggcgugagcca

SEQ ID NO: 112385 - RNA, 22 nt, Human
ugggauuacaggcgugagccac

SEQ ID NO: 112386 - RNA, 23 nt, Human
ugggauuacaggcgugagccacc

SEQ ID NO: 112387 - RNA, 23 nt, Human
ugggauuacaggcgugagccacc

SEQ ID NO: 112388 - RNA, 24 nt, Human
ugggauuacaggcgugagccaccg

SEQ ID NO: 112389 - RNA, 24 nt, Human
ugggcucagcucagggaucuguug

SEQ ID NO: 112390 - RNA, 24 nt, Human
ugggguuucaccauguuggucagg

SEQ ID NO: 112391 - RNA, 24 nt, Human
uggucaggcuggucucgaacuccu

SEQ ID NO: 112392 - RNA, 21 nt, Human
uguauuuuuaguagagauggg

SEQ ID NO: 112393 - RNA, 19 nt, Human
ugugcuggagggugcggga

SEQ ID NO: 112394 - RNA, 21 nt, Human
ugugugguggggucaguaauu

SEQ ID NO: 112395 - RNA, 18 nt, Human
uuaguagagaugggguuu

SEQ ID NO: 112396 - RNA, 22 nt, Human
uuaguagagaugggguuucacc

SEQ ID NO: 112397 - RNA, 24 nt, Human
uuaguagagaugggguuucaccau

SEQ ID NO: 112398 - RNA, 18 nt, Human
uugccccuuugcgcuucc

SEQ ID NO: 112399 - RNA, 23 nt, Human
uuguauuuuuaguagagaugggg

SEQ ID NO: 112400 - RNA, 24 nt, Human
uuucaccauguuggucaggcuggu

SEQ ID NO: 112401 - RNA, 24 nt, Human
uuuuuaguagagaugggguuucac

SEQ ID NO: 112402 - RNA, 20 nt, Human
uuuuuguauuuuuaguagag

SEQ ID NO: 112403 - RNA, 20 nt, Human
uuuuuuuuuuugagacagag

SEQ ID NO: 112404 - RNA, 25 nt, Human
uuuuuuuuuuuugagacagagucuc

SEQ ID NO: 112405 - RNA, 18 nt, Human
uuuuuuuuuuuuuuuuug

SEQ ID NO: 112406 - RNA, 23 nt, Human
aaacauuucugacaucuuccucc

SEQ ID NO: 112407 - RNA, 24 nt, Human
aacgucacuucccuuccggaccac

SEQ ID NO: 112408 - RNA, 24 nt, Human
accacaaggggcgcugacuccgaa

SEQ ID NO: 112409 - RNA, 19 nt, Human
accccaccuuccuccauac

SEQ ID NO: 112410 - RNA, 23 nt, Human
acccgcucgccugccacaccacc

SEQ ID NO: 112411 - RNA, 24 nt, Human
agccccaguagcaaagcuuuaguc

SEQ ID NO: 112412 - RNA, 24 nt, Human
aucuuccuccagcucagucugcca

SEQ ID NO: 112413 - RNA, 18 nt, Human
auuucugacaucuuccuc

SEQ ID NO: 112414 - RNA, 19 nt, Human
cacaccaccuguucuccau

SEQ ID NO: 112415 - RNA, 19 nt, Human
caccuguucuccauugggg

SEQ ID NO: 112416 - RNA, 24 nt, Human
ccaauagacguuugugaacguccu

SEQ ID NO: 112417 - RNA, 20 nt, Human
ccagcccgcguucuggaggc

SEQ ID NO: 112418 - RNA, 19 nt, Human
ccauccaaguugaugccaa

SEQ ID NO: 112419 - RNA, 24 nt, Human
cccacccgcucgccugccacacca

SEQ ID NO: 112420 - RNA, 21 nt, Human
cccaccuuccuccauacagaa

SEQ ID NO: 112421 - RNA, 25 nt, Human
cccaccuuccuccauacagaauuga

SEQ ID NO: 112422 - RNA, 19 nt, Human
cccgcguucuggaggcagg

SEQ ID NO: 112423 - RNA, 22 nt, Human
ccuccagcucagucugccaugc

SEQ ID NO: 112424 - RNA, 22 nt, Human
cggaauccucagccccaguagc

SEQ ID NO: 112425 - RNA, 23 nt, Human
gcuuugggagauuauacaggucc

SEQ ID NO: 112426 - RNA, 18 nt, Human
ggaaauguccacuccuuu

SEQ ID NO: 112427 - RNA, 27 nt, Human
uaaacaggcagcccugcagguggucca

SEQ ID NO: 112428 - RNA, 24 nt, Human
uaccugcauuuuuaaagacagcuu

SEQ ID NO: 112429 - RNA, 24 nt, Human
ucacaugcuuaccugcauuuuuaa

SEQ ID NO: 112430 - RNA, 19 nt, Human
uccuccagcucagucugcc

SEQ ID NO: 112431 - RNA, 25 nt, Human
uccuuugggggugauuuuucuccuc

SEQ ID NO: 112432 - RNA, 18 nt, Human
ugccacaccaccuguucu

SEQ ID NO: 112433 - RNA, 24 nt, Human
uguccauuuugucaauaaacaggc

SEQ ID NO: 112434 - RNA, 22 nt, Human
aaaaaaaaaaaaguuuggguua

SEQ ID NO: 112435 - RNA, 23 nt, Human
aaaaaaaaaguuuggguuauagu

SEQ ID NO: 112436 - RNA, 22 nt, Human
aaaaaaaccaaagaucuacaaa

SEQ ID NO: 112437 - RNA, 24 nt, Human
aaaaacgugaaaggauuccuuaac

SEQ ID NO: 112438 - RNA, 21 nt, Human
aaacaagacauucauaaacua

SEQ ID NO: 112439 - RNA, 23 nt, Human
aaaccgacacccaugucauuuua

SEQ ID NO: 112440 - RNA, 23 nt, Human
aaaugcuaaaaaauuaggucaaa

SEQ ID NO: 112441 - RNA, 24 nt, Human
aaccugacaaaaaaaccaaagauc

SEQ ID NO: 112442 - RNA, 20 nt, Human
aagacauucauaaacuauaa

SEQ ID NO: 112443 - RNA, 22 nt, Human
aagaucuacaaaaccgacaccc

SEQ ID NO: 112444 - RNA, 24 nt, Human
acacacauacgcacaucuuauuuu

SEQ ID NO: 112445 - RNA, 21 nt, Human
acacucagccaggugccuggc

SEQ ID NO: 112446 - RNA, 24 nt, Human
agacaagauacgcagcacauucuu

SEQ ID NO: 112447 - RNA, 23 nt, Human
agggaaugucauguuuuacauuu

SEQ ID NO: 112448 - RNA, 22 nt, Human
agugaagauaacaaaaaaaucc

SEQ ID NO: 112449 - RNA, 23 nt, Human
auacacacacauacgcacaucuu

SEQ ID NO: 112450 - RNA, 22 nt, Human
caaaaacauuuaaagaaagaga

SEQ ID NO: 112451 - RNA, 19 nt, Human
caaaaccgacacccauguc

SEQ ID NO: 112452 - RNA, 28 nt, Human
caagaugcuccauuuaauggaacaacuc

SEQ ID NO: 112453 - RNA, 20 nt, Human
cacaaacaagacauucauaa

SEQ ID NO: 112454 - RNA, 20 nt, Human
cacuccagcacacucagcca

SEQ ID NO: 112455 - RNA, 20 nt, Human
cauacaacuuccaaauccuc

SEQ ID NO: 112456 - RNA, 23 nt, Human
cauacacacacauacgcacaucu

SEQ ID NO: 112457 - RNA, 23 nt, Human
ccaacuaccuguuaacucuuaac

SEQ ID NO: 112458 - RNA, 25 nt, Human
ccaauucuccaggcauacacacacu

SEQ ID NO: 112459 - RNA, 21 nt, Human
ccucuuuaaaaaaaaaaaaaa

SEQ ID NO: 112460 - RNA, 21 nt, Human
cuacugacgacugcuacuuga

SEQ ID NO: 112461 - RNA, 28 nt, Human
cucauugucugcgacaaauccaacuacc

SEQ ID NO: 112462 - RNA, 24 nt, Human
cugacaaaaaaaccaaagaucuac

SEQ ID NO: 112463 - RNA, 20 nt, Human
gagaagaaaccauacuggua

SEQ ID NO: 112464 - RNA, 19 nt, Human
gaugacacauuuccugguc

SEQ ID NO: 112465 - RNA, 22 nt, Human
ggcauacacacacauacgcaca

SEQ ID NO: 112466 - RNA, 24 nt, Human
gucacuuucacaaacaagacauuc

SEQ ID NO: 112467 - RNA, 25 nt, Human
uaaaccugacaaaaaaaccaaagau

SEQ ID NO: 112468 - RNA, 18 nt, Human
uaaagugaagauaacaaa

SEQ ID NO: 112469 - RNA, 23 nt, Human
uaacaaaaaaauccauacaacuu

SEQ ID NO: 112470 - RNA, 21 nt, Human
uacacagggaccugagaaucc

SEQ ID NO: 112471 - RNA, 21 nt, Human
uauaagguggagaggucauac

SEQ ID NO: 112472 - RNA, 30 nt, Human
uccaaauccucuuuaaaaaaaaaaaaaagg

SEQ ID NO: 112473 - RNA, 20 nt, Human
ucuuuaaaaaaaaaaaaaaa

SEQ ID NO: 112474 - RNA, 19 nt, Human
ugaaacaccaauucuccag

SEQ ID NO: 112475 - RNA, 20 nt, Human
ugaaacaccaauucuccagg

SEQ ID NO: 112476 - RNA, 18 nt, Human
ugagguagauuguuuccu

SEQ ID NO: 112477 - RNA, 19 nt, Human
ugcgacaaauccaacuacc

SEQ ID NO: 112478 - RNA, 23 nt, Human
ugcuaaaaaauuaggucaaauaa

SEQ ID NO: 112479 - RNA, 22 nt, Human
uggaacaacucaaaugcuaaaa

SEQ ID NO: 112480 - RNA, 23 nt, Human
uggaacaacucaaaugcuaaaaa

SEQ ID NO: 112481 - RNA, 23 nt, Human
uggcaagaugacacauuuccugg

SEQ ID NO: 112482 - RNA, 25 nt, Human
uggcaagaugacacauuuccugguc

SEQ ID NO: 112483 - RNA, 21 nt, Human
ugucugcgacaaauccaacua

SEQ ID NO: 112484 - RNA, 22 nt, Human
uuaaaccugacaaaaaaaccaa

SEQ ID NO: 112485 - RNA, 26 nt, Human
uuaaaccugacaaaaaaaccaaagau

SEQ ID NO: 112486 - RNA, 24 nt, Human
uuauaaacuccuacugacgacugc

SEQ ID NO: 112487 - RNA, 25 nt, Human
uuuaaaaaaaaaaaaaaguuugggu

SEQ ID NO: 112488 - RNA, 21 nt, Human
uuucacgguauauauuuggcc

SEQ ID NO: 112489 - RNA, 24 nt, Human
uuuccuaugcaguaaagugaagau

SEQ ID NO: 112490 - RNA, 20 nt, Human
aagagccuuaagauugcuaa

SEQ ID NO: 112491 - RNA, 23 nt, Human
acaagguacaugugcuaauguuc

SEQ ID NO: 112492 - RNA, 19 nt, Human
acauucuuuucagccuacc

SEQ ID NO: 112493 - RNA, 26 nt, Human
agccuugaaagaaugguugagaacag

SEQ ID NO: 112494 - RNA, 18 nt, Human
aggcacaagguacaugug

SEQ ID NO: 112495 - RNA, 27 nt, Human
auaaaaauacaguacagugcauaaaua

SEQ ID NO: 112496 - RNA, 21 nt, Human
auaaaaauuacauucuuuuca

SEQ ID NO: 112497 - RNA, 22 nt, Human
auagaaaaguuuugaaaagguu

SEQ ID NO: 112498 - RNA, 19 nt, Human
cauacaggccucagaguag

SEQ ID NO: 112499 - RNA, 21 nt, Human
cccagaugagcagugcagaag

SEQ ID NO: 112500 - RNA, 19 nt, Human
ccuuggcagcuuucugaag

SEQ ID NO: 112501 - RNA, 19 nt, Human
cuagaaguucucauauuca

SEQ ID NO: 112502 - RNA, 21 nt, Human
cugcaaucauagaaaaguuuu

SEQ ID NO: 112503 - RNA, 26 nt, Human
cuuggcagcuuucugaagcuuccucu

SEQ ID NO: 112504 - RNA, 20 nt, Human
gagauggugccuuggcagcu

SEQ ID NO: 112505 - RNA, 19 nt, Human
gguaaaacauuuugugcuu

SEQ ID NO: 112506 - RNA, 22 nt, Human
guuccuggagauggugccuugg

SEQ ID NO: 112507 - RNA, 22 nt, Human
uacaaaguuauaugauaccucc

SEQ ID NO: 112508 - RNA, 19 nt, Human
uaccuccuggauguuuccu

SEQ ID NO: 112509 - RNA, 19 nt, Human
uagcaggacuucuuuggug

SEQ ID NO: 112510 - RNA, 21 nt, Human
uauaugcaccuguauauuuga

SEQ ID NO: 112511 - RNA, 24 nt, Human
ucaaauuaauucagccuaaaaauc

SEQ ID NO: 112512 - RNA, 18 nt, Human
ucagaguagugcaccauc

SEQ ID NO: 112513 - RNA, 23 nt, Human
ucuauuucuguuuuuuuuuuuaa

SEQ ID NO: 112514 - RNA, 19 nt, Human
ucugaagcuuccucugccc

SEQ ID NO: 112515 - RNA, 20 nt, Human
ucugcaaucauagaaaaguu

SEQ ID NO: 112516 - RNA, 21 nt, Human
ugaaaggggccauacaggccu

SEQ ID NO: 112517 - RNA, 22 nt, Human
ugcccagaugagcagugcagaa

SEQ ID NO: 112518 - RNA, 19 nt, Human
ugcgugcugggaguuccug

SEQ ID NO: 112519 - RNA, 20 nt, Human
uggagauggugccuuggcag

SEQ ID NO: 112520 - RNA, 21 nt, Human
uggauguuuccuagaaguucu

SEQ ID NO: 112521 - RNA, 18 nt, Human
uggcagcuuucugaagcu

SEQ ID NO: 112522 - RNA, 18 nt, Human
ugggguagaguuagagaa

SEQ ID NO: 112523 - RNA, 20 nt, Human
uguugcuuuguuuuuuguug

SEQ ID NO: 112524 - RNA, 27 nt, Human
uuagagcucuauuucugucguccggga

SEQ ID NO: 112525 - RNA, 19 nt, Human
uucucugcaaucauagaaa

SEQ ID NO: 112526 - RNA, 22 nt, Human
uuguguuaacuaaauaagaaua

SEQ ID NO: 112527 - RNA, 21 nt, Human
uuuaauaagugaggcacagcu

SEQ ID NO: 112528 - RNA, 23 nt, Human
uuuacguugcugcucacuuuuca

SEQ ID NO: 112529 - RNA, 23 nt, Human
uuucacauaacuuagagcucuau

SEQ ID NO: 112530 - RNA, 24 nt, Human
aaauggguugguggcaccaaggua

SEQ ID NO: 112531 - RNA, 18 nt, Human
aagcuuuugccaugugau

SEQ ID NO: 112532 - RNA, 23 nt, Human
agccauuggggagggagaggggg

SEQ ID NO: 112533 - RNA, 18 nt, Human
agcccuuuccucucccuc

SEQ ID NO: 112534 - RNA, 19 nt, Human
aggaaaaggagaguugaga

SEQ ID NO: 112535 - RNA, 20 nt, Human
aggaaaaggagaguugagaa

SEQ ID NO: 112536 - RNA, 22 nt, Human
agggagagggggaaaaagucaa

SEQ ID NO: 112537 - RNA, 24 nt, Human
agggagagggggaaaaagucaaag

SEQ ID NO: 112538 - RNA, 25 nt, Human
auuacaauuuauuaaacacacuguu

SEQ ID NO: 112539 - RNA, 24 nt, Human
caaagggcuuuuucuucuaaauuu

SEQ ID NO: 112540 - RNA, 18 nt, Human
cagaguucugcaauucuc

SEQ ID NO: 112541 - RNA, 20 nt, Human
ccccaccggccgggacccuc

SEQ ID NO: 112542 - RNA, 22 nt, Human
ccccgcacucacaacugugaac

SEQ ID NO: 112543 - RNA, 21 nt, Human
ccgcgacccucugauccuucc

SEQ ID NO: 112544 - RNA, 26 nt, Human
ccggccgcgacccucugauccuuccu

SEQ ID NO: 112545 - RNA, 19 nt, Human
cgcacucacaacugugaac

SEQ ID NO: 112546 - RNA, 23 nt, Human
cucuagcccuuuccucucccucu

SEQ ID NO: 112547 - RNA, 20 nt, Human
cucugccgggcccugccuuc

SEQ ID NO: 112548 - RNA, 20 nt, Human
cugcccccacaaaggcaucg

SEQ ID NO: 112549 - RNA, 22 nt, Human
gagggagagggggaaaaaguca

SEQ ID NO: 112550 - RNA, 19 nt, Human
gauggaugagaaugagcac

SEQ ID NO: 112551 - RNA, 19 nt, Human
gcgacccucugauccuucc

SEQ ID NO: 112552 - RNA, 23 nt, Human
ggagagggggaaaaagucaaagg

SEQ ID NO: 112553 - RNA, 19 nt, Human
ggagggagagggggaaaaa

SEQ ID NO: 112554 - RNA, 19 nt, Human
ggguugguggcaccaaggu

SEQ ID NO: 112555 - RNA, 23 nt, Human
uacaauuuauuaaacacacuguu

SEQ ID NO: 112556 - RNA, 26 nt, Human
uacagcaccaaagaaauucaaauagg

SEQ ID NO: 112557 - RNA, 22 nt, Human
uauagaacuguacacaaaauaa

SEQ ID NO: 112558 - RNA, 18 nt, Human
uauguucuuugucuuaau

SEQ ID NO: 112559 - RNA, 18 nt, Human
ucccucugaguuggcccc

SEQ ID NO: 112560 - RNA, 19 nt, Human
ugauauguucuuugucuua

SEQ ID NO: 112561 - RNA, 24 nt, Human
ugauucugcccccacaaaggcauc

SEQ ID NO: 112562 - RNA, 23 nt, Human
ugccaugugauucugcccccaca

SEQ ID NO: 112563 - RNA, 18 nt, Human
ugcuacacagccauuggg

SEQ ID NO: 112564 - RNA, 20 nt, Human
ugcuacacagccauuggggg

SEQ ID NO: 112565 - RNA, 20 nt, Human
uggguugguggcaccaaggu

SEQ ID NO: 112566 - RNA, 27 nt, Human
uucaaauaggaaaaggagaguugagaa

SEQ ID NO: 112567 - RNA, 20 nt, Human
uucagaaugaaggcagauga

SEQ ID NO: 112568 - RNA, 25 nt, Human
uuucauaauacauauauuuauugcc

SEQ ID NO: 112569 - RNA, 21 nt, Human
aaacccagaccaaguggaaga

SEQ ID NO: 112570 - RNA, 22 nt, Human
acaaaauacgccauguccuuuc

SEQ ID NO: 112571 - RNA, 19 nt, Human
accacuucaccccuccccu

SEQ ID NO: 112572 - RNA, 20 nt, Human
agaccccugucuucaacauc

SEQ ID NO: 112573 - RNA, 20 nt, Human
agagacagugggcacauggg

SEQ ID NO: 112574 - RNA, 18 nt, Human
agagcccagaugccacuc

SEQ ID NO: 112575 - RNA, 20 nt, Human
agaugccacuccucccgugg

SEQ ID NO: 112576 - RNA, 22 nt, Human
agcauccuggcccucaaguagc

SEQ ID NO: 112577 - RNA, 18 nt, Human
aggaucagggaaagugag

SEQ ID NO: 112578 - RNA, 25 nt, Human
aggugggaggaaggugggagggagg

SEQ ID NO: 112579 - RNA, 23 nt, Human
augcagcccugcacacaccccac

SEQ ID NO: 112580 - RNA, 20 nt, Human
cacacaccccacacuauucc

SEQ ID NO: 112581 - RNA, 21 nt, Human
cacauuauuuaaccaucaguc

SEQ ID NO: 112582 - RNA, 22 nt, Human
cacccccgagaccccugucuuc

SEQ ID NO: 112583 - RNA, 22 nt, Human
cacgacagcugucagcggccca

SEQ ID NO: 112584 - RNA, 22 nt, Human
cacuucaccccuccccuggccu

SEQ ID NO: 112585 - RNA, 23 nt, Human
cagagucagagcccugaggccag

SEQ ID NO: 112586 - RNA, 21 nt, Human
cagggcucccuagauagugag

SEQ ID NO: 112587 - RNA, 21 nt, Human
cagugggcacaugggccaggc

SEQ ID NO: 112588 - RNA, 22 nt, Human
caugggccaggcagccaacacc

SEQ ID NO: 112589 - RNA, 23 nt, Human
ccacuucaccccuccccuggccu

SEQ ID NO: 112590 - RNA, 20 nt, Human
ccagaccaaguggaagagac

SEQ ID NO: 112591 - RNA, 22 nt, Human
cccccuacacacagucacugag

SEQ ID NO: 112592 - RNA, 19 nt, Human
ccccgacugagggcucucc

SEQ ID NO: 112593 - RNA, 23 nt, Human
ccccuccccuggccugccccgac

SEQ ID NO: 112594 - RNA, 18 nt, Human
ccggagcccacccccgag

SEQ ID NO: 112595 - RNA, 20 nt, Human
ccguuucuucccugggggag

SEQ ID NO: 112596 - RNA, 24 nt, Human
cggaugcagcccugcacacacccc

SEQ ID NO: 112597 - RNA, 21 nt, Human
cggcccagcuccaugcagcaa

SEQ ID NO: 112598 - RNA, 25 nt, Human
cuauuccguuucuucccugggggag

SEQ ID NO: 112599 - RNA, 21 nt, Human
cucagggccauggcaauuuac

SEQ ID NO: 112600 - RNA, 18 nt, Human
cugaggccagggagacca

SEQ ID NO: 112601 - RNA, 21 nt, Human
cugagggcucuccagcccugg

SEQ ID NO: 112602 - RNA, 19 nt, Human
cugcucccuccucgguggc

SEQ ID NO: 112603 - RNA, 19 nt, Human
gaagacagggagcagacua

SEQ ID NO: 112604 - RNA, 20 nt, Human
gaccacauauuccaacuuuc

SEQ ID NO: 112605 - RNA, 19 nt, Human
gagacagugggcacauggg

SEQ ID NO: 112606 - RNA, 22 nt, Human
gagacagugggcacaugggccg

SEQ ID NO: 112607 - RNA, 20 nt, Human
gagggcucuccagcccuggc

SEQ ID NO: 112608 - RNA, 23 nt, Human
gaggggugcccaggggaggacag

SEQ ID NO: 112609 - RNA, 22 nt, Human
gaugcagcccugcacacacccc

SEQ ID NO: 112610 - RNA, 21 nt, Human
gcacacaccccacacuauucc

SEQ ID NO: 112611 - RNA, 21 nt, Human
gccaucugcggaugcagcccu

SEQ ID NO: 112612 - RNA, 25 nt, Human
gccauguccuuucucuucucuucca

SEQ ID NO: 112613 - RNA, 21 nt, Human
ggaaagugaggggugcccagg

SEQ ID NO: 112614 - RNA, 20 nt, Human
ggaaggugggagggaggugg

SEQ ID NO: 112615 - RNA, 25 nt, Human
ggagucccuuccauaugccacacua

SEQ ID NO: 112616 - RNA, 20 nt, Human
ggcagccaacaccugugggu

SEQ ID NO: 112617 - RNA, 19 nt, Human
ggcagccaacaccuguggu

SEQ ID NO: 112618 - RNA, 22 nt, Human
gggaaagugaggggugcccagg

SEQ ID NO: 112619 - RNA, 21 nt, Human
gggaggucagaggcugcgggc

SEQ ID NO: 112620 - RNA, 19 nt, Human
ggguuagagagccccaccc

SEQ ID NO: 112621 - RNA, 20 nt, Human
gucacugaggaaaguccuga

SEQ ID NO: 112622 - RNA, 19 nt, Human
gugggcacaugggccaggc

SEQ ID NO: 112623 - RNA, 18 nt, Human
uaacaggcuccagguggg

SEQ ID NO: 112624 - RNA, 23 nt, Human
ucccugggggagcauccuggccc

SEQ ID NO: 112625 - RNA, 19 nt, Human
ucgguggcugccgcuucug

SEQ ID NO: 112626 - RNA, 18 nt, Human
ucuccagcccuggcccag

SEQ ID NO: 112627 - RNA, 21 nt, Human
ucuccagcccuggcccagggc

SEQ ID NO: 112628 - RNA, 18 nt, Human
ugaggagcccucuuggga

SEQ ID NO: 112629 - RNA, 20 nt, Human
ugaggggugcccaggggagg

SEQ ID NO: 112630 - RNA, 22 nt, Human
ugcacacaccccacacuauucc

SEQ ID NO: 112631 - RNA, 23 nt, Human
ugcaggaucagggaaagugaggg

SEQ ID NO: 112632 - RNA, 19 nt, Human
ugcccaggggaggacaggg

SEQ ID NO: 112633 - RNA, 19 nt, Human
uggaagagacagugggcac

SEQ ID NO: 112634 - RNA, 22 nt, Human
uggaagagacagugggcacaug

SEQ ID NO: 112635 - RNA, 20 nt, Human
uggaagcugggcacaggguc

SEQ ID NO: 112636 - RNA, 21 nt, Human
uggaagcugggcacagggucc

SEQ ID NO: 112637 - RNA, 24 nt, Human
uggaagcugggcacaggguccugg

SEQ ID NO: 112638 - RNA, 19 nt, Human
uggcucagggccauggcaa

SEQ ID NO: 112639 - RNA, 24 nt, Human
uggcucagggccauggcaauuuac

SEQ ID NO: 112640 - RNA, 22 nt, Human
ugggauuccaggugggccuggu

SEQ ID NO: 112641 - RNA, 20 nt, Human
ugggccaggcagccaacacc

SEQ ID NO: 112642 - RNA, 19 nt, Human
uggguucagcccugaaccc

SEQ ID NO: 112643 - RNA, 21 nt, Human
uguccaggcaaccacuucacc

SEQ ID NO: 112644 - RNA, 18 nt, Human
uucccugggggagcaucc

SEQ ID NO: 112645 - RNA, 27 nt, Human
uucccugggggagcauccuggcccuca

SEQ ID NO: 112646 - RNA, 18 nt, Human
uuguuuggggugauuggg

SEQ ID NO: 112647 - RNA, 23 nt, Human
uuuuuuguuauuuugcuuuccac

SEQ ID NO: 112648 - RNA, 20 nt, Human
aaaaaguuauuucgaagaac

SEQ ID NO: 112649 - RNA, 19 nt, Human
aaaaguuauuucgaagaac

SEQ ID NO: 112650 - RNA, 22 nt, Human
aacuugacacacucccugcggc

SEQ ID NO: 112651 - RNA, 27 nt, Human
aagcacaaccagcgguaauugggguac

SEQ ID NO: 112652 - RNA, 19 nt, Human
aaucugaccggcucuccuu

SEQ ID NO: 112653 - RNA, 21 nt, Human
agaaaaaaguuauuucgaaga

SEQ ID NO: 112654 - RNA, 24 nt, Human
agaggugggucguggcggcuggcg

SEQ ID NO: 112655 - RNA, 20 nt, Human
agcaaauaucauggaccucu

SEQ ID NO: 112656 - RNA, 20 nt, Human
agccagcaccucaguucugg

SEQ ID NO: 112657 - RNA, 19 nt, Human
aggaaaguuaggggaaucu

SEQ ID NO: 112658 - RNA, 22 nt, Human
auguacaaacacacacacaggc

SEQ ID NO: 112659 - RNA, 21 nt, Human
cacacaugagcuagccagcac

SEQ ID NO: 112660 - RNA, 18 nt, Human
cagucuuucccuucaagu

SEQ ID NO: 112661 - RNA, 26 nt, Human
caucuuguaaacaaaagggaagaggu

SEQ ID NO: 112662 - RNA, 22 nt, Human
cccggcaaagaggacggaaaaa

SEQ ID NO: 112663 - RNA, 18 nt, Human
ccgcccagucuuucccuu

SEQ ID NO: 112664 - RNA, 22 nt, Human
ccgcugcucccggcaaagagga

SEQ ID NO: 112665 - RNA, 18 nt, Human
ccggcaaagaggacggaa

SEQ ID NO: 112666 - RNA, 19 nt, Human
ccgggcgaaggggcgcaca

SEQ ID NO: 112667 - RNA, 22 nt, Human
cgaaaaagcacaaccagcggua

SEQ ID NO: 112668 - RNA, 25 nt, Human
cgaagaacguuccaaguccaggaaa

SEQ ID NO: 112669 - RNA, 33 nt, Human
cgccucgugucucccgggccagucaguuucaau

SEQ ID NO: 112670 - RNA, 20 nt, Human
cggcaaagaggacggaaaaa

SEQ ID NO: 112671 - RNA, 18 nt, Human
cguggcggcuggcgagga

SEQ ID NO: 112672 - RNA, 21 nt, Human
cuauguacaaacacacacaca

SEQ ID NO: 112673 - RNA, 22 nt, Human
cucccgggccagucaguuucag

SEQ ID NO: 112674 - RNA, 21 nt, Human
gaaaaagcacaaccagcggua

SEQ ID NO: 112675 - RNA, 24 nt, Human
gaagaacguuccaaguccaggaaa

SEQ ID NO: 112676 - RNA, 23 nt, Human
gcaguaggagaggaagugccgaa

SEQ ID NO: 112677 - RNA, 18 nt, Human
gcuggcgaggagcgcagg

SEQ ID NO: 112678 - RNA, 18 nt, Human
ggaugagcaauccgugcu

SEQ ID NO: 112679 - RNA, 18 nt, Human
gggcagggggaaagggcu

SEQ ID NO: 112680 - RNA, 20 nt, Human
guacaaacacacacacaggc

SEQ ID NO: 112681 - RNA, 22 nt, Human
uacaaacacacacacaggccaa

SEQ ID NO: 112682 - RNA, 23 nt, Human
uagcaguaggagaggaagugccg

SEQ ID NO: 112683 - RNA, 22 nt, Human
uagccagcaccucaguucuggc

SEQ ID NO: 112684 - RNA, 21 nt, Human
uaggagaggaagugccgaaaa

SEQ ID NO: 112685 - RNA, 20 nt, Human
uauguacaaacacacacaca

SEQ ID NO: 112686 - RNA, 24 nt, Human
uauguacaaacacacacacaggcc

SEQ ID NO: 112687 - RNA, 25 nt, Human
uauguacaaacacacacacaggcca

SEQ ID NO: 112688 - RNA, 19 nt, Human
uccaaacugcggggcaggg

SEQ ID NO: 112689 - RNA, 20 nt, Human
ucggaugagcaauccgugcu

SEQ ID NO: 112690 - RNA, 24 nt, Human
ucuuguaaacaaaagggaagaggu

SEQ ID NO: 112691 - RNA, 21 nt, Human
uguaaacaaaagggaagaggu

SEQ ID NO: 112692 - RNA, 23 nt, Human
uguacaaacacacacacaggcca

SEQ ID NO: 112693 - RNA, 25 nt, Human
uguacaaacacacacacaggccaau

SEQ ID NO: 112694 - RNA, 19 nt, Human
ugucugcagagcaguuggu

SEQ ID NO: 112695 - RNA, 28 nt, Human
uguuucauuuccuuuaauaaugaaaauc

SEQ ID NO: 112696 - RNA, 22 nt, Human
uuagcaaauaucauggaccucu

SEQ ID NO: 112697 - RNA, 22 nt, Human
uuguaaacaaaagggaagaggu

SEQ ID NO: 112698 - RNA, 21 nt, Human
uuuaaaauacucuuagacaca

SEQ ID NO: 112699 - RNA, 19 nt, Human
aaaccaacacaaauccuaa

SEQ ID NO: 112700 - RNA, 19 nt, Human
aacacaaauccuaaaccua

SEQ ID NO: 112701 - RNA, 21 nt, Human
aaccaacacaaauccuaaacc

SEQ ID NO: 112702 - RNA, 22 nt, Human
aaugaacaggcaaacaaaacca

SEQ ID NO: 112703 - RNA, 21 nt, Human
acaggcaaacaaaaccaacac

SEQ ID NO: 112704 - RNA, 22 nt, Human
acaggcaaacaaaaccaacaca

SEQ ID NO: 112705 - RNA, 19 nt, Human
acuccaugaaccaucgacc

SEQ ID NO: 112706 - RNA, 21 nt, Human
agaaaugccgaaccagucuga

SEQ ID NO: 112707 - RNA, 20 nt, Human
aggcaaacaaaaccaacaca

SEQ ID NO: 112708 - RNA, 22 nt, Human
aggcaaacaaaaccaacacaaa

SEQ ID NO: 112709 - RNA, 24 nt, Human
augaacaggcaaacaaaaccaaca

SEQ ID NO: 112710 - RNA, 23 nt, Human
caaaaccaacacaaauccuaaac

SEQ ID NO: 112711 - RNA, 24 nt, Human
caaacaaaaccaacacaaauccua

SEQ ID NO: 112712 - RNA, 24 nt, Human
caaauccuaaaccuagaaucagau

SEQ ID NO: 112713 - RNA, 20 nt, Human
caggcaaacaaaaccaacac

SEQ ID NO: 112714 - RNA, 19 nt, Human
ccaugaaccaucgaccagg

SEQ ID NO: 112715 - RNA, 19 nt, Human
ccugcagcucauucacauc

SEQ ID NO: 112716 - RNA, 23 nt, Human
gaaaugaacaggcaaacaaaacc

SEQ ID NO: 112717 - RNA, 19 nt, Human
gcaacauuguacacaugag

SEQ ID NO: 112718 - RNA, 23 nt, Human
uacaaugucagcaauugcuggag

SEQ ID NO: 112719 - RNA, 20 nt, Human
uccaagaaaugccgaaccag

SEQ ID NO: 112720 - RNA, 25 nt, Human
ugaaaugaacaggcaaacaaaacca

SEQ ID NO: 112721 - RNA, 26 nt, Human
ugaaaugaacaggcaaacaaaaccaa

SEQ ID NO: 112722 - RNA, 26 nt, Human
uguaaccagguuuuccaagaaaugcc

SEQ ID NO: 112723 - RNA, 24 nt, Human
uuuccaagaaaugccgaaccaguc

SEQ ID NO: 112724 - RNA, 27 nt, Human
aaaaaaaaaaaacuguaauauuuacaa

SEQ ID NO: 112725 - RNA, 23 nt, Human
aaugauggauguacgugaaagaa

SEQ ID NO: 112726 - RNA, 19 nt, Human
aggcgcuggcugagcgcug

SEQ ID NO: 112727 - RNA, 21 nt, Human
auaaacagacaccauacuaaa

SEQ ID NO: 112728 - RNA, 19 nt, Human
aucagauuuugucuuugau

SEQ ID NO: 112729 - RNA, 19 nt, Human
aucauuugagcaguccugu

SEQ ID NO: 112730 - RNA, 19 nt, Human
caacaaugguuuaaaagga

SEQ ID NO: 112731 - RNA, 19 nt, Human
caccaauauauggaucaga

SEQ ID NO: 112732 - RNA, 24 nt, Human
cccgcgcgcucgcccuuccugcag

SEQ ID NO: 112733 - RNA, 20 nt, Human
cggcagcggcggcggcgggc

SEQ ID NO: 112734 - RNA, 20 nt, Human
cugaaggaugcaguggcaga

SEQ ID NO: 112735 - RNA, 21 nt, Human
cugcagggaacaaaggcggcg

SEQ ID NO: 112736 - RNA, 23 nt, Human
cugggguuuccugcagaaucuag

SEQ ID NO: 112737 - RNA, 21 nt, Human
gaagucauaaaauuguggggu

SEQ ID NO: 112738 - RNA, 19 nt, Human
gcagcggcggcggcgggca

SEQ ID NO: 112739 - RNA, 20 nt, Human
gcaguggcagaaucuggccu

SEQ ID NO: 112740 - RNA, 20 nt, Human
gccaaauggaagucauaaaa

SEQ ID NO: 112741 - RNA, 19 nt, Human
gcccgcgcgcucgcccuuc

SEQ ID NO: 112742 - RNA, 18 nt, Human
gcuggcccgcgcgcucgc

SEQ ID NO: 112743 - RNA, 19 nt, Human
gggguggggguugggggag

SEQ ID NO: 112744 - RNA, 21 nt, Human
guggggguugggggaggagag

SEQ ID NO: 112745 - RNA, 21 nt, Human
uaaaaauuccuaaagcaugau

SEQ ID NO: 112746 - RNA, 18 nt, Human
uaaaauuguggggugggg

SEQ ID NO: 112747 - RNA, 22 nt, Human
uaaacagacaccauacuaaaau

SEQ ID NO: 112748 - RNA, 22 nt, Human
uacaacaauuaaacauuuuaga

SEQ ID NO: 112749 - RNA, 21 nt, Human
uacacucaacaacaaugguuu

SEQ ID NO: 112750 - RNA, 18 nt, Human
uacgugaaagaaaaaagc

SEQ ID NO: 112751 - RNA, 23 nt, Human
uaguaaaaaaaaaaaaacuguaa

SEQ ID NO: 112752 - RNA, 23 nt, Human
uauguaguaaaaaaaaaaaaacu

SEQ ID NO: 112753 - RNA, 23 nt, Human
uauguuuucuuugguugcuguug

SEQ ID NO: 112754 - RNA, 19 nt, Human
uccugcagggaacaaaggc

SEQ ID NO: 112755 - RNA, 19 nt, Human
ucggcagcggcggcggcgg

SEQ ID NO: 112756 - RNA, 23 nt, Human
ucuuugguugcuguuguaaagaa

SEQ ID NO: 112757 - RNA, 23 nt, Human
ugcagggaacaaaggcggcgcuc

SEQ ID NO: 112758 - RNA, 22 nt, Human
ugugcuauuucuuuucuaguuu

SEQ ID NO: 112759 - RNA, 21 nt, Human
ugugggguggggguuggggga

SEQ ID NO: 112760 - RNA, 20 nt, Human
uuaugugcuauuucuuuucu

SEQ ID NO: 112761 - RNA, 23 nt, Human
uucaacaauugccaaauggaagu

SEQ ID NO: 112762 - RNA, 21 nt, Human
uucaacuuuuccagcaaguca

SEQ ID NO: 112763 - RNA, 23 nt, Human
uucacauaagaaaaaauugaaaa

SEQ ID NO: 112764 - RNA, 20 nt, Human
uuccugcagaaucuagcacc

SEQ ID NO: 112765 - RNA, 18 nt, Human
uugugggguggggguugg

SEQ ID NO: 112766 - RNA, 19 nt, Human
uuuuagggaaaaaaacauu

SEQ ID NO: 112767 - RNA, 23 nt, Human
aacaaaaaaaaaaaacauucaca

SEQ ID NO: 112768 - RNA, 24 nt, Human
aacaacaacaacaaaaaaaaaaaa

SEQ ID NO: 112769 - RNA, 25 nt, Human
aacagcaauuaaaaacaacaacaac

SEQ ID NO: 112770 - RNA, 22 nt, Human
aacauucacaaccugucacaga

SEQ ID NO: 112771 - RNA, 20 nt, Human
aagcagagcccagguuccuc

SEQ ID NO: 112772 - RNA, 19 nt, Human
acaacaacaaaaaaaaaaa

SEQ ID NO: 112773 - RNA, 20 nt, Human
acaacaacaaaaaaaaaaaa

SEQ ID NO: 112774 - RNA, 22 nt, Human
acccaaaugcccuuuuuguucc

SEQ ID NO: 112775 - RNA, 23 nt, Human
accucagccccuugaauagcuag

SEQ ID NO: 112776 - RNA, 19 nt, Human
agagcccagguuccucagg

SEQ ID NO: 112777 - RNA, 22 nt, Human
agcaauuaaaaacaacaacaac

SEQ ID NO: 112778 - RNA, 25 nt, Human
caaacuccugggcucaggcgauccu

SEQ ID NO: 112779 - RNA, 24 nt, Human
caacaaaaaaaaaaaacauucaca

SEQ ID NO: 112780 - RNA, 20 nt, Human
caccgguggccggggauccc

SEQ ID NO: 112781 - RNA, 21 nt, Human
caccgguggccggggaucccc

SEQ ID NO: 112782 - RNA, 21 nt, Human
caccucagccccuugaauagc

SEQ ID NO: 112783 - RNA, 20 nt, Human
cagagcccagguuccucagg

SEQ ID NO: 112784 - RNA, 22 nt, Human
cagcaccagaggaacccacugg

SEQ ID NO: 112785 - RNA, 24 nt, Human
cauuauguugcuuagacuggucuc

SEQ ID NO: 112786 - RNA, 23 nt, Human
ccccuguacccaaaugcccuuuu

SEQ ID NO: 112787 - RNA, 26 nt, Human
ccucccaccucagccccuugaauagc

SEQ ID NO: 112788 - RNA, 23 nt, Human
ccuugaauagcuaggauuacagg

SEQ ID NO: 112789 - RNA, 20 nt, Human
cggcgcacgccugccgggga

SEQ ID NO: 112790 - RNA, 24 nt, Human
cucaggcgauccucccaccucagc

SEQ ID NO: 112791 - RNA, 24 nt, Human
cucccaccucagccccuugaauag

SEQ ID NO: 112792 - RNA, 23 nt, Human
cuuuauuuuuuaauuuuuauuuu

SEQ ID NO: 112793 - RNA, 26 nt, Human
gaauagcuaggauuacagguauaugc

SEQ ID NO: 112794 - RNA, 21 nt, Human
gauuacagguauaugccccug

SEQ ID NO: 112795 - RNA, 23 nt, Human
gauuacagguauaugccccugua

SEQ ID NO: 112796 - RNA, 20 nt, Human
gcagcaccagaggaacccac

SEQ ID NO: 112797 - RNA, 22 nt, Human
gcagcaggcggaggaagcagag

SEQ ID NO: 112798 - RNA, 18 nt, Human
gccugccggggacugccg

SEQ ID NO: 112799 - RNA, 19 nt, Human
gcggaggaagcagagccca

SEQ ID NO: 112800 - RNA, 19 nt, Human
gcugcagcaccagaggaac

SEQ ID NO: 112801 - RNA, 18 nt, Human
ggaggaagcagagcccag

SEQ ID NO: 112802 - RNA, 20 nt, Human
ggaggaagcagagcccaggu

SEQ ID NO: 112803 - RNA, 24 nt, Human
ggaggaagcagagcccagguuccu

SEQ ID NO: 112804 - RNA, 18 nt, Human
ggagucuuucauccaaag

SEQ ID NO: 112805 - RNA, 20 nt, Human
gggguucucuaucucuccgu

SEQ ID NO: 112806 - RNA, 22 nt, Human
uacagguauaugccccuguacc

SEQ ID NO: 112807 - RNA, 24 nt, Human
uacagguauaugccccuguaccca

SEQ ID NO: 112808 - RNA, 23 nt, Human
uacccaaaugcccuuuuuguucc

SEQ ID NO: 112809 - RNA, 19 nt, Human
uaugccccuguacccaaau

SEQ ID NO: 112810 - RNA, 24 nt, Human
uauguugcuuagacuggucucaaa

SEQ ID NO: 112811 - RNA, 18 nt, Human
ucagccccuugaauagcu

SEQ ID NO: 112812 - RNA, 24 nt, Human
uccaaagaggucagcuacagccac

SEQ ID NO: 112813 - RNA, 20 nt, Human
uccccagcuuccuggcgcuc

SEQ ID NO: 112814 - RNA, 19 nt, Human
ucccggcugucugcugccc

SEQ ID NO: 112815 - RNA, 23 nt, Human
uccgugacggucacgggucccca

SEQ ID NO: 112816 - RNA, 18 nt, Human
uccucccaccucagcccc

SEQ ID NO: 112817 - RNA, 24 nt, Human
uccugggacuaaacgggaaaagga

SEQ ID NO: 112818 - RNA, 21 nt, Human
uccugggcucaggcgauccuc

SEQ ID NO: 112819 - RNA, 22 nt, Human
uccugggcucaggcgauccucc

SEQ ID NO: 112820 - RNA, 24 nt, Human
uccugggcucaggcgauccuccca

SEQ ID NO: 112821 - RNA, 19 nt, Human
ucucaaacuccugggcuca

SEQ ID NO: 112822 - RNA, 21 nt, Human
ucucccggcugucugcugccc

SEQ ID NO: 112823 - RNA, 22 nt, Human
ucucccggcugucugcugcccg

SEQ ID NO: 112824 - RNA, 24 nt, Human
ugcccggcgcacgccugccgggga

SEQ ID NO: 112825 - RNA, 24 nt, Human
ugccggggacugccggccacuccg

SEQ ID NO: 112826 - RNA, 22 nt, Human
uuaaaaacaacaacaacaaaaa

SEQ ID NO: 112827 - RNA, 25 nt, Human
uuuuaauuuuuauuuuucggagacu

SEQ ID NO: 112828 - RNA, 24 nt, Human
uuuuuuuuuuuuuuuuaaggaggg

SEQ ID NO: 112829 - RNA, 23 nt, Human
uuuuuuuuuuuuuuuuuuuaagg

SEQ ID NO: 112830 - RNA, 26 nt, Human
aaacaaauguuuuuagacauugaaaa

SEQ ID NO: 112831 - RNA, 24 nt, Human
aaagaccaacugcgcccagucccc

SEQ ID NO: 112832 - RNA, 24 nt, Human
aaagaccaacugcgcccagucccc

SEQ ID NO: 112833 - RNA, 25 nt, Human
aacaaauguuuuuagacauugaaaa

SEQ ID NO: 112834 - RNA, 23 nt, Human
aacaguaaccagaacacaccccc

SEQ ID NO: 112835 - RNA, 24 nt, Human
aaggcgccccacccccauccuccg

SEQ ID NO: 112836 - RNA, 21 nt, Human
acauugaaaagugguuaaaga

SEQ ID NO: 112837 - RNA, 21 nt, Human
acauugaaaagugguuaaaga

SEQ ID NO: 112838 - RNA, 23 nt, Human
accaacugcgcccagucccccaa

SEQ ID NO: 112839 - RNA, 23 nt, Human
accaacugcgcccagucccccaa

SEQ ID NO: 112840 - RNA, 19 nt, Human
accauagccaccugguuug

SEQ ID NO: 112841 - RNA, 21 nt, Human
acccccaucaagugucaccuc

SEQ ID NO: 112842 - RNA, 21 nt, Human
agaacacacccccaucaagug

SEQ ID NO: 112843 - RNA, 24 nt, Human
agcugauggcacagccuuagaaca

SEQ ID NO: 112844 - RNA, 19 nt, Human
aggaaggcgccccaccccc

SEQ ID NO: 112845 - RNA, 24 nt, Human
augaacaggggaggaaggagcuga

SEQ ID NO: 112846 - RNA, 25 nt, Human
cacccucuggagaccuuggaccuaa

SEQ ID NO: 112847 - RNA, 19 nt, Human
cagcaucagguuuucuguu

SEQ ID NO: 112848 - RNA, 19 nt, Human
cagcaucagguuuucuguu

SEQ ID NO: 112849 - RNA, 21 nt, Human
cagccuuagaacaguaaccag

SEQ ID NO: 112850 - RNA, 24 nt, Human
caugaacucuaguaugggccuacg

SEQ ID NO: 112851 - RNA, 27 nt, Human
ccaacuuuuauguaacuggcuuuccua

SEQ ID NO: 112852 - RNA, 24 nt, Human
ccaagguguguuaaagcugaguga

SEQ ID NO: 112853 - RNA, 30 nt, Human
ccagaacacacccccaucaagugucaccuu

SEQ ID NO: 112854 - RNA, 23 nt, Human
ccauugcccucaaccuucuuuuu

SEQ ID NO: 112855 - RNA, 21 nt, Human
ccccaucaagugucaccucca

SEQ ID NO: 112856 - RNA, 20 nt, Human
ccccaugaagcuguuucaga

SEQ ID NO: 112857 - RNA, 24 nt, Human
cccccauccuccguuuucugggcu

SEQ ID NO: 112858 - RNA, 18 nt, Human
cccccucucucuuucuuc

SEQ ID NO: 112859 - RNA, 24 nt, Human
cccccucucucuuucuucuccuga

SEQ ID NO: 112860 - RNA, 20 nt, Human
ccccucucucuuucuucucc

SEQ ID NO: 112861 - RNA, 20 nt, Human
cccucuucucccuuuauucc

SEQ ID NO: 112862 - RNA, 20 nt, Human
cccucuucucccuuuauucc

SEQ ID NO: 112863 - RNA, 19 nt, Human
ccuccguuuucugggcuca

SEQ ID NO: 112864 - RNA, 20 nt, Human
ccuccuagaggggaagugaa

SEQ ID NO: 112865 - RNA, 19 nt, Human
cgccccacccccauccucc

SEQ ID NO: 112866 - RNA, 22 nt, Human
cuccaggaaggcgccccacccc

SEQ ID NO: 112867 - RNA, 21 nt, Human
cuccugagccaacuuuuaugu

SEQ ID NO: 112868 - RNA, 21 nt, Human
cugagugcagaauggagggug

SEQ ID NO: 112869 - RNA, 21 nt, Human
cugagugcagaauggagggug

SEQ ID NO: 112870 - RNA, 21 nt, Human
cugcgcccagucccccaagug

SEQ ID NO: 112871 - RNA, 21 nt, Human
cugcgcccagucccccaagug

SEQ ID NO: 112872 - RNA, 21 nt, Human
cuggagaccuuggaccuaagu

SEQ ID NO: 112873 - RNA, 24 nt, Human
gaaaaaaaaacuucuuuaauggga

SEQ ID NO: 112874 - RNA, 24 nt, Human
gaaaaaaaaacuucuuuaauggga

SEQ ID NO: 112875 - RNA, 24 nt, Human
gaacaguaaccagaacacaccccc

SEQ ID NO: 112876 - RNA, 22 nt, Human
gagccaacuuuuauguaacugg

SEQ ID NO: 112877 - RNA, 18 nt, Human
gagcugaugcuguguccc

SEQ ID NO: 112878 - RNA, 18 nt, Human
gagcugaugcuguguccc

SEQ ID NO: 112879 - RNA, 27 nt, Human
gaggaaggagcugauggcacagccuua

SEQ ID NO: 112880 - RNA, 20 nt, Human
gcagugcucacuuuuuuuuu

SEQ ID NO: 112881 - RNA, 21 nt, Human
gcuacaaucagacuuucuaag

SEQ ID NO: 112882 - RNA, 27 nt, Human
gcugugcugucucaguaggacauugaa

SEQ ID NO: 112883 - RNA, 18 nt, Human
gcuuuccuaggcuggggc

SEQ ID NO: 112884 - RNA, 24 nt, Human
gggaggaaggagcugauggcacag

SEQ ID NO: 112885 - RNA, 22 nt, Human
guaugggccuacggacaaucau

SEQ ID NO: 112886 - RNA, 20 nt, Human
guccccagcaucagguuuuc

SEQ ID NO: 112887 - RNA, 24 nt, Human
uaaagcucuaagacuccugagcca

SEQ ID NO: 112888 - RNA, 22 nt, Human
uaacauauccaugaacucuagu

SEQ ID NO: 112889 - RNA, 22 nt, Human
uaacauauccaugaacucuagu

SEQ ID NO: 112890 - RNA, 21 nt, Human
uaagcaaaugggaaugugaua

SEQ ID NO: 112891 - RNA, 25 nt, Human
uagaacaguaaccagaacacacccc

SEQ ID NO: 112892 - RNA, 27 nt, Human
uagcuacaaucagacuuucuaagcaac

SEQ ID NO: 112893 - RNA, 28 nt, Human
ucaccuccaggaaggcgccccacccccu

SEQ ID NO: 112894 - RNA, 23 nt, Human
uccagcuuucacccucuggagac

SEQ ID NO: 112895 - RNA, 20 nt, Human
uccaugaacucuaguauggg

SEQ ID NO: 112896 - RNA, 20 nt, Human
uccaugaacucuaguauggg

SEQ ID NO: 112897 - RNA, 19 nt, Human
uccccagcaucagguuuuc

SEQ ID NO: 112898 - RNA, 19 nt, Human
uccguuuucugggcucaua

SEQ ID NO: 112899 - RNA, 25 nt, Human
uccuuccuuguccauugcccucaac

SEQ ID NO: 112900 - RNA, 25 nt, Human
uccuuccuuguccauugcccucaac

SEQ ID NO: 112901 - RNA, 19 nt, Human
ucuaagacuccugagccaa

SEQ ID NO: 112902 - RNA, 22 nt, Human
ucuuucuucuccugauguuuuc

SEQ ID NO: 112903 - RNA, 23 nt, Human
ucuuucuucuccugauguuuucu

SEQ ID NO: 112904 - RNA, 23 nt, Human
ucuuucuucuccugauguuuucu

SEQ ID NO: 112905 - RNA, 19 nt, Human
ugaacuaaguaaagaagcc

SEQ ID NO: 112906 - RNA, 19 nt, Human
ugagaccugguccaggagc

SEQ ID NO: 112907 - RNA, 20 nt, Human
ugauauacauauaaccauua

SEQ ID NO: 112908 - RNA, 21 nt, Human
ugcagugcucacuuuuuuuuu

SEQ ID NO: 112909 - RNA, 20 nt, Human
ugcuguguccccagcaucag

SEQ ID NO: 112910 - RNA, 18 nt, Human
ugggccugguccaggagc

SEQ ID NO: 112911 - RNA, 18 nt, Human
uuaguugcaagagucacu

SEQ ID NO: 112912 - RNA, 19 nt, Human
uucccucuucucccuuuau

SEQ ID NO: 112913 - RNA, 19 nt, Human
uucccucuucucccuuuau

SEQ ID NO: 112914 - RNA, 20 nt, Human
uucccucuucucccuuuauu

SEQ ID NO: 112915 - RNA, 22 nt, Human
uucccucuucucccuuuauucc

SEQ ID NO: 112916 - RNA, 21 nt, Human
acacaauuacagaaccagccc

SEQ ID NO: 112917 - RNA, 26 nt, Human
acaucacacacaauuacagaaccagc

SEQ ID NO: 112918 - RNA, 21 nt, Human
accugagccucccucccaucu

SEQ ID NO: 112919 - RNA, 31 nt, Human
accuuguugcaccucguggcugcuuuguucc

SEQ ID NO: 112920 - RNA, 19 nt, Human
agagguugcacagggcaug

SEQ ID NO: 112921 - RNA, 20 nt, Human
agagguugcacagggcaugg

SEQ ID NO: 112922 - RNA, 23 nt, Human
agauggccuugugcugagugugg

SEQ ID NO: 112923 - RNA, 18 nt, Human
aggcaggugcguguuggc

SEQ ID NO: 112924 - RNA, 22 nt, Human
augaaacgugaacuauacagga

SEQ ID NO: 112925 - RNA, 27 nt, Human
caacucaugggucccuugaaucucccu

SEQ ID NO: 112926 - RNA, 22 nt, Human
caaggaggguaaggauaugggu

SEQ ID NO: 112927 - RNA, 25 nt, Human
caaggaggguaaggauauggguuuc

SEQ ID NO: 112928 - RNA, 22 nt, Human
cacacaauuacagaaccagccc

SEQ ID NO: 112929 - RNA, 21 nt, Human
cacccugccugacccagcugg

SEQ ID NO: 112930 - RNA, 18 nt, Human
cacccuggaggagcccag

SEQ ID NO: 112931 - RNA, 20 nt, Human
cagccccaggcugcugugcu

SEQ ID NO: 112932 - RNA, 22 nt, Human
cagcugggcucacaggucaggg

SEQ ID NO: 112933 - RNA, 20 nt, Human
cagggaccugagccucccuu

SEQ ID NO: 112934 - RNA, 21 nt, Human
caggggcuggccggccgcucc

SEQ ID NO: 112935 - RNA, 18 nt, Human
caggguggagcugucugc

SEQ ID NO: 112936 - RNA, 20 nt, Human
caucuggagccagccugucc

SEQ ID NO: 112937 - RNA, 23 nt, Human
caugaaacgugaacuauacagga

SEQ ID NO: 112938 - RNA, 19 nt, Human
ccacgucccagccaggggc

SEQ ID NO: 112939 - RNA, 20 nt, Human
ccacuugucccuccacagaa

SEQ ID NO: 112940 - RNA, 18 nt, Human
ccagcugggcucacaggu

SEQ ID NO: 112941 - RNA, 20 nt, Human
ccagcugggcucacagguca

SEQ ID NO: 112942 - RNA, 22 nt, Human
ccccagggaccugagccucccu

SEQ ID NO: 112943 - RNA, 24 nt, Human
cccccuagccccagggaccugagc

SEQ ID NO: 112944 - RNA, 18 nt, Human
ccccuagccccagggacc

SEQ ID NO: 112945 - RNA, 19 nt, Human
ccccuagccccagggaccu

SEQ ID NO: 112946 - RNA, 24 nt, Human
ccccuagccccagggaccugagcc

SEQ ID NO: 112947 - RNA, 21 nt, Human
ccgccgguccucuccggccau

SEQ ID NO: 112948 - RNA, 20 nt, Human
ccggagcugggggucacagu

SEQ ID NO: 112949 - RNA, 24 nt, Human
ccuaggagacagccaaugacugcc

SEQ ID NO: 112950 - RNA, 23 nt, Human
ccuugugcugaguguggccuccu

SEQ ID NO: 112951 - RNA, 24 nt, Human
ccuugugcugaguguggccuccuu

SEQ ID NO: 112952 - RNA, 22 nt, Human
cgcagggcggccugugggcacc

SEQ ID NO: 112953 - RNA, 21 nt, Human
cgccucugagcuugggaaccu

SEQ ID NO: 112954 - RNA, 22 nt, Human
cuagccccagggaccugagccu

SEQ ID NO: 112955 - RNA, 19 nt, Human
cucccagcuuggacucggc

SEQ ID NO: 112956 - RNA, 18 nt, Human
cucggccaggguggagcu

SEQ ID NO: 112957 - RNA, 22 nt, Human
cugaauuggcuucacaucacac

SEQ ID NO: 112958 - RNA, 25 nt, Human
cugaauuggcuucacaucacaccgu

SEQ ID NO: 112959 - RNA, 19 nt, Human
cugcacccugccugaccca

SEQ ID NO: 112960 - RNA, 23 nt, Human
cugggggucacagugcgccucug

SEQ ID NO: 112961 - RNA, 18 nt, Human
cuucacaucacacacaau

SEQ ID NO: 112962 - RNA, 20 nt, Human
cuucccaaagcaggaaaucc

SEQ ID NO: 112963 - RNA, 23 nt, Human
cuucccaaagcaggaaauccugg

SEQ ID NO: 112964 - RNA, 21 nt, Human
gagaugaagucagcaccugcu

SEQ ID NO: 112965 - RNA, 22 nt, Human
gagcacacacccuggaggagcc

SEQ ID NO: 112966 - RNA, 19 nt, Human
gagccgccgguccucuccg

SEQ ID NO: 112967 - RNA, 18 nt, Human
gagcugagcagaaggggc

SEQ ID NO: 112968 - RNA, 21 nt, Human
gagcugucugcuuuggaugua

SEQ ID NO: 112969 - RNA, 21 nt, Human
gcacccugccugacccagcug

SEQ ID NO: 112970 - RNA, 18 nt, Human
gcuggggcgagcacggcu

SEQ ID NO: 112971 - RNA, 20 nt, Human
gcuguggagaauggcccaga

SEQ ID NO: 112972 - RNA, 20 nt, Human
gcuugguguuggaggacagg

SEQ ID NO: 112973 - RNA, 22 nt, Human
ggagaugaagucagcaccugcu

SEQ ID NO: 112974 - RNA, 20 nt, Human
ggaggccagccccaggcugc

SEQ ID NO: 112975 - RNA, 18 nt, Human
ggaggcugccagacccca

SEQ ID NO: 112976 - RNA, 20 nt, Human
ggccaggggcuggccggccg

SEQ ID NO: 112977 - RNA, 25 nt, Human
ggucacuuuuauuugccugucugaa

SEQ ID NO: 112978 - RNA, 25 nt, Human
gguccuggggccaggggcuggccgg

SEQ ID NO: 112979 - RNA, 20 nt, Human
gugcuugguguuggaggaca

SEQ ID NO: 112980 - RNA, 19 nt, Human
uaaaaaaauacacucuuug

SEQ ID NO: 112981 - RNA, 23 nt, Human
uaccgcauguccugugccagccu

SEQ ID NO: 112982 - RNA, 18 nt, Human
ucacaggucaggggagag

SEQ ID NO: 112983 - RNA, 19 nt, Human
ucacaggucaggggagagu

SEQ ID NO: 112984 - RNA, 20 nt, Human
ucagcaccugcuggggcgag

SEQ ID NO: 112985 - RNA, 20 nt, Human
ucagcgccgcgggaugcugc

SEQ ID NO: 112986 - RNA, 22 nt, Human
ucagcuggacaagugcuggcug

SEQ ID NO: 112987 - RNA, 18 nt, Human
ucaggggagaguuggggc

SEQ ID NO: 112988 - RNA, 18 nt, Human
uccauccuggcgcucagc

SEQ ID NO: 112989 - RNA, 18 nt, Human
ucccaaagcaggaaaucc

SEQ ID NO: 112990 - RNA, 21 nt, Human
ucccaaagcaggaaauccugg

SEQ ID NO: 112991 - RNA, 23 nt, Human
ucccagccaggggcaugagaugg

SEQ ID NO: 112992 - RNA, 21 nt, Human
ucccccuagccccagggaccu

SEQ ID NO: 112993 - RNA, 22 nt, Human
ucccuugaaucucccagcuugg

SEQ ID NO: 112994 - RNA, 24 nt, Human
ugagaugggggcccuggaugggag

SEQ ID NO: 112995 - RNA, 22 nt, Human
ugagcuugggaaccugcuucag

SEQ ID NO: 112996 - RNA, 24 nt, Human
ugaguccacuugucccuccacaga

SEQ ID NO: 112997 - RNA, 19 nt, Human
ugaguguggccucagcucc

SEQ ID NO: 112998 - RNA, 23 nt, Human
ugaguguggccucagcucccauu

SEQ ID NO: 112999 - RNA, 24 nt, Human
ugcacccugccugacccagcuggg

SEQ ID NO: 113000 - RNA, 21 nt, Human
ugccucacggggccugucugc

SEQ ID NO: 113001 - RNA, 23 nt, Human
ugcuguggucagccuggcgcugc

SEQ ID NO: 113002 - RNA, 19 nt, Human
ugcuugguguuggaggaca

SEQ ID NO: 113003 - RNA, 19 nt, Human
uggagcugucugcuuugga

SEQ ID NO: 113004 - RNA, 21 nt, Human
uggaggacaggccggagcugg

SEQ ID NO: 113005 - RNA, 23 nt, Human
uggaggagcccagauggccuugu

SEQ ID NO: 113006 - RNA, 22 nt, Human
uggaugggaggcugccagaccc

SEQ ID NO: 113007 - RNA, 20 nt, Human
uggcccagagcugagcagaa

SEQ ID NO: 113008 - RNA, 21 nt, Human
uggcugagccacgucccagcc

SEQ ID NO: 113009 - RNA, 25 nt, Human
ugggggcuuccuccgagccgccggu

SEQ ID NO: 113010 - RNA, 22 nt, Human
uguggccguguuccauccuggc

SEQ ID NO: 113011 - RNA, 23 nt, Human
uguggccguguuccauccuggcg

SEQ ID NO: 113012 - RNA, 25 nt, Human
uguggccguguuccauccuggcgcu

SEQ ID NO: 113013 - RNA, 23 nt, Human
uguuccauccuggcgcucagcug

SEQ ID NO: 113014 - RNA, 18 nt, Human
uucagccugggguugcug

SEQ ID NO: 113015 - RNA, 25 nt, Human
uugcaccucguggcugcuuuguucc

SEQ ID NO: 113016 - RNA, 18 nt, Human
uuggaggacaggccggag

SEQ ID NO: 113017 - RNA, 26 nt, Human
aaaaaaaaaaaaaaaagcaacccaca

SEQ ID NO: 113018 - RNA, 18 nt, Human
aaaaaaaaaaagcaaccc

SEQ ID NO: 113019 - RNA, 18 nt, Human
aaaaaaaaagcaacccac

SEQ ID NO: 113020 - RNA, 19 nt, Human
aaaaaaaagugcaaaggca

SEQ ID NO: 113021 - RNA, 19 nt, Human
aaaaaugcugauuugcaau

SEQ ID NO: 113022 - RNA, 23 nt, Human
aaaacagucaacaaaccaaaggg

SEQ ID NO: 113023 - RNA, 20 nt, Human
aaaacaguuuccugcauuuu

SEQ ID NO: 113024 - RNA, 19 nt, Human
aaaaugaugacacucaucu

SEQ ID NO: 113025 - RNA, 21 nt, Human
aaacaggcaaaaagauaaaca

SEQ ID NO: 113026 - RNA, 20 nt, Human
aaacccugccuuaaauuagg

SEQ ID NO: 113027 - RNA, 22 nt, Human
aaaugauaauuuucacagacaa

SEQ ID NO: 113028 - RNA, 19 nt, Human
aacacgcaauuuuuuuucc

SEQ ID NO: 113029 - RNA, 20 nt, Human
aacaguuccucaaugaaugu

SEQ ID NO: 113030 - RNA, 20 nt, Human
aacauccucaugcccagugu

SEQ ID NO: 113031 - RNA, 21 nt, Human
aaccuauuaauaugaaaaaau

SEQ ID NO: 113032 - RNA, 25 nt, Human
aagaaauaaaaucaaaacagucaac

SEQ ID NO: 113033 - RNA, 20 nt, Human
aagauagagaacaaacaaaa

SEQ ID NO: 113034 - RNA, 18 nt, Human
aauuaggcacauuccuca

SEQ ID NO: 113035 - RNA, 23 nt, Human
aauuguuuuaaacaccaucuugu

SEQ ID NO: 113036 - RNA, 21 nt, Human
acaagaaagaaaacgaaaaaa

SEQ ID NO: 113037 - RNA, 26 nt, Human
acaggcaaaaagauaaacaaccuauu

SEQ ID NO: 113038 - RNA, 18 nt, Human
accauguggauacagccu

SEQ ID NO: 113039 - RNA, 18 nt, Human
accgccgaggagugagcu

SEQ ID NO: 113040 - RNA, 21 nt, Human
accucuugcugcagcuucugg

SEQ ID NO: 113041 - RNA, 27 nt, Human
acuuuaaaauucagaaaucaaaggcca

SEQ ID NO: 113042 - RNA, 20 nt, Human
agacauuaaugugcugaaaa

SEQ ID NO: 113043 - RNA, 25 nt, Human
agcaaacaggcaaaaagauaaacaa

SEQ ID NO: 113044 - RNA, 23 nt, Human
agccauuguagacaguaccugac

SEQ ID NO: 113045 - RNA, 20 nt, Human
agccuuaaugguauuuagaa

SEQ ID NO: 113046 - RNA, 18 nt, Human
aggcauuugaugaucacu

SEQ ID NO: 113047 - RNA, 24 nt, Human
aguaaacagacaaaagcaaucauc

SEQ ID NO: 113048 - RNA, 18 nt, Human
aguccugauugcuguggc

SEQ ID NO: 113049 - RNA, 18 nt, Human
auaucacagguucccaac

SEQ ID NO: 113050 - RNA, 24 nt, Human
aucaaauuaccugaauaaauccaa

SEQ ID NO: 113051 - RNA, 19 nt, Human
aucaaugucaaaaugcuua

SEQ ID NO: 113052 - RNA, 19 nt, Human
augcuuacaauaaauaaaa

SEQ ID NO: 113053 - RNA, 20 nt, Human
augguacaaaagggggaugg

SEQ ID NO: 113054 - RNA, 22 nt, Human
auugcugagauaggugacaagc

SEQ ID NO: 113055 - RNA, 24 nt, Human
auuuaaccaaauugaucaguuacu

SEQ ID NO: 113056 - RNA, 22 nt, Human
caaaaaacauucaacaggagca

SEQ ID NO: 113057 - RNA, 18 nt, Human
caaaaaccaaaaaacaaa

SEQ ID NO: 113058 - RNA, 19 nt, Human
caaaaaccaaaaaacaaaa

SEQ ID NO: 113059 - RNA, 28 nt, Human
caaacaggcaaaaagauaaacaaccuau

SEQ ID NO: 113060 - RNA, 18 nt, Human
caacagaaagacuguuua

SEQ ID NO: 113061 - RNA, 18 nt, Human
caacagaugagacagacu

SEQ ID NO: 113062 - RNA, 23 nt, Human
caagaacaacucaaaaaccaaaa

SEQ ID NO: 113063 - RNA, 22 nt, Human
caagccuuaaugguauuuagaa

SEQ ID NO: 113064 - RNA, 21 nt, Human
caccaaagaaauaaaaucaaa

SEQ ID NO: 113065 - RNA, 19 nt, Human
cagacugcagaaaggcuaa

SEQ ID NO: 113066 - RNA, 18 nt, Human
cagcaaaaaaguccauga

SEQ ID NO: 113067 - RNA, 19 nt, Human
cagcaaaacacuuaacaga

SEQ ID NO: 113068 - RNA, 18 nt, Human
cagcauaauucaauauga

SEQ ID NO: 113069 - RNA, 26 nt, Human
cagugggcuagccuuucucccccugg

SEQ ID NO: 113070 - RNA, 25 nt, Human
cauacaagauacaaauucaauuauc

SEQ ID NO: 113071 - RNA, 18 nt, Human
caucagcaaaaaagucca

SEQ ID NO: 113072 - RNA, 18 nt, Human
caugccaguggugauugc

SEQ ID NO: 113073 - RNA, 20 nt, Human
cauugcacuuaacaugagua

SEQ ID NO: 113074 - RNA, 18 nt, Human
ccugauugcuguggcugg

SEQ ID NO: 113075 - RNA, 23 nt, Human
ccugccaaucaacaguuccucaa

SEQ ID NO: 113076 - RNA, 21 nt, Human
cucaugcccaguguucuagag

SEQ ID NO: 113077 - RNA, 21 nt, Human
cuccccaaaaaaaaaaaaaaa

SEQ ID NO: 113078 - RNA, 24 nt, Human
cugagcacuaguugcauauccagu

SEQ ID NO: 113079 - RNA, 22 nt, Human
cugcaacauccucaugcccagu

SEQ ID NO: 113080 - RNA, 18 nt, Human
cugcagcuucuggagaaa

SEQ ID NO: 113081 - RNA, 19 nt, Human
cuuaaguucuuuaagugac

SEQ ID NO: 113082 - RNA, 24 nt, Human
cuuguagggaaaacagcuuucugu

SEQ ID NO: 113083 - RNA, 23 nt, Human
gaaaacgaaaaaaaaaaaaucaa

SEQ ID NO: 113084 - RNA, 20 nt, Human
gaacaagagcaauggacaaa

SEQ ID NO: 113085 - RNA, 21 nt, Human
gaagagcugugaguccugauu

SEQ ID NO: 113086 - RNA, 19 nt, Human
gaaugaauuugggaaaaau

SEQ ID NO: 113087 - RNA, 23 nt, Human
gacugagugaggggaccacagaa

SEQ ID NO: 113088 - RNA, 19 nt, Human
gagagacugagugagggga

SEQ ID NO: 113089 - RNA, 19 nt, Human
gcaaacaggcaaaaagaua

SEQ ID NO: 113090 - RNA, 19 nt, Human
gcaauuuuuuuuccauuua

SEQ ID NO: 113091 - RNA, 19 nt, Human
gcaggcucuugcagcaugu

SEQ ID NO: 113092 - RNA, 20 nt, Human
gguauaaaaauucuuaaguu

SEQ ID NO: 113093 - RNA, 18 nt, Human
guaaauuuaaacaccaag

SEQ ID NO: 113094 - RNA, 18 nt, Human
guacagcuaaccaacaga

SEQ ID NO: 113095 - RNA, 23 nt, Human
guauguuguuuucuggagugcaa

SEQ ID NO: 113096 - RNA, 23 nt, Human
gugcaagggauuuggcaaccauc

SEQ ID NO: 113097 - RNA, 25 nt, Human
uaaaaaguagucaaaaaacauucaa

SEQ ID NO: 113098 - RNA, 21 nt, Human
uaaaauggugcaagggauuug

SEQ ID NO: 113099 - RNA, 22 nt, Human
uaaacaaccuauuaauaugaaa

SEQ ID NO: 113100 - RNA, 23 nt, Human
uaaauuaccauuuuacuaagaaa

SEQ ID NO: 113101 - RNA, 20 nt, Human
uaagaguaccaaagacagcu

SEQ ID NO: 113102 - RNA, 21 nt, Human
uaagauagagaacaaacaaaa

SEQ ID NO: 113103 - RNA, 24 nt, Human
uaauaugcaucacacaauauuaua

SEQ ID NO: 113104 - RNA, 22 nt, Human
uaaugaaaaccgguucaaauca

SEQ ID NO: 113105 - RNA, 23 nt, Human
uacagaauuaacaaaaucauuuc

SEQ ID NO: 113106 - RNA, 21 nt, Human
uacagacaaguaugaaaaaua

SEQ ID NO: 113107 - RNA, 23 nt, Human
uacuuuauaagccaaauaucaaa

SEQ ID NO: 113108 - RNA, 20 nt, Human
uagaaguaaugguuacugcc

SEQ ID NO: 113109 - RNA, 21 nt, Human
uauaaucuuugugagcagaga

SEQ ID NO: 113110 - RNA, 22 nt, Human
uauccaccaaagaaauaaaauc

SEQ ID NO: 113111 - RNA, 23 nt, Human
uaugaauugaagucauacuuuaa

SEQ ID NO: 113112 - RNA, 21 nt, Human
uaugcacagccauuguagaca

SEQ ID NO: 113113 - RNA, 20 nt, Human
ucagaaccuuuauugcugag

SEQ ID NO: 113114 - RNA, 26 nt, Human
ucagacacaacucuguucacagcuuu

SEQ ID NO: 113115 - RNA, 20 nt, Human
ucagugccugccaaucaaca

SEQ ID NO: 113116 - RNA, 18 nt, Human
uccaccaaagaaauaaaa

SEQ ID NO: 113117 - RNA, 25 nt, Human
ucccaacagaugagacaggguaccc

SEQ ID NO: 113118 - RNA, 21 nt, Human
uccccaaaaaaaaaaaaaaaa

SEQ ID NO: 113119 - RNA, 26 nt, Human
ucuguccuauugccugagacuuuuag

SEQ ID NO: 113120 - RNA, 22 nt, Human
ucugugggacccaccaucuaga

SEQ ID NO: 113121 - RNA, 19 nt, Human
ugaaaguguuuugaacuug

SEQ ID NO: 113122 - RNA, 19 nt, Human
ugaaauaccuaaaauguua

SEQ ID NO: 113123 - RNA, 23 nt, Human
ugaaauaccuaaaauguuauagg

SEQ ID NO: 113124 - RNA, 18 nt, Human
ugaacaaauccaugaauu

SEQ ID NO: 113125 - RNA, 21 nt, Human
ugacaagaacaacucaaaaac

SEQ ID NO: 113126 - RNA, 24 nt, Human
ugacaagaacaacucaaaaaccaa

SEQ ID NO: 113127 - RNA, 24 nt, Human
ugagagacugagugaggggaccac

SEQ ID NO: 113128 - RNA, 21 nt, Human
ugaggcaggaaaaaguaucug

SEQ ID NO: 113129 - RNA, 18 nt, Human
ugaguuugugucauugug

SEQ ID NO: 113130 - RNA, 18 nt, Human
ugauaguaaauuuaaaca

SEQ ID NO: 113131 - RNA, 24 nt, Human
ugauaguaaauuuaaacaccaagg

SEQ ID NO: 113132 - RNA, 20 nt, Human
uggaaugaauuugggaaaaa

SEQ ID NO: 113133 - RNA, 20 nt, Human
uggcuaugcuggguguuugg

SEQ ID NO: 113134 - RNA, 19 nt, Human
ugggugugaacucuuuggu

SEQ ID NO: 113135 - RNA, 21 nt, Human
ugguacaaaagggggaugguu

SEQ ID NO: 113136 - RNA, 18 nt, Human
uguaggaaucaaggccuc

SEQ ID NO: 113137 - RNA, 20 nt, Human
ugugccuguuucauaaagau

SEQ ID NO: 113138 - RNA, 24 nt, Human
uguugagcuguaccucuugcugca

SEQ ID NO: 113139 - RNA, 21 nt, Human
uguugaguaaaacguuuggau

SEQ ID NO: 113140 - RNA, 23 nt, Human
uguuucuuuucagaggacauggu

SEQ ID NO: 113141 - RNA, 23 nt, Human
uuaaaucuuauuuacccccucau

SEQ ID NO: 113142 - RNA, 22 nt, Human
uuaagaguaccaaagacagcuu

SEQ ID NO: 113143 - RNA, 19 nt, Human
uucccaguuacaaaaaaug

SEQ ID NO: 113144 - RNA, 22 nt, Human
uucguagccuuguauuucuguu

SEQ ID NO: 113145 - RNA, 22 nt, Human
uugaguauucauuaaaacaacg

SEQ ID NO: 113146 - RNA, 23 nt, Human
uugcauagaaagacuucuaucug

SEQ ID NO: 113147 - RNA, 19 nt, Human
uuuagcaaugauaguaaau

SEQ ID NO: 113148 - RNA, 19 nt, Human
uuuggauuccaaaggccau

SEQ ID NO: 113149 - RNA, 22 nt, Human
aaaaaaaaaaaaaaagaaagaa

SEQ ID NO: 113150 - RNA, 24 nt, Human
aaaaaagaaagaaaaaauaucaag

SEQ ID NO: 113151 - RNA, 21 nt, Human
aaaaauagacuuugaacaaaa

SEQ ID NO: 113152 - RNA, 26 nt, Human
aaaacaucucaaauuauuauacacau

SEQ ID NO: 113153 - RNA, 22 nt, Human
aaaagaaagaaaaaauaucaag

SEQ ID NO: 113154 - RNA, 22 nt, Human
aagccagaggcagguggagaga

SEQ ID NO: 113155 - RNA, 19 nt, Human
aaggaaaaaaauauuuucc

SEQ ID NO: 113156 - RNA, 20 nt, Human
aagugagcagcgggcugggc

SEQ ID NO: 113157 - RNA, 22 nt, Human
acaaggaacagaacagaacagu

SEQ ID NO: 113158 - RNA, 20 nt, Human
acagacuaggagggagccgg

SEQ ID NO: 113159 - RNA, 23 nt, Human
acccagugaggggcugguggcuc

SEQ ID NO: 113160 - RNA, 20 nt, Human
accccgaggagaaacucccg

SEQ ID NO: 113161 - RNA, 21 nt, Human
agaaagaaaaaauaucaagga

SEQ ID NO: 113162 - RNA, 20 nt, Human
agaacagaacagucucuccc

SEQ ID NO: 113163 - RNA, 19 nt, Human
aggcagguggagagagggu

SEQ ID NO: 113164 - RNA, 19 nt, Human
agggaaaaacugcuuugug

SEQ ID NO: 113165 - RNA, 26 nt, Human
agggggguguggagaaaggagcagaa

SEQ ID NO: 113166 - RNA, 18 nt, Human
agguccccagggccuggg

SEQ ID NO: 113167 - RNA, 24 nt, Human
aguggaggggaggccaaggggggg

SEQ ID NO: 113168 - RNA, 19 nt, Human
augcacuuuugguuuuugg

SEQ ID NO: 113169 - RNA, 28 nt, Human
auucuuuuuuuuuuuuuuuuuuuuuugg

SEQ ID NO: 113170 - RNA, 23 nt, Human
auugucucccauuuuuuggcuuu

SEQ ID NO: 113171 - RNA, 23 nt, Human
caacacaguuacacaaggaacag

SEQ ID NO: 113172 - RNA, 23 nt, Human
caagcaaguggaccaagcuuccu

SEQ ID NO: 113173 - RNA, 21 nt, Human
caaggcuucuuuggcagucug

SEQ ID NO: 113174 - RNA, 21 nt, Human
caaguggaccaagcuuccuuu

SEQ ID NO: 113175 - RNA, 19 nt, Human
cagaaagggacuuaccccc

SEQ ID NO: 113176 - RNA, 24 nt, Human
ccacccaucacauagauguagcac

SEQ ID NO: 113177 - RNA, 21 nt, Human
cccaccccacccaucacauag

SEQ ID NO: 113178 - RNA, 23 nt, Human
ccccagggccugggggugcuggg

SEQ ID NO: 113179 - RNA, 18 nt, Human
ccccagguccccagggcc

SEQ ID NO: 113180 - RNA, 25 nt, Human
ccccauccacaaaaaaaaaaaaaaa

SEQ ID NO: 113181 - RNA, 18 nt, Human
cccccauccccgccccca

SEQ ID NO: 113182 - RNA, 21 nt, Human
cccccauccccgcccccaggc

SEQ ID NO: 113183 - RNA, 18 nt, Human
cccuccccaccccaccca

SEQ ID NO: 113184 - RNA, 22 nt, Human
cccuccccaccccacccaucac

SEQ ID NO: 113185 - RNA, 23 nt, Human
cccuccccaccccacccaucaca

SEQ ID NO: 113186 - RNA, 21 nt, Human
ccgcccccaggcaguugcccc

SEQ ID NO: 113187 - RNA, 21 nt, Human
ccuccugcuccgaccccgagg

SEQ ID NO: 113188 - RNA, 20 nt, Human
cgaacccagugaggggcugg

SEQ ID NO: 113189 - RNA, 24 nt, Human
cggguuggggggaaaguugguugg

SEQ ID NO: 113190 - RNA, 21 nt, Human
cgguuggucaaagauaaaaac

SEQ ID NO: 113191 - RNA, 18 nt, Human
cucacacuccgcgugccu

SEQ ID NO: 113192 - RNA, 18 nt, Human
cucccccggcaugacccc

SEQ ID NO: 113193 - RNA, 24 nt, Human
cucccccggcaugacccccucaaa

SEQ ID NO: 113194 - RNA, 20 nt, Human
cucugaaacccggggacaga

SEQ ID NO: 113195 - RNA, 22 nt, Human
cugagaaccccagguccccagg

SEQ ID NO: 113196 - RNA, 18 nt, Human
gaaacccggggacagagg

SEQ ID NO: 113197 - RNA, 18 nt, Human
gaacccagugaggggcug

SEQ ID NO: 113198 - RNA, 20 nt, Human
gacgcaggacagacuaggag

SEQ ID NO: 113199 - RNA, 22 nt, Human
gagcagaggccugagaagccag

SEQ ID NO: 113200 - RNA, 22 nt, Human
gaguggaggggaggccaagggg

SEQ ID NO: 113201 - RNA, 22 nt, Human
gcccccauccccgcccccaggc

SEQ ID NO: 113202 - RNA, 24 nt, Human
gcggcacaagggaugacacgcguu

SEQ ID NO: 113203 - RNA, 19 nt, Human
gcuuccacccugcccccau

SEQ ID NO: 113204 - RNA, 22 nt, Human
ggaaaguugguugggugggagg

SEQ ID NO: 113205 - RNA, 19 nt, Human
ggaaggaguggaggggagg

SEQ ID NO: 113206 - RNA, 22 nt, Human
ggaggggaggccaaggggggug

SEQ ID NO: 113207 - RNA, 18 nt, Human
ggcaggagcgggcugagg

SEQ ID NO: 113208 - RNA, 20 nt, Human
ggcucccccggcaugacccc

SEQ ID NO: 113209 - RNA, 24 nt, Human
gggaaaaacugcuuugugcuuugg

SEQ ID NO: 113210 - RNA, 21 nt, Human
gggaaaguugguuggguggga

SEQ ID NO: 113211 - RNA, 24 nt, Human
gggaaguugucucugaaacccggg

SEQ ID NO: 113212 - RNA, 19 nt, Human
gggacagaggacgcaggaa

SEQ ID NO: 113213 - RNA, 18 nt, Human
gggcaggagcgggcugag

SEQ ID NO: 113214 - RNA, 23 nt, Human
gggcugagggugggggccacuug

SEQ ID NO: 113215 - RNA, 22 nt, Human
gggcugcagcuguggaggaggg

SEQ ID NO: 113216 - RNA, 21 nt, Human
gggcuggagcgcacacgcucu

SEQ ID NO: 113217 - RNA, 18 nt, Human
ggggaggccaaggggggu

SEQ ID NO: 113218 - RNA, 18 nt, Human
gggggugcugggcgggca

SEQ ID NO: 113219 - RNA, 19 nt, Human
ggugcugggcgggcaggag

SEQ ID NO: 113220 - RNA, 19 nt, Human
gguggagagaggguggaaa

SEQ ID NO: 113221 - RNA, 18 nt, Human
uaaaaauagacuuugaac

SEQ ID NO: 113222 - RNA, 23 nt, Human
uacacaaggaacagaacagaaca

SEQ ID NO: 113223 - RNA, 22 nt, Human
uagacccuagacauguagacuc

SEQ ID NO: 113224 - RNA, 21 nt, Human
uaggagggagccgggaggaug

SEQ ID NO: 113225 - RNA, 18 nt, Human
ucacauagauguagcacc

SEQ ID NO: 113226 - RNA, 23 nt, Human
uccacaaaaaaaaaaaaaaagaa

SEQ ID NO: 113227 - RNA, 24 nt, Human
uccacaaaaaaaaaaaaaaagaaa

SEQ ID NO: 113228 - RNA, 25 nt, Human
uccacaaaaaaaaaaaaaaagaaag

SEQ ID NO: 113229 - RNA, 18 nt, Human
uccaugugaaauugucuc

SEQ ID NO: 113230 - RNA, 22 nt, Human
ucccaccccuagggaaaaacug

SEQ ID NO: 113231 - RNA, 22 nt, Human
ucccgcccagccugcggcacaa

SEQ ID NO: 113232 - RNA, 22 nt, Human
ucguggcccuuccugacucucc

SEQ ID NO: 113233 - RNA, 28 nt, Human
ucucccauuuuuuggcuuuuggggggga

SEQ ID NO: 113234 - RNA, 18 nt, Human
ucuuuuuuuuuuuuuuuu

SEQ ID NO: 113235 - RNA, 21 nt, Human
ugaacaaaaaggaacauuugc

SEQ ID NO: 113236 - RNA, 21 nt, Human
ugacacgcguuccccaaaucc

SEQ ID NO: 113237 - RNA, 18 nt, Human
ugagaaccccaggucccc

SEQ ID NO: 113238 - RNA, 22 nt, Human
ugagaagccagaggcaggugga

SEQ ID NO: 113239 - RNA, 19 nt, Human
ugagcagcgggcugggcug

SEQ ID NO: 113240 - RNA, 19 nt, Human
ugagggugggggccacuug

SEQ ID NO: 113241 - RNA, 19 nt, Human
ugauucccuccccacccca

SEQ ID NO: 113242 - RNA, 24 nt, Human
ugccccggugacacaucaagacaa

SEQ ID NO: 113243 - RNA, 24 nt, Human
ugcuccgaccccgaggagaaacuc

SEQ ID NO: 113244 - RNA, 22 nt, Human
ugcuuugucguggcccuuccug

SEQ ID NO: 113245 - RNA, 21 nt, Human
ugcuuugugcuuugggaaguu

SEQ ID NO: 113246 - RNA, 21 nt, Human
uggaggaggguuucagaggag

SEQ ID NO: 113247 - RNA, 21 nt, Human
uggaggggaggccaagggggg

SEQ ID NO: 113248 - RNA, 24 nt, Human
uggcaaggcuucuuuggcagucug

SEQ ID NO: 113249 - RNA, 18 nt, Human
ugggagggagccagguug

SEQ ID NO: 113250 - RNA, 25 nt, Human
ugggagggagccagguugggaugga

SEQ ID NO: 113251 - RNA, 21 nt, Human
ugggcugcagcuguggaggag

SEQ ID NO: 113252 - RNA, 20 nt, Human
uggggaggggguuagcgucc

SEQ ID NO: 113253 - RNA, 19 nt, Human
ugggugggagggagccagg

SEQ ID NO: 113254 - RNA, 20 nt, Human
ugggugggagggagccaggu

SEQ ID NO: 113255 - RNA, 21 nt, Human
ugggugggagggagccagguu

SEQ ID NO: 113256 - RNA, 23 nt, Human
ugggugggagggagccagguugg

SEQ ID NO: 113257 - RNA, 21 nt, Human
uggguugcuugucuguuuccg

SEQ ID NO: 113258 - RNA, 21 nt, Human
ugguaagguugaaugcacuuu

SEQ ID NO: 113259 - RNA, 23 nt, Human
ugguaagguugaaugcacuuuug

SEQ ID NO: 113260 - RNA, 19 nt, Human
ugucucugaaacccgggga

SEQ ID NO: 113261 - RNA, 18 nt, Human
uguggcuggggagggggu

SEQ ID NO: 113262 - RNA, 20 nt, Human
uuccggguuggggggaaagu

SEQ ID NO: 113263 - RNA, 25 nt, Human
uucuuuggcagucugagaaccccag

SEQ ID NO: 113264 - RNA, 20 nt, Human
uuguuuccugugucuucugg

SEQ ID NO: 113265 - RNA, 21 nt, Human
uuucugcuuugucguggcccu

SEQ ID NO: 113266 - RNA, 22 nt, Human
uuuggggggguucaguuugggu

SEQ ID NO: 113267 - RNA, 22 nt, Human
uuuggucauguucgguugguca

SEQ ID NO: 113268 - RNA, 18 nt, Human
uuuuuuuuuuuuuuuuug

SEQ ID NO: 113269 - RNA, 20 nt, Human
uuuuuuuuuuuuuuuuuggu

SEQ ID NO: 113270 - RNA, 24 nt, Human
uuuuuuuuuuuuuuuuugguaagg

SEQ ID NO: 113271 - RNA, 25 nt, Human
aaaaauacaccacacgauacaacuc

SEQ ID NO: 113272 - RNA, 18 nt, Human
aaaagccacaaguggugc

SEQ ID NO: 113273 - RNA, 18 nt, Human
aaacaaaacaaggaccuc

SEQ ID NO: 113274 - RNA, 24 nt, Human
aagaagaagaaauggcaaagagaa

SEQ ID NO: 113275 - RNA, 21 nt, Human
aagaagaagaagaaauggcaa

SEQ ID NO: 113276 - RNA, 25 nt, Human
aagaagaagaagaaauggcaaagaa

SEQ ID NO: 113277 - RNA, 27 nt, Human
aagaagaagaagaaauggcaaagagaa

SEQ ID NO: 113278 - RNA, 22 nt, Human
aaugagacuggcaaagaacaaa

SEQ ID NO: 113279 - RNA, 21 nt, Human
acaaaacaaaacaaggaccuc

SEQ ID NO: 113280 - RNA, 23 nt, Human
accacacgauacaacucaauaca

SEQ ID NO: 113281 - RNA, 25 nt, Human
agaagaagaagaaauggcaaagaga

SEQ ID NO: 113282 - RNA, 25 nt, Human
agaagaagaagaaauggcaaagagg

SEQ ID NO: 113283 - RNA, 28 nt, Human
agaagaugaaaaugagacuggcaaagaa

SEQ ID NO: 113284 - RNA, 22 nt, Human
agcaccaucaacauucuucaag

SEQ ID NO: 113285 - RNA, 18 nt, Human
agccacaaguggugcaaa

SEQ ID NO: 113286 - RNA, 29 nt, Human
aguagaugugcagaagaaauggaaggauu

SEQ ID NO: 113287 - RNA, 31 nt, Human
aguagaugugcagaagaaauggaaggauucc

SEQ ID NO: 113288 - RNA, 30 nt, Human
aguagaugugcagaagaaauggaaggauuu

SEQ ID NO: 113289 - RNA, 26 nt, Human
aguuuuuucaaauuucuuucuuuuuu

SEQ ID NO: 113290 - RNA, 21 nt, Human
auauguucuuuuggaaaacca

SEQ ID NO: 113291 - RNA, 21 nt, Human
caaaacaaaacaaggaccuca

SEQ ID NO: 113292 - RNA, 19 nt, Human
caacuuagccgaaaccucc

SEQ ID NO: 113293 - RNA, 19 nt, Human
caacuuugggcaaauaauc

SEQ ID NO: 113294 - RNA, 20 nt, Human
cagagccccugggucaccgg

SEQ ID NO: 113295 - RNA, 22 nt, Human
cagcaccuaacaauguggauca

SEQ ID NO: 113296 - RNA, 31 nt, Human
cagcuuucaguuaaaaaagaagaagaagaaa

SEQ ID NO: 113297 - RNA, 18 nt, Human
caguucaucucugucuag

SEQ ID NO: 113298 - RNA, 19 nt, Human
ccauggaagaagaugaaaa

SEQ ID NO: 113299 - RNA, 26 nt, Human
cccucuguggaagauauucaaaagcc

SEQ ID NO: 113300 - RNA, 19 nt, Human
ccuccugcugccguggugc

SEQ ID NO: 113301 - RNA, 21 nt, Human
ccuucuuuuucucuuuugccc

SEQ ID NO: 113302 - RNA, 23 nt, Human
ccuuuggaaguuuggguuuuaaa

SEQ ID NO: 113303 - RNA, 21 nt, Human
cugcuugcccaagaaacaaag

SEQ ID NO: 113304 - RNA, 18 nt, Human
cugggucaccggcggagg

SEQ ID NO: 113305 - RNA, 18 nt, Human
gaagaagaagaaauggca

SEQ ID NO: 113306 - RNA, 24 nt, Human
gaucaauccuucuuuuucucuuuu

SEQ ID NO: 113307 - RNA, 20 nt, Human
ggaaaaccaaacaugcuuua

SEQ ID NO: 113308 - RNA, 25 nt, Human
guaagaguguugaaaaaaaaauuca

SEQ ID NO: 113309 - RNA, 26 nt, Human
uaaaaaagaagaagaagaaauggcaa

SEQ ID NO: 113310 - RNA, 31 nt, Human
uaaaaaagaagaagaagaaauggcaaagagg

SEQ ID NO: 113311 - RNA, 24 nt, Human
uaacagguguaagaguguugaaaa

SEQ ID NO: 113312 - RNA, 23 nt, Human
uaccuccaacuuagccgaaaccu

SEQ ID NO: 113313 - RNA, 31 nt, Human
uaugguuuuuauuuuucaauuuuuauuuugg

SEQ ID NO: 113314 - RNA, 18 nt, Human
uauuaugaacaaaacaaa

SEQ ID NO: 113315 - RNA, 23 nt, Human
uauuuugguuuucuuacaaaggu

SEQ ID NO: 113316 - RNA, 26 nt, Human
uauuuugguuuucuuacaaagguuga

SEQ ID NO: 113317 - RNA, 25 nt, Human
uauuuugguuuucuuacaaagguuu

SEQ ID NO: 113318 - RNA, 31 nt, Human
uauuuuucaauuuuuauuuugguuuucuuaa

SEQ ID NO: 113319 - RNA, 24 nt, Human
ucaauuuuuauuuugguuuucuua

SEQ ID NO: 113320 - RNA, 25 nt, Human
ucaauuuuuauuuugguuuucuuaa

SEQ ID NO: 113321 - RNA, 25 nt, Human
ucaauuuuuauuuugguuuucuuac

SEQ ID NO: 113322 - RNA, 24 nt, Human
ucaccggcggagguaucaccuggc

SEQ ID NO: 113323 - RNA, 22 nt, Human
ucaguuaaaaaagaagaagaaa

SEQ ID NO: 113324 - RNA, 25 nt, Human
ucaguuaaaaaagaagaagaagaaa

SEQ ID NO: 113325 - RNA, 18 nt, Human
uccauaacagguguaaga

SEQ ID NO: 113326 - RNA, 22 nt, Human
uccuucuuuuucucuuuugccc

SEQ ID NO: 113327 - RNA, 22 nt, Human
ucugaaauacuauuaauuagca

SEQ ID NO: 113328 - RNA, 24 nt, Human
ucugaucaauccuucuuuuucucu

SEQ ID NO: 113329 - RNA, 21 nt, Human
ugaacaaaacaaaacaaggac

SEQ ID NO: 113330 - RNA, 27 nt, Human
ugcucugaucaauccuucuuuuucucu

SEQ ID NO: 113331 - RNA, 20 nt, Human
uggaaccauggaagaagaug

SEQ ID NO: 113332 - RNA, 18 nt, Human
uggaagaagaugaaaaug

SEQ ID NO: 113333 - RNA, 21 nt, Human
uggcaaagaacaaaugcugaa

SEQ ID NO: 113334 - RNA, 21 nt, Human
uguaagaguguugaaaaaaaa

SEQ ID NO: 113335 - RNA, 23 nt, Human
uguauuaugaacaaaacaaaaca

SEQ ID NO: 113336 - RNA, 22 nt, Human
ugugcagaagaaauggaaggau

SEQ ID NO: 113337 - RNA, 23 nt, Human
ugugcagaagaaauggaaggauu

SEQ ID NO: 113338 - RNA, 23 nt, Human
ugugcagaagaaauggaaggauu

SEQ ID NO: 113339 - RNA, 25 nt, Human
ugugcagaagaaauggaaggauuca

SEQ ID NO: 113340 - RNA, 26 nt, Human
ugugcagaagaaauggaaggauucag

SEQ ID NO: 113341 - RNA, 25 nt, Human
ugugcagaagaaauggaaggauucc

SEQ ID NO: 113342 - RNA, 24 nt, Human
ugugcagaagaaauggaaggauuu

SEQ ID NO: 113343 - RNA, 22 nt, Human
uguggaagauauucaaaagcca

SEQ ID NO: 113344 - RNA, 21 nt, Human
uuaauugggaauaagauggaa

SEQ ID NO: 113345 - RNA, 24 nt, Human
uucaaauuucuuucuuuuuuaauu

SEQ ID NO: 113346 - RNA, 26 nt, Human
uucaaauuucuuucuuuuuuaauuua

SEQ ID NO: 113347 - RNA, 18 nt, Human
uucaaguaucugaaauac

SEQ ID NO: 113348 - RNA, 20 nt, Human
uucaguuaaaaaagaagaag

SEQ ID NO: 113349 - RNA, 19 nt, Human
uucucuuuugcccacaauu

SEQ ID NO: 113350 - RNA, 29 nt, Human
uugaaaaaaaaauucaaauuuuuggggga

SEQ ID NO: 113351 - RNA, 24 nt, Human
uuucaaauuucuuucuuuuuuaau

SEQ ID NO: 113352 - RNA, 21 nt, Human
uuugggggagcgggggaagga

SEQ ID NO: 113353 - RNA, 19 nt, Human
uuuggguuuuaaacuuccc

SEQ ID NO: 113354 - RNA, 18 nt, Human
uuuguauuaugaacaaaa

SEQ ID NO: 113355 - RNA, 24 nt, Human
uuuugcccacaauuuaagcaagua

SEQ ID NO: 113356 - RNA, 28 nt, Human
uuuuuucaaauuucuuucuuuuuuaauu

SEQ ID NO: 113357 - RNA, 21 nt, Human
aaauaaauagaacaccgagau

SEQ ID NO: 113358 - RNA, 19 nt, Human
aaggucuuacaggaagaca

SEQ ID NO: 113359 - RNA, 24 nt, Human
agaauagcaccauuguguaggaca

SEQ ID NO: 113360 - RNA, 24 nt, Human
agaguccuagagugacugagauug

SEQ ID NO: 113361 - RNA, 22 nt, Human
aggaggaagcgggagacccggc

SEQ ID NO: 113362 - RNA, 23 nt, Human
aggaggaggaagcgggagacccg

SEQ ID NO: 113363 - RNA, 21 nt, Human
agucacucagggggcauuuga

SEQ ID NO: 113364 - RNA, 21 nt, Human
augaauggacaucaggucagg

SEQ ID NO: 113365 - RNA, 24 nt, Human
caacggauuguguuguuucugggu

SEQ ID NO: 113366 - RNA, 22 nt, Human
ccugcgcccggcaccugaaggg

SEQ ID NO: 113367 - RNA, 21 nt, Human
gaaaaguccgaacugugagag

SEQ ID NO: 113368 - RNA, 18 nt, Human
gagccgggcccgggcgga

SEQ ID NO: 113369 - RNA, 22 nt, Human
gaggcccuuggagcaggaggag

SEQ ID NO: 113370 - RNA, 18 nt, Human
gcacggcgcggguccggg

SEQ ID NO: 113371 - RNA, 18 nt, Human
gcggagcgcagcgaaacg

SEQ ID NO: 113372 - RNA, 20 nt, Human
gcggagcgcagcgaaacggc

SEQ ID NO: 113373 - RNA, 23 nt, Human
gcggggccuggcugagccgggcc

SEQ ID NO: 113374 - RNA, 23 nt, Human
ggcaggagcacggcgcggguccg

SEQ ID NO: 113375 - RNA, 19 nt, Human
ggcccgggcggagcgcagc

SEQ ID NO: 113376 - RNA, 20 nt, Human
ggccuggcugagccgggccc

SEQ ID NO: 113377 - RNA, 23 nt, Human
gggccuggcugagccgggcccgg

SEQ ID NO: 113378 - RNA, 22 nt, Human
gggcggagcgcagcgaaacggc

SEQ ID NO: 113379 - RNA, 25 nt, Human
ggggcagucacucagggggcauuug

SEQ ID NO: 113380 - RNA, 21 nt, Human
ggggccuggcugagccgggcc

SEQ ID NO: 113381 - RNA, 22 nt, Human
ggggccuggcugagccgggccc

SEQ ID NO: 113382 - RNA, 20 nt, Human
gucuucuggccugggcuggg

SEQ ID NO: 113383 - RNA, 19 nt, Human
ucacucagggggcauuuga

SEQ ID NO: 113384 - RNA, 18 nt, Human
ucucuuagaaagagaggg

SEQ ID NO: 113385 - RNA, 19 nt, Human
ucuggccugggcugggggc

SEQ ID NO: 113386 - RNA, 18 nt, Human
ucuucuggccugggcugg

SEQ ID NO: 113387 - RNA, 23 nt, Human
ugggaugaauggacaucagguca

SEQ ID NO: 113388 - RNA, 25 nt, Human
ugggggcagucacucagggggcauu

SEQ ID NO: 113389 - RNA, 18 nt, Human
uguuuuaaaaaauacaga

SEQ ID NO: 113390 - RNA, 20 nt, Human
uucuggccugggcugggggc

SEQ ID NO: 113391 - RNA, 20 nt, Human
aaaaaaauaaaacaaaaagc

SEQ ID NO: 113392 - RNA, 20 nt, Human
aaaagaucaacaaccacaua

SEQ ID NO: 113393 - RNA, 21 nt, Human
aagaaaaaagaggagcaccuu

SEQ ID NO: 113394 - RNA, 18 nt, Human
aaguuguucccugcccuu

SEQ ID NO: 113395 - RNA, 18 nt, Human
aaugacaagaaaaaagag

SEQ ID NO: 113396 - RNA, 23 nt, Human
accagcaaugacaagaaaaaaga

SEQ ID NO: 113397 - RNA, 22 nt, Human
agaaaagaaaagcaguucaaag

SEQ ID NO: 113398 - RNA, 21 nt, Human
aggaggagaaucccuguggca

SEQ ID NO: 113399 - RNA, 22 nt, Human
cagcaaaaaaagagaaguauca

SEQ ID NO: 113400 - RNA, 24 nt, Human
cagcaaugacaagaaaaaagagga

SEQ ID NO: 113401 - RNA, 18 nt, Human
cauguacagauuuugugc

SEQ ID NO: 113402 - RNA, 22 nt, Human
ccaaauauuaguaaucuugacc

SEQ ID NO: 113403 - RNA, 20 nt, Human
ccgggcccgucauaaaacuc

SEQ ID NO: 113404 - RNA, 23 nt, Human
gaacaagaggaacacauauggag

SEQ ID NO: 113405 - RNA, 25 nt, Human
ggaaaaaaaagaucaacaaccacau

SEQ ID NO: 113406 - RNA, 19 nt, Human
gucggucacuugcacuggu

SEQ ID NO: 113407 - RNA, 19 nt, Human
guggaacagcaaaaaaaga

SEQ ID NO: 113408 - RNA, 24 nt, Human
gugucuguaaggaaaaaaaagauc

SEQ ID NO: 113409 - RNA, 20 nt, Human
uacaaucuguguuucugacc

SEQ ID NO: 113410 - RNA, 20 nt, Human
uagaacaagaggaacacaua

SEQ ID NO: 113411 - RNA, 21 nt, Human
uagaacaagaggaacacauau

SEQ ID NO: 113412 - RNA, 21 nt, Human
ucaaaguagcaccaucaaguu

SEQ ID NO: 113413 - RNA, 24 nt, Human
ucaacaaccacauacaagcuuaca

SEQ ID NO: 113414 - RNA, 20 nt, Human
ucagaaagaaagguuaucuc

SEQ ID NO: 113415 - RNA, 21 nt, Human
uccaggagauuaaucaaugaa

SEQ ID NO: 113416 - RNA, 19 nt, Human
ucugcagaugggcuaggau

SEQ ID NO: 113417 - RNA, 21 nt, Human
ucuguguuucugaccaguuga

SEQ ID NO: 113418 - RNA, 21 nt, Human
ucuucugggacucauagaaua

SEQ ID NO: 113419 - RNA, 19 nt, Human
ucuuuaaagccuucccaaa

SEQ ID NO: 113420 - RNA, 21 nt, Human
ugacaaaagcagccccauaau

SEQ ID NO: 113421 - RNA, 19 nt, Human
ugagcacagucauugcucu

SEQ ID NO: 113422 - RNA, 21 nt, Human
uggaacagcaaaaaaagagaa

SEQ ID NO: 113423 - RNA, 24 nt, Human
ugguggaacagcaaaaaaagagaa

SEQ ID NO: 113424 - RNA, 19 nt, Human
uguaaggaaaaaaaagauc

SEQ ID NO: 113425 - RNA, 26 nt, Human
uguaaggaaaaaaaagaucaacaacu

SEQ ID NO: 113426 - RNA, 21 nt, Human
uguggcuuuaaaaauauuucu

SEQ ID NO: 113427 - RNA, 25 nt, Human
uguggcuuuaaaaauauuucuuuaa

SEQ ID NO: 113428 - RNA, 19 nt, Human
uuagaacaagaggaacaca

SEQ ID NO: 113429 - RNA, 20 nt, Human
uugguggaacagcaaaaaaa

SEQ ID NO: 113430 - RNA, 21 nt, Human
uugguggaacagcaaaaaaag

SEQ ID NO: 113431 - RNA, 23 nt, Human
uuuaaaccaaucuuccaggagau

SEQ ID NO: 113432 - RNA, 26 nt, Human
uuuguugggauuucagauagaguuug

SEQ ID NO: 113433 - RNA, 18 nt, Human
uuuuaaaccaaucuucca

SEQ ID NO: 113434 - RNA, 24 nt, Human
uuuuucaucuucugggacucauag

SEQ ID NO: 113435 - RNA, 22 nt, Human
aaaagaagaagaaguagcacca

SEQ ID NO: 113436 - RNA, 22 nt, Human
aaaagcagcugcaaaguaccac

SEQ ID NO: 113437 - RNA, 24 nt, Human
aaacuaaaccuugaucugccuaau

SEQ ID NO: 113438 - RNA, 26 nt, Human
aaaugucauuucaggccuaguggucc

SEQ ID NO: 113439 - RNA, 21 nt, Human
aacuaaaccuugaucugccua

SEQ ID NO: 113440 - RNA, 21 nt, Human
aagcuuuauuuuaacagugga

SEQ ID NO: 113441 - RNA, 20 nt, Human
aauacaagaaugaaaauggg

SEQ ID NO: 113442 - RNA, 18 nt, Human
acaagaaugaaaaugggc

SEQ ID NO: 113443 - RNA, 18 nt, Human
acggcugcccggcgugcg

SEQ ID NO: 113444 - RNA, 23 nt, Human
agaaagacagaaauuuauacugg

SEQ ID NO: 113445 - RNA, 21 nt, Human
agcucucggaaggccggacuu

SEQ ID NO: 113446 - RNA, 23 nt, Human
aggccuuaguagucuuagaaaug

SEQ ID NO: 113447 - RNA, 24 nt, Human
agggaccuaaauuuugaaacagcu

SEQ ID NO: 113448 - RNA, 22 nt, Human
auccuagucuuuaaaaaccuau

SEQ ID NO: 113449 - RNA, 18 nt, Human
cacccacaccuccuagca

SEQ ID NO: 113450 - RNA, 23 nt, Human
cacccacaccuccuagcacccuu

SEQ ID NO: 113451 - RNA, 20 nt, Human
cccacaccuccuagcacccu

SEQ ID NO: 113452 - RNA, 24 nt, Human
ccuagugguccgaaucugcccucc

SEQ ID NO: 113453 - RNA, 21 nt, Human
cgcccgaggcgcgagggacgg

SEQ ID NO: 113454 - RNA, 18 nt, Human
cggaaggccggacuucca

SEQ ID NO: 113455 - RNA, 19 nt, Human
cggcgugcgggggccgcgg

SEQ ID NO: 113456 - RNA, 20 nt, Human
cuagcacccuuugguuuucu

SEQ ID NO: 113457 - RNA, 20 nt, Human
cucacuucacacaucagugc

SEQ ID NO: 113458 - RNA, 18 nt, Human
cuccuagcacccuuuggu

SEQ ID NO: 113459 - RNA, 19 nt, Human
cugcaaaagcagcugcaaa

SEQ ID NO: 113460 - RNA, 19 nt, Human
cuguuaacaaaaagaagaa

SEQ ID NO: 113461 - RNA, 19 nt, Human
gaucugccuaauugcugac

SEQ ID NO: 113462 - RNA, 24 nt, Human
gcaaacaguauggaaggcacccac

SEQ ID NO: 113463 - RNA, 18 nt, Human
gcgugcgggggccgcggc

SEQ ID NO: 113464 - RNA, 22 nt, Human
ggauugcagaaaauauugauau

SEQ ID NO: 113465 - RNA, 20 nt, Human
ggcaacacauaauuuuuggu

SEQ ID NO: 113466 - RNA, 26 nt, Human
ggccggacuuccagcgauacgcaccg

SEQ ID NO: 113467 - RNA, 25 nt, Human
ggguuggaagauauggcuacugagu

SEQ ID NO: 113468 - RNA, 18 nt, Human
gguggcgcgcccgaggcg

SEQ ID NO: 113469 - RNA, 18 nt, Human
gucaagucauucaguuug

SEQ ID NO: 113470 - RNA, 19 nt, Human
uaaaaggccuuaguagucu

SEQ ID NO: 113471 - RNA, 26 nt, Human
uacaagaaugaaaaugggcaaacagu

SEQ ID NO: 113472 - RNA, 21 nt, Human
uacagaccaagggaccuaaau

SEQ ID NO: 113473 - RNA, 18 nt, Human
uacuaauauauauauaua

SEQ ID NO: 113474 - RNA, 19 nt, Human
uacugugauucaacagagc

SEQ ID NO: 113475 - RNA, 23 nt, Human
uagcagaaagacagaaauuuaua

SEQ ID NO: 113476 - RNA, 19 nt, Human
uauaauacaagaaugaaaa

SEQ ID NO: 113477 - RNA, 18 nt, Human
uaucgcugucuuuuucuc

SEQ ID NO: 113478 - RNA, 23 nt, Human
uaucgcugucuuuuucuccuuca

SEQ ID NO: 113479 - RNA, 22 nt, Human
ucaacagagcuguuuuucaagc

SEQ ID NO: 113480 - RNA, 18 nt, Human
ucccgggugcggcggcuc

SEQ ID NO: 113481 - RNA, 21 nt, Human
ucuccuucagcaaguagaggu

SEQ ID NO: 113482 - RNA, 19 nt, Human
ugauauaaacaaacauuua

SEQ ID NO: 113483 - RNA, 18 nt, Human
ugcagaaaauauugauau

SEQ ID NO: 113484 - RNA, 20 nt, Human
uggaaggcacccacaccucc

SEQ ID NO: 113485 - RNA, 21 nt, Human
uggaaguuaaacuaaaccuug

SEQ ID NO: 113486 - RNA, 21 nt, Human
uggcaacacauaauuuuuggu

SEQ ID NO: 113487 - RNA, 25 nt, Human
ugggcaaacaguauggaaggcaccc

SEQ ID NO: 113488 - RNA, 19 nt, Human
ugggggguuggaagauaug

SEQ ID NO: 113489 - RNA, 18 nt, Human
uguuaacaaaaagaagaa

SEQ ID NO: 113490 - RNA, 24 nt, Human
uuaaaggacagcacagucuuucaa

SEQ ID NO: 113491 - RNA, 22 nt, Human
uuaacaaaaagaagaagaagua

SEQ ID NO: 113492 - RNA, 20 nt, Human
uuacuaauauauauauauau

SEQ ID NO: 113493 - RNA, 18 nt, Human
uucacacaucagugcauu

SEQ ID NO: 113494 - RNA, 23 nt, Human
uucacauucaauauccuagucuu

SEQ ID NO: 113495 - RNA, 20 nt, Human
uuugacuauuuuuggaccau

SEQ ID NO: 113496 - RNA, 22 nt, Human
aaaauaauucacaucaacggua

SEQ ID NO: 113497 - RNA, 19 nt, Human
aagaaaaaaauaaagccaa

SEQ ID NO: 113498 - RNA, 24 nt, Human
acgguauuugggagaacauggagc

SEQ ID NO: 113499 - RNA, 18 nt, Human
agaaagcagggccaggcc

SEQ ID NO: 113500 - RNA, 22 nt, Human
agccaauuuuuggguuggcacc

SEQ ID NO: 113501 - RNA, 18 nt, Human
agcuggcauaacauuggc

SEQ ID NO: 113502 - RNA, 20 nt, Human
caccaaaauggcccuuccug

SEQ ID NO: 113503 - RNA, 18 nt, Human
cacccccagcaguggagg

SEQ ID NO: 113504 - RNA, 19 nt, Human
cagggacaacguggggcag

SEQ ID NO: 113505 - RNA, 23 nt, Human
cagggccaggcccacccacgggg

SEQ ID NO: 113506 - RNA, 20 nt, Human
cauuggaaagugcagugguu

SEQ ID NO: 113507 - RNA, 20 nt, Human
ccacggggcccucguguggg

SEQ ID NO: 113508 - RNA, 21 nt, Human
ccacggggcccucgugugggg

SEQ ID NO: 113509 - RNA, 18 nt, Human
ccccugagccccucgagc

SEQ ID NO: 113510 - RNA, 20 nt, Human
ccccugagccccucgagccu

SEQ ID NO: 113511 - RNA, 23 nt, Human
ccccugagccccucgagccucug

SEQ ID NO: 113512 - RNA, 19 nt, Human
cccugagccccucgagccu

SEQ ID NO: 113513 - RNA, 20 nt, Human
cccuuccagaagcacccgcc

SEQ ID NO: 113514 - RNA, 20 nt, Human
ccggcagggcggccggccuu

SEQ ID NO: 113515 - RNA, 24 nt, Human
ccgggggcucgggcggccccuuuc

SEQ ID NO: 113516 - RNA, 24 nt, Human
ccucuggccacggcuggcugccug

SEQ ID NO: 113517 - RNA, 21 nt, Human
cgagaagggaguugaacaaug

SEQ ID NO: 113518 - RNA, 26 nt, Human
cugagguaauaaguuaagaauaagca

SEQ ID NO: 113519 - RNA, 26 nt, Human
cuuagccucgggcucggcuucagggc

SEQ ID NO: 113520 - RNA, 18 nt, Human
cuuccuggcacgcgccgg

SEQ ID NO: 113521 - RNA, 19 nt, Human
gaagaguacagcucacccc

SEQ ID NO: 113522 - RNA, 21 nt, Human
gacaacguggggcagugggga

SEQ ID NO: 113523 - RNA, 22 nt, Human
gagaacauggagcuggcauaac

SEQ ID NO: 113524 - RNA, 21 nt, Human
gcacaccggcagggcggccgg

SEQ ID NO: 113525 - RNA, 22 nt, Human
gccccugagccccucgagccuc

SEQ ID NO: 113526 - RNA, 18 nt, Human
gccugagccccugagccc

SEQ ID NO: 113527 - RNA, 23 nt, Human
gcgagggguugggacgcgggagc

SEQ ID NO: 113528 - RNA, 18 nt, Human
gcggagcccugguguccc

SEQ ID NO: 113529 - RNA, 23 nt, Human
gcggcacaccggcagggcggccg

SEQ ID NO: 113530 - RNA, 22 nt, Human
gcuuucugugggcagggcuugc

SEQ ID NO: 113531 - RNA, 21 nt, Human
ggcauuggaaagugcaguggu

SEQ ID NO: 113532 - RNA, 18 nt, Human
ggccagggcugcuccugg

SEQ ID NO: 113533 - RNA, 18 nt, Human
ggcugaugggggccaggg

SEQ ID NO: 113534 - RNA, 21 nt, Human
guuagcugugccuucaggcgg

SEQ ID NO: 113535 - RNA, 19 nt, Human
uaagaaaaaaauaaagcca

SEQ ID NO: 113536 - RNA, 25 nt, Human
uaaguuaagaauaagcaccaaaaug

SEQ ID NO: 113537 - RNA, 21 nt, Human
uagaaagcagggccaggccca

SEQ ID NO: 113538 - RNA, 24 nt, Human
ucagggacaacguggggcaguggg

SEQ ID NO: 113539 - RNA, 24 nt, Human
uccagaagcacccgccggcggcac

SEQ ID NO: 113540 - RNA, 18 nt, Human
ucucugggcgccggcccc

SEQ ID NO: 113541 - RNA, 21 nt, Human
ucugggcgccggccccggggg

SEQ ID NO: 113542 - RNA, 24 nt, Human
ugagccccugagccccucgagccu

SEQ ID NO: 113543 - RNA, 26 nt, Human
ugagguaauaaguuaagaauaagcac

SEQ ID NO: 113544 - RNA, 20 nt, Human
ugaguugucuguggcauugg

SEQ ID NO: 113545 - RNA, 21 nt, Human
ugccugaguuuugccaaaccc

SEQ ID NO: 113546 - RNA, 18 nt, Human
ugcgaagugguuagcugu

SEQ ID NO: 113547 - RNA, 19 nt, Human
uggcauuggaaagugcagu

SEQ ID NO: 113548 - RNA, 22 nt, Human
uggcguagaaagcagggccagg

SEQ ID NO: 113549 - RNA, 19 nt, Human
ugggagaacauggagcugg

SEQ ID NO: 113550 - RNA, 21 nt, Human
ugggcucucugggcgccggcc

SEQ ID NO: 113551 - RNA, 22 nt, Human
uggggacgggugccugagcccc

SEQ ID NO: 113552 - RNA, 20 nt, Human
uggggcaguggggacagcac

SEQ ID NO: 113553 - RNA, 22 nt, Human
ugggggccagggcugcuccugg

SEQ ID NO: 113554 - RNA, 18 nt, Human
ugguagacuuuuuuuuuu

SEQ ID NO: 113555 - RNA, 19 nt, Human
uggucuauagggauguggc

SEQ ID NO: 113556 - RNA, 21 nt, Human
uguggggacgggugccugagc

SEQ ID NO: 113557 - RNA, 19 nt, Human
uugguagacuuuuuuuuuu

SEQ ID NO: 113558 - RNA, 22 nt, Human
uugucuguggcauuggaaagug

SEQ ID NO: 113559 - RNA, 23 nt, Human
aaaaaccaacaaaacaaaacaaa

SEQ ID NO: 113560 - RNA, 23 nt, Human
aaaaaccaacaaaacaaaacaaa

SEQ ID NO: 113561 - RNA, 22 nt, Human
aaaaccauacaguauuuccaag

SEQ ID NO: 113562 - RNA, 23 nt, Human
aaaauccaugaaccucaguucag

SEQ ID NO: 113563 - RNA, 23 nt, Human
aaaauccaugaaccucaguucag

SEQ ID NO: 113564 - RNA, 23 nt, Human
aaaauccaugaaccucaguucag

SEQ ID NO: 113565 - RNA, 19 nt, Human
aaacagcacagauuagaga

SEQ ID NO: 113566 - RNA, 19 nt, Human
aaacagcacagauuagaga

SEQ ID NO: 113567 - RNA, 19 nt, Human
aaacagcacagauuagaga

SEQ ID NO: 113568 - RNA, 19 nt, Human
aaacaguccuggaaaaucc

SEQ ID NO: 113569 - RNA, 19 nt, Human
aaacaguccuggaaaaucc

SEQ ID NO: 113570 - RNA, 19 nt, Human
aaacaguccuggaaaaucc

SEQ ID NO: 113571 - RNA, 21 nt, Human
aaaccaacaaaacaaaacaaa

SEQ ID NO: 113572 - RNA, 21 nt, Human
aaaccaacaaaacaaaacaaa

SEQ ID NO: 113573 - RNA, 21 nt, Human
aaaccaacaaaacaaaacaaa

SEQ ID NO: 113574 - RNA, 21 nt, Human
aaagcaauugagauugaagca

SEQ ID NO: 113575 - RNA, 24 nt, Human
aaaucuuuaaaaaccaacaaaaca

SEQ ID NO: 113576 - RNA, 24 nt, Human
aaaucuuuaaaaaccaacaaaaca

SEQ ID NO: 113577 - RNA, 24 nt, Human
aacaaaaccauacaguauuuccaa

SEQ ID NO: 113578 - RNA, 24 nt, Human
aacaaaaccauacaguauuuccaa

SEQ ID NO: 113579 - RNA, 25 nt, Human
aacaaaaccauacaguauuuccaag

SEQ ID NO: 113580 - RNA, 20 nt, Human
aaccaugugagccauggcca

SEQ ID NO: 113581 - RNA, 20 nt, Human
aaccaugugagccauggcca

SEQ ID NO: 113582 - RNA, 20 nt, Human
aaccaugugagccauggcca

SEQ ID NO: 113583 - RNA, 26 nt, Human
aagaagacaaaugugggaauccagcc

SEQ ID NO: 113584 - RNA, 26 nt, Human
aagaagacaaaugugggaauccagcc

SEQ ID NO: 113585 - RNA, 26 nt, Human
aagaagacaaaugugggaauccagcc

SEQ ID NO: 113586 - RNA, 21 nt, Human
aagagaaacuagaagccugag

SEQ ID NO: 113587 - RNA, 21 nt, Human
aagagaaacuagaagccugag

SEQ ID NO: 113588 - RNA, 23 nt, Human
aaucuuuaaaaaccaacaaaaca

SEQ ID NO: 113589 - RNA, 18 nt, Human
acaaaacaaaacaaaacc

SEQ ID NO: 113590 - RNA, 18 nt, Human
acaaaacaaaacaaaacc

SEQ ID NO: 113591 - RNA, 18 nt, Human
acaaaacaaaacaaaacc

SEQ ID NO: 113592 - RNA, 22 nt, Human
accaccaacuccaccuagguag

SEQ ID NO: 113593 - RNA, 22 nt, Human
accaccaacuccaccuagguag

SEQ ID NO: 113594 - RNA, 22 nt, Human
accaccaacuccaccuagguag

SEQ ID NO: 113595 - RNA, 21 nt, Human
agaaagaagacaaauguggga

SEQ ID NO: 113596 - RNA, 21 nt, Human
agaaagaagacaaauguggga

SEQ ID NO: 113597 - RNA, 22 nt, Human
agaaagaagacaaaugugggaa

SEQ ID NO: 113598 - RNA, 22 nt, Human
agaaagaagacaaaugugggaa

SEQ ID NO: 113599 - RNA, 22 nt, Human
agaaagaagacaaaugugggaa

SEQ ID NO: 113600 - RNA, 23 nt, Human
agacagaaagaagacaaaugugg

SEQ ID NO: 113601 - RNA, 23 nt, Human
agacagaaagaagacaaaugugg

SEQ ID NO: 113602 - RNA, 20 nt, Human
agagaaacuagaagccugag

SEQ ID NO: 113603 - RNA, 19 nt, Human
agcaccaccaacuccaccu

SEQ ID NO: 113604 - RNA, 19 nt, Human
agcaccaccaacuccaccu

SEQ ID NO: 113605 - RNA, 19 nt, Human
agcaccaccaacuccaccu

SEQ ID NO: 113606 - RNA, 21 nt, Human
agccagccagaaacuguagga

SEQ ID NO: 113607 - RNA, 23 nt, Human
agccguacugguaacugccugcg

SEQ ID NO: 113608 - RNA, 23 nt, Human
agccguacugguaacugccugcg

SEQ ID NO: 113609 - RNA, 23 nt, Human
agccguacugguaacugccugcg

SEQ ID NO: 113610 - RNA, 20 nt, Human
aggaagaaaaaacuagaggg

SEQ ID NO: 113611 - RNA, 20 nt, Human
aggaagaaaaaacuagaggg

SEQ ID NO: 113612 - RNA, 19 nt, Human
aggaagcuacuguauaugu

SEQ ID NO: 113613 - RNA, 19 nt, Human
aggaagcuacuguauaugu

SEQ ID NO: 113614 - RNA, 19 nt, Human
aggaagcuacuguauaugu

SEQ ID NO: 113615 - RNA, 21 nt, Human
auaacagcagugacaaggaag

SEQ ID NO: 113616 - RNA, 21 nt, Human
auaacagcagugacaaggaag

SEQ ID NO: 113617 - RNA, 20 nt, Human
auacacaaugcuccagauac

SEQ ID NO: 113618 - RNA, 20 nt, Human
auacacaaugcuccagauac

SEQ ID NO: 113619 - RNA, 20 nt, Human
auacacaaugcuccagauac

SEQ ID NO: 113620 - RNA, 18 nt, Human
aucugugacaaguuccca

SEQ ID NO: 113621 - RNA, 18 nt, Human
aucugugacaaguuccca

SEQ ID NO: 113622 - RNA, 20 nt, Human
auggagcaauauuguuuggu

SEQ ID NO: 113623 - RNA, 20 nt, Human
auggagcaauauuguuuggu

SEQ ID NO: 113624 - RNA, 20 nt, Human
auggagcaauauuguuuggu

SEQ ID NO: 113625 - RNA, 23 nt, Human
caaaacaaaacaaaaccauacag

SEQ ID NO: 113626 - RNA, 23 nt, Human
caaaacaaaacaaaaccauacag

SEQ ID NO: 113627 - RNA, 23 nt, Human
caaaacaaaacaaaaccauacag

SEQ ID NO: 113628 - RNA, 23 nt, Human
caaaaccauacaguauuuccaag

SEQ ID NO: 113629 - RNA, 23 nt, Human
caaaaccauacaguauuuccaag

SEQ ID NO: 113630 - RNA, 21 nt, Human
caacaaaacaaaacaaaacca

SEQ ID NO: 113631 - RNA, 21 nt, Human
caacaaaacaaaacaaaacca

SEQ ID NO: 113632 - RNA, 21 nt, Human
caacaaaacaaaacaaaacca

SEQ ID NO: 113633 - RNA, 25 nt, Human
caacaaaacaaaacaaaaccauaca

SEQ ID NO: 113634 - RNA, 25 nt, Human
caacaaaacaaaacaaaaccauaca

SEQ ID NO: 113635 - RNA, 25 nt, Human
caacaaaacaaaacaaaaccauaca

SEQ ID NO: 113636 - RNA, 19 nt, Human
caacaaaugccuuaaguuc

SEQ ID NO: 113637 - RNA, 18 nt, Human
cacagauuagagacccag

SEQ ID NO: 113638 - RNA, 18 nt, Human
cacagauuagagacccag

SEQ ID NO: 113639 - RNA, 18 nt, Human
cacagauuagagacccag

SEQ ID NO: 113640 - RNA, 19 nt, Human
cacuugaaagaauugcuuu

SEQ ID NO: 113641 - RNA, 19 nt, Human
cacuugaaagaauugcuuu

SEQ ID NO: 113642 - RNA, 19 nt, Human
cacuugaaagaauugcuuu

SEQ ID NO: 113643 - RNA, 22 nt, Human
cagagaacuuugaaacagcaca

SEQ ID NO: 113644 - RNA, 22 nt, Human
cagagaacuuugaaacagcaca

SEQ ID NO: 113645 - RNA, 22 nt, Human
cagagaacuuugaaacagcaca

SEQ ID NO: 113646 - RNA, 20 nt, Human
cagagccugggcgaguccgg

SEQ ID NO: 113647 - RNA, 21 nt, Human
cagagccugggcgaguccggg

SEQ ID NO: 113648 - RNA, 24 nt, Human
caggagccaggggaggccagugcu

SEQ ID NO: 113649 - RNA, 23 nt, Human
caguucaguucuguguuccauca

SEQ ID NO: 113650 - RNA, 23 nt, Human
caguucaguucuguguuccauca

SEQ ID NO: 113651 - RNA, 23 nt, Human
caguucaguucuguguuccauca

SEQ ID NO: 113652 - RNA, 19 nt, Human
caucugugacaaguuccca

SEQ ID NO: 113653 - RNA, 23 nt, Human
ccagauaccacaugccccuucuc

SEQ ID NO: 113654 - RNA, 23 nt, Human
ccagauaccacaugccccuucuc

SEQ ID NO: 113655 - RNA, 23 nt, Human
ccagauaccacaugccccuucuc

SEQ ID NO: 113656 - RNA, 25 nt, Human
ccaucaggccuuacgguccucagca

SEQ ID NO: 113657 - RNA, 25 nt, Human
ccaucaggccuuacgguccucagca

SEQ ID NO: 113658 - RNA, 25 nt, Human
ccaucaggccuuacgguccucagca

SEQ ID NO: 113659 - RNA, 23 nt, Human
ccggggacccucaggcucucagg

SEQ ID NO: 113660 - RNA, 22 nt, Human
ccguuaguaaugggcauguuug

SEQ ID NO: 113661 - RNA, 22 nt, Human
ccguuaguaaugggcauguuug

SEQ ID NO: 113662 - RNA, 22 nt, Human
ccguuaguaaugggcauguuug

SEQ ID NO: 113663 - RNA, 24 nt, Human
ccugaauuuaaauaucagcaccac

SEQ ID NO: 113664 - RNA, 24 nt, Human
ccugaauuuaaauaucagcaccac

SEQ ID NO: 113665 - RNA, 24 nt, Human
ccugaauuuaaauaucagcaccac

SEQ ID NO: 113666 - RNA, 18 nt, Human
ccuuaaguucuuucaugg

SEQ ID NO: 113667 - RNA, 18 nt, Human
ccuuaaguucuuucaugg

SEQ ID NO: 113668 - RNA, 18 nt, Human
ccuuaaguucuuucaugg

SEQ ID NO: 113669 - RNA, 23 nt, Human
ccuuagagucaccugugaguuug

SEQ ID NO: 113670 - RNA, 23 nt, Human
ccuuagagucaccugugaguuug

SEQ ID NO: 113671 - RNA, 23 nt, Human
ccuuagagucaccugugaguuug

SEQ ID NO: 113672 - RNA, 19 nt, Human
cuccagauaccacaugccc

SEQ ID NO: 113673 - RNA, 19 nt, Human
cuccagauaccacaugccc

SEQ ID NO: 113674 - RNA, 19 nt, Human
cuccagauaccacaugccc

SEQ ID NO: 113675 - RNA, 20 nt, Human
cugaagacuucucacaaucu

SEQ ID NO: 113676 - RNA, 20 nt, Human
cugaagacuucucacaaucu

SEQ ID NO: 113677 - RNA, 20 nt, Human
cugaagacuucucacaaucu

SEQ ID NO: 113678 - RNA, 24 nt, Human
cugagucuuaaagacagaaagaag

SEQ ID NO: 113679 - RNA, 23 nt, Human
cuucagugucuuuucuucaugca

SEQ ID NO: 113680 - RNA, 23 nt, Human
cuucagugucuuuucuucaugca

SEQ ID NO: 113681 - RNA, 19 nt, Human
cuucucuucccuacccagg

SEQ ID NO: 113682 - RNA, 19 nt, Human
cuucucuucccuacccagg

SEQ ID NO: 113683 - RNA, 19 nt, Human
cuuggauugauagaacagg

SEQ ID NO: 113684 - RNA, 19 nt, Human
cuuggauugauagaacagg

SEQ ID NO: 113685 - RNA, 19 nt, Human
cuuggauugauagaacagg

SEQ ID NO: 113686 - RNA, 18 nt, Human
cuuucuggguuuaaugaa

SEQ ID NO: 113687 - RNA, 22 nt, Human
gaauaaaucuguaaaaccuaga

SEQ ID NO: 113688 - RNA, 22 nt, Human
gaauaaaucuguaaaaccuaga

SEQ ID NO: 113689 - RNA, 22 nt, Human
gaauaaaucuguaaaaccuaga

SEQ ID NO: 113690 - RNA, 20 nt, Human
gagaaacuagaagccugagu

SEQ ID NO: 113691 - RNA, 20 nt, Human
gagaaacuagaagccugagu

SEQ ID NO: 113692 - RNA, 20 nt, Human
gagaaacuagaagccugagu

SEQ ID NO: 113693 - RNA, 19 nt, Human
gagcucagagccugggcga

SEQ ID NO: 113694 - RNA, 20 nt, Human
gaguacaucagaaucaugug

SEQ ID NO: 113695 - RNA, 20 nt, Human
gaguacaucagaaucaugug

SEQ ID NO: 113696 - RNA, 20 nt, Human
gaguacaucagaaucaugug

SEQ ID NO: 113697 - RNA, 22 nt, Human
gagucuuaaagacagaaagaag

SEQ ID NO: 113698 - RNA, 23 nt, Human
gauacugcucuuccagagaccac

SEQ ID NO: 113699 - RNA, 23 nt, Human
gauacugcucuuccagagaccac

SEQ ID NO: 113700 - RNA, 23 nt, Human
gauacugcucuuccagagaccac

SEQ ID NO: 113701 - RNA, 24 nt, Human
gccugaauuuaaauaucagcacug

SEQ ID NO: 113702 - RNA, 24 nt, Human
gccugaauuuaaauaucagcacug

SEQ ID NO: 113703 - RNA, 24 nt, Human
gccugaauuuaaauaucagcacug

SEQ ID NO: 113704 - RNA, 25 nt, Human
gcucucaggccaccgcgucuccugc

SEQ ID NO: 113705 - RNA, 21 nt, Human
ggagagagcucagagccuggg

SEQ ID NO: 113706 - RNA, 21 nt, Human
gggccaaauauuucauaacgu

SEQ ID NO: 113707 - RNA, 21 nt, Human
gggccaaauauuucauaacgu

SEQ ID NO: 113708 - RNA, 21 nt, Human
gggccaaauauuucauaacgu

SEQ ID NO: 113709 - RNA, 25 nt, Human
guaaaacauagauauuucgggcccu

SEQ ID NO: 113710 - RNA, 25 nt, Human
guaaaacauagauauuucgggcccu

SEQ ID NO: 113711 - RNA, 25 nt, Human
guaaaacauagauauuucgggcccu

SEQ ID NO: 113712 - RNA, 19 nt, Human
gucaucauggagcaauauu

SEQ ID NO: 113713 - RNA, 19 nt, Human
gucaucauggagcaauauu

SEQ ID NO: 113714 - RNA, 19 nt, Human
gucaucauggagcaauauu

SEQ ID NO: 113715 - RNA, 18 nt, Human
uaacagcagugacaagga

SEQ ID NO: 113716 - RNA, 22 nt, Human
uaacagcagugacaaggaagaa

SEQ ID NO: 113717 - RNA, 22 nt, Human
uaacagcagugacaaggaagaa

SEQ ID NO: 113718 - RNA, 22 nt, Human
uaacagcagugacaaggaagaa

SEQ ID NO: 113719 - RNA, 24 nt, Human
uaacagcauguucugucauuacuu

SEQ ID NO: 113720 - RNA, 24 nt, Human
uaacagcauguucugucauuacuu

SEQ ID NO: 113721 - RNA, 24 nt, Human
uaacagcauguucugucauuacuu

SEQ ID NO: 113722 - RNA, 21 nt, Human
uaagacucaucaauaguguua

SEQ ID NO: 113723 - RNA, 21 nt, Human
uaagacucaucaauaguguua

SEQ ID NO: 113724 - RNA, 21 nt, Human
uaagacucaucaauaguguua

SEQ ID NO: 113725 - RNA, 24 nt, Human
uaagucaucauggagcaauauugu

SEQ ID NO: 113726 - RNA, 24 nt, Human
uaagucaucauggagcaauauugu

SEQ ID NO: 113727 - RNA, 24 nt, Human
uaagucaucauggagcaauauugu

SEQ ID NO: 113728 - RNA, 22 nt, Human
uaaguugaauuaaguaaccuug

SEQ ID NO: 113729 - RNA, 22 nt, Human
uaaguugaauuaaguaaccuug

SEQ ID NO: 113730 - RNA, 22 nt, Human
uaaguugaauuaaguaaccuug

SEQ ID NO: 113731 - RNA, 24 nt, Human
uacaaagcaauugagauugaagca

SEQ ID NO: 113732 - RNA, 24 nt, Human
uacaaagcaauugagauugaagca

SEQ ID NO: 113733 - RNA, 22 nt, Human
uacaaaggaagaauuagagaag

SEQ ID NO: 113734 - RNA, 22 nt, Human
uacaaaggaagaauuagagaag

SEQ ID NO: 113735 - RNA, 22 nt, Human
uacaaaggaagaauuagagaag

SEQ ID NO: 113736 - RNA, 18 nt, Human
uacagugccuggacaugc

SEQ ID NO: 113737 - RNA, 22 nt, Human
uagaagccugaguuucccuagg

SEQ ID NO: 113738 - RNA, 22 nt, Human
uagaagccugaguuucccuagg

SEQ ID NO: 113739 - RNA, 22 nt, Human
uagaagccugaguuucccuagg

SEQ ID NO: 113740 - RNA, 22 nt, Human
uagccagccguacugguaacug

SEQ ID NO: 113741 - RNA, 22 nt, Human
uagccagccguacugguaacug

SEQ ID NO: 113742 - RNA, 22 nt, Human
uagccagccguacugguaacug

SEQ ID NO: 113743 - RNA, 21 nt, Human
uaucugaaauaaugcacauga

SEQ ID NO: 113744 - RNA, 21 nt, Human
uaucugaaauaaugcacauga

SEQ ID NO: 113745 - RNA, 21 nt, Human
uaucugaaauaaugcacauga

SEQ ID NO: 113746 - RNA, 19 nt, Human
uauuagaucagaaacaagu

SEQ ID NO: 113747 - RNA, 19 nt, Human
uauuagaucagaaacaagu

SEQ ID NO: 113748 - RNA, 19 nt, Human
uauuagaucagaaacaagu

SEQ ID NO: 113749 - RNA, 18 nt, Human
uauuaugguuccaucagg

SEQ ID NO: 113750 - RNA, 18 nt, Human
uauuaugguuccaucagg

SEQ ID NO: 113751 - RNA, 18 nt, Human
uauuaugguuccaucagg

SEQ ID NO: 113752 - RNA, 21 nt, Human
uauuucauaguauguauauaa

SEQ ID NO: 113753 - RNA, 21 nt, Human
uauuucauaguauguauauaa

SEQ ID NO: 113754 - RNA, 21 nt, Human
uauuucauaguauguauauaa

SEQ ID NO: 113755 - RNA, 20 nt, Human
ucaauaguguuaucaucaag

SEQ ID NO: 113756 - RNA, 20 nt, Human
ucaauaguguuaucaucaag

SEQ ID NO: 113757 - RNA, 20 nt, Human
ucaauaguguuaucaucaag

SEQ ID NO: 113758 - RNA, 20 nt, Human
ucagcaccaccaacuccacc

SEQ ID NO: 113759 - RNA, 20 nt, Human
ucagcaccaccaacuccacc

SEQ ID NO: 113760 - RNA, 20 nt, Human
ucagcaccaccaacuccacc

SEQ ID NO: 113761 - RNA, 19 nt, Human
ucauguuuucacuuacaaa

SEQ ID NO: 113762 - RNA, 19 nt, Human
ucauguuuucacuuacaaa

SEQ ID NO: 113763 - RNA, 19 nt, Human
ucauguuuucacuuacaaa

SEQ ID NO: 113764 - RNA, 22 nt, Human
ucccccaagaguuucugauucu

SEQ ID NO: 113765 - RNA, 24 nt, Human
ucccccaagaguuucugauucugu

SEQ ID NO: 113766 - RNA, 24 nt, Human
ucccccaagaguuucugauucugu

SEQ ID NO: 113767 - RNA, 21 nt, Human
uccgagucugauaaaccaaca

SEQ ID NO: 113768 - RNA, 21 nt, Human
uccgagucugauaaaccaaca

SEQ ID NO: 113769 - RNA, 21 nt, Human
uccgagucugauaaaccaaca

SEQ ID NO: 113770 - RNA, 18 nt, Human
ucgcgcgguucgucccuc

SEQ ID NO: 113771 - RNA, 19 nt, Human
ucuauacacaaugcuccag

SEQ ID NO: 113772 - RNA, 19 nt, Human
ucuauacacaaugcuccag

SEQ ID NO: 113773 - RNA, 19 nt, Human
ucuauacacaaugcuccag

SEQ ID NO: 113774 - RNA, 26 nt, Human
ucuccugcgcagcgcgcucugggagc

SEQ ID NO: 113775 - RNA, 19 nt, Human
ucugaacauucuuucuggg

SEQ ID NO: 113776 - RNA, 20 nt, Human
ugaaacagcacagauuagag

SEQ ID NO: 113777 - RNA, 20 nt, Human
ugaaacagcacagauuagag

SEQ ID NO: 113778 - RNA, 20 nt, Human
ugaaacagcacagauuagag

SEQ ID NO: 113779 - RNA, 21 nt, Human
ugaaauaaugcacaugagcua

SEQ ID NO: 113780 - RNA, 21 nt, Human
ugaaauaaugcacaugagcua

SEQ ID NO: 113781 - RNA, 21 nt, Human
ugaaauaaugcacaugagcua

SEQ ID NO: 113782 - RNA, 22 nt, Human
ugaaaugcugcacaucuuaguu

SEQ ID NO: 113783 - RNA, 22 nt, Human
ugaaaugcugcacaucuuaguu

SEQ ID NO: 113784 - RNA, 22 nt, Human
ugaaaugcugcacaucuuaguu

SEQ ID NO: 113785 - RNA, 21 nt, Human
ugacaaggaagaaaaaacuag

SEQ ID NO: 113786 - RNA, 21 nt, Human
ugacaaggaagaaaaaacuag

SEQ ID NO: 113787 - RNA, 21 nt, Human
ugacaaggaagaaaaaacuag

SEQ ID NO: 113788 - RNA, 20 nt, Human
ugagaaaaauagauuccgag

SEQ ID NO: 113789 - RNA, 20 nt, Human
ugagaaaaauagauuccgag

SEQ ID NO: 113790 - RNA, 20 nt, Human
ugagaaaaauagauuccgag

SEQ ID NO: 113791 - RNA, 21 nt, Human
ugagaagauggaggccugagu

SEQ ID NO: 113792 - RNA, 21 nt, Human
ugagaagauggaggccugagu

SEQ ID NO: 113793 - RNA, 21 nt, Human
ugagaagauggaggccugagu

SEQ ID NO: 113794 - RNA, 25 nt, Human
ugagcuauaauuuacugcuaaguaa

SEQ ID NO: 113795 - RNA, 25 nt, Human
ugagcuauaauuuacugcuaaguaa

SEQ ID NO: 113796 - RNA, 25 nt, Human
ugagcuauaauuuacugcuaaguaa

SEQ ID NO: 113797 - RNA, 23 nt, Human
ugaguaaaaguagauaaccuuag

SEQ ID NO: 113798 - RNA, 23 nt, Human
ugaguaaaaguagauaaccuuag

SEQ ID NO: 113799 - RNA, 23 nt, Human
ugaguaaaaguagauaaccuuag

SEQ ID NO: 113800 - RNA, 22 nt, Human
ugaguggaggccagugguuuga

SEQ ID NO: 113801 - RNA, 22 nt, Human
ugaguggaggccagugguuuga

SEQ ID NO: 113802 - RNA, 22 nt, Human
ugaguggaggccagugguuuga

SEQ ID NO: 113803 - RNA, 22 nt, Human
ugcaccaacauuuauggaauga

SEQ ID NO: 113804 - RNA, 22 nt, Human
ugcaccaacauuuauggaauga

SEQ ID NO: 113805 - RNA, 22 nt, Human
ugcaccaacauuuauggaauga

SEQ ID NO: 113806 - RNA, 19 nt, Human
ugccacagagaacuuugaa

SEQ ID NO: 113807 - RNA, 19 nt, Human
ugccacagagaacuuugaa

SEQ ID NO: 113808 - RNA, 19 nt, Human
ugccacagagaacuuugaa

SEQ ID NO: 113809 - RNA, 23 nt, Human
ugccacagagaacuuugaaacag

SEQ ID NO: 113810 - RNA, 23 nt, Human
ugccacagagaacuuugaaacag

SEQ ID NO: 113811 - RNA, 23 nt, Human
ugccacagagaacuuugaaacag

SEQ ID NO: 113812 - RNA, 24 nt, Human
ugccacagagaacuuugaaacagc

SEQ ID NO: 113813 - RNA, 24 nt, Human
ugccacagagaacuuugaaacagc

SEQ ID NO: 113814 - RNA, 24 nt, Human
ugccacagagaacuuugaaacagc

SEQ ID NO: 113815 - RNA, 22 nt, Human
ugccuggacaugcuuggugcug

SEQ ID NO: 113816 - RNA, 22 nt, Human
ugccuggacaugcuuggugcug

SEQ ID NO: 113817 - RNA, 22 nt, Human
ugccuggacaugcuuggugcug

SEQ ID NO: 113818 - RNA, 22 nt, Human
ugcugauacugcucuuccagag

SEQ ID NO: 113819 - RNA, 22 nt, Human
ugcugauacugcucuuccagag

SEQ ID NO: 113820 - RNA, 22 nt, Human
ugcugauacugcucuuccagag

SEQ ID NO: 113821 - RNA, 19 nt, Human
ugcugcacaucuuaguuuc

SEQ ID NO: 113822 - RNA, 19 nt, Human
ugcugcacaucuuaguuuc

SEQ ID NO: 113823 - RNA, 19 nt, Human
ugcugcacaucuuaguuuc

SEQ ID NO: 113824 - RNA, 18 nt, Human
ugcuuggugcugaauaac

SEQ ID NO: 113825 - RNA, 18 nt, Human
ugcuuggugcugaauaac

SEQ ID NO: 113826 - RNA, 18 nt, Human
ugcuuggugcugaauaac

SEQ ID NO: 113827 - RNA, 21 nt, Human
ugcuuggugcugaauaacaug

SEQ ID NO: 113828 - RNA, 21 nt, Human
ugcuuggugcugaauaacaug

SEQ ID NO: 113829 - RNA, 21 nt, Human
ugcuuggugcugaauaacaug

SEQ ID NO: 113830 - RNA, 18 nt, Human
ugcuuugccacagagaac

SEQ ID NO: 113831 - RNA, 18 nt, Human
ugcuuugccacagagaac

SEQ ID NO: 113832 - RNA, 18 nt, Human
ugcuuugccacagagaac

SEQ ID NO: 113833 - RNA, 19 nt, Human
uggaaagcucgccucgcca

SEQ ID NO: 113834 - RNA, 20 nt, Human
uggaaagcucgccucgccac

SEQ ID NO: 113835 - RNA, 22 nt, Human
uggauugauagaacagguuuuc

SEQ ID NO: 113836 - RNA, 22 nt, Human
uggauugauagaacagguuuuc

SEQ ID NO: 113837 - RNA, 22 nt, Human
uggauugauagaacagguuuuc

SEQ ID NO: 113838 - RNA, 25 nt, Human
uuaaaaaccaacaaaacaaaacaaa

SEQ ID NO: 113839 - RNA, 19 nt, Human
uuaaaauauuaacaaucuu

SEQ ID NO: 113840 - RNA, 19 nt, Human
uuaaaauauuaacaaucuu

SEQ ID NO: 113841 - RNA, 19 nt, Human
uuaaaauauuaacaaucuu

SEQ ID NO: 113842 - RNA, 18 nt, Human
uuaaauaucagcaccacc

SEQ ID NO: 113843 - RNA, 18 nt, Human
uuaaauaucagcaccacc

SEQ ID NO: 113844 - RNA, 18 nt, Human
uuaaauaucagcaccacc

SEQ ID NO: 113845 - RNA, 23 nt, Human
uuacugcuaaguaaagucuuaga

SEQ ID NO: 113846 - RNA, 23 nt, Human
uucuguguuccaucaggccuuac

SEQ ID NO: 113847 - RNA, 23 nt, Human
uucuguguuccaucaggccuuac

SEQ ID NO: 113848 - RNA, 23 nt, Human
uucuguguuccaucaggccuuac

SEQ ID NO: 113849 - RNA, 20 nt, Human
uugcacguuccucuuccaug

SEQ ID NO: 113850 - RNA, 22 nt, Human
uugcacguuccucuuccaugac

SEQ ID NO: 113851 - RNA, 22 nt, Human
uuggauguaaguggaauagguu

SEQ ID NO: 113852 - RNA, 22 nt, Human
uuggauguaaguggaauagguu

SEQ ID NO: 113853 - RNA, 22 nt, Human
uuggauguaaguggaauagguu

SEQ ID NO: 113854 - RNA, 23 nt, Human
uuguaagacaacauauaacauaa

SEQ ID NO: 113855 - RNA, 23 nt, Human
uuguaagacaacauauaacauaa

SEQ ID NO: 113856 - RNA, 23 nt, Human
uuguaagacaacauauaacauaa

SEQ ID NO: 113857 - RNA, 21 nt, Human
uuuaaugaagccagccagaaa

SEQ ID NO: 113858 - RNA, 24 nt, Human
uuuacugcuaaguaaagucuuaga

SEQ ID NO: 113859 - RNA, 24 nt, Human
uuuacugcuaaguaaagucuuaga

SEQ ID NO: 113860 - RNA, 23 nt, Human
uuucugaacauucuuucuggguu

SEQ ID NO: 113861 - RNA, 21 nt, Human
uuuucacuuacaaagcaauug

SEQ ID NO: 113862 - RNA, 21 nt, Human
uuuucacuuacaaagcaauug

SEQ ID NO: 113863 - RNA, 21 nt, Human
uuuucacuuacaaagcaauug

SEQ ID NO: 113864 - RNA, 24 nt, Human
uuuuuuagcuucagugucuuuucu

SEQ ID NO: 113865 - RNA, 22 nt, Human
aaaaauauucaaacugccagag

SEQ ID NO: 113866 - RNA, 23 nt, Human
aaaaauauucaaacugccagagc

SEQ ID NO: 113867 - RNA, 23 nt, Human
aaaaugagcaccaugacaucucu

SEQ ID NO: 113868 - RNA, 24 nt, Human
aaacuguugccuugguacaagacu

SEQ ID NO: 113869 - RNA, 19 nt, Human
aaaggaacuguuaacgcug

SEQ ID NO: 113870 - RNA, 20 nt, Human
aaaggaacuguuaacgcugg

SEQ ID NO: 113871 - RNA, 18 nt, Human
aaauaaauugccaccugg

SEQ ID NO: 113872 - RNA, 22 nt, Human
aaauaagauugaaauuggcuua

SEQ ID NO: 113873 - RNA, 18 nt, Human
aaaucggcccuuaauuuu

SEQ ID NO: 113874 - RNA, 20 nt, Human
aaauguugaaaaucucugcu

SEQ ID NO: 113875 - RNA, 22 nt, Human
aaccacgacaaaacagaaggaa

SEQ ID NO: 113876 - RNA, 21 nt, Human
aagaaugucuuuaaaauuggc

SEQ ID NO: 113877 - RNA, 18 nt, Human
aaggaacagaggacucug

SEQ ID NO: 113878 - RNA, 18 nt, Human
aaggaacagaggacucug

SEQ ID NO: 113879 - RNA, 25 nt, Human
aauagauaaagcuuuuugggaagga

SEQ ID NO: 113880 - RNA, 25 nt, Human
aauuccuagcaaaacagaaaaaggg

SEQ ID NO: 113881 - RNA, 24 nt, Human
acaaaacagaaggaaccacugaaa

SEQ ID NO: 113882 - RNA, 25 nt, Human
acccccaaacgccccaccuccgacc

SEQ ID NO: 113883 - RNA, 18 nt, Human
accuccagccccaaucca

SEQ ID NO: 113884 - RNA, 20 nt, Human
acgcccgcagcgccaggagu

SEQ ID NO: 113885 - RNA, 24 nt, Human
agauacuguuaacccaagaaugaa

SEQ ID NO: 113886 - RNA, 18 nt, Human
agccacaaccaaaaagcc

SEQ ID NO: 113887 - RNA, 18 nt, Human
agcugugcaggcucccug

SEQ ID NO: 113888 - RNA, 22 nt, Human
aggaagucuuagcccccuagga

SEQ ID NO: 113889 - RNA, 19 nt, Human
aguuuuuuuuuuucucuuu

SEQ ID NO: 113890 - RNA, 20 nt, Human
auaaauugucuuuguuucgu

SEQ ID NO: 113891 - RNA, 22 nt, Human
auaccaacauuaaaguguuuaa

SEQ ID NO: 113892 - RNA, 20 nt, Human
auagaacaaaacucauuuga

SEQ ID NO: 113893 - RNA, 21 nt, Human
auccgcgcccaccugccccuc

SEQ ID NO: 113894 - RNA, 18 nt, Human
augaagcgcgugccugcc

SEQ ID NO: 113895 - RNA, 21 nt, Human
auugccaccugggggcagccc

SEQ ID NO: 113896 - RNA, 20 nt, Human
caaaaauauucaaacugcca

SEQ ID NO: 113897 - RNA, 20 nt, Human
caaaacagaaggaaccacug

SEQ ID NO: 113898 - RNA, 21 nt, Human
caaaacagaaggaaccacuga

SEQ ID NO: 113899 - RNA, 22 nt, Human
caaaaugagcaccaugacaucu

SEQ ID NO: 113900 - RNA, 21 nt, Human
caaagcacuaaaaugaguguc

SEQ ID NO: 113901 - RNA, 26 nt, Human
cacccgcgccccgcugccucuucgcc

SEQ ID NO: 113902 - RNA, 25 nt, Human
cacccugcgcagccaccuccccacc

SEQ ID NO: 113903 - RNA, 20 nt, Human
caccgcacacccccaaacgc

SEQ ID NO: 113904 - RNA, 23 nt, Human
caccgcacacccccaaacgcccc

SEQ ID NO: 113905 - RNA, 19 nt, Human
caccuccccaccgcacacc

SEQ ID NO: 113906 - RNA, 20 nt, Human
caccuccccaccgcgcagcc

SEQ ID NO: 113907 - RNA, 20 nt, Human
caccugccccucaggcgccc

SEQ ID NO: 113908 - RNA, 21 nt, Human
cagacgcccggcgcgccuccc

SEQ ID NO: 113909 - RNA, 20 nt, Human
caggagugccgccuugccac

SEQ ID NO: 113910 - RNA, 20 nt, Human
cagucuucucuuccagaagg

SEQ ID NO: 113911 - RNA, 26 nt, Human
cauauaagagcucauuacaaaucaag

SEQ ID NO: 113912 - RNA, 20 nt, Human
cauccucaguaaaauaagag

SEQ ID NO: 113913 - RNA, 23 nt, Human
ccacccugcgcagccaccucccc

SEQ ID NO: 113914 - RNA, 24 nt, Human
ccaccgcacacccccaaagggccc

SEQ ID NO: 113915 - RNA, 19 nt, Human
ccauuugucacccuuaccu

SEQ ID NO: 113916 - RNA, 22 nt, Human
cccaagucgauaaugauagcuc

SEQ ID NO: 113917 - RNA, 23 nt, Human
cccaccgcgcagccaccucccca

SEQ ID NO: 113918 - RNA, 20 nt, Human
cccagcccuuucucgccucc

SEQ ID NO: 113919 - RNA, 22 nt, Human
ccccaaacgccccaccuccgac

SEQ ID NO: 113920 - RNA, 23 nt, Human
ccccaccgcgcagccaccucccc

SEQ ID NO: 113921 - RNA, 21 nt, Human
ccccauguagcgucaguccca

SEQ ID NO: 113922 - RNA, 22 nt, Human
cccccaaacgccccaccuccga

SEQ ID NO: 113923 - RNA, 19 nt, Human
ccccucaggcgcccagccc

SEQ ID NO: 113924 - RNA, 20 nt, Human
cccugcgcagccaccucccc

SEQ ID NO: 113925 - RNA, 20 nt, Human
cccugcgcagccaccucccc

SEQ ID NO: 113926 - RNA, 23 nt, Human
cccuuucucgccuccugggcacg

SEQ ID NO: 113927 - RNA, 23 nt, Human
ccgcugccucuucgcggcgcucu

SEQ ID NO: 113928 - RNA, 21 nt, Human
ccgcuggccacucccuccacc

SEQ ID NO: 113929 - RNA, 20 nt, Human
ccucaguaaaauaagaguau

SEQ ID NO: 113930 - RNA, 25 nt, Human
ccuccagccccaauccacccgcgcc

SEQ ID NO: 113931 - RNA, 20 nt, Human
ccuccagccccaauccaccu

SEQ ID NO: 113932 - RNA, 18 nt, Human
ccucccgcuuaaucuggg

SEQ ID NO: 113933 - RNA, 23 nt, Human
ccucccuugaagccacaaccaaa

SEQ ID NO: 113934 - RNA, 18 nt, Human
ccuccuuaaccccuuacc

SEQ ID NO: 113935 - RNA, 26 nt, Human
ccuggauccgcgcccaccugccccuc

SEQ ID NO: 113936 - RNA, 19 nt, Human
ccugggcacgaugcccggg

SEQ ID NO: 113937 - RNA, 20 nt, Human
cgacaaaacagaaggaaccc

SEQ ID NO: 113938 - RNA, 19 nt, Human
cgcaccuccagccccaauc

SEQ ID NO: 113939 - RNA, 19 nt, Human
cgccggaccgacuggggaa

SEQ ID NO: 113940 - RNA, 19 nt, Human
cgcugccucuucgcggcgc

SEQ ID NO: 113941 - RNA, 21 nt, Human
cgcugccucuucgcggcgcuc

SEQ ID NO: 113942 - RNA, 26 nt, Human
cuccagccccaauccacccgcgcccc

SEQ ID NO: 113943 - RNA, 27 nt, Human
cuccagccccaauccacccgcgccccg

SEQ ID NO: 113944 - RNA, 19 nt, Human
cugccugguaaguugggag

SEQ ID NO: 113945 - RNA, 19 nt, Human
cugcgcagccaccucccca

SEQ ID NO: 113946 - RNA, 22 nt, Human
cuggccacucccuccacccugc

SEQ ID NO: 113947 - RNA, 21 nt, Human
gaccugagccacgucuucccu

SEQ ID NO: 113948 - RNA, 18 nt, Human
gagcaucaccuccuuaac

SEQ ID NO: 113949 - RNA, 19 nt, Human
gagcugccauuaugugugu

SEQ ID NO: 113950 - RNA, 18 nt, Human
gcaagaagcugugcaggc

SEQ ID NO: 113951 - RNA, 21 nt, Human
gccaccuccccaccgcacacc

SEQ ID NO: 113952 - RNA, 22 nt, Human
gccaccuccccaccgcacaccc

SEQ ID NO: 113953 - RNA, 25 nt, Human
gccaccuccccaccgcgcagccacc

SEQ ID NO: 113954 - RNA, 23 nt, Human
gccccauguagcgucagucccau

SEQ ID NO: 113955 - RNA, 20 nt, Human
gccgcuggccacucccucca

SEQ ID NO: 113956 - RNA, 20 nt, Human
gccuccugggcacgaugccc

SEQ ID NO: 113957 - RNA, 25 nt, Human
gccugggcccccggaccuugggagc

SEQ ID NO: 113958 - RNA, 23 nt, Human
gcgggcgcggggaacaagcgggg

SEQ ID NO: 113959 - RNA, 19 nt, Human
ggaaaagcagucugucugg

SEQ ID NO: 113960 - RNA, 18 nt, Human
ggaggggagugagaugcu

SEQ ID NO: 113961 - RNA, 21 nt, Human
gggagggaggggguaugaggg

SEQ ID NO: 113962 - RNA, 19 nt, Human
gggagucaauuuuugugaa

SEQ ID NO: 113963 - RNA, 23 nt, Human
ggggaaaagcagucugucuggaa

SEQ ID NO: 113964 - RNA, 19 nt, Human
guccaaaaugagcaccaug

SEQ ID NO: 113965 - RNA, 21 nt, Human
gugaaguuuuuuuuuuucucu

SEQ ID NO: 113966 - RNA, 18 nt, Human
gugugagcugccauuaug

SEQ ID NO: 113967 - RNA, 23 nt, Human
guuccuguggggacgcccgcagc

SEQ ID NO: 113968 - RNA, 21 nt, Human
guugugagugcaagaagcugu

SEQ ID NO: 113969 - RNA, 22 nt, Human
uaaaaaaaaaucucucuuugcg

SEQ ID NO: 113970 - RNA, 22 nt, Human
uaaaauacacauuuuucuuuuu

SEQ ID NO: 113971 - RNA, 22 nt, Human
uaaagauagagccauguccucc

SEQ ID NO: 113972 - RNA, 24 nt, Human
uaaauugccaccugggggcagccc

SEQ ID NO: 113973 - RNA, 19 nt, Human
uaacuaccuuaauauucac

SEQ ID NO: 113974 - RNA, 22 nt, Human
uaacuuaugaagauaauauucu

SEQ ID NO: 113975 - RNA, 18 nt, Human
uaaggaacagaggacucu

SEQ ID NO: 113976 - RNA, 18 nt, Human
uagaaaauacuaaugcca

SEQ ID NO: 113977 - RNA, 18 nt, Human
uagaaaauacuaaugcca

SEQ ID NO: 113978 - RNA, 21 nt, Human
uagaagggacacugccuggua

SEQ ID NO: 113979 - RNA, 21 nt, Human
uagcacgcacgcaccugugac

SEQ ID NO: 113980 - RNA, 23 nt, Human
uauucugccagucuucucuucca

SEQ ID NO: 113981 - RNA, 19 nt, Human
ucaggccaaguucaagaug

SEQ ID NO: 113982 - RNA, 20 nt, Human
uccacccgcgccccgcugcc

SEQ ID NO: 113983 - RNA, 24 nt, Human
ucccagaaaauguucucaggccaa

SEQ ID NO: 113984 - RNA, 23 nt, Human
ucccauuagcacgcacgcaccug

SEQ ID NO: 113985 - RNA, 22 nt, Human
uccccaccgcacacccccaaac

SEQ ID NO: 113986 - RNA, 22 nt, Human
uccccgccugggcccccggacc

SEQ ID NO: 113987 - RNA, 23 nt, Human
ucgcagccaagcccggcggccgc

SEQ ID NO: 113988 - RNA, 18 nt, Human
ucucugaaaaaugcagaa

SEQ ID NO: 113989 - RNA, 25 nt, Human
ugaaguuuuuuuuuuucucuuuaaa

SEQ ID NO: 113990 - RNA, 23 nt, Human
ugaauaacuaccuuaauauucac

SEQ ID NO: 113991 - RNA, 23 nt, Human
ugaugggguaacccugacuuaaa

SEQ ID NO: 113992 - RNA, 22 nt, Human
ugcaagaagcugugcaggcucc

SEQ ID NO: 113993 - RNA, 21 nt, Human
ugccugguaaguugggaggga

SEQ ID NO: 113994 - RNA, 22 nt, Human
uggggaaaagcagucugucugg

SEQ ID NO: 113995 - RNA, 22 nt, Human
ugguuuuaccauuauuuaaagu

SEQ ID NO: 113996 - RNA, 26 nt, Human
ugucuggaaguucacugcaaugggga

SEQ ID NO: 113997 - RNA, 18 nt, Human
ugugaauaacuaccuuaa

SEQ ID NO: 113998 - RNA, 20 nt, Human
ugugauguguuuaugcuaac

SEQ ID NO: 113999 - RNA, 23 nt, Human
uguuugagauacuguuaacccaa

SEQ ID NO: 114000 - RNA, 22 nt, Human
uuaaaugaaucuucuuaccuaa

SEQ ID NO: 114001 - RNA, 24 nt, Human
uuaauauucacuaauagcuuuuag

SEQ ID NO: 114002 - RNA, 21 nt, Human
uuaguacuuaaaaaauauucu

SEQ ID NO: 114003 - RNA, 21 nt, Human
uuccuguggggacgcccgcag

SEQ ID NO: 114004 - RNA, 23 nt, Human
uucugggucaaagucuguuccug

SEQ ID NO: 114005 - RNA, 22 nt, Human
uugguacaagacugauaugaaa

SEQ ID NO: 114006 - RNA, 20 nt, Human
uuuccuauaaaauccaucca

SEQ ID NO: 114007 - RNA, 23 nt, Human
uuuccuauaaaauccauccagaa

SEQ ID NO: 114008 - RNA, 20 nt, Human
uuucucuuggccacguguug

SEQ ID NO: 114009 - RNA, 23 nt, Human
uuuuccauaauugcuacuuuuca

SEQ ID NO: 114010 - RNA, 21 nt, Human
aaaaaaaaaagaagaagaaga

SEQ ID NO: 114011 - RNA, 23 nt, Human
aaaaaaaaaagaagaagaagaag

SEQ ID NO: 114012 - RNA, 19 nt, Human
aaaaaaaagaagaagaaga

SEQ ID NO: 114013 - RNA, 19 nt, Human
aaaaaaaagaagaagaaga

SEQ ID NO: 114014 - RNA, 18 nt, Human
aaaaaagaagaagaagaa

SEQ ID NO: 114015 - RNA, 19 nt, Human
aaaaacaagauguaagaaa

SEQ ID NO: 114016 - RNA, 20 nt, Human
aaaagaauaagaaacaucaa

SEQ ID NO: 114017 - RNA, 22 nt, Human
aaaagacaaauugcuccauuag

SEQ ID NO: 114018 - RNA, 18 nt, Human
aaacccgggauacagcag

SEQ ID NO: 114019 - RNA, 21 nt, Human
aagaaaaaaaaaagaagaaga

SEQ ID NO: 114020 - RNA, 22 nt, Human
aagaaaaaaaaaagaagaagaa

SEQ ID NO: 114021 - RNA, 21 nt, Human
aagagaaagaagcuuuuuaaa

SEQ ID NO: 114022 - RNA, 26 nt, Human
aauuuucaucuuauaauucuuggaga

SEQ ID NO: 114023 - RNA, 24 nt, Human
accaaguguuguuucccaguucug

SEQ ID NO: 114024 - RNA, 21 nt, Human
agaaaaaaaaaagaagaagaa

SEQ ID NO: 114025 - RNA, 19 nt, Human
agaacuuacgggauaaaac

SEQ ID NO: 114026 - RNA, 18 nt, Human
agagggacagugaggcuu

SEQ ID NO: 114027 - RNA, 20 nt, Human
agaguggaagaaaaaaaaaa

SEQ ID NO: 114028 - RNA, 22 nt, Human
agccggagagggacagugaggc

SEQ ID NO: 114029 - RNA, 18 nt, Human
aggccacaggaggauucu

SEQ ID NO: 114030 - RNA, 18 nt, Human
auauauauauauaucaca

SEQ ID NO: 114031 - RNA, 18 nt, Human
augaauauaaaauauugc

SEQ ID NO: 114032 - RNA, 23 nt, Human
auuguuuggaagaacuuugucca

SEQ ID NO: 114033 - RNA, 19 nt, Human
auuuuauauauauauauau

SEQ ID NO: 114034 - RNA, 25 nt, Human
auuuucaucuuauaauucuuggaga

SEQ ID NO: 114035 - RNA, 18 nt, Human
caaaagacaaauugcucc

SEQ ID NO: 114036 - RNA, 23 nt, Human
caaaagacaaauugcuccauuag

SEQ ID NO: 114037 - RNA, 18 nt, Human
caagcagaggccacagga

SEQ ID NO: 114038 - RNA, 24 nt, Human
caccuuuauauuaaaaacccggga

SEQ ID NO: 114039 - RNA, 20 nt, Human
cagaacuuacgggauaaaac

SEQ ID NO: 114040 - RNA, 23 nt, Human
cgggauacagcaggauuaguagc

SEQ ID NO: 114041 - RNA, 23 nt, Human
cucccgcagcuccuucagcaccc

SEQ ID NO: 114042 - RNA, 18 nt, Human
cuucccacaaacugcagu

SEQ ID NO: 114043 - RNA, 23 nt, Human
gaaaaaaaaaagaagaagaagaa

SEQ ID NO: 114044 - RNA, 22 nt, Human
gaacuuuguccagucagaaaug

SEQ ID NO: 114045 - RNA, 18 nt, Human
gaagaaaaaaaaaagaag

SEQ ID NO: 114046 - RNA, 22 nt, Human
gaagagaaagaagcuuuuuaag

SEQ ID NO: 114047 - RNA, 19 nt, Human
gaggccacaggaggauucu

SEQ ID NO: 114048 - RNA, 20 nt, Human
gcaaaagacaaauugcucca

SEQ ID NO: 114049 - RNA, 23 nt, Human
ggagagggacagugaggcuuggg

SEQ ID NO: 114050 - RNA, 19 nt, Human
ggguuuauauggagagagc

SEQ ID NO: 114051 - RNA, 22 nt, Human
gguacaucugaaucuucauggu

SEQ ID NO: 114052 - RNA, 21 nt, Human
gguauguaacaugaacauuua

SEQ ID NO: 114053 - RNA, 20 nt, Human
gucagaaaugaguaaaaaca

SEQ ID NO: 114054 - RNA, 24 nt, Human
gugaagagaaagaagcuuuuuaag

SEQ ID NO: 114055 - RNA, 18 nt, Human
guuguuucccaguucugu

SEQ ID NO: 114056 - RNA, 24 nt, Human
guuuggaagaacuuuguccaguca

SEQ ID NO: 114057 - RNA, 22 nt, Human
uaaaaagaauaagaaacaucaa

SEQ ID NO: 114058 - RNA, 19 nt, Human
uaaaagagacuaaccaagu

SEQ ID NO: 114059 - RNA, 20 nt, Human
uaaaagagacuaaccaagug

SEQ ID NO: 114060 - RNA, 22 nt, Human
uaaaaggcuguucacaauauac

SEQ ID NO: 114061 - RNA, 20 nt, Human
uaacuuaaaagagacuaacc

SEQ ID NO: 114062 - RNA, 22 nt, Human
uaagaaacaucaauuggcuuuu

SEQ ID NO: 114063 - RNA, 24 nt, Human
uaagaaacauuaaaacagggggca

SEQ ID NO: 114064 - RNA, 21 nt, Human
uaauagagacuuugcucuggc

SEQ ID NO: 114065 - RNA, 18 nt, Human
uacaaagcaaaauaagcu

SEQ ID NO: 114066 - RNA, 21 nt, Human
uacaaagcaaaauaagcuuaa

SEQ ID NO: 114067 - RNA, 21 nt, Human
uacuagucagcauguuaucuu

SEQ ID NO: 114068 - RNA, 18 nt, Human
uauagcaaaagacaaauu

SEQ ID NO: 114069 - RNA, 24 nt, Human
ucagcacccgcacgaaauucccgg

SEQ ID NO: 114070 - RNA, 22 nt, Human
ucccgcagcuccuucagcaccc

SEQ ID NO: 114071 - RNA, 23 nt, Human
ucccgcagcuccuucagcacccg

SEQ ID NO: 114072 - RNA, 18 nt, Human
ugaucauauauaguagca

SEQ ID NO: 114073 - RNA, 23 nt, Human
ugcugucuguauucuaggguuuc

SEQ ID NO: 114074 - RNA, 22 nt, Human
uggagagagcuagagccggaga

SEQ ID NO: 114075 - RNA, 19 nt, Human
ugggugaagagaaagaagc

SEQ ID NO: 114076 - RNA, 25 nt, Human
ugggugaagagaaagaagcuuuuua

SEQ ID NO: 114077 - RNA, 22 nt, Human
ugugaguauuuauaacaaaaua

SEQ ID NO: 114078 - RNA, 18 nt, Human
uguguguuuuuguuucuc

SEQ ID NO: 114079 - RNA, 19 nt, Human
uguuguuucccaguucugu

SEQ ID NO: 114080 - RNA, 20 nt, Human
uuacaaagcaaaauaagcuu

SEQ ID NO: 114081 - RNA, 20 nt, Human
uuauauauauauauaucaca

SEQ ID NO: 114082 - RNA, 18 nt, Human
uucaugcuaugucauaug

SEQ ID NO: 114083 - RNA, 23 nt, Human
uugacauaaucuugaggguuuau

SEQ ID NO: 114084 - RNA, 21 nt, Human
uuuauauauauauauaucaca

SEQ ID NO: 114085 - RNA, 24 nt, Human
uuuauuuuacucaaugugacucuu

SEQ ID NO: 114086 - RNA, 20 nt, Human
aaaacugguaauuaaagaaa

SEQ ID NO: 114087 - RNA, 26 nt, Human
aaacaggacagcagaucucagcaggg

SEQ ID NO: 114088 - RNA, 21 nt, Human
aaagaagaccagcagcccagg

SEQ ID NO: 114089 - RNA, 22 nt, Human
aaauucccccaaacagaauacc

SEQ ID NO: 114090 - RNA, 22 nt, Human
aaauucccccaaacagaauacc

SEQ ID NO: 114091 - RNA, 21 nt, Human
aacaaauucccccaaacagaa

SEQ ID NO: 114092 - RNA, 21 nt, Human
aagcaaaacucacacauccua

SEQ ID NO: 114093 - RNA, 21 nt, Human
aagcaaaacucacacauccuu

SEQ ID NO: 114094 - RNA, 21 nt, Human
aagcggcuccgcggcccgugc

SEQ ID NO: 114095 - RNA, 20 nt, Human
aaggggcucaggccuuccuu

SEQ ID NO: 114096 - RNA, 18 nt, Human
aaucauccaaaucaaaca

SEQ ID NO: 114097 - RNA, 21 nt, Human
aaucauccaaaucaaacagua

SEQ ID NO: 114098 - RNA, 20 nt, Human
acaaauucccccaaacagaa

SEQ ID NO: 114099 - RNA, 20 nt, Human
accaccacccccaacccagc

SEQ ID NO: 114100 - RNA, 20 nt, Human
accaccacccccaacccagc

SEQ ID NO: 114101 - RNA, 24 nt, Human
accaccacccccaacccagcugcu

SEQ ID NO: 114102 - RNA, 24 nt, Human
accaccacccccaacccagcugcu

SEQ ID NO: 114103 - RNA, 22 nt, Human
acccgagggcuggggugacgag

SEQ ID NO: 114104 - RNA, 23 nt, Human
acucugggcuacuggguggcacc

SEQ ID NO: 114105 - RNA, 23 nt, Human
acuggguucugguuuaaaccaaa

SEQ ID NO: 114106 - RNA, 19 nt, Human
agauaagaagugcuccaaa

SEQ ID NO: 114107 - RNA, 24 nt, Human
agccaaauaaugugugcugaccuc

SEQ ID NO: 114108 - RNA, 21 nt, Human
agccaauucaggcuugcuuua

SEQ ID NO: 114109 - RNA, 21 nt, Human
agccaauucaggcuugcuuua

SEQ ID NO: 114110 - RNA, 21 nt, Human
aggggagggcaaggggcagag

SEQ ID NO: 114111 - RNA, 20 nt, Human
auacaauguacugcauagcc

SEQ ID NO: 114112 - RNA, 20 nt, Human
auacaauguacugcauagcc

SEQ ID NO: 114113 - RNA, 24 nt, Human
caaaagcaaaacucacacauccua

SEQ ID NO: 114114 - RNA, 20 nt, Human
caagacgguaaggagaaagc

SEQ ID NO: 114115 - RNA, 20 nt, Human
cacacaaucauccaaaucaa

SEQ ID NO: 114116 - RNA, 21 nt, Human
cacacauccuacgcacccacc

SEQ ID NO: 114117 - RNA, 24 nt, Human
caccagcuugacagaaacaggaca

SEQ ID NO: 114118 - RNA, 23 nt, Human
cacccaccccucuacuucuggcc

SEQ ID NO: 114119 - RNA, 24 nt, Human
cacccaccccucuacuucuggccc

SEQ ID NO: 114120 - RNA, 24 nt, Human
cacccccaacccagcugcuggccu

SEQ ID NO: 114121 - RNA, 24 nt, Human
cacccccaacccagcugcuggccu

SEQ ID NO: 114122 - RNA, 22 nt, Human
cacccccucuacuucuggccca

SEQ ID NO: 114123 - RNA, 20 nt, Human
caccccucuacuucuggcca

SEQ ID NO: 114124 - RNA, 21 nt, Human
caccccucuacuucuggccca

SEQ ID NO: 114125 - RNA, 24 nt, Human
cacuggguucugguuuaagccaaa

SEQ ID NO: 114126 - RNA, 18 nt, Human
cagaacagaguaggugga

SEQ ID NO: 114127 - RNA, 23 nt, Human
cagaccauucagguuugugagga

SEQ ID NO: 114128 - RNA, 19 nt, Human
cagaguagguggacgaagu

SEQ ID NO: 114129 - RNA, 22 nt, Human
cagcagggugggcucaucucua

SEQ ID NO: 114130 - RNA, 18 nt, Human
cagcccagggagcaccga

SEQ ID NO: 114131 - RNA, 21 nt, Human
caggggagggcaaggggcaga

SEQ ID NO: 114132 - RNA, 23 nt, Human
cauccucugucucuggcuggagg

SEQ ID NO: 114133 - RNA, 18 nt, Human
caugcuuauuacucagga

SEQ ID NO: 114134 - RNA, 18 nt, Human
caugcuuauuacucagga

SEQ ID NO: 114135 - RNA, 22 nt, Human
cauguggggcccagucuugcuc

SEQ ID NO: 114136 - RNA, 22 nt, Human
cauguggggcccagucuugcuc

SEQ ID NO: 114137 - RNA, 23 nt, Human
cauuaaugaccaccacccccaac

SEQ ID NO: 114138 - RNA, 23 nt, Human
cauuaaugaccaccacccccaac

SEQ ID NO: 114139 - RNA, 26 nt, Human
ccaaacagaauacaauguacugcaua

SEQ ID NO: 114140 - RNA, 26 nt, Human
ccaaacagaauacaauguacugcaua

SEQ ID NO: 114141 - RNA, 18 nt, Human
ccacauugcacacaucug

SEQ ID NO: 114142 - RNA, 18 nt, Human
ccacauugcacacaucug

SEQ ID NO: 114143 - RNA, 20 nt, Human
ccacauugcacacaucugau

SEQ ID NO: 114144 - RNA, 21 nt, Human
ccaccacccccaacccagcug

SEQ ID NO: 114145 - RNA, 21 nt, Human
ccaccacccccaacccagcug

SEQ ID NO: 114146 - RNA, 18 nt, Human
ccaggaaaaaaggcuguc

SEQ ID NO: 114147 - RNA, 18 nt, Human
ccaggaaaaaaggcuguc

SEQ ID NO: 114148 - RNA, 19 nt, Human
ccaggccacauccucuguc

SEQ ID NO: 114149 - RNA, 20 nt, Human
ccaggccacauccucugucu

SEQ ID NO: 114150 - RNA, 21 nt, Human
cccaaacagaauacaauguac

SEQ ID NO: 114151 - RNA, 21 nt, Human
cccaaacagaauacaauguac

SEQ ID NO: 114152 - RNA, 22 nt, Human
ccucagaauacaaggaaaccaa

SEQ ID NO: 114153 - RNA, 18 nt, Human
ccuccuugaagagugagg

SEQ ID NO: 114154 - RNA, 20 nt, Human
ccucugucucuggcuggagg

SEQ ID NO: 114155 - RNA, 19 nt, Human
ccuuacgcacccaccccuc

SEQ ID NO: 114156 - RNA, 24 nt, Human
ccuuuuuguuccuggagucaaaag

SEQ ID NO: 114157 - RNA, 24 nt, Human
ccuuuuuguuccuggagucaaaag

SEQ ID NO: 114158 - RNA, 21 nt, Human
cgugcucaucugggcucugcu

SEQ ID NO: 114159 - RNA, 19 nt, Human
cuaaagcucacucugggcu

SEQ ID NO: 114160 - RNA, 19 nt, Human
cuaaagcucacucugggcu

SEQ ID NO: 114161 - RNA, 18 nt, Human
cuagagagagcuaaagcu

SEQ ID NO: 114162 - RNA, 19 nt, Human
cuauggacccgagggcugg

SEQ ID NO: 114163 - RNA, 21 nt, Human
cucacacauccuacgcaccca

SEQ ID NO: 114164 - RNA, 25 nt, Human
cucacacauccuacgcacccacccc

SEQ ID NO: 114165 - RNA, 26 nt, Human
cucacacauccuuacgcacccacccc

SEQ ID NO: 114166 - RNA, 22 nt, Human
cucagaauacaaggaaaccaac

SEQ ID NO: 114167 - RNA, 22 nt, Human
cucagaauacaaggaaaccaac

SEQ ID NO: 114168 - RNA, 20 nt, Human
cucaggccuuccuucuucag

SEQ ID NO: 114169 - RNA, 21 nt, Human
cucuauggacccgagggcugg

SEQ ID NO: 114170 - RNA, 26 nt, Human
cucucuguucugugagcagcuggaag

SEQ ID NO: 114171 - RNA, 21 nt, Human
cuggaagguaaagaagaccag

SEQ ID NO: 114172 - RNA, 18 nt, Human
cuggccuucaagccucuc

SEQ ID NO: 114173 - RNA, 18 nt, Human
cuggccuucaagccucuc

SEQ ID NO: 114174 - RNA, 20 nt, Human
cuggccuucaagccucucua

SEQ ID NO: 114175 - RNA, 20 nt, Human
cuggccuucaagccucucua

SEQ ID NO: 114176 - RNA, 22 nt, Human
cuuugaaccaggccacauccuc

SEQ ID NO: 114177 - RNA, 22 nt, Human
cuuugaaccaggccacauccuc

SEQ ID NO: 114178 - RNA, 19 nt, Human
gaaacugggaugugggauu

SEQ ID NO: 114179 - RNA, 19 nt, Human
gaaacugggaugugggauu

SEQ ID NO: 114180 - RNA, 22 nt, Human
gcaaaacucacacauccuacgc

SEQ ID NO: 114181 - RNA, 23 nt, Human
gcaaaacucacacauccuuacgc

SEQ ID NO: 114182 - RNA, 22 nt, Human
gcuccuccggagcugggucccg

SEQ ID NO: 114183 - RNA, 21 nt, Human
ggagccggcaaggaggagaug

SEQ ID NO: 114184 - RNA, 21 nt, Human
ggagccggcaaggaggagaug

SEQ ID NO: 114185 - RNA, 21 nt, Human
ggagggcaaggggcagagugg

SEQ ID NO: 114186 - RNA, 20 nt, Human
ggcaggggagggcaaggggc

SEQ ID NO: 114187 - RNA, 23 nt, Human
gggcucaggccuuccuucuucag

SEQ ID NO: 114188 - RNA, 22 nt, Human
ggggcaggggagggcaaggggc

SEQ ID NO: 114189 - RNA, 20 nt, Human
uaaaacaaauucccccaaac

SEQ ID NO: 114190 - RNA, 20 nt, Human
uaaaacaaauucccccaaac

SEQ ID NO: 114191 - RNA, 20 nt, Human
uaaggaaacagaaucaccug

SEQ ID NO: 114192 - RNA, 20 nt, Human
uaaggaaacagaaucaccug

SEQ ID NO: 114193 - RNA, 21 nt, Human
uacugcauagccaauucaggc

SEQ ID NO: 114194 - RNA, 21 nt, Human
uacugcauagccaauucaggc

SEQ ID NO: 114195 - RNA, 22 nt, Human
uacuucuggcccaggaaaaaag

SEQ ID NO: 114196 - RNA, 22 nt, Human
uacuucuggcccaggaaaaaag

SEQ ID NO: 114197 - RNA, 19 nt, Human
uagcccaaaugagacucca

SEQ ID NO: 114198 - RNA, 19 nt, Human
uauuuuauuugcuauguac

SEQ ID NO: 114199 - RNA, 19 nt, Human
uauuuuauuugcuauguac

SEQ ID NO: 114200 - RNA, 18 nt, Human
ucagaccauucagguuug

SEQ ID NO: 114201 - RNA, 18 nt, Human
ucauucuagagcuaaagc

SEQ ID NO: 114202 - RNA, 23 nt, Human
uccucagaauacaaggaaaccaa

SEQ ID NO: 114203 - RNA, 21 nt, Human
uccucugucucuggcuggagg

SEQ ID NO: 114204 - RNA, 21 nt, Human
uccucugucucuggcuggagg

SEQ ID NO: 114205 - RNA, 18 nt, Human
ucuaagacaguuguggcc

SEQ ID NO: 114206 - RNA, 26 nt, Human
ucucuaagccauguggggcccagucu

SEQ ID NO: 114207 - RNA, 26 nt, Human
ucucuaagccauguggggcccagucu

SEQ ID NO: 114208 - RNA, 18 nt, Human
ucucuauggacccgaggg

SEQ ID NO: 114209 - RNA, 24 nt, Human
ucuggcccaggaaaaaaggcuguc

SEQ ID NO: 114210 - RNA, 24 nt, Human
ucuggcccaggaaaaaaggcuguc

SEQ ID NO: 114211 - RNA, 19 nt, Human
ucugugagcagcuggaagg

SEQ ID NO: 114212 - RNA, 18 nt, Human
ucuucugcuuguauguag

SEQ ID NO: 114213 - RNA, 23 nt, Human
ucuuuaacauccucagaauacaa

SEQ ID NO: 114214 - RNA, 23 nt, Human
ucuuuaacauccucagaauacaa

SEQ ID NO: 114215 - RNA, 20 nt, Human
ugaaagagcaauuggauaac

SEQ ID NO: 114216 - RNA, 20 nt, Human
ugaaagagcaauuggauaac

SEQ ID NO: 114217 - RNA, 22 nt, Human
ugaauagucacacaaucaucca

SEQ ID NO: 114218 - RNA, 19 nt, Human
ugacagaaacaggacagca

SEQ ID NO: 114219 - RNA, 21 nt, Human
ugacagaaacaggacagcaga

SEQ ID NO: 114220 - RNA, 19 nt, Human
ugaccaccacccccaaccc

SEQ ID NO: 114221 - RNA, 19 nt, Human
ugaccaccacccccaaccc

SEQ ID NO: 114222 - RNA, 18 nt, Human
ugagaaacugggaugugg

SEQ ID NO: 114223 - RNA, 18 nt, Human
ugagaaacugggaugugg

SEQ ID NO: 114224 - RNA, 19 nt, Human
ugaggugacuguugugagg

SEQ ID NO: 114225 - RNA, 18 nt, Human
ugccacauugcacacauc

SEQ ID NO: 114226 - RNA, 18 nt, Human
ugccacauugcacacauc

SEQ ID NO: 114227 - RNA, 21 nt, Human
ugccauuaaugaccaccaccc

SEQ ID NO: 114228 - RNA, 21 nt, Human
ugccauuaaugaccaccaccc

SEQ ID NO: 114229 - RNA, 18 nt, Human
ugccuagacacagugggc

SEQ ID NO: 114230 - RNA, 18 nt, Human
ugcucauucuagagagag

SEQ ID NO: 114231 - RNA, 23 nt, Human
uggaaaacugguaauuaaagaaa

SEQ ID NO: 114232 - RNA, 20 nt, Human
uggaagaaacuaaacacugc

SEQ ID NO: 114233 - RNA, 23 nt, Human
uggaagaaacuaaacacugcuuc

SEQ ID NO: 114234 - RNA, 19 nt, Human
uggaaggaacugccucaug

SEQ ID NO: 114235 - RNA, 19 nt, Human
uggaaggaacugccucaug

SEQ ID NO: 114236 - RNA, 22 nt, Human
uggagucaaaagcaaaacucac

SEQ ID NO: 114237 - RNA, 22 nt, Human
uggagucaaaagcaaaacucac

SEQ ID NO: 114238 - RNA, 19 nt, Human
uggcaauuggaauaaacag

SEQ ID NO: 114239 - RNA, 21 nt, Human
uggcauuuggaauaaacaggg

SEQ ID NO: 114240 - RNA, 21 nt, Human
uggcuaaaacaaauuccccca

SEQ ID NO: 114241 - RNA, 21 nt, Human
uggcuaaaacaaauuccccca

SEQ ID NO: 114242 - RNA, 22 nt, Human
uggcuaaaacaaauucccccaa

SEQ ID NO: 114243 - RNA, 22 nt, Human
uggcuaaaacaaauucccccaa

SEQ ID NO: 114244 - RNA, 23 nt, Human
uggcuaaaacaaauucccccaaa

SEQ ID NO: 114245 - RNA, 23 nt, Human
uggcuaaaacaaauucccccaaa

SEQ ID NO: 114246 - RNA, 18 nt, Human
ugggaugugggauuuacc

SEQ ID NO: 114247 - RNA, 18 nt, Human
ugggaugugggauuuacc

SEQ ID NO: 114248 - RNA, 18 nt, Human
uguacaaaacugacacca

SEQ ID NO: 114249 - RNA, 18 nt, Human
uguacaaaacugacacca

SEQ ID NO: 114250 - RNA, 22 nt, Human
uguugugaggggcaggggaggg

SEQ ID NO: 114251 - RNA, 27 nt, Human
uuaaaccaaauaaugugugcugaccuc

SEQ ID NO: 114252 - RNA, 19 nt, Human
uuaaggaaacagaaucacc

SEQ ID NO: 114253 - RNA, 19 nt, Human
uuaaggaaacagaaucacc

SEQ ID NO: 114254 - RNA, 22 nt, Human
uucuucagaccauucagguuug

SEQ ID NO: 114255 - RNA, 26 nt, Human
uuguugcauccucugcuuugggcccu

SEQ ID NO: 114256 - RNA, 26 nt, Human
uuguugcauccucugcuuugggcccu

SEQ ID NO: 114257 - RNA, 26 nt, Human
aacuccuucucgccuccuccucgccg

SEQ ID NO: 114258 - RNA, 22 nt, Human
accccugagaccuauucacgaa

SEQ ID NO: 114259 - RNA, 24 nt, Human
aggggagggagaagccuucacugu

SEQ ID NO: 114260 - RNA, 18 nt, Human
aggggcggcuggcgcgcu

SEQ ID NO: 114261 - RNA, 25 nt, Human
aggugggggcgcggcuccucgcgcg

SEQ ID NO: 114262 - RNA, 18 nt, Human
cagccgcggggacggaga

SEQ ID NO: 114263 - RNA, 20 nt, Human
cauggccccgcucccggggc

SEQ ID NO: 114264 - RNA, 20 nt, Human
ccacaccccguggugccgag

SEQ ID NO: 114265 - RNA, 24 nt, Human
ccaggugggggcgcggcuccuucc

SEQ ID NO: 114266 - RNA, 24 nt, Human
cccacgggcgggagggcucgacuu

SEQ ID NO: 114267 - RNA, 21 nt, Human
cccccaaccccugagaccuau

SEQ ID NO: 114268 - RNA, 19 nt, Human
ccccgcgacccgcuccccg

SEQ ID NO: 114269 - RNA, 25 nt, Human
ccccugagaccuauucacgaacagg

SEQ ID NO: 114270 - RNA, 20 nt, Human
ccgccccgcgacccgcuccc

SEQ ID NO: 114271 - RNA, 21 nt, Human
ccgccccgcgacccgcucccc

SEQ ID NO: 114272 - RNA, 22 nt, Human
ccgccgccccgcgacccgcucc

SEQ ID NO: 114273 - RNA, 22 nt, Human
ccgccgccgccccgcgacccgc

SEQ ID NO: 114274 - RNA, 24 nt, Human
ccgccgccgccccgcgacccgcuc

SEQ ID NO: 114275 - RNA, 20 nt, Human
ccuccuccuccuccaacucc

SEQ ID NO: 114276 - RNA, 21 nt, Human
ccuccuccuccuccuccucca

SEQ ID NO: 114277 - RNA, 20 nt, Human
ccuccucgccgccgccgccc

SEQ ID NO: 114278 - RNA, 20 nt, Human
ccucgccgccgccgccccgc

SEQ ID NO: 114279 - RNA, 22 nt, Human
ccucgccgccgccgccccgcga

SEQ ID NO: 114280 - RNA, 18 nt, Human
ccucgccuccuccuccuc

SEQ ID NO: 114281 - RNA, 20 nt, Human
ccucgccuccuccuccuccu

SEQ ID NO: 114282 - RNA, 18 nt, Human
cgcggggacgcacagggg

SEQ ID NO: 114283 - RNA, 22 nt, Human
cggccgggaccccgcugggcuc

SEQ ID NO: 114284 - RNA, 21 nt, Human
cucccccaaccccugagaccu

SEQ ID NO: 114285 - RNA, 23 nt, Human
cuccuccuccuccuccaacuccu

SEQ ID NO: 114286 - RNA, 23 nt, Human
cuccuccuccuccuccuccaacu

SEQ ID NO: 114287 - RNA, 25 nt, Human
cuccucgccgccgccgccccgcgac

SEQ ID NO: 114288 - RNA, 24 nt, Human
cucgcucgcccucgccuccuccuc

SEQ ID NO: 114289 - RNA, 23 nt, Human
cuggcagucccucccccaacccc

SEQ ID NO: 114290 - RNA, 22 nt, Human
gagggagaagccuucacugucc

SEQ ID NO: 114291 - RNA, 19 nt, Human
gcagcuaggucaugugauu

SEQ ID NO: 114292 - RNA, 21 nt, Human
gcgcuccgcucgagugagguc

SEQ ID NO: 114293 - RNA, 21 nt, Human
gcgggcccaggcgcuggggug

SEQ ID NO: 114294 - RNA, 18 nt, Human
gcggggcgcgggccgggg

SEQ ID NO: 114295 - RNA, 18 nt, Human
gcucggaggcgcgcgggg

SEQ ID NO: 114296 - RNA, 20 nt, Human
ggaugggucgggcgagcugg

SEQ ID NO: 114297 - RNA, 21 nt, Human
ggcagucccucccccaacccc

SEQ ID NO: 114298 - RNA, 20 nt, Human
ggggggcuggaggcauggcc

SEQ ID NO: 114299 - RNA, 21 nt, Human
gggucgggcgagcuggggggc

SEQ ID NO: 114300 - RNA, 19 nt, Human
gucgggcgagcuggggggc

SEQ ID NO: 114301 - RNA, 22 nt, Human
gugggaggggagggagaagccu

SEQ ID NO: 114302 - RNA, 23 nt, Human
uagaaaaaaauauaguguccaaa

SEQ ID NO: 114303 - RNA, 24 nt, Human
ucagcuccaggugggggcgcggcu

SEQ ID NO: 114304 - RNA, 18 nt, Human
uccaggaucaggacgugc

SEQ ID NO: 114305 - RNA, 25 nt, Human
uccaggaucaggacgugcacgggac

SEQ ID NO: 114306 - RNA, 21 nt, Human
ucccacaccccguggugccga

SEQ ID NO: 114307 - RNA, 18 nt, Human
uccccgugggcgcuccgc

SEQ ID NO: 114308 - RNA, 20 nt, Human
uccccgugggcgcuccgcuc

SEQ ID NO: 114309 - RNA, 21 nt, Human
ucccucuguucucuccgggcu

SEQ ID NO: 114310 - RNA, 18 nt, Human
uccuucucgccuccuccu

SEQ ID NO: 114311 - RNA, 20 nt, Human
ucgcccacgggcgggagggc

SEQ ID NO: 114312 - RNA, 22 nt, Human
ucgccgccgccgccccgcgacc

SEQ ID NO: 114313 - RNA, 27 nt, Human
ucgccuccuccuccuccuccuccaacu

SEQ ID NO: 114314 - RNA, 23 nt, Human
ucgccuccuccucgccgccgccg

SEQ ID NO: 114315 - RNA, 21 nt, Human
ugaagucaggugggaggggag

SEQ ID NO: 114316 - RNA, 20 nt, Human
ugagguacgagguugcugaa

SEQ ID NO: 114317 - RNA, 19 nt, Human
ugauucagcuccagguggg

SEQ ID NO: 114318 - RNA, 24 nt, Human
ugcagaaugacauuuggccucuaa

SEQ ID NO: 114319 - RNA, 18 nt, Human
uggaaggggcggcuggcg

SEQ ID NO: 114320 - RNA, 20 nt, Human
ugggaggggagggagaagcc

SEQ ID NO: 114321 - RNA, 19 nt, Human
uggggcgggcccaggcgcu

SEQ ID NO: 114322 - RNA, 20 nt, Human
uguggacagagcguggggcg

SEQ ID NO: 114323 - RNA, 20 nt, Human
uguggcggcggcuguucugg

SEQ ID NO: 114324 - RNA, 25 nt, Human
uuacgaggcuuaccuuggaacauuu

SEQ ID NO: 114325 - RNA, 19 nt, Human
uucaaguugaauuuagaaa

SEQ ID NO: 114326 - RNA, 20 nt, Human
uucggcucgggagcccgggc

SEQ ID NO: 114327 - RNA, 23 nt, Human
uuggugauggugggaugaccuuu

SEQ ID NO: 114328 - RNA, 20 nt, Human
uuuguggcggcggcuguucu

SEQ ID NO: 114329 - RNA, 20 nt, Human
aaggaucaaagggggugggg

SEQ ID NO: 114330 - RNA, 26 nt, Human
aaguagaaaggaucaaaggggguggg

SEQ ID NO: 114331 - RNA, 25 nt, Human
acacaacccagucaaggggggaacc

SEQ ID NO: 114332 - RNA, 18 nt, Human
acccuggaaaggagaagg

SEQ ID NO: 114333 - RNA, 24 nt, Human
acccuugggccagggaaccccagc

SEQ ID NO: 114334 - RNA, 20 nt, Human
agaaacacaacccagucaag

SEQ ID NO: 114335 - RNA, 21 nt, Human
agaaagagccagacugcagua

SEQ ID NO: 114336 - RNA, 18 nt, Human
agccagacugcaguaugc

SEQ ID NO: 114337 - RNA, 19 nt, Human
agcgacggaggagugagga

SEQ ID NO: 114338 - RNA, 21 nt, Human
agcucugaguuagaagcucau

SEQ ID NO: 114339 - RNA, 25 nt, Human
aggcaggaaaagaaacacaacccag

SEQ ID NO: 114340 - RNA, 25 nt, Human
aggcaggaaaagaaacacaagggac

SEQ ID NO: 114341 - RNA, 23 nt, Human
aggggguggggguagggguccca

SEQ ID NO: 114342 - RNA, 21 nt, Human
agggguggggaggugaggcuu

SEQ ID NO: 114343 - RNA, 18 nt, Human
agucggggcggcugcggg

SEQ ID NO: 114344 - RNA, 18 nt, Human
auacgguggcuucaaagc

SEQ ID NO: 114345 - RNA, 24 nt, Human
auggggguucaagggguggggagg

SEQ ID NO: 114346 - RNA, 22 nt, Human
caaaggggguggggguaggggu

SEQ ID NO: 114347 - RNA, 18 nt, Human
caagggaagucccucuuc

SEQ ID NO: 114348 - RNA, 21 nt, Human
cacccuggaaaggagaaggaa

SEQ ID NO: 114349 - RNA, 18 nt, Human
caccuggcauggcaaggu

SEQ ID NO: 114350 - RNA, 21 nt, Human
cagcaccauuaggauccugau

SEQ ID NO: 114351 - RNA, 21 nt, Human
cagcacccuggaaaggagaag

SEQ ID NO: 114352 - RNA, 28 nt, Human
cagcacccuggaaaggagaaggaaugac

SEQ ID NO: 114353 - RNA, 19 nt, Human
caguccuuucaccguggaa

SEQ ID NO: 114354 - RNA, 18 nt, Human
cagucggggcggcugcgg

SEQ ID NO: 114355 - RNA, 23 nt, Human
cauggcaaggugagccuggggag

SEQ ID NO: 114356 - RNA, 24 nt, Human
cauggcaaggugagccuggggagg

SEQ ID NO: 114357 - RNA, 20 nt, Human
ccagccuucccuaaggagga

SEQ ID NO: 114358 - RNA, 18 nt, Human
ccccagcccccagcaccc

SEQ ID NO: 114359 - RNA, 18 nt, Human
ccccauucuggggcuccc

SEQ ID NO: 114360 - RNA, 18 nt, Human
cccccagcacccuggaaa

SEQ ID NO: 114361 - RNA, 22 nt, Human
ccccccaacaucuuggucccca

SEQ ID NO: 114362 - RNA, 20 nt, Human
cccucuucccucuguagucc

SEQ ID NO: 114363 - RNA, 24 nt, Human
cccuugggccagggaaccccagcc

SEQ ID NO: 114364 - RNA, 21 nt, Human
ccuggggaggugaggggcagg

SEQ ID NO: 114365 - RNA, 19 nt, Human
cuggggcucccucacgguc

SEQ ID NO: 114366 - RNA, 18 nt, Human
cuuaacucuggggagggg

SEQ ID NO: 114367 - RNA, 21 nt, Human
cuucucgggcucggugcaguc

SEQ ID NO: 114368 - RNA, 18 nt, Human
gagccuggggaggugagg

SEQ ID NO: 114369 - RNA, 21 nt, Human
gaggaggcuggacccuugggc

SEQ ID NO: 114370 - RNA, 26 nt, Human
gagugaggaggcaggcauugggggug

SEQ ID NO: 114371 - RNA, 22 nt, Human
gaucaaaggggguggggguagg

SEQ ID NO: 114372 - RNA, 21 nt, Human
gcaggcauugggggugggggg

SEQ ID NO: 114373 - RNA, 20 nt, Human
gcggggaaccagucggggcg

SEQ ID NO: 114374 - RNA, 26 nt, Human
ggaggcaggcauuggggguggggggg

SEQ ID NO: 114375 - RNA, 24 nt, Human
ggaucaaaggggguggggguaggg

SEQ ID NO: 114376 - RNA, 19 nt, Human
ggccgggcuugggcuggaa

SEQ ID NO: 114377 - RNA, 24 nt, Human
ggcuuggguggggagggaggggag

SEQ ID NO: 114378 - RNA, 19 nt, Human
gggcagggggaggggauuu

SEQ ID NO: 114379 - RNA, 21 nt, Human
gggcagggggaggggauuugc

SEQ ID NO: 114380 - RNA, 26 nt, Human
gggcucccucacggucccucccaccc

SEQ ID NO: 114381 - RNA, 22 nt, Human
ggggagggaggggagaaagagc

SEQ ID NO: 114382 - RNA, 20 nt, Human
gggguggggguagggguccc

SEQ ID NO: 114383 - RNA, 20 nt, Human
ggugaggggcagggggaggg

SEQ ID NO: 114384 - RNA, 23 nt, Human
gguggggguaggggucccagccu

SEQ ID NO: 114385 - RNA, 21 nt, Human
uagaaaggaucaaagggggug

SEQ ID NO: 114386 - RNA, 19 nt, Human
uaggauccugauucacccc

SEQ ID NO: 114387 - RNA, 21 nt, Human
uaggauccugauucacccccc

SEQ ID NO: 114388 - RNA, 19 nt, Human
uaugcccuauggccuggcg

SEQ ID NO: 114389 - RNA, 23 nt, Human
ucaagggaagucccucuucccuc

SEQ ID NO: 114390 - RNA, 20 nt, Human
ucacccccccaacaucuugg

SEQ ID NO: 114391 - RNA, 21 nt, Human
ucccuaaggaggaagcagaug

SEQ ID NO: 114392 - RNA, 18 nt, Human
ucccucccaccccggaca

SEQ ID NO: 114393 - RNA, 21 nt, Human
ucccucuucccucuguagucc

SEQ ID NO: 114394 - RNA, 19 nt, Human
ugaagggcagcgacggagg

SEQ ID NO: 114395 - RNA, 20 nt, Human
ugagaggaggcuggacccuu

SEQ ID NO: 114396 - RNA, 22 nt, Human
ugagaggaggcuggacccuugg

SEQ ID NO: 114397 - RNA, 22 nt, Human
ugagccuggggaggugaggggc

SEQ ID NO: 114398 - RNA, 23 nt, Human
ugagccuggggaggugaggggca

SEQ ID NO: 114399 - RNA, 28 nt, Human
ugagccuggggaggugaggggcaggggg

SEQ ID NO: 114400 - RNA, 20 nt, Human
ugaggaggcaggcauugggg

SEQ ID NO: 114401 - RNA, 22 nt, Human
ugaggcaggaaaagaaacacaa

SEQ ID NO: 114402 - RNA, 24 nt, Human
ugcaaauuaugcccuauggccugg

SEQ ID NO: 114403 - RNA, 21 nt, Human
ugcagagcugggcugaggcag

SEQ ID NO: 114404 - RNA, 22 nt, Human
ugcagagcugggcugaggcagg

SEQ ID NO: 114405 - RNA, 19 nt, Human
uggaauggggugagaggag

SEQ ID NO: 114406 - RNA, 18 nt, Human
uggcaaggugagccuggg

SEQ ID NO: 114407 - RNA, 22 nt, Human
uggcaaggugagccuggggagg

SEQ ID NO: 114408 - RNA, 18 nt, Human
uggccuggcggugggggg

SEQ ID NO: 114409 - RNA, 19 nt, Human
uggcgguggggggccgggc

SEQ ID NO: 114410 - RNA, 19 nt, Human
uggcgguggggggccgggc

SEQ ID NO: 114411 - RNA, 23 nt, Human
ugggccagggaaccccagccccc

SEQ ID NO: 114412 - RNA, 18 nt, Human
uggggagggaggggagaa

SEQ ID NO: 114413 - RNA, 19 nt, Human
uggggagggaggggagaaa

SEQ ID NO: 114414 - RNA, 24 nt, Human
uggggagggaggggagaaagagcc

SEQ ID NO: 114415 - RNA, 25 nt, Human
uggggaggugaggggcagggggagg

SEQ ID NO: 114416 - RNA, 26 nt, Human
uggggaggugaggggcagggggaggg

SEQ ID NO: 114417 - RNA, 20 nt, Human
uggggggccgggcuugggcu

SEQ ID NO: 114418 - RNA, 18 nt, Human
uggggguucaaggggugg

SEQ ID NO: 114419 - RNA, 19 nt, Human
uucucagauuugagaugca

SEQ ID NO: 114420 - RNA, 22 nt, Human
uucuggggcucccucacggucc

SEQ ID NO: 114421 - RNA, 21 nt, Human
uuggguggggagggaggggag

SEQ ID NO: 114422 - RNA, 18 nt, Human
uuuuaauacagacccagg

SEQ ID NO: 114423 - RNA, 24 nt, Human
uuuuuuuuuuuuuuuuucacaguu

SEQ ID NO: 114424 - RNA, 24 nt, Human
uuuuuuuuuuuuuuuuuuucacag

SEQ ID NO: 114425 - RNA, 20 nt, Human
aaaaaaacacagaaggagca

SEQ ID NO: 114426 - RNA, 22 nt, Human
aaaaacacagaaggagcaaaac

SEQ ID NO: 114427 - RNA, 25 nt, Human
aaacacagaaggagcaaaacuaaca

SEQ ID NO: 114428 - RNA, 18 nt, Human
aacucagggcugagcccc

SEQ ID NO: 114429 - RNA, 20 nt, Human
acaggguuuggugccggcgu

SEQ ID NO: 114430 - RNA, 21 nt, Human
agaaaaaaacacagaaggagc

SEQ ID NO: 114431 - RNA, 24 nt, Human
agcacagaggugccuagggaagga

SEQ ID NO: 114432 - RNA, 24 nt, Human
agcuauggggacagaggagaggga

SEQ ID NO: 114433 - RNA, 21 nt, Human
aggacccugcacaaagcaggc

SEQ ID NO: 114434 - RNA, 22 nt, Human
aggagcugcgcaggcaggaggg

SEQ ID NO: 114435 - RNA, 18 nt, Human
aggagggagggcgggcag

SEQ ID NO: 114436 - RNA, 18 nt, Human
aggagggagggcgggcag

SEQ ID NO: 114437 - RNA, 24 nt, Human
aggagggagggcgggcaggagggc

SEQ ID NO: 114438 - RNA, 21 nt, Human
aggagggcagggcaggagagc

SEQ ID NO: 114439 - RNA, 19 nt, Human
aggcagcagcguugugucc

SEQ ID NO: 114440 - RNA, 24 nt, Human
aggcaggagggagggcgggcagga

SEQ ID NO: 114441 - RNA, 24 nt, Human
agggagggcgggcaggagggcagg

SEQ ID NO: 114442 - RNA, 19 nt, Human
agggcaggagagcccgggg

SEQ ID NO: 114443 - RNA, 19 nt, Human
aguggggaggggugggagg

SEQ ID NO: 114444 - RNA, 18 nt, Human
caaagcaggcagcagcgu

SEQ ID NO: 114445 - RNA, 25 nt, Human
caaagcaggcagcagcguugugucc

SEQ ID NO: 114446 - RNA, 21 nt, Human
caacucagggcugagccccgg

SEQ ID NO: 114447 - RNA, 21 nt, Human
cacacagcgcggccagggcag

SEQ ID NO: 114448 - RNA, 22 nt, Human
caccacacagcgcggccagggc

SEQ ID NO: 114449 - RNA, 23 nt, Human
cagagggcccugcgcaggugaug

SEQ ID NO: 114450 - RNA, 19 nt, Human
cagcacagaggugccuagg

SEQ ID NO: 114451 - RNA, 22 nt, Human
cagcacagaggugccuagggaa

SEQ ID NO: 114452 - RNA, 20 nt, Human
cagcagcguuguguccuggc

SEQ ID NO: 114453 - RNA, 21 nt, Human
cagcucagggcugagccccag

SEQ ID NO: 114454 - RNA, 21 nt, Human
cagcucagggcugagccucag

SEQ ID NO: 114455 - RNA, 23 nt, Human
caggcaggagggagggcgggcag

SEQ ID NO: 114456 - RNA, 19 nt, Human
cauagaaagggggccuuug

SEQ ID NO: 114457 - RNA, 23 nt, Human
caugaacauagaaagggggccuu

SEQ ID NO: 114458 - RNA, 21 nt, Human
ccacacagcgcggccagggca

SEQ ID NO: 114459 - RNA, 19 nt, Human
cccaagcugaggagaagag

SEQ ID NO: 114460 - RNA, 18 nt, Human
cccgagaggcgucuugcu

SEQ ID NO: 114461 - RNA, 21 nt, Human
ccgcccagagaccgaggcugc

SEQ ID NO: 114462 - RNA, 22 nt, Human
ccucuguggcaccaaggggcuc

SEQ ID NO: 114463 - RNA, 23 nt, Human
cgagacagaggccaauggcugcc

SEQ ID NO: 114464 - RNA, 20 nt, Human
cgcggccagggcagagaggg

SEQ ID NO: 114465 - RNA, 23 nt, Human
cuugagugcagccagcgccccug

SEQ ID NO: 114466 - RNA, 23 nt, Human
cuuuccaagcuugggcucuguuu

SEQ ID NO: 114467 - RNA, 24 nt, Human
gaaaaaaacacagaaggagcaaaa

SEQ ID NO: 114468 - RNA, 23 nt, Human
gagacggggccgagucgccgaga

SEQ ID NO: 114469 - RNA, 23 nt, Human
gagcugcgcaggcaggagggagg

SEQ ID NO: 114470 - RNA, 18 nt, Human
gagugaaaaccuuuauuu

SEQ ID NO: 114471 - RNA, 23 nt, Human
gaugaguggggaggggugggagg

SEQ ID NO: 114472 - RNA, 20 nt, Human
gccgcccagagaccgaggcu

SEQ ID NO: 114473 - RNA, 20 nt, Human
gccuccugaccuugguuucc

SEQ ID NO: 114474 - RNA, 22 nt, Human
gcugagccccggaggacccugc

SEQ ID NO: 114475 - RNA, 20 nt, Human
gcuguagggccaagguccag

SEQ ID NO: 114476 - RNA, 18 nt, Human
ggaaaaaccagcuauggg

SEQ ID NO: 114477 - RNA, 22 nt, Human
ggagagggaggcuagugcggca

SEQ ID NO: 114478 - RNA, 20 nt, Human
ggaggacaggguuuggugcc

SEQ ID NO: 114479 - RNA, 19 nt, Human
ggaggacccugcacaaagc

SEQ ID NO: 114480 - RNA, 18 nt, Human
ggaggggugggaggacag

SEQ ID NO: 114481 - RNA, 22 nt, Human
ggcagggcaggagagcccgggg

SEQ ID NO: 114482 - RNA, 20 nt, Human
ggcgggcaggagggcagggc

SEQ ID NO: 114483 - RNA, 24 nt, Human
ggcucuguuuagugaugagugggg

SEQ ID NO: 114484 - RNA, 20 nt, Human
gggaaggagcugcgcaggca

SEQ ID NO: 114485 - RNA, 18 nt, Human
gggcaggagagcccgggg

SEQ ID NO: 114486 - RNA, 21 nt, Human
gggucuugagugcagccagcg

SEQ ID NO: 114487 - RNA, 18 nt, Human
gugggaugcagcacagag

SEQ ID NO: 114488 - RNA, 25 nt, Human
uaacaugaacauagaaagggggccu

SEQ ID NO: 114489 - RNA, 20 nt, Human
uaagacacagcccucugugg

SEQ ID NO: 114490 - RNA, 21 nt, Human
uagcucagagcugagccccag

SEQ ID NO: 114491 - RNA, 24 nt, Human
ucagaaaaaaacacagaaggagca

SEQ ID NO: 114492 - RNA, 19 nt, Human
ucagagcugagccccagag

SEQ ID NO: 114493 - RNA, 22 nt, Human
ucugaggaaggagagguuugcg

SEQ ID NO: 114494 - RNA, 19 nt, Human
ugcacaaagcaggcagcag

SEQ ID NO: 114495 - RNA, 24 nt, Human
ugcagccagcgccccugcgaguac

SEQ ID NO: 114496 - RNA, 23 nt, Human
ugccccaagcugaggagaagagc

SEQ ID NO: 114497 - RNA, 18 nt, Human
ugggaaaaaccagcuaug

SEQ ID NO: 114498 - RNA, 18 nt, Human
ugggaggacaggguuugg

SEQ ID NO: 114499 - RNA, 23 nt, Human
uggggaggggugggaggacaggg

SEQ ID NO: 114500 - RNA, 20 nt, Human
uguggcaccaaggggcucuc

SEQ ID NO: 114501 - RNA, 21 nt, Human
aagccuuuauugggucagggc

SEQ ID NO: 114502 - RNA, 21 nt, Human
aagggacacgguggccaccag

SEQ ID NO: 114503 - RNA, 25 nt, Human
accuguggcccugaaguccuggucc

SEQ ID NO: 114504 - RNA, 21 nt, Human
acuguagccccgcugaccccg

SEQ ID NO: 114505 - RNA, 25 nt, Human
agagcuccuccucgggcagccgcuc

SEQ ID NO: 114506 - RNA, 22 nt, Human
agaggcugggagcugccccaga

SEQ ID NO: 114507 - RNA, 18 nt, Human
agccugucgggggcagcc

SEQ ID NO: 114508 - RNA, 24 nt, Human
agccuuuauugggucagggcuugc

SEQ ID NO: 114509 - RNA, 19 nt, Human
agcuccuccucgggcagcc

SEQ ID NO: 114510 - RNA, 18 nt, Human
aggaagcuggcagggagc

SEQ ID NO: 114511 - RNA, 20 nt, Human
aggcccagggcgucguccga

SEQ ID NO: 114512 - RNA, 21 nt, Human
aggccgggcagccugcggagg

SEQ ID NO: 114513 - RNA, 18 nt, Human
agggacacgguggccacc

SEQ ID NO: 114514 - RNA, 22 nt, Human
agguggagcggguguguggcuc

SEQ ID NO: 114515 - RNA, 20 nt, Human
augucccugugcaccagcuu

SEQ ID NO: 114516 - RNA, 18 nt, Human
caaugaacagcuccaucc

SEQ ID NO: 114517 - RNA, 20 nt, Human
caccuguggcccugaagucc

SEQ ID NO: 114518 - RNA, 26 nt, Human
caccuguggcccugaaguccuggucc

SEQ ID NO: 114519 - RNA, 18 nt, Human
cacgguggcaccuuuggg

SEQ ID NO: 114520 - RNA, 23 nt, Human
cagcacggccaccagcugggagu

SEQ ID NO: 114521 - RNA, 23 nt, Human
cagccugucgggggcagcccugg

SEQ ID NO: 114522 - RNA, 22 nt, Human
cagcgcggucucgggguccccc

SEQ ID NO: 114523 - RNA, 23 nt, Human
cagcgcggucucgggguccccca

SEQ ID NO: 114524 - RNA, 23 nt, Human
cagcggugcuggccgugugggac

SEQ ID NO: 114525 - RNA, 22 nt, Human
caggagccuugggauggcugca

SEQ ID NO: 114526 - RNA, 20 nt, Human
caggaggcgugggggcagug

SEQ ID NO: 114527 - RNA, 19 nt, Human
cagggagggcccagcccgg

SEQ ID NO: 114528 - RNA, 20 nt, Human
ccacggaccccgagaaaacc

SEQ ID NO: 114529 - RNA, 23 nt, Human
ccacggugcaucugcaagggagc

SEQ ID NO: 114530 - RNA, 19 nt, Human
ccagcaugggaagaggcug

SEQ ID NO: 114531 - RNA, 19 nt, Human
ccagcugggaguaggcggc

SEQ ID NO: 114532 - RNA, 22 nt, Human
ccccuggaaggacuguagcccc

SEQ ID NO: 114533 - RNA, 26 nt, Human
cccugaaguccuggucccgaggaggc

SEQ ID NO: 114534 - RNA, 20 nt, Human
cccugggaagcuaguguggc

SEQ ID NO: 114535 - RNA, 22 nt, Human
ccgcucccgacggcccgaggcg

SEQ ID NO: 114536 - RNA, 18 nt, Human
ccugcggagggccugggg

SEQ ID NO: 114537 - RNA, 25 nt, Human
ccugcggugggcgucggccuagagc

SEQ ID NO: 114538 - RNA, 22 nt, Human
cgcucccgacggcccgaggcgc

SEQ ID NO: 114539 - RNA, 19 nt, Human
cugcagggggagggaggcc

SEQ ID NO: 114540 - RNA, 24 nt, Human
cuggccgugugggacccgggcccg

SEQ ID NO: 114541 - RNA, 21 nt, Human
cuuggcagcaccuguggcccu

SEQ ID NO: 114542 - RNA, 20 nt, Human
gaagacggaggagagacugg

SEQ ID NO: 114543 - RNA, 23 nt, Human
gagagccagccugucgggggcag

SEQ ID NO: 114544 - RNA, 20 nt, Human
gagcagcggugcuggccgug

SEQ ID NO: 114545 - RNA, 19 nt, Human
gaggagagacuggaagaug

SEQ ID NO: 114546 - RNA, 19 nt, Human
gaggucauucuggacuugg

SEQ ID NO: 114547 - RNA, 20 nt, Human
gcacggccaccagcugggag

SEQ ID NO: 114548 - RNA, 19 nt, Human
gcccugaaguccugguccc

SEQ ID NO: 114549 - RNA, 20 nt, Human
gcccugaaguccuggucccu

SEQ ID NO: 114550 - RNA, 19 nt, Human
gcccugggaagcuagugug

SEQ ID NO: 114551 - RNA, 18 nt, Human
gccgugugggacccgggc

SEQ ID NO: 114552 - RNA, 22 nt, Human
gccuggggagaccuggggcugg

SEQ ID NO: 114553 - RNA, 20 nt, Human
gcggagggccuggggagacc

SEQ ID NO: 114554 - RNA, 21 nt, Human
gcucccgacggcccgaggcgc

SEQ ID NO: 114555 - RNA, 19 nt, Human
gcugggcgggugcccgggc

SEQ ID NO: 114556 - RNA, 23 nt, Human
gcuuagcaccauggacggggugg

SEQ ID NO: 114557 - RNA, 20 nt, Human
ggaagguggcguccggcccc

SEQ ID NO: 114558 - RNA, 23 nt, Human
ggagaccuggggcugggcggggg

SEQ ID NO: 114559 - RNA, 20 nt, Human
ggagaggugcaggcccaggg

SEQ ID NO: 114560 - RNA, 18 nt, Human
ggagcggguguguggcuc

SEQ ID NO: 114561 - RNA, 21 nt, Human
ggccagguaggucaggagccu

SEQ ID NO: 114562 - RNA, 22 nt, Human
ggcgucguccgagugagcagcg

SEQ ID NO: 114563 - RNA, 20 nt, Human
ggcugggcgggugcccgggc

SEQ ID NO: 114564 - RNA, 21 nt, Human
gggaagguggcguccggcccc

SEQ ID NO: 114565 - RNA, 18 nt, Human
gggaaugguccuggggaa

SEQ ID NO: 114566 - RNA, 22 nt, Human
gggcccagcccggcugggcggg

SEQ ID NO: 114567 - RNA, 24 nt, Human
gggcgggggccggggcuacgggga

SEQ ID NO: 114568 - RNA, 20 nt, Human
gggcgucggccuagagcucc

SEQ ID NO: 114569 - RNA, 20 nt, Human
gggcgucggccuagagcucc

SEQ ID NO: 114570 - RNA, 21 nt, Human
gggcgucggccuagagcuccu

SEQ ID NO: 114571 - RNA, 21 nt, Human
ggggcugggcgggggccgggg

SEQ ID NO: 114572 - RNA, 20 nt, Human
gggggagggaggccgggcag

SEQ ID NO: 114573 - RNA, 22 nt, Human
ggucaggagccuugggauggcu

SEQ ID NO: 114574 - RNA, 21 nt, Human
ggugggccuuaaauucaauga

SEQ ID NO: 114575 - RNA, 20 nt, Human
guccagagacgacuguaagg

SEQ ID NO: 114576 - RNA, 19 nt, Human
gucccgaggaggcuccgcu

SEQ ID NO: 114577 - RNA, 18 nt, Human
guccgagugagcagcggu

SEQ ID NO: 114578 - RNA, 21 nt, Human
gugggggcagugagcacaggg

SEQ ID NO: 114579 - RNA, 22 nt, Human
uaaagagagcggccacuggaag

SEQ ID NO: 114580 - RNA, 18 nt, Human
uagcaccauggacggggu

SEQ ID NO: 114581 - RNA, 22 nt, Human
uaggagacccgcacgguggcac

SEQ ID NO: 114582 - RNA, 24 nt, Human
uaggucaggagccuugggauggcu

SEQ ID NO: 114583 - RNA, 20 nt, Human
ucagcgaggccagagugaag

SEQ ID NO: 114584 - RNA, 21 nt, Human
uccagagcucaggggccaggu

SEQ ID NO: 114585 - RNA, 23 nt, Human
uccgcucccgacggcccgaggcg

SEQ ID NO: 114586 - RNA, 20 nt, Human
uccuggucccgaggaggcuc

SEQ ID NO: 114587 - RNA, 20 nt, Human
ugaacagcuccauccagucc

SEQ ID NO: 114588 - RNA, 21 nt, Human
ugaagagcggcauuugggcug

SEQ ID NO: 114589 - RNA, 21 nt, Human
ugcagggggagggaggccggg

SEQ ID NO: 114590 - RNA, 19 nt, Human
ugcggaggaaggugaccgg

SEQ ID NO: 114591 - RNA, 18 nt, Human
uggcugcagggggaggga

SEQ ID NO: 114592 - RNA, 22 nt, Human
uggcugcagggggagggaggcc

SEQ ID NO: 114593 - RNA, 23 nt, Human
ugggaagaggcugggagcugccc

SEQ ID NO: 114594 - RNA, 19 nt, Human
ugggaagcuaguguggcag

SEQ ID NO: 114595 - RNA, 20 nt, Human
ugggaggagcuggagaggug

SEQ ID NO: 114596 - RNA, 27 nt, Human
ugggaggagcuggagaggugcaggccc

SEQ ID NO: 114597 - RNA, 21 nt, Human
uggggcugggcgggggccggg

SEQ ID NO: 114598 - RNA, 19 nt, Human
uguggcagggagggcccag

SEQ ID NO: 114599 - RNA, 28 nt, Human
aaaaaaaaaaaacacacaacauugagag

SEQ ID NO: 114600 - RNA, 30 nt, Human
aaaaaaaaaaacacacaacauugagaggag

SEQ ID NO: 114601 - RNA, 28 nt, Human
aaaaaaaaaacacacaacauugagagga

SEQ ID NO: 114602 - RNA, 21 nt, Human
aaaaaugaaccaagcaaaagu

SEQ ID NO: 114603 - RNA, 18 nt, Human
aaagggaaaaaaaaugaa

SEQ ID NO: 114604 - RNA, 18 nt, Human
aagaaaauuagcuugaaa

SEQ ID NO: 114605 - RNA, 21 nt, Human
acacaaaaaaaaaaaacacac

SEQ ID NO: 114606 - RNA, 20 nt, Human
acagagagcgaggguccaca

SEQ ID NO: 114607 - RNA, 18 nt, Human
agcacacaaaaaaaaaaa

SEQ ID NO: 114608 - RNA, 24 nt, Human
aggagaacugaacggccuuuggug

SEQ ID NO: 114609 - RNA, 19 nt, Human
aggaugcauacuuuuccca

SEQ ID NO: 114610 - RNA, 18 nt, Human
aggcgugugucccugggc

SEQ ID NO: 114611 - RNA, 22 nt, Human
aguucgaguguaaaucaaagca

SEQ ID NO: 114612 - RNA, 19 nt, Human
auaaacaccagcaguggcu

SEQ ID NO: 114613 - RNA, 21 nt, Human
auaacaugaaacuccagaggg

SEQ ID NO: 114614 - RNA, 21 nt, Human
auaggaugcauacuuuuccca

SEQ ID NO: 114615 - RNA, 21 nt, Human
caaaaaaaaaaaacacacaac

SEQ ID NO: 114616 - RNA, 24 nt, Human
caaauaugaaccccugagcaaacc

SEQ ID NO: 114617 - RNA, 27 nt, Human
caacauugagaggaaugccaaaaauau

SEQ ID NO: 114618 - RNA, 22 nt, Human
caagggaaucuacacccggagc

SEQ ID NO: 114619 - RNA, 23 nt, Human
caccagcaguggcuaacuguuac

SEQ ID NO: 114620 - RNA, 20 nt, Human
cacccggagcuucuacagag

SEQ ID NO: 114621 - RNA, 25 nt, Human
caggagaacugaacggccuuuggug

SEQ ID NO: 114622 - RNA, 24 nt, Human
ccaccaaaaaaguggagacucaga

SEQ ID NO: 114623 - RNA, 21 nt, Human
ccagcacacaaaaaaaaaaaa

SEQ ID NO: 114624 - RNA, 23 nt, Human
cccacucacugcgucucuuuuuc

SEQ ID NO: 114625 - RNA, 19 nt, Human
ccccucccuccagcacaca

SEQ ID NO: 114626 - RNA, 19 nt, Human
cuggagcccaggagaacug

SEQ ID NO: 114627 - RNA, 18 nt, Human
cugggaaauugggggcag

SEQ ID NO: 114628 - RNA, 23 nt, Human
cuucccaucuaaagucaugcuua

SEQ ID NO: 114629 - RNA, 26 nt, Human
cuuuucccacucacugcgucucuuuu

SEQ ID NO: 114630 - RNA, 22 nt, Human
cuuuuugcagccuuucuccacc

SEQ ID NO: 114631 - RNA, 22 nt, Human
gagacagagagcgaggguccac

SEQ ID NO: 114632 - RNA, 21 nt, Human
gcaagggaaucuacacccgga

SEQ ID NO: 114633 - RNA, 23 nt, Human
gcaguggcuaacuguuacacaac

SEQ ID NO: 114634 - RNA, 18 nt, Human
gcggaggaaaacucuugc

SEQ ID NO: 114635 - RNA, 19 nt, Human
gcuggagcccaggagaacu

SEQ ID NO: 114636 - RNA, 20 nt, Human
ggaauguucacauaaacacc

SEQ ID NO: 114637 - RNA, 22 nt, Human
ucaagagguauaugauguuggc

SEQ ID NO: 114638 - RNA, 22 nt, Human
uccacagacacauuagcaccau

SEQ ID NO: 114639 - RNA, 19 nt, Human
ucugggaaauugggggcag

SEQ ID NO: 114640 - RNA, 20 nt, Human
ugagaggaaugccaaaaaua

SEQ ID NO: 114641 - RNA, 24 nt, Human
ugauacagugcaagggaaucuaca

SEQ ID NO: 114642 - RNA, 19 nt, Human
ugcuggagacagagagcga

SEQ ID NO: 114643 - RNA, 18 nt, Human
ugggggcagggaaugaaa

SEQ ID NO: 114644 - RNA, 25 nt, Human
ugggggcagggaaugaaaaaguugg

SEQ ID NO: 114645 - RNA, 24 nt, Human
uucagaaaaagaaaauuagcuuga

SEQ ID NO: 114646 - RNA, 23 nt, Human
uucucuauuacaacuuuuuuaaa

SEQ ID NO: 114647 - RNA, 23 nt, Human
uugcagccuuucuccaccaaaaa

SEQ ID NO: 114648 - RNA, 24 nt, Human
uuucccacucacugcgucucuuuu

SEQ ID NO: 114649 - RNA, 19 nt, Human
aaggggagggacagugggg

SEQ ID NO: 114650 - RNA, 21 nt, Human
acugaaauaacggacgugcac

SEQ ID NO: 114651 - RNA, 21 nt, Human
aggcaguaaaagccgucagcu

SEQ ID NO: 114652 - RNA, 21 nt, Human
augccccccagaaucagcacc

SEQ ID NO: 114653 - RNA, 20 nt, Human
cacccccccacagugaguca

SEQ ID NO: 114654 - RNA, 24 nt, Human
cacccccccacagugagucaucug

SEQ ID NO: 114655 - RNA, 21 nt, Human
cacugcccacagccacccccc

SEQ ID NO: 114656 - RNA, 21 nt, Human
cagcaccaugucaucacaggc

SEQ ID NO: 114657 - RNA, 19 nt, Human
cagcagcuuuaaugccccc

SEQ ID NO: 114658 - RNA, 24 nt, Human
caggggaugcugaaucucagcuca

SEQ ID NO: 114659 - RNA, 22 nt, Human
cagugggguucugcugagaccc

SEQ ID NO: 114660 - RNA, 20 nt, Human
ccacagccacccccccacag

SEQ ID NO: 114661 - RNA, 18 nt, Human
cccacagccaccccccca

SEQ ID NO: 114662 - RNA, 20 nt, Human
cccacagccacccccccaca

SEQ ID NO: 114663 - RNA, 19 nt, Human
ccccagaaucagcaccaug

SEQ ID NO: 114664 - RNA, 23 nt, Human
ccccccagaaucagcaccauguc

SEQ ID NO: 114665 - RNA, 21 nt, Human
ccccugcgguggccuuggcag

SEQ ID NO: 114666 - RNA, 18 nt, Human
ccucugucccuugcuccc

SEQ ID NO: 114667 - RNA, 21 nt, Human
ccuuggcagguccgagcccag

SEQ ID NO: 114668 - RNA, 22 nt, Human
cgugcacucgcacgcucacgug

SEQ ID NO: 114669 - RNA, 19 nt, Human
cucacugcccacagccacc

SEQ ID NO: 114670 - RNA, 21 nt, Human
cugcgguggccuuggcagguc

SEQ ID NO: 114671 - RNA, 19 nt, Human
cugcugagaccccgacucc

SEQ ID NO: 114672 - RNA, 20 nt, Human
cuugggucaaggggcggguc

SEQ ID NO: 114673 - RNA, 18 nt, Human
gacccccgccucuguccc

SEQ ID NO: 114674 - RNA, 18 nt, Human
gagucaucugccagggug

SEQ ID NO: 114675 - RNA, 23 nt, Human
gcacacaagccucuagcaccaag

SEQ ID NO: 114676 - RNA, 22 nt, Human
gcuaggacccccgccucugucc

SEQ ID NO: 114677 - RNA, 18 nt, Human
ggagggacagugggguuc

SEQ ID NO: 114678 - RNA, 19 nt, Human
gguccgagcccagcgcccc

SEQ ID NO: 114679 - RNA, 24 nt, Human
gugcacucgcacgcucacgugcac

SEQ ID NO: 114680 - RNA, 19 nt, Human
uaaaacagcagcuuuaaug

SEQ ID NO: 114681 - RNA, 21 nt, Human
uccgcucacugcccacagcca

SEQ ID NO: 114682 - RNA, 23 nt, Human
ucugcugagaccccgacuccucc

SEQ ID NO: 114683 - RNA, 20 nt, Human
ucugucccuugcuccccccu

SEQ ID NO: 114684 - RNA, 23 nt, Human
ugccuuuuaaaacagcagcuuua

SEQ ID NO: 114685 - RNA, 18 nt, Human
uuaaaacagcagcuuuaa

SEQ ID NO: 114686 - RNA, 26 nt, Human
uuaaaacagcagcuuuaaugcccccc

SEQ ID NO: 114687 - RNA, 22 nt, Human
agaggcucgcuggcucccacgg

SEQ ID NO: 114688 - RNA, 22 nt, Human
agggugaguuggugaacgugug

SEQ ID NO: 114689 - RNA, 18 nt, Human
caggacugcugaaucaaa

SEQ ID NO: 114690 - RNA, 24 nt, Human
ccaauguccuugcuggugccuucc

SEQ ID NO: 114691 - RNA, 23 nt, Human
ccuugcuggugccuuccucccgg

SEQ ID NO: 114692 - RNA, 23 nt, Human
cugguuucugucucuucagcaga

SEQ ID NO: 114693 - RNA, 19 nt, Human
gucucuucagcagaugcug

SEQ ID NO: 114694 - RNA, 18 nt, Human
guugucuuuuguucuuga

SEQ ID NO: 114695 - RNA, 22 nt, Human
ucccuugagcacguaagaucag

SEQ ID NO: 114696 - RNA, 18 nt, Human
uccuugcuggugccuucc

SEQ ID NO: 114697 - RNA, 19 nt, Human
uccuugcuggugccuuccu

SEQ ID NO: 114698 - RNA, 21 nt, Human
ucucuucagcagaugcugcuc

SEQ ID NO: 114699 - RNA, 20 nt, Human
uguccuugcuggugccuucc

SEQ ID NO: 114700 - RNA, 24 nt, Human
uuuuuuucuuuguuuuuuguuuuu

SEQ ID NO: 114701 - RNA, 21 nt, Human
uuuuuuuuuuucuuuguuuuu

SEQ ID NO: 114702 - RNA, 21 nt, Human
agccaugcagcaguaagccuu

SEQ ID NO: 114703 - RNA, 23 nt, Human
caacagucccuaugaagaagggg

SEQ ID NO: 114704 - RNA, 27 nt, Human
cacacuaaagcucaagauccugggaac

SEQ ID NO: 114705 - RNA, 20 nt, Human
cagaaaaagcacccccggga

SEQ ID NO: 114706 - RNA, 23 nt, Human
cagaaaaagcacccccgggagua

SEQ ID NO: 114707 - RNA, 19 nt, Human
cauagguauagcacacuaa

SEQ ID NO: 114708 - RNA, 21 nt, Human
caucuuugccccagcuuugga

SEQ ID NO: 114709 - RNA, 18 nt, Human
caugcagacagccaugcg

SEQ ID NO: 114710 - RNA, 19 nt, Human
ccaggcuccuucaccaggc

SEQ ID NO: 114711 - RNA, 19 nt, Human
cccaggcuccuucaccagg

SEQ ID NO: 114712 - RNA, 21 nt, Human
cccuccugcccccggugaggg

SEQ ID NO: 114713 - RNA, 23 nt, Human
ccgccgcccgccgcuaaucccuc

SEQ ID NO: 114714 - RNA, 21 nt, Human
ccucuaggcuuccagacccgc

SEQ ID NO: 114715 - RNA, 22 nt, Human
ccugguuccccucuaggcuucc

SEQ ID NO: 114716 - RNA, 20 nt, Human
cucaagauccugggaacagg

SEQ ID NO: 114717 - RNA, 18 nt, Human
cucacccaggcuccuuca

SEQ ID NO: 114718 - RNA, 24 nt, Human
cucacgaccccuucacuguuaccc

SEQ ID NO: 114719 - RNA, 21 nt, Human
cuccaagggaaaggaaagaga

SEQ ID NO: 114720 - RNA, 24 nt, Human
cuuggcccggcucugcagccuggu

SEQ ID NO: 114721 - RNA, 24 nt, Human
gagucacuguccccucacgacccc

SEQ ID NO: 114722 - RNA, 22 nt, Human
gccuuggucccuccugcccccg

SEQ ID NO: 114723 - RNA, 20 nt, Human
ggaugguguuucucacccag

SEQ ID NO: 114724 - RNA, 29 nt, Human
gguguuugguuuucuuuuuuuuuuuuuuu

SEQ ID NO: 114725 - RNA, 22 nt, Human
guucugggcccagccuuggucc

SEQ ID NO: 114726 - RNA, 19 nt, Human
guuugguuuucuuuuuuuu

SEQ ID NO: 114727 - RNA, 23 nt, Human
uaagacacauagguauagcacac

SEQ ID NO: 114728 - RNA, 22 nt, Human
uaaucccuuggcccggcucugc

SEQ ID NO: 114729 - RNA, 21 nt, Human
uacccuaggacuauguguucu

SEQ ID NO: 114730 - RNA, 18 nt, Human
uagcauagguggcacuuc

SEQ ID NO: 114731 - RNA, 22 nt, Human
uccccucacgaccccuucacug

SEQ ID NO: 114732 - RNA, 21 nt, Human
ucccugcagaaaaagcacccc

SEQ ID NO: 114733 - RNA, 24 nt, Human
ugaagguaauacauuguaaucaug

SEQ ID NO: 114734 - RNA, 19 nt, Human
ugacucugcugucuucccu

SEQ ID NO: 114735 - RNA, 22 nt, Human
ugcagccugguuccccucuagg

SEQ ID NO: 114736 - RNA, 21 nt, Human
ugccccagcuuuggauggugu

SEQ ID NO: 114737 - RNA, 23 nt, Human
ugguuuucuuuuuuuuuuuuuuu

SEQ ID NO: 114738 - RNA, 18 nt, Human
ugucuucccuccaaggga

SEQ ID NO: 114739 - RNA, 19 nt, Human
uucuuuuuuuuuuuuuuua

SEQ ID NO: 114740 - RNA, 23 nt, Human
uucuuuuuuuuuuuuuuuaacug

SEQ ID NO: 114741 - RNA, 18 nt, Human
acagccgaaugaugcucg

SEQ ID NO: 114742 - RNA, 23 nt, Human
agauggccaguggaggaaggugc

SEQ ID NO: 114743 - RNA, 24 nt, Human
agcugggaggcagggaaggaagua

SEQ ID NO: 114744 - RNA, 21 nt, Human
agcugggcagggcccgggccu

SEQ ID NO: 114745 - RNA, 18 nt, Human
agggaaggaaguaguggg

SEQ ID NO: 114746 - RNA, 25 nt, Human
agggaaggaaguaguggggcugggg

SEQ ID NO: 114747 - RNA, 20 nt, Human
agggggacgggugcgugucc

SEQ ID NO: 114748 - RNA, 18 nt, Human
augauguuuaaauacuga

SEQ ID NO: 114749 - RNA, 24 nt, Human
cacccaucagugcucuaccucccc

SEQ ID NO: 114750 - RNA, 33 nt, Human
cacccaucagugcucuaccuccccuucccccuc

SEQ ID NO: 114751 - RNA, 19 nt, Human
cacgcaccgacggcagagu

SEQ ID NO: 114752 - RNA, 20 nt, Human
cacugacccaaggacaagau

SEQ ID NO: 114753 - RNA, 19 nt, Human
cccgaggugcccauguccc

SEQ ID NO: 114754 - RNA, 24 nt, Human
cccgaggugcccaugucccacuga

SEQ ID NO: 114755 - RNA, 20 nt, Human
ccgacggcagagucucccgg

SEQ ID NO: 114756 - RNA, 19 nt, Human
ccucaagcugaggggugga

SEQ ID NO: 114757 - RNA, 21 nt, Human
ccuccaggcucugucugggcc

SEQ ID NO: 114758 - RNA, 21 nt, Human
ccuuuuccuuaggacuccuga

SEQ ID NO: 114759 - RNA, 26 nt, Human
cgcccuauuccuucagcgcuucgacu

SEQ ID NO: 114760 - RNA, 23 nt, Human
cgcgcacgcaccgacggcagagu

SEQ ID NO: 114761 - RNA, 19 nt, Human
cucugucugggccugaugc

SEQ ID NO: 114762 - RNA, 19 nt, Human
gaaggaaguaguggggcug

SEQ ID NO: 114763 - RNA, 19 nt, Human
gaagguccugggggagaug

SEQ ID NO: 114764 - RNA, 19 nt, Human
gaagguccugggggagaug

SEQ ID NO: 114765 - RNA, 25 nt, Human
gaccugguccuucccgccaggaugc

SEQ ID NO: 114766 - RNA, 20 nt, Human
gaguuaugcgagaaagagaa

SEQ ID NO: 114767 - RNA, 25 nt, Human
gcagggcccgggccucccgaggugg

SEQ ID NO: 114768 - RNA, 25 nt, Human
gccucaggggagucaccccagcagc

SEQ ID NO: 114769 - RNA, 22 nt, Human
gcgcacgcaccgacggcagagu

SEQ ID NO: 114770 - RNA, 20 nt, Human
gcucuaccuccccuuccccc

SEQ ID NO: 114771 - RNA, 22 nt, Human
gcuuuuauuuacagaaaggccu

SEQ ID NO: 114772 - RNA, 21 nt, Human
ggaaggaaguaguggggcugg

SEQ ID NO: 114773 - RNA, 22 nt, Human
ggaaggaaguaguggggcuggc

SEQ ID NO: 114774 - RNA, 19 nt, Human
ggacuccugagucccagac

SEQ ID NO: 114775 - RNA, 19 nt, Human
gggggagaugguuuccugg

SEQ ID NO: 114776 - RNA, 23 nt, Human
ggguggaucggggagaaaggggu

SEQ ID NO: 114777 - RNA, 22 nt, Human
ucacccaucagugcucuaccuc

SEQ ID NO: 114778 - RNA, 22 nt, Human
ucagugcucuaccuccccuucc

SEQ ID NO: 114779 - RNA, 18 nt, Human
uccgcgcacgcaccgacg

SEQ ID NO: 114780 - RNA, 23 nt, Human
uccugagucccagacagaagguc

SEQ ID NO: 114781 - RNA, 23 nt, Human
ugacccaaggacaagauggccag

SEQ ID NO: 114782 - RNA, 19 nt, Human
ugagaugggaucaggaacu

SEQ ID NO: 114783 - RNA, 21 nt, Human
ugagucccagacagaaggucc

SEQ ID NO: 114784 - RNA, 24 nt, Human
ugccuccaggcucugucugggccu

SEQ ID NO: 114785 - RNA, 21 nt, Human
ugcucuaccuccccuuccccc

SEQ ID NO: 114786 - RNA, 18 nt, Human
uggaacuguagcugggcc

SEQ ID NO: 114787 - RNA, 20 nt, Human
uggaaggaaagccgcccuau

SEQ ID NO: 114788 - RNA, 22 nt, Human
ugggaggcagggaaggaaguag

SEQ ID NO: 114789 - RNA, 23 nt, Human
uggggcuggcuuaaggguauagc

SEQ ID NO: 114790 - RNA, 25 nt, Human
uggguggaucggggagaaaggggug

SEQ ID NO: 114791 - RNA, 19 nt, Human
ugguaacagccgaaugaug

SEQ ID NO: 114792 - RNA, 20 nt, Human
uguagcugggcagggcccgg

SEQ ID NO: 114793 - RNA, 23 nt, Human
uucacccaucagugcucuaccuc

SEQ ID NO: 114794 - RNA, 23 nt, Human
caggcgacagcccgaugagggug

SEQ ID NO: 114795 - RNA, 23 nt, Human
ccccgcuccuucaugaccgucca

SEQ ID NO: 114796 - RNA, 24 nt, Human
cccgccugccacacccccgcuccu

SEQ ID NO: 114797 - RNA, 22 nt, Human
ccucuccuggacgucacccgcc

SEQ ID NO: 114798 - RNA, 22 nt, Human
cuucaugaccguccacugugcu

SEQ ID NO: 114799 - RNA, 18 nt, Human
gaugagggugcucgcugg

SEQ ID NO: 114800 - RNA, 23 nt, Human
gccacacccccgcuccuucauga

SEQ ID NO: 114801 - RNA, 19 nt, Human
gcucccucuccuggacguc

SEQ ID NO: 114802 - RNA, 24 nt, Human
ggcugagcggagucugagcugcgg

SEQ ID NO: 114803 - RNA, 18 nt, Human
uacacacccuaccuucuc

SEQ ID NO: 114804 - RNA, 18 nt, Human
ucacccgccugccacacc

SEQ ID NO: 114805 - RNA, 23 nt, Human
ucucaaaugcugggcuuacaggu

SEQ ID NO: 114806 - RNA, 22 nt, Human
ugcuauguaaacaaguuacuga

SEQ ID NO: 114807 - RNA, 21 nt, Human
uggcaaggcccgcgcguccag

SEQ ID NO: 114808 - RNA, 24 nt, Human
uggcaaggcccgcgcguccagucg

SEQ ID NO: 114809 - RNA, 21 nt, Human
uuguacacaaccuuuuauaua

SEQ ID NO: 114810 - RNA, 20 nt, Human
uuuauugggaugagaucaua

SEQ ID NO: 114811 - RNA, 21 nt, Human
aaaacaacaucuccccaggcc

SEQ ID NO: 114812 - RNA, 21 nt, Human
aaaacaacaucuccccaggcc

SEQ ID NO: 114813 - RNA, 21 nt, Human
aaacaacaucuccccaggccu

SEQ ID NO: 114814 - RNA, 21 nt, Human
aaacaacaucuccccaggccu

SEQ ID NO: 114815 - RNA, 22 nt, Human
aaacccaagggugucccuccag

SEQ ID NO: 114816 - RNA, 21 nt, Human
aaacccaagggugucccuccg

SEQ ID NO: 114817 - RNA, 21 nt, Human
aaagacaucuuccuggaggcc

SEQ ID NO: 114818 - RNA, 20 nt, Human
aaauagcuucguacaaaaac

SEQ ID NO: 114819 - RNA, 20 nt, Human
aaauagcuucguacaaaaac

SEQ ID NO: 114820 - RNA, 18 nt, Human
aacagagcugcccaugug

SEQ ID NO: 114821 - RNA, 18 nt, Human
aacagccugcccaggugu

SEQ ID NO: 114822 - RNA, 18 nt, Human
aacagccugcccaggugu

SEQ ID NO: 114823 - RNA, 20 nt, Human
aaccacaagagccgccccuu

SEQ ID NO: 114824 - RNA, 20 nt, Human
aaccacaagagccgccccuu

SEQ ID NO: 114825 - RNA, 23 nt, Human
aaggaccaaggagacaccaacag

SEQ ID NO: 114826 - RNA, 23 nt, Human
aaggaccaaggagacaccaacag

SEQ ID NO: 114827 - RNA, 22 nt, Human
aagugcagagagagccaagagg

SEQ ID NO: 114828 - RNA, 22 nt, Human
aagugcagagagagccaagagg

SEQ ID NO: 114829 - RNA, 19 nt, Human
acaacaucuccccaggccu

SEQ ID NO: 114830 - RNA, 21 nt, Human
acaagagccgccccuuuggga

SEQ ID NO: 114831 - RNA, 21 nt, Human
acaagagccgccccuuuggga

SEQ ID NO: 114832 - RNA, 18 nt, Human
acaguggagaagcugcug

SEQ ID NO: 114833 - RNA, 18 nt, Human
acaguggagaagcugcug

SEQ ID NO: 114834 - RNA, 20 nt, Human
accaggccccaagcuccagc

SEQ ID NO: 114835 - RNA, 20 nt, Human
accaggccccaagcuccagc

SEQ ID NO: 114836 - RNA, 19 nt, Human
agaauaaaacuaagcccua

SEQ ID NO: 114837 - RNA, 19 nt, Human
agacaccaacagccugccc

SEQ ID NO: 114838 - RNA, 19 nt, Human
agacaccaacagccugccc

SEQ ID NO: 114839 - RNA, 22 nt, Human
agacaccaggugaugguccacc

SEQ ID NO: 114840 - RNA, 22 nt, Human
agacaccaggugaugguccacc

SEQ ID NO: 114841 - RNA, 18 nt, Human
agagccaagaggucaaga

SEQ ID NO: 114842 - RNA, 18 nt, Human
agagccaagaggucaaga

SEQ ID NO: 114843 - RNA, 18 nt, Human
agagcucuggccaggaac

SEQ ID NO: 114844 - RNA, 21 nt, Human
agcuccagccugcugaguccc

SEQ ID NO: 114845 - RNA, 21 nt, Human
agcuccagccugcugaguccc

SEQ ID NO: 114846 - RNA, 20 nt, Human
agcucuggccaggaacgcuc

SEQ ID NO: 114847 - RNA, 20 nt, Human
agcucuggccaggaacgcuc

SEQ ID NO: 114848 - RNA, 22 nt, Human
aggaauuuguccuuguuuuugu

SEQ ID NO: 114849 - RNA, 22 nt, Human
aggaauuuguccuuguuuuugu

SEQ ID NO: 114850 - RNA, 22 nt, Human
aggaggacaaggcuaugcaaua

SEQ ID NO: 114851 - RNA, 22 nt, Human
aggaggcugcugcggagccuug

SEQ ID NO: 114852 - RNA, 20 nt, Human
aggcagcucacagacaugca

SEQ ID NO: 114853 - RNA, 20 nt, Human
aggcagcucacagacaugca

SEQ ID NO: 114854 - RNA, 18 nt, Human
agggugucccuccagcug

SEQ ID NO: 114855 - RNA, 18 nt, Human
agggugucccuccagcug

SEQ ID NO: 114856 - RNA, 21 nt, Human
aggugaugguccaccaggccc

SEQ ID NO: 114857 - RNA, 20 nt, Human
aguagcaggaauuuguccuu

SEQ ID NO: 114858 - RNA, 23 nt, Human
auccucuuuccccuuuggguccc

SEQ ID NO: 114859 - RNA, 21 nt, Human
augaaaggcagcucacagaca

SEQ ID NO: 114860 - RNA, 21 nt, Human
augaaaggcagcucacagaca

SEQ ID NO: 114861 - RNA, 23 nt, Human
auggugccagagauuuugaaacc

SEQ ID NO: 114862 - RNA, 23 nt, Human
auggugccagagauuuugaaacc

SEQ ID NO: 114863 - RNA, 21 nt, Human
augucaccugugggagaccgg

SEQ ID NO: 114864 - RNA, 21 nt, Human
augucaccugugggagaccgg

SEQ ID NO: 114865 - RNA, 18 nt, Human
augucuuuccagaauaaa

SEQ ID NO: 114866 - RNA, 18 nt, Human
augucuuuccagaauaaa

SEQ ID NO: 114867 - RNA, 22 nt, Human
caaagagguagagcucuggcca

SEQ ID NO: 114868 - RNA, 22 nt, Human
caaagagguagagcucuggcca

SEQ ID NO: 114869 - RNA, 21 nt, Human
caacagccugcccaggugugg

SEQ ID NO: 114870 - RNA, 21 nt, Human
caacagccugcccaggugugg

SEQ ID NO: 114871 - RNA, 18 nt, Human
caagagccgccccuuugg

SEQ ID NO: 114872 - RNA, 18 nt, Human
caagagccgccccuuugg

SEQ ID NO: 114873 - RNA, 21 nt, Human
caagauggugccagagauuuu

SEQ ID NO: 114874 - RNA, 21 nt, Human
caagauggugccagagauuuu

SEQ ID NO: 114875 - RNA, 20 nt, Human
caaguccacggccuggguca

SEQ ID NO: 114876 - RNA, 20 nt, Human
caaguccacggccuggguca

SEQ ID NO: 114877 - RNA, 22 nt, Human
cacaaaaaucacaggaacucgc

SEQ ID NO: 114878 - RNA, 21 nt, Human
cacacuccuccccaggcugca

SEQ ID NO: 114879 - RNA, 22 nt, Human
cacacuccuccccaggcugcag

SEQ ID NO: 114880 - RNA, 23 nt, Human
cacaggguagaaaggggucagcu

SEQ ID NO: 114881 - RNA, 19 nt, Human
cacaguccuccacacccuc

SEQ ID NO: 114882 - RNA, 19 nt, Human
caccaacagccugcccagg

SEQ ID NO: 114883 - RNA, 18 nt, Human
caccugugggagaccggg

SEQ ID NO: 114884 - RNA, 18 nt, Human
caccugugggagaccggg

SEQ ID NO: 114885 - RNA, 28 nt, Human
cacggcccucaggugaaguagcggcagg

SEQ ID NO: 114886 - RNA, 22 nt, Human
cacugcuguuugcgugcgcgug

SEQ ID NO: 114887 - RNA, 21 nt, Human
cacuucccugcuuugugguuc

SEQ ID NO: 114888 - RNA, 21 nt, Human
cacuucccugcuuugugguuc

SEQ ID NO: 114889 - RNA, 22 nt, Human
cagaaaccccagugugauggug

SEQ ID NO: 114890 - RNA, 22 nt, Human
cagaaaccccagugugauggug

SEQ ID NO: 114891 - RNA, 22 nt, Human
cagaauaaaacuaagcccuacu

SEQ ID NO: 114892 - RNA, 22 nt, Human
cagaauaaaacuaagcccuacu

SEQ ID NO: 114893 - RNA, 22 nt, Human
cagcaugaaaacaacaucuccc

SEQ ID NO: 114894 - RNA, 22 nt, Human
cagcaugaaaacaacaucuccc

SEQ ID NO: 114895 - RNA, 18 nt, Human
cagcugguaaaaauuggg

SEQ ID NO: 114896 - RNA, 23 nt, Human
caggaggacaaggcuaugcaaua

SEQ ID NO: 114897 - RNA, 20 nt, Human
caggaggcaaagagguagag

SEQ ID NO: 114898 - RNA, 20 nt, Human
caggccccaagcuccagccu

SEQ ID NO: 114899 - RNA, 22 nt, Human
caggcugggcugggcuguggcc

SEQ ID NO: 114900 - RNA, 22 nt, Human
caggcugggcugggcuguggcc

SEQ ID NO: 114901 - RNA, 18 nt, Human
caugucuuaguagcagga

SEQ ID NO: 114902 - RNA, 18 nt, Human
caugucuuaguagcagga

SEQ ID NO: 114903 - RNA, 26 nt, Human
ccaaagagaucaaaacauacuaaaac

SEQ ID NO: 114904 - RNA, 26 nt, Human
ccaaagagaucaaaacauacuaaaac

SEQ ID NO: 114905 - RNA, 23 nt, Human
ccacaagagccgccccuuuggga

SEQ ID NO: 114906 - RNA, 22 nt, Human
ccaccaggccccaagcuccagc

SEQ ID NO: 114907 - RNA, 22 nt, Human
ccaccaggccccaagcuccagc

SEQ ID NO: 114908 - RNA, 21 nt, Human
ccagaauaaaacuaagcccua

SEQ ID NO: 114909 - RNA, 23 nt, Human
ccaggugaugguccaccaggccc

SEQ ID NO: 114910 - RNA, 18 nt, Human
cccacaggugccgugcug

SEQ ID NO: 114911 - RNA, 22 nt, Human
cccucaugccggugaccaucuc

SEQ ID NO: 114912 - RNA, 19 nt, Human
ccgggaaauccucuuuccc

SEQ ID NO: 114913 - RNA, 24 nt, Human
ccuacagacaccaggugauggucc

SEQ ID NO: 114914 - RNA, 24 nt, Human
ccuacagacaccaggugauggucc

SEQ ID NO: 114915 - RNA, 22 nt, Human
ccucaugccggugaccaucucc

SEQ ID NO: 114916 - RNA, 21 nt, Human
ccuccacacccucaugccggu

SEQ ID NO: 114917 - RNA, 21 nt, Human
ccucuuuccccuuuggguccc

SEQ ID NO: 114918 - RNA, 24 nt, Human
ccuguacuccagauuccccaaaga

SEQ ID NO: 114919 - RNA, 24 nt, Human
ccuguacuccagauuccccaaaga

SEQ ID NO: 114920 - RNA, 25 nt, Human
ccuugcuuaucucugcuuuucucuu

SEQ ID NO: 114921 - RNA, 18 nt, Human
cgucaggcugggcugggc

SEQ ID NO: 114922 - RNA, 18 nt, Human
cgucaggcugggcugggc

SEQ ID NO: 114923 - RNA, 24 nt, Human
cgugcgcguguguuugugugugug

SEQ ID NO: 114924 - RNA, 28 nt, Human
cguguguuugugugugugugugugcgug

SEQ ID NO: 114925 - RNA, 19 nt, Human
cuccauaugacccagggag

SEQ ID NO: 114926 - RNA, 19 nt, Human
cucugccuagagagagccc

SEQ ID NO: 114927 - RNA, 19 nt, Human
cucugccuagagagagccc

SEQ ID NO: 114928 - RNA, 18 nt, Human
cucugcuuggggcaagcc

SEQ ID NO: 114929 - RNA, 18 nt, Human
cucugcuuggggcaagcc

SEQ ID NO: 114930 - RNA, 22 nt, Human
cucugcuuggggcaagccuggg

SEQ ID NO: 114931 - RNA, 22 nt, Human
cucugcuuggggcaagccuggg

SEQ ID NO: 114932 - RNA, 19 nt, Human
cucuuccucacugcuguuu

SEQ ID NO: 114933 - RNA, 21 nt, Human
cucuuccucacugcuguuugc

SEQ ID NO: 114934 - RNA, 19 nt, Human
cugcaggucuauguguguc

SEQ ID NO: 114935 - RNA, 19 nt, Human
cugcaggucuauguguguc

SEQ ID NO: 114936 - RNA, 23 nt, Human
cugguaaaaauugggcaauuucu

SEQ ID NO: 114937 - RNA, 23 nt, Human
cugguaaaaauugggcaauuucu

SEQ ID NO: 114938 - RNA, 18 nt, Human
cuggucucugcggaaggc

SEQ ID NO: 114939 - RNA, 20 nt, Human
cuguggggcgcagcccaccu

SEQ ID NO: 114940 - RNA, 23 nt, Human
cuugaaguacagagaucucuggu

SEQ ID NO: 114941 - RNA, 19 nt, Human
cuuggagaugucuuuccag

SEQ ID NO: 114942 - RNA, 19 nt, Human
cuuggagaugucuuuccag

SEQ ID NO: 114943 - RNA, 18 nt, Human
gaaagaaaugccacggga

SEQ ID NO: 114944 - RNA, 18 nt, Human
gaaagaaaugccacggga

SEQ ID NO: 114945 - RNA, 19 nt, Human
gaacagagcugcccaugug

SEQ ID NO: 114946 - RNA, 19 nt, Human
gaacagagcugcccaugug

SEQ ID NO: 114947 - RNA, 21 nt, Human
gacaggaaauggacaugaggg

SEQ ID NO: 114948 - RNA, 24 nt, Human
gacgcugucaggggucagcaggag

SEQ ID NO: 114949 - RNA, 21 nt, Human
gagaucaaaacauacuaaaac

SEQ ID NO: 114950 - RNA, 18 nt, Human
gagguagagcucuggcca

SEQ ID NO: 114951 - RNA, 18 nt, Human
gaggucaagauggugcca

SEQ ID NO: 114952 - RNA, 18 nt, Human
gaggucaagauggugcca

SEQ ID NO: 114953 - RNA, 21 nt, Human
gaugguggaagcagcaugaaa

SEQ ID NO: 114954 - RNA, 21 nt, Human
gaugguggaagcagcaugaaa

SEQ ID NO: 114955 - RNA, 19 nt, Human
gcaaagugcagagagagcc

SEQ ID NO: 114956 - RNA, 19 nt, Human
gcaaagugcagagagagcc

SEQ ID NO: 114957 - RNA, 19 nt, Human
gcagcaugaaaacaacauc

SEQ ID NO: 114958 - RNA, 19 nt, Human
gcagcaugaaaacaacauc

SEQ ID NO: 114959 - RNA, 23 nt, Human
gcagcaugaaaacaacaucuccc

SEQ ID NO: 114960 - RNA, 21 nt, Human
gcaggaggcaaagagguagag

SEQ ID NO: 114961 - RNA, 21 nt, Human
gcaggaggcaaagagguagag

SEQ ID NO: 114962 - RNA, 22 nt, Human
gcagggcguggagucgauguag

SEQ ID NO: 114963 - RNA, 18 nt, Human
gcaggucacacaguccuc

SEQ ID NO: 114964 - RNA, 18 nt, Human
gcaggucacacaguccuc

SEQ ID NO: 114965 - RNA, 22 nt, Human
gcccacuucccugcuuuguggu

SEQ ID NO: 114966 - RNA, 22 nt, Human
gcccacuucccugcuuuguggu

SEQ ID NO: 114967 - RNA, 19 nt, Human
gcgcagcccaccuucuccu

SEQ ID NO: 114968 - RNA, 19 nt, Human
gcgcagcccaccuucuccu

SEQ ID NO: 114969 - RNA, 21 nt, Human
gcugucaggggucagcaggag

SEQ ID NO: 114970 - RNA, 21 nt, Human
gcugucaggggucagcaggag

SEQ ID NO: 114971 - RNA, 18 nt, Human
ggaaauggacaugaggga

SEQ ID NO: 114972 - RNA, 18 nt, Human
ggaaauggacaugaggga

SEQ ID NO: 114973 - RNA, 22 nt, Human
ggacaggaaauggacaugaggg

SEQ ID NO: 114974 - RNA, 22 nt, Human
ggacaggaaauggacaugaggg

SEQ ID NO: 114975 - RNA, 19 nt, Human
ggacaugagggacauuuuu

SEQ ID NO: 114976 - RNA, 19 nt, Human
ggacaugagggacauuuuu

SEQ ID NO: 114977 - RNA, 18 nt, Human
ggaggcccgggaaauccu

SEQ ID NO: 114978 - RNA, 23 nt, Human
ggcaaagugcagagagagccagu

SEQ ID NO: 114979 - RNA, 26 nt, Human
ggcaagccugggucagguggguucuc

SEQ ID NO: 114980 - RNA, 26 nt, Human
ggcaagccugggucagguggguucuc

SEQ ID NO: 114981 - RNA, 20 nt, Human
ggccagggucuggcgagggg

SEQ ID NO: 114982 - RNA, 18 nt, Human
ggccccaagcuccagccu

SEQ ID NO: 114983 - RNA, 22 nt, Human
ggcgcagcccaccuucuccuca

SEQ ID NO: 114984 - RNA, 22 nt, Human
ggcgcagcccaccuucuccuca

SEQ ID NO: 114985 - RNA, 20 nt, Human
gggcugggcuguggccaguc

SEQ ID NO: 114986 - RNA, 20 nt, Human
gggcugggcuguggccaguc

SEQ ID NO: 114987 - RNA, 19 nt, Human
ggguucucaguacuuuuuc

SEQ ID NO: 114988 - RNA, 19 nt, Human
ggguucucaguacuuuuuc

SEQ ID NO: 114989 - RNA, 21 nt, Human
ggugccagagauuuugaaacc

SEQ ID NO: 114990 - RNA, 23 nt, Human
gugcgcguguguuugugugugug

SEQ ID NO: 114991 - RNA, 28 nt, Human
gugcgcguguguuugugugugugugugu

SEQ ID NO: 114992 - RNA, 22 nt, Human
guguguuugugugugugugugu

SEQ ID NO: 114993 - RNA, 23 nt, Human
guuuuugucacacaaagguuggu

SEQ ID NO: 114994 - RNA, 23 nt, Human
guuuuugucacacaaagguuggu

SEQ ID NO: 114995 - RNA, 24 nt, Human
uaaauagcuucguacaaaaaccca

SEQ ID NO: 114996 - RNA, 24 nt, Human
uaaauagcuucguacaaaaaccca

SEQ ID NO: 114997 - RNA, 23 nt, Human
uaaauucuuccagucagacugag

SEQ ID NO: 114998 - RNA, 23 nt, Human
uaaauucuuccagucagacugag

SEQ ID NO: 114999 - RNA, 23 nt, Human
uaaucuuauugaaaagggaggag

SEQ ID NO: 115000 - RNA, 19 nt, Human
uacucaggaaaaaugguga

SEQ ID NO: 115001 - RNA, 19 nt, Human
uacucaggaaaaaugguga

SEQ ID NO: 115002 - RNA, 27 nt, Human
uagaaaggaggcugcugcggagccuug

SEQ ID NO: 115003 - RNA, 19 nt, Human
uagagcucuggccaggaac

SEQ ID NO: 115004 - RNA, 19 nt, Human
uagagcucuggccaggaac

SEQ ID NO: 115005 - RNA, 22 nt, Human
uagaucggggacucaggggagu

SEQ ID NO: 115006 - RNA, 22 nt, Human
uagaucggggacucaggggagu

SEQ ID NO: 115007 - RNA, 18 nt, Human
uagcggcagggcguggag

SEQ ID NO: 115008 - RNA, 24 nt, Human
uagcuucguacaaaaacccaaggg

SEQ ID NO: 115009 - RNA, 24 nt, Human
uagcuucguacaaaaacccaaggg

SEQ ID NO: 115010 - RNA, 23 nt, Human
uaguagcaggaauuuguccuugu

SEQ ID NO: 115011 - RNA, 23 nt, Human
uaguagcaggaauuuguccuugu

SEQ ID NO: 115012 - RNA, 18 nt, Human
ucaaaacauacuaaaaca

SEQ ID NO: 115013 - RNA, 18 nt, Human
ucaaaacauacuaaaaca

SEQ ID NO: 115014 - RNA, 24 nt, Human
ucaugccggugaccaucuccacag

SEQ ID NO: 115015 - RNA, 20 nt, Human
uccacaguaggcacggugac

SEQ ID NO: 115016 - RNA, 19 nt, Human
uccagaauaaaacuaagcc

SEQ ID NO: 115017 - RNA, 19 nt, Human
uccagaauaaaacuaagcc

SEQ ID NO: 115018 - RNA, 19 nt, Human
uccccaagacacaggcuca

SEQ ID NO: 115019 - RNA, 19 nt, Human
uccccaagacacaggcuca

SEQ ID NO: 115020 - RNA, 23 nt, Human
uccccaagacacaggcucauuaa

SEQ ID NO: 115021 - RNA, 23 nt, Human
uccccaagacacaggcucauuaa

SEQ ID NO: 115022 - RNA, 21 nt, Human
uccccaggcugcaggagccca

SEQ ID NO: 115023 - RNA, 22 nt, Human
uccccaggcugcaggagcccau

SEQ ID NO: 115024 - RNA, 19 nt, Human
ucccuccagcugguaaaaa

SEQ ID NO: 115025 - RNA, 19 nt, Human
ucgcaguagaggcgaaggg

SEQ ID NO: 115026 - RNA, 23 nt, Human
ucgguggucaggggcggagaggc

SEQ ID NO: 115027 - RNA, 23 nt, Human
ucgguggucaggggcggagaggc

SEQ ID NO: 115028 - RNA, 19 nt, Human
ucucagguugggcaugugg

SEQ ID NO: 115029 - RNA, 19 nt, Human
ucucagguugggcaugugg

SEQ ID NO: 115030 - RNA, 18 nt, Human
ucugcuuuucucuuccuc

SEQ ID NO: 115031 - RNA, 21 nt, Human
ucuguggggcgcagcccaccu

SEQ ID NO: 115032 - RNA, 21 nt, Human
ucuguggggcgcagcccaccu

SEQ ID NO: 115033 - RNA, 18 nt, Human
ugaaaacaacaucucccc

SEQ ID NO: 115034 - RNA, 18 nt, Human
ugaaaacaacaucucccc

SEQ ID NO: 115035 - RNA, 24 nt, Human
ugaaaacaacaucuccccaggccu

SEQ ID NO: 115036 - RNA, 25 nt, Human
ugaaaacaacaucuccccaggccuc

SEQ ID NO: 115037 - RNA, 25 nt, Human
ugaaaacaacaucuccccaggccuc

SEQ ID NO: 115038 - RNA, 21 nt, Human
ugaaguacagagaucucuggu

SEQ ID NO: 115039 - RNA, 20 nt, Human
ugacaguggagaagcugcug

SEQ ID NO: 115040 - RNA, 20 nt, Human
ugacaguggagaagcugcug

SEQ ID NO: 115041 - RNA, 18 nt, Human
ugagaagaggagccucuu

SEQ ID NO: 115042 - RNA, 18 nt, Human
ugagaagaggagccucuu

SEQ ID NO: 115043 - RNA, 21 nt, Human
ugagggacauuuuugagacag

SEQ ID NO: 115044 - RNA, 21 nt, Human
ugagggacauuuuugagacag

SEQ ID NO: 115045 - RNA, 25 nt, Human
ugagggacauuuuugagacaggggg

SEQ ID NO: 115046 - RNA, 25 nt, Human
ugagggacauuuuugagacaggggg

SEQ ID NO: 115047 - RNA, 20 nt, Human
ugaggucugcugugggggug

SEQ ID NO: 115048 - RNA, 20 nt, Human
ugaggucugcugugggggug

SEQ ID NO: 115049 - RNA, 22 nt, Human
ugaguccccaagacacaggcuc

SEQ ID NO: 115050 - RNA, 23 nt, Human
ugaguuaacagcaugucuuagua

SEQ ID NO: 115051 - RNA, 23 nt, Human
ugaguuaacagcaugucuuagua

SEQ ID NO: 115052 - RNA, 19 nt, Human
ugcuguuugcgugcgcgug

SEQ ID NO: 115053 - RNA, 21 nt, Human
uggcguuuuggguguucagcc

SEQ ID NO: 115054 - RNA, 24 nt, Human
ugggcuguggccagucgagggguc

SEQ ID NO: 115055 - RNA, 24 nt, Human
ugggcuguggccagucgagggguc

SEQ ID NO: 115056 - RNA, 20 nt, Human
uggggguggaccucaccuug

SEQ ID NO: 115057 - RNA, 20 nt, Human
uggggguggaccucaccuug

SEQ ID NO: 115058 - RNA, 21 nt, Human
ugguaaaaauugggcaauuuc

SEQ ID NO: 115059 - RNA, 22 nt, Human
ugguagcgauggggaacagguc

SEQ ID NO: 115060 - RNA, 22 nt, Human
ugguagcgauggggaacagguc

SEQ ID NO: 115061 - RNA, 19 nt, Human
uggugccagagauuuugaa

SEQ ID NO: 115062 - RNA, 19 nt, Human
uggugccagagauuuugaa

SEQ ID NO: 115063 - RNA, 20 nt, Human
uguggccagucgaggggucc

SEQ ID NO: 115064 - RNA, 20 nt, Human
uguggccagucgaggggucc

SEQ ID NO: 115065 - RNA, 19 nt, Human
ugugggagaccggguccac

SEQ ID NO: 115066 - RNA, 19 nt, Human
ugugggagaccggguccac

SEQ ID NO: 115067 - RNA, 23 nt, Human
ugugugucuaacagugcucagcc

SEQ ID NO: 115068 - RNA, 23 nt, Human
ugugugucuaacagugcucagcc

SEQ ID NO: 115069 - RNA, 21 nt, Human
ugugugugugugugugcgugu

SEQ ID NO: 115070 - RNA, 21 nt, Human
ugugugugugugugugcgugu

SEQ ID NO: 115071 - RNA, 21 nt, Human
uguguuugugugugugugugu

SEQ ID NO: 115072 - RNA, 22 nt, Human
uguuugcgugcgcguguguuug

SEQ ID NO: 115073 - RNA, 24 nt, Human
uguuugugugugugugugugcgug

SEQ ID NO: 115074 - RNA, 22 nt, Human
uuaaauagcuucguacaaaaac

SEQ ID NO: 115075 - RNA, 20 nt, Human
uuccucacugcuguuugcgu

SEQ ID NO: 115076 - RNA, 20 nt, Human
uugaaaccacaagagccgcc

SEQ ID NO: 115077 - RNA, 20 nt, Human
uugaaaccacaagagccgcc

SEQ ID NO: 115078 - RNA, 21 nt, Human
uugaaaccacaagagccgccc

SEQ ID NO: 115079 - RNA, 21 nt, Human
uugaaaccacaagagccgccc

SEQ ID NO: 115080 - RNA, 22 nt, Human
uuuggccaaaugguagcgaugg

SEQ ID NO: 115081 - RNA, 22 nt, Human
uuuggccaaaugguagcgaugg

SEQ ID NO: 115082 - RNA, 23 nt, Human
uuugugugugugugugugcgugu

SEQ ID NO: 115083 - RNA, 20 nt, Human
ccccucaggacggccacccc

SEQ ID NO: 115084 - RNA, 22 nt, Human
cccuugggcugggugcagagcc

SEQ ID NO: 115085 - RNA, 18 nt, Human
ccucucugagcccuucuc

SEQ ID NO: 115086 - RNA, 18 nt, Human
cgguggcggggagcuggg

SEQ ID NO: 115087 - RNA, 19 nt, Human
cugcacacacacuuuauuu

SEQ ID NO: 115088 - RNA, 19 nt, Human
gcccuucucacuucccccu

SEQ ID NO: 115089 - RNA, 18 nt, Human
gcgguggcggggagcugg

SEQ ID NO: 115090 - RNA, 19 nt, Human
gcugggugcagagccccca

SEQ ID NO: 115091 - RNA, 18 nt, Human
ggcggggagcugggugcu

SEQ ID NO: 115092 - RNA, 25 nt, Human
uauuuuguccucucugagcccuucu

SEQ ID NO: 115093 - RNA, 24 nt, Human
aagaagucaugauugagucuuaaa

SEQ ID NO: 115094 - RNA, 19 nt, Human
agaagcagcagcagcacca

SEQ ID NO: 115095 - RNA, 20 nt, Human
agagagcccgagaggggggc

SEQ ID NO: 115096 - RNA, 18 nt, Human
agagcccgagaggggggc

SEQ ID NO: 115097 - RNA, 21 nt, Human
agagcccgagaggggggccgg

SEQ ID NO: 115098 - RNA, 19 nt, Human
agcacgucuggcaccuuca

SEQ ID NO: 115099 - RNA, 21 nt, Human
agcagcaccaggcccagcaac

SEQ ID NO: 115100 - RNA, 19 nt, Human
agcccggagccgcagaagg

SEQ ID NO: 115101 - RNA, 21 nt, Human
agcccggagccgcagaagguc

SEQ ID NO: 115102 - RNA, 24 nt, Human
agcccucuggcugcgggagggguc

SEQ ID NO: 115103 - RNA, 19 nt, Human
aggcagcgcggcgggcagc

SEQ ID NO: 115104 - RNA, 23 nt, Human
aggccccagccccagugccucag

SEQ ID NO: 115105 - RNA, 18 nt, Human
aggcuccagcccucuggc

SEQ ID NO: 115106 - RNA, 18 nt, Human
aggggucuggggucuccu

SEQ ID NO: 115107 - RNA, 19 nt, Human
cagaaggucagcaggagca

SEQ ID NO: 115108 - RNA, 19 nt, Human
cagcagcaccaggcccagc

SEQ ID NO: 115109 - RNA, 24 nt, Human
cagggcgcaggccucggccgaggu

SEQ ID NO: 115110 - RNA, 20 nt, Human
ccagccccagugccucagaa

SEQ ID NO: 115111 - RNA, 21 nt, Human
ccaggcccagcaacacagcug

SEQ ID NO: 115112 - RNA, 23 nt, Human
ccaggcccagcaacacagcugcc

SEQ ID NO: 115113 - RNA, 18 nt, Human
ccccagccccagugccca

SEQ ID NO: 115114 - RNA, 19 nt, Human
ccccagccccagugccucu

SEQ ID NO: 115115 - RNA, 22 nt, Human
cccgcgacggcccgcccgggac

SEQ ID NO: 115116 - RNA, 18 nt, Human
cccuagcugccccagaag

SEQ ID NO: 115117 - RNA, 21 nt, Human
ccucugagcaggcuccagccc

SEQ ID NO: 115118 - RNA, 23 nt, Human
cgggaggggucuggggucuccuc

SEQ ID NO: 115119 - RNA, 19 nt, Human
gagagcccgagaggggggc

SEQ ID NO: 115120 - RNA, 18 nt, Human
gagcaggcuccagcccuc

SEQ ID NO: 115121 - RNA, 22 nt, Human
gcagcaccaccagcagcaccag

SEQ ID NO: 115122 - RNA, 25 nt, Human
gcgacggcccgcccgggacuggacc

SEQ ID NO: 115123 - RNA, 22 nt, Human
gcgggaggggucuggggucucc

SEQ ID NO: 115124 - RNA, 18 nt, Human
gcucggcagcaaagcaga

SEQ ID NO: 115125 - RNA, 24 nt, Human
ggcccagcaacacagcugccaaca

SEQ ID NO: 115126 - RNA, 25 nt, Human
gguuguggaugggcugcaggaugaa

SEQ ID NO: 115127 - RNA, 30 nt, Human
ucggcagcaaagcagauguuauuucucucu

SEQ ID NO: 115128 - RNA, 20 nt, Human
ugagagagcccgagaggggg

SEQ ID NO: 115129 - RNA, 22 nt, Human
ugagucuuaaaaaagaacaauc

SEQ ID NO: 115130 - RNA, 20 nt, Human
ugccucagaagcagcagcag

SEQ ID NO: 115131 - RNA, 19 nt, Human
uggcucggcagcaaagcag

SEQ ID NO: 115132 - RNA, 18 nt, Human
uguggaugggcugcagga

SEQ ID NO: 115133 - RNA, 18 nt, Human
uguugcaguucagagagg

SEQ ID NO: 115134 - RNA, 24 nt, Human
uucaaagcaccucugagcaggcuc

SEQ ID NO: 115135 - RNA, 24 nt, Human
aaagugcugggauuacagguauga

SEQ ID NO: 115136 - RNA, 18 nt, Human
aaccaaauaacuucuuca

SEQ ID NO: 115137 - RNA, 21 nt, Human
aaggaggauauagacacauuc

SEQ ID NO: 115138 - RNA, 21 nt, Human
aagucaaguuuagaccuucgg

SEQ ID NO: 115139 - RNA, 18 nt, Human
aagugcugggauuacagg

SEQ ID NO: 115140 - RNA, 19 nt, Human
aagugcugggauuacaggu

SEQ ID NO: 115141 - RNA, 26 nt, Human
aagugcugggauuacagguaugagcc

SEQ ID NO: 115142 - RNA, 24 nt, Human
acccaggcuggaaugaagugguau

SEQ ID NO: 115143 - RNA, 20 nt, Human
acgggguguugccauguugg

SEQ ID NO: 115144 - RNA, 24 nt, Human
acgggguguugccauguuggccag

SEQ ID NO: 115145 - RNA, 21 nt, Human
acuauaggcgcaugcuaccau

SEQ ID NO: 115146 - RNA, 19 nt, Human
agacaggagccgaacgggg

SEQ ID NO: 115147 - RNA, 21 nt, Human
agacaggagccgaacgggggc

SEQ ID NO: 115148 - RNA, 27 nt, Human
agaguuuuccuuuuuuuuuuuuuuuuu

SEQ ID NO: 115149 - RNA, 19 nt, Human
agcagcugggacuauaggc

SEQ ID NO: 115150 - RNA, 24 nt, Human
agccccgacacacccugcugcccu

SEQ ID NO: 115151 - RNA, 24 nt, Human
agcgauucucaugccucagccucc

SEQ ID NO: 115152 - RNA, 23 nt, Human
aggcaggucucgaacuccuggcc

SEQ ID NO: 115153 - RNA, 18 nt, Human
aggguaccugccuugaaa

SEQ ID NO: 115154 - RNA, 19 nt, Human
aggucuccgacuccgaugu

SEQ ID NO: 115155 - RNA, 19 nt, Human
aguagcugcagggggaagg

SEQ ID NO: 115156 - RNA, 24 nt, Human
agugguaugaucucaguugaaugc

SEQ ID NO: 115157 - RNA, 22 nt, Human
aucacagaguuuuccuuuuuuu

SEQ ID NO: 115158 - RNA, 24 nt, Human
augaucugcccaccguagccuccc

SEQ ID NO: 115159 - RNA, 24 nt, Human
augcaaccuccaccuccuagguuc

SEQ ID NO: 115160 - RNA, 21 nt, Human
augccaggcuaauuuuuauau

SEQ ID NO: 115161 - RNA, 22 nt, Human
augccucagccuccugagcagc

SEQ ID NO: 115162 - RNA, 24 nt, Human
caaagugcugggauuacagguaug

SEQ ID NO: 115163 - RNA, 23 nt, Human
caaaucaauaacccgcagugugc

SEQ ID NO: 115164 - RNA, 22 nt, Human
caaauguccaucacagaguuuu

SEQ ID NO: 115165 - RNA, 18 nt, Human
caaccuccaccuccuagg

SEQ ID NO: 115166 - RNA, 23 nt, Human
caaccuccaccuccuagguucaa

SEQ ID NO: 115167 - RNA, 28 nt, Human
caagcgauucucaugccucagccuccug

SEQ ID NO: 115168 - RNA, 22 nt, Human
cacaacuguagucaaguugaga

SEQ ID NO: 115169 - RNA, 20 nt, Human
caccguagccucccaaagug

SEQ ID NO: 115170 - RNA, 22 nt, Human
cagaguuuuccuuuuuuuuuuu

SEQ ID NO: 115171 - RNA, 22 nt, Human
cagcgacccucucccgcgguuu

SEQ ID NO: 115172 - RNA, 22 nt, Human
cagggggucuccuucgccuucu

SEQ ID NO: 115173 - RNA, 24 nt, Human
cagugguagccuagagaggccgcu

SEQ ID NO: 115174 - RNA, 21 nt, Human
ccaaagugcugggauuacagg

SEQ ID NO: 115175 - RNA, 21 nt, Human
ccaaagugcugggauuacagg

SEQ ID NO: 115176 - RNA, 22 nt, Human
ccaaagugcugggauuacaggu

SEQ ID NO: 115177 - RNA, 24 nt, Human
ccaaagugcugggauuacagguau

SEQ ID NO: 115178 - RNA, 24 nt, Human
ccaccuccuagguucaagcgauuc

SEQ ID NO: 115179 - RNA, 19 nt, Human
ccauguuggccaggcaggu

SEQ ID NO: 115180 - RNA, 22 nt, Human
ccauguuggccaggcaggucuc

SEQ ID NO: 115181 - RNA, 23 nt, Human
ccauguuggccaggcaggucucg

SEQ ID NO: 115182 - RNA, 24 nt, Human
ccccacccuguaaauccucuuucu

SEQ ID NO: 115183 - RNA, 19 nt, Human
ccccccacccuguaaaucc

SEQ ID NO: 115184 - RNA, 21 nt, Human
ccccgacacacccugcugccc

SEQ ID NO: 115185 - RNA, 18 nt, Human
ccccucuguccccccacc

SEQ ID NO: 115186 - RNA, 25 nt, Human
ccccucuguccccccacccuguaaa

SEQ ID NO: 115187 - RNA, 21 nt, Human
ccgacuccgaugucuuaaucc

SEQ ID NO: 115188 - RNA, 19 nt, Human
ccgccacugucucccuucu

SEQ ID NO: 115189 - RNA, 21 nt, Human
ccgcuaacagacaggagccga

SEQ ID NO: 115190 - RNA, 20 nt, Human
ccguagccucccaaagugcu

SEQ ID NO: 115191 - RNA, 23 nt, Human
ccuagguucaagcgauucucaug

SEQ ID NO: 115192 - RNA, 22 nt, Human
ccuccuagguucaagcgauucu

SEQ ID NO: 115193 - RNA, 22 nt, Human
ccucucccgcgguuuccggaag

SEQ ID NO: 115194 - RNA, 19 nt, Human
ccucuuucuuuuucguucc

SEQ ID NO: 115195 - RNA, 18 nt, Human
ccugaagguccccuucuc

SEQ ID NO: 115196 - RNA, 24 nt, Human
ccugagcagcugggacuauaggcg

SEQ ID NO: 115197 - RNA, 24 nt, Human
ccuggccucagaugaucugcccac

SEQ ID NO: 115198 - RNA, 20 nt, Human
ccuucugucuuucugcgucc

SEQ ID NO: 115199 - RNA, 22 nt, Human
cgccuggaaacacgaacuuccg

SEQ ID NO: 115200 - RNA, 21 nt, Human
cuacggcagggggucuccuuc

SEQ ID NO: 115201 - RNA, 18 nt, Human
cuccgggccacagagacg

SEQ ID NO: 115202 - RNA, 21 nt, Human
cugcccuucggacgccuccac

SEQ ID NO: 115203 - RNA, 18 nt, Human
cugcuguggggaaaggag

SEQ ID NO: 115204 - RNA, 19 nt, Human
cugguuccugcugccccuc

SEQ ID NO: 115205 - RNA, 26 nt, Human
cuguaaauccucuuucuuuuucguuc

SEQ ID NO: 115206 - RNA, 19 nt, Human
cuguagucaaguugagaag

SEQ ID NO: 115207 - RNA, 21 nt, Human
cuugcucugucacccaggcug

SEQ ID NO: 115208 - RNA, 28 nt, Human
cuuugccuggaccugaagguccccuucc

SEQ ID NO: 115209 - RNA, 22 nt, Human
cuuuuuuuuuuuuuuuuucaag

SEQ ID NO: 115210 - RNA, 18 nt, Human
gaaagaaagcugcugugg

SEQ ID NO: 115211 - RNA, 20 nt, Human
gaagaccucaaaaaagucaa

SEQ ID NO: 115212 - RNA, 21 nt, Human
gaagcucucauagagauuuau

SEQ ID NO: 115213 - RNA, 20 nt, Human
gaaggugcuguuagaaggag

SEQ ID NO: 115214 - RNA, 26 nt, Human
gagcagcugggacuauaggcgcaugc

SEQ ID NO: 115215 - RNA, 24 nt, Human
gagccccgacacacccugcugccc

SEQ ID NO: 115216 - RNA, 18 nt, Human
gauuacagguaugagcca

SEQ ID NO: 115217 - RNA, 23 nt, Human
gauuacagguaugagccacucca

SEQ ID NO: 115218 - RNA, 24 nt, Human
gauuacagguaugagccacuccac

SEQ ID NO: 115219 - RNA, 22 nt, Human
gcaaccuccaccuccuagguuc

SEQ ID NO: 115220 - RNA, 23 nt, Human
gcagugugcauuuuggaaaacca

SEQ ID NO: 115221 - RNA, 24 nt, Human
gcccuucggacgccuccacgucag

SEQ ID NO: 115222 - RNA, 21 nt, Human
gccuccugagcagcugggacu

SEQ ID NO: 115223 - RNA, 24 nt, Human
gcgauucucaugccucagccuccu

SEQ ID NO: 115224 - RNA, 24 nt, Human
gcucugucacccaggcuggaauga

SEQ ID NO: 115225 - RNA, 21 nt, Human
gcugccccucuguccccccac

SEQ ID NO: 115226 - RNA, 23 nt, Human
gggguguugccauguuggccagg

SEQ ID NO: 115227 - RNA, 22 nt, Human
ggguguugccauguuggccagg

SEQ ID NO: 115228 - RNA, 20 nt, Human
ggucucgaacuccuggccuc

SEQ ID NO: 115229 - RNA, 24 nt, Human
uaauuuuuauauuuuuauuagaga

SEQ ID NO: 115230 - RNA, 24 nt, Human
uacagguaugagccacuccaccca

SEQ ID NO: 115231 - RNA, 21 nt, Human
uagagacgggguguugccaug

SEQ ID NO: 115232 - RNA, 22 nt, Human
uagagacgggguguugccaugu

SEQ ID NO: 115233 - RNA, 18 nt, Human
uagcaggugaggccuccc

SEQ ID NO: 115234 - RNA, 22 nt, Human
uagcugcagggggaaggugcug

SEQ ID NO: 115235 - RNA, 24 nt, Human
uagucacaccaaaauguauuuauu

SEQ ID NO: 115236 - RNA, 24 nt, Human
uauuagagacgggguguugccaug

SEQ ID NO: 115237 - RNA, 22 nt, Human
ucaaauuucugaguacacagag

SEQ ID NO: 115238 - RNA, 24 nt, Human
ucacaccaaaauguauuuauuaca

SEQ ID NO: 115239 - RNA, 26 nt, Human
ucacccaggcuggaaugaagugguau

SEQ ID NO: 115240 - RNA, 25 nt, Human
ucagcgacccucucccgcgguuucc

SEQ ID NO: 115241 - RNA, 23 nt, Human
ucccaaagugcugggauuacagg

SEQ ID NO: 115242 - RNA, 19 nt, Human
uccgagccccgacacaccc

SEQ ID NO: 115243 - RNA, 21 nt, Human
uccuagguucaagcgauucuc

SEQ ID NO: 115244 - RNA, 24 nt, Human
uccuagguucaagcgauucucaug

SEQ ID NO: 115245 - RNA, 24 nt, Human
uccucuuucuuuuucguucccacg

SEQ ID NO: 115246 - RNA, 24 nt, Human
uccugagcagcugggacuauaggc

SEQ ID NO: 115247 - RNA, 18 nt, Human
uccuuuuuuuuuuuuuuu

SEQ ID NO: 115248 - RNA, 18 nt, Human
uccuuuuuuuuuuuuuuu

SEQ ID NO: 115249 - RNA, 21 nt, Human
ucucccgcgguuuccggaagc

SEQ ID NO: 115250 - RNA, 21 nt, Human
ucucccuucugguuccugcug

SEQ ID NO: 115251 - RNA, 19 nt, Human
ucucgaacuccuggccuca

SEQ ID NO: 115252 - RNA, 20 nt, Human
ucucuggggggaacauaugg

SEQ ID NO: 115253 - RNA, 21 nt, Human
ucugaagaguagcugcagggg

SEQ ID NO: 115254 - RNA, 18 nt, Human
ucugucacccaggcugga

SEQ ID NO: 115255 - RNA, 23 nt, Human
ucuugcucugucacccaggcugg

SEQ ID NO: 115256 - RNA, 24 nt, Human
ucuugcucugucacccaggcugga

SEQ ID NO: 115257 - RNA, 22 nt, Human
ugaaugcaaccuccaccuccua

SEQ ID NO: 115258 - RNA, 20 nt, Human
ugacaggaaagaaagcugcu

SEQ ID NO: 115259 - RNA, 18 nt, Human
ugagacagagucuugcuc

SEQ ID NO: 115260 - RNA, 22 nt, Human
ugagacagagucuugcucuguc

SEQ ID NO: 115261 - RNA, 21 nt, Human
ugagccacuccacccagccca

SEQ ID NO: 115262 - RNA, 24 nt, Human
ugaucugcccaccguagccuccca

SEQ ID NO: 115263 - RNA, 27 nt, Human
ugccauguuggccaggcaggucucgaa

SEQ ID NO: 115264 - RNA, 22 nt, Human
ugccucagccuccugagcagcu

SEQ ID NO: 115265 - RNA, 24 nt, Human
ugccucagccuccugagcagcugg

SEQ ID NO: 115266 - RNA, 24 nt, Human
ugcucugucacccaggcuggaaug

SEQ ID NO: 115267 - RNA, 24 nt, Human
ugcugggauuacagguaugagcca

SEQ ID NO: 115268 - RNA, 23 nt, Human
uggaaugaagugguaugaucuca

SEQ ID NO: 115269 - RNA, 24 nt, Human
uggaaugaagugguaugaucucag

SEQ ID NO: 115270 - RNA, 24 nt, Human
uggccaggcaggucucgaacuccu

SEQ ID NO: 115271 - RNA, 20 nt, Human
uggccucagaugaucugccc

SEQ ID NO: 115272 - RNA, 22 nt, Human
ugggacuauaggcgcaugcuac

SEQ ID NO: 115273 - RNA, 24 nt, Human
ugggacuauaggcgcaugcuacca

SEQ ID NO: 115274 - RNA, 25 nt, Human
ugggacuauaggcgcaugcuaccau

SEQ ID NO: 115275 - RNA, 18 nt, Human
ugggauuacagguaugag

SEQ ID NO: 115276 - RNA, 19 nt, Human
ugggauuacagguaugagc

SEQ ID NO: 115277 - RNA, 22 nt, Human
ugggauuacagguaugagccac

SEQ ID NO: 115278 - RNA, 22 nt, Human
ugggauuacagguaugagccac

SEQ ID NO: 115279 - RNA, 23 nt, Human
ugggauuacagguaugagccacu

SEQ ID NO: 115280 - RNA, 24 nt, Human
ugggauuacagguaugagccacuc

SEQ ID NO: 115281 - RNA, 25 nt, Human
ugggauuacagguaugagccacucc

SEQ ID NO: 115282 - RNA, 26 nt, Human
ugggauuacagguaugagccacucca

SEQ ID NO: 115283 - RNA, 18 nt, Human
uggggggaacauauggug

SEQ ID NO: 115284 - RNA, 21 nt, Human
ugucacccaggcuggaaugaa

SEQ ID NO: 115285 - RNA, 19 nt, Human
ugucagugguagccuagag

SEQ ID NO: 115286 - RNA, 22 nt, Human
uguuccuuaaaauaauuaagcu

SEQ ID NO: 115287 - RNA, 24 nt, Human
uuauuagagacgggguguugccau

SEQ ID NO: 115288 - RNA, 23 nt, Human
uucaagcgauucucaugccucag

SEQ ID NO: 115289 - RNA, 20 nt, Human
uuccauagaagagaaaaaga

SEQ ID NO: 115290 - RNA, 22 nt, Human
uucuucaaauuucugaguacac

SEQ ID NO: 115291 - RNA, 19 nt, Human
uugacaggaaagaaagcug

SEQ ID NO: 115292 - RNA, 24 nt, Human
uugccauguuggccaggcaggucu

SEQ ID NO: 115293 - RNA, 24 nt, Human
uuuuucguucccacgacagaaguu

SEQ ID NO: 115294 - RNA, 24 nt, Human
uuuuuuuuuuucaagaagcucuca

SEQ ID NO: 115295 - RNA, 24 nt, Human
uuuuuuuuuuuugagacagagucu

SEQ ID NO: 115296 - RNA, 18 nt, Human
uuuuuuuuuuuuuuuuug

SEQ ID NO: 115297 - RNA, 24 nt, Human
caccagcuccucuuccagccugcg

SEQ ID NO: 115298 - RNA, 24 nt, Human
ccagcuccucuuccagccugcgcc

SEQ ID NO: 115299 - RNA, 22 nt, Human
ccuggccucuguccuggcuuca

SEQ ID NO: 115300 - RNA, 19 nt, Human
cucaccagcuccucuucca

SEQ ID NO: 115301 - RNA, 20 nt, Human
gcuccuggccucuguccugg

SEQ ID NO: 115302 - RNA, 24 nt, Human
ggguggggagggcugcagggcugg

SEQ ID NO: 115303 - RNA, 20 nt, Human
ugcagguggaugccgggugg

SEQ ID NO: 115304 - RNA, 19 nt, Human
ugccggguggggagggcug

SEQ ID NO: 115305 - RNA, 20 nt, Human
uggcuccuggccucuguccu

SEQ ID NO: 115306 - RNA, 22 nt, Human
uggcuucaugguccugacagcu

SEQ ID NO: 115307 - RNA, 20 nt, Human
ugggggugcugggggugggc

SEQ ID NO: 115308 - RNA, 20 nt, Human
aaagucuccccggagcgcag

SEQ ID NO: 115309 - RNA, 19 nt, Human
acacacaaaacauucaaac

SEQ ID NO: 115310 - RNA, 24 nt, Human
agacacccccuccccccaaggaaa

SEQ ID NO: 115311 - RNA, 21 nt, Human
aggaaaaaaaguuggccucau

SEQ ID NO: 115312 - RNA, 21 nt, Human
caaggaaaaaaaguuggccuc

SEQ ID NO: 115313 - RNA, 21 nt, Human
caaucaacccaaccauuagca

SEQ ID NO: 115314 - RNA, 21 nt, Human
caugcucacggcaaaggcuua

SEQ ID NO: 115315 - RNA, 24 nt, Human
ccaguggcgaguccagggucaccc

SEQ ID NO: 115316 - RNA, 20 nt, Human
ccccuccccccaaggaaaug

SEQ ID NO: 115317 - RNA, 25 nt, Human
cccgcggucgcgagggcggcgaggc

SEQ ID NO: 115318 - RNA, 21 nt, Human
ccucaaaagaccuuccaagga

SEQ ID NO: 115319 - RNA, 22 nt, Human
gaacacgcaucccuccuuccac

SEQ ID NO: 115320 - RNA, 19 nt, Human
gcagacacccccucccccc

SEQ ID NO: 115321 - RNA, 23 nt, Human
ggccggcucucagccuggaagcc

SEQ ID NO: 115322 - RNA, 24 nt, Human
ggcgccgcucggaagggcggguac

SEQ ID NO: 115323 - RNA, 19 nt, Human
uacacacaaaacauucaaa

SEQ ID NO: 115324 - RNA, 21 nt, Human
uagauccucaacauacaauca

SEQ ID NO: 115325 - RNA, 22 nt, Human
uagccuacaggauccaccucuc

SEQ ID NO: 115326 - RNA, 24 nt, Human
ucaaacuacuuuuuuuccaucucu

SEQ ID NO: 115327 - RNA, 24 nt, Human
ucuccccggagcgcaggugaaagu

SEQ ID NO: 115328 - RNA, 24 nt, Human
ucuugcuaaccacaaggaaaaaaa

SEQ ID NO: 115329 - RNA, 22 nt, Human
ugaaaguuucaugcaaacucca

SEQ ID NO: 115330 - RNA, 21 nt, Human
ugcagacacccccucccccca

SEQ ID NO: 115331 - RNA, 21 nt, Human
ugccgcuucuuacaggaccuu

SEQ ID NO: 115332 - RNA, 22 nt, Human
uggaacacgcaucccuccuucc

SEQ ID NO: 115333 - RNA, 18 nt, Human
uggaagccuuuuagccua

SEQ ID NO: 115334 - RNA, 24 nt, Human
ugguauacuccuuacacacaaaac

SEQ ID NO: 115335 - RNA, 22 nt, Human
ugugcaugcucacggcaaaggc

SEQ ID NO: 115336 - RNA, 23 nt, Human
ugugcaugcucacggcaaaggcu

SEQ ID NO: 115337 - RNA, 23 nt, Human
uuuuccaucucuugcagucuugc

SEQ ID NO: 115338 - RNA, 21 nt, Human
aaacaacccaugcgcaaagau

SEQ ID NO: 115339 - RNA, 20 nt, Human
aauuugcuucuccaaaguca

SEQ ID NO: 115340 - RNA, 22 nt, Human
accaaguagaauaaaaagaaaa

SEQ ID NO: 115341 - RNA, 26 nt, Human
accaaguagaauaaaaagaaaaaaaa

SEQ ID NO: 115342 - RNA, 19 nt, Human
acucuggcuuccccucccc

SEQ ID NO: 115343 - RNA, 23 nt, Human
agaaaaaaaaaaaaaaacaaccc

SEQ ID NO: 115344 - RNA, 22 nt, Human
agaauaaaaugaaguuaagcag

SEQ ID NO: 115345 - RNA, 22 nt, Human
caaaaguggacucuggcuuccc

SEQ ID NO: 115346 - RNA, 21 nt, Human
caaagcugcacuaucguccca

SEQ ID NO: 115347 - RNA, 22 nt, Human
ccaaagcugcacuaucguccca

SEQ ID NO: 115348 - RNA, 28 nt, Human
ccaaguagaauaaaaagaaaaaaaaaaa

SEQ ID NO: 115349 - RNA, 21 nt, Human
cccaaagcugcacuaucgucc

SEQ ID NO: 115350 - RNA, 25 nt, Human
ccccccaccccucugggauaaaaau

SEQ ID NO: 115351 - RNA, 19 nt, Human
ccccccucccccccacccc

SEQ ID NO: 115352 - RNA, 19 nt, Human
ccccucccccccaccccuc

SEQ ID NO: 115353 - RNA, 20 nt, Human
ccccucugggauaaaaauuu

SEQ ID NO: 115354 - RNA, 21 nt, Human
cccuccccccucccccccacc

SEQ ID NO: 115355 - RNA, 23 nt, Human
cuuccccuccccccuccccccca

SEQ ID NO: 115356 - RNA, 18 nt, Human
gaugccacuagccuaaaa

SEQ ID NO: 115357 - RNA, 24 nt, Human
gcuuccccuccccccuccccccca

SEQ ID NO: 115358 - RNA, 23 nt, Human
guacacauuaaagaauaaaauga

SEQ ID NO: 115359 - RNA, 19 nt, Human
uaauuugcuucuccaaagu

SEQ ID NO: 115360 - RNA, 23 nt, Human
ucagguacacauuaaagaauaaa

SEQ ID NO: 115361 - RNA, 20 nt, Human
uccccccucccccccacccc

SEQ ID NO: 115362 - RNA, 18 nt, Human
uccccuccccccuccccc

SEQ ID NO: 115363 - RNA, 23 nt, Human
ucuggcuuccccuccccccuccc

SEQ ID NO: 115364 - RNA, 20 nt, Human
ugacaaaaguggacucuggc

SEQ ID NO: 115365 - RNA, 19 nt, Human
ugaucugcuggcucagggc

SEQ ID NO: 115366 - RNA, 19 nt, Human
ugccacuagccuaaaagcc

SEQ ID NO: 115367 - RNA, 24 nt, Human
uggcuuccccuccccccucccccc

SEQ ID NO: 115368 - RNA, 22 nt, Human
uuccccuccccccuccccccca

SEQ ID NO: 115369 - RNA, 19 nt, Human
uugcuucuccaaagucauu

SEQ ID NO: 115370 - RNA, 18 nt, Human
agagcugucggacacugu

SEQ ID NO: 115371 - RNA, 24 nt, Human
aggcagacgccauguuuucccucg

SEQ ID NO: 115372 - RNA, 23 nt, Human
caaaacaaaacuuaauuuuuuag

SEQ ID NO: 115373 - RNA, 21 nt, Human
cacuguucacgaacugcucca

SEQ ID NO: 115374 - RNA, 22 nt, Human
cucuuguuuagcucaggaugga

SEQ ID NO: 115375 - RNA, 21 nt, Human
cugcugcccuccgaacacuug

SEQ ID NO: 115376 - RNA, 24 nt, Human
cuggccaagaugguaguuucucuu

SEQ ID NO: 115377 - RNA, 22 nt, Human
gcagagaaaaugguuuucugaa

SEQ ID NO: 115378 - RNA, 23 nt, Human
gcagagaaaaugguuuucugaaa

SEQ ID NO: 115379 - RNA, 19 nt, Human
uccacgacagacuuuaaag

SEQ ID NO: 115380 - RNA, 25 nt, Human
ucuccaggugacacaggcuuggucc

SEQ ID NO: 115381 - RNA, 21 nt, Human
ugguccucucugcugcccucc

SEQ ID NO: 115382 - RNA, 22 nt, Human
ugucacuggccaagaugguagu

SEQ ID NO: 115383 - RNA, 21 nt, Human
aaaaaaccacacacacaaaua

SEQ ID NO: 115384 - RNA, 25 nt, Human
aaaaaaccacacacacaaauacugc

SEQ ID NO: 115385 - RNA, 25 nt, Human
aaaaaaccacacacacaaauacugc

SEQ ID NO: 115386 - RNA, 23 nt, Human
aaaaaagaaagaaauauaaaaag

SEQ ID NO: 115387 - RNA, 23 nt, Human
aaaaccacacacacaaauacugc

SEQ ID NO: 115388 - RNA, 23 nt, Human
aaaagagaaaggaaaagaagaaa

SEQ ID NO: 115389 - RNA, 25 nt, Human
aaaaggguacuugggcacgacacaa

SEQ ID NO: 115390 - RNA, 20 nt, Human
aaaaguagcacuuuuuaaaa

SEQ ID NO: 115391 - RNA, 22 nt, Human
aaacauacacagugcugucccu

SEQ ID NO: 115392 - RNA, 20 nt, Human
aaagaaagaaauauaaaaaa

SEQ ID NO: 115393 - RNA, 21 nt, Human
aaaguagcaaaauacaaagga

SEQ ID NO: 115394 - RNA, 19 nt, Human
aagaaagaaauauaaaaag

SEQ ID NO: 115395 - RNA, 22 nt, Human
aagaaagaaauauaaaaagcaa

SEQ ID NO: 115396 - RNA, 20 nt, Human
aaggaaaagaagaaauacga

SEQ ID NO: 115397 - RNA, 26 nt, Human
aaucaucugaagcacaggauaaccga

SEQ ID NO: 115398 - RNA, 22 nt, Human
acagugcugucccuuucaaauu

SEQ ID NO: 115399 - RNA, 22 nt, Human
acuuaaaacaucaaaaaagcuu

SEQ ID NO: 115400 - RNA, 19 nt, Human
agaaaagagaaaggaaaag

SEQ ID NO: 115401 - RNA, 21 nt, Human
agaaaagagaaaggaaaagaa

SEQ ID NO: 115402 - RNA, 24 nt, Human
agaaagaaauauaaaaagcaaugu

SEQ ID NO: 115403 - RNA, 23 nt, Human
agaaauauaaaaagcaauguggc

SEQ ID NO: 115404 - RNA, 22 nt, Human
agaagacuccaugaaaugagag

SEQ ID NO: 115405 - RNA, 25 nt, Human
aggaaaagaagaaauacgacgugag

SEQ ID NO: 115406 - RNA, 24 nt, Human
caaaaaagcuuucugauaaaaagc

SEQ ID NO: 115407 - RNA, 24 nt, Human
caacauuaaaaaagaaagaaauau

SEQ ID NO: 115408 - RNA, 20 nt, Human
cacaaauacugcaaaguagc

SEQ ID NO: 115409 - RNA, 22 nt, Human
cacacacaaauacugcaaagua

SEQ ID NO: 115410 - RNA, 19 nt, Human
caccaauaaccagcuccca

SEQ ID NO: 115411 - RNA, 24 nt, Human
caccaauaaccagcucccaagcac

SEQ ID NO: 115412 - RNA, 23 nt, Human
cacgacacaaucagaauuaguuu

SEQ ID NO: 115413 - RNA, 18 nt, Human
cagucaucaaaaugacca

SEQ ID NO: 115414 - RNA, 20 nt, Human
cagucaucaaaaugaccagg

SEQ ID NO: 115415 - RNA, 25 nt, Human
caucugaagcacaggauaaccuuga

SEQ ID NO: 115416 - RNA, 27 nt, Human
ccuccaaccgcugccgccuccagccug

SEQ ID NO: 115417 - RNA, 21 nt, Human
ccucccuuuccgcccucccua

SEQ ID NO: 115418 - RNA, 18 nt, Human
ccugaggcgccgccgccg

SEQ ID NO: 115419 - RNA, 22 nt, Human
cuccaaauggcagugccucccu

SEQ ID NO: 115420 - RNA, 18 nt, Human
cucccuuuccgcccuccc

SEQ ID NO: 115421 - RNA, 20 nt, Human
cuugcucccauuuuuucugu

SEQ ID NO: 115422 - RNA, 20 nt, Human
cuuuugguuuuggcaacauu

SEQ ID NO: 115423 - RNA, 20 nt, Human
gaagacuccaugaaaugaga

SEQ ID NO: 115424 - RNA, 20 nt, Human
gauuauaaucaucugaagca

SEQ ID NO: 115425 - RNA, 21 nt, Human
gcaacauuaaaaaagaaagaa

SEQ ID NO: 115426 - RNA, 20 nt, Human
gccgccgaaguccccgcugc

SEQ ID NO: 115427 - RNA, 21 nt, Human
gccgccuccagccuggcacug

SEQ ID NO: 115428 - RNA, 24 nt, Human
ggaccacaccaauaaccagcuccc

SEQ ID NO: 115429 - RNA, 18 nt, Human
ggcgaagccuccaaccgc

SEQ ID NO: 115430 - RNA, 24 nt, Human
gugagcuuuuuugaucagaagacu

SEQ ID NO: 115431 - RNA, 22 nt, Human
uaaaaaagaaagaaauauaaaa

SEQ ID NO: 115432 - RNA, 23 nt, Human
uaaaaagcucagcuuuuaaauca

SEQ ID NO: 115433 - RNA, 19 nt, Human
uaaccagcucccaagcaca

SEQ ID NO: 115434 - RNA, 23 nt, Human
uaaccagcucccaagcacaaguu

SEQ ID NO: 115435 - RNA, 19 nt, Human
uaaggaaaaaaaaccacac

SEQ ID NO: 115436 - RNA, 20 nt, Human
uacaaaggaaaacaaagcua

SEQ ID NO: 115437 - RNA, 19 nt, Human
uacugcaaaguagcaaaau

SEQ ID NO: 115438 - RNA, 22 nt, Human
uagaaaagagaaaggaaaagaa

SEQ ID NO: 115439 - RNA, 20 nt, Human
uaggaccacaccaauaacca

SEQ ID NO: 115440 - RNA, 23 nt, Human
uccccgcugcaaagccgggcgaa

SEQ ID NO: 115441 - RNA, 20 nt, Human
uccgggccgaggugccugag

SEQ ID NO: 115442 - RNA, 21 nt, Human
uccgggccgaggugccugagg

SEQ ID NO: 115443 - RNA, 22 nt, Human
uccgggccgaggugccugaggc

SEQ ID NO: 115444 - RNA, 19 nt, Human
ucuccaaauggcagugccu

SEQ ID NO: 115445 - RNA, 22 nt, Human
ugaaauggaaugucuccaaaug

SEQ ID NO: 115446 - RNA, 18 nt, Human
ugaggcgccgccgccgaa

SEQ ID NO: 115447 - RNA, 22 nt, Human
ugauaaaaagcucagcuuuuaa

SEQ ID NO: 115448 - RNA, 20 nt, Human
ugcuuugauuguucucagau

SEQ ID NO: 115449 - RNA, 24 nt, Human
uggcaacauuaaaaaagaaagaaa

SEQ ID NO: 115450 - RNA, 24 nt, Human
uguccgggccgaggugccugaggc

SEQ ID NO: 115451 - RNA, 21 nt, Human
uugguuuuggcaacauuaaaa

SEQ ID NO: 115452 - RNA, 22 nt, Human
uuucaagucuuccuguuguaca

SEQ ID NO: 115453 - RNA, 19 nt, Human
uuucugcaaauuugggaga

SEQ ID NO: 115454 - RNA, 23 nt, Human
uuuucuguagggguggggguggg

SEQ ID NO: 115455 - RNA, 19 nt, Human
aaacagaaaaacggcacca

SEQ ID NO: 115456 - RNA, 23 nt, Human
aaacucccgaccucaagcaaucc

SEQ ID NO: 115457 - RNA, 20 nt, Human
aaaugccucugcucacccuu

SEQ ID NO: 115458 - RNA, 21 nt, Human
aacagcuggcaggagaggaug

SEQ ID NO: 115459 - RNA, 18 nt, Human
aauuacaggcgugagcca

SEQ ID NO: 115460 - RNA, 22 nt, Human
aauuacaggcgugagccacugc

SEQ ID NO: 115461 - RNA, 22 nt, Human
aauuacaggcgugagccacugc

SEQ ID NO: 115462 - RNA, 24 nt, Human
accauguuggucaggcuggucucg

SEQ ID NO: 115463 - RNA, 18 nt, Human
accucgugauccaccagc

SEQ ID NO: 115464 - RNA, 23 nt, Human
acugguuucaaacucccgaccuc

SEQ ID NO: 115465 - RNA, 20 nt, Human
agaaggcaaacagaaaaacg

SEQ ID NO: 115466 - RNA, 24 nt, Human
agagugcugggauuacaggcauga

SEQ ID NO: 115467 - RNA, 21 nt, Human
agcaauccgcccaccucagcc

SEQ ID NO: 115468 - RNA, 28 nt, Human
aggcaggaggccagacugaaggucgacc

SEQ ID NO: 115469 - RNA, 19 nt, Human
aggcugggccugcaggcca

SEQ ID NO: 115470 - RNA, 20 nt, Human
agggugaggagggcagaggu

SEQ ID NO: 115471 - RNA, 21 nt, Human
agguggcgguggcggcggcgg

SEQ ID NO: 115472 - RNA, 22 nt, Human
aguagagaugggguuucaccau

SEQ ID NO: 115473 - RNA, 18 nt, Human
agugcugggauuacaggc

SEQ ID NO: 115474 - RNA, 20 nt, Human
agugcugggauuacaggcau

SEQ ID NO: 115475 - RNA, 22 nt, Human
agugcugggauuacaggcauga

SEQ ID NO: 115476 - RNA, 21 nt, Human
augggguuucaccauguuggu

SEQ ID NO: 115477 - RNA, 23 nt, Human
augggguuucaccauguugguca

SEQ ID NO: 115478 - RNA, 24 nt, Human
augggguuucaccauguuggucag

SEQ ID NO: 115479 - RNA, 23 nt, Human
caaauuucaagugccagcagccu

SEQ ID NO: 115480 - RNA, 21 nt, Human
caacagaaggcaucaucugaa

SEQ ID NO: 115481 - RNA, 24 nt, Human
caacaugcuggaauuacaggcgug

SEQ ID NO: 115482 - RNA, 19 nt, Human
caaccuagauccuuccagc

SEQ ID NO: 115483 - RNA, 20 nt, Human
caagaaggcaaacagaaaaa

SEQ ID NO: 115484 - RNA, 18 nt, Human
cacagacaggucaaccua

SEQ ID NO: 115485 - RNA, 18 nt, Human
caccagccucggccuccc

SEQ ID NO: 115486 - RNA, 21 nt, Human
caccauguuggucaggcuggu

SEQ ID NO: 115487 - RNA, 24 nt, Human
caccauguuggucaggcuggucuc

SEQ ID NO: 115488 - RNA, 24 nt, Human
caccucagccucccagagugcugg

SEQ ID NO: 115489 - RNA, 21 nt, Human
cagacugauugcccuucucaa

SEQ ID NO: 115490 - RNA, 24 nt, Human
cagagugcugggauuacaggcaug

SEQ ID NO: 115491 - RNA, 20 nt, Human
cagguggcgguggcggcggc

SEQ ID NO: 115492 - RNA, 22 nt, Human
ccaacaugcuggaauuacaggc

SEQ ID NO: 115493 - RNA, 24 nt, Human
ccaacaugcuggaauuacaggcgu

SEQ ID NO: 115494 - RNA, 21 nt, Human
ccagaaaggcaggaggccaga

SEQ ID NO: 115495 - RNA, 23 nt, Human
ccagagugcugggauuacaggca

SEQ ID NO: 115496 - RNA, 24 nt, Human
ccagagugcugggauuacaggcau

SEQ ID NO: 115497 - RNA, 20 nt, Human
ccaggcugggccugcaggcc

SEQ ID NO: 115498 - RNA, 24 nt, Human
cccagagugcugggauuacaggca

SEQ ID NO: 115499 - RNA, 24 nt, Human
cccgaccucaagcaauccgcccac

SEQ ID NO: 115500 - RNA, 22 nt, Human
cccugagggugaggagggcaga

SEQ ID NO: 115501 - RNA, 21 nt, Human
ccgcccaccucagccucccag

SEQ ID NO: 115502 - RNA, 25 nt, Human
ccgcccaccucagccucccagagug

SEQ ID NO: 115503 - RNA, 18 nt, Human
ccgcgcuccucgccgccc

SEQ ID NO: 115504 - RNA, 23 nt, Human
ccgcgcuccucgccgcccgccga

SEQ ID NO: 115505 - RNA, 25 nt, Human
ccucucugcuuccagccuccaggag

SEQ ID NO: 115506 - RNA, 25 nt, Human
cgaccucaagcaauccgcccaccuc

SEQ ID NO: 115507 - RNA, 21 nt, Human
cggcggcguccagcuccggcu

SEQ ID NO: 115508 - RNA, 24 nt, Human
cgugauccaccagccucggccucc

SEQ ID NO: 115509 - RNA, 21 nt, Human
cucaagcaauccgcccaccuc

SEQ ID NO: 115510 - RNA, 24 nt, Human
cucaagcaauccgcccaccucagc

SEQ ID NO: 115511 - RNA, 22 nt, Human
cucacccuuaaucaguucccca

SEQ ID NO: 115512 - RNA, 23 nt, Human
cucccgaccucaagcaauccgcc

SEQ ID NO: 115513 - RNA, 20 nt, Human
cuccgcgcuccucgccgccc

SEQ ID NO: 115514 - RNA, 19 nt, Human
cucugcuuccagccuccag

SEQ ID NO: 115515 - RNA, 18 nt, Human
cugcugaccucgugaucc

SEQ ID NO: 115516 - RNA, 24 nt, Human
cuuccccuauucucuggaccacag

SEQ ID NO: 115517 - RNA, 24 nt, Human
gaccucaagcaauccgcccaccuc

SEQ ID NO: 115518 - RNA, 22 nt, Human
gaccucgugauccaccagccuc

SEQ ID NO: 115519 - RNA, 22 nt, Human
gaccucgugauccaccagccuc

SEQ ID NO: 115520 - RNA, 24 nt, Human
gaccucgugauccaccagccucgg

SEQ ID NO: 115521 - RNA, 24 nt, Human
gagaugggguuucaccauguuggu

SEQ ID NO: 115522 - RNA, 18 nt, Human
gagggugaggagggcaga

SEQ ID NO: 115523 - RNA, 19 nt, Human
gagugcugggauuacaggc

SEQ ID NO: 115524 - RNA, 18 nt, Human
gauuacaggcaugagcca

SEQ ID NO: 115525 - RNA, 22 nt, Human
gauuacaggcaugagccacugc

SEQ ID NO: 115526 - RNA, 22 nt, Human
gauuacaggcaugagccacugc

SEQ ID NO: 115527 - RNA, 21 nt, Human
gcaaacagaaaaacggcacca

SEQ ID NO: 115528 - RNA, 26 nt, Human
gcgguggcggcggcggcguccagcuc

SEQ ID NO: 115529 - RNA, 22 nt, Human
gcuccggcuccgcgcuccucgc

SEQ ID NO: 115530 - RNA, 24 nt, Human
gcuuccagccuccaggagcuccac

SEQ ID NO: 115531 - RNA, 18 nt, Human
ggacuugugguuugguuc

SEQ ID NO: 115532 - RNA, 22 nt, Human
ggauuacaggcaugagccacug

SEQ ID NO: 115533 - RNA, 18 nt, Human
ggcccuuaauaacagaau

SEQ ID NO: 115534 - RNA, 22 nt, Human
gggguuucaccauguuggucag

SEQ ID NO: 115535 - RNA, 19 nt, Human
ggucucgaacugcugaccu

SEQ ID NO: 115536 - RNA, 23 nt, Human
guagagaugggguuucaccaugu

SEQ ID NO: 115537 - RNA, 24 nt, Human
gugauccaccagccucggccuccc

SEQ ID NO: 115538 - RNA, 20 nt, Human
guggcgguggcggcggcggc

SEQ ID NO: 115539 - RNA, 20 nt, Human
guggcgguggcggcggcggc

SEQ ID NO: 115540 - RNA, 25 nt, Human
gugucccugagggugaggagggcag

SEQ ID NO: 115541 - RNA, 22 nt, Human
guuugguucuaaaccuccccau

SEQ ID NO: 115542 - RNA, 20 nt, Human
uaaauuguuuguccaggcug

SEQ ID NO: 115543 - RNA, 22 nt, Human
uacaggcgugagccacugcgcc

SEQ ID NO: 115544 - RNA, 23 nt, Human
uacaggcgugagccacugcgccu

SEQ ID NO: 115545 - RNA, 19 nt, Human
uaccuccucucugcuucca

SEQ ID NO: 115546 - RNA, 22 nt, Human
uaccuccucucugcuuccagcc

SEQ ID NO: 115547 - RNA, 22 nt, Human
uagagaugggguuucaccaugu

SEQ ID NO: 115548 - RNA, 24 nt, Human
uaguagagaugggguuucaccaug

SEQ ID NO: 115549 - RNA, 25 nt, Human
uaguagagaugggguuucaccaugu

SEQ ID NO: 115550 - RNA, 26 nt, Human
uaguagagaugggguuucaccauguu

SEQ ID NO: 115551 - RNA, 24 nt, Human
uccaccagccucggccucccaaca

SEQ ID NO: 115552 - RNA, 24 nt, Human
ucccagagugcugggauuacaggc

SEQ ID NO: 115553 - RNA, 23 nt, Human
uccccaggcagagucugcaacag

SEQ ID NO: 115554 - RNA, 20 nt, Human
ucccugagggugaggagggc

SEQ ID NO: 115555 - RNA, 24 nt, Human
ucccugagggugaggagggcagag

SEQ ID NO: 115556 - RNA, 21 nt, Human
uccgcccaccucagccuccca

SEQ ID NO: 115557 - RNA, 22 nt, Human
uccgcccaccucagccucccag

SEQ ID NO: 115558 - RNA, 19 nt, Human
uccuugaggggacuugugg

SEQ ID NO: 115559 - RNA, 20 nt, Human
ucgccgcccgccgacucccg

SEQ ID NO: 115560 - RNA, 18 nt, Human
ugaaaacaaagucaauuc

SEQ ID NO: 115561 - RNA, 19 nt, Human
ugcaacagcuggcaggaga

SEQ ID NO: 115562 - RNA, 24 nt, Human
ugcaagaaggcaaacagaaaaacg

SEQ ID NO: 115563 - RNA, 26 nt, Human
ugcaagaaggcaaacagaaaaacggc

SEQ ID NO: 115564 - RNA, 21 nt, Human
ugccagcagccuggguuuaug

SEQ ID NO: 115565 - RNA, 24 nt, Human
ugcuggaauuacaggcgugagcca

SEQ ID NO: 115566 - RNA, 19 nt, Human
uggaauuacaggcgugagc

SEQ ID NO: 115567 - RNA, 21 nt, Human
uggaauuacaggcgugagcca

SEQ ID NO: 115568 - RNA, 22 nt, Human
uggaauuacaggcgugagccac

SEQ ID NO: 115569 - RNA, 22 nt, Human
uggaauuacaggcgugagccac

SEQ ID NO: 115570 - RNA, 24 nt, Human
uggaauuacaggcgugagccacug

SEQ ID NO: 115571 - RNA, 24 nt, Human
uggaauuacaggcgugagccacug

SEQ ID NO: 115572 - RNA, 18 nt, Human
uggcgguggcggcggcgg

SEQ ID NO: 115573 - RNA, 18 nt, Human
ugggauuacaggcaugag

SEQ ID NO: 115574 - RNA, 19 nt, Human
ugggauuacaggcaugagc

SEQ ID NO: 115575 - RNA, 21 nt, Human
ugggauuacaggcaugagcca

SEQ ID NO: 115576 - RNA, 22 nt, Human
ugggauuacaggcaugagccac

SEQ ID NO: 115577 - RNA, 22 nt, Human
ugggauuacaggcaugagccac

SEQ ID NO: 115578 - RNA, 23 nt, Human
ugggauuacaggcaugagccacu

SEQ ID NO: 115579 - RNA, 24 nt, Human
ugggauuacaggcaugagccacug

SEQ ID NO: 115580 - RNA, 24 nt, Human
ugggauuacaggcaugagccacug

SEQ ID NO: 115581 - RNA, 19 nt, Human
ugggccugcaggccagaaa

SEQ ID NO: 115582 - RNA, 24 nt, Human
ugggguuucaccauguuggucagg

SEQ ID NO: 115583 - RNA, 24 nt, Human
uggucaggcuggucucgaacugcu

SEQ ID NO: 115584 - RNA, 22 nt, Human
ugucccacuggaaucucuuuca

SEQ ID NO: 115585 - RNA, 23 nt, Human
uguucuuuccucuugagaaguua

SEQ ID NO: 115586 - RNA, 18 nt, Human
uuaguagagaugggguuu

SEQ ID NO: 115587 - RNA, 22 nt, Human
uuaguagagaugggguuucacc

SEQ ID NO: 115588 - RNA, 24 nt, Human
uuaguagagaugggguuucaccau

SEQ ID NO: 115589 - RNA, 24 nt, Human
uuucaccauguuggucaggcuggu

SEQ ID NO: 115590 - RNA, 24 nt, Human
uuuuuaguagagaugggguuucac

SEQ ID NO: 115591 - RNA, 23 nt, Human
uuuuuuaguagagaugggguuuc

SEQ ID NO: 115592 - RNA, 24 nt, Human
uuuuuuuuuuuuuuaguagagaug

SEQ ID NO: 115593 - RNA, 26 nt, Human
uuuuuuuuuuuuuuuuaguagagaug

SEQ ID NO: 115594 - RNA, 18 nt, Human
aagcaggagaauugcuug

SEQ ID NO: 115595 - RNA, 24 nt, Human
aagcaggagaauugcuugaaccca

SEQ ID NO: 115596 - RNA, 21 nt, Human
aagcuucagaggaaacaaacu

SEQ ID NO: 115597 - RNA, 20 nt, Human
aauugcuugaacccagacgg

SEQ ID NO: 115598 - RNA, 25 nt, Human
acaagcuucagaggaaagggaacgc

SEQ ID NO: 115599 - RNA, 20 nt, Human
accccgcugcagcagucaag

SEQ ID NO: 115600 - RNA, 24 nt, Human
acugcacuccagcuugggcaacag

SEQ ID NO: 115601 - RNA, 24 nt, Human
agacggcagagguugcagugagcc

SEQ ID NO: 115602 - RNA, 20 nt, Human
agaggccugggagccugggg

SEQ ID NO: 115603 - RNA, 24 nt, Human
agagguugcagugagccgagaucg

SEQ ID NO: 115604 - RNA, 24 nt, Human
agcuugggcaacagaaugagacuc

SEQ ID NO: 115605 - RNA, 24 nt, Human
aggcugaagcaggagaauugcuug

SEQ ID NO: 115606 - RNA, 21 nt, Human
agggcugccagcuaagaccau

SEQ ID NO: 115607 - RNA, 24 nt, Human
aucgcgccacugcacuccagcuug

SEQ ID NO: 115608 - RNA, 18 nt, Human
cacccucuagcccugccu

SEQ ID NO: 115609 - RNA, 18 nt, Human
cacugcacuccagcuugg

SEQ ID NO: 115610 - RNA, 19 nt, Human
cacugcacuccagcuuggg

SEQ ID NO: 115611 - RNA, 21 nt, Human
cacugcacuccagcuugggca

SEQ ID NO: 115612 - RNA, 23 nt, Human
cacugcacuccagcuugggcaac

SEQ ID NO: 115613 - RNA, 24 nt, Human
cacugcacuccagcuugggcaaca

SEQ ID NO: 115614 - RNA, 20 nt, Human
ccacugcacuccagcuuggg

SEQ ID NO: 115615 - RNA, 21 nt, Human
ccacugcacuccagcuugggc

SEQ ID NO: 115616 - RNA, 23 nt, Human
ccacugcacuccagcuugggcaa

SEQ ID NO: 115617 - RNA, 24 nt, Human
ccacugcacuccagcuugggcaac

SEQ ID NO: 115618 - RNA, 24 nt, Human
ccagcuaagaccaugaaggcugua

SEQ ID NO: 115619 - RNA, 18 nt, Human
cccucuagcccugccucc

SEQ ID NO: 115620 - RNA, 21 nt, Human
ccucuagcccugccucccuca

SEQ ID NO: 115621 - RNA, 22 nt, Human
ccuucuagcuccgaaauuccag

SEQ ID NO: 115622 - RNA, 24 nt, Human
cgccacugcacuccagcuugggca

SEQ ID NO: 115623 - RNA, 22 nt, Human
cgcgccacugcacuccagcuug

SEQ ID NO: 115624 - RNA, 26 nt, Human
cuagucacccucuagcccugccuccc

SEQ ID NO: 115625 - RNA, 22 nt, Human
cucuagcccugccucccucauu

SEQ ID NO: 115626 - RNA, 26 nt, Human
cuucuagcuccgaaauuccaggcauc

SEQ ID NO: 115627 - RNA, 23 nt, Human
gagaucgcgccacugcacuccag

SEQ ID NO: 115628 - RNA, 22 nt, Human
gccacugcacuccagcuugggc

SEQ ID NO: 115629 - RNA, 24 nt, Human
gccacugcacuccagcuugggcaa

SEQ ID NO: 115630 - RNA, 20 nt, Human
gccgagaucgcgccacugca

SEQ ID NO: 115631 - RNA, 23 nt, Human
gcuccgaaauuccaggcaucuga

SEQ ID NO: 115632 - RNA, 18 nt, Human
ggcagagguugcagugag

SEQ ID NO: 115633 - RNA, 20 nt, Human
ggcagagguugcagugagcc

SEQ ID NO: 115634 - RNA, 23 nt, Human
ggcagagguugcagugagccgag

SEQ ID NO: 115635 - RNA, 19 nt, Human
guugcagugagccgagauc

SEQ ID NO: 115636 - RNA, 21 nt, Human
guugcagugagccgagaucgc

SEQ ID NO: 115637 - RNA, 21 nt, Human
uaacgggaaucugacuaccuu

SEQ ID NO: 115638 - RNA, 21 nt, Human
uaugccacaugggggccacgg

SEQ ID NO: 115639 - RNA, 22 nt, Human
uaugccacaugggggccacggg

SEQ ID NO: 115640 - RNA, 21 nt, Human
ucaagauaacgggaaucugac

SEQ ID NO: 115641 - RNA, 24 nt, Human
uccagcuugggcaacagaaugaga

SEQ ID NO: 115642 - RNA, 20 nt, Human
ucccagagaccccgcugcag

SEQ ID NO: 115643 - RNA, 23 nt, Human
ucgggaggcugaagcaggagaau

SEQ ID NO: 115644 - RNA, 24 nt, Human
ugaacccagacggcagagguugca

SEQ ID NO: 115645 - RNA, 24 nt, Human
ugaagcaggagaauugcuugaacc

SEQ ID NO: 115646 - RNA, 25 nt, Human
ugaagcaggagaauugcuugaaccc

SEQ ID NO: 115647 - RNA, 22 nt, Human
ugagccgagaucgcgccacugc

SEQ ID NO: 115648 - RNA, 21 nt, Human
ugcacagaugggccgugugga

SEQ ID NO: 115649 - RNA, 19 nt, Human
ugggaggccuggcugcuag

SEQ ID NO: 115650 - RNA, 22 nt, Human
uuaugccacaugggggccacgg

SEQ ID NO: 115651 - RNA, 23 nt, Human
uuaugccacaugggggccacggg

SEQ ID NO: 115652 - RNA, 20 nt, Human
uucagaggaaacaaacuugu

SEQ ID NO: 115653 - RNA, 18 nt, Human
uugcagugagccgagauc

SEQ ID NO: 115654 - RNA, 19 nt, Human
uugcagugagccgagaucg

SEQ ID NO: 115655 - RNA, 22 nt, Human
uugcagugagccgagaucgcgc

SEQ ID NO: 115656 - RNA, 23 nt, Human
aaccacaaaaaaaaucuuuauca

SEQ ID NO: 115657 - RNA, 18 nt, Human
aagaaaagcccagugccc

SEQ ID NO: 115658 - RNA, 19 nt, Human
cacccugcugcugcucuuc

SEQ ID NO: 115659 - RNA, 24 nt, Human
cagucgaaccacaaaaaaaaucuu

SEQ ID NO: 115660 - RNA, 21 nt, Human
cauaaugaacaucagaagaaa

SEQ ID NO: 115661 - RNA, 20 nt, Human
ccagcaccauaaugaacauc

SEQ ID NO: 115662 - RNA, 23 nt, Human
ccagcaccauaaugaacaucaga

SEQ ID NO: 115663 - RNA, 21 nt, Human
ccagucgaaccacaaaaaaaa

SEQ ID NO: 115664 - RNA, 21 nt, Human
cccgcacucagcacaguccag

SEQ ID NO: 115665 - RNA, 21 nt, Human
cccugcugcugcucuuccuuc

SEQ ID NO: 115666 - RNA, 20 nt, Human
ccugcugcugcucuuccuuc

SEQ ID NO: 115667 - RNA, 20 nt, Human
cucccacccugcugcugcuc

SEQ ID NO: 115668 - RNA, 18 nt, Human
gaaccacaaaaaaaaucu

SEQ ID NO: 115669 - RNA, 24 nt, Human
gggaaggaggagaggaaagaucac

SEQ ID NO: 115670 - RNA, 19 nt, Human
ucaaagacagagcuuccca

SEQ ID NO: 115671 - RNA, 24 nt, Human
ucgaaccacaaaaaaaaucuuuau

SEQ ID NO: 115672 - RNA, 21 nt, Human
ugacuggagcuucucucccac

SEQ ID NO: 115673 - RNA, 21 nt, Human
ugacuugggaaggaggagagg

SEQ ID NO: 115674 - RNA, 23 nt, Human
uggcagcccugaaaucaauguuu

SEQ ID NO: 115675 - RNA, 18 nt, Human
uuacucaagacacgucag

SEQ ID NO: 115676 - RNA, 21 nt, Human
aaaaaugcaggcccuggcuca

SEQ ID NO: 115677 - RNA, 21 nt, Human
aaaauucccagaacccugcuu

SEQ ID NO: 115678 - RNA, 18 nt, Human
aaacagaauagagggugg

SEQ ID NO: 115679 - RNA, 24 nt, Human
aaacagaauagagggugggguugg

SEQ ID NO: 115680 - RNA, 22 nt, Human
aacugcuuccaacagugucuau

SEQ ID NO: 115681 - RNA, 19 nt, Human
aagaaacagaauagagggu

SEQ ID NO: 115682 - RNA, 21 nt, Human
aagaaacagaauagagggugg

SEQ ID NO: 115683 - RNA, 20 nt, Human
aauaccugggggcagccaag

SEQ ID NO: 115684 - RNA, 22 nt, Human
accccgaccaaugaaucccuac

SEQ ID NO: 115685 - RNA, 20 nt, Human
acucugcugggcauguggag

SEQ ID NO: 115686 - RNA, 19 nt, Human
agaacccugcuucuggcuc

SEQ ID NO: 115687 - RNA, 20 nt, Human
agaauagagggugggguugg

SEQ ID NO: 115688 - RNA, 24 nt, Human
agacagcagaucaugaggcucaca

SEQ ID NO: 115689 - RNA, 19 nt, Human
agagauguauaaagacccu

SEQ ID NO: 115690 - RNA, 18 nt, Human
agaggaagcuguguaugu

SEQ ID NO: 115691 - RNA, 22 nt, Human
agagggugggguuggaggagag

SEQ ID NO: 115692 - RNA, 21 nt, Human
agagguacaguaauggggugg

SEQ ID NO: 115693 - RNA, 18 nt, Human
agaugggacucugcagac

SEQ ID NO: 115694 - RNA, 20 nt, Human
agcacacccuucuuccuaac

SEQ ID NO: 115695 - RNA, 19 nt, Human
aggaaaagagaaucaauga

SEQ ID NO: 115696 - RNA, 21 nt, Human
aggaagaaacagaauagaggg

SEQ ID NO: 115697 - RNA, 26 nt, Human
aggaagaaacagaauagaggggaccc

SEQ ID NO: 115698 - RNA, 21 nt, Human
aggaagcuguguauguguacc

SEQ ID NO: 115699 - RNA, 21 nt, Human
aggauggaaccaaaagaggaa

SEQ ID NO: 115700 - RNA, 23 nt, Human
aggauggacauguauuuuucacc

SEQ ID NO: 115701 - RNA, 18 nt, Human
aggccuuugagggaccug

SEQ ID NO: 115702 - RNA, 24 nt, Human
auaccugggggcagccaagaggga

SEQ ID NO: 115703 - RNA, 23 nt, Human
caaaauucccagaacccugcuuc

SEQ ID NO: 115704 - RNA, 20 nt, Human
caacagugucuauauguuaa

SEQ ID NO: 115705 - RNA, 21 nt, Human
caaggcaaacauguggaaucc

SEQ ID NO: 115706 - RNA, 22 nt, Human
cacaaaggacuaaaaagcugca

SEQ ID NO: 115707 - RNA, 23 nt, Human
cacaaaggacuaaaaagcugcag

SEQ ID NO: 115708 - RNA, 23 nt, Human
cacaccuggccacaggauaacuu

SEQ ID NO: 115709 - RNA, 18 nt, Human
cacgggacgcugggcgcc

SEQ ID NO: 115710 - RNA, 19 nt, Human
cagaauagagggugggguu

SEQ ID NO: 115711 - RNA, 20 nt, Human
cagaggaguggcgacccaca

SEQ ID NO: 115712 - RNA, 19 nt, Human
cagcagugcccugggagac

SEQ ID NO: 115713 - RNA, 25 nt, Human
cagcagugcccugggagacugagua

SEQ ID NO: 115714 - RNA, 18 nt, Human
caggggcuggcaguccag

SEQ ID NO: 115715 - RNA, 18 nt, Human
cagucaccaggaaggggg

SEQ ID NO: 115716 - RNA, 19 nt, Human
cagugcacagcagccgggu

SEQ ID NO: 115717 - RNA, 22 nt, Human
cauccugucaagcuucaagacc

SEQ ID NO: 115718 - RNA, 18 nt, Human
cauguggaauccccaguc

SEQ ID NO: 115719 - RNA, 18 nt, Human
ccagacauuccuaugcaa

SEQ ID NO: 115720 - RNA, 21 nt, Human
ccagcagugcccugggagacu

SEQ ID NO: 115721 - RNA, 18 nt, Human
ccagugcacagcagccgg

SEQ ID NO: 115722 - RNA, 22 nt, Human
cccaagggacaggaaugugagc

SEQ ID NO: 115723 - RNA, 20 nt, Human
ccccgaccaaugaaucccua

SEQ ID NO: 115724 - RNA, 26 nt, Human
cccgccccccugugggaaggagaccc

SEQ ID NO: 115725 - RNA, 20 nt, Human
ccuggcagcggagggaaagg

SEQ ID NO: 115726 - RNA, 18 nt, Human
cgagaccacaccuggcca

SEQ ID NO: 115727 - RNA, 19 nt, Human
cggaccagcagugcccugg

SEQ ID NO: 115728 - RNA, 22 nt, Human
cgggcuccgaaaggagagcgug

SEQ ID NO: 115729 - RNA, 18 nt, Human
cgucacuuccggcgggcg

SEQ ID NO: 115730 - RNA, 20 nt, Human
cuggccaccaagugccacuc

SEQ ID NO: 115731 - RNA, 20 nt, Human
cuguguauguguacccccau

SEQ ID NO: 115732 - RNA, 22 nt, Human
cuuccccgccccccugugggag

SEQ ID NO: 115733 - RNA, 21 nt, Human
cuugagacucccaaggcaaag

SEQ ID NO: 115734 - RNA, 23 nt, Human
cuuucuggccaccaagugccacu

SEQ ID NO: 115735 - RNA, 19 nt, Human
gaaaacauccugucaagcu

SEQ ID NO: 115736 - RNA, 22 nt, Human
gaaaggagagcguggugucugg

SEQ ID NO: 115737 - RNA, 24 nt, Human
gacccucaaagggaaaaauaauuc

SEQ ID NO: 115738 - RNA, 20 nt, Human
gagcucacagaacuacagac

SEQ ID NO: 115739 - RNA, 18 nt, Human
gagcugaugcauuucuua

SEQ ID NO: 115740 - RNA, 18 nt, Human
gaggaggaagaaacagaa

SEQ ID NO: 115741 - RNA, 22 nt, Human
gaggaggaagaaacagaauaga

SEQ ID NO: 115742 - RNA, 23 nt, Human
gaggaggaagaaacagaauagag

SEQ ID NO: 115743 - RNA, 19 nt, Human
gaguggcgacccacaguag

SEQ ID NO: 115744 - RNA, 21 nt, Human
gcagccaagagggaagauuuc

SEQ ID NO: 115745 - RNA, 19 nt, Human
gccggguccuagcuauugg

SEQ ID NO: 115746 - RNA, 21 nt, Human
gcuacccuuuuagaaggaacu

SEQ ID NO: 115747 - RNA, 26 nt, Human
ggaagggacuggcuggaguguggcgg

SEQ ID NO: 115748 - RNA, 23 nt, Human
ggagagcguggugucuggaggug

SEQ ID NO: 115749 - RNA, 24 nt, Human
ggauggaaccaaaagaggaagcug

SEQ ID NO: 115750 - RNA, 18 nt, Human
ggcagccaagagggaaga

SEQ ID NO: 115751 - RNA, 20 nt, Human
ggcggugggcgucccagugc

SEQ ID NO: 115752 - RNA, 24 nt, Human
gggacaggaaugugagcucugugg

SEQ ID NO: 115753 - RNA, 22 nt, Human
gggagcacaaaggacuaaaaag

SEQ ID NO: 115754 - RNA, 18 nt, Human
ggugguaaggauggaacc

SEQ ID NO: 115755 - RNA, 20 nt, Human
guaaggauggaaccaaaaga

SEQ ID NO: 115756 - RNA, 21 nt, Human
guauuaaguccagggcuaccc

SEQ ID NO: 115757 - RNA, 23 nt, Human
uaacuucccuucucaauacagcc

SEQ ID NO: 115758 - RNA, 19 nt, Human
uaccacaacaugcucgccu

SEQ ID NO: 115759 - RNA, 24 nt, Human
uagaaggaacugcuuccaacagug

SEQ ID NO: 115760 - RNA, 18 nt, Human
uaguuccgggccgucacu

SEQ ID NO: 115761 - RNA, 18 nt, Human
ucccuguguccucucucc

SEQ ID NO: 115762 - RNA, 23 nt, Human
ucugcagacccgugggagcacaa

SEQ ID NO: 115763 - RNA, 20 nt, Human
ucugugggcugguuagccca

SEQ ID NO: 115764 - RNA, 20 nt, Human
ugaagggaggacaggggcug

SEQ ID NO: 115765 - RNA, 21 nt, Human
ugagacucccaaggcaaacau

SEQ ID NO: 115766 - RNA, 25 nt, Human
ugaggaggaagaaacagaauagagg

SEQ ID NO: 115767 - RNA, 23 nt, Human
ugcaauguucuccacaguaaaua

SEQ ID NO: 115768 - RNA, 19 nt, Human
ugccugugacuccuuggag

SEQ ID NO: 115769 - RNA, 20 nt, Human
uggaaccaaaagaggaagcu

SEQ ID NO: 115770 - RNA, 21 nt, Human
uggaaccaaaagaggaagcug

SEQ ID NO: 115771 - RNA, 21 nt, Human
ugggacucugcagacccgugg

SEQ ID NO: 115772 - RNA, 22 nt, Human
ugggacucugcagacccguggg

SEQ ID NO: 115773 - RNA, 24 nt, Human
ugggagcacaaaggacuaaaaagc

SEQ ID NO: 115774 - RNA, 22 nt, Human
ugggggcagccaagagggaaga

SEQ ID NO: 115775 - RNA, 22 nt, Human
uggggugggggccagagguauc

SEQ ID NO: 115776 - RNA, 27 nt, Human
uggggugggggccagagguauccggcu

SEQ ID NO: 115777 - RNA, 25 nt, Human
uggguaauauuuaaaaaaaaaaaaa

SEQ ID NO: 115778 - RNA, 26 nt, Human
ugguaaccgagaccacaccuggccac

SEQ ID NO: 115779 - RNA, 21 nt, Human
ugguaaggauggaaccaaaag

SEQ ID NO: 115780 - RNA, 23 nt, Human
ugguaaggauggaaccaaaagag

SEQ ID NO: 115781 - RNA, 19 nt, Human
uggugucuggaggugaucg

SEQ ID NO: 115782 - RNA, 19 nt, Human
uguagaggcuuuuuccaga

SEQ ID NO: 115783 - RNA, 19 nt, Human
uguauaaagacccucaaag

SEQ ID NO: 115784 - RNA, 19 nt, Human
ugugagcucugugggcugg

SEQ ID NO: 115785 - RNA, 19 nt, Human
uguggcgggcugacagguc

SEQ ID NO: 115786 - RNA, 19 nt, Human
uguguauguguacccccau

SEQ ID NO: 115787 - RNA, 20 nt, Human
uucacugacugagcugaugc

SEQ ID NO: 115788 - RNA, 24 nt, Human
uucccagaacccugcuucuggcuc

SEQ ID NO: 115789 - RNA, 19 nt, Human
uucccuucucaauacagcc

SEQ ID NO: 115790 - RNA, 21 nt, Human
uuguggaaggaaaagagaauc

SEQ ID NO: 115791 - RNA, 21 nt, Human
uuuaaaaaaaaaaaaaacugu

SEQ ID NO: 115792 - RNA, 21 nt, Human
uuuuuuguauucacugacuga

SEQ ID NO: 115793 - RNA, 18 nt, Human
uuuuuuuuuuuuuucuug

SEQ ID NO: 115794 - RNA, 19 nt, Human
uuuuuuuuuuuuuucuugu

SEQ ID NO: 115795 - RNA, 23 nt, Human
aaaaaacaaagcggcuuaguggg

SEQ ID NO: 115796 - RNA, 23 nt, Human
aaaaauuaguugagaaaaaauaa

SEQ ID NO: 115797 - RNA, 18 nt, Human
aaaauacugacuauucau

SEQ ID NO: 115798 - RNA, 21 nt, Human
aaaauacugacuauucauaau

SEQ ID NO: 115799 - RNA, 18 nt, Human
aaacaaauaacccugagc

SEQ ID NO: 115800 - RNA, 20 nt, Human
aaagacaagagaguuaucaa

SEQ ID NO: 115801 - RNA, 22 nt, Human
aaauagcccuaaaccuuaaagg

SEQ ID NO: 115802 - RNA, 25 nt, Human
aacacagaaaaugaaaauauuuaga

SEQ ID NO: 115803 - RNA, 18 nt, Human
aacacccacccgccucuc

SEQ ID NO: 115804 - RNA, 23 nt, Human
aagcggcuuauuuuaauaguauc

SEQ ID NO: 115805 - RNA, 19 nt, Human
aagggaauuauggaauuaa

SEQ ID NO: 115806 - RNA, 20 nt, Human
aagggaauuauggaauuaag

SEQ ID NO: 115807 - RNA, 26 nt, Human
aauagcccuaaaccuuaaaggacaaa

SEQ ID NO: 115808 - RNA, 18 nt, Human
acaacagcgugagauuuc

SEQ ID NO: 115809 - RNA, 25 nt, Human
acacagaaaaugaaaauauuuagaa

SEQ ID NO: 115810 - RNA, 21 nt, Human
acccucugaacuaacacccac

SEQ ID NO: 115811 - RNA, 26 nt, Human
acccugagcauacauuuuugaaaaac

SEQ ID NO: 115812 - RNA, 25 nt, Human
acuagacucuacauugggcagccuu

SEQ ID NO: 115813 - RNA, 22 nt, Human
agaaggacaggaugaauacugg

SEQ ID NO: 115814 - RNA, 21 nt, Human
agaauuuaaaucuuuggacaa

SEQ ID NO: 115815 - RNA, 19 nt, Human
agcacaaguaaauucuuua

SEQ ID NO: 115816 - RNA, 18 nt, Human
aggaagacuuaguugcug

SEQ ID NO: 115817 - RNA, 22 nt, Human
aggccaaccaauuuaacugcag

SEQ ID NO: 115818 - RNA, 19 nt, Human
aggugccaacucucuaaaa

SEQ ID NO: 115819 - RNA, 24 nt, Human
aguaaagacaagagaguuaucaag

SEQ ID NO: 115820 - RNA, 24 nt, Human
auaaaauagcccuaaaccuuaaag

SEQ ID NO: 115821 - RNA, 19 nt, Human
auaccuaccaacaugucaa

SEQ ID NO: 115822 - RNA, 24 nt, Human
aucgucacacagcugugauaagag

SEQ ID NO: 115823 - RNA, 25 nt, Human
augccugcauauuuaaaaaacaaag

SEQ ID NO: 115824 - RNA, 24 nt, Human
auguaaaagucaauuugcacuucu

SEQ ID NO: 115825 - RNA, 24 nt, Human
auuuuucuaaucuuucuucuacua

SEQ ID NO: 115826 - RNA, 22 nt, Human
caaaggcaccuacaguugaaau

SEQ ID NO: 115827 - RNA, 21 nt, Human
caccuacaguugaaauuuuuc

SEQ ID NO: 115828 - RNA, 23 nt, Human
cagaaagcguucuucuguaacuu

SEQ ID NO: 115829 - RNA, 22 nt, Human
ccaaaaaucacaacuuugaagg

SEQ ID NO: 115830 - RNA, 22 nt, Human
cccaugccugcauauuuaaaaa

SEQ ID NO: 115831 - RNA, 25 nt, Human
cccucugaacuaacacccacccgcc

SEQ ID NO: 115832 - RNA, 26 nt, Human
cuaccacaucaaaggugccaacucuc

SEQ ID NO: 115833 - RNA, 21 nt, Human
cuuaaaacuucagcagaagaa

SEQ ID NO: 115834 - RNA, 23 nt, Human
cuucuacuagacugugacucucc

SEQ ID NO: 115835 - RNA, 19 nt, Human
cuuuggcuaacagccuagu

SEQ ID NO: 115836 - RNA, 24 nt, Human
gaacuaacacccacccgccucuca

SEQ ID NO: 115837 - RNA, 20 nt, Human
gacacaauaaacaugguuag

SEQ ID NO: 115838 - RNA, 21 nt, Human
gaugaauacuggccauuuucu

SEQ ID NO: 115839 - RNA, 24 nt, Human
gccaggaucagaaagcguucuucu

SEQ ID NO: 115840 - RNA, 21 nt, Human
gcccuaaaccuuaaaggacaa

SEQ ID NO: 115841 - RNA, 20 nt, Human
ggaauggggaaagagaagga

SEQ ID NO: 115842 - RNA, 23 nt, Human
uaaauaugauucuuuguaaugcu

SEQ ID NO: 115843 - RNA, 19 nt, Human
uaacaguuccaggauaaca

SEQ ID NO: 115844 - RNA, 24 nt, Human
uaccacaucaaaggugccaacucu

SEQ ID NO: 115845 - RNA, 21 nt, Human
uaccuaccaacaugucaaagc

SEQ ID NO: 115846 - RNA, 19 nt, Human
uacucacuuaaaacuucag

SEQ ID NO: 115847 - RNA, 22 nt, Human
uagaagaaaguggaugaucagc

SEQ ID NO: 115848 - RNA, 19 nt, Human
uagguugcaaaggcaccua

SEQ ID NO: 115849 - RNA, 18 nt, Human
uauccagagauguuagag

SEQ ID NO: 115850 - RNA, 21 nt, Human
uaugauacuacaguuucaaag

SEQ ID NO: 115851 - RNA, 23 nt, Human
ucccaaaaaucacaacuuugaag

SEQ ID NO: 115852 - RNA, 19 nt, Human
uccugacaacagcgugaga

SEQ ID NO: 115853 - RNA, 22 nt, Human
ucuacuagacugugacucucca

SEQ ID NO: 115854 - RNA, 23 nt, Human
ucuguaacuucuucauguugacc

SEQ ID NO: 115855 - RNA, 21 nt, Human
ucuuuauaauccucugguuua

SEQ ID NO: 115856 - RNA, 21 nt, Human
ugaaacaaauaacccugagca

SEQ ID NO: 115857 - RNA, 18 nt, Human
ugaacuaacacccacccg

SEQ ID NO: 115858 - RNA, 27 nt, Human
ugacaacagcgugagauuucaacagaa

SEQ ID NO: 115859 - RNA, 24 nt, Human
ugagcauacauuuuugaaaaacau

SEQ ID NO: 115860 - RNA, 19 nt, Human
ugagugccuucauuuaacu

SEQ ID NO: 115861 - RNA, 20 nt, Human
ugcagcuuugaagccuggaa

SEQ ID NO: 115862 - RNA, 23 nt, Human
uggaacaaauacucacuuaaaac

SEQ ID NO: 115863 - RNA, 22 nt, Human
uggggaaagagaaggacaggau

SEQ ID NO: 115864 - RNA, 22 nt, Human
ugucagauucauugcuguaagu

SEQ ID NO: 115865 - RNA, 18 nt, Human
uuaaaacaauuuaauacu

SEQ ID NO: 115866 - RNA, 20 nt, Human
uuagggucucccaggauagg

SEQ ID NO: 115867 - RNA, 20 nt, Human
uucacaaucccaccuguaca

SEQ ID NO: 115868 - RNA, 22 nt, Human
uucaggaagaauacugagugcc

SEQ ID NO: 115869 - RNA, 18 nt, Human
uuguacaauauuucuccu

SEQ ID NO: 115870 - RNA, 23 nt, Human
uuuaacaaagguuuguuuccaga

SEQ ID NO: 115871 - RNA, 21 nt, Human
uuuacugcaacuuaauauuuc

SEQ ID NO: 115872 - RNA, 25 nt, Human
uuuccagaagaacuuuugaugucag

SEQ ID NO: 115873 - RNA, 20 nt, Human
uuuuuuuuuuuuuuuuuugg

SEQ ID NO: 115874 - RNA, 22 nt, Human
aaaaaaaaaaaaaauggaacua

SEQ ID NO: 115875 - RNA, 25 nt, Human
aaaaaaaaaaauggaacuauuuggc

SEQ ID NO: 115876 - RNA, 24 nt, Human
aaacaaaaacccagaagaucuaac

SEQ ID NO: 115877 - RNA, 20 nt, Human
aaacaggaaaagauuuuuaa

SEQ ID NO: 115878 - RNA, 20 nt, Human
aaagaaaagagguuuauuug

SEQ ID NO: 115879 - RNA, 25 nt, Human
aaagaggaacuagcugggcguggug

SEQ ID NO: 115880 - RNA, 18 nt, Human
aaagggaacauuuagggu

SEQ ID NO: 115881 - RNA, 21 nt, Human
aaauaccuccuacuaggccca

SEQ ID NO: 115882 - RNA, 20 nt, Human
aaaucaggauauuagaagac

SEQ ID NO: 115883 - RNA, 24 nt, Human
aaaucauccacguagaaccaagag

SEQ ID NO: 115884 - RNA, 21 nt, Human
aaccaagagcuugccaacacu

SEQ ID NO: 115885 - RNA, 23 nt, Human
aaccagagugagaacucacucau

SEQ ID NO: 115886 - RNA, 20 nt, Human
aagcaaaacaaaaacccaga

SEQ ID NO: 115887 - RNA, 27 nt, Human
aagcaaaacaaaaacccagaagaucua

SEQ ID NO: 115888 - RNA, 28 nt, Human
aagcaaaacaaaaacccagaagaucuaa

SEQ ID NO: 115889 - RNA, 18 nt, Human
aagcagcaaauggcagac

SEQ ID NO: 115890 - RNA, 26 nt, Human
aaguggagguugcagagugagcugag

SEQ ID NO: 115891 - RNA, 18 nt, Human
aaucgcuugaaccuggga

SEQ ID NO: 115892 - RNA, 22 nt, Human
aauuagccaggcauggugacuu

SEQ ID NO: 115893 - RNA, 20 nt, Human
acaagagugaaacucugucu

SEQ ID NO: 115894 - RNA, 21 nt, Human
acaagagugaaacucugucuc

SEQ ID NO: 115895 - RNA, 23 nt, Human
acagggaacagccaccucuucca

SEQ ID NO: 115896 - RNA, 23 nt, Human
accauaucaccaccugagaaugg

SEQ ID NO: 115897 - RNA, 19 nt, Human
acccaaauaccuccuacua

SEQ ID NO: 115898 - RNA, 24 nt, Human
accccuucucuacuaaaaauacaa

SEQ ID NO: 115899 - RNA, 20 nt, Human
accugaggucaggaguucaa

SEQ ID NO: 115900 - RNA, 24 nt, Human
accugaggucaggaguucaagacc

SEQ ID NO: 115901 - RNA, 25 nt, Human
acuccagccugggcaacaagaguga

SEQ ID NO: 115902 - RNA, 19 nt, Human
agaagaucuaacaacccug

SEQ ID NO: 115903 - RNA, 22 nt, Human
agagagcaagcgagagaggagg

SEQ ID NO: 115904 - RNA, 18 nt, Human
agagugaaacucugucuc

SEQ ID NO: 115905 - RNA, 22 nt, Human
agagugaaacucugucucaaaa

SEQ ID NO: 115906 - RNA, 22 nt, Human
agaugggcggauuaccugaggu

SEQ ID NO: 115907 - RNA, 23 nt, Human
agccaggcauggugacuugugcc

SEQ ID NO: 115908 - RNA, 24 nt, Human
agcccggccaauguggugaaaccc

SEQ ID NO: 115909 - RNA, 23 nt, Human
aggaaacccucucaggaaccaac

SEQ ID NO: 115910 - RNA, 20 nt, Human
aggaggcugguccucuaaga

SEQ ID NO: 115911 - RNA, 22 nt, Human
aggcaugagaaucgcuugaacc

SEQ ID NO: 115912 - RNA, 24 nt, Human
aggcaugagaaucgcuugaaccug

SEQ ID NO: 115913 - RNA, 24 nt, Human
aggcugaggcaugagaaucgcuug

SEQ ID NO: 115914 - RNA, 25 nt, Human
agugagaacucacucauuacuaugg

SEQ ID NO: 115915 - RNA, 24 nt, Human
auaagcuuauuuuccuuauuucaa

SEQ ID NO: 115916 - RNA, 24 nt, Human
aucacgccauuguacuccagccug

SEQ ID NO: 115917 - RNA, 21 nt, Human
aucauauaauaacaacaugaa

SEQ ID NO: 115918 - RNA, 18 nt, Human
auccaaaccauaucacca

SEQ ID NO: 115919 - RNA, 22 nt, Human
auccgcccccaugacccaaaua

SEQ ID NO: 115920 - RNA, 18 nt, Human
aucuagguauauccaagg

SEQ ID NO: 115921 - RNA, 19 nt, Human
augccuguaaucucagcac

SEQ ID NO: 115922 - RNA, 19 nt, Human
augggcggauuaccugagg

SEQ ID NO: 115923 - RNA, 24 nt, Human
auuaccugaggucaggaguucaag

SEQ ID NO: 115924 - RNA, 24 nt, Human
auuguacuccagccugggcaacaa

SEQ ID NO: 115925 - RNA, 19 nt, Human
caaagccuguuaagcagca

SEQ ID NO: 115926 - RNA, 23 nt, Human
caacaagagugaaacucugucuc

SEQ ID NO: 115927 - RNA, 21 nt, Human
caacacugaaaaaccugacac

SEQ ID NO: 115928 - RNA, 24 nt, Human
caacacugaaaaaccugacacaaa

SEQ ID NO: 115929 - RNA, 24 nt, Human
caagaccagcccggccaauguggu

SEQ ID NO: 115930 - RNA, 22 nt, Human
caagagcuugccaacacugaaa

SEQ ID NO: 115931 - RNA, 23 nt, Human
caauccuauccuuucaaucuuca

SEQ ID NO: 115932 - RNA, 24 nt, Human
caauguggugaaaccccuucucua

SEQ ID NO: 115933 - RNA, 20 nt, Human
cacagaaacuuacagaguac

SEQ ID NO: 115934 - RNA, 25 nt, Human
caccuauucccugugugacaggggu

SEQ ID NO: 115935 - RNA, 20 nt, Human
caccucuuccacaacccagu

SEQ ID NO: 115936 - RNA, 24 nt, Human
cagaagauuugcugacuuaaacac

SEQ ID NO: 115937 - RNA, 21 nt, Human
cagacacguuaagccugcaua

SEQ ID NO: 115938 - RNA, 21 nt, Human
cagagugaaaugcaguauguu

SEQ ID NO: 115939 - RNA, 24 nt, Human
cagcacuuugggaagccgagaugg

SEQ ID NO: 115940 - RNA, 28 nt, Human
cagcacuuugggaagccgagaugggcgg

SEQ ID NO: 115941 - RNA, 21 nt, Human
cagccuuaucaaaagaggaac

SEQ ID NO: 115942 - RNA, 21 nt, Human
cagcucuugcauaaacaacca

SEQ ID NO: 115943 - RNA, 22 nt, Human
caggagaacauccacguagaaa

SEQ ID NO: 115944 - RNA, 25 nt, Human
caucaauaucuugcuuaaauuuggu

SEQ ID NO: 115945 - RNA, 20 nt, Human
caugccuguaaucucagcac

SEQ ID NO: 115946 - RNA, 23 nt, Human
cauuaagcuugucaaaaucugca

SEQ ID NO: 115947 - RNA, 19 nt, Human
cauuguacuccagccuggg

SEQ ID NO: 115948 - RNA, 21 nt, Human
cauuguacuccagccugggca

SEQ ID NO: 115949 - RNA, 22 nt, Human
cauuguacuccagccugggcaa

SEQ ID NO: 115950 - RNA, 23 nt, Human
cauuguacuccagccugggcaac

SEQ ID NO: 115951 - RNA, 24 nt, Human
cauuguacuccagccugggcaaca

SEQ ID NO: 115952 - RNA, 20 nt, Human
cauuuugcuacauauacaca

SEQ ID NO: 115953 - RNA, 24 nt, Human
ccaagagcuugccaacacugaaaa

SEQ ID NO: 115954 - RNA, 18 nt, Human
ccaugccuguaaucucag

SEQ ID NO: 115955 - RNA, 20 nt, Human
ccauuguacuccagccuggg

SEQ ID NO: 115956 - RNA, 21 nt, Human
ccauuguacuccagccugggc

SEQ ID NO: 115957 - RNA, 22 nt, Human
ccauuguacuccagccugggca

SEQ ID NO: 115958 - RNA, 23 nt, Human
ccauuguacuccagccugggcaa

SEQ ID NO: 115959 - RNA, 24 nt, Human
ccauuguacuccagccugggcaac

SEQ ID NO: 115960 - RNA, 24 nt, Human
cccaugccuguaaucucagcacuu

SEQ ID NO: 115961 - RNA, 20 nt, Human
ccccaugacccaaauaccuc

SEQ ID NO: 115962 - RNA, 23 nt, Human
ccccaugacccaaauaccuccua

SEQ ID NO: 115963 - RNA, 18 nt, Human
cccggccaauguggugaa

SEQ ID NO: 115964 - RNA, 23 nt, Human
cccggccaauguggugaaacccc

SEQ ID NO: 115965 - RNA, 20 nt, Human
ccuccuacuaggcccaccuc

SEQ ID NO: 115966 - RNA, 21 nt, Human
ccugggaaguggagguugcag

SEQ ID NO: 115967 - RNA, 20 nt, Human
ccuguaaucucagcacuuug

SEQ ID NO: 115968 - RNA, 19 nt, Human
ccuguagucccagcuacuc

SEQ ID NO: 115969 - RNA, 21 nt, Human
ccuguagucccagcuacucgg

SEQ ID NO: 115970 - RNA, 20 nt, Human
ccuucaccuauucccugugu

SEQ ID NO: 115971 - RNA, 24 nt, Human
cgagaugggcggauuaccugaggu

SEQ ID NO: 115972 - RNA, 26 nt, Human
cgagaugggcggauuaccugagguca

SEQ ID NO: 115973 - RNA, 24 nt, Human
cgccauuguacuccagccugggca

SEQ ID NO: 115974 - RNA, 24 nt, Human
cggauuaccugaggucaggaguuc

SEQ ID NO: 115975 - RNA, 23 nt, Human
cggccaauguggugaaaccccuu

SEQ ID NO: 115976 - RNA, 24 nt, Human
cguagaaccaagagcuugccaaca

SEQ ID NO: 115977 - RNA, 22 nt, Human
cuacuaggcccaccucuaacac

SEQ ID NO: 115978 - RNA, 18 nt, Human
cuagcugggcgugguggc

SEQ ID NO: 115979 - RNA, 23 nt, Human
cuagcugggcgugguggcccaug

SEQ ID NO: 115980 - RNA, 24 nt, Human
cuagcugggcgugguggcccaugc

SEQ ID NO: 115981 - RNA, 22 nt, Human
cuaggcccaccucuaacacuga

SEQ ID NO: 115982 - RNA, 18 nt, Human
cucaaaaaaaaaaaaaaa

SEQ ID NO: 115983 - RNA, 21 nt, Human
cucgauggggucauucuggga

SEQ ID NO: 115984 - RNA, 19 nt, Human
cucugucucaaaaaaaaaa

SEQ ID NO: 115985 - RNA, 20 nt, Human
cugacuuaaacacugcaaaa

SEQ ID NO: 115986 - RNA, 24 nt, Human
cugcucgccaguguuacugucucc

SEQ ID NO: 115987 - RNA, 19 nt, Human
cuugccaacacugaaaaac

SEQ ID NO: 115988 - RNA, 18 nt, Human
cuuuuaaacaaccagcuc

SEQ ID NO: 115989 - RNA, 24 nt, Human
gaaaucauccacguagaaccaaga

SEQ ID NO: 115990 - RNA, 20 nt, Human
gaaguggagguugcagagug

SEQ ID NO: 115991 - RNA, 24 nt, Human
gacagggaacagccaccucuucca

SEQ ID NO: 115992 - RNA, 23 nt, Human
gagaucacgccauuguacuccag

SEQ ID NO: 115993 - RNA, 20 nt, Human
gagguugcagagugagcuga

SEQ ID NO: 115994 - RNA, 18 nt, Human
gauguucuuccuuuguau

SEQ ID NO: 115995 - RNA, 23 nt, Human
gauuaccugaggucaggaguuca

SEQ ID NO: 115996 - RNA, 24 nt, Human
gauuaccugaggucaggaguucaa

SEQ ID NO: 115997 - RNA, 24 nt, Human
gccaauguggugaaaccccuucuc

SEQ ID NO: 115998 - RNA, 22 nt, Human
gccauuguacuccagccugggc

SEQ ID NO: 115999 - RNA, 24 nt, Human
gccauuguacuccagccugggcaa

SEQ ID NO: 116000 - RNA, 19 nt, Human
gcuuuuuuuuuuuugcuga

SEQ ID NO: 116001 - RNA, 20 nt, Human
ggaacuagcugggcguggug

SEQ ID NO: 116002 - RNA, 26 nt, Human
ggagguugcagagugagcugagauca

SEQ ID NO: 116003 - RNA, 22 nt, Human
ggauuaccugaggucaggaguu

SEQ ID NO: 116004 - RNA, 23 nt, Human
ggauuaccugaggucaggaguuc

SEQ ID NO: 116005 - RNA, 19 nt, Human
ggccagguuucuucagccc

SEQ ID NO: 116006 - RNA, 21 nt, Human
ggcccaugccuguaaucucag

SEQ ID NO: 116007 - RNA, 24 nt, Human
gggcgugguggcccaugccuguaa

SEQ ID NO: 116008 - RNA, 19 nt, Human
ggguugcuccauccucaaa

SEQ ID NO: 116009 - RNA, 21 nt, Human
gguacccagagugaaaugcag

SEQ ID NO: 116010 - RNA, 24 nt, Human
gguggcccaugccuguaaucucag

SEQ ID NO: 116011 - RNA, 25 nt, Human
guacuccagccugggcaacaagagu

SEQ ID NO: 116012 - RNA, 18 nt, Human
gugaaggggagccagugu

SEQ ID NO: 116013 - RNA, 25 nt, Human
guuccaggcucuuuuaaacaaccag

SEQ ID NO: 116014 - RNA, 23 nt, Human
guuuaucuggguagauguccaug

SEQ ID NO: 116015 - RNA, 26 nt, Human
uaaaaaacagaagauuugcugacuua

SEQ ID NO: 116016 - RNA, 20 nt, Human
uaaaaauacaaaauuagcca

SEQ ID NO: 116017 - RNA, 22 nt, Human
uaaaaauacaaaauuagccagg

SEQ ID NO: 116018 - RNA, 23 nt, Human
uaaaaauacaaaauuagccaggc

SEQ ID NO: 116019 - RNA, 21 nt, Human
uaaaagggaacauuuagggua

SEQ ID NO: 116020 - RNA, 22 nt, Human
uaaacaaccagagugagaacuc

SEQ ID NO: 116021 - RNA, 23 nt, Human
uaaacaaccagcucuugcauaaa

SEQ ID NO: 116022 - RNA, 19 nt, Human
uaacgggaaacguuagguc

SEQ ID NO: 116023 - RNA, 21 nt, Human
uaagggauccgcccccaugac

SEQ ID NO: 116024 - RNA, 23 nt, Human
uacagaguacuggaguugaaaga

SEQ ID NO: 116025 - RNA, 23 nt, Human
uaccugaggucaggaguucaaga

SEQ ID NO: 116026 - RNA, 23 nt, Human
uacuccagccugggcaacaagag

SEQ ID NO: 116027 - RNA, 24 nt, Human
uacuccagccugggcaacaagagu

SEQ ID NO: 116028 - RNA, 25 nt, Human
uacuccagccugggcaacaagagug

SEQ ID NO: 116029 - RNA, 22 nt, Human
uagaaagaaaagagguuuauuu

SEQ ID NO: 116030 - RNA, 21 nt, Human
uagaaccaagagcuugccaac

SEQ ID NO: 116031 - RNA, 22 nt, Human
uaguccgagcuggggcaccugc

SEQ ID NO: 116032 - RNA, 24 nt, Human
uaguccgagcuggggcaccugcuc

SEQ ID NO: 116033 - RNA, 20 nt, Human
uauccaaggaaaaauaaacu

SEQ ID NO: 116034 - RNA, 20 nt, Human
ucaccuaauggaagugaagu

SEQ ID NO: 116035 - RNA, 23 nt, Human
ucacgccauuguacuccagccug

SEQ ID NO: 116036 - RNA, 23 nt, Human
ucacucauuacuauggggauggc

SEQ ID NO: 116037 - RNA, 24 nt, Human
uccaaggaaaaauaaacuuaagau

SEQ ID NO: 116038 - RNA, 22 nt, Human
uccuacuaggcccaccucuaac

SEQ ID NO: 116039 - RNA, 22 nt, Human
uccuauccuuucaaucuucacc

SEQ ID NO: 116040 - RNA, 21 nt, Human
uccuuuguauuuguauuguca

SEQ ID NO: 116041 - RNA, 24 nt, Human
ucgcuugaaccugggaaguggagg

SEQ ID NO: 116042 - RNA, 24 nt, Human
ucgggaggcugaggcaugagaauc

SEQ ID NO: 116043 - RNA, 19 nt, Human
ucucaaaacaggaaaagau

SEQ ID NO: 116044 - RNA, 20 nt, Human
ucucuacuaaaaauacaaaa

SEQ ID NO: 116045 - RNA, 18 nt, Human
ucucucuccagauguucu

SEQ ID NO: 116046 - RNA, 18 nt, Human
ucugcagcauaauggaag

SEQ ID NO: 116047 - RNA, 23 nt, Human
ucugucucaaaaaaaaaaaaaaa

SEQ ID NO: 116048 - RNA, 25 nt, Human
ucugucucaaaaaaaaaaaaaaaaa

SEQ ID NO: 116049 - RNA, 19 nt, Human
ugaaaagcagauuuaaaag

SEQ ID NO: 116050 - RNA, 23 nt, Human
ugaaaagcagauuuaaaagggaa

SEQ ID NO: 116051 - RNA, 21 nt, Human
ugaaagagaacugagaucacc

SEQ ID NO: 116052 - RNA, 24 nt, Human
ugaaccugggaaguggagguugca

SEQ ID NO: 116053 - RNA, 21 nt, Human
ugaccccagugagcauuugau

SEQ ID NO: 116054 - RNA, 22 nt, Human
ugagcugagaucacgccauugu

SEQ ID NO: 116055 - RNA, 24 nt, Human
ugaggcaugagaaucgcuugaacc

SEQ ID NO: 116056 - RNA, 21 nt, Human
ugaggucaaggaugaaaucca

SEQ ID NO: 116057 - RNA, 22 nt, Human
ugauaaaaccugaaguaccacu

SEQ ID NO: 116058 - RNA, 21 nt, Human
ugcaacuuucauccauugcug

SEQ ID NO: 116059 - RNA, 20 nt, Human
ugcacuacaccaucaaggcc

SEQ ID NO: 116060 - RNA, 20 nt, Human
ugcauaaacaaccagaguga

SEQ ID NO: 116061 - RNA, 23 nt, Human
ugccuguaaucucagcacuuugg

SEQ ID NO: 116062 - RNA, 24 nt, Human
ugccuguaaucucagcacuuuggg

SEQ ID NO: 116063 - RNA, 24 nt, Human
ugccuguagucccagcuacucggg

SEQ ID NO: 116064 - RNA, 20 nt, Human
ugcugaagaccagcuggcua

SEQ ID NO: 116065 - RNA, 23 nt, Human
uggaagcucauucccucuucugc

SEQ ID NO: 116066 - RNA, 22 nt, Human
uggaggggacaaaacauccaaa

SEQ ID NO: 116067 - RNA, 22 nt, Human
uggcacaaagucauacauaagg

SEQ ID NO: 116068 - RNA, 23 nt, Human
uggcagcaacagaccagaacuca

SEQ ID NO: 116069 - RNA, 21 nt, Human
uggcccaugccuguaaucuca

SEQ ID NO: 116070 - RNA, 24 nt, Human
uggcccaugccuguaaucucagca

SEQ ID NO: 116071 - RNA, 20 nt, Human
uggcugugacacuucuacug

SEQ ID NO: 116072 - RNA, 22 nt, Human
ugggaagccgagaugggcggau

SEQ ID NO: 116073 - RNA, 26 nt, Human
ugggaaguggagguugcagagugagc

SEQ ID NO: 116074 - RNA, 24 nt, Human
ugggcggauuaccugaggucagga

SEQ ID NO: 116075 - RNA, 19 nt, Human
uggugaaaccccuucucua

SEQ ID NO: 116076 - RNA, 24 nt, Human
uggugacuugugccuguaguccca

SEQ ID NO: 116077 - RNA, 24 nt, Human
ugguggcccaugccuguaaucuca

SEQ ID NO: 116078 - RNA, 19 nt, Human
uguacuccagccugggcaa

SEQ ID NO: 116079 - RNA, 22 nt, Human
uguacuccagccugggcaacaa

SEQ ID NO: 116080 - RNA, 24 nt, Human
ugucacuguauggaaucuagguau

SEQ ID NO: 116081 - RNA, 22 nt, Human
uguuacugucuccaucagccug

SEQ ID NO: 116082 - RNA, 23 nt, Human
uuacuauggggauggcacaaagu

SEQ ID NO: 116083 - RNA, 23 nt, Human
uucaaaaagcaaaacaaaaaccc

SEQ ID NO: 116084 - RNA, 21 nt, Human
uugaaagagaacugagaucac

SEQ ID NO: 116085 - RNA, 24 nt, Human
uugaaccugggaaguggagguugc

SEQ ID NO: 116086 - RNA, 20 nt, Human
uugcagagugagcugagauc

SEQ ID NO: 116087 - RNA, 19 nt, Human
uuguauuuguauugucacu

SEQ ID NO: 116088 - RNA, 24 nt, Human
uuuggaggggacaaaacauccaaa

SEQ ID NO: 116089 - RNA, 20 nt, Human
uuuuuuuuuuagaaagaaaa

SEQ ID NO: 116090 - RNA, 18 nt, Human
uuuuuuuuuuucagcagu

SEQ ID NO: 116091 - RNA, 20 nt, Human
uuuuuuuuuuuucagcaguc

SEQ ID NO: 116092 - RNA, 22 nt, Human
uuuuuuuuuuuuuuuuuuucag

SEQ ID NO: 116093 - RNA, 23 nt, Human
caaaagcagcuaugagcggagac

SEQ ID NO: 116094 - RNA, 24 nt, Human
cgucaaagaacucccaaaauuaau

SEQ ID NO: 116095 - RNA, 22 nt, Human
ggagacagccaaaucuaugcca

SEQ ID NO: 116096 - RNA, 20 nt, Human
uucacacagcagaccaccau

SEQ ID NO: 116097 - RNA, 19 nt, Human
accguggagcggaaaaggg

SEQ ID NO: 116098 - RNA, 20 nt, Human
aggugcaggcgcaggccagc

SEQ ID NO: 116099 - RNA, 21 nt, Human
ccacgggaucgaggaagacuc

SEQ ID NO: 116100 - RNA, 21 nt, Human
ccacugcccgccgcgaccgcc

SEQ ID NO: 116101 - RNA, 24 nt, Human
cccgcgaccggaagagagcaaggc

SEQ ID NO: 116102 - RNA, 22 nt, Human
ccgccacugcccgccgcgaccg

SEQ ID NO: 116103 - RNA, 18 nt, Human
cgaccgcccucuacaccc

SEQ ID NO: 116104 - RNA, 19 nt, Human
cgaccgcccucuacacccg

SEQ ID NO: 116105 - RNA, 23 nt, Human
cgccacugcccgccgcgaccgcc

SEQ ID NO: 116106 - RNA, 18 nt, Human
cgcccgcacccggccgca

SEQ ID NO: 116107 - RNA, 23 nt, Human
cucuacacccggugucccgcgac

SEQ ID NO: 116108 - RNA, 20 nt, Human
cugccgccacugcccgccgc

SEQ ID NO: 116109 - RNA, 20 nt, Human
gcacggaggucaccguggag

SEQ ID NO: 116110 - RNA, 19 nt, Human
ggaagacuccgcccgcacc

SEQ ID NO: 116111 - RNA, 19 nt, Human
guggagcggaaaaggguag

SEQ ID NO: 116112 - RNA, 18 nt, Human
uccgcccgcacccggccg

SEQ ID NO: 116113 - RNA, 22 nt, Human
ugccgccacugcccgccgcgac

SEQ ID NO: 116114 - RNA, 24 nt, Human
aagaagaaacuuuacagcacauuu

SEQ ID NO: 116115 - RNA, 21 nt, Human
ccaaugcaauggcuagucuuu

SEQ ID NO: 116116 - RNA, 21 nt, Human
cgcgacuagcagcaaaacuuc

SEQ ID NO: 116117 - RNA, 24 nt, Human
uagucuuuacuggaaagaagaaac

SEQ ID NO: 116118 - RNA, 28 nt, Human
uccgcgacuagcagcaaaaccggggucc

SEQ ID NO: 116119 - RNA, 18 nt, Human
ugcaauggcuagucuuua

SEQ ID NO: 116120 - RNA, 22 nt, Human
uggaaagaagaaacuuuacagc

SEQ ID NO: 116121 - RNA, 23 nt, Human
ugggagaaggagccaaugcaaug

SEQ ID NO: 116122 - RNA, 24 nt, Human
uuuuuuuuuuuuuuuuuuuauggg

SEQ ID NO: 116123 - RNA, 21 nt, Human
accagugcuguggucccuggu

SEQ ID NO: 116124 - RNA, 25 nt, Human
cagaguaacgguccaaaccagugcu

SEQ ID NO: 116125 - RNA, 27 nt, Human
ccugccacaagcaaagggaugggagac

SEQ ID NO: 116126 - RNA, 23 nt, Human
ucccuggugcccggguagugguc

SEQ ID NO: 116127 - RNA, 23 nt, Human
uuaaggucccauauacuuuuucu

SEQ ID NO: 116128 - RNA, 18 nt, Human
uugauacaaguaaagaag

SEQ ID NO: 116129 - RNA, 22 nt, Human
uuuuucugguccaugugcagag

SEQ ID NO: 116130 - RNA, 25 nt, Human
aaagacaccacagucggacaggaag

SEQ ID NO: 116131 - RNA, 19 nt, Human
agaggaaagggagaugcag

SEQ ID NO: 116132 - RNA, 20 nt, Human
caaagacaccacagucggac

SEQ ID NO: 116133 - RNA, 18 nt, Human
ccucagcaaagacaccac

SEQ ID NO: 116134 - RNA, 21 nt, Human
ccugggguggggaucacuggg

SEQ ID NO: 116135 - RNA, 21 nt, Human
cgagcggcuucagcucccucc

SEQ ID NO: 116136 - RNA, 21 nt, Human
gcggcuucagcucccucccag

SEQ ID NO: 116137 - RNA, 18 nt, Human
uaaaggcaccccggauuc

SEQ ID NO: 116138 - RNA, 23 nt, Human
uaccaggucccccuucaccaucc

SEQ ID NO: 116139 - RNA, 24 nt, Human
uaccaggucccccuucaccauccu

SEQ ID NO: 116140 - RNA, 23 nt, Human
uagcagguaagucaugauuuagg

SEQ ID NO: 116141 - RNA, 18 nt, Human
uccugggguggggaucac

SEQ ID NO: 116142 - RNA, 19 nt, Human
ugaauccuaaaggcacccc

SEQ ID NO: 116143 - RNA, 19 nt, Human
ugacccucagcaaagacac

SEQ ID NO: 116144 - RNA, 18 nt, Human
uggaggacagaggaaagg

SEQ ID NO: 116145 - RNA, 19 nt, Human
uggaggacagaggaaaggg

SEQ ID NO: 116146 - RNA, 24 nt, Human
uuucacuuuuccaaugaguuuuua

SEQ ID NO: 116147 - RNA, 20 nt, Human
uuuuuuuuuuuuucacuuuu

SEQ ID NO: 116148 - RNA, 23 nt, Human
uuuuuuuuuuuuucacuuuucca

SEQ ID NO: 116149 - RNA, 24 nt, Human
uuuuuuuuuuuuuuuuucacuuuu

SEQ ID NO: 116150 - RNA, 22 nt, Human
agaggaacuauuucuuagccca

SEQ ID NO: 116151 - RNA, 20 nt, Human
aggaacacaagucagugaca

SEQ ID NO: 116152 - RNA, 18 nt, Human
caagaggaacuauuucuu

SEQ ID NO: 116153 - RNA, 23 nt, Human
ccucaacaccaacguccuuccug

SEQ ID NO: 116154 - RNA, 24 nt, Human
cucaacaccaacguccuuccugac

SEQ ID NO: 116155 - RNA, 18 nt, Human
uaucaagaggaacuauuu

SEQ ID NO: 116156 - RNA, 21 nt, Human
ugcuaaccucaacaccaacgu

SEQ ID NO: 116157 - RNA, 23 nt, Human
uguuuauuuaucaagaggaacua

SEQ ID NO: 116158 - RNA, 24 nt, Human
uuuuuuuuuuuuuuuuuuucaaag

SEQ ID NO: 116159 - RNA, 18 nt, Human
aacuccuccccggaucuc

SEQ ID NO: 116160 - RNA, 22 nt, Human
accacggaggaggcgguccaga

SEQ ID NO: 116161 - RNA, 18 nt, Human
accccaggccccacccgc

SEQ ID NO: 116162 - RNA, 23 nt, Human
agagugaggaaacgcagaaggcc

SEQ ID NO: 116163 - RNA, 21 nt, Human
caccacggaggaggcggucca

SEQ ID NO: 116164 - RNA, 21 nt, Human
caccucccuucuccgcccaag

SEQ ID NO: 116165 - RNA, 22 nt, Human
caccucccuucuccgcccaagg

SEQ ID NO: 116166 - RNA, 20 nt, Human
ccaccggagcccaaagcggu

SEQ ID NO: 116167 - RNA, 22 nt, Human
ccaggccccacccgcugcgcgc

SEQ ID NO: 116168 - RNA, 21 nt, Human
cccaaagcgguaccagggaau

SEQ ID NO: 116169 - RNA, 24 nt, Human
ccgggggcaagugcaacuccuccc

SEQ ID NO: 116170 - RNA, 22 nt, Human
ccucuguccaggaaccccaggc

SEQ ID NO: 116171 - RNA, 18 nt, Human
ccugggccgcagcgcgca

SEQ ID NO: 116172 - RNA, 20 nt, Human
cgugacagcuggggacgcgg

SEQ ID NO: 116173 - RNA, 20 nt, Human
cucaggccccccaggcuucu

SEQ ID NO: 116174 - RNA, 18 nt, Human
gcgcagcgugacagcugg

SEQ ID NO: 116175 - RNA, 21 nt, Human
ggaauuucgcuuggucccacc

SEQ ID NO: 116176 - RNA, 23 nt, Human
ggagucaccucccuucuccgccc

SEQ ID NO: 116177 - RNA, 23 nt, Human
ggcuggggcuggggcuggguugc

SEQ ID NO: 116178 - RNA, 20 nt, Human
gggcuggggcuggggcuggg

SEQ ID NO: 116179 - RNA, 22 nt, Human
gggcuggggcuggggcuggggc

SEQ ID NO: 116180 - RNA, 23 nt, Human
gggcuggggcuggggcuggggcu

SEQ ID NO: 116181 - RNA, 24 nt, Human
gggcuggggcuggguugcggggag

SEQ ID NO: 116182 - RNA, 18 nt, Human
gggcuggguugcggggag

SEQ ID NO: 116183 - RNA, 18 nt, Human
ggucccaccggagcccaa

SEQ ID NO: 116184 - RNA, 18 nt, Human
ucaggccccccaggcuuc

SEQ ID NO: 116185 - RNA, 22 nt, Human
ucaggccccccaggcuucuugg

SEQ ID NO: 116186 - RNA, 19 nt, Human
uccccggaucucucccugc

SEQ ID NO: 116187 - RNA, 21 nt, Human
uccgccggagucaccucccuu

SEQ ID NO: 116188 - RNA, 24 nt, Human
uccuccucuguccaggaaccccag

SEQ ID NO: 116189 - RNA, 21 nt, Human
ucucggaauuucgcuuggucc

SEQ ID NO: 116190 - RNA, 25 nt, Human
ugacagcuggggacgcggcggggcu

SEQ ID NO: 116191 - RNA, 19 nt, Human
ugcccgcugguaugugaga

SEQ ID NO: 116192 - RNA, 20 nt, Human
uggggcuggggcuggggcuc

SEQ ID NO: 116193 - RNA, 23 nt, Human
uggggcuggggcuggggcugggu

SEQ ID NO: 116194 - RNA, 21 nt, Human
uguuccaacucccuguucugu

SEQ ID NO: 116195 - RNA, 23 nt, Human
uugacacuuguucaagucucuca

SEQ ID NO: 116196 - RNA, 20 nt, Human
uuuuuuuuuuuucagaggcc

SEQ ID NO: 116197 - RNA, 21 nt, Human
uuuuuuuuuuuuuuuucagag

SEQ ID NO: 116198 - RNA, 22 nt, Human
uuuuuuuuuuuuuuuuuuucag

SEQ ID NO: 116199 - RNA, 18 nt, Human
aaccgccacaacugaaca

SEQ ID NO: 116200 - RNA, 24 nt, Human
accaccaacgaaaauggccacgcc

SEQ ID NO: 116201 - RNA, 21 nt, Human
accgccacaacugaacaccac

SEQ ID NO: 116202 - RNA, 19 nt, Human
acugaacaccaccaacgaa

SEQ ID NO: 116203 - RNA, 21 nt, Human
agagcugaaugaaacugaacc

SEQ ID NO: 116204 - RNA, 21 nt, Human
ccacaacugaacaccaccaac

SEQ ID NO: 116205 - RNA, 19 nt, Human
cugaccagcaaccgccaca

SEQ ID NO: 116206 - RNA, 20 nt, Human
gacugcuuuauugguggcag

SEQ ID NO: 116207 - RNA, 23 nt, Human
uccccaaagaagagcucgguuau

SEQ ID NO: 116208 - RNA, 21 nt, Human
ugaaugaaacugaaccaagcg

SEQ ID NO: 116209 - RNA, 23 nt, Human
ugguaaagacugcuuuauuggug

SEQ ID NO: 116210 - RNA, 24 nt, Human
uugguggcaguuacuacaagucaa

SEQ ID NO: 116211 - RNA, 19 nt, Human
uuuaucagauuacuggucc

SEQ ID NO: 116212 - RNA, 21 nt, Human
aaacagguauucucuguuccc

SEQ ID NO: 116213 - RNA, 22 nt, Human
aacaaaacagacaccagucuaa

SEQ ID NO: 116214 - RNA, 23 nt, Human
aacaaaacagacaccagucuaaa

SEQ ID NO: 116215 - RNA, 20 nt, Human
aauccccgaggugacuaacu

SEQ ID NO: 116216 - RNA, 23 nt, Human
acccuuugaaauuaccugcccaa

SEQ ID NO: 116217 - RNA, 26 nt, Human
acuucaaaggguuuaugccaaaaaag

SEQ ID NO: 116218 - RNA, 19 nt, Human
agaaaggcuccugcacccc

SEQ ID NO: 116219 - RNA, 23 nt, Human
agcacagacugacauuaacaagc

SEQ ID NO: 116220 - RNA, 19 nt, Human
aggagcacaaacacagagc

SEQ ID NO: 116221 - RNA, 26 nt, Human
caaaaaacaaaccaguccucugcagc

SEQ ID NO: 116222 - RNA, 27 nt, Human
caaaaaacaaaccaguccucugcagcc

SEQ ID NO: 116223 - RNA, 18 nt, Human
caaacacagagcaaagca

SEQ ID NO: 116224 - RNA, 23 nt, Human
caaccucaagucccugagguccu

SEQ ID NO: 116225 - RNA, 24 nt, Human
cacaaacacagagcaaagcaccau

SEQ ID NO: 116226 - RNA, 24 nt, Human
cacauccaaauccagaaaggcucc

SEQ ID NO: 116227 - RNA, 18 nt, Human
cacaugaccuuggcuucu

SEQ ID NO: 116228 - RNA, 18 nt, Human
cauccaaguaaaaaaaaa

SEQ ID NO: 116229 - RNA, 23 nt, Human
ccacauccaaauccagaaaggcu

SEQ ID NO: 116230 - RNA, 21 nt, Human
ccagggaaaucaggagcacaa

SEQ ID NO: 116231 - RNA, 21 nt, Human
gcaaagcaccauuucuuuaaa

SEQ ID NO: 116232 - RNA, 22 nt, Human
gcaccccaugcucaaaaaugca

SEQ ID NO: 116233 - RNA, 22 nt, Human
gccaaaaaacaaaccaguccuc

SEQ ID NO: 116234 - RNA, 19 nt, Human
ucaaaaaugcaaccucaag

SEQ ID NO: 116235 - RNA, 24 nt, Human
ucagcacagacugacauuaacaag

SEQ ID NO: 116236 - RNA, 19 nt, Human
uccaaauccagaaaggcuc

SEQ ID NO: 116237 - RNA, 26 nt, Human
uccauagccacauccaaauccagaaa

SEQ ID NO: 116238 - RNA, 19 nt, Human
uccccgaggugacuaacuc

SEQ ID NO: 116239 - RNA, 21 nt, Human
uccucauuucaugcacaugac

SEQ ID NO: 116240 - RNA, 21 nt, Human
ugcaaaaauguuaagccaucc

SEQ ID NO: 116241 - RNA, 18 nt, Human
ugcaaaauggaaaaaauc

SEQ ID NO: 116242 - RNA, 23 nt, Human
ugcaaaauggaaaaaauccccga

SEQ ID NO: 116243 - RNA, 18 nt, Human
ugccaaaaaacaaaccag

SEQ ID NO: 116244 - RNA, 22 nt, Human
ugccaacgcgaccgccccagag

SEQ ID NO: 116245 - RNA, 19 nt, Human
uggcuucuguguucuuucc

SEQ ID NO: 116246 - RNA, 21 nt, Human
uguggcacagcugcauuaaca

SEQ ID NO: 116247 - RNA, 23 nt, Human
uuucauaaacaaaccaaaacauc

SEQ ID NO: 116248 - RNA, 23 nt, Human
uuuccauagccacauccaaaucc

SEQ ID NO: 116249 - RNA, 24 nt, Human
uuuuuuuucauucauguauuuauu

SEQ ID NO: 116250 - RNA, 21 nt, Human
uuuuuuuuuuuuuuuuucauu

SEQ ID NO: 116251 - RNA, 20 nt, Human
acuuccagaggcugcaccuc

SEQ ID NO: 116252 - RNA, 22 nt, Human
auccacuuccagaggcugcacc

SEQ ID NO: 116253 - RNA, 19 nt, Human
caccaagaccuuuuuuuuc

SEQ ID NO: 116254 - RNA, 24 nt, Human
cgaaaggcgcagagaaugaggaca

SEQ ID NO: 116255 - RNA, 18 nt, Human
cggcaccucaccaagacc

SEQ ID NO: 116256 - RNA, 21 nt, Human
gaaaggcgcagagaaugagga

SEQ ID NO: 116257 - RNA, 19 nt, Human
ugaggacagaugaaauggc

SEQ ID NO: 116258 - RNA, 22 nt, Human
uugauccacuuccagaggcugc

SEQ ID NO: 116259 - RNA, 20 nt, Human
uuuuuuuuuuuuuuuuucac

SEQ ID NO: 116260 - RNA, 20 nt, Human
uuuuuuuuuuuuuuuuucac

SEQ ID NO: 116261 - RNA, 21 nt, Human
aagaggucaugauugcagaag

SEQ ID NO: 116262 - RNA, 19 nt, Human
aagcagggucagugacccc

SEQ ID NO: 116263 - RNA, 19 nt, Human
aaggaggucaccauggaga

SEQ ID NO: 116264 - RNA, 24 nt, Human
acaugauccaggggaggccggcca

SEQ ID NO: 116265 - RNA, 18 nt, Human
auggagacaucaagaggu

SEQ ID NO: 116266 - RNA, 20 nt, Human
cacagugugagggacagaac

SEQ ID NO: 116267 - RNA, 19 nt, Human
caggaugggccgguggggc

SEQ ID NO: 116268 - RNA, 24 nt, Human
caggggaggccggccacaaaugca

SEQ ID NO: 116269 - RNA, 19 nt, Human
ccacaaaaaacggucagcc

SEQ ID NO: 116270 - RNA, 19 nt, Human
ccaggggaggccggccaca

SEQ ID NO: 116271 - RNA, 22 nt, Human
ccggccacaaaugcaguaacau

SEQ ID NO: 116272 - RNA, 23 nt, Human
gccggccacaaaugcaguaacau

SEQ ID NO: 116273 - RNA, 22 nt, Human
ggaggccggccacaaaugcagu

SEQ ID NO: 116274 - RNA, 21 nt, Human
ugauugcagaagaggugacug

SEQ ID NO: 116275 - RNA, 20 nt, Human
uggggcuggucaggucacag

SEQ ID NO: 116276 - RNA, 26 nt, Human
cauugguuuuucucuuuuuuccacuu

SEQ ID NO: 116277 - RNA, 22 nt, Human
ccacuuaucaccaauuuauuuc

SEQ ID NO: 116278 - RNA, 20 nt, Human
uacauuguuaugaaucauug

SEQ ID NO: 116279 - RNA, 21 nt, Human
ucauugguuuuucucuuuuuu

SEQ ID NO: 116280 - RNA, 22 nt, Human
uuaugaaucauugguuuuucuc

SEQ ID NO: 116281 - RNA, 20 nt, Human
ugccuggauggggccagaga

SEQ ID NO: 116282 - RNA, 19 nt, Human
uggggccagagaggaggac

SEQ ID NO: 116283 - RNA, 19 nt, Human
uuuuuuuuuugcaagcccc

SEQ ID NO: 116284 - RNA, 22 nt, Human
uuuuuuuuuuuugcaagcccca

SEQ ID NO: 116285 - RNA, 18 nt, Human
uuuuuuuuuuuuuuuuug

SEQ ID NO: 116286 - RNA, 21 nt, Human
uuuuuuuuuuuuuuuuugcaa

SEQ ID NO: 116287 - RNA, 21 nt, Human
ccaaagagauuuuaauggcuc

SEQ ID NO: 116288 - RNA, 18 nt, Human
gcucuuguuucuucccca

SEQ ID NO: 116289 - RNA, 21 nt, Human
uuaauggcucuuguuucuucc

SEQ ID NO: 116290 - RNA, 24 nt, Human
aagcaaacagcaguaacaugggac

SEQ ID NO: 116291 - RNA, 19 nt, Human
aggcacaaaaaaggauuaa

SEQ ID NO: 116292 - RNA, 22 nt, Human
cacuguauaucaccuuucaaaa

SEQ ID NO: 116293 - RNA, 23 nt, Human
cacuguauaucaccuuucaaaau

SEQ ID NO: 116294 - RNA, 20 nt, Human
cacuuggagcaaagaaaggu

SEQ ID NO: 116295 - RNA, 23 nt, Human
cccacuguauaucaccuuucaaa

SEQ ID NO: 116296 - RNA, 19 nt, Human
cuuaaaugagcaagagaag

SEQ ID NO: 116297 - RNA, 19 nt, Human
gaaauagaagcugcauuug

SEQ ID NO: 116298 - RNA, 19 nt, Human
gaagccacauggugaaaau

SEQ ID NO: 116299 - RNA, 21 nt, Human
gaugaaaggcacaaaaaagga

SEQ ID NO: 116300 - RNA, 19 nt, Human
gcauuuuauuuuauuguau

SEQ ID NO: 116301 - RNA, 21 nt, Human
gguccaaacuucacuuggagc

SEQ ID NO: 116302 - RNA, 18 nt, Human
guuauggugcuacugaaa

SEQ ID NO: 116303 - RNA, 26 nt, Human
uaaguaaaagcaaacagcaguaacau

SEQ ID NO: 116304 - RNA, 19 nt, Human
ucauuuguuuucugugccc

SEQ ID NO: 116305 - RNA, 20 nt, Human
ucugugagaaacugaggguu

SEQ ID NO: 116306 - RNA, 19 nt, Human
ugaaaggcacaaaaaagga

SEQ ID NO: 116307 - RNA, 21 nt, Human
ugaaaggcacaaaaaaggauu

SEQ ID NO: 116308 - RNA, 20 nt, Human
ugaaaguaaguaaaagcaaa

SEQ ID NO: 116309 - RNA, 25 nt, Human
ugagaaacugaggguuuucauuugu

SEQ ID NO: 116310 - RNA, 24 nt, Human
ugagcaagagaaggauucagguga

SEQ ID NO: 116311 - RNA, 19 nt, Human
ugaggguuuucauuuguuu

SEQ ID NO: 116312 - RNA, 22 nt, Human
ugggacuuaaaugagcaagaga

SEQ ID NO: 116313 - RNA, 18 nt, Human
uuccaaacagagggcagu

SEQ ID NO: 116314 - RNA, 23 nt, Human
uucugcuggguccaaacuucacu

SEQ ID NO: 116315 - RNA, 18 nt, Human
uuuucauuuguuuucugu

SEQ ID NO: 116316 - RNA, 22 nt, Human
uuuucauuuguuuucugugccc

SEQ ID NO: 116317 - RNA, 18 nt, Human
aaaguugcuugagauggc

SEQ ID NO: 116318 - RNA, 18 nt, Human
aaaguugcuugagauggc

SEQ ID NO: 116319 - RNA, 19 nt, Human
aaaguugcuugagauggcu

SEQ ID NO: 116320 - RNA, 19 nt, Human
aaaguugcuugagauggcu

SEQ ID NO: 116321 - RNA, 21 nt, Human
aagcagaaugauaaaaucagg

SEQ ID NO: 116322 - RNA, 21 nt, Human
aagcagaaugauaaaaucagg

SEQ ID NO: 116323 - RNA, 22 nt, Human
aagcagaaugauaaaaucaggg

SEQ ID NO: 116324 - RNA, 22 nt, Human
aagcagaaugauaaaaucaggg

SEQ ID NO: 116325 - RNA, 18 nt, Human
cagcgugagaugaucuuu

SEQ ID NO: 116326 - RNA, 20 nt, Human
caugaacccuagucugccuu

SEQ ID NO: 116327 - RNA, 20 nt, Human
caugaacccuagucugccuu

SEQ ID NO: 116328 - RNA, 18 nt, Human
cuggaaucaguaaauuaa

SEQ ID NO: 116329 - RNA, 21 nt, Human
gugagaugaucuuugauuaaa

SEQ ID NO: 116330 - RNA, 21 nt, Human
gugagaugaucuuugauuaaa

SEQ ID NO: 116331 - RNA, 28 nt, Human
uaaaggcacaagcagaaauuggagaccc

SEQ ID NO: 116332 - RNA, 28 nt, Human
uaaaggcacaagcagaaauuggagaccc

SEQ ID NO: 116333 - RNA, 24 nt, Human
uagguucucugacagaaccaagga

SEQ ID NO: 116334 - RNA, 24 nt, Human
uagguucucugacagaaccaagga

SEQ ID NO: 116335 - RNA, 23 nt, Human
ucaaacgucgaaaaucaaagaaa

SEQ ID NO: 116336 - RNA, 23 nt, Human
ucaaacgucgaaaaucaaagaaa

SEQ ID NO: 116337 - RNA, 20 nt, Human
ucaguaaauuaaaauacgga

SEQ ID NO: 116338 - RNA, 20 nt, Human
ucaguaaauuaaaauacgga

SEQ ID NO: 116339 - RNA, 18 nt, Human
ucgaaaaucaaagaaaaa

SEQ ID NO: 116340 - RNA, 19 nt, Human
ucgaaaaucaaagaaaaag

SEQ ID NO: 116341 - RNA, 22 nt, Human
ucgaaaguugcuugagauggcu

SEQ ID NO: 116342 - RNA, 22 nt, Human
ucgaaaguugcuugagauggcu

SEQ ID NO: 116343 - RNA, 21 nt, Human
ugaaaauuuggagcagaaauc

SEQ ID NO: 116344 - RNA, 21 nt, Human
ugaaaauuuggagcagaaauc

SEQ ID NO: 116345 - RNA, 21 nt, Human
uggagcagaaaucuuuaaugu

SEQ ID NO: 116346 - RNA, 21 nt, Human
uggagcagaaaucuuuaaugu

SEQ ID NO: 116347 - RNA, 20 nt, Human
uugaguaggauccaaugauc

SEQ ID NO: 116348 - RNA, 20 nt, Human
uugaguaggauccaaugauc

SEQ ID NO: 116349 - RNA, 19 nt, Human
uuucuaaaggcacaagcag

SEQ ID NO: 116350 - RNA, 19 nt, Human
uuucuaaaggcacaagcag

SEQ ID NO: 116351 - RNA, 26 nt, Human
aaaccccuccaccugaaggcuuuggg

SEQ ID NO: 116352 - RNA, 24 nt, Human
aaagaaaaauacuaaagccacuag

SEQ ID NO: 116353 - RNA, 22 nt, Human
aaccaaaucacucccagaggcc

SEQ ID NO: 116354 - RNA, 24 nt, Human
aaccaaaucacucccagaggccua

SEQ ID NO: 116355 - RNA, 25 nt, Human
aagacagacauaauaaaaugcaaau

SEQ ID NO: 116356 - RNA, 21 nt, Human
aagagaccgucaaaugaaaca

SEQ ID NO: 116357 - RNA, 18 nt, Human
aagaugacacuuucacac

SEQ ID NO: 116358 - RNA, 19 nt, Human
aagccaaaugcagaagccc

SEQ ID NO: 116359 - RNA, 19 nt, Human
accugaauaagaaaaacuc

SEQ ID NO: 116360 - RNA, 27 nt, Human
agaaaaacuccagcuauuuaacaacua

SEQ ID NO: 116361 - RNA, 24 nt, Human
agcagcagcaccuguggguuuuua

SEQ ID NO: 116362 - RNA, 21 nt, Human
auggcugggucaucugaaaac

SEQ ID NO: 116363 - RNA, 24 nt, Human
caacuagagaaaaguacuccucag

SEQ ID NO: 116364 - RNA, 25 nt, Human
caagaggaacuguaauuuugcuugg

SEQ ID NO: 116365 - RNA, 20 nt, Human
caauauuaaagaaucaggca

SEQ ID NO: 116366 - RNA, 21 nt, Human
cagguuaagaaugugcaagua

SEQ ID NO: 116367 - RNA, 23 nt, Human
cccaagaggaacuguaauuuugc

SEQ ID NO: 116368 - RNA, 20 nt, Human
ccgaucuagccuuggaacag

SEQ ID NO: 116369 - RNA, 26 nt, Human
ccuacuguuauauguguuuaaaaauc

SEQ ID NO: 116370 - RNA, 22 nt, Human
ccugaauaagaaaaacuccagc

SEQ ID NO: 116371 - RNA, 19 nt, Human
cgacugaacuuuuagaaaa

SEQ ID NO: 116372 - RNA, 20 nt, Human
cucccuuaaaaugggcuauu

SEQ ID NO: 116373 - RNA, 18 nt, Human
gauaagacagacauaaua

SEQ ID NO: 116374 - RNA, 27 nt, Human
gauaagacagacauaauaaaaugcaaa

SEQ ID NO: 116375 - RNA, 22 nt, Human
gccaaaugcagaagcccauuua

SEQ ID NO: 116376 - RNA, 18 nt, Human
gcugggagauaugcaaaa

SEQ ID NO: 116377 - RNA, 23 nt, Human
ggcaaagaaccaaaucacuccca

SEQ ID NO: 116378 - RNA, 24 nt, Human
gugaaauucacagagaauacaaau

SEQ ID NO: 116379 - RNA, 18 nt, Human
uaacugauacauuaaugg

SEQ ID NO: 116380 - RNA, 21 nt, Human
uaagagagguagugaaauccu

SEQ ID NO: 116381 - RNA, 18 nt, Human
uagagaaaaguacuccuc

SEQ ID NO: 116382 - RNA, 19 nt, Human
uagguugaaaaaaccuuga

SEQ ID NO: 116383 - RNA, 24 nt, Human
uauuaaagaaucaggcauuccuag

SEQ ID NO: 116384 - RNA, 21 nt, Human
uauuuuguguucaaauacagg

SEQ ID NO: 116385 - RNA, 26 nt, Human
ucaaaaagagaccgucaaaugaaaca

SEQ ID NO: 116386 - RNA, 22 nt, Human
ucaaaugaaacauuagggcaaa

SEQ ID NO: 116387 - RNA, 23 nt, Human
ucaauucaaccuccauuaaaccu

SEQ ID NO: 116388 - RNA, 24 nt, Human
ucagaucuuguagauggcuggguc

SEQ ID NO: 116389 - RNA, 22 nt, Human
ucagcagucauaguuuacauuu

SEQ ID NO: 116390 - RNA, 22 nt, Human
ucucccuuaaaaugggcuauuu

SEQ ID NO: 116391 - RNA, 21 nt, Human
ugaaggcuuugggauaacuga

SEQ ID NO: 116392 - RNA, 22 nt, Human
ugauuggcagugaagaugacac

SEQ ID NO: 116393 - RNA, 21 nt, Human
ugcaaguaggucucuuccaca

SEQ ID NO: 116394 - RNA, 22 nt, Human
ugcaaguaggucucuuccacau

SEQ ID NO: 116395 - RNA, 23 nt, Human
uggaacagguagaaagccaaaug

SEQ ID NO: 116396 - RNA, 24 nt, Human
uggcugggucaucugaaaaccaug

SEQ ID NO: 116397 - RNA, 22 nt, Human
ugucccugccuuaauguuucug

SEQ ID NO: 116398 - RNA, 19 nt, Human
ugugaacaagaccggucaa

SEQ ID NO: 116399 - RNA, 23 nt, Human
ugugcaacauagaaaaagguucc

SEQ ID NO: 116400 - RNA, 23 nt, Human
uuaaagcuuuaugucgauucuga

SEQ ID NO: 116401 - RNA, 19 nt, Human
uuaauuucccaaagcucuu

SEQ ID NO: 116402 - RNA, 19 nt, Human
uucccaaagcucuuugaag

SEQ ID NO: 116403 - RNA, 19 nt, Human
uugcuagaucucucucuca

SEQ ID NO: 116404 - RNA, 18 nt, Human
uuggccauuuaaaacaaa

SEQ ID NO: 116405 - RNA, 23 nt, Human
uuggccauuuaaaacaaagaaaa

SEQ ID NO: 116406 - RNA, 18 nt, Human
uugguacuuaugcuggga

SEQ ID NO: 116407 - RNA, 19 nt, Human
uuuccuacuguuauaugug

SEQ ID NO: 116408 - RNA, 20 nt, Human
uuuugcuagaucucucucuc

SEQ ID NO: 116409 - RNA, 18 nt, Human
uuuuuuuuuuuuuucuug

SEQ ID NO: 116410 - RNA, 21 nt, Human
acuaauuuuugaaagcuagaa

SEQ ID NO: 116411 - RNA, 20 nt, Human
acugcgaggcagggggccgg

SEQ ID NO: 116412 - RNA, 31 nt, Human
acuggggauuuuuuuuuaaccuuuauucauu

SEQ ID NO: 116413 - RNA, 22 nt, Human
agaggagacgggcaaagccgcg

SEQ ID NO: 116414 - RNA, 24 nt, Human
agucagcacaagaaaaaaacgaca

SEQ ID NO: 116415 - RNA, 25 nt, Human
auaaaaccucuuuguaaacauguaa

SEQ ID NO: 116416 - RNA, 20 nt, Human
auagguaggaaaaugaauac

SEQ ID NO: 116417 - RNA, 18 nt, Human
caagagaaaacccuaaac

SEQ ID NO: 116418 - RNA, 22 nt, Human
caccagccucuacucgccucac

SEQ ID NO: 116419 - RNA, 21 nt, Human
cacucuacaaccaagagaaaa

SEQ ID NO: 116420 - RNA, 26 nt, Human
caucaaaaaugcauuaacaagaucau

SEQ ID NO: 116421 - RNA, 25 nt, Human
cauucagaaugcaauucugggccac

SEQ ID NO: 116422 - RNA, 21 nt, Human
ccacgggcugcacuacuggcc

SEQ ID NO: 116423 - RNA, 26 nt, Human
cccggcccugggcuuagcccgccggc

SEQ ID NO: 116424 - RNA, 19 nt, Human
ccgccgccgccggccgugc

SEQ ID NO: 116425 - RNA, 21 nt, Human
ccuacgcgggcggccucuuuu

SEQ ID NO: 116426 - RNA, 23 nt, Human
ccucuacucgccucaccuucccc

SEQ ID NO: 116427 - RNA, 24 nt, Human
ccucuacucgccucaccuuccccg

SEQ ID NO: 116428 - RNA, 22 nt, Human
cgccggccgugccuuccuacgc

SEQ ID NO: 116429 - RNA, 21 nt, Human
cgccucaccuuccccggcuga

SEQ ID NO: 116430 - RNA, 18 nt, Human
cgcggagcccaggggagc

SEQ ID NO: 116431 - RNA, 21 nt, Human
cgcugcgcuccgccgccgccg

SEQ ID NO: 116432 - RNA, 19 nt, Human
cggcuccacgggcugcacu

SEQ ID NO: 116433 - RNA, 20 nt, Human
cucuacaaccaagagaaaac

SEQ ID NO: 116434 - RNA, 25 nt, Human
cugcacaaaaucuaaaaaaaagacc

SEQ ID NO: 116435 - RNA, 19 nt, Human
gagacgggcaaagccgcgg

SEQ ID NO: 116436 - RNA, 24 nt, Human
gcacaaaaucuaaaaaaaagacca

SEQ ID NO: 116437 - RNA, 20 nt, Human
gcacaagaaaaaaacgacaa

SEQ ID NO: 116438 - RNA, 20 nt, Human
gcccgccggcgcugcugggg

SEQ ID NO: 116439 - RNA, 19 nt, Human
gcuuauaguuagucagcac

SEQ ID NO: 116440 - RNA, 23 nt, Human
ggccacucuacaaccaagagaaa

SEQ ID NO: 116441 - RNA, 19 nt, Human
guuaaccuuuucaauagca

SEQ ID NO: 116442 - RNA, 18 nt, Human
uaaaaaauaaaucaaugu

SEQ ID NO: 116443 - RNA, 24 nt, Human
uaacugcacaaaaucuaaaaaaaa

SEQ ID NO: 116444 - RNA, 21 nt, Human
uaagccuaggauggcaaaauu

SEQ ID NO: 116445 - RNA, 23 nt, Human
uacucgccucaccuuccccggcu

SEQ ID NO: 116446 - RNA, 21 nt, Human
ucaccaauuacaguaaaagaa

SEQ ID NO: 116447 - RNA, 22 nt, Human
ucagcacaagaaaaaaacgaca

SEQ ID NO: 116448 - RNA, 24 nt, Human
ucugggccacucuacaaccaagag

SEQ ID NO: 116449 - RNA, 20 nt, Human
ucuuuugucugcccggcccu

SEQ ID NO: 116450 - RNA, 24 nt, Human
ugcauuaacaagaucaugcuuaua

SEQ ID NO: 116451 - RNA, 22 nt, Human
ugcauuuaagccuaggauggca

SEQ ID NO: 116452 - RNA, 24 nt, Human
uguaaacauguaccuuuucuuccc

SEQ ID NO: 116453 - RNA, 18 nt, Human
uucagaaugcaauucugg

SEQ ID NO: 116454 - RNA, 25 nt, Human
aaaaagaaaagaaagaaccaaaaag

SEQ ID NO: 116455 - RNA, 26 nt, Human
aaccuaauaaaaagaaaagaaagaac

SEQ ID NO: 116456 - RNA, 25 nt, Human
aagaaagaaccaaaaagaaguagua

SEQ ID NO: 116457 - RNA, 21 nt, Human
aagaaccaaaaagaaguagua

SEQ ID NO: 116458 - RNA, 18 nt, Human
acccugggaugaagggag

SEQ ID NO: 116459 - RNA, 22 nt, Human
aggcugcagcuccuccgcggcc

SEQ ID NO: 116460 - RNA, 18 nt, Human
aggcuggggcaggaggcc

SEQ ID NO: 116461 - RNA, 18 nt, Human
cagaggccaacugagguu

SEQ ID NO: 116462 - RNA, 22 nt, Human
ccccuggccagggaagaggggc

SEQ ID NO: 116463 - RNA, 21 nt, Human
cccuucagaauugagacuuaa

SEQ ID NO: 116464 - RNA, 20 nt, Human
ccgggccgagguucuggcgc

SEQ ID NO: 116465 - RNA, 21 nt, Human
ccuggcuggccuggcuuggga

SEQ ID NO: 116466 - RNA, 20 nt, Human
ccugggaugaagggaggugu

SEQ ID NO: 116467 - RNA, 25 nt, Human
ccuucagaauugagacuuaaccuaa

SEQ ID NO: 116468 - RNA, 23 nt, Human
cgcccgggccgagguucuggcgc

SEQ ID NO: 116469 - RNA, 18 nt, Human
cgcggccgacgagggcgc

SEQ ID NO: 116470 - RNA, 18 nt, Human
cggcagaauuugcaugca

SEQ ID NO: 116471 - RNA, 31 nt, Human
cgugccuuagcccacggcagaauuugcaugg

SEQ ID NO: 116472 - RNA, 21 nt, Human
cucccccucuuccuugacucc

SEQ ID NO: 116473 - RNA, 24 nt, Human
cucccucccccucuuccuugacuc

SEQ ID NO: 116474 - RNA, 23 nt, Human
cucugguuagcgugccuuagccc

SEQ ID NO: 116475 - RNA, 19 nt, Human
cugcagcuccuccgcggcc

SEQ ID NO: 116476 - RNA, 18 nt, Human
cuggcuggccuggcuugg

SEQ ID NO: 116477 - RNA, 21 nt, Human
cuuccuguuggaggcugcagc

SEQ ID NO: 116478 - RNA, 18 nt, Human
ggcagggaucacaccuuc

SEQ ID NO: 116479 - RNA, 23 nt, Human
ggggcagaggccaacugagguuu

SEQ ID NO: 116480 - RNA, 20 nt, Human
ggugugagggagagcugagg

SEQ ID NO: 116481 - RNA, 18 nt, Human
gugagggagagcugaggg

SEQ ID NO: 116482 - RNA, 25 nt, Human
uagcauggcagggaucacaccuucc

SEQ ID NO: 116483 - RNA, 24 nt, Human
uccgcggccgacgagggccggggc

SEQ ID NO: 116484 - RNA, 21 nt, Human
uccuccgcggccgacgagggc

SEQ ID NO: 116485 - RNA, 22 nt, Human
uccuggcuggccuggcuuggga

SEQ ID NO: 116486 - RNA, 18 nt, Human
ugagggggagaagccccu

SEQ ID NO: 116487 - RNA, 18 nt, Human
uggaguaggcuggggcag

SEQ ID NO: 116488 - RNA, 19 nt, Human
uucucccucccccucuucc

SEQ ID NO: 116489 - RNA, 20 nt, Human
uucucccucccccucuuccu

SEQ ID NO: 116490 - RNA, 24 nt, Human
uugcaugcagcgcuccuggcuggc

SEQ ID NO: 116491 - RNA, 20 nt, Human
aaagugcugggauuacaagg

SEQ ID NO: 116492 - RNA, 25 nt, Human
aaagugcugggauuacaagguguga

SEQ ID NO: 116493 - RNA, 24 nt, Human
aaccucagggugauccgcccaccu

SEQ ID NO: 116494 - RNA, 20 nt, Human
aagugcugggauuacaaggu

SEQ ID NO: 116495 - RNA, 22 nt, Human
aagugcugggauuacaaggugu

SEQ ID NO: 116496 - RNA, 27 nt, Human
aagugcugggauuacaaggugugagcc

SEQ ID NO: 116497 - RNA, 21 nt, Human
aauggcacuaucucggcucac

SEQ ID NO: 116498 - RNA, 21 nt, Human
acaggguuucaccauguuggu

SEQ ID NO: 116499 - RNA, 23 nt, Human
acaggguuucaccauguugguca

SEQ ID NO: 116500 - RNA, 24 nt, Human
acaggguuucaccauguuggucag

SEQ ID NO: 116501 - RNA, 20 nt, Human
accauguuggucaggcuggu

SEQ ID NO: 116502 - RNA, 21 nt, Human
accucagggugauccgcccac

SEQ ID NO: 116503 - RNA, 30 nt, Human
acucuguugcccaagcuggaguacaauggg

SEQ ID NO: 116504 - RNA, 23 nt, Human
agugagcaaucccugauuccagg

SEQ ID NO: 116505 - RNA, 25 nt, Human
caaagugcugggauuacaaggugug

SEQ ID NO: 116506 - RNA, 22 nt, Human
caagcgauucuccugucucagc

SEQ ID NO: 116507 - RNA, 21 nt, Human
caccauguuggucaggcuggu

SEQ ID NO: 116508 - RNA, 21 nt, Human
caccauguuggucaggcuggu

SEQ ID NO: 116509 - RNA, 24 nt, Human
caccauguuggucaggcugguuuu

SEQ ID NO: 116510 - RNA, 24 nt, Human
caggguuucaccauguuggucagg

SEQ ID NO: 116511 - RNA, 21 nt, Human
caggugcccgccaccacaccc

SEQ ID NO: 116512 - RNA, 22 nt, Human
caggugcccgccaccacacccc

SEQ ID NO: 116513 - RNA, 24 nt, Human
cauguuggucaggcugguuuugaa

SEQ ID NO: 116514 - RNA, 21 nt, Human
ccaaagugcugggauuacaag

SEQ ID NO: 116515 - RNA, 24 nt, Human
ccaaagugcugggauuacaaggug

SEQ ID NO: 116516 - RNA, 25 nt, Human
ccaaagugcugggauuacaaggugu

SEQ ID NO: 116517 - RNA, 21 nt, Human
ccacugcuccuggccuuaugg

SEQ ID NO: 116518 - RNA, 23 nt, Human
cccaagcuggaguacaauggcac

SEQ ID NO: 116519 - RNA, 24 nt, Human
ccucuaggguucaagcgauucucc

SEQ ID NO: 116520 - RNA, 20 nt, Human
ccuggccuuauggugaaguc

SEQ ID NO: 116521 - RNA, 22 nt, Human
cgucaagacugaaucauucuuu

SEQ ID NO: 116522 - RNA, 23 nt, Human
cugucucagccuccugaaaggcu

SEQ ID NO: 116523 - RNA, 23 nt, Human
cuucaggaagaucguggaguuuc

SEQ ID NO: 116524 - RNA, 19 nt, Human
gauuacaaggugugagcca

SEQ ID NO: 116525 - RNA, 23 nt, Human
gauuacaaggugugagccacugc

SEQ ID NO: 116526 - RNA, 18 nt, Human
gauuacaggugcccgcca

SEQ ID NO: 116527 - RNA, 21 nt, Human
gauucuccugucucagccucc

SEQ ID NO: 116528 - RNA, 22 nt, Human
gcaaacuccgccucuaggguuc

SEQ ID NO: 116529 - RNA, 20 nt, Human
gcaguacuuguuagguaagu

SEQ ID NO: 116530 - RNA, 24 nt, Human
gcgauucuccugucucagccuccu

SEQ ID NO: 116531 - RNA, 20 nt, Human
gcuggaguacaauggcacua

SEQ ID NO: 116532 - RNA, 23 nt, Human
gcugguuuugaacuccuaaccuc

SEQ ID NO: 116533 - RNA, 24 nt, Human
ggcugguuuugaacuccuaaccuc

SEQ ID NO: 116534 - RNA, 22 nt, Human
gggauuacaaggugugagccac

SEQ ID NO: 116535 - RNA, 20 nt, Human
ggguucaagcgauucuccug

SEQ ID NO: 116536 - RNA, 22 nt, Human
ggguuucaccauguuggucagg

SEQ ID NO: 116537 - RNA, 23 nt, Human
ggugauccgcccaccuuggccuc

SEQ ID NO: 116538 - RNA, 19 nt, Human
uaagugucuuccauucacc

SEQ ID NO: 116539 - RNA, 22 nt, Human
uagagacaggguuucaccaugu

SEQ ID NO: 116540 - RNA, 21 nt, Human
uaggguucaagcgauucuccu

SEQ ID NO: 116541 - RNA, 24 nt, Human
uaguagagacaggguuucaccaug

SEQ ID NO: 116542 - RNA, 25 nt, Human
uaguagagacaggguuucaccaugu

SEQ ID NO: 116543 - RNA, 24 nt, Human
uauuuaguagagacaggguuucac

SEQ ID NO: 116544 - RNA, 18 nt, Human
ucacugcaaacuccgccu

SEQ ID NO: 116545 - RNA, 19 nt, Human
ucacugcaaacuccgccuc

SEQ ID NO: 116546 - RNA, 23 nt, Human
ucacugcaaacuccgccucuagg

SEQ ID NO: 116547 - RNA, 24 nt, Human
ucacugcaaacuccgccucuaggg

SEQ ID NO: 116548 - RNA, 18 nt, Human
ucagccuccugaaaggcu

SEQ ID NO: 116549 - RNA, 24 nt, Human
ucagggugauccgcccaccuuggc

SEQ ID NO: 116550 - RNA, 23 nt, Human
uccauucaccgucaagacugaau

SEQ ID NO: 116551 - RNA, 23 nt, Human
ucccaaagugcugggauuacaag

SEQ ID NO: 116552 - RNA, 24 nt, Human
ucuaggguucaagcgauucuccug

SEQ ID NO: 116553 - RNA, 26 nt, Human
ucuccugucucagccuccugaaaggc

SEQ ID NO: 116554 - RNA, 22 nt, Human
ucuuacucuguugcccaagcug

SEQ ID NO: 116555 - RNA, 23 nt, Human
ucuuacucuguugcccaagcugg

SEQ ID NO: 116556 - RNA, 24 nt, Human
ucuuacucuguugcccaagcugga

SEQ ID NO: 116557 - RNA, 24 nt, Human
ugauccgcccaccuuggccuccca

SEQ ID NO: 116558 - RNA, 24 nt, Human
ugcccaagcuggaguacaauggca

SEQ ID NO: 116559 - RNA, 21 nt, Human
ugcgauuacaggugcccgcca

SEQ ID NO: 116560 - RNA, 22 nt, Human
ugcgauuacaggugcccgccac

SEQ ID NO: 116561 - RNA, 24 nt, Human
ugcgauuacaggugcccgccacca

SEQ ID NO: 116562 - RNA, 25 nt, Human
ugcuccuggccuuauggugaagucu

SEQ ID NO: 116563 - RNA, 25 nt, Human
ugcugggauuacaaggugugagcca

SEQ ID NO: 116564 - RNA, 20 nt, Human
ugggauuacaaggugugagc

SEQ ID NO: 116565 - RNA, 23 nt, Human
ugggauuacaaggugugagccac

SEQ ID NO: 116566 - RNA, 23 nt, Human
ugggauuacaaggugugagccac

SEQ ID NO: 116567 - RNA, 25 nt, Human
ugggauuacaaggugugagccacug

SEQ ID NO: 116568 - RNA, 24 nt, Human
uggucaggcugguuuugaacuccu

SEQ ID NO: 116569 - RNA, 25 nt, Human
ugucucagccuccugaaaggcugcg

SEQ ID NO: 116570 - RNA, 23 nt, Human
uguggguugaguuucacauuuua

SEQ ID NO: 116571 - RNA, 24 nt, Human
uuaguagagacaggguuucaccau

SEQ ID NO: 116572 - RNA, 23 nt, Human
uucaagcgauucuccugucucag

SEQ ID NO: 116573 - RNA, 18 nt, Human
uuggccucccaaagugcu

SEQ ID NO: 116574 - RNA, 24 nt, Human
uuucaccauguuggucaggcuggu

SEQ ID NO: 116575 - RNA, 23 nt, Human
uuucauuaucaccacauauugcu

SEQ ID NO: 116576 - RNA, 21 nt, Human
aacaaccuagccucuucaccc

SEQ ID NO: 116577 - RNA, 19 nt, Human
aaccuagccucuucacccg

SEQ ID NO: 116578 - RNA, 25 nt, Human
acucaucucuccucccucacucccu

SEQ ID NO: 116579 - RNA, 20 nt, Human
agaaagaaugcuugaucuga

SEQ ID NO: 116580 - RNA, 18 nt, Human
caccuccuuaaacaaccu

SEQ ID NO: 116581 - RNA, 19 nt, Human
caggagcaaagccuuucug

SEQ ID NO: 116582 - RNA, 24 nt, Human
ccaccuccuuaaacaaccuagccu

SEQ ID NO: 116583 - RNA, 21 nt, Human
cccaccuccuuaaacaaccuu

SEQ ID NO: 116584 - RNA, 23 nt, Human
ccuagccucuucacccgccaaaa

SEQ ID NO: 116585 - RNA, 18 nt, Human
ccuuaaacaaccuagccu

SEQ ID NO: 116586 - RNA, 24 nt, Human
cgccccaccuccuuaaacaaccua

SEQ ID NO: 116587 - RNA, 18 nt, Human
gaaauucuuuaugucguu

SEQ ID NO: 116588 - RNA, 18 nt, Human
gagcaggagcaaagccuu

SEQ ID NO: 116589 - RNA, 22 nt, Human
gccaaaauccaagguccaccua

SEQ ID NO: 116590 - RNA, 22 nt, Human
gcgccccaccuccuuaaacaac

SEQ ID NO: 116591 - RNA, 23 nt, Human
uagccacucaucucuccucccuc

SEQ ID NO: 116592 - RNA, 18 nt, Human
ucccgcuuguaaacacca

SEQ ID NO: 116593 - RNA, 19 nt, Human
ugaaacgcgccccaccucc

SEQ ID NO: 116594 - RNA, 23 nt, Human
ugcugggcuuuuucaaagagagc

SEQ ID NO: 116595 - RNA, 20 nt, Human
uggaagacguucccagcugu

SEQ ID NO: 116596 - RNA, 21 nt, Human
aaaaaaaaaaagcacauaaaa

SEQ ID NO: 116597 - RNA, 23 nt, Human
aaaaaaaaaaagcacauaaaauc

SEQ ID NO: 116598 - RNA, 19 nt, Human
aaaaaaaaagccaaaucug

SEQ ID NO: 116599 - RNA, 21 nt, Human
aaaaaaagccaaaucugacca

SEQ ID NO: 116600 - RNA, 19 nt, Human
aaacaaaaacaacaacaga

SEQ ID NO: 116601 - RNA, 23 nt, Human
aaacaaaaacaacaacagaauaa

SEQ ID NO: 116602 - RNA, 30 nt, Human
aaacaacaacagaauaagcuuuccccacac

SEQ ID NO: 116603 - RNA, 25 nt, Human
aaaccacaucaucccaacaguuuuc

SEQ ID NO: 116604 - RNA, 18 nt, Human
aaacugugaaaacugaua

SEQ ID NO: 116605 - RNA, 19 nt, Human
aaaucagaauauaaaauaa

SEQ ID NO: 116606 - RNA, 20 nt, Human
aacaucugagacaacuaugg

SEQ ID NO: 116607 - RNA, 25 nt, Human
aaccacaucaucccaacaguuuucc

SEQ ID NO: 116608 - RNA, 22 nt, Human
aaccugcaaaccacaucauccc

SEQ ID NO: 116609 - RNA, 22 nt, Human
aagaaaaaaaaaguauguccaa

SEQ ID NO: 116610 - RNA, 22 nt, Human
aagcaccuugugcaggugacuc

SEQ ID NO: 116611 - RNA, 19 nt, Human
aaguaugacauccauaaaa

SEQ ID NO: 116612 - RNA, 23 nt, Human
aaugcucaucugggcuaggcaac

SEQ ID NO: 116613 - RNA, 26 nt, Human
acaacaacagaauaagcuuuccccac

SEQ ID NO: 116614 - RNA, 22 nt, Human
acaauaaaauaaaauaucuaga

SEQ ID NO: 116615 - RNA, 22 nt, Human
acacauguauugucaaguauga

SEQ ID NO: 116616 - RNA, 25 nt, Human
accacaucaucccaacaguuuucca

SEQ ID NO: 116617 - RNA, 20 nt, Human
acccuaguuugcuggaauca

SEQ ID NO: 116618 - RNA, 23 nt, Human
acuuagugaagacagcuuuccag

SEQ ID NO: 116619 - RNA, 21 nt, Human
agaaaggcaaauaaaaauggc

SEQ ID NO: 116620 - RNA, 21 nt, Human
agaacaaacagcacuuaaaug

SEQ ID NO: 116621 - RNA, 21 nt, Human
agaaggaaacggaauucugaa

SEQ ID NO: 116622 - RNA, 23 nt, Human
agaguuacaggaacaaauuugau

SEQ ID NO: 116623 - RNA, 25 nt, Human
agcaagcagguccccucucagccug

SEQ ID NO: 116624 - RNA, 19 nt, Human
agcgacgguggagaacagg

SEQ ID NO: 116625 - RNA, 22 nt, Human
aggaggauaugcccagugacug

SEQ ID NO: 116626 - RNA, 24 nt, Human
aggcacagcaaccugcaaaccaca

SEQ ID NO: 116627 - RNA, 25 nt, Human
aggugacucaggggcugcugagaag

SEQ ID NO: 116628 - RNA, 21 nt, Human
agguggaagucgagcgacggu

SEQ ID NO: 116629 - RNA, 20 nt, Human
agucuucuuuuuucuuuccu

SEQ ID NO: 116630 - RNA, 18 nt, Human
auaugaggugugaaaguc

SEQ ID NO: 116631 - RNA, 20 nt, Human
auccaaagagcuuuacugca

SEQ ID NO: 116632 - RNA, 23 nt, Human
augaagaccaaauccaauugaca

SEQ ID NO: 116633 - RNA, 22 nt, Human
caaaacaguccuaaccguuuua

SEQ ID NO: 116634 - RNA, 25 nt, Human
caacaacagaauaagcuuuccccac

SEQ ID NO: 116635 - RNA, 23 nt, Human
caacuauggcuccaaacaaucag

SEQ ID NO: 116636 - RNA, 24 nt, Human
caacucuuaaaaaaaaaaagcaca

SEQ ID NO: 116637 - RNA, 19 nt, Human
cacugaauugacugggcaa

SEQ ID NO: 116638 - RNA, 30 nt, Human
cagcaaccugcaaaccacaucaucccaacu

SEQ ID NO: 116639 - RNA, 19 nt, Human
cagcaaccugcaaaccacu

SEQ ID NO: 116640 - RNA, 22 nt, Human
cagcaagcagguccccucucag

SEQ ID NO: 116641 - RNA, 26 nt, Human
cagcaagcagguccccucucagccuu

SEQ ID NO: 116642 - RNA, 21 nt, Human
cagcaucaaacagauaagcuc

SEQ ID NO: 116643 - RNA, 24 nt, Human
caggcacagcaaccugcaaaccac

SEQ ID NO: 116644 - RNA, 18 nt, Human
cauaaccagcaguuccca

SEQ ID NO: 116645 - RNA, 22 nt, Human
ccccaaaauaaccuagaaagaa

SEQ ID NO: 116646 - RNA, 18 nt, Human
ccccacacuaauuucuaa

SEQ ID NO: 116647 - RNA, 23 nt, Human
ccccaguuaacagcacauaucca

SEQ ID NO: 116648 - RNA, 24 nt, Human
ccuaaccguuuuaacaaaucucaa

SEQ ID NO: 116649 - RNA, 22 nt, Human
ccucuuaucuuuccuggacaaa

SEQ ID NO: 116650 - RNA, 20 nt, Human
ccuugcagaaaagcacugua

SEQ ID NO: 116651 - RNA, 24 nt, Human
cucagccuggccuuggcaaugagc

SEQ ID NO: 116652 - RNA, 24 nt, Human
cucuuaaaaaaaaaaagcacauaa

SEQ ID NO: 116653 - RNA, 24 nt, Human
cuuaaaaaaaggagaaaaugacua

SEQ ID NO: 116654 - RNA, 19 nt, Human
cuugcagaaaagcacugua

SEQ ID NO: 116655 - RNA, 19 nt, Human
cuuggcaaugagcugcuuc

SEQ ID NO: 116656 - RNA, 21 nt, Human
gaaaaaaaaagccaaaucuga

SEQ ID NO: 116657 - RNA, 23 nt, Human
gaaaaggacuauuuuaauguaaa

SEQ ID NO: 116658 - RNA, 21 nt, Human
gaaauaacuuuauccaaaagg

SEQ ID NO: 116659 - RNA, 21 nt, Human
gaacaucugagacaacuaugg

SEQ ID NO: 116660 - RNA, 21 nt, Human
gagaaaauucugaaaaccaca

SEQ ID NO: 116661 - RNA, 21 nt, Human
gagcgacgguggagaacaggu

SEQ ID NO: 116662 - RNA, 23 nt, Human
gauuuggggugagagauggcauu

SEQ ID NO: 116663 - RNA, 21 nt, Human
gcaaaaaucagaugcauagac

SEQ ID NO: 116664 - RNA, 21 nt, Human
gccuuggcaaugagcugcuuc

SEQ ID NO: 116665 - RNA, 22 nt, Human
gggaaaaggacuauuuuaaugu

SEQ ID NO: 116666 - RNA, 22 nt, Human
guuaguuuucuuuucuccuauu

SEQ ID NO: 116667 - RNA, 19 nt, Human
uaaaaaucagaugaaaaug

SEQ ID NO: 116668 - RNA, 20 nt, Human
uaaaagcacaaaacaguuuc

SEQ ID NO: 116669 - RNA, 25 nt, Human
uaaaagcacaaaacaguuucuaaca

SEQ ID NO: 116670 - RNA, 22 nt, Human
uaaaauaaugaagaccaaaucc

SEQ ID NO: 116671 - RNA, 25 nt, Human
uaaacaaaaacaacaacaaccccgg

SEQ ID NO: 116672 - RNA, 19 nt, Human
uaaauugcuaucaaucacu

SEQ ID NO: 116673 - RNA, 21 nt, Human
uaacagcacauauccaaagga

SEQ ID NO: 116674 - RNA, 19 nt, Human
uaaccagcaguucccaagc

SEQ ID NO: 116675 - RNA, 20 nt, Human
uaaggcaccacuauaaugaa

SEQ ID NO: 116676 - RNA, 20 nt, Human
uaaguaauacgcuguaaaag

SEQ ID NO: 116677 - RNA, 27 nt, Human
uaauuuuucuuuaaaugcauuuuaaga

SEQ ID NO: 116678 - RNA, 21 nt, Human
uacaggaacaaauuugauauc

SEQ ID NO: 116679 - RNA, 22 nt, Human
uacuuuggaaagauugccuaag

SEQ ID NO: 116680 - RNA, 20 nt, Human
uagaaaggcaaauaaaaaug

SEQ ID NO: 116681 - RNA, 18 nt, Human
uagaacaucugagacaac

SEQ ID NO: 116682 - RNA, 20 nt, Human
uagcaucuacugaugaacau

SEQ ID NO: 116683 - RNA, 22 nt, Human
uagccaagugggaaggugguag

SEQ ID NO: 116684 - RNA, 21 nt, Human
uaggcccucaauaaaauauua

SEQ ID NO: 116685 - RNA, 19 nt, Human
uagguaaaugcucaucugg

SEQ ID NO: 116686 - RNA, 19 nt, Human
uaguuagaugccuucccca

SEQ ID NO: 116687 - RNA, 23 nt, Human
uaucauauaauuuaagaagcucu

SEQ ID NO: 116688 - RNA, 19 nt, Human
uauccaaaggacagcuagc

SEQ ID NO: 116689 - RNA, 23 nt, Human
uaugaugagguugagugcugaaa

SEQ ID NO: 116690 - RNA, 22 nt, Human
ucaaaacuguaaaaaggcacca

SEQ ID NO: 116691 - RNA, 22 nt, Human
ucagccuggccuuggcaaugag

SEQ ID NO: 116692 - RNA, 23 nt, Human
ucaggcacagcaaccugcaaacc

SEQ ID NO: 116693 - RNA, 19 nt, Human
ucauuuuuuaaaaggcuuc

SEQ ID NO: 116694 - RNA, 18 nt, Human
uccacaauaaaauaaaau

SEQ ID NO: 116695 - RNA, 24 nt, Human
ucugaucagacuucaaauuuuucu

SEQ ID NO: 116696 - RNA, 18 nt, Human
ucuguuuuacuguacauu

SEQ ID NO: 116697 - RNA, 22 nt, Human
ugaaaaaaaaagccaaaucuga

SEQ ID NO: 116698 - RNA, 26 nt, Human
ugaaaaaaaaagccaaaucugaccau

SEQ ID NO: 116699 - RNA, 22 nt, Human
ugaaaguaaacaaaaacaacaa

SEQ ID NO: 116700 - RNA, 19 nt, Human
ugacaaacacuuaaacaca

SEQ ID NO: 116701 - RNA, 23 nt, Human
ugagaagccacagcuaucugugg

SEQ ID NO: 116702 - RNA, 18 nt, Human
ugagugcugaaacuguga

SEQ ID NO: 116703 - RNA, 20 nt, Human
ugaguucaguuguguaauuu

SEQ ID NO: 116704 - RNA, 21 nt, Human
ugcccagugacugggacccug

SEQ ID NO: 116705 - RNA, 18 nt, Human
uggagaacagguuggcag

SEQ ID NO: 116706 - RNA, 19 nt, Human
uggcacaacagggaaaagg

SEQ ID NO: 116707 - RNA, 21 nt, Human
uggcauaaguagcaauggggc

SEQ ID NO: 116708 - RNA, 20 nt, Human
uggcugaagaaaaccaggaa

SEQ ID NO: 116709 - RNA, 21 nt, Human
uggcuuauacaacauacacug

SEQ ID NO: 116710 - RNA, 20 nt, Human
ugggacccugccacagcauc

SEQ ID NO: 116711 - RNA, 21 nt, Human
uguaaaaaggcaccaauuacc

SEQ ID NO: 116712 - RNA, 20 nt, Human
uguacauuuaaaaaacugag

SEQ ID NO: 116713 - RNA, 21 nt, Human
uuaaacagauauaauccauag

SEQ ID NO: 116714 - RNA, 21 nt, Human
uuaaugcagcaguuggaaaag

SEQ ID NO: 116715 - RNA, 23 nt, Human
uuacuguacauugagaauaugug

SEQ ID NO: 116716 - RNA, 19 nt, Human
uuagagguggaagucgagc

SEQ ID NO: 116717 - RNA, 21 nt, Human
uucaaaagguaaauuauuaaa

SEQ ID NO: 116718 - RNA, 22 nt, Human
uugauaaugucaaaaugaugug

SEQ ID NO: 116719 - RNA, 21 nt, Human
agaacccagggggcacaccug

SEQ ID NO: 116720 - RNA, 21 nt, Human
aggaagucacugaggggccac

SEQ ID NO: 116721 - RNA, 21 nt, Human
cacgagggucaggacaggcac

SEQ ID NO: 116722 - RNA, 22 nt, Human
cacugggcucucggucgggggc

SEQ ID NO: 116723 - RNA, 19 nt, Human
cagcauugaaggguauggg

SEQ ID NO: 116724 - RNA, 24 nt, Human
caggcacugagaggcugagggagu

SEQ ID NO: 116725 - RNA, 18 nt, Human
cagggggcacaccugguc

SEQ ID NO: 116726 - RNA, 20 nt, Human
ccagaacccagggggcacac

SEQ ID NO: 116727 - RNA, 24 nt, Human
cccuugcugcuccagccgcuggcg

SEQ ID NO: 116728 - RNA, 19 nt, Human
cgagggucaggacaggcac

SEQ ID NO: 116729 - RNA, 27 nt, Human
cuccggcucucuggcccuggcccugac

SEQ ID NO: 116730 - RNA, 19 nt, Human
cuggcccuggcccugacuc

SEQ ID NO: 116731 - RNA, 18 nt, Human
gagcaggacccaccacuc

SEQ ID NO: 116732 - RNA, 21 nt, Human
gcucucuggcccuggcccuga

SEQ ID NO: 116733 - RNA, 23 nt, Human
gcucucuggcccuggcccugacu

SEQ ID NO: 116734 - RNA, 19 nt, Human
ggccacagcauugaagggu

SEQ ID NO: 116735 - RNA, 24 nt, Human
ggcucucuggcccuggcccugacu

SEQ ID NO: 116736 - RNA, 21 nt, Human
gguccaagagguggaggcauu

SEQ ID NO: 116737 - RNA, 19 nt, Human
ucacugaggggccacagca

SEQ ID NO: 116738 - RNA, 21 nt, Human
ucccuugcugcuccagccgcu

SEQ ID NO: 116739 - RNA, 26 nt, Human
ucuccggcucucuggcccuggcccca

SEQ ID NO: 116740 - RNA, 20 nt, Human
ucucuccggcucucuggccc

SEQ ID NO: 116741 - RNA, 20 nt, Human
ugagaggcugagggaguguu

SEQ ID NO: 116742 - RNA, 21 nt, Human
ugaggggccacagcauugaag

SEQ ID NO: 116743 - RNA, 23 nt, Human
ugaggggccacagcauugaaggg

SEQ ID NO: 116744 - RNA, 20 nt, Human
ugcuaggagcaguucucuuu

SEQ ID NO: 116745 - RNA, 24 nt, Human
aagcacaggguagguggguguggg

SEQ ID NO: 116746 - RNA, 19 nt, Human
aagcagagcccccaguccc

SEQ ID NO: 116747 - RNA, 20 nt, Human
aagccagcaggaucccagga

SEQ ID NO: 116748 - RNA, 23 nt, Human
acaggguaggugggugugggggc

SEQ ID NO: 116749 - RNA, 24 nt, Human
accccauggacccaggugcagagg

SEQ ID NO: 116750 - RNA, 22 nt, Human
acugccuugcuggcccuccccc

SEQ ID NO: 116751 - RNA, 23 nt, Human
agaccccgcagaccccauggaag

SEQ ID NO: 116752 - RNA, 21 nt, Human
agaccccgcagaccccgcaga

SEQ ID NO: 116753 - RNA, 23 nt, Human
agcagagcccccagucccugccc

SEQ ID NO: 116754 - RNA, 22 nt, Human
agcagggacaggaggcugacug

SEQ ID NO: 116755 - RNA, 20 nt, Human
aggcagaccccgcagacccc

SEQ ID NO: 116756 - RNA, 21 nt, Human
aggcagggccaggcauggggg

SEQ ID NO: 116757 - RNA, 21 nt, Human
aggccaggcagaccccgcaga

SEQ ID NO: 116758 - RNA, 20 nt, Human
cacaggguaggugggugugg

SEQ ID NO: 116759 - RNA, 23 nt, Human
cacaggguaggugggugugggaa

SEQ ID NO: 116760 - RNA, 19 nt, Human
caccuggcucaggcagggc

SEQ ID NO: 116761 - RNA, 20 nt, Human
caccuggcucaggcagggcc

SEQ ID NO: 116762 - RNA, 19 nt, Human
cacugcccccacccuacgc

SEQ ID NO: 116763 - RNA, 20 nt, Human
cacugcccccacccuacgcc

SEQ ID NO: 116764 - RNA, 26 nt, Human
cacuuuauuacuccugaagccccacc

SEQ ID NO: 116765 - RNA, 22 nt, Human
cagaacccacaggccaggcaga

SEQ ID NO: 116766 - RNA, 23 nt, Human
cagcaggaucccaggaggacugg

SEQ ID NO: 116767 - RNA, 19 nt, Human
caggcagggccaggcaugg

SEQ ID NO: 116768 - RNA, 20 nt, Human
cagggacaggaggcugacug

SEQ ID NO: 116769 - RNA, 23 nt, Human
ccaggcuuucucgggcguggggg

SEQ ID NO: 116770 - RNA, 24 nt, Human
cccaagccagcaggaucccaggag

SEQ ID NO: 116771 - RNA, 24 nt, Human
cccacaaagguuagacgcaaagca

SEQ ID NO: 116772 - RNA, 23 nt, Human
cccacaggccaggcagaccccgc

SEQ ID NO: 116773 - RNA, 18 nt, Human
cccagcucccuccaaguc

SEQ ID NO: 116774 - RNA, 23 nt, Human
cccauuccucacugcccccaccc

SEQ ID NO: 116775 - RNA, 23 nt, Human
ccccagagccgggcccaagccag

SEQ ID NO: 116776 - RNA, 19 nt, Human
ccccgcagaccccauggac

SEQ ID NO: 116777 - RNA, 19 nt, Human
ccccgcagaccccgcagac

SEQ ID NO: 116778 - RNA, 20 nt, Human
cccgcagaccccauggaccc

SEQ ID NO: 116779 - RNA, 20 nt, Human
cccgcagaccccgcagaccc

SEQ ID NO: 116780 - RNA, 19 nt, Human
cccuucggccuugggggcc

SEQ ID NO: 116781 - RNA, 24 nt, Human
ccggcagaacccacaggccaggca

SEQ ID NO: 116782 - RNA, 25 nt, Human
ccucaugaucucccucccuccaccc

SEQ ID NO: 116783 - RNA, 18 nt, Human
cggcguucgggggcccgg

SEQ ID NO: 116784 - RNA, 22 nt, Human
cucccagcucccuccaaguccc

SEQ ID NO: 116785 - RNA, 21 nt, Human
cucccuccaagucccucauga

SEQ ID NO: 116786 - RNA, 18 nt, Human
cucccucccuccacccac

SEQ ID NO: 116787 - RNA, 18 nt, Human
gaacucccagcucccucc

SEQ ID NO: 116788 - RNA, 22 nt, Human
gacccauuccucacugccccca

SEQ ID NO: 116789 - RNA, 24 nt, Human
gaccccgcagaccccgcagacccc

SEQ ID NO: 116790 - RNA, 23 nt, Human
gagccgggcccaagccagcagga

SEQ ID NO: 116791 - RNA, 21 nt, Human
gaucucccucccuccacccac

SEQ ID NO: 116792 - RNA, 19 nt, Human
gcaccagcagggacaggag

SEQ ID NO: 116793 - RNA, 22 nt, Human
gcaugggggccuguauuuuguc

SEQ ID NO: 116794 - RNA, 22 nt, Human
gcccccacccuacgcccuccac

SEQ ID NO: 116795 - RNA, 19 nt, Human
gcuggcccucccccacaaa

SEQ ID NO: 116796 - RNA, 23 nt, Human
ggacaggugucugggucccccag

SEQ ID NO: 116797 - RNA, 20 nt, Human
ggacugggaguggggccugg

SEQ ID NO: 116798 - RNA, 21 nt, Human
ggccuugggggccccagagcc

SEQ ID NO: 116799 - RNA, 26 nt, Human
gggaggucggagggagcuuaagggac

SEQ ID NO: 116800 - RNA, 19 nt, Human
gggaguggggccugguggg

SEQ ID NO: 116801 - RNA, 18 nt, Human
gggcccggcugggcgcac

SEQ ID NO: 116802 - RNA, 24 nt, Human
ggggacuggaggcuucugggaggu

SEQ ID NO: 116803 - RNA, 20 nt, Human
gggggacugccuugcuggcc

SEQ ID NO: 116804 - RNA, 19 nt, Human
gggggcaccagcagggaca

SEQ ID NO: 116805 - RNA, 21 nt, Human
ggggggacugccuugcuggcc

SEQ ID NO: 116806 - RNA, 22 nt, Human
gucccucaugaucucccucccu

SEQ ID NO: 116807 - RNA, 18 nt, Human
guggggacuggaggcuuc

SEQ ID NO: 116808 - RNA, 19 nt, Human
gugucugggucccccaggc

SEQ ID NO: 116809 - RNA, 25 nt, Human
ucacugcccccacccuacgcccucc

SEQ ID NO: 116810 - RNA, 19 nt, Human
ucccggcguucgggggccc

SEQ ID NO: 116811 - RNA, 23 nt, Human
ucccguggaugaacucccagcuc

SEQ ID NO: 116812 - RNA, 20 nt, Human
ucccuccacccaccuggcuc

SEQ ID NO: 116813 - RNA, 19 nt, Human
ucccugaacgccugccggg

SEQ ID NO: 116814 - RNA, 20 nt, Human
ucccugaacgccugccgggc

SEQ ID NO: 116815 - RNA, 21 nt, Human
ucucccguggaugaacuccca

SEQ ID NO: 116816 - RNA, 18 nt, Human
ucucccucccuccaccca

SEQ ID NO: 116817 - RNA, 20 nt, Human
ucugggucccccaggcuuuc

SEQ ID NO: 116818 - RNA, 19 nt, Human
ugaagccccaccggcagaa

SEQ ID NO: 116819 - RNA, 22 nt, Human
ugacuguggggacaggugucug

SEQ ID NO: 116820 - RNA, 20 nt, Human
ugaucucccucccuccaccc

SEQ ID NO: 116821 - RNA, 20 nt, Human
ugcccccacccuacgcccuc

SEQ ID NO: 116822 - RNA, 20 nt, Human
ugccuugcuggcccuccccc

SEQ ID NO: 116823 - RNA, 24 nt, Human
uggccggcccaggcguggccgcgc

SEQ ID NO: 116824 - RNA, 24 nt, Human
uggggacaggaugucugggucccc

SEQ ID NO: 116825 - RNA, 24 nt, Human
uggggacaggugucuggguccccc

SEQ ID NO: 116826 - RNA, 26 nt, Human
ugggggcaccagcagggacaggaggc

SEQ ID NO: 116827 - RNA, 22 nt, Human
uggggggacugccuugcuggcc

SEQ ID NO: 116828 - RNA, 26 nt, Human
ugggucccccaggcuuuccccuaggg

SEQ ID NO: 116829 - RNA, 23 nt, Human
ugguggggacuggaggcuucugg

SEQ ID NO: 116830 - RNA, 27 nt, Human
uugcagacagaggcuguacggacccau

SEQ ID NO: 116831 - RNA, 24 nt, Human
aaaaaaagaggacauuuucaaugu

SEQ ID NO: 116832 - RNA, 27 nt, Human
aaaaaauacaugaaacaaaaacaaagc

SEQ ID NO: 116833 - RNA, 23 nt, Human
aaacaagaugagagauuuccuga

SEQ ID NO: 116834 - RNA, 21 nt, Human
aagaaggaaauuauuucucau

SEQ ID NO: 116835 - RNA, 22 nt, Human
aagaauccuguugugauuugcu

SEQ ID NO: 116836 - RNA, 22 nt, Human
aagacaguugaagaauucauac

SEQ ID NO: 116837 - RNA, 25 nt, Human
aagcaaauaaaauaauacauucaua

SEQ ID NO: 116838 - RNA, 27 nt, Human
aaguaucagaauucagggauauaagcu

SEQ ID NO: 116839 - RNA, 19 nt, Human
agaaggaaauuauuucuca

SEQ ID NO: 116840 - RNA, 20 nt, Human
caaacuacagaaauaacuga

SEQ ID NO: 116841 - RNA, 23 nt, Human
cacacagaaucacaaacauucaa

SEQ ID NO: 116842 - RNA, 22 nt, Human
cacgauaaugauauguaugaga

SEQ ID NO: 116843 - RNA, 22 nt, Human
cagaaauaacugaauuguaaca

SEQ ID NO: 116844 - RNA, 20 nt, Human
cagaaucacaaacauucaac

SEQ ID NO: 116845 - RNA, 24 nt, Human
cagagcccugcguuugagcccccc

SEQ ID NO: 116846 - RNA, 18 nt, Human
ccaaaccccugcacagcc

SEQ ID NO: 116847 - RNA, 19 nt, Human
ccagccccaaaaaggccac

SEQ ID NO: 116848 - RNA, 23 nt, Human
ccagccccaaaaaggccacacag

SEQ ID NO: 116849 - RNA, 22 nt, Human
ccccugcacagccauucugccu

SEQ ID NO: 116850 - RNA, 22 nt, Human
cccgcacuaucaccuggagcag

SEQ ID NO: 116851 - RNA, 20 nt, Human
ccuccaaaccccugcacagc

SEQ ID NO: 116852 - RNA, 20 nt, Human
cuccaaaccccugcacagcc

SEQ ID NO: 116853 - RNA, 22 nt, Human
gaaacaaaaacaagaugagaga

SEQ ID NO: 116854 - RNA, 24 nt, Human
gaaaugccuccaaguuucucauac

SEQ ID NO: 116855 - RNA, 23 nt, Human
gagcagugccugcgucccagagc

SEQ ID NO: 116856 - RNA, 22 nt, Human
ggagcacacaucgugugcccuc

SEQ ID NO: 116857 - RNA, 22 nt, Human
guguuccacgauaaugauaugu

SEQ ID NO: 116858 - RNA, 21 nt, Human
guugcauucuaaaauuacuau

SEQ ID NO: 116859 - RNA, 25 nt, Human
uaaaaaauacaugaaacaaaaacaa

SEQ ID NO: 116860 - RNA, 19 nt, Human
uaaaaugacacuagaagua

SEQ ID NO: 116861 - RNA, 20 nt, Human
uaagagcaaagagcugcaga

SEQ ID NO: 116862 - RNA, 24 nt, Human
uacuaugaagucucaacuucacug

SEQ ID NO: 116863 - RNA, 21 nt, Human
uaugaacaaagaaaucauaca

SEQ ID NO: 116864 - RNA, 24 nt, Human
uccaaaccccugcacagccauucu

SEQ ID NO: 116865 - RNA, 23 nt, Human
uccacgauaaugauauguaugag

SEQ ID NO: 116866 - RNA, 22 nt, Human
uccagccccaaaaaggccacac

SEQ ID NO: 116867 - RNA, 18 nt, Human
ucccgcacuaucaccugg

SEQ ID NO: 116868 - RNA, 22 nt, Human
ucccuaggauuauucuuagucu

SEQ ID NO: 116869 - RNA, 18 nt, Human
ucucuggagaaagauaua

SEQ ID NO: 116870 - RNA, 23 nt, Human
ucucuuguaagacaguugaagaa

SEQ ID NO: 116871 - RNA, 21 nt, Human
ucugaaauagaaaacucuuaa

SEQ ID NO: 116872 - RNA, 22 nt, Human
ugaaauagaaaacucuuaagua

SEQ ID NO: 116873 - RNA, 21 nt, Human
ugaagucucaacuucacugaa

SEQ ID NO: 116874 - RNA, 21 nt, Human
ugacacuagaaguauaaauga

SEQ ID NO: 116875 - RNA, 23 nt, Human
ugagaugcucuuccuuauaaacu

SEQ ID NO: 116876 - RNA, 24 nt, Human
ugcagagaaucccaacauuaacag

SEQ ID NO: 116877 - RNA, 18 nt, Human
ugccuaaauucaugacau

SEQ ID NO: 116878 - RNA, 21 nt, Human
uggcaaagugccgaccagugg

SEQ ID NO: 116879 - RNA, 23 nt, Human
uuacuaugaagucucaacuucac

SEQ ID NO: 116880 - RNA, 18 nt, Human
uuccagccccaaaaaggc

SEQ ID NO: 116881 - RNA, 20 nt, Human
uuuaaaaaauacaugaaaca

SEQ ID NO: 116882 - RNA, 23 nt, Human
uuuguaaacuagucauauaaaau

SEQ ID NO: 116883 - RNA, 21 nt, Human
uuuuuuuuuuuuuucuuauuu

SEQ ID NO: 116884 - RNA, 21 nt, Human
aaaaacaacaacacaucuaca

SEQ ID NO: 116885 - RNA, 21 nt, Human
aaaaagaaaaaaagaaaaaga

SEQ ID NO: 116886 - RNA, 25 nt, Human
aaaaagaaaaagaaaaagaaaagaa

SEQ ID NO: 116887 - RNA, 22 nt, Human
aaaaagaaaaagaaaagaaaag

SEQ ID NO: 116888 - RNA, 19 nt, Human
aaaaagaaaagaaaagucc

SEQ ID NO: 116889 - RNA, 21 nt, Human
aaaagaaaaaaagaaaaagaa

SEQ ID NO: 116890 - RNA, 21 nt, Human
aaaugccucugucacauuucu

SEQ ID NO: 116891 - RNA, 22 nt, Human
aaauugcagugagccgagauug

SEQ ID NO: 116892 - RNA, 25 nt, Human
aagaaaagaaaaguccauacucuaa

SEQ ID NO: 116893 - RNA, 21 nt, Human
aagaaauccauagucuaaagc

SEQ ID NO: 116894 - RNA, 19 nt, Human
aagaagcaauacacaaaca

SEQ ID NO: 116895 - RNA, 18 nt, Human
aagcaauacacaaacauc

SEQ ID NO: 116896 - RNA, 21 nt, Human
aagcaggagaaucgcuugaac

SEQ ID NO: 116897 - RNA, 24 nt, Human
aagcaggagaaucgcuugaacuug

SEQ ID NO: 116898 - RNA, 25 nt, Human
aagcaggagaaucgcuugaacuugg

SEQ ID NO: 116899 - RNA, 24 nt, Human
aaggcauaacaaaguaaacugaaa

SEQ ID NO: 116900 - RNA, 18 nt, Human
aaguaacaaaggcugccc

SEQ ID NO: 116901 - RNA, 21 nt, Human
aauccaaugauaaaaacaaca

SEQ ID NO: 116902 - RNA, 18 nt, Human
aaucgcuugaacuuggga

SEQ ID NO: 116903 - RNA, 20 nt, Human
acaaaguaaacugaaaugaa

SEQ ID NO: 116904 - RNA, 21 nt, Human
accauaaaaaguaaaaagcua

SEQ ID NO: 116905 - RNA, 20 nt, Human
accccauaguucaacagaau

SEQ ID NO: 116906 - RNA, 19 nt, Human
acugcacuccagccuggag

SEQ ID NO: 116907 - RNA, 21 nt, Human
agaaaaagaaaaagaaaagaa

SEQ ID NO: 116908 - RNA, 20 nt, Human
agaaugaggauccaaaaaga

SEQ ID NO: 116909 - RNA, 24 nt, Human
agacgcaaauugcagugagccgag

SEQ ID NO: 116910 - RNA, 28 nt, Human
aguaacaaaggcugcccuuggggagaga

SEQ ID NO: 116911 - RNA, 22 nt, Human
agugcagugugggaccccauag

SEQ ID NO: 116912 - RNA, 19 nt, Human
aguuuaguuaucaauauuc

SEQ ID NO: 116913 - RNA, 24 nt, Human
auugcagugagccgagauugugcc

SEQ ID NO: 116914 - RNA, 24 nt, Human
auugugccacugcacuccagccug

SEQ ID NO: 116915 - RNA, 23 nt, Human
caacaacacaucuacauaaacac

SEQ ID NO: 116916 - RNA, 28 nt, Human
caacuucaauauaaugggaagggauaac

SEQ ID NO: 116917 - RNA, 21 nt, Human
caauuuaauugcaaaagacac

SEQ ID NO: 116918 - RNA, 18 nt, Human
cacaucuacauaaacacu

SEQ ID NO: 116919 - RNA, 18 nt, Human
cacuccagccuggagagu

SEQ ID NO: 116920 - RNA, 19 nt, Human
cacuccagccuggagagug

SEQ ID NO: 116921 - RNA, 18 nt, Human
cacugcacuccagccugg

SEQ ID NO: 116922 - RNA, 19 nt, Human
cacugcacuccagccugga

SEQ ID NO: 116923 - RNA, 22 nt, Human
cacugcacuccagccuggagag

SEQ ID NO: 116924 - RNA, 25 nt, Human
cacugcacuccagccuggagagugu

SEQ ID NO: 116925 - RNA, 24 nt, Human
ccaaaaagaagcaauacacaaaca

SEQ ID NO: 116926 - RNA, 19 nt, Human
ccacugcacuccagccugg

SEQ ID NO: 116927 - RNA, 20 nt, Human
ccacugcacuccagccugga

SEQ ID NO: 116928 - RNA, 22 nt, Human
ccacugcacuccagccuggaga

SEQ ID NO: 116929 - RNA, 22 nt, Human
ccacugcacuccagccuggaga

SEQ ID NO: 116930 - RNA, 23 nt, Human
ccacugcacuccagccuggagag

SEQ ID NO: 116931 - RNA, 24 nt, Human
ccacugcacuccagccuggagagu

SEQ ID NO: 116932 - RNA, 26 nt, Human
ccacugcacuccagccuggagagugu

SEQ ID NO: 116933 - RNA, 21 nt, Human
ccuuggggagagacuuuuuuc

SEQ ID NO: 116934 - RNA, 24 nt, Human
cgagauugugccacugcacuccag

SEQ ID NO: 116935 - RNA, 23 nt, Human
cucaaaaagaaaaaaagaaaaag

SEQ ID NO: 116936 - RNA, 26 nt, Human
cugucacauuucucaacuucaauaua

SEQ ID NO: 116937 - RNA, 23 nt, Human
gagaaucgcuugaacuugggaga

SEQ ID NO: 116938 - RNA, 22 nt, Human
gagaaugaggauccaaaaagaa

SEQ ID NO: 116939 - RNA, 24 nt, Human
gcaaauugcagugagccgagauug

SEQ ID NO: 116940 - RNA, 21 nt, Human
gcaagccuaguccaccaagau

SEQ ID NO: 116941 - RNA, 18 nt, Human
gcacuccagccuggagag

SEQ ID NO: 116942 - RNA, 19 nt, Human
uaaaaagcuacacauaagc

SEQ ID NO: 116943 - RNA, 19 nt, Human
uaaaaagcuacacauaagc

SEQ ID NO: 116944 - RNA, 21 nt, Human
uaaaaagcuacacauaagcac

SEQ ID NO: 116945 - RNA, 23 nt, Human
uaaagcaggagaaucgcuugaac

SEQ ID NO: 116946 - RNA, 20 nt, Human
uaacaauauuccuggauuag

SEQ ID NO: 116947 - RNA, 22 nt, Human
uacaguauuaguaaauggauga

SEQ ID NO: 116948 - RNA, 20 nt, Human
uaggaaggacuguaagguuu

SEQ ID NO: 116949 - RNA, 27 nt, Human
ucaaaaagaaaaaaagaaaaagaaaaa

SEQ ID NO: 116950 - RNA, 18 nt, Human
uccaaaaagaagcaauac

SEQ ID NO: 116951 - RNA, 18 nt, Human
uccaaaaagaagcaauac

SEQ ID NO: 116952 - RNA, 24 nt, Human
uccaaaacugggggagagugugaa

SEQ ID NO: 116953 - RNA, 22 nt, Human
uccagaaaacaaaacugcaaac

SEQ ID NO: 116954 - RNA, 20 nt, Human
ucgcuugaacuugggagacg

SEQ ID NO: 116955 - RNA, 18 nt, Human
ucucaaaaagaaaaaaag

SEQ ID NO: 116956 - RNA, 28 nt, Human
ucucaaaaagaaaaaaagaaaaagaaaa

SEQ ID NO: 116957 - RNA, 25 nt, Human
ucucugagaaaguugugaaucaguu

SEQ ID NO: 116958 - RNA, 22 nt, Human
ugagccgagauugugccacugc

SEQ ID NO: 116959 - RNA, 19 nt, Human
ugauaaaaacaacaacaca

SEQ ID NO: 116960 - RNA, 23 nt, Human
ugcaaaagacacagaauauuaag

SEQ ID NO: 116961 - RNA, 22 nt, Human
ugcccuuacaguggguggaauu

SEQ ID NO: 116962 - RNA, 20 nt, Human
ugggaggggugcagucagug

SEQ ID NO: 116963 - RNA, 23 nt, Human
ugggaggggugcagucaguguuu

SEQ ID NO: 116964 - RNA, 18 nt, Human
uuaauaauggggcugggg

SEQ ID NO: 116965 - RNA, 24 nt, Human
uuaaucagcaccauaaaaaguaaa

SEQ ID NO: 116966 - RNA, 20 nt, Human
uuccuuuagauaacaugugg

SEQ ID NO: 116967 - RNA, 18 nt, Human
uugcagugagccgagauu

SEQ ID NO: 116968 - RNA, 19 nt, Human
uugcagugagccgagauug

SEQ ID NO: 116969 - RNA, 22 nt, Human
uugcagugagccgagauugugc

SEQ ID NO: 116970 - RNA, 23 nt, Human
uugugccacugcacuccagccug

SEQ ID NO: 116971 - RNA, 23 nt, Human
uuuuuuuuuuuuuuuaccucuua

SEQ ID NO: 116972 - RNA, 19 nt, Human
aacuaccuagccaagcccc

SEQ ID NO: 116973 - RNA, 19 nt, Human
aagcaggcgugagcuggcc

SEQ ID NO: 116974 - RNA, 23 nt, Human
acagccaggcccacaugcccagc

SEQ ID NO: 116975 - RNA, 22 nt, Human
acagcuuuaggauucagcaggg

SEQ ID NO: 116976 - RNA, 23 nt, Human
acaguuucacauuuuccaggcuc

SEQ ID NO: 116977 - RNA, 25 nt, Human
agaacuaccuagccaagccccuccc

SEQ ID NO: 116978 - RNA, 22 nt, Human
aggaagcaggcgugagcuggcc

SEQ ID NO: 116979 - RNA, 23 nt, Human
aggcgaagcgaaggaggagcgag

SEQ ID NO: 116980 - RNA, 24 nt, Human
caacaagcgcaugaaacaguuaaa

SEQ ID NO: 116981 - RNA, 21 nt, Human
cacagccaggcccacaugccc

SEQ ID NO: 116982 - RNA, 23 nt, Human
cacagcuuuaggauucagcaggg

SEQ ID NO: 116983 - RNA, 21 nt, Human
cagcagggcagggagggagga

SEQ ID NO: 116984 - RNA, 20 nt, Human
caggagacaguuucacauuu

SEQ ID NO: 116985 - RNA, 22 nt, Human
ccaagagaaaauuaagcccaga

SEQ ID NO: 116986 - RNA, 26 nt, Human
ccagccaaacaugaugucgacugcag

SEQ ID NO: 116987 - RNA, 18 nt, Human
ccccaaagggcucccuca

SEQ ID NO: 116988 - RNA, 19 nt, Human
ccccaaagggcucccucau

SEQ ID NO: 116989 - RNA, 21 nt, Human
ccccaagagaaaauuaagccc

SEQ ID NO: 116990 - RNA, 23 nt, Human
ccccagcagcugccucccucccu

SEQ ID NO: 116991 - RNA, 24 nt, Human
ccccuccccagcagcugccucccu

SEQ ID NO: 116992 - RNA, 20 nt, Human
ccgggagucccagaaaggag

SEQ ID NO: 116993 - RNA, 19 nt, Human
ccuagccaagccccucccc

SEQ ID NO: 116994 - RNA, 18 nt, Human
ccucaggcuugagagccc

SEQ ID NO: 116995 - RNA, 18 nt, Human
ccucccuggaugagggga

SEQ ID NO: 116996 - RNA, 21 nt, Human
ccuccucaaccgcugccaccu

SEQ ID NO: 116997 - RNA, 25 nt, Human
ccugggaccagggccagccugaggc

SEQ ID NO: 116998 - RNA, 25 nt, Human
cuccucaaccgcugccaccugggac

SEQ ID NO: 116999 - RNA, 22 nt, Human
gaacacagccaggcccacaugc

SEQ ID NO: 117000 - RNA, 21 nt, Human
gaagaaaaccucaggcuugag

SEQ ID NO: 117001 - RNA, 20 nt, Human
gacugcagggacccacagga

SEQ ID NO: 117002 - RNA, 21 nt, Human
gcgaagcgaaggaggagcgag

SEQ ID NO: 117003 - RNA, 24 nt, Human
ggacccacaggacacaugucccuu

SEQ ID NO: 117004 - RNA, 21 nt, Human
ggcaaaaugauaggaaacuaa

SEQ ID NO: 117005 - RNA, 19 nt, Human
ggcaaugggggcaccugaa

SEQ ID NO: 117006 - RNA, 23 nt, Human
uaccuagccaagccccuccccag

SEQ ID NO: 117007 - RNA, 24 nt, Human
uagccaagccccuccccagcagcu

SEQ ID NO: 117008 - RNA, 21 nt, Human
uccccagcagcugccucccuc

SEQ ID NO: 117009 - RNA, 24 nt, Human
uccucaaccgcugccaccugggac

SEQ ID NO: 117010 - RNA, 22 nt, Human
ugacaguguagacgccugaugg

SEQ ID NO: 117011 - RNA, 20 nt, Human
ugagagcccuguaccccucc

SEQ ID NO: 117012 - RNA, 20 nt, Human
ugaggggaguugugccggga

SEQ ID NO: 117013 - RNA, 26 nt, Human
ugagugacaguguagacgccugaugg

SEQ ID NO: 117014 - RNA, 20 nt, Human
ugcaggagacaguuucacau

SEQ ID NO: 117015 - RNA, 21 nt, Human
ugccgggagucccagaaagga

SEQ ID NO: 117016 - RNA, 20 nt, Human
uguaccccuccucaaccggu

SEQ ID NO: 117017 - RNA, 22 nt, Human
uuuaaugaggggaaugaccacc

SEQ ID NO: 117018 - RNA, 19 nt, Human
uuuucaaaaaauacuacgg

SEQ ID NO: 117019 - RNA, 18 nt, Human
gacaagcggcuucuuuua

SEQ ID NO: 117020 - RNA, 24 nt, Human
ucacagagacaagcggcuucuuuu

SEQ ID NO: 117021 - RNA, 18 nt, Human
aaaaacaagcauuuacuu

SEQ ID NO: 117022 - RNA, 24 nt, Human
aaaaacaccuaaucaaguugacac

SEQ ID NO: 117023 - RNA, 22 nt, Human
aaaaacagcaaguaauugcagc

SEQ ID NO: 117024 - RNA, 19 nt, Human
aaaaacagcuagaaaagcc

SEQ ID NO: 117025 - RNA, 26 nt, Human
aaacacaaaauauuuuaaaauaaaac

SEQ ID NO: 117026 - RNA, 23 nt, Human
aacaaacuacuacaaaaacaagc

SEQ ID NO: 117027 - RNA, 27 nt, Human
aacaagaacaaacuacuacaaaaacaa

SEQ ID NO: 117028 - RNA, 21 nt, Human
aagaaauaaaccauaagauca

SEQ ID NO: 117029 - RNA, 22 nt, Human
aagaacaaacuacuacaaaaac

SEQ ID NO: 117030 - RNA, 18 nt, Human
aaguugcaaaagcuauaa

SEQ ID NO: 117031 - RNA, 19 nt, Human
aaugaacaucacauccuuc

SEQ ID NO: 117032 - RNA, 21 nt, Human
acaagaacaaacuacuacaaa

SEQ ID NO: 117033 - RNA, 22 nt, Human
acacuacaucuauuguaaucaa

SEQ ID NO: 117034 - RNA, 21 nt, Human
acagguuuccuucaaauaaaa

SEQ ID NO: 117035 - RNA, 25 nt, Human
acuacaaaaacaagcauuuacuuga

SEQ ID NO: 117036 - RNA, 21 nt, Human
acuacuacaaaaacaagcauu

SEQ ID NO: 117037 - RNA, 21 nt, Human
aggcagguuugaaaaaaaucu

SEQ ID NO: 117038 - RNA, 20 nt, Human
auaaacaucaacgaucccag

SEQ ID NO: 117039 - RNA, 20 nt, Human
caaaaacgcuauugcaaugc

SEQ ID NO: 117040 - RNA, 23 nt, Human
caagaacaaacuacuacaaaaac

SEQ ID NO: 117041 - RNA, 24 nt, Human
caagaacacaugcuagucaggugc

SEQ ID NO: 117042 - RNA, 18 nt, Human
cagcaaagucacaagcua

SEQ ID NO: 117043 - RNA, 26 nt, Human
cagcaguggaaauuucuggaggguuu

SEQ ID NO: 117044 - RNA, 20 nt, Human
ccaugaauccuuacagguuc

SEQ ID NO: 117045 - RNA, 22 nt, Human
cccauaaaaacaccuaaucaag

SEQ ID NO: 117046 - RNA, 19 nt, Human
ccucuguuuuuuuugaccc

SEQ ID NO: 117047 - RNA, 22 nt, Human
cuacuacaaaaacaagcauuua

SEQ ID NO: 117048 - RNA, 21 nt, Human
cuagaaaagcagaauauagaa

SEQ ID NO: 117049 - RNA, 19 nt, Human
cugaaagugaacaguucug

SEQ ID NO: 117050 - RNA, 23 nt, Human
cugccucugccaauuuugcaauc

SEQ ID NO: 117051 - RNA, 25 nt, Human
cuuaaaaacauauuaacgugcucaa

SEQ ID NO: 117052 - RNA, 21 nt, Human
gaaaagcagaauauagaaaua

SEQ ID NO: 117053 - RNA, 18 nt, Human
gcaguggaaauuucugga

SEQ ID NO: 117054 - RNA, 19 nt, Human
gccucggccgccgccgccc

SEQ ID NO: 117055 - RNA, 20 nt, Human
gccucugccaauuuugcaau

SEQ ID NO: 117056 - RNA, 22 nt, Human
gcugaacacaagacuuucccug

SEQ ID NO: 117057 - RNA, 23 nt, Human
guaaacaucaaauaacuugaaca

SEQ ID NO: 117058 - RNA, 18 nt, Human
gugaagaacagcagugga

SEQ ID NO: 117059 - RNA, 18 nt, Human
uaaaaacaccuaaucaag

SEQ ID NO: 117060 - RNA, 19 nt, Human
uaaaaacagcuagaaaagc

SEQ ID NO: 117061 - RNA, 26 nt, Human
uaaaacaguuaagcaacauaaaaaau

SEQ ID NO: 117062 - RNA, 18 nt, Human
uaaaccauaagaucaaua

SEQ ID NO: 117063 - RNA, 19 nt, Human
uaagaucaauaaaaacagc

SEQ ID NO: 117064 - RNA, 23 nt, Human
uaaguguuucgguacaucugugu

SEQ ID NO: 117065 - RNA, 24 nt, Human
uaaguguuucgguacaucuguguu

SEQ ID NO: 117066 - RNA, 23 nt, Human
uacggugcaugaauauacauagu

SEQ ID NO: 117067 - RNA, 20 nt, Human
uagcaugaaucaauacgguu

SEQ ID NO: 117068 - RNA, 19 nt, Human
ucagccccauuaaacaguu

SEQ ID NO: 117069 - RNA, 22 nt, Human
ucagccucggccgccgccgccc

SEQ ID NO: 117070 - RNA, 22 nt, Human
uccuucaaaaauuuuauaccaa

SEQ ID NO: 117071 - RNA, 24 nt, Human
ucucuauuuuuacaaguuuacaua

SEQ ID NO: 117072 - RNA, 25 nt, Human
ucucuuuacucacauuuaccugcug

SEQ ID NO: 117073 - RNA, 25 nt, Human
ugaacagcuuuacacaucagcccca

SEQ ID NO: 117074 - RNA, 19 nt, Human
ugaagaacagcaguggaaa

SEQ ID NO: 117075 - RNA, 19 nt, Human
ugaccccuuacacauugac

SEQ ID NO: 117076 - RNA, 22 nt, Human
ugaugcuguuuacagacauuau

SEQ ID NO: 117077 - RNA, 21 nt, Human
ugcacagauacuucaaacaca

SEQ ID NO: 117078 - RNA, 22 nt, Human
ugcauuacacaucaaauaugua

SEQ ID NO: 117079 - RNA, 21 nt, Human
ugccaauuuugcaaucaagaa

SEQ ID NO: 117080 - RNA, 21 nt, Human
ugcugcagggcuguauuuaca

SEQ ID NO: 117081 - RNA, 18 nt, Human
uggaaggugauccucuuc

SEQ ID NO: 117082 - RNA, 21 nt, Human
ugggccuauauguaaggcagg

SEQ ID NO: 117083 - RNA, 24 nt, Human
uguaaacaucaaauaacuugaaca

SEQ ID NO: 117084 - RNA, 23 nt, Human
uguauuuacacugacuauggcuu

SEQ ID NO: 117085 - RNA, 18 nt, Human
uucaaauaaaacaguuaa

SEQ ID NO: 117086 - RNA, 28 nt, Human
uucacaauuaaguguuucgguacaucug

SEQ ID NO: 117087 - RNA, 22 nt, Human
uucccugagguguaaacaucaa

SEQ ID NO: 117088 - RNA, 26 nt, Human
uucuacaguugcacauaacacaguau

SEQ ID NO: 117089 - RNA, 22 nt, Human
uuuaaaauaaaacuggcaguga

SEQ ID NO: 117090 - RNA, 25 nt, Human
uuuaacaagaacaaacuacuacaaa

SEQ ID NO: 117091 - RNA, 26 nt, Human
uuucgguacaucuguguuguaauuaa

SEQ ID NO: 117092 - RNA, 19 nt, Human
agagaguaccgagucagcu

SEQ ID NO: 117093 - RNA, 21 nt, Human
agcggcagcggcggcggcggc

SEQ ID NO: 117094 - RNA, 23 nt, Human
agcggcggcggcggcggcggcgg

SEQ ID NO: 117095 - RNA, 19 nt, Human
cagcggcagcggcagcggc

SEQ ID NO: 117096 - RNA, 23 nt, Human
cagcggcagcggcagcggcggcg

SEQ ID NO: 117097 - RNA, 23 nt, Human
cggcggcggcggcggcgguggag

SEQ ID NO: 117098 - RNA, 19 nt, Human
cggcggcggcggcggugga

SEQ ID NO: 117099 - RNA, 22 nt, Human
gcagcggcggcggcggcggcuu

SEQ ID NO: 117100 - RNA, 20 nt, Human
gcggcggcggcggcggcggc

SEQ ID NO: 117101 - RNA, 20 nt, Human
gcggcggcggcggcggcggc

SEQ ID NO: 117102 - RNA, 24 nt, Human
gcggcggcggcggcggcggcggug

SEQ ID NO: 117103 - RNA, 20 nt, Human
gcggcggcggcggcggcggu

SEQ ID NO: 117104 - RNA, 18 nt, Human
gcggcggcggcgguggag

SEQ ID NO: 117105 - RNA, 23 nt, Human
ggcagcggcggcggcggcggcgg

SEQ ID NO: 117106 - RNA, 20 nt, Human
ggcggcggcggcggcggcgg

SEQ ID NO: 117107 - RNA, 19 nt, Human
ggcggcggcggcggcggug

SEQ ID NO: 117108 - RNA, 21 nt, Human
uaccgagucagcuacggaggu

SEQ ID NO: 117109 - RNA, 18 nt, Human
uccuucccagcagcucca

SEQ ID NO: 117110 - RNA, 24 nt, Human
ucguuuuccuucccagcagcucca

SEQ ID NO: 117111 - RNA, 22 nt, Human
uucagagaguaccgagucagcu

SEQ ID NO: 117112 - RNA, 19 nt, Human
acaggucccuuccuccaca

SEQ ID NO: 117113 - RNA, 21 nt, Human
aguaucuaucaagaaaaaaaa

SEQ ID NO: 117114 - RNA, 21 nt, Human
caagaaaaaaaaaaaucaaaa

SEQ ID NO: 117115 - RNA, 23 nt, Human
caccugggcccucagggagcagc

SEQ ID NO: 117116 - RNA, 22 nt, Human
caccugugcacggccaccccuc

SEQ ID NO: 117117 - RNA, 24 nt, Human
cagcaucugcccagcgaggaccug

SEQ ID NO: 117118 - RNA, 24 nt, Human
cagcucggguucacuccuguccgu

SEQ ID NO: 117119 - RNA, 18 nt, Human
caggucccuuccuccaca

SEQ ID NO: 117120 - RNA, 27 nt, Human
caggucccuuccuccacagugugggga

SEQ ID NO: 117121 - RNA, 23 nt, Human
ccccaccuccaccaccugggccc

SEQ ID NO: 117122 - RNA, 19 nt, Human
ccucaugccugugagcugc

SEQ ID NO: 117123 - RNA, 18 nt, Human
ccuuggagccugggcacc

SEQ ID NO: 117124 - RNA, 19 nt, Human
ccuuggagccugggcaccu

SEQ ID NO: 117125 - RNA, 20 nt, Human
cuguccuuggagccugggca

SEQ ID NO: 117126 - RNA, 18 nt, Human
ggagcagcaucugcccag

SEQ ID NO: 117127 - RNA, 22 nt, Human
gguuggucggcacagcucgggu

SEQ ID NO: 117128 - RNA, 25 nt, Human
guaucuaucaagaaaaaaaaaaauc

SEQ ID NO: 117129 - RNA, 21 nt, Human
gugcacggccaccccucaugc

SEQ ID NO: 117130 - RNA, 22 nt, Human
uacacagccuuauuuuuauuag

SEQ ID NO: 117131 - RNA, 25 nt, Human
ucaaaauucccuuccugcuccaacc

SEQ ID NO: 117132 - RNA, 21 nt, Human
uccaaccccaccuccaccacc

SEQ ID NO: 117133 - RNA, 23 nt, Human
uccacaguguggggacgaaaggg

SEQ ID NO: 117134 - RNA, 24 nt, Human
uccacaguguggggacgaaagggc

SEQ ID NO: 117135 - RNA, 22 nt, Human
ucuaucaagaaaaaaaaaaauc

SEQ ID NO: 117136 - RNA, 22 nt, Human
ugccacaggucccuuccuccac

SEQ ID NO: 117137 - RNA, 20 nt, Human
ugcuccaaccccaccuccac

SEQ ID NO: 117138 - RNA, 22 nt, Human
uggggacgaaagggcagcuggc

SEQ ID NO: 117139 - RNA, 19 nt, Human
aaaaaagaaaagcuaagaa

SEQ ID NO: 117140 - RNA, 24 nt, Human
aaaaugcugggauuacaggcauga

SEQ ID NO: 117141 - RNA, 22 nt, Human
aaauacaccugaguuaguuuuc

SEQ ID NO: 117142 - RNA, 26 nt, Human
aaaugcugggauuacaggcaugagcc

SEQ ID NO: 117143 - RNA, 19 nt, Human
aaccucuauuuccucaccu

SEQ ID NO: 117144 - RNA, 24 nt, Human
aagcaauucugcuucaaccuccca

SEQ ID NO: 117145 - RNA, 24 nt, Human
aagugauccacccgccucagccuc

SEQ ID NO: 117146 - RNA, 21 nt, Human
aaucugauaacccaaaauuug

SEQ ID NO: 117147 - RNA, 24 nt, Human
acaagguuucaccauguuggccag

SEQ ID NO: 117148 - RNA, 23 nt, Human
accauguuggccagguuggucuc

SEQ ID NO: 117149 - RNA, 25 nt, Human
acccgccucagccucucaaaaugcu

SEQ ID NO: 117150 - RNA, 18 nt, Human
agaauagcacccacuggc

SEQ ID NO: 117151 - RNA, 22 nt, Human
agacagaaacuggaguuggaaa

SEQ ID NO: 117152 - RNA, 23 nt, Human
agccuccgcguugcucgucuccc

SEQ ID NO: 117153 - RNA, 19 nt, Human
aggaagugaugguagcuuu

SEQ ID NO: 117154 - RNA, 21 nt, Human
aggacuccugaggcacuucuc

SEQ ID NO: 117155 - RNA, 21 nt, Human
aggcacaugccaccacaccca

SEQ ID NO: 117156 - RNA, 21 nt, Human
aggcaugagccaccaugcccg

SEQ ID NO: 117157 - RNA, 25 nt, Human
aggccggagugcaguggugugaucu

SEQ ID NO: 117158 - RNA, 22 nt, Human
agguuucaccauguuggccagg

SEQ ID NO: 117159 - RNA, 22 nt, Human
aguagagacaagguuucaccau

SEQ ID NO: 117160 - RNA, 19 nt, Human
agugcaguggugugaucuc

SEQ ID NO: 117161 - RNA, 21 nt, Human
agugcaguggugugaucucag

SEQ ID NO: 117162 - RNA, 23 nt, Human
agugcaguggugugaucucagcu

SEQ ID NO: 117163 - RNA, 24 nt, Human
agugcaguggugugaucucagcuc

SEQ ID NO: 117164 - RNA, 24 nt, Human
aguggugugaucucagcucacugc

SEQ ID NO: 117165 - RNA, 24 nt, Human
auucuuguauuuuuaguagagaca

SEQ ID NO: 117166 - RNA, 22 nt, Human
caaaaugcugggauuacaggca

SEQ ID NO: 117167 - RNA, 23 nt, Human
caaaaugcugggauuacaggcau

SEQ ID NO: 117168 - RNA, 24 nt, Human
caaaaugcugggauuacaggcaug

SEQ ID NO: 117169 - RNA, 20 nt, Human
caaccuccaccuccuggguu

SEQ ID NO: 117170 - RNA, 23 nt, Human
caaccuccaccuccuggguucaa

SEQ ID NO: 117171 - RNA, 24 nt, Human
caagguuucaccauguuggccagg

SEQ ID NO: 117172 - RNA, 19 nt, Human
caccacacccagcuaauuc

SEQ ID NO: 117173 - RNA, 19 nt, Human
caccaugcccggccuccca

SEQ ID NO: 117174 - RNA, 21 nt, Human
caccauguuggccagguuggu

SEQ ID NO: 117175 - RNA, 22 nt, Human
caccauguuggccagguugguc

SEQ ID NO: 117176 - RNA, 24 nt, Human
caccauguuggccagguuggucuc

SEQ ID NO: 117177 - RNA, 23 nt, Human
cacccgccucagccucucaaaau

SEQ ID NO: 117178 - RNA, 21 nt, Human
cacugcaaccuccaccuccug

SEQ ID NO: 117179 - RNA, 23 nt, Human
cacugcaaccuccaccuccuggg

SEQ ID NO: 117180 - RNA, 18 nt, Human
caggacuccugaggcacu

SEQ ID NO: 117181 - RNA, 24 nt, Human
caguagcugggauauaggcacaug

SEQ ID NO: 117182 - RNA, 19 nt, Human
caugccaccacacccagcu

SEQ ID NO: 117183 - RNA, 19 nt, Human
ccacccgccucagccucuc

SEQ ID NO: 117184 - RNA, 27 nt, Human
ccaccuccuggguucaagcaauucuuu

SEQ ID NO: 117185 - RNA, 19 nt, Human
ccaggccggagugcagugg

SEQ ID NO: 117186 - RNA, 20 nt, Human
cccacuggcuacacaggccc

SEQ ID NO: 117187 - RNA, 23 nt, Human
cccacuggcuacacaggccccag

SEQ ID NO: 117188 - RNA, 20 nt, Human
cccaggccggagugcagugg

SEQ ID NO: 117189 - RNA, 22 nt, Human
ccccuguaaggccaucggcucc

SEQ ID NO: 117190 - RNA, 19 nt, Human
ccgccgccgccguuagcgc

SEQ ID NO: 117191 - RNA, 24 nt, Human
ccgccucagccucucaaaaugcug

SEQ ID NO: 117192 - RNA, 20 nt, Human
ccggccccuguaaggccauc

SEQ ID NO: 117193 - RNA, 23 nt, Human
ccuaggcagcuuaugauuaguuu

SEQ ID NO: 117194 - RNA, 19 nt, Human
ccuccaccuccuggguuca

SEQ ID NO: 117195 - RNA, 18 nt, Human
ccucccaguagcugggau

SEQ ID NO: 117196 - RNA, 22 nt, Human
ccuccuggguucaagcaauucu

SEQ ID NO: 117197 - RNA, 22 nt, Human
ccugaccucaagugauccaccc

SEQ ID NO: 117198 - RNA, 23 nt, Human
ccugaccucaagugauccacccg

SEQ ID NO: 117199 - RNA, 19 nt, Human
ccuggguucaagcaauucu

SEQ ID NO: 117200 - RNA, 20 nt, Human
cgcccaagacacugcgucag

SEQ ID NO: 117201 - RNA, 24 nt, Human
cgcccggaagggggccccagccuc

SEQ ID NO: 117202 - RNA, 24 nt, Human
cgccucagccucucaaaaugcugg

SEQ ID NO: 117203 - RNA, 24 nt, Human
cgcucugucgcccaggccggagug

SEQ ID NO: 117204 - RNA, 19 nt, Human
cggagugcaguggugugau

SEQ ID NO: 117205 - RNA, 19 nt, Human
cggagugcaguggugugau

SEQ ID NO: 117206 - RNA, 23 nt, Human
cggagugcaguggugugaucuca

SEQ ID NO: 117207 - RNA, 28 nt, Human
cggagugcaguggugugauggcucuagc

SEQ ID NO: 117208 - RNA, 24 nt, Human
cucacugcaaccuccaccuccugg

SEQ ID NO: 117209 - RNA, 27 nt, Human
cucacugcaaccuccaccuccuggguu

SEQ ID NO: 117210 - RNA, 21 nt, Human
cuccuggguucaagcaauucu

SEQ ID NO: 117211 - RNA, 19 nt, Human
cuccuuccgggcaggggcc

SEQ ID NO: 117212 - RNA, 18 nt, Human
cuggcuccuuccgggcag

SEQ ID NO: 117213 - RNA, 24 nt, Human
gaaaaaaaaaagaaaagcuaagaa

SEQ ID NO: 117214 - RNA, 24 nt, Human
gaccucaagugauccacccgccuc

SEQ ID NO: 117215 - RNA, 18 nt, Human
gauuacaggcaugagcca

SEQ ID NO: 117216 - RNA, 21 nt, Human
gauuacaggcaugagccacca

SEQ ID NO: 117217 - RNA, 24 nt, Human
gauuacaggcaugagccaccaugc

SEQ ID NO: 117218 - RNA, 22 nt, Human
gcaaccuccaccuccuggguuc

SEQ ID NO: 117219 - RNA, 20 nt, Human
gcaaguggggaguucuggag

SEQ ID NO: 117220 - RNA, 23 nt, Human
gcccggaagggggccccagccuc

SEQ ID NO: 117221 - RNA, 19 nt, Human
gcgagaacgcggcaagugg

SEQ ID NO: 117222 - RNA, 27 nt, Human
gcgccgcagccgcuccuuccccccagg

SEQ ID NO: 117223 - RNA, 18 nt, Human
gcguugcucgucucccuu

SEQ ID NO: 117224 - RNA, 25 nt, Human
gcucugucgcccaggccggagugca

SEQ ID NO: 117225 - RNA, 24 nt, Human
ggauuacaggcaugagccaccaug

SEQ ID NO: 117226 - RNA, 20 nt, Human
ggucucaaacuccugaccuc

SEQ ID NO: 117227 - RNA, 24 nt, Human
gugauccacccgccucagccucuc

SEQ ID NO: 117228 - RNA, 26 nt, Human
guuuuuuuucuuuuuugucuuuuuga

SEQ ID NO: 117229 - RNA, 26 nt, Human
uaaaaccaugaauuuaaagcucaagc

SEQ ID NO: 117230 - RNA, 24 nt, Human
uaauucuuguauuuuuaguagaga

SEQ ID NO: 117231 - RNA, 23 nt, Human
uacaggcaugagccaccaugccc

SEQ ID NO: 117232 - RNA, 27 nt, Human
uacguuuagcuuuaaaaccaugaauuu

SEQ ID NO: 117233 - RNA, 22 nt, Human
uagagacaagguuucaccaugu

SEQ ID NO: 117234 - RNA, 18 nt, Human
uagcuggcugccuaggca

SEQ ID NO: 117235 - RNA, 24 nt, Human
uaguagagacaagguuucaccaug

SEQ ID NO: 117236 - RNA, 26 nt, Human
uaguagagacaagguuucaccauguu

SEQ ID NO: 117237 - RNA, 23 nt, Human
ucaaaaugcugggauuacaggca

SEQ ID NO: 117238 - RNA, 24 nt, Human
ucaaaaugcugggauuacaggcau

SEQ ID NO: 117239 - RNA, 24 nt, Human
ucaaaguaccuacccaaaauucua

SEQ ID NO: 117240 - RNA, 21 nt, Human
ucaccauguuggccagguugg

SEQ ID NO: 117241 - RNA, 23 nt, Human
ucacugcaaccuccaccuccugg

SEQ ID NO: 117242 - RNA, 23 nt, Human
ucacugcaaccuccaccuccugg

SEQ ID NO: 117243 - RNA, 24 nt, Human
ucacugcaaccuccaccuccuggg

SEQ ID NO: 117244 - RNA, 27 nt, Human
ucacugcaaccuccaccuccuggguuc

SEQ ID NO: 117245 - RNA, 19 nt, Human
uccgccccggacuggcucc

SEQ ID NO: 117246 - RNA, 19 nt, Human
uccuggguucaagcaauuc

SEQ ID NO: 117247 - RNA, 21 nt, Human
uccuggguucaagcaauucug

SEQ ID NO: 117248 - RNA, 24 nt, Human
ucgcccaggccggagugcaguggu

SEQ ID NO: 117249 - RNA, 24 nt, Human
ucucaaaaugcugggauuacaggc

SEQ ID NO: 117250 - RNA, 18 nt, Human
ucucgcucugucgcccag

SEQ ID NO: 117251 - RNA, 19 nt, Human
ucucgcucugucgcccagg

SEQ ID NO: 117252 - RNA, 24 nt, Human
ucucgcucugucgcccaggccgga

SEQ ID NO: 117253 - RNA, 26 nt, Human
ucucgcucugucgcccaggccggagu

SEQ ID NO: 117254 - RNA, 27 nt, Human
ucucgcucugucgcccaggccggagug

SEQ ID NO: 117255 - RNA, 21 nt, Human
ucucuuguuaucuucaguugu

SEQ ID NO: 117256 - RNA, 24 nt, Human
ucucuuguuaucuucaguugugau

SEQ ID NO: 117257 - RNA, 24 nt, Human
ucugucgcccaggccggagugcag

SEQ ID NO: 117258 - RNA, 24 nt, Human
ugaccucaagugauccacccgccu

SEQ ID NO: 117259 - RNA, 23 nt, Human
ugaggaagugaugguagcuuuuc

SEQ ID NO: 117260 - RNA, 23 nt, Human
ugauuaguuucacagaauagcac

SEQ ID NO: 117261 - RNA, 22 nt, Human
ugcaguggugugaucucagcuc

SEQ ID NO: 117262 - RNA, 20 nt, Human
ugcuucaaccucccaguagc

SEQ ID NO: 117263 - RNA, 23 nt, Human
ugcuucaaccucccaguagcugg

SEQ ID NO: 117264 - RNA, 26 nt, Human
ugcuucaaccucccaguagcugggau

SEQ ID NO: 117265 - RNA, 18 nt, Human
uggaaucugauaacccaa

SEQ ID NO: 117266 - RNA, 19 nt, Human
uggagcaagacagaaacug

SEQ ID NO: 117267 - RNA, 19 nt, Human
uggaguuggaaaaaaaaaa

SEQ ID NO: 117268 - RNA, 24 nt, Human
uggccagguuggucucaaacuccu

SEQ ID NO: 117269 - RNA, 23 nt, Human
ugggauauaggcacaugccacca

SEQ ID NO: 117270 - RNA, 18 nt, Human
ugggauuacaggcaugag

SEQ ID NO: 117271 - RNA, 22 nt, Human
ugggauuacaggcaugagccac

SEQ ID NO: 117272 - RNA, 23 nt, Human
ugggauuacaggcaugagccacc

SEQ ID NO: 117273 - RNA, 24 nt, Human
ugggauuacaggcaugagccacca

SEQ ID NO: 117274 - RNA, 25 nt, Human
ugggauuacaggcaugagccaccau

SEQ ID NO: 117275 - RNA, 21 nt, Human
ugguagcuuuucaucugccca

SEQ ID NO: 117276 - RNA, 24 nt, Human
uggugugaucucagcucacugcaa

SEQ ID NO: 117277 - RNA, 27 nt, Human
uuaaagcucaagccuguagcuggcugc

SEQ ID NO: 117278 - RNA, 24 nt, Human
uuaguagagacaagguuucaccau

SEQ ID NO: 117279 - RNA, 18 nt, Human
uucacagaauagcaccca

SEQ ID NO: 117280 - RNA, 19 nt, Human
uucacagaauagcacccac

SEQ ID NO: 117281 - RNA, 20 nt, Human
uucuuguauuuuuaguagag

SEQ ID NO: 117282 - RNA, 23 nt, Human
uugagacagucucgcucugucgc

SEQ ID NO: 117283 - RNA, 18 nt, Human
uuucacagaauagcaccc

SEQ ID NO: 117284 - RNA, 19 nt, Human
uuucaccauguuggccagg

SEQ ID NO: 117285 - RNA, 20 nt, Human
uuucaccauguuggccaggu

SEQ ID NO: 117286 - RNA, 20 nt, Human
uuugauccaggcuccauccu

SEQ ID NO: 117287 - RNA, 24 nt, Human
uuuuuaguagagacaagguuucac

SEQ ID NO: 117288 - RNA, 21 nt, Human
uuuuugucuuuuugagacagu

SEQ ID NO: 117289 - RNA, 21 nt, Human
uuuuuuucuuuuuugucuuuu

SEQ ID NO: 117290 - RNA, 21 nt, Human
uuuuuuuucuuuuuugucuuu

SEQ ID NO: 117291 - RNA, 24 nt, Human
aaaaaagaagauaucgaaaucuua

SEQ ID NO: 117292 - RNA, 27 nt, Human
aaaaggaaacaaacuaaggggggaaaa

SEQ ID NO: 117293 - RNA, 18 nt, Human
aaauaucgaaagcggccu

SEQ ID NO: 117294 - RNA, 19 nt, Human
aacauggugaaaccccguc

SEQ ID NO: 117295 - RNA, 20 nt, Human
aacauggugaaaccccgucu

SEQ ID NO: 117296 - RNA, 21 nt, Human
aacauggugaaaccccgucuc

SEQ ID NO: 117297 - RNA, 22 nt, Human
aagaacagugaccaccuuacaa

SEQ ID NO: 117298 - RNA, 18 nt, Human
acaaaaguaagcuaguac

SEQ ID NO: 117299 - RNA, 24 nt, Human
acagagccagacuccaucucaaaa

SEQ ID NO: 117300 - RNA, 24 nt, Human
accccgucucuacuaaaaauacaa

SEQ ID NO: 117301 - RNA, 18 nt, Human
acgccacugcacuccagc

SEQ ID NO: 117302 - RNA, 18 nt, Human
acucaggaggcugaggca

SEQ ID NO: 117303 - RNA, 24 nt, Human
acuccagccugggagacagagcca

SEQ ID NO: 117304 - RNA, 18 nt, Human
acugcacuccagccuggg

SEQ ID NO: 117305 - RNA, 24 nt, Human
acugcacuccagccugggagacag

SEQ ID NO: 117306 - RNA, 24 nt, Human
agcacuuugggaggccgaggcggg

SEQ ID NO: 117307 - RNA, 21 nt, Human
agccgggcguguuggcaggug

SEQ ID NO: 117308 - RNA, 24 nt, Human
agccugggagacagagccagacuc

SEQ ID NO: 117309 - RNA, 24 nt, Human
agcggccaggcgcgguggcucaug

SEQ ID NO: 117310 - RNA, 28 nt, Human
aggcagaaaaugaaucaaaagggacccc

SEQ ID NO: 117311 - RNA, 18 nt, Human
aggcagaagggugggggu

SEQ ID NO: 117312 - RNA, 25 nt, Human
aggcaggaaaauggugucaacccgg

SEQ ID NO: 117313 - RNA, 21 nt, Human
aggccgaggcggguggaucac

SEQ ID NO: 117314 - RNA, 24 nt, Human
aggcgcgguggcucaugccuguaa

SEQ ID NO: 117315 - RNA, 24 nt, Human
aggcggacguugcagugagccgag

SEQ ID NO: 117316 - RNA, 24 nt, Human
aggcggguggaucacgaggucagg

SEQ ID NO: 117317 - RNA, 21 nt, Human
aggcugaggcaggaaaauggu

SEQ ID NO: 117318 - RNA, 22 nt, Human
agugaccaccuuacaaaccaga

SEQ ID NO: 117319 - RNA, 22 nt, Human
auauuucucuucaguagucuua

SEQ ID NO: 117320 - RNA, 24 nt, Human
auuacgccacugcacuccagccug

SEQ ID NO: 117321 - RNA, 18 nt, Human
cacaaagugcuuuugaau

SEQ ID NO: 117322 - RNA, 28 nt, Human
caccuuauuccuuuaaguaauccaaacu

SEQ ID NO: 117323 - RNA, 23 nt, Human
cacuccagccugggagacagagc

SEQ ID NO: 117324 - RNA, 18 nt, Human
cacugcacuccagccugg

SEQ ID NO: 117325 - RNA, 19 nt, Human
cacugcacuccagccuggg

SEQ ID NO: 117326 - RNA, 22 nt, Human
cacugcacuccagccugggaga

SEQ ID NO: 117327 - RNA, 24 nt, Human
cacugcacuccagccugggagaca

SEQ ID NO: 117328 - RNA, 25 nt, Human
cacugcacuccagccugggagacag

SEQ ID NO: 117329 - RNA, 22 nt, Human
cagacuccaucucaaaaaaaaa

SEQ ID NO: 117330 - RNA, 22 nt, Human
cagcacuuugggaggccgaggc

SEQ ID NO: 117331 - RNA, 24 nt, Human
cagcacuuugggaggccgaggcgg

SEQ ID NO: 117332 - RNA, 24 nt, Human
caugccuguaaucgcagcacuuug

SEQ ID NO: 117333 - RNA, 19 nt, Human
cauuuuccaagcucuucuu

SEQ ID NO: 117334 - RNA, 22 nt, Human
ccacucuucccaugaucauuuc

SEQ ID NO: 117335 - RNA, 19 nt, Human
ccacugcacuccagccugg

SEQ ID NO: 117336 - RNA, 20 nt, Human
ccacugcacuccagccuggg

SEQ ID NO: 117337 - RNA, 22 nt, Human
ccacugcacuccagccugggag

SEQ ID NO: 117338 - RNA, 24 nt, Human
ccacugcacuccagccugggagac

SEQ ID NO: 117339 - RNA, 24 nt, Human
ccagaccauccuggcuaacauggu

SEQ ID NO: 117340 - RNA, 21 nt, Human
ccccaagcacaucuacaaacc

SEQ ID NO: 117341 - RNA, 23 nt, Human
ccccaagcacaucuacaaaccag

SEQ ID NO: 117342 - RNA, 22 nt, Human
ccuggcuaacauggugaaaccc

SEQ ID NO: 117343 - RNA, 23 nt, Human
ccuggcuaacauggugaaacccc

SEQ ID NO: 117344 - RNA, 24 nt, Human
ccuggcuaacauggugaaaccccg

SEQ ID NO: 117345 - RNA, 22 nt, Human
ccuguaaucgcagcacuuuggg

SEQ ID NO: 117346 - RNA, 24 nt, Human
ccuguaaucgcagcacuuugggag

SEQ ID NO: 117347 - RNA, 24 nt, Human
cgaggcggguggaucacgagguca

SEQ ID NO: 117348 - RNA, 20 nt, Human
cgcacacaaagaggcaggag

SEQ ID NO: 117349 - RNA, 26 nt, Human
cgccacugcacuccagccugggagac

SEQ ID NO: 117350 - RNA, 24 nt, Human
cggccaggcgcgguggcucaugcc

SEQ ID NO: 117351 - RNA, 24 nt, Human
cucaugccuguaaucgcagcacuu

SEQ ID NO: 117352 - RNA, 24 nt, Human
cuuacaaaccagaaauuccaggca

SEQ ID NO: 117353 - RNA, 18 nt, Human
cuuacugagcccauucca

SEQ ID NO: 117354 - RNA, 19 nt, Human
cuucuuacugagcccauuc

SEQ ID NO: 117355 - RNA, 20 nt, Human
gaaagaagauaggcagaaaa

SEQ ID NO: 117356 - RNA, 23 nt, Human
gaagauaggcagaaaaugaauca

SEQ ID NO: 117357 - RNA, 23 nt, Human
gagauuacgccacugcacuccag

SEQ ID NO: 117358 - RNA, 24 nt, Human
gcacuccagccugggagacagagc

SEQ ID NO: 117359 - RNA, 24 nt, Human
gcuaacauggugaaaccccgucuc

SEQ ID NO: 117360 - RNA, 23 nt, Human
ggacguugcagugagccgagauu

SEQ ID NO: 117361 - RNA, 24 nt, Human
ggacguugcagugagccgagauua

SEQ ID NO: 117362 - RNA, 21 nt, Human
ggcucaugccuguaaucgcag

SEQ ID NO: 117363 - RNA, 21 nt, Human
gguggaucacgaggucaggag

SEQ ID NO: 117364 - RNA, 20 nt, Human
gguggcucaugccuguaauc

SEQ ID NO: 117365 - RNA, 24 nt, Human
gugcacaugucugcgucucuguga

SEQ ID NO: 117366 - RNA, 23 nt, Human
guggcucaugccuguaaucgcag

SEQ ID NO: 117367 - RNA, 21 nt, Human
guugcagugagccgagauuac

SEQ ID NO: 117368 - RNA, 26 nt, Human
uaaaaaaacacauaugugaaagaaga

SEQ ID NO: 117369 - RNA, 22 nt, Human
uaacauggugaaaccccgucuc

SEQ ID NO: 117370 - RNA, 24 nt, Human
uaacauggugaaaccccgucucua

SEQ ID NO: 117371 - RNA, 20 nt, Human
uaaccacucuucccaugauc

SEQ ID NO: 117372 - RNA, 21 nt, Human
uaaccacucuucccaugauca

SEQ ID NO: 117373 - RNA, 23 nt, Human
uacaaaccagaaauuccaggcaa

SEQ ID NO: 117374 - RNA, 24 nt, Human
uacaaaccagaaauuccaggcaac

SEQ ID NO: 117375 - RNA, 18 nt, Human
uaccagggaaggggcagc

SEQ ID NO: 117376 - RNA, 20 nt, Human
uagaacacagcacaaagugc

SEQ ID NO: 117377 - RNA, 23 nt, Human
uaggcagaaaaugaaucaaaaua

SEQ ID NO: 117378 - RNA, 19 nt, Human
uagguagcauaauuauaag

SEQ ID NO: 117379 - RNA, 24 nt, Human
uagucccaucuacugguaguccca

SEQ ID NO: 117380 - RNA, 28 nt, Human
uauagaacacagcacaaagugcuuuuga

SEQ ID NO: 117381 - RNA, 22 nt, Human
uauguaaaaaaacacauaugug

SEQ ID NO: 117382 - RNA, 19 nt, Human
ucaauuuuuauuauguuuu

SEQ ID NO: 117383 - RNA, 20 nt, Human
ucaauuuuuauuauguuuuu

SEQ ID NO: 117384 - RNA, 18 nt, Human
ucacgaggucaggagauc

SEQ ID NO: 117385 - RNA, 24 nt, Human
ucacgaggucaggagauccagacc

SEQ ID NO: 117386 - RNA, 23 nt, Human
ucaguagucuuaaccacucuucc

SEQ ID NO: 117387 - RNA, 23 nt, Human
uccauauuacaaauauuuuaaaa

SEQ ID NO: 117388 - RNA, 21 nt, Human
uccccaagcacaucuacaaac

SEQ ID NO: 117389 - RNA, 18 nt, Human
ucuauaaaauaaaaggaa

SEQ ID NO: 117390 - RNA, 24 nt, Human
ucuccccaagcacaucuacaaacc

SEQ ID NO: 117391 - RNA, 22 nt, Human
ucucuacuaaaaauacaaaaaa

SEQ ID NO: 117392 - RNA, 19 nt, Human
ucugcauuuuccaagcucu

SEQ ID NO: 117393 - RNA, 21 nt, Human
ugaaagaagauaggcagaaaa

SEQ ID NO: 117394 - RNA, 25 nt, Human
ugaccaccuuacaaaccagaaauuc

SEQ ID NO: 117395 - RNA, 22 nt, Human
ugagccgagauuacgccacugc

SEQ ID NO: 117396 - RNA, 23 nt, Human
ugaggcaggaaaauggugucaac

SEQ ID NO: 117397 - RNA, 20 nt, Human
ugccuguagucccaucuacu

SEQ ID NO: 117398 - RNA, 18 nt, Human
uggcucaugccuguaauc

SEQ ID NO: 117399 - RNA, 22 nt, Human
uggcucaugccuguaaucgcag

SEQ ID NO: 117400 - RNA, 24 nt, Human
uggcucaugccuguaaucgcagca

SEQ ID NO: 117401 - RNA, 23 nt, Human
ugggaggccgaggcggguggauc

SEQ ID NO: 117402 - RNA, 24 nt, Human
ugggaggccgaggcggguggauca

SEQ ID NO: 117403 - RNA, 21 nt, Human
uggugucaacccgggaggcgg

SEQ ID NO: 117404 - RNA, 24 nt, Human
uguaaaaaaacacauaugugaaag

SEQ ID NO: 117405 - RNA, 24 nt, Human
uguuggcaggugccuguaguccca

SEQ ID NO: 117406 - RNA, 21 nt, Human
uuaaaaaagaacagugaccac

SEQ ID NO: 117407 - RNA, 24 nt, Human
uuaaaaguuguguuuuaaaaaguu

SEQ ID NO: 117408 - RNA, 23 nt, Human
uuaaguaauccaaacuauuuucu

SEQ ID NO: 117409 - RNA, 23 nt, Human
uuacgccacugcacuccagccug

SEQ ID NO: 117410 - RNA, 20 nt, Human
uuacugagcccauuccauau

SEQ ID NO: 117411 - RNA, 23 nt, Human
uuagaaaauaucgaaagcggcca

SEQ ID NO: 117412 - RNA, 23 nt, Human
uucaauuuuuauuauguuuuuua

SEQ ID NO: 117413 - RNA, 22 nt, Human
uucacagugacgcacacaaaga

SEQ ID NO: 117414 - RNA, 23 nt, Human
uucaugccuuucuaguaaauuaa

SEQ ID NO: 117415 - RNA, 19 nt, Human
uugaucucgaagaaaacug

SEQ ID NO: 117416 - RNA, 24 nt, Human
uugaucucgaagaaaacugaaaua

SEQ ID NO: 117417 - RNA, 20 nt, Human
uugcagugagccgagauuac

SEQ ID NO: 117418 - RNA, 21 nt, Human
uugcagugagccgagauuacg

SEQ ID NO: 117419 - RNA, 25 nt, Human
uugggaggccgaggcggguggauca

SEQ ID NO: 117420 - RNA, 22 nt, Human
aaaagauuuguucacacacugg

SEQ ID NO: 117421 - RNA, 22 nt, Human
aaccagcaccaacaggaaguuc

SEQ ID NO: 117422 - RNA, 23 nt, Human
aaccagcaccaacaggaaguuca

SEQ ID NO: 117423 - RNA, 22 nt, Human
aagagcaucaugugaaccagca

SEQ ID NO: 117424 - RNA, 19 nt, Human
acacugcuauuccaaaggg

SEQ ID NO: 117425 - RNA, 24 nt, Human
aggauagcuggaggauuuggacaa

SEQ ID NO: 117426 - RNA, 27 nt, Human
aggcagaugauagaaaacgggggaccc

SEQ ID NO: 117427 - RNA, 21 nt, Human
cacaaugacuagcagaccugc

SEQ ID NO: 117428 - RNA, 18 nt, Human
cacagcgaggggcagggc

SEQ ID NO: 117429 - RNA, 21 nt, Human
cagcgaggggcagggcugcuc

SEQ ID NO: 117430 - RNA, 23 nt, Human
caucaugugaaccagcaccaaca

SEQ ID NO: 117431 - RNA, 18 nt, Human
caugagguucacuugugc

SEQ ID NO: 117432 - RNA, 22 nt, Human
cccaaugggaaacucaaaguca

SEQ ID NO: 117433 - RNA, 19 nt, Human
gaaccagcaccaacaggaa

SEQ ID NO: 117434 - RNA, 24 nt, Human
gcgaggggcagggcugcuccaaac

SEQ ID NO: 117435 - RNA, 22 nt, Human
gcuuucauuccagccaagacac

SEQ ID NO: 117436 - RNA, 21 nt, Human
ggaaacucaaagucaucaguu

SEQ ID NO: 117437 - RNA, 22 nt, Human
ggcagggcugcuccaaacccca

SEQ ID NO: 117438 - RNA, 23 nt, Human
gucugggugggggucacaugugu

SEQ ID NO: 117439 - RNA, 21 nt, Human
ucccucugucugggugggggu

SEQ ID NO: 117440 - RNA, 21 nt, Human
ugaaggucaucccucugucug

SEQ ID NO: 117441 - RNA, 23 nt, Human
uggaggauuuggacaaaagauuu

SEQ ID NO: 117442 - RNA, 23 nt, Human
uuuuaggcagaugauagaaaacg

SEQ ID NO: 117443 - RNA, 21 nt, Human
aaaagaagaugggucuagaua

SEQ ID NO: 117444 - RNA, 22 nt, Human
aaacugggcucccaucuuuacc

SEQ ID NO: 117445 - RNA, 22 nt, Human
aaagaaacauccaaagccugaa

SEQ ID NO: 117446 - RNA, 23 nt, Human
aagcaacuagaacuuaucacaaa

SEQ ID NO: 117447 - RNA, 21 nt, Human
aaucacugagugauuauggaa

SEQ ID NO: 117448 - RNA, 21 nt, Human
acaguaaggguaaaaaugaaa

SEQ ID NO: 117449 - RNA, 21 nt, Human
aggaagugaucgcuuaugaca

SEQ ID NO: 117450 - RNA, 21 nt, Human
augaaaugauuaacaccacca

SEQ ID NO: 117451 - RNA, 23 nt, Human
caguaaggguaaaaaugaaauga

SEQ ID NO: 117452 - RNA, 21 nt, Human
ccccagaaaaugcuucauacu

SEQ ID NO: 117453 - RNA, 20 nt, Human
cccgcgagcguccggcagcu

SEQ ID NO: 117454 - RNA, 25 nt, Human
cccgcggcgggaugcguuccgagac

SEQ ID NO: 117455 - RNA, 23 nt, Human
cugagugauuauggaaaggcaaa

SEQ ID NO: 117456 - RNA, 19 nt, Human
cugcuaaagaaacauccaa

SEQ ID NO: 117457 - RNA, 21 nt, Human
guuccgagacccgcgagcguc

SEQ ID NO: 117458 - RNA, 19 nt, Human
uaaagaaacauccaaagcc

SEQ ID NO: 117459 - RNA, 20 nt, Human
uaaccaaaagcagauaguaa

SEQ ID NO: 117460 - RNA, 22 nt, Human
uaagugaggcuucagaaagucc

SEQ ID NO: 117461 - RNA, 20 nt, Human
uaauaaagguaaggccauca

SEQ ID NO: 117462 - RNA, 20 nt, Human
uacaguaaugugagagaaac

SEQ ID NO: 117463 - RNA, 23 nt, Human
uaccaggacagcucuuuuuagug

SEQ ID NO: 117464 - RNA, 24 nt, Human
uagccauggccuggcuucaggcau

SEQ ID NO: 117465 - RNA, 23 nt, Human
uauaaccaaaagcagauaguaac

SEQ ID NO: 117466 - RNA, 24 nt, Human
uaucaaaauaaaaccauacuuccu

SEQ ID NO: 117467 - RNA, 22 nt, Human
uaucacaaaacugcuaaagaaa

SEQ ID NO: 117468 - RNA, 22 nt, Human
uaugacaucauuucauugaucu

SEQ ID NO: 117469 - RNA, 22 nt, Human
ucaaaaagaagaugggucuaga

SEQ ID NO: 117470 - RNA, 23 nt, Human
ucaaaauaaaaccauacuuccua

SEQ ID NO: 117471 - RNA, 22 nt, Human
ucccauaauuuaaaaaaacuug

SEQ ID NO: 117472 - RNA, 18 nt, Human
ugagagaaacucaaacag

SEQ ID NO: 117473 - RNA, 23 nt, Human
ugagagaaacucaaacaguaagg

SEQ ID NO: 117474 - RNA, 26 nt, Human
ugauuaacaccaccagaggaggaagc

SEQ ID NO: 117475 - RNA, 24 nt, Human
uggaaaggcaaaguauauacagua

SEQ ID NO: 117476 - RNA, 19 nt, Human
uucaaaaagaagauggguc

SEQ ID NO: 117477 - RNA, 19 nt, Human
agcggcggcgcagcgggca

SEQ ID NO: 117478 - RNA, 22 nt, Human
aggccugggggguggggguggg

SEQ ID NO: 117479 - RNA, 22 nt, Human
agggauacaagaggcaccaagg

SEQ ID NO: 117480 - RNA, 30 nt, Human
auggagcacuagggauacaagaggcaccag

SEQ ID NO: 117481 - RNA, 22 nt, Human
ccugcaucccuuccugaaagua

SEQ ID NO: 117482 - RNA, 21 nt, Human
cgggcacacucugagcucgca

SEQ ID NO: 117483 - RNA, 23 nt, Human
gaaaccgugcaaaugccaaacua

SEQ ID NO: 117484 - RNA, 21 nt, Human
gccugcaucccuuccugaaag

SEQ ID NO: 117485 - RNA, 21 nt, Human
gcggcgcagcgggcacacucu

SEQ ID NO: 117486 - RNA, 21 nt, Human
gcgguggcggcggcggcaggu

SEQ ID NO: 117487 - RNA, 23 nt, Human
gcgguggcggcggcggcagguac

SEQ ID NO: 117488 - RNA, 30 nt, Human
ggacacuacaacauugucauggggaaaacg

SEQ ID NO: 117489 - RNA, 22 nt, Human
gggggugggggugggggacacu

SEQ ID NO: 117490 - RNA, 19 nt, Human
gguggcgguggcggcggcg

SEQ ID NO: 117491 - RNA, 20 nt, Human
guggcgguggcggcggcggc

SEQ ID NO: 117492 - RNA, 21 nt, Human
guggcgguggcggcggcggca

SEQ ID NO: 117493 - RNA, 22 nt, Human
guggcgguggcggcggcggcag

SEQ ID NO: 117494 - RNA, 22 nt, Human
ucagaacuaugacauauuccuc

SEQ ID NO: 117495 - RNA, 22 nt, Human
ugagacacgucuaaccaguuua

SEQ ID NO: 117496 - RNA, 18 nt, Human
uggcgguggcggcggcgg

SEQ ID NO: 117497 - RNA, 21 nt, Human
ugggggacacuacaacauugu

SEQ ID NO: 117498 - RNA, 19 nt, Human
ugggggguggggguggggg

SEQ ID NO: 117499 - RNA, 20 nt, Human
ugggggugggggacacuaca

SEQ ID NO: 117500 - RNA, 18 nt, Human
ugguaggggaaaagggcg

SEQ ID NO: 117501 - RNA, 21 nt, Human
aacuguauaggcuacagggac

SEQ ID NO: 117502 - RNA, 22 nt, Human
aagacaaguccagggacaaccc

SEQ ID NO: 117503 - RNA, 21 nt, Human
aaguccccuuuagagagaccc

SEQ ID NO: 117504 - RNA, 24 nt, Human
acccugcucugggcugguuugggg

SEQ ID NO: 117505 - RNA, 19 nt, Human
agaaagcaagacccugcaa

SEQ ID NO: 117506 - RNA, 20 nt, Human
agaagaggucaaagaaagca

SEQ ID NO: 117507 - RNA, 22 nt, Human
agaaggagggggugggacggag

SEQ ID NO: 117508 - RNA, 21 nt, Human
agaggcaucccagugaccccu

SEQ ID NO: 117509 - RNA, 21 nt, Human
aucccagugacccccagaagu

SEQ ID NO: 117510 - RNA, 19 nt, Human
caagacaaguccagggaca

SEQ ID NO: 117511 - RNA, 22 nt, Human
caagacaaguccagggacaacc

SEQ ID NO: 117512 - RNA, 18 nt, Human
caagaggcaucccaguga

SEQ ID NO: 117513 - RNA, 24 nt, Human
caagaggcaucccagugaccccca

SEQ ID NO: 117514 - RNA, 18 nt, Human
cagggacaaaggguagaa

SEQ ID NO: 117515 - RNA, 18 nt, Human
caucccagugacccccag

SEQ ID NO: 117516 - RNA, 19 nt, Human
cccagugacccccagaagu

SEQ ID NO: 117517 - RNA, 22 nt, Human
cccccagaagugacugggguaa

SEQ ID NO: 117518 - RNA, 21 nt, Human
cccguagacuccuaggcugga

SEQ ID NO: 117519 - RNA, 21 nt, Human
cccugcucugggcugguuugg

SEQ ID NO: 117520 - RNA, 19 nt, Human
ccuaggcuggagcacugga

SEQ ID NO: 117521 - RNA, 21 nt, Human
ccuaggcuggagcacuggaca

SEQ ID NO: 117522 - RNA, 21 nt, Human
ccugcucugggcugguuuggg

SEQ ID NO: 117523 - RNA, 19 nt, Human
cggaaugggugaucugggc

SEQ ID NO: 117524 - RNA, 23 nt, Human
cuacagggacaaaggguagaagc

SEQ ID NO: 117525 - RNA, 19 nt, Human
cuccuaggcuggagcacug

SEQ ID NO: 117526 - RNA, 21 nt, Human
gaaccaagacaaguccaggga

SEQ ID NO: 117527 - RNA, 20 nt, Human
gagcauggccaguggugggc

SEQ ID NO: 117528 - RNA, 20 nt, Human
gagcauggccaguggugggc

SEQ ID NO: 117529 - RNA, 25 nt, Human
gagcauggccaguggugggcuucgg

SEQ ID NO: 117530 - RNA, 24 nt, Human
gagggggugggacggagggggcag

SEQ ID NO: 117531 - RNA, 19 nt, Human
gccgcgguucuaccugugg

SEQ ID NO: 117532 - RNA, 23 nt, Human
gcgcuauccuagaaggagggggu

SEQ ID NO: 117533 - RNA, 22 nt, Human
gggggugggacggagggggcag

SEQ ID NO: 117534 - RNA, 19 nt, Human
ggugggacggagggggcag

SEQ ID NO: 117535 - RNA, 21 nt, Human
uagagagacccugcucugggc

SEQ ID NO: 117536 - RNA, 26 nt, Human
ucuggaaccaagacaaguccagggac

SEQ ID NO: 117537 - RNA, 22 nt, Human
ugacccccagaagugacugggg

SEQ ID NO: 117538 - RNA, 18 nt, Human
ugacugggguaaggggag

SEQ ID NO: 117539 - RNA, 25 nt, Human
uugcagccauuccucuuuguuggug

SEQ ID NO: 117540 - RNA, 22 nt, Human
uuguugguguaggggaggagag

SEQ ID NO: 117541 - RNA, 24 nt, Human
aaagugcugggauuacagguguga

SEQ ID NO: 117542 - RNA, 24 nt, Human
aagcgauucucaugccuuggccuc

SEQ ID NO: 117543 - RNA, 18 nt, Human
aagugcugggauuacagg

SEQ ID NO: 117544 - RNA, 19 nt, Human
aagugcugggauuacaggu

SEQ ID NO: 117545 - RNA, 26 nt, Human
aagugcugggauuacaggugugagcc

SEQ ID NO: 117546 - RNA, 23 nt, Human
aauuuuuguaucuuuaguagaga

SEQ ID NO: 117547 - RNA, 24 nt, Human
accauguuggccaggcuggucuug

SEQ ID NO: 117548 - RNA, 21 nt, Human
acccacugccccccgugcccc

SEQ ID NO: 117549 - RNA, 24 nt, Human
acccacugccccccgugccccacc

SEQ ID NO: 117550 - RNA, 24 nt, Human
agagacuuaggggagugcacugcu

SEQ ID NO: 117551 - RNA, 23 nt, Human
agcgauucucaugccuuggccuc

SEQ ID NO: 117552 - RNA, 24 nt, Human
agcgauucucaugccuuggccucu

SEQ ID NO: 117553 - RNA, 25 nt, Human
aggccggagugcaguggugccaucu

SEQ ID NO: 117554 - RNA, 23 nt, Human
aguacccacugccccccgugccc

SEQ ID NO: 117555 - RNA, 22 nt, Human
aguagagaugggguuucaccau

SEQ ID NO: 117556 - RNA, 18 nt, Human
aguagcugggauuacagg

SEQ ID NO: 117557 - RNA, 18 nt, Human
aguagcugggauuacagg

SEQ ID NO: 117558 - RNA, 21 nt, Human
agugcaguggugccaucucag

SEQ ID NO: 117559 - RNA, 24 nt, Human
agugcaguggugccaucucagcuc

SEQ ID NO: 117560 - RNA, 19 nt, Human
auccacaccuggcccucug

SEQ ID NO: 117561 - RNA, 19 nt, Human
aucuguuuuauuaagauag

SEQ ID NO: 117562 - RNA, 22 nt, Human
augaacucuuaaaucuaaagaa

SEQ ID NO: 117563 - RNA, 22 nt, Human
augccuuggccucucgaguagc

SEQ ID NO: 117564 - RNA, 18 nt, Human
augggguuucaccauguu

SEQ ID NO: 117565 - RNA, 22 nt, Human
augggguuucaccauguuggcc

SEQ ID NO: 117566 - RNA, 23 nt, Human
augggguuucaccauguuggcca

SEQ ID NO: 117567 - RNA, 24 nt, Human
auuuuuguaucuuuaguagagaug

SEQ ID NO: 117568 - RNA, 22 nt, Human
caaaagcagccauuccccuuuc

SEQ ID NO: 117569 - RNA, 24 nt, Human
caaagugcugggauuacaggugug

SEQ ID NO: 117570 - RNA, 23 nt, Human
caaccuccaccucccagguucaa

SEQ ID NO: 117571 - RNA, 24 nt, Human
cacaccaccacgcucagcaaauuu

SEQ ID NO: 117572 - RNA, 21 nt, Human
caccauguuggccaggcuggu

SEQ ID NO: 117573 - RNA, 24 nt, Human
caccauguuggccaggcuggucuu

SEQ ID NO: 117574 - RNA, 27 nt, Human
caccauguuggccaggcuggucuugaa

SEQ ID NO: 117575 - RNA, 22 nt, Human
cacccaccuuggccucccaaag

SEQ ID NO: 117576 - RNA, 23 nt, Human
cacccaccuuggccucccaaagu

SEQ ID NO: 117577 - RNA, 20 nt, Human
cacugcaaccuccaccuccc

SEQ ID NO: 117578 - RNA, 21 nt, Human
cagcacaagugcauaaaugaa

SEQ ID NO: 117579 - RNA, 21 nt, Human
caggugcacaccaccacgcuc

SEQ ID NO: 117580 - RNA, 21 nt, Human
caggugcaucugcuucugcug

SEQ ID NO: 117581 - RNA, 24 nt, Human
cauguuggccaggcuggucuugaa

SEQ ID NO: 117582 - RNA, 20 nt, Human
ccaaagugcugggauuacag

SEQ ID NO: 117583 - RNA, 21 nt, Human
ccaaagugcugggauuacagg

SEQ ID NO: 117584 - RNA, 21 nt, Human
ccaaagugcugggauuacagg

SEQ ID NO: 117585 - RNA, 24 nt, Human
ccaaagugcugggauuacaggugu

SEQ ID NO: 117586 - RNA, 20 nt, Human
ccaccagucucacugccuga

SEQ ID NO: 117587 - RNA, 24 nt, Human
ccaccucccagguucaagcgauuc

SEQ ID NO: 117588 - RNA, 22 nt, Human
ccacugccccccgugccccacc

SEQ ID NO: 117589 - RNA, 18 nt, Human
ccagacacugaccuggag

SEQ ID NO: 117590 - RNA, 20 nt, Human
cccagguucaagcgauucuc

SEQ ID NO: 117591 - RNA, 23 nt, Human
cccagguucaagcgauucucaug

SEQ ID NO: 117592 - RNA, 19 nt, Human
ccccuuuccccuuccccau

SEQ ID NO: 117593 - RNA, 22 nt, Human
cccgugccccaccagucucacu

SEQ ID NO: 117594 - RNA, 22 nt, Human
ccucccagguucaagcgauucu

SEQ ID NO: 117595 - RNA, 24 nt, Human
ccugaccucagaugacccacccac

SEQ ID NO: 117596 - RNA, 21 nt, Human
ccuggcccucugggaaucugu

SEQ ID NO: 117597 - RNA, 28 nt, Human
cggagugcaguggugccauccuagcacg

SEQ ID NO: 117598 - RNA, 24 nt, Human
cucacugcaaccuccaccucccag

SEQ ID NO: 117599 - RNA, 24 nt, Human
cucgaguagcugggauuacaggug

SEQ ID NO: 117600 - RNA, 23 nt, Human
cugcaaccuccaccucccagguu

SEQ ID NO: 117601 - RNA, 24 nt, Human
cugcaaccuccaccucccagguuc

SEQ ID NO: 117602 - RNA, 18 nt, Human
cuggguuugaggagauuu

SEQ ID NO: 117603 - RNA, 24 nt, Human
cugucauuaauaugugugaccuug

SEQ ID NO: 117604 - RNA, 21 nt, Human
cuguggauccacaccuggccc

SEQ ID NO: 117605 - RNA, 24 nt, Human
cuuggccucucgaguagcugggau

SEQ ID NO: 117606 - RNA, 23 nt, Human
gaccaauuaguguaagcucagca

SEQ ID NO: 117607 - RNA, 20 nt, Human
gagaugggguuucaccaugu

SEQ ID NO: 117608 - RNA, 24 nt, Human
gagaugggguuucaccauguuggc

SEQ ID NO: 117609 - RNA, 26 nt, Human
gaguagcugggauuacaggugcacac

SEQ ID NO: 117610 - RNA, 18 nt, Human
gauuacaggugugagcca

SEQ ID NO: 117611 - RNA, 21 nt, Human
gauuacaggugugagccacca

SEQ ID NO: 117612 - RNA, 24 nt, Human
gauuacaggugugagccaccaugc

SEQ ID NO: 117613 - RNA, 22 nt, Human
gcaaccuccaccucccagguuc

SEQ ID NO: 117614 - RNA, 18 nt, Human
gcccugggauggaaugaa

SEQ ID NO: 117615 - RNA, 21 nt, Human
gccggagugcaguggugccag

SEQ ID NO: 117616 - RNA, 27 nt, Human
gccuggcuggagguccuuguccuuggg

SEQ ID NO: 117617 - RNA, 20 nt, Human
gccuuggccucucgaguagc

SEQ ID NO: 117618 - RNA, 21 nt, Human
gcucagcauagugcugggcac

SEQ ID NO: 117619 - RNA, 23 nt, Human
gcuggucuugaacuccugaccuc

SEQ ID NO: 117620 - RNA, 24 nt, Human
ggauuacaggugugagccaccaug

SEQ ID NO: 117621 - RNA, 18 nt, Human
ggcccucugggaaucugu

SEQ ID NO: 117622 - RNA, 24 nt, Human
ggcuggucuugaacuccugaccuc

SEQ ID NO: 117623 - RNA, 22 nt, Human
gggguuucaccauguuggccag

SEQ ID NO: 117624 - RNA, 22 nt, Human
ggguuucaccauguuggccagg

SEQ ID NO: 117625 - RNA, 19 nt, Human
ggucuugaacuccugaccu

SEQ ID NO: 117626 - RNA, 23 nt, Human
guagagaugggguuucaccaugu

SEQ ID NO: 117627 - RNA, 18 nt, Human
guagcugggauuacaggu

SEQ ID NO: 117628 - RNA, 18 nt, Human
gucuucuugcccuccugg

SEQ ID NO: 117629 - RNA, 18 nt, Human
guuuuggucuucuugccc

SEQ ID NO: 117630 - RNA, 23 nt, Human
uaaagaagacuuuuuuacuacaa

SEQ ID NO: 117631 - RNA, 18 nt, Human
uaagcucagcauagugcu

SEQ ID NO: 117632 - RNA, 22 nt, Human
uacaaguacccacugccccccg

SEQ ID NO: 117633 - RNA, 19 nt, Human
uacaggugcacaccaccac

SEQ ID NO: 117634 - RNA, 22 nt, Human
uacaggugugagccaccaugcc

SEQ ID NO: 117635 - RNA, 22 nt, Human
uagagaugggguuucaccaugu

SEQ ID NO: 117636 - RNA, 24 nt, Human
uaguagagaugggguuucaccaug

SEQ ID NO: 117637 - RNA, 25 nt, Human
uaguagagaugggguuucaccaugu

SEQ ID NO: 117638 - RNA, 24 nt, Human
uaucaaaagcagccauuccccuuu

SEQ ID NO: 117639 - RNA, 25 nt, Human
ucaaaagcagccauuccccuuuccc

SEQ ID NO: 117640 - RNA, 18 nt, Human
ucaaucccauucuugccc

SEQ ID NO: 117641 - RNA, 20 nt, Human
ucaauuccuucacaaugccu

SEQ ID NO: 117642 - RNA, 24 nt, Human
ucacugcaaccuccaccucccagg

SEQ ID NO: 117643 - RNA, 25 nt, Human
ucacugcaaccuccaccucccaggu

SEQ ID NO: 117644 - RNA, 26 nt, Human
ucacugcaaccuccaccucccagguu

SEQ ID NO: 117645 - RNA, 25 nt, Human
ucagcucacugcaaccuccaccucc

SEQ ID NO: 117646 - RNA, 23 nt, Human
uccaagucuccuacacuagauuu

SEQ ID NO: 117647 - RNA, 23 nt, Human
ucccaaagugcugggauuacagg

SEQ ID NO: 117648 - RNA, 21 nt, Human
ucccagguucaagcgauucuc

SEQ ID NO: 117649 - RNA, 24 nt, Human
ucccagguucaagcgauucucaug

SEQ ID NO: 117650 - RNA, 18 nt, Human
uccccuuuccccuucccc

SEQ ID NO: 117651 - RNA, 19 nt, Human
uccccuuuccccuucccca

SEQ ID NO: 117652 - RNA, 18 nt, Human
uccugguagcaagacucu

SEQ ID NO: 117653 - RNA, 19 nt, Human
ucguugccuaggccggagu

SEQ ID NO: 117654 - RNA, 23 nt, Human
ucucgaguagcugggauuacagg

SEQ ID NO: 117655 - RNA, 24 nt, Human
ucucgaguagcugggauuacaggu

SEQ ID NO: 117656 - RNA, 24 nt, Human
ucuuuaguagagaugggguuucac

SEQ ID NO: 117657 - RNA, 24 nt, Human
ugacccacccaccuuggccuccca

SEQ ID NO: 117658 - RNA, 25 nt, Human
ugaccucagaugacccacccaccuu

SEQ ID NO: 117659 - RNA, 22 nt, Human
ugauuguuuucuuugggccgag

SEQ ID NO: 117660 - RNA, 24 nt, Human
ugcacaccaccacgcucagcaaau

SEQ ID NO: 117661 - RNA, 19 nt, Human
ugccuaggccggagugcag

SEQ ID NO: 117662 - RNA, 24 nt, Human
ugccuaggccggagugcaguggug

SEQ ID NO: 117663 - RNA, 22 nt, Human
ugccuuggccucucgaguagcu

SEQ ID NO: 117664 - RNA, 24 nt, Human
ugccuuucugagagaagauaaucc

SEQ ID NO: 117665 - RNA, 24 nt, Human
ugcugggauuacaggugugagcca

SEQ ID NO: 117666 - RNA, 21 nt, Human
uggaaaaaagucaacguucuu

SEQ ID NO: 117667 - RNA, 21 nt, Human
uggaaugaaacuccagacacu

SEQ ID NO: 117668 - RNA, 18 nt, Human
uggagguccuuguccuug

SEQ ID NO: 117669 - RNA, 24 nt, Human
uggccaggcuggucuugaacuccu

SEQ ID NO: 117670 - RNA, 23 nt, Human
uggcuggagguccuuguccuugg

SEQ ID NO: 117671 - RNA, 20 nt, Human
ugggauggaaugaaacucca

SEQ ID NO: 117672 - RNA, 21 nt, Human
ugggauuacaggugcacacca

SEQ ID NO: 117673 - RNA, 22 nt, Human
ugggauuacaggugcacaccac

SEQ ID NO: 117674 - RNA, 24 nt, Human
ugggauuacaggugcacaccacca

SEQ ID NO: 117675 - RNA, 18 nt, Human
ugggauuacaggugugag

SEQ ID NO: 117676 - RNA, 22 nt, Human
ugggauuacaggugugagccac

SEQ ID NO: 117677 - RNA, 23 nt, Human
ugggauuacaggugugagccacc

SEQ ID NO: 117678 - RNA, 24 nt, Human
ugggauuacaggugugagccacca

SEQ ID NO: 117679 - RNA, 25 nt, Human
ugggauuacaggugugagccaccau

SEQ ID NO: 117680 - RNA, 24 nt, Human
ugggguuucaccauguuggccagg

SEQ ID NO: 117681 - RNA, 24 nt, Human
uggugccaucucagcucacugcaa

SEQ ID NO: 117682 - RNA, 22 nt, Human
uguuuguuuguuuguauuggag

SEQ ID NO: 117683 - RNA, 18 nt, Human
uuaguagagaugggguuu

SEQ ID NO: 117684 - RNA, 22 nt, Human
uuaguagagaugggguuucacc

SEQ ID NO: 117685 - RNA, 24 nt, Human
uuaguagagaugggguuucaccau

SEQ ID NO: 117686 - RNA, 22 nt, Human
uucaagauaugugucagggaac

SEQ ID NO: 117687 - RNA, 20 nt, Human
uucaagcgauucucaugccu

SEQ ID NO: 117688 - RNA, 19 nt, Human
uugaccuucaaguccugug

SEQ ID NO: 117689 - RNA, 24 nt, Human
uugccuaggccggagugcaguggu

SEQ ID NO: 117690 - RNA, 20 nt, Human
uuggagccaauuucaugagg

SEQ ID NO: 117691 - RNA, 18 nt, Human
uuggccucccaaagugcu

SEQ ID NO: 117692 - RNA, 22 nt, Human
uugggccgagaauuguuuuuuu

SEQ ID NO: 117693 - RNA, 20 nt, Human
uuggucuucuugcccuccug

SEQ ID NO: 117694 - RNA, 21 nt, Human
uuggucuucuugcccuccugg

SEQ ID NO: 117695 - RNA, 20 nt, Human
uuuaguagagaugggguuuu

SEQ ID NO: 117696 - RNA, 24 nt, Human
uuucaccauguuggccaggcuggu

SEQ ID NO: 117697 - RNA, 23 nt, Human
uuuugcucucguugccuaggccg

SEQ ID NO: 117698 - RNA, 22 nt, Human
uuuuucaacacuuucaucacuu

SEQ ID NO: 117699 - RNA, 25 nt, Human
uuuuucaacacuuucaucacuuggu

SEQ ID NO: 117700 - RNA, 20 nt, Human
uuuuuguaucuuuaguagag

SEQ ID NO: 117701 - RNA, 22 nt, Human
aaaacaaaccuacacaaaaaac

SEQ ID NO: 117702 - RNA, 20 nt, Human
aaaacaaagaauuguugagc

SEQ ID NO: 117703 - RNA, 24 nt, Human
aauaaaaaacaaaccuacacaaaa

SEQ ID NO: 117704 - RNA, 21 nt, Human
agccaacaugggagaucugcu

SEQ ID NO: 117705 - RNA, 20 nt, Human
auauauggauauauauuuug

SEQ ID NO: 117706 - RNA, 23 nt, Human
aucaaaaauaaaaaacaaaccua

SEQ ID NO: 117707 - RNA, 21 nt, Human
caaaccuacacaaaaaaccac

SEQ ID NO: 117708 - RNA, 23 nt, Human
cagcccacaugacucagggacac

SEQ ID NO: 117709 - RNA, 23 nt, Human
caggauucagcccacaugacucc

SEQ ID NO: 117710 - RNA, 20 nt, Human
caucaaaaauaaaaaacaaa

SEQ ID NO: 117711 - RNA, 21 nt, Human
ccaccugcucugagugaaagu

SEQ ID NO: 117712 - RNA, 23 nt, Human
cuaguggaaacccuguuuucucc

SEQ ID NO: 117713 - RNA, 22 nt, Human
cuccccagcgguugcuggaggc

SEQ ID NO: 117714 - RNA, 22 nt, Human
gaagaucaucaaaaauaaaaaa

SEQ ID NO: 117715 - RNA, 19 nt, Human
uaaaaaacaaaccuacaca

SEQ ID NO: 117716 - RNA, 23 nt, Human
uaaaaaacaaaccuacacaaaaa

SEQ ID NO: 117717 - RNA, 23 nt, Human
uauauaugggauauauauauaua

SEQ ID NO: 117718 - RNA, 23 nt, Human
uauauaugggauauauauauaua

SEQ ID NO: 117719 - RNA, 23 nt, Human
ucaaaaauaaaaaacaaaccuac

SEQ ID NO: 117720 - RNA, 22 nt, Human
ucaucaaaaauaaaaaacaaac

SEQ ID NO: 117721 - RNA, 19 nt, Human
ugaaaaugccauuacacau

SEQ ID NO: 117722 - RNA, 25 nt, Human
ugaaaaugccauuacacauuuaaaa

SEQ ID NO: 117723 - RNA, 18 nt, Human
ugacucagggacacacuc

SEQ ID NO: 117724 - RNA, 18 nt, Human
ugagacaccugccuguaa

SEQ ID NO: 117725 - RNA, 23 nt, Human
uggaaacccuguuuucuccuucc

SEQ ID NO: 117726 - RNA, 23 nt, Human
uggccuuucaagugaugucuagu

SEQ ID NO: 117727 - RNA, 20 nt, Human
ugggauauauauauauaugg

SEQ ID NO: 117728 - RNA, 18 nt, Human
uucaagugaugucuagug

SEQ ID NO: 117729 - RNA, 19 nt, Human
aaccucacacccuggcccc

SEQ ID NO: 117730 - RNA, 21 nt, Human
aaggaagagggaaccaaggag

SEQ ID NO: 117731 - RNA, 20 nt, Human
aaggagcugagcccuggugg

SEQ ID NO: 117732 - RNA, 20 nt, Human
acaauccugucuccaggucc

SEQ ID NO: 117733 - RNA, 21 nt, Human
agacaagagccaagauucagc

SEQ ID NO: 117734 - RNA, 24 nt, Human
agagcucuugccagucuccugcuc

SEQ ID NO: 117735 - RNA, 18 nt, Human
agccgguagaggcagccc

SEQ ID NO: 117736 - RNA, 23 nt, Human
aggaggacucgcgaggcggggcc

SEQ ID NO: 117737 - RNA, 23 nt, Human
aguuugggaagcaggguacagau

SEQ ID NO: 117738 - RNA, 22 nt, Human
caacacaauuccccuuuauuga

SEQ ID NO: 117739 - RNA, 21 nt, Human
cacacccuggccccucggccc

SEQ ID NO: 117740 - RNA, 18 nt, Human
cacccuggccccucggcc

SEQ ID NO: 117741 - RNA, 23 nt, Human
caccugggcuggaaagagaagac

SEQ ID NO: 117742 - RNA, 23 nt, Human
cagccgcaacggaggugaaaccu

SEQ ID NO: 117743 - RNA, 20 nt, Human
cagccucugcacucagcccc

SEQ ID NO: 117744 - RNA, 22 nt, Human
caggaaccaagcugaguggaac

SEQ ID NO: 117745 - RNA, 23 nt, Human
caggggcccgggccuaacguccu

SEQ ID NO: 117746 - RNA, 23 nt, Human
cagguggcaguggcgauggcuuu

SEQ ID NO: 117747 - RNA, 20 nt, Human
ccagacaauccugucuccag

SEQ ID NO: 117748 - RNA, 20 nt, Human
ccccacacaccgggcaaagu

SEQ ID NO: 117749 - RNA, 21 nt, Human
ccccagacaauccugucucca

SEQ ID NO: 117750 - RNA, 18 nt, Human
ccccagaggaggcaccgg

SEQ ID NO: 117751 - RNA, 21 nt, Human
ccccucggccccagacaaucc

SEQ ID NO: 117752 - RNA, 21 nt, Human
ccccuggaggaugcgguccgu

SEQ ID NO: 117753 - RNA, 21 nt, Human
cccucggccccagacaaucuu

SEQ ID NO: 117754 - RNA, 18 nt, Human
cccuggccccucggcccc

SEQ ID NO: 117755 - RNA, 18 nt, Human
ccgcgccgccgccgccgc

SEQ ID NO: 117756 - RNA, 22 nt, Human
ccgggagguuggcuguggggcg

SEQ ID NO: 117757 - RNA, 22 nt, Human
ccguggcucaguagauuugggg

SEQ ID NO: 117758 - RNA, 19 nt, Human
ccucacacccuggccccuc

SEQ ID NO: 117759 - RNA, 24 nt, Human
ccucacacccuggccccucggccc

SEQ ID NO: 117760 - RNA, 18 nt, Human
ccucggccccagacaauc

SEQ ID NO: 117761 - RNA, 23 nt, Human
ccucggccccagacaauccuguc

SEQ ID NO: 117762 - RNA, 22 nt, Human
ccuggccccucggccccagaca

SEQ ID NO: 117763 - RNA, 21 nt, Human
ccugggcuggaaagagaagac

SEQ ID NO: 117764 - RNA, 23 nt, Human
ccugucuccagguccugggaguu

SEQ ID NO: 117765 - RNA, 18 nt, Human
cgccgccgccgccgcggc

SEQ ID NO: 117766 - RNA, 18 nt, Human
cgcuccgccccacacacc

SEQ ID NO: 117767 - RNA, 22 nt, Human
cuagagccuucgggccaagguc

SEQ ID NO: 117768 - RNA, 24 nt, Human
cucagccccaggucgggcccuggc

SEQ ID NO: 117769 - RNA, 21 nt, Human
cugcaggcccccuggaggaug

SEQ ID NO: 117770 - RNA, 23 nt, Human
cugggaugacccacggaaggcac

SEQ ID NO: 117771 - RNA, 18 nt, Human
cuguggggcgggggcggg

SEQ ID NO: 117772 - RNA, 21 nt, Human
cuugcuagagccuucgggcca

SEQ ID NO: 117773 - RNA, 22 nt, Human
gaaccaagcugaguggaaccag

SEQ ID NO: 117774 - RNA, 20 nt, Human
gaaccaaggagcugagcccu

SEQ ID NO: 117775 - RNA, 21 nt, Human
gaagcccagaggcuucaccug

SEQ ID NO: 117776 - RNA, 21 nt, Human
gaggcagguggcaguggcgau

SEQ ID NO: 117777 - RNA, 25 nt, Human
gcacagccgcaacggaggugaaacc

SEQ ID NO: 117778 - RNA, 21 nt, Human
gcaguccgcuccgccccacac

SEQ ID NO: 117779 - RNA, 19 nt, Human
gccggggcugagcugguga

SEQ ID NO: 117780 - RNA, 20 nt, Human
ggaggacgugccaggggccc

SEQ ID NO: 117781 - RNA, 18 nt, Human
ggaggaggacucgcgagg

SEQ ID NO: 117782 - RNA, 24 nt, Human
ggaguggccggggcugagcuggug

SEQ ID NO: 117783 - RNA, 23 nt, Human
ggaugacccacggaaggcacuug

SEQ ID NO: 117784 - RNA, 21 nt, Human
ggccugcaggcccccuggagg

SEQ ID NO: 117785 - RNA, 23 nt, Human
ggcugguucccuuccccagagga

SEQ ID NO: 117786 - RNA, 20 nt, Human
ggcugugguggcaucggggg

SEQ ID NO: 117787 - RNA, 25 nt, Human
gggaagcaggguacagaagaaagau

SEQ ID NO: 117788 - RNA, 19 nt, Human
gggagguuggcuguggggc

SEQ ID NO: 117789 - RNA, 20 nt, Human
gggcaggaaccaagcugagu

SEQ ID NO: 117790 - RNA, 20 nt, Human
gggcaggcacccggggagga

SEQ ID NO: 117791 - RNA, 18 nt, Human
gggcccuggcaggugcug

SEQ ID NO: 117792 - RNA, 18 nt, Human
gggccugcaggcccccug

SEQ ID NO: 117793 - RNA, 18 nt, Human
gggcuucaggaagcccag

SEQ ID NO: 117794 - RNA, 18 nt, Human
gggguuguggcaguggca

SEQ ID NO: 117795 - RNA, 21 nt, Human
ggguuguggcaguggcagggg

SEQ ID NO: 117796 - RNA, 21 nt, Human
guagaggcagccccgcgccca

SEQ ID NO: 117797 - RNA, 23 nt, Human
guccugcucagccucugcacuca

SEQ ID NO: 117798 - RNA, 23 nt, Human
gugcccgggagguuggcuguggg

SEQ ID NO: 117799 - RNA, 20 nt, Human
guggcaguggcgauggcugu

SEQ ID NO: 117800 - RNA, 28 nt, Human
ucacacccuggccccucggccccagaca

SEQ ID NO: 117801 - RNA, 19 nt, Human
ucagcgggaggcagguggc

SEQ ID NO: 117802 - RNA, 19 nt, Human
uccgcgccgccgccgccgc

SEQ ID NO: 117803 - RNA, 18 nt, Human
ugaguggaaccagaggcg

SEQ ID NO: 117804 - RNA, 24 nt, Human
ugcacucagccccaggucgggccc

SEQ ID NO: 117805 - RNA, 18 nt, Human
ugcuagagccuucgggcc

SEQ ID NO: 117806 - RNA, 18 nt, Human
uggaaccagaggcggcuc

SEQ ID NO: 117807 - RNA, 18 nt, Human
uggcaggccugaguccua

SEQ ID NO: 117808 - RNA, 19 nt, Human
uggcagggaguggccgggg

SEQ ID NO: 117809 - RNA, 20 nt, Human
uggcagggaguggccggggc

SEQ ID NO: 117810 - RNA, 24 nt, Human
uggcaggggaagcuccuggacucu

SEQ ID NO: 117811 - RNA, 24 nt, Human
uggccccucggccccagacaaucc

SEQ ID NO: 117812 - RNA, 25 nt, Human
uggccccucggccccagacaauccu

SEQ ID NO: 117813 - RNA, 19 nt, Human
uggccggggcugagcuggu

SEQ ID NO: 117814 - RNA, 21 nt, Human
uggcugugguggcaucggggg

SEQ ID NO: 117815 - RNA, 23 nt, Human
ugggaugacccacggaaggcacu

SEQ ID NO: 117816 - RNA, 24 nt, Human
uggggccugcaggcccccuggagg

SEQ ID NO: 117817 - RNA, 18 nt, Human
uggggcgggggcggggca

SEQ ID NO: 117818 - RNA, 21 nt, Human
ugguggguggcccaucccagg

SEQ ID NO: 117819 - RNA, 20 nt, Human
uguggcauuggcaggccuga

SEQ ID NO: 117820 - RNA, 23 nt, Human
uuuuuuuuuuuuuuuuucaccaa

SEQ ID NO: 117821 - RNA, 22 nt, Human
agagaucuaaaaugaaucaagg

SEQ ID NO: 117822 - RNA, 18 nt, Human
aggcauuucuugaaauuc

SEQ ID NO: 117823 - RNA, 22 nt, Human
cccccaggugccaucucugucc

SEQ ID NO: 117824 - RNA, 24 nt, Human
cucagaacccccaggugccaucuc

SEQ ID NO: 117825 - RNA, 23 nt, Human
cuugaaauucaauggcuuuuuuu

SEQ ID NO: 117826 - RNA, 21 nt, Human
ucauuugggaauguucaaaug

SEQ ID NO: 117827 - RNA, 22 nt, Human
ucauuugggaauguucaaaugu

SEQ ID NO: 117828 - RNA, 21 nt, Human
ugccucagaacccccaggugc

SEQ ID NO: 117829 - RNA, 20 nt, Human
uguugcugguggucuggucc

SEQ ID NO: 117830 - RNA, 23 nt, Human
uuucuugaaauucaauggcuuuu

SEQ ID NO: 117831 - RNA, 23 nt, Human
aaauguugaacacauacagaacu

SEQ ID NO: 117832 - RNA, 22 nt, Human
aagaagacaacauacauaaaaa

SEQ ID NO: 117833 - RNA, 20 nt, Human
aaugcaaaagcacaaaugaa

SEQ ID NO: 117834 - RNA, 19 nt, Human
acaaaugaaugaaauucug

SEQ ID NO: 117835 - RNA, 18 nt, Human
accuuacuuacuuuaugc

SEQ ID NO: 117836 - RNA, 21 nt, Human
acugaauuaagaagcaacaac

SEQ ID NO: 117837 - RNA, 22 nt, Human
agaaaaaaagaaauguuuagaa

SEQ ID NO: 117838 - RNA, 21 nt, Human
agaaugcuuuuaagaaccaag

SEQ ID NO: 117839 - RNA, 24 nt, Human
agaaugcuuuuaagaaccaaggac

SEQ ID NO: 117840 - RNA, 19 nt, Human
agaggcugggguaauucug

SEQ ID NO: 117841 - RNA, 19 nt, Human
aggaggguggggguugaaa

SEQ ID NO: 117842 - RNA, 25 nt, Human
caacauacauaaaaagcacuccaaa

SEQ ID NO: 117843 - RNA, 23 nt, Human
caacaugucaauuuggcaaucaa

SEQ ID NO: 117844 - RNA, 21 nt, Human
caguauugaagaagacaacau

SEQ ID NO: 117845 - RNA, 19 nt, Human
ccacacauuacuucagcuc

SEQ ID NO: 117846 - RNA, 18 nt, Human
cccccacguaacacaccg

SEQ ID NO: 117847 - RNA, 29 nt, Human
cucccccacguaacacaccgcgucaagau

SEQ ID NO: 117848 - RNA, 18 nt, Human
gaacugaauuaagaagca

SEQ ID NO: 117849 - RNA, 24 nt, Human
gaagaagacaacauacauaaaaag

SEQ ID NO: 117850 - RNA, 18 nt, Human
gagaaguggaggcaggug

SEQ ID NO: 117851 - RNA, 19 nt, Human
gaggggagaaguggaggca

SEQ ID NO: 117852 - RNA, 24 nt, Human
gcacaucuaacacuguacuuuuua

SEQ ID NO: 117853 - RNA, 19 nt, Human
ggagaaguggaggcaggug

SEQ ID NO: 117854 - RNA, 18 nt, Human
gguauguaagugcaaugg

SEQ ID NO: 117855 - RNA, 19 nt, Human
uacaagagaacaaaaaaau

SEQ ID NO: 117856 - RNA, 27 nt, Human
uacagcauauuggaaagcuaaagcaga

SEQ ID NO: 117857 - RNA, 18 nt, Human
uaugucucuuaacaacuu

SEQ ID NO: 117858 - RNA, 19 nt, Human
ucccuaaggcaaucaagga

SEQ ID NO: 117859 - RNA, 21 nt, Human
uccuccgucacugcuuucguu

SEQ ID NO: 117860 - RNA, 19 nt, Human
ucuguaguugcuuucaggc

SEQ ID NO: 117861 - RNA, 19 nt, Human
ucuugaggagggugggggu

SEQ ID NO: 117862 - RNA, 18 nt, Human
ugaaaagcagaagucucu

SEQ ID NO: 117863 - RNA, 24 nt, Human
ugaacacauacagaacugaauuaa

SEQ ID NO: 117864 - RNA, 18 nt, Human
ugaagaagacaacauaca

SEQ ID NO: 117865 - RNA, 26 nt, Human
ugaauuaagaagcaacaacugcccua

SEQ ID NO: 117866 - RNA, 19 nt, Human
ugacaaaggcuauacagca

SEQ ID NO: 117867 - RNA, 19 nt, Human
ugcuuuuaagaaccaagga

SEQ ID NO: 117868 - RNA, 19 nt, Human
uggaaagcuaaagcagaac

SEQ ID NO: 117869 - RNA, 22 nt, Human
uggaacauucacaguuuaaugc

SEQ ID NO: 117870 - RNA, 19 nt, Human
uggaagagcuguauuagua

SEQ ID NO: 117871 - RNA, 24 nt, Human
ugguacaagcuccuccgucacugc

SEQ ID NO: 117872 - RNA, 19 nt, Human
uguaagaaugacaauccaa

SEQ ID NO: 117873 - RNA, 22 nt, Human
ugugcacaucuaacacuguacu

SEQ ID NO: 117874 - RNA, 23 nt, Human
uuaccggugguacaagcuccucc

SEQ ID NO: 117875 - RNA, 25 nt, Human
uucaaaaauguugaacacauacaga

SEQ ID NO: 117876 - RNA, 18 nt, Human
uucaguauugaagaagac

SEQ ID NO: 117877 - RNA, 19 nt, Human
uucugucccuaaggcaauc

SEQ ID NO: 117878 - RNA, 24 nt, Human
uucuugaggggagaaguggaggca

SEQ ID NO: 117879 - RNA, 22 nt, Human
uuuacauaauucacaaugagaa

SEQ ID NO: 117880 - RNA, 23 nt, Human
uuuaguacuaacuaaaauaugcu

SEQ ID NO: 117881 - RNA, 22 nt, Human
uuucagguuguggccaagccag

SEQ ID NO: 117882 - RNA, 24 nt, Human
uuucauaaacaaauauauaucacu

SEQ ID NO: 117883 - RNA, 22 nt, Human
uuuccaccuuaacaggugaaaa

SEQ ID NO: 117884 - RNA, 19 nt, Human
uuucuugguggugguaugu

SEQ ID NO: 117885 - RNA, 22 nt, Human
uuuucuuuuccucauuucuccc

SEQ ID NO: 117886 - RNA, 25 nt, Human
uuuucuuuuccucauuuugguuuuu

SEQ ID NO: 117887 - RNA, 24 nt, Human
aaaaaaaaaccaaagagagagacc

SEQ ID NO: 117888 - RNA, 26 nt, Human
aaaaaaauauauucuuuguauuguuu

SEQ ID NO: 117889 - RNA, 26 nt, Human
aaaaaaccaaagagagagaccagaua

SEQ ID NO: 117890 - RNA, 24 nt, Human
aaaaaaccccgaacacuaaguguu

SEQ ID NO: 117891 - RNA, 22 nt, Human
aaaaaaucuucccgaaacauca

SEQ ID NO: 117892 - RNA, 22 nt, Human
aaaaaccaaagagagagaccag

SEQ ID NO: 117893 - RNA, 18 nt, Human
aaaaagaaccccccccac

SEQ ID NO: 117894 - RNA, 19 nt, Human
aaaaagaaccuagaugccu

SEQ ID NO: 117895 - RNA, 23 nt, Human
aaaaaggcaugagucaccagcaa

SEQ ID NO: 117896 - RNA, 27 nt, Human
aaaacagcauuuucauaacaaaaaacc

SEQ ID NO: 117897 - RNA, 20 nt, Human
aaaacggaaaaaaaagaacc

SEQ ID NO: 117898 - RNA, 22 nt, Human
aaaagguccaagaacaugaaag

SEQ ID NO: 117899 - RNA, 22 nt, Human
aaacaaaaacaaaacggaaaaa

SEQ ID NO: 117900 - RNA, 21 nt, Human
aaacaaaaccccccucccccc

SEQ ID NO: 117901 - RNA, 23 nt, Human
aaacaaaaccccccuccccccaa

SEQ ID NO: 117902 - RNA, 24 nt, Human
aaaccaaagagagagaccagauau

SEQ ID NO: 117903 - RNA, 20 nt, Human
aaaccccccuccccccaaac

SEQ ID NO: 117904 - RNA, 24 nt, Human
aaacggaaaaaaaagaaccccccc

SEQ ID NO: 117905 - RNA, 20 nt, Human
aaagaaccccccccaccccc

SEQ ID NO: 117906 - RNA, 23 nt, Human
aaagaaccccccccacccccccg

SEQ ID NO: 117907 - RNA, 23 nt, Human
aaagaaccccccccacccccccg

SEQ ID NO: 117908 - RNA, 19 nt, Human
aacaaaaccccccuccccc

SEQ ID NO: 117909 - RNA, 21 nt, Human
aacaaaacggaaaaaaaagaa

SEQ ID NO: 117910 - RNA, 21 nt, Human
aacaauuucuacaucugcaag

SEQ ID NO: 117911 - RNA, 24 nt, Human
aacaucaauccacccuuccauggc

SEQ ID NO: 117912 - RNA, 21 nt, Human
aacaugaaagggaaaagguga

SEQ ID NO: 117913 - RNA, 22 nt, Human
aacaugaaagggaaaaggugaa

SEQ ID NO: 117914 - RNA, 22 nt, Human
aaccccccccacccccccgcca

SEQ ID NO: 117915 - RNA, 26 nt, Human
aagaaccccccccacccccccgccaa

SEQ ID NO: 117916 - RNA, 30 nt, Human
aagaauccaaacaaaaccccccuccccccc

SEQ ID NO: 117917 - RNA, 22 nt, Human
aauaaaaagaaccuagaugccu

SEQ ID NO: 117918 - RNA, 21 nt, Human
acaaaaagaauccaaacaaaa

SEQ ID NO: 117919 - RNA, 23 nt, Human
acaaaaagaauccaaacaaaacc

SEQ ID NO: 117920 - RNA, 24 nt, Human
acaaaaccccccuccccccaaaca

SEQ ID NO: 117921 - RNA, 25 nt, Human
acagaccaaaaaauauauauaaaua

SEQ ID NO: 117922 - RNA, 21 nt, Human
acaugcauaguccaaauacaa

SEQ ID NO: 117923 - RNA, 24 nt, Human
accccccuccccccaaacaaaaac

SEQ ID NO: 117924 - RNA, 19 nt, Human
agaaccccccccacccccc

SEQ ID NO: 117925 - RNA, 22 nt, Human
agauagaugugugugggugugu

SEQ ID NO: 117926 - RNA, 20 nt, Human
agcaaugacgacaaaaagaa

SEQ ID NO: 117927 - RNA, 25 nt, Human
agcaaugacgacaaaaagaauccaa

SEQ ID NO: 117928 - RNA, 21 nt, Human
agggagaggagcgagcgcggg

SEQ ID NO: 117929 - RNA, 27 nt, Human
auccaaacaaaaccccccuccccccaa

SEQ ID NO: 117930 - RNA, 24 nt, Human
augacgacaaaaagaauccaaaca

SEQ ID NO: 117931 - RNA, 23 nt, Human
caaaacggaaaaaaaagaacccc

SEQ ID NO: 117932 - RNA, 23 nt, Human
caaacaaaaacaaaacggaaaaa

SEQ ID NO: 117933 - RNA, 24 nt, Human
caaacaaaaacaaaacggaaaaaa

SEQ ID NO: 117934 - RNA, 27 nt, Human
caaacaaaaccccccuccccccaaaca

SEQ ID NO: 117935 - RNA, 22 nt, Human
caauuucuacaucugcaagaca

SEQ ID NO: 117936 - RNA, 20 nt, Human
caccagcaaugacgacaaaa

SEQ ID NO: 117937 - RNA, 27 nt, Human
cacccccccgccaaaaaaaaaccaaag

SEQ ID NO: 117938 - RNA, 22 nt, Human
caccugcucgcgaaaacagccc

SEQ ID NO: 117939 - RNA, 25 nt, Human
cacuauagaaaaaaaucuucccgaa

SEQ ID NO: 117940 - RNA, 19 nt, Human
caguacaaaagguccaaga

SEQ ID NO: 117941 - RNA, 26 nt, Human
caguuuuaucagagaaacaaagcaac

SEQ ID NO: 117942 - RNA, 24 nt, Human
ccaaacaaaaacaaaacggaaaaa

SEQ ID NO: 117943 - RNA, 19 nt, Human
ccaaacaaaaccccccucc

SEQ ID NO: 117944 - RNA, 25 nt, Human
ccacccccccgccaaaaaaaaacca

SEQ ID NO: 117945 - RNA, 21 nt, Human
ccagauauuuaaaucaacugg

SEQ ID NO: 117946 - RNA, 28 nt, Human
ccagcaaugacgacaaaaagaauccaaa

SEQ ID NO: 117947 - RNA, 21 nt, Human
cccacagaguucacuauagaa

SEQ ID NO: 117948 - RNA, 22 nt, Human
cccacagaguucacuauagaaa

SEQ ID NO: 117949 - RNA, 24 nt, Human
cccacccccccgccaaaaaaaaac

SEQ ID NO: 117950 - RNA, 26 nt, Human
ccccaaacaaaaacaaaacggaaaaa

SEQ ID NO: 117951 - RNA, 30 nt, Human
ccccacccccccgccaaaaaaaaaccaaaa

SEQ ID NO: 117952 - RNA, 22 nt, Human
cccccaaacaaaaacaaaacgg

SEQ ID NO: 117953 - RNA, 24 nt, Human
cccccacccccccgccaaaaaaaa

SEQ ID NO: 117954 - RNA, 19 nt, Human
ccccccaaacaaaaacaaa

SEQ ID NO: 117955 - RNA, 27 nt, Human
ccccccuccccccaaaccggguccuuc

SEQ ID NO: 117956 - RNA, 20 nt, Human
cccuccccccaaacaaaaac

SEQ ID NO: 117957 - RNA, 27 nt, Human
ccuuccauggcucggaagucgcaguuc

SEQ ID NO: 117958 - RNA, 26 nt, Human
cgagggagaggagcgagcgcgggcgg

SEQ ID NO: 117959 - RNA, 23 nt, Human
cgcucgaagccccggucgggucc

SEQ ID NO: 117960 - RNA, 22 nt, Human
cggaaaaaaaagaacccccccc

SEQ ID NO: 117961 - RNA, 24 nt, Human
cggaaaaaaaagaaccccccccac

SEQ ID NO: 117962 - RNA, 24 nt, Human
gaaaacagcauuuucauaacaaaa

SEQ ID NO: 117963 - RNA, 22 nt, Human
gaaccccccccacccccccgcc

SEQ ID NO: 117964 - RNA, 27 nt, Human
gaaccccccccacccccccgccaaaaa

SEQ ID NO: 117965 - RNA, 22 nt, Human
gagaggagcgagcgcgggcggu

SEQ ID NO: 117966 - RNA, 19 nt, Human
gcaaugacgacaaaaagaa

SEQ ID NO: 117967 - RNA, 24 nt, Human
gccaaaaaaaaaccaaagagagag

SEQ ID NO: 117968 - RNA, 20 nt, Human
gccgggccggcgagggcccg

SEQ ID NO: 117969 - RNA, 22 nt, Human
ggaaaaaaaagaacccccccca

SEQ ID NO: 117970 - RNA, 20 nt, Human
ggcggccgggccggcgaggg

SEQ ID NO: 117971 - RNA, 24 nt, Human
ggcugcgagggagaggagcgagcg

SEQ ID NO: 117972 - RNA, 18 nt, Human
gggggucgggggcccugc

SEQ ID NO: 117973 - RNA, 18 nt, Human
guggggcccgggaccggc

SEQ ID NO: 117974 - RNA, 25 nt, Human
uaaaaaccucaguaauuuauaucaa

SEQ ID NO: 117975 - RNA, 19 nt, Human
uaaauaaaaaccuuaaaca

SEQ ID NO: 117976 - RNA, 21 nt, Human
uaacaaaaaaccccgaacacu

SEQ ID NO: 117977 - RNA, 23 nt, Human
uacaaagaacagaccaaaaaaua

SEQ ID NO: 117978 - RNA, 25 nt, Human
uaggaauaaaaagaaccuagaugcc

SEQ ID NO: 117979 - RNA, 18 nt, Human
uaucagagaaacaaagca

SEQ ID NO: 117980 - RNA, 20 nt, Human
uaucagagaaacaaagcaac

SEQ ID NO: 117981 - RNA, 24 nt, Human
uaucagagaaacaaagcaacaauu

SEQ ID NO: 117982 - RNA, 19 nt, Human
ucagagaaacaaagcaaca

SEQ ID NO: 117983 - RNA, 19 nt, Human
uccaaacaaaaccccccuc

SEQ ID NO: 117984 - RNA, 18 nt, Human
uccaagaacaugaaaggg

SEQ ID NO: 117985 - RNA, 22 nt, Human
uccccccaaacaaaaacaaaac

SEQ ID NO: 117986 - RNA, 19 nt, Human
ugaaagggaaaaggugaug

SEQ ID NO: 117987 - RNA, 22 nt, Human
ugccuggauuuucaguacaaaa

SEQ ID NO: 117988 - RNA, 20 nt, Human
uggggcccgggaccggcggg

SEQ ID NO: 117989 - RNA, 20 nt, Human
uggguguguacgugugugca

SEQ ID NO: 117990 - RNA, 19 nt, Human
uguauagauagaugugugu

SEQ ID NO: 117991 - RNA, 22 nt, Human
uguauagauagauguguguggg

SEQ ID NO: 117992 - RNA, 24 nt, Human
uguggggcccgggaccggcggggc

SEQ ID NO: 117993 - RNA, 21 nt, Human
uguguggguguguacgugugu

SEQ ID NO: 117994 - RNA, 23 nt, Human
uguguggguguguacgugugugc

SEQ ID NO: 117995 - RNA, 24 nt, Human
uguguggguguguacgugugugca

SEQ ID NO: 117996 - RNA, 20 nt, Human
uuaaagaacagaauacaugu

SEQ ID NO: 117997 - RNA, 23 nt, Human
uuacaaagaacagaccaaaaaau

SEQ ID NO: 117998 - RNA, 23 nt, Human
uucauaacaaaaaaccccgaaca

SEQ ID NO: 117999 - RNA, 28 nt, Human
uucauaacaaaaaaccccgaacacuaag

SEQ ID NO: 118000 - RNA, 24 nt, Human
uuccauggcucggaagucgcaguu

SEQ ID NO: 118001 - RNA, 22 nt, Human
uugcauuauuucaggaaucagu

SEQ ID NO: 118002 - RNA, 20 nt, Human
uuguauuguuucuuuaaaca

SEQ ID NO: 118003 - RNA, 21 nt, Human
uuucauaacaaaaaaccccga

SEQ ID NO: 118004 - RNA, 23 nt, Human
uuuuuuuuuuuuuuuuuacaaag

SEQ ID NO: 118005 - RNA, 21 nt, Human
aaacuucccuugucccaccug

SEQ ID NO: 118006 - RNA, 19 nt, Human
aacagucccaccuggccac

SEQ ID NO: 118007 - RNA, 21 nt, Human
aacugaaccucacacaauccc

SEQ ID NO: 118008 - RNA, 21 nt, Human
aagaagccaggacuggggguu

SEQ ID NO: 118009 - RNA, 21 nt, Human
aauccccucaaacaaagaagc

SEQ ID NO: 118010 - RNA, 21 nt, Human
acaaaauaaaaaauaugcagc

SEQ ID NO: 118011 - RNA, 26 nt, Human
acacaauccccucaaacaaagaagcc

SEQ ID NO: 118012 - RNA, 26 nt, Human
acacacauaaaccugaacuccccccc

SEQ ID NO: 118013 - RNA, 20 nt, Human
acagucccaccuggccaccu

SEQ ID NO: 118014 - RNA, 21 nt, Human
accaauugccccaagccuggg

SEQ ID NO: 118015 - RNA, 23 nt, Human
accugaacucccccccaccccac

SEQ ID NO: 118016 - RNA, 19 nt, Human
aguaacuagcuccaaaaug

SEQ ID NO: 118017 - RNA, 23 nt, Human
auaauaauaaaaaagaaaugcac

SEQ ID NO: 118018 - RNA, 18 nt, Human
cacaauccccucaaacaa

SEQ ID NO: 118019 - RNA, 28 nt, Human
cacacacauaaaccugaacuccccccca

SEQ ID NO: 118020 - RNA, 22 nt, Human
cacacauaaaccugaacucccc

SEQ ID NO: 118021 - RNA, 18 nt, Human
cacccaccccacaacuga

SEQ ID NO: 118022 - RNA, 21 nt, Human
cacccaccccacaacugaacc

SEQ ID NO: 118023 - RNA, 18 nt, Human
caccccacccucccuuac

SEQ ID NO: 118024 - RNA, 23 nt, Human
caccccacccucccuuacuccca

SEQ ID NO: 118025 - RNA, 19 nt, Human
cacccucccuuacucccag

SEQ ID NO: 118026 - RNA, 20 nt, Human
cacugccauaacacuagaga

SEQ ID NO: 118027 - RNA, 18 nt, Human
caggaaugagaggagccc

SEQ ID NO: 118028 - RNA, 19 nt, Human
cauaacacuagagaaacaa

SEQ ID NO: 118029 - RNA, 20 nt, Human
ccaaaaugaaaaaacuuccc

SEQ ID NO: 118030 - RNA, 23 nt, Human
ccaccccacccucccuuacuccc

SEQ ID NO: 118031 - RNA, 24 nt, Human
ccaguaacuagcuccaaaaugaaa

SEQ ID NO: 118032 - RNA, 22 nt, Human
cccacaccugcucuuuccuuua

SEQ ID NO: 118033 - RNA, 18 nt, Human
cccaccccacaacugaac

SEQ ID NO: 118034 - RNA, 22 nt, Human
cccaccuccacugccauaacac

SEQ ID NO: 118035 - RNA, 25 nt, Human
ccccaccccacccucccuuacuccc

SEQ ID NO: 118036 - RNA, 18 nt, Human
ccccaccccccaaccagg

SEQ ID NO: 118037 - RNA, 23 nt, Human
ccccacccucccuuacucccagu

SEQ ID NO: 118038 - RNA, 25 nt, Human
cccccaccccacccucccuuacucc

SEQ ID NO: 118039 - RNA, 18 nt, Human
ccccccaaccaggagacg

SEQ ID NO: 118040 - RNA, 18 nt, Human
ccccccaccccacccucc

SEQ ID NO: 118041 - RNA, 23 nt, Human
ccccccaccccacccucccuuac

SEQ ID NO: 118042 - RNA, 26 nt, Human
ccccccaccccacccucccuuacucc

SEQ ID NO: 118043 - RNA, 23 nt, Human
cccccccaccccacccucccuua

SEQ ID NO: 118044 - RNA, 25 nt, Human
cccccccaccccacccucccuuacu

SEQ ID NO: 118045 - RNA, 23 nt, Human
cccccccaccccccaaccaggag

SEQ ID NO: 118046 - RNA, 21 nt, Human
ccugaacucccccccacccca

SEQ ID NO: 118047 - RNA, 22 nt, Human
ccuggccaccugguacccccuc

SEQ ID NO: 118048 - RNA, 18 nt, Human
cucccccccaccccaccc

SEQ ID NO: 118049 - RNA, 23 nt, Human
cugaaaagggaugagaagagagg

SEQ ID NO: 118050 - RNA, 18 nt, Human
gaacacccccaccucaaa

SEQ ID NO: 118051 - RNA, 22 nt, Human
gaagccaggacuggggguucac

SEQ ID NO: 118052 - RNA, 25 nt, Human
uaaaaaauaugcagcagcucaccac

SEQ ID NO: 118053 - RNA, 23 nt, Human
ucccaccuggccaccugguaccc

SEQ ID NO: 118054 - RNA, 21 nt, Human
ucccccccaccccacccuccc

SEQ ID NO: 118055 - RNA, 25 nt, Human
ucccccccaccccacccucccuuac

SEQ ID NO: 118056 - RNA, 25 nt, Human
uccccucaaacaaagaagccaggac

SEQ ID NO: 118057 - RNA, 24 nt, Human
ugaaaaaacuucccuugucccacc

SEQ ID NO: 118058 - RNA, 21 nt, Human
ugccauaacacuagagaaaca

SEQ ID NO: 118059 - RNA, 22 nt, Human
ugccauaacacuagagaaacaa

SEQ ID NO: 118060 - RNA, 26 nt, Human
ugccauaacacuagagaaaccggcgc

SEQ ID NO: 118061 - RNA, 24 nt, Human
ugcucuuuccuuuaccaauugccc

SEQ ID NO: 118062 - RNA, 18 nt, Human
uggccaccugguaccccc

SEQ ID NO: 118063 - RNA, 27 nt, Human
aaaauuauacauccucuacugcucuuc

SEQ ID NO: 118064 - RNA, 20 nt, Human
aaacagaaugcuacauagug

SEQ ID NO: 118065 - RNA, 19 nt, Human
aaagaacuacccugcccuu

SEQ ID NO: 118066 - RNA, 21 nt, Human
aacuauauccuaaaacuugac

SEQ ID NO: 118067 - RNA, 18 nt, Human
aagaacuacccugcccuu

SEQ ID NO: 118068 - RNA, 20 nt, Human
aagaaggggauaugguucug

SEQ ID NO: 118069 - RNA, 21 nt, Human
aagaaggggauaugguucugg

SEQ ID NO: 118070 - RNA, 18 nt, Human
aagcaucacaacauguua

SEQ ID NO: 118071 - RNA, 20 nt, Human
aaguaccuuguaaucuuaaa

SEQ ID NO: 118072 - RNA, 19 nt, Human
aaucucagcagcuaauuuc

SEQ ID NO: 118073 - RNA, 22 nt, Human
aaugcuacauagugaugcugag

SEQ ID NO: 118074 - RNA, 20 nt, Human
acaaagcaacauaaaguaag

SEQ ID NO: 118075 - RNA, 24 nt, Human
acaacuccaguuccaaugcuuccc

SEQ ID NO: 118076 - RNA, 21 nt, Human
acagcagguugauacuaaaau

SEQ ID NO: 118077 - RNA, 20 nt, Human
acagucaguagaucuaccag

SEQ ID NO: 118078 - RNA, 24 nt, Human
acucccucccggagcccucccccg

SEQ ID NO: 118079 - RNA, 25 nt, Human
acucuguaauuuagaauuacaacca

SEQ ID NO: 118080 - RNA, 19 nt, Human
agaaagcaaggagagcagc

SEQ ID NO: 118081 - RNA, 22 nt, Human
agacaggccggccuggccaggc

SEQ ID NO: 118082 - RNA, 20 nt, Human
agacccagcaaacugggcua

SEQ ID NO: 118083 - RNA, 23 nt, Human
agcaaggagagcagcaccuucuc

SEQ ID NO: 118084 - RNA, 22 nt, Human
agccagcacaauagccgaggca

SEQ ID NO: 118085 - RNA, 22 nt, Human
agccaggcccacuagcugcggu

SEQ ID NO: 118086 - RNA, 21 nt, Human
agcugcaaggggaaauggaaa

SEQ ID NO: 118087 - RNA, 20 nt, Human
agcugucuugaggguuuucc

SEQ ID NO: 118088 - RNA, 24 nt, Human
aggaagaaggggauaugguucugg

SEQ ID NO: 118089 - RNA, 24 nt, Human
aggcagaaacucaaucucagcagc

SEQ ID NO: 118090 - RNA, 19 nt, Human
agggaaaguaccuuguaau

SEQ ID NO: 118091 - RNA, 22 nt, Human
aguuugcaaccaaguacaagag

SEQ ID NO: 118092 - RNA, 23 nt, Human
aguuugcaaccaaguacaagagg

SEQ ID NO: 118093 - RNA, 18 nt, Human
auacuagcgggaggggag

SEQ ID NO: 118094 - RNA, 21 nt, Human
augcuacauagugaugcugag

SEQ ID NO: 118095 - RNA, 25 nt, Human
caaagaugcuaaaacagaaugcuac

SEQ ID NO: 118096 - RNA, 19 nt, Human
caaaguguccagccagcac

SEQ ID NO: 118097 - RNA, 22 nt, Human
caaggagagcagcaccuucucc

SEQ ID NO: 118098 - RNA, 22 nt, Human
caagguaaguccaguuuaaacc

SEQ ID NO: 118099 - RNA, 18 nt, Human
caauaccaacccagacag

SEQ ID NO: 118100 - RNA, 26 nt, Human
cacacacagacauacaauuacaugaa

SEQ ID NO: 118101 - RNA, 21 nt, Human
cagauggcaaaaacauaccaa

SEQ ID NO: 118102 - RNA, 23 nt, Human
caguguguuucuggcucagagcc

SEQ ID NO: 118103 - RNA, 25 nt, Human
caguugcucuaauauacagcagguu

SEQ ID NO: 118104 - RNA, 21 nt, Human
cauaaaacacacacagacaua

SEQ ID NO: 118105 - RNA, 18 nt, Human
cauacauauauagacaua

SEQ ID NO: 118106 - RNA, 21 nt, Human
cauccaucuuccaugggaauc

SEQ ID NO: 118107 - RNA, 21 nt, Human
ccaaauaaauagguuuaggaa

SEQ ID NO: 118108 - RNA, 20 nt, Human
ccauccaucuuccaugggaa

SEQ ID NO: 118109 - RNA, 19 nt, Human
ccccaaacgccucccuucg

SEQ ID NO: 118110 - RNA, 21 nt, Human
ccccaaacgccucccuucgcc

SEQ ID NO: 118111 - RNA, 23 nt, Human
ccccaaacgccucccuucgccgc

SEQ ID NO: 118112 - RNA, 23 nt, Human
cccuucgccgccgccgccuccuc

SEQ ID NO: 118113 - RNA, 19 nt, Human
ccgccgccgccuccuccuc

SEQ ID NO: 118114 - RNA, 19 nt, Human
ccggccuggcccggccccc

SEQ ID NO: 118115 - RNA, 23 nt, Human
ccuccacaguggaggcauaucca

SEQ ID NO: 118116 - RNA, 19 nt, Human
ccucccccuccaugacagu

SEQ ID NO: 118117 - RNA, 22 nt, Human
ccucccggagcccucccccggc

SEQ ID NO: 118118 - RNA, 19 nt, Human
ccugugaaaguuauccucc

SEQ ID NO: 118119 - RNA, 21 nt, Human
cgaggaagaaggggauauggu

SEQ ID NO: 118120 - RNA, 27 nt, Human
cgccgccgccuccuccucccccuccaa

SEQ ID NO: 118121 - RNA, 22 nt, Human
cuacugcucuucccugcuccug

SEQ ID NO: 118122 - RNA, 19 nt, Human
cucagagccugucaggaaa

SEQ ID NO: 118123 - RNA, 19 nt, Human
cuccaaaacaccaaauaaa

SEQ ID NO: 118124 - RNA, 21 nt, Human
cucccccggcucagccggccu

SEQ ID NO: 118125 - RNA, 21 nt, Human
cugaaggccugaauaucaaca

SEQ ID NO: 118126 - RNA, 18 nt, Human
cuguccuccccacauaca

SEQ ID NO: 118127 - RNA, 19 nt, Human
cuguguuuucaagcaucac

SEQ ID NO: 118128 - RNA, 22 nt, Human
cuuccaaaacauagagacccag

SEQ ID NO: 118129 - RNA, 20 nt, Human
gaacauucacuccuguccuc

SEQ ID NO: 118130 - RNA, 22 nt, Human
gaauggcagagcggacccugga

SEQ ID NO: 118131 - RNA, 22 nt, Human
gaccagauggcaaaaacauacc

SEQ ID NO: 118132 - RNA, 22 nt, Human
gagaauaaacauuacucaagua

SEQ ID NO: 118133 - RNA, 22 nt, Human
gaggcggccccaaacgccuccc

SEQ ID NO: 118134 - RNA, 19 nt, Human
gccgccgccgccuccuccu

SEQ ID NO: 118135 - RNA, 24 nt, Human
gccgccgccgccuccuccuccccc

SEQ ID NO: 118136 - RNA, 19 nt, Human
gccuccuccucccccucca

SEQ ID NO: 118137 - RNA, 20 nt, Human
gcggacccuggaggcggccc

SEQ ID NO: 118138 - RNA, 20 nt, Human
gcugagaaauacugucaauu

SEQ ID NO: 118139 - RNA, 19 nt, Human
gcugccuccuccucucgcc

SEQ ID NO: 118140 - RNA, 24 nt, Human
ggcaaaaacauaccaauuacaauc

SEQ ID NO: 118141 - RNA, 20 nt, Human
gggucugucuggguguauca

SEQ ID NO: 118142 - RNA, 21 nt, Human
gguucuggcugccuccuccuc

SEQ ID NO: 118143 - RNA, 23 nt, Human
guagggcaaucaaaaacaugaaa

SEQ ID NO: 118144 - RNA, 24 nt, Human
guagguaguaaauggagccaagaa

SEQ ID NO: 118145 - RNA, 21 nt, Human
gugaccaaaguguccagccag

SEQ ID NO: 118146 - RNA, 19 nt, Human
gugguccaucauauauucu

SEQ ID NO: 118147 - RNA, 18 nt, Human
uaaacccccaacuuccaa

SEQ ID NO: 118148 - RNA, 20 nt, Human
uaaagcaauguggaguuaag

SEQ ID NO: 118149 - RNA, 18 nt, Human
uaacucaaggugacucag

SEQ ID NO: 118150 - RNA, 27 nt, Human
uaccaauuacccugugaaaguuauccu

SEQ ID NO: 118151 - RNA, 25 nt, Human
uacgcaagaaaagugugugaacauu

SEQ ID NO: 118152 - RNA, 21 nt, Human
uacugcucuucccugcuccug

SEQ ID NO: 118153 - RNA, 21 nt, Human
uagagacccagcaaacugggc

SEQ ID NO: 118154 - RNA, 18 nt, Human
uagccaaaucaaaugauc

SEQ ID NO: 118155 - RNA, 21 nt, Human
uauaacauuuauguuuuuaga

SEQ ID NO: 118156 - RNA, 22 nt, Human
uauaacauuuauguuuuuagau

SEQ ID NO: 118157 - RNA, 25 nt, Human
uauaauagaaagauuuuagauaaaa

SEQ ID NO: 118158 - RNA, 23 nt, Human
uauccuaaaacuugaccugguca

SEQ ID NO: 118159 - RNA, 19 nt, Human
uauuauauucaguugcucu

SEQ ID NO: 118160 - RNA, 20 nt, Human
uauuuucccccuuuucuuuc

SEQ ID NO: 118161 - RNA, 18 nt, Human
ucaaaagauuucuggguc

SEQ ID NO: 118162 - RNA, 23 nt, Human
ucacaggagaaaucaugguucau

SEQ ID NO: 118163 - RNA, 23 nt, Human
ucacuggaaagggaaggaaaugc

SEQ ID NO: 118164 - RNA, 19 nt, Human
ucagaaagcaaggagagca

SEQ ID NO: 118165 - RNA, 23 nt, Human
ucagcucauuugguuucucuuuu

SEQ ID NO: 118166 - RNA, 18 nt, Human
ucagggagaaaguaagug

SEQ ID NO: 118167 - RNA, 31 nt, Human
ucauauauucuaccucaaagacaaucuagaa

SEQ ID NO: 118168 - RNA, 25 nt, Human
uccacaguggaggcauauccagggc

SEQ ID NO: 118169 - RNA, 19 nt, Human
ucccggagcccucccccgg

SEQ ID NO: 118170 - RNA, 23 nt, Human
ucccggagcccucccccggcuca

SEQ ID NO: 118171 - RNA, 23 nt, Human
ucccuucgccgccgccgccuccu

SEQ ID NO: 118172 - RNA, 24 nt, Human
ucccuucgccgccgccgccuccuc

SEQ ID NO: 118173 - RNA, 20 nt, Human
uccuccucucgccuaacagu

SEQ ID NO: 118174 - RNA, 24 nt, Human
uccuccucucgccuaacaguucgc

SEQ ID NO: 118175 - RNA, 22 nt, Human
uccuguccuccccacauacaua

SEQ ID NO: 118176 - RNA, 21 nt, Human
ucucuacuccuguguuuucaa

SEQ ID NO: 118177 - RNA, 20 nt, Human
ucuugcccauccaucuucca

SEQ ID NO: 118178 - RNA, 22 nt, Human
ugaccaaaguguccagccagca

SEQ ID NO: 118179 - RNA, 21 nt, Human
ugaccuggucaaacuuauucc

SEQ ID NO: 118180 - RNA, 24 nt, Human
ugcaaaauaaaaauauacaauuga

SEQ ID NO: 118181 - RNA, 21 nt, Human
ugcaaggggaaauggaaagaa

SEQ ID NO: 118182 - RNA, 23 nt, Human
ugggaaucagaauauuggcuuca

SEQ ID NO: 118183 - RNA, 21 nt, Human
uguuaauacauauucacagcu

SEQ ID NO: 118184 - RNA, 22 nt, Human
uguuuuuagauuuucuuugccu

SEQ ID NO: 118185 - RNA, 22 nt, Human
uucauccaauuuucuucagaaa

SEQ ID NO: 118186 - RNA, 20 nt, Human
uugaggguuuuccugauaga

SEQ ID NO: 118187 - RNA, 18 nt, Human
uugaugaauuauucugca

SEQ ID NO: 118188 - RNA, 21 nt, Human
uuuauguuuaugauccuaaaa

SEQ ID NO: 118189 - RNA, 18 nt, Human
uuucugggucugucuggg

SEQ ID NO: 118190 - RNA, 19 nt, Human
uuugucccuuuuuuuguuu

SEQ ID NO: 118191 - RNA, 20 nt, Human
uuuguuucagauuuuaaggc

SEQ ID NO: 118192 - RNA, 21 nt, Human
uuuucccccuuuucuuucuuu

SEQ ID NO: 118193 - RNA, 24 nt, Human
uuuuguuucagauuuuaaggcaga

SEQ ID NO: 118194 - RNA, 20 nt, Human
aaagcagaagcaaagggcaa

SEQ ID NO: 118195 - RNA, 21 nt, Human
aagcagaagcaaagggcaaac

SEQ ID NO: 118196 - RNA, 20 nt, Human
aggcauuuuacauauucuuu

SEQ ID NO: 118197 - RNA, 19 nt, Human
auggcaauaaguaggacug

SEQ ID NO: 118198 - RNA, 21 nt, Human
auucuuuggcagcuucccuga

SEQ ID NO: 118199 - RNA, 19 nt, Human
caaaugucuuucaagguuu

SEQ ID NO: 118200 - RNA, 20 nt, Human
cagcuucccugaaaaaaagc

SEQ ID NO: 118201 - RNA, 19 nt, Human
cauuccacauccuggaaca

SEQ ID NO: 118202 - RNA, 20 nt, Human
cugaaaaaaagcagaagcaa

SEQ ID NO: 118203 - RNA, 23 nt, Human
cuucccacaaguccacauggcaa

SEQ ID NO: 118204 - RNA, 18 nt, Human
guaaacaagguccaaguc

SEQ ID NO: 118205 - RNA, 21 nt, Human
ucacgcugcauuccacauccu

SEQ ID NO: 118206 - RNA, 22 nt, Human
uccacauggcaauaaguaggac

SEQ ID NO: 118207 - RNA, 18 nt, Human
ucccugaaaaaaagcaga

SEQ ID NO: 118208 - RNA, 21 nt, Human
ucccugaaaaaaagcagaagc

SEQ ID NO: 118209 - RNA, 24 nt, Human
ucccugaaaaaaagcagaagcaaa

SEQ ID NO: 118210 - RNA, 20 nt, Human
ugaaaaaaagcagaagcaaa

SEQ ID NO: 118211 - RNA, 22 nt, Human
ugauuagaguaaacaaggucca

SEQ ID NO: 118212 - RNA, 20 nt, Human
ugcaacucggcucuccaggc

SEQ ID NO: 118213 - RNA, 21 nt, Human
ugcugcaucuccugccuugau

SEQ ID NO: 118214 - RNA, 22 nt, Human
uggacuuccagcacugcaacuc

SEQ ID NO: 118215 - RNA, 27 nt, Human
uggacuuccagcacugcaacucggcuc

SEQ ID NO: 118216 - RNA, 23 nt, Human
uguccuucccacaaguccacaug

SEQ ID NO: 118217 - RNA, 23 nt, Human
uuuuuugcaugcuauugacaaac

SEQ ID NO: 118218 - RNA, 20 nt, Human
aaacaaauggcauaagagca

SEQ ID NO: 118219 - RNA, 22 nt, Human
acuauaaacaccuggaaacgga

SEQ ID NO: 118220 - RNA, 18 nt, Human
acuuggucucugaguuuc

SEQ ID NO: 118221 - RNA, 18 nt, Human
caaacugaccaaggacug

SEQ ID NO: 118222 - RNA, 20 nt, Human
caccacuauaaacaccugga

SEQ ID NO: 118223 - RNA, 23 nt, Human
cacgugaauacacuuugugcaug

SEQ ID NO: 118224 - RNA, 19 nt, Human
cacucucuuuuucuuucuc

SEQ ID NO: 118225 - RNA, 19 nt, Human
ccacucucuuuuucuuucu

SEQ ID NO: 118226 - RNA, 18 nt, Human
cccucucucccucuaugu

SEQ ID NO: 118227 - RNA, 18 nt, Human
cucagaccacaacaaaaa

SEQ ID NO: 118228 - RNA, 27 nt, Human
cucucuuuuucuuucucuccucucuuu

SEQ ID NO: 118229 - RNA, 18 nt, Human
cucuuuuucuuucucucc

SEQ ID NO: 118230 - RNA, 19 nt, Human
cugcugcacgugaauacca

SEQ ID NO: 118231 - RNA, 19 nt, Human
gcacucgcuucccaggcgc

SEQ ID NO: 118232 - RNA, 23 nt, Human
gccgggugcugccgccucucugc

SEQ ID NO: 118233 - RNA, 22 nt, Human
uaaaacaccacuauaaacaccu

SEQ ID NO: 118234 - RNA, 24 nt, Human
uaaacaccuggaaacggaaacuaa

SEQ ID NO: 118235 - RNA, 20 nt, Human
uaaguaagggguauaggcuc

SEQ ID NO: 118236 - RNA, 20 nt, Human
uauaaacaccuggaaacgga

SEQ ID NO: 118237 - RNA, 18 nt, Human
ucacaggucuacauucuc

SEQ ID NO: 118238 - RNA, 19 nt, Human
ucagaccacaacaaaaaca

SEQ ID NO: 118239 - RNA, 24 nt, Human
ucccaggcgcuucgcaggugagcc

SEQ ID NO: 118240 - RNA, 24 nt, Human
ucucacaggucuacauucucuuua

SEQ ID NO: 118241 - RNA, 24 nt, Human
ucucccucucucccucuauguuuc

SEQ ID NO: 118242 - RNA, 19 nt, Human
ucucuuuuucuuucucucc

SEQ ID NO: 118243 - RNA, 18 nt, Human
ucuuacccacccaagagg

SEQ ID NO: 118244 - RNA, 20 nt, Human
ugaauacacuuugugcaugc

SEQ ID NO: 118245 - RNA, 22 nt, Human
ugaccaaggacuggaaagaugu

SEQ ID NO: 118246 - RNA, 23 nt, Human
ugaccaaggacuggaaagauguu

SEQ ID NO: 118247 - RNA, 18 nt, Human
ugagccgggugcugccgc

SEQ ID NO: 118248 - RNA, 20 nt, Human
ugcagauucuuuuuggccaa

SEQ ID NO: 118249 - RNA, 21 nt, Human
uggcucagaccacaacaaaaa

SEQ ID NO: 118250 - RNA, 18 nt, Human
ugguacagaauacuguau

SEQ ID NO: 118251 - RNA, 22 nt, Human
uuaaaacaccacuauaaacacc

SEQ ID NO: 118252 - RNA, 22 nt, Human
uuacacaaccaaacugaccaag

SEQ ID NO: 118253 - RNA, 19 nt, Human
uuucaaagagcuuacagau

SEQ ID NO: 118254 - RNA, 19 nt, Human
uuucucuccucucuuuccc

SEQ ID NO: 118255 - RNA, 18 nt, Human
caaaaucauacacaaugg

SEQ ID NO: 118256 - RNA, 28 nt, Human
cacccucgcgcagacugagagcuagaag

SEQ ID NO: 118257 - RNA, 22 nt, Human
ccggagguccugggcuuuccuu

SEQ ID NO: 118258 - RNA, 18 nt, Human
ccucgcgcagacugagag

SEQ ID NO: 118259 - RNA, 23 nt, Human
cgcgcagacugagagcuagaagc

SEQ ID NO: 118260 - RNA, 19 nt, Human
cggagguccugggcuuucc

SEQ ID NO: 118261 - RNA, 22 nt, Human
cucugcagcugcugugcucugc

SEQ ID NO: 118262 - RNA, 23 nt, Human
cucugcuccggagguccugggcu

SEQ ID NO: 118263 - RNA, 18 nt, Human
cugugcucugcuccggag

SEQ ID NO: 118264 - RNA, 24 nt, Human
gcucugcuccggagguccugggcu

SEQ ID NO: 118265 - RNA, 23 nt, Human
gugugugugugugcgcgcgugcg

SEQ ID NO: 118266 - RNA, 21 nt, Human
uaaaagaagcaaaguacaaaa

SEQ ID NO: 118267 - RNA, 24 nt, Human
uaaugcguguguguaugugugugu

SEQ ID NO: 118268 - RNA, 27 nt, Human
uacaaacauaaaagaagcaaaguacaa

SEQ ID NO: 118269 - RNA, 21 nt, Human
ugaaaggcuuuuaacuaguug

SEQ ID NO: 118270 - RNA, 26 nt, Human
ugcguguguguaugugugugugugug

SEQ ID NO: 118271 - RNA, 18 nt, Human
ugcugugcucugcuccgg

SEQ ID NO: 118272 - RNA, 20 nt, Human
uggccuugccucugcagcug

SEQ ID NO: 118273 - RNA, 20 nt, Human
uguguaugugugugugugug

SEQ ID NO: 118274 - RNA, 21 nt, Human
uguguaugugugugugugugu

SEQ ID NO: 118275 - RNA, 19 nt, Human
uguguguaugugugugugu

SEQ ID NO: 118276 - RNA, 21 nt, Human
ugugugugugugcgcgcgugc

SEQ ID NO: 118277 - RNA, 21 nt, Human
ugugugugugugugugcgcgc

SEQ ID NO: 118278 - RNA, 22 nt, Human
ugugugugugugugugcgcgcg

SEQ ID NO: 118279 - RNA, 21 nt, Human
aagccagaggcccugggcccg

SEQ ID NO: 118280 - RNA, 18 nt, Human
agaggaaaaggagcagga

SEQ ID NO: 118281 - RNA, 19 nt, Human
agaggaaaaggagcaggag

SEQ ID NO: 118282 - RNA, 21 nt, Human
agcaggaggugacugguaugg

SEQ ID NO: 118283 - RNA, 18 nt, Human
aggcaggguggucaggga

SEQ ID NO: 118284 - RNA, 22 nt, Human
agugccccccaaagcccugccc

SEQ ID NO: 118285 - RNA, 25 nt, Human
auucauucccaugucccuucuccag

SEQ ID NO: 118286 - RNA, 20 nt, Human
caaagcccugcccuggcugu

SEQ ID NO: 118287 - RNA, 20 nt, Human
caagagccacuugggcaggg

SEQ ID NO: 118288 - RNA, 22 nt, Human
caagcucugccccagaggcugg

SEQ ID NO: 118289 - RNA, 20 nt, Human
cacaggccacucugcccccu

SEQ ID NO: 118290 - RNA, 20 nt, Human
cacucugcccccuccagccc

SEQ ID NO: 118291 - RNA, 27 nt, Human
cacucugcccccuccagcccccaucuu

SEQ ID NO: 118292 - RNA, 18 nt, Human
cagcaaauggccuccccu

SEQ ID NO: 118293 - RNA, 21 nt, Human
cagccgacacccucaucuucu

SEQ ID NO: 118294 - RNA, 23 nt, Human
caggaggugacugguauggggug

SEQ ID NO: 118295 - RNA, 19 nt, Human
caggggucuucuccuggcu

SEQ ID NO: 118296 - RNA, 19 nt, Human
caguaagguucuggaggcc

SEQ ID NO: 118297 - RNA, 19 nt, Human
cagugccagcugcuccugg

SEQ ID NO: 118298 - RNA, 27 nt, Human
cagugggcuggccuucuucccccuggg

SEQ ID NO: 118299 - RNA, 18 nt, Human
ccacagugccaguaaggu

SEQ ID NO: 118300 - RNA, 18 nt, Human
ccacccgccucacagccg

SEQ ID NO: 118301 - RNA, 23 nt, Human
ccacucugcccccuccagccccc

SEQ ID NO: 118302 - RNA, 19 nt, Human
ccagagggaccggcgggcg

SEQ ID NO: 118303 - RNA, 23 nt, Human
ccagccacagcucuuugggggcu

SEQ ID NO: 118304 - RNA, 19 nt, Human
cccaugucccuucuccagg

SEQ ID NO: 118305 - RNA, 25 nt, Human
ccccagaggcugggacugggacacc

SEQ ID NO: 118306 - RNA, 21 nt, Human
ccccauuucaauucauuccca

SEQ ID NO: 118307 - RNA, 24 nt, Human
cccccaaagcccugcccuggcugu

SEQ ID NO: 118308 - RNA, 22 nt, Human
ccccuccagcccccaucuucuc

SEQ ID NO: 118309 - RNA, 20 nt, Human
cccugggcccggcccagucc

SEQ ID NO: 118310 - RNA, 23 nt, Human
ccucaucuucuagugccccccaa

SEQ ID NO: 118311 - RNA, 27 nt, Human
ccuccacaggcaggguggucagggagc

SEQ ID NO: 118312 - RNA, 19 nt, Human
cuagugccccccaaagccc

SEQ ID NO: 118313 - RNA, 21 nt, Human
cucugcccccuccagccccca

SEQ ID NO: 118314 - RNA, 22 nt, Human
cugcgggcucgggcggcacggg

SEQ ID NO: 118315 - RNA, 18 nt, Human
cuggaggccugggggggu

SEQ ID NO: 118316 - RNA, 22 nt, Human
cuucuagugccccccaaagccc

SEQ ID NO: 118317 - RNA, 24 nt, Human
cuugcuuagcuagugguccugccc

SEQ ID NO: 118318 - RNA, 19 nt, Human
gagucagaggcugucacga

SEQ ID NO: 118319 - RNA, 19 nt, Human
gcacggggugggcggccgg

SEQ ID NO: 118320 - RNA, 22 nt, Human
gcccugggcccggcccaguccu

SEQ ID NO: 118321 - RNA, 24 nt, Human
gcccuugguucccaguggugucgg

SEQ ID NO: 118322 - RNA, 23 nt, Human
gccgagggcagccccagggccca

SEQ ID NO: 118323 - RNA, 24 nt, Human
gcucugggagaagacagccuugga

SEQ ID NO: 118324 - RNA, 19 nt, Human
ggaccggcgggcggcugcg

SEQ ID NO: 118325 - RNA, 23 nt, Human
ggccacucugcccccuccagccc

SEQ ID NO: 118326 - RNA, 20 nt, Human
ggcccaguccuguaggugac

SEQ ID NO: 118327 - RNA, 22 nt, Human
gggaagucuggccgccguuucc

SEQ ID NO: 118328 - RNA, 20 nt, Human
gggagugggcaugagaccua

SEQ ID NO: 118329 - RNA, 19 nt, Human
gggcagcaaauggccuccc

SEQ ID NO: 118330 - RNA, 19 nt, Human
gggcaggucagugggggcu

SEQ ID NO: 118331 - RNA, 20 nt, Human
gggcauugcugguggcagug

SEQ ID NO: 118332 - RNA, 22 nt, Human
gggcggcacggggugggcggcc

SEQ ID NO: 118333 - RNA, 21 nt, Human
gggcggcugcgggcucgggcg

SEQ ID NO: 118334 - RNA, 19 nt, Human
gggugggcggccgggcucc

SEQ ID NO: 118335 - RNA, 22 nt, Human
gucauccccccagccacagcuc

SEQ ID NO: 118336 - RNA, 19 nt, Human
gugagggcccuugguuccc

SEQ ID NO: 118337 - RNA, 19 nt, Human
gugaggggaagcuggccug

SEQ ID NO: 118338 - RNA, 24 nt, Human
gugguccugccccagaggccaucc

SEQ ID NO: 118339 - RNA, 18 nt, Human
guggugagucagaggcug

SEQ ID NO: 118340 - RNA, 22 nt, Human
uaacaggucaccuccacaggcc

SEQ ID NO: 118341 - RNA, 19 nt, Human
ucaauucauucccaugucc

SEQ ID NO: 118342 - RNA, 19 nt, Human
ucagugggggcugcggccg

SEQ ID NO: 118343 - RNA, 26 nt, Human
ucauccccccagccacagcucuuugg

SEQ ID NO: 118344 - RNA, 26 nt, Human
uccugcacggcugcagggggagagcg

SEQ ID NO: 118345 - RNA, 20 nt, Human
ucggcgcuucccggccccgc

SEQ ID NO: 118346 - RNA, 18 nt, Human
ucuagugccccccaaagc

SEQ ID NO: 118347 - RNA, 22 nt, Human
ucuagugcuguggccgcaaguc

SEQ ID NO: 118348 - RNA, 28 nt, Human
ugaaggcagcaaggcagggcauugcugg

SEQ ID NO: 118349 - RNA, 24 nt, Human
ugaggggaagcuggccuggccugc

SEQ ID NO: 118350 - RNA, 18 nt, Human
ugcagggggagagcggcc

SEQ ID NO: 118351 - RNA, 23 nt, Human
ugcccggguccuacggacauccc

SEQ ID NO: 118352 - RNA, 19 nt, Human
ugccgagggcagccccagg

SEQ ID NO: 118353 - RNA, 20 nt, Human
ugccuggugaggagaugccc

SEQ ID NO: 118354 - RNA, 21 nt, Human
ugcucugggagaagacagccu

SEQ ID NO: 118355 - RNA, 19 nt, Human
uggcuugcuuagcuagugg

SEQ ID NO: 118356 - RNA, 21 nt, Human
ugggacugggacaccccuggc

SEQ ID NO: 118357 - RNA, 23 nt, Human
ugggcaggucagugggggcugcg

SEQ ID NO: 118358 - RNA, 19 nt, Human
ugggggcugcuccaugacc

SEQ ID NO: 118359 - RNA, 18 nt, Human
uggucagggagccuggcc

SEQ ID NO: 118360 - RNA, 23 nt, Human
ugucccaagagccacuugggcag

SEQ ID NO: 118361 - RNA, 21 nt, Human
uucccaugucccuucuccagg

SEQ ID NO: 118362 - RNA, 22 nt, Human
uugcugguggcagugccacagu

SEQ ID NO: 118363 - RNA, 20 nt, Human
acaggaacagggugggguac

SEQ ID NO: 118364 - RNA, 25 nt, Human
acaggaacagggugggguacaagug

SEQ ID NO: 118365 - RNA, 18 nt, Human
acccccucuuuccugcca

SEQ ID NO: 118366 - RNA, 28 nt, Human
acucaucccugucccuugcagucccccu

SEQ ID NO: 118367 - RNA, 19 nt, Human
agaggaagaagguggagga

SEQ ID NO: 118368 - RNA, 19 nt, Human
agaggaagccaggccugga

SEQ ID NO: 118369 - RNA, 20 nt, Human
agcacagagaacccagagga

SEQ ID NO: 118370 - RNA, 21 nt, Human
agcacagagaacccagaggaa

SEQ ID NO: 118371 - RNA, 18 nt, Human
agccaggccuggaagccu

SEQ ID NO: 118372 - RNA, 22 nt, Human
agcuggucucucccgugacaca

SEQ ID NO: 118373 - RNA, 19 nt, Human
aggaagaagguggaggagg

SEQ ID NO: 118374 - RNA, 21 nt, Human
aggaagaagguggaggaggac

SEQ ID NO: 118375 - RNA, 25 nt, Human
aggaagaagguggaggaggacaggg

SEQ ID NO: 118376 - RNA, 18 nt, Human
aggcggggaggauggcuc

SEQ ID NO: 118377 - RNA, 21 nt, Human
aggcggggaggauggcugggg

SEQ ID NO: 118378 - RNA, 20 nt, Human
aggcugggaugggcaaaugc

SEQ ID NO: 118379 - RNA, 21 nt, Human
aucccacgccucccuccucca

SEQ ID NO: 118380 - RNA, 21 nt, Human
aucccugucccuugcaguccc

SEQ ID NO: 118381 - RNA, 19 nt, Human
augggcaaaugccugcaga

SEQ ID NO: 118382 - RNA, 18 nt, Human
auucccaucccacgccuc

SEQ ID NO: 118383 - RNA, 21 nt, Human
caaggcggggaggauggcugg

SEQ ID NO: 118384 - RNA, 24 nt, Human
cacgccucccuccuccaugccucu

SEQ ID NO: 118385 - RNA, 24 nt, Human
ccaaggcggggaggauggcugggg

SEQ ID NO: 118386 - RNA, 22 nt, Human
ccacgagagccugcccagcaca

SEQ ID NO: 118387 - RNA, 21 nt, Human
ccagaggaagaagguggagga

SEQ ID NO: 118388 - RNA, 22 nt, Human
ccagcacagagaacccagagga

SEQ ID NO: 118389 - RNA, 27 nt, Human
cccacgagagccugcccagcacagaga

SEQ ID NO: 118390 - RNA, 21 nt, Human
ccccaaggcggggaggauggc

SEQ ID NO: 118391 - RNA, 24 nt, Human
ccgcacccccucuuuccugccagg

SEQ ID NO: 118392 - RNA, 19 nt, Human
ccucccaucuccugcccca

SEQ ID NO: 118393 - RNA, 24 nt, Human
ccucugcuuccucuugcgcugagc

SEQ ID NO: 118394 - RNA, 26 nt, Human
cgccucccuccuccaugccucugcuc

SEQ ID NO: 118395 - RNA, 19 nt, Human
cuccaugccucugcuccuc

SEQ ID NO: 118396 - RNA, 19 nt, Human
cucccaucuccugccccac

SEQ ID NO: 118397 - RNA, 20 nt, Human
cuccuccaugccucugcucc

SEQ ID NO: 118398 - RNA, 24 nt, Human
cucuccccucccaucuccugcccc

SEQ ID NO: 118399 - RNA, 27 nt, Human
cucugcucugggcccaguaaggccccu

SEQ ID NO: 118400 - RNA, 23 nt, Human
cugcuuccucuugcgcugagccu

SEQ ID NO: 118401 - RNA, 18 nt, Human
cugggcccaguaaggccc

SEQ ID NO: 118402 - RNA, 24 nt, Human
cuucauggagcccccaaggcgggg

SEQ ID NO: 118403 - RNA, 24 nt, Human
cuugcgcugagccugguggccccc

SEQ ID NO: 118404 - RNA, 20 nt, Human
gaacccagaggaagaaggug

SEQ ID NO: 118405 - RNA, 18 nt, Human
gaagguggaggaggacag

SEQ ID NO: 118406 - RNA, 18 nt, Human
gacuggagggcaaagggc

SEQ ID NO: 118407 - RNA, 18 nt, Human
gagcugugcaggugggcc

SEQ ID NO: 118408 - RNA, 25 nt, Human
gaggaggacaggggagcugugcagg

SEQ ID NO: 118409 - RNA, 19 nt, Human
gcaaaugccugcagacauc

SEQ ID NO: 118410 - RNA, 22 nt, Human
gcugccgcacccccucuuuccu

SEQ ID NO: 118411 - RNA, 20 nt, Human
ggaggacaggggagcugugc

SEQ ID NO: 118412 - RNA, 22 nt, Human
ggcugcuggcuccaugaguagg

SEQ ID NO: 118413 - RNA, 22 nt, Human
ggggagacuggagggcaaaggg

SEQ ID NO: 118414 - RNA, 20 nt, Human
ggggagcugugcaggugggc

SEQ ID NO: 118415 - RNA, 21 nt, Human
gguggaggaggacaggggagc

SEQ ID NO: 118416 - RNA, 22 nt, Human
uaaauagcuguguguguuggac

SEQ ID NO: 118417 - RNA, 20 nt, Human
ucauggagcccccaaggcgg

SEQ ID NO: 118418 - RNA, 22 nt, Human
uccaugaguagggcaggggagc

SEQ ID NO: 118419 - RNA, 20 nt, Human
ucccaucccacgccucccuu

SEQ ID NO: 118420 - RNA, 18 nt, Human
ucccuccuccaugccucu

SEQ ID NO: 118421 - RNA, 19 nt, Human
ucccuugcagucccccuug

SEQ ID NO: 118422 - RNA, 20 nt, Human
ucuccccucccaucuccugc

SEQ ID NO: 118423 - RNA, 21 nt, Human
ucugaaggggagacuggaggg

SEQ ID NO: 118424 - RNA, 19 nt, Human
ugaaggggagacuggaggg

SEQ ID NO: 118425 - RNA, 22 nt, Human
ugaaggggagacuggagggcaa

SEQ ID NO: 118426 - RNA, 23 nt, Human
ugccaggcuggagagcuggucuc

SEQ ID NO: 118427 - RNA, 23 nt, Human
ugcccagcacagagaacccagag

SEQ ID NO: 118428 - RNA, 22 nt, Human
ugccugcagacaucugacuggc

SEQ ID NO: 118429 - RNA, 24 nt, Human
uggagagcuggucucuccccuccc

SEQ ID NO: 118430 - RNA, 21 nt, Human
uggagggcaaagggcaauggg

SEQ ID NO: 118431 - RNA, 19 nt, Human
uggaguccaagggccagug

SEQ ID NO: 118432 - RNA, 19 nt, Human
uggcccccacucaucccug

SEQ ID NO: 118433 - RNA, 18 nt, Human
ugggaugggcaaaugccu

SEQ ID NO: 118434 - RNA, 22 nt, Human
uggucucuccccucccaucucc

SEQ ID NO: 118435 - RNA, 22 nt, Human
uguguguguuggacagguccuu

SEQ ID NO: 118436 - RNA, 20 nt, Human
uugccuggcugcuggcucca

SEQ ID NO: 118437 - RNA, 19 nt, Human
aaaaaugguuaugacaaug

SEQ ID NO: 118438 - RNA, 22 nt, Human
aacccaaaagauagcggaaagu

SEQ ID NO: 118439 - RNA, 25 nt, Human
acacugaaaauguagccuuugauaa

SEQ ID NO: 118440 - RNA, 23 nt, Human
acagagggaaacuucagauacca

SEQ ID NO: 118441 - RNA, 21 nt, Human
aucaagauacauguacaaaca

SEQ ID NO: 118442 - RNA, 23 nt, Human
cagauaccaagguaauuucuggg

SEQ ID NO: 118443 - RNA, 22 nt, Human
cagcaagcaaaacaaaauuucu

SEQ ID NO: 118444 - RNA, 23 nt, Human
cauguacaaacaaaauuucagau

SEQ ID NO: 118445 - RNA, 24 nt, Human
ccaaugcaaggaaaauaaucugga

SEQ ID NO: 118446 - RNA, 20 nt, Human
ccucaaguaguuuccuccuc

SEQ ID NO: 118447 - RNA, 20 nt, Human
ccucuaggaaaaagcuucca

SEQ ID NO: 118448 - RNA, 20 nt, Human
cugggcagguuuaaaaccuu

SEQ ID NO: 118449 - RNA, 18 nt, Human
gaacccaaaagauagcgg

SEQ ID NO: 118450 - RNA, 24 nt, Human
gauuugaaacuuuuuaauuaagga

SEQ ID NO: 118451 - RNA, 24 nt, Human
ggagacagagggaaacuucagaua

SEQ ID NO: 118452 - RNA, 20 nt, Human
uaacaguucuuacaauauga

SEQ ID NO: 118453 - RNA, 21 nt, Human
uaacucaaaagauaugugucc

SEQ ID NO: 118454 - RNA, 21 nt, Human
uaagauacaaagcacacguga

SEQ ID NO: 118455 - RNA, 18 nt, Human
uacaaacaaaauuucaga

SEQ ID NO: 118456 - RNA, 24 nt, Human
uacagcaaacaaauaugaaagaua

SEQ ID NO: 118457 - RNA, 26 nt, Human
uagaucacaaaauagaauuuuccaag

SEQ ID NO: 118458 - RNA, 21 nt, Human
uaguaucagugggcuuuugua

SEQ ID NO: 118459 - RNA, 19 nt, Human
ucaauaacaaagucaaagc

SEQ ID NO: 118460 - RNA, 24 nt, Human
ucagaugcucuuggaaacacaucu

SEQ ID NO: 118461 - RNA, 25 nt, Human
ucuuaaaaucuuuuuucuuuuucuu

SEQ ID NO: 118462 - RNA, 22 nt, Human
ugacaaauaacaagcuuaauua

SEQ ID NO: 118463 - RNA, 20 nt, Human
ugcaaggaaaauaaucugga

SEQ ID NO: 118464 - RNA, 19 nt, Human
ugcaugacaaauaacaagc

SEQ ID NO: 118465 - RNA, 22 nt, Human
ugggcuuuuguauuggcaguuu

SEQ ID NO: 118466 - RNA, 18 nt, Human
uguauuggcaguuugucu

SEQ ID NO: 118467 - RNA, 23 nt, Human
uguccuaguuggauacauuuuuu

SEQ ID NO: 118468 - RNA, 18 nt, Human
ugucuagauuugaaacuu

SEQ ID NO: 118469 - RNA, 23 nt, Human
uuaaaacagcaagcaaaacaaaa

SEQ ID NO: 118470 - RNA, 19 nt, Human
uuacacugaaaauguagcc

SEQ ID NO: 118471 - RNA, 20 nt, Human
uucuugcaaaaccaucuuua

SEQ ID NO: 118472 - RNA, 24 nt, Human
uuuaaaaguugauagaauaacugu

SEQ ID NO: 118473 - RNA, 21 nt, Human
uuucacaacugugcagucacu

SEQ ID NO: 118474 - RNA, 24 nt, Human
uuuuuuuuuuuuuuuuuuacacag

SEQ ID NO: 118475 - RNA, 24 nt, Human
aaaaaaaaaagcuccagugcucac

SEQ ID NO: 118476 - RNA, 23 nt, Human
aaaaaacaaaaagcaagcaucua

SEQ ID NO: 118477 - RNA, 20 nt, Human
aaacagugaaauauagcccc

SEQ ID NO: 118478 - RNA, 23 nt, Human
aaaggguucugaugugcucgucu

SEQ ID NO: 118479 - RNA, 19 nt, Human
aacaaaaacuaugaacaac

SEQ ID NO: 118480 - RNA, 21 nt, Human
aacaaaaacuaugaacaacca

SEQ ID NO: 118481 - RNA, 19 nt, Human
aacagaacaaagcaacaac

SEQ ID NO: 118482 - RNA, 21 nt, Human
aacuaugaugcacuccaagug

SEQ ID NO: 118483 - RNA, 20 nt, Human
aacucacuguccccacccca

SEQ ID NO: 118484 - RNA, 23 nt, Human
aagaaaacaaaaacaaacuguag

SEQ ID NO: 118485 - RNA, 22 nt, Human
aagaaaacucaaugcacaaaug

SEQ ID NO: 118486 - RNA, 24 nt, Human
aagaauccccaaacagucuuuuua

SEQ ID NO: 118487 - RNA, 22 nt, Human
aagagcacaacaggaaccaaag

SEQ ID NO: 118488 - RNA, 23 nt, Human
aagagcacaacaggaaccaaagu

SEQ ID NO: 118489 - RNA, 21 nt, Human
aagcaacaacaaacagugaaa

SEQ ID NO: 118490 - RNA, 23 nt, Human
aauauaacagaacaaagcaacaa

SEQ ID NO: 118491 - RNA, 20 nt, Human
acaaaaagcaagcaucuaca

SEQ ID NO: 118492 - RNA, 21 nt, Human
acaaaaagcaagcaucuacaa

SEQ ID NO: 118493 - RNA, 21 nt, Human
acaaagcaacaacaaacagug

SEQ ID NO: 118494 - RNA, 23 nt, Human
acacacacacacacacacacaca

SEQ ID NO: 118495 - RNA, 23 nt, Human
acacacacacacacacacacaua

SEQ ID NO: 118496 - RNA, 27 nt, Human
acacacacacacacacauacauacucu

SEQ ID NO: 118497 - RNA, 27 nt, Human
acacacacauacauacucucacacaca

SEQ ID NO: 118498 - RNA, 27 nt, Human
acacacauacauacucucacacacaca

SEQ ID NO: 118499 - RNA, 19 nt, Human
acagaacaaagcaacaaca

SEQ ID NO: 118500 - RNA, 23 nt, Human
accaauuuuucuucccaacacca

SEQ ID NO: 118501 - RNA, 20 nt, Human
accccaaauaucucuacagc

SEQ ID NO: 118502 - RNA, 20 nt, Human
acccucccacccauuucccc

SEQ ID NO: 118503 - RNA, 23 nt, Human
accuuguccuauauccuguuagu

SEQ ID NO: 118504 - RNA, 25 nt, Human
agaaaacaaaaacaaacuguagaac

SEQ ID NO: 118505 - RNA, 22 nt, Human
agaaaauaaaagcagcaaaaag

SEQ ID NO: 118506 - RNA, 20 nt, Human
agcaacaacaaacagugaaa

SEQ ID NO: 118507 - RNA, 23 nt, Human
aggaaaaagaauccccaaacagu

SEQ ID NO: 118508 - RNA, 19 nt, Human
aggaagauuuuaauaaagg

SEQ ID NO: 118509 - RNA, 22 nt, Human
auauauguauauauauauauua

SEQ ID NO: 118510 - RNA, 20 nt, Human
augucucuggccagugagca

SEQ ID NO: 118511 - RNA, 20 nt, Human
auuuucuuuucacguuaagc

SEQ ID NO: 118512 - RNA, 22 nt, Human
caacaaaaacuaugaacaacca

SEQ ID NO: 118513 - RNA, 23 nt, Human
caagagcacaacaggaaccaaag

SEQ ID NO: 118514 - RNA, 20 nt, Human
caaguauuuacaacaauacu

SEQ ID NO: 118515 - RNA, 19 nt, Human
caauaggaaaaaaauaacc

SEQ ID NO: 118516 - RNA, 21 nt, Human
cacaacaggaaccaaaguaaa

SEQ ID NO: 118517 - RNA, 20 nt, Human
cacacacacacacacacaca

SEQ ID NO: 118518 - RNA, 20 nt, Human
cacacacacacacacacaca

SEQ ID NO: 118519 - RNA, 20 nt, Human
cacacacacacacacacaca

SEQ ID NO: 118520 - RNA, 20 nt, Human
cacacacacacacacacaca

SEQ ID NO: 118521 - RNA, 22 nt, Human
cacacacacacacacacacaca

SEQ ID NO: 118522 - RNA, 26 nt, Human
cacacacacacacacacacacacaca

SEQ ID NO: 118523 - RNA, 25 nt, Human
cacacacacacacacacacacauac

SEQ ID NO: 118524 - RNA, 22 nt, Human
cacacacacacacacacacaua

SEQ ID NO: 118525 - RNA, 26 nt, Human
cacacacacacacacacacauacaua

SEQ ID NO: 118526 - RNA, 20 nt, Human
cacacacacacacacacaua

SEQ ID NO: 118527 - RNA, 22 nt, Human
cacacacacacacacacauaca

SEQ ID NO: 118528 - RNA, 19 nt, Human
cacacacacacacacauac

SEQ ID NO: 118529 - RNA, 30 nt, Human
cacacauacauacucucacacacacaucuu

SEQ ID NO: 118530 - RNA, 20 nt, Human
cacccauuuccccauccaaa

SEQ ID NO: 118531 - RNA, 20 nt, Human
cacccucccacccauuuccc

SEQ ID NO: 118532 - RNA, 20 nt, Human
cacccucucccuccucuucc

SEQ ID NO: 118533 - RNA, 19 nt, Human
cacugcuauggaaugccug

SEQ ID NO: 118534 - RNA, 18 nt, Human
cagcaaccagugcagucu

SEQ ID NO: 118535 - RNA, 24 nt, Human
cagcacucaggauaaaucauaucu

SEQ ID NO: 118536 - RNA, 25 nt, Human
caugauugaaaaaacaaaaagcaag

SEQ ID NO: 118537 - RNA, 21 nt, Human
ccacccauuuccccauccaaa

SEQ ID NO: 118538 - RNA, 26 nt, Human
cccaacaccacccucccacccauuuc

SEQ ID NO: 118539 - RNA, 24 nt, Human
cccauccaaacucacuguccccac

SEQ ID NO: 118540 - RNA, 22 nt, Human
ccccaaauaucucuacagcuau

SEQ ID NO: 118541 - RNA, 20 nt, Human
cccucccacccauuucccca

SEQ ID NO: 118542 - RNA, 19 nt, Human
ccgccgccgccuccuccuc

SEQ ID NO: 118543 - RNA, 20 nt, Human
ccgccgccgccuccuccucg

SEQ ID NO: 118544 - RNA, 21 nt, Human
ccgccgccgccuccuccucgc

SEQ ID NO: 118545 - RNA, 20 nt, Human
ccuccugcgccgccgccgcc

SEQ ID NO: 118546 - RNA, 20 nt, Human
ccugcucauucaggccugag

SEQ ID NO: 118547 - RNA, 21 nt, Human
ccugucacguuguaaaaaaaa

SEQ ID NO: 118548 - RNA, 20 nt, Human
cgcacacacacacacacaca

SEQ ID NO: 118549 - RNA, 25 nt, Human
cgcgcacacacacacacacacacac

SEQ ID NO: 118550 - RNA, 25 nt, Human
cgcgcgcacacacacacacacacac

SEQ ID NO: 118551 - RNA, 19 nt, Human
cuagagcuucaacaaaaac

SEQ ID NO: 118552 - RNA, 22 nt, Human
cucccacccauuuccccaucca

SEQ ID NO: 118553 - RNA, 22 nt, Human
cuggcuuccucacugccuacug

SEQ ID NO: 118554 - RNA, 18 nt, Human
cuguccccaccccaaaua

SEQ ID NO: 118555 - RNA, 18 nt, Human
cuugaggaaaagugggaa

SEQ ID NO: 118556 - RNA, 24 nt, Human
gaccugggauggcugucaaagggu

SEQ ID NO: 118557 - RNA, 23 nt, Human
gcacacacacacacacacacaca

SEQ ID NO: 118558 - RNA, 19 nt, Human
gccgccgccgccuccuccu

SEQ ID NO: 118559 - RNA, 22 nt, Human
guaagugaucaaaagcacugcc

SEQ ID NO: 118560 - RNA, 22 nt, Human
guuaaaaucucauaaaaauaca

SEQ ID NO: 118561 - RNA, 19 nt, Human
guuauggcagcugggucgc

SEQ ID NO: 118562 - RNA, 19 nt, Human
guugugacuguauagaaaa

SEQ ID NO: 118563 - RNA, 21 nt, Human
guuuaucugccuuuguucugg

SEQ ID NO: 118564 - RNA, 25 nt, Human
uaaaaaaaguuucuucuuaagcuag

SEQ ID NO: 118565 - RNA, 22 nt, Human
uaaaagaaaacucaaugcacaa

SEQ ID NO: 118566 - RNA, 19 nt, Human
uaaccucugggccacugaa

SEQ ID NO: 118567 - RNA, 22 nt, Human
uaagauaguuacauaaauacuc

SEQ ID NO: 118568 - RNA, 18 nt, Human
uacaaaacagaacacauu

SEQ ID NO: 118569 - RNA, 23 nt, Human
uacaagagcacaacaggaaccaa

SEQ ID NO: 118570 - RNA, 22 nt, Human
uacacaugcacacaaauacuuu

SEQ ID NO: 118571 - RNA, 20 nt, Human
uacauacucucacacacaca

SEQ ID NO: 118572 - RNA, 18 nt, Human
uacaucaagucacaaucc

SEQ ID NO: 118573 - RNA, 21 nt, Human
uacaucaagucacaauccaau

SEQ ID NO: 118574 - RNA, 18 nt, Human
uacuacaacaaacuucca

SEQ ID NO: 118575 - RNA, 22 nt, Human
uagcaacuuuaaaaacuuuggu

SEQ ID NO: 118576 - RNA, 26 nt, Human
uagcaggugcaaugcugacugcucaa

SEQ ID NO: 118577 - RNA, 18 nt, Human
uauaaaagugcuaagggc

SEQ ID NO: 118578 - RNA, 22 nt, Human
uauaauaaggaaaaagaauccu

SEQ ID NO: 118579 - RNA, 23 nt, Human
uauauauauauauuauauacaca

SEQ ID NO: 118580 - RNA, 22 nt, Human
uauauauauauuauauacacau

SEQ ID NO: 118581 - RNA, 18 nt, Human
uauauauguauauauaua

SEQ ID NO: 118582 - RNA, 21 nt, Human
uauauauguauauauauauau

SEQ ID NO: 118583 - RNA, 25 nt, Human
uauauauguauauauauauauuaua

SEQ ID NO: 118584 - RNA, 18 nt, Human
uauauguauauauauaua

SEQ ID NO: 118585 - RNA, 24 nt, Human
uauggccaugauugaaaaaacaaa

SEQ ID NO: 118586 - RNA, 23 nt, Human
uauguauauauauauauuauaua

SEQ ID NO: 118587 - RNA, 25 nt, Human
uauguauauauauauauuauauaca

SEQ ID NO: 118588 - RNA, 19 nt, Human
uauguguauaaauauauau

SEQ ID NO: 118589 - RNA, 22 nt, Human
ucacaauccaauacaauccacu

SEQ ID NO: 118590 - RNA, 19 nt, Human
ucacugccuacugcaguug

SEQ ID NO: 118591 - RNA, 23 nt, Human
ucaguauauaauaaggaaaaaga

SEQ ID NO: 118592 - RNA, 19 nt, Human
ucaugugcugacucugcua

SEQ ID NO: 118593 - RNA, 18 nt, Human
ucccaacaccacccuccc

SEQ ID NO: 118594 - RNA, 19 nt, Human
ucccaacaccacccuccca

SEQ ID NO: 118595 - RNA, 19 nt, Human
ucccaacaccacccuccca

SEQ ID NO: 118596 - RNA, 21 nt, Human
ucccaacaccacccucccacc

SEQ ID NO: 118597 - RNA, 18 nt, Human
uccccgagccaagcugac

SEQ ID NO: 118598 - RNA, 23 nt, Human
uccugcgccgccgccgccuccuc

SEQ ID NO: 118599 - RNA, 21 nt, Human
ucuaagaaaacacuuggucag

SEQ ID NO: 118600 - RNA, 23 nt, Human
ucuaagaaaacacuuggucaguu

SEQ ID NO: 118601 - RNA, 21 nt, Human
ucucuggcuuccucacugccu

SEQ ID NO: 118602 - RNA, 18 nt, Human
ucuucccaacaccacccu

SEQ ID NO: 118603 - RNA, 18 nt, Human
ugaaaaaacaaaaagcaa

SEQ ID NO: 118604 - RNA, 20 nt, Human
ugaacaaccaacaauauaac

SEQ ID NO: 118605 - RNA, 23 nt, Human
ugauugauuggcuuggaagaaaa

SEQ ID NO: 118606 - RNA, 19 nt, Human
ugcaaacagcuagaacacc

SEQ ID NO: 118607 - RNA, 20 nt, Human
ugccaagaaucaaguugcag

SEQ ID NO: 118608 - RNA, 23 nt, Human
ugcucaaggcgugcgugcgcgcg

SEQ ID NO: 118609 - RNA, 26 nt, Human
ugggauggcugucaaaggguucugau

SEQ ID NO: 118610 - RNA, 18 nt, Human
uguaaaaaaaaaaaagcu

SEQ ID NO: 118611 - RNA, 21 nt, Human
uguaaaaaaaaaaaagcucca

SEQ ID NO: 118612 - RNA, 21 nt, Human
uguagaaucaguauauaauaa

SEQ ID NO: 118613 - RNA, 24 nt, Human
uguauguguauaaauauauaugua

SEQ ID NO: 118614 - RNA, 24 nt, Human
uguggcuuuagaccugggauggcu

SEQ ID NO: 118615 - RNA, 24 nt, Human
uguguauaaauauauauguauaua

SEQ ID NO: 118616 - RNA, 20 nt, Human
uucaacaggaaaacauaaau

SEQ ID NO: 118617 - RNA, 23 nt, Human
uucccaacaccacccucccaccc

SEQ ID NO: 118618 - RNA, 22 nt, Human
uuccccauccaaacucacuguc

SEQ ID NO: 118619 - RNA, 23 nt, Human
uuguaaaaaaaaaaaagcuccag

SEQ ID NO: 118620 - RNA, 21 nt, Human
uuuguaagugaucaaaagcac

SEQ ID NO: 118621 - RNA, 23 nt, Human
uuuuugauuucaacucaaaaugu

SEQ ID NO: 118622 - RNA, 20 nt, Human
uuuuuuuuuuuuuuuuuugg

SEQ ID NO: 118623 - RNA, 23 nt, Human
aaaaaaaaaaagauuguucccau

SEQ ID NO: 118624 - RNA, 23 nt, Human
aaaauaucacagguaacagaaug

SEQ ID NO: 118625 - RNA, 19 nt, Human
aaccacugaauaaaucagg

SEQ ID NO: 118626 - RNA, 27 nt, Human
aaccacugaauaaaucaggguaagcag

SEQ ID NO: 118627 - RNA, 21 nt, Human
aaugaaaacaaaaccacugaa

SEQ ID NO: 118628 - RNA, 21 nt, Human
acuagacugcuuuugacaucu

SEQ ID NO: 118629 - RNA, 18 nt, Human
acugccugagagaaagga

SEQ ID NO: 118630 - RNA, 20 nt, Human
acugccugagagaaaggagg

SEQ ID NO: 118631 - RNA, 18 nt, Human
agauggcaguuggaaaaa

SEQ ID NO: 118632 - RNA, 22 nt, Human
auggcaguuggaaaaaaaaaaa

SEQ ID NO: 118633 - RNA, 19 nt, Human
cacacaggcacgaccacua

SEQ ID NO: 118634 - RNA, 27 nt, Human
cacuccuuccuguccaucgguuuucca

SEQ ID NO: 118635 - RNA, 21 nt, Human
caguuggaaaaaaaaaaaaaa

SEQ ID NO: 118636 - RNA, 19 nt, Human
ccacagggugauuugcacu

SEQ ID NO: 118637 - RNA, 18 nt, Human
cccccggcgcccgccgcc

SEQ ID NO: 118638 - RNA, 20 nt, Human
ccccggcgcccgccgcccag

SEQ ID NO: 118639 - RNA, 20 nt, Human
ccgccuccaauugccaauuc

SEQ ID NO: 118640 - RNA, 21 nt, Human
ccgcgcgcgccccuccggccc

SEQ ID NO: 118641 - RNA, 21 nt, Human
cgcgcgcgccccuccggcccc

SEQ ID NO: 118642 - RNA, 22 nt, Human
cggcccccggcgcccgccgccc

SEQ ID NO: 118643 - RNA, 21 nt, Human
cggcgcccgccgcccagcgga

SEQ ID NO: 118644 - RNA, 22 nt, Human
cuaccgccuccaauugccaauu

SEQ ID NO: 118645 - RNA, 24 nt, Human
cuuccuguccaucgguuuuccaca

SEQ ID NO: 118646 - RNA, 20 nt, Human
gccuaaacgcuggggugccg

SEQ ID NO: 118647 - RNA, 23 nt, Human
gcgcgccccuccggcccccggcg

SEQ ID NO: 118648 - RNA, 23 nt, Human
ggcccccggcgcccgccgcccag

SEQ ID NO: 118649 - RNA, 21 nt, Human
gggugccgccgccgcgcgcgc

SEQ ID NO: 118650 - RNA, 21 nt, Human
uauaaacuagacugcuuuuga

SEQ ID NO: 118651 - RNA, 19 nt, Human
ucagaagcuaacacacaag

SEQ ID NO: 118652 - RNA, 25 nt, Human
uccagaaugaaaacaaaaccacuga

SEQ ID NO: 118653 - RNA, 18 nt, Human
ucccuucugauacacaca

SEQ ID NO: 118654 - RNA, 20 nt, Human
ucuguaagaaaauuguauag

SEQ ID NO: 118655 - RNA, 24 nt, Human
ugagagaaaggaggcaagauaccu

SEQ ID NO: 118656 - RNA, 20 nt, Human
ugccgccgccgcgcgcgccc

SEQ ID NO: 118657 - RNA, 19 nt, Human
ugccugagagaaaggaggc

SEQ ID NO: 118658 - RNA, 19 nt, Human
uggaaaaaaaaaaaaaaga

SEQ ID NO: 118659 - RNA, 23 nt, Human
uucacacggugcaugauuacuuc

SEQ ID NO: 118660 - RNA, 19 nt, Human
aaagaaaagcaagauggca

SEQ ID NO: 118661 - RNA, 19 nt, Human
aacaacaaagcagcaggaa

SEQ ID NO: 118662 - RNA, 18 nt, Human
aagaacucuaaaaucggc

SEQ ID NO: 118663 - RNA, 26 nt, Human
aagacccuuuccacgucaaggcacuc

SEQ ID NO: 118664 - RNA, 20 nt, Human
aagcuggacuucggcaaugc

SEQ ID NO: 118665 - RNA, 20 nt, Human
acaaagcagcaggaaacagg

SEQ ID NO: 118666 - RNA, 21 nt, Human
acaaagcagcaggaaacaggg

SEQ ID NO: 118667 - RNA, 21 nt, Human
acaaagcagcaggaaacaggg

SEQ ID NO: 118668 - RNA, 18 nt, Human
accccgggguucucgggc

SEQ ID NO: 118669 - RNA, 20 nt, Human
acccgagccgcagcggaggc

SEQ ID NO: 118670 - RNA, 24 nt, Human
accucgaggagcgcucagagggcu

SEQ ID NO: 118671 - RNA, 23 nt, Human
acuucaaaggagacuaggacagg

SEQ ID NO: 118672 - RNA, 20 nt, Human
agaacaacaaagcagcagga

SEQ ID NO: 118673 - RNA, 18 nt, Human
agccgcagcggaggccac

SEQ ID NO: 118674 - RNA, 19 nt, Human
agcggcagccaccuccccc

SEQ ID NO: 118675 - RNA, 18 nt, Human
agcuggacuucggcaaug

SEQ ID NO: 118676 - RNA, 19 nt, Human
aggaagacccuuuccacgu

SEQ ID NO: 118677 - RNA, 26 nt, Human
aggcagaacaacaaagcagcaggaaa

SEQ ID NO: 118678 - RNA, 19 nt, Human
caaacccgagccgcagcgg

SEQ ID NO: 118679 - RNA, 20 nt, Human
caacaaaauggcggacgcgg

SEQ ID NO: 118680 - RNA, 24 nt, Human
cacaauacgacuaugauacaaaca

SEQ ID NO: 118681 - RNA, 21 nt, Human
caccgacccccgccgucacac

SEQ ID NO: 118682 - RNA, 20 nt, Human
cagcaggaaacagggcaaca

SEQ ID NO: 118683 - RNA, 19 nt, Human
caggaaacagggcaacagc

SEQ ID NO: 118684 - RNA, 21 nt, Human
caggaggcagccgcugugugc

SEQ ID NO: 118685 - RNA, 18 nt, Human
ccaauagccacagcaaca

SEQ ID NO: 118686 - RNA, 18 nt, Human
ccacuucaaaggagacua

SEQ ID NO: 118687 - RNA, 21 nt, Human
ccauggccucaagcuuucucu

SEQ ID NO: 118688 - RNA, 24 nt, Human
ccccgggguucucgggcugcucgg

SEQ ID NO: 118689 - RNA, 19 nt, Human
ccuccagugacucccggcc

SEQ ID NO: 118690 - RNA, 25 nt, Human
ccuccggggugcuuuugcccagcuu

SEQ ID NO: 118691 - RNA, 20 nt, Human
ccucucgcacaccucgagga

SEQ ID NO: 118692 - RNA, 21 nt, Human
cgacagaaucagucccaugua

SEQ ID NO: 118693 - RNA, 19 nt, Human
cgaggcaccgaacucgaag

SEQ ID NO: 118694 - RNA, 23 nt, Human
cgccuuagcccggcagacggcuu

SEQ ID NO: 118695 - RNA, 23 nt, Human
cggcuccgggcccgcagcauccu

SEQ ID NO: 118696 - RNA, 22 nt, Human
cgucacacgaggcaccgaacuc

SEQ ID NO: 118697 - RNA, 27 nt, Human
cucuuccuuaagguucacuuccuguug

SEQ ID NO: 118698 - RNA, 18 nt, Human
cugcucggcgucccaggg

SEQ ID NO: 118699 - RNA, 19 nt, Human
gaaaagcaagauggcagcu

SEQ ID NO: 118700 - RNA, 20 nt, Human
gagccgcagcggaggccacc

SEQ ID NO: 118701 - RNA, 26 nt, Human
gcaaacccgagccgcagcggaggcca

SEQ ID NO: 118702 - RNA, 24 nt, Human
gccagcacuuuccucucgacaggg

SEQ ID NO: 118703 - RNA, 25 nt, Human
ggcagaacaacaaagcagcaggaaa

SEQ ID NO: 118704 - RNA, 19 nt, Human
ggcggcggcuguccucgcc

SEQ ID NO: 118705 - RNA, 27 nt, Human
gggccagcacuuuccucucgacagggg

SEQ ID NO: 118706 - RNA, 19 nt, Human
gggcccgcagcauccuccg

SEQ ID NO: 118707 - RNA, 22 nt, Human
uaggacaggcagaacaacaaag

SEQ ID NO: 118708 - RNA, 18 nt, Human
uccaaagaaaagcaagau

SEQ ID NO: 118709 - RNA, 22 nt, Human
ucugcggcgguaggggcggcgg

SEQ ID NO: 118710 - RNA, 20 nt, Human
ugagagaaaaugcuuuccca

SEQ ID NO: 118711 - RNA, 24 nt, Human
ugagagaaaaugcuuucccacuuc

SEQ ID NO: 118712 - RNA, 18 nt, Human
ugcaguaucucgccaugg

SEQ ID NO: 118713 - RNA, 18 nt, Human
ugcgacugccagucugca

SEQ ID NO: 118714 - RNA, 19 nt, Human
ugcuccggggccgccacac

SEQ ID NO: 118715 - RNA, 18 nt, Human
uggcagcuaagccacugc

SEQ ID NO: 118716 - RNA, 23 nt, Human
uguacaaacgggcagcaaugaga

SEQ ID NO: 118717 - RNA, 18 nt, Human
uguccaaagaaaagcaag

SEQ ID NO: 118718 - RNA, 25 nt, Human
uguccaaagaaaagcaagauggcag

SEQ ID NO: 118719 - RNA, 20 nt, Human
ugugcauuccaaaugugugu

SEQ ID NO: 118720 - RNA, 25 nt, Human
ugugcauuccaaaugugugugcgac

SEQ ID NO: 118721 - RNA, 23 nt, Human
ugugugcauuccaaaugugugug

SEQ ID NO: 118722 - RNA, 20 nt, Human
uuccucucggcuccgggccc

SEQ ID NO: 118723 - RNA, 19 nt, Human
aauggggaguaaugacucc

SEQ ID NO: 118724 - RNA, 18 nt, Human
acagagguggccccaguu

SEQ ID NO: 118725 - RNA, 23 nt, Human
acccccagcccuggcagggguuc

SEQ ID NO: 118726 - RNA, 21 nt, Human
acucaaccaacccucacacac

SEQ ID NO: 118727 - RNA, 28 nt, Human
cacacacccacuggggugcacccaaagg

SEQ ID NO: 118728 - RNA, 21 nt, Human
caccccagcuccugcugaggg

SEQ ID NO: 118729 - RNA, 19 nt, Human
caggggccaccccagcucc

SEQ ID NO: 118730 - RNA, 22 nt, Human
cccccagcccuggcagggguuc

SEQ ID NO: 118731 - RNA, 20 nt, Human
ccccuucucacccccagccc

SEQ ID NO: 118732 - RNA, 20 nt, Human
cccucacacacacacacaca

SEQ ID NO: 118733 - RNA, 22 nt, Human
cgccgcuggccccgcccggccc

SEQ ID NO: 118734 - RNA, 20 nt, Human
cgcgcggcgggcugcggcuc

SEQ ID NO: 118735 - RNA, 20 nt, Human
cgcgggacgcaggccgggcg

SEQ ID NO: 118736 - RNA, 22 nt, Human
cgcgggagggcgcgggccaggc

SEQ ID NO: 118737 - RNA, 19 nt, Human
cggcucggcggcgguggcg

SEQ ID NO: 118738 - RNA, 21 nt, Human
cggcucggcggcgguggcgca

SEQ ID NO: 118739 - RNA, 22 nt, Human
cguggcagggaggguggccuga

SEQ ID NO: 118740 - RNA, 20 nt, Human
cucacacacacacacacacc

SEQ ID NO: 118741 - RNA, 18 nt, Human
cucacccccagcccuggc

SEQ ID NO: 118742 - RNA, 21 nt, Human
cucaggggccaccccagcucc

SEQ ID NO: 118743 - RNA, 24 nt, Human
gacgcggaggccggagcaagucug

SEQ ID NO: 118744 - RNA, 21 nt, Human
gcagggguucuaggcaacuca

SEQ ID NO: 118745 - RNA, 21 nt, Human
gcgcggacgcggaggccggag

SEQ ID NO: 118746 - RNA, 21 nt, Human
gcgcugggcgcggacgcggag

SEQ ID NO: 118747 - RNA, 20 nt, Human
gcggcucggcggcgguggcg

SEQ ID NO: 118748 - RNA, 22 nt, Human
gcgggccaggccgcccgcacgu

SEQ ID NO: 118749 - RNA, 18 nt, Human
gcucauuuauuuaaaagg

SEQ ID NO: 118750 - RNA, 18 nt, Human
gcuggccccgcccggccc

SEQ ID NO: 118751 - RNA, 20 nt, Human
ggccggagcaagucugagca

SEQ ID NO: 118752 - RNA, 22 nt, Human
ggguggccugagccccuacagc

SEQ ID NO: 118753 - RNA, 21 nt, Human
gguggccccaguuuggguucg

SEQ ID NO: 118754 - RNA, 21 nt, Human
gguggcucaggugcccugaag

SEQ ID NO: 118755 - RNA, 20 nt, Human
guggccccaguuuggguucg

SEQ ID NO: 118756 - RNA, 21 nt, Human
ucggcggcgguggcgcagggc

SEQ ID NO: 118757 - RNA, 19 nt, Human
ucuuuuggaggggcccuag

SEQ ID NO: 118758 - RNA, 25 nt, Human
ugacaaggcgcuaaugcgccgcugg

SEQ ID NO: 118759 - RNA, 19 nt, Human
ugacuccccuucucacccc

SEQ ID NO: 118760 - RNA, 20 nt, Human
ugacuccccuucucaccccc

SEQ ID NO: 118761 - RNA, 19 nt, Human
uggccugagccccuacagc

SEQ ID NO: 118762 - RNA, 21 nt, Human
uuggaggggcccuagguaaug

SEQ ID NO: 118763 - RNA, 21 nt, Human
aaacacaccacacuaguacca

SEQ ID NO: 118764 - RNA, 29 nt, Human
aaacagaaaagggaaagagcauccuucgg

SEQ ID NO: 118765 - RNA, 26 nt, Human
aaacagaaaagggaaagaggggaccc

SEQ ID NO: 118766 - RNA, 18 nt, Human
aacacaccacacuaguac

SEQ ID NO: 118767 - RNA, 19 nt, Human
aacugccucagagggaccg

SEQ ID NO: 118768 - RNA, 22 nt, Human
aagaacacacacagaccagaag

SEQ ID NO: 118769 - RNA, 18 nt, Human
aagugccacggagaccag

SEQ ID NO: 118770 - RNA, 22 nt, Human
aauuuccaagcaaacacaccac

SEQ ID NO: 118771 - RNA, 19 nt, Human
acaaaacuuuaaaaaucug

SEQ ID NO: 118772 - RNA, 21 nt, Human
acagaacaagacaaugcuaaa

SEQ ID NO: 118773 - RNA, 19 nt, Human
accacuucuuccuaaacag

SEQ ID NO: 118774 - RNA, 18 nt, Human
acugccccgucaacugcc

SEQ ID NO: 118775 - RNA, 21 nt, Human
agaacaagacaaugcuaaaac

SEQ ID NO: 118776 - RNA, 20 nt, Human
agaacaucuacagggugcaa

SEQ ID NO: 118777 - RNA, 21 nt, Human
agaccagaagacagcacggug

SEQ ID NO: 118778 - RNA, 20 nt, Human
agagaaucauggagccagug

SEQ ID NO: 118779 - RNA, 22 nt, Human
agccccgaauggggauggggag

SEQ ID NO: 118780 - RNA, 24 nt, Human
agcgggcgcgcugacaaaggcccg

SEQ ID NO: 118781 - RNA, 22 nt, Human
aggaauuuccaagcaaacacac

SEQ ID NO: 118782 - RNA, 18 nt, Human
augaaaacaccaugcucc

SEQ ID NO: 118783 - RNA, 20 nt, Human
auggagccaguggaguuaga

SEQ ID NO: 118784 - RNA, 26 nt, Human
caagcaaacacaccacacuaguacca

SEQ ID NO: 118785 - RNA, 21 nt, Human
caaggaauuuccaagcaaaca

SEQ ID NO: 118786 - RNA, 22 nt, Human
cacacagaccagaagacagcac

SEQ ID NO: 118787 - RNA, 20 nt, Human
cacagaccagaagacagcac

SEQ ID NO: 118788 - RNA, 18 nt, Human
cacgcaggggcagccauc

SEQ ID NO: 118789 - RNA, 21 nt, Human
cagaacaagacaaugcuaaaa

SEQ ID NO: 118790 - RNA, 24 nt, Human
cagaauccuucaggcuagcuccuc

SEQ ID NO: 118791 - RNA, 20 nt, Human
cagccccccaucgucagccc

SEQ ID NO: 118792 - RNA, 19 nt, Human
caggacucaggccacgcag

SEQ ID NO: 118793 - RNA, 18 nt, Human
ccaagcaaacacaccaca

SEQ ID NO: 118794 - RNA, 20 nt, Human
ccacgcgcggcugccccggc

SEQ ID NO: 118795 - RNA, 19 nt, Human
cccacgcgcggcugccccg

SEQ ID NO: 118796 - RNA, 18 nt, Human
ccccccaucgucagcccc

SEQ ID NO: 118797 - RNA, 19 nt, Human
cccgggagggauagagaca

SEQ ID NO: 118798 - RNA, 18 nt, Human
ccgcccgccgccgcuccg

SEQ ID NO: 118799 - RNA, 19 nt, Human
ccgccgccgcuccggcugc

SEQ ID NO: 118800 - RNA, 20 nt, Human
ccgccgccgcuccggcugcc

SEQ ID NO: 118801 - RNA, 25 nt, Human
ccucccuccaucagcaccaacuaaa

SEQ ID NO: 118802 - RNA, 18 nt, Human
ccucuggcgcccucggcc

SEQ ID NO: 118803 - RNA, 23 nt, Human
ccucuggcgcccucggcccggcc

SEQ ID NO: 118804 - RNA, 27 nt, Human
cgcacucacagacuugcauacguagug

SEQ ID NO: 118805 - RNA, 21 nt, Human
cggccugaagccuagagcugg

SEQ ID NO: 118806 - RNA, 28 nt, Human
cgggagggauagagacacggacggaggc

SEQ ID NO: 118807 - RNA, 23 nt, Human
cuaaaacuguggguuucaaaaac

SEQ ID NO: 118808 - RNA, 22 nt, Human
cuacagggugcaaaggaaccac

SEQ ID NO: 118809 - RNA, 24 nt, Human
cuagagcuggcuugaagaacacac

SEQ ID NO: 118810 - RNA, 18 nt, Human
cucggcccggccgcugac

SEQ ID NO: 118811 - RNA, 18 nt, Human
cucugcaaccuagugcaa

SEQ ID NO: 118812 - RNA, 25 nt, Human
cugcucggcccgcccgccgccgcuc

SEQ ID NO: 118813 - RNA, 18 nt, Human
cuucacuguaaggguuuu

SEQ ID NO: 118814 - RNA, 21 nt, Human
gaacacacacagaccagaaga

SEQ ID NO: 118815 - RNA, 19 nt, Human
gaagccuagagcuggcuug

SEQ ID NO: 118816 - RNA, 21 nt, Human
gaauggggauggggagaccuc

SEQ ID NO: 118817 - RNA, 24 nt, Human
gacagaacaagacaaugcuaaaac

SEQ ID NO: 118818 - RNA, 19 nt, Human
gacugccccgucaacugcc

SEQ ID NO: 118819 - RNA, 21 nt, Human
gaggaugcuucucugcaaccu

SEQ ID NO: 118820 - RNA, 22 nt, Human
gcaaggcuuccccugccauucc

SEQ ID NO: 118821 - RNA, 23 nt, Human
gcccucggcccggccgcugaccu

SEQ ID NO: 118822 - RNA, 24 nt, Human
gccgcuccggcugccagcaccgcc

SEQ ID NO: 118823 - RNA, 19 nt, Human
gcgcugacaaaggcccggg

SEQ ID NO: 118824 - RNA, 21 nt, Human
gcucggcccgcccgccgccgc

SEQ ID NO: 118825 - RNA, 22 nt, Human
gcugacaaaggcccgggaggga

SEQ ID NO: 118826 - RNA, 19 nt, Human
gggcaaggaauuuccaagc

SEQ ID NO: 118827 - RNA, 22 nt, Human
uacaagugccacggagaccagg

SEQ ID NO: 118828 - RNA, 24 nt, Human
uagaacaucuacagggugcaaagg

SEQ ID NO: 118829 - RNA, 24 nt, Human
uaggaagggggaaugaaaacacca

SEQ ID NO: 118830 - RNA, 19 nt, Human
ucacagguggagguggggc

SEQ ID NO: 118831 - RNA, 23 nt, Human
uccaagcaaacacaccacacuag

SEQ ID NO: 118832 - RNA, 20 nt, Human
ucugagugugaaccuggcuc

SEQ ID NO: 118833 - RNA, 22 nt, Human
ugaaaacaccaugcuccgaggu

SEQ ID NO: 118834 - RNA, 19 nt, Human
ugaagaacacacacagacc

SEQ ID NO: 118835 - RNA, 20 nt, Human
ugaagccuagagcuggcuug

SEQ ID NO: 118836 - RNA, 21 nt, Human
ugaggucucggcaucgugucu

SEQ ID NO: 118837 - RNA, 22 nt, Human
ugauuacaaaggaaaacuuugu

SEQ ID NO: 118838 - RNA, 24 nt, Human
uggaagggacagaacaagacaaug

SEQ ID NO: 118839 - RNA, 19 nt, Human
uggaccagaggugggggca

SEQ ID NO: 118840 - RNA, 19 nt, Human
uggaccagaggugggggca

SEQ ID NO: 118841 - RNA, 30 nt, Human
uguggggcaaggaauuuccaagcaaacacc

SEQ ID NO: 118842 - RNA, 22 nt, Human
uuacaagugccacggagaccag

SEQ ID NO: 118843 - RNA, 21 nt, Human
uucgacuucccccucccucca

SEQ ID NO: 118844 - RNA, 21 nt, Human
uuugggacugccccucagggc

SEQ ID NO: 118845 - RNA, 24 nt, Human
uuuuuuuuuuuuuuuuuucagugg

SEQ ID NO: 118846 - RNA, 18 nt, Human
aaaaauauuucuaccuuc

SEQ ID NO: 118847 - RNA, 22 nt, Human
aaacaaaacaaaaagcuauaua

SEQ ID NO: 118848 - RNA, 21 nt, Human
aaacaggaaugaaucauuuau

SEQ ID NO: 118849 - RNA, 23 nt, Human
aaacuccuagcuucaagcaaucc

SEQ ID NO: 118850 - RNA, 24 nt, Human
aaagugcuaagauuauaggcauga

SEQ ID NO: 118851 - RNA, 21 nt, Human
aaaucacaauaggaaaccagu

SEQ ID NO: 118852 - RNA, 23 nt, Human
aacaaaaauacuuaaaaauuaga

SEQ ID NO: 118853 - RNA, 22 nt, Human
aacccauguaaguaccaacaaa

SEQ ID NO: 118854 - RNA, 25 nt, Human
aagcaauccuccuaccuuggccucc

SEQ ID NO: 118855 - RNA, 25 nt, Human
aagcaauccuccuaccuuggccucc

SEQ ID NO: 118856 - RNA, 24 nt, Human
aaguagcuuggacuacaggcacac

SEQ ID NO: 118857 - RNA, 21 nt, Human
acaaguuuucuuaacuuguua

SEQ ID NO: 118858 - RNA, 24 nt, Human
acagcgaggaggaaaaaauucuga

SEQ ID NO: 118859 - RNA, 24 nt, Human
acagcucacugcagccacaaccuc

SEQ ID NO: 118860 - RNA, 25 nt, Human
acccuguugcccaggcuggucucaa

SEQ ID NO: 118861 - RNA, 19 nt, Human
agacagggucucacgcucu

SEQ ID NO: 118862 - RNA, 19 nt, Human
agacagggucucacgcucu

SEQ ID NO: 118863 - RNA, 22 nt, Human
agauuauaggcaugagccacug

SEQ ID NO: 118864 - RNA, 24 nt, Human
agauuauaggcaugagccacugca

SEQ ID NO: 118865 - RNA, 18 nt, Human
aggaggaaaaaauucuga

SEQ ID NO: 118866 - RNA, 21 nt, Human
aggaggaaaaaauucugacaa

SEQ ID NO: 118867 - RNA, 21 nt, Human
aggcaugagccacugcaccca

SEQ ID NO: 118868 - RNA, 21 nt, Human
aggcuauagcauaagggcaca

SEQ ID NO: 118869 - RNA, 22 nt, Human
aucacaauaggaaaccaguaca

SEQ ID NO: 118870 - RNA, 23 nt, Human
aucacagcucacugcagccacaa

SEQ ID NO: 118871 - RNA, 24 nt, Human
caaagugcuaagauuauaggcaug

SEQ ID NO: 118872 - RNA, 25 nt, Human
caaccuccugggcucaaccgauccu

SEQ ID NO: 118873 - RNA, 27 nt, Human
caagcaauccuccuaccuuggccuccc

SEQ ID NO: 118874 - RNA, 22 nt, Human
caaguagcuuggacuacaggca

SEQ ID NO: 118875 - RNA, 25 nt, Human
cacaucacagcucacugcagccaca

SEQ ID NO: 118876 - RNA, 19 nt, Human
cacugcacccagcccaaaa

SEQ ID NO: 118877 - RNA, 23 nt, Human
cagccacaaccuccugggcucaa

SEQ ID NO: 118878 - RNA, 24 nt, Human
caggaccuuacccuguugcccagg

SEQ ID NO: 118879 - RNA, 22 nt, Human
caggagccugcugcaacaauug

SEQ ID NO: 118880 - RNA, 18 nt, Human
cagggaaauuagcauaca

SEQ ID NO: 118881 - RNA, 24 nt, Human
cagggucucacgcucuugcccagg

SEQ ID NO: 118882 - RNA, 23 nt, Human
cauauuaccaacucacucccagc

SEQ ID NO: 118883 - RNA, 21 nt, Human
caucacagcucacugcagcca

SEQ ID NO: 118884 - RNA, 23 nt, Human
caucacagcucacugcagccaca

SEQ ID NO: 118885 - RNA, 23 nt, Human
caugcaccaccauacccggcuaa

SEQ ID NO: 118886 - RNA, 24 nt, Human
ccaaagugcuaagauuauaggcau

SEQ ID NO: 118887 - RNA, 19 nt, Human
ccacugcacccagcccaaa

SEQ ID NO: 118888 - RNA, 23 nt, Human
ccacugcacccagcccaaaaaag

SEQ ID NO: 118889 - RNA, 18 nt, Human
ccaucaaacauaacaggc

SEQ ID NO: 118890 - RNA, 26 nt, Human
ccuccuaccuuggccucccaaagugc

SEQ ID NO: 118891 - RNA, 24 nt, Human
ccuccugggcucaaccgauccucc

SEQ ID NO: 118892 - RNA, 25 nt, Human
ccuccugucucagccuucaaguagc

SEQ ID NO: 118893 - RNA, 23 nt, Human
ccugucucagccuucaaguagcu

SEQ ID NO: 118894 - RNA, 27 nt, Human
ccuuacccuguugcccaggcuggucuc

SEQ ID NO: 118895 - RNA, 24 nt, Human
cucacugcagccacaaccuccugg

SEQ ID NO: 118896 - RNA, 23 nt, Human
cucauauuaccaacucacuccca

SEQ ID NO: 118897 - RNA, 23 nt, Human
cugcagccacaaccuccugggcu

SEQ ID NO: 118898 - RNA, 21 nt, Human
cuuacccuguugcccaggcug

SEQ ID NO: 118899 - RNA, 24 nt, Human
cuucaaguagcuuggacuacaggc

SEQ ID NO: 118900 - RNA, 18 nt, Human
cuuggacuacaggcacac

SEQ ID NO: 118901 - RNA, 22 nt, Human
gauuauaggcaugagccacugc

SEQ ID NO: 118902 - RNA, 20 nt, Human
gcagccacaaccuccugggc

SEQ ID NO: 118903 - RNA, 26 nt, Human
ggacuacaggcacacaugcaccacca

SEQ ID NO: 118904 - RNA, 21 nt, Human
ggcacaucacagcucacugca

SEQ ID NO: 118905 - RNA, 19 nt, Human
gggcucaaccgauccuccu

SEQ ID NO: 118906 - RNA, 19 nt, Human
gggcucaaccgauccuccu

SEQ ID NO: 118907 - RNA, 21 nt, Human
guaaguaccaacaaaaauacu

SEQ ID NO: 118908 - RNA, 24 nt, Human
uaaaagucacuguaacaaauuuaa

SEQ ID NO: 118909 - RNA, 21 nt, Human
uaaaaucacaauaggaaacca

SEQ ID NO: 118910 - RNA, 21 nt, Human
uaaaggaauguuagcaaguca

SEQ ID NO: 118911 - RNA, 22 nt, Human
uaacuuguuaaaggaauguuag

SEQ ID NO: 118912 - RNA, 21 nt, Human
uaagauuauaggcaugagcca

SEQ ID NO: 118913 - RNA, 24 nt, Human
uaagauuauaggcaugagccacug

SEQ ID NO: 118914 - RNA, 24 nt, Human
uaagauuauaggcaugagccacug

SEQ ID NO: 118915 - RNA, 24 nt, Human
uaaguuuuugaucuuguagagaca

SEQ ID NO: 118916 - RNA, 21 nt, Human
uacccuguugcccaggcuggu

SEQ ID NO: 118917 - RNA, 24 nt, Human
uacccuguugcccaggcuggucuc

SEQ ID NO: 118918 - RNA, 27 nt, Human
uacccuguugcccaggcuggucucaaa

SEQ ID NO: 118919 - RNA, 22 nt, Human
uagagacaggaccuuacccugu

SEQ ID NO: 118920 - RNA, 20 nt, Human
uagcaagucaacauuccuuc

SEQ ID NO: 118921 - RNA, 21 nt, Human
uagcaagucaacauuccuucc

SEQ ID NO: 118922 - RNA, 20 nt, Human
uagcuucaagcaauccuccu

SEQ ID NO: 118923 - RNA, 21 nt, Human
uagcuucaagcaauccuccua

SEQ ID NO: 118924 - RNA, 25 nt, Human
uagcuucaagcaauccuccuaccuu

SEQ ID NO: 118925 - RNA, 23 nt, Human
uauuuuagaucaccauuagauug

SEQ ID NO: 118926 - RNA, 25 nt, Human
ucaaccgauccuccugucucagccu

SEQ ID NO: 118927 - RNA, 24 nt, Human
ucaagcaauccuccuaccuuggcc

SEQ ID NO: 118928 - RNA, 24 nt, Human
ucacugcagccacaaccuccuggg

SEQ ID NO: 118929 - RNA, 21 nt, Human
ucacuguaacaaauuuaaaca

SEQ ID NO: 118930 - RNA, 24 nt, Human
ucccaaagugcuaagauuauaggc

SEQ ID NO: 118931 - RNA, 25 nt, Human
ucccaucaaacauaacaggcuuuuc

SEQ ID NO: 118932 - RNA, 18 nt, Human
uccuagcuucaagcaauc

SEQ ID NO: 118933 - RNA, 19 nt, Human
ucuacauugauguccagag

SEQ ID NO: 118934 - RNA, 19 nt, Human
ucucacgcucuugcccagg

SEQ ID NO: 118935 - RNA, 21 nt, Human
ugagccacugcacccagccca

SEQ ID NO: 118936 - RNA, 23 nt, Human
ugcccaggcuauagcauaagggc

SEQ ID NO: 118937 - RNA, 24 nt, Human
ugcccaggcuggucucaaacuccu

SEQ ID NO: 118938 - RNA, 22 nt, Human
ugcuugagacugccaggagccu

SEQ ID NO: 118939 - RNA, 24 nt, Human
uggacuacaggcacacaugcacca

SEQ ID NO: 118940 - RNA, 27 nt, Human
uggacuacaggcacacaugcaccacca

SEQ ID NO: 118941 - RNA, 24 nt, Human
ugggcucaaccgauccuccugucu

SEQ ID NO: 118942 - RNA, 22 nt, Human
uguugcccaggcuggucucaaa

SEQ ID NO: 118943 - RNA, 22 nt, Human
uuauaacccauguaaguaccaa

SEQ ID NO: 118944 - RNA, 24 nt, Human
uucaagcaauccuccuaccuuggc

SEQ ID NO: 118945 - RNA, 18 nt, Human
uuggccucccaaagugcu

SEQ ID NO: 118946 - RNA, 18 nt, Human
uuuuuuuuuuuaaacagg

SEQ ID NO: 118947 - RNA, 22 nt, Human
uuuuuuuuuuuuuuaaacagga

SEQ ID NO: 118948 - RNA, 23 nt, Human
uuuuuuuuuuuuuuuuaaacagg

SEQ ID NO: 118949 - RNA, 21 nt, Human
aaagcgggagguaccagagac

SEQ ID NO: 118950 - RNA, 23 nt, Human
aagaaagcacugcaagcaaacaa

SEQ ID NO: 118951 - RNA, 21 nt, Human
aagagcccugugaaugugggc

SEQ ID NO: 118952 - RNA, 19 nt, Human
aaugcggggaugaagaaag

SEQ ID NO: 118953 - RNA, 23 nt, Human
accagacacuuuaccuccauucu

SEQ ID NO: 118954 - RNA, 28 nt, Human
accagagacagagacguggggcccaguc

SEQ ID NO: 118955 - RNA, 18 nt, Human
accuccauucucaggcgc

SEQ ID NO: 118956 - RNA, 24 nt, Human
accuccauucucaggcgcugagga

SEQ ID NO: 118957 - RNA, 22 nt, Human
agagccauaaaauuaagaaagc

SEQ ID NO: 118958 - RNA, 18 nt, Human
agcagaucugcucugcug

SEQ ID NO: 118959 - RNA, 22 nt, Human
agguaccuucaggacccacagc

SEQ ID NO: 118960 - RNA, 24 nt, Human
auaaaaaugaaaacaaaacaccuc

SEQ ID NO: 118961 - RNA, 22 nt, Human
auaaaauuaagaaagcacugca

SEQ ID NO: 118962 - RNA, 23 nt, Human
augaagaaagaauucacagcccc

SEQ ID NO: 118963 - RNA, 18 nt, Human
caaaccagacaccuggcc

SEQ ID NO: 118964 - RNA, 20 nt, Human
caaaggcccagagacagaga

SEQ ID NO: 118965 - RNA, 23 nt, Human
cagcauaguuaacgagcucccag

SEQ ID NO: 118966 - RNA, 24 nt, Human
ccagaagagccauaaaauuaagaa

SEQ ID NO: 118967 - RNA, 25 nt, Human
ccagacaccuggccaguguccugau

SEQ ID NO: 118968 - RNA, 25 nt, Human
cccaaaccagacaccuggccagugu

SEQ ID NO: 118969 - RNA, 22 nt, Human
cuaauggccuuuccagugugcu

SEQ ID NO: 118970 - RNA, 20 nt, Human
cugcaagcaaacaaaaacca

SEQ ID NO: 118971 - RNA, 22 nt, Human
cugcuggggcaauucuaauggc

SEQ ID NO: 118972 - RNA, 19 nt, Human
cuggacccaaaccagacac

SEQ ID NO: 118973 - RNA, 19 nt, Human
gagaaaguggagggacugc

SEQ ID NO: 118974 - RNA, 22 nt, Human
gagacagagacguggggcccau

SEQ ID NO: 118975 - RNA, 23 nt, Human
gcacugcaagcaaacaaaaacca

SEQ ID NO: 118976 - RNA, 23 nt, Human
gggaaugcggggaugaagaaaga

SEQ ID NO: 118977 - RNA, 24 nt, Human
uaaaaaagcgggagguaccagaga

SEQ ID NO: 118978 - RNA, 21 nt, Human
uaacgagcucccagaccagac

SEQ ID NO: 118979 - RNA, 24 nt, Human
uaaguucuuggcaguaacaacaua

SEQ ID NO: 118980 - RNA, 23 nt, Human
uaccuagugcuucauuuugcucu

SEQ ID NO: 118981 - RNA, 21 nt, Human
uagaagaucagcgcuuccuuc

SEQ ID NO: 118982 - RNA, 19 nt, Human
uauucggcugaaaguucag

SEQ ID NO: 118983 - RNA, 19 nt, Human
ucccagaccagacacuuua

SEQ ID NO: 118984 - RNA, 19 nt, Human
ucguguggaaaaggggagg

SEQ ID NO: 118985 - RNA, 20 nt, Human
ugaaugugggcaaugcccuc

SEQ ID NO: 118986 - RNA, 24 nt, Human
ugacaugaugaugagcacucugga

SEQ ID NO: 118987 - RNA, 18 nt, Human
ugagcacucuggacccaa

SEQ ID NO: 118988 - RNA, 18 nt, Human
ugcaagcaaacaaaaacc

SEQ ID NO: 118989 - RNA, 25 nt, Human
ugcaguguaaaaaagcgggagguac

SEQ ID NO: 118990 - RNA, 24 nt, Human
ugcggggaugaagaaagaauucac

SEQ ID NO: 118991 - RNA, 25 nt, Human
ugcgguguaaaaaaccgggagguac

SEQ ID NO: 118992 - RNA, 21 nt, Human
ugcucugcuggggcaauucua

SEQ ID NO: 118993 - RNA, 18 nt, Human
ugcuuugagaaaguggag

SEQ ID NO: 118994 - RNA, 19 nt, Human
uggaaaaaaagcagaucug

SEQ ID NO: 118995 - RNA, 20 nt, Human
uggaaaaaaagcagaucugc

SEQ ID NO: 118996 - RNA, 29 nt, Human
uggguguuaguuuucucaucuaugugagg

SEQ ID NO: 118997 - RNA, 23 nt, Human
ugguauugcugggcuucccauuu

SEQ ID NO: 118998 - RNA, 20 nt, Human
uucccagaagagccauaaaa

SEQ ID NO: 118999 - RNA, 20 nt, Human
uucugauucuuuuggaccgu

SEQ ID NO: 119000 - RNA, 25 nt, Human
uugcucuggaaaaaaagcagaucug

SEQ ID NO: 119001 - RNA, 22 nt, Human
aaaaaacgagguacgaagagga

SEQ ID NO: 119002 - RNA, 21 nt, Human
aaaaacgagguacgaagagga

SEQ ID NO: 119003 - RNA, 19 nt, Human
aaacuucugcauuucaaag

SEQ ID NO: 119004 - RNA, 20 nt, Human
aagaaggaauauuuuaaaaa

SEQ ID NO: 119005 - RNA, 24 nt, Human
aagcccgcagccgcggugccucag

SEQ ID NO: 119006 - RNA, 19 nt, Human
aaggagcuggcccagcaac

SEQ ID NO: 119007 - RNA, 24 nt, Human
acgcucagacuggaaacaaaggag

SEQ ID NO: 119008 - RNA, 22 nt, Human
agcggugggaggaccccccacg

SEQ ID NO: 119009 - RNA, 21 nt, Human
agcuggcccagcaacuuuccc

SEQ ID NO: 119010 - RNA, 22 nt, Human
aggaccccccacgagccaaaaa

SEQ ID NO: 119011 - RNA, 21 nt, Human
auacaacuguacauaaacuuc

SEQ ID NO: 119012 - RNA, 19 nt, Human
caaaaaacgagguacgaag

SEQ ID NO: 119013 - RNA, 22 nt, Human
cacgagccaaaaaacgagguac

SEQ ID NO: 119014 - RNA, 18 nt, Human
cagccgcggugccucaga

SEQ ID NO: 119015 - RNA, 21 nt, Human
ccagcggugggaggacccccc

SEQ ID NO: 119016 - RNA, 21 nt, Human
ccccacgagccaaaaaacgag

SEQ ID NO: 119017 - RNA, 18 nt, Human
ccccccacgagccaaaaa

SEQ ID NO: 119018 - RNA, 25 nt, Human
ccccccacgagccaaaaaacgaggu

SEQ ID NO: 119019 - RNA, 23 nt, Human
gaugucaacaucaaagaaggaau

SEQ ID NO: 119020 - RNA, 23 nt, Human
gcggugccucagaagacccucgg

SEQ ID NO: 119021 - RNA, 18 nt, Human
ggagagccgggaacucag

SEQ ID NO: 119022 - RNA, 20 nt, Human
uaaaaagcacauagaaaccc

SEQ ID NO: 119023 - RNA, 20 nt, Human
ucccugcggagagccgggaa

SEQ ID NO: 119024 - RNA, 24 nt, Human
ucucuucuuugugcuuauaguuga

SEQ ID NO: 119025 - RNA, 22 nt, Human
uggaaacaaaggagcuggccca

SEQ ID NO: 119026 - RNA, 24 nt, Human
uuugaugucaacaucaaagaagga

SEQ ID NO: 119027 - RNA, 30 nt, Human
uuuuuuuuauuguuuuuuuuuuuuuuuuuu

SEQ ID NO: 119028 - RNA, 24 nt, Human
uuuuuuuuuuaaaaccacauacuu

SEQ ID NO: 119029 - RNA, 24 nt, Human
uuuuuuuuuuuuuuuauuguuuuu

SEQ ID NO: 119030 - RNA, 23 nt, Human
aaaagguuuauugcuuauaaaaa

SEQ ID NO: 119031 - RNA, 21 nt, Human
aagccccacaaaacacaagaa

SEQ ID NO: 119032 - RNA, 24 nt, Human
aaguuaccaaaacccaagccccac

SEQ ID NO: 119033 - RNA, 19 nt, Human
acaaaacacaagaaccccg

SEQ ID NO: 119034 - RNA, 21 nt, Human
accaaaacccaagccccacaa

SEQ ID NO: 119035 - RNA, 18 nt, Human
acccaagccccacaaaac

SEQ ID NO: 119036 - RNA, 18 nt, Human
agacaccagcacugccga

SEQ ID NO: 119037 - RNA, 21 nt, Human
aggagcagcuguacacaucug

SEQ ID NO: 119038 - RNA, 22 nt, Human
caaaacacaagaaccccgcaug

SEQ ID NO: 119039 - RNA, 22 nt, Human
caaaacccaagccccacaaaac

SEQ ID NO: 119040 - RNA, 19 nt, Human
caagaaccccgcaugacga

SEQ ID NO: 119041 - RNA, 23 nt, Human
caagaaccccgcaugacgauacc

SEQ ID NO: 119042 - RNA, 22 nt, Human
caagccccacaaaacacaagaa

SEQ ID NO: 119043 - RNA, 26 nt, Human
cagcucgcggagacgacagacaccag

SEQ ID NO: 119044 - RNA, 21 nt, Human
ccaaaacccaagccccacaaa

SEQ ID NO: 119045 - RNA, 25 nt, Human
ccaaaacccaagccccacaaaacac

SEQ ID NO: 119046 - RNA, 22 nt, Human
ccacaaaacacaagaaccccgc

SEQ ID NO: 119047 - RNA, 18 nt, Human
cccaagccccacaaaaca

SEQ ID NO: 119048 - RNA, 20 nt, Human
cccacaaaacacaagaaccc

SEQ ID NO: 119049 - RNA, 21 nt, Human
cccacaaaacacaagaacccc

SEQ ID NO: 119050 - RNA, 19 nt, Human
cccaugaacacaagggcuc

SEQ ID NO: 119051 - RNA, 23 nt, Human
ccucugcacacauggcgcugcuu

SEQ ID NO: 119052 - RNA, 21 nt, Human
cuggguggggucugaggcugg

SEQ ID NO: 119053 - RNA, 18 nt, Human
cuguacacaucugggcag

SEQ ID NO: 119054 - RNA, 21 nt, Human
gaaggugcuggguggggucug

SEQ ID NO: 119055 - RNA, 19 nt, Human
gcagugaggaaccagcuga

SEQ ID NO: 119056 - RNA, 20 nt, Human
gccccacaaaacacaagaac

SEQ ID NO: 119057 - RNA, 21 nt, Human
ggguggggucugaggcugggg

SEQ ID NO: 119058 - RNA, 22 nt, Human
ggguggggucugaggcuggggc

SEQ ID NO: 119059 - RNA, 21 nt, Human
guuaccaaaacccaagcccca

SEQ ID NO: 119060 - RNA, 24 nt, Human
uacaaaagguuuauugcuuauaaa

SEQ ID NO: 119061 - RNA, 23 nt, Human
uaccaaaacccaagccccacaaa

SEQ ID NO: 119062 - RNA, 26 nt, Human
uaccaaaacccaagccccacaaaaca

SEQ ID NO: 119063 - RNA, 21 nt, Human
uaccagguucuagaaaggucu

SEQ ID NO: 119064 - RNA, 24 nt, Human
uaccagguucuagaaaggucuucu

SEQ ID NO: 119065 - RNA, 25 nt, Human
ucuaccagguucuagaaaggucuuc

SEQ ID NO: 119066 - RNA, 21 nt, Human
ugcgugucugggaaggugcug

SEQ ID NO: 119067 - RNA, 22 nt, Human
ugcuggguggggucugaggcuc

SEQ ID NO: 119068 - RNA, 23 nt, Human
uuuaugaaagggaggagcagcug

SEQ ID NO: 119069 - RNA, 20 nt, Human
aaaaaagaaaaagaaacauc

SEQ ID NO: 119070 - RNA, 19 nt, Human
aaaagaaaaagaaacaucu

SEQ ID NO: 119071 - RNA, 26 nt, Human
aagcacuaggauuauaagugugagcc

SEQ ID NO: 119072 - RNA, 21 nt, Human
aagugugagccaccguaccca

SEQ ID NO: 119073 - RNA, 23 nt, Human
acacugguagccgccuuccccuc

SEQ ID NO: 119074 - RNA, 19 nt, Human
agcucaagugauccucuca

SEQ ID NO: 119075 - RNA, 22 nt, Human
agugaaacuucucuuaagacug

SEQ ID NO: 119076 - RNA, 28 nt, Human
caaaagaaaaugaacuaauauaugaugg

SEQ ID NO: 119077 - RNA, 24 nt, Human
caaagcacuaggauuauaagugug

SEQ ID NO: 119078 - RNA, 23 nt, Human
caacagcagcuaacacuuugcuu

SEQ ID NO: 119079 - RNA, 27 nt, Human
caagugauccucucacaucaaccuccc

SEQ ID NO: 119080 - RNA, 24 nt, Human
cacaucaaccucccaaagcacuag

SEQ ID NO: 119081 - RNA, 24 nt, Human
cacuaggauuauaagugugagcca

SEQ ID NO: 119082 - RNA, 21 nt, Human
cauacaacagcagcuaacacu

SEQ ID NO: 119083 - RNA, 21 nt, Human
caucaaccucccaaagcacua

SEQ ID NO: 119084 - RNA, 21 nt, Human
ccagcccauaccccacuuugc

SEQ ID NO: 119085 - RNA, 20 nt, Human
cccauacaacagcagcuaac

SEQ ID NO: 119086 - RNA, 20 nt, Human
ccucccaaagcacuaggauu

SEQ ID NO: 119087 - RNA, 22 nt, Human
ccucucacaucaaccucccaaa

SEQ ID NO: 119088 - RNA, 20 nt, Human
ccugagcucaagugauccuc

SEQ ID NO: 119089 - RNA, 24 nt, Human
cucaagugauccucucacaucaac

SEQ ID NO: 119090 - RNA, 18 nt, Human
gauuauaagugugagcca

SEQ ID NO: 119091 - RNA, 24 nt, Human
gauuauaagugugagccaccguac

SEQ ID NO: 119092 - RNA, 20 nt, Human
ggaaaaaaagaaaaagaaac

SEQ ID NO: 119093 - RNA, 22 nt, Human
ggauuauaagugugagccaccg

SEQ ID NO: 119094 - RNA, 22 nt, Human
gugagccaccguacccagccca

SEQ ID NO: 119095 - RNA, 21 nt, Human
uaggauuauaagugugagcca

SEQ ID NO: 119096 - RNA, 22 nt, Human
uaggauuauaagugugagccac

SEQ ID NO: 119097 - RNA, 23 nt, Human
uaggauuauaagugugagccacc

SEQ ID NO: 119098 - RNA, 24 nt, Human
uaggauuauaagugugagccaccg

SEQ ID NO: 119099 - RNA, 22 nt, Human
uauguugcccccauuggucuca

SEQ ID NO: 119100 - RNA, 24 nt, Human
uauguugcccccauuggucucaaa

SEQ ID NO: 119101 - RNA, 22 nt, Human
ucaaaaggaaaaaaagaaaaag

SEQ ID NO: 119102 - RNA, 24 nt, Human
ucaaaaggaaaaaaagaaaaagaa

SEQ ID NO: 119103 - RNA, 19 nt, Human
ucacaucaaccucccaaag

SEQ ID NO: 119104 - RNA, 19 nt, Human
ucccauacaacagcagcua

SEQ ID NO: 119105 - RNA, 23 nt, Human
ucucaaauuccugagcucaagug

SEQ ID NO: 119106 - RNA, 23 nt, Human
ucucacaucaaccucccaaagca

SEQ ID NO: 119107 - RNA, 24 nt, Human
ucucacuauguugcccccauuggu

SEQ ID NO: 119108 - RNA, 18 nt, Human
ugagcucaagugauccuc

SEQ ID NO: 119109 - RNA, 19 nt, Human
ugagcucaagugauccucu

SEQ ID NO: 119110 - RNA, 18 nt, Human
uguuuacauuuuuaguga

SEQ ID NO: 119111 - RNA, 18 nt, Human
uuaaagcuguuuacauuu

SEQ ID NO: 119112 - RNA, 25 nt, Human
uuccugagcucaagugauccucuca

SEQ ID NO: 119113 - RNA, 19 nt, Human
uuuacugcaacucuaaaac

SEQ ID NO: 119114 - RNA, 21 nt, Human
uuuuuagugaaacuucucuua

SEQ ID NO: 119115 - RNA, 24 nt, Human
aaaaacaaaaaaacaagccagaga

SEQ ID NO: 119116 - RNA, 25 nt, Human
aaaaacaaaaaaacaagccagagaa

SEQ ID NO: 119117 - RNA, 23 nt, Human
aaaacaaaaaaacaagccagaga

SEQ ID NO: 119118 - RNA, 24 nt, Human
aaacagaugugaggauaagaagac

SEQ ID NO: 119119 - RNA, 22 nt, Human
aaagcaaauaagccaaaggagg

SEQ ID NO: 119120 - RNA, 25 nt, Human
aaagcaaauaagccaaaggagguuu

SEQ ID NO: 119121 - RNA, 19 nt, Human
aacaaaaaaacaagccaga

SEQ ID NO: 119122 - RNA, 20 nt, Human
aacauggcaaaaccccgucu

SEQ ID NO: 119123 - RNA, 21 nt, Human
aacauggcaaaaccccgucuc

SEQ ID NO: 119124 - RNA, 22 nt, Human
aaugguaagaaaggcagcuaug

SEQ ID NO: 119125 - RNA, 24 nt, Human
aauugcuugaacccaagaggcgga

SEQ ID NO: 119126 - RNA, 19 nt, Human
acagguguaaaggugagaa

SEQ ID NO: 119127 - RNA, 22 nt, Human
acugcccuucaaaccaaaaugg

SEQ ID NO: 119128 - RNA, 21 nt, Human
agaaagaggccgggcauggug

SEQ ID NO: 119129 - RNA, 22 nt, Human
agaaaggagacuaaaaucugga

SEQ ID NO: 119130 - RNA, 23 nt, Human
agaaaggagacuaaaaucuggaa

SEQ ID NO: 119131 - RNA, 23 nt, Human
agacagcucuggcuuucuuccuu

SEQ ID NO: 119132 - RNA, 21 nt, Human
agacagguguaaaggugagaa

SEQ ID NO: 119133 - RNA, 22 nt, Human
agacuaaaaucuggaaaagcaa

SEQ ID NO: 119134 - RNA, 24 nt, Human
agagagcgagacuccaucucaaaa

SEQ ID NO: 119135 - RNA, 22 nt, Human
agaggcggagguugcagugagc

SEQ ID NO: 119136 - RNA, 19 nt, Human
agccacauuucugcacucu

SEQ ID NO: 119137 - RNA, 23 nt, Human
agccgggcgugguggcacaugcc

SEQ ID NO: 119138 - RNA, 18 nt, Human
agccuggccaacauggca

SEQ ID NO: 119139 - RNA, 24 nt, Human
agccuggccaacauggcaaaaccc

SEQ ID NO: 119140 - RNA, 24 nt, Human
agccugggcaagagagcgagacuc

SEQ ID NO: 119141 - RNA, 23 nt, Human
agcuaugaacauggggaagacaa

SEQ ID NO: 119142 - RNA, 24 nt, Human
agcuaugaacauggggaagacaag

SEQ ID NO: 119143 - RNA, 26 nt, Human
aggcagauggaucaucugaagucaag

SEQ ID NO: 119144 - RNA, 22 nt, Human
aggccgggcaugguggcucacg

SEQ ID NO: 119145 - RNA, 20 nt, Human
aggcggagguugcagugagc

SEQ ID NO: 119146 - RNA, 24 nt, Human
aggcggagguugcagugagcugag

SEQ ID NO: 119147 - RNA, 21 nt, Human
agguugcagugagcugagaac

SEQ ID NO: 119148 - RNA, 23 nt, Human
augcagcagaauugcuugaaccc

SEQ ID NO: 119149 - RNA, 22 nt, Human
auugcacuccagccugggcaag

SEQ ID NO: 119150 - RNA, 18 nt, Human
caaaaaaaaggugagaaa

SEQ ID NO: 119151 - RNA, 19 nt, Human
caacagccugggcuguugg

SEQ ID NO: 119152 - RNA, 24 nt, Human
caacauggcaaaaccccgucucuu

SEQ ID NO: 119153 - RNA, 22 nt, Human
cacgccuguaaucccagcacug

SEQ ID NO: 119154 - RNA, 23 nt, Human
cacuccagccugggcaagagagc

SEQ ID NO: 119155 - RNA, 24 nt, Human
cacuccagccugggcaagagagcg

SEQ ID NO: 119156 - RNA, 24 nt, Human
cagauggaucaucugaagucaaga

SEQ ID NO: 119157 - RNA, 22 nt, Human
cagcacugugggaggcccaagg

SEQ ID NO: 119158 - RNA, 25 nt, Human
cagcacugugggaggcccaaggcag

SEQ ID NO: 119159 - RNA, 21 nt, Human
cagcagaauugcuugaaccca

SEQ ID NO: 119160 - RNA, 18 nt, Human
cagcucuggcuuucuucc

SEQ ID NO: 119161 - RNA, 20 nt, Human
cauugcacuccagccugggc

SEQ ID NO: 119162 - RNA, 21 nt, Human
cauugcacuccagccugggca

SEQ ID NO: 119163 - RNA, 22 nt, Human
cauugcacuccagccugggcaa

SEQ ID NO: 119164 - RNA, 22 nt, Human
cauugcacuccagccugggcaa

SEQ ID NO: 119165 - RNA, 23 nt, Human
cauugcacuccagccugggcaag

SEQ ID NO: 119166 - RNA, 24 nt, Human
cauugcacuccagccugggcaaga

SEQ ID NO: 119167 - RNA, 24 nt, Human
ccaaggcagauggaucaucugaag

SEQ ID NO: 119168 - RNA, 27 nt, Human
ccaaggcagauggaucaucugaaguca

SEQ ID NO: 119169 - RNA, 20 nt, Human
ccauugcacuccagccuggg

SEQ ID NO: 119170 - RNA, 21 nt, Human
ccauugcacuccagccugggc

SEQ ID NO: 119171 - RNA, 22 nt, Human
ccauugcacuccagccugggca

SEQ ID NO: 119172 - RNA, 24 nt, Human
ccauugcacuccagccugggcaag

SEQ ID NO: 119173 - RNA, 22 nt, Human
cccagguacucgggaggcugau

SEQ ID NO: 119174 - RNA, 23 nt, Human
ccuggccaacauggcaaaacccc

SEQ ID NO: 119175 - RNA, 24 nt, Human
ccuggccaacauggcaaaaccccg

SEQ ID NO: 119176 - RNA, 22 nt, Human
ccugggcaagagagcgagacuc

SEQ ID NO: 119177 - RNA, 21 nt, Human
ccuguaaucccagcacugugg

SEQ ID NO: 119178 - RNA, 21 nt, Human
cgagaccagccuggccaacau

SEQ ID NO: 119179 - RNA, 23 nt, Human
cgagacuccaucucaaaaaaaag

SEQ ID NO: 119180 - RNA, 24 nt, Human
cgccuguaaucccagcacuguggg

SEQ ID NO: 119181 - RNA, 19 nt, Human
cucaaaaaaaaggugagaa

SEQ ID NO: 119182 - RNA, 22 nt, Human
cucacgccuguaaucccagcac

SEQ ID NO: 119183 - RNA, 23 nt, Human
cucacgccuguaaucccagcacu

SEQ ID NO: 119184 - RNA, 25 nt, Human
cucuggcuuucuuccuuuuccaacu

SEQ ID NO: 119185 - RNA, 24 nt, Human
cuggaaaagcaaauaagccaaagg

SEQ ID NO: 119186 - RNA, 18 nt, Human
gaaaggcagcuaugaaca

SEQ ID NO: 119187 - RNA, 22 nt, Human
gaccaagugaagaccauuguga

SEQ ID NO: 119188 - RNA, 23 nt, Human
gagaacgugccauugcacuccag

SEQ ID NO: 119189 - RNA, 23 nt, Human
gagaguaaagagaaggcucugag

SEQ ID NO: 119190 - RNA, 20 nt, Human
gagguugcagugagcugaga

SEQ ID NO: 119191 - RNA, 19 nt, Human
gaucaucugaagucaagag

SEQ ID NO: 119192 - RNA, 24 nt, Human
gaucaucugaagucaagaguucga

SEQ ID NO: 119193 - RNA, 23 nt, Human
gcaggugugaagauaggaaaggc

SEQ ID NO: 119194 - RNA, 21 nt, Human
gccaacauggcaaaaccccgu

SEQ ID NO: 119195 - RNA, 19 nt, Human
gccauugcacuccagccug

SEQ ID NO: 119196 - RNA, 22 nt, Human
gccauugcacuccagccugggc

SEQ ID NO: 119197 - RNA, 24 nt, Human
gccauugcacuccagccugggcaa

SEQ ID NO: 119198 - RNA, 23 nt, Human
gccugggcaagagagcgagacuc

SEQ ID NO: 119199 - RNA, 19 nt, Human
ggagaugcaaaguggggca

SEQ ID NO: 119200 - RNA, 21 nt, Human
ggagguugcagugagcugaga

SEQ ID NO: 119201 - RNA, 24 nt, Human
ggagguugcagugagcugagaacg

SEQ ID NO: 119202 - RNA, 20 nt, Human
ggaucaucugaagucaagaa

SEQ ID NO: 119203 - RNA, 21 nt, Human
ggcacaugccuguaaucccag

SEQ ID NO: 119204 - RNA, 23 nt, Human
ggcaugguggcucacgccuguaa

SEQ ID NO: 119205 - RNA, 23 nt, Human
ggcgugguggcacaugccuguaa

SEQ ID NO: 119206 - RNA, 21 nt, Human
gggaaaaacaaaaaaacaagc

SEQ ID NO: 119207 - RNA, 24 nt, Human
gguggcucacgccuguaaucccag

SEQ ID NO: 119208 - RNA, 18 nt, Human
gguguaaaggugagaaag

SEQ ID NO: 119209 - RNA, 23 nt, Human
guggcacaugccuguaaucccag

SEQ ID NO: 119210 - RNA, 23 nt, Human
guggcucacgccuguaaucccag

SEQ ID NO: 119211 - RNA, 24 nt, Human
guugcagugagcugagaacgugcc

SEQ ID NO: 119212 - RNA, 22 nt, Human
uaaaaauacaaaauuagccggg

SEQ ID NO: 119213 - RNA, 23 nt, Human
uaaaaauacaaaauuagccgggc

SEQ ID NO: 119214 - RNA, 19 nt, Human
uaagaaaggcagcuaugaa

SEQ ID NO: 119215 - RNA, 22 nt, Human
uagccgggcgugguggcacaug

SEQ ID NO: 119216 - RNA, 25 nt, Human
ucaaaaaaaaggugagaaagauagg

SEQ ID NO: 119217 - RNA, 27 nt, Human
ucaaaccaaaaugguaagaaaggcagu

SEQ ID NO: 119218 - RNA, 23 nt, Human
uccagccugggcaagagagcgag

SEQ ID NO: 119219 - RNA, 24 nt, Human
uccagccugggcaagagagcgaga

SEQ ID NO: 119220 - RNA, 24 nt, Human
uccugaacgccaagaggaagucuc

SEQ ID NO: 119221 - RNA, 19 nt, Human
ucgggaggcugaugcagca

SEQ ID NO: 119222 - RNA, 23 nt, Human
ucgggaggcugaugcagcagaau

SEQ ID NO: 119223 - RNA, 19 nt, Human
ucucuacucaacuuguuuu

SEQ ID NO: 119224 - RNA, 22 nt, Human
ucugaagucaagaguucgagac

SEQ ID NO: 119225 - RNA, 21 nt, Human
ugaggaagacagggaugaagg

SEQ ID NO: 119226 - RNA, 18 nt, Human
ugagguaucaacagccug

SEQ ID NO: 119227 - RNA, 19 nt, Human
ugcacuccagccugggcaa

SEQ ID NO: 119228 - RNA, 22 nt, Human
ugcacuccagccugggcaagag

SEQ ID NO: 119229 - RNA, 21 nt, Human
ugcagcagaauugcuugaacc

SEQ ID NO: 119230 - RNA, 23 nt, Human
ugccuguaaucccagguacucgg

SEQ ID NO: 119231 - RNA, 24 nt, Human
ugccuguaaucccagguacucggg

SEQ ID NO: 119232 - RNA, 24 nt, Human
uggaaaagcaaauaagccaaagga

SEQ ID NO: 119233 - RNA, 24 nt, Human
uggaucaucugaagucaagaguuc

SEQ ID NO: 119234 - RNA, 21 nt, Human
uggcacaugccuguaauccca

SEQ ID NO: 119235 - RNA, 22 nt, Human
uggcacaugccuguaaucccag

SEQ ID NO: 119236 - RNA, 22 nt, Human
uggcucacgccuguaaucccag

SEQ ID NO: 119237 - RNA, 24 nt, Human
uggcucacgccuguaaucccagca

SEQ ID NO: 119238 - RNA, 20 nt, Human
ugggaaaaacaaaaaaacaa

SEQ ID NO: 119239 - RNA, 21 nt, Human
ugggaaaaacaaaaaaacaag

SEQ ID NO: 119240 - RNA, 26 nt, Human
ugggaaaaacaaaaaaacaagccaga

SEQ ID NO: 119241 - RNA, 19 nt, Human
ugggaggcccaaggcagau

SEQ ID NO: 119242 - RNA, 25 nt, Human
ugggaggcccaaggcagauggauca

SEQ ID NO: 119243 - RNA, 24 nt, Human
ugguggcacaugccuguaauccca

SEQ ID NO: 119244 - RNA, 24 nt, Human
ugguggcucacgccuguaauccca

SEQ ID NO: 119245 - RNA, 19 nt, Human
ugugaaaacagaugugagg

SEQ ID NO: 119246 - RNA, 24 nt, Human
ugugaagauaggaaaggcaggcuc

SEQ ID NO: 119247 - RNA, 22 nt, Human
ugugaggcuggagaaauuuagc

SEQ ID NO: 119248 - RNA, 18 nt, Human
uuagccgggcgugguggc

SEQ ID NO: 119249 - RNA, 20 nt, Human
uuagccgggcgugguggcac

SEQ ID NO: 119250 - RNA, 24 nt, Human
uuagccgggcgugguggcacaugc

SEQ ID NO: 119251 - RNA, 24 nt, Human
uugaacccaagaggcggagguugc

SEQ ID NO: 119252 - RNA, 22 nt, Human
uugcagugagcugagaacgugc

SEQ ID NO: 119253 - RNA, 24 nt, Human
uugcuugaacccaagaggcggagg

SEQ ID NO: 119254 - RNA, 22 nt, Human
uuuuuuuuuuuuacucaauaaa

SEQ ID NO: 119255 - RNA, 24 nt, Human
aaaaaaacaccuuucacauguucu

SEQ ID NO: 119256 - RNA, 18 nt, Human
aacuugcaugaguucaua

SEQ ID NO: 119257 - RNA, 23 nt, Human
agaaaagcaaagcgucaccagga

SEQ ID NO: 119258 - RNA, 21 nt, Human
agaagaaaagcaaagcgucac

SEQ ID NO: 119259 - RNA, 23 nt, Human
agaaggaggcacuuucucaccaa

SEQ ID NO: 119260 - RNA, 19 nt, Human
agagguccugauccuggga

SEQ ID NO: 119261 - RNA, 25 nt, Human
aguucauauuggaaaaaaaaaacac

SEQ ID NO: 119262 - RNA, 22 nt, Human
cagaagaaaagcaaagcgucac

SEQ ID NO: 119263 - RNA, 18 nt, Human
ccugaaauccaggaguuc

SEQ ID NO: 119264 - RNA, 21 nt, Human
cugauccugggaagaaggagg

SEQ ID NO: 119265 - RNA, 19 nt, Human
gagugugugugcagaaugu

SEQ ID NO: 119266 - RNA, 30 nt, Human
gugugagagugugugugugugugugugugg

SEQ ID NO: 119267 - RNA, 20 nt, Human
gugugugugugugugugugu

SEQ ID NO: 119268 - RNA, 26 nt, Human
uaaaacuagugcgcucuaagggcaca

SEQ ID NO: 119269 - RNA, 23 nt, Human
ucugggcgagugugagagugugu

SEQ ID NO: 119270 - RNA, 22 nt, Human
ugggaagaaggaggcacuuucu

SEQ ID NO: 119271 - RNA, 26 nt, Human
ugugagugugugugcagaaugucucu

SEQ ID NO: 119272 - RNA, 18 nt, Human
ugugugagugugugugca

SEQ ID NO: 119273 - RNA, 22 nt, Human
ugugugagugugugugcagaau

SEQ ID NO: 119274 - RNA, 19 nt, Human
ugugugugcagaaugucuc

SEQ ID NO: 119275 - RNA, 20 nt, Human
ugugugugugugagugugug

SEQ ID NO: 119276 - RNA, 21 nt, Human
ugugugugugugagugugugu

SEQ ID NO: 119277 - RNA, 21 nt, Human
ugugugugugugagugugugu

SEQ ID NO: 119278 - RNA, 21 nt, Human
ugugugugugugugagugugu

SEQ ID NO: 119279 - RNA, 25 nt, Human
ugugugugugugugugagugugugu

SEQ ID NO: 119280 - RNA, 18 nt, Human
ugugugugugugugugug

SEQ ID NO: 119281 - RNA, 18 nt, Human
ugugugugugugugugug

SEQ ID NO: 119282 - RNA, 25 nt, Human
ugugugugugugugugugagugugu

SEQ ID NO: 119283 - RNA, 20 nt, Human
ugugugugugugugugugug

SEQ ID NO: 119284 - RNA, 21 nt, Human
ugugugugugugugugugugu

SEQ ID NO: 119285 - RNA, 21 nt, Human
ugugugugugugugugugugu

SEQ ID NO: 119286 - RNA, 22 nt, Human
ugugugugugugugugugugug

SEQ ID NO: 119287 - RNA, 19 nt, Human
uuggaagcuggagaucaag

SEQ ID NO: 119288 - RNA, 20 nt, Human
uuugucucugggcgagugug

SEQ ID NO: 119289 - RNA, 22 nt, Human
aaaaaugacuccgaggagggga

SEQ ID NO: 119290 - RNA, 22 nt, Human
aaacauuauuaucaaagagugc

SEQ ID NO: 119291 - RNA, 25 nt, Human
aaagaaacagagacagagaacuuaa

SEQ ID NO: 119292 - RNA, 21 nt, Human
aacaggaaaaaaugacuccga

SEQ ID NO: 119293 - RNA, 21 nt, Human
aaccggaggggaaugagcccc

SEQ ID NO: 119294 - RNA, 24 nt, Human
aacugcuuuccaucaaugaagaau

SEQ ID NO: 119295 - RNA, 19 nt, Human
acagaaaugucauuagaaa

SEQ ID NO: 119296 - RNA, 21 nt, Human
accaaggcggccccuaaagac

SEQ ID NO: 119297 - RNA, 24 nt, Human
acuccgaggaggggaccggagaag

SEQ ID NO: 119298 - RNA, 21 nt, Human
agaaccggaggggaaugagcc

SEQ ID NO: 119299 - RNA, 21 nt, Human
agacagagaacuuaacacaug

SEQ ID NO: 119300 - RNA, 25 nt, Human
agccccugucggcgacgcugucucu

SEQ ID NO: 119301 - RNA, 18 nt, Human
agccggcacggacggccc

SEQ ID NO: 119302 - RNA, 19 nt, Human
aggcgggggcgcuggaggc

SEQ ID NO: 119303 - RNA, 19 nt, Human
caaaacggcccgcccgagg

SEQ ID NO: 119304 - RNA, 24 nt, Human
caacaguauuccuccugaauguuu

SEQ ID NO: 119305 - RNA, 19 nt, Human
caaccgccuggaggcgacg

SEQ ID NO: 119306 - RNA, 22 nt, Human
caaggcggccccuaaagacaaa

SEQ ID NO: 119307 - RNA, 18 nt, Human
caccuucgcuuccaagag

SEQ ID NO: 119308 - RNA, 19 nt, Human
caguggaaagaugaaugga

SEQ ID NO: 119309 - RNA, 19 nt, Human
cccgcgcccgccgcaaccg

SEQ ID NO: 119310 - RNA, 23 nt, Human
cccggggcgugaggaaagggcgg

SEQ ID NO: 119311 - RNA, 20 nt, Human
ccgaggugagucaccgagga

SEQ ID NO: 119312 - RNA, 20 nt, Human
ccuccuuuuuucccacugac

SEQ ID NO: 119313 - RNA, 19 nt, Human
cgccacgacggcccgagcc

SEQ ID NO: 119314 - RNA, 19 nt, Human
cggcagagggggaacagga

SEQ ID NO: 119315 - RNA, 21 nt, Human
cggccccuaaagacaaaacgg

SEQ ID NO: 119316 - RNA, 24 nt, Human
cggccccuaaagacaaaacggccc

SEQ ID NO: 119317 - RNA, 22 nt, Human
cggcccgagccggcacggacgg

SEQ ID NO: 119318 - RNA, 21 nt, Human
cggcccgggagaaaggaccgg

SEQ ID NO: 119319 - RNA, 18 nt, Human
cugcaacaguauuccucc

SEQ ID NO: 119320 - RNA, 21 nt, Human
cugucggcgacgcugucucuc

SEQ ID NO: 119321 - RNA, 22 nt, Human
gaaaagcuauugaacuccccac

SEQ ID NO: 119322 - RNA, 25 nt, Human
gaaaagcuauugaacuccccaccaa

SEQ ID NO: 119323 - RNA, 23 nt, Human
gaaaccucgccccaccaaggcgg

SEQ ID NO: 119324 - RNA, 19 nt, Human
gagaaaggaccgggaacgg

SEQ ID NO: 119325 - RNA, 21 nt, Human
gagcucgagucgccacgacgg

SEQ ID NO: 119326 - RNA, 23 nt, Human
gcggguccuccacggagaaauuc

SEQ ID NO: 119327 - RNA, 20 nt, Human
ggaccggagaaggcgggggc

SEQ ID NO: 119328 - RNA, 18 nt, Human
ggagaaggcgggggcgcu

SEQ ID NO: 119329 - RNA, 18 nt, Human
ggcgcuggaggcgcagug

SEQ ID NO: 119330 - RNA, 18 nt, Human
gggaacaggaaaaaauga

SEQ ID NO: 119331 - RNA, 22 nt, Human
ggggaccggagaaggcgggggc

SEQ ID NO: 119332 - RNA, 18 nt, Human
uaaacaacaucaagaaaa

SEQ ID NO: 119333 - RNA, 25 nt, Human
uaacuuaauugaaaagcuauugaac

SEQ ID NO: 119334 - RNA, 30 nt, Human
uaagcaaauucucuugccaaguucuuuauu

SEQ ID NO: 119335 - RNA, 22 nt, Human
uacaaauuaccaauuguccucu

SEQ ID NO: 119336 - RNA, 20 nt, Human
uaucaaagagugcaaaguua

SEQ ID NO: 119337 - RNA, 18 nt, Human
ucacggaaaccucgcccc

SEQ ID NO: 119338 - RNA, 23 nt, Human
ucagcugcaacaguauuccuccu

SEQ ID NO: 119339 - RNA, 19 nt, Human
ucauagccgacaccuucgc

SEQ ID NO: 119340 - RNA, 19 nt, Human
uccaagagaauugccucac

SEQ ID NO: 119341 - RNA, 21 nt, Human
ucuaaaaaccuccuuuuuucc

SEQ ID NO: 119342 - RNA, 22 nt, Human
ucuaaaaaccuccuuuuuuccc

SEQ ID NO: 119343 - RNA, 29 nt, Human
ucuaaaaaccuccuuuuuucccacugacu

SEQ ID NO: 119344 - RNA, 23 nt, Human
ugacuccgaggaggggaccggag

SEQ ID NO: 119345 - RNA, 19 nt, Human
ugaggaaagggcggcagag

SEQ ID NO: 119346 - RNA, 20 nt, Human
ugaggaaagggcggcagagg

SEQ ID NO: 119347 - RNA, 23 nt, Human
ugggucuauacuaauugugacug

SEQ ID NO: 119348 - RNA, 22 nt, Human
uuaacacaugauacuuccacaa

SEQ ID NO: 119349 - RNA, 19 nt, Human
uuaacagaggcuacaauac

SEQ ID NO: 119350 - RNA, 18 nt, Human
uuccaagagaauugccuc

SEQ ID NO: 119351 - RNA, 18 nt, Human
uuuacauuaagcaaauuc

SEQ ID NO: 119352 - RNA, 24 nt, Human
uuuuuuuuuuuuuuuuucauauuu

SEQ ID NO: 119353 - RNA, 23 nt, Human
aaaaauccaaacaggaaucagcc

SEQ ID NO: 119354 - RNA, 23 nt, Human
aaacaagugaauauucacaaagg

SEQ ID NO: 119355 - RNA, 21 nt, Human
aaaccucccaccuacugcucc

SEQ ID NO: 119356 - RNA, 23 nt, Human
aacacaccuucccagcaauagaa

SEQ ID NO: 119357 - RNA, 18 nt, Human
aaccuggucuccuccugg

SEQ ID NO: 119358 - RNA, 20 nt, Human
aagcccccaacccaaugcuc

SEQ ID NO: 119359 - RNA, 22 nt, Human
aaggaacaaugacagcugggau

SEQ ID NO: 119360 - RNA, 19 nt, Human
acaaguccaggacaggccc

SEQ ID NO: 119361 - RNA, 21 nt, Human
acacacacacacacguaccac

SEQ ID NO: 119362 - RNA, 21 nt, Human
acacacacacacacguaccac

SEQ ID NO: 119363 - RNA, 22 nt, Human
acacacacacacguaccacaca

SEQ ID NO: 119364 - RNA, 31 nt, Human
acacacacguaccacacacgcacacacacag

SEQ ID NO: 119365 - RNA, 26 nt, Human
acacaccuucccagcaauagaaaauc

SEQ ID NO: 119366 - RNA, 31 nt, Human
acacacgcacacacacacacacacuuugugg

SEQ ID NO: 119367 - RNA, 21 nt, Human
acacgcacacacacacacaca

SEQ ID NO: 119368 - RNA, 23 nt, Human
acaguaccaggcauaccccacac

SEQ ID NO: 119369 - RNA, 22 nt, Human
accacacacgcacacacacaca

SEQ ID NO: 119370 - RNA, 23 nt, Human
accacucccuccucugcacacgc

SEQ ID NO: 119371 - RNA, 18 nt, Human
acccugcccuucccucuu

SEQ ID NO: 119372 - RNA, 23 nt, Human
accugagcugggagaagggaggc

SEQ ID NO: 119373 - RNA, 19 nt, Human
acgcacacacacacacaca

SEQ ID NO: 119374 - RNA, 20 nt, Human
acggagcaagggcucugcag

SEQ ID NO: 119375 - RNA, 23 nt, Human
acgugaggagggagggaaggagg

SEQ ID NO: 119376 - RNA, 19 nt, Human
acuggcgugcuacagguac

SEQ ID NO: 119377 - RNA, 24 nt, Human
acuuuguggcucaagugcaggcca

SEQ ID NO: 119378 - RNA, 19 nt, Human
agaaagcaggaacucagca

SEQ ID NO: 119379 - RNA, 27 nt, Human
agacuagaaugguuucccuggcugggu

SEQ ID NO: 119380 - RNA, 20 nt, Human
agcagggcucuggcugccuc

SEQ ID NO: 119381 - RNA, 24 nt, Human
agcauccauccacuccggccugcu

SEQ ID NO: 119382 - RNA, 20 nt, Human
agccuugugucuggaggccc

SEQ ID NO: 119383 - RNA, 19 nt, Human
aggacagugagggacaggg

SEQ ID NO: 119384 - RNA, 21 nt, Human
aggugugcugucuuaggcucc

SEQ ID NO: 119385 - RNA, 18 nt, Human
aguccuuggagcucagcu

SEQ ID NO: 119386 - RNA, 18 nt, Human
agugagggacagggcugg

SEQ ID NO: 119387 - RNA, 19 nt, Human
auggccucaugcucagucc

SEQ ID NO: 119388 - RNA, 20 nt, Human
caaggacagaggacagugag

SEQ ID NO: 119389 - RNA, 18 nt, Human
cacaaacaggcacaccac

SEQ ID NO: 119390 - RNA, 20 nt, Human
cacacaaacaggcacaccac

SEQ ID NO: 119391 - RNA, 21 nt, Human
cacacacaaacaggcacacca

SEQ ID NO: 119392 - RNA, 18 nt, Human
cacacacacacuuugugg

SEQ ID NO: 119393 - RNA, 20 nt, Human
cacacgcacacacacacaca

SEQ ID NO: 119394 - RNA, 18 nt, Human
caccauggagcuccaggc

SEQ ID NO: 119395 - RNA, 30 nt, Human
cacguaccacacacgcacacacacacacag

SEQ ID NO: 119396 - RNA, 18 nt, Human
cacuccuggaaugcaagg

SEQ ID NO: 119397 - RNA, 23 nt, Human
cacugcaaccuggucuccuccug

SEQ ID NO: 119398 - RNA, 21 nt, Human
cagaaucccagcuaggguccu

SEQ ID NO: 119399 - RNA, 19 nt, Human
cagaggccagguggcuacg

SEQ ID NO: 119400 - RNA, 29 nt, Human
cagaugcaugcacacacaaacaggcacag

SEQ ID NO: 119401 - RNA, 20 nt, Human
cagccacccccgcuccgccc

SEQ ID NO: 119402 - RNA, 22 nt, Human
cagccacccccgcuccgccccg

SEQ ID NO: 119403 - RNA, 18 nt, Human
cagccagaacugcugugc

SEQ ID NO: 119404 - RNA, 18 nt, Human
cagcuccuggguaggcuc

SEQ ID NO: 119405 - RNA, 19 nt, Human
caggaagaagccugucagu

SEQ ID NO: 119406 - RNA, 22 nt, Human
caggacaggcccuggaagccaa

SEQ ID NO: 119407 - RNA, 19 nt, Human
cagggccaccugagcuggg

SEQ ID NO: 119408 - RNA, 24 nt, Human
cauaccccacaccagucagguauc

SEQ ID NO: 119409 - RNA, 24 nt, Human
caugaagccaccauggagcuccag

SEQ ID NO: 119410 - RNA, 24 nt, Human
ccacugcaaccuggucuccuccug

SEQ ID NO: 119411 - RNA, 28 nt, Human
ccaggacaggcccuggaagccaacagaa

SEQ ID NO: 119412 - RNA, 19 nt, Human
ccagucagguaucugugug

SEQ ID NO: 119413 - RNA, 20 nt, Human
cccaacccaaugcucugaau

SEQ ID NO: 119414 - RNA, 22 nt, Human
cccagaagcccaaggaagggcc

SEQ ID NO: 119415 - RNA, 21 nt, Human
ccccuucacagcuccugggua

SEQ ID NO: 119416 - RNA, 21 nt, Human
cccucucuacccugcccuucc

SEQ ID NO: 119417 - RNA, 19 nt, Human
cccuggaagccaacagaau

SEQ ID NO: 119418 - RNA, 28 nt, Human
ccucauagccacacacacacacacguag

SEQ ID NO: 119419 - RNA, 19 nt, Human
ccuggcugggugucagcug

SEQ ID NO: 119420 - RNA, 23 nt, Human
cgagccuugugucuggaggccgg

SEQ ID NO: 119421 - RNA, 23 nt, Human
cguaccacacacgcacacacagg

SEQ ID NO: 119422 - RNA, 18 nt, Human
cucacuggcagcacugug

SEQ ID NO: 119423 - RNA, 19 nt, Human
cucacuggcagcacugugg

SEQ ID NO: 119424 - RNA, 19 nt, Human
cucauagccacacacacac

SEQ ID NO: 119425 - RNA, 28 nt, Human
cucauagccacacacacacacacguacc

SEQ ID NO: 119426 - RNA, 21 nt, Human
cucugcugcugcgguggcugc

SEQ ID NO: 119427 - RNA, 19 nt, Human
cugcaaccuggucuccucc

SEQ ID NO: 119428 - RNA, 20 nt, Human
cugggccucggccuuuggcc

SEQ ID NO: 119429 - RNA, 20 nt, Human
cuggggcugagggaacaggg

SEQ ID NO: 119430 - RNA, 19 nt, Human
cuuucuggcaguggcccga

SEQ ID NO: 119431 - RNA, 21 nt, Human
gaaacacaccuucccagcaau

SEQ ID NO: 119432 - RNA, 22 nt, Human
gacagcauccauccacuccggc

SEQ ID NO: 119433 - RNA, 23 nt, Human
gacccuugccccuucacagcucc

SEQ ID NO: 119434 - RNA, 18 nt, Human
gagcugggagaagggagg

SEQ ID NO: 119435 - RNA, 19 nt, Human
gaggacagugagggacagg

SEQ ID NO: 119436 - RNA, 21 nt, Human
gaggacagugagggacagggc

SEQ ID NO: 119437 - RNA, 21 nt, Human
gauagcugacauggcagucug

SEQ ID NO: 119438 - RNA, 23 nt, Human
gcacacacaaacaggcacaccac

SEQ ID NO: 119439 - RNA, 27 nt, Human
gcacacgcgcacacacacacacauggu

SEQ ID NO: 119440 - RNA, 19 nt, Human
gccagagaaaccagggggc

SEQ ID NO: 119441 - RNA, 18 nt, Human
gcccugcuccccucccac

SEQ ID NO: 119442 - RNA, 18 nt, Human
gccuuggaguguggccag

SEQ ID NO: 119443 - RNA, 23 nt, Human
gcgcacacacacacacaugcucg

SEQ ID NO: 119444 - RNA, 25 nt, Human
gcgcacacacacacacaugcucgcu

SEQ ID NO: 119445 - RNA, 23 nt, Human
gcggaggugguccugccaaccug

SEQ ID NO: 119446 - RNA, 21 nt, Human
gcugcugcgguggcugcuugg

SEQ ID NO: 119447 - RNA, 19 nt, Human
ggaaggaagaggugggagg

SEQ ID NO: 119448 - RNA, 26 nt, Human
ggagggaaggaggucuaggggucgac

SEQ ID NO: 119449 - RNA, 21 nt, Human
ggcaguggcccgauucucuuu

SEQ ID NO: 119450 - RNA, 21 nt, Human
ggcaugaagccaccauggagc

SEQ ID NO: 119451 - RNA, 18 nt, Human
ggccacaggguggaagga

SEQ ID NO: 119452 - RNA, 19 nt, Human
ggcugagaaaaccugagga

SEQ ID NO: 119453 - RNA, 18 nt, Human
gggaagagagccagcagc

SEQ ID NO: 119454 - RNA, 20 nt, Human
gggaaggaggucuagggagg

SEQ ID NO: 119455 - RNA, 19 nt, Human
gggagaagggaggcaugaa

SEQ ID NO: 119456 - RNA, 18 nt, Human
gggcuggggccaaaagaa

SEQ ID NO: 119457 - RNA, 23 nt, Human
ggucacaggggagguagaaagga

SEQ ID NO: 119458 - RNA, 22 nt, Human
guagaaaggaaaaggcccaaag

SEQ ID NO: 119459 - RNA, 24 nt, Human
gucaaaccucccaccuacugcucc

SEQ ID NO: 119460 - RNA, 19 nt, Human
gucacaggggagguagaaa

SEQ ID NO: 119461 - RNA, 20 nt, Human
gucagaaagcaggaacucag

SEQ ID NO: 119462 - RNA, 23 nt, Human
gucuggaugcugacaaguccagg

SEQ ID NO: 119463 - RNA, 24 nt, Human
uaacagaucugaggcuaggaaagg

SEQ ID NO: 119464 - RNA, 21 nt, Human
uaccacacacgcacacacaca

SEQ ID NO: 119465 - RNA, 26 nt, Human
uacccugcccuucccucuuggcucca

SEQ ID NO: 119466 - RNA, 22 nt, Human
uacucccccagcccaggcaaca

SEQ ID NO: 119467 - RNA, 18 nt, Human
uacuggacauacccucuc

SEQ ID NO: 119468 - RNA, 19 nt, Human
uacugggauagcugacaug

SEQ ID NO: 119469 - RNA, 21 nt, Human
uauaaagugcauuuugccugc

SEQ ID NO: 119470 - RNA, 22 nt, Human
ucaaaccucccaccuacugcuc

SEQ ID NO: 119471 - RNA, 21 nt, Human
ucagacaaggcagcuggcuug

SEQ ID NO: 119472 - RNA, 19 nt, Human
ucagguaucuguguguacu

SEQ ID NO: 119473 - RNA, 22 nt, Human
ucagucccagaagcccaaggaa

SEQ ID NO: 119474 - RNA, 21 nt, Human
uccaggucagaaagcaggaac

SEQ ID NO: 119475 - RNA, 19 nt, Human
ucccaccuacugcuccugg

SEQ ID NO: 119476 - RNA, 22 nt, Human
ucccucugccugaguccuugga

SEQ ID NO: 119477 - RNA, 23 nt, Human
ucccucugccugaguccuuggag

SEQ ID NO: 119478 - RNA, 19 nt, Human
ucccucuuggcuccaggag

SEQ ID NO: 119479 - RNA, 21 nt, Human
uccuggaaugcaaggauuggc

SEQ ID NO: 119480 - RNA, 22 nt, Human
uccuggguaggcucugaggcug

SEQ ID NO: 119481 - RNA, 19 nt, Human
ucucagauuugcccuucca

SEQ ID NO: 119482 - RNA, 20 nt, Human
ucucgacuggggcugaggga

SEQ ID NO: 119483 - RNA, 23 nt, Human
ucucuauaaagugcauuuugccu

SEQ ID NO: 119484 - RNA, 22 nt, Human
ucucuuuccucucgacuggggc

SEQ ID NO: 119485 - RNA, 28 nt, Human
ucugcacacgcgcacacacacacacagu

SEQ ID NO: 119486 - RNA, 20 nt, Human
ucugcugcugcgguggcugc

SEQ ID NO: 119487 - RNA, 19 nt, Human
ugacagcugggauucucuu

SEQ ID NO: 119488 - RNA, 20 nt, Human
ugagggaacagggaagcccc

SEQ ID NO: 119489 - RNA, 18 nt, Human
ugccuccagaaucccaug

SEQ ID NO: 119490 - RNA, 20 nt, Human
ugccugaguccuuggagcuc

SEQ ID NO: 119491 - RNA, 22 nt, Human
ugccugaguccuuggagcucag

SEQ ID NO: 119492 - RNA, 20 nt, Human
uggaaggaaugguguucugg

SEQ ID NO: 119493 - RNA, 18 nt, Human
uggcagugggaaggaaga

SEQ ID NO: 119494 - RNA, 21 nt, Human
uggcucaagugcaggccacag

SEQ ID NO: 119495 - RNA, 23 nt, Human
ugggacugagcccaguagcagag

SEQ ID NO: 119496 - RNA, 23 nt, Human
ugggaggcacaggccacuccugg

SEQ ID NO: 119497 - RNA, 23 nt, Human
ugggcacccaggcuuugcucacg

SEQ ID NO: 119498 - RNA, 19 nt, Human
uggguguaaucucuacuug

SEQ ID NO: 119499 - RNA, 24 nt, Human
uggugccuuggaguguggccagag

SEQ ID NO: 119500 - RNA, 21 nt, Human
ugguggagaaguaggcggagg

SEQ ID NO: 119501 - RNA, 24 nt, Human
uguccagacugcuccagccacccc

SEQ ID NO: 119502 - RNA, 18 nt, Human
uguuccgagggagcccuc

SEQ ID NO: 119503 - RNA, 18 nt, Human
uugccccuucacagcucc

SEQ ID NO: 119504 - RNA, 24 nt, Human
aagccccggccccacgggccucac

SEQ ID NO: 119505 - RNA, 20 nt, Human
aaggaaaaaagggaagcaaa

SEQ ID NO: 119506 - RNA, 23 nt, Human
acccugagacccuaagcucuccu

SEQ ID NO: 119507 - RNA, 18 nt, Human
acgggccucacgcgcccc

SEQ ID NO: 119508 - RNA, 24 nt, Human
acgggccucacgcgccccaggagg

SEQ ID NO: 119509 - RNA, 19 nt, Human
agacagacaccccgcccuc

SEQ ID NO: 119510 - RNA, 19 nt, Human
aggaaaaaagggaagcaaa

SEQ ID NO: 119511 - RNA, 20 nt, Human
aggaagacggucugagagaa

SEQ ID NO: 119512 - RNA, 18 nt, Human
aggugcacagaagccccg

SEQ ID NO: 119513 - RNA, 22 nt, Human
cagcggggccucugggcagcgc

SEQ ID NO: 119514 - RNA, 18 nt, Human
caggagucagcggggccc

SEQ ID NO: 119515 - RNA, 20 nt, Human
cauguccccaagagcggcac

SEQ ID NO: 119516 - RNA, 25 nt, Human
ccacggggaccuggaggcuggcagg

SEQ ID NO: 119517 - RNA, 24 nt, Human
ccacuggccggugucggggucugg

SEQ ID NO: 119518 - RNA, 21 nt, Human
ccccaggggagccaggcugcu

SEQ ID NO: 119519 - RNA, 25 nt, Human
ccccgcccucagggugcucccccca

SEQ ID NO: 119520 - RNA, 20 nt, Human
ccgcggagggaggcugcagg

SEQ ID NO: 119521 - RNA, 23 nt, Human
ccugagacccuaagcucuccugg

SEQ ID NO: 119522 - RNA, 22 nt, Human
ccuggccggaggucacccccuc

SEQ ID NO: 119523 - RNA, 22 nt, Human
cgccgcggagggaggcugcagg

SEQ ID NO: 119524 - RNA, 20 nt, Human
cggagggaggcugcaggugu

SEQ ID NO: 119525 - RNA, 22 nt, Human
cucuccuggcugcucucucaaa

SEQ ID NO: 119526 - RNA, 21 nt, Human
cugcaccccaggggagccagg

SEQ ID NO: 119527 - RNA, 21 nt, Human
cuggcaggagucagcggggcc

SEQ ID NO: 119528 - RNA, 22 nt, Human
gaagaggccgcgagagcccagg

SEQ ID NO: 119529 - RNA, 21 nt, Human
gacccauguccccaagagcgg

SEQ ID NO: 119530 - RNA, 25 nt, Human
gagaagguggaaaggaaaaaaggga

SEQ ID NO: 119531 - RNA, 18 nt, Human
gcacagaagccccggccc

SEQ ID NO: 119532 - RNA, 21 nt, Human
gcaccccaggggagccaggcu

SEQ ID NO: 119533 - RNA, 18 nt, Human
ggaccuggaggcuggcag

SEQ ID NO: 119534 - RNA, 21 nt, Human
ggggaccuggaggcuggcagg

SEQ ID NO: 119535 - RNA, 18 nt, Human
gucacccccuccuucugg

SEQ ID NO: 119536 - RNA, 22 nt, Human
gucacccccuccuucuggaccc

SEQ ID NO: 119537 - RNA, 19 nt, Human
uaucuaaaggagugugagg

SEQ ID NO: 119538 - RNA, 23 nt, Human
uccuggcugcucucucaaacccu

SEQ ID NO: 119539 - RNA, 26 nt, Human
ugaggcgccugcaccccaggggagcc

SEQ ID NO: 119540 - RNA, 18 nt, Human
uggaaaggaaaaaaggga

SEQ ID NO: 119541 - RNA, 19 nt, Human
ugggcagggcccgccgcgg

SEQ ID NO: 119542 - RNA, 19 nt, Human
ugggccagggcugcagggg

SEQ ID NO: 119543 - RNA, 23 nt, Human
uguccccaagagcggcacuacau

SEQ ID NO: 119544 - RNA, 19 nt, Human
ugucggggucugggacacc

SEQ ID NO: 119545 - RNA, 25 nt, Human
ugugucaggaggcaccuggccggag

SEQ ID NO: 119546 - RNA, 20 nt, Human
uugccgcgggcugcgcucuc

SEQ ID NO: 119547 - RNA, 20 nt, Human
aagcuucagcacuagucaca

SEQ ID NO: 119548 - RNA, 21 nt, Human
uaagcuucagcacuagucaca

SEQ ID NO: 119549 - RNA, 21 nt, Human
ugaaugauauuuuauuagcuu

SEQ ID NO: 119550 - RNA, 22 nt, Human
ugcccuuagcauuaauaagcuu

SEQ ID NO: 119551 - RNA, 19 nt, Human
uggcuaggugagugugagg

SEQ ID NO: 119552 - RNA, 21 nt, Human
uucuuguuuuaaaaaaugcaa

SEQ ID NO: 119553 - RNA, 20 nt, Human
ugucugugagcagaacauaa

SEQ ID NO: 119554 - RNA, 21 nt, Human
agagggcauucaccggguggg

SEQ ID NO: 119555 - RNA, 19 nt, Human
aggaaccuuuauugagugu

SEQ ID NO: 119556 - RNA, 19 nt, Human
cccgcgcuccccucccuuc

SEQ ID NO: 119557 - RNA, 19 nt, Human
cccucccuuccccacccca

SEQ ID NO: 119558 - RNA, 22 nt, Human
cucccuuccccaccccagcaga

SEQ ID NO: 119559 - RNA, 23 nt, Human
cucgcagucuucccgcgcucccc

SEQ ID NO: 119560 - RNA, 18 nt, Human
cuggacccggcugccagg

SEQ ID NO: 119561 - RNA, 26 nt, Human
gagggcauucaccgggugggugagcg

SEQ ID NO: 119562 - RNA, 18 nt, Human
gaguguccucagggaagg

SEQ ID NO: 119563 - RNA, 21 nt, Human
gauucaggaaccuuuauugag

SEQ ID NO: 119564 - RNA, 22 nt, Human
gccccguuucgagccacacaca

SEQ ID NO: 119565 - RNA, 21 nt, Human
gcuccccucccuuccccaccc

SEQ ID NO: 119566 - RNA, 23 nt, Human
uauugaguguccucagggaaggu

SEQ ID NO: 119567 - RNA, 19 nt, Human
ugaguguccucagggaagg

SEQ ID NO: 119568 - RNA, 21 nt, Human
ugaguguccucagggaaggug

SEQ ID NO: 119569 - RNA, 19 nt, Human
ugccaggggcucgcagucu

SEQ ID NO: 119570 - RNA, 21 nt, Human
uggcaggaagauucaggaacc

SEQ ID NO: 119571 - RNA, 23 nt, Human
uuuggcaggaagauucaggaacc

SEQ ID NO: 119572 - RNA, 23 nt, Human
uuuuuuuuuuuuuuuuuggcagg

SEQ ID NO: 119573 - RNA, 20 nt, Human
uuuuuuuuuuuuuuuuuugg

SEQ ID NO: 119574 - RNA, 21 nt, Human
aaggagagaacacaccacagc

SEQ ID NO: 119575 - RNA, 19 nt, Human
acaccacagccuccagagc

SEQ ID NO: 119576 - RNA, 20 nt, Human
accacagccuccagagcgcc

SEQ ID NO: 119577 - RNA, 21 nt, Human
agagaacacaccacagccucc

SEQ ID NO: 119578 - RNA, 18 nt, Human
agauaaggcacgcaugcg

SEQ ID NO: 119579 - RNA, 19 nt, Human
agguuacagggggaggcag

SEQ ID NO: 119580 - RNA, 21 nt, Human
cacaccacagccuccagagcg

SEQ ID NO: 119581 - RNA, 18 nt, Human
cacagguuacagggggag

SEQ ID NO: 119582 - RNA, 22 nt, Human
ccuccagagcgccuccauugca

SEQ ID NO: 119583 - RNA, 18 nt, Human
cuuccgagauaggcccag

SEQ ID NO: 119584 - RNA, 23 nt, Human
gcacgcaugcgcuccuccgugcc

SEQ ID NO: 119585 - RNA, 23 nt, Human
uuuuuugugcugacugugcacgg

SEQ ID NO: 119586 - RNA, 21 nt, Human
acuugcuacuuccugcuggag

SEQ ID NO: 119587 - RNA, 19 nt, Human
caggcaggcgggcaggugc

SEQ ID NO: 119588 - RNA, 22 nt, Human
cccgccugcaaaagucugggga

SEQ ID NO: 119589 - RNA, 18 nt, Human
gacaggcaggcgggcagg

SEQ ID NO: 119590 - RNA, 23 nt, Human
uccugcuggaggacaggcaggcg

SEQ ID NO: 119591 - RNA, 18 nt, Human
aaggaggcauggugggga

SEQ ID NO: 119592 - RNA, 22 nt, Human
aaggaggcaugguggggagggc

SEQ ID NO: 119593 - RNA, 24 nt, Human
aggucuggaggguuccugggcagc

SEQ ID NO: 119594 - RNA, 20 nt, Human
cacuuuauucuucacuugga

SEQ ID NO: 119595 - RNA, 18 nt, Human
ccugggcagcagaccugg

SEQ ID NO: 119596 - RNA, 18 nt, Human
gaaggaggcauggugggg

SEQ ID NO: 119597 - RNA, 23 nt, Human
gaccuggguccugggaaggaggc

SEQ ID NO: 119598 - RNA, 22 nt, Human
ggaaggaggcaugguggggagg

SEQ ID NO: 119599 - RNA, 22 nt, Human
ggaaggaggcaugguggggagg

SEQ ID NO: 119600 - RNA, 24 nt, Human
gggaaggaggcaugguggggaggg

SEQ ID NO: 119601 - RNA, 23 nt, Human
gggcagcagaccuggguccuggg

SEQ ID NO: 119602 - RNA, 24 nt, Human
gggcagcagaccuggguccuggga

SEQ ID NO: 119603 - RNA, 18 nt, Human
gucuggaggguuccuggg

SEQ ID NO: 119604 - RNA, 19 nt, Human
ugggaaggaggcauggugg

SEQ ID NO: 119605 - RNA, 26 nt, Human
acccuggagccuccucuucuugcccu

SEQ ID NO: 119606 - RNA, 23 nt, Human
accucuggcuguugcuguagccu

SEQ ID NO: 119607 - RNA, 22 nt, Human
agaggagccacggccgucugca

SEQ ID NO: 119608 - RNA, 18 nt, Human
ccccagggugggucuggg

SEQ ID NO: 119609 - RNA, 21 nt, Human
cccccagggugggucuggguc

SEQ ID NO: 119610 - RNA, 20 nt, Human
ccucuggcuguugcuguagc

SEQ ID NO: 119611 - RNA, 21 nt, Human
ccuugcagccccccagggugg

SEQ ID NO: 119612 - RNA, 18 nt, Human
cggcccucgccccaaccc

SEQ ID NO: 119613 - RNA, 24 nt, Human
cucgccccaacccuggagccuccc

SEQ ID NO: 119614 - RNA, 24 nt, Human
gccccaacccuggagccuccucuu

SEQ ID NO: 119615 - RNA, 20 nt, Human
ggggaccaaccccaggcuuu

SEQ ID NO: 119616 - RNA, 21 nt, Human
uauugagcagauuccagggaa

SEQ ID NO: 119617 - RNA, 23 nt, Human
uccccaggaacaccucuggcugu

SEQ ID NO: 119618 - RNA, 25 nt, Human
ugauagggacaaaggggcaacuggu

SEQ ID NO: 119619 - RNA, 18 nt, Human
uggcaaaaacaacacaaa

SEQ ID NO: 119620 - RNA, 23 nt, Human
uggcaaaaacaacacaaaaggga

SEQ ID NO: 119621 - RNA, 18 nt, Human
aaggagaaaaguggaaaa

SEQ ID NO: 119622 - RNA, 23 nt, Human
uuuaaaggagaaaaguggaaaac

SEQ ID NO: 119623 - RNA, 22 nt, Human
aagaacaacacaaaaggggccg

SEQ ID NO: 119624 - RNA, 19 nt, Human
cugcacagccagucuauau

SEQ ID NO: 119625 - RNA, 21 nt, Human
gcugcugcguuggcaagaaca

SEQ ID NO: 119626 - RNA, 18 nt, Human
uggcaagaacaacacaaa

SEQ ID NO: 119627 - RNA, 21 nt, Human
agaaacaacaaaggaggaccg

SEQ ID NO: 119628 - RNA, 27 nt, Human
aaagaucuagauuggugauccucuagg

SEQ ID NO: 119629 - RNA, 21 nt, Human
aagcauuuaaggagaggcauu

SEQ ID NO: 119630 - RNA, 20 nt, Human
aggcauuauagucagcagug

SEQ ID NO: 119631 - RNA, 30 nt, Human
cacaaggccagccagcauuugggccccagg

SEQ ID NO: 119632 - RNA, 27 nt, Human
cacuguggcgagcacuguauugcuggu

SEQ ID NO: 119633 - RNA, 24 nt, Human
cagcagugggaugcaugccaacug

SEQ ID NO: 119634 - RNA, 18 nt, Human
cauuuuguuuggcacaaa

SEQ ID NO: 119635 - RNA, 20 nt, Human
ccaacuguuuuauugaugau

SEQ ID NO: 119636 - RNA, 19 nt, Human
cuggcagauggguagcuuu

SEQ ID NO: 119637 - RNA, 23 nt, Human
cuuugugugacugcccacugugg

SEQ ID NO: 119638 - RNA, 20 nt, Human
uagauuggugaucuggcaga

SEQ ID NO: 119639 - RNA, 22 nt, Human
uauugcuggucccuagaagcau

SEQ ID NO: 119640 - RNA, 18 nt, Human
uauuuggaccacaaggcc

SEQ ID NO: 119641 - RNA, 18 nt, Human
ucuaaccuuuuaaugaga

SEQ ID NO: 119642 - RNA, 21 nt, Human
uggugcauagacugguuuucc

SEQ ID NO: 119643 - RNA, 18 nt, Human
ugugugacugcccacugu

SEQ ID NO: 119644 - RNA, 23 nt, Human
uguuuuauugaugaugccuauuu

SEQ ID NO: 119645 - RNA, 24 nt, Human
aagcacaaaaggagaguucacugg

SEQ ID NO: 119646 - RNA, 20 nt, Human
agaaauuaugagaaccagca

SEQ ID NO: 119647 - RNA, 22 nt, Human
agaacagaagaaauggcuaccu

SEQ ID NO: 119648 - RNA, 25 nt, Human
caacuacaaacauaaaugaggaucu

SEQ ID NO: 119649 - RNA, 21 nt, Human
ccagcagcaauauuccucaag

SEQ ID NO: 119650 - RNA, 19 nt, Human
cucaagcauccaucucaac

SEQ ID NO: 119651 - RNA, 18 nt, Human
gcagcaauauuccucaag

SEQ ID NO: 119652 - RNA, 18 nt, Human
ggacucccucauuuacuc

SEQ ID NO: 119653 - RNA, 24 nt, Human
uaugagaaccagcagcaauauucc

SEQ ID NO: 119654 - RNA, 27 nt, Human
ugauaagcacaaaaggagaguucacug

SEQ ID NO: 119655 - RNA, 22 nt, Human
uucagggaaauauaaagggaaa

SEQ ID NO: 119656 - RNA, 23 nt, Human
aaacacaucuauuauuuacaaca

SEQ ID NO: 119657 - RNA, 19 nt, Human
acccaauaaaaauauucac

SEQ ID NO: 119658 - RNA, 18 nt, Human
uuuuuuuuuuuuuuuuug

SEQ ID NO: 119659 - RNA, 24 nt, Human
uuuuuuuuuuuuuuuuuggcgcuu

SEQ ID NO: 119660 - RNA, 22 nt, Human
uuuuuuuuuuuuuuuuuuuggc

SEQ ID NO: 119661 - RNA, 20 nt, Human
aaaagacuuacacauccaaa

SEQ ID NO: 119662 - RNA, 19 nt, Human
aagguaaguaggcuugaaa

SEQ ID NO: 119663 - RNA, 23 nt, Human
aaugcacacucaugccaaaugac

SEQ ID NO: 119664 - RNA, 26 nt, Human
acaaaaauauuugacccucaccagaa

SEQ ID NO: 119665 - RNA, 24 nt, Human
acccucaccagaaaaacagauaac

SEQ ID NO: 119666 - RNA, 20 nt, Human
acuagagaaccuuuauaaag

SEQ ID NO: 119667 - RNA, 23 nt, Human
acucuaaaucuacucugaaaauc

SEQ ID NO: 119668 - RNA, 21 nt, Human
agacaaaugcagauaauucuu

SEQ ID NO: 119669 - RNA, 22 nt, Human
agauuaguuuagaauagagguu

SEQ ID NO: 119670 - RNA, 22 nt, Human
aguucagaaaauguucaaaguc

SEQ ID NO: 119671 - RNA, 18 nt, Human
aguuuagaauagagguuu

SEQ ID NO: 119672 - RNA, 22 nt, Human
caccagaaaaacagauaacucu

SEQ ID NO: 119673 - RNA, 24 nt, Human
caccagaaaaacagauaacucuaa

SEQ ID NO: 119674 - RNA, 22 nt, Human
cagucuuauuuugaacuagcau

SEQ ID NO: 119675 - RNA, 23 nt, Human
ccacagaaaugaggacugccaca

SEQ ID NO: 119676 - RNA, 23 nt, Human
ccucaccagaaaaacagauaacu

SEQ ID NO: 119677 - RNA, 24 nt, Human
cuagcauguuuuaaucaaagguau

SEQ ID NO: 119678 - RNA, 22 nt, Human
gagcagucuuauuuugaacuag

SEQ ID NO: 119679 - RNA, 19 nt, Human
ggaaugcacacucaugcca

SEQ ID NO: 119680 - RNA, 22 nt, Human
uacagucauggcuaaucagaga

SEQ ID NO: 119681 - RNA, 21 nt, Human
uaucaaagauaaagcuacuau

SEQ ID NO: 119682 - RNA, 22 nt, Human
uauggaauuaaucaaauaucaa

SEQ ID NO: 119683 - RNA, 20 nt, Human
ucaccagaaaaacagauaac

SEQ ID NO: 119684 - RNA, 21 nt, Human
ucugaaaaucuaaucaauugc

SEQ ID NO: 119685 - RNA, 26 nt, Human
ucuucagauuccacagaaaugaggac

SEQ ID NO: 119686 - RNA, 20 nt, Human
ugaaaacccuuggaaacuga

SEQ ID NO: 119687 - RNA, 24 nt, Human
uggauauuauuuauucuugccuuu

SEQ ID NO: 119688 - RNA, 23 nt, Human
ugggaaaauacugagaaaacuaa

SEQ ID NO: 119689 - RNA, 21 nt, Human
uguuaccagacaaaugcagag

SEQ ID NO: 119690 - RNA, 18 nt, Human
uucugcucucuaaagaaa

SEQ ID NO: 119691 - RNA, 22 nt, Human
uucugcucucuaaagaaaaauc

SEQ ID NO: 119692 - RNA, 24 nt, Human
uuugacccucaccagaaaaacaga

SEQ ID NO: 119693 - RNA, 23 nt, Human
uuugggaaaauacugagaaaacu

SEQ ID NO: 119694 - RNA, 20 nt, Human
aaagcagcaguuuucuucau

SEQ ID NO: 119695 - RNA, 21 nt, Human
aaagcagcaguuuucuucaug

SEQ ID NO: 119696 - RNA, 19 nt, Human
aacacuuuucaaauguguc

SEQ ID NO: 119697 - RNA, 19 nt, Human
aacuuguuuuaucuuccuu

SEQ ID NO: 119698 - RNA, 22 nt, Human
accaccgccaccuuccaguccu

SEQ ID NO: 119699 - RNA, 18 nt, Human
acugagcaucuugucuua

SEQ ID NO: 119700 - RNA, 21 nt, Human
agaauuuuucaaacacuuuuc

SEQ ID NO: 119701 - RNA, 22 nt, Human
caccaccgccaccuuccagucc

SEQ ID NO: 119702 - RNA, 19 nt, Human
caccgccaccuuccagucc

SEQ ID NO: 119703 - RNA, 23 nt, Human
ccucugagccgccccaacggccu

SEQ ID NO: 119704 - RNA, 22 nt, Human
ccugcaccuucaccaccgccac

SEQ ID NO: 119705 - RNA, 26 nt, Human
cgacugaggucugagaaagaagaaaa

SEQ ID NO: 119706 - RNA, 20 nt, Human
cggccugcaccuucaccacc

SEQ ID NO: 119707 - RNA, 21 nt, Human
cugaaagcagcaguuuucuuc

SEQ ID NO: 119708 - RNA, 18 nt, Human
cugccucugagccgcccc

SEQ ID NO: 119709 - RNA, 24 nt, Human
gacuuuugcugaaagcagcaguuu

SEQ ID NO: 119710 - RNA, 21 nt, Human
gcaccuucaccaccgccaccu

SEQ ID NO: 119711 - RNA, 23 nt, Human
ggccugcaacagcuuuuaucaag

SEQ ID NO: 119712 - RNA, 20 nt, Human
guucauccgacugaggucug

SEQ ID NO: 119713 - RNA, 23 nt, Human
uagcagagaaacgugcuuaaaaa

SEQ ID NO: 119714 - RNA, 19 nt, Human
ucaccaccgccaccuucca

SEQ ID NO: 119715 - RNA, 22 nt, Human
ugcaccuucaccaccgccaccu

SEQ ID NO: 119716 - RNA, 25 nt, Human
ugccucugagccgccccaacggccu

SEQ ID NO: 119717 - RNA, 18 nt, Human
uggaaggaauuuuauagc

SEQ ID NO: 119718 - RNA, 19 nt, Human
uggaaggaauuuuauagca

SEQ ID NO: 119719 - RNA, 20 nt, Human
uuccaaagaaaauucuggcu

SEQ ID NO: 119720 - RNA, 24 nt, Human
uugcugaaagcagcaguuuucuuc

SEQ ID NO: 119721 - RNA, 22 nt, Human
aaaacaguaaaaaccaggaaaa

SEQ ID NO: 119722 - RNA, 23 nt, Human
aaaacaguaaaaaccaggaaaaa

SEQ ID NO: 119723 - RNA, 18 nt, Human
aaacggaaaaaaaagcau

SEQ ID NO: 119724 - RNA, 24 nt, Human
aaagcaaaaauguuauccuccccu

SEQ ID NO: 119725 - RNA, 26 nt, Human
aaccaggaaaaaaaauagaaaccuag

SEQ ID NO: 119726 - RNA, 23 nt, Human
aaugaacaaaaacggaaaaaaaa

SEQ ID NO: 119727 - RNA, 30 nt, Human
accaaaacaguaaaaaccaggaaaaaaaaa

SEQ ID NO: 119728 - RNA, 19 nt, Human
acuuuauugcuuggauguu

SEQ ID NO: 119729 - RNA, 19 nt, Human
agaaauaaauaagaaggac

SEQ ID NO: 119730 - RNA, 20 nt, Human
agaaauaaauaagaaggaca

SEQ ID NO: 119731 - RNA, 23 nt, Human
agcgcggcugguggucgcggcgg

SEQ ID NO: 119732 - RNA, 20 nt, Human
aggcggcggcggccgagggg

SEQ ID NO: 119733 - RNA, 27 nt, Human
agguggggucgcgcggcggggcagcac

SEQ ID NO: 119734 - RNA, 22 nt, Human
cagcauccaaaaugaacaaaaa

SEQ ID NO: 119735 - RNA, 24 nt, Human
cauuuucuuuuuguagauguuucu

SEQ ID NO: 119736 - RNA, 25 nt, Human
ccaaaaugaacaaaaacggaaaaaa

SEQ ID NO: 119737 - RNA, 21 nt, Human
ccgauggugaaggugccugag

SEQ ID NO: 119738 - RNA, 19 nt, Human
ccgugcaggaauucccagg

SEQ ID NO: 119739 - RNA, 22 nt, Human
cggcggaggcggcucgagcuuc

SEQ ID NO: 119740 - RNA, 25 nt, Human
cuagaaauaaauaagaaggacauaa

SEQ ID NO: 119741 - RNA, 22 nt, Human
cuccccucauccuagaaauaaa

SEQ ID NO: 119742 - RNA, 21 nt, Human
cucgcggcgcaggcggcggcg

SEQ ID NO: 119743 - RNA, 19 nt, Human
cugaaacuggagaggcuac

SEQ ID NO: 119744 - RNA, 19 nt, Human
cugcuuuuugcuuuauuuc

SEQ ID NO: 119745 - RNA, 25 nt, Human
cugguggucgcggcggccggggcuc

SEQ ID NO: 119746 - RNA, 21 nt, Human
cuuuaggucaccugccgaugg

SEQ ID NO: 119747 - RNA, 20 nt, Human
gcucucggggaggccggggc

SEQ ID NO: 119748 - RNA, 20 nt, Human
gcugguggucgcggcggccg

SEQ ID NO: 119749 - RNA, 19 nt, Human
ggccggggcucgcucucgg

SEQ ID NO: 119750 - RNA, 18 nt, Human
ggcuacucucuugucuuc

SEQ ID NO: 119751 - RNA, 19 nt, Human
uaccaaaacaguaaaaacc

SEQ ID NO: 119752 - RNA, 27 nt, Human
uaccaaaacaguaaaaaccaggaaaaa

SEQ ID NO: 119753 - RNA, 18 nt, Human
uagaaaccuagcgguugc

SEQ ID NO: 119754 - RNA, 21 nt, Human
uauuucagauuucuuugguug

SEQ ID NO: 119755 - RNA, 23 nt, Human
ucaauauauauauuaccaaaaca

SEQ ID NO: 119756 - RNA, 24 nt, Human
uccaaaaugaacaaaaacggaaaa

SEQ ID NO: 119757 - RNA, 25 nt, Human
uccaaaaugaacaaaaacggaaaaa

SEQ ID NO: 119758 - RNA, 19 nt, Human
uccucugaaggguaaaaau

SEQ ID NO: 119759 - RNA, 19 nt, Human
ucgcucaggcgccucggug

SEQ ID NO: 119760 - RNA, 24 nt, Human
ucgcucucggggaggccggggcgg

SEQ ID NO: 119761 - RNA, 19 nt, Human
ucgguggcgguuggucggc

SEQ ID NO: 119762 - RNA, 23 nt, Human
ucuuugguguugguuaagguugu

SEQ ID NO: 119763 - RNA, 22 nt, Human
ucuuugguugggguucucccca

SEQ ID NO: 119764 - RNA, 20 nt, Human
ugaacaaaaacggaaaaaaa

SEQ ID NO: 119765 - RNA, 21 nt, Human
ugaacaaaaacggaaaaaaaa

SEQ ID NO: 119766 - RNA, 25 nt, Human
ugaacaaaaacggaaaaaaaagcau

SEQ ID NO: 119767 - RNA, 24 nt, Human
uuaaagaauaacaguaaacauucc

SEQ ID NO: 119768 - RNA, 23 nt, Human
uuacugcacauuuucaaagagag

SEQ ID NO: 119769 - RNA, 22 nt, Human
uucaauauauauauuaccaaaa

SEQ ID NO: 119770 - RNA, 18 nt, Human
uugacauuuucuuuuugu

SEQ ID NO: 119771 - RNA, 24 nt, Human
uugcuuggauguuucuuugguguu

SEQ ID NO: 119772 - RNA, 22 nt, Human
uugcuuuauuucugaaugguca

SEQ ID NO: 119773 - RNA, 18 nt, Human
uuuagcaccagcauccaa

SEQ ID NO: 119774 - RNA, 26 nt, Human
uuucuuguuucaauauauauauuacc

SEQ ID NO: 119775 - RNA, 18 nt, Human
uuuuuuuuuuuuccucug

SEQ ID NO: 119776 - RNA, 24 nt, Human
uuuuuuuuuuuuuuuuuccucuga

SEQ ID NO: 119777 - RNA, 25 nt, Human
aaacagacaaaaaauauaaaggaca

SEQ ID NO: 119778 - RNA, 24 nt, Human
aaaccgugcaaacgcucaacacaa

SEQ ID NO: 119779 - RNA, 27 nt, Human
aaaccgugcaaacgcucaguuaaagag

SEQ ID NO: 119780 - RNA, 19 nt, Human
aagcaacauuuaauauccu

SEQ ID NO: 119781 - RNA, 21 nt, Human
acauaacuguaugaucacaca

SEQ ID NO: 119782 - RNA, 22 nt, Human
acccacauaacuguaugaucac

SEQ ID NO: 119783 - RNA, 18 nt, Human
acccgcuccugccgccgc

SEQ ID NO: 119784 - RNA, 23 nt, Human
acuacccgcuccugccgccgcuc

SEQ ID NO: 119785 - RNA, 22 nt, Human
agaaacggaggagggaacccca

SEQ ID NO: 119786 - RNA, 24 nt, Human
agacaaaaaauauaaaggacaaga

SEQ ID NO: 119787 - RNA, 27 nt, Human
agacaaaaaauauaaaggacaagagaa

SEQ ID NO: 119788 - RNA, 22 nt, Human
agacaaaaaauauaaaggacug

SEQ ID NO: 119789 - RNA, 26 nt, Human
caaacuagaagccacccacauaacug

SEQ ID NO: 119790 - RNA, 26 nt, Human
caaauagcaacagcuucaaaacaaaa

SEQ ID NO: 119791 - RNA, 22 nt, Human
caacacaaaccaacgccauaca

SEQ ID NO: 119792 - RNA, 18 nt, Human
cacaguguccgucaaaau

SEQ ID NO: 119793 - RNA, 22 nt, Human
cagaagccugugauuuccuagg

SEQ ID NO: 119794 - RNA, 22 nt, Human
ccgccucacauucaaaccccgg

SEQ ID NO: 119795 - RNA, 24 nt, Human
ccgcugcagggggcggggccagga

SEQ ID NO: 119796 - RNA, 24 nt, Human
ccggcaaaauggcgcgacagcgag

SEQ ID NO: 119797 - RNA, 22 nt, Human
ccugaggccagagcgcaugagc

SEQ ID NO: 119798 - RNA, 21 nt, Human
cgacagcgagccugaggccag

SEQ ID NO: 119799 - RNA, 20 nt, Human
cuccugccgccgcuccgccu

SEQ ID NO: 119800 - RNA, 21 nt, Human
cugugauuuccuaggaaacca

SEQ ID NO: 119801 - RNA, 20 nt, Human
gaccguagcuggcacuaccc

SEQ ID NO: 119802 - RNA, 21 nt, Human
gauacagaaacggaggaggga

SEQ ID NO: 119803 - RNA, 27 nt, Human
gauuauccaaaccgugcaaacgcucaa

SEQ ID NO: 119804 - RNA, 18 nt, Human
gcagcugugcucagaagc

SEQ ID NO: 119805 - RNA, 29 nt, Human
gccagagcgcaugagcgagcggcccgguc

SEQ ID NO: 119806 - RNA, 19 nt, Human
gcuccugccgccgcuccgc

SEQ ID NO: 119807 - RNA, 18 nt, Human
ggauacagaaacggagga

SEQ ID NO: 119808 - RNA, 23 nt, Human
ggccagagcgcaugagcgagcgg

SEQ ID NO: 119809 - RNA, 22 nt, Human
ggggauacagaaacggaggagg

SEQ ID NO: 119810 - RNA, 22 nt, Human
uaaaagcguaaauaaacagaca

SEQ ID NO: 119811 - RNA, 22 nt, Human
uaguaacagaaagucuccacag

SEQ ID NO: 119812 - RNA, 22 nt, Human
uauccaaaccgugcaaacgcuc

SEQ ID NO: 119813 - RNA, 23 nt, Human
uccuuuguuuuaaugcagcugug

SEQ ID NO: 119814 - RNA, 19 nt, Human
ugagcgagcggcccgcugc

SEQ ID NO: 119815 - RNA, 24 nt, Human
ugcaaacgcucaacacaaaccaac

SEQ ID NO: 119816 - RNA, 23 nt, Human
ugcaaacgcucaacacaaaccuc

SEQ ID NO: 119817 - RNA, 18 nt, Human
ugcaaacuagaagccacc

SEQ ID NO: 119818 - RNA, 19 nt, Human
ugcuauaggaucucguggg

SEQ ID NO: 119819 - RNA, 23 nt, Human
uggcgcgacagcgagccugaggc

SEQ ID NO: 119820 - RNA, 20 nt, Human
ugugcacugcuuggcaagua

SEQ ID NO: 119821 - RNA, 18 nt, Human
uuaggauuuuuauugcug

SEQ ID NO: 119822 - RNA, 19 nt, Human
aagguccccugccuucuag

SEQ ID NO: 119823 - RNA, 24 nt, Human
acuggcuguuugucuuguuuuccu

SEQ ID NO: 119824 - RNA, 19 nt, Human
acuuggcucauuacagcag

SEQ ID NO: 119825 - RNA, 20 nt, Human
aggcggggggugagggcuca

SEQ ID NO: 119826 - RNA, 18 nt, Human
aggggugaggcuguggag

SEQ ID NO: 119827 - RNA, 18 nt, Human
aguaggggaggcgggggg

SEQ ID NO: 119828 - RNA, 23 nt, Human
cacccccaacuuuuagcugccac

SEQ ID NO: 119829 - RNA, 21 nt, Human
caccuucccaaguuucagagc

SEQ ID NO: 119830 - RNA, 20 nt, Human
caguaggggaggcggggggu

SEQ ID NO: 119831 - RNA, 22 nt, Human
ccaacaccaugagaacaguagg

SEQ ID NO: 119832 - RNA, 20 nt, Human
ccagaaugacgggacugggc

SEQ ID NO: 119833 - RNA, 21 nt, Human
ccuccccugaaucccucaccu

SEQ ID NO: 119834 - RNA, 21 nt, Human
ccucuucuuccccuuuuagcc

SEQ ID NO: 119835 - RNA, 20 nt, Human
ccugaaucccucaccuuccc

SEQ ID NO: 119836 - RNA, 23 nt, Human
ccugaaucccucaccuucccaag

SEQ ID NO: 119837 - RNA, 18 nt, Human
ccugccuucuagcccaga

SEQ ID NO: 119838 - RNA, 20 nt, Human
ccugccuucuagcccagaau

SEQ ID NO: 119839 - RNA, 21 nt, Human
ccugguuuucucaguaucagu

SEQ ID NO: 119840 - RNA, 22 nt, Human
ccugguuuucucaguaucagug

SEQ ID NO: 119841 - RNA, 21 nt, Human
ccuugggcugauccucuucuu

SEQ ID NO: 119842 - RNA, 23 nt, Human
cgaggccaacaccaugagaacca

SEQ ID NO: 119843 - RNA, 23 nt, Human
cuagcccagaaugacgggacugg

SEQ ID NO: 119844 - RNA, 21 nt, Human
cucacucucugccagucuguc

SEQ ID NO: 119845 - RNA, 24 nt, Human
cucagcccccagccccugacuggc

SEQ ID NO: 119846 - RNA, 18 nt, Human
cucccugucgucaacucc

SEQ ID NO: 119847 - RNA, 24 nt, Human
cucuuccucuucucucuucuccaa

SEQ ID NO: 119848 - RNA, 18 nt, Human
cugacuggcagugauggc

SEQ ID NO: 119849 - RNA, 18 nt, Human
cugugagcaucugcugcu

SEQ ID NO: 119850 - RNA, 19 nt, Human
cuuccucucuuccucuucc

SEQ ID NO: 119851 - RNA, 19 nt, Human
gagaacaguaggggaggcc

SEQ ID NO: 119852 - RNA, 20 nt, Human
gagcucucagcuacuagcuc

SEQ ID NO: 119853 - RNA, 18 nt, Human
gaggaggggagaguggua

SEQ ID NO: 119854 - RNA, 20 nt, Human
gauaaggggauuaggaaaga

SEQ ID NO: 119855 - RNA, 19 nt, Human
gccaagguccccugccuuc

SEQ ID NO: 119856 - RNA, 21 nt, Human
gccccauccauggaggaguug

SEQ ID NO: 119857 - RNA, 24 nt, Human
gcucauuacagcaguaccaguaug

SEQ ID NO: 119858 - RNA, 23 nt, Human
ggaagugggauccucugaccucc

SEQ ID NO: 119859 - RNA, 20 nt, Human
ggaggcggggggugagggcu

SEQ ID NO: 119860 - RNA, 18 nt, Human
ggcugcaaggugcccagg

SEQ ID NO: 119861 - RNA, 24 nt, Human
ggcuguuugucuuguuuuccucuu

SEQ ID NO: 119862 - RNA, 22 nt, Human
gggaguuugugcuuccugcuug

SEQ ID NO: 119863 - RNA, 22 nt, Human
gggggugggaggggugaggcug

SEQ ID NO: 119864 - RNA, 18 nt, Human
gugggaggggugaggcug

SEQ ID NO: 119865 - RNA, 25 nt, Human
uagcaaacacgaggccaacaccaug

SEQ ID NO: 119866 - RNA, 22 nt, Human
uaggggaggcggggggugaggg

SEQ ID NO: 119867 - RNA, 19 nt, Human
ucagagcugggccgagcug

SEQ ID NO: 119868 - RNA, 21 nt, Human
ucagcuugggggaguuugugc

SEQ ID NO: 119869 - RNA, 24 nt, Human
ucaguguagcuccuggggacuuca

SEQ ID NO: 119870 - RNA, 22 nt, Human
uccccugaaucccucaccuucc

SEQ ID NO: 119871 - RNA, 19 nt, Human
uccgcagggaucgggacac

SEQ ID NO: 119872 - RNA, 21 nt, Human
ucucucuucuccaccuucucc

SEQ ID NO: 119873 - RNA, 26 nt, Human
ucugugagcaucugcugcuccucuca

SEQ ID NO: 119874 - RNA, 22 nt, Human
ucuucuccaccuucuccucacu

SEQ ID NO: 119875 - RNA, 21 nt, Human
ugaaggcggcguauagggcag

SEQ ID NO: 119876 - RNA, 23 nt, Human
ugaccgaaggcagaguuuguaug

SEQ ID NO: 119877 - RNA, 18 nt, Human
ugaccuccccugaauccc

SEQ ID NO: 119878 - RNA, 18 nt, Human
uggaggaggggagagugg

SEQ ID NO: 119879 - RNA, 22 nt, Human
uggcauagcaaacacgaggcca

SEQ ID NO: 119880 - RNA, 19 nt, Human
ugggaggggugaggcugug

SEQ ID NO: 119881 - RNA, 18 nt, Human
ugggggugggagggguga

SEQ ID NO: 119882 - RNA, 21 nt, Human
ugggggugggaggggugaggc

SEQ ID NO: 119883 - RNA, 23 nt, Human
ugggggugggaggggugaggcug

SEQ ID NO: 119884 - RNA, 19 nt, Human
uguauguucuccccguguc

SEQ ID NO: 119885 - RNA, 19 nt, Human
uguucuccccgugucgccc

SEQ ID NO: 119886 - RNA, 19 nt, Human
uguuugucuuguuuuccuc

SEQ ID NO: 119887 - RNA, 23 nt, Human
uucuuccccuuuuagccuggccg

SEQ ID NO: 119888 - RNA, 20 nt, Human
uugaaguuuggaggagggga

SEQ ID NO: 119889 - RNA, 22 nt, Human
agcuccccggcuuggccagccu

SEQ ID NO: 119890 - RNA, 19 nt, Human
aucuugaauaaauauggaa

SEQ ID NO: 119891 - RNA, 20 nt, Human
caagaugaccauccugaguu

SEQ ID NO: 119892 - RNA, 19 nt, Human
caccauggcuguggcccac

SEQ ID NO: 119893 - RNA, 23 nt, Human
caggccacucccaccauggcugu

SEQ ID NO: 119894 - RNA, 26 nt, Human
cagggcagguccaggccacucccacc

SEQ ID NO: 119895 - RNA, 21 nt, Human
cagggucaguguggcccaggg

SEQ ID NO: 119896 - RNA, 19 nt, Human
ccuccaagaugaccauccu

SEQ ID NO: 119897 - RNA, 25 nt, Human
ccuccaagaugaccauccugaguuu

SEQ ID NO: 119898 - RNA, 23 nt, Human
cugccaugccuguaucaggguca

SEQ ID NO: 119899 - RNA, 18 nt, Human
cuguggcccaccccuugg

SEQ ID NO: 119900 - RNA, 21 nt, Human
cuuggccagccucaucuggcc

SEQ ID NO: 119901 - RNA, 22 nt, Human
uccaagaugaccauccugaguu

SEQ ID NO: 119902 - RNA, 18 nt, Human
ugaguuucuagcucuugu

SEQ ID NO: 119903 - RNA, 23 nt, Human
uggcccaccccuugguccccugg

SEQ ID NO: 119904 - RNA, 18 nt, Human
uggcuguggcccaccccu

SEQ ID NO: 119905 - RNA, 18 nt, Human
uggcuguggcccaccccu

SEQ ID NO: 119906 - RNA, 22 nt, Human
uguggcccaccccuuggucccu

SEQ ID NO: 119907 - RNA, 18 nt, Human
uucccauucuucugccau

SEQ ID NO: 119908 - RNA, 20 nt, Human
uucugucaguauaaaauauu

SEQ ID NO: 119909 - RNA, 20 nt, Human
aagcccucuccauccccuug

SEQ ID NO: 119910 - RNA, 24 nt, Human
aaugcagaaccuacaaauaaguua

SEQ ID NO: 119911 - RNA, 19 nt, Human
caagcccucuccauccccu

SEQ ID NO: 119912 - RNA, 22 nt, Human
cauguacgugugugugugugug

SEQ ID NO: 119913 - RNA, 22 nt, Human
ccggagcaaggcuaucuccuuu

SEQ ID NO: 119914 - RNA, 20 nt, Human
guuaaccugacaggaaaaau

SEQ ID NO: 119915 - RNA, 23 nt, Human
uacgugugugugugugugucugu

SEQ ID NO: 119916 - RNA, 19 nt, Human
ucaggcgggagggaaggca

SEQ ID NO: 119917 - RNA, 21 nt, Human
ucccaggccucuagcuaccuu

SEQ ID NO: 119918 - RNA, 23 nt, Human
ucccaggccucuagcuccgaccc

SEQ ID NO: 119919 - RNA, 19 nt, Human
ugacugaggaaggucaggc

SEQ ID NO: 119920 - RNA, 23 nt, Human
uggucagcucuggacaggcaggc

SEQ ID NO: 119921 - RNA, 20 nt, Human
uguacgugugugugugugug

SEQ ID NO: 119922 - RNA, 19 nt, Human
ugugugcauguacgugugu

SEQ ID NO: 119923 - RNA, 20 nt, Human
ugugugugugugugucugug

SEQ ID NO: 119924 - RNA, 22 nt, Human
ugugugugugugugucugugug

SEQ ID NO: 119925 - RNA, 19 nt, Human
uuucccaggccucuagcua

SEQ ID NO: 119926 - RNA, 23 nt, Human
aaagagucacaguccugacccuc

SEQ ID NO: 119927 - RNA, 19 nt, Human
aaauagagauaaauacaug

SEQ ID NO: 119928 - RNA, 21 nt, Human
aacagggauuucuugucuccc

SEQ ID NO: 119929 - RNA, 24 nt, Human
aagaagaaaaacgagauuccccag

SEQ ID NO: 119930 - RNA, 24 nt, Human
acaggccugacaugauuccuccug

SEQ ID NO: 119931 - RNA, 19 nt, Human
acaguggaggggacacugg

SEQ ID NO: 119932 - RNA, 18 nt, Human
accaggggcucacagcgg

SEQ ID NO: 119933 - RNA, 24 nt, Human
acccucgugggggcagggcaggug

SEQ ID NO: 119934 - RNA, 22 nt, Human
agaaaaacaggagacacgucgg

SEQ ID NO: 119935 - RNA, 20 nt, Human
aggaccaggggcucacagcg

SEQ ID NO: 119936 - RNA, 23 nt, Human
aggaccaggggcucacagcggcu

SEQ ID NO: 119937 - RNA, 23 nt, Human
aggcaggagaaugaaacucagaa

SEQ ID NO: 119938 - RNA, 22 nt, Human
aggggaugggaggacaggagcu

SEQ ID NO: 119939 - RNA, 21 nt, Human
augggauggggagggcuuggc

SEQ ID NO: 119940 - RNA, 25 nt, Human
caaggcaaauguccaggcaccugcc

SEQ ID NO: 119941 - RNA, 18 nt, Human
cacacaggccugacauga

SEQ ID NO: 119942 - RNA, 22 nt, Human
cacagccaaggggaugcagggg

SEQ ID NO: 119943 - RNA, 19 nt, Human
caccucugcuuguccaggg

SEQ ID NO: 119944 - RNA, 21 nt, Human
cagagccagggcuggggagca

SEQ ID NO: 119945 - RNA, 18 nt, Human
caggagcuuuuucucacu

SEQ ID NO: 119946 - RNA, 21 nt, Human
caggagcuuuuucucacugcu

SEQ ID NO: 119947 - RNA, 21 nt, Human
cagggaaggacacagaggccu

SEQ ID NO: 119948 - RNA, 23 nt, Human
ccaaaagucuuaagaagaaaaac

SEQ ID NO: 119949 - RNA, 18 nt, Human
ccagaaaaacaggagaca

SEQ ID NO: 119950 - RNA, 21 nt, Human
ccagagugaggggugcaagga

SEQ ID NO: 119951 - RNA, 18 nt, Human
ccagggccaugccuccca

SEQ ID NO: 119952 - RNA, 23 nt, Human
ccagugcccauugcagagccagg

SEQ ID NO: 119953 - RNA, 23 nt, Human
ccguucugcucuucccugucuuu

SEQ ID NO: 119954 - RNA, 20 nt, Human
ccuaucuaccucccagucca

SEQ ID NO: 119955 - RNA, 18 nt, Human
cucccucccacaucccca

SEQ ID NO: 119956 - RNA, 20 nt, Human
cucuggccaccucugcuugu

SEQ ID NO: 119957 - RNA, 19 nt, Human
cugucugcucccucccaca

SEQ ID NO: 119958 - RNA, 20 nt, Human
gaggggugcaaggacccaga

SEQ ID NO: 119959 - RNA, 21 nt, Human
ggaccaggggcucacagcggc

SEQ ID NO: 119960 - RNA, 23 nt, Human
gggaaggacacagaggccugggg

SEQ ID NO: 119961 - RNA, 18 nt, Human
gggauggggagggcuugg

SEQ ID NO: 119962 - RNA, 23 nt, Human
gggcugggcugcaggcuccgggc

SEQ ID NO: 119963 - RNA, 20 nt, Human
ggggacccucaggaccaggg

SEQ ID NO: 119964 - RNA, 20 nt, Human
ggggcugggcugcaggcucc

SEQ ID NO: 119965 - RNA, 19 nt, Human
gggucuggguggggcuggg

SEQ ID NO: 119966 - RNA, 21 nt, Human
gguggagggugacaguggagc

SEQ ID NO: 119967 - RNA, 23 nt, Human
gguggggcugggcugcaggcucc

SEQ ID NO: 119968 - RNA, 21 nt, Human
gucaaaccaugucccaaaagu

SEQ ID NO: 119969 - RNA, 21 nt, Human
gugcaaggacccagaugggga

SEQ ID NO: 119970 - RNA, 19 nt, Human
uauuuaccuaucuaccucc

SEQ ID NO: 119971 - RNA, 20 nt, Human
uccaggcaccugccuggccc

SEQ ID NO: 119972 - RNA, 22 nt, Human
uccugacccucgugggggcagg

SEQ ID NO: 119973 - RNA, 18 nt, Human
uccugucugcucccuccc

SEQ ID NO: 119974 - RNA, 18 nt, Human
uccuuucacacacaggcc

SEQ ID NO: 119975 - RNA, 19 nt, Human
ucugcucccucccacaucc

SEQ ID NO: 119976 - RNA, 22 nt, Human
ucuggguggggcugggcugcag

SEQ ID NO: 119977 - RNA, 19 nt, Human
ugcaaggacccagaugggg

SEQ ID NO: 119978 - RNA, 22 nt, Human
ugccuggcccuaaaaagaguca

SEQ ID NO: 119979 - RNA, 20 nt, Human
uggaggggacacuggugagu

SEQ ID NO: 119980 - RNA, 20 nt, Human
uggagggugacaguggagcu

SEQ ID NO: 119981 - RNA, 19 nt, Human
ugggauggggagggcuugg

SEQ ID NO: 119982 - RNA, 22 nt, Human
uggugaguggggggugaagagg

SEQ ID NO: 119983 - RNA, 19 nt, Human
ugugcagucggcugaggcc

SEQ ID NO: 119984 - RNA, 20 nt, Human
uucgugggaccccagggcca

SEQ ID NO: 119985 - RNA, 21 nt, Human
uugcagagccagggcugggga

SEQ ID NO: 119986 - RNA, 19 nt, Human
uuucuugucucccacgugg

SEQ ID NO: 119987 - RNA, 25 nt, Human
agaggcaggcccaagaagggaaccc

SEQ ID NO: 119988 - RNA, 18 nt, Human
agccugggcugggguagu

SEQ ID NO: 119989 - RNA, 22 nt, Human
caagaagggaaccccaggaagc

SEQ ID NO: 119990 - RNA, 23 nt, Human
caccucuggcccagccccugcuu

SEQ ID NO: 119991 - RNA, 18 nt, Human
cagccccugcuuggccuc

SEQ ID NO: 119992 - RNA, 21 nt, Human
cuccuuggucucucuucucgu

SEQ ID NO: 119993 - RNA, 20 nt, Human
cugggcugggguaguuuuua

SEQ ID NO: 119994 - RNA, 25 nt, Human
cuuuaagaggcaggcccaagaaggg

SEQ ID NO: 119995 - RNA, 20 nt, Human
gaaacaagcacaaaaggcca

SEQ ID NO: 119996 - RNA, 21 nt, Human
gaaacaagcacaaaaggccau

SEQ ID NO: 119997 - RNA, 22 nt, Human
gagccucaguuuccccauguug

SEQ ID NO: 119998 - RNA, 18 nt, Human
gauugggaggagagggag

SEQ ID NO: 119999 - RNA, 24 nt, Human
gcccagccccugcuuggccuccuu

SEQ ID NO: 120000 - RNA, 19 nt, Human
gccuccuuggucucucuuc

SEQ ID NO: 120001 - RNA, 18 nt, Human
ggagauugggaggagagg

SEQ ID NO: 120002 - RNA, 22 nt, Human
gggguaguuuuuagucaugggc

SEQ ID NO: 120003 - RNA, 23 nt, Human
uaggaaacaagcacaaaaggcca

SEQ ID NO: 120004 - RNA, 18 nt, Human
ucaccagcuuugugaucu

SEQ ID NO: 120005 - RNA, 18 nt, Human
ucaugggcuuauggaccc

SEQ ID NO: 120006 - RNA, 19 nt, Human
uccuuggucucucuucucg

SEQ ID NO: 120007 - RNA, 21 nt, Human
ucuccagcuagcucaggccuu

SEQ ID NO: 120008 - RNA, 21 nt, Human
ugcuuggccuccuuggucucu

SEQ ID NO: 120009 - RNA, 19 nt, Human
ugggaggcccagccuaugg

SEQ ID NO: 120010 - RNA, 19 nt, Human
uggugagagccugggcugg

SEQ ID NO: 120011 - RNA, 19 nt, Human
acagcuacccucuacagag

SEQ ID NO: 120012 - RNA, 21 nt, Human
acccugagugguucggggagu

SEQ ID NO: 120013 - RNA, 20 nt, Human
agaagccacagcuacccucu

SEQ ID NO: 120014 - RNA, 20 nt, Human
agaagccacagcuacccucu

SEQ ID NO: 120015 - RNA, 23 nt, Human
agaagccacagcuacccucuaca

SEQ ID NO: 120016 - RNA, 23 nt, Human
agaagccacagcuacccucuaca

SEQ ID NO: 120017 - RNA, 22 nt, Human
agaaggagaggccaagcgcuug

SEQ ID NO: 120018 - RNA, 21 nt, Human
agaggcacuggggaggggucg

SEQ ID NO: 120019 - RNA, 21 nt, Human
agaggcacuggggaggggucg

SEQ ID NO: 120020 - RNA, 21 nt, Human
agaggcacuggggaggggucg

SEQ ID NO: 120021 - RNA, 23 nt, Human
agccggucucuugucgugacaca

SEQ ID NO: 120022 - RNA, 18 nt, Human
aggaaugucucgaccuug

SEQ ID NO: 120023 - RNA, 18 nt, Human
aggaaugucucgaccuug

SEQ ID NO: 120024 - RNA, 20 nt, Human
aggacccugagugguucggg

SEQ ID NO: 120025 - RNA, 22 nt, Human
aggagaggcacuggggaggggu

SEQ ID NO: 120026 - RNA, 22 nt, Human
aggagaggcacuggggaggggu

SEQ ID NO: 120027 - RNA, 25 nt, Human
auccauuuuccucccuccccuucaa

SEQ ID NO: 120028 - RNA, 25 nt, Human
auccauuuuccucccuccccuucag

SEQ ID NO: 120029 - RNA, 25 nt, Human
caaagagggcagcauguuucucucc

SEQ ID NO: 120030 - RNA, 23 nt, Human
cacaggacccugagugguucggg

SEQ ID NO: 120031 - RNA, 18 nt, Human
cacgcgggcaccuagaag

SEQ ID NO: 120032 - RNA, 18 nt, Human
cacgcgggcaccuagaag

SEQ ID NO: 120033 - RNA, 26 nt, Human
cacgcgggcaccuagaagccacagcu

SEQ ID NO: 120034 - RNA, 26 nt, Human
cacgcgggcaccuagaagccacagcu

SEQ ID NO: 120035 - RNA, 21 nt, Human
cacuguucccucccucucuca

SEQ ID NO: 120036 - RNA, 24 nt, Human
cagcauguuucucucccccagccc

SEQ ID NO: 120037 - RNA, 23 nt, Human
cagggccaggagaggcacugggg

SEQ ID NO: 120038 - RNA, 23 nt, Human
cagggccaggagaggcacugggg

SEQ ID NO: 120039 - RNA, 23 nt, Human
cagggccaggagaggcacugggg

SEQ ID NO: 120040 - RNA, 18 nt, Human
ccacagcuacccucuaca

SEQ ID NO: 120041 - RNA, 24 nt, Human
ccaggagaggcacuggggaggggu

SEQ ID NO: 120042 - RNA, 24 nt, Human
ccaggagaggcacuggggaggggu

SEQ ID NO: 120043 - RNA, 20 nt, Human
cccuggccaguucucucucc

SEQ ID NO: 120044 - RNA, 19 nt, Human
cugaagcaguagagcagcc

SEQ ID NO: 120045 - RNA, 19 nt, Human
cugaagcaguagagcagcc

SEQ ID NO: 120046 - RNA, 20 nt, Human
cugaagcaguagagcagccc

SEQ ID NO: 120047 - RNA, 20 nt, Human
cugaagcaguagagcagccc

SEQ ID NO: 120048 - RNA, 19 nt, Human
cuguucccucccucucuca

SEQ ID NO: 120049 - RNA, 23 nt, Human
gagaaggagaggccaagcgcuug

SEQ ID NO: 120050 - RNA, 18 nt, Human
gagaggcacuggggaggg

SEQ ID NO: 120051 - RNA, 18 nt, Human
gcaccaugcgcaggaaug

SEQ ID NO: 120052 - RNA, 18 nt, Human
gcaccaugcgcaggaaug

SEQ ID NO: 120053 - RNA, 18 nt, Human
gcacuggggaggggucgg

SEQ ID NO: 120054 - RNA, 18 nt, Human
gcacuggggaggggucgg

SEQ ID NO: 120055 - RNA, 18 nt, Human
gcacuggggaggggucgg

SEQ ID NO: 120056 - RNA, 19 nt, Human
gccacagcuacccucuaca

SEQ ID NO: 120057 - RNA, 22 nt, Human
gcuguaggucugcuugaggauc

SEQ ID NO: 120058 - RNA, 19 nt, Human
ggagaggcacuggggaggg

SEQ ID NO: 120059 - RNA, 19 nt, Human
ggagaggcacuggggaggg

SEQ ID NO: 120060 - RNA, 18 nt, Human
ggccuugggauccuagaa

SEQ ID NO: 120061 - RNA, 20 nt, Human
ggccuugggauccuagagcc

SEQ ID NO: 120062 - RNA, 23 nt, Human
gggcacuggaguggcaccuucca

SEQ ID NO: 120063 - RNA, 23 nt, Human
gggcacuggaguggcaccuucca

SEQ ID NO: 120064 - RNA, 23 nt, Human
gggcacuggaguggcaccuucca

SEQ ID NO: 120065 - RNA, 25 nt, Human
gguugugugaguuugugucaaacuu

SEQ ID NO: 120066 - RNA, 21 nt, Human
ucagcgccugacugcuacaaa

SEQ ID NO: 120067 - RNA, 24 nt, Human
uccagccucugcaaagugaaggaa

SEQ ID NO: 120068 - RNA, 19 nt, Human
uccagggccaggagaggca

SEQ ID NO: 120069 - RNA, 19 nt, Human
uccagggccaggagaggca

SEQ ID NO: 120070 - RNA, 19 nt, Human
uccagggccaggagaggca

SEQ ID NO: 120071 - RNA, 24 nt, Human
ugaaggaagagaaggagaggccaa

SEQ ID NO: 120072 - RNA, 24 nt, Human
ugagcagugcgucaugguugugug

SEQ ID NO: 120073 - RNA, 24 nt, Human
ugagcagugcgucaugguugugug

SEQ ID NO: 120074 - RNA, 19 nt, Human
uuuuccucccuccccuuca

SEQ ID NO: 120075 - RNA, 19 nt, Human
aagccacagcugcccucca

SEQ ID NO: 120076 - RNA, 19 nt, Human
aagccacagcugcccucca

SEQ ID NO: 120077 - RNA, 19 nt, Human
acagcugcccuccacagag

SEQ ID NO: 120078 - RNA, 21 nt, Human
acccugaguggugcggggagu

SEQ ID NO: 120079 - RNA, 18 nt, Human
aggaaugucucgaccuug

SEQ ID NO: 120080 - RNA, 18 nt, Human
aggaaugucucgaccuug

SEQ ID NO: 120081 - RNA, 22 nt, Human
aggagaggcacuggggaggggu

SEQ ID NO: 120082 - RNA, 19 nt, Human
agguggcugccgucuucca

SEQ ID NO: 120083 - RNA, 23 nt, Human
cacaggacccugaguggugcggg

SEQ ID NO: 120084 - RNA, 23 nt, Human
cagggccaggagaggcacugggg

SEQ ID NO: 120085 - RNA, 23 nt, Human
cagggccaggagaggcacugggg

SEQ ID NO: 120086 - RNA, 23 nt, Human
cagggccaggagaggcacugggg

SEQ ID NO: 120087 - RNA, 23 nt, Human
caguggagcagcccguaguucuu

SEQ ID NO: 120088 - RNA, 23 nt, Human
caguggagcagcccguaguucuu

SEQ ID NO: 120089 - RNA, 24 nt, Human
ccaggagaggcacuggggaggggu

SEQ ID NO: 120090 - RNA, 24 nt, Human
ccaggagaggcacuggggaggggu

SEQ ID NO: 120091 - RNA, 24 nt, Human
ccaggagaggcacuggggaggggu

SEQ ID NO: 120092 - RNA, 18 nt, Human
ccccuagaagccacagcu

SEQ ID NO: 120093 - RNA, 18 nt, Human
ccccuagaagccacagcu

SEQ ID NO: 120094 - RNA, 24 nt, Human
cccuagaagccacagcugcccucc

SEQ ID NO: 120095 - RNA, 24 nt, Human
cccuagaagccacagcugcccucc

SEQ ID NO: 120096 - RNA, 21 nt, Human
ccgucuuccagccuccccauc

SEQ ID NO: 120097 - RNA, 20 nt, Human
cuccacagagcggcacugca

SEQ ID NO: 120098 - RNA, 20 nt, Human
cuccacagagcggcacugca

SEQ ID NO: 120099 - RNA, 19 nt, Human
cugaagcaguggagcagcc

SEQ ID NO: 120100 - RNA, 20 nt, Human
cugaagcaguggagcagccc

SEQ ID NO: 120101 - RNA, 20 nt, Human
cugaagcaguggagcagccc

SEQ ID NO: 120102 - RNA, 24 nt, Human
gagaagcagaaggaggucugggag

SEQ ID NO: 120103 - RNA, 18 nt, Human
gagaggcacuggggaggg

SEQ ID NO: 120104 - RNA, 18 nt, Human
gagaggcacuggggaggg

SEQ ID NO: 120105 - RNA, 20 nt, Human
gagcagcagggagaugugga

SEQ ID NO: 120106 - RNA, 22 nt, Human
gagucugagaagcagaaggagg

SEQ ID NO: 120107 - RNA, 18 nt, Human
gcaccaugcgcaggaaug

SEQ ID NO: 120108 - RNA, 18 nt, Human
gcaccaugcgcaggaaug

SEQ ID NO: 120109 - RNA, 19 nt, Human
gcgacucgaugagcagcag

SEQ ID NO: 120110 - RNA, 19 nt, Human
ggagaggcacuggggaggg

SEQ ID NO: 120111 - RNA, 19 nt, Human
ggagaggcacuggggaggg

SEQ ID NO: 120112 - RNA, 24 nt, Human
gggagauguggagcagcucuaagu

SEQ ID NO: 120113 - RNA, 18 nt, Human
gggcacuggaguggcacc

SEQ ID NO: 120114 - RNA, 18 nt, Human
gggcacuggaguggcacc

SEQ ID NO: 120115 - RNA, 18 nt, Human
gggcacuggaguggcacc

SEQ ID NO: 120116 - RNA, 19 nt, Human
gggcacuggaguggcaccu

SEQ ID NO: 120117 - RNA, 19 nt, Human
gggcacuggaguggcaccu

SEQ ID NO: 120118 - RNA, 19 nt, Human
gggcacuggaguggcaccu

SEQ ID NO: 120119 - RNA, 18 nt, Human
gguuguuggugaagguac

SEQ ID NO: 120120 - RNA, 19 nt, Human
gucuuccagccuccccauc

SEQ ID NO: 120121 - RNA, 27 nt, Human
ucagggccaggagaggcacuggggagg

SEQ ID NO: 120122 - RNA, 27 nt, Human
ucagggccaggagaggcacuggggagg

SEQ ID NO: 120123 - RNA, 27 nt, Human
ucagggccaggagaggcacuggggagg

SEQ ID NO: 120124 - RNA, 23 nt, Human
uccacagagcggcacugcaccau

SEQ ID NO: 120125 - RNA, 23 nt, Human
uccacagagcggcacugcaccau

SEQ ID NO: 120126 - RNA, 20 nt, Human
ucugcugcguuuccuccaug

SEQ ID NO: 120127 - RNA, 22 nt, Human
ugagaagcagaaggaggucugg

SEQ ID NO: 120128 - RNA, 24 nt, Human
ugagcagugcgucaugguugugcg

SEQ ID NO: 120129 - RNA, 24 nt, Human
ugagcagugcgucaugguugugcg

SEQ ID NO: 120130 - RNA, 20 nt, Human
ugcggggagucgggccuugg

SEQ ID NO: 120131 - RNA, 22 nt, Human
uggaugccuuccucuagguccu

SEQ ID NO: 120132 - RNA, 23 nt, Human
uguuggaggaugucggaauagag

SEQ ID NO: 120133 - RNA, 20 nt, Human
uuaagacaaggcuggugggc

SEQ ID NO: 120134 - RNA, 20 nt, Human
uuaagacaaggcuggugggc

SEQ ID NO: 120135 - RNA, 20 nt, Human
uuaagacaaggcuggugggc

SEQ ID NO: 120136 - RNA, 22 nt, Human
uucagggccaggagaggcacug

SEQ ID NO: 120137 - RNA, 22 nt, Human
uucagggccaggagaggcacug

SEQ ID NO: 120138 - RNA, 22 nt, Human
uucagggccaggagaggcacug

SEQ ID NO: 120139 - RNA, 19 nt, Human
uuggaugccuuccucuagg

SEQ ID NO: 120140 - RNA, 22 nt, Human
uuuccuccauguuggaggaugu

SEQ ID NO: 120141 - RNA, 23 nt, Human
aaaggcgggggaagggggcggga

SEQ ID NO: 120142 - RNA, 22 nt, Human
aagaaggcgaguggcgggaggc

SEQ ID NO: 120143 - RNA, 21 nt, Human
aagcgcaaacacggggcgacc

SEQ ID NO: 120144 - RNA, 19 nt, Human
aauaaacacacggaaaaaa

SEQ ID NO: 120145 - RNA, 18 nt, Human
accgaggagacacgggac

SEQ ID NO: 120146 - RNA, 22 nt, Human
acgcaggaaaaaggcccgccag

SEQ ID NO: 120147 - RNA, 18 nt, Human
agagagacggggccggag

SEQ ID NO: 120148 - RNA, 22 nt, Human
agaggggaggagggaccgccag

SEQ ID NO: 120149 - RNA, 21 nt, Human
aggaaaggaauaaaacucuaa

SEQ ID NO: 120150 - RNA, 18 nt, Human
aggagggaccgccaggca

SEQ ID NO: 120151 - RNA, 19 nt, Human
aggcagaggcagggggacg

SEQ ID NO: 120152 - RNA, 18 nt, Human
aggcccgccagcccgcug

SEQ ID NO: 120153 - RNA, 22 nt, Human
aggcgaguggcgggaggccagg

SEQ ID NO: 120154 - RNA, 27 nt, Human
agggaagaaaggcgggggaagggggcg

SEQ ID NO: 120155 - RNA, 23 nt, Human
aggggcccggucccccccaccuc

SEQ ID NO: 120156 - RNA, 22 nt, Human
agggguccccagggggugcggu

SEQ ID NO: 120157 - RNA, 19 nt, Human
aguggcgggaggccaggga

SEQ ID NO: 120158 - RNA, 21 nt, Human
agugggcuccccaggccccac

SEQ ID NO: 120159 - RNA, 19 nt, Human
augggacacagaaugggga

SEQ ID NO: 120160 - RNA, 21 nt, Human
caaacagugcaacauggucaa

SEQ ID NO: 120161 - RNA, 22 nt, Human
cacaguaaagccaaccugucac

SEQ ID NO: 120162 - RNA, 18 nt, Human
cagaggcagggggacgga

SEQ ID NO: 120163 - RNA, 25 nt, Human
caggccccacagguggguccaagag

SEQ ID NO: 120164 - RNA, 20 nt, Human
cagggaagcccgacguggug

SEQ ID NO: 120165 - RNA, 18 nt, Human
cagugggcuccccaggcc

SEQ ID NO: 120166 - RNA, 18 nt, Human
caugacccaggcggaggc

SEQ ID NO: 120167 - RNA, 27 nt, Human
ccaccucacgggcaggacaggaaaaau

SEQ ID NO: 120168 - RNA, 19 nt, Human
cccaugacccaggcggagg

SEQ ID NO: 120169 - RNA, 22 nt, Human
ccccccaccucacgggcaggac

SEQ ID NO: 120170 - RNA, 24 nt, Human
cccgcuccguggccuccuuccucc

SEQ ID NO: 120171 - RNA, 19 nt, Human
ccggaggggugcaggcugg

SEQ ID NO: 120172 - RNA, 20 nt, Human
ccuccuuccucccuggcccc

SEQ ID NO: 120173 - RNA, 25 nt, Human
cgaggggucccuagagaggggcccg

SEQ ID NO: 120174 - RNA, 28 nt, Human
cggagggaagaaaggcgggggaaggggg

SEQ ID NO: 120175 - RNA, 24 nt, Human
cgggggaagggggcgggagggagu

SEQ ID NO: 120176 - RNA, 28 nt, Human
cgggggaagggggcgggagggagucggg

SEQ ID NO: 120177 - RNA, 23 nt, Human
cucaaaaaaggaaaggaauaaaa

SEQ ID NO: 120178 - RNA, 18 nt, Human
cuccuuccucccuggccc

SEQ ID NO: 120179 - RNA, 20 nt, Human
cugccgggggccgccccgga

SEQ ID NO: 120180 - RNA, 21 nt, Human
cugccucgggcgcaugcaaac

SEQ ID NO: 120181 - RNA, 20 nt, Human
cugggacgcaggaaaaaggc

SEQ ID NO: 120182 - RNA, 22 nt, Human
gaaggcgaguggcgggaggcca

SEQ ID NO: 120183 - RNA, 18 nt, Human
gaagggggcgggagggag

SEQ ID NO: 120184 - RNA, 19 nt, Human
gacccaggcggaggccagc

SEQ ID NO: 120185 - RNA, 22 nt, Human
gagucacaguaaagccaaccug

SEQ ID NO: 120186 - RNA, 26 nt, Human
gcugggacgcaggaaaaaggcccggu

SEQ ID NO: 120187 - RNA, 23 nt, Human
ggaaaaaaaaucucaaaaaagga

SEQ ID NO: 120188 - RNA, 24 nt, Human
ggaagggggcgggagggagucggg

SEQ ID NO: 120189 - RNA, 19 nt, Human
ggaggggcgcagggguccc

SEQ ID NO: 120190 - RNA, 18 nt, Human
gggcuccccaggccccac

SEQ ID NO: 120191 - RNA, 20 nt, Human
ggggaagggggcgggaggga

SEQ ID NO: 120192 - RNA, 18 nt, Human
ggggaggggaggggcgca

SEQ ID NO: 120193 - RNA, 21 nt, Human
ggggaggggaggggcgcaggg

SEQ ID NO: 120194 - RNA, 23 nt, Human
ggggaggggaggggcgcaggggu

SEQ ID NO: 120195 - RNA, 25 nt, Human
ggggggaggggaggggcgcaggggu

SEQ ID NO: 120196 - RNA, 25 nt, Human
ggggugcaggcugggacgcaggaaa

SEQ ID NO: 120197 - RNA, 24 nt, Human
gguaugggugcaaggagaggggag

SEQ ID NO: 120198 - RNA, 18 nt, Human
ggugcaaggagaggggag

SEQ ID NO: 120199 - RNA, 26 nt, Human
guacuuucuuucuccuuaucuugaaa

SEQ ID NO: 120200 - RNA, 25 nt, Human
uaaagccaaccugucacuugguacc

SEQ ID NO: 120201 - RNA, 19 nt, Human
uagagaggggcccgguccc

SEQ ID NO: 120202 - RNA, 18 nt, Human
ucacaaggcgggugggcg

SEQ ID NO: 120203 - RNA, 23 nt, Human
uccccaggccccacagguggguc

SEQ ID NO: 120204 - RNA, 22 nt, Human
ucccuagagaggggcccggucc

SEQ ID NO: 120205 - RNA, 18 nt, Human
uccguggccuccuuccuc

SEQ ID NO: 120206 - RNA, 23 nt, Human
ucgcggagggaagaaaggcgggg

SEQ ID NO: 120207 - RNA, 26 nt, Human
ucgggcccagugagcaggggcaccag

SEQ ID NO: 120208 - RNA, 22 nt, Human
ucggggggaggaaacaauguag

SEQ ID NO: 120209 - RNA, 18 nt, Human
ucucuuggggcacugcgg

SEQ ID NO: 120210 - RNA, 19 nt, Human
ugagcaggggcaccagguc

SEQ ID NO: 120211 - RNA, 21 nt, Human
ugaucuuccagguucaguccc

SEQ ID NO: 120212 - RNA, 22 nt, Human
ugccucgggcgcaugcaaacag

SEQ ID NO: 120213 - RNA, 21 nt, Human
uggccccucagugggcucccu

SEQ ID NO: 120214 - RNA, 31 nt, Human
uggguccaagagagacggggccggagggguu

SEQ ID NO: 120215 - RNA, 21 nt, Human
uuccagguucaguccccaccg

SEQ ID NO: 120216 - RNA, 20 nt, Human
aaacaaaauguccacuagaa

SEQ ID NO: 120217 - RNA, 22 nt, Human
aacuuaguaaacacuuuaauac

SEQ ID NO: 120218 - RNA, 21 nt, Human
aagaaaaaagaaaaucucugu

SEQ ID NO: 120219 - RNA, 22 nt, Human
aggagaaauucagagaaugaaa

SEQ ID NO: 120220 - RNA, 25 nt, Human
caacugaaauuuagacaauaaacuc

SEQ ID NO: 120221 - RNA, 22 nt, Human
caagacacaacugaaauuuaga

SEQ ID NO: 120222 - RNA, 25 nt, Human
cuuaguaaacacuuuaauacccucu

SEQ ID NO: 120223 - RNA, 25 nt, Human
uaaguagauaacucaaaaagaacaa

SEQ ID NO: 120224 - RNA, 21 nt, Human
uagcuuaagaaaaagaaugau

SEQ ID NO: 120225 - RNA, 22 nt, Human
ucacugcacaaaacuauuuuaa

SEQ ID NO: 120226 - RNA, 21 nt, Human
ucagauaagaugguuuuccuu

SEQ ID NO: 120227 - RNA, 22 nt, Human
uggagagaagcaaguuguguug

SEQ ID NO: 120228 - RNA, 19 nt, Human
uggcaagacacaacugaaa

SEQ ID NO: 120229 - RNA, 25 nt, Human
uuaguaaacacuuuaauacccucug

SEQ ID NO: 120230 - RNA, 24 nt, Human
uuauugaaaagaaaaaagaaaauc

SEQ ID NO: 120231 - RNA, 18 nt, Human
aaaauauugaauguggca

SEQ ID NO: 120232 - RNA, 22 nt, Human
agaagagcugaaucugugaaaa

SEQ ID NO: 120233 - RNA, 20 nt, Human
agagaagagcugaaucugug

SEQ ID NO: 120234 - RNA, 19 nt, Human
ggucuugguuggcaguagg

SEQ ID NO: 120235 - RNA, 25 nt, Human
uaaaauguaaggagagaagagcuga

SEQ ID NO: 120236 - RNA, 21 nt, Human
uccugcguuguguucuuugau

SEQ ID NO: 120237 - RNA, 19 nt, Human
ugaguuggccugucagcug

SEQ ID NO: 120238 - RNA, 22 nt, Human
uggcaguagguugaguuggccu

SEQ ID NO: 120239 - RNA, 21 nt, Human
uguucuuugauauuuccuugg

SEQ ID NO: 120240 - RNA, 23 nt, Human
uuggcaguagguugaguuggccu

SEQ ID NO: 120241 - RNA, 21 nt, Human
ccagucucagucaauucaaaa

SEQ ID NO: 120242 - RNA, 26 nt, Human
gcacaauuccagaaacaagggaacgc

SEQ ID NO: 120243 - RNA, 18 nt, Human
uaauuuauugaaaugacu

SEQ ID NO: 120244 - RNA, 22 nt, Human
uauaaaauaaauaaagggacaa

SEQ ID NO: 120245 - RNA, 19 nt, Human
ucaaaaauaaggagggaaa

SEQ ID NO: 120246 - RNA, 20 nt, Human
ugauauguuuguagcauuuc

SEQ ID NO: 120247 - RNA, 21 nt, Human
uggaaaggaaauagauucuua

SEQ ID NO: 120248 - RNA, 28 nt, Human
uggaaaggaaauagauucuuaaagaaau

SEQ ID NO: 120249 - RNA, 20 nt, Human
uguauacauauguuugauau

SEQ ID NO: 120250 - RNA, 27 nt, Human
aaacggaacacggaggccuuuacccuc

SEQ ID NO: 120251 - RNA, 26 nt, Human
aaauaaaaacaaaaucccagaucaua

SEQ ID NO: 120252 - RNA, 25 nt, Human
acacuggaaucuuugguugcuacca

SEQ ID NO: 120253 - RNA, 25 nt, Human
acccuaagaaugcacaauugugagc

SEQ ID NO: 120254 - RNA, 22 nt, Human
acuugaaaaaaugcaauagaaa

SEQ ID NO: 120255 - RNA, 22 nt, Human
acuugcaaaccccagggaugga

SEQ ID NO: 120256 - RNA, 18 nt, Human
agagucuuucauaugcuc

SEQ ID NO: 120257 - RNA, 22 nt, Human
agagucuuucauaugcucaaac

SEQ ID NO: 120258 - RNA, 19 nt, Human
agauggaggcuggggccaa

SEQ ID NO: 120259 - RNA, 21 nt, Human
agauguuaacuaaauuucugu

SEQ ID NO: 120260 - RNA, 20 nt, Human
agcaucaccaaugcugccca

SEQ ID NO: 120261 - RNA, 21 nt, Human
aggcaaggcuacggaggaggg

SEQ ID NO: 120262 - RNA, 19 nt, Human
aggcagagucuuucauaug

SEQ ID NO: 120263 - RNA, 21 nt, Human
aggcagagucuuucauaugcu

SEQ ID NO: 120264 - RNA, 26 nt, Human
aggcuacaacucaggauacagcauca

SEQ ID NO: 120265 - RNA, 25 nt, Human
auacagcaucaccaaugcugcccag

SEQ ID NO: 120266 - RNA, 22 nt, Human
aucacaacuguggcugaagacu

SEQ ID NO: 120267 - RNA, 24 nt, Human
auuucuagauuuggggagaaacaa

SEQ ID NO: 120268 - RNA, 24 nt, Human
caaaacaaaagguuuuaacaaaaa

SEQ ID NO: 120269 - RNA, 21 nt, Human
caagccccgacaccucuggga

SEQ ID NO: 120270 - RNA, 22 nt, Human
caauagaaaaccggacaccaug

SEQ ID NO: 120271 - RNA, 24 nt, Human
cagaggcuacaacucaggauacag

SEQ ID NO: 120272 - RNA, 28 nt, Human
cagaucauauagauguuuaguuaaagag

SEQ ID NO: 120273 - RNA, 21 nt, Human
caggauacagcaucaccaaug

SEQ ID NO: 120274 - RNA, 21 nt, Human
cauuauagaguuaaugcagag

SEQ ID NO: 120275 - RNA, 18 nt, Human
cauuuaguuaacuuuucc

SEQ ID NO: 120276 - RNA, 24 nt, Human
ccagggauggaaaaacccuaagaa

SEQ ID NO: 120277 - RNA, 19 nt, Human
ccccagggauggaaaaacc

SEQ ID NO: 120278 - RNA, 20 nt, Human
ccccagggauggaaaaaccc

SEQ ID NO: 120279 - RNA, 19 nt, Human
ccucugggaagaggacgga

SEQ ID NO: 120280 - RNA, 20 nt, Human
cggcaggaaacggaacacgg

SEQ ID NO: 120281 - RNA, 22 nt, Human
cuaguagucacuaaguuuuucu

SEQ ID NO: 120282 - RNA, 22 nt, Human
cucaggauacagcaucaccaau

SEQ ID NO: 120283 - RNA, 23 nt, Human
cuuguaaacaaaaaagcucccau

SEQ ID NO: 120284 - RNA, 19 nt, Human
gagcauuuaacaaccauca

SEQ ID NO: 120285 - RNA, 22 nt, Human
gcuccgaucaucugcucugcuu

SEQ ID NO: 120286 - RNA, 24 nt, Human
guuaacuuuuccacuugaaaaaau

SEQ ID NO: 120287 - RNA, 20 nt, Human
uaaaaacaaaaucccagauc

SEQ ID NO: 120288 - RNA, 23 nt, Human
uacaacucaggauacagcaucac

SEQ ID NO: 120289 - RNA, 26 nt, Human
ucaaaauaaaaacaaaaucccagauc

SEQ ID NO: 120290 - RNA, 24 nt, Human
ucaaccauuuaguuaacuuuucca

SEQ ID NO: 120291 - RNA, 19 nt, Human
ucauaugcucaaacacugg

SEQ ID NO: 120292 - RNA, 23 nt, Human
ucccagaucauauagauguuuac

SEQ ID NO: 120293 - RNA, 19 nt, Human
ucugcuucuucuguuccuc

SEQ ID NO: 120294 - RNA, 19 nt, Human
ucuuaagucuucacuuuag

SEQ ID NO: 120295 - RNA, 23 nt, Human
ucuuuacaccaaguaaaugguug

SEQ ID NO: 120296 - RNA, 19 nt, Human
ugaaaaaaugcaauagaaa

SEQ ID NO: 120297 - RNA, 24 nt, Human
ugaaaaaaugcaauagaaaaccgg

SEQ ID NO: 120298 - RNA, 23 nt, Human
ugaacuaaaauuucuagauuugg

SEQ ID NO: 120299 - RNA, 19 nt, Human
ugagagacgaagauggagg

SEQ ID NO: 120300 - RNA, 23 nt, Human
ugcucugcuucuucuguuccuca

SEQ ID NO: 120301 - RNA, 21 nt, Human
uggcuugcagacaagaagcca

SEQ ID NO: 120302 - RNA, 19 nt, Human
uggggccaagccccgacac

SEQ ID NO: 120303 - RNA, 23 nt, Human
uuaacuaaauuucugugacaaau

SEQ ID NO: 120304 - RNA, 23 nt, Human
uuaagugaacaacuugcaaaccc

SEQ ID NO: 120305 - RNA, 25 nt, Human
uucaaaauaaaaacaaaaucccaga

SEQ ID NO: 120306 - RNA, 24 nt, Human
uuuuuuuuuuuuuuuuuuuuacag

SEQ ID NO: 120307 - RNA, 23 nt, Human
caccacuggagggagcugaggcc

SEQ ID NO: 120308 - RNA, 23 nt, Human
caccacuggagggagcugaggcc

SEQ ID NO: 120309 - RNA, 20 nt, Human
cacgacagacugaagaccac

SEQ ID NO: 120310 - RNA, 21 nt, Human
cacuggagggagcugaggccc

SEQ ID NO: 120311 - RNA, 21 nt, Human
cacuggagggagcugaggccc

SEQ ID NO: 120312 - RNA, 23 nt, Human
cagcaauaaggagaguucucauc

SEQ ID NO: 120313 - RNA, 20 nt, Human
cagcugccuaaaggagccgc

SEQ ID NO: 120314 - RNA, 21 nt, Human
ccacccgaccaggaauccagu

SEQ ID NO: 120315 - RNA, 18 nt, Human
cccacgagcgucgcuggg

SEQ ID NO: 120316 - RNA, 18 nt, Human
cccacgagcgucgcuggg

SEQ ID NO: 120317 - RNA, 20 nt, Human
cccacgagcgucgcugggug

SEQ ID NO: 120318 - RNA, 20 nt, Human
cccacgagcgucgcugggug

SEQ ID NO: 120319 - RNA, 23 nt, Human
ccccgcuuucaccaucgcuuucc

SEQ ID NO: 120320 - RNA, 18 nt, Human
cccgcuugcccucucccc

SEQ ID NO: 120321 - RNA, 18 nt, Human
cccggcuccgccccccuc

SEQ ID NO: 120322 - RNA, 18 nt, Human
ccgccgcucccagcgccu

SEQ ID NO: 120323 - RNA, 19 nt, Human
ccgcugcugccgcuacugc

SEQ ID NO: 120324 - RNA, 19 nt, Human
ccgcuugcccucuccccgc

SEQ ID NO: 120325 - RNA, 23 nt, Human
ccggcucccggcuccgccccccu

SEQ ID NO: 120326 - RNA, 19 nt, Human
ccucccggccgcuuccugg

SEQ ID NO: 120327 - RNA, 21 nt, Human
ccucuccccgccgcggaugga

SEQ ID NO: 120328 - RNA, 19 nt, Human
ccuuccgaugggagacgag

SEQ ID NO: 120329 - RNA, 18 nt, Human
cgacagacugaagaccac

SEQ ID NO: 120330 - RNA, 24 nt, Human
cgccccgccgcucccagcgccuca

SEQ ID NO: 120331 - RNA, 19 nt, Human
cgccgccgccgcugcuccg

SEQ ID NO: 120332 - RNA, 22 nt, Human
cgccgcugcugccgcuacugcg

SEQ ID NO: 120333 - RNA, 21 nt, Human
cgcugcugccgcuacugcggg

SEQ ID NO: 120334 - RNA, 22 nt, Human
cgcuugcccucuccccgccgcg

SEQ ID NO: 120335 - RNA, 18 nt, Human
cggcccgauucgcuccug

SEQ ID NO: 120336 - RNA, 20 nt, Human
cggcucccggcuccgccccc

SEQ ID NO: 120337 - RNA, 22 nt, Human
cuaccggucccgcuugcccucu

SEQ ID NO: 120338 - RNA, 26 nt, Human
cucacggccccgcuuucaccaucgcu

SEQ ID NO: 120339 - RNA, 18 nt, Human
cucccggccgcuuccugg

SEQ ID NO: 120340 - RNA, 21 nt, Human
cucccgguguuaacauuucga

SEQ ID NO: 120341 - RNA, 22 nt, Human
cucccgguguuaacauuucgau

SEQ ID NO: 120342 - RNA, 19 nt, Human
cuccugcccucccggccgc

SEQ ID NO: 120343 - RNA, 27 nt, Human
cuucccagccccguuacaaccgaguuc

SEQ ID NO: 120344 - RNA, 27 nt, Human
cuucccagccccguuacaaccgaguuc

SEQ ID NO: 120345 - RNA, 21 nt, Human
cuuccugggucugaacucugg

SEQ ID NO: 120346 - RNA, 20 nt, Human
gaguacagggcggccaccac

SEQ ID NO: 120347 - RNA, 20 nt, Human
gaguacagggcggccaccac

SEQ ID NO: 120348 - RNA, 22 nt, Human
gccccgccgcucccagcgccuc

SEQ ID NO: 120349 - RNA, 19 nt, Human
gcugggugaguggccugga

SEQ ID NO: 120350 - RNA, 19 nt, Human
gcugggugaguggccugga

SEQ ID NO: 120351 - RNA, 22 nt, Human
gcuuccugggucugaacucugg

SEQ ID NO: 120352 - RNA, 21 nt, Human
ggaggcggcgccgcugcugcc

SEQ ID NO: 120353 - RNA, 21 nt, Human
gggaggcggcgccgcugcugc

SEQ ID NO: 120354 - RNA, 21 nt, Human
gggugaguggccuggagagcu

SEQ ID NO: 120355 - RNA, 21 nt, Human
gggugaguggccuggagagcu

SEQ ID NO: 120356 - RNA, 19 nt, Human
uaacagaguagaucagcca

SEQ ID NO: 120357 - RNA, 19 nt, Human
uaacagaguagaucagcca

SEQ ID NO: 120358 - RNA, 24 nt, Human
uagcaaaaugauacaaaacugucu

SEQ ID NO: 120359 - RNA, 24 nt, Human
uagcaaaaugauacaaaacugucu

SEQ ID NO: 120360 - RNA, 20 nt, Human
ucacggccccgcuuucacca

SEQ ID NO: 120361 - RNA, 18 nt, Human
ucagggaguacagggcgg

SEQ ID NO: 120362 - RNA, 18 nt, Human
ucagggaguacagggcgg

SEQ ID NO: 120363 - RNA, 24 nt, Human
ucccagccccguuacaaccgaguu

SEQ ID NO: 120364 - RNA, 24 nt, Human
ucccagccccguuacaaccgaguu

SEQ ID NO: 120365 - RNA, 22 nt, Human
ucccccacgagcgucgcugggu

SEQ ID NO: 120366 - RNA, 22 nt, Human
ucccccacgagcgucgcugggu

SEQ ID NO: 120367 - RNA, 21 nt, Human
ucccggcuccgccccccucac

SEQ ID NO: 120368 - RNA, 19 nt, Human
uccuagaccgggggacgug

SEQ ID NO: 120369 - RNA, 19 nt, Human
uccuagaccgggggacgug

SEQ ID NO: 120370 - RNA, 24 nt, Human
uccuagaccgggggacgugucacu

SEQ ID NO: 120371 - RNA, 24 nt, Human
uccuagaccgggggacgugucacu

SEQ ID NO: 120372 - RNA, 21 nt, Human
uccugggucugaacucuggga

SEQ ID NO: 120373 - RNA, 23 nt, Human
ucgauccuagaccgggggacgug

SEQ ID NO: 120374 - RNA, 23 nt, Human
ucgauccuagaccgggggacgug

SEQ ID NO: 120375 - RNA, 22 nt, Human
ucggugcacgacagacugaaga

SEQ ID NO: 120376 - RNA, 20 nt, Human
ucucucucugcuuuucuucc

SEQ ID NO: 120377 - RNA, 20 nt, Human
ucucucucugcuuuucuucc

SEQ ID NO: 120378 - RNA, 21 nt, Human
ugcuccggccccuaccggucc

SEQ ID NO: 120379 - RNA, 20 nt, Human
uggaaucgucagggaguaca

SEQ ID NO: 120380 - RNA, 20 nt, Human
uggaaucgucagggaguaca

SEQ ID NO: 120381 - RNA, 24 nt, Human
uggagggagcugaggcccuggaaa

SEQ ID NO: 120382 - RNA, 24 nt, Human
uggagggagcugaggcccuggaaa

SEQ ID NO: 120383 - RNA, 18 nt, Human
uggcagcucuuggagucu

SEQ ID NO: 120384 - RNA, 18 nt, Human
uggcagcucuuggagucu

SEQ ID NO: 120385 - RNA, 21 nt, Human
uggccuggagagcucccggug

SEQ ID NO: 120386 - RNA, 21 nt, Human
uggccuggagagcucccggug

SEQ ID NO: 120387 - RNA, 18 nt, Human
ugggucugaacucuggga

SEQ ID NO: 120388 - RNA, 21 nt, Human
ugucugcccuucacagcaaua

SEQ ID NO: 120389 - RNA, 21 nt, Human
ugucugcccuucacagcaaua

SEQ ID NO: 120390 - RNA, 20 nt, Human
uugguaguuacaguggaauc

SEQ ID NO: 120391 - RNA, 20 nt, Human
uugguaguuacaguggaauc

SEQ ID NO: 120392 - RNA, 19 nt, Human
uuuccugucgccccgccgc

SEQ ID NO: 120393 - RNA, 21 nt, Human
uuuccugucgccccgccgcua

SEQ ID NO: 120394 - RNA, 24 nt, Human
uuuuuuuuuuuuuucuuuacacag

SEQ ID NO: 120395 - RNA, 24 nt, Human
uuuuuuuuuuuuuucuuuacacag

SEQ ID NO: 120396 - RNA, 22 nt, Human
aaaauaaaaacaaaaagguguu

SEQ ID NO: 120397 - RNA, 24 nt, Human
aaacacaggucaauacauccacac

SEQ ID NO: 120398 - RNA, 19 nt, Human
aagcagucuccauggauuc

SEQ ID NO: 120399 - RNA, 24 nt, Human
aaguaauuuauaacucagagccag

SEQ ID NO: 120400 - RNA, 25 nt, Human
aaguacaaaauuccccccaaaguuc

SEQ ID NO: 120401 - RNA, 23 nt, Human
acaauggaaaagcccagcacggg

SEQ ID NO: 120402 - RNA, 28 nt, Human
acacacacacacacacacacgcagggga

SEQ ID NO: 120403 - RNA, 21 nt, Human
acacacacacacacacacgca

SEQ ID NO: 120404 - RNA, 21 nt, Human
acacacacggagaaaacaaac

SEQ ID NO: 120405 - RNA, 28 nt, Human
acaggaaaaaaguacaaaauucccccca

SEQ ID NO: 120406 - RNA, 24 nt, Human
acagugaagacacuaagcaaacac

SEQ ID NO: 120407 - RNA, 19 nt, Human
agcccagcacgggaaguca

SEQ ID NO: 120408 - RNA, 24 nt, Human
agguggaaccagggagagggggga

SEQ ID NO: 120409 - RNA, 25 nt, Human
aguucuucaguuuuuuuuuuuucag

SEQ ID NO: 120410 - RNA, 25 nt, Human
auacauccacacacacacacacaca

SEQ ID NO: 120411 - RNA, 20 nt, Human
caaaacccagcccugacucc

SEQ ID NO: 120412 - RNA, 23 nt, Human
caaaacccagcccugacuccagg

SEQ ID NO: 120413 - RNA, 31 nt, Human
caauacauccacacacacacacacacacaca

SEQ ID NO: 120414 - RNA, 20 nt, Human
cacacacacacacacacaca

SEQ ID NO: 120415 - RNA, 22 nt, Human
cacacacacacacacacacaca

SEQ ID NO: 120416 - RNA, 26 nt, Human
cacacacacacacacacacacacacg

SEQ ID NO: 120417 - RNA, 18 nt, Human
cacacacacggagaaaac

SEQ ID NO: 120418 - RNA, 18 nt, Human
cacaggaaaaaaguacaa

SEQ ID NO: 120419 - RNA, 21 nt, Human
ccacacacacacacacacaca

SEQ ID NO: 120420 - RNA, 18 nt, Human
ccaccuccccacccacuc

SEQ ID NO: 120421 - RNA, 20 nt, Human
ccaccuccccacccacucca

SEQ ID NO: 120422 - RNA, 21 nt, Human
cccaccaccuccccacccacu

SEQ ID NO: 120423 - RNA, 23 nt, Human
cccaccaccuccccacccacucc

SEQ ID NO: 120424 - RNA, 20 nt, Human
cccagcccugacuccaggcc

SEQ ID NO: 120425 - RNA, 25 nt, Human
ccccaccaccuccccacccacucca

SEQ ID NO: 120426 - RNA, 24 nt, Human
ccccacccacuccauggagaggca

SEQ ID NO: 120427 - RNA, 18 nt, Human
ccccaggugacugucagg

SEQ ID NO: 120428 - RNA, 23 nt, Human
ccccaggugacugucaggaccag

SEQ ID NO: 120429 - RNA, 25 nt, Human
ccccaggugacugucaggaccaggg

SEQ ID NO: 120430 - RNA, 29 nt, Human
ccucccguggaaaaacgaagggcaaagac

SEQ ID NO: 120431 - RNA, 21 nt, Human
cgauaaagcucaaaaaagucc

SEQ ID NO: 120432 - RNA, 21 nt, Human
cgcaggggacgccggccccca

SEQ ID NO: 120433 - RNA, 22 nt, Human
cgccggcccccaccaccucccc

SEQ ID NO: 120434 - RNA, 23 nt, Human
cggcccccaccaccuccccaccc

SEQ ID NO: 120435 - RNA, 18 nt, Human
cuccucccguggaaaaac

SEQ ID NO: 120436 - RNA, 22 nt, Human
gaccucuucuucuuuucccuga

SEQ ID NO: 120437 - RNA, 20 nt, Human
gcaggcggggcgggccgugg

SEQ ID NO: 120438 - RNA, 21 nt, Human
gccggcccccaccaccucccc

SEQ ID NO: 120439 - RNA, 22 nt, Human
ggaggagccuggaggccagggg

SEQ ID NO: 120440 - RNA, 19 nt, Human
gggacaauggaaaagccca

SEQ ID NO: 120441 - RNA, 21 nt, Human
uaaaaacaaaaagguguuaac

SEQ ID NO: 120442 - RNA, 26 nt, Human
uacacaggaaaaaaguacaaaauucc

SEQ ID NO: 120443 - RNA, 31 nt, Human
uacauccacacacacacacacacacacacag

SEQ ID NO: 120444 - RNA, 22 nt, Human
uaggaaaacacacacacggaga

SEQ ID NO: 120445 - RNA, 21 nt, Human
ucagaaagguggaaccaggga

SEQ ID NO: 120446 - RNA, 20 nt, Human
uccacacacacacacacaca

SEQ ID NO: 120447 - RNA, 21 nt, Human
uccacacacacacacacacac

SEQ ID NO: 120448 - RNA, 24 nt, Human
uccacacacacacacacacacaca

SEQ ID NO: 120449 - RNA, 20 nt, Human
uccccacccacuccauggag

SEQ ID NO: 120450 - RNA, 22 nt, Human
ugaagacacuaagcaaacacug

SEQ ID NO: 120451 - RNA, 24 nt, Human
ugaagacacuaagcaaacacuggu

SEQ ID NO: 120452 - RNA, 18 nt, Human
ugacuccaggcuccuccu

SEQ ID NO: 120453 - RNA, 19 nt, Human
ugacuccaggcuccuccuc

SEQ ID NO: 120454 - RNA, 19 nt, Human
uggaaaaacgaagggcaaa

SEQ ID NO: 120455 - RNA, 26 nt, Human
uggaaaagcccagcacgggaagucag

SEQ ID NO: 120456 - RNA, 18 nt, Human
uggagaggcagaggagga

SEQ ID NO: 120457 - RNA, 21 nt, Human
uggagaggcagaggaggagcc

SEQ ID NO: 120458 - RNA, 24 nt, Human
uuaauuaaaaaaaaaaaggaaaaa

SEQ ID NO: 120459 - RNA, 19 nt, Human
uuuuuuuuuuuuaaagaaa

SEQ ID NO: 120460 - RNA, 19 nt, Human
uuuuuuuuuuuuuuuuuaa

SEQ ID NO: 120461 - RNA, 18 nt, Human
aaacuagacucacagcca

SEQ ID NO: 120462 - RNA, 24 nt, Human
aaagaaacggaggggcaggagugg

SEQ ID NO: 120463 - RNA, 19 nt, Human
aacuagacucacagccacc

SEQ ID NO: 120464 - RNA, 22 nt, Human
aagcaaaaacuagacucacagc

SEQ ID NO: 120465 - RNA, 18 nt, Human
aagcugcuccacucugcc

SEQ ID NO: 120466 - RNA, 23 nt, Human
aagugaccccacgucccgggggu

SEQ ID NO: 120467 - RNA, 18 nt, Human
aaugccugucccccuccc

SEQ ID NO: 120468 - RNA, 21 nt, Human
accccacgucccggggguggg

SEQ ID NO: 120469 - RNA, 24 nt, Human
acuacucacuucagcaaagaaacg

SEQ ID NO: 120470 - RNA, 22 nt, Human
agacucacagccaccgcccugg

SEQ ID NO: 120471 - RNA, 20 nt, Human
agcaaagaaacggaggggca

SEQ ID NO: 120472 - RNA, 18 nt, Human
agccacggccccaccccu

SEQ ID NO: 120473 - RNA, 22 nt, Human
agccggcuucagccacggcccc

SEQ ID NO: 120474 - RNA, 26 nt, Human
agcgcccacccgccccuugccagggc

SEQ ID NO: 120475 - RNA, 24 nt, Human
aggaagcuccgugcccacgcgccc

SEQ ID NO: 120476 - RNA, 23 nt, Human
agggcugagggccgagcagggug

SEQ ID NO: 120477 - RNA, 21 nt, Human
agugaccccacgucccggggg

SEQ ID NO: 120478 - RNA, 20 nt, Human
caacaaugccugucccccuc

SEQ ID NO: 120479 - RNA, 19 nt, Human
caccccugccuuccccuuu

SEQ ID NO: 120480 - RNA, 24 nt, Human
caccccugccuuccccuuugguuu

SEQ ID NO: 120481 - RNA, 20 nt, Human
cacggagaagauucaggggg

SEQ ID NO: 120482 - RNA, 24 nt, Human
cagccuccagggcaccccacuggg

SEQ ID NO: 120483 - RNA, 18 nt, Human
cagcuccacagcaccccu

SEQ ID NO: 120484 - RNA, 20 nt, Human
cagcuccacagcaccccucc

SEQ ID NO: 120485 - RNA, 28 nt, Human
cagguguagaaauuucggccaaagucuu

SEQ ID NO: 120486 - RNA, 22 nt, Human
ccagccagggucuggcccuggg

SEQ ID NO: 120487 - RNA, 23 nt, Human
ccagggccgcccccaggccccug

SEQ ID NO: 120488 - RNA, 19 nt, Human
ccccaccccugccuucccc

SEQ ID NO: 120489 - RNA, 22 nt, Human
ccccacuggggaaccgcccgcc

SEQ ID NO: 120490 - RNA, 26 nt, Human
cccccaggccccugcaauauaccugc

SEQ ID NO: 120491 - RNA, 19 nt, Human
ccccuaaauucuauggcuu

SEQ ID NO: 120492 - RNA, 21 nt, Human
ccccuaaauucuauggcuuca

SEQ ID NO: 120493 - RNA, 20 nt, Human
ccccucgagaaaacggccuu

SEQ ID NO: 120494 - RNA, 24 nt, Human
ccccuggcaacaaugccugucccc

SEQ ID NO: 120495 - RNA, 18 nt, Human
cccgccccuugccagggc

SEQ ID NO: 120496 - RNA, 24 nt, Human
cccgccuggcagcgcccacccgcc

SEQ ID NO: 120497 - RNA, 25 nt, Human
cccugggccgcugugggugggcccc

SEQ ID NO: 120498 - RNA, 22 nt, Human
ccggcagccuccagggcacccc

SEQ ID NO: 120499 - RNA, 22 nt, Human
ccuccaggaucacacuacucac

SEQ ID NO: 120500 - RNA, 18 nt, Human
ccucccaccucggguucc

SEQ ID NO: 120501 - RNA, 22 nt, Human
ccucccaccucggguuccaggc

SEQ ID NO: 120502 - RNA, 21 nt, Human
ccugcagggcugggccggggg

SEQ ID NO: 120503 - RNA, 18 nt, Human
ccugcccuccccucgaga

SEQ ID NO: 120504 - RNA, 18 nt, Human
ccugucccccucccagga

SEQ ID NO: 120505 - RNA, 18 nt, Human
cgccugagccaggcgcgg

SEQ ID NO: 120506 - RNA, 24 nt, Human
cggggccaggccggggggccucca

SEQ ID NO: 120507 - RNA, 18 nt, Human
cuagacacagguguagaa

SEQ ID NO: 120508 - RNA, 21 nt, Human
cuccacggugacucugcugcc

SEQ ID NO: 120509 - RNA, 22 nt, Human
cuccaggccgggccugcccucc

SEQ ID NO: 120510 - RNA, 19 nt, Human
cuccgugcccacgcgcccc

SEQ ID NO: 120511 - RNA, 21 nt, Human
cucugcccggcagccuccagg

SEQ ID NO: 120512 - RNA, 18 nt, Human
cuggcccugggccgcugu

SEQ ID NO: 120513 - RNA, 20 nt, Human
cuggcccugggccgcugugg

SEQ ID NO: 120514 - RNA, 19 nt, Human
gacacagguguagaaauuu

SEQ ID NO: 120515 - RNA, 19 nt, Human
gacaccaaccgguccuccc

SEQ ID NO: 120516 - RNA, 22 nt, Human
gagggccgagcagggugacacc

SEQ ID NO: 120517 - RNA, 18 nt, Human
gagugggguagggcgggc

SEQ ID NO: 120518 - RNA, 22 nt, Human
gagugggguagggcgggccucc

SEQ ID NO: 120519 - RNA, 18 nt, Human
gccaguccagggccgccc

SEQ ID NO: 120520 - RNA, 18 nt, Human
gccugucccccucccagg

SEQ ID NO: 120521 - RNA, 20 nt, Human
gcgcagccuccgggagcaag

SEQ ID NO: 120522 - RNA, 19 nt, Human
ggcagccuccagggcaccc

SEQ ID NO: 120523 - RNA, 24 nt, Human
ggccgcugugggugggccccgagg

SEQ ID NO: 120524 - RNA, 18 nt, Human
gggcaggagugggguagg

SEQ ID NO: 120525 - RNA, 20 nt, Human
gggcaggagugggguagggc

SEQ ID NO: 120526 - RNA, 20 nt, Human
gugcccacgcgccccacgcg

SEQ ID NO: 120527 - RNA, 24 nt, Human
uaacgggggcggcuggcggggcgg

SEQ ID NO: 120528 - RNA, 31 nt, Human
ucacagccaccgcccugggcacggccccaag

SEQ ID NO: 120529 - RNA, 21 nt, Human
ucagcaaagaaacggaggggc

SEQ ID NO: 120530 - RNA, 22 nt, Human
ucagcaaagaaacggaggggca

SEQ ID NO: 120531 - RNA, 24 nt, Human
ucagcaaagaaacggaggggcagg

SEQ ID NO: 120532 - RNA, 21 nt, Human
ucagggggcugcacgcgccca

SEQ ID NO: 120533 - RNA, 23 nt, Human
uccacagcaccccuccaggccgg

SEQ ID NO: 120534 - RNA, 22 nt, Human
uccagggccgcccccaggcccc

SEQ ID NO: 120535 - RNA, 23 nt, Human
ucccggggguggggccgccugag

SEQ ID NO: 120536 - RNA, 20 nt, Human
ucgagaagcacccgccuggc

SEQ ID NO: 120537 - RNA, 22 nt, Human
ugagccaggcgcggccccugca

SEQ ID NO: 120538 - RNA, 23 nt, Human
ugcagggcugggccgggggcuuu

SEQ ID NO: 120539 - RNA, 24 nt, Human
ugcagucugcguucuggcuuccag

SEQ ID NO: 120540 - RNA, 19 nt, Human
ugccuuccccuuugguuuc

SEQ ID NO: 120541 - RNA, 26 nt, Human
ugcuccacucugcccggcagccucca

SEQ ID NO: 120542 - RNA, 18 nt, Human
ugggaagagacugcagca

SEQ ID NO: 120543 - RNA, 21 nt, Human
ugggguagggcgggccucugu

SEQ ID NO: 120544 - RNA, 23 nt, Human
uucagcaaagaaacggaggggca

SEQ ID NO: 120545 - RNA, 23 nt, Human
uucagccacggccccaccccugc

SEQ ID NO: 120546 - RNA, 21 nt, Human
uuuggugcagcauuuugguug

SEQ ID NO: 120547 - RNA, 24 nt, Human
uuuuuugguuucauuuuucuuuua

SEQ ID NO: 120548 - RNA, 18 nt, Human
aagauucauuuuaccacc

SEQ ID NO: 120549 - RNA, 20 nt, Human
acaacagaagaacuucugga

SEQ ID NO: 120550 - RNA, 21 nt, Human
agaaaaaaaaaaagaaaaaga

SEQ ID NO: 120551 - RNA, 22 nt, Human
agaaaaaaaaaaagaaaaagaa

SEQ ID NO: 120552 - RNA, 22 nt, Human
agagaaaaaaaaaaagaaaaag

SEQ ID NO: 120553 - RNA, 18 nt, Human
agagugaguccuugaaaa

SEQ ID NO: 120554 - RNA, 18 nt, Human
auuccauucacugauggg

SEQ ID NO: 120555 - RNA, 22 nt, Human
auuccauucacugaugggcaaa

SEQ ID NO: 120556 - RNA, 23 nt, Human
caaaauaauuacacagacaccau

SEQ ID NO: 120557 - RNA, 18 nt, Human
caacaaaagcggagcaca

SEQ ID NO: 120558 - RNA, 22 nt, Human
cacaaaauaugaacuucucaag

SEQ ID NO: 120559 - RNA, 18 nt, Human
cacugcaacaagguucac

SEQ ID NO: 120560 - RNA, 22 nt, Human
cauugcauggcacauccaaagu

SEQ ID NO: 120561 - RNA, 26 nt, Human
cauuuuaccaccaccaucugccgaac

SEQ ID NO: 120562 - RNA, 22 nt, Human
cauuuuuguuucuaagagugag

SEQ ID NO: 120563 - RNA, 23 nt, Human
cucauugguccauuccauucacu

SEQ ID NO: 120564 - RNA, 21 nt, Human
cuuccaccuuauacacugcaa

SEQ ID NO: 120565 - RNA, 22 nt, Human
gcaguaaguuucggugagauuu

SEQ ID NO: 120566 - RNA, 21 nt, Human
ggugagauuucuuuaggcuuc

SEQ ID NO: 120567 - RNA, 20 nt, Human
guugacacuuaagauacugu

SEQ ID NO: 120568 - RNA, 31 nt, Human
uaaauuagagaaaaaaaaaaagaaaaagaaa

SEQ ID NO: 120569 - RNA, 21 nt, Human
uaacuccccaggaucugucug

SEQ ID NO: 120570 - RNA, 24 nt, Human
uaacuccccaggaucugucugugu

SEQ ID NO: 120571 - RNA, 18 nt, Human
uaacugguugacacuuaa

SEQ ID NO: 120572 - RNA, 23 nt, Human
uaagacaaccacaaaaugaagua

SEQ ID NO: 120573 - RNA, 22 nt, Human
uacacagacaccauugcauggc

SEQ ID NO: 120574 - RNA, 23 nt, Human
uaccaccaccaucugccgaaccc

SEQ ID NO: 120575 - RNA, 24 nt, Human
uaccaccaccaucugccgaaccca

SEQ ID NO: 120576 - RNA, 21 nt, Human
uaguguauuucuuuauaacuc

SEQ ID NO: 120577 - RNA, 21 nt, Human
uauuuugcauuuuuaaaaaua

SEQ ID NO: 120578 - RNA, 18 nt, Human
ucauuuuaccaccaccau

SEQ ID NO: 120579 - RNA, 27 nt, Human
uccucaguaccucugggcagugacugu

SEQ ID NO: 120580 - RNA, 21 nt, Human
ucuggaaaauguucuauggaa

SEQ ID NO: 120581 - RNA, 23 nt, Human
ugaaaucaaugcagaugucacaa

SEQ ID NO: 120582 - RNA, 20 nt, Human
ugacccacuuuuuauugcug

SEQ ID NO: 120583 - RNA, 23 nt, Human
ugauaccaccucauugguccauu

SEQ ID NO: 120584 - RNA, 23 nt, Human
ugauuuuaaucacaagacagcag

SEQ ID NO: 120585 - RNA, 18 nt, Human
ugcauggcacauccaaag

SEQ ID NO: 120586 - RNA, 22 nt, Human
ugcauggcacauccaaaguuuu

SEQ ID NO: 120587 - RNA, 21 nt, Human
ugggcagugacuguaccauga

SEQ ID NO: 120588 - RNA, 24 nt, Human
uuaaucacaagacagcagaugaac

SEQ ID NO: 120589 - RNA, 24 nt, Human
uuacagaaguuauaaaaaaccaga

SEQ ID NO: 120590 - RNA, 22 nt, Human
uuagagaaaaaaaaaaagaaaa

SEQ ID NO: 120591 - RNA, 19 nt, Human
uuccucaguaccucugggc

SEQ ID NO: 120592 - RNA, 23 nt, Human
uuccucaguaccucugggcagug

SEQ ID NO: 120593 - RNA, 22 nt, Human
uucuuuaggcuuccaccuuaua

SEQ ID NO: 120594 - RNA, 24 nt, Human
uugcauggcacauccaaaguuuuc

SEQ ID NO: 120595 - RNA, 21 nt, Human
uuugacaaaacuuuaaagcuu

SEQ ID NO: 120596 - RNA, 21 nt, Human
aaaaagaaaaaagaaaaucag

SEQ ID NO: 120597 - RNA, 23 nt, Human
aacaauggugggaaugggaagaa

SEQ ID NO: 120598 - RNA, 23 nt, Human
aacagggaaaagaccaagguaag

SEQ ID NO: 120599 - RNA, 23 nt, Human
aacuacuauaaauccacaagcaa

SEQ ID NO: 120600 - RNA, 21 nt, Human
aagagcacgagauaccaaccc

SEQ ID NO: 120601 - RNA, 25 nt, Human
aagcgaccagcaagcaguccacugc

SEQ ID NO: 120602 - RNA, 19 nt, Human
aagcggcagcggcggcggc

SEQ ID NO: 120603 - RNA, 18 nt, Human
aagcugcaucaaggagag

SEQ ID NO: 120604 - RNA, 20 nt, Human
aagugugggacgguggagga

SEQ ID NO: 120605 - RNA, 24 nt, Human
acagggaaaagaccaagguaagga

SEQ ID NO: 120606 - RNA, 20 nt, Human
acuacuauaaauccacaagc

SEQ ID NO: 120607 - RNA, 19 nt, Human
acuuccacaagagccacua

SEQ ID NO: 120608 - RNA, 21 nt, Human
agaaaaaagaaaaucagccua

SEQ ID NO: 120609 - RNA, 23 nt, Human
agaagucuccaccuaaaugcagc

SEQ ID NO: 120610 - RNA, 19 nt, Human
agcugcaucaaggagaggg

SEQ ID NO: 120611 - RNA, 23 nt, Human
agucuccaccuaaaugcagcagc

SEQ ID NO: 120612 - RNA, 23 nt, Human
auggccaagacaaagaaaacuaa

SEQ ID NO: 120613 - RNA, 18 nt, Human
caagacaaagaaaacuaa

SEQ ID NO: 120614 - RNA, 22 nt, Human
cacacuuccacaagagccacua

SEQ ID NO: 120615 - RNA, 23 nt, Human
caccccuccccgccaggcgcaag

SEQ ID NO: 120616 - RNA, 18 nt, Human
cacggugcuucugaagug

SEQ ID NO: 120617 - RNA, 21 nt, Human
cagcagccgggauugaggcug

SEQ ID NO: 120618 - RNA, 22 nt, Human
cagcauguugggagaugaacag

SEQ ID NO: 120619 - RNA, 20 nt, Human
caucaaggagaggguggacu

SEQ ID NO: 120620 - RNA, 22 nt, Human
ccaagacaaagaaaacuaagaa

SEQ ID NO: 120621 - RNA, 24 nt, Human
ccaccucugcucaggcaucaggag

SEQ ID NO: 120622 - RNA, 21 nt, Human
ccaccugcagguaauuuuuca

SEQ ID NO: 120623 - RNA, 18 nt, Human
ccucccuuccuucuuucc

SEQ ID NO: 120624 - RNA, 21 nt, Human
ccuuccuuucuuccugccucc

SEQ ID NO: 120625 - RNA, 25 nt, Human
ccuuccuuucuuccugccuccccug

SEQ ID NO: 120626 - RNA, 18 nt, Human
ccuucuuuccuuccuucc

SEQ ID NO: 120627 - RNA, 24 nt, Human
cggcagcggcggcggccgcucucc

SEQ ID NO: 120628 - RNA, 21 nt, Human
cuaagacacacuuccacaaga

SEQ ID NO: 120629 - RNA, 21 nt, Human
cuuccuucuuuccuuccuucc

SEQ ID NO: 120630 - RNA, 23 nt, Human
cuucugaaguguuucaccccucc

SEQ ID NO: 120631 - RNA, 23 nt, Human
gaaaaaaaaauuuguccaugaaa

SEQ ID NO: 120632 - RNA, 21 nt, Human
gacaaagaaaacuaagaaaga

SEQ ID NO: 120633 - RNA, 19 nt, Human
gaccuuguuucagaccugu

SEQ ID NO: 120634 - RNA, 18 nt, Human
gagcacagcauguuggga

SEQ ID NO: 120635 - RNA, 22 nt, Human
gagcacgagauaccaacccccu

SEQ ID NO: 120636 - RNA, 18 nt, Human
gaggggagaaaaaaaaaa

SEQ ID NO: 120637 - RNA, 18 nt, Human
gaguuaugaaaaguucga

SEQ ID NO: 120638 - RNA, 23 nt, Human
gcacagcauguugggagaugaac

SEQ ID NO: 120639 - RNA, 18 nt, Human
gcggcagcggcggcggcc

SEQ ID NO: 120640 - RNA, 19 nt, Human
ggacucccccaccucugcu

SEQ ID NO: 120641 - RNA, 23 nt, Human
ggcagcggcggcggccgcucucc

SEQ ID NO: 120642 - RNA, 19 nt, Human
gguaaggagccugggaggg

SEQ ID NO: 120643 - RNA, 26 nt, Human
gugaugaggaacuaaauuugggaggg

SEQ ID NO: 120644 - RNA, 18 nt, Human
guggacucccccaccucu

SEQ ID NO: 120645 - RNA, 18 nt, Human
uaaccccacugaagcgcu

SEQ ID NO: 120646 - RNA, 22 nt, Human
uaacuaagacacacuuccacaa

SEQ ID NO: 120647 - RNA, 18 nt, Human
uacugaacagaaguuuuu

SEQ ID NO: 120648 - RNA, 27 nt, Human
uaugacugaacuacuauaaauccacaa

SEQ ID NO: 120649 - RNA, 18 nt, Human
ucaccccuccccgccagg

SEQ ID NO: 120650 - RNA, 25 nt, Human
ucaccccuccccgccaggcgcaagc

SEQ ID NO: 120651 - RNA, 23 nt, Human
ucagacacggugcuucugaagug

SEQ ID NO: 120652 - RNA, 20 nt, Human
ucccuuccuucuuuccuucc

SEQ ID NO: 120653 - RNA, 20 nt, Human
uccucccuuccuucuuuccc

SEQ ID NO: 120654 - RNA, 28 nt, Human
ucgaguuaaaaaaaaaaagaaaaaagaa

SEQ ID NO: 120655 - RNA, 20 nt, Human
ucuuacugaacagaaguuuu

SEQ ID NO: 120656 - RNA, 20 nt, Human
ucuuuguucuuuugugauga

SEQ ID NO: 120657 - RNA, 20 nt, Human
ugaacagggaaaagaccaag

SEQ ID NO: 120658 - RNA, 26 nt, Human
ugaguuggauuuaggguucuccccgg

SEQ ID NO: 120659 - RNA, 22 nt, Human
ugauguaacuaagacacacuuc

SEQ ID NO: 120660 - RNA, 23 nt, Human
ugcuucugaaguguuucaccccu

SEQ ID NO: 120661 - RNA, 22 nt, Human
ugggaaugggaagaagucucca

SEQ ID NO: 120662 - RNA, 21 nt, Human
ugggaggggagaaaaaaaaau

SEQ ID NO: 120663 - RNA, 18 nt, Human
uucuuacugaacagaagu

SEQ ID NO: 120664 - RNA, 20 nt, Human
uuuaguaucugucugcauuu

SEQ ID NO: 120665 - RNA, 18 nt, Human
aacaggaagccaaaggca

SEQ ID NO: 120666 - RNA, 21 nt, Human
aacaguaaccaacaacauucu

SEQ ID NO: 120667 - RNA, 24 nt, Human
aaucgcuugaaccagggaggugga

SEQ ID NO: 120668 - RNA, 21 nt, Human
accggggggcggcgcggggcg

SEQ ID NO: 120669 - RNA, 18 nt, Human
acugcacuccagccuggg

SEQ ID NO: 120670 - RNA, 23 nt, Human
acugcacuccagccugggugaca

SEQ ID NO: 120671 - RNA, 22 nt, Human
aggcaggagaaucgcuugaacc

SEQ ID NO: 120672 - RNA, 24 nt, Human
aggcaggagaaucgcuugaaccag

SEQ ID NO: 120673 - RNA, 29 nt, Human
agggagguggagguugcagugacaacggu

SEQ ID NO: 120674 - RNA, 24 nt, Human
aggguggcggcggcggcgcggcgg

SEQ ID NO: 120675 - RNA, 24 nt, Human
agguggagguugcagugagcugag

SEQ ID NO: 120676 - RNA, 24 nt, Human
auucugcauacccuucacauuccc

SEQ ID NO: 120677 - RNA, 24 nt, Human
auugcgccacugcacuccagccug

SEQ ID NO: 120678 - RNA, 21 nt, Human
cacauacugcgcccguccccc

SEQ ID NO: 120679 - RNA, 18 nt, Human
cacuccagccugggugac

SEQ ID NO: 120680 - RNA, 19 nt, Human
cacuccagccugggugaca

SEQ ID NO: 120681 - RNA, 19 nt, Human
cacugcacuccagccuggg

SEQ ID NO: 120682 - RNA, 21 nt, Human
cacugcacuccagccugggug

SEQ ID NO: 120683 - RNA, 22 nt, Human
cacugcacuccagccuggguga

SEQ ID NO: 120684 - RNA, 23 nt, Human
cacugcacuccagccugggugac

SEQ ID NO: 120685 - RNA, 24 nt, Human
cacugcacuccagccugggugaca

SEQ ID NO: 120686 - RNA, 20 nt, Human
ccacugcacuccagccuggg

SEQ ID NO: 120687 - RNA, 20 nt, Human
ccacugcacuccagccuggg

SEQ ID NO: 120688 - RNA, 20 nt, Human
ccacugcacuccagccuggg

SEQ ID NO: 120689 - RNA, 21 nt, Human
ccacugcacuccagccugggu

SEQ ID NO: 120690 - RNA, 24 nt, Human
ccacugcacuccagccugggugac

SEQ ID NO: 120691 - RNA, 21 nt, Human
ccagggagguggagguugcag

SEQ ID NO: 120692 - RNA, 18 nt, Human
cccccacuguggagucug

SEQ ID NO: 120693 - RNA, 26 nt, Human
cgccacugcacuccagccugggugac

SEQ ID NO: 120694 - RNA, 24 nt, Human
cgcggggcgcagaggguggcaggg

SEQ ID NO: 120695 - RNA, 21 nt, Human
cggcgcggcgggggacgcggg

SEQ ID NO: 120696 - RNA, 25 nt, Human
cgggaccggggggcggcgcggggcg

SEQ ID NO: 120697 - RNA, 19 nt, Human
cggggcgucgggcggagga

SEQ ID NO: 120698 - RNA, 22 nt, Human
gagaaucgcuugaaccagggag

SEQ ID NO: 120699 - RNA, 23 nt, Human
gagauugcgccacugcacuccag

SEQ ID NO: 120700 - RNA, 21 nt, Human
gagguggagguugcagugagc

SEQ ID NO: 120701 - RNA, 23 nt, Human
gagguugcagugagcugagauug

SEQ ID NO: 120702 - RNA, 18 nt, Human
gauuugguucuuguucug

SEQ ID NO: 120703 - RNA, 19 nt, Human
gccacugcacuccagccug

SEQ ID NO: 120704 - RNA, 24 nt, Human
gccacugcacuccagccuggguga

SEQ ID NO: 120705 - RNA, 18 nt, Human
gcgcggcgggggacgcgg

SEQ ID NO: 120706 - RNA, 18 nt, Human
gcggcgcggggcgcagag

SEQ ID NO: 120707 - RNA, 21 nt, Human
gcggcggcggcgcggcggggg

SEQ ID NO: 120708 - RNA, 22 nt, Human
ggaaaagugggagaaccgcaac

SEQ ID NO: 120709 - RNA, 24 nt, Human
ggacgcggggcgucgggcggagga

SEQ ID NO: 120710 - RNA, 24 nt, Human
ggaggcaggagaaucgcuugaacc

SEQ ID NO: 120711 - RNA, 22 nt, Human
ggagguugcagugagcugagau

SEQ ID NO: 120712 - RNA, 24 nt, Human
ggagguugcagugagcugagauug

SEQ ID NO: 120713 - RNA, 25 nt, Human
ggagucuguggucagcuaguuagcg

SEQ ID NO: 120714 - RNA, 22 nt, Human
ggcgcggcgggggacgcggggc

SEQ ID NO: 120715 - RNA, 20 nt, Human
gggcggcgcggggcgcagag

SEQ ID NO: 120716 - RNA, 18 nt, Human
gggcgucgggcggaggag

SEQ ID NO: 120717 - RNA, 25 nt, Human
ggggcgcagaggguggcggcggcgg

SEQ ID NO: 120718 - RNA, 19 nt, Human
gguggagguugcagugagc

SEQ ID NO: 120719 - RNA, 19 nt, Human
guggcggcggcggcgcggc

SEQ ID NO: 120720 - RNA, 19 nt, Human
guugcagugagcugagauu

SEQ ID NO: 120721 - RNA, 21 nt, Human
guugcagugagcugagauugc

SEQ ID NO: 120722 - RNA, 18 nt, Human
uacauucggaagugaggu

SEQ ID NO: 120723 - RNA, 18 nt, Human
uacgguggugggcugccc

SEQ ID NO: 120724 - RNA, 24 nt, Human
ucgcuugaaccagggagguggagg

SEQ ID NO: 120725 - RNA, 22 nt, Human
ugagcugagauugcgccacugc

SEQ ID NO: 120726 - RNA, 24 nt, Human
ugauuugguucuuguucugcuuau

SEQ ID NO: 120727 - RNA, 18 nt, Human
uggaaaaacaggcggccc

SEQ ID NO: 120728 - RNA, 21 nt, Human
uggcggcggcggcgcggcggg

SEQ ID NO: 120729 - RNA, 22 nt, Human
uggcggcggcggcgcggcgggg

SEQ ID NO: 120730 - RNA, 22 nt, Human
uuagcgugguuugcuggaaaaa

SEQ ID NO: 120731 - RNA, 18 nt, Human
uucgugcucgccaaaccu

SEQ ID NO: 120732 - RNA, 24 nt, Human
uugaaccagggagguggagguugc

SEQ ID NO: 120733 - RNA, 28 nt, Human
uugauauacgguggugggcugcccuucu

SEQ ID NO: 120734 - RNA, 19 nt, Human
uugcagugagcugagauug

SEQ ID NO: 120735 - RNA, 22 nt, Human
uugcagugagcugagauugcgc

SEQ ID NO: 120736 - RNA, 23 nt, Human
uugcgccacugcacuccagccug

SEQ ID NO: 120737 - RNA, 24 nt, Human
uugugucugcucacggaacgugau

SEQ ID NO: 120738 - RNA, 21 nt, Human
uuugauuugguucuuguucug

SEQ ID NO: 120739 - RNA, 23 nt, Human
aaaaaggaaugcagcaaagaaga

SEQ ID NO: 120740 - RNA, 23 nt, Human
aaaguccuccauucaggccuuuc

SEQ ID NO: 120741 - RNA, 20 nt, Human
aaaugcuuacuuucugcucu

SEQ ID NO: 120742 - RNA, 23 nt, Human
aagcgugguggcccggggaagga

SEQ ID NO: 120743 - RNA, 21 nt, Human
acaccuaauguucucggcugu

SEQ ID NO: 120744 - RNA, 23 nt, Human
agaguucgacauuggaguccuua

SEQ ID NO: 120745 - RNA, 21 nt, Human
aggaaaggcacaggaaguuag

SEQ ID NO: 120746 - RNA, 19 nt, Human
aguuccaucaggaucccau

SEQ ID NO: 120747 - RNA, 24 nt, Human
auugcaguuuggggggaaaauuca

SEQ ID NO: 120748 - RNA, 22 nt, Human
caacccaaaaugacugaacggg

SEQ ID NO: 120749 - RNA, 21 nt, Human
cacggcaacccaaaaugacug

SEQ ID NO: 120750 - RNA, 21 nt, Human
cacggcaacccaaaaugacuu

SEQ ID NO: 120751 - RNA, 20 nt, Human
cagcaaagaagaguucgaca

SEQ ID NO: 120752 - RNA, 23 nt, Human
cagccgaaccaaugauuaaagac

SEQ ID NO: 120753 - RNA, 24 nt, Human
caggaaaagccaucuucagucuug

SEQ ID NO: 120754 - RNA, 18 nt, Human
caggccuuucuuguaagu

SEQ ID NO: 120755 - RNA, 21 nt, Human
cauguagaagcaaacugcacc

SEQ ID NO: 120756 - RNA, 19 nt, Human
cauuuucuuucauuuuguc

SEQ ID NO: 120757 - RNA, 24 nt, Human
ccaaugauuaaagaccucuaaggc

SEQ ID NO: 120758 - RNA, 18 nt, Human
ccagaaaggcucggggca

SEQ ID NO: 120759 - RNA, 18 nt, Human
ccuauggcugagauaggg

SEQ ID NO: 120760 - RNA, 23 nt, Human
ccuuuagcaucauguagaagcca

SEQ ID NO: 120761 - RNA, 20 nt, Human
cgaggugauaggaaaggcac

SEQ ID NO: 120762 - RNA, 24 nt, Human
cgcacgccuggaguucuuccccag

SEQ ID NO: 120763 - RNA, 20 nt, Human
cggcuuauugcaguuugggg

SEQ ID NO: 120764 - RNA, 25 nt, Human
cuacauaaaagcagccgaaccaaug

SEQ ID NO: 120765 - RNA, 19 nt, Human
cugacagucaaagagcaag

SEQ ID NO: 120766 - RNA, 21 nt, Human
cugcagcgcugcgcgacuggg

SEQ ID NO: 120767 - RNA, 23 nt, Human
cuuaguuccaucaggaucccauu

SEQ ID NO: 120768 - RNA, 22 nt, Human
gaaaugaugaaaacacauguuc

SEQ ID NO: 120769 - RNA, 25 nt, Human
gaagaaaaaggaaugcagcaaagaa

SEQ ID NO: 120770 - RNA, 27 nt, Human
gaagaaaaaggaaugcagcaaagaaga

SEQ ID NO: 120771 - RNA, 18 nt, Human
gccuaaacuacauaaaag

SEQ ID NO: 120772 - RNA, 18 nt, Human
gccuggaguucuucccca

SEQ ID NO: 120773 - RNA, 18 nt, Human
gcggcuuauugcaguuug

SEQ ID NO: 120774 - RNA, 23 nt, Human
ggaguucuuccccagaaaggcuc

SEQ ID NO: 120775 - RNA, 26 nt, Human
ggcaacccaaaaugacugaacggugg

SEQ ID NO: 120776 - RNA, 18 nt, Human
ggccuuggaaggcggcuu

SEQ ID NO: 120777 - RNA, 22 nt, Human
ggugauaggaaaggcacaggaa

SEQ ID NO: 120778 - RNA, 20 nt, Human
gugaagaaaaaggaaugcag

SEQ ID NO: 120779 - RNA, 20 nt, Human
uaaaagcagccgaaccaaug

SEQ ID NO: 120780 - RNA, 24 nt, Human
uacagaaaaguccuccauucaggc

SEQ ID NO: 120781 - RNA, 18 nt, Human
uaggaaaggcacaggaag

SEQ ID NO: 120782 - RNA, 22 nt, Human
uaggaaaggcacaggaaguuag

SEQ ID NO: 120783 - RNA, 21 nt, Human
uaggaagcgugguggcccggg

SEQ ID NO: 120784 - RNA, 18 nt, Human
uaggugcaaugaccuaca

SEQ ID NO: 120785 - RNA, 23 nt, Human
ucacugcagcgcugcgcgacugg

SEQ ID NO: 120786 - RNA, 22 nt, Human
ucaucauuaaauaugcccaaac

SEQ ID NO: 120787 - RNA, 19 nt, Human
uccacaacaccuaauguuc

SEQ ID NO: 120788 - RNA, 24 nt, Human
ugacagucaaagagcaagugaaac

SEQ ID NO: 120789 - RNA, 24 nt, Human
ugacugaacggugguccaaaaauc

SEQ ID NO: 120790 - RNA, 23 nt, Human
ugauaggaaaggcacaggaaguu

SEQ ID NO: 120791 - RNA, 20 nt, Human
ugcgggaggaugcggggcug

SEQ ID NO: 120792 - RNA, 20 nt, Human
uggcccggggaaggaugcgg

SEQ ID NO: 120793 - RNA, 24 nt, Human
uggcugagauaggugcaaugaccu

SEQ ID NO: 120794 - RNA, 21 nt, Human
uguguuuucuagcuguccagg

SEQ ID NO: 120795 - RNA, 18 nt, Human
uuagauaggcuggaaaug

SEQ ID NO: 120796 - RNA, 22 nt, Human
aaaaacacugcauccccagccc

SEQ ID NO: 120797 - RNA, 24 nt, Human
aaaaacacugcauccccagccccc

SEQ ID NO: 120798 - RNA, 21 nt, Human
aaaccaagaccccccaaaaaa

SEQ ID NO: 120799 - RNA, 23 nt, Human
aacuuggcagcaccuccuugguc

SEQ ID NO: 120800 - RNA, 25 nt, Human
aagaccagagcccccucccaccaug

SEQ ID NO: 120801 - RNA, 20 nt, Human
aagcagagccagaguaagga

SEQ ID NO: 120802 - RNA, 19 nt, Human
aaugugugugugugugugu

SEQ ID NO: 120803 - RNA, 23 nt, Human
aauguguguguguguguguuugu

SEQ ID NO: 120804 - RNA, 22 nt, Human
acacacucccagaguucagccc

SEQ ID NO: 120805 - RNA, 19 nt, Human
acacugcauccccagcccc

SEQ ID NO: 120806 - RNA, 27 nt, Human
acacugcauccccagccccccgcaaac

SEQ ID NO: 120807 - RNA, 24 nt, Human
acagaacacugcagcucacagcaa

SEQ ID NO: 120808 - RNA, 20 nt, Human
accaagaccaaagacggaac

SEQ ID NO: 120809 - RNA, 19 nt, Human
accagcaggacccaaagcc

SEQ ID NO: 120810 - RNA, 20 nt, Human
accccccaaaaaacacugca

SEQ ID NO: 120811 - RNA, 24 nt, Human
accccuagguggaccauucauuug

SEQ ID NO: 120812 - RNA, 23 nt, Human
acccuacguccaggcuucuuccu

SEQ ID NO: 120813 - RNA, 24 nt, Human
acgcagacacacacgcacauccaa

SEQ ID NO: 120814 - RNA, 21 nt, Human
acugagcaucucucuacaaua

SEQ ID NO: 120815 - RNA, 21 nt, Human
acugcagcucacagcaaaacc

SEQ ID NO: 120816 - RNA, 25 nt, Human
acugcagcucacagcaaaaccagca

SEQ ID NO: 120817 - RNA, 21 nt, Human
acuugugcuucccucagcugg

SEQ ID NO: 120818 - RNA, 24 nt, Human
agaaaaaugugugugugugugugg

SEQ ID NO: 120819 - RNA, 22 nt, Human
agaaaagaccagagcccccucc

SEQ ID NO: 120820 - RNA, 18 nt, Human
agaaaguguaagcagagc

SEQ ID NO: 120821 - RNA, 22 nt, Human
agaccagagcccccucccacca

SEQ ID NO: 120822 - RNA, 19 nt, Human
agaccuggaaggguuagca

SEQ ID NO: 120823 - RNA, 23 nt, Human
agauaccacagacccacagaaca

SEQ ID NO: 120824 - RNA, 21 nt, Human
agcaaaaccagcaggacccaa

SEQ ID NO: 120825 - RNA, 22 nt, Human
agcaaaaccagcaggacccaaa

SEQ ID NO: 120826 - RNA, 22 nt, Human
agccaacauugacuaagucuga

SEQ ID NO: 120827 - RNA, 26 nt, Human
agccuggcaaacaagagaccagacca

SEQ ID NO: 120828 - RNA, 22 nt, Human
agccuucuauucccaaagcuaa

SEQ ID NO: 120829 - RNA, 24 nt, Human
aggaaaagaagaccuuuguucaaa

SEQ ID NO: 120830 - RNA, 23 nt, Human
aggagugggacccagggcagggg

SEQ ID NO: 120831 - RNA, 18 nt, Human
agggugggguggggcagg

SEQ ID NO: 120832 - RNA, 21 nt, Human
agguugcacauuugggggagg

SEQ ID NO: 120833 - RNA, 20 nt, Human
auccuggccccuggugugga

SEQ ID NO: 120834 - RNA, 22 nt, Human
augcagaaccaccaaaucucag

SEQ ID NO: 120835 - RNA, 22 nt, Human
caaaaccagcaggacccaaagc

SEQ ID NO: 120836 - RNA, 21 nt, Human
caaaagacaaaccgcccacuu

SEQ ID NO: 120837 - RNA, 24 nt, Human
caagaaguacauuaauguccacag

SEQ ID NO: 120838 - RNA, 19 nt, Human
cacacaugcagaaccacca

SEQ ID NO: 120839 - RNA, 18 nt, Human
cacagaacacugcagcuc

SEQ ID NO: 120840 - RNA, 20 nt, Human
cacagaacacugcagcucac

SEQ ID NO: 120841 - RNA, 19 nt, Human
caccauggagccgaggugg

SEQ ID NO: 120842 - RNA, 21 nt, Human
caccauggagccgaggugggg

SEQ ID NO: 120843 - RNA, 19 nt, Human
cacuuuagaaaagaccaga

SEQ ID NO: 120844 - RNA, 23 nt, Human
cagauaccacagacccacagaac

SEQ ID NO: 120845 - RNA, 23 nt, Human
cagcaaaaccagcaggacccaaa

SEQ ID NO: 120846 - RNA, 26 nt, Human
cagcaaaaccagcaggacccaaagcc

SEQ ID NO: 120847 - RNA, 18 nt, Human
cagcaggacccaaagccg

SEQ ID NO: 120848 - RNA, 24 nt, Human
cagccccccgcaaacaaaggaaaa

SEQ ID NO: 120849 - RNA, 21 nt, Human
caggaccaaauccuuauucca

SEQ ID NO: 120850 - RNA, 21 nt, Human
caggauuugggucagaaccaa

SEQ ID NO: 120851 - RNA, 19 nt, Human
cauaaaccaagacccccca

SEQ ID NO: 120852 - RNA, 24 nt, Human
cauccccagccccccgcaaacaaa

SEQ ID NO: 120853 - RNA, 24 nt, Human
caugcagaaccaccaaaucucagc

SEQ ID NO: 120854 - RNA, 21 nt, Human
ccaagaccccccaaaaaacac

SEQ ID NO: 120855 - RNA, 18 nt, Human
ccacagauuuuacccgga

SEQ ID NO: 120856 - RNA, 23 nt, Human
ccacggugcuuuuuuaacccuga

SEQ ID NO: 120857 - RNA, 22 nt, Human
ccagaaaacaggaccaaauccu

SEQ ID NO: 120858 - RNA, 24 nt, Human
ccagagcccccucccaccauggag

SEQ ID NO: 120859 - RNA, 18 nt, Human
ccaggcgaaggcuccaga

SEQ ID NO: 120860 - RNA, 22 nt, Human
ccccaaaaaacacugcaucccc

SEQ ID NO: 120861 - RNA, 23 nt, Human
ccccaaaaaacacugcauccccu

SEQ ID NO: 120862 - RNA, 24 nt, Human
cccccaaaaaacacugcaucccca

SEQ ID NO: 120863 - RNA, 24 nt, Human
ccccccaaaaaacacugcaucccc

SEQ ID NO: 120864 - RNA, 19 nt, Human
cccccgcaaacaaaggaaa

SEQ ID NO: 120865 - RNA, 19 nt, Human
cccccucccaccauggagc

SEQ ID NO: 120866 - RNA, 19 nt, Human
ccccugguguggagagacc

SEQ ID NO: 120867 - RNA, 23 nt, Human
ccuccaucaccuacauauugcuu

SEQ ID NO: 120868 - RNA, 18 nt, Human
ccucccaccauggagccg

SEQ ID NO: 120869 - RNA, 20 nt, Human
ccuggauuuaggaauucagc

SEQ ID NO: 120870 - RNA, 28 nt, Human
cguucacacgcacacacacucauaugcg

SEQ ID NO: 120871 - RNA, 18 nt, Human
cugaaggcauggagggag

SEQ ID NO: 120872 - RNA, 18 nt, Human
cuggguucugucucccca

SEQ ID NO: 120873 - RNA, 24 nt, Human
gaaagugaguaacagacauggagg

SEQ ID NO: 120874 - RNA, 19 nt, Human
gagagaaaguguaagcaga

SEQ ID NO: 120875 - RNA, 19 nt, Human
gagccucaguuucacugug

SEQ ID NO: 120876 - RNA, 22 nt, Human
gcaaaaccagcaggacccaaag

SEQ ID NO: 120877 - RNA, 24 nt, Human
gcaaaaccagcaggacccaaagcc

SEQ ID NO: 120878 - RNA, 22 nt, Human
gcaaacauacacucaugcaccc

SEQ ID NO: 120879 - RNA, 24 nt, Human
gcaaacauacacucaugcacccuc

SEQ ID NO: 120880 - RNA, 21 nt, Human
ggaacuggauccuggccccug

SEQ ID NO: 120881 - RNA, 21 nt, Human
ggagggggaagaaaucugggc

SEQ ID NO: 120882 - RNA, 24 nt, Human
ggauuugggucagaaccaagaugg

SEQ ID NO: 120883 - RNA, 19 nt, Human
ggcaggagugggacccagg

SEQ ID NO: 120884 - RNA, 20 nt, Human
ggcaggagugggacccaggg

SEQ ID NO: 120885 - RNA, 20 nt, Human
ggcugaggggcucaagggca

SEQ ID NO: 120886 - RNA, 18 nt, Human
gggaaagaucaaaagaca

SEQ ID NO: 120887 - RNA, 20 nt, Human
ggggcaggagugggacccag

SEQ ID NO: 120888 - RNA, 24 nt, Human
ggggcagggcaaacggcugagggg

SEQ ID NO: 120889 - RNA, 20 nt, Human
ggggcucaagggcagggagc

SEQ ID NO: 120890 - RNA, 20 nt, Human
gggucagaaccaagauggga

SEQ ID NO: 120891 - RNA, 20 nt, Human
gggugggguggggcaggagu

SEQ ID NO: 120892 - RNA, 23 nt, Human
guccaggaaggagguucuuuguc

SEQ ID NO: 120893 - RNA, 18 nt, Human
gugaaaagcaauuccuuc

SEQ ID NO: 120894 - RNA, 24 nt, Human
guuucaguuuuaacacugagcauc

SEQ ID NO: 120895 - RNA, 23 nt, Human
uaaaaaauuaaaaucuacaagag

SEQ ID NO: 120896 - RNA, 19 nt, Human
uaaaccaagaccccccaaa

SEQ ID NO: 120897 - RNA, 23 nt, Human
uaaaccaagaccccccaaaaaac

SEQ ID NO: 120898 - RNA, 24 nt, Human
uaaaccaagaccccccaaaaaaca

SEQ ID NO: 120899 - RNA, 20 nt, Human
uaagaagacaaaccuguauc

SEQ ID NO: 120900 - RNA, 18 nt, Human
uaaggacuggguaugugc

SEQ ID NO: 120901 - RNA, 22 nt, Human
uaagucuuuagcauggugucua

SEQ ID NO: 120902 - RNA, 21 nt, Human
uacaauaugaccgcagguagg

SEQ ID NO: 120903 - RNA, 23 nt, Human
uagaaaagaccagagcccccucc

SEQ ID NO: 120904 - RNA, 24 nt, Human
uagaaaagaccagagcccccuccc

SEQ ID NO: 120905 - RNA, 19 nt, Human
uagaugaccaaagaugugu

SEQ ID NO: 120906 - RNA, 23 nt, Human
uagccuucuauucccaaagcuaa

SEQ ID NO: 120907 - RNA, 23 nt, Human
ucaaaguaagaagacaaaccugu

SEQ ID NO: 120908 - RNA, 22 nt, Human
ucaauggucauuauuacuuccc

SEQ ID NO: 120909 - RNA, 27 nt, Human
ucacacgcacacacacucauaugcgug

SEQ ID NO: 120910 - RNA, 19 nt, Human
ucacagcaaaaccagcagg

SEQ ID NO: 120911 - RNA, 21 nt, Human
ucacagcaaaaccagcaggac

SEQ ID NO: 120912 - RNA, 23 nt, Human
ucacagcaaaaccagcaggaccc

SEQ ID NO: 120913 - RNA, 18 nt, Human
ucacuguguguaaaaugg

SEQ ID NO: 120914 - RNA, 25 nt, Human
ucagccagacgagaaugaacuuuuc

SEQ ID NO: 120915 - RNA, 18 nt, Human
uccccagccccccgcaaa

SEQ ID NO: 120916 - RNA, 18 nt, Human
uccccaggcgaaggcucc

SEQ ID NO: 120917 - RNA, 22 nt, Human
ucccucagcugggacacacucc

SEQ ID NO: 120918 - RNA, 21 nt, Human
ucucuuguuucucucuggguu

SEQ ID NO: 120919 - RNA, 21 nt, Human
ucugaaggcauggagggaggu

SEQ ID NO: 120920 - RNA, 23 nt, Human
ucuuaguugucaauggucauuau

SEQ ID NO: 120921 - RNA, 21 nt, Human
ucuuguuucucucuggguucu

SEQ ID NO: 120922 - RNA, 23 nt, Human
ugaaaagcaauuccuucauguga

SEQ ID NO: 120923 - RNA, 21 nt, Human
ugaaagugaguaacagacaug

SEQ ID NO: 120924 - RNA, 19 nt, Human
ugaagacaaggauaagggu

SEQ ID NO: 120925 - RNA, 27 nt, Human
ugaaugcaaacauacacucaugcaccc

SEQ ID NO: 120926 - RNA, 24 nt, Human
ugagagauggagggggaagaaauc

SEQ ID NO: 120927 - RNA, 21 nt, Human
ugagggaacuggauccuggcc

SEQ ID NO: 120928 - RNA, 20 nt, Human
ugcaaacauacacucaugca

SEQ ID NO: 120929 - RNA, 24 nt, Human
ugccaagaagaucuuguguaugua

SEQ ID NO: 120930 - RNA, 26 nt, Human
ugcgugccacgcacauggcacacgca

SEQ ID NO: 120931 - RNA, 24 nt, Human
uggaaggguuagcaauacacucuc

SEQ ID NO: 120932 - RNA, 19 nt, Human
uggaggaaaagcuguggau

SEQ ID NO: 120933 - RNA, 21 nt, Human
uggaggaaaagcuguggaucu

SEQ ID NO: 120934 - RNA, 23 nt, Human
ugggaguuggcucugacuucugg

SEQ ID NO: 120935 - RNA, 23 nt, Human
ugggaucuccacacuguguguuu

SEQ ID NO: 120936 - RNA, 25 nt, Human
ugggcuagaaaacuuggcagcaccu

SEQ ID NO: 120937 - RNA, 19 nt, Human
ugggggcagggcaaacggc

SEQ ID NO: 120938 - RNA, 20 nt, Human
uggguucugucuccccaggc

SEQ ID NO: 120939 - RNA, 24 nt, Human
uguaaaaaaaggaaaagaagaccc

SEQ ID NO: 120940 - RNA, 25 nt, Human
uguccuaaaaacaucccuaaaaugc

SEQ ID NO: 120941 - RNA, 22 nt, Human
uguguguguguguguguuugug

SEQ ID NO: 120942 - RNA, 23 nt, Human
uguguguguguguguguuugugu

SEQ ID NO: 120943 - RNA, 23 nt, Human
uguguguguguguguuugugugu

SEQ ID NO: 120944 - RNA, 19 nt, Human
uguguguguguguuugugu

SEQ ID NO: 120945 - RNA, 21 nt, Human
uguguguguguguuugugugu

SEQ ID NO: 120946 - RNA, 19 nt, Human
uguugugcuuucuuuuuuc

SEQ ID NO: 120947 - RNA, 24 nt, Human
uguuuauccaccaagaccaaagac

SEQ ID NO: 120948 - RNA, 22 nt, Human
uuaaccauuuccuaaaugugua

SEQ ID NO: 120949 - RNA, 22 nt, Human
uuccuuuauaucugagccucag

SEQ ID NO: 120950 - RNA, 19 nt, Human
uugcacauuugggggagga

SEQ ID NO: 120951 - RNA, 21 nt, Human
uugcuacuugugcuucccuca

SEQ ID NO: 120952 - RNA, 20 nt, Human
uuuccuuuauaucugagccu

SEQ ID NO: 120953 - RNA, 18 nt, Human
uuuuuuuuuuuuuuuuug

SEQ ID NO: 120954 - RNA, 21 nt, Human
aaaaaccaggggaggaaguuu

SEQ ID NO: 120955 - RNA, 25 nt, Human
aaagcacuguuuauccaggcuccag

SEQ ID NO: 120956 - RNA, 21 nt, Human
aagccugccuccaccuuggcc

SEQ ID NO: 120957 - RNA, 30 nt, Human
acagacccaggacccagagucaugacccaa

SEQ ID NO: 120958 - RNA, 25 nt, Human
acccauccccagagcaaccuaccca

SEQ ID NO: 120959 - RNA, 22 nt, Human
aggacccuccaccccugguguc

SEQ ID NO: 120960 - RNA, 23 nt, Human
aggucacagacccaggacccaga

SEQ ID NO: 120961 - RNA, 22 nt, Human
auaccaucucccuaaaaaacca

SEQ ID NO: 120962 - RNA, 20 nt, Human
auggggcccgggacaugggc

SEQ ID NO: 120963 - RNA, 22 nt, Human
cacagacccaggacccagaguc

SEQ ID NO: 120964 - RNA, 19 nt, Human
cacaugcauguuuagcccu

SEQ ID NO: 120965 - RNA, 21 nt, Human
caccgggcauggaagcaaugg

SEQ ID NO: 120966 - RNA, 18 nt, Human
caccuuggccccugcagu

SEQ ID NO: 120967 - RNA, 21 nt, Human
cacuggcacuacaguggccuc

SEQ ID NO: 120968 - RNA, 20 nt, Human
cagacagcaccgggcaugga

SEQ ID NO: 120969 - RNA, 20 nt, Human
cagacccaggacccagaguc

SEQ ID NO: 120970 - RNA, 19 nt, Human
cagcaucugggcccaggcc

SEQ ID NO: 120971 - RNA, 19 nt, Human
cagcccaaaccagcuccag

SEQ ID NO: 120972 - RNA, 22 nt, Human
caggacccagagucaugaccca

SEQ ID NO: 120973 - RNA, 19 nt, Human
caggggauaccaucucccu

SEQ ID NO: 120974 - RNA, 22 nt, Human
caguggccucggccugagaccc

SEQ ID NO: 120975 - RNA, 20 nt, Human
caucccacacccccaggggc

SEQ ID NO: 120976 - RNA, 24 nt, Human
caucccacacccccaggggcucca

SEQ ID NO: 120977 - RNA, 22 nt, Human
caucucccuaaaaaaccagggg

SEQ ID NO: 120978 - RNA, 18 nt, Human
caugacccauguaggagg

SEQ ID NO: 120979 - RNA, 24 nt, Human
ccagccuagccugcuccaaagcca

SEQ ID NO: 120980 - RNA, 27 nt, Human
ccauccccagagcaaccuacccacccc

SEQ ID NO: 120981 - RNA, 22 nt, Human
cccaaggucacagacccaggac

SEQ ID NO: 120982 - RNA, 19 nt, Human
cccaggacccuccaccccu

SEQ ID NO: 120983 - RNA, 22 nt, Human
cccauccccagagcaaccuacc

SEQ ID NO: 120984 - RNA, 21 nt, Human
ccccagagcaaccuacccacc

SEQ ID NO: 120985 - RNA, 21 nt, Human
ccccaggggcuccaucagucc

SEQ ID NO: 120986 - RNA, 22 nt, Human
cccccaggggcuccaucagucc

SEQ ID NO: 120987 - RNA, 21 nt, Human
ccccugggacuaucucccagg

SEQ ID NO: 120988 - RNA, 19 nt, Human
ccccuggugucuccagguc

SEQ ID NO: 120989 - RNA, 27 nt, Human
cccggaccccugggacuaucucccagg

SEQ ID NO: 120990 - RNA, 23 nt, Human
cccuccuccaucccacaccccca

SEQ ID NO: 120991 - RNA, 19 nt, Human
ccucuugcccucuacucca

SEQ ID NO: 120992 - RNA, 23 nt, Human
ccucuugcccucuacuccagggg

SEQ ID NO: 120993 - RNA, 22 nt, Human
ccugagacccucgaugagcccc

SEQ ID NO: 120994 - RNA, 21 nt, Human
ccuggguuggaguagaaaagc

SEQ ID NO: 120995 - RNA, 21 nt, Human
ccugucccuggcccgaucagc

SEQ ID NO: 120996 - RNA, 22 nt, Human
cggaccccugggacuaucuccc

SEQ ID NO: 120997 - RNA, 24 nt, Human
cuccagggcaggaggacugaacuu

SEQ ID NO: 120998 - RNA, 22 nt, Human
cuccaggggauaccaucucccu

SEQ ID NO: 120999 - RNA, 23 nt, Human
cuccaggucucucuugcucuggg

SEQ ID NO: 121000 - RNA, 24 nt, Human
cuccaucccacacccccaggggcu

SEQ ID NO: 121001 - RNA, 21 nt, Human
cuccauggaaccaagugcccc

SEQ ID NO: 121002 - RNA, 22 nt, Human
cucccuuaaauaaacccauccc

SEQ ID NO: 121003 - RNA, 26 nt, Human
cuccuugcccucuuagcagccugggu

SEQ ID NO: 121004 - RNA, 26 nt, Human
cuggcacuacaguggccucggccuga

SEQ ID NO: 121005 - RNA, 18 nt, Human
cugggcccaggccaggcc

SEQ ID NO: 121006 - RNA, 23 nt, Human
ggcaggaggacugaacuuaagcc

SEQ ID NO: 121007 - RNA, 27 nt, Human
ggcgcucucuccucuugcccucuacuc

SEQ ID NO: 121008 - RNA, 20 nt, Human
gggauaccaucucccuaaaa

SEQ ID NO: 121009 - RNA, 26 nt, Human
gggcaggaggacugaacuuaagccug

SEQ ID NO: 121010 - RNA, 19 nt, Human
gggcccgggacaugggcaa

SEQ ID NO: 121011 - RNA, 24 nt, Human
guuuuuuucucaacucuggggcag

SEQ ID NO: 121012 - RNA, 24 nt, Human
uacaguggccucggccugagaccc

SEQ ID NO: 121013 - RNA, 19 nt, Human
uacccaaggucacagaccc

SEQ ID NO: 121014 - RNA, 22 nt, Human
uacccaaggucacagacccagg

SEQ ID NO: 121015 - RNA, 19 nt, Human
uacccacccugcacccuga

SEQ ID NO: 121016 - RNA, 24 nt, Human
uaucucccaggacccuccaccccu

SEQ ID NO: 121017 - RNA, 20 nt, Human
ucaguccuggcuagcucagc

SEQ ID NO: 121018 - RNA, 20 nt, Human
uccaccuuggccccugcagu

SEQ ID NO: 121019 - RNA, 21 nt, Human
uccagagccuccaaagcacug

SEQ ID NO: 121020 - RNA, 24 nt, Human
uccagagccuccaaagcacuguuu

SEQ ID NO: 121021 - RNA, 19 nt, Human
uccagggcaggaggacuga

SEQ ID NO: 121022 - RNA, 20 nt, Human
uccagggcaggaggacugaa

SEQ ID NO: 121023 - RNA, 21 nt, Human
uccaucccacacccccagggg

SEQ ID NO: 121024 - RNA, 21 nt, Human
uccccagagcaaccuacccac

SEQ ID NO: 121025 - RNA, 18 nt, Human
uccccaggguacuuccuu

SEQ ID NO: 121026 - RNA, 23 nt, Human
ucccggaccccugggacuaucuc

SEQ ID NO: 121027 - RNA, 19 nt, Human
ucccuaaaaaaccagggga

SEQ ID NO: 121028 - RNA, 22 nt, Human
ucccuaaaaaaccaggggagga

SEQ ID NO: 121029 - RNA, 18 nt, Human
ucccuucccuccccaggg

SEQ ID NO: 121030 - RNA, 18 nt, Human
ucuccaggucucucuugc

SEQ ID NO: 121031 - RNA, 19 nt, Human
ucucccaggacccuccacc

SEQ ID NO: 121032 - RNA, 18 nt, Human
ucucccuaaaaaaccagg

SEQ ID NO: 121033 - RNA, 21 nt, Human
ugagcugagggagguuccagc

SEQ ID NO: 121034 - RNA, 25 nt, Human
ugcccccagcugccugcccuagucc

SEQ ID NO: 121035 - RNA, 26 nt, Human
ugccuccaccuuggccccugcaguuc

SEQ ID NO: 121036 - RNA, 24 nt, Human
uggaaccaagugcccccagcugcc

SEQ ID NO: 121037 - RNA, 19 nt, Human
ugggaaugaacuggcugca

SEQ ID NO: 121038 - RNA, 18 nt, Human
ugggacuaucucccagga

SEQ ID NO: 121039 - RNA, 24 nt, Human
ugguuuugacagcccaaaccagcu

SEQ ID NO: 121040 - RNA, 19 nt, Human
ugucccuucccuccccagg

SEQ ID NO: 121041 - RNA, 21 nt, Human
uuccucugucccuucccuccc

SEQ ID NO: 121042 - RNA, 18 nt, Human
uucucaacucuggggcag

SEQ ID NO: 121043 - RNA, 26 nt, Human
uuucucaacucuggggcagagacugg

SEQ ID NO: 121044 - RNA, 21 nt, Human
uuuuuuuuuuuuuuuuccaga

SEQ ID NO: 121045 - RNA, 22 nt, Human
uuuuuuuuuuuuuuuuuuccag

SEQ ID NO: 121046 - RNA, 25 nt, Human
aaaaacccagccuuccccccuccuc

SEQ ID NO: 121047 - RNA, 24 nt, Human
aaacccagccuuccccccuccuca

SEQ ID NO: 121048 - RNA, 22 nt, Human
aagcugcugggaauggaauggc

SEQ ID NO: 121049 - RNA, 21 nt, Human
aagggucccuggagaagggug

SEQ ID NO: 121050 - RNA, 22 nt, Human
acucugagggacaccaggaagc

SEQ ID NO: 121051 - RNA, 23 nt, Human
agagauaaaugaagauuugagcc

SEQ ID NO: 121052 - RNA, 21 nt, Human
aggaggcuaagaacagagcuc

SEQ ID NO: 121053 - RNA, 21 nt, Human
aggagugggcaggguguggug

SEQ ID NO: 121054 - RNA, 22 nt, Human
aggcaagaggccuggagaagca

SEQ ID NO: 121055 - RNA, 27 nt, Human
aggccagagauaaaugaagagggaccc

SEQ ID NO: 121056 - RNA, 22 nt, Human
agggguggagugaugugaucua

SEQ ID NO: 121057 - RNA, 19 nt, Human
agguguggggagaggggcc

SEQ ID NO: 121058 - RNA, 22 nt, Human
caagaacagagcccuggccugg

SEQ ID NO: 121059 - RNA, 18 nt, Human
caccuagacccaaaacac

SEQ ID NO: 121060 - RNA, 21 nt, Human
cagagcccuggccugggcucu

SEQ ID NO: 121061 - RNA, 22 nt, Human
cagaggagaaucucugagaucc

SEQ ID NO: 121062 - RNA, 18 nt, Human
cagaucccaggccugggg

SEQ ID NO: 121063 - RNA, 22 nt, Human
cagaucccaggccuggggagcc

SEQ ID NO: 121064 - RNA, 19 nt, Human
cagcccuuuccccuuccuc

SEQ ID NO: 121065 - RNA, 18 nt, Human
caggaggcuaagaacaga

SEQ ID NO: 121066 - RNA, 26 nt, Human
ccaaaaaacccagccuuccccccucc

SEQ ID NO: 121067 - RNA, 28 nt, Human
ccaaaaaacccagccuuccccccuccuc

SEQ ID NO: 121068 - RNA, 19 nt, Human
ccacaaagacucaaaggca

SEQ ID NO: 121069 - RNA, 22 nt, Human
ccacaaagacucaaaggcaaga

SEQ ID NO: 121070 - RNA, 23 nt, Human
ccaugccugcagcccuuucagug

SEQ ID NO: 121071 - RNA, 19 nt, Human
cccaccacuauuccuaacc

SEQ ID NO: 121072 - RNA, 22 nt, Human
cccaccacuauuccuaacccua

SEQ ID NO: 121073 - RNA, 18 nt, Human
cccccaaaccaaagggag

SEQ ID NO: 121074 - RNA, 23 nt, Human
cccgccugcaugccucucugccu

SEQ ID NO: 121075 - RNA, 23 nt, Human
ccgcagccucaggagccaggguu

SEQ ID NO: 121076 - RNA, 22 nt, Human
ccgccugcaugccucucugccu

SEQ ID NO: 121077 - RNA, 22 nt, Human
ccuagacccaaaacacugaggu

SEQ ID NO: 121078 - RNA, 21 nt, Human
ccuccagccuguugcugcugc

SEQ ID NO: 121079 - RNA, 25 nt, Human
ccucccaucaagcagggaacuagau

SEQ ID NO: 121080 - RNA, 19 nt, Human
ccugcaugccucucugccu

SEQ ID NO: 121081 - RNA, 19 nt, Human
ccuguugcugcugcuccuc

SEQ ID NO: 121082 - RNA, 21 nt, Human
ccuuccucccaccacuauucc

SEQ ID NO: 121083 - RNA, 22 nt, Human
ccuuuaguggggugggaccuca

SEQ ID NO: 121084 - RNA, 21 nt, Human
cuccaaagcugcugggaaugg

SEQ ID NO: 121085 - RNA, 24 nt, Human
cuccuaggaccccgccugcaugcc

SEQ ID NO: 121086 - RNA, 22 nt, Human
cucugagauccaaaaaacccag

SEQ ID NO: 121087 - RNA, 24 nt, Human
cugcaugccucucugccuccaaua

SEQ ID NO: 121088 - RNA, 18 nt, Human
cuggucuaaacagcuuua

SEQ ID NO: 121089 - RNA, 22 nt, Human
gaaagguguuuggaugaagacu

SEQ ID NO: 121090 - RNA, 19 nt, Human
gaccuggguuauucuccuc

SEQ ID NO: 121091 - RNA, 23 nt, Human
gagauaaaugaagauuugagcca

SEQ ID NO: 121092 - RNA, 26 nt, Human
gccuguugcugcugcuccucugggug

SEQ ID NO: 121093 - RNA, 23 nt, Human
ggacuccucaggcuuacucugag

SEQ ID NO: 121094 - RNA, 23 nt, Human
ggcaaagggaaagguguuuggau

SEQ ID NO: 121095 - RNA, 22 nt, Human
ggccugggcucugcuggccgca

SEQ ID NO: 121096 - RNA, 21 nt, Human
gggcucugcuggccgcagccu

SEQ ID NO: 121097 - RNA, 22 nt, Human
ggggcgagguguggggagaggg

SEQ ID NO: 121098 - RNA, 22 nt, Human
ggugucuuggucagcugaugau

SEQ ID NO: 121099 - RNA, 18 nt, Human
gugaggcccagcccuuuc

SEQ ID NO: 121100 - RNA, 21 nt, Human
guuuggaugaagacugaggca

SEQ ID NO: 121101 - RNA, 22 nt, Human
uaaaugaagauuugagccauug

SEQ ID NO: 121102 - RNA, 18 nt, Human
uaagggucccuggagaag

SEQ ID NO: 121103 - RNA, 24 nt, Human
uacagcccaugccugcagcccuuu

SEQ ID NO: 121104 - RNA, 24 nt, Human
uaccucccuccacaucugaggauc

SEQ ID NO: 121105 - RNA, 19 nt, Human
uagacccaaaacacugagg

SEQ ID NO: 121106 - RNA, 18 nt, Human
uauucuccucccaguccu

SEQ ID NO: 121107 - RNA, 23 nt, Human
ucaaaggcaagaggccuggagaa

SEQ ID NO: 121108 - RNA, 24 nt, Human
ucaggagccaggguuaaggccaga

SEQ ID NO: 121109 - RNA, 27 nt, Human
uccaauagugacucccuaagcugggac

SEQ ID NO: 121110 - RNA, 19 nt, Human
uccacaaagacucaaaggc

SEQ ID NO: 121111 - RNA, 21 nt, Human
ucccacagaggagaaucucug

SEQ ID NO: 121112 - RNA, 24 nt, Human
ucccaccacuauuccuaaccuggg

SEQ ID NO: 121113 - RNA, 25 nt, Human
uccccuuccucccaccacuauuccu

SEQ ID NO: 121114 - RNA, 25 nt, Human
ucccuccagccuguugcugcugcuc

SEQ ID NO: 121115 - RNA, 22 nt, Human
uccucaggugucuuggucagcu

SEQ ID NO: 121116 - RNA, 18 nt, Human
uccucugggugccaagau

SEQ ID NO: 121117 - RNA, 23 nt, Human
ucuccaaagcugcugggaaugga

SEQ ID NO: 121118 - RNA, 21 nt, Human
ucuugcuucccucucccucca

SEQ ID NO: 121119 - RNA, 23 nt, Human
ugacucccuaagcugggacuccu

SEQ ID NO: 121120 - RNA, 21 nt, Human
ugagggacaccaggaagcuca

SEQ ID NO: 121121 - RNA, 22 nt, Human
ugcuggccgcagccucaggagc

SEQ ID NO: 121122 - RNA, 20 nt, Human
uggcagggcugacagagaaa

SEQ ID NO: 121123 - RNA, 19 nt, Human
uggcagggguggagugaug

SEQ ID NO: 121124 - RNA, 23 nt, Human
uggggugggaccucaggcagacc

SEQ ID NO: 121125 - RNA, 21 nt, Human
uggugauggugucagauccca

SEQ ID NO: 121126 - RNA, 21 nt, Human
uucauuaggauccucccauca

SEQ ID NO: 121127 - RNA, 22 nt, Human
uugagccauugauaaaugccaa

SEQ ID NO: 121128 - RNA, 23 nt, Human
uugcuucccucucccuccagccu

SEQ ID NO: 121129 - RNA, 19 nt, Human
aagaaauguucccccaaaa

SEQ ID NO: 121130 - RNA, 19 nt, Human
agagauucucaguguguga

SEQ ID NO: 121131 - RNA, 18 nt, Human
agcgaggcugggcuggag

SEQ ID NO: 121132 - RNA, 22 nt, Human
aguguuaaagauuaucugugcc

SEQ ID NO: 121133 - RNA, 23 nt, Human
cccccaaaaugcuggugaauaaa

SEQ ID NO: 121134 - RNA, 24 nt, Human
ggcuggagggaggguccagggagu

SEQ ID NO: 121135 - RNA, 19 nt, Human
uauccaaguacagggcgau

SEQ ID NO: 121136 - RNA, 22 nt, Human
ucccccaaaaugcuggugaaua

SEQ ID NO: 121137 - RNA, 18 nt, Human
ugagucggaggcgggagc

SEQ ID NO: 121138 - RNA, 21 nt, Human
uguaaaagaaauguuccccca

SEQ ID NO: 121139 - RNA, 21 nt, Human
uuaaagauuaucugugccuag

SEQ ID NO: 121140 - RNA, 23 nt, Human
uuaaugcugguagaauuucacag

SEQ ID NO: 121141 - RNA, 22 nt, Human
accaggcgugguggcacaugcc

SEQ ID NO: 121142 - RNA, 24 nt, Human
acccacugccugagccacguccag

SEQ ID NO: 121143 - RNA, 25 nt, Human
acugugccgcugcacuccagcucug

SEQ ID NO: 121144 - RNA, 19 nt, Human
acuuggaaggcugaggcgg

SEQ ID NO: 121145 - RNA, 18 nt, Human
aggagggggcugggggcg

SEQ ID NO: 121146 - RNA, 18 nt, Human
aggcaagccgcugggcgg

SEQ ID NO: 121147 - RNA, 19 nt, Human
aggcagaaauagaacauuc

SEQ ID NO: 121148 - RNA, 21 nt, Human
aggcugaggcgggaggauugc

SEQ ID NO: 121149 - RNA, 24 nt, Human
aggcugaggcgggaggauugcuug

SEQ ID NO: 121150 - RNA, 25 nt, Human
augggcccagucuuggcuggcugcc

SEQ ID NO: 121151 - RNA, 23 nt, Human
caccagcggcguccugcucagcc

SEQ ID NO: 121152 - RNA, 27 nt, Human
caucaaauuccuuuacuucugaggucu

SEQ ID NO: 121153 - RNA, 21 nt, Human
caugccuguaguccuaguuac

SEQ ID NO: 121154 - RNA, 23 nt, Human
ccacugccugagccacguccaac

SEQ ID NO: 121155 - RNA, 18 nt, Human
ccagcaccagcggcgucc

SEQ ID NO: 121156 - RNA, 22 nt, Human
ccagcaccagcggcguccugcu

SEQ ID NO: 121157 - RNA, 19 nt, Human
cccagggagcccccccuca

SEQ ID NO: 121158 - RNA, 22 nt, Human
ccccagggagcccccccucacc

SEQ ID NO: 121159 - RNA, 20 nt, Human
ccccagggagcccccccucu

SEQ ID NO: 121160 - RNA, 23 nt, Human
ccccuuuaaggggaggcagaaau

SEQ ID NO: 121161 - RNA, 24 nt, Human
cccucugcagggagcgagcaggca

SEQ ID NO: 121162 - RNA, 20 nt, Human
ccgcugcacuccagcucugg

SEQ ID NO: 121163 - RNA, 22 nt, Human
ccgcugcacuccagcucuggau

SEQ ID NO: 121164 - RNA, 21 nt, Human
ccuguaguccuaguuacuugg

SEQ ID NO: 121165 - RNA, 23 nt, Human
cgcugcacuccagcucuggauga

SEQ ID NO: 121166 - RNA, 18 nt, Human
cugcacuccagcucugga

SEQ ID NO: 121167 - RNA, 18 nt, Human
cugcacuccagcucugga

SEQ ID NO: 121168 - RNA, 21 nt, Human
cuuuaaggggaggcagaaaua

SEQ ID NO: 121169 - RNA, 24 nt, Human
gaggcgggaggauugcuugagccu

SEQ ID NO: 121170 - RNA, 19 nt, Human
gagggggcugggggcggcc

SEQ ID NO: 121171 - RNA, 21 nt, Human
gcugggggcggccagcaccag

SEQ ID NO: 121172 - RNA, 18 nt, Human
guccugcucagccccucu

SEQ ID NO: 121173 - RNA, 24 nt, Human
uaguuacuuggaaggcugaggcgg

SEQ ID NO: 121174 - RNA, 25 nt, Human
uccagcucuggaugacacagugaga

SEQ ID NO: 121175 - RNA, 19 nt, Human
uccagugagccaugacugu

SEQ ID NO: 121176 - RNA, 24 nt, Human
ucucuguguucaugggcccagucu

SEQ ID NO: 121177 - RNA, 19 nt, Human
ucuuggcuggcugccuccc

SEQ ID NO: 121178 - RNA, 22 nt, Human
ugacugugccgcugcacuccag

SEQ ID NO: 121179 - RNA, 22 nt, Human
ugaggcgggaggauugcuugag

SEQ ID NO: 121180 - RNA, 24 nt, Human
ugaggcgggaggauugcuugagcc

SEQ ID NO: 121181 - RNA, 24 nt, Human
ugaguuccagugagccaugacugu

SEQ ID NO: 121182 - RNA, 23 nt, Human
ugccuguaguccuaguuacuugg

SEQ ID NO: 121183 - RNA, 22 nt, Human
uggaaggcugaggcgggaggau

SEQ ID NO: 121184 - RNA, 23 nt, Human
uggcugccccuuucuacccacug

SEQ ID NO: 121185 - RNA, 27 nt, Human
uggcugccuccccccagggagcccccc

SEQ ID NO: 121186 - RNA, 22 nt, Human
ugguggcacaugccuguagucc

SEQ ID NO: 121187 - RNA, 18 nt, Human
uuacuucugaggucuccc

SEQ ID NO: 121188 - RNA, 22 nt, Human
uuccagugagccaugacugugc

SEQ ID NO: 121189 - RNA, 22 nt, Human
uugcuugagccugaguuccagu

SEQ ID NO: 121190 - RNA, 20 nt, Human
uuggaaggcugaggcgggag

SEQ ID NO: 121191 - RNA, 21 nt, Human
uuggcuggcugccucccccca

SEQ ID NO: 121192 - RNA, 26 nt, Human
aagcaagaaggaaggaggggggaccc

SEQ ID NO: 121193 - RNA, 25 nt, Human
agaaggaaggagggagggcagagcc

SEQ ID NO: 121194 - RNA, 19 nt, Human
aggaaggagggagggcaga

SEQ ID NO: 121195 - RNA, 21 nt, Human
aggcagagcacaaagcuggag

SEQ ID NO: 121196 - RNA, 25 nt, Human
cagagggaggcgaugcuacuguuuu

SEQ ID NO: 121197 - RNA, 18 nt, Human
caggagaggagggugaga

SEQ ID NO: 121198 - RNA, 22 nt, Human
caggagaggagggugagagccc

SEQ ID NO: 121199 - RNA, 19 nt, Human
ccaccaguccagggguggg

SEQ ID NO: 121200 - RNA, 24 nt, Human
ccaggggugggagcacuacagggg

SEQ ID NO: 121201 - RNA, 24 nt, Human
ccugcagccuucucugucugucuc

SEQ ID NO: 121202 - RNA, 18 nt, Human
cgcccugcugagcaacaa

SEQ ID NO: 121203 - RNA, 23 nt, Human
cugcagccuucucugucugucuc

SEQ ID NO: 121204 - RNA, 23 nt, Human
cuguuuaauugcaggaggugggg

SEQ ID NO: 121205 - RNA, 24 nt, Human
gaaggaaggagggagggcagagcg

SEQ ID NO: 121206 - RNA, 23 nt, Human
gaggccucccgcagggugggggc

SEQ ID NO: 121207 - RNA, 21 nt, Human
ggaggccucccgcaggguggg

SEQ ID NO: 121208 - RNA, 20 nt, Human
ggcagagcgcccugcugagc

SEQ ID NO: 121209 - RNA, 26 nt, Human
gggugguggcuggugcgaauggccug

SEQ ID NO: 121210 - RNA, 21 nt, Human
uagaagcaagaaggaaggagg

SEQ ID NO: 121211 - RNA, 18 nt, Human
ucugucucuuggcgcagg

SEQ ID NO: 121212 - RNA, 22 nt, Human
ugagagcccgaggcagggagcc

SEQ ID NO: 121213 - RNA, 19 nt, Human
ugcaggaggugggggggug

SEQ ID NO: 121214 - RNA, 20 nt, Human
ugcugagcaacaaaggacuc

SEQ ID NO: 121215 - RNA, 21 nt, Human
ugggagugggugguggcuggg

SEQ ID NO: 121216 - RNA, 25 nt, Human
ugggagugggugguggcuggugcga

SEQ ID NO: 121217 - RNA, 19 nt, Human
uggggaggccucccgcagg

SEQ ID NO: 121218 - RNA, 25 nt, Human
uguuuaauugcaggagguggggggg

SEQ ID NO: 121219 - RNA, 21 nt, Human
uuuaauugcaggagguggggg

SEQ ID NO: 121220 - RNA, 18 nt, Human
uuuuuuuuuuucagaggg

SEQ ID NO: 121221 - RNA, 19 nt, Human
uuuuuuuuuuuuucagagg

SEQ ID NO: 121222 - RNA, 28 nt, Human
uuuuuuuuuuuuuuuuuuuuucagaggg

SEQ ID NO: 121223 - RNA, 25 nt, Human
aaaaggaaggagggagggcagagug

SEQ ID NO: 121224 - RNA, 19 nt, Human
aggaaggagggagggcaga

SEQ ID NO: 121225 - RNA, 18 nt, Human
aggggugggaguaggagg

SEQ ID NO: 121226 - RNA, 24 nt, Human
auguaccagggcuaugagaagcaa

SEQ ID NO: 121227 - RNA, 21 nt, Human
caacaaaggccuccugcagcc

SEQ ID NO: 121228 - RNA, 19 nt, Human
ccaccaguccagggguggg

SEQ ID NO: 121229 - RNA, 26 nt, Human
ccaggggugggagcacuacaaggggu

SEQ ID NO: 121230 - RNA, 18 nt, Human
ccucccacaggguggggg

SEQ ID NO: 121231 - RNA, 19 nt, Human
ccugcagccuucucugucu

SEQ ID NO: 121232 - RNA, 22 nt, Human
cugcagccuucucugucuucuc

SEQ ID NO: 121233 - RNA, 23 nt, Human
cuguuuaauugcaggaggugggg

SEQ ID NO: 121234 - RNA, 23 nt, Human
gagaagcaaaaggaaggagggag

SEQ ID NO: 121235 - RNA, 21 nt, Human
gcagccuucucugucuucucc

SEQ ID NO: 121236 - RNA, 19 nt, Human
gggaguaggagguggucag

SEQ ID NO: 121237 - RNA, 23 nt, Human
gggcuaugagaagcaaaaggaag

SEQ ID NO: 121238 - RNA, 20 nt, Human
ggugggagcacuacaagggg

SEQ ID NO: 121239 - RNA, 22 nt, Human
uccccugcugagcaacaaaggc

SEQ ID NO: 121240 - RNA, 18 nt, Human
ugagaagcaaaaggaagg

SEQ ID NO: 121241 - RNA, 23 nt, Human
ugagaagcaaaaggaaggaggga

SEQ ID NO: 121242 - RNA, 24 nt, Human
ugcagccuucucugucuucuccug

SEQ ID NO: 121243 - RNA, 20 nt, Human
ugcugcaggugcauggggag

SEQ ID NO: 121244 - RNA, 19 nt, Human
ugggaguaggaggugguca

SEQ ID NO: 121245 - RNA, 19 nt, Human
uggggagaccucccacagg

SEQ ID NO: 121246 - RNA, 18 nt, Human
ugggggccaccaguccag

SEQ ID NO: 121247 - RNA, 24 nt, Human
uguuuaauugcaggaggugggggu

SEQ ID NO: 121248 - RNA, 23 nt, Human
uucucugucuucuccugcugcag

SEQ ID NO: 121249 - RNA, 22 nt, Human
uuuaauugcaggaggugggggu

SEQ ID NO: 121250 - RNA, 26 nt, Human
aagcaagaaggaaggaggggggaccc

SEQ ID NO: 121251 - RNA, 19 nt, Human
accgcacaccggggcuaug

SEQ ID NO: 121252 - RNA, 30 nt, Human
accuuccccaaggcaggggccaccaguugu

SEQ ID NO: 121253 - RNA, 25 nt, Human
agaaggaaggagggagggcagagcc

SEQ ID NO: 121254 - RNA, 20 nt, Human
agccccuugcugagcaacaa

SEQ ID NO: 121255 - RNA, 19 nt, Human
agcuagauagagaggaccc

SEQ ID NO: 121256 - RNA, 19 nt, Human
aggaaggagggagggcaga

SEQ ID NO: 121257 - RNA, 25 nt, Human
agggggugggaggugugcauaagaa

SEQ ID NO: 121258 - RNA, 18 nt, Human
caggggccaccaguccag

SEQ ID NO: 121259 - RNA, 19 nt, Human
ccaccaguccagggguggg

SEQ ID NO: 121260 - RNA, 22 nt, Human
ccccuugcugagcaacaaaggc

SEQ ID NO: 121261 - RNA, 23 nt, Human
cccuugcugagcaacaaaggccg

SEQ ID NO: 121262 - RNA, 21 nt, Human
ccugcugccuucucugucugu

SEQ ID NO: 121263 - RNA, 18 nt, Human
ccuuccccaaggcagggg

SEQ ID NO: 121264 - RNA, 21 nt, Human
cugucugucuccuggugcagg

SEQ ID NO: 121265 - RNA, 22 nt, Human
gaaggaaggagggagggcagag

SEQ ID NO: 121266 - RNA, 31 nt, Human
gaauacagggggugggaggugugcauaagaa

SEQ ID NO: 121267 - RNA, 24 nt, Human
gagaagcaagaaggaaggagggag

SEQ ID NO: 121268 - RNA, 26 nt, Human
gcacaccggggcuaugagaagcaaga

SEQ ID NO: 121269 - RNA, 19 nt, Human
gcacaggccagcccgguac

SEQ ID NO: 121270 - RNA, 24 nt, Human
uauuuuauugcaggaggugggggu

SEQ ID NO: 121271 - RNA, 19 nt, Human
uuuuuuuuuuuuuugccga

SEQ ID NO: 121272 - RNA, 18 nt, Human
uuuuuuuuuuuuuuuuug

SEQ ID NO: 121273 - RNA, 22 nt, Human
uuuuuuuuuuuuuuuuugccga

SEQ ID NO: 121274 - RNA, 23 nt, Human
uuuuuuuuuuuuuuuuugccgau

SEQ ID NO: 121275 - RNA, 26 nt, Human
aagcaagaaggaaggaggggggaccc

SEQ ID NO: 121276 - RNA, 20 nt, Human
agaagcaagaaggaaggagg

SEQ ID NO: 121277 - RNA, 25 nt, Human
agaaggaaggagggagggcagagcc

SEQ ID NO: 121278 - RNA, 19 nt, Human
aggaaggagggagggcaga

SEQ ID NO: 121279 - RNA, 21 nt, Human
aggcagagcacaaagcuggag

SEQ ID NO: 121280 - RNA, 22 nt, Human
aggccucccgcagggugggggc

SEQ ID NO: 121281 - RNA, 18 nt, Human
caggagaggagggugaga

SEQ ID NO: 121282 - RNA, 19 nt, Human
ccaccaguccagggguggg

SEQ ID NO: 121283 - RNA, 24 nt, Human
ccugcagccuucucugucugucuc

SEQ ID NO: 121284 - RNA, 18 nt, Human
cgcccugcugagcaacaa

SEQ ID NO: 121285 - RNA, 18 nt, Human
cugagcaacaaaggacuc

SEQ ID NO: 121286 - RNA, 23 nt, Human
cugcagccuucucugucugucuc

SEQ ID NO: 121287 - RNA, 23 nt, Human
cuguuuaauugcaggaggugggg

SEQ ID NO: 121288 - RNA, 28 nt, Human
gcaagaaggaaggagggagggcagagcg

SEQ ID NO: 121289 - RNA, 21 nt, Human
ggaggccucccgcaggguggg

SEQ ID NO: 121290 - RNA, 20 nt, Human
ggcagagcgcccugcugagc

SEQ ID NO: 121291 - RNA, 21 nt, Human
gggagcacuacaguggguggg

SEQ ID NO: 121292 - RNA, 21 nt, Human
uacagugggugggagugggug

SEQ ID NO: 121293 - RNA, 18 nt, Human
ucugucucuuggcacagg

SEQ ID NO: 121294 - RNA, 19 nt, Human
ugggagugggugguggucg

SEQ ID NO: 121295 - RNA, 20 nt, Human
ugggagugggugguggucgg

SEQ ID NO: 121296 - RNA, 19 nt, Human
uggggaggccucccgcagg

SEQ ID NO: 121297 - RNA, 18 nt, Human
ugggggccaccaguccag

SEQ ID NO: 121298 - RNA, 24 nt, Human
uguuuaauugcaggaggugggggu

SEQ ID NO: 121299 - RNA, 22 nt, Human
uuuaauugcaggaggugggggu

SEQ ID NO: 121300 - RNA, 21 nt, Human
aagugcccuccaccauggccc

SEQ ID NO: 121301 - RNA, 18 nt, Human
agauacggcccacggacc

SEQ ID NO: 121302 - RNA, 19 nt, Human
caccauggccccaaaccca

SEQ ID NO: 121303 - RNA, 24 nt, Human
caccauggccccaaacccaauggc

SEQ ID NO: 121304 - RNA, 21 nt, Human
ccaaacccaauggccuucgcc

SEQ ID NO: 121305 - RNA, 19 nt, Human
ccugaagugcccuccacca

SEQ ID NO: 121306 - RNA, 18 nt, Human
cugaagugcccuccacca

SEQ ID NO: 121307 - RNA, 23 nt, Human
gaagugcccuccaccauggcccc

SEQ ID NO: 121308 - RNA, 22 nt, Human
ucagugccgucggagcccucag

SEQ ID NO: 121309 - RNA, 24 nt, Human
ugaagugcccuccaccauggcccc

SEQ ID NO: 121310 - RNA, 21 nt, Human
uuuuuuuuuuuugcaagaagc

SEQ ID NO: 121311 - RNA, 18 nt, Human
uuuuuuuuuuuuuuuuug

SEQ ID NO: 121312 - RNA, 21 nt, Human
uuuuuuuuuuuuuuuuugcaa

SEQ ID NO: 121313 - RNA, 21 nt, Human
acaggaugcuggaaccaaagu

SEQ ID NO: 121314 - RNA, 20 nt, Human
gaugcuggaaccaaagugaa

SEQ ID NO: 121315 - RNA, 21 nt, Human
ggaaccaaagugaacagggaa

SEQ ID NO: 121316 - RNA, 24 nt, Human
guuauauuuaucagcaaggaucau

SEQ ID NO: 121317 - RNA, 21 nt, Human
aaucuggcgaggggacucggc

SEQ ID NO: 121318 - RNA, 21 nt, Human
aaugcaaaagcagcugcagaa

SEQ ID NO: 121319 - RNA, 25 nt, Human
accccaaggggcacagcccggaggg

SEQ ID NO: 121320 - RNA, 21 nt, Human
agaauccugccccuuccaccc

SEQ ID NO: 121321 - RNA, 22 nt, Human
agaauccugccccuuccacccc

SEQ ID NO: 121322 - RNA, 24 nt, Human
aggaaagaaaucaacacaaugaaa

SEQ ID NO: 121323 - RNA, 25 nt, Human
aggaaagaaaucaacacaaugaaag

SEQ ID NO: 121324 - RNA, 20 nt, Human
caaggggcacagcccggaga

SEQ ID NO: 121325 - RNA, 22 nt, Human
cacagcccggagaugaagcuua

SEQ ID NO: 121326 - RNA, 23 nt, Human
cagaauccugccccuuccacccc

SEQ ID NO: 121327 - RNA, 22 nt, Human
cagcugcagaauccugccccuu

SEQ ID NO: 121328 - RNA, 21 nt, Human
gaaggaaagaaaucaacacaa

SEQ ID NO: 121329 - RNA, 21 nt, Human
ggaucacaagugcacgcucug

SEQ ID NO: 121330 - RNA, 23 nt, Human
ucacaagugcacgcucugguaga

SEQ ID NO: 121331 - RNA, 23 nt, Human
ugacgcgcgggcggaaccaaggg

SEQ ID NO: 121332 - RNA, 21 nt, Human
uuuuuuuuuuuuuuuuuaagg

SEQ ID NO: 121333 - RNA, 21 nt, Human
aaaaaaaaaaaaacaaaaaaa

SEQ ID NO: 121334 - RNA, 24 nt, Human
aaaaaaacaaaaaaaaaaaccuca

SEQ ID NO: 121335 - RNA, 19 nt, Human
aaaaagaaaaacgggaagg

SEQ ID NO: 121336 - RNA, 22 nt, Human
aaaauaagacaagcagguagaa

SEQ ID NO: 121337 - RNA, 22 nt, Human
aaacaaaaaaaaaaaccucaaa

SEQ ID NO: 121338 - RNA, 19 nt, Human
aaccaaaauauugcuagcc

SEQ ID NO: 121339 - RNA, 22 nt, Human
aagcagguagaaaaaacaaugc

SEQ ID NO: 121340 - RNA, 23 nt, Human
acaaaaaaaaaaaaaacaaaaaa

SEQ ID NO: 121341 - RNA, 19 nt, Human
agaaaaacgggaaggauuc

SEQ ID NO: 121342 - RNA, 22 nt, Human
agacaagcagguagaaaaaaca

SEQ ID NO: 121343 - RNA, 27 nt, Human
agacaagcagguagaaaaaagggaccc

SEQ ID NO: 121344 - RNA, 21 nt, Human
agcgcccacaggacggacgac

SEQ ID NO: 121345 - RNA, 21 nt, Human
agcgcugcccccucccgccuc

SEQ ID NO: 121346 - RNA, 21 nt, Human
aggcgccgaggcuggagagcu

SEQ ID NO: 121347 - RNA, 22 nt, Human
caaaaaaaaaaaaaacaaaaaa

SEQ ID NO: 121348 - RNA, 22 nt, Human
caacauacaaaaaaaaaaaaaa

SEQ ID NO: 121349 - RNA, 19 nt, Human
caagcagguagaaaaaaca

SEQ ID NO: 121350 - RNA, 19 nt, Human
caagcagguagaaaaaaca

SEQ ID NO: 121351 - RNA, 23 nt, Human
cacacagaugccuccuccacaca

SEQ ID NO: 121352 - RNA, 24 nt, Human
caccacacagaugccuccuccaca

SEQ ID NO: 121353 - RNA, 26 nt, Human
cauaaaaagaaaaacgggaaggauuc

SEQ ID NO: 121354 - RNA, 22 nt, Human
ccgccuccugacagcccggacc

SEQ ID NO: 121355 - RNA, 19 nt, Human
ccgcgggccccgaccacuc

SEQ ID NO: 121356 - RNA, 21 nt, Human
ccgucuucauuuggaacaagg

SEQ ID NO: 121357 - RNA, 22 nt, Human
cgacacgaggcccagcgcugcc

SEQ ID NO: 121358 - RNA, 19 nt, Human
cgccgaggcuggagagcuc

SEQ ID NO: 121359 - RNA, 20 nt, Human
cgcugcccccucccgccucc

SEQ ID NO: 121360 - RNA, 22 nt, Human
cuuuguaauguucuaaaaacug

SEQ ID NO: 121361 - RNA, 19 nt, Human
gcaggacggcacuggugca

SEQ ID NO: 121362 - RNA, 21 nt, Human
gcagugccagggccaccacac

SEQ ID NO: 121363 - RNA, 22 nt, Human
gccgcgggccccgaccacuccg

SEQ ID NO: 121364 - RNA, 19 nt, Human
ggcacuggugcaggcgggg

SEQ ID NO: 121365 - RNA, 22 nt, Human
gggcaccgcccaagcuuuuccu

SEQ ID NO: 121366 - RNA, 21 nt, Human
ggugcaggcggggacgcugcc

SEQ ID NO: 121367 - RNA, 20 nt, Human
uaaaaagaaaaacgggaagg

SEQ ID NO: 121368 - RNA, 19 nt, Human
ucauuuggaacaagggggg

SEQ ID NO: 121369 - RNA, 22 nt, Human
ucuaaauuauucuaaaaauaag

SEQ ID NO: 121370 - RNA, 18 nt, Human
ugacuuccaaaugcuccu

SEQ ID NO: 121371 - RNA, 21 nt, Human
ugagaaguuugccaacugccu

SEQ ID NO: 121372 - RNA, 25 nt, Human
ugcccccucccgccuccugacagcc

SEQ ID NO: 121373 - RNA, 20 nt, Human
uggcauaaaaagaaaaacgg

SEQ ID NO: 121374 - RNA, 22 nt, Human
uggugcaggcggggacgcugcc

SEQ ID NO: 121375 - RNA, 25 nt, Human
uguuuuguuuuucuaaauuauucua

SEQ ID NO: 121376 - RNA, 23 nt, Human
uucauuguccugagaaguuugcc

SEQ ID NO: 121377 - RNA, 25 nt, Human
aaacagcuugugaaacuuaauacuu

SEQ ID NO: 121378 - RNA, 26 nt, Human
aaacagcuugugaaacuuaauacuuu

SEQ ID NO: 121379 - RNA, 19 nt, Human
aaagaggucaccagccccu

SEQ ID NO: 121380 - RNA, 19 nt, Human
acaaagaccauccgauucu

SEQ ID NO: 121381 - RNA, 23 nt, Human
acccaauauaaaucuguccacaa

SEQ ID NO: 121382 - RNA, 20 nt, Human
acccaauauaaaucuguccc

SEQ ID NO: 121383 - RNA, 20 nt, Human
acuuuuuuuuuuuuuuugca

SEQ ID NO: 121384 - RNA, 20 nt, Human
acuuuuuuuuuuuuuuugca

SEQ ID NO: 121385 - RNA, 19 nt, Human
agcaaaaagaggucacccg

SEQ ID NO: 121386 - RNA, 21 nt, Human
agcagacgacaucuucaguuu

SEQ ID NO: 121387 - RNA, 20 nt, Human
agcaggguguucaggaccug

SEQ ID NO: 121388 - RNA, 25 nt, Human
aggcggcggcgcgcguuccucgcgg

SEQ ID NO: 121389 - RNA, 18 nt, Human
aggguguucaggaccugc

SEQ ID NO: 121390 - RNA, 21 nt, Human
caacucucagaucaaaaggca

SEQ ID NO: 121391 - RNA, 21 nt, Human
cacagaugaaaaacuuaacac

SEQ ID NO: 121392 - RNA, 18 nt, Human
caccuucauugguucaaa

SEQ ID NO: 121393 - RNA, 19 nt, Human
cagaaucaguuacaaagac

SEQ ID NO: 121394 - RNA, 18 nt, Human
cagaugaaaaacuuaaca

SEQ ID NO: 121395 - RNA, 19 nt, Human
cccaagggacugauaaagg

SEQ ID NO: 121396 - RNA, 25 nt, Human
cccaccccacccggcggcgguggcg

SEQ ID NO: 121397 - RNA, 21 nt, Human
ccccacccggcggcgguggcg

SEQ ID NO: 121398 - RNA, 22 nt, Human
cccccgcagcgcggcaucgccc

SEQ ID NO: 121399 - RNA, 25 nt, Human
cccggcggcgguggcgguggcggcg

SEQ ID NO: 121400 - RNA, 18 nt, Human
cggcggcgguggcggugg

SEQ ID NO: 121401 - RNA, 19 nt, Human
cggcggcgguggcgguggc

SEQ ID NO: 121402 - RNA, 18 nt, Human
cggcgguggcgguggcgg

SEQ ID NO: 121403 - RNA, 24 nt, Human
cuggaggcggcggcgcgcguuccc

SEQ ID NO: 121404 - RNA, 21 nt, Human
gaacuugcaggagucugcgug

SEQ ID NO: 121405 - RNA, 21 nt, Human
gcaaagcaguccucuaagaac

SEQ ID NO: 121406 - RNA, 22 nt, Human
gcagccuguacugucuucaauc

SEQ ID NO: 121407 - RNA, 22 nt, Human
gcagccuguacugucuucaauc

SEQ ID NO: 121408 - RNA, 18 nt, Human
gccccucccaccccaccc

SEQ ID NO: 121409 - RNA, 22 nt, Human
gccccuguagacuuaagggacu

SEQ ID NO: 121410 - RNA, 20 nt, Human
gcgcccacccuggaggcggc

SEQ ID NO: 121411 - RNA, 24 nt, Human
gcggcgguggcgguggcggcggcu

SEQ ID NO: 121412 - RNA, 20 nt, Human
ggcggcgguggcgguggcgg

SEQ ID NO: 121413 - RNA, 23 nt, Human
ggcggcgguggcgguggcggcgg

SEQ ID NO: 121414 - RNA, 26 nt, Human
ggcggcgguggcgguggcggcggcug

SEQ ID NO: 121415 - RNA, 21 nt, Human
ggggaacuugcaggagucugc

SEQ ID NO: 121416 - RNA, 22 nt, Human
gguggcgguggcggcggcugug

SEQ ID NO: 121417 - RNA, 23 nt, Human
guggcgguggcggcggcugugcg

SEQ ID NO: 121418 - RNA, 21 nt, Human
uaagaacuuaggggaacuugc

SEQ ID NO: 121419 - RNA, 24 nt, Human
uagcaaaaagaggucaccagcccc

SEQ ID NO: 121420 - RNA, 19 nt, Human
uagcaaaaagaggucaccc

SEQ ID NO: 121421 - RNA, 19 nt, Human
ucccaccccacccggcggc

SEQ ID NO: 121422 - RNA, 20 nt, Human
ucccgccccucccaccccac

SEQ ID NO: 121423 - RNA, 20 nt, Human
ucuaccacaggcaaacaguu

SEQ ID NO: 121424 - RNA, 20 nt, Human
ucuaccacaggcaaacaguu

SEQ ID NO: 121425 - RNA, 19 nt, Human
ucuucaguuuucuagcucu

SEQ ID NO: 121426 - RNA, 25 nt, Human
ucuuuauggaacuuugcaacucuca

SEQ ID NO: 121427 - RNA, 22 nt, Human
ugagaaaauauauuugaguaca

SEQ ID NO: 121428 - RNA, 22 nt, Human
ugagaaaauauauuugaguaca

SEQ ID NO: 121429 - RNA, 20 nt, Human
ugaugcaacauuguagagca

SEQ ID NO: 121430 - RNA, 21 nt, Human
ugcgugcaugacgccacuaug

SEQ ID NO: 121431 - RNA, 21 nt, Human
uggaaaaaaaaugacugugga

SEQ ID NO: 121432 - RNA, 23 nt, Human
uggaugaggcagaggagaagcuu

SEQ ID NO: 121433 - RNA, 20 nt, Human
uuaacacacaauaacagaag

SEQ ID NO: 121434 - RNA, 20 nt, Human
uucaacacugcaacaucaau

SEQ ID NO: 121435 - RNA, 19 nt, Human
uucccgccccucccacccc

SEQ ID NO: 121436 - RNA, 24 nt, Human
uuucacugucucuuggucccaagu

SEQ ID NO: 121437 - RNA, 18 nt, Human
uuucuagcucuuguaguu

SEQ ID NO: 121438 - RNA, 20 nt, Human
uuugaacucuugaugcaaca

SEQ ID NO: 121439 - RNA, 23 nt, Human
uuuuguuguuugaacucuugauu

SEQ ID NO: 121440 - RNA, 30 nt, Human
uuuuuuauuuuguuguuugaacucuugauu

SEQ ID NO: 121441 - RNA, 18 nt, Human
aaacagagacaccccaag

SEQ ID NO: 121442 - RNA, 20 nt, Human
aaagagaggcugggaaagug

SEQ ID NO: 121443 - RNA, 20 nt, Human
aacauggcgaaaccucgucu

SEQ ID NO: 121444 - RNA, 21 nt, Human
aacauggcgaaaccucgucuc

SEQ ID NO: 121445 - RNA, 22 nt, Human
aagagcuggguaaagggggagg

SEQ ID NO: 121446 - RNA, 24 nt, Human
aagcggaaggagagacggaaccca

SEQ ID NO: 121447 - RNA, 25 nt, Human
aagcggaaggagagacggaacccag

SEQ ID NO: 121448 - RNA, 18 nt, Human
aagcgggaggaucgcuug

SEQ ID NO: 121449 - RNA, 23 nt, Human
aaggauggcuugagcccaggagg

SEQ ID NO: 121450 - RNA, 19 nt, Human
aagggaugggguguggcag

SEQ ID NO: 121451 - RNA, 27 nt, Human
acagcggcagagaaagacaaagaagcc

SEQ ID NO: 121452 - RNA, 20 nt, Human
accaugcagacgaggagggu

SEQ ID NO: 121453 - RNA, 23 nt, Human
accccaagagcuggguaaagggg

SEQ ID NO: 121454 - RNA, 21 nt, Human
acccugcccguccccuccccu

SEQ ID NO: 121455 - RNA, 18 nt, Human
acugcaccccagccuggg

SEQ ID NO: 121456 - RNA, 24 nt, Human
acugcaccccagccugggcgacag

SEQ ID NO: 121457 - RNA, 22 nt, Human
agacaccgacagcggcagagaa

SEQ ID NO: 121458 - RNA, 24 nt, Human
agcacuuagggaggcugaagcggg

SEQ ID NO: 121459 - RNA, 23 nt, Human
agccggcugugguggcgcgugcc

SEQ ID NO: 121460 - RNA, 23 nt, Human
agccugggcaacauggcgaaacc

SEQ ID NO: 121461 - RNA, 24 nt, Human
agccugggcaacauggcgaaaccu

SEQ ID NO: 121462 - RNA, 24 nt, Human
aggacaucaaagggacagggcuga

SEQ ID NO: 121463 - RNA, 20 nt, Human
aggaccagcaggcacgcccc

SEQ ID NO: 121464 - RNA, 20 nt, Human
aggaggcggggcgagcugcc

SEQ ID NO: 121465 - RNA, 22 nt, Human
aggcaaagcaaagagaggcugg

SEQ ID NO: 121466 - RNA, 19 nt, Human
aggcaggaaguggggaugg

SEQ ID NO: 121467 - RNA, 25 nt, Human
aggcaggaaguggggaugggggacc

SEQ ID NO: 121468 - RNA, 26 nt, Human
aggcaggaaguggggaugggggaccc

SEQ ID NO: 121469 - RNA, 20 nt, Human
aggcugaagcgggaggaucg

SEQ ID NO: 121470 - RNA, 24 nt, Human
aggcugaagcgggaggaucgcuug

SEQ ID NO: 121471 - RNA, 21 nt, Human
agggagagcaagaaaauggua

SEQ ID NO: 121472 - RNA, 21 nt, Human
aggggcugaaggaaaggagga

SEQ ID NO: 121473 - RNA, 20 nt, Human
agguggagugagccugagga

SEQ ID NO: 121474 - RNA, 22 nt, Human
agguugaggcugcagugcuggg

SEQ ID NO: 121475 - RNA, 24 nt, Human
aguggcucacgccugcaaucccag

SEQ ID NO: 121476 - RNA, 24 nt, Human
aucgcgccacugcaccccagccug

SEQ ID NO: 121477 - RNA, 25 nt, Human
caaaaagcaaagaaggccgaggcaa

SEQ ID NO: 121478 - RNA, 20 nt, Human
caaagaaggccgaggcaaug

SEQ ID NO: 121479 - RNA, 24 nt, Human
caacauggcgaaaccucgucucua

SEQ ID NO: 121480 - RNA, 27 nt, Human
cacaaaaagcaaagaaggccgaggcaa

SEQ ID NO: 121481 - RNA, 19 nt, Human
cacgccugcaaucccagca

SEQ ID NO: 121482 - RNA, 23 nt, Human
cacugcaccccagccugggcgac

SEQ ID NO: 121483 - RNA, 24 nt, Human
cacugcaccccagccugggcgaca

SEQ ID NO: 121484 - RNA, 19 nt, Human
cagacagacaccgacagcg

SEQ ID NO: 121485 - RNA, 21 nt, Human
cagacagacaccgacagcggc

SEQ ID NO: 121486 - RNA, 23 nt, Human
cagagaaagacaaagaagcggaa

SEQ ID NO: 121487 - RNA, 21 nt, Human
cagagacccugcccguccccu

SEQ ID NO: 121488 - RNA, 24 nt, Human
cagcacuuagggaggcugaagcgg

SEQ ID NO: 121489 - RNA, 20 nt, Human
cagcaggcacgccccuggcc

SEQ ID NO: 121490 - RNA, 21 nt, Human
cagcggcagagaaagacaaag

SEQ ID NO: 121491 - RNA, 25 nt, Human
cagcuaagagcagacagacagacac

SEQ ID NO: 121492 - RNA, 21 nt, Human
cagcugcuggggaagcugagg

SEQ ID NO: 121493 - RNA, 19 nt, Human
cagggcagaggggcugaag

SEQ ID NO: 121494 - RNA, 18 nt, Human
ccacugcaccccagccug

SEQ ID NO: 121495 - RNA, 20 nt, Human
ccacugcaccccagccuggg

SEQ ID NO: 121496 - RNA, 21 nt, Human
ccacugcaccccagccugggc

SEQ ID NO: 121497 - RNA, 24 nt, Human
ccacugcaccccagccugggcgac

SEQ ID NO: 121498 - RNA, 22 nt, Human
ccccuccccucucccccacaaa

SEQ ID NO: 121499 - RNA, 24 nt, Human
ccccuccccucucccccacaaaaa

SEQ ID NO: 121500 - RNA, 20 nt, Human
ccccuggcugaucccggcuc

SEQ ID NO: 121501 - RNA, 25 nt, Human
cccggaguucaagaccagccugggc

SEQ ID NO: 121502 - RNA, 21 nt, Human
cccguccccuccccucucccc

SEQ ID NO: 121503 - RNA, 18 nt, Human
cccuccccucucccccac

SEQ ID NO: 121504 - RNA, 19 nt, Human
ccuccccucucccccacaa

SEQ ID NO: 121505 - RNA, 21 nt, Human
ccugggcaacauggcgaaacc

SEQ ID NO: 121506 - RNA, 24 nt, Human
ccugggcaacauggcgaaaccucg

SEQ ID NO: 121507 - RNA, 21 nt, Human
ccuguagucccagcugcuggg

SEQ ID NO: 121508 - RNA, 22 nt, Human
ccuguagucccagcugcugggg

SEQ ID NO: 121509 - RNA, 18 nt, Human
cgacagcggcagagaaag

SEQ ID NO: 121510 - RNA, 23 nt, Human
cgccacugcaccccagccugggc

SEQ ID NO: 121511 - RNA, 26 nt, Human
cgccacugcaccccagccugggcgac

SEQ ID NO: 121512 - RNA, 18 nt, Human
cgcuugagccccggaguu

SEQ ID NO: 121513 - RNA, 24 nt, Human
cggggcaggcaaagcaaagagagg

SEQ ID NO: 121514 - RNA, 22 nt, Human
cucacgccugcaaucccagcac

SEQ ID NO: 121515 - RNA, 24 nt, Human
cucacgccugcaaucccagcacuu

SEQ ID NO: 121516 - RNA, 20 nt, Human
cucccccacaaaaagcaaag

SEQ ID NO: 121517 - RNA, 21 nt, Human
cuccccucucccccacaaaaa

SEQ ID NO: 121518 - RNA, 22 nt, Human
cuggcugaucccggcucccuuc

SEQ ID NO: 121519 - RNA, 22 nt, Human
gaaaaaacagagacaccccaag

SEQ ID NO: 121520 - RNA, 20 nt, Human
gaacccagcgggaggaggcg

SEQ ID NO: 121521 - RNA, 19 nt, Human
gacaaagaagcggaaggag

SEQ ID NO: 121522 - RNA, 24 nt, Human
gaucgcuugagccccggaguucaa

SEQ ID NO: 121523 - RNA, 19 nt, Human
gcaaagagaggcugggaaa

SEQ ID NO: 121524 - RNA, 22 nt, Human
gcagugcugggaucgcgccacu

SEQ ID NO: 121525 - RNA, 24 nt, Human
gccacugcaccccagccugggcga

SEQ ID NO: 121526 - RNA, 24 nt, Human
gcccaggagguugaggcugcagug

SEQ ID NO: 121527 - RNA, 21 nt, Human
gcuaagagcagacagacagac

SEQ ID NO: 121528 - RNA, 20 nt, Human
gcugggaucgcgccacugca

SEQ ID NO: 121529 - RNA, 24 nt, Human
gcuugagcccaggagguugaggcu

SEQ ID NO: 121530 - RNA, 23 nt, Human
ggaaaaaacagagacaccccaag

SEQ ID NO: 121531 - RNA, 19 nt, Human
ggaccagcaggcacgcccc

SEQ ID NO: 121532 - RNA, 25 nt, Human
ggcaauggagacagcuaagagcaga

SEQ ID NO: 121533 - RNA, 18 nt, Human
gggaggccaaagggaacu

SEQ ID NO: 121534 - RNA, 22 nt, Human
gggaggcugaagcgggaggauc

SEQ ID NO: 121535 - RNA, 21 nt, Human
gggaucgcgccacugcacccc

SEQ ID NO: 121536 - RNA, 23 nt, Human
gggaucgcgccacugcaccccag

SEQ ID NO: 121537 - RNA, 18 nt, Human
gggggaggccaaagggaa

SEQ ID NO: 121538 - RNA, 19 nt, Human
gugugcagggacagggcag

SEQ ID NO: 121539 - RNA, 22 nt, Human
ucccccacaaaaagcaaagaag

SEQ ID NO: 121540 - RNA, 22 nt, Human
uccccucucccccacaaaaagc

SEQ ID NO: 121541 - RNA, 25 nt, Human
uccccucucccccacaaaaagcaaa

SEQ ID NO: 121542 - RNA, 23 nt, Human
ucgcuugagccccggaguucaag

SEQ ID NO: 121543 - RNA, 24 nt, Human
ugaaggaaaggaggacaucaaagg

SEQ ID NO: 121544 - RNA, 26 nt, Human
ugaaggaaaggaggacaucaaaggga

SEQ ID NO: 121545 - RNA, 19 nt, Human
ugagauguacacaugugcu

SEQ ID NO: 121546 - RNA, 22 nt, Human
ugagcccaggagguugaggcug

SEQ ID NO: 121547 - RNA, 23 nt, Human
ugagccccggaguucaagaccag

SEQ ID NO: 121548 - RNA, 23 nt, Human
ugagccugaggaagguggcugag

SEQ ID NO: 121549 - RNA, 18 nt, Human
ugcagggacagggcagag

SEQ ID NO: 121550 - RNA, 21 nt, Human
ugcagggacagggcagagggg

SEQ ID NO: 121551 - RNA, 25 nt, Human
ugcccguccccuccccucuccccca

SEQ ID NO: 121552 - RNA, 22 nt, Human
ugccuguagucccagcugcugg

SEQ ID NO: 121553 - RNA, 23 nt, Human
ugccuguagucccagcugcuggg

SEQ ID NO: 121554 - RNA, 19 nt, Human
ugcucacacagggccacga

SEQ ID NO: 121555 - RNA, 23 nt, Human
uggcagacuggggauguaggugg

SEQ ID NO: 121556 - RNA, 20 nt, Human
uggccccuggcugaucccuc

SEQ ID NO: 121557 - RNA, 24 nt, Human
uggcgcgugccuguagucccagcu

SEQ ID NO: 121558 - RNA, 24 nt, Human
uggcucacgccugcaaucccagca

SEQ ID NO: 121559 - RNA, 19 nt, Human
ugggaaaguggcucacgcc

SEQ ID NO: 121560 - RNA, 18 nt, Human
ugguagacucagacggag

SEQ ID NO: 121561 - RNA, 24 nt, Human
ugguggcgcgugccuguaguccca

SEQ ID NO: 121562 - RNA, 23 nt, Human
ugugcagggacagggcagagggg

SEQ ID NO: 121563 - RNA, 20 nt, Human
uugagauaaggcugagaugu

SEQ ID NO: 121564 - RNA, 22 nt, Human
uugagccccggaguucaagacc

SEQ ID NO: 121565 - RNA, 23 nt, Human
aaaacaaaaauaaaaaggcacaa

SEQ ID NO: 121566 - RNA, 21 nt, Human
aaacaaaaauaaaaaggcaca

SEQ ID NO: 121567 - RNA, 23 nt, Human
aaacaaaaauaaaaaggcacaaa

SEQ ID NO: 121568 - RNA, 21 nt, Human
aaaucagccugccaaggacac

SEQ ID NO: 121569 - RNA, 23 nt, Human
aacuuuuggucacacucucaaca

SEQ ID NO: 121570 - RNA, 21 nt, Human
aaguauccauuucaugcuuug

SEQ ID NO: 121571 - RNA, 20 nt, Human
aaugucucucacucucuggc

SEQ ID NO: 121572 - RNA, 22 nt, Human
acaaaaauaaaaaggcacaaac

SEQ ID NO: 121573 - RNA, 21 nt, Human
acacacacacacacacacaca

SEQ ID NO: 121574 - RNA, 29 nt, Human
acacacacacacacacacacaauauuuac

SEQ ID NO: 121575 - RNA, 22 nt, Human
agaaaucagccugccaaggaca

SEQ ID NO: 121576 - RNA, 18 nt, Human
aggaacaacuugacucag

SEQ ID NO: 121577 - RNA, 20 nt, Human
aggauuccgauuccugaaca

SEQ ID NO: 121578 - RNA, 21 nt, Human
agggcgcgguggcggcgagcg

SEQ ID NO: 121579 - RNA, 22 nt, Human
agggcgcgguggcggcgagcgg

SEQ ID NO: 121580 - RNA, 25 nt, Human
auaucaaagcauuaaaaacaaaaau

SEQ ID NO: 121581 - RNA, 23 nt, Human
augccuccccuuugcaaacaauc

SEQ ID NO: 121582 - RNA, 20 nt, Human
caaagcauuaaaaacaaaaa

SEQ ID NO: 121583 - RNA, 24 nt, Human
caaaguagaaacaaaugcuuccag

SEQ ID NO: 121584 - RNA, 22 nt, Human
caaggacacugaugccuccccu

SEQ ID NO: 121585 - RNA, 26 nt, Human
cacacaauauuuacaauauaaauuuu

SEQ ID NO: 121586 - RNA, 26 nt, Human
cacacacacacacacaauauuuacaa

SEQ ID NO: 121587 - RNA, 20 nt, Human
cacacacacacacacacaca

SEQ ID NO: 121588 - RNA, 23 nt, Human
cacgcuaaaauuuuccuucucaa

SEQ ID NO: 121589 - RNA, 19 nt, Human
cagugagcacgcuaaaauu

SEQ ID NO: 121590 - RNA, 19 nt, Human
cauggcacaauguuuugaa

SEQ ID NO: 121591 - RNA, 18 nt, Human
ccuaugguguucagaaau

SEQ ID NO: 121592 - RNA, 21 nt, Human
ccucccacugcuccuaaagcc

SEQ ID NO: 121593 - RNA, 19 nt, Human
cggggcugucggccgggcg

SEQ ID NO: 121594 - RNA, 22 nt, Human
cuaaagccacaccuuaauauac

SEQ ID NO: 121595 - RNA, 23 nt, Human
cucggggcugucggccgggcggc

SEQ ID NO: 121596 - RNA, 21 nt, Human
cugcgggcggagcggagggcg

SEQ ID NO: 121597 - RNA, 20 nt, Human
cuguacauauauauauauau

SEQ ID NO: 121598 - RNA, 22 nt, Human
cuguacauauauauauauauau

SEQ ID NO: 121599 - RNA, 21 nt, Human
gaggcuaacauugaaauauca

SEQ ID NO: 121600 - RNA, 21 nt, Human
gcgcgguggcggcgagcgggg

SEQ ID NO: 121601 - RNA, 22 nt, Human
gcugucacuggggcuacaggca

SEQ ID NO: 121602 - RNA, 22 nt, Human
gcugucguuuuuuuuuuuuuuu

SEQ ID NO: 121603 - RNA, 23 nt, Human
guuaaugucucucacucucuggc

SEQ ID NO: 121604 - RNA, 22 nt, Human
uaaaaaggcacaaacaacuuua

SEQ ID NO: 121605 - RNA, 18 nt, Human
uaauaaaggccauuuguu

SEQ ID NO: 121606 - RNA, 20 nt, Human
uacacacacacacacacaca

SEQ ID NO: 121607 - RNA, 22 nt, Human
uacauauauauauauauauaca

SEQ ID NO: 121608 - RNA, 24 nt, Human
uaccacauuuccuaccuagaaauc

SEQ ID NO: 121609 - RNA, 22 nt, Human
uacuaaccuuucugcugguacc

SEQ ID NO: 121610 - RNA, 26 nt, Human
uauacacacacacacacacacacaau

SEQ ID NO: 121611 - RNA, 25 nt, Human
uauauacacacacacacacacacac

SEQ ID NO: 121612 - RNA, 25 nt, Human
uauauacacacacacacacacacag

SEQ ID NO: 121613 - RNA, 18 nt, Human
uauauauauauauauaca

SEQ ID NO: 121614 - RNA, 24 nt, Human
ucacucaguuuuuaauaaaggcca

SEQ ID NO: 121615 - RNA, 21 nt, Human
ucagagcugagucugcuguuc

SEQ ID NO: 121616 - RNA, 23 nt, Human
ucgucucggggcugucggccggg

SEQ ID NO: 121617 - RNA, 18 nt, Human
ucugcugguacccuccca

SEQ ID NO: 121618 - RNA, 21 nt, Human
ugaaauaucaaagcauuaaaa

SEQ ID NO: 121619 - RNA, 20 nt, Human
ugacucagucucuugauggg

SEQ ID NO: 121620 - RNA, 18 nt, Human
uguacauauauauauaua

SEQ ID NO: 121621 - RNA, 19 nt, Human
uguacauauauauauauau

SEQ ID NO: 121622 - RNA, 20 nt, Human
uguacauauauauauauaua

SEQ ID NO: 121623 - RNA, 18 nt, Human
ugucacuggggcuacagg

SEQ ID NO: 121624 - RNA, 24 nt, Human
uguccgaaaaacagucauaucaaa

SEQ ID NO: 121625 - RNA, 24 nt, Human
uguucagaaauugaggcuaacauu

SEQ ID NO: 121626 - RNA, 25 nt, Human
uguucauuaaaagugagcgugagcu

SEQ ID NO: 121627 - RNA, 19 nt, Human
uuaaggaacaacuugacuc

SEQ ID NO: 121628 - RNA, 21 nt, Human
uucaacuagaaaggugcaaac

SEQ ID NO: 121629 - RNA, 20 nt, Human
uuuugaauugggugggaauc

SEQ ID NO: 121630 - RNA, 20 nt, Human
aaaauuaacaaaaagauauu

SEQ ID NO: 121631 - RNA, 20 nt, Human
aaacaugaucaaaauaaauc

SEQ ID NO: 121632 - RNA, 22 nt, Human
aaagaagaagagaggaaaagaa

SEQ ID NO: 121633 - RNA, 19 nt, Human
aagaagaagagaggaaaag

SEQ ID NO: 121634 - RNA, 21 nt, Human
aagaagaagagaggaaaagaa

SEQ ID NO: 121635 - RNA, 21 nt, Human
aagaagaagagaggaaaagaa

SEQ ID NO: 121636 - RNA, 22 nt, Human
aagaagaagagaggaaaagaac

SEQ ID NO: 121637 - RNA, 24 nt, Human
aagaagaagagaggaaaagaacac

SEQ ID NO: 121638 - RNA, 21 nt, Human
accgcgaaagaagaagagagg

SEQ ID NO: 121639 - RNA, 19 nt, Human
agaagaagagaggaaaaga

SEQ ID NO: 121640 - RNA, 19 nt, Human
aggaaaagaacaccgaaga

SEQ ID NO: 121641 - RNA, 19 nt, Human
auagagcaaaauuaacaaa

SEQ ID NO: 121642 - RNA, 23 nt, Human
caaaucucaccuccuucagaggc

SEQ ID NO: 121643 - RNA, 25 nt, Human
ccgaagauauaaccagucgaagccg

SEQ ID NO: 121644 - RNA, 21 nt, Human
ccgacggcgagcgcacuaaag

SEQ ID NO: 121645 - RNA, 27 nt, Human
ccuguaauuauaacaugaccggggucc

SEQ ID NO: 121646 - RNA, 23 nt, Human
gaaaaaagaacauaaucucccaa

SEQ ID NO: 121647 - RNA, 21 nt, Human
gaucuucacaggaagcagcuu

SEQ ID NO: 121648 - RNA, 21 nt, Human
guagcacaaaucucaccuccu

SEQ ID NO: 121649 - RNA, 23 nt, Human
guagcacaaaucucaccuccuuc

SEQ ID NO: 121650 - RNA, 22 nt, Human
uaaagcacgcagguagagccga

SEQ ID NO: 121651 - RNA, 21 nt, Human
uaaguguaaaccauugcuuuu

SEQ ID NO: 121652 - RNA, 23 nt, Human
uaugaaagauaaugaggugccuu

SEQ ID NO: 121653 - RNA, 21 nt, Human
ucacaaaacaucaaaaaugaa

SEQ ID NO: 121654 - RNA, 24 nt, Human
ucccaaaguagcacaaaucucacc

SEQ ID NO: 121655 - RNA, 25 nt, Human
ugaaaaaagaacauaaucucccaaa

SEQ ID NO: 121656 - RNA, 19 nt, Human
ugaaccgcgaaagaagaag

SEQ ID NO: 121657 - RNA, 23 nt, Human
ugauaugcaaaaaaaucacacuu

SEQ ID NO: 121658 - RNA, 21 nt, Human
ugggagagacagaaggaucag

SEQ ID NO: 121659 - RNA, 23 nt, Human
ugggagagacagaaggaucaggc

SEQ ID NO: 121660 - RNA, 24 nt, Human
ugggagagacagaaggaucaggcg

SEQ ID NO: 121661 - RNA, 20 nt, Human
uuaauguucuuuucaaugau

SEQ ID NO: 121662 - RNA, 20 nt, Human
uugaaaauuuugcaaaggcu

SEQ ID NO: 121663 - RNA, 23 nt, Human
uugaaaauuuugcaaaggcucau

SEQ ID NO: 121664 - RNA, 22 nt, Human
uugggagagacagaaggaucag

SEQ ID NO: 121665 - RNA, 18 nt, Human
aaccccgacugcccaccc

SEQ ID NO: 121666 - RNA, 18 nt, Human
agagauggucaggcccag

SEQ ID NO: 121667 - RNA, 23 nt, Human
aggaaggcugcccaggucagagc

SEQ ID NO: 121668 - RNA, 19 nt, Human
aggagggauggguacagua

SEQ ID NO: 121669 - RNA, 21 nt, Human
agggagaugaaggagggaugg

SEQ ID NO: 121670 - RNA, 19 nt, Human
agggauggguacaguaacc

SEQ ID NO: 121671 - RNA, 21 nt, Human
caaccccgacugcccaccccu

SEQ ID NO: 121672 - RNA, 18 nt, Human
ccaggucagagcuguugg

SEQ ID NO: 121673 - RNA, 21 nt, Human
ccccuugggauucuugccucu

SEQ ID NO: 121674 - RNA, 23 nt, Human
cccuugggauucuugccucuggc

SEQ ID NO: 121675 - RNA, 21 nt, Human
cuguugguguugacuccuucc

SEQ ID NO: 121676 - RNA, 19 nt, Human
ggagaugaaggagggaugg

SEQ ID NO: 121677 - RNA, 18 nt, Human
ggagggagaugaaggagg

SEQ ID NO: 121678 - RNA, 24 nt, Human
uacaccagagauccauuuauuaca

SEQ ID NO: 121679 - RNA, 23 nt, Human
uauuacaguccugcaaccccgac

SEQ ID NO: 121680 - RNA, 26 nt, Human
ucagagaccuccuagacuuguccccu

SEQ ID NO: 121681 - RNA, 20 nt, Human
ucagagcuguugguguugac

SEQ ID NO: 121682 - RNA, 23 nt, Human
ucccagagauggucaggcccaga

SEQ ID NO: 121683 - RNA, 23 nt, Human
ugcccaggucagagcuguuggug

SEQ ID NO: 121684 - RNA, 24 nt, Human
aaagccccaaagcacaugucaaca

SEQ ID NO: 121685 - RNA, 18 nt, Human
aaauacacaaaaacauac

SEQ ID NO: 121686 - RNA, 24 nt, Human
aaaugaccuuguguucuaccuggu

SEQ ID NO: 121687 - RNA, 22 nt, Human
aaccauugaaaggaacuggugu

SEQ ID NO: 121688 - RNA, 19 nt, Human
aagacaguguucugucaag

SEQ ID NO: 121689 - RNA, 21 nt, Human
aagucaacucagauaccaccg

SEQ ID NO: 121690 - RNA, 23 nt, Human
acaaaacuucccugggacccaag

SEQ ID NO: 121691 - RNA, 18 nt, Human
acaugugcacacacagaa

SEQ ID NO: 121692 - RNA, 20 nt, Human
acugcuaugaccucauccag

SEQ ID NO: 121693 - RNA, 18 nt, Human
agauaccaccagcugugg

SEQ ID NO: 121694 - RNA, 19 nt, Human
auauauauauauauauaua

SEQ ID NO: 121695 - RNA, 19 nt, Human
auauauauauauauauaua

SEQ ID NO: 121696 - RNA, 19 nt, Human
auauauauauauauauaua

SEQ ID NO: 121697 - RNA, 19 nt, Human
auauauauauauauauaua

SEQ ID NO: 121698 - RNA, 19 nt, Human
auauauauauauauauaua

SEQ ID NO: 121699 - RNA, 19 nt, Human
auauauauauauauauaua

SEQ ID NO: 121700 - RNA, 19 nt, Human
auauauauauauauauaua

SEQ ID NO: 121701 - RNA, 19 nt, Human
auauauauauauauauaua

SEQ ID NO: 121702 - RNA, 19 nt, Human
auauauauauauauauaua

SEQ ID NO: 121703 - RNA, 19 nt, Human
auauauauauauauauaua

SEQ ID NO: 121704 - RNA, 19 nt, Human
auauauauauauauauaua

SEQ ID NO: 121705 - RNA, 19 nt, Human
auauauauauauauauaua

SEQ ID NO: 121706 - RNA, 19 nt, Human
auauauauauauauauaua

SEQ ID NO: 121707 - RNA, 19 nt, Human
auauauauauauauauaua

SEQ ID NO: 121708 - RNA, 19 nt, Human
auauauauauauauauaua

SEQ ID NO: 121709 - RNA, 19 nt, Human
auauauauauauauauaua

SEQ ID NO: 121710 - RNA, 19 nt, Human
auauauauauauauauaua

SEQ ID NO: 121711 - RNA, 19 nt, Human
auauauauauauauauaua

SEQ ID NO: 121712 - RNA, 19 nt, Human
auauauauauauauauaua

SEQ ID NO: 121713 - RNA, 19 nt, Human
auauauauauauauauaua

SEQ ID NO: 121714 - RNA, 19 nt, Human
auauauauauauauauaua

SEQ ID NO: 121715 - RNA, 19 nt, Human
auauauauauauauauaua

SEQ ID NO: 121716 - RNA, 19 nt, Human
auauauauauauauauaua

SEQ ID NO: 121717 - RNA, 19 nt, Human
auauauauauauauauaua

SEQ ID NO: 121718 - RNA, 24 nt, Human
augaauuccccccaaaugcacaaa

SEQ ID NO: 121719 - RNA, 24 nt, Human
auuaaaauauauauauauauauau

SEQ ID NO: 121720 - RNA, 22 nt, Human
auugccucagcucuuggaaauu

SEQ ID NO: 121721 - RNA, 20 nt, Human
caaccuuuagcaucacuggc

SEQ ID NO: 121722 - RNA, 21 nt, Human
caagguggaaagacacugcca

SEQ ID NO: 121723 - RNA, 23 nt, Human
cacaaaacuucccugggacccuu

SEQ ID NO: 121724 - RNA, 25 nt, Human
cagauauguauuacacaugugcaca

SEQ ID NO: 121725 - RNA, 22 nt, Human
cagcacaauuccacgcaaucaa

SEQ ID NO: 121726 - RNA, 24 nt, Human
cauacauuuguuuaagaaauaaaa

SEQ ID NO: 121727 - RNA, 18 nt, Human
caugcaccccauucugcc

SEQ ID NO: 121728 - RNA, 25 nt, Human
caugcaccccauucugccaccugcu

SEQ ID NO: 121729 - RNA, 24 nt, Human
cccacacagaaucaaggacuuuau

SEQ ID NO: 121730 - RNA, 21 nt, Human
cccaucgaacuggagcuuccu

SEQ ID NO: 121731 - RNA, 23 nt, Human
ccccaaaugcacaaacaaauaaa

SEQ ID NO: 121732 - RNA, 23 nt, Human
ccccauucugccaccugcugccu

SEQ ID NO: 121733 - RNA, 19 nt, Human
ccuuucaggauccugaagc

SEQ ID NO: 121734 - RNA, 23 nt, Human
cgcaaucaagcacugcuaugacc

SEQ ID NO: 121735 - RNA, 24 nt, Human
cgcaaucaagcacugcuaugaccu

SEQ ID NO: 121736 - RNA, 25 nt, Human
gaaaggaacugguguaaaagcccca

SEQ ID NO: 121737 - RNA, 22 nt, Human
gaauuccccccaaaugcacaaa

SEQ ID NO: 121738 - RNA, 18 nt, Human
gaccuuguguucuaccug

SEQ ID NO: 121739 - RNA, 19 nt, Human
gaccuuguguucuaccugg

SEQ ID NO: 121740 - RNA, 18 nt, Human
gagcuccuccacaaaacu

SEQ ID NO: 121741 - RNA, 22 nt, Human
gcaaucaagcacugcuaugacc

SEQ ID NO: 121742 - RNA, 21 nt, Human
gccccaaagcacaugucaaca

SEQ ID NO: 121743 - RNA, 20 nt, Human
gucaacucagauaccaccag

SEQ ID NO: 121744 - RNA, 28 nt, Human
uaaaagccccaaagcacaugucaacacu

SEQ ID NO: 121745 - RNA, 27 nt, Human
uaaaaggcauaaaauuuaacuugaaaa

SEQ ID NO: 121746 - RNA, 23 nt, Human
uagagcaaaaccuuucaggaucc

SEQ ID NO: 121747 - RNA, 24 nt, Human
uagagcaaaaccuuucaggauccu

SEQ ID NO: 121748 - RNA, 20 nt, Human
uagcuggauagcaaaaaagu

SEQ ID NO: 121749 - RNA, 19 nt, Human
uauauauauauauauauau

SEQ ID NO: 121750 - RNA, 19 nt, Human
uauauauauauauauauau

SEQ ID NO: 121751 - RNA, 19 nt, Human
uauauauauauauauauau

SEQ ID NO: 121752 - RNA, 19 nt, Human
uauauauauauauauauau

SEQ ID NO: 121753 - RNA, 19 nt, Human
uauauauauauauauauau

SEQ ID NO: 121754 - RNA, 19 nt, Human
uauauauauauauauauau

SEQ ID NO: 121755 - RNA, 19 nt, Human
uauauauauauauauauau

SEQ ID NO: 121756 - RNA, 19 nt, Human
uauauauauauauauauau

SEQ ID NO: 121757 - RNA, 19 nt, Human
uauauauauauauauauau

SEQ ID NO: 121758 - RNA, 19 nt, Human
uauauauauauauauauau

SEQ ID NO: 121759 - RNA, 19 nt, Human
uauauauauauauauauau

SEQ ID NO: 121760 - RNA, 19 nt, Human
uauauauauauauauauau

SEQ ID NO: 121761 - RNA, 24 nt, Human
uauauauauauauauauauaugua

SEQ ID NO: 121762 - RNA, 21 nt, Human
uauauguauauaugcaauaca

SEQ ID NO: 121763 - RNA, 24 nt, Human
ucacuggcuaaaacauagccaugu

SEQ ID NO: 121764 - RNA, 19 nt, Human
ucccugggacccaaggugg

SEQ ID NO: 121765 - RNA, 20 nt, Human
uccuccacaaaacuucccug

SEQ ID NO: 121766 - RNA, 18 nt, Human
uccuugacccacaucaua

SEQ ID NO: 121767 - RNA, 21 nt, Human
ucuaugcacaauacuaucaaa

SEQ ID NO: 121768 - RNA, 24 nt, Human
ucugccaccugcugccuucuucug

SEQ ID NO: 121769 - RNA, 20 nt, Human
ugaaaagaucauuucggcua

SEQ ID NO: 121770 - RNA, 19 nt, Human
ugaaaggaacugguguaaa

SEQ ID NO: 121771 - RNA, 22 nt, Human
ugaacccacacagaaucaagga

SEQ ID NO: 121772 - RNA, 27 nt, Human
ugacccacaucauaaugcugcaucccc

SEQ ID NO: 121773 - RNA, 21 nt, Human
ugagcuccuccacaaaacuuc

SEQ ID NO: 121774 - RNA, 21 nt, Human
ugaucccagauauguauuaca

SEQ ID NO: 121775 - RNA, 24 nt, Human
ugcacaaacaaauaaaaauagcug

SEQ ID NO: 121776 - RNA, 18 nt, Human
ugccaccugcugccuucu

SEQ ID NO: 121777 - RNA, 22 nt, Human
uggaaaauauugaguuaaaaac

SEQ ID NO: 121778 - RNA, 23 nt, Human
uggaaagacacugccauauagug

SEQ ID NO: 121779 - RNA, 18 nt, Human
uggagcuuccuagaaggu

SEQ ID NO: 121780 - RNA, 21 nt, Human
uggauagcaaaaaaguuagaa

SEQ ID NO: 121781 - RNA, 21 nt, Human
uucugccaccugcugccuucu

SEQ ID NO: 121782 - RNA, 20 nt, Human
uugaacccacacagaaucaa

SEQ ID NO: 121783 - RNA, 19 nt, Human
uuucaggauccugaagcuu

SEQ ID NO: 121784 - RNA, 21 nt, Human
uuucaggauccugaagcuuug

SEQ ID NO: 121785 - RNA, 24 nt, Human
uuuucagaaaccuucaugcacccc

SEQ ID NO: 121786 - RNA, 21 nt, Human
uuuuuuuuuuuuuuaaaacga

SEQ ID NO: 121787 - RNA, 18 nt, Human
aaagugcugggauuacag

SEQ ID NO: 121788 - RNA, 19 nt, Human
aaagugcugggauuacagg

SEQ ID NO: 121789 - RNA, 22 nt, Human
aaagugcugggauuacaggugu

SEQ ID NO: 121790 - RNA, 24 nt, Human
aaagugcugggauuacagguguga

SEQ ID NO: 121791 - RNA, 18 nt, Human
aagugcugggauuacagg

SEQ ID NO: 121792 - RNA, 19 nt, Human
aagugcugggauuacaggu

SEQ ID NO: 121793 - RNA, 26 nt, Human
aagugcugggauuacaggugugagcc

SEQ ID NO: 121794 - RNA, 18 nt, Human
acggaguuucaucguguu

SEQ ID NO: 121795 - RNA, 19 nt, Human
acggaguuucaucguguug

SEQ ID NO: 121796 - RNA, 24 nt, Human
acggaguuucaucguguugcccag

SEQ ID NO: 121797 - RNA, 19 nt, Human
agaaggcuguuucggaagg

SEQ ID NO: 121798 - RNA, 22 nt, Human
aggcaauccgccugccucggcc

SEQ ID NO: 121799 - RNA, 24 nt, Human
aggcaauccgccugccucggccuc

SEQ ID NO: 121800 - RNA, 18 nt, Human
agggauucagcagugagg

SEQ ID NO: 121801 - RNA, 19 nt, Human
aguagcugggacuacaggc

SEQ ID NO: 121802 - RNA, 19 nt, Human
aguagcugggacuacaggc

SEQ ID NO: 121803 - RNA, 20 nt, Human
caaccucuuccuccuggguu

SEQ ID NO: 121804 - RNA, 22 nt, Human
caagcaauucuccugccucagc

SEQ ID NO: 121805 - RNA, 23 nt, Human
cacugcaaccucuuccuccuggg

SEQ ID NO: 121806 - RNA, 20 nt, Human
cagccuccugaguagcuggg

SEQ ID NO: 121807 - RNA, 24 nt, Human
caucguguugcccagacugaucuu

SEQ ID NO: 121808 - RNA, 27 nt, Human
caucguguugcccagacugaucuugaa

SEQ ID NO: 121809 - RNA, 22 nt, Human
ccuaaagugcugggauuacagg

SEQ ID NO: 121810 - RNA, 24 nt, Human
ccuaaagugcugggauuacaggug

SEQ ID NO: 121811 - RNA, 24 nt, Human
ccuccuggguucaagcaauucucc

SEQ ID NO: 121812 - RNA, 23 nt, Human
ccugaguagcugggacuacaggc

SEQ ID NO: 121813 - RNA, 23 nt, Human
ccugaguagcugggacuacaggc

SEQ ID NO: 121814 - RNA, 23 nt, Human
ccugccucagccuccugaguagc

SEQ ID NO: 121815 - RNA, 23 nt, Human
ccuggguucaagcaauucuccug

SEQ ID NO: 121816 - RNA, 21 nt, Human
cgaguuuuuuuuuuuuuuuuu

SEQ ID NO: 121817 - RNA, 23 nt, Human
cgcggggccgcgcuugcucuagc

SEQ ID NO: 121818 - RNA, 21 nt, Human
cggggccgcgcuugcucuagc

SEQ ID NO: 121819 - RNA, 24 nt, Human
cguguugcccagacugaucuugaa

SEQ ID NO: 121820 - RNA, 21 nt, Human
cuaaagugcugggauuacagg

SEQ ID NO: 121821 - RNA, 24 nt, Human
cuaaagugcugggauuacaggugu

SEQ ID NO: 121822 - RNA, 23 nt, Human
cucacugcaaccucuuccuccug

SEQ ID NO: 121823 - RNA, 24 nt, Human
cucacugcaaccucuuccuccugg

SEQ ID NO: 121824 - RNA, 24 nt, Human
cucagccuccugaguagcugggac

SEQ ID NO: 121825 - RNA, 21 nt, Human
cucaggcaauccgccugccuc

SEQ ID NO: 121826 - RNA, 19 nt, Human
cuccgggccgcggggccgc

SEQ ID NO: 121827 - RNA, 21 nt, Human
cuccgggccgcggggccgcgc

SEQ ID NO: 121828 - RNA, 21 nt, Human
cuccuggguucaagcaauucu

SEQ ID NO: 121829 - RNA, 23 nt, Human
cugccucagccuccugaguagcu

SEQ ID NO: 121830 - RNA, 18 nt, Human
cuguuggcaggcuucucc

SEQ ID NO: 121831 - RNA, 20 nt, Human
cuugaacuccugagcucagg

SEQ ID NO: 121832 - RNA, 18 nt, Human
cuuguucuguugcccagg

SEQ ID NO: 121833 - RNA, 24 nt, Human
gacuacaggcguacgccaccaugc

SEQ ID NO: 121834 - RNA, 24 nt, Human
gagcucaggcaauccgccugccuc

SEQ ID NO: 121835 - RNA, 26 nt, Human
gaguagcugggacuacaggcguacgc

SEQ ID NO: 121836 - RNA, 20 nt, Human
gaguuuuuuuuuuuuuuuuu

SEQ ID NO: 121837 - RNA, 18 nt, Human
gauuacaggugugagcca

SEQ ID NO: 121838 - RNA, 22 nt, Human
gauuacaggugugagccacagc

SEQ ID NO: 121839 - RNA, 22 nt, Human
gcaaccucuuccuccuggguuc

SEQ ID NO: 121840 - RNA, 20 nt, Human
gcagaguauuugggggacaa

SEQ ID NO: 121841 - RNA, 21 nt, Human
gcgcuugcucuagcucgugcc

SEQ ID NO: 121842 - RNA, 21 nt, Human
gcucacugcaaccucuuccuc

SEQ ID NO: 121843 - RNA, 24 nt, Human
gcucaggcaauccgccugccucgg

SEQ ID NO: 121844 - RNA, 20 nt, Human
gcucuagcucgugccgaauu

SEQ ID NO: 121845 - RNA, 24 nt, Human
ggacuacaggcguacgccaccaug

SEQ ID NO: 121846 - RNA, 22 nt, Human
gguucuuguucuguugcccagg

SEQ ID NO: 121847 - RNA, 18 nt, Human
guggcaugaucuuggcuc

SEQ ID NO: 121848 - RNA, 20 nt, Human
guuuuuuuuuuuuuuuuugg

SEQ ID NO: 121849 - RNA, 20 nt, Human
uaaaaaguugagaagaugga

SEQ ID NO: 121850 - RNA, 24 nt, Human
uaaagugcugggauuacaggugug

SEQ ID NO: 121851 - RNA, 23 nt, Human
uaauuuuuuguauuuuaguagag

SEQ ID NO: 121852 - RNA, 24 nt, Human
uaauuuuuuguauuuuaguagaga

SEQ ID NO: 121853 - RNA, 22 nt, Human
uacaggugugagccacagcgcc

SEQ ID NO: 121854 - RNA, 22 nt, Human
uacaggugugagccacagcgcc

SEQ ID NO: 121855 - RNA, 23 nt, Human
uacaggugugagccacagcgccu

SEQ ID NO: 121856 - RNA, 19 nt, Human
uaguagagacggaguuuca

SEQ ID NO: 121857 - RNA, 24 nt, Human
uaguagagacggaguuucaucgug

SEQ ID NO: 121858 - RNA, 19 nt, Human
ucaagcaauucuccugccu

SEQ ID NO: 121859 - RNA, 22 nt, Human
ucacugcaaccucuuccuccug

SEQ ID NO: 121860 - RNA, 24 nt, Human
ucacugcaaccucuuccuccuggg

SEQ ID NO: 121861 - RNA, 23 nt, Human
ucagccuccugaguagcugggac

SEQ ID NO: 121862 - RNA, 24 nt, Human
uccuaaagugcugggauuacaggu

SEQ ID NO: 121863 - RNA, 24 nt, Human
uccugaguagcugggacuacaggc

SEQ ID NO: 121864 - RNA, 19 nt, Human
uccuggguucaagcaauuc

SEQ ID NO: 121865 - RNA, 21 nt, Human
uccuggguucaagcaauucuc

SEQ ID NO: 121866 - RNA, 24 nt, Human
uccuggguucaagcaauucuccug

SEQ ID NO: 121867 - RNA, 18 nt, Human
ucggccuccuaaagugcu

SEQ ID NO: 121868 - RNA, 24 nt, Human
ucuccugccucagccuccugagua

SEQ ID NO: 121869 - RNA, 24 nt, Human
ucucgaguuuuuuuuuuuuuuuuu

SEQ ID NO: 121870 - RNA, 25 nt, Human
ucuggaggggcgagaaugagaugga

SEQ ID NO: 121871 - RNA, 19 nt, Human
ucuucuggaggggcgagaa

SEQ ID NO: 121872 - RNA, 23 nt, Human
ucuugaacuccugagcucaggca

SEQ ID NO: 121873 - RNA, 23 nt, Human
ucuuguucuguugcccagguugg

SEQ ID NO: 121874 - RNA, 24 nt, Human
ucuuguucuguugcccagguugga

SEQ ID NO: 121875 - RNA, 24 nt, Human
ugaacuccugagcucaggcaaucc

SEQ ID NO: 121876 - RNA, 21 nt, Human
ugagauggaguucaccagcag

SEQ ID NO: 121877 - RNA, 22 nt, Human
ugagauggguucuuguucuguu

SEQ ID NO: 121878 - RNA, 23 nt, Human
ugagauggguucuuguucuguug

SEQ ID NO: 121879 - RNA, 24 nt, Human
ugaucuugaacuccugagcucagg

SEQ ID NO: 121880 - RNA, 24 nt, Human
ugcccagacugaucuugaacuccu

SEQ ID NO: 121881 - RNA, 21 nt, Human
ugcccagguuggagugaugug

SEQ ID NO: 121882 - RNA, 24 nt, Human
ugccucagccuccugaguagcugg

SEQ ID NO: 121883 - RNA, 24 nt, Human
ugccucggccuccuaaagugcugg

SEQ ID NO: 121884 - RNA, 25 nt, Human
ugcugggauuacaggugugagccac

SEQ ID NO: 121885 - RNA, 23 nt, Human
uggaaacugaauccucuuuguau

SEQ ID NO: 121886 - RNA, 24 nt, Human
uggaggggcgagaaugagauggag

SEQ ID NO: 121887 - RNA, 24 nt, Human
uggagugauguggcaugaucuugg

SEQ ID NO: 121888 - RNA, 19 nt, Human
uggcaugaucuuggcucac

SEQ ID NO: 121889 - RNA, 21 nt, Human
uggcaugaucuuggcucacug

SEQ ID NO: 121890 - RNA, 22 nt, Human
ugggacuacaggcguacgccac

SEQ ID NO: 121891 - RNA, 24 nt, Human
ugggacuacaggcguacgccacca

SEQ ID NO: 121892 - RNA, 25 nt, Human
ugggacuacaggcguacgccaccau

SEQ ID NO: 121893 - RNA, 18 nt, Human
ugggauuacaggugugag

SEQ ID NO: 121894 - RNA, 19 nt, Human
ugggauuacaggugugagc

SEQ ID NO: 121895 - RNA, 21 nt, Human
ugggauuacaggugugagcca

SEQ ID NO: 121896 - RNA, 22 nt, Human
ugggauuacaggugugagccac

SEQ ID NO: 121897 - RNA, 22 nt, Human
ugggauuacaggugugagccac

SEQ ID NO: 121898 - RNA, 23 nt, Human
ugggauuacaggugugagccaca

SEQ ID NO: 121899 - RNA, 24 nt, Human
ugggauuacaggugugagccacag

SEQ ID NO: 121900 - RNA, 27 nt, Human
ugggauuacaggugugagccacagcgc

SEQ ID NO: 121901 - RNA, 21 nt, Human
uggguucaagcaauucuccug

SEQ ID NO: 121902 - RNA, 23 nt, Human
uggguucaagcaauucuccugcc

SEQ ID NO: 121903 - RNA, 24 nt, Human
uggguucaagcaauucuccugccu

SEQ ID NO: 121904 - RNA, 24 nt, Human
uggguucuuguucuguugcccagg

SEQ ID NO: 121905 - RNA, 18 nt, Human
uguugcccagacugaucu

SEQ ID NO: 121906 - RNA, 22 nt, Human
uguugcccagacugaucuugaa

SEQ ID NO: 121907 - RNA, 23 nt, Human
uguuucggaaggucacuguuggc

SEQ ID NO: 121908 - RNA, 21 nt, Human
uuaaaaaguugagaagaugga

SEQ ID NO: 121909 - RNA, 18 nt, Human
uuaguagagacggaguuu

SEQ ID NO: 121910 - RNA, 20 nt, Human
uuaguagagacggaguuuca

SEQ ID NO: 121911 - RNA, 21 nt, Human
uuaguagagacggaguuucau

SEQ ID NO: 121912 - RNA, 24 nt, Human
uuaguagagacggaguuucaucgu

SEQ ID NO: 121913 - RNA, 21 nt, Human
uucaagcaauucuccugccuc

SEQ ID NO: 121914 - RNA, 24 nt, Human
uucaagcaauucuccugccucagc

SEQ ID NO: 121915 - RNA, 21 nt, Human
uucuuguucuguugcccaggu

SEQ ID NO: 121916 - RNA, 21 nt, Human
uucuuguucuguugcccaggu

SEQ ID NO: 121917 - RNA, 24 nt, Human
uucuuguucuguugcccagguugg

SEQ ID NO: 121918 - RNA, 24 nt, Human
uuggagugauguggcaugaucuug

SEQ ID NO: 121919 - RNA, 25 nt, Human
uuucuguguuaaaaaguugagaagg

SEQ ID NO: 121920 - RNA, 22 nt, Human
uuuuaguagagacggaguuuca

SEQ ID NO: 121921 - RNA, 20 nt, Human
uuuuguauuuuaguagagac

SEQ ID NO: 121922 - RNA, 20 nt, Human
uuuuuguauuuuaguagaga

SEQ ID NO: 121923 - RNA, 21 nt, Human
uuuuuuuuuuuuuuuuuguuu

SEQ ID NO: 121924 - RNA, 22 nt, Human
aaaagcauuuuuaaucaacuua

SEQ ID NO: 121925 - RNA, 19 nt, Human
aacaagcuaaugugggauu

SEQ ID NO: 121926 - RNA, 24 nt, Human
aagaggaaaaaaaguguguucuga

SEQ ID NO: 121927 - RNA, 23 nt, Human
acugcaguuauuagaagugagcc

SEQ ID NO: 121928 - RNA, 24 nt, Human
caaaaaauacagcuagaaguaggc

SEQ ID NO: 121929 - RNA, 20 nt, Human
caacuuuauuaauguccugc

SEQ ID NO: 121930 - RNA, 26 nt, Human
caucacuaagagaaugggcaucucgg

SEQ ID NO: 121931 - RNA, 21 nt, Human
cauuugaagcugggagaaaga

SEQ ID NO: 121932 - RNA, 30 nt, Human
ccagagaccuuucugggaacaugccuucuu

SEQ ID NO: 121933 - RNA, 20 nt, Human
cgagacacuguagccuaaaa

SEQ ID NO: 121934 - RNA, 19 nt, Human
cugcagcagcguacauuag

SEQ ID NO: 121935 - RNA, 21 nt, Human
cugggagaaagaggaaaaaaa

SEQ ID NO: 121936 - RNA, 24 nt, Human
cuucaugauacauuauguuuuacu

SEQ ID NO: 121937 - RNA, 25 nt, Human
cuuucugggaacaugccuucuccag

SEQ ID NO: 121938 - RNA, 18 nt, Human
gcccaaugaugaauuugc

SEQ ID NO: 121939 - RNA, 20 nt, Human
gggggcggccggccugggca

SEQ ID NO: 121940 - RNA, 18 nt, Human
uacauuauguuuuacuga

SEQ ID NO: 121941 - RNA, 23 nt, Human
uaccacaggucaucuuuggucau

SEQ ID NO: 121942 - RNA, 21 nt, Human
uccugcagcagcguacauuag

SEQ ID NO: 121943 - RNA, 22 nt, Human
ucgagacacuguagccuaaaaa

SEQ ID NO: 121944 - RNA, 24 nt, Human
ucucuuugguuaugaauuuuuauu

SEQ ID NO: 121945 - RNA, 23 nt, Human
ucugcccauuucccuguggaauc

SEQ ID NO: 121946 - RNA, 21 nt, Human
uggaaucuaguaucaguguug

SEQ ID NO: 121947 - RNA, 22 nt, Human
ugggagaaagaggaaaaaaagu

SEQ ID NO: 121948 - RNA, 21 nt, Human
ugggggcggccggccugggca

SEQ ID NO: 121949 - RNA, 22 nt, Human
ugucccuccagagaccuuucug

SEQ ID NO: 121950 - RNA, 22 nt, Human
uucaggagccccgagggguggg

SEQ ID NO: 121951 - RNA, 21 nt, Human
aaaaagaaaaaaaaaugaaag

SEQ ID NO: 121952 - RNA, 24 nt, Human
aaaagaaaaaaaaaugaaagcaag

SEQ ID NO: 121953 - RNA, 26 nt, Human
aaaagaaaaagaaagaaagaaaagaa

SEQ ID NO: 121954 - RNA, 24 nt, Human
aaacaugaucacuaguaauggcac

SEQ ID NO: 121955 - RNA, 22 nt, Human
aaagaaaaagaaagaaagaaaa

SEQ ID NO: 121956 - RNA, 21 nt, Human
aagaaaaagaaagaaagaaaa

SEQ ID NO: 121957 - RNA, 24 nt, Human
aagaaagaaagaaaagaaagaaaa

SEQ ID NO: 121958 - RNA, 20 nt, Human
aagaggaaacagaaugcaga

SEQ ID NO: 121959 - RNA, 21 nt, Human
auuaaaaagaaaaagaaagaa

SEQ ID NO: 121960 - RNA, 22 nt, Human
caaaggacagcucugugccacc

SEQ ID NO: 121961 - RNA, 19 nt, Human
cacaacuagaagaggaaac

SEQ ID NO: 121962 - RNA, 18 nt, Human
cacacguugucaguuucc

SEQ ID NO: 121963 - RNA, 24 nt, Human
ccacugggccuucuauuucuagca

SEQ ID NO: 121964 - RNA, 20 nt, Human
cccaggcuacagauggauca

SEQ ID NO: 121965 - RNA, 22 nt, Human
cccccagaaggauuuuaauugu

SEQ ID NO: 121966 - RNA, 21 nt, Human
ccuucuauuucuagcaaaauc

SEQ ID NO: 121967 - RNA, 22 nt, Human
cguauugugcuuccagugcccc

SEQ ID NO: 121968 - RNA, 21 nt, Human
cugccaaccuaaugauucuug

SEQ ID NO: 121969 - RNA, 19 nt, Human
gaguuugcuuuuguagagu

SEQ ID NO: 121970 - RNA, 24 nt, Human
gaucucaucucaucuuacaugcaa

SEQ ID NO: 121971 - RNA, 25 nt, Human
gcaaaggacagcucugugccaccuu

SEQ ID NO: 121972 - RNA, 19 nt, Human
ggcauacgagcuggcaggu

SEQ ID NO: 121973 - RNA, 24 nt, Human
guacauuuuugcacugaaacagaa

SEQ ID NO: 121974 - RNA, 24 nt, Human
uaguacaggaauguccugucuccu

SEQ ID NO: 121975 - RNA, 24 nt, Human
uauuuuccccaucccucccacucc

SEQ ID NO: 121976 - RNA, 21 nt, Human
ucaaauuaaaaagaaaaaaaa

SEQ ID NO: 121977 - RNA, 21 nt, Human
uccccaucccucccacuccca

SEQ ID NO: 121978 - RNA, 20 nt, Human
ucuaccauuacacuuccaga

SEQ ID NO: 121979 - RNA, 22 nt, Human
ugaaacagaagcaauacaaguu

SEQ ID NO: 121980 - RNA, 19 nt, Human
ugcaaacagacacuguucc

SEQ ID NO: 121981 - RNA, 24 nt, Human
ugcaaaggacagcucugugccacc

SEQ ID NO: 121982 - RNA, 20 nt, Human
uggaauuaaaaagaaaaaga

SEQ ID NO: 121983 - RNA, 18 nt, Human
uggcacaacuagaagagg

SEQ ID NO: 121984 - RNA, 22 nt, Human
uguccugucuccuucccaggcu

SEQ ID NO: 121985 - RNA, 23 nt, Human
uguccugucuccuucccaggcuu

SEQ ID NO: 121986 - RNA, 22 nt, Human
uuaaaggggggaaaaaaacaug

SEQ ID NO: 121987 - RNA, 22 nt, Human
uuaugcauauaccugccaaccu

SEQ ID NO: 121988 - RNA, 18 nt, Human
uucaaauuaaaaagaaaa

SEQ ID NO: 121989 - RNA, 23 nt, Human
uucauuaaaggggggaaaaaaac

SEQ ID NO: 121990 - RNA, 23 nt, Human
aaaaaaaaaaaaaaaaaaaagag

SEQ ID NO: 121991 - RNA, 25 nt, Human
aaaaaaaaaaaaaagagcuacuuca

SEQ ID NO: 121992 - RNA, 24 nt, Human
aaaaaaaaaagagcuacuucaaag

SEQ ID NO: 121993 - RNA, 25 nt, Human
aaaaaaauuuuaacaagcaaggcua

SEQ ID NO: 121994 - RNA, 25 nt, Human
aaacaugaaauagauccaccugcuu

SEQ ID NO: 121995 - RNA, 25 nt, Human
aacaagguuccaaauaacaccucuu

SEQ ID NO: 121996 - RNA, 22 nt, Human
aagcaagcaaagucaguaccau

SEQ ID NO: 121997 - RNA, 18 nt, Human
aagcauauuaaaaaggaa

SEQ ID NO: 121998 - RNA, 25 nt, Human
aagcugcuccucagaccuuccuccg

SEQ ID NO: 121999 - RNA, 29 nt, Human
acaguuacugcaaaaaaaaaaaaaaaaaa

SEQ ID NO: 122000 - RNA, 25 nt, Human
accgcauuuucucuugaagcaucgu

SEQ ID NO: 122001 - RNA, 21 nt, Human
acuguccaaaacaagguucca

SEQ ID NO: 122002 - RNA, 25 nt, Human
aggcaacugguaaacuguccaaaac

SEQ ID NO: 122003 - RNA, 19 nt, Human
aucuugugauccauucuug

SEQ ID NO: 122004 - RNA, 22 nt, Human
caacgcugcugccacagaccga

SEQ ID NO: 122005 - RNA, 23 nt, Human
caacugguaaacuguccaaaaca

SEQ ID NO: 122006 - RNA, 22 nt, Human
caaguucagacaauacagcuaa

SEQ ID NO: 122007 - RNA, 23 nt, Human
caccccucgagcccucucagcaa

SEQ ID NO: 122008 - RNA, 18 nt, Human
cagcccaccccucgagcc

SEQ ID NO: 122009 - RNA, 22 nt, Human
ccaaaaaggaccagaacaaaaa

SEQ ID NO: 122010 - RNA, 30 nt, Human
ccaccccucgagcccucucagcaacucuaa

SEQ ID NO: 122011 - RNA, 19 nt, Human
ccccucgagcccucucagc

SEQ ID NO: 122012 - RNA, 22 nt, Human
ccccucgagcccucucagcaac

SEQ ID NO: 122013 - RNA, 21 nt, Human
cccucgagcccucucagcaac

SEQ ID NO: 122014 - RNA, 22 nt, Human
ccgccgcgggaguccgaccguc

SEQ ID NO: 122015 - RNA, 24 nt, Human
ccgucuccgccuccccucgcucuc

SEQ ID NO: 122016 - RNA, 23 nt, Human
ccuacccauacauaucccaaaua

SEQ ID NO: 122017 - RNA, 19 nt, Human
cguaucacagcagguuaca

SEQ ID NO: 122018 - RNA, 20 nt, Human
cuacaggccaaucacaaugc

SEQ ID NO: 122019 - RNA, 20 nt, Human
cuccgccuccccucgcucuc

SEQ ID NO: 122020 - RNA, 21 nt, Human
cuccgccuccccucgcucucc

SEQ ID NO: 122021 - RNA, 23 nt, Human
cucgcucuccgcucccggggccg

SEQ ID NO: 122022 - RNA, 19 nt, Human
cugcaaaaaaaaaaaaaaa

SEQ ID NO: 122023 - RNA, 18 nt, Human
cuuaaaaaaaaaaaaaaa

SEQ ID NO: 122024 - RNA, 18 nt, Human
cuuaaaaaaaaaaaaaaa

SEQ ID NO: 122025 - RNA, 20 nt, Human
cuuugggauaaaaggcaacu

SEQ ID NO: 122026 - RNA, 22 nt, Human
gccaacgcugcugccacagacc

SEQ ID NO: 122027 - RNA, 24 nt, Human
ggccaaucacaaugcaaguucaga

SEQ ID NO: 122028 - RNA, 22 nt, Human
gguuacaacaacuuugggauaa

SEQ ID NO: 122029 - RNA, 18 nt, Human
guaccauuacagauauuc

SEQ ID NO: 122030 - RNA, 23 nt, Human
uaaaaaacaguuacugcaaaaaa

SEQ ID NO: 122031 - RNA, 30 nt, Human
uaaaaaacaguuacugcaaaaaaaaaaaaa

SEQ ID NO: 122032 - RNA, 33 nt, Human
uacagauauucuuaaaaaaaaaaaaaaaaaaaa

SEQ ID NO: 122033 - RNA, 24 nt, Human
uacccuacccauacauaucccaaa

SEQ ID NO: 122034 - RNA, 24 nt, Human
uacucaauucuuaaaaauuagaaa

SEQ ID NO: 122035 - RNA, 24 nt, Human
uagaaauugcuguagcaguauuca

SEQ ID NO: 122036 - RNA, 24 nt, Human
uagcaguauucacuauaacuuaac

SEQ ID NO: 122037 - RNA, 28 nt, Human
uagugugucaggcacuuucugagauacc

SEQ ID NO: 122038 - RNA, 23 nt, Human
ucaaaaacaugaaauagauccac

SEQ ID NO: 122039 - RNA, 22 nt, Human
ucaaagcaagcaaagucaguac

SEQ ID NO: 122040 - RNA, 23 nt, Human
ucccaaauaguuuuugaucaaaa

SEQ ID NO: 122041 - RNA, 23 nt, Human
uccuccgucuccgccuccccucg

SEQ ID NO: 122042 - RNA, 22 nt, Human
ucuccgccuccccucgcucucc

SEQ ID NO: 122043 - RNA, 22 nt, Human
ugcaaaaaaaaaaaaaaaaaaa

SEQ ID NO: 122044 - RNA, 21 nt, Human
ugguauacuucaaauacccuc

SEQ ID NO: 122045 - RNA, 25 nt, Human
ugugucaggcacuuucugagauacc

SEQ ID NO: 122046 - RNA, 25 nt, Human
ugugucaggcacuuucugagauacc

SEQ ID NO: 122047 - RNA, 18 nt, Human
uuagaaauugcuguagca

SEQ ID NO: 122048 - RNA, 23 nt, Human
uuuaagcauauuaaaaaggaaac

SEQ ID NO: 122049 - RNA, 19 nt, Human
aaaaaaacaaaacagaaag

SEQ ID NO: 122050 - RNA, 24 nt, Human
aaaaaaacaaaacagaaagaaaug

SEQ ID NO: 122051 - RNA, 18 nt, Human
aaaaaacaaaacagaaag

SEQ ID NO: 122052 - RNA, 23 nt, Human
aaacagaaagaaaugucuugugg

SEQ ID NO: 122053 - RNA, 21 nt, Human
aaagaaaacugguauaaauga

SEQ ID NO: 122054 - RNA, 22 nt, Human
aacgauaacccuuacgccccac

SEQ ID NO: 122055 - RNA, 20 nt, Human
aagccgucccccacacagug

SEQ ID NO: 122056 - RNA, 24 nt, Human
aauugucagaaacugcugaaugcc

SEQ ID NO: 122057 - RNA, 24 nt, Human
acaaacaaauucacauaucagaac

SEQ ID NO: 122058 - RNA, 24 nt, Human
acaaagcgugagaagccguccccc

SEQ ID NO: 122059 - RNA, 24 nt, Human
acaacggaugaagagaguaaacaa

SEQ ID NO: 122060 - RNA, 23 nt, Human
agaaaaaaacaaaacagaaagaa

SEQ ID NO: 122061 - RNA, 21 nt, Human
agaaagaaaugucuuguggua

SEQ ID NO: 122062 - RNA, 24 nt, Human
agcacuuuguugacaaggagugug

SEQ ID NO: 122063 - RNA, 22 nt, Human
aggagaaaaaaacaaaacagaa

SEQ ID NO: 122064 - RNA, 21 nt, Human
aucaucauaaagaaaacuggu

SEQ ID NO: 122065 - RNA, 24 nt, Human
caacgcgcuuuucuucuuuaaucu

SEQ ID NO: 122066 - RNA, 23 nt, Human
caaggcaagguccugaccuugcc

SEQ ID NO: 122067 - RNA, 21 nt, Human
caaugcaaccugaagccuaga

SEQ ID NO: 122068 - RNA, 22 nt, Human
cacccuccgccggcgacagcuc

SEQ ID NO: 122069 - RNA, 23 nt, Human
cacuguaucaucauaaagaaaac

SEQ ID NO: 122070 - RNA, 20 nt, Human
cacuucucguuacuuuacag

SEQ ID NO: 122071 - RNA, 22 nt, Human
cacuuuagcuuucuacugauuu

SEQ ID NO: 122072 - RNA, 22 nt, Human
caggagaaaaaaacaaaacaga

SEQ ID NO: 122073 - RNA, 19 nt, Human
ccgccggcgacagcuccuc

SEQ ID NO: 122074 - RNA, 22 nt, Human
cgccggcgacagcuccucaguc

SEQ ID NO: 122075 - RNA, 27 nt, Human
cgugagaagccgucccccacacagugg

SEQ ID NO: 122076 - RNA, 22 nt, Human
cugaagccuagagucacaacgg

SEQ ID NO: 122077 - RNA, 19 nt, Human
cugcagcaucuuccgcuuu

SEQ ID NO: 122078 - RNA, 21 nt, Human
cuugugguaugcaugcacaug

SEQ ID NO: 122079 - RNA, 19 nt, Human
gagaaaaaaacaaaacaga

SEQ ID NO: 122080 - RNA, 22 nt, Human
gagaaaaaaacaaaacagaaag

SEQ ID NO: 122081 - RNA, 24 nt, Human
ggcaagaaacaucuugcuguacag

SEQ ID NO: 122082 - RNA, 21 nt, Human
gggaagaggcguugcgcggcg

SEQ ID NO: 122083 - RNA, 20 nt, Human
guaaacaaagcgugagaagc

SEQ ID NO: 122084 - RNA, 18 nt, Human
guaugcaugcacaugcac

SEQ ID NO: 122085 - RNA, 22 nt, Human
uaaagaaaaacuggaaauccau

SEQ ID NO: 122086 - RNA, 19 nt, Human
uagaugaggaaacacggcg

SEQ ID NO: 122087 - RNA, 23 nt, Human
uauaaagcacuucucguuacuuu

SEQ ID NO: 122088 - RNA, 21 nt, Human
uaucaucauaaagaaaacugg

SEQ ID NO: 122089 - RNA, 18 nt, Human
uauucugugucuugugcu

SEQ ID NO: 122090 - RNA, 24 nt, Human
ucaaauaucuacaucuaaaauuuu

SEQ ID NO: 122091 - RNA, 22 nt, Human
ucuuccgcuuuuguugucugag

SEQ ID NO: 122092 - RNA, 18 nt, Human
ugaggaaacacggcggca

SEQ ID NO: 122093 - RNA, 22 nt, Human
ugcacuguucccggagcgccug

SEQ ID NO: 122094 - RNA, 18 nt, Human
ugccucgucucuccuccc

SEQ ID NO: 122095 - RNA, 21 nt, Human
ugccuuguuuaguugucacaa

SEQ ID NO: 122096 - RNA, 22 nt, Human
ugcuuuuuuuuuuuuuuguuaa

SEQ ID NO: 122097 - RNA, 24 nt, Human
ugggagaaaguaaagaaaaacugg

SEQ ID NO: 122098 - RNA, 22 nt, Human
uuacaacaaugcauuaacaaaa

SEQ ID NO: 122099 - RNA, 24 nt, Human
uuaguugucacaaacaaauucaca

SEQ ID NO: 122100 - RNA, 22 nt, Human
uuuacaacaaugcauuaacaaa

SEQ ID NO: 122101 - RNA, 18 nt, Human
aagcaaucugagcgcccc

SEQ ID NO: 122102 - RNA, 25 nt, Human
aagccacuuccaaacgucccuccaa

SEQ ID NO: 122103 - RNA, 22 nt, Human
aaguggccuucagagaaagagc

SEQ ID NO: 122104 - RNA, 21 nt, Human
acaaaacacaguaauccucaa

SEQ ID NO: 122105 - RNA, 21 nt, Human
acacaguaauccucaauguua

SEQ ID NO: 122106 - RNA, 20 nt, Human
acccggaggggaggaugggg

SEQ ID NO: 122107 - RNA, 24 nt, Human
agaaaagagauggcggugucaagg

SEQ ID NO: 122108 - RNA, 24 nt, Human
aggaaacucaguggacugacaagc

SEQ ID NO: 122109 - RNA, 20 nt, Human
aggaaugcaccgcguucccc

SEQ ID NO: 122110 - RNA, 23 nt, Human
aggcagagcucaggaguccuccc

SEQ ID NO: 122111 - RNA, 20 nt, Human
aggcaggcuauugaauggcc

SEQ ID NO: 122112 - RNA, 21 nt, Human
aggcuggguacacuggguccc

SEQ ID NO: 122113 - RNA, 18 nt, Human
agggcccaaccgcuucuc

SEQ ID NO: 122114 - RNA, 22 nt, Human
agugugaaaacccggaggggag

SEQ ID NO: 122115 - RNA, 22 nt, Human
augcuaaugcgcugggcaugaa

SEQ ID NO: 122116 - RNA, 24 nt, Human
augugcucagauggggcucaucug

SEQ ID NO: 122117 - RNA, 19 nt, Human
auucagaaccaaucuggug

SEQ ID NO: 122118 - RNA, 22 nt, Human
caaaacacaguaauccucaaug

SEQ ID NO: 122119 - RNA, 19 nt, Human
caaaguccuagcccgucca

SEQ ID NO: 122120 - RNA, 18 nt, Human
caaagugcccuuggcuca

SEQ ID NO: 122121 - RNA, 22 nt, Human
caaguacaaauacuuaucugag

SEQ ID NO: 122122 - RNA, 19 nt, Human
cagcagggcacgaggccag

SEQ ID NO: 122123 - RNA, 18 nt, Human
cagcuuugggcagaggga

SEQ ID NO: 122124 - RNA, 23 nt, Human
ccaaagcaaucugagcgccccca

SEQ ID NO: 122125 - RNA, 21 nt, Human
ccaaaguccuagcccguccac

SEQ ID NO: 122126 - RNA, 22 nt, Human
ccaccagcaccucugaguucac

SEQ ID NO: 122127 - RNA, 25 nt, Human
ccaccccuccugccauaggaaggac

SEQ ID NO: 122128 - RNA, 23 nt, Human
cccaggcucgaggaaccgcccuc

SEQ ID NO: 122129 - RNA, 21 nt, Human
cccauacagauugugugaggu

SEQ ID NO: 122130 - RNA, 28 nt, Human
ccccaaaguccuagcccguccaccagca

SEQ ID NO: 122131 - RNA, 18 nt, Human
ccccaccccuccugccau

SEQ ID NO: 122132 - RNA, 21 nt, Human
ccccgcacuccgcacgucaac

SEQ ID NO: 122133 - RNA, 23 nt, Human
ccccggagccccgcacuccgcac

SEQ ID NO: 122134 - RNA, 22 nt, Human
cccggacgaaggcaggcuauug

SEQ ID NO: 122135 - RNA, 21 nt, Human
ccggagccccgcacuccgcac

SEQ ID NO: 122136 - RNA, 25 nt, Human
ccuagcccguccaccagcaccucug

SEQ ID NO: 122137 - RNA, 22 nt, Human
ccucgcuccaggggagcugguc

SEQ ID NO: 122138 - RNA, 20 nt, Human
ccucuggccccaggagcaga

SEQ ID NO: 122139 - RNA, 23 nt, Human
ccugcccggcuagacuuugggag

SEQ ID NO: 122140 - RNA, 23 nt, Human
ccugugcgcgcugccugaagccu

SEQ ID NO: 122141 - RNA, 21 nt, Human
ccuucagagaaagagccccau

SEQ ID NO: 122142 - RNA, 24 nt, Human
cgcacacugagccagcccugugug

SEQ ID NO: 122143 - RNA, 21 nt, Human
cgcccagugugaaaacccgga

SEQ ID NO: 122144 - RNA, 18 nt, Human
cuaaccccaaaguccuag

SEQ ID NO: 122145 - RNA, 24 nt, Human
cucaauguuacuggaagaggcaga

SEQ ID NO: 122146 - RNA, 19 nt, Human
cuccugaacaggccagaaa

SEQ ID NO: 122147 - RNA, 18 nt, Human
cucgugcugcucaguccc

SEQ ID NO: 122148 - RNA, 23 nt, Human
cucucagcgucuccaaagcaauc

SEQ ID NO: 122149 - RNA, 19 nt, Human
cucugaguucacuggccac

SEQ ID NO: 122150 - RNA, 19 nt, Human
gaaagagagggaaggggcc

SEQ ID NO: 122151 - RNA, 22 nt, Human
gagaaagagccccauggccuaa

SEQ ID NO: 122152 - RNA, 18 nt, Human
gaggauggggucucgugc

SEQ ID NO: 122153 - RNA, 18 nt, Human
gagguaggagagagggca

SEQ ID NO: 122154 - RNA, 20 nt, Human
gcagagggaaggagguuuga

SEQ ID NO: 122155 - RNA, 22 nt, Human
gcccauacagauugugugaggu

SEQ ID NO: 122156 - RNA, 24 nt, Human
ggaaggacagcuuugggcagaggg

SEQ ID NO: 122157 - RNA, 23 nt, Human
ggagguaggagagagggcagaag

SEQ ID NO: 122158 - RNA, 22 nt, Human
ggcacgaggccagaggcugggu

SEQ ID NO: 122159 - RNA, 21 nt, Human
ggccuucgcugggugaggccu

SEQ ID NO: 122160 - RNA, 20 nt, Human
gggcaaggccuucggcugca

SEQ ID NO: 122161 - RNA, 22 nt, Human
gucauguaugaggcacguccug

SEQ ID NO: 122162 - RNA, 18 nt, Human
uacuggaagaggcagagc

SEQ ID NO: 122163 - RNA, 18 nt, Human
uccaccagcaccucugag

SEQ ID NO: 122164 - RNA, 23 nt, Human
uccaccagcaccucugaguucac

SEQ ID NO: 122165 - RNA, 25 nt, Human
uccugggacccccaccccuccugcc

SEQ ID NO: 122166 - RNA, 22 nt, Human
ucgcugggugaggccuucccca

SEQ ID NO: 122167 - RNA, 23 nt, Human
ucucgugcugcucagucccccgg

SEQ ID NO: 122168 - RNA, 20 nt, Human
ucugagaagguggagguagg

SEQ ID NO: 122169 - RNA, 20 nt, Human
ucuggggaaagagagggaag

SEQ ID NO: 122170 - RNA, 20 nt, Human
ugaacaggccagaaauuggu

SEQ ID NO: 122171 - RNA, 18 nt, Human
ugaggcuccugaacaggc

SEQ ID NO: 122172 - RNA, 22 nt, Human
ugccagagccugugcgcgcugg

SEQ ID NO: 122173 - RNA, 20 nt, Human
ugccagggcccaaccgcuuc

SEQ ID NO: 122174 - RNA, 23 nt, Human
ugccagggcccaaccgcuucucc

SEQ ID NO: 122175 - RNA, 23 nt, Human
ugccagggcccaaccgcuucucc

SEQ ID NO: 122176 - RNA, 21 nt, Human
ugcccuuggcucacccggcug

SEQ ID NO: 122177 - RNA, 20 nt, Human
ugccuggccggggaggccca

SEQ ID NO: 122178 - RNA, 21 nt, Human
uggaagaggcagagcucagga

SEQ ID NO: 122179 - RNA, 21 nt, Human
uggaagaggcagagcucagga

SEQ ID NO: 122180 - RNA, 20 nt, Human
ugggcagagggaaggagguu

SEQ ID NO: 122181 - RNA, 19 nt, Human
ugggccccucauggcucag

SEQ ID NO: 122182 - RNA, 20 nt, Human
uggguaaggagcagcuggau

SEQ ID NO: 122183 - RNA, 24 nt, Human
uggguaaggagcagcuggaugugc

SEQ ID NO: 122184 - RNA, 20 nt, Human
ugggugaggccuuccccagc

SEQ ID NO: 122185 - RNA, 18 nt, Human
ugugccagggcccaaccg

SEQ ID NO: 122186 - RNA, 19 nt, Human
uuacugcagucacggacgc

SEQ ID NO: 122187 - RNA, 23 nt, Human
uugggcccauacagauuguguga

SEQ ID NO: 122188 - RNA, 19 nt, Human
aaaauccucucuccaugcu

SEQ ID NO: 122189 - RNA, 24 nt, Human
aaauaggaagcgcagccacaggca

SEQ ID NO: 122190 - RNA, 18 nt, Human
aacaggcagacaccacag

SEQ ID NO: 122191 - RNA, 20 nt, Human
aaggagagugucacgcaaca

SEQ ID NO: 122192 - RNA, 23 nt, Human
aaggagagugucacgcaacaggc

SEQ ID NO: 122193 - RNA, 22 nt, Human
aagugaccccuugaugcaagga

SEQ ID NO: 122194 - RNA, 20 nt, Human
aaguuucccaaauaccuuuc

SEQ ID NO: 122195 - RNA, 19 nt, Human
aauccucucuccaugcucg

SEQ ID NO: 122196 - RNA, 21 nt, Human
acaccacagaggagccaguac

SEQ ID NO: 122197 - RNA, 20 nt, Human
acaccauccuggaagaaaaa

SEQ ID NO: 122198 - RNA, 23 nt, Human
acaggcagacaccacagaggagc

SEQ ID NO: 122199 - RNA, 24 nt, Human
agaaaaauggacccuccagucaaa

SEQ ID NO: 122200 - RNA, 18 nt, Human
agaauuccccccaacuca

SEQ ID NO: 122201 - RNA, 26 nt, Human
agaauuccccccaacucagggcagua

SEQ ID NO: 122202 - RNA, 19 nt, Human
agaguacacaucgagucug

SEQ ID NO: 122203 - RNA, 23 nt, Human
agcaauacccugagguucccagc

SEQ ID NO: 122204 - RNA, 22 nt, Human
aggcagacaccacagaggagcc

SEQ ID NO: 122205 - RNA, 23 nt, Human
aggcagacaccacagaggagcca

SEQ ID NO: 122206 - RNA, 24 nt, Human
augcgagguaguugagaaacaagg

SEQ ID NO: 122207 - RNA, 21 nt, Human
caagcaauacccugagguucc

SEQ ID NO: 122208 - RNA, 18 nt, Human
caccaaguguucaaaucc

SEQ ID NO: 122209 - RNA, 21 nt, Human
cacucugcagccccacccacc

SEQ ID NO: 122210 - RNA, 19 nt, Human
cacugagaauuccccccaa

SEQ ID NO: 122211 - RNA, 24 nt, Human
cacugagaauuccccccaacucag

SEQ ID NO: 122212 - RNA, 20 nt, Human
cacuuuauaacggucuaggu

SEQ ID NO: 122213 - RNA, 23 nt, Human
cagaggagccaguacacgugaug

SEQ ID NO: 122214 - RNA, 24 nt, Human
caggcagacaccacagaggagcca

SEQ ID NO: 122215 - RNA, 21 nt, Human
caugcucgguaaguccaugug

SEQ ID NO: 122216 - RNA, 21 nt, Human
cccacccaccaucgguuccca

SEQ ID NO: 122217 - RNA, 25 nt, Human
cccacccaccaucgguucccaucgc

SEQ ID NO: 122218 - RNA, 20 nt, Human
ccccacccaccaucgguucc

SEQ ID NO: 122219 - RNA, 18 nt, Human
ccccgaccgcaugcgccc

SEQ ID NO: 122220 - RNA, 25 nt, Human
ccccggacagccagugaacaacccc

SEQ ID NO: 122221 - RNA, 23 nt, Human
ccucccgucagcgacagagcugg

SEQ ID NO: 122222 - RNA, 22 nt, Human
ccuggaagaaaaauggacccuc

SEQ ID NO: 122223 - RNA, 22 nt, Human
cggacagccagugaacaacccc

SEQ ID NO: 122224 - RNA, 21 nt, Human
cuaaaauccucucuccaugcu

SEQ ID NO: 122225 - RNA, 21 nt, Human
cuagcuaaaauccucucucca

SEQ ID NO: 122226 - RNA, 18 nt, Human
cuucagauccucccguca

SEQ ID NO: 122227 - RNA, 24 nt, Human
gaacaaccccgaccgcaugcgccc

SEQ ID NO: 122228 - RNA, 20 nt, Human
gagaauuccccccaacucag

SEQ ID NO: 122229 - RNA, 21 nt, Human
gaggagccaguacacgugaug

SEQ ID NO: 122230 - RNA, 19 nt, Human
gccggcgacgcgcgcggag

SEQ ID NO: 122231 - RNA, 20 nt, Human
ggcacucugcagccccaccc

SEQ ID NO: 122232 - RNA, 19 nt, Human
gucacauuaagaaaguaac

SEQ ID NO: 122233 - RNA, 22 nt, Human
uaaagaaagucuccaaagccga

SEQ ID NO: 122234 - RNA, 19 nt, Human
uaaguccauguggcacacu

SEQ ID NO: 122235 - RNA, 20 nt, Human
uaaguccauguggcacacuu

SEQ ID NO: 122236 - RNA, 19 nt, Human
uacccugagguucccagca

SEQ ID NO: 122237 - RNA, 20 nt, Human
uacccugagguucccagcac

SEQ ID NO: 122238 - RNA, 22 nt, Human
ucacgcaacaggcagacaccac

SEQ ID NO: 122239 - RNA, 23 nt, Human
ucauauugcccuuucaacugcag

SEQ ID NO: 122240 - RNA, 19 nt, Human
ucccagcccuagaaauagg

SEQ ID NO: 122241 - RNA, 22 nt, Human
uccuggaagaaaaauggacccu

SEQ ID NO: 122242 - RNA, 22 nt, Human
ucugccgcaacucaagaacugc

SEQ ID NO: 122243 - RNA, 22 nt, Human
ugaagaaucauccgcuacaaga

SEQ ID NO: 122244 - RNA, 19 nt, Human
ugagaggguuuuagaggaa

SEQ ID NO: 122245 - RNA, 23 nt, Human
ugcaagugacaaguuucccaaau

SEQ ID NO: 122246 - RNA, 25 nt, Human
ugcaagugacaaguuucccaaauac

SEQ ID NO: 122247 - RNA, 20 nt, Human
uggaagaaaaauggacccuc

SEQ ID NO: 122248 - RNA, 23 nt, Human
uggcaagcaauacccugagguuc

SEQ ID NO: 122249 - RNA, 25 nt, Human
uggcaagcaauacccugagguuccc

SEQ ID NO: 122250 - RNA, 21 nt, Human
uuaaagaaagucuccaaagcc

SEQ ID NO: 122251 - RNA, 22 nt, Human
uuaagaaaguaacuucauauug

SEQ ID NO: 122252 - RNA, 20 nt, Human
uuacucuuugaccugcggcc

SEQ ID NO: 122253 - RNA, 21 nt, Human
uuagaguacacaucgagucug

SEQ ID NO: 122254 - RNA, 18 nt, Human
cucuguggggagcagggu

SEQ ID NO: 122255 - RNA, 19 nt, Human
uuccauggguuuacugagg

SEQ ID NO: 122256 - RNA, 19 nt, Human
agggguugcccuggaggag

SEQ ID NO: 122257 - RNA, 21 nt, Human
caguaaacaggcugccucucc

SEQ ID NO: 122258 - RNA, 19 nt, Human
cggacccucaacagccucu

SEQ ID NO: 122259 - RNA, 22 nt, Human
cucaacagccucuucuuucucc

SEQ ID NO: 122260 - RNA, 18 nt, Human
cuggaggagggguggggg

SEQ ID NO: 122261 - RNA, 19 nt, Human
gaggaggggugggggcccc

SEQ ID NO: 122262 - RNA, 21 nt, Human
ggaagacagacaugaaugcau

SEQ ID NO: 122263 - RNA, 21 nt, Human
ggugggggccccggccucggc

SEQ ID NO: 122264 - RNA, 19 nt, Human
uacucaaggagucacucag

SEQ ID NO: 122265 - RNA, 21 nt, Human
ucagccccuucugugccagaa

SEQ ID NO: 122266 - RNA, 24 nt, Human
ucuccagggagggcugccauucau

SEQ ID NO: 122267 - RNA, 18 nt, Human
ugagcuggggagggccug

SEQ ID NO: 122268 - RNA, 19 nt, Human
ugagcuggggagggccugu

SEQ ID NO: 122269 - RNA, 18 nt, Human
ugcccuggaggaggggug

SEQ ID NO: 122270 - RNA, 19 nt, Human
ugcuguaggaccaaggggu

SEQ ID NO: 122271 - RNA, 18 nt, Human
uggaggaggggugggggc

SEQ ID NO: 122272 - RNA, 20 nt, Human
uggguugagcuggggagggc

SEQ ID NO: 122273 - RNA, 23 nt, Human
uuuaauggguugagcuggggagg

SEQ ID NO: 122274 - RNA, 18 nt, Human
uuuauuaugcguauucag

SEQ ID NO: 122275 - RNA, 21 nt, Human
uuuuuuuuuuuuuuggaugga

SEQ ID NO: 122276 - RNA, 21 nt, Human
aaauguggaaagcuacuugcu

SEQ ID NO: 122277 - RNA, 25 nt, Human
aacaccgucucuccucugauuucug

SEQ ID NO: 122278 - RNA, 22 nt, Human
acaguaaaagcugguuucuccu

SEQ ID NO: 122279 - RNA, 23 nt, Human
acuacucgggaggcugagguggg

SEQ ID NO: 122280 - RNA, 25 nt, Human
acugcacaccagcccagcgcugcag

SEQ ID NO: 122281 - RNA, 22 nt, Human
agcacaggucucccgcuguucc

SEQ ID NO: 122282 - RNA, 20 nt, Human
aggcaaucuguaaaacuagc

SEQ ID NO: 122283 - RNA, 19 nt, Human
aguagagaucaguggguca

SEQ ID NO: 122284 - RNA, 18 nt, Human
agugggucagaaacaacu

SEQ ID NO: 122285 - RNA, 20 nt, Human
auaaaaugcauuucuacccc

SEQ ID NO: 122286 - RNA, 20 nt, Human
auugcaaacucgauagaugc

SEQ ID NO: 122287 - RNA, 23 nt, Human
cacuacucgggaggcugaggugg

SEQ ID NO: 122288 - RNA, 24 nt, Human
cacuacucgggaggcugagguggg

SEQ ID NO: 122289 - RNA, 19 nt, Human
cacugcacaccagcccagc

SEQ ID NO: 122290 - RNA, 19 nt, Human
cacugcacaccagcccagc

SEQ ID NO: 122291 - RNA, 25 nt, Human
cacugcacaccagcccagcgcugca

SEQ ID NO: 122292 - RNA, 21 nt, Human
ccaauccaguccuucagaccc

SEQ ID NO: 122293 - RNA, 19 nt, Human
ccacugcacaccagcccag

SEQ ID NO: 122294 - RNA, 19 nt, Human
ccacugcacaccagcccag

SEQ ID NO: 122295 - RNA, 20 nt, Human
ccacugcacaccagcccagc

SEQ ID NO: 122296 - RNA, 20 nt, Human
ccagcccagcgcugcagccg

SEQ ID NO: 122297 - RNA, 21 nt, Human
cccccaggacuggcacgacag

SEQ ID NO: 122298 - RNA, 22 nt, Human
cccccaggacuggcacgacagg

SEQ ID NO: 122299 - RNA, 23 nt, Human
ccuagauccacuacucgggaggc

SEQ ID NO: 122300 - RNA, 19 nt, Human
cgagagccugcagcccagc

SEQ ID NO: 122301 - RNA, 21 nt, Human
cgcaccacugcacaccagccc

SEQ ID NO: 122302 - RNA, 24 nt, Human
cgucucugucuugcucccuggaga

SEQ ID NO: 122303 - RNA, 24 nt, Human
cuccaaagggcucccaacaccguc

SEQ ID NO: 122304 - RNA, 20 nt, Human
cucugucuugcucccuggag

SEQ ID NO: 122305 - RNA, 21 nt, Human
cuguaaaacuagcacaggucu

SEQ ID NO: 122306 - RNA, 25 nt, Human
gaaaaaauaaaacuucuauuaaaga

SEQ ID NO: 122307 - RNA, 19 nt, Human
gacccugucugaaacuugu

SEQ ID NO: 122308 - RNA, 18 nt, Human
gagauggauggaucacgg

SEQ ID NO: 122309 - RNA, 21 nt, Human
gauguagccaggacuuggucu

SEQ ID NO: 122310 - RNA, 20 nt, Human
gcaccacugcacaccagccc

SEQ ID NO: 122311 - RNA, 25 nt, Human
gcucccuggagauggauggaucacg

SEQ ID NO: 122312 - RNA, 24 nt, Human
ggagacuggcguucuccaaagggc

SEQ ID NO: 122313 - RNA, 19 nt, Human
ggagauggauggaucacgg

SEQ ID NO: 122314 - RNA, 21 nt, Human
gggaggcugaggugggaacca

SEQ ID NO: 122315 - RNA, 25 nt, Human
gggaggcugaggugggaaccagauc

SEQ ID NO: 122316 - RNA, 23 nt, Human
gucucugucuugcucccuggaga

SEQ ID NO: 122317 - RNA, 19 nt, Human
uaaaacuagcacaggucuc

SEQ ID NO: 122318 - RNA, 20 nt, Human
uaguagagaucaguggguca

SEQ ID NO: 122319 - RNA, 20 nt, Human
ucccaacaccgucucuccuc

SEQ ID NO: 122320 - RNA, 23 nt, Human
uccuuggaagacaggucugaugu

SEQ ID NO: 122321 - RNA, 18 nt, Human
uccuugugguaguagaga

SEQ ID NO: 122322 - RNA, 18 nt, Human
ucugugacaaauguggaa

SEQ ID NO: 122323 - RNA, 20 nt, Human
ucuugcucccuggagaugga

SEQ ID NO: 122324 - RNA, 27 nt, Human
ugacauugcaaacucgauagaugcaac

SEQ ID NO: 122325 - RNA, 21 nt, Human
ugcacgaaaaaauaaaacuuc

SEQ ID NO: 122326 - RNA, 21 nt, Human
ugcagccgagagccugcagcc

SEQ ID NO: 122327 - RNA, 30 nt, Human
uggagauggauggaucacggagggggccaa

SEQ ID NO: 122328 - RNA, 22 nt, Human
uggauggaucacggagggggcc

SEQ ID NO: 122329 - RNA, 18 nt, Human
uggccugucugcacugua

SEQ ID NO: 122330 - RNA, 21 nt, Human
ugggauguagccaggacuugg

SEQ ID NO: 122331 - RNA, 22 nt, Human
ugggucagaaacaacuccugac

SEQ ID NO: 122332 - RNA, 23 nt, Human
uggucuccuuggaagacaggucu

SEQ ID NO: 122333 - RNA, 21 nt, Human
uguagccaggacuuggucucc

SEQ ID NO: 122334 - RNA, 20 nt, Human
uguuccacuggcucacccac

SEQ ID NO: 122335 - RNA, 23 nt, Human
uuaaagaauaaaaugcauuucua

SEQ ID NO: 122336 - RNA, 22 nt, Human
aaaauggccaguggccgauuga

SEQ ID NO: 122337 - RNA, 25 nt, Human
accaauuccccuuuacaacugaugc

SEQ ID NO: 122338 - RNA, 21 nt, Human
agaaaauucccacuuaauuga

SEQ ID NO: 122339 - RNA, 18 nt, Human
agcaucuauuuuaaaagu

SEQ ID NO: 122340 - RNA, 20 nt, Human
augaaauacuggaaggcaua

SEQ ID NO: 122341 - RNA, 24 nt, Human
ccaauuccccuuuacaacugaugc

SEQ ID NO: 122342 - RNA, 19 nt, Human
ccagaaaauucccacuuaa

SEQ ID NO: 122343 - RNA, 24 nt, Human
cugagauugcugcugaaagucuac

SEQ ID NO: 122344 - RNA, 19 nt, Human
uaagggcaguuuuaauucu

SEQ ID NO: 122345 - RNA, 22 nt, Human
uagaaaaaaauggccaguggcc

SEQ ID NO: 122346 - RNA, 25 nt, Human
uauuuuuaaaacuuuauuuuaaaaa

SEQ ID NO: 122347 - RNA, 25 nt, Human
ucuacagucugugaauauaccaauu

SEQ ID NO: 122348 - RNA, 22 nt, Human
ugaccaucuuccagaaaauucc

SEQ ID NO: 122349 - RNA, 23 nt, Human
ugagcaucuauuuuaaaaguuuu

SEQ ID NO: 122350 - RNA, 21 nt, Human
uggccaguggccgauugaaag

SEQ ID NO: 122351 - RNA, 23 nt, Human
uugaaagguauauuaaaauuaag

SEQ ID NO: 122352 - RNA, 24 nt, Human
uugaaagguauauuaaaauuaagg

SEQ ID NO: 122353 - RNA, 23 nt, Human
uugauuuuaaaaaauauagcaug

SEQ ID NO: 122354 - RNA, 22 nt, Human
uuucuugugauugguacaauuu

SEQ ID NO: 122355 - RNA, 20 nt, Human
uuuguaagcuucugagauug

SEQ ID NO: 122356 - RNA, 21 nt, Human
uuuguaagcuucugagauugc

SEQ ID NO: 122357 - RNA, 22 nt, Human
uuuguaagcuucugagauugcu

SEQ ID NO: 122358 - RNA, 20 nt, Human
aaaacagcaagucgggcuug

SEQ ID NO: 122359 - RNA, 19 nt, Human
aaccacagaacaaaacagc

SEQ ID NO: 122360 - RNA, 22 nt, Human
accagcccccaaucccaacccc

SEQ ID NO: 122361 - RNA, 22 nt, Human
accccaccuccaggccaauaca

SEQ ID NO: 122362 - RNA, 22 nt, Human
acuguauuuccaugucagcugg

SEQ ID NO: 122363 - RNA, 22 nt, Human
agcccagcugggcccaagcugg

SEQ ID NO: 122364 - RNA, 19 nt, Human
agcuggggcucucagccgc

SEQ ID NO: 122365 - RNA, 24 nt, Human
aggcaggcagcauuucugaaccca

SEQ ID NO: 122366 - RNA, 18 nt, Human
agggagggcccgggagga

SEQ ID NO: 122367 - RNA, 18 nt, Human
aggggaggacaacagagg

SEQ ID NO: 122368 - RNA, 22 nt, Human
augaagggagccccaggauaca

SEQ ID NO: 122369 - RNA, 23 nt, Human
caacaagguggguuuuguccccu

SEQ ID NO: 122370 - RNA, 26 nt, Human
caaucccaaccccaccuccaggccaa

SEQ ID NO: 122371 - RNA, 20 nt, Human
cagaacaaaacagcaagucg

SEQ ID NO: 122372 - RNA, 21 nt, Human
cagagcccagcugggcccaag

SEQ ID NO: 122373 - RNA, 22 nt, Human
cagcaccacccugcaggcucca

SEQ ID NO: 122374 - RNA, 24 nt, Human
cagcaccacccugcaggcuccaac

SEQ ID NO: 122375 - RNA, 24 nt, Human
cagcaccacccugcaggcuccaac

SEQ ID NO: 122376 - RNA, 20 nt, Human
cagcccccaaucccaacccc

SEQ ID NO: 122377 - RNA, 23 nt, Human
cagcucuacccccaccaaacaga

SEQ ID NO: 122378 - RNA, 21 nt, Human
caggcagggcagguuuccaag

SEQ ID NO: 122379 - RNA, 26 nt, Human
caggcuccaacaagguggguuucuua

SEQ ID NO: 122380 - RNA, 26 nt, Human
ccaaccccaccuccaggccaauacau

SEQ ID NO: 122381 - RNA, 24 nt, Human
ccagcaccacccugcaggcuccaa

SEQ ID NO: 122382 - RNA, 19 nt, Human
ccagcccccaaucccaacc

SEQ ID NO: 122383 - RNA, 21 nt, Human
ccagcgggcgcugguagggcc

SEQ ID NO: 122384 - RNA, 20 nt, Human
ccagcucauccucaggccuc

SEQ ID NO: 122385 - RNA, 22 nt, Human
ccagggaggggaaaaccacaga

SEQ ID NO: 122386 - RNA, 27 nt, Human
cccaaucccaaccccaccuccaggcca

SEQ ID NO: 122387 - RNA, 27 nt, Human
cccccaaucccaaccccaccuccaggc

SEQ ID NO: 122388 - RNA, 19 nt, Human
ccccugggacuggcucagu

SEQ ID NO: 122389 - RNA, 21 nt, Human
ccccugggacuggcucagucc

SEQ ID NO: 122390 - RNA, 24 nt, Human
ccccugggacuggcucagucccag

SEQ ID NO: 122391 - RNA, 23 nt, Human
cccucaggcagggcagguuucca

SEQ ID NO: 122392 - RNA, 20 nt, Human
ccgcccaaggggaggacaac

SEQ ID NO: 122393 - RNA, 21 nt, Human
ccucaggccucuagcggccuc

SEQ ID NO: 122394 - RNA, 20 nt, Human
ccugcaggcuccaacaaggu

SEQ ID NO: 122395 - RNA, 23 nt, Human
ccugcaggcuccaacaagguggg

SEQ ID NO: 122396 - RNA, 25 nt, Human
ccugcaggcuccaacaagguggguu

SEQ ID NO: 122397 - RNA, 18 nt, Human
ccuggugugggguagggg

SEQ ID NO: 122398 - RNA, 19 nt, Human
cgcccaggacagugggcgg

SEQ ID NO: 122399 - RNA, 19 nt, Human
cucuagcggccucauccuc

SEQ ID NO: 122400 - RNA, 20 nt, Human
cuguuucugugcuggcgcgc

SEQ ID NO: 122401 - RNA, 26 nt, Human
gacaacagaggucagcugcagaggaa

SEQ ID NO: 122402 - RNA, 19 nt, Human
gaggacggccugguguggg

SEQ ID NO: 122403 - RNA, 19 nt, Human
gccgcugggccaggggccc

SEQ ID NO: 122404 - RNA, 23 nt, Human
gcgcugguagggccggggagggg

SEQ ID NO: 122405 - RNA, 19 nt, Human
gcgggcgcugguagggccg

SEQ ID NO: 122406 - RNA, 20 nt, Human
gcucagucccagcaccaccc

SEQ ID NO: 122407 - RNA, 23 nt, Human
ggaaggcuggcaccagccccagu

SEQ ID NO: 122408 - RNA, 18 nt, Human
ggacagugggcgggcgag

SEQ ID NO: 122409 - RNA, 22 nt, Human
ggaggacaacagaggucagcug

SEQ ID NO: 122410 - RNA, 22 nt, Human
ggaucagcucuacccccaccaa

SEQ ID NO: 122411 - RNA, 18 nt, Human
ggcccgggacacugaaca

SEQ ID NO: 122412 - RNA, 20 nt, Human
ggcggccgggucggagaggg

SEQ ID NO: 122413 - RNA, 18 nt, Human
gggaggccggaggccaac

SEQ ID NO: 122414 - RNA, 20 nt, Human
gggcccgggacacugaacag

SEQ ID NO: 122415 - RNA, 19 nt, Human
gguggcagagcccagcugg

SEQ ID NO: 122416 - RNA, 26 nt, Human
uagggccggggaggggacucccugga

SEQ ID NO: 122417 - RNA, 21 nt, Human
ucagcuggggcucucagccgc

SEQ ID NO: 122418 - RNA, 22 nt, Human
uccaagggagggcccgggagga

SEQ ID NO: 122419 - RNA, 19 nt, Human
uccaaugcacgaaacagau

SEQ ID NO: 122420 - RNA, 18 nt, Human
ucgccgaggccgugcgcu

SEQ ID NO: 122421 - RNA, 21 nt, Human
ucuacccccaccaaacagaug

SEQ ID NO: 122422 - RNA, 20 nt, Human
ugcacgaaacagaucugugc

SEQ ID NO: 122423 - RNA, 22 nt, Human
ugcacgaaacagaucugugcuc

SEQ ID NO: 122424 - RNA, 25 nt, Human
uggcaccagcccccaaucccaaccc

SEQ ID NO: 122425 - RNA, 18 nt, Human
uggcagagcccagcuggg

SEQ ID NO: 122426 - RNA, 23 nt, Human
ugggacuggcucagucccagcac

SEQ ID NO: 122427 - RNA, 18 nt, Human
ugggaggggccgcugggc

SEQ ID NO: 122428 - RNA, 21 nt, Human
ugggccaggggccuccugcuc

SEQ ID NO: 122429 - RNA, 22 nt, Human
ugggcgggcgagugugugggug

SEQ ID NO: 122430 - RNA, 21 nt, Human
ugggguaggggcucagcccag

SEQ ID NO: 122431 - RNA, 18 nt, Human
uggguuuuguccccucuc

SEQ ID NO: 122432 - RNA, 20 nt, Human
ugugugggaggggccgcugg

SEQ ID NO: 122433 - RNA, 24 nt, Human
ugugugggugugugugggaggggc

SEQ ID NO: 122434 - RNA, 20 nt, Human
uuuguccccucucacuccuu

SEQ ID NO: 122435 - RNA, 23 nt, Human
uuuuuuuuuuuugaggggaggcc

SEQ ID NO: 122436 - RNA, 19 nt, Human
uuuuuuuuuuuuugagggg

SEQ ID NO: 122437 - RNA, 22 nt, Human
uuuuuuuuuuuuuuuuugaggg

SEQ ID NO: 122438 - RNA, 22 nt, Human
aagauaccacccuucaccccga

SEQ ID NO: 122439 - RNA, 21 nt, Human
aagcgggggcagaacagagcu

SEQ ID NO: 122440 - RNA, 23 nt, Human
acccaacagacgcuccaccgacc

SEQ ID NO: 122441 - RNA, 20 nt, Human
accccgacauccuccuaagc

SEQ ID NO: 122442 - RNA, 19 nt, Human
caacugccaagauaccacc

SEQ ID NO: 122443 - RNA, 25 nt, Human
caagauaccacccuucaccccgaca

SEQ ID NO: 122444 - RNA, 24 nt, Human
caccaggucccgagcugggggccc

SEQ ID NO: 122445 - RNA, 21 nt, Human
cacccuucaccccgacauccu

SEQ ID NO: 122446 - RNA, 26 nt, Human
cagaaaauuuucuuccugcucauuac

SEQ ID NO: 122447 - RNA, 20 nt, Human
caggggcugugccccagccc

SEQ ID NO: 122448 - RNA, 18 nt, Human
cagggugggaauggggug

SEQ ID NO: 122449 - RNA, 18 nt, Human
caggucccgagcuggggg

SEQ ID NO: 122450 - RNA, 22 nt, Human
caggucccgagcugggggcccc

SEQ ID NO: 122451 - RNA, 25 nt, Human
ccacccuucaccccgacauccuccu

SEQ ID NO: 122452 - RNA, 19 nt, Human
ccccgacauccuccuaagc

SEQ ID NO: 122453 - RNA, 19 nt, Human
cccuaaauccaagggaacc

SEQ ID NO: 122454 - RNA, 23 nt, Human
cuaccacaauucaacaaaggugc

SEQ ID NO: 122455 - RNA, 23 nt, Human
cucauuacccaagcccagaguuc

SEQ ID NO: 122456 - RNA, 24 nt, Human
cugccaagauaccacccuucaccc

SEQ ID NO: 122457 - RNA, 22 nt, Human
cuuuauugcuguuagaaaaggg

SEQ ID NO: 122458 - RNA, 19 nt, Human
gacauccuccuaagcuacc

SEQ ID NO: 122459 - RNA, 24 nt, Human
gagcccgcggccagcggggccuga

SEQ ID NO: 122460 - RNA, 21 nt, Human
gcccagaguucuugccccagc

SEQ ID NO: 122461 - RNA, 18 nt, Human
gcggcccggacccaacag

SEQ ID NO: 122462 - RNA, 22 nt, Human
gcuucaacugccaagauaccac

SEQ ID NO: 122463 - RNA, 22 nt, Human
ggcagaacagagcugggcuuaa

SEQ ID NO: 122464 - RNA, 19 nt, Human
gggaauggggugcagggaa

SEQ ID NO: 122465 - RNA, 20 nt, Human
gggcgaagccggcggcccgg

SEQ ID NO: 122466 - RNA, 24 nt, Human
ggggaggggccuggacacauguca

SEQ ID NO: 122467 - RNA, 19 nt, Human
ggggcagaacagagcuggg

SEQ ID NO: 122468 - RNA, 24 nt, Human
ggggugcagggaagcaggggcugu

SEQ ID NO: 122469 - RNA, 24 nt, Human
ggugcaggugcagaacuucagggu

SEQ ID NO: 122470 - RNA, 21 nt, Human
uaaauccaagggaaccagaaa

SEQ ID NO: 122471 - RNA, 18 nt, Human
uaagaucagaaaauuuuc

SEQ ID NO: 122472 - RNA, 22 nt, Human
uacccagugccuuucccucugc

SEQ ID NO: 122473 - RNA, 18 nt, Human
uauugcuguuagaaaagg

SEQ ID NO: 122474 - RNA, 23 nt, Human
ucaaacagaggaaagcgggggca

SEQ ID NO: 122475 - RNA, 19 nt, Human
ucagaaaauuuucuuccug

SEQ ID NO: 122476 - RNA, 19 nt, Human
ucaggcuggggcagcagcc

SEQ ID NO: 122477 - RNA, 18 nt, Human
ucccucugccagcuguac

SEQ ID NO: 122478 - RNA, 19 nt, Human
uccuaagcuaccacaauuc

SEQ ID NO: 122479 - RNA, 19 nt, Human
ucuugccccagcuucaacu

SEQ ID NO: 122480 - RNA, 23 nt, Human
ugagguacccagugccuuucccu

SEQ ID NO: 122481 - RNA, 21 nt, Human
ugcagaacuucagggugggaa

SEQ ID NO: 122482 - RNA, 19 nt, Human
ugggaauggggugcaggga

SEQ ID NO: 122483 - RNA, 19 nt, Human
ugucaggcuggggcagcag

SEQ ID NO: 122484 - RNA, 27 nt, Human
uguuagaaaagggugguuacaaguuuc

SEQ ID NO: 122485 - RNA, 21 nt, Human
uucagggugggaauggggugc

SEQ ID NO: 122486 - RNA, 20 nt, Human
guggagcuggccuguguccc

SEQ ID NO: 122487 - RNA, 21 nt, Human
uuaaggcucuggcaacacugu

SEQ ID NO: 122488 - RNA, 21 nt, Human
acagaaaagacagucccugga

SEQ ID NO: 122489 - RNA, 28 nt, Human
agcagcgcuggcggcuuggcucuugcgc

SEQ ID NO: 122490 - RNA, 23 nt, Human
aggugagggcagaauguuggggg

SEQ ID NO: 122491 - RNA, 22 nt, Human
aucuccccacaacuuccuccag

SEQ ID NO: 122492 - RNA, 21 nt, Human
cacucaauguuuauugaacag

SEQ ID NO: 122493 - RNA, 18 nt, Human
cccaggcccaggcugccc

SEQ ID NO: 122494 - RNA, 23 nt, Human
cccguuccucuccuucuccgcca

SEQ ID NO: 122495 - RNA, 19 nt, Human
cgccagucugcgcugcggc

SEQ ID NO: 122496 - RNA, 25 nt, Human
cgccagucugcgcugcggcugccac

SEQ ID NO: 122497 - RNA, 19 nt, Human
cuccccacaacuuccucca

SEQ ID NO: 122498 - RNA, 19 nt, Human
cugcccguuccucuccuuc

SEQ ID NO: 122499 - RNA, 24 nt, Human
gaaggacacuaaggcacauggcug

SEQ ID NO: 122500 - RNA, 21 nt, Human
gcucaugguggaacuccuccu

SEQ ID NO: 122501 - RNA, 21 nt, Human
guggaaaguagcccuucugga

SEQ ID NO: 122502 - RNA, 19 nt, Human
uaagaaggacacuaaggca

SEQ ID NO: 122503 - RNA, 23 nt, Human
uccaggcugggcacagaggugag

SEQ ID NO: 122504 - RNA, 20 nt, Human
ucccaguggaucuccccaca

SEQ ID NO: 122505 - RNA, 18 nt, Human
uccucuccuucuccgcca

SEQ ID NO: 122506 - RNA, 20 nt, Human
uccuugucuguagguuucca

SEQ ID NO: 122507 - RNA, 21 nt, Human
ucugcgcugcggcugccacgg

SEQ ID NO: 122508 - RNA, 24 nt, Human
ugagggcagaauguuggggguccc

SEQ ID NO: 122509 - RNA, 26 nt, Human
ugagggcagaauguuggggguccuga

SEQ ID NO: 122510 - RNA, 27 nt, Human
ugagggcagaauguuggggguccugaa

SEQ ID NO: 122511 - RNA, 22 nt, Human
uggaaaguagcccuucuggaca

SEQ ID NO: 122512 - RNA, 24 nt, Human
uggaaaguagcccuucuggacaga

SEQ ID NO: 122513 - RNA, 20 nt, Human
aaacuuguaccaaagacuua

SEQ ID NO: 122514 - RNA, 23 nt, Human
aaacuuguaccaaagacuuauga

SEQ ID NO: 122515 - RNA, 18 nt, Human
aaucacauuucuuuuuau

SEQ ID NO: 122516 - RNA, 19 nt, Human
aauggaagagcaggaugga

SEQ ID NO: 122517 - RNA, 24 nt, Human
acaaaucacauuucuuuuuaucau

SEQ ID NO: 122518 - RNA, 28 nt, Human
acacagcugucagggaaaggggaacgcc

SEQ ID NO: 122519 - RNA, 19 nt, Human
accuugaggauauagaagg

SEQ ID NO: 122520 - RNA, 20 nt, Human
cagcaucagcccugggacaa

SEQ ID NO: 122521 - RNA, 24 nt, Human
gaagagcaggauggauuuggcugg

SEQ ID NO: 122522 - RNA, 19 nt, Human
gauaaauacuuuauuucaa

SEQ ID NO: 122523 - RNA, 20 nt, Human
gaucauuugaagcacaaaca

SEQ ID NO: 122524 - RNA, 19 nt, Human
guaaacuuguaccaaagac

SEQ ID NO: 122525 - RNA, 21 nt, Human
uaccuguacagcaucagcccu

SEQ ID NO: 122526 - RNA, 18 nt, Human
uaccuugaggauauagaa

SEQ ID NO: 122527 - RNA, 19 nt, Human
uaccuugaggauauagaag

SEQ ID NO: 122528 - RNA, 21 nt, Human
uaggaaggaucauuugaagca

SEQ ID NO: 122529 - RNA, 24 nt, Human
uagggugcuuaaagcuaacuaguc

SEQ ID NO: 122530 - RNA, 22 nt, Human
ucacaucucuuagccuaagagu

SEQ ID NO: 122531 - RNA, 22 nt, Human
ucaguaucaccacaucugcuuc

SEQ ID NO: 122532 - RNA, 19 nt, Human
ucauuugaagcacaaacaa

SEQ ID NO: 122533 - RNA, 19 nt, Human
ugaauagauuuaugaauuu

SEQ ID NO: 122534 - RNA, 22 nt, Human
uggaagaaauggaagagcagga

SEQ ID NO: 122535 - RNA, 22 nt, Human
uuggcagugggauauggaaucc

SEQ ID NO: 122536 - RNA, 21 nt, Human
uuucaaaagugcaaagaaggg

SEQ ID NO: 122537 - RNA, 30 nt, Human
aaacgaaaaugcaaagucaguaagugaauc

SEQ ID NO: 122538 - RNA, 22 nt, Human
aacugcccuccccggcuucccc

SEQ ID NO: 122539 - RNA, 22 nt, Human
accgcguccucucuuccagucc

SEQ ID NO: 122540 - RNA, 23 nt, Human
accgcguccucucuuccaguccc

SEQ ID NO: 122541 - RNA, 21 nt, Human
augcgccauccccagucaagu

SEQ ID NO: 122542 - RNA, 23 nt, Human
caacugcccuccccggcuucccc

SEQ ID NO: 122543 - RNA, 23 nt, Human
cacagaauucaaaucacacucgg

SEQ ID NO: 122544 - RNA, 20 nt, Human
caccucaaggccagcagagu

SEQ ID NO: 122545 - RNA, 22 nt, Human
ccagcagaguucgggguagacg

SEQ ID NO: 122546 - RNA, 31 nt, Human
ccaugcaugcgccauccccagucaaguccuu

SEQ ID NO: 122547 - RNA, 21 nt, Human
cccaugcaugcgccaucccca

SEQ ID NO: 122548 - RNA, 21 nt, Human
cgcgggguccucaacugcccu

SEQ ID NO: 122549 - RNA, 20 nt, Human
cuggccggcggcgcuuuccu

SEQ ID NO: 122550 - RNA, 21 nt, Human
cugguagacugaagaugaauu

SEQ ID NO: 122551 - RNA, 24 nt, Human
cuuccccaccucaaggccagcaga

SEQ ID NO: 122552 - RNA, 19 nt, Human
gcccuccccggcuucccca

SEQ ID NO: 122553 - RNA, 22 nt, Human
gcgggggcugguagacugaaga

SEQ ID NO: 122554 - RNA, 24 nt, Human
uaucacagaauucaaaucacacuc

SEQ ID NO: 122555 - RNA, 23 nt, Human
ucaacugcccuccccggcuuccc

SEQ ID NO: 122556 - RNA, 25 nt, Human
ucaacugcccuccccggcuucccca

SEQ ID NO: 122557 - RNA, 22 nt, Human
ucaguaagugaaucaauaauau

SEQ ID NO: 122558 - RNA, 26 nt, Human
uccucccaugcaugcgccauccccag

SEQ ID NO: 122559 - RNA, 21 nt, Human
uccugcugcggucguagcugc

SEQ ID NO: 122560 - RNA, 20 nt, Human
ugaagaugaauuccucccau

SEQ ID NO: 122561 - RNA, 20 nt, Human
uguccggccacagcugggcc

SEQ ID NO: 122562 - RNA, 22 nt, Human
uuaaaauagagguaacauuuac

SEQ ID NO: 122563 - RNA, 22 nt, Human
uuauagcaguaauuaaaauaga

SEQ ID NO: 122564 - RNA, 18 nt, Human
aacuuggauccucaauga

SEQ ID NO: 122565 - RNA, 20 nt, Human
acaucuuuuuaaaaaaugaa

SEQ ID NO: 122566 - RNA, 18 nt, Human
auaaaauuuccccagaca

SEQ ID NO: 122567 - RNA, 21 nt, Human
caaacaagccucugagauuac

SEQ ID NO: 122568 - RNA, 22 nt, Human
cagaauuaaaaucucaacuugg

SEQ ID NO: 122569 - RNA, 19 nt, Human
cagcaaacaagccucugag

SEQ ID NO: 122570 - RNA, 25 nt, Human
caggcacccucagcaaacaagccuc

SEQ ID NO: 122571 - RNA, 18 nt, Human
cccucagcaaacaagccu

SEQ ID NO: 122572 - RNA, 21 nt, Human
cccucagcaaacaagccucug

SEQ ID NO: 122573 - RNA, 19 nt, Human
ccucaaugauucaacuggu

SEQ ID NO: 122574 - RNA, 18 nt, Human
ccucugagauuacagccg

SEQ ID NO: 122575 - RNA, 18 nt, Human
cuguccuuaaguccuucc

SEQ ID NO: 122576 - RNA, 26 nt, Human
uaaaaaugucacagaauuaaaaucuc

SEQ ID NO: 122577 - RNA, 19 nt, Human
uagugguaacauuuuaccc

SEQ ID NO: 122578 - RNA, 24 nt, Human
uccucaaugauucaacugguuuau

SEQ ID NO: 122579 - RNA, 21 nt, Human
ucgcacgugcgcaggcacccu

SEQ ID NO: 122580 - RNA, 19 nt, Human
ugucacagaauuaaaaucu

SEQ ID NO: 122581 - RNA, 21 nt, Human
uuaaaaucucaacuuggaucc

SEQ ID NO: 122582 - RNA, 25 nt, Human
uuaaaguagugguaacauuuuaccc

SEQ ID NO: 122583 - RNA, 18 nt, Human
uuggucaguuucaagaua

SEQ ID NO: 122584 - RNA, 24 nt, Human
aaggaaucucgugccucagccucc

SEQ ID NO: 122585 - RNA, 19 nt, Human
aaguacugggauuacaggc

SEQ ID NO: 122586 - RNA, 22 nt, Human
aaguacugggauuacaggcgug

SEQ ID NO: 122587 - RNA, 23 nt, Human
aaguacugggauuacaggcguga

SEQ ID NO: 122588 - RNA, 26 nt, Human
aaguacugggauuacaggcgugagcc

SEQ ID NO: 122589 - RNA, 22 nt, Human
aaguagcugggauuacaggcau

SEQ ID NO: 122590 - RNA, 24 nt, Human
aaguagcugggauuacaggcaugc

SEQ ID NO: 122591 - RNA, 24 nt, Human
aauaaaacaauaagcaauuacaga

SEQ ID NO: 122592 - RNA, 21 nt, Human
acauuaaucaugacacaauua

SEQ ID NO: 122593 - RNA, 18 nt, Human
acucugucauccaggcug

SEQ ID NO: 122594 - RNA, 25 nt, Human
acucugucauccaggcuggaguaca

SEQ ID NO: 122595 - RNA, 18 nt, Human
acuuagcaaacuuuaucc

SEQ ID NO: 122596 - RNA, 19 nt, Human
aggaaucucgugccucagc

SEQ ID NO: 122597 - RNA, 23 nt, Human
aggcaugcaccaccgugcucggc

SEQ ID NO: 122598 - RNA, 23 nt, Human
aggcgugagccaccgugcccggc

SEQ ID NO: 122599 - RNA, 23 nt, Human
aggggucuuaaaagacaaagagu

SEQ ID NO: 122600 - RNA, 19 nt, Human
aguacaguggugugaucuc

SEQ ID NO: 122601 - RNA, 21 nt, Human
aguacaguggugugaucucag

SEQ ID NO: 122602 - RNA, 22 nt, Human
aguagagaugggguuucaccau

SEQ ID NO: 122603 - RNA, 21 nt, Human
aguauacaauaaaacaauaag

SEQ ID NO: 122604 - RNA, 19 nt, Human
aguggugugaucucagcuc

SEQ ID NO: 122605 - RNA, 24 nt, Human
auccaggcuggaguacaguggugu

SEQ ID NO: 122606 - RNA, 18 nt, Human
augggguuucaccauguu

SEQ ID NO: 122607 - RNA, 28 nt, Human
caaagaguauacaauaaaaccggggccc

SEQ ID NO: 122608 - RNA, 18 nt, Human
caacauagccucaaccuc

SEQ ID NO: 122609 - RNA, 18 nt, Human
caccauguuagccaggcu

SEQ ID NO: 122610 - RNA, 22 nt, Human
caccauguuagccaggcugcuc

SEQ ID NO: 122611 - RNA, 31 nt, Human
caccauguuagccaggcugcucuuuaacucc

SEQ ID NO: 122612 - RNA, 22 nt, Human
cacucugucauccaggcuggag

SEQ ID NO: 122613 - RNA, 23 nt, Human
cacucugucauccaggcuggagu

SEQ ID NO: 122614 - RNA, 33 nt, Human
cauguuagccaggcugcucuuuaacuccuggag

SEQ ID NO: 122615 - RNA, 19 nt, Human
ccaaguacugggauuacag

SEQ ID NO: 122616 - RNA, 21 nt, Human
ccaaguacugggauuacaggc

SEQ ID NO: 122617 - RNA, 23 nt, Human
ccaaguacugggauuacaggcgu

SEQ ID NO: 122618 - RNA, 23 nt, Human
ccaaguagcugggauuacaggca

SEQ ID NO: 122619 - RNA, 24 nt, Human
ccaaguagcugggauuacaggcau

SEQ ID NO: 122620 - RNA, 22 nt, Human
ccacucugucauccaggcugga

SEQ ID NO: 122621 - RNA, 24 nt, Human
ccacucugucauccaggcuggagu

SEQ ID NO: 122622 - RNA, 18 nt, Human
cccaaguacugggauuac

SEQ ID NO: 122623 - RNA, 22 nt, Human
cccaaguacugggauuacaggc

SEQ ID NO: 122624 - RNA, 24 nt, Human
cccaaguacugggauuacaggcgu

SEQ ID NO: 122625 - RNA, 23 nt, Human
cccaaguagcugggauuacaggc

SEQ ID NO: 122626 - RNA, 24 nt, Human
cccaaguagcugggauuacaggca

SEQ ID NO: 122627 - RNA, 23 nt, Human
ccggccucaaacuauauuuucua

SEQ ID NO: 122628 - RNA, 18 nt, Human
ccucaaccucuuggguuc

SEQ ID NO: 122629 - RNA, 18 nt, Human
ccucccaaguacugggau

SEQ ID NO: 122630 - RNA, 24 nt, Human
ccuggccucaaguugauaugccug

SEQ ID NO: 122631 - RNA, 24 nt, Human
cucagccucccaaguagcugggau

SEQ ID NO: 122632 - RNA, 22 nt, Human
cucagcucaacauagccucaac

SEQ ID NO: 122633 - RNA, 24 nt, Human
cuccacucugucauccaggcugga

SEQ ID NO: 122634 - RNA, 25 nt, Human
cucgugccucagccucccaaguagc

SEQ ID NO: 122635 - RNA, 20 nt, Human
cugccuuggccucccaagua

SEQ ID NO: 122636 - RNA, 24 nt, Human
cuggaguacaguggugugaucuca

SEQ ID NO: 122637 - RNA, 18 nt, Human
gagaugggguuucaccau

SEQ ID NO: 122638 - RNA, 24 nt, Human
gagaugggguuucaccauguuagc

SEQ ID NO: 122639 - RNA, 24 nt, Human
gauuacaggcaugcaccaccgugc

SEQ ID NO: 122640 - RNA, 18 nt, Human
gauuacaggcgugagcca

SEQ ID NO: 122641 - RNA, 20 nt, Human
gauuacaggcgugagccacc

SEQ ID NO: 122642 - RNA, 21 nt, Human
gauuacaggcgugagccaccg

SEQ ID NO: 122643 - RNA, 24 nt, Human
ggauuacaggcaugcaccaccgug

SEQ ID NO: 122644 - RNA, 25 nt, Human
ggccucaaguugauaugccugccuu

SEQ ID NO: 122645 - RNA, 22 nt, Human
ggcuggaguacaguggugugau

SEQ ID NO: 122646 - RNA, 18 nt, Human
gggguuucaccauguuag

SEQ ID NO: 122647 - RNA, 22 nt, Human
gggguuucaccauguuagccag

SEQ ID NO: 122648 - RNA, 22 nt, Human
ggguuucaccauguuagccagg

SEQ ID NO: 122649 - RNA, 23 nt, Human
guagagaugggguuucaccaugu

SEQ ID NO: 122650 - RNA, 22 nt, Human
gugccucagccucccaaguagc

SEQ ID NO: 122651 - RNA, 23 nt, Human
gugccucagccucccaaguagcu

SEQ ID NO: 122652 - RNA, 25 nt, Human
uaaaacaauaagcaauuaacuaaca

SEQ ID NO: 122653 - RNA, 25 nt, Human
uaaauacacauuaaucaugacacaa

SEQ ID NO: 122654 - RNA, 19 nt, Human
uaaguuaagagaaagugcu

SEQ ID NO: 122655 - RNA, 21 nt, Human
uaaucaugacacaauuauuuc

SEQ ID NO: 122656 - RNA, 24 nt, Human
uaauuuuuuguauuuuuaguagag

SEQ ID NO: 122657 - RNA, 25 nt, Human
uaauuuuuuguauuuuuaguagaga

SEQ ID NO: 122658 - RNA, 23 nt, Human
uacaggcgugagccaccgugccc

SEQ ID NO: 122659 - RNA, 22 nt, Human
uacaguggugugaucucagcuc

SEQ ID NO: 122660 - RNA, 24 nt, Human
uacugggauuacaggcgugagcca

SEQ ID NO: 122661 - RNA, 22 nt, Human
uagagaugggguuucaccaugu

SEQ ID NO: 122662 - RNA, 23 nt, Human
uagcaaacuuuauccugagauuu

SEQ ID NO: 122663 - RNA, 20 nt, Human
uagccucaaccucuuggguu

SEQ ID NO: 122664 - RNA, 24 nt, Human
uaguagagaugggguuucaccaug

SEQ ID NO: 122665 - RNA, 26 nt, Human
uaguagagaugggguuucaccauguu

SEQ ID NO: 122666 - RNA, 18 nt, Human
uagugggcucucuucuaa

SEQ ID NO: 122667 - RNA, 24 nt, Human
uauacaauaaaacaauaagcaauu

SEQ ID NO: 122668 - RNA, 23 nt, Human
ucaacauagccucaaccucuugg

SEQ ID NO: 122669 - RNA, 20 nt, Human
ucagccucccaaguagcugg

SEQ ID NO: 122670 - RNA, 23 nt, Human
uccacucugucauccaggcugga

SEQ ID NO: 122671 - RNA, 23 nt, Human
ucccaaguacugggauuacaggc

SEQ ID NO: 122672 - RNA, 24 nt, Human
ucccaaguacugggauuacaggcg

SEQ ID NO: 122673 - RNA, 24 nt, Human
ucccaaguagcugggauuacaggc

SEQ ID NO: 122674 - RNA, 18 nt, Human
ucugucauccaggcugga

SEQ ID NO: 122675 - RNA, 20 nt, Human
ucuguuuuuuugaaacagag

SEQ ID NO: 122676 - RNA, 19 nt, Human
ugaaacagagucuccacuc

SEQ ID NO: 122677 - RNA, 23 nt, Human
ugaaauggcagauuuauuaagua

SEQ ID NO: 122678 - RNA, 24 nt, Human
ugccucagccucccaaguagcugg

SEQ ID NO: 122679 - RNA, 18 nt, Human
ugccugccuuggccuccc

SEQ ID NO: 122680 - RNA, 19 nt, Human
uggaguacaguggugugau

SEQ ID NO: 122681 - RNA, 19 nt, Human
uggaguacaguggugugau

SEQ ID NO: 122682 - RNA, 28 nt, Human
uggaguacaguggugugauggcucuagc

SEQ ID NO: 122683 - RNA, 21 nt, Human
uggccucaaguugauaugccu

SEQ ID NO: 122684 - RNA, 21 nt, Human
ugggauuacaggcaugcacca

SEQ ID NO: 122685 - RNA, 24 nt, Human
ugggauuacaggcaugcaccaccg

SEQ ID NO: 122686 - RNA, 18 nt, Human
ugggauuacaggcgugag

SEQ ID NO: 122687 - RNA, 21 nt, Human
ugggauuacaggcgugagcca

SEQ ID NO: 122688 - RNA, 22 nt, Human
ugggauuacaggcgugagccac

SEQ ID NO: 122689 - RNA, 23 nt, Human
ugggauuacaggcgugagccacc

SEQ ID NO: 122690 - RNA, 23 nt, Human
ugggauuacaggcgugagccacc

SEQ ID NO: 122691 - RNA, 24 nt, Human
ugggauuacaggcgugagccaccg

SEQ ID NO: 122692 - RNA, 24 nt, Human
ugggguuucaccauguuagccagg

SEQ ID NO: 122693 - RNA, 22 nt, Human
uggugugaucucagcucaacau

SEQ ID NO: 122694 - RNA, 21 nt, Human
uguauuuuuaguagagauggg

SEQ ID NO: 122695 - RNA, 22 nt, Human
uuaaaagacaaagaguauacaa

SEQ ID NO: 122696 - RNA, 18 nt, Human
uuaguagagaugggguuu

SEQ ID NO: 122697 - RNA, 22 nt, Human
uuaguagagaugggguuucacc

SEQ ID NO: 122698 - RNA, 24 nt, Human
uuaguagagaugggguuucaccau

SEQ ID NO: 122699 - RNA, 27 nt, Human
uuguacaguuauaucuauaguacauua

SEQ ID NO: 122700 - RNA, 23 nt, Human
uuguauuuuuaguagagaugggg

SEQ ID NO: 122701 - RNA, 24 nt, Human
uuuaaaaaaaugaagaaucaaacu

SEQ ID NO: 122702 - RNA, 21 nt, Human
uuucaccauguuagccaggcu

SEQ ID NO: 122703 - RNA, 24 nt, Human
uuuuuaguagagaugggguuucac

SEQ ID NO: 122704 - RNA, 21 nt, Human
uuuuuguauuuuuaguagaga

SEQ ID NO: 122705 - RNA, 24 nt, Human
uuuuuuguauuuuuaguagagaug

SEQ ID NO: 122706 - RNA, 23 nt, Human
uuuuuuuuuuuuuugaaauuuga

SEQ ID NO: 122707 - RNA, 26 nt, Human
uuuuuuuuuuuuuuuuuuuuuugggg

SEQ ID NO: 122708 - RNA, 22 nt, Human
aacucccucccucccuccccca

SEQ ID NO: 122709 - RNA, 22 nt, Human
aagugucauaagucaucccacu

SEQ ID NO: 122710 - RNA, 20 nt, Human
accccaguuccugccagccg

SEQ ID NO: 122711 - RNA, 20 nt, Human
acucccucccucccuccccc

SEQ ID NO: 122712 - RNA, 22 nt, Human
acucccucccucccucccccac

SEQ ID NO: 122713 - RNA, 18 nt, Human
aggcagagccaugcugug

SEQ ID NO: 122714 - RNA, 19 nt, Human
aucccgcgccggcucccgc

SEQ ID NO: 122715 - RNA, 22 nt, Human
caacucccucccucccuccccc

SEQ ID NO: 122716 - RNA, 18 nt, Human
cacacauaaccauaggau

SEQ ID NO: 122717 - RNA, 22 nt, Human
cacacauaaccauaggaucccc

SEQ ID NO: 122718 - RNA, 19 nt, Human
caccccaguuccugccagc

SEQ ID NO: 122719 - RNA, 18 nt, Human
cagcacccggccgacccc

SEQ ID NO: 122720 - RNA, 21 nt, Human
caguuccugccagccagccug

SEQ ID NO: 122721 - RNA, 22 nt, Human
ccccggccucggccucggccca

SEQ ID NO: 122722 - RNA, 33 nt, Human
ccccggccucggccucggcccagcacccggccg

SEQ ID NO: 122723 - RNA, 26 nt, Human
cccucccucccccacccuugauucua

SEQ ID NO: 122724 - RNA, 20 nt, Human
ccggccucggccucggccca

SEQ ID NO: 122725 - RNA, 23 nt, Human
ccucccucccccacccuugauuc

SEQ ID NO: 122726 - RNA, 23 nt, Human
cgccccggccucggccucggccc

SEQ ID NO: 122727 - RNA, 18 nt, Human
cgcuccgagucccagauc

SEQ ID NO: 122728 - RNA, 24 nt, Human
cggcuccugggucccgcuccggau

SEQ ID NO: 122729 - RNA, 20 nt, Human
cucccucccucccuccccca

SEQ ID NO: 122730 - RNA, 33 nt, Human
cucuggaucccgccccggccucggccucggccg

SEQ ID NO: 122731 - RNA, 21 nt, Human
gccaacucccucccucccucc

SEQ ID NO: 122732 - RNA, 21 nt, Human
gccucggccucggcccagcac

SEQ ID NO: 122733 - RNA, 21 nt, Human
gcucuggaucccgccccggcc

SEQ ID NO: 122734 - RNA, 22 nt, Human
gucccagaucccgcgccggcuc

SEQ ID NO: 122735 - RNA, 18 nt, Human
uagccaccccaguuccug

SEQ ID NO: 122736 - RNA, 19 nt, Human
uaucaaguccucugcugaa

SEQ ID NO: 122737 - RNA, 23 nt, Human
ucaccaugccuuuucuuaaacug

SEQ ID NO: 122738 - RNA, 18 nt, Human
uccugggucccgcuccgg

SEQ ID NO: 122739 - RNA, 22 nt, Human
ucucaggaacacucgcagccag

SEQ ID NO: 122740 - RNA, 24 nt, Human
ugaaacugccaacucccucccucc

SEQ ID NO: 122741 - RNA, 21 nt, Human
ugcugaagaagacugaggucc

SEQ ID NO: 122742 - RNA, 18 nt, Human
ugucauaagucaucccac

SEQ ID NO: 122743 - RNA, 26 nt, Human
ugucgcaggucacuucuucaccaggu

SEQ ID NO: 122744 - RNA, 19 nt, Human
aaagugcugagaauacagg

SEQ ID NO: 122745 - RNA, 19 nt, Human
aaagugcugagugaacacg

SEQ ID NO: 122746 - RNA, 18 nt, Human
aaccugccucggccuccc

SEQ ID NO: 122747 - RNA, 21 nt, Human
acaggcacccaccaccacgcc

SEQ ID NO: 122748 - RNA, 21 nt, Human
agagugcuguccagcgugcuc

SEQ ID NO: 122749 - RNA, 20 nt, Human
aggcacccaccaccacgccu

SEQ ID NO: 122750 - RNA, 18 nt, Human
agggaaagugcugaguga

SEQ ID NO: 122751 - RNA, 20 nt, Human
agugcuguccagcgugcugc

SEQ ID NO: 122752 - RNA, 18 nt, Human
aguggcuggaauuacagg

SEQ ID NO: 122753 - RNA, 19 nt, Human
aguguaguggugugaucuu

SEQ ID NO: 122754 - RNA, 21 nt, Human
aguguaguggugugaucuuag

SEQ ID NO: 122755 - RNA, 20 nt, Human
augagguuucaccaugcugg

SEQ ID NO: 122756 - RNA, 24 nt, Human
augagguuucaccaugcuggccag

SEQ ID NO: 122757 - RNA, 24 nt, Human
augguuuggugaaaaaccauacaa

SEQ ID NO: 122758 - RNA, 18 nt, Human
caaagugcugagaauaca

SEQ ID NO: 122759 - RNA, 20 nt, Human
caaccucugccuccuggguu

SEQ ID NO: 122760 - RNA, 22 nt, Human
caaccugccucggccucccaaa

SEQ ID NO: 122761 - RNA, 22 nt, Human
caagcaauucuccugccucagc

SEQ ID NO: 122762 - RNA, 21 nt, Human
caccaugcuggccaggcuagu

SEQ ID NO: 122763 - RNA, 24 nt, Human
caccaugcuggccaggcuagucuc

SEQ ID NO: 122764 - RNA, 27 nt, Human
caccaugcuggccaggcuagucucaaa

SEQ ID NO: 122765 - RNA, 18 nt, Human
cacccaccaccacgccug

SEQ ID NO: 122766 - RNA, 21 nt, Human
cacugcaaccucugccuccug

SEQ ID NO: 122767 - RNA, 23 nt, Human
cacugcaaccucugccuccuggg

SEQ ID NO: 122768 - RNA, 18 nt, Human
cagagugcuguccagcgu

SEQ ID NO: 122769 - RNA, 19 nt, Human
cagcgugcugcagagggaa

SEQ ID NO: 122770 - RNA, 22 nt, Human
caggugaucaaccugccucggc

SEQ ID NO: 122771 - RNA, 24 nt, Human
caugcuggccaggcuagucucaaa

SEQ ID NO: 122772 - RNA, 21 nt, Human
ccacgccuggcuaauuauuau

SEQ ID NO: 122773 - RNA, 24 nt, Human
ccuccuggguucaagcaauucucc

SEQ ID NO: 122774 - RNA, 19 nt, Human
ccucugccuccuggguuca

SEQ ID NO: 122775 - RNA, 20 nt, Human
ccugaccucaggugaucaac

SEQ ID NO: 122776 - RNA, 21 nt, Human
ccugaccucaggugaucaacc

SEQ ID NO: 122777 - RNA, 23 nt, Human
ccugaccucaggugaucaaccug

SEQ ID NO: 122778 - RNA, 24 nt, Human
ccugccucagccucucgaguggcu

SEQ ID NO: 122779 - RNA, 23 nt, Human
ccuggguucaagcaauucuccug

SEQ ID NO: 122780 - RNA, 24 nt, Human
cgcccaggcuggaguguaguggug

SEQ ID NO: 122781 - RNA, 24 nt, Human
cgucucgcccaggcuggaguguag

SEQ ID NO: 122782 - RNA, 24 nt, Human
cucacugcaaccucugccuccugg

SEQ ID NO: 122783 - RNA, 21 nt, Human
cuccuggguucaagcaauucu

SEQ ID NO: 122784 - RNA, 23 nt, Human
cucgaguggcuggaauuacaggc

SEQ ID NO: 122785 - RNA, 24 nt, Human
cugcaaccucugccuccuggguuc

SEQ ID NO: 122786 - RNA, 23 nt, Human
cugccucggccucccaaagugcu

SEQ ID NO: 122787 - RNA, 24 nt, Human
gaccucaggugaucaaccugccuc

SEQ ID NO: 122788 - RNA, 28 nt, Human
gagaauacaggggggugagccgguaccc

SEQ ID NO: 122789 - RNA, 22 nt, Human
gagguuucaccaugcuggccag

SEQ ID NO: 122790 - RNA, 20 nt, Human
gcccaggcuggaguguagug

SEQ ID NO: 122791 - RNA, 23 nt, Human
gcccaggcuggaguguaguggug

SEQ ID NO: 122792 - RNA, 24 nt, Human
gcccaggcuggaguguaguggugu

SEQ ID NO: 122793 - RNA, 23 nt, Human
gcuagucucaaacuccugaccuc

SEQ ID NO: 122794 - RNA, 20 nt, Human
gcuggaauuacaggcaccca

SEQ ID NO: 122795 - RNA, 22 nt, Human
ggcuggaguguaguggugugau

SEQ ID NO: 122796 - RNA, 18 nt, Human
ggggugagccaccacgcc

SEQ ID NO: 122797 - RNA, 24 nt, Human
ggggugagccaccacgccuggccu

SEQ ID NO: 122798 - RNA, 23 nt, Human
uagagggaugagguuucaccaug

SEQ ID NO: 122799 - RNA, 23 nt, Human
uagcucacugcaaccucugccuc

SEQ ID NO: 122800 - RNA, 19 nt, Human
ucaagcaauucuccugccu

SEQ ID NO: 122801 - RNA, 24 nt, Human
ucacugcaaccucugccuccuggg

SEQ ID NO: 122802 - RNA, 25 nt, Human
ucacugcaaccucugccuccugggu

SEQ ID NO: 122803 - RNA, 26 nt, Human
ucacugcaaccucugccuccuggguu

SEQ ID NO: 122804 - RNA, 22 nt, Human
ucagccucucgaguggcuggaa

SEQ ID NO: 122805 - RNA, 21 nt, Human
uccuggguucaagcaauucuc

SEQ ID NO: 122806 - RNA, 24 nt, Human
uccuggguucaagcaauucuccug

SEQ ID NO: 122807 - RNA, 24 nt, Human
ucgcccaggcuggaguguaguggu

SEQ ID NO: 122808 - RNA, 18 nt, Human
ucggccucccaaagugcu

SEQ ID NO: 122809 - RNA, 26 nt, Human
ucuccugccucagccucucgaguggc

SEQ ID NO: 122810 - RNA, 24 nt, Human
ucucgaguggcuggaauuacaggc

SEQ ID NO: 122811 - RNA, 22 nt, Human
ucucuguggcaucagcaggggu

SEQ ID NO: 122812 - RNA, 24 nt, Human
ucugccuccuggguucaagcaauu

SEQ ID NO: 122813 - RNA, 24 nt, Human
ucuugccgucucgcccaggcugga

SEQ ID NO: 122814 - RNA, 24 nt, Human
ugaccucaggugaucaaccugccu

SEQ ID NO: 122815 - RNA, 26 nt, Human
ugagaauacaggggggugagccacca

SEQ ID NO: 122816 - RNA, 24 nt, Human
ugagguuucaccaugcuggccagg

SEQ ID NO: 122817 - RNA, 24 nt, Human
ugccgucucgcccaggcuggagug

SEQ ID NO: 122818 - RNA, 24 nt, Human
ugccucagccucucgaguggcugg

SEQ ID NO: 122819 - RNA, 21 nt, Human
ugccucggccucccaaagugc

SEQ ID NO: 122820 - RNA, 24 nt, Human
ugccucggccucccaaagugcuga

SEQ ID NO: 122821 - RNA, 19 nt, Human
uggaauuacaggcacccac

SEQ ID NO: 122822 - RNA, 21 nt, Human
uggaauuacaggcacccacca

SEQ ID NO: 122823 - RNA, 24 nt, Human
uggaauuacaggcacccaccacca

SEQ ID NO: 122824 - RNA, 24 nt, Human
uggccaggcuagucucaaacuccu

SEQ ID NO: 122825 - RNA, 21 nt, Human
uggguucaagcaauucuccug

SEQ ID NO: 122826 - RNA, 23 nt, Human
uggguucaagcaauucuccugcc

SEQ ID NO: 122827 - RNA, 24 nt, Human
uggugugaucuuagcucacugcaa

SEQ ID NO: 122828 - RNA, 23 nt, Human
uuagagggaugagguuucaccau

SEQ ID NO: 122829 - RNA, 21 nt, Human
uucaagcaauucuccugccuc

SEQ ID NO: 122830 - RNA, 24 nt, Human
uucaagcaauucuccugccucagc

SEQ ID NO: 122831 - RNA, 21 nt, Human
uucucuguggcaucagcaggg

SEQ ID NO: 122832 - RNA, 24 nt, Human
uugccgucucgcccaggcuggagu

SEQ ID NO: 122833 - RNA, 21 nt, Human
uuucaccaugcuggccaggcu

SEQ ID NO: 122834 - RNA, 19 nt, Human
aaaaaggaaagaaaaaaag

SEQ ID NO: 122835 - RNA, 25 nt, Human
aaaagaaaaaaaaacgaagaaagaa

SEQ ID NO: 122836 - RNA, 23 nt, Human
aaaaggaaaaaaaaaggaaagaa

SEQ ID NO: 122837 - RNA, 21 nt, Human
aaagaaaaaaaaacgaagaaa

SEQ ID NO: 122838 - RNA, 26 nt, Human
aacuaagcacacagagaaacaaagcc

SEQ ID NO: 122839 - RNA, 20 nt, Human
aagaaaaaaaaacgaagaaa

SEQ ID NO: 122840 - RNA, 21 nt, Human
aagaaaaaaaaacgaagaaag

SEQ ID NO: 122841 - RNA, 21 nt, Human
aagaaacaaacauaauaaaaa

SEQ ID NO: 122842 - RNA, 23 nt, Human
aagaaacaaacauaauaaaaaua

SEQ ID NO: 122843 - RNA, 26 nt, Human
aagaaagaaacaaacauaauaaaaaa

SEQ ID NO: 122844 - RNA, 24 nt, Human
aagaauuggaaucacaaaaucaag

SEQ ID NO: 122845 - RNA, 22 nt, Human
aagacaauuacaaagaauugga

SEQ ID NO: 122846 - RNA, 24 nt, Human
aagacccucucacuccagucucag

SEQ ID NO: 122847 - RNA, 23 nt, Human
aaggaaaaaaaaaggaaagaaaa

SEQ ID NO: 122848 - RNA, 19 nt, Human
aaggaaagaaaaaaagaaa

SEQ ID NO: 122849 - RNA, 19 nt, Human
acaaaaggaaaaaaaaagg

SEQ ID NO: 122850 - RNA, 22 nt, Human
acacagagaaacaaagccuaga

SEQ ID NO: 122851 - RNA, 20 nt, Human
agaagacccucucacuccaa

SEQ ID NO: 122852 - RNA, 22 nt, Human
aggaaaaaaaaaggaaagaaaa

SEQ ID NO: 122853 - RNA, 18 nt, Human
aggaaagaaaaaaagaaa

SEQ ID NO: 122854 - RNA, 20 nt, Human
aggaaagaaaaaaagaaaag

SEQ ID NO: 122855 - RNA, 18 nt, Human
aggucaacacaaggucaa

SEQ ID NO: 122856 - RNA, 23 nt, Human
caaaaccaauuuggcagcacaaa

SEQ ID NO: 122857 - RNA, 23 nt, Human
caaaaggaaaaaaaaaggaaaga

SEQ ID NO: 122858 - RNA, 24 nt, Human
caaagaauuggaaucacaaaauca

SEQ ID NO: 122859 - RNA, 21 nt, Human
caaaggucaacacaaggucaa

SEQ ID NO: 122860 - RNA, 20 nt, Human
caacgaugaacaaacggcag

SEQ ID NO: 122861 - RNA, 23 nt, Human
cacacagagaaacaaagccuaga

SEQ ID NO: 122862 - RNA, 20 nt, Human
cacagaaauacaaacaccac

SEQ ID NO: 122863 - RNA, 21 nt, Human
caccugagccugccgcugccu

SEQ ID NO: 122864 - RNA, 21 nt, Human
cagagaaacaaagccuagagg

SEQ ID NO: 122865 - RNA, 20 nt, Human
cagccgccgccgccgccucg

SEQ ID NO: 122866 - RNA, 22 nt, Human
cagcggcugcaccugagccugc

SEQ ID NO: 122867 - RNA, 25 nt, Human
cauaauaaaaauacacaucagcauc

SEQ ID NO: 122868 - RNA, 18 nt, Human
ccgaaucccgggggagcc

SEQ ID NO: 122869 - RNA, 24 nt, Human
ccgcagccgccgccgccgccucgg

SEQ ID NO: 122870 - RNA, 21 nt, Human
ccgccgccgccgccucgcugc

SEQ ID NO: 122871 - RNA, 21 nt, Human
ccgccgccgcugccgcugccc

SEQ ID NO: 122872 - RNA, 21 nt, Human
ccgccucgcugcugaggccga

SEQ ID NO: 122873 - RNA, 20 nt, Human
ccgcgucccgccgccgcugc

SEQ ID NO: 122874 - RNA, 22 nt, Human
ccgcgucccgccgccgcugccg

SEQ ID NO: 122875 - RNA, 23 nt, Human
ccgcugccucaguugcugccugc

SEQ ID NO: 122876 - RNA, 24 nt, Human
ccuccgcagccgccgccgccgccu

SEQ ID NO: 122877 - RNA, 23 nt, Human
cgaagaaagaaacaaacauaaua

SEQ ID NO: 122878 - RNA, 20 nt, Human
cgucccgccgccgcugccgc

SEQ ID NO: 122879 - RNA, 19 nt, Human
cucaguugcugccugcgcc

SEQ ID NO: 122880 - RNA, 21 nt, Human
cugcgccuccgcagccgccgc

SEQ ID NO: 122881 - RNA, 21 nt, Human
cuuuaggcacaacgaugaaca

SEQ ID NO: 122882 - RNA, 19 nt, Human
cuuugagcagcggcugcac

SEQ ID NO: 122883 - RNA, 21 nt, Human
gaaagaaacaaacauaauaaa

SEQ ID NO: 122884 - RNA, 18 nt, Human
gagccugccgcugccuca

SEQ ID NO: 122885 - RNA, 22 nt, Human
ucacagaaauacaaacaccacg

SEQ ID NO: 122886 - RNA, 21 nt, Human
ucccgccgccgcugccgcugc

SEQ ID NO: 122887 - RNA, 23 nt, Human
ugaggccgaaucccgggggagcc

SEQ ID NO: 122888 - RNA, 19 nt, Human
uggcagcacaaaaggaaaa

SEQ ID NO: 122889 - RNA, 27 nt, Human
uggcagcacaaaaggaaaaaaaaagga

SEQ ID NO: 122890 - RNA, 18 nt, Human
ugugcuaguagggcugcu

SEQ ID NO: 122891 - RNA, 22 nt, Human
uucacagaaauacaaacaccac

SEQ ID NO: 122892 - RNA, 23 nt, Human
uuggcagcacaaaaggaaaaaaa

SEQ ID NO: 122893 - RNA, 20 nt, Human
uugucuuuaaaacuaagcac

SEQ ID NO: 122894 - RNA, 19 nt, Human
aaaaacaccacccuauaca

SEQ ID NO: 122895 - RNA, 19 nt, Human
aaaacaaaaugaaacaaaa

SEQ ID NO: 122896 - RNA, 24 nt, Human
aaacaaaguauagacuguaugugg

SEQ ID NO: 122897 - RNA, 23 nt, Human
aaaggaaaauuauaacccaagac

SEQ ID NO: 122898 - RNA, 19 nt, Human
aacaaguaugucucuaaac

SEQ ID NO: 122899 - RNA, 18 nt, Human
aacauuuugugugaccag

SEQ ID NO: 122900 - RNA, 19 nt, Human
aagaaaacaaaacgcaggg

SEQ ID NO: 122901 - RNA, 21 nt, Human
aauuucauuguuacuaaaaaa

SEQ ID NO: 122902 - RNA, 23 nt, Human
acagaaaccaucuucugagacau

SEQ ID NO: 122903 - RNA, 24 nt, Human
accaguuuuuucagugcagcauca

SEQ ID NO: 122904 - RNA, 20 nt, Human
acuguaaacauuaaaacugc

SEQ ID NO: 122905 - RNA, 22 nt, Human
agaacaaaaccuaaucauuaua

SEQ ID NO: 122906 - RNA, 19 nt, Human
agaagcauaaauaucaaac

SEQ ID NO: 122907 - RNA, 19 nt, Human
agaauagcagcaaucaccu

SEQ ID NO: 122908 - RNA, 18 nt, Human
agauggagacaaaauugc

SEQ ID NO: 122909 - RNA, 19 nt, Human
agcagugaguacaacagca

SEQ ID NO: 122910 - RNA, 18 nt, Human
aggcaggcuaggggcgac

SEQ ID NO: 122911 - RNA, 24 nt, Human
aggcgggcaggcaggcuaggggcc

SEQ ID NO: 122912 - RNA, 19 nt, Human
aggggcagggaggaccuag

SEQ ID NO: 122913 - RNA, 30 nt, Human
aguacaacagcaaaaaaauuauuguacaaa

SEQ ID NO: 122914 - RNA, 25 nt, Human
aguacauaauuacaaugcuacacag

SEQ ID NO: 122915 - RNA, 19 nt, Human
auacucuggaagcacagga

SEQ ID NO: 122916 - RNA, 18 nt, Human
auaguaaaauacaugacc

SEQ ID NO: 122917 - RNA, 19 nt, Human
augaaauaaaaacaccacc

SEQ ID NO: 122918 - RNA, 21 nt, Human
auuuuugucuacaauaaauga

SEQ ID NO: 122919 - RNA, 20 nt, Human
caaaaaugugcaaaauuccu

SEQ ID NO: 122920 - RNA, 21 nt, Human
caaaauaaacacuguccugga

SEQ ID NO: 122921 - RNA, 25 nt, Human
caaaauaaacacuguccuggacuug

SEQ ID NO: 122922 - RNA, 20 nt, Human
caaaauauauauuuaggggc

SEQ ID NO: 122923 - RNA, 20 nt, Human
caauccacuauuagcaguga

SEQ ID NO: 122924 - RNA, 25 nt, Human
caccaaaauuucucugcaccaacag

SEQ ID NO: 122925 - RNA, 19 nt, Human
caccacagcuucaccaaaa

SEQ ID NO: 122926 - RNA, 24 nt, Human
cacccuauacaauccacuauuagc

SEQ ID NO: 122927 - RNA, 21 nt, Human
cagcaaauaauguaaagcuaa

SEQ ID NO: 122928 - RNA, 20 nt, Human
cagcacauucacauuuuccc

SEQ ID NO: 122929 - RNA, 20 nt, Human
cagcaucuuggggguuugau

SEQ ID NO: 122930 - RNA, 18 nt, Human
caguacugauagucaacg

SEQ ID NO: 122931 - RNA, 20 nt, Human
caguacugauagucaacgaa

SEQ ID NO: 122932 - RNA, 21 nt, Human
caucacaucgccagcaaucuc

SEQ ID NO: 122933 - RNA, 21 nt, Human
ccagaauagcagcaaucaccu

SEQ ID NO: 122934 - RNA, 25 nt, Human
ccaguccaugcgaagaguacagucc

SEQ ID NO: 122935 - RNA, 23 nt, Human
cccaacauauccggugaacaaaa

SEQ ID NO: 122936 - RNA, 18 nt, Human
cccacauugcaauaaauc

SEQ ID NO: 122937 - RNA, 20 nt, Human
cccccauucccuuuuuaagu

SEQ ID NO: 122938 - RNA, 23 nt, Human
ccuccgcgauggcggcggcggcg

SEQ ID NO: 122939 - RNA, 19 nt, Human
ccuggcucugccauuuccu

SEQ ID NO: 122940 - RNA, 22 nt, Human
cgacccccgggcagggcugggg

SEQ ID NO: 122941 - RNA, 19 nt, Human
cgacuccgaugcggcuggg

SEQ ID NO: 122942 - RNA, 26 nt, Human
cgcgauggcggcggcggcggcgaccu

SEQ ID NO: 122943 - RNA, 19 nt, Human
cggccccugggcagccgcg

SEQ ID NO: 122944 - RNA, 22 nt, Human
cggcggcuccgcgggguccccc

SEQ ID NO: 122945 - RNA, 22 nt, Human
cuccuggcucugccauuuccug

SEQ ID NO: 122946 - RNA, 21 nt, Human
cuggggagcuggccggccccu

SEQ ID NO: 122947 - RNA, 25 nt, Human
cugggggcggcggcggcgcgacccc

SEQ ID NO: 122948 - RNA, 20 nt, Human
gaagcacaggauaucugaca

SEQ ID NO: 122949 - RNA, 18 nt, Human
gacaauagcuaaauaucc

SEQ ID NO: 122950 - RNA, 22 nt, Human
gaggggcugaauuaaauauaac

SEQ ID NO: 122951 - RNA, 24 nt, Human
gcaaauaauguaaagcuaacaaaa

SEQ ID NO: 122952 - RNA, 18 nt, Human
gcgauggcggcggcggcg

SEQ ID NO: 122953 - RNA, 20 nt, Human
gcgauggcggcggcggcggc

SEQ ID NO: 122954 - RNA, 24 nt, Human
gcggcggcggcgcgacccccgggc

SEQ ID NO: 122955 - RNA, 20 nt, Human
gcggcggcggcggcggcggc

SEQ ID NO: 122956 - RNA, 23 nt, Human
gcggcggcggcggcggcggcggc

SEQ ID NO: 122957 - RNA, 25 nt, Human
gcggcggcggcggcggcucggacuc

SEQ ID NO: 122958 - RNA, 20 nt, Human
gcggcggcggcgggggcggc

SEQ ID NO: 122959 - RNA, 23 nt, Human
gcggcggcgggggcggcggcggc

SEQ ID NO: 122960 - RNA, 30 nt, Human
gcggcggcgggggcggcggcggcggcggcg

SEQ ID NO: 122961 - RNA, 20 nt, Human
gcuaggggcgacgcuggggg

SEQ ID NO: 122962 - RNA, 21 nt, Human
gcucauguuuacuaacucgac

SEQ ID NO: 122963 - RNA, 23 nt, Human
ggagacaaaauugcaauaaaagc

SEQ ID NO: 122964 - RNA, 18 nt, Human
ggcgacgcugggggcggc

SEQ ID NO: 122965 - RNA, 19 nt, Human
ggcgcggcggcuccgcggg

SEQ ID NO: 122966 - RNA, 20 nt, Human
ggcggcggcgcgacccccgg

SEQ ID NO: 122967 - RNA, 21 nt, Human
gggcagggaggaccuagggua

SEQ ID NO: 122968 - RNA, 24 nt, Human
gggcggcggcggcggcggcggcgg

SEQ ID NO: 122969 - RNA, 18 nt, Human
gggggcggcggcggcgcg

SEQ ID NO: 122970 - RNA, 24 nt, Human
gggggcggcggcggcggcggcggg

SEQ ID NO: 122971 - RNA, 22 nt, Human
gucaaaaucagaaggugaaacc

SEQ ID NO: 122972 - RNA, 19 nt, Human
gugaaugagguacaaaaaa

SEQ ID NO: 122973 - RNA, 19 nt, Human
uaaaagaacuucccagucc

SEQ ID NO: 122974 - RNA, 26 nt, Human
uaaaauaauacuuaugcagucaaaca

SEQ ID NO: 122975 - RNA, 21 nt, Human
uaaaauauucagaauaguauc

SEQ ID NO: 122976 - RNA, 21 nt, Human
uaaagcuaacaaaaaugugca

SEQ ID NO: 122977 - RNA, 21 nt, Human
uaagaugaugccaguguacua

SEQ ID NO: 122978 - RNA, 21 nt, Human
uaaguuacaguagacaggcaa

SEQ ID NO: 122979 - RNA, 22 nt, Human
uaauauggaaaaucaugucaau

SEQ ID NO: 122980 - RNA, 23 nt, Human
uaauauggaaaaucaugucaauu

SEQ ID NO: 122981 - RNA, 22 nt, Human
uacaauaaaugaaauaaaaaca

SEQ ID NO: 122982 - RNA, 19 nt, Human
uacagaaugcaaaauacua

SEQ ID NO: 122983 - RNA, 28 nt, Human
uaccauauacucuauaaaaaauuauucu

SEQ ID NO: 122984 - RNA, 23 nt, Human
uagaaauaacucagaacaaaacc

SEQ ID NO: 122985 - RNA, 24 nt, Human
uagaagagauggucgucuuaauau

SEQ ID NO: 122986 - RNA, 20 nt, Human
uagcaucugugaccucuugc

SEQ ID NO: 122987 - RNA, 19 nt, Human
uaggagacaaagcgccuau

SEQ ID NO: 122988 - RNA, 22 nt, Human
uauucuaugaaagucuuaaguu

SEQ ID NO: 122989 - RNA, 24 nt, Human
ucaaucaacugauguuggaaacuc

SEQ ID NO: 122990 - RNA, 18 nt, Human
ucaauggacacauuccag

SEQ ID NO: 122991 - RNA, 20 nt, Human
ucaauggacacauuccagaa

SEQ ID NO: 122992 - RNA, 20 nt, Human
ucacauaaagccaauaugac

SEQ ID NO: 122993 - RNA, 20 nt, Human
uccaaaacacagcugcaaga

SEQ ID NO: 122994 - RNA, 19 nt, Human
uccagaauagcagcaauca

SEQ ID NO: 122995 - RNA, 20 nt, Human
uccagaauagcagcaaucac

SEQ ID NO: 122996 - RNA, 22 nt, Human
ucccagguguuaaauaucauuu

SEQ ID NO: 122997 - RNA, 22 nt, Human
uccgcgauggcggcggcggcuu

SEQ ID NO: 122998 - RNA, 19 nt, Human
ucuuucucuagaaauaacu

SEQ ID NO: 122999 - RNA, 23 nt, Human
ugacacaauauaccauauacucu

SEQ ID NO: 123000 - RNA, 22 nt, Human
ugacacgcuuacaaauuugcca

SEQ ID NO: 123001 - RNA, 20 nt, Human
ugaccugaaauguuuuaacc

SEQ ID NO: 123002 - RNA, 21 nt, Human
ugagaaaaaauagcaucugug

SEQ ID NO: 123003 - RNA, 21 nt, Human
ugauaugcaacagcuuuccuu

SEQ ID NO: 123004 - RNA, 18 nt, Human
ugcauggcucacucgagg

SEQ ID NO: 123005 - RNA, 22 nt, Human
uggaagcacaggauaucugaca

SEQ ID NO: 123006 - RNA, 21 nt, Human
uggcgcggcggcuccgcgggg

SEQ ID NO: 123007 - RNA, 22 nt, Human
uggcggcggcggcggcgaccgg

SEQ ID NO: 123008 - RNA, 26 nt, Human
uggcucacucgaggucaacuuagacc

SEQ ID NO: 123009 - RNA, 20 nt, Human
uggggagcuggccggccccu

SEQ ID NO: 123010 - RNA, 19 nt, Human
ugggggcggcggcggcgcg

SEQ ID NO: 123011 - RNA, 19 nt, Human
uguaaaacuguagauuuga

SEQ ID NO: 123012 - RNA, 23 nt, Human
uguaaacauuaaaacugcuuucc

SEQ ID NO: 123013 - RNA, 20 nt, Human
uguccuguuuucccaggugu

SEQ ID NO: 123014 - RNA, 26 nt, Human
ugucuuaugaaaacaaaaugaaacaa

SEQ ID NO: 123015 - RNA, 24 nt, Human
uguuacccaacuuacacaaugcgc

SEQ ID NO: 123016 - RNA, 22 nt, Human
uguuuucccagguguuaaauau

SEQ ID NO: 123017 - RNA, 19 nt, Human
uuaaaugacacgcuuacaa

SEQ ID NO: 123018 - RNA, 25 nt, Human
uuacagccacacuugagacaaugac

SEQ ID NO: 123019 - RNA, 18 nt, Human
uuaggggcagggaggacc

SEQ ID NO: 123020 - RNA, 21 nt, Human
uucaauggacacauuccagaa

SEQ ID NO: 123021 - RNA, 21 nt, Human
uuccagaauagcagcaaucac

SEQ ID NO: 123022 - RNA, 20 nt, Human
uugaucucaauggucuagaa

SEQ ID NO: 123023 - RNA, 24 nt, Human
uugaucucaauggucuagaacaug

SEQ ID NO: 123024 - RNA, 19 nt, Human
uugcauggcucacucgagg

SEQ ID NO: 123025 - RNA, 19 nt, Human
uuuaaacuuauuaguaaca

SEQ ID NO: 123026 - RNA, 21 nt, Human
aaaacaaaaaaaaaucaguga

SEQ ID NO: 123027 - RNA, 18 nt, Human
aaaacaguacuuuugcca

SEQ ID NO: 123028 - RNA, 24 nt, Human
aaaagaccucaaaauacugcacag

SEQ ID NO: 123029 - RNA, 19 nt, Human
aaaauacugcacagaaaca

SEQ ID NO: 123030 - RNA, 24 nt, Human
aaacgggugaacaaccaagucaag

SEQ ID NO: 123031 - RNA, 20 nt, Human
aaagagaagaguugggaugc

SEQ ID NO: 123032 - RNA, 22 nt, Human
aaauagaaacaaggaaacaaaa

SEQ ID NO: 123033 - RNA, 19 nt, Human
aacaaagagaagaguuggg

SEQ ID NO: 123034 - RNA, 26 nt, Human
aacaaggaaacaaaauaaaaacaaaa

SEQ ID NO: 123035 - RNA, 18 nt, Human
aaccacugagaaaaaguc

SEQ ID NO: 123036 - RNA, 21 nt, Human
aaccacugagaaaaaguccac

SEQ ID NO: 123037 - RNA, 20 nt, Human
aagccuguaacaaucuacaa

SEQ ID NO: 123038 - RNA, 31 nt, Human
acaaaaaaaaaucagugacaguaaagagaaa

SEQ ID NO: 123039 - RNA, 25 nt, Human
acaaaacgggugaacaaccaaguca

SEQ ID NO: 123040 - RNA, 22 nt, Human
acaggcaaggaaauaugcugug

SEQ ID NO: 123041 - RNA, 19 nt, Human
accaccacguacacaggga

SEQ ID NO: 123042 - RNA, 22 nt, Human
acugauacagaacaacaacuga

SEQ ID NO: 123043 - RNA, 23 nt, Human
agaaaucagugaggagcugagaa

SEQ ID NO: 123044 - RNA, 18 nt, Human
agauacugaaggugacau

SEQ ID NO: 123045 - RNA, 21 nt, Human
agcacaaaaauucaacugaua

SEQ ID NO: 123046 - RNA, 23 nt, Human
agcugagcucauauaaagaaauc

SEQ ID NO: 123047 - RNA, 21 nt, Human
aggaaacaaaauaaaaacaaa

SEQ ID NO: 123048 - RNA, 21 nt, Human
agggaugaguuagaacacugu

SEQ ID NO: 123049 - RNA, 18 nt, Human
auaaacaaaauuuucugc

SEQ ID NO: 123050 - RNA, 22 nt, Human
augaagaccagguacguucuua

SEQ ID NO: 123051 - RNA, 21 nt, Human
caaacaaucaacaguagacac

SEQ ID NO: 123052 - RNA, 23 nt, Human
caacuauuuccauuaauuacacu

SEQ ID NO: 123053 - RNA, 28 nt, Human
caaggaaacaaaauaaaaacaaaaaaaa

SEQ ID NO: 123054 - RNA, 23 nt, Human
caccaaaugcugcaaggccaaca

SEQ ID NO: 123055 - RNA, 23 nt, Human
cacugagaaaaaguccacucaac

SEQ ID NO: 123056 - RNA, 19 nt, Human
cagcaugacacagaaucuc

SEQ ID NO: 123057 - RNA, 19 nt, Human
caguaaagagaagccuuug

SEQ ID NO: 123058 - RNA, 22 nt, Human
cagugaggagcugagaaaauau

SEQ ID NO: 123059 - RNA, 30 nt, Human
cauaaacaaaauuuucugcuucuccucccc

SEQ ID NO: 123060 - RNA, 21 nt, Human
cauguuaaccacugagaaaaa

SEQ ID NO: 123061 - RNA, 21 nt, Human
ccaaaugcugcaaggccaaca

SEQ ID NO: 123062 - RNA, 20 nt, Human
ccacaggucuuugagaacuc

SEQ ID NO: 123063 - RNA, 21 nt, Human
ccacugagaaaaaguccacuc

SEQ ID NO: 123064 - RNA, 18 nt, Human
ccucaaaauacugcacag

SEQ ID NO: 123065 - RNA, 20 nt, Human
ccucccuucaaagcuucaag

SEQ ID NO: 123066 - RNA, 21 nt, Human
cuacuugaaaacuuguuucca

SEQ ID NO: 123067 - RNA, 19 nt, Human
cucaagcaaacaaucaaca

SEQ ID NO: 123068 - RNA, 21 nt, Human
cucugugggaaaaaugaggga

SEQ ID NO: 123069 - RNA, 22 nt, Human
cucuucuaugauguuccucuag

SEQ ID NO: 123070 - RNA, 21 nt, Human
cugauacagaacaacaacuga

SEQ ID NO: 123071 - RNA, 20 nt, Human
cuuuuuaaaauaccuggcca

SEQ ID NO: 123072 - RNA, 20 nt, Human
cuuuuuuuuuuuaacagucu

SEQ ID NO: 123073 - RNA, 20 nt, Human
gacacaagagucaaaaaucu

SEQ ID NO: 123074 - RNA, 19 nt, Human
gagaaaaaguccacucaac

SEQ ID NO: 123075 - RNA, 22 nt, Human
gcaaagaguucaacaacauucu

SEQ ID NO: 123076 - RNA, 20 nt, Human
gcaauucugaaaggaaaacc

SEQ ID NO: 123077 - RNA, 21 nt, Human
gccucggggaggggacccgcu

SEQ ID NO: 123078 - RNA, 18 nt, Human
ggaaauagaaacaaggaa

SEQ ID NO: 123079 - RNA, 21 nt, Human
ggacauucuccugaaaacuag

SEQ ID NO: 123080 - RNA, 22 nt, Human
ggaccaacucuaucuaaaaguu

SEQ ID NO: 123081 - RNA, 18 nt, Human
ggaggaccuuuguaucua

SEQ ID NO: 123082 - RNA, 22 nt, Human
gguaaacaaaauagcugcauuu

SEQ ID NO: 123083 - RNA, 23 nt, Human
gguaaacaaaauagcugcauuug

SEQ ID NO: 123084 - RNA, 23 nt, Human
uaaaaaaaacuuugguagagaaa

SEQ ID NO: 123085 - RNA, 21 nt, Human
uaaaaguugcuuacgaguaac

SEQ ID NO: 123086 - RNA, 20 nt, Human
uaaaauaucaauagcuauga

SEQ ID NO: 123087 - RNA, 22 nt, Human
uaaaauaucaauagcuaugaca

SEQ ID NO: 123088 - RNA, 24 nt, Human
uaaacaaaauuuucugcuucuccu

SEQ ID NO: 123089 - RNA, 23 nt, Human
uaaagaaaucagugaggagcuga

SEQ ID NO: 123090 - RNA, 19 nt, Human
uaacaugcaaagaguucaa

SEQ ID NO: 123091 - RNA, 18 nt, Human
uaacuugaaucuugugua

SEQ ID NO: 123092 - RNA, 23 nt, Human
uacaauagguugaaaaagaccuc

SEQ ID NO: 123093 - RNA, 22 nt, Human
uacgaguaacuugaaucuugug

SEQ ID NO: 123094 - RNA, 22 nt, Human
uagacacaagagucaaaaaucu

SEQ ID NO: 123095 - RNA, 24 nt, Human
uagccacagggaucucuuucccag

SEQ ID NO: 123096 - RNA, 24 nt, Human
uagcuaugacaauucauuucucuu

SEQ ID NO: 123097 - RNA, 23 nt, Human
uagcugcauuugcuugucagcug

SEQ ID NO: 123098 - RNA, 21 nt, Human
uaguaaaaaaggagucaaaua

SEQ ID NO: 123099 - RNA, 18 nt, Human
uauaaagaaaucagugag

SEQ ID NO: 123100 - RNA, 19 nt, Human
uaugacaccaaaugcugca

SEQ ID NO: 123101 - RNA, 21 nt, Human
uaugacaccaaaugcugcaag

SEQ ID NO: 123102 - RNA, 21 nt, Human
ucaaaauacugcacagaaaca

SEQ ID NO: 123103 - RNA, 20 nt, Human
uccaguggcuaagagaacuc

SEQ ID NO: 123104 - RNA, 22 nt, Human
ucuuaaguguuuucugcacauc

SEQ ID NO: 123105 - RNA, 18 nt, Human
ugaaacagcaucaaguuu

SEQ ID NO: 123106 - RNA, 20 nt, Human
ugaaaggaaaaccagcauga

SEQ ID NO: 123107 - RNA, 18 nt, Human
ugaauauacaagauauua

SEQ ID NO: 123108 - RNA, 19 nt, Human
ugacaauucauuucucuuu

SEQ ID NO: 123109 - RNA, 22 nt, Human
ugacacagaaucucaaauuccc

SEQ ID NO: 123110 - RNA, 20 nt, Human
ugacaggaaaggcuuauuua

SEQ ID NO: 123111 - RNA, 24 nt, Human
ugagaaaaaguccacucaacuauu

SEQ ID NO: 123112 - RNA, 19 nt, Human
ugcaaaguuuuugcuccug

SEQ ID NO: 123113 - RNA, 24 nt, Human
ugcuucauaauuaaugguguguaa

SEQ ID NO: 123114 - RNA, 18 nt, Human
ugggacauucuccugaaa

SEQ ID NO: 123115 - RNA, 24 nt, Human
uguguaagaacccuccccccuuuu

SEQ ID NO: 123116 - RNA, 18 nt, Human
uucaaagaauuaagagcc

SEQ ID NO: 123117 - RNA, 23 nt, Human
uucaacugauacagaacaacaac

SEQ ID NO: 123118 - RNA, 22 nt, Human
uucaagcaauucugaaaggaaa

SEQ ID NO: 123119 - RNA, 19 nt, Human
uugaugcaacuagaaagaa

SEQ ID NO: 123120 - RNA, 23 nt, Human
aaaaaagagaaaaaagcaacaag

SEQ ID NO: 123121 - RNA, 21 nt, Human
aaaaagcaacaagaaccccac

SEQ ID NO: 123122 - RNA, 21 nt, Human
aaaacaacaaaccuaaauuuu

SEQ ID NO: 123123 - RNA, 22 nt, Human
aaaacagcaugcugucaaagag

SEQ ID NO: 123124 - RNA, 22 nt, Human
aaaugacccaaaauuaggaagu

SEQ ID NO: 123125 - RNA, 23 nt, Human
aaauucaccuucauaaaucaaaa

SEQ ID NO: 123126 - RNA, 18 nt, Human
aagaaaccaagagugcua

SEQ ID NO: 123127 - RNA, 22 nt, Human
aagaaccccacccucacccuuc

SEQ ID NO: 123128 - RNA, 19 nt, Human
aagagaggaaaaaaagaga

SEQ ID NO: 123129 - RNA, 22 nt, Human
aagagugcuauuucuaguuuua

SEQ ID NO: 123130 - RNA, 23 nt, Human
aagcaaauacgccaaugcugaau

SEQ ID NO: 123131 - RNA, 23 nt, Human
aagcaacaagaaccccacccuca

SEQ ID NO: 123132 - RNA, 25 nt, Human
aagcaacaagaaccccacccucacc

SEQ ID NO: 123133 - RNA, 22 nt, Human
acaaaacagcaugcugucaaag

SEQ ID NO: 123134 - RNA, 23 nt, Human
acaaaagauaacagcauuuuuca

SEQ ID NO: 123135 - RNA, 21 nt, Human
accccacccucacccuuccca

SEQ ID NO: 123136 - RNA, 22 nt, Human
accccacccucacccuucccaa

SEQ ID NO: 123137 - RNA, 24 nt, Human
agaaccccacccucacccuuccca

SEQ ID NO: 123138 - RNA, 20 nt, Human
agagaaaaaagcaacaagaa

SEQ ID NO: 123139 - RNA, 18 nt, Human
agagaggaaaaaaagaga

SEQ ID NO: 123140 - RNA, 22 nt, Human
auaggcaccuugucaacuaaau

SEQ ID NO: 123141 - RNA, 18 nt, Human
auaguuguuuuuguaagg

SEQ ID NO: 123142 - RNA, 24 nt, Human
augacccaaaauuaggaaguucca

SEQ ID NO: 123143 - RNA, 21 nt, Human
caaaaaaguucugagaacaau

SEQ ID NO: 123144 - RNA, 20 nt, Human
caaaauacaauuaggacaua

SEQ ID NO: 123145 - RNA, 22 nt, Human
caagcaaauacgccaaugcugu

SEQ ID NO: 123146 - RNA, 20 nt, Human
cagcaugcugucaaagagug

SEQ ID NO: 123147 - RNA, 23 nt, Human
cauaaccaaaaaaaaaaaaaaga

SEQ ID NO: 123148 - RNA, 24 nt, Human
cauaaccaaaaaaaaaaaaaagaa

SEQ ID NO: 123149 - RNA, 20 nt, Human
cauuuuuuaagagaggaaaa

SEQ ID NO: 123150 - RNA, 24 nt, Human
ccaagcacuccaaaauuuggguuc

SEQ ID NO: 123151 - RNA, 19 nt, Human
ccacccucacccuucccaa

SEQ ID NO: 123152 - RNA, 18 nt, Human
cccacccucacccuuccc

SEQ ID NO: 123153 - RNA, 18 nt, Human
ccccacccucacccuucc

SEQ ID NO: 123154 - RNA, 20 nt, Human
cguugggggggagggaccug

SEQ ID NO: 123155 - RNA, 22 nt, Human
cuaaaugauuuucauaaacacc

SEQ ID NO: 123156 - RNA, 23 nt, Human
gaaccccacccucacccuuccca

SEQ ID NO: 123157 - RNA, 24 nt, Human
gaaugcaaguuucuccacaaaaca

SEQ ID NO: 123158 - RNA, 24 nt, Human
gagaaaaaagcaacaagaacccca

SEQ ID NO: 123159 - RNA, 26 nt, Human
gagaggaaaaaaagagaaaaaagcaa

SEQ ID NO: 123160 - RNA, 20 nt, Human
gccaggccuugaccggaggc

SEQ ID NO: 123161 - RNA, 19 nt, Human
ggaggccggagcucccacc

SEQ ID NO: 123162 - RNA, 19 nt, Human
ggcgcucccggccaggccu

SEQ ID NO: 123163 - RNA, 29 nt, Human
guaagguuuuuuuuuucauuuuuuuuuua

SEQ ID NO: 123164 - RNA, 21 nt, Human
gugcaacaugaagggaaugcc

SEQ ID NO: 123165 - RNA, 24 nt, Human
guuuaaaacaacaaaccuaaauuu

SEQ ID NO: 123166 - RNA, 23 nt, Human
uaaaaacaaaagauaacagcauu

SEQ ID NO: 123167 - RNA, 18 nt, Human
uaaaacaacaaaccuaaa

SEQ ID NO: 123168 - RNA, 25 nt, Human
uaaaugacccaaaauuaggaaguuc

SEQ ID NO: 123169 - RNA, 20 nt, Human
uaacagcauuuuucagugcc

SEQ ID NO: 123170 - RNA, 21 nt, Human
uaagagaggaaaaaaagagaa

SEQ ID NO: 123171 - RNA, 27 nt, Human
uaaugggcucuucaugaaugcaaguuu

SEQ ID NO: 123172 - RNA, 23 nt, Human
uccaaauaaaccuuucucucagc

SEQ ID NO: 123173 - RNA, 22 nt, Human
uccacaaaacagcaugcuguca

SEQ ID NO: 123174 - RNA, 19 nt, Human
ucugaagauccuuccuugu

SEQ ID NO: 123175 - RNA, 20 nt, Human
ugauaaugggcucuucauga

SEQ ID NO: 123176 - RNA, 19 nt, Human
ugcaaguacauuuuuuaag

SEQ ID NO: 123177 - RNA, 27 nt, Human
uggcaaaauauaguuguuuuuguaagg

SEQ ID NO: 123178 - RNA, 23 nt, Human
ugguggguacaaaucaaauucac

SEQ ID NO: 123179 - RNA, 24 nt, Human
ugucaaagagugugcaacaugaag

SEQ ID NO: 123180 - RNA, 19 nt, Human
uucauuccccaaaauacaa

SEQ ID NO: 123181 - RNA, 22 nt, Human
uuuaacuuggacucucgcgaga

SEQ ID NO: 123182 - RNA, 20 nt, Human
uuucagaccuuuacaaaaug

SEQ ID NO: 123183 - RNA, 18 nt, Human
uuuuuuuuuuuuggaggg

SEQ ID NO: 123184 - RNA, 19 nt, Human
uuuuuuuuuuuuuuggagg

SEQ ID NO: 123185 - RNA, 24 nt, Human
uuuuuuuuuuuuuuuuuuggaggg

SEQ ID NO: 123186 - RNA, 24 nt, Human
aaccugaggugggggcugagaggg

SEQ ID NO: 123187 - RNA, 24 nt, Human
aagaagaaagcagaaaucacaugg

SEQ ID NO: 123188 - RNA, 20 nt, Human
aagagacuggggcucggggg

SEQ ID NO: 123189 - RNA, 22 nt, Human
aagcagaaaucacaugggucug

SEQ ID NO: 123190 - RNA, 20 nt, Human
accugaggugggggcugaga

SEQ ID NO: 123191 - RNA, 19 nt, Human
agaagaaagcagaaaucac

SEQ ID NO: 123192 - RNA, 19 nt, Human
agagacuggggcucggggg

SEQ ID NO: 123193 - RNA, 21 nt, Human
aggagacguucagaccccuca

SEQ ID NO: 123194 - RNA, 21 nt, Human
agggcaguuuccaugggggau

SEQ ID NO: 123195 - RNA, 19 nt, Human
agggcuagaggucaggcuu

SEQ ID NO: 123196 - RNA, 18 nt, Human
aucuugcuaaagaagaaa

SEQ ID NO: 123197 - RNA, 22 nt, Human
caagcuggauuaaccgcagcug

SEQ ID NO: 123198 - RNA, 24 nt, Human
cagaccccucagaccaauccauga

SEQ ID NO: 123199 - RNA, 21 nt, Human
cagacucugucaagccucaua

SEQ ID NO: 123200 - RNA, 23 nt, Human
ccucuuacggggcauggggggau

SEQ ID NO: 123201 - RNA, 23 nt, Human
ccuggccgggcauugggggcucg

SEQ ID NO: 123202 - RNA, 21 nt, Human
cuaaccugaggugggggcuga

SEQ ID NO: 123203 - RNA, 18 nt, Human
cuccaaagccugcugucc

SEQ ID NO: 123204 - RNA, 23 nt, Human
cucucuggaccuagcgggccuga

SEQ ID NO: 123205 - RNA, 18 nt, Human
gaagagacuggggcucgg

SEQ ID NO: 123206 - RNA, 19 nt, Human
gaagcgucuuccaccucuu

SEQ ID NO: 123207 - RNA, 21 nt, Human
gacucuuccuuaucuagaaac

SEQ ID NO: 123208 - RNA, 20 nt, Human
gauucuucaggggagucuaa

SEQ ID NO: 123209 - RNA, 19 nt, Human
gcagugggggagggggcag

SEQ ID NO: 123210 - RNA, 19 nt, Human
ggaccuagcgggccugaug

SEQ ID NO: 123211 - RNA, 21 nt, Human
gggcauugggggcucgcucuc

SEQ ID NO: 123212 - RNA, 19 nt, Human
ggggagggggcagacucug

SEQ ID NO: 123213 - RNA, 23 nt, Human
gggugcagugggggagggggcag

SEQ ID NO: 123214 - RNA, 20 nt, Human
gguggaggcgcagccgucac

SEQ ID NO: 123215 - RNA, 19 nt, Human
gugcagugggggagggggc

SEQ ID NO: 123216 - RNA, 21 nt, Human
gugggggcugagagggucucu

SEQ ID NO: 123217 - RNA, 20 nt, Human
guucagaccccucagaccaa

SEQ ID NO: 123218 - RNA, 20 nt, Human
uagaaaccagaauaucuugc

SEQ ID NO: 123219 - RNA, 22 nt, Human
uagccuggccgggcauuggggg

SEQ ID NO: 123220 - RNA, 24 nt, Human
uagccuggccgggcauugggggcu

SEQ ID NO: 123221 - RNA, 27 nt, Human
uaggagagcccaagaggaucgcagugg

SEQ ID NO: 123222 - RNA, 22 nt, Human
ucacaugggucugggggcaggg

SEQ ID NO: 123223 - RNA, 18 nt, Human
ucagaccaauccaugagu

SEQ ID NO: 123224 - RNA, 19 nt, Human
ucucuggaccuagcgggcc

SEQ ID NO: 123225 - RNA, 19 nt, Human
ucugaagagacuggggcuc

SEQ ID NO: 123226 - RNA, 20 nt, Human
ucugaagagacuggggcucg

SEQ ID NO: 123227 - RNA, 18 nt, Human
ucugcaggguuggggcug

SEQ ID NO: 123228 - RNA, 18 nt, Human
ugccagugcccugagagg

SEQ ID NO: 123229 - RNA, 19 nt, Human
ugcuggacagcggauaagg

SEQ ID NO: 123230 - RNA, 18 nt, Human
uggaaggaagcgucuucc

SEQ ID NO: 123231 - RNA, 18 nt, Human
uggcaaaggcaggcuggg

SEQ ID NO: 123232 - RNA, 21 nt, Human
uggggcucucucucuuggggu

SEQ ID NO: 123233 - RNA, 18 nt, Human
ugggggcagggagggggu

SEQ ID NO: 123234 - RNA, 18 nt, Human
ugggggcugagagggucu

SEQ ID NO: 123235 - RNA, 20 nt, Human
ugucacgggggaggccccgg

SEQ ID NO: 123236 - RNA, 21 nt, Human
ugugaccgagacauucuuuca

SEQ ID NO: 123237 - RNA, 22 nt, Human
uuccaugggggauucuucagga

SEQ ID NO: 123238 - RNA, 24 nt, Human
uucuucaggggagucuaagugauu

SEQ ID NO: 123239 - RNA, 21 nt, Human
aaaaagcugcucccauagccc

SEQ ID NO: 123240 - RNA, 23 nt, Human
aaaaggguugagaccugcaagag

SEQ ID NO: 123241 - RNA, 24 nt, Human
aaauaacaacaaaaaucuuuccuc

SEQ ID NO: 123242 - RNA, 21 nt, Human
aagagacaggcugauaggaug

SEQ ID NO: 123243 - RNA, 19 nt, Human
aagaggaaaacaaaucaga

SEQ ID NO: 123244 - RNA, 20 nt, Human
aagaggaaaacaaaucagau

SEQ ID NO: 123245 - RNA, 19 nt, Human
aagcagaagucuaagaggc

SEQ ID NO: 123246 - RNA, 19 nt, Human
aagcagaagucuaagaggc

SEQ ID NO: 123247 - RNA, 22 nt, Human
acagcagugccagguguggaaa

SEQ ID NO: 123248 - RNA, 20 nt, Human
accacaacuugggcacagca

SEQ ID NO: 123249 - RNA, 24 nt, Human
agaaaugucuacucuuugucauuc

SEQ ID NO: 123250 - RNA, 21 nt, Human
agacaaaaggguugagaccug

SEQ ID NO: 123251 - RNA, 21 nt, Human
agcacaauucucaacaacacu

SEQ ID NO: 123252 - RNA, 19 nt, Human
agcagguggagaugcauga

SEQ ID NO: 123253 - RNA, 19 nt, Human
aggcagacaaaaggguuga

SEQ ID NO: 123254 - RNA, 24 nt, Human
aggcucuuccaagcuuugucagca

SEQ ID NO: 123255 - RNA, 22 nt, Human
aguaagagaaaugucuacucuu

SEQ ID NO: 123256 - RNA, 22 nt, Human
auaggauggguggaguccuuug

SEQ ID NO: 123257 - RNA, 20 nt, Human
aucuuauauaucccuucccc

SEQ ID NO: 123258 - RNA, 24 nt, Human
auggggaaucuauugguaggaccc

SEQ ID NO: 123259 - RNA, 19 nt, Human
auucucaacaacacucuag

SEQ ID NO: 123260 - RNA, 24 nt, Human
caaagagcuaucagauacacagca

SEQ ID NO: 123261 - RNA, 24 nt, Human
caauaugaacaauauucaccaccc

SEQ ID NO: 123262 - RNA, 21 nt, Human
caauuuaacaguuaccacauc

SEQ ID NO: 123263 - RNA, 24 nt, Human
cagcacagcagugccaggugugga

SEQ ID NO: 123264 - RNA, 25 nt, Human
cagcagcaccugcaggcucuuccaa

SEQ ID NO: 123265 - RNA, 21 nt, Human
cagcagugccagguguggaaa

SEQ ID NO: 123266 - RNA, 22 nt, Human
caucagguucaggaacuccagg

SEQ ID NO: 123267 - RNA, 19 nt, Human
caucccuucuuauuugggg

SEQ ID NO: 123268 - RNA, 19 nt, Human
cccauccaacuucuuggaa

SEQ ID NO: 123269 - RNA, 25 nt, Human
cccugguuuccccucacuuugaggg

SEQ ID NO: 123270 - RNA, 19 nt, Human
ccuuacuggccugggagca

SEQ ID NO: 123271 - RNA, 21 nt, Human
cguuucuaggggggaaaaaaa

SEQ ID NO: 123272 - RNA, 19 nt, Human
cuaaacauuggaaacaagu

SEQ ID NO: 123273 - RNA, 23 nt, Human
cuauuucccuuacuggccuggga

SEQ ID NO: 123274 - RNA, 18 nt, Human
cucagacuuuaccagaga

SEQ ID NO: 123275 - RNA, 22 nt, Human
cugccaaagagcuaucagauac

SEQ ID NO: 123276 - RNA, 22 nt, Human
gcacaauucucaacaacacucu

SEQ ID NO: 123277 - RNA, 21 nt, Human
ggaaauauguauuucugcuuc

SEQ ID NO: 123278 - RNA, 21 nt, Human
ggaggcaauggggaaucuauu

SEQ ID NO: 123279 - RNA, 21 nt, Human
ggcaggggcuugccacaaggu

SEQ ID NO: 123280 - RNA, 22 nt, Human
ggcaguggggagcccuugcagg

SEQ ID NO: 123281 - RNA, 20 nt, Human
ggcucagacacccuuuugcu

SEQ ID NO: 123282 - RNA, 22 nt, Human
gggaaaaaaaagcugcucccau

SEQ ID NO: 123283 - RNA, 23 nt, Human
gggaauuuugcccuuggggccag

SEQ ID NO: 123284 - RNA, 20 nt, Human
gggagaggcuggaucaggca

SEQ ID NO: 123285 - RNA, 19 nt, Human
ggggagcccuugcagguuu

SEQ ID NO: 123286 - RNA, 24 nt, Human
gggugauguguggcauuuguuuug

SEQ ID NO: 123287 - RNA, 20 nt, Human
guccuuugggaaggaggagg

SEQ ID NO: 123288 - RNA, 22 nt, Human
gucuggacgggugaauacagga

SEQ ID NO: 123289 - RNA, 18 nt, Human
gugcauuggguccaucau

SEQ ID NO: 123290 - RNA, 19 nt, Human
gugcauuggguccaucauu

SEQ ID NO: 123291 - RNA, 22 nt, Human
guggaaagcagaagucuaagag

SEQ ID NO: 123292 - RNA, 23 nt, Human
uaagaggcagacaaaaggguuga

SEQ ID NO: 123293 - RNA, 26 nt, Human
uacccacccauccaacuucuuggaaa

SEQ ID NO: 123294 - RNA, 23 nt, Human
uaggauggguggaguccuuuggg

SEQ ID NO: 123295 - RNA, 26 nt, Human
uaugaacaauauucaccacccucauu

SEQ ID NO: 123296 - RNA, 18 nt, Human
ucagauacacagcaauuu

SEQ ID NO: 123297 - RNA, 19 nt, Human
ucaggaacuccagguucuc

SEQ ID NO: 123298 - RNA, 23 nt, Human
ucccauagcccuggcuccccagg

SEQ ID NO: 123299 - RNA, 24 nt, Human
ucuacagaccaggaaacugaagcu

SEQ ID NO: 123300 - RNA, 24 nt, Human
ucuauuucccuuacuggccuggga

SEQ ID NO: 123301 - RNA, 21 nt, Human
ucucuguagacacaaggcuuu

SEQ ID NO: 123302 - RNA, 25 nt, Human
ucugccagucagccacccuguccug

SEQ ID NO: 123303 - RNA, 21 nt, Human
ugaagcuugauuugucccaag

SEQ ID NO: 123304 - RNA, 18 nt, Human
ugaaggccuggcguggac

SEQ ID NO: 123305 - RNA, 18 nt, Human
ugaauacacagucuggua

SEQ ID NO: 123306 - RNA, 20 nt, Human
ugacucgaugcaguaggcag

SEQ ID NO: 123307 - RNA, 23 nt, Human
ugacucgaugcaguaggcagugg

SEQ ID NO: 123308 - RNA, 24 nt, Human
ugagagugugaacaaggucuggaa

SEQ ID NO: 123309 - RNA, 18 nt, Human
ugaucuugaaggaacaug

SEQ ID NO: 123310 - RNA, 18 nt, Human
ugauggaagagggcuuaa

SEQ ID NO: 123311 - RNA, 22 nt, Human
ugcaguaggcaguggggagccc

SEQ ID NO: 123312 - RNA, 20 nt, Human
ugccaaagagcuaucaggau

SEQ ID NO: 123313 - RNA, 18 nt, Human
ugccaagggaaccucugg

SEQ ID NO: 123314 - RNA, 23 nt, Human
ugcucagacuuuaccagagacga

SEQ ID NO: 123315 - RNA, 25 nt, Human
uggaaagcagaagucuaagaggcag

SEQ ID NO: 123316 - RNA, 18 nt, Human
uggaaaggaugaucucua

SEQ ID NO: 123317 - RNA, 24 nt, Human
uggaagagacaggcugauaggaug

SEQ ID NO: 123318 - RNA, 23 nt, Human
uggaguugggguuggaauccauc

SEQ ID NO: 123319 - RNA, 19 nt, Human
ugggaaggaggaggcaaug

SEQ ID NO: 123320 - RNA, 20 nt, Human
ugggaaggaggaggcaaugg

SEQ ID NO: 123321 - RNA, 24 nt, Human
ugggaaggaggaggcaauggggaa

SEQ ID NO: 123322 - RNA, 21 nt, Human
ugggcaggggcuugccacaag

SEQ ID NO: 123323 - RNA, 19 nt, Human
ugggguauuuucccagaug

SEQ ID NO: 123324 - RNA, 22 nt, Human
uggguggaguccuuugggaagg

SEQ ID NO: 123325 - RNA, 21 nt, Human
ugggugucagucccucucugg

SEQ ID NO: 123326 - RNA, 21 nt, Human
ugguaagggugauguguggca

SEQ ID NO: 123327 - RNA, 24 nt, Human
uguaagaaauaacaacaaaaaucu

SEQ ID NO: 123328 - RNA, 19 nt, Human
ugugaaagguaccuuaucc

SEQ ID NO: 123329 - RNA, 19 nt, Human
uuauauaucccuuccccau

SEQ ID NO: 123330 - RNA, 18 nt, Human
uucaaagaguucaauuug

SEQ ID NO: 123331 - RNA, 23 nt, Human
uucaaagaguucaauuuguucau

SEQ ID NO: 123332 - RNA, 24 nt, Human
uucaauuuguucauucuucaaauu

SEQ ID NO: 123333 - RNA, 26 nt, Human
uucauuauacaaacauauagacugcc

SEQ ID NO: 123334 - RNA, 22 nt, Human
uuccagggaugggcaccugaua

SEQ ID NO: 123335 - RNA, 23 nt, Human
uuccccauggauaacagcaccuu

SEQ ID NO: 123336 - RNA, 19 nt, Human
uucccugggaauuuugccc

SEQ ID NO: 123337 - RNA, 21 nt, Human
uucccugggaauuuugcccuu

SEQ ID NO: 123338 - RNA, 20 nt, Human
uuggggccagagaaacaugg

SEQ ID NO: 123339 - RNA, 22 nt, Human
aaacaacaacaacauaaagcac

SEQ ID NO: 123340 - RNA, 21 nt, Human
aaauacacauccuaaaaauaa

SEQ ID NO: 123341 - RNA, 26 nt, Human
aacaacaacaacauaaagcacuggaa

SEQ ID NO: 123342 - RNA, 18 nt, Human
aacuugguaugcaaguaa

SEQ ID NO: 123343 - RNA, 21 nt, Human
aagaccaccacagaucucaag

SEQ ID NO: 123344 - RNA, 21 nt, Human
aagcacuggaaccaaagaacc

SEQ ID NO: 123345 - RNA, 21 nt, Human
aagugucaaacaacaaaugag

SEQ ID NO: 123346 - RNA, 20 nt, Human
aauacagaauugauggagga

SEQ ID NO: 123347 - RNA, 22 nt, Human
acagcaacuguacauccuccca

SEQ ID NO: 123348 - RNA, 22 nt, Human
agaauaaaucaccuucacaaaa

SEQ ID NO: 123349 - RNA, 22 nt, Human
agacaaacuuuuucaaagcuca

SEQ ID NO: 123350 - RNA, 21 nt, Human
aguaaaauuaguaauuucuaa

SEQ ID NO: 123351 - RNA, 20 nt, Human
auccaaaaacaacaacaaca

SEQ ID NO: 123352 - RNA, 23 nt, Human
auccuaaaaauaaugguaaaaau

SEQ ID NO: 123353 - RNA, 22 nt, Human
augagacuacucaccaacaaaa

SEQ ID NO: 123354 - RNA, 23 nt, Human
caaaaacaacaacaacauaaagc

SEQ ID NO: 123355 - RNA, 19 nt, Human
caaagcgcuacaucuuacu

SEQ ID NO: 123356 - RNA, 18 nt, Human
cacaauuuagaccagaau

SEQ ID NO: 123357 - RNA, 22 nt, Human
cacacaacagcaacuguacauc

SEQ ID NO: 123358 - RNA, 24 nt, Human
caccacagaucucaaggcaugaga

SEQ ID NO: 123359 - RNA, 19 nt, Human
cacuggaaccaaagaacca

SEQ ID NO: 123360 - RNA, 19 nt, Human
cauagacaagguuuaugaa

SEQ ID NO: 123361 - RNA, 20 nt, Human
cauccaaaaacaacaacaac

SEQ ID NO: 123362 - RNA, 23 nt, Human
ccaaaaacaacaacaacauaaag

SEQ ID NO: 123363 - RNA, 19 nt, Human
ccaacaaaaucuauccccc

SEQ ID NO: 123364 - RNA, 21 nt, Human
ccuucacaaaacuaagacaaa

SEQ ID NO: 123365 - RNA, 26 nt, Human
cuccccgcgccucgcgcgcucccgac

SEQ ID NO: 123366 - RNA, 19 nt, Human
cucgcuccuggucccaggc

SEQ ID NO: 123367 - RNA, 21 nt, Human
cuggucccaggcuccccgcgc

SEQ ID NO: 123368 - RNA, 19 nt, Human
cuguacuaauuugggggag

SEQ ID NO: 123369 - RNA, 18 nt, Human
cuuaaaauguauuugauu

SEQ ID NO: 123370 - RNA, 18 nt, Human
cuugaucuggcuggccac

SEQ ID NO: 123371 - RNA, 23 nt, Human
gacuacucaccaacaaaaucuau

SEQ ID NO: 123372 - RNA, 21 nt, Human
gagcuguaaaaccaaguacaa

SEQ ID NO: 123373 - RNA, 23 nt, Human
gcuuaaaauguauuugauuauuc

SEQ ID NO: 123374 - RNA, 23 nt, Human
ggacacuuaacuugcuuaaaaug

SEQ ID NO: 123375 - RNA, 19 nt, Human
ggagagcacagaugagaca

SEQ ID NO: 123376 - RNA, 23 nt, Human
gugggcggcggcugcagguaggc

SEQ ID NO: 123377 - RNA, 24 nt, Human
uaaauaaaugaaauacacauccua

SEQ ID NO: 123378 - RNA, 21 nt, Human
uaagaaaaauaucaccuggga

SEQ ID NO: 123379 - RNA, 18 nt, Human
uaagaauaaaucaccuuc

SEQ ID NO: 123380 - RNA, 21 nt, Human
uaagacaaacuuuuucaaagc

SEQ ID NO: 123381 - RNA, 26 nt, Human
uaagucccuauuaccuguagcagucu

SEQ ID NO: 123382 - RNA, 25 nt, Human
uaauauguaacaccauccaaaaaca

SEQ ID NO: 123383 - RNA, 18 nt, Human
uaauuugggggagacugg

SEQ ID NO: 123384 - RNA, 18 nt, Human
uaucaaaaaaaggaaagg

SEQ ID NO: 123385 - RNA, 18 nt, Human
uaucaaaaaaaggaaagg

SEQ ID NO: 123386 - RNA, 23 nt, Human
uaucaaaaaaaggaaaggaacac

SEQ ID NO: 123387 - RNA, 21 nt, Human
uauguuuuuagagauauucca

SEQ ID NO: 123388 - RNA, 20 nt, Human
ucaaaaaaaggaaaggaaca

SEQ ID NO: 123389 - RNA, 21 nt, Human
ucaaagcucagcuugauuugc

SEQ ID NO: 123390 - RNA, 22 nt, Human
ucacaaaacuaagacaaacuuu

SEQ ID NO: 123391 - RNA, 20 nt, Human
uccccgcgccucgcgcgcuc

SEQ ID NO: 123392 - RNA, 22 nt, Human
ucuaucccugcuauugcaccua

SEQ ID NO: 123393 - RNA, 18 nt, Human
ugaaugacuuagaaguaa

SEQ ID NO: 123394 - RNA, 23 nt, Human
ugacuuagaaguaaaauuaguaa

SEQ ID NO: 123395 - RNA, 22 nt, Human
ugaucuggcuggccaccauuuu

SEQ ID NO: 123396 - RNA, 19 nt, Human
ugccgugggcggcggcugc

SEQ ID NO: 123397 - RNA, 23 nt, Human
ugccgugggcggcggcugcaggu

SEQ ID NO: 123398 - RNA, 25 nt, Human
ugccgugggcggcggcugcagguag

SEQ ID NO: 123399 - RNA, 21 nt, Human
ugcuggaacuacacagagaca

SEQ ID NO: 123400 - RNA, 22 nt, Human
uggucccaggcuccccgcgccu

SEQ ID NO: 123401 - RNA, 20 nt, Human
uucagaugguaaacuuuucu

SEQ ID NO: 123402 - RNA, 21 nt, Human
uuuaagaagucauuucauaga

SEQ ID NO: 123403 - RNA, 25 nt, Human
uuuuuuuuuuuuuuuuuuuuuaagg

SEQ ID NO: 123404 - RNA, 18 nt, Human
aaacagaugugcacauac

SEQ ID NO: 123405 - RNA, 24 nt, Human
aaacagaugugcacauacauuccc

SEQ ID NO: 123406 - RNA, 21 nt, Human
acaauccagguggccucugca

SEQ ID NO: 123407 - RNA, 21 nt, Human
agaaauguugaccacacacug

SEQ ID NO: 123408 - RNA, 18 nt, Human
agacauaaaauguccaag

SEQ ID NO: 123409 - RNA, 19 nt, Human
agaugugcacauacauucc

SEQ ID NO: 123410 - RNA, 19 nt, Human
agcaggcgggucuggcggc

SEQ ID NO: 123411 - RNA, 22 nt, Human
aggcgggucuggcggcugugag

SEQ ID NO: 123412 - RNA, 19 nt, Human
auccagguggccucugcag

SEQ ID NO: 123413 - RNA, 18 nt, Human
aucuaaacaguuacaaaa

SEQ ID NO: 123414 - RNA, 20 nt, Human
caaaaagaaugaauauaaua

SEQ ID NO: 123415 - RNA, 22 nt, Human
caaaacuaaugaauaaauaaau

SEQ ID NO: 123416 - RNA, 23 nt, Human
caauaauuaagccccuuuguucu

SEQ ID NO: 123417 - RNA, 18 nt, Human
cagugagcuuccuccucc

SEQ ID NO: 123418 - RNA, 21 nt, Human
cagugagcuuccuccucccuu

SEQ ID NO: 123419 - RNA, 24 nt, Human
ccagaaacacuguaaaacuaccau

SEQ ID NO: 123420 - RNA, 18 nt, Human
ccuucaggaacagccacc

SEQ ID NO: 123421 - RNA, 19 nt, Human
ccuuuguucuaagccagaa

SEQ ID NO: 123422 - RNA, 21 nt, Human
cuccuaagcgaugcucaaaca

SEQ ID NO: 123423 - RNA, 19 nt, Human
cucuuuccucuucuguucc

SEQ ID NO: 123424 - RNA, 23 nt, Human
gaacauuugaaaacauucuaccu

SEQ ID NO: 123425 - RNA, 19 nt, Human
gcagggccuccuucaggaa

SEQ ID NO: 123426 - RNA, 23 nt, Human
gucucucuuuccucuucuguucc

SEQ ID NO: 123427 - RNA, 23 nt, Human
uaaauaaauagaagacuucuccu

SEQ ID NO: 123428 - RNA, 18 nt, Human
ucaaacacauuaggcaca

SEQ ID NO: 123429 - RNA, 19 nt, Human
ucaaauuaaauaugaaucc

SEQ ID NO: 123430 - RNA, 18 nt, Human
ucugcagcugugucucuc

SEQ ID NO: 123431 - RNA, 25 nt, Human
ugagaaauguugaccacacacugug

SEQ ID NO: 123432 - RNA, 20 nt, Human
ugagaggagcggaagagcug

SEQ ID NO: 123433 - RNA, 23 nt, Human
ugagaggagcggaagagcuggcg

SEQ ID NO: 123434 - RNA, 19 nt, Human
ugcagcugugucucucuuu

SEQ ID NO: 123435 - RNA, 18 nt, Human
ugccuuacaagaaagaca

SEQ ID NO: 123436 - RNA, 24 nt, Human
uggcggcugugagaggagcggaag

SEQ ID NO: 123437 - RNA, 19 nt, Human
ugugaaaucauuucaauaa

SEQ ID NO: 123438 - RNA, 23 nt, Human
ugugcacauacauuccccugccu

SEQ ID NO: 123439 - RNA, 18 nt, Human
uguugcaggcuccucaga

SEQ ID NO: 123440 - RNA, 18 nt, Human
uuaggcacaauccaggug

SEQ ID NO: 123441 - RNA, 21 nt, Human
aaaaaaagucagugaaaaaga

SEQ ID NO: 123442 - RNA, 23 nt, Human
aaacuccaaguguauauagggug

SEQ ID NO: 123443 - RNA, 24 nt, Human
aauaagaaugcaaacuccaagugu

SEQ ID NO: 123444 - RNA, 20 nt, Human
aauucuccuccguagugagu

SEQ ID NO: 123445 - RNA, 20 nt, Human
aauuuucuucuuaauucaag

SEQ ID NO: 123446 - RNA, 23 nt, Human
acaaaaaaagucagugaaaaaga

SEQ ID NO: 123447 - RNA, 23 nt, Human
agcacaaaacuaaaauccagagc

SEQ ID NO: 123448 - RNA, 23 nt, Human
aggcucauuagcagagucaguuu

SEQ ID NO: 123449 - RNA, 24 nt, Human
aguuccaucugccucccaggcagc

SEQ ID NO: 123450 - RNA, 19 nt, Human
auaccagaguccccccggc

SEQ ID NO: 123451 - RNA, 23 nt, Human
cacaaaacuaaaauccagagcag

SEQ ID NO: 123452 - RNA, 20 nt, Human
cagagcagggauaagggaag

SEQ ID NO: 123453 - RNA, 18 nt, Human
cagaguccccccggcccc

SEQ ID NO: 123454 - RNA, 25 nt, Human
cccccacaaaaaaagucagugaaaa

SEQ ID NO: 123455 - RNA, 20 nt, Human
cccggccccgcccccacaaa

SEQ ID NO: 123456 - RNA, 23 nt, Human
ccuggaaaagauuuaacuaagca

SEQ ID NO: 123457 - RNA, 23 nt, Human
cuacauggauuccuuugccucuu

SEQ ID NO: 123458 - RNA, 24 nt, Human
cuuaaauucucauuccauuguuuu

SEQ ID NO: 123459 - RNA, 19 nt, Human
gagcagggauaagggaaga

SEQ ID NO: 123460 - RNA, 25 nt, Human
gagucaguuuuuucaaacaucuucu

SEQ ID NO: 123461 - RNA, 22 nt, Human
guacaucacccuuuaaaugcuu

SEQ ID NO: 123462 - RNA, 18 nt, Human
uaaaauccagagcaggga

SEQ ID NO: 123463 - RNA, 21 nt, Human
uacuacauggauuccuuugcc

SEQ ID NO: 123464 - RNA, 19 nt, Human
ucaaacaucuucucccaag

SEQ ID NO: 123465 - RNA, 18 nt, Human
uccagagcagggauaagg

SEQ ID NO: 123466 - RNA, 18 nt, Human
uccccccggccccgcccc

SEQ ID NO: 123467 - RNA, 26 nt, Human
uccccccggccccgcccccacaaaaa

SEQ ID NO: 123468 - RNA, 18 nt, Human
ucugccucccaggcagcu

SEQ ID NO: 123469 - RNA, 24 nt, Human
ugugugaaaggauacauguguaca

SEQ ID NO: 123470 - RNA, 22 nt, Human
uugaguuugccccaucagcucc

SEQ ID NO: 123471 - RNA, 19 nt, Human
uuucaaacaucuucuccca

SEQ ID NO: 123472 - RNA, 20 nt, Human
uuucacauaguccucaugcc

SEQ ID NO: 123473 - RNA, 23 nt, Human
uuuugagucuuucauagaagccu

SEQ ID NO: 123474 - RNA, 24 nt, Human
uuuuuaagcagaggauaucuacua

SEQ ID NO: 123475 - RNA, 19 nt, Human
aaaacaaagcaaagcaaaa

SEQ ID NO: 123476 - RNA, 24 nt, Human
aaaacaaagcaaagcaaaacaaaa

SEQ ID NO: 123477 - RNA, 19 nt, Human
aaacaaaauacacauagaa

SEQ ID NO: 123478 - RNA, 22 nt, Human
aaacaaagcaaagcaaaacaaa

SEQ ID NO: 123479 - RNA, 23 nt, Human
aaacaaagcaaagcaaaacaaag

SEQ ID NO: 123480 - RNA, 19 nt, Human
aaagcaaaacaaaacaaaa

SEQ ID NO: 123481 - RNA, 19 nt, Human
aaagcaaagcaaaacaaaa

SEQ ID NO: 123482 - RNA, 19 nt, Human
aacauggugaaaccccguc

SEQ ID NO: 123483 - RNA, 20 nt, Human
aacauggugaaaccccgucu

SEQ ID NO: 123484 - RNA, 21 nt, Human
aacauggugaaaccccgucuc

SEQ ID NO: 123485 - RNA, 18 nt, Human
aagcaaaacaaaacaaaa

SEQ ID NO: 123486 - RNA, 22 nt, Human
aagcaaagcaaaacaaaacaaa

SEQ ID NO: 123487 - RNA, 24 nt, Human
aaggugggaggaucacuugacuca

SEQ ID NO: 123488 - RNA, 18 nt, Human
aaucgcuugaaccuggga

SEQ ID NO: 123489 - RNA, 24 nt, Human
acaaaacaaaauacacauagaauu

SEQ ID NO: 123490 - RNA, 19 nt, Human
acaaagcaaagcaaaacaa

SEQ ID NO: 123491 - RNA, 21 nt, Human
acaaagcaaagcaaaacaaaa

SEQ ID NO: 123492 - RNA, 25 nt, Human
acaaagcaaagcaaaacaaaacaaa

SEQ ID NO: 123493 - RNA, 20 nt, Human
acagagcgagacuccgucuc

SEQ ID NO: 123494 - RNA, 24 nt, Human
acagagcgagacuccgucucaaaa

SEQ ID NO: 123495 - RNA, 24 nt, Human
accccgucucuacuaaaaauacaa

SEQ ID NO: 123496 - RNA, 24 nt, Human
acugcacuccagccuggaugacag

SEQ ID NO: 123497 - RNA, 26 nt, Human
acugcacuccagccuggaugacagag

SEQ ID NO: 123498 - RNA, 23 nt, Human
agacucaaucauuacaaaaauaa

SEQ ID NO: 123499 - RNA, 24 nt, Human
agauggggguugcagugagccgag

SEQ ID NO: 123500 - RNA, 18 nt, Human
agcaaaaaaugaagccag

SEQ ID NO: 123501 - RNA, 19 nt, Human
agcaccuguagucccagcu

SEQ ID NO: 123502 - RNA, 24 nt, Human
agcacuuugggaggccuggguggg

SEQ ID NO: 123503 - RNA, 20 nt, Human
agccgggugugguggugagc

SEQ ID NO: 123504 - RNA, 24 nt, Human
agccuggaugacagagcgagacuc

SEQ ID NO: 123505 - RNA, 21 nt, Human
agccugggcaacauagagucc

SEQ ID NO: 123506 - RNA, 21 nt, Human
agccugggcaacauagagucc

SEQ ID NO: 123507 - RNA, 22 nt, Human
agccuggucaacauggugaaac

SEQ ID NO: 123508 - RNA, 24 nt, Human
agccuggucaacauggugaaaccc

SEQ ID NO: 123509 - RNA, 22 nt, Human
agcugcacccaccggcccugcu

SEQ ID NO: 123510 - RNA, 19 nt, Human
aggagggagggugggaaag

SEQ ID NO: 123511 - RNA, 21 nt, Human
aggaguucgagaccagccugg

SEQ ID NO: 123512 - RNA, 23 nt, Human
aggaucacuugacucaggaguuc

SEQ ID NO: 123513 - RNA, 19 nt, Human
aggcaagggacugaggagg

SEQ ID NO: 123514 - RNA, 22 nt, Human
aggcaggagaaucgcuugaacc

SEQ ID NO: 123515 - RNA, 24 nt, Human
aggcaggagaaucgcuugaaccug

SEQ ID NO: 123516 - RNA, 20 nt, Human
aggcaugguggcucacaccu

SEQ ID NO: 123517 - RNA, 21 nt, Human
aggccugggugggcagaucac

SEQ ID NO: 123518 - RNA, 22 nt, Human
agggagggugggaaagcccagg

SEQ ID NO: 123519 - RNA, 18 nt, Human
aggugggaggaucacuug

SEQ ID NO: 123520 - RNA, 19 nt, Human
aguggcugguuaguccuau

SEQ ID NO: 123521 - RNA, 23 nt, Human
aguuccauaacagccugggcaac

SEQ ID NO: 123522 - RNA, 22 nt, Human
auaauaauaaaagcaauaacaa

SEQ ID NO: 123523 - RNA, 19 nt, Human
auacacauagaauuugucc

SEQ ID NO: 123524 - RNA, 21 nt, Human
aucaccaggucaggaguucga

SEQ ID NO: 123525 - RNA, 24 nt, Human
aucaugccacugcacuccagccug

SEQ ID NO: 123526 - RNA, 22 nt, Human
augauaauaaaagcaauaauaa

SEQ ID NO: 123527 - RNA, 22 nt, Human
augccacugcacuccagccugg

SEQ ID NO: 123528 - RNA, 20 nt, Human
caaaacaaaacaaaauacac

SEQ ID NO: 123529 - RNA, 25 nt, Human
caaagcaaagcaaaacaaaacaaaa

SEQ ID NO: 123530 - RNA, 20 nt, Human
caacauggugaaaccccguc

SEQ ID NO: 123531 - RNA, 22 nt, Human
caacauggugaaaccccgucuc

SEQ ID NO: 123532 - RNA, 24 nt, Human
caacauggugaaaccccgucucua

SEQ ID NO: 123533 - RNA, 19 nt, Human
caagaucagacucucacug

SEQ ID NO: 123534 - RNA, 24 nt, Human
caagggacugaggaggugaaacca

SEQ ID NO: 123535 - RNA, 24 nt, Human
cacaccuuuaaucccagcacuuug

SEQ ID NO: 123536 - RNA, 23 nt, Human
caccggcccugcugugccccgac

SEQ ID NO: 123537 - RNA, 24 nt, Human
caccuguagucccagcuacuuagg

SEQ ID NO: 123538 - RNA, 19 nt, Human
caccuuuaaucccagcacu

SEQ ID NO: 123539 - RNA, 24 nt, Human
caccuuuaaucccagcacuuuggg

SEQ ID NO: 123540 - RNA, 26 nt, Human
caccuuuaaucccagcacuuugggag

SEQ ID NO: 123541 - RNA, 23 nt, Human
cacuccagccuggaugacagagc

SEQ ID NO: 123542 - RNA, 24 nt, Human
cacuccagccuggaugacagagcg

SEQ ID NO: 123543 - RNA, 18 nt, Human
cacugcacuccagccugg

SEQ ID NO: 123544 - RNA, 19 nt, Human
cacugcacuccagccugga

SEQ ID NO: 123545 - RNA, 19 nt, Human
cacugcacuccagccugga

SEQ ID NO: 123546 - RNA, 22 nt, Human
cacugcacuccagccuggauga

SEQ ID NO: 123547 - RNA, 24 nt, Human
cacugcacuccagccuggaugaca

SEQ ID NO: 123548 - RNA, 21 nt, Human
cagcaaaaaaugaagccagga

SEQ ID NO: 123549 - RNA, 22 nt, Human
cagcaaaaaaugaagccaggaa

SEQ ID NO: 123550 - RNA, 29 nt, Human
cagcaaaaaaugaagccaggaaucacagu

SEQ ID NO: 123551 - RNA, 24 nt, Human
cagcacuuugggaggccugggugg

SEQ ID NO: 123552 - RNA, 20 nt, Human
cagggaaagccgaggaggug

SEQ ID NO: 123553 - RNA, 22 nt, Human
caucagcaaaaaaugaagccaa

SEQ ID NO: 123554 - RNA, 19 nt, Human
ccacugcacuccagccugg

SEQ ID NO: 123555 - RNA, 21 nt, Human
ccacugcacuccagccuggau

SEQ ID NO: 123556 - RNA, 24 nt, Human
ccacugcacuccagccuggaugac

SEQ ID NO: 123557 - RNA, 20 nt, Human
ccaucagcaaaaaaugaagc

SEQ ID NO: 123558 - RNA, 19 nt, Human
ccaugccagccucuggacg

SEQ ID NO: 123559 - RNA, 21 nt, Human
cccccgcacugggcccggcuc

SEQ ID NO: 123560 - RNA, 22 nt, Human
cccccgcacugggcccggcucc

SEQ ID NO: 123561 - RNA, 24 nt, Human
ccccgcacugggcccggcuccguc

SEQ ID NO: 123562 - RNA, 23 nt, Human
cccugcgcccccgcacugggccc

SEQ ID NO: 123563 - RNA, 25 nt, Human
ccgccgaccugugaggcggcugcac

SEQ ID NO: 123564 - RNA, 18 nt, Human
ccggcggcgggcgaggag

SEQ ID NO: 123565 - RNA, 21 nt, Human
ccgucucaaaacaaagcaaag

SEQ ID NO: 123566 - RNA, 22 nt, Human
ccugcgcccccgcacugggccc

SEQ ID NO: 123567 - RNA, 22 nt, Human
ccugcuaaggagggaggguggg

SEQ ID NO: 123568 - RNA, 22 nt, Human
ccuggaugacagagcgagacuc

SEQ ID NO: 123569 - RNA, 21 nt, Human
ccuggcccguccgccgaccug

SEQ ID NO: 123570 - RNA, 21 nt, Human
ccugggagauggggguugcag

SEQ ID NO: 123571 - RNA, 23 nt, Human
ccuggucaacauggugaaacccc

SEQ ID NO: 123572 - RNA, 24 nt, Human
ccuggucaacauggugaaaccccg

SEQ ID NO: 123573 - RNA, 21 nt, Human
ccuguagucccagcuacuuag

SEQ ID NO: 123574 - RNA, 24 nt, Human
cgagaccagccuggucaacauggu

SEQ ID NO: 123575 - RNA, 24 nt, Human
cgagaucaugccacugcacuccag

SEQ ID NO: 123576 - RNA, 23 nt, Human
cgagggaaggccaggaaucuugg

SEQ ID NO: 123577 - RNA, 19 nt, Human
cgcagggaaagccgaggag

SEQ ID NO: 123578 - RNA, 18 nt, Human
cgccuggcccguccgccg

SEQ ID NO: 123579 - RNA, 23 nt, Human
cgucucaaaacaaagcaaagcaa

SEQ ID NO: 123580 - RNA, 19 nt, Human
cucaaaacaaagcaaagca

SEQ ID NO: 123581 - RNA, 22 nt, Human
cucacaccuuuaaucccagcac

SEQ ID NO: 123582 - RNA, 24 nt, Human
cucacaccuuuaaucccagcacuu

SEQ ID NO: 123583 - RNA, 20 nt, Human
cucaguacucggcccgcgcc

SEQ ID NO: 123584 - RNA, 20 nt, Human
cuccucacaagcuuccauuc

SEQ ID NO: 123585 - RNA, 19 nt, Human
cugaggccaguuguuucca

SEQ ID NO: 123586 - RNA, 21 nt, Human
cugaggccaguuguuuccaua

SEQ ID NO: 123587 - RNA, 19 nt, Human
cugccggaccggcccuccu

SEQ ID NO: 123588 - RNA, 24 nt, Human
gacagagcgagacuccgucucaaa

SEQ ID NO: 123589 - RNA, 23 nt, Human
gagaaucgcuugaaccugggaga

SEQ ID NO: 123590 - RNA, 27 nt, Human
gaggaggcgcgagccagcugcacccac

SEQ ID NO: 123591 - RNA, 21 nt, Human
gaggaugcaggagagggcuga

SEQ ID NO: 123592 - RNA, 21 nt, Human
gaucaccaggucaggaguucg

SEQ ID NO: 123593 - RNA, 22 nt, Human
gaucaccaggucaggaguucga

SEQ ID NO: 123594 - RNA, 24 nt, Human
gaucaccaggucaggaguucgaga

SEQ ID NO: 123595 - RNA, 23 nt, Human
gaugcaggagagggcugaggugg

SEQ ID NO: 123596 - RNA, 18 nt, Human
gcaaagcaaaacaaaaca

SEQ ID NO: 123597 - RNA, 21 nt, Human
gcaacauagaguccgucuccu

SEQ ID NO: 123598 - RNA, 19 nt, Human
gcacccaccggcccugcug

SEQ ID NO: 123599 - RNA, 24 nt, Human
gcacuccagccuggaugacagagc

SEQ ID NO: 123600 - RNA, 21 nt, Human
gcaggagagggcugagguggg

SEQ ID NO: 123601 - RNA, 20 nt, Human
gccgagaucaugccacugca

SEQ ID NO: 123602 - RNA, 19 nt, Human
gccgggugugguggugagc

SEQ ID NO: 123603 - RNA, 19 nt, Human
gcugaggccaguuguuucc

SEQ ID NO: 123604 - RNA, 18 nt, Human
ggaagaaaccgaaagaaa

SEQ ID NO: 123605 - RNA, 19 nt, Human
ggaccggaggagacggcgg

SEQ ID NO: 123606 - RNA, 24 nt, Human
ggaggcaggagaaucgcuugaacc

SEQ ID NO: 123607 - RNA, 20 nt, Human
ggagggugggaaagcccagg

SEQ ID NO: 123608 - RNA, 22 nt, Human
ggaucacuugacucaggaguuc

SEQ ID NO: 123609 - RNA, 23 nt, Human
ggcaagggacugaggaggugaaa

SEQ ID NO: 123610 - RNA, 23 nt, Human
ggcagaucaccaggucaggaguu

SEQ ID NO: 123611 - RNA, 20 nt, Human
gggcccggcuccgucgaggg

SEQ ID NO: 123612 - RNA, 19 nt, Human
gggguugcagugagccgag

SEQ ID NO: 123613 - RNA, 21 nt, Human
gggguugcagugagccgagau

SEQ ID NO: 123614 - RNA, 22 nt, Human
gggguugcagugagccgagauc

SEQ ID NO: 123615 - RNA, 23 nt, Human
gggguugcagugagccgagauca

SEQ ID NO: 123616 - RNA, 24 nt, Human
gguggcucacaccuuuaaucccag

SEQ ID NO: 123617 - RNA, 24 nt, Human
gguggugagcaccuguagucccag

SEQ ID NO: 123618 - RNA, 20 nt, Human
gguugcagugagccgagauc

SEQ ID NO: 123619 - RNA, 24 nt, Human
gugacguccagcuggugucucaau

SEQ ID NO: 123620 - RNA, 24 nt, Human
guguaggcuggaugugguagguga

SEQ ID NO: 123621 - RNA, 24 nt, Human
guugcagugagccgagaucaugcc

SEQ ID NO: 123622 - RNA, 24 nt, Human
uaaaaaacacacauagggccaggc

SEQ ID NO: 123623 - RNA, 18 nt, Human
uacacauagaauuugucc

SEQ ID NO: 123624 - RNA, 19 nt, Human
uacguguaggcuggaugug

SEQ ID NO: 123625 - RNA, 24 nt, Human
uagggccaggcaugguggcucaca

SEQ ID NO: 123626 - RNA, 18 nt, Human
uaggugacgccuauaauc

SEQ ID NO: 123627 - RNA, 23 nt, Human
uaucacccagugugaaaagcaga

SEQ ID NO: 123628 - RNA, 25 nt, Human
ucaaaacaaagcaaagcaaaacaac

SEQ ID NO: 123629 - RNA, 20 nt, Human
ucaccaggucaggaguucga

SEQ ID NO: 123630 - RNA, 24 nt, Human
ucaccaggucaggaguucgagacc

SEQ ID NO: 123631 - RNA, 22 nt, Human
ucagcaaaaaaugaagccagga

SEQ ID NO: 123632 - RNA, 23 nt, Human
ucagcaaaaaaugaagccaggaa

SEQ ID NO: 123633 - RNA, 23 nt, Human
ucaugccacugcacuccagccug

SEQ ID NO: 123634 - RNA, 20 nt, Human
uccaaguuauuaucacccag

SEQ ID NO: 123635 - RNA, 23 nt, Human
uccagccuggaugacagagcgag

SEQ ID NO: 123636 - RNA, 24 nt, Human
uccagccuggaugacagagcgaga

SEQ ID NO: 123637 - RNA, 18 nt, Human
ucccgcgcccugcgcccc

SEQ ID NO: 123638 - RNA, 23 nt, Human
ucgcuugaaccugggagaugggg

SEQ ID NO: 123639 - RNA, 21 nt, Human
ucucacugggguaggcaaggg

SEQ ID NO: 123640 - RNA, 24 nt, Human
ucucuacuaaaaauacaaaaaauu

SEQ ID NO: 123641 - RNA, 24 nt, Human
ugaaccugggagauggggguugca

SEQ ID NO: 123642 - RNA, 23 nt, Human
ugacucaggaguuccauaacagg

SEQ ID NO: 123643 - RNA, 22 nt, Human
ugagccgagaucaugccacugc

SEQ ID NO: 123644 - RNA, 18 nt, Human
ugaggcggcugcacugcc

SEQ ID NO: 123645 - RNA, 23 nt, Human
ugaggggccuaagagagggcagu

SEQ ID NO: 123646 - RNA, 24 nt, Human
ugaggugggggaggaacaacuggu

SEQ ID NO: 123647 - RNA, 19 nt, Human
ugcacugccggaccggccc

SEQ ID NO: 123648 - RNA, 24 nt, Human
uggcucacaccuuuaaucccagca

SEQ ID NO: 123649 - RNA, 18 nt, Human
ugggagauggggguugca

SEQ ID NO: 123650 - RNA, 24 nt, Human
ugggagauggggguugcagugagc

SEQ ID NO: 123651 - RNA, 23 nt, Human
ugggaggaucacuugacucagga

SEQ ID NO: 123652 - RNA, 20 nt, Human
ugggaggccugggugggcag

SEQ ID NO: 123653 - RNA, 24 nt, Human
ugggaggccugggugggcagauca

SEQ ID NO: 123654 - RNA, 22 nt, Human
ugggugggcagaucaccagguc

SEQ ID NO: 123655 - RNA, 23 nt, Human
ugggugggcagaucaccagguca

SEQ ID NO: 123656 - RNA, 24 nt, Human
ugguggugagcaccuguaguccca

SEQ ID NO: 123657 - RNA, 22 nt, Human
uguacugggagagagauuuggg

SEQ ID NO: 123658 - RNA, 23 nt, Human
uuaaaugaggggccuaagagagg

SEQ ID NO: 123659 - RNA, 18 nt, Human
uuagccgggugugguggu

SEQ ID NO: 123660 - RNA, 24 nt, Human
uuagccgggugugguggugagcac

SEQ ID NO: 123661 - RNA, 20 nt, Human
uuaguaguuaaaaaacacac

SEQ ID NO: 123662 - RNA, 24 nt, Human
uugaaccugggagauggggguugc

SEQ ID NO: 123663 - RNA, 18 nt, Human
uugcagugagccgagauc

SEQ ID NO: 123664 - RNA, 20 nt, Human
uugcagugagccgagaucau

SEQ ID NO: 123665 - RNA, 21 nt, Human
uugcagugagccgagaucaug

SEQ ID NO: 123666 - RNA, 18 nt, Human
uuuuuuuuuuuuuuuuug

SEQ ID NO: 123667 - RNA, 24 nt, Human
aaaaaaaccaacccuuccuucuua

SEQ ID NO: 123668 - RNA, 20 nt, Human
aaaauggucaaaaccuuuaa

SEQ ID NO: 123669 - RNA, 20 nt, Human
aaccaacaugacacacagga

SEQ ID NO: 123670 - RNA, 26 nt, Human
aagaagacaucaaacaucuaaaacca

SEQ ID NO: 123671 - RNA, 23 nt, Human
aauacaaguaccaaaaaccaaca

SEQ ID NO: 123672 - RNA, 22 nt, Human
aauacaauaguuaucuucaauu

SEQ ID NO: 123673 - RNA, 22 nt, Human
acacacccaguguucuaauaca

SEQ ID NO: 123674 - RNA, 22 nt, Human
acacaggaaaaaauaaaagugc

SEQ ID NO: 123675 - RNA, 25 nt, Human
aguaaauaguggaaauacuauauua

SEQ ID NO: 123676 - RNA, 21 nt, Human
auaauuccucauaacaaaaug

SEQ ID NO: 123677 - RNA, 24 nt, Human
auauauuuucaaaacuuugcagag

SEQ ID NO: 123678 - RNA, 33 nt, Human
auuaugccauacuaagaagacaucaaacaucuu

SEQ ID NO: 123679 - RNA, 24 nt, Human
caaaugacaauacaaguaccaaaa

SEQ ID NO: 123680 - RNA, 22 nt, Human
caacaugacacacaggaaaaaa

SEQ ID NO: 123681 - RNA, 21 nt, Human
caaguaccaaaaaccaacaug

SEQ ID NO: 123682 - RNA, 23 nt, Human
cacacaggaaaaaauaaaagugc

SEQ ID NO: 123683 - RNA, 21 nt, Human
cagcacacuaauaaaacauua

SEQ ID NO: 123684 - RNA, 23 nt, Human
cauacuaagaagacaucaaacau

SEQ ID NO: 123685 - RNA, 23 nt, Human
cauguagaaaauggaaaaaaacc

SEQ ID NO: 123686 - RNA, 19 nt, Human
ccaaaaaccaacaugacac

SEQ ID NO: 123687 - RNA, 27 nt, Human
ccaacaugacacacaggaaaaaauaaa

SEQ ID NO: 123688 - RNA, 20 nt, Human
ccagaaaacugcuccgcuga

SEQ ID NO: 123689 - RNA, 23 nt, Human
cuuacuggguccagggaucucca

SEQ ID NO: 123690 - RNA, 22 nt, Human
gaacaacaggauaccucccuca

SEQ ID NO: 123691 - RNA, 21 nt, Human
gaagacaucaaacaucuaaaa

SEQ ID NO: 123692 - RNA, 20 nt, Human
gaaugugauacauguauaau

SEQ ID NO: 123693 - RNA, 24 nt, Human
gacaauacaaguaccaaaaaccaa

SEQ ID NO: 123694 - RNA, 24 nt, Human
gccuuuucgguaagacuuuaagga

SEQ ID NO: 123695 - RNA, 21 nt, Human
guaacauauuccccaagaaaa

SEQ ID NO: 123696 - RNA, 24 nt, Human
uaacaaaauggucaaaaccuuuaa

SEQ ID NO: 123697 - RNA, 24 nt, Human
uaagaacaacaggauaccucccuc

SEQ ID NO: 123698 - RNA, 19 nt, Human
uaagaagacaucaaacauc

SEQ ID NO: 123699 - RNA, 26 nt, Human
uaagaagacaucaaacaucuaaaacc

SEQ ID NO: 123700 - RNA, 19 nt, Human
uaccaaaaaccaacaugac

SEQ ID NO: 123701 - RNA, 20 nt, Human
uaccaaaaaccaacaugaca

SEQ ID NO: 123702 - RNA, 21 nt, Human
uagaaaauggaaaaaaaccaa

SEQ ID NO: 123703 - RNA, 18 nt, Human
uauucuuacuggguccag

SEQ ID NO: 123704 - RNA, 23 nt, Human
uccacaauagauaucugaaaauc

SEQ ID NO: 123705 - RNA, 20 nt, Human
uccauguagaaaauggaaaa

SEQ ID NO: 123706 - RNA, 24 nt, Human
uccauguagaaaauggaaaaaaac

SEQ ID NO: 123707 - RNA, 22 nt, Human
ucccucaacagcacacuaauaa

SEQ ID NO: 123708 - RNA, 19 nt, Human
ucuccaaaugacaauacaa

SEQ ID NO: 123709 - RNA, 23 nt, Human
ucuccaaaugacaauacaaguac

SEQ ID NO: 123710 - RNA, 23 nt, Human
ucuccaaaugacaauacaaguac

SEQ ID NO: 123711 - RNA, 20 nt, Human
ugaaaaaauagcauacaaaa

SEQ ID NO: 123712 - RNA, 23 nt, Human
ugaaaaaauagcauacaaaauca

SEQ ID NO: 123713 - RNA, 21 nt, Human
ugaaaaucuuagcaaugcugu

SEQ ID NO: 123714 - RNA, 24 nt, Human
ugacaauacaaguaccaaaaacca

SEQ ID NO: 123715 - RNA, 25 nt, Human
ugacaauacaaguaccaaaaaccaa

SEQ ID NO: 123716 - RNA, 20 nt, Human
ugagaagagugaguaagaac

SEQ ID NO: 123717 - RNA, 22 nt, Human
ugagcuggguggaggcgcggag

SEQ ID NO: 123718 - RNA, 24 nt, Human
ugccaaaggguucaauaacuuauc

SEQ ID NO: 123719 - RNA, 20 nt, Human
ugcuccgcugaagacugggg

SEQ ID NO: 123720 - RNA, 21 nt, Human
ugcuuuuauuuaaaaaaccaa

SEQ ID NO: 123721 - RNA, 19 nt, Human
uggaaaaaaaccaacccuu

SEQ ID NO: 123722 - RNA, 24 nt, Human
uggaaaaaaaccaacccuuccuuc

SEQ ID NO: 123723 - RNA, 19 nt, Human
uguagaaaauggaaaaaaa

SEQ ID NO: 123724 - RNA, 22 nt, Human
uuaaauuuuuagaaauucugaa

SEQ ID NO: 123725 - RNA, 24 nt, Human
uuagaaaucuuuuauuguuucucc

SEQ ID NO: 123726 - RNA, 25 nt, Human
uucaauucaauauucauugaaagac

SEQ ID NO: 123727 - RNA, 20 nt, Human
uuccauacgaaauccacagc

SEQ ID NO: 123728 - RNA, 20 nt, Human
uuccccaagaaaacagaacu

SEQ ID NO: 123729 - RNA, 19 nt, Human
uugcuuuuauuuaaaaaac

SEQ ID NO: 123730 - RNA, 18 nt, Human
uuuuuuuuuuuuuuuuug

SEQ ID NO: 123731 - RNA, 19 nt, Human
uuuuuuuuuuuuuuuuuug

SEQ ID NO: 123732 - RNA, 23 nt, Human
aaaaaccagcauuucuauaccac

SEQ ID NO: 123733 - RNA, 21 nt, Human
aaacacaagacaaaaauccaa

SEQ ID NO: 123734 - RNA, 23 nt, Human
aaacagcuggggaucauuucuag

SEQ ID NO: 123735 - RNA, 25 nt, Human
aaaucaacccacuccugaaaacuga

SEQ ID NO: 123736 - RNA, 20 nt, Human
aaccgcugguucuccagaug

SEQ ID NO: 123737 - RNA, 21 nt, Human
aacuaaagaaacacaagacaa

SEQ ID NO: 123738 - RNA, 20 nt, Human
aagcaauaaaaacuguacaa

SEQ ID NO: 123739 - RNA, 26 nt, Human
acacaagacaaaaauccaacaagcaa

SEQ ID NO: 123740 - RNA, 19 nt, Human
acaggaaaaacguuccacg

SEQ ID NO: 123741 - RNA, 18 nt, Human
acuccugaaaacugaaaa

SEQ ID NO: 123742 - RNA, 19 nt, Human
agacaaaaauccaacaagc

SEQ ID NO: 123743 - RNA, 26 nt, Human
agacaaaaauccaacaagcaauaaaa

SEQ ID NO: 123744 - RNA, 20 nt, Human
caaaaacuaaagaaacacaa

SEQ ID NO: 123745 - RNA, 20 nt, Human
caacaagcaauaaaaacugu

SEQ ID NO: 123746 - RNA, 24 nt, Human
caacaagcaauaaaaacuguacaa

SEQ ID NO: 123747 - RNA, 21 nt, Human
caagacaaaaauccaacaagc

SEQ ID NO: 123748 - RNA, 20 nt, Human
cacaaaaacuaaagaaacac

SEQ ID NO: 123749 - RNA, 21 nt, Human
cacgucuuaagaacaggaaaa

SEQ ID NO: 123750 - RNA, 19 nt, Human
cacuuugcuaccugcugcc

SEQ ID NO: 123751 - RNA, 20 nt, Human
ccacgagacauacagcaacu

SEQ ID NO: 123752 - RNA, 24 nt, Human
ccacuccugaaaacugaaaaacca

SEQ ID NO: 123753 - RNA, 21 nt, Human
ccaucuucuacagcaaaauca

SEQ ID NO: 123754 - RNA, 23 nt, Human
cggcgucacuuugcuaccugcug

SEQ ID NO: 123755 - RNA, 24 nt, Human
cggcgucacuuugcuaccugcugc

SEQ ID NO: 123756 - RNA, 21 nt, Human
cuaaagaaacacaagacaaaa

SEQ ID NO: 123757 - RNA, 21 nt, Human
cugaaaacugaaaaaccagca

SEQ ID NO: 123758 - RNA, 20 nt, Human
cuuaagaacaggaaaaacgu

SEQ ID NO: 123759 - RNA, 21 nt, Human
gccaucuucuacagcaaaauc

SEQ ID NO: 123760 - RNA, 25 nt, Human
gccuagacacacaucaauaugaaag

SEQ ID NO: 123761 - RNA, 21 nt, Human
gcgucacuuugcuaccugcug

SEQ ID NO: 123762 - RNA, 22 nt, Human
gugccaucuucuacagcaaaau

SEQ ID NO: 123763 - RNA, 25 nt, Human
uaaagaaacacaagacaaaaaucca

SEQ ID NO: 123764 - RNA, 19 nt, Human
uaaccgcugguucuccaga

SEQ ID NO: 123765 - RNA, 25 nt, Human
uaagugccaucuucuacagcaaaau

SEQ ID NO: 123766 - RNA, 21 nt, Human
uaccacgagacauacagcaac

SEQ ID NO: 123767 - RNA, 18 nt, Human
uaccugcugccgcagcca

SEQ ID NO: 123768 - RNA, 19 nt, Human
uaucugaaaaauguguaac

SEQ ID NO: 123769 - RNA, 20 nt, Human
ucacaaaaacuaaagaaaca

SEQ ID NO: 123770 - RNA, 24 nt, Human
ucacgucuuaagaacaggaaaaac

SEQ ID NO: 123771 - RNA, 29 nt, Human
ucugaaaaauguguaacuuaaaaaaaagg

SEQ ID NO: 123772 - RNA, 24 nt, Human
uggccacagguccugccuagacac

SEQ ID NO: 123773 - RNA, 18 nt, Human
uguacacuguaggugcug

SEQ ID NO: 123774 - RNA, 24 nt, Human
uguguaacuuaaaaaaaaguuauu

SEQ ID NO: 123775 - RNA, 27 nt, Human
uguucaguucccuuuucuacaguccua

SEQ ID NO: 123776 - RNA, 24 nt, Human
uuauuaacaacuuaauacaagacu

SEQ ID NO: 123777 - RNA, 18 nt, Human
uuccacgggaauggagag

SEQ ID NO: 123778 - RNA, 23 nt, Human
uuucuagcuuuacgugauucacu

SEQ ID NO: 123779 - RNA, 21 nt, Human
acuucagaaaugcugcuuaga

SEQ ID NO: 123780 - RNA, 23 nt, Human
agccaccaaagaguccacuucag

SEQ ID NO: 123781 - RNA, 21 nt, Human
aggaaggaaaguccuuaaaaa

SEQ ID NO: 123782 - RNA, 22 nt, Human
agucaagccccaaggugaggca

SEQ ID NO: 123783 - RNA, 20 nt, Human
agucagaagagccuucugag

SEQ ID NO: 123784 - RNA, 22 nt, Human
caagccccaaggugaggcagag

SEQ ID NO: 123785 - RNA, 20 nt, Human
caccucuucaaccuucagcc

SEQ ID NO: 123786 - RNA, 21 nt, Human
caccucuucaaccuucagccc

SEQ ID NO: 123787 - RNA, 22 nt, Human
cacuucagaaaugcugcuuaga

SEQ ID NO: 123788 - RNA, 27 nt, Human
cagaagagccuucugagcuugggcacc

SEQ ID NO: 123789 - RNA, 24 nt, Human
cagcaugaguguucaagaagagaa

SEQ ID NO: 123790 - RNA, 19 nt, Human
cauauguguguaugugugu

SEQ ID NO: 123791 - RNA, 20 nt, Human
cauuccauggaccacuggaa

SEQ ID NO: 123792 - RNA, 21 nt, Human
cauuccauggaccacuggaau

SEQ ID NO: 123793 - RNA, 21 nt, Human
ccaaggugaggcagagccuga

SEQ ID NO: 123794 - RNA, 22 nt, Human
ccacaucaagagggcacagcca

SEQ ID NO: 123795 - RNA, 18 nt, Human
ccagugugccaccuacca

SEQ ID NO: 123796 - RNA, 20 nt, Human
ccccaaggugaggcagagcc

SEQ ID NO: 123797 - RNA, 18 nt, Human
cccuugguuucagcauuc

SEQ ID NO: 123798 - RNA, 20 nt, Human
cucugaucuacacucuuugc

SEQ ID NO: 123799 - RNA, 21 nt, Human
cucuucaaccuucagccccag

SEQ ID NO: 123800 - RNA, 24 nt, Human
cucuucaaccuucagccccagucc

SEQ ID NO: 123801 - RNA, 20 nt, Human
cuucugagcuugggcaccca

SEQ ID NO: 123802 - RNA, 25 nt, Human
ggagauggaggaaggaaaguccuua

SEQ ID NO: 123803 - RNA, 23 nt, Human
uaaaaugcaaagccaccaaagag

SEQ ID NO: 123804 - RNA, 23 nt, Human
uaaacaaagccugccucaccaca

SEQ ID NO: 123805 - RNA, 19 nt, Human
uauaaacaaagccugccuc

SEQ ID NO: 123806 - RNA, 22 nt, Human
uauacaaaagucaagccccaag

SEQ ID NO: 123807 - RNA, 20 nt, Human
uauaugacauauguguguau

SEQ ID NO: 123808 - RNA, 21 nt, Human
uauaugacauauguguguaug

SEQ ID NO: 123809 - RNA, 20 nt, Human
uaugacauauguguguaugu

SEQ ID NO: 123810 - RNA, 26 nt, Human
ucaaccuucagccccagucccaauca

SEQ ID NO: 123811 - RNA, 23 nt, Human
ucagccccagucccaaucaagga

SEQ ID NO: 123812 - RNA, 21 nt, Human
ucuuugcccaguagucagaag

SEQ ID NO: 123813 - RNA, 18 nt, Human
ugacauauguguguaugu

SEQ ID NO: 123814 - RNA, 20 nt, Human
ugagaaugcgcaagcuauaa

SEQ ID NO: 123815 - RNA, 21 nt, Human
ugaggcagagccugaucucau

SEQ ID NO: 123816 - RNA, 21 nt, Human
ugccaguuuguuccagagaug

SEQ ID NO: 123817 - RNA, 21 nt, Human
ugccugagaagaagcauucca

SEQ ID NO: 123818 - RNA, 18 nt, Human
ugccugguggugccagca

SEQ ID NO: 123819 - RNA, 18 nt, Human
ugcuaguaauauaugaca

SEQ ID NO: 123820 - RNA, 19 nt, Human
uggagauggaggaaggaaa

SEQ ID NO: 123821 - RNA, 19 nt, Human
ugggcuuucagcaugagug

SEQ ID NO: 123822 - RNA, 22 nt, Human
ugggcuuucagcaugaguguuc

SEQ ID NO: 123823 - RNA, 20 nt, Human
uguauguguguggguauaua

SEQ ID NO: 123824 - RNA, 23 nt, Human
uguauguguguggguauauacau

SEQ ID NO: 123825 - RNA, 20 nt, Human
uguggguauauacauuuaca

SEQ ID NO: 123826 - RNA, 19 nt, Human
uguguguaugugugugggu

SEQ ID NO: 123827 - RNA, 22 nt, Human
uguuccagagaugagcuugcuc

SEQ ID NO: 123828 - RNA, 21 nt, Human
uucacugcugcucugaucuac

SEQ ID NO: 123829 - RNA, 21 nt, Human
uuggagacuuuaacaguuuua

SEQ ID NO: 123830 - RNA, 19 nt, Human
uuuaaaaugcaaagccacc

SEQ ID NO: 123831 - RNA, 23 nt, Human
uuugcacauuuuucaagcauucc

SEQ ID NO: 123832 - RNA, 19 nt, Human
aaaacaaauacugaaaggc

SEQ ID NO: 123833 - RNA, 20 nt, Human
aaaacaaauacugaaaggcu

SEQ ID NO: 123834 - RNA, 21 nt, Human
aaaacacacuggcuugaaaca

SEQ ID NO: 123835 - RNA, 20 nt, Human
aaauguagaggugaaauacg

SEQ ID NO: 123836 - RNA, 22 nt, Human
aacagacacuuaaauauacaug

SEQ ID NO: 123837 - RNA, 22 nt, Human
aagaagcccaguucuggguggc

SEQ ID NO: 123838 - RNA, 25 nt, Human
aagcagcagcagcgguggcagcagc

SEQ ID NO: 123839 - RNA, 23 nt, Human
aagcaugcucuugauuacaagcc

SEQ ID NO: 123840 - RNA, 21 nt, Human
aagcaugggcugacaacacca

SEQ ID NO: 123841 - RNA, 19 nt, Human
aagguaucacuggagcaaa

SEQ ID NO: 123842 - RNA, 20 nt, Human
acaaugcauaguaaacacaa

SEQ ID NO: 123843 - RNA, 27 nt, Human
acacaggagccuuucaagagagcuuca

SEQ ID NO: 123844 - RNA, 22 nt, Human
acaggcaccgggcccuguaccg

SEQ ID NO: 123845 - RNA, 22 nt, Human
accugcaaauuuauucuugacu

SEQ ID NO: 123846 - RNA, 24 nt, Human
acugggugcccagggagcugggac

SEQ ID NO: 123847 - RNA, 18 nt, Human
acuuggugguguuugcuc

SEQ ID NO: 123848 - RNA, 22 nt, Human
agaaaaaacacacuggcuugaa

SEQ ID NO: 123849 - RNA, 18 nt, Human
agaacccaggcaggggca

SEQ ID NO: 123850 - RNA, 18 nt, Human
agaacucucccagccucc

SEQ ID NO: 123851 - RNA, 21 nt, Human
agacaaaccccaaaucaacua

SEQ ID NO: 123852 - RNA, 20 nt, Human
agcagcagcagcgguggcag

SEQ ID NO: 123853 - RNA, 22 nt, Human
agcagcgguggcagcagcagcc

SEQ ID NO: 123854 - RNA, 19 nt, Human
agcgguggcagcagcagcc

SEQ ID NO: 123855 - RNA, 21 nt, Human
agcugggguuguuggccaggg

SEQ ID NO: 123856 - RNA, 21 nt, Human
aggaacagcucgccuuaaccc

SEQ ID NO: 123857 - RNA, 23 nt, Human
aggcaggggcacuucuggugggg

SEQ ID NO: 123858 - RNA, 28 nt, Human
agggagcugggacagaacccaggcaggg

SEQ ID NO: 123859 - RNA, 18 nt, Human
agguggcagcucaggggg

SEQ ID NO: 123860 - RNA, 21 nt, Human
aguaaacacaacucuacugaa

SEQ ID NO: 123861 - RNA, 23 nt, Human
agugccccagcauccugggugac

SEQ ID NO: 123862 - RNA, 22 nt, Human
auagaaaccaucaaagacaaac

SEQ ID NO: 123863 - RNA, 18 nt, Human
auaugcuggcagacagag

SEQ ID NO: 123864 - RNA, 18 nt, Human
augguaaagggaggagga

SEQ ID NO: 123865 - RNA, 22 nt, Human
auuaggaaagagcuagcggaga

SEQ ID NO: 123866 - RNA, 23 nt, Human
caaaacaaauacugaaaggcuuu

SEQ ID NO: 123867 - RNA, 24 nt, Human
caaaacaaauacugaaaggcuuua

SEQ ID NO: 123868 - RNA, 18 nt, Human
caaagacaaaccccaaau

SEQ ID NO: 123869 - RNA, 21 nt, Human
caaauauguacacguagcuug

SEQ ID NO: 123870 - RNA, 22 nt, Human
caaauggacucaucuguuggga

SEQ ID NO: 123871 - RNA, 23 nt, Human
caagguaucacuggagcaaacaa

SEQ ID NO: 123872 - RNA, 24 nt, Human
cacaaaacaaugcauaguaaacac

SEQ ID NO: 123873 - RNA, 22 nt, Human
cacacacugucucugcgccucu

SEQ ID NO: 123874 - RNA, 21 nt, Human
cacagagccuuacaucaaaac

SEQ ID NO: 123875 - RNA, 21 nt, Human
cacguagcuugaaaaaucacc

SEQ ID NO: 123876 - RNA, 21 nt, Human
cagaauucugggcuguggcau

SEQ ID NO: 123877 - RNA, 22 nt, Human
cagcaacggcagaagcagcagc

SEQ ID NO: 123878 - RNA, 23 nt, Human
cagcagcgguggcagcagcagcc

SEQ ID NO: 123879 - RNA, 20 nt, Human
cagcaggcugaagcuggggu

SEQ ID NO: 123880 - RNA, 21 nt, Human
cagcauccugggugacuugcc

SEQ ID NO: 123881 - RNA, 18 nt, Human
cagcucagggggaauauc

SEQ ID NO: 123882 - RNA, 23 nt, Human
caggagccuuucaagagagcuuc

SEQ ID NO: 123883 - RNA, 19 nt, Human
caggggcacuucugguggg

SEQ ID NO: 123884 - RNA, 19 nt, Human
caguuccccugaugcuuuc

SEQ ID NO: 123885 - RNA, 19 nt, Human
cauaugcuggcagacagag

SEQ ID NO: 123886 - RNA, 25 nt, Human
caucaaagacaaaccccaaaucaac

SEQ ID NO: 123887 - RNA, 18 nt, Human
cauuguauaauaaacaca

SEQ ID NO: 123888 - RNA, 18 nt, Human
ccaaucagauggccucug

SEQ ID NO: 123889 - RNA, 27 nt, Human
cccaaaccacagagccuuacaucaaaa

SEQ ID NO: 123890 - RNA, 24 nt, Human
cccaaaucaacuaauaauguuuac

SEQ ID NO: 123891 - RNA, 22 nt, Human
cccaaucagauggccucugaag

SEQ ID NO: 123892 - RNA, 19 nt, Human
ccccagcauccugggugac

SEQ ID NO: 123893 - RNA, 20 nt, Human
cccccccaaaccacagagcc

SEQ ID NO: 123894 - RNA, 26 nt, Human
cccuguaccgggcucugccugaggcu

SEQ ID NO: 123895 - RNA, 22 nt, Human
ccucaaguugcacacccagucu

SEQ ID NO: 123896 - RNA, 19 nt, Human
ccucugaaggcaggccugg

SEQ ID NO: 123897 - RNA, 22 nt, Human
ccuggagcuuucugggcuccug

SEQ ID NO: 123898 - RNA, 24 nt, Human
ccuguaccgggcucugccugaggc

SEQ ID NO: 123899 - RNA, 18 nt, Human
cucaaauuguaacgggag

SEQ ID NO: 123900 - RNA, 21 nt, Human
cucauugcagucaggugacga

SEQ ID NO: 123901 - RNA, 20 nt, Human
cucccaaaucuggagaacuc

SEQ ID NO: 123902 - RNA, 23 nt, Human
cucucggucugaaugguaaaggg

SEQ ID NO: 123903 - RNA, 23 nt, Human
cugaggcucuggcugcccagcag

SEQ ID NO: 123904 - RNA, 22 nt, Human
cugcugccgcugugacccaugc

SEQ ID NO: 123905 - RNA, 20 nt, Human
cuggaaguggucuucuucuu

SEQ ID NO: 123906 - RNA, 20 nt, Human
cugggcuccugacgauuucc

SEQ ID NO: 123907 - RNA, 19 nt, Human
cugggguuguuggccaggg

SEQ ID NO: 123908 - RNA, 21 nt, Human
cuucuggugggguggccuugg

SEQ ID NO: 123909 - RNA, 25 nt, Human
cuucuuucccgauuccuggagcuuu

SEQ ID NO: 123910 - RNA, 22 nt, Human
cuuuaaaccaggaacagcucgc

SEQ ID NO: 123911 - RNA, 18 nt, Human
gaaacuggaaguggucuu

SEQ ID NO: 123912 - RNA, 20 nt, Human
gaccugggaacuggcuggca

SEQ ID NO: 123913 - RNA, 18 nt, Human
gagaggaugggacacugg

SEQ ID NO: 123914 - RNA, 18 nt, Human
gaggaugggacacugggg

SEQ ID NO: 123915 - RNA, 20 nt, Human
gcaaaagagauuaagaauca

SEQ ID NO: 123916 - RNA, 20 nt, Human
gcaacggcagaagcagcagc

SEQ ID NO: 123917 - RNA, 18 nt, Human
gcagcagcagcgguggca

SEQ ID NO: 123918 - RNA, 20 nt, Human
gccagauuucaaauguagag

SEQ ID NO: 123919 - RNA, 21 nt, Human
gcucuggcugcccagcaggcu

SEQ ID NO: 123920 - RNA, 23 nt, Human
ggaaaaccauuuacaaaauuuuc

SEQ ID NO: 123921 - RNA, 19 nt, Human
ggagaacucucccagccuc

SEQ ID NO: 123922 - RNA, 21 nt, Human
ggaugggacacugggggcugg

SEQ ID NO: 123923 - RNA, 21 nt, Human
ggcaccgggcccuguaccggg

SEQ ID NO: 123924 - RNA, 26 nt, Human
ggcgaaauggggaagcaugcucuuga

SEQ ID NO: 123925 - RNA, 23 nt, Human
gggguuggggcuggcgcaaaaag

SEQ ID NO: 123926 - RNA, 24 nt, Human
ggguauggaucgacaccacuuccu

SEQ ID NO: 123927 - RNA, 21 nt, Human
gggugcacacaagcugggcuu

SEQ ID NO: 123928 - RNA, 19 nt, Human
gguagagagagggauaagc

SEQ ID NO: 123929 - RNA, 18 nt, Human
ggugcccagggagcuggg

SEQ ID NO: 123930 - RNA, 23 nt, Human
gucuggaaacuggaaguggucuu

SEQ ID NO: 123931 - RNA, 19 nt, Human
gucuggccugagugugaga

SEQ ID NO: 123932 - RNA, 23 nt, Human
guucuggguggcaucaagugcuu

SEQ ID NO: 123933 - RNA, 23 nt, Human
uaaaacagcuucugcuguaaagc

SEQ ID NO: 123934 - RNA, 18 nt, Human
uaaacacaaaacaaugca

SEQ ID NO: 123935 - RNA, 27 nt, Human
uaaaccaggaacagcucgccuuaaccc

SEQ ID NO: 123936 - RNA, 20 nt, Human
uaaagugccccagcauccuu

SEQ ID NO: 123937 - RNA, 22 nt, Human
uacagaacgaagaaaaaacaca

SEQ ID NO: 123938 - RNA, 24 nt, Human
uacagaacgaagaaaaaacacacu

SEQ ID NO: 123939 - RNA, 22 nt, Human
uacaggcaccgggcccuguacc

SEQ ID NO: 123940 - RNA, 24 nt, Human
uacccugcuggaggaacuuggugg

SEQ ID NO: 123941 - RNA, 18 nt, Human
uacucuagcuccuccagg

SEQ ID NO: 123942 - RNA, 22 nt, Human
uagaaaccaucaaagacaaacc

SEQ ID NO: 123943 - RNA, 19 nt, Human
uagaggugaaauacgaggu

SEQ ID NO: 123944 - RNA, 18 nt, Human
uaugcuggcagacagagu

SEQ ID NO: 123945 - RNA, 19 nt, Human
ucacacaaggcaauaggau

SEQ ID NO: 123946 - RNA, 20 nt, Human
uccacgagggcuucuuuccc

SEQ ID NO: 123947 - RNA, 21 nt, Human
ucuaugggcauccugcucaga

SEQ ID NO: 123948 - RNA, 24 nt, Human
ucuccuguuaacaguuccccugau

SEQ ID NO: 123949 - RNA, 21 nt, Human
ucugccugaggcucuggcugc

SEQ ID NO: 123950 - RNA, 20 nt, Human
ucugggcuguggcauuuuga

SEQ ID NO: 123951 - RNA, 19 nt, Human
ucuucaucugggcucacac

SEQ ID NO: 123952 - RNA, 23 nt, Human
ugaaaggcuuuaaaccaggaaca

SEQ ID NO: 123953 - RNA, 21 nt, Human
ugagaaaaguuuacaggacag

SEQ ID NO: 123954 - RNA, 23 nt, Human
ugagaaaaguuuacaggacagug

SEQ ID NO: 123955 - RNA, 21 nt, Human
ugagaggaugggacacugggg

SEQ ID NO: 123956 - RNA, 27 nt, Human
ugagaggaugggacacugggggcugga

SEQ ID NO: 123957 - RNA, 18 nt, Human
ugagcugguggggacuca

SEQ ID NO: 123958 - RNA, 19 nt, Human
ugaggcucuggcugcccag

SEQ ID NO: 123959 - RNA, 21 nt, Human
ugcccagcaggcugaagcugg

SEQ ID NO: 123960 - RNA, 23 nt, Human
ugcccaggggagucuggccugag

SEQ ID NO: 123961 - RNA, 18 nt, Human
ugccccagcauccugggu

SEQ ID NO: 123962 - RNA, 20 nt, Human
ugcuacaggcaccgggcccu

SEQ ID NO: 123963 - RNA, 19 nt, Human
ugcuguaaagcucauuagg

SEQ ID NO: 123964 - RNA, 24 nt, Human
uggcagcaacggcagaagcagcag

SEQ ID NO: 123965 - RNA, 19 nt, Human
uggccagaaggugagugcu

SEQ ID NO: 123966 - RNA, 20 nt, Human
uggccauacccugcuggagg

SEQ ID NO: 123967 - RNA, 24 nt, Human
ugggacagaacccaggcaggggca

SEQ ID NO: 123968 - RNA, 23 nt, Human
ugggcuccugacgauuucccacc

SEQ ID NO: 123969 - RNA, 21 nt, Human
ugggugacuugcccagaauuc

SEQ ID NO: 123970 - RNA, 20 nt, Human
uguuuacagauguucccccc

SEQ ID NO: 123971 - RNA, 22 nt, Human
uguuuacagauguuccccccca

SEQ ID NO: 123972 - RNA, 24 nt, Human
uuaacaguuccccugaugcuuucu

SEQ ID NO: 123973 - RNA, 22 nt, Human
uuccuggagcuuucugggcucc

SEQ ID NO: 123974 - RNA, 22 nt, Human
uucuaugggcauccugcucaga

SEQ ID NO: 123975 - RNA, 25 nt, Human
uucuuccugggcugcucuuguagag

SEQ ID NO: 123976 - RNA, 19 nt, Human
uuuacagauguuccccccc

SEQ ID NO: 123977 - RNA, 21 nt, Human
aaaaggcacacaucagagaga

SEQ ID NO: 123978 - RNA, 22 nt, Human
agguaguguauuagagcagagc

SEQ ID NO: 123979 - RNA, 21 nt, Human
auaaggaaaagacuuucucca

SEQ ID NO: 123980 - RNA, 23 nt, Human
caaaaggcacacaucagagagac

SEQ ID NO: 123981 - RNA, 21 nt, Human
caagagaaaaugagagacucg

SEQ ID NO: 123982 - RNA, 19 nt, Human
cgaccguccaucgcugcuc

SEQ ID NO: 123983 - RNA, 20 nt, Human
cgggugaugaggaacgucac

SEQ ID NO: 123984 - RNA, 19 nt, Human
cguccacgaacauguagga

SEQ ID NO: 123985 - RNA, 24 nt, Human
gagcagaaugcagggguuacugug

SEQ ID NO: 123986 - RNA, 21 nt, Human
gccggaucggcaaggccagga

SEQ ID NO: 123987 - RNA, 23 nt, Human
ggcaaaacuaacugguccacaag

SEQ ID NO: 123988 - RNA, 19 nt, Human
ggugaugaggaacgucacc

SEQ ID NO: 123989 - RNA, 18 nt, Human
guccacaagagaaaauga

SEQ ID NO: 123990 - RNA, 18 nt, Human
ucacccacugcagggcgg

SEQ ID NO: 123991 - RNA, 24 nt, Human
ucagagagacaguugcaaacucag

SEQ ID NO: 123992 - RNA, 18 nt, Human
ucauugaggagggggcuc

SEQ ID NO: 123993 - RNA, 24 nt, Human
uccacaagagaaaaugagagacuc

SEQ ID NO: 123994 - RNA, 20 nt, Human
ucgcuggagaacguguucuc

SEQ ID NO: 123995 - RNA, 21 nt, Human
ucugcacgaugaacuccggga

SEQ ID NO: 123996 - RNA, 21 nt, Human
uuucuuuucaauaaugucuga

SEQ ID NO: 123997 - RNA, 24 nt, Human
uuuuuuuuuuuuuuuuuuucuuuu

SEQ ID NO: 123998 - RNA, 21 nt, Human
aaagaaagagauauauuaaaa

SEQ ID NO: 123999 - RNA, 20 nt, Human
aagaaagagauauauuaaaa

SEQ ID NO: 124000 - RNA, 23 nt, Human
aagaaagagauauauuaaaauca

SEQ ID NO: 124001 - RNA, 19 nt, Human
aaggacaguucuuuuuguu

SEQ ID NO: 124002 - RNA, 20 nt, Human
aaggcgacggccacugcaga

SEQ ID NO: 124003 - RNA, 20 nt, Human
aauaaaaaggcacacucgaa

SEQ ID NO: 124004 - RNA, 23 nt, Human
aauaaaaaggcacacucgaaaaa

SEQ ID NO: 124005 - RNA, 19 nt, Human
agagauggcagggaucacc

SEQ ID NO: 124006 - RNA, 24 nt, Human
agcaggcucuuccugcgcugacuu

SEQ ID NO: 124007 - RNA, 27 nt, Human
aucaauaguagugauaagaguuuccuu

SEQ ID NO: 124008 - RNA, 22 nt, Human
augucggaagaaaaagaaagag

SEQ ID NO: 124009 - RNA, 20 nt, Human
caaaauaaaguagaugaaua

SEQ ID NO: 124010 - RNA, 25 nt, Human
caauggcuucuuuucucccgugucc

SEQ ID NO: 124011 - RNA, 23 nt, Human
cacucgaaaaauuugagcgcaga

SEQ ID NO: 124012 - RNA, 24 nt, Human
cccguguccaaagcaggccggggc

SEQ ID NO: 124013 - RNA, 18 nt, Human
cggaagaaaaagaaagag

SEQ ID NO: 124014 - RNA, 22 nt, Human
cuagaaucaauaguagugauaa

SEQ ID NO: 124015 - RNA, 24 nt, Human
gacaguucuuuuuguuuuguuucu

SEQ ID NO: 124016 - RNA, 21 nt, Human
gaguuuccuugaaacaccgcc

SEQ ID NO: 124017 - RNA, 22 nt, Human
guaguuagcaauggcuucuuuu

SEQ ID NO: 124018 - RNA, 22 nt, Human
uaaaguagaugaauaaaaaggc

SEQ ID NO: 124019 - RNA, 23 nt, Human
uacacauuaaggaaacaucaaaa

SEQ ID NO: 124020 - RNA, 19 nt, Human
ucaauaguagugauaagaa

SEQ ID NO: 124021 - RNA, 20 nt, Human
uccaccaacuggaacuagaa

SEQ ID NO: 124022 - RNA, 23 nt, Human
aaaaucccacccaaucacagaaa

SEQ ID NO: 124023 - RNA, 21 nt, Human
aaccuugcuuucaccaccaac

SEQ ID NO: 124024 - RNA, 20 nt, Human
aagcagaggaggcggagacc

SEQ ID NO: 124025 - RNA, 22 nt, Human
aagguaccccccauccccaacc

SEQ ID NO: 124026 - RNA, 24 nt, Human
aagguaccccccauccccaacccc

SEQ ID NO: 124027 - RNA, 24 nt, Human
aagguaccccccauccccaacccc

SEQ ID NO: 124028 - RNA, 19 nt, Human
aaguagcugggacuacagg

SEQ ID NO: 124029 - RNA, 20 nt, Human
aaguagcugggacuacaggc

SEQ ID NO: 124030 - RNA, 21 nt, Human
acagaaaaggcauccucugua

SEQ ID NO: 124031 - RNA, 24 nt, Human
acaggccccccgagauguacacac

SEQ ID NO: 124032 - RNA, 21 nt, Human
acaggcgcccaccaccacgcc

SEQ ID NO: 124033 - RNA, 22 nt, Human
accccccauccccaacccccau

SEQ ID NO: 124034 - RNA, 25 nt, Human
accccgcgaacccccagggccggcc

SEQ ID NO: 124035 - RNA, 20 nt, Human
acgggguuucacuguguuug

SEQ ID NO: 124036 - RNA, 21 nt, Human
acgggguuucacuguguuugu

SEQ ID NO: 124037 - RNA, 24 nt, Human
acgggguuucacuguguuuguuag

SEQ ID NO: 124038 - RNA, 24 nt, Human
agagaccugucucccaaguagcug

SEQ ID NO: 124039 - RNA, 22 nt, Human
agauaugcacagcccccccccg

SEQ ID NO: 124040 - RNA, 18 nt, Human
agaucugugcucugcgac

SEQ ID NO: 124041 - RNA, 19 nt, Human
agaugcggacacagccacc

SEQ ID NO: 124042 - RNA, 23 nt, Human
agaugcggacacagccaccccgc

SEQ ID NO: 124043 - RNA, 21 nt, Human
agcagaggaggcggagaccug

SEQ ID NO: 124044 - RNA, 21 nt, Human
agcagcuccagcagccccagg

SEQ ID NO: 124045 - RNA, 20 nt, Human
agcaggggcaggcaagaaga

SEQ ID NO: 124046 - RNA, 18 nt, Human
agcccccgcggaugcacc

SEQ ID NO: 124047 - RNA, 18 nt, Human
agccugcaguccugaaga

SEQ ID NO: 124048 - RNA, 21 nt, Human
agcggagaaacgagaagcaga

SEQ ID NO: 124049 - RNA, 19 nt, Human
aggcaagaagacaccccgc

SEQ ID NO: 124050 - RNA, 19 nt, Human
aggcagcagcuccagcagc

SEQ ID NO: 124051 - RNA, 20 nt, Human
aggccgaagccaaaugguga

SEQ ID NO: 124052 - RNA, 21 nt, Human
aggcggagaccugccccagaa

SEQ ID NO: 124053 - RNA, 22 nt, Human
aguaaggucaggacuacagcug

SEQ ID NO: 124054 - RNA, 23 nt, Human
aguagcugggacuacaggcgccc

SEQ ID NO: 124055 - RNA, 19 nt, Human
auaaaaagggaaaaaaucc

SEQ ID NO: 124056 - RNA, 21 nt, Human
caagaagacaccccgcgaacc

SEQ ID NO: 124057 - RNA, 25 nt, Human
caagguaccccccauccccaacccc

SEQ ID NO: 124058 - RNA, 30 nt, Human
cacacagcaccccccagaugcgagcagccu

SEQ ID NO: 124059 - RNA, 20 nt, Human
cacagcccccccccgaaaug

SEQ ID NO: 124060 - RNA, 27 nt, Human
cacagccucaucucacagcuucccagg

SEQ ID NO: 124061 - RNA, 18 nt, Human
cacaugucccccccuagg

SEQ ID NO: 124062 - RNA, 25 nt, Human
cacccacgcgcccgccugcugccag

SEQ ID NO: 124063 - RNA, 25 nt, Human
caccccccccggguugcgcacagcc

SEQ ID NO: 124064 - RNA, 22 nt, Human
caccccgcgaacccccagggcc

SEQ ID NO: 124065 - RNA, 22 nt, Human
caccccucaagaugcgcacagc

SEQ ID NO: 124066 - RNA, 18 nt, Human
cagaacagaggcagcagc

SEQ ID NO: 124067 - RNA, 18 nt, Human
cagagacacgggagccac

SEQ ID NO: 124068 - RNA, 21 nt, Human
cagagauaagcacgugucccc

SEQ ID NO: 124069 - RNA, 23 nt, Human
cagagccugggugagccugggag

SEQ ID NO: 124070 - RNA, 25 nt, Human
cagaggcagcagcuccagcagcccc

SEQ ID NO: 124071 - RNA, 20 nt, Human
cagcagcuccagcagcccca

SEQ ID NO: 124072 - RNA, 21 nt, Human
cagcagcuccagcagccccag

SEQ ID NO: 124073 - RNA, 22 nt, Human
cagcaggggcaggcaagaagac

SEQ ID NO: 124074 - RNA, 20 nt, Human
caggaaggggcugcaaggua

SEQ ID NO: 124075 - RNA, 25 nt, Human
caggaccgaacacccgaagucuacc

SEQ ID NO: 124076 - RNA, 25 nt, Human
caggcaagaagacaccccgcgaacc

SEQ ID NO: 124077 - RNA, 21 nt, Human
caggcgcccaccaccacgccu

SEQ ID NO: 124078 - RNA, 22 nt, Human
cagucccuccccucuccugggg

SEQ ID NO: 124079 - RNA, 21 nt, Human
cauaaaaagggaaaaaauccc

SEQ ID NO: 124080 - RNA, 22 nt, Human
cauaaaaagggaaaaaauccca

SEQ ID NO: 124081 - RNA, 19 nt, Human
cauccccaacccccauguc

SEQ ID NO: 124082 - RNA, 19 nt, Human
cauccuagggcuaaagggu

SEQ ID NO: 124083 - RNA, 19 nt, Human
ccacagccagcagcagcgg

SEQ ID NO: 124084 - RNA, 21 nt, Human
ccacguguuauucaggcugga

SEQ ID NO: 124085 - RNA, 21 nt, Human
ccagcagccccagggggcucu

SEQ ID NO: 124086 - RNA, 20 nt, Human
ccaggaccgaacacccgaag

SEQ ID NO: 124087 - RNA, 24 nt, Human
ccaggggccagucccuccccucuc

SEQ ID NO: 124088 - RNA, 19 nt, Human
ccagggggcucuagccaca

SEQ ID NO: 124089 - RNA, 23 nt, Human
cccaaguagcugggacuacaggc

SEQ ID NO: 124090 - RNA, 23 nt, Human
cccaaguagcugggacuacaggc

SEQ ID NO: 124091 - RNA, 22 nt, Human
cccacgcgcccgccugcugcca

SEQ ID NO: 124092 - RNA, 21 nt, Human
cccaggggccagucccucccc

SEQ ID NO: 124093 - RNA, 26 nt, Human
cccaugucuggagcagccugggagga

SEQ ID NO: 124094 - RNA, 19 nt, Human
ccccaagaugcacaggccc

SEQ ID NO: 124095 - RNA, 23 nt, Human
ccccagaugcgagcagccccccu

SEQ ID NO: 124096 - RNA, 22 nt, Human
ccccauccccaacccccauguc

SEQ ID NO: 124097 - RNA, 24 nt, Human
ccccauccccaacccccaugucug

SEQ ID NO: 124098 - RNA, 20 nt, Human
cccccagauaugcacagccc

SEQ ID NO: 124099 - RNA, 24 nt, Human
ccccccaagaugcacaggcccccc

SEQ ID NO: 124100 - RNA, 24 nt, Human
ccccccauccccaacccccauguc

SEQ ID NO: 124101 - RNA, 21 nt, Human
cccccccgagaugcacacagc

SEQ ID NO: 124102 - RNA, 25 nt, Human
ccccccgagaugcacacagcacccc

SEQ ID NO: 124103 - RNA, 22 nt, Human
ccccccgagauguacacacccc

SEQ ID NO: 124104 - RNA, 24 nt, Human
ccccccggguugcgcacagccccc

SEQ ID NO: 124105 - RNA, 21 nt, Human
cccccggguugcgcacagccc

SEQ ID NO: 124106 - RNA, 20 nt, Human
cccccugcacccacgcgccc

SEQ ID NO: 124107 - RNA, 21 nt, Human
cccccugcacccacgcgcccg

SEQ ID NO: 124108 - RNA, 20 nt, Human
ccccugggccuugccccagg

SEQ ID NO: 124109 - RNA, 23 nt, Human
ccgaacacccgaagucuacccaa

SEQ ID NO: 124110 - RNA, 21 nt, Human
ccucugccucccagccugagc

SEQ ID NO: 124111 - RNA, 22 nt, Human
ccugcaguccugaagacgccuc

SEQ ID NO: 124112 - RNA, 27 nt, Human
ccugcugccagagccacucuccggagc

SEQ ID NO: 124113 - RNA, 22 nt, Human
ccugggagaggaaaccagagcu

SEQ ID NO: 124114 - RNA, 19 nt, Human
ccuugccccaggcaucuac

SEQ ID NO: 124115 - RNA, 23 nt, Human
ccuuguuugaauucagcaggcca

SEQ ID NO: 124116 - RNA, 21 nt, Human
cgaaaugcgcacagccgcccc

SEQ ID NO: 124117 - RNA, 27 nt, Human
cgaacacccgaagucuacccaaagccu

SEQ ID NO: 124118 - RNA, 22 nt, Human
cgaccaggaccgaacacccgaa

SEQ ID NO: 124119 - RNA, 21 nt, Human
cgagaugcacacagcaccccc

SEQ ID NO: 124120 - RNA, 19 nt, Human
cgagaugcgcacagccccc

SEQ ID NO: 124121 - RNA, 19 nt, Human
cgcgcaacaccccccccgg

SEQ ID NO: 124122 - RNA, 23 nt, Human
cgcgcaacaccccccccggguug

SEQ ID NO: 124123 - RNA, 21 nt, Human
cgcggaugcacacagcccccc

SEQ ID NO: 124124 - RNA, 18 nt, Human
cgcuucuuuaaagaucug

SEQ ID NO: 124125 - RNA, 19 nt, Human
cggagaaacgagaagcaga

SEQ ID NO: 124126 - RNA, 22 nt, Human
cggaugcacacagccccccaag

SEQ ID NO: 124127 - RNA, 28 nt, Human
cgggguuucacuguguuuguuagucagg

SEQ ID NO: 124128 - RNA, 21 nt, Human
cuacccaaagccuucugcacu

SEQ ID NO: 124129 - RNA, 24 nt, Human
cucacagcuucccaggggccaguc

SEQ ID NO: 124130 - RNA, 20 nt, Human
cucagcaggggcaggcaaga

SEQ ID NO: 124131 - RNA, 19 nt, Human
cuccagcagccccaggggg

SEQ ID NO: 124132 - RNA, 21 nt, Human
cucccaccaaagccauccuag

SEQ ID NO: 124133 - RNA, 21 nt, Human
cuccuggccucgcacacgauc

SEQ ID NO: 124134 - RNA, 20 nt, Human
cucuccggagccugcagucc

SEQ ID NO: 124135 - RNA, 19 nt, Human
cucugccaaaggccgggcc

SEQ ID NO: 124136 - RNA, 27 nt, Human
cugcacugaagggggcaacagagacac

SEQ ID NO: 124137 - RNA, 20 nt, Human
cuggaaagaugggcagcaga

SEQ ID NO: 124138 - RNA, 18 nt, Human
cuggagcagccugggagg

SEQ ID NO: 124139 - RNA, 22 nt, Human
cuugcuccucugccaaaggccg

SEQ ID NO: 124140 - RNA, 20 nt, Human
gaaaugcgcacagccgcccc

SEQ ID NO: 124141 - RNA, 21 nt, Human
gaacacccgaagucuacccaa

SEQ ID NO: 124142 - RNA, 18 nt, Human
gaacccccagggccggcc

SEQ ID NO: 124143 - RNA, 21 nt, Human
gaagcagaggaggcggagacc

SEQ ID NO: 124144 - RNA, 21 nt, Human
gacuacagcugggccacagcc

SEQ ID NO: 124145 - RNA, 20 nt, Human
gaggaggccugccugcaucu

SEQ ID NO: 124146 - RNA, 21 nt, Human
gaugcgcgcaacacccccccc

SEQ ID NO: 124147 - RNA, 22 nt, Human
gcaagaaagagcagagcucaga

SEQ ID NO: 124148 - RNA, 21 nt, Human
gcaggcaagaagacaccccgc

SEQ ID NO: 124149 - RNA, 18 nt, Human
gccucaucucacagcuuc

SEQ ID NO: 124150 - RNA, 24 nt, Human
gccucccagccugagcagagccug

SEQ ID NO: 124151 - RNA, 24 nt, Human
gccuggcuaauuuuuuuguauuuu

SEQ ID NO: 124152 - RNA, 19 nt, Human
gcgcccgccugcugccaga

SEQ ID NO: 124153 - RNA, 21 nt, Human
gcggagaaacgagaagcagag

SEQ ID NO: 124154 - RNA, 21 nt, Human
gcggagaaacgagaagcagag

SEQ ID NO: 124155 - RNA, 18 nt, Human
gcggaugcacacagcccc

SEQ ID NO: 124156 - RNA, 22 nt, Human
gcuaguuauccaccgcuucucc

SEQ ID NO: 124157 - RNA, 24 nt, Human
gcuaguuauccaccgcuucuccaa

SEQ ID NO: 124158 - RNA, 25 nt, Human
ggaaaaaaucccacccaaucacaga

SEQ ID NO: 124159 - RNA, 18 nt, Human
ggagcagccugggaggag

SEQ ID NO: 124160 - RNA, 23 nt, Human
ggcauccucuguauguuuccugc

SEQ ID NO: 124161 - RNA, 23 nt, Human
ggccugucccugaggccccccca

SEQ ID NO: 124162 - RNA, 23 nt, Human
guagagacgggguuucacugugu

SEQ ID NO: 124163 - RNA, 24 nt, Human
gucuggagcagccugggaggaggc

SEQ ID NO: 124164 - RNA, 20 nt, Human
gucuugaucuccuggccucg

SEQ ID NO: 124165 - RNA, 23 nt, Human
gugagccugggagaggaaaccag

SEQ ID NO: 124166 - RNA, 24 nt, Human
gugccacguguuauucaggcugga

SEQ ID NO: 124167 - RNA, 23 nt, Human
guggccuuuccaggccugucccu

SEQ ID NO: 124168 - RNA, 22 nt, Human
uaaaaaauuauaagguuugugc

SEQ ID NO: 124169 - RNA, 21 nt, Human
uaaaaagggaaaaaaucccac

SEQ ID NO: 124170 - RNA, 21 nt, Human
uaaagaagaguaaggucagga

SEQ ID NO: 124171 - RNA, 26 nt, Human
uaauuuuuuuguauuuuuaguagaga

SEQ ID NO: 124172 - RNA, 19 nt, Human
uacaaggagggagccccag

SEQ ID NO: 124173 - RNA, 19 nt, Human
uagaugcaacagccccccc

SEQ ID NO: 124174 - RNA, 23 nt, Human
uagaugcgcgcaacacccccccc

SEQ ID NO: 124175 - RNA, 19 nt, Human
uagccacagccagcagcag

SEQ ID NO: 124176 - RNA, 19 nt, Human
uaggaugcgcacagccccu

SEQ ID NO: 124177 - RNA, 20 nt, Human
uaguagagacgggguuucac

SEQ ID NO: 124178 - RNA, 24 nt, Human
uaguagagacgggguuucacugug

SEQ ID NO: 124179 - RNA, 22 nt, Human
uauccccucucccaccaaagcc

SEQ ID NO: 124180 - RNA, 22 nt, Human
uauucaggcuggagggacuccu

SEQ ID NO: 124181 - RNA, 23 nt, Human
ucaggacuacagcugggccacag

SEQ ID NO: 124182 - RNA, 19 nt, Human
uccacauaaaaagggaaaa

SEQ ID NO: 124183 - RNA, 22 nt, Human
uccagaacagaggcagcagcuc

SEQ ID NO: 124184 - RNA, 21 nt, Human
uccagaugcggacacagccac

SEQ ID NO: 124185 - RNA, 24 nt, Human
ucccaaguagcugggacuacaggc

SEQ ID NO: 124186 - RNA, 24 nt, Human
uccccccagauaugcacagccccc

SEQ ID NO: 124187 - RNA, 20 nt, Human
uccguagagaccugucuccc

SEQ ID NO: 124188 - RNA, 19 nt, Human
uccugacuuccuggaaaga

SEQ ID NO: 124189 - RNA, 23 nt, Human
ucuccuggggaaccuugcuuuca

SEQ ID NO: 124190 - RNA, 21 nt, Human
ucugccaaaggccgggcccau

SEQ ID NO: 124191 - RNA, 27 nt, Human
ucugcgaccaggaccgaaccggggucc

SEQ ID NO: 124192 - RNA, 22 nt, Human
ugaagacgccucagcaggggca

SEQ ID NO: 124193 - RNA, 25 nt, Human
ugagcagagccugggugagccuggg

SEQ ID NO: 124194 - RNA, 22 nt, Human
ugagccugggagaggaaaccag

SEQ ID NO: 124195 - RNA, 26 nt, Human
ugaggcccccccaguuuccccugggc

SEQ ID NO: 124196 - RNA, 19 nt, Human
ugcaagguaccccccaucc

SEQ ID NO: 124197 - RNA, 18 nt, Human
ugccaaaggccgggccca

SEQ ID NO: 124198 - RNA, 23 nt, Human
ugccacguguuauucaggcugga

SEQ ID NO: 124199 - RNA, 19 nt, Human
ugccccaggcaucuacuac

SEQ ID NO: 124200 - RNA, 22 nt, Human
ugcgagcagccccccugagaug

SEQ ID NO: 124201 - RNA, 23 nt, Human
ugcggacacagccaccccgcgua

SEQ ID NO: 124202 - RNA, 22 nt, Human
ugcuagaugcgcgcaacacccc

SEQ ID NO: 124203 - RNA, 24 nt, Human
uggcuaguuauccaccgcuucucc

SEQ ID NO: 124204 - RNA, 21 nt, Human
ugggacuacaggcgcccacca

SEQ ID NO: 124205 - RNA, 24 nt, Human
ugggacuacaggcgcccaccacca

SEQ ID NO: 124206 - RNA, 21 nt, Human
uguauguuuccugcggaaugc

SEQ ID NO: 124207 - RNA, 21 nt, Human
uguauuuuuaguagagacggg

SEQ ID NO: 124208 - RNA, 19 nt, Human
ugucugaagucaugggcuu

SEQ ID NO: 124209 - RNA, 22 nt, Human
ugugcagacacccacgggggau

SEQ ID NO: 124210 - RNA, 18 nt, Human
uguuagucaggauggucu

SEQ ID NO: 124211 - RNA, 18 nt, Human
uuaguagagacgggguuu

SEQ ID NO: 124212 - RNA, 21 nt, Human
uuaguagagacgggguuucac

SEQ ID NO: 124213 - RNA, 21 nt, Human
uuaguagagacgggguuucac

SEQ ID NO: 124214 - RNA, 24 nt, Human
uuaguagagacgggguuucacugu

SEQ ID NO: 124215 - RNA, 23 nt, Human
uucacuuuuauuaugaacaaaca

SEQ ID NO: 124216 - RNA, 19 nt, Human
uuccccugggccuugcccc

SEQ ID NO: 124217 - RNA, 23 nt, Human
uuguauuuuuaguagagacgggg

SEQ ID NO: 124218 - RNA, 24 nt, Human
uuuccaggccugucccugaggccc

SEQ ID NO: 124219 - RNA, 24 nt, Human
uuuuuaguagagacgggguuucac

SEQ ID NO: 124220 - RNA, 21 nt, Human
uuuuuguauuuuuaguagaga

SEQ ID NO: 124221 - RNA, 21 nt, Human
uuuuuuguauuuuuaguagag

SEQ ID NO: 124222 - RNA, 24 nt, Human
uuuuuuguauuuuuaguagagacg

SEQ ID NO: 124223 - RNA, 19 nt, Human
gacacgaacccggcuggga

SEQ ID NO: 124224 - RNA, 21 nt, Human
aaaaaaaaaaaaaaaagcuag

SEQ ID NO: 124225 - RNA, 28 nt, Human
aaaaagaaaacccugcucuuggccacac

SEQ ID NO: 124226 - RNA, 18 nt, Human
aaaagcagaagaacuaag

SEQ ID NO: 124227 - RNA, 19 nt, Human
aaacaaaugaccauaucag

SEQ ID NO: 124228 - RNA, 23 nt, Human
aaauaaaccauuagucacacaga

SEQ ID NO: 124229 - RNA, 20 nt, Human
aaccuggaguaagaugggcu

SEQ ID NO: 124230 - RNA, 21 nt, Human
aagaacaaaaagaaaacccug

SEQ ID NO: 124231 - RNA, 22 nt, Human
aauuccccguaggaauuaucuc

SEQ ID NO: 124232 - RNA, 23 nt, Human
aauugcaaaagcagaagaacuaa

SEQ ID NO: 124233 - RNA, 19 nt, Human
acaaauaaaccauuaguca

SEQ ID NO: 124234 - RNA, 22 nt, Human
accagucuucugcccuuccccc

SEQ ID NO: 124235 - RNA, 19 nt, Human
acccugcuguauuaguaaa

SEQ ID NO: 124236 - RNA, 25 nt, Human
acugauuuugaggauucugaggcag

SEQ ID NO: 124237 - RNA, 23 nt, Human
agaaaugggagcaguucuaagaa

SEQ ID NO: 124238 - RNA, 25 nt, Human
agcacaacccacauuuauuuccuca

SEQ ID NO: 124239 - RNA, 19 nt, Human
aggcagcucaguauugugg

SEQ ID NO: 124240 - RNA, 23 nt, Human
auaauaaugauggcaaaaaugac

SEQ ID NO: 124241 - RNA, 22 nt, Human
auaaucccccucagcaucaaaa

SEQ ID NO: 124242 - RNA, 18 nt, Human
auacaaagccugcaagua

SEQ ID NO: 124243 - RNA, 19 nt, Human
aucuuugacauuccuuuaa

SEQ ID NO: 124244 - RNA, 24 nt, Human
caaaaaugacacaaaguagaaaua

SEQ ID NO: 124245 - RNA, 22 nt, Human
caaaguagaaauauauagcuac

SEQ ID NO: 124246 - RNA, 21 nt, Human
caacugaguucuuauuuaguu

SEQ ID NO: 124247 - RNA, 22 nt, Human
cacaguuucauaaucuuaggga

SEQ ID NO: 124248 - RNA, 26 nt, Human
cacaguuuuaagaauuccccguagga

SEQ ID NO: 124249 - RNA, 21 nt, Human
cacauuuauuuccucauggaa

SEQ ID NO: 124250 - RNA, 22 nt, Human
cagaccuacccucagugcccug

SEQ ID NO: 124251 - RNA, 18 nt, Human
cagauuccuuuggucuau

SEQ ID NO: 124252 - RNA, 18 nt, Human
cagucuucugcccuuccc

SEQ ID NO: 124253 - RNA, 18 nt, Human
caguuuuaagaauucccc

SEQ ID NO: 124254 - RNA, 24 nt, Human
caucuggcccaguuacccugcugu

SEQ ID NO: 124255 - RNA, 21 nt, Human
cauuauuugagcauuuggcag

SEQ ID NO: 124256 - RNA, 26 nt, Human
cauucauuuaacaaaacuuacuugag

SEQ ID NO: 124257 - RNA, 22 nt, Human
ccagcucuuucuccuucuuccu

SEQ ID NO: 124258 - RNA, 19 nt, Human
cccccagcucuuucuccuu

SEQ ID NO: 124259 - RNA, 19 nt, Human
cccccuuccccucucucuc

SEQ ID NO: 124260 - RNA, 21 nt, Human
ccccucucucucccuuuugcc

SEQ ID NO: 124261 - RNA, 20 nt, Human
cccucagugcccugaggauu

SEQ ID NO: 124262 - RNA, 18 nt, Human
cccuuuugccuuuuuuau

SEQ ID NO: 124263 - RNA, 23 nt, Human
ccucuccaguucauacuuuggug

SEQ ID NO: 124264 - RNA, 18 nt, Human
ccuugguuuccuucuucu

SEQ ID NO: 124265 - RNA, 23 nt, Human
ccuugguuuccuucuucuuuugg

SEQ ID NO: 124266 - RNA, 23 nt, Human
cucucaaaaccauagagcuccac

SEQ ID NO: 124267 - RNA, 23 nt, Human
cucucacucucccauucucuuuu

SEQ ID NO: 124268 - RNA, 22 nt, Human
gacccccuuccccucucucucc

SEQ ID NO: 124269 - RNA, 22 nt, Human
gcuaaaaaaaaaaaaaaaaaaa

SEQ ID NO: 124270 - RNA, 19 nt, Human
ggaaaauaaggggugggug

SEQ ID NO: 124271 - RNA, 19 nt, Human
ggcagcuggcugcuggugg

SEQ ID NO: 124272 - RNA, 20 nt, Human
guggcuggcagcugguggcu

SEQ ID NO: 124273 - RNA, 23 nt, Human
uaaaauugaguccaagaaucuuu

SEQ ID NO: 124274 - RNA, 25 nt, Human
uaaaccagucuucugcccuuccccc

SEQ ID NO: 124275 - RNA, 23 nt, Human
uaaaugcuaaauacuaagugcua

SEQ ID NO: 124276 - RNA, 20 nt, Human
uaacacagggcagaucucuc

SEQ ID NO: 124277 - RNA, 21 nt, Human
uaacuccaaucaauccaauau

SEQ ID NO: 124278 - RNA, 18 nt, Human
uaacuggauaacacaggg

SEQ ID NO: 124279 - RNA, 18 nt, Human
uaagaugggcuagaucug

SEQ ID NO: 124280 - RNA, 22 nt, Human
uaagaugggcuagaucugguca

SEQ ID NO: 124281 - RNA, 21 nt, Human
uaaucccccucagcaucaaaa

SEQ ID NO: 124282 - RNA, 21 nt, Human
uaaugauggcaaaaaugacac

SEQ ID NO: 124283 - RNA, 22 nt, Human
uaccauagauaaucaaaacaac

SEQ ID NO: 124284 - RNA, 19 nt, Human
uaccugaggugcaguguga

SEQ ID NO: 124285 - RNA, 21 nt, Human
uagaaagggccaauauucuca

SEQ ID NO: 124286 - RNA, 18 nt, Human
ucaaaaccauagagcucc

SEQ ID NO: 124287 - RNA, 21 nt, Human
ucaaaauuugugaccagauuu

SEQ ID NO: 124288 - RNA, 19 nt, Human
ucagauuccuuuggucuau

SEQ ID NO: 124289 - RNA, 18 nt, Human
uccuuauuuccuuuuccc

SEQ ID NO: 124290 - RNA, 22 nt, Human
uccuuauuuccuuuuccuccua

SEQ ID NO: 124291 - RNA, 20 nt, Human
ucucaaaaccauagagcucc

SEQ ID NO: 124292 - RNA, 24 nt, Human
ucucccuuuugccuuuuuuauuuu

SEQ ID NO: 124293 - RNA, 26 nt, Human
ucugcccuucccccagcucuuucucc

SEQ ID NO: 124294 - RNA, 18 nt, Human
ucuuucuccuucuuccuc

SEQ ID NO: 124295 - RNA, 25 nt, Human
ugacauuccuuuaagggaaaaccau

SEQ ID NO: 124296 - RNA, 20 nt, Human
ugagacccccuuccccucuc

SEQ ID NO: 124297 - RNA, 28 nt, Human
ugaugauauaauacaaauaaaccauuag

SEQ ID NO: 124298 - RNA, 22 nt, Human
ugcccugaggauucugggagac

SEQ ID NO: 124299 - RNA, 20 nt, Human
ugccuuuuuuauuuucucuc

SEQ ID NO: 124300 - RNA, 24 nt, Human
ugcugguggcuggcagcugguggc

SEQ ID NO: 124301 - RNA, 19 nt, Human
uggcagcuggcugcuggug

SEQ ID NO: 124302 - RNA, 23 nt, Human
ugggcaggaaauuagucugcauu

SEQ ID NO: 124303 - RNA, 18 nt, Human
uguccuaaugaucuggaa

SEQ ID NO: 124304 - RNA, 19 nt, Human
ugugugguucuaaauucau

SEQ ID NO: 124305 - RNA, 24 nt, Human
uuaaaacaaaugaccauaucagau

SEQ ID NO: 124306 - RNA, 19 nt, Human
uuagggaaguuacugaacc

SEQ ID NO: 124307 - RNA, 22 nt, Human
uucuaagaacaaaaagaaaacc

SEQ ID NO: 124308 - RNA, 19 nt, Human
uugugaccagauuuuaaaa

SEQ ID NO: 124309 - RNA, 24 nt, Human
uuugugaccagauuuuaaaagauu

SEQ ID NO: 124310 - RNA, 26 nt, Human
aaaauagucccuaaaaaucucacuaa

SEQ ID NO: 124311 - RNA, 22 nt, Human
acaaaaaagggaugggaacaau

SEQ ID NO: 124312 - RNA, 23 nt, Human
acacaaaaaagggaugggaacaa

SEQ ID NO: 124313 - RNA, 19 nt, Human
accaaaagcauauacaauu

SEQ ID NO: 124314 - RNA, 20 nt, Human
acggagugcagcgcgugccc

SEQ ID NO: 124315 - RNA, 24 nt, Human
agaaaggcaugccauguugaguua

SEQ ID NO: 124316 - RNA, 25 nt, Human
agcagccaauauucucaagaguucc

SEQ ID NO: 124317 - RNA, 25 nt, Human
auaagucaauuuuauaaaauuaagu

SEQ ID NO: 124318 - RNA, 18 nt, Human
auggaaugaaugaaugaa

SEQ ID NO: 124319 - RNA, 25 nt, Human
cagaaagaucccuaaacaaaagcua

SEQ ID NO: 124320 - RNA, 22 nt, Human
cagcagcauuuuaugacacagc

SEQ ID NO: 124321 - RNA, 21 nt, Human
cgaaaagcacccccuuuaaca

SEQ ID NO: 124322 - RNA, 19 nt, Human
cucacuaaauaguuuacgg

SEQ ID NO: 124323 - RNA, 18 nt, Human
gggaaucaaguucacuau

SEQ ID NO: 124324 - RNA, 25 nt, Human
uaaaagaccaucagaaagaucccua

SEQ ID NO: 124325 - RNA, 24 nt, Human
uaacagguacagagauacugaaaa

SEQ ID NO: 124326 - RNA, 24 nt, Human
uagaaaaacaauuuuguaggaacg

SEQ ID NO: 124327 - RNA, 22 nt, Human
uagaucgaaaagcacccccuuu

SEQ ID NO: 124328 - RNA, 23 nt, Human
uagucuagaaaaauaagucaauu

SEQ ID NO: 124329 - RNA, 19 nt, Human
ucagaaagaucccuaaaca

SEQ ID NO: 124330 - RNA, 27 nt, Human
ucagaaagaucccuaaacaaaagcuaa

SEQ ID NO: 124331 - RNA, 20 nt, Human
uccccaaauagcggaaccac

SEQ ID NO: 124332 - RNA, 19 nt, Human
ucccuaaacaaaagcuaaa

SEQ ID NO: 124333 - RNA, 22 nt, Human
ucucaagaguuccuaauuacca

SEQ ID NO: 124334 - RNA, 23 nt, Human
ucucauuaguuuuauuucuauaa

SEQ ID NO: 124335 - RNA, 20 nt, Human
ugaaacacacaaaaaaggga

SEQ ID NO: 124336 - RNA, 23 nt, Human
ugacacagcugccagaacauccc

SEQ ID NO: 124337 - RNA, 20 nt, Human
ugaguuacggagugcagcgc

SEQ ID NO: 124338 - RNA, 23 nt, Human
uggaagcaggggaaucaaguuca

SEQ ID NO: 124339 - RNA, 21 nt, Human
aagaaaaagcacacacugccc

SEQ ID NO: 124340 - RNA, 25 nt, Human
accuccggcuccagcaccucuacug

SEQ ID NO: 124341 - RNA, 23 nt, Human
agaaaccagcauggagaugucau

SEQ ID NO: 124342 - RNA, 19 nt, Human
agauaggugggaugauggg

SEQ ID NO: 124343 - RNA, 23 nt, Human
agcuuggugaccuccggcuccag

SEQ ID NO: 124344 - RNA, 18 nt, Human
aggggaggggccugaggc

SEQ ID NO: 124345 - RNA, 22 nt, Human
aggggggagaaaagaaaaagca

SEQ ID NO: 124346 - RNA, 23 nt, Human
agguggaggcucgaugcauggga

SEQ ID NO: 124347 - RNA, 21 nt, Human
auacucauguccuuccuccag

SEQ ID NO: 124348 - RNA, 21 nt, Human
aucucauucaugcuggagugg

SEQ ID NO: 124349 - RNA, 22 nt, Human
aucucauucaugcuggagugga

SEQ ID NO: 124350 - RNA, 18 nt, Human
caggccccgcccuaggga

SEQ ID NO: 124351 - RNA, 20 nt, Human
cauagaucucuacucgguug

SEQ ID NO: 124352 - RNA, 21 nt, Human
caugaccgcauacucaugucc

SEQ ID NO: 124353 - RNA, 26 nt, Human
cauuccuguccucaaaguuuguguca

SEQ ID NO: 124354 - RNA, 21 nt, Human
ccagcaccucuacugucuucu

SEQ ID NO: 124355 - RNA, 18 nt, Human
ccagguguacagcaugac

SEQ ID NO: 124356 - RNA, 20 nt, Human
ccuccuccagauaaggguug

SEQ ID NO: 124357 - RNA, 22 nt, Human
ccugaggcuaccgcagggcccc

SEQ ID NO: 124358 - RNA, 20 nt, Human
cgccgcgcucggccccgccc

SEQ ID NO: 124359 - RNA, 23 nt, Human
cgcgcucggccccgccccggccc

SEQ ID NO: 124360 - RNA, 18 nt, Human
cgggaacagcugcgccag

SEQ ID NO: 124361 - RNA, 21 nt, Human
cuccagcaccucuacugucuu

SEQ ID NO: 124362 - RNA, 18 nt, Human
cuuggugaccuccggcuc

SEQ ID NO: 124363 - RNA, 19 nt, Human
gaagcucuucaagcagguc

SEQ ID NO: 124364 - RNA, 22 nt, Human
gaagcucuucaagcagguccac

SEQ ID NO: 124365 - RNA, 21 nt, Human
gacaaaugcauuccuguccuc

SEQ ID NO: 124366 - RNA, 21 nt, Human
gccggggcgcaggaugcucug

SEQ ID NO: 124367 - RNA, 21 nt, Human
gcgccgcgcucggccccgccc

SEQ ID NO: 124368 - RNA, 21 nt, Human
gcgcucggccccgccccggcc

SEQ ID NO: 124369 - RNA, 22 nt, Human
gcuauggagaaaccagcaugga

SEQ ID NO: 124370 - RNA, 19 nt, Human
gcuuucucucuccugcuuc

SEQ ID NO: 124371 - RNA, 28 nt, Human
ggagaaaccagcauggagaugucauggg

SEQ ID NO: 124372 - RNA, 18 nt, Human
ggcaggcuggcuguggcu

SEQ ID NO: 124373 - RNA, 21 nt, Human
ggcuguggcuuucucucuccu

SEQ ID NO: 124374 - RNA, 24 nt, Human
gggaagcaaccacagauagguggg

SEQ ID NO: 124375 - RNA, 20 nt, Human
ggggggagaaaagaaaaagc

SEQ ID NO: 124376 - RNA, 21 nt, Human
ggucauggcugcaguuucugu

SEQ ID NO: 124377 - RNA, 21 nt, Human
gugauguguuuggggaggugc

SEQ ID NO: 124378 - RNA, 18 nt, Human
uacaugauggaggaaggu

SEQ ID NO: 124379 - RNA, 22 nt, Human
uaggugggaugaugggauggag

SEQ ID NO: 124380 - RNA, 20 nt, Human
uauggagaaaccagcaugga

SEQ ID NO: 124381 - RNA, 19 nt, Human
uccuccagauaagggucug

SEQ ID NO: 124382 - RNA, 18 nt, Human
uccuccagcaucucauuc

SEQ ID NO: 124383 - RNA, 22 nt, Human
uccugcuucucuuccuccucca

SEQ ID NO: 124384 - RNA, 18 nt, Human
ucugcggcggguccaggg

SEQ ID NO: 124385 - RNA, 22 nt, Human
ugacaaaugcauuccuguccuc

SEQ ID NO: 124386 - RNA, 21 nt, Human
ugaccuccggcuccagcaccu

SEQ ID NO: 124387 - RNA, 22 nt, Human
ugaccuccggcuccagcaccuc

SEQ ID NO: 124388 - RNA, 23 nt, Human
ugauggaggaagguggaggcucg

SEQ ID NO: 124389 - RNA, 20 nt, Human
ugcucaauguaccuugcaau

SEQ ID NO: 124390 - RNA, 25 nt, Human
uggagaaaccagcauggagauguca

SEQ ID NO: 124391 - RNA, 23 nt, Human
uggcaggcuggcuguggcuuucu

SEQ ID NO: 124392 - RNA, 18 nt, Human
uggcaggcuggcuguggg

SEQ ID NO: 124393 - RNA, 18 nt, Human
uggcugcuggucggggag

SEQ ID NO: 124394 - RNA, 22 nt, Human
uggcuguggcuuucucucuccu

SEQ ID NO: 124395 - RNA, 21 nt, Human
uggcuuucucucuccugcuuc

SEQ ID NO: 124396 - RNA, 24 nt, Human
ugggaauggcccgggaacagcugc

SEQ ID NO: 124397 - RNA, 21 nt, Human
uguccuuccuccagcaucuca

SEQ ID NO: 124398 - RNA, 23 nt, Human
uuacuuuuuuuuuuuuuuuuuca

SEQ ID NO: 124399 - RNA, 19 nt, Human
uuccuccagcaucucauuc

SEQ ID NO: 124400 - RNA, 22 nt, Human
uuuuuuuuuuuuuuuuucauuu

SEQ ID NO: 124401 - RNA, 24 nt, Human
aacuuacccccuccccagcccccg

SEQ ID NO: 124402 - RNA, 19 nt, Human
aagaagcccuggcgacugc

SEQ ID NO: 124403 - RNA, 20 nt, Human
aagaagcccuggcgacugcc

SEQ ID NO: 124404 - RNA, 22 nt, Human
aaggaucccguuccccugcccu

SEQ ID NO: 124405 - RNA, 22 nt, Human
acaaacuccagaagcugccggg

SEQ ID NO: 124406 - RNA, 21 nt, Human
acacggucaugcgugcacacg

SEQ ID NO: 124407 - RNA, 23 nt, Human
acacuguuuugucuccaaaguga

SEQ ID NO: 124408 - RNA, 22 nt, Human
acagcaaacgccgccacccaca

SEQ ID NO: 124409 - RNA, 18 nt, Human
accaggaagggaugcucc

SEQ ID NO: 124410 - RNA, 20 nt, Human
acccccuccccagcccccgc

SEQ ID NO: 124411 - RNA, 21 nt, Human
acccccuccccagcccccgcc

SEQ ID NO: 124412 - RNA, 19 nt, Human
acuccccgaugggcugcau

SEQ ID NO: 124413 - RNA, 21 nt, Human
agacuggaugcucccccuugg

SEQ ID NO: 124414 - RNA, 26 nt, Human
agcgccaccuaccuguaccagguggc

SEQ ID NO: 124415 - RNA, 21 nt, Human
agcugccucugcccugggcuc

SEQ ID NO: 124416 - RNA, 22 nt, Human
aggaagggaugcuccauguggc

SEQ ID NO: 124417 - RNA, 20 nt, Human
aggagcccaccuccgggggc

SEQ ID NO: 124418 - RNA, 19 nt, Human
aggaucccguuccccugcc

SEQ ID NO: 124419 - RNA, 18 nt, Human
aggcaggcuggcugaggg

SEQ ID NO: 124420 - RNA, 20 nt, Human
aggcaggcuggcugagggga

SEQ ID NO: 124421 - RNA, 22 nt, Human
agggcagcuccuucuggacaga

SEQ ID NO: 124422 - RNA, 24 nt, Human
agggcgagggguugggggggaagc

SEQ ID NO: 124423 - RNA, 22 nt, Human
agguggaggcugcagggccaag

SEQ ID NO: 124424 - RNA, 23 nt, Human
aguacguuauuguuacaaacacu

SEQ ID NO: 124425 - RNA, 22 nt, Human
auaauacugugucuuuggccuu

SEQ ID NO: 124426 - RNA, 21 nt, Human
aucccguuccccugcccuccg

SEQ ID NO: 124427 - RNA, 21 nt, Human
caaagugacagucccggcucc

SEQ ID NO: 124428 - RNA, 25 nt, Human
cacacguggucccucuguguguggu

SEQ ID NO: 124429 - RNA, 25 nt, Human
caccaggagcccaccuccgggggcu

SEQ ID NO: 124430 - RNA, 21 nt, Human
cacccccuccuggcgccgggg

SEQ ID NO: 124431 - RNA, 22 nt, Human
cacccccuccuggcgccgggga

SEQ ID NO: 124432 - RNA, 24 nt, Human
cacccgucaccaggagcccaccuc

SEQ ID NO: 124433 - RNA, 19 nt, Human
caccgaggccgcccagcag

SEQ ID NO: 124434 - RNA, 18 nt, Human
caccuaccuguaccaggu

SEQ ID NO: 124435 - RNA, 21 nt, Human
cacuguuuugucuccaaagug

SEQ ID NO: 124436 - RNA, 20 nt, Human
cagcaaacgccgccacccac

SEQ ID NO: 124437 - RNA, 22 nt, Human
cagccgccugcgcgccccgcgg

SEQ ID NO: 124438 - RNA, 26 nt, Human
cagggacugggaggggggccgggggg

SEQ ID NO: 124439 - RNA, 21 nt, Human
cauggauaaacuuacccccuc

SEQ ID NO: 124440 - RNA, 23 nt, Human
ccaacaccuugaaccugggggcc

SEQ ID NO: 124441 - RNA, 18 nt, Human
ccacaguauccccucagg

SEQ ID NO: 124442 - RNA, 23 nt, Human
ccccagcccccgccggccccucu

SEQ ID NO: 124443 - RNA, 23 nt, Human
cccccuccccagcccccgccggc

SEQ ID NO: 124444 - RNA, 18 nt, Human
ccccugaaugccuggcug

SEQ ID NO: 124445 - RNA, 21 nt, Human
cccgcgauaggugcucagggc

SEQ ID NO: 124446 - RNA, 21 nt, Human
cccgggcgcgcuggggggcga

SEQ ID NO: 124447 - RNA, 20 nt, Human
cccgggcggccacacggggc

SEQ ID NO: 124448 - RNA, 21 nt, Human
cccuccgcccccgccaacacc

SEQ ID NO: 124449 - RNA, 18 nt, Human
cccuggcgacugccuugg

SEQ ID NO: 124450 - RNA, 20 nt, Human
ccgcccccgccaacaccuug

SEQ ID NO: 124451 - RNA, 22 nt, Human
ccggagagccccggccuccucc

SEQ ID NO: 124452 - RNA, 21 nt, Human
ccucacaggaaaacacucccu

SEQ ID NO: 124453 - RNA, 22 nt, Human
ccuccccagcccccgccggccc

SEQ ID NO: 124454 - RNA, 18 nt, Human
ccuccgggggcucagcuc

SEQ ID NO: 124455 - RNA, 24 nt, Human
ccuccuagauggaccucuggcugu

SEQ ID NO: 124456 - RNA, 19 nt, Human
ccuggcgccggggaucccc

SEQ ID NO: 124457 - RNA, 21 nt, Human
ccugggucucagucccagaaa

SEQ ID NO: 124458 - RNA, 19 nt, Human
ccuggucuggcgagggauc

SEQ ID NO: 124459 - RNA, 22 nt, Human
ccuugaaccugggggccucgcu

SEQ ID NO: 124460 - RNA, 21 nt, Human
ccuuggccuggaaguggcuuc

SEQ ID NO: 124461 - RNA, 21 nt, Human
cgagagcuaccgaaagccaaa

SEQ ID NO: 124462 - RNA, 21 nt, Human
cgagagcuaccgaaagccaac

SEQ ID NO: 124463 - RNA, 20 nt, Human
cgagguggaggcugcagggc

SEQ ID NO: 124464 - RNA, 18 nt, Human
cgcacaggccugggauaa

SEQ ID NO: 124465 - RNA, 22 nt, Human
cgcaccgaggccgcccagcagc

SEQ ID NO: 124466 - RNA, 19 nt, Human
cgcgauaggugcucagggc

SEQ ID NO: 124467 - RNA, 20 nt, Human
cggcgcugcccaccggcugc

SEQ ID NO: 124468 - RNA, 18 nt, Human
cgggauggggcaucgggc

SEQ ID NO: 124469 - RNA, 23 nt, Human
cggugggaggugaggagaggggu

SEQ ID NO: 124470 - RNA, 22 nt, Human
cuccagaagcugccgggugucc

SEQ ID NO: 124471 - RNA, 20 nt, Human
cuccauguggcaaacacacc

SEQ ID NO: 124472 - RNA, 20 nt, Human
cuccccagcccccgccggcc

SEQ ID NO: 124473 - RNA, 23 nt, Human
cuccccagcccccgccggccccc

SEQ ID NO: 124474 - RNA, 18 nt, Human
cucccggcacccuccuag

SEQ ID NO: 124475 - RNA, 18 nt, Human
cuccgggggcucagcucc

SEQ ID NO: 124476 - RNA, 18 nt, Human
cuccuagauggaccucug

SEQ ID NO: 124477 - RNA, 24 nt, Human
cucucugccaucuucacucaccuu

SEQ ID NO: 124478 - RNA, 24 nt, Human
cucugugcaggugccuggcaagac

SEQ ID NO: 124479 - RNA, 22 nt, Human
cucuguguggccugagcauggu

SEQ ID NO: 124480 - RNA, 19 nt, Human
cugagaggcccacggaggc

SEQ ID NO: 124481 - RNA, 18 nt, Human
cugaugggggaggccuca

SEQ ID NO: 124482 - RNA, 23 nt, Human
cugcacccccuccuggcgccggg

SEQ ID NO: 124483 - RNA, 21 nt, Human
cugccuccacugacaaacucc

SEQ ID NO: 124484 - RNA, 20 nt, Human
cugcguguacuugggugugu

SEQ ID NO: 124485 - RNA, 22 nt, Human
cugggcuugaggaagcguccug

SEQ ID NO: 124486 - RNA, 20 nt, Human
cugugugugugugaacgugg

SEQ ID NO: 124487 - RNA, 19 nt, Human
cuguuggucccccagcggc

SEQ ID NO: 124488 - RNA, 21 nt, Human
cuuaaagacuggaugcucccc

SEQ ID NO: 124489 - RNA, 22 nt, Human
cuucacucaccuucguccuucc

SEQ ID NO: 124490 - RNA, 18 nt, Human
gaaugaaggaccugggga

SEQ ID NO: 124491 - RNA, 22 nt, Human
gagcaugguucacagcaaacgc

SEQ ID NO: 124492 - RNA, 21 nt, Human
gaggagagggguuuccaaacc

SEQ ID NO: 124493 - RNA, 18 nt, Human
gaucccguuccccugccc

SEQ ID NO: 124494 - RNA, 21 nt, Human
gcagaagcucccaaggaaacc

SEQ ID NO: 124495 - RNA, 21 nt, Human
gcauggauaaacuuacccccu

SEQ ID NO: 124496 - RNA, 20 nt, Human
gccaaggcuggcuuuuucca

SEQ ID NO: 124497 - RNA, 19 nt, Human
gccuggcaagaccaggaag

SEQ ID NO: 124498 - RNA, 19 nt, Human
gccuuggugacaucuucgg

SEQ ID NO: 124499 - RNA, 18 nt, Human
gcgauaggugcucagggc

SEQ ID NO: 124500 - RNA, 20 nt, Human
gcgauaggugcucagggccc

SEQ ID NO: 124501 - RNA, 18 nt, Human
gcgcugcccaccggcugc

SEQ ID NO: 124502 - RNA, 22 nt, Human
gcggaaaaagaggacagggccg

SEQ ID NO: 124503 - RNA, 21 nt, Human
gcggcgcugcccaccggcugc

SEQ ID NO: 124504 - RNA, 18 nt, Human
gcugccggguguccaggc

SEQ ID NO: 124505 - RNA, 18 nt, Human
ggacacccgucaccagga

SEQ ID NO: 124506 - RNA, 21 nt, Human
ggagcuuguacuacuguuuga

SEQ ID NO: 124507 - RNA, 24 nt, Human
ggaggugaggagagggguuuccaa

SEQ ID NO: 124508 - RNA, 18 nt, Human
ggaucccguuccccugcc

SEQ ID NO: 124509 - RNA, 20 nt, Human
ggcaggcuggcugaggggag

SEQ ID NO: 124510 - RNA, 20 nt, Human
ggcccgggcgcgcugggggg

SEQ ID NO: 124511 - RNA, 21 nt, Human
ggccuggccggauccccucug

SEQ ID NO: 124512 - RNA, 24 nt, Human
ggccugggucucagucccagaaac

SEQ ID NO: 124513 - RNA, 20 nt, Human
gggaggggacauggcugagc

SEQ ID NO: 124514 - RNA, 18 nt, Human
gggccuggccggaucccc

SEQ ID NO: 124515 - RNA, 21 nt, Human
gggcugcuccacaguaucccc

SEQ ID NO: 124516 - RNA, 19 nt, Human
ggugggaggugaggagagg

SEQ ID NO: 124517 - RNA, 20 nt, Human
guaucuguaggcacgguccu

SEQ ID NO: 124518 - RNA, 21 nt, Human
guaugugucucuguguggccu

SEQ ID NO: 124519 - RNA, 24 nt, Human
gugcacacguggucccucugugug

SEQ ID NO: 124520 - RNA, 18 nt, Human
uaaacuuacccccucccc

SEQ ID NO: 124521 - RNA, 23 nt, Human
ucacagcaaacgccgccacccac

SEQ ID NO: 124522 - RNA, 22 nt, Human
ucagcuccucccggcacccucc

SEQ ID NO: 124523 - RNA, 24 nt, Human
ucagcuccucccggcacccuccua

SEQ ID NO: 124524 - RNA, 19 nt, Human
uccacugacaaacuccaga

SEQ ID NO: 124525 - RNA, 21 nt, Human
uccaggcugaagguccccggg

SEQ ID NO: 124526 - RNA, 19 nt, Human
uccccagcccccgccggcc

SEQ ID NO: 124527 - RNA, 23 nt, Human
ucccccagcggcgagguggaggc

SEQ ID NO: 124528 - RNA, 18 nt, Human
uccccgaugggcugcauu

SEQ ID NO: 124529 - RNA, 21 nt, Human
uccccgcgauaggugcucagg

SEQ ID NO: 124530 - RNA, 20 nt, Human
ucccugagcugccggagggu

SEQ ID NO: 124531 - RNA, 18 nt, Human
ucccugcgcggcgcugcc

SEQ ID NO: 124532 - RNA, 21 nt, Human
uccuagauggaccucuggcug

SEQ ID NO: 124533 - RNA, 24 nt, Human
uccuaugaauugcacacguguccu

SEQ ID NO: 124534 - RNA, 21 nt, Human
uccugccaggccugggucuca

SEQ ID NO: 124535 - RNA, 19 nt, Human
uccuggucuggcgagggau

SEQ ID NO: 124536 - RNA, 22 nt, Human
uccuucuggacagaggggccug

SEQ ID NO: 124537 - RNA, 24 nt, Human
ucuccaaagugacagucccggcuc

SEQ ID NO: 124538 - RNA, 18 nt, Human
ucuccagguggaugcaga

SEQ ID NO: 124539 - RNA, 18 nt, Human
ucuccagguggaugcaga

SEQ ID NO: 124540 - RNA, 22 nt, Human
ucucuguagaaggcugggcuug

SEQ ID NO: 124541 - RNA, 21 nt, Human
ucugagcugccucugcccugg

SEQ ID NO: 124542 - RNA, 22 nt, Human
ucuguaggcacgguccugccag

SEQ ID NO: 124543 - RNA, 21 nt, Human
ucugugugugugugaacgugg

SEQ ID NO: 124544 - RNA, 26 nt, Human
ucugugugugugugaacguggugugu

SEQ ID NO: 124545 - RNA, 19 nt, Human
ugaagaagguucagaaggu

SEQ ID NO: 124546 - RNA, 21 nt, Human
ugacuccccgaugggcugcau

SEQ ID NO: 124547 - RNA, 21 nt, Human
ugagcugccucugcccugggc

SEQ ID NO: 124548 - RNA, 18 nt, Human
ugaggggaagauggcagg

SEQ ID NO: 124549 - RNA, 18 nt, Human
ugcacacguguccugugc

SEQ ID NO: 124550 - RNA, 21 nt, Human
ugcacccccuccuggcgccgg

SEQ ID NO: 124551 - RNA, 21 nt, Human
ugcccaaggucacggugggag

SEQ ID NO: 124552 - RNA, 22 nt, Human
ugcccuccgcccccgccaacac

SEQ ID NO: 124553 - RNA, 18 nt, Human
ugccuagagccuccacuc

SEQ ID NO: 124554 - RNA, 22 nt, Human
ugccuagagccuccacucugag

SEQ ID NO: 124555 - RNA, 18 nt, Human
ugccucugcccugggcuc

SEQ ID NO: 124556 - RNA, 19 nt, Human
ugccuggaggagguacugc

SEQ ID NO: 124557 - RNA, 22 nt, Human
ugcguguacuuggguguguaua

SEQ ID NO: 124558 - RNA, 21 nt, Human
ugcuccauguggcaaacacac

SEQ ID NO: 124559 - RNA, 21 nt, Human
ugcuggucacguccucucugc

SEQ ID NO: 124560 - RNA, 21 nt, Human
uggaaguggcuucggaaaagg

SEQ ID NO: 124561 - RNA, 23 nt, Human
uggacacccgucaccaggagccc

SEQ ID NO: 124562 - RNA, 24 nt, Human
uggauaaacuuacccccuccccag

SEQ ID NO: 124563 - RNA, 24 nt, Human
uggcaaacacaccccugaaugccu

SEQ ID NO: 124564 - RNA, 19 nt, Human
uggccggauccccucugcc

SEQ ID NO: 124565 - RNA, 21 nt, Human
uggcgacugccuuggccugga

SEQ ID NO: 124566 - RNA, 24 nt, Human
ugggaggugaggagagggguuucc

SEQ ID NO: 124567 - RNA, 21 nt, Human
ugggcaggaacgugagcgcca

SEQ ID NO: 124568 - RNA, 19 nt, Human
uggggaggggaggggugaa

SEQ ID NO: 124569 - RNA, 19 nt, Human
uggggcaucgggcuucucc

SEQ ID NO: 124570 - RNA, 23 nt, Human
ugguguggacugggcugcuccac

SEQ ID NO: 124571 - RNA, 22 nt, Human
uguagaaggcugggcuugagga

SEQ ID NO: 124572 - RNA, 21 nt, Human
ugucucuguguggccugagca

SEQ ID NO: 124573 - RNA, 22 nt, Human
ugugcaggugccuggcaagacc

SEQ ID NO: 124574 - RNA, 21 nt, Human
uguggacugggcugcuccaca

SEQ ID NO: 124575 - RNA, 19 nt, Human
uguggcaaacacaccccug

SEQ ID NO: 124576 - RNA, 22 nt, Human
ugugugugugugaacguggugu

SEQ ID NO: 124577 - RNA, 25 nt, Human
ugugugugugugaacguggugugua

SEQ ID NO: 124578 - RNA, 18 nt, Human
uuccacuguggggagggg

SEQ ID NO: 124579 - RNA, 19 nt, Human
uuccccugcccuccgcccc

SEQ ID NO: 124580 - RNA, 24 nt, Human
uugaaccugggggccucgcugggc

SEQ ID NO: 124581 - RNA, 18 nt, Human
uugguguuggugggcagc

SEQ ID NO: 124582 - RNA, 23 nt, Human
aacccauucaaccugcugagcag

SEQ ID NO: 124583 - RNA, 22 nt, Human
agaccccaugggccccaccccu

SEQ ID NO: 124584 - RNA, 26 nt, Human
agagaccccaugggccccaccccuuc

SEQ ID NO: 124585 - RNA, 24 nt, Human
aggugaccacugagaacccauuca

SEQ ID NO: 124586 - RNA, 21 nt, Human
aguggcccagcugagcugagg

SEQ ID NO: 124587 - RNA, 18 nt, Human
caccccugggccuuccuc

SEQ ID NO: 124588 - RNA, 21 nt, Human
ccaccccugggccuuccuccc

SEQ ID NO: 124589 - RNA, 22 nt, Human
ccacugagaacccauucaaccu

SEQ ID NO: 124590 - RNA, 25 nt, Human
ccccacagcugugacuguaccugcu

SEQ ID NO: 124591 - RNA, 18 nt, Human
cucccauguggcugcagg

SEQ ID NO: 124592 - RNA, 28 nt, Human
cugaggaaggugaccacugagaacccau

SEQ ID NO: 124593 - RNA, 20 nt, Human
gaccccaugggccccacccc

SEQ ID NO: 124594 - RNA, 22 nt, Human
gagaacccauucaaccugcuga

SEQ ID NO: 124595 - RNA, 25 nt, Human
gcuguuuauugucuccauggggugg

SEQ ID NO: 124596 - RNA, 23 nt, Human
ggcagaaaggagcaggacuuggg

SEQ ID NO: 124597 - RNA, 22 nt, Human
gggcagaaaggagcaggacuug

SEQ ID NO: 124598 - RNA, 18 nt, Human
uauugucuccauggggug

SEQ ID NO: 124599 - RNA, 23 nt, Human
uccccacagcugugacuguaccu

SEQ ID NO: 124600 - RNA, 24 nt, Human
ugacuguaccugcuccacuucagc

SEQ ID NO: 124601 - RNA, 21 nt, Human
ugggcagaaaggagcaggacu

SEQ ID NO: 124602 - RNA, 18 nt, Human
uggggugggugaagagga

SEQ ID NO: 124603 - RNA, 21 nt, Human
uggggugggugaagaggagug

SEQ ID NO: 124604 - RNA, 19 nt, Human
ugucuccauggggugggug

SEQ ID NO: 124605 - RNA, 21 nt, Human
uguggcugcaggccauccucu

SEQ ID NO: 124606 - RNA, 21 nt, Human
aaagggccagguggggcuggg

SEQ ID NO: 124607 - RNA, 20 nt, Human
agacuaggcaggaaggcaag

SEQ ID NO: 124608 - RNA, 20 nt, Human
agaggacagugcuugcugga

SEQ ID NO: 124609 - RNA, 18 nt, Human
agccagcacugggaggga

SEQ ID NO: 124610 - RNA, 18 nt, Human
aggcagaaagggaggcug

SEQ ID NO: 124611 - RNA, 22 nt, Human
aggcugguggccaggcugggac

SEQ ID NO: 124612 - RNA, 21 nt, Human
aggggucaggcugcaggaggg

SEQ ID NO: 124613 - RNA, 24 nt, Human
ccagguggggcuggggacaagguc

SEQ ID NO: 124614 - RNA, 19 nt, Human
ccugcaggacccuauucca

SEQ ID NO: 124615 - RNA, 18 nt, Human
gagagaagagggguggcc

SEQ ID NO: 124616 - RNA, 19 nt, Human
gagcucagggcaugcucga

SEQ ID NO: 124617 - RNA, 21 nt, Human
ggcaggaaggcaagggacaaa

SEQ ID NO: 124618 - RNA, 23 nt, Human
ggccuggggucaggcagaaaggg

SEQ ID NO: 124619 - RNA, 22 nt, Human
ggucagcaagaucuuccccagc

SEQ ID NO: 124620 - RNA, 22 nt, Human
ggucaggcagaaagggaggcug

SEQ ID NO: 124621 - RNA, 21 nt, Human
gucaggcagaaagggaggcug

SEQ ID NO: 124622 - RNA, 25 nt, Human
gugggagagaagagggguggccugg

SEQ ID NO: 124623 - RNA, 19 nt, Human
uaggcaggaaggcaaggga

SEQ ID NO: 124624 - RNA, 20 nt, Human
uauucuacccugcaggaccc

SEQ ID NO: 124625 - RNA, 20 nt, Human
ugccuaggggucaggcugca

SEQ ID NO: 124626 - RNA, 21 nt, Human
ugccuaggggucaggcugcag

SEQ ID NO: 124627 - RNA, 20 nt, Human
ugcgcaggggcccuggccag

SEQ ID NO: 124628 - RNA, 21 nt, Human
uggccaggcugggacccuggg

SEQ ID NO: 124629 - RNA, 19 nt, Human
uggggcugguuagacagag

SEQ ID NO: 124630 - RNA, 24 nt, Human
ugguggccaggcugggacccuggg

SEQ ID NO: 124631 - RNA, 23 nt, Human
uguauggccacacgaggagccug

SEQ ID NO: 124632 - RNA, 26 nt, Human
uuccccagcugugcccuggcauugcu

SEQ ID NO: 124633 - RNA, 22 nt, Human
uuccccagcugugcccuggccg

SEQ ID NO: 124634 - RNA, 24 nt, Human
aagaaggcagaguggguugggagu

SEQ ID NO: 124635 - RNA, 22 nt, Human
auggcggagaaggguggggggu

SEQ ID NO: 124636 - RNA, 19 nt, Human
cacaagcugaaaaagaagg

SEQ ID NO: 124637 - RNA, 23 nt, Human
cauugccacaagcugaaaaagaa

SEQ ID NO: 124638 - RNA, 21 nt, Human
gguggacaggggcugugaguu

SEQ ID NO: 124639 - RNA, 19 nt, Human
guggggccacauagggugg

SEQ ID NO: 124640 - RNA, 23 nt, Human
uggcggagaagggugggggguug

SEQ ID NO: 124641 - RNA, 18 nt, Human
uggggccacauagggugg

SEQ ID NO: 124642 - RNA, 19 nt, Human
uggguugggaguagggaag

SEQ ID NO: 124643 - RNA, 22 nt, Human
uggguugggaguagggaagaau

SEQ ID NO: 124644 - RNA, 23 nt, Human
uguuguggggccacauagggugg

SEQ ID NO: 124645 - RNA, 22 nt, Human
aacaggagcagaugaccaauag

SEQ ID NO: 124646 - RNA, 19 nt, Human
aagaaagagggagaaaaug

SEQ ID NO: 124647 - RNA, 23 nt, Human
aagcaaaaaugggaacaugccaa

SEQ ID NO: 124648 - RNA, 24 nt, Human
aagcaaaaaugggaacaugccaaa

SEQ ID NO: 124649 - RNA, 21 nt, Human
aagcgaauuccaaggugugca

SEQ ID NO: 124650 - RNA, 25 nt, Human
aagcgaauuccaaggugugcaauuu

SEQ ID NO: 124651 - RNA, 21 nt, Human
aaugggaacaugccaaaagga

SEQ ID NO: 124652 - RNA, 22 nt, Human
aauguuaaaucucucagguaac

SEQ ID NO: 124653 - RNA, 18 nt, Human
acagaucauauguagaca

SEQ ID NO: 124654 - RNA, 19 nt, Human
accacaggguuucugacac

SEQ ID NO: 124655 - RNA, 24 nt, Human
accacguucuuuacugaucuguug

SEQ ID NO: 124656 - RNA, 22 nt, Human
acuggggaaccagacauacauu

SEQ ID NO: 124657 - RNA, 19 nt, Human
agagggagaaaaugucgag

SEQ ID NO: 124658 - RNA, 23 nt, Human
agcaaaaaugggaacaugccaaa

SEQ ID NO: 124659 - RNA, 19 nt, Human
agcucuacuggggaaccag

SEQ ID NO: 124660 - RNA, 19 nt, Human
agcuuggugacaacccaua

SEQ ID NO: 124661 - RNA, 24 nt, Human
auugagcuaagcaaaaaugggaac

SEQ ID NO: 124662 - RNA, 24 nt, Human
caauagcaccuagcuuggugacaa

SEQ ID NO: 124663 - RNA, 22 nt, Human
cacagcaagggucaaaugcuga

SEQ ID NO: 124664 - RNA, 19 nt, Human
cacaggaccuuccguccug

SEQ ID NO: 124665 - RNA, 21 nt, Human
caccgacuauuucucccucaa

SEQ ID NO: 124666 - RNA, 22 nt, Human
caccgcgcgacgucuggaagau

SEQ ID NO: 124667 - RNA, 20 nt, Human
caccuuccuguuugccucca

SEQ ID NO: 124668 - RNA, 18 nt, Human
cagacacagggcccuaau

SEQ ID NO: 124669 - RNA, 22 nt, Human
cagcagacacagggcccuaaua

SEQ ID NO: 124670 - RNA, 20 nt, Human
cagguggguuuggccccagg

SEQ ID NO: 124671 - RNA, 19 nt, Human
ccaaauuucuggaauccac

SEQ ID NO: 124672 - RNA, 22 nt, Human
ccacaggcugaauuucaccaca

SEQ ID NO: 124673 - RNA, 25 nt, Human
cccccaagaacacuccaaauuucug

SEQ ID NO: 124674 - RNA, 26 nt, Human
cccccaagaacacuccaaauuucugg

SEQ ID NO: 124675 - RNA, 19 nt, Human
ccccuuagaaguuugagcc

SEQ ID NO: 124676 - RNA, 22 nt, Human
ccuagcuuggugacaacccaua

SEQ ID NO: 124677 - RNA, 19 nt, Human
ccuauccuucucaaagcac

SEQ ID NO: 124678 - RNA, 19 nt, Human
ccuccacagaaaacaaaau

SEQ ID NO: 124679 - RNA, 18 nt, Human
cucuuguagccugguucu

SEQ ID NO: 124680 - RNA, 19 nt, Human
cugaagcuguaguaagagc

SEQ ID NO: 124681 - RNA, 30 nt, Human
cuugaugauuauauauaguuuguauuaccu

SEQ ID NO: 124682 - RNA, 22 nt, Human
cuuggccucugcuuuuucucuu

SEQ ID NO: 124683 - RNA, 25 nt, Human
cuuggccucugcuuuuucucuuggu

SEQ ID NO: 124684 - RNA, 22 nt, Human
gagcucuacuggggaaccagac

SEQ ID NO: 124685 - RNA, 23 nt, Human
ggaaagaauuuccucugauuaaa

SEQ ID NO: 124686 - RNA, 23 nt, Human
ggaagaaagagggagaaaauguc

SEQ ID NO: 124687 - RNA, 19 nt, Human
ggcccuaauaauacuuaac

SEQ ID NO: 124688 - RNA, 24 nt, Human
gggaagaaagagggagaaaauguc

SEQ ID NO: 124689 - RNA, 20 nt, Human
gggucaugggaagaaagagg

SEQ ID NO: 124690 - RNA, 19 nt, Human
gguacccugacauuggccu

SEQ ID NO: 124691 - RNA, 21 nt, Human
ggucaugggaagaaagaggga

SEQ ID NO: 124692 - RNA, 25 nt, Human
gucuggaagaucccgagcacaggag

SEQ ID NO: 124693 - RNA, 19 nt, Human
uacccugacauuggccugg

SEQ ID NO: 124694 - RNA, 20 nt, Human
uaccugaaucuacagguaac

SEQ ID NO: 124695 - RNA, 22 nt, Human
uaccugaaucuacagguaacac

SEQ ID NO: 124696 - RNA, 22 nt, Human
uacugaucuguugcccuuggcc

SEQ ID NO: 124697 - RNA, 23 nt, Human
uacuggggaaccagacauacauu

SEQ ID NO: 124698 - RNA, 25 nt, Human
uagaaguuugagcccauuggguugg

SEQ ID NO: 124699 - RNA, 22 nt, Human
uagaguccacagggauuuccaa

SEQ ID NO: 124700 - RNA, 21 nt, Human
ucaccuuccuguuugccucca

SEQ ID NO: 124701 - RNA, 18 nt, Human
ucaguagagauaguuaua

SEQ ID NO: 124702 - RNA, 24 nt, Human
uccacagaaaacaaaauuaaagua

SEQ ID NO: 124703 - RNA, 25 nt, Human
uccacagaaaacaaaauuaaaguac

SEQ ID NO: 124704 - RNA, 22 nt, Human
ucccucaaacucuuggccucug

SEQ ID NO: 124705 - RNA, 20 nt, Human
uccuuuagaaagcgaauucc

SEQ ID NO: 124706 - RNA, 22 nt, Human
uccuuuagaaagcgaauuccaa

SEQ ID NO: 124707 - RNA, 20 nt, Human
ucucuggugugaacaggagc

SEQ ID NO: 124708 - RNA, 19 nt, Human
ugaacaggagcagaugacc

SEQ ID NO: 124709 - RNA, 18 nt, Human
ugaagugcaucaugugaa

SEQ ID NO: 124710 - RNA, 21 nt, Human
ugaggcaguagagcucuacug

SEQ ID NO: 124711 - RNA, 19 nt, Human
uggccuggucuuucuaauc

SEQ ID NO: 124712 - RNA, 19 nt, Human
ugucacauuuacaguuauc

SEQ ID NO: 124713 - RNA, 22 nt, Human
uuccccccaagaacacuccaaa

SEQ ID NO: 124714 - RNA, 21 nt, Human
uuuggccccagguacccugac

SEQ ID NO: 124715 - RNA, 19 nt, Human
aacaauaucuuuauuuagc

SEQ ID NO: 124716 - RNA, 19 nt, Human
aaguccccagccccuccag

SEQ ID NO: 124717 - RNA, 23 nt, Human
acaaguccccagccccuccagga

SEQ ID NO: 124718 - RNA, 19 nt, Human
accuguugucucuggaggg

SEQ ID NO: 124719 - RNA, 21 nt, Human
agacacaaguccccagccccu

SEQ ID NO: 124720 - RNA, 24 nt, Human
agcccagauagcaaaacugcagcc

SEQ ID NO: 124721 - RNA, 18 nt, Human
agguaguuguucuuacac

SEQ ID NO: 124722 - RNA, 23 nt, Human
auccccgcagacacaagucccca

SEQ ID NO: 124723 - RNA, 20 nt, Human
aucuuagaccacauaggcca

SEQ ID NO: 124724 - RNA, 19 nt, Human
cagagaguucuucagagcu

SEQ ID NO: 124725 - RNA, 19 nt, Human
cagcucccaauugucaaag

SEQ ID NO: 124726 - RNA, 24 nt, Human
caggaagggcagaggaaugugaug

SEQ ID NO: 124727 - RNA, 25 nt, Human
cagguagacagagucuaggccucag

SEQ ID NO: 124728 - RNA, 22 nt, Human
cagucagcacccucacagagcc

SEQ ID NO: 124729 - RNA, 24 nt, Human
cauuuuauuacaagaguguagaga

SEQ ID NO: 124730 - RNA, 23 nt, Human
ccagaccagguagacagagucua

SEQ ID NO: 124731 - RNA, 23 nt, Human
cccacagcccagauagcaaaacu

SEQ ID NO: 124732 - RNA, 18 nt, Human
cccccccucacuccagcc

SEQ ID NO: 124733 - RNA, 22 nt, Human
cccccccucacuccagcccuag

SEQ ID NO: 124734 - RNA, 24 nt, Human
ccccuccaggacagcaauaagggu

SEQ ID NO: 124735 - RNA, 25 nt, Human
cccgcagacacaaguccccagcccc

SEQ ID NO: 124736 - RNA, 22 nt, Human
cccuucacucuuggcagcuccc

SEQ ID NO: 124737 - RNA, 24 nt, Human
ccuaacccuagcaggccuccuggc

SEQ ID NO: 124738 - RNA, 18 nt, Human
ccucacagagccagcuag

SEQ ID NO: 124739 - RNA, 19 nt, Human
ccuccaggacagcaauaag

SEQ ID NO: 124740 - RNA, 23 nt, Human
ccuccaggacagcaauaaggguc

SEQ ID NO: 124741 - RNA, 22 nt, Human
cuccagcccuaguccuggugcc

SEQ ID NO: 124742 - RNA, 19 nt, Human
cucuggagggugugcagag

SEQ ID NO: 124743 - RNA, 19 nt, Human
cugaagccagucagcaccc

SEQ ID NO: 124744 - RNA, 19 nt, Human
cugggcccaggggcuucca

SEQ ID NO: 124745 - RNA, 18 nt, Human
cuugcccacagcccagau

SEQ ID NO: 124746 - RNA, 23 nt, Human
gaccuccuaacccuagcaggccu

SEQ ID NO: 124747 - RNA, 18 nt, Human
gcccuaguccuggugccu

SEQ ID NO: 124748 - RNA, 25 nt, Human
ggauaugugcacucccugugcgcuc

SEQ ID NO: 124749 - RNA, 22 nt, Human
ggccuaaggaccuccuaacccu

SEQ ID NO: 124750 - RNA, 21 nt, Human
uaagggucuuacaaggccagu

SEQ ID NO: 124751 - RNA, 21 nt, Human
uaccccccccucacuccagcc

SEQ ID NO: 124752 - RNA, 22 nt, Human
uagcaggccuccuggcucaagc

SEQ ID NO: 124753 - RNA, 20 nt, Human
uaggggcaggcaggaucccu

SEQ ID NO: 124754 - RNA, 20 nt, Human
uauccugggcugucucuucc

SEQ ID NO: 124755 - RNA, 21 nt, Human
uauuacaagaguguagagaag

SEQ ID NO: 124756 - RNA, 18 nt, Human
ucacaaggaucagggaag

SEQ ID NO: 124757 - RNA, 21 nt, Human
ucacaaggaucagggaagguu

SEQ ID NO: 124758 - RNA, 19 nt, Human
ucagggaagguuccaagga

SEQ ID NO: 124759 - RNA, 21 nt, Human
ucagggaagguuccaaggaac

SEQ ID NO: 124760 - RNA, 22 nt, Human
uccaggguaggggcaggcagga

SEQ ID NO: 124761 - RNA, 22 nt, Human
uccccagccccuccaggacagc

SEQ ID NO: 124762 - RNA, 23 nt, Human
ucccugugcgcucuggauccccg

SEQ ID NO: 124763 - RNA, 19 nt, Human
ugagguacugagcugagcu

SEQ ID NO: 124764 - RNA, 19 nt, Human
ugccuggauaugugcacuc

SEQ ID NO: 124765 - RNA, 25 nt, Human
uggauccccgcagacacaagucccc

SEQ ID NO: 124766 - RNA, 18 nt, Human
uggcuaguucuaacuugc

SEQ ID NO: 124767 - RNA, 19 nt, Human
ugggaaggcuccaucagca

SEQ ID NO: 124768 - RNA, 21 nt, Human
uguacaaacauuaaaaauaga

SEQ ID NO: 124769 - RNA, 22 nt, Human
ugucucuucccuucacucuugg

SEQ ID NO: 124770 - RNA, 29 nt, Human
ugugcagaggcaaguccagggggaacgcc

SEQ ID NO: 124771 - RNA, 19 nt, Human
uuaaaaauagacauuuuau

SEQ ID NO: 124772 - RNA, 21 nt, Human
uucccuucacucuuggcagcu

SEQ ID NO: 124773 - RNA, 21 nt, Human
uugaaauaccccccccucacu

SEQ ID NO: 124774 - RNA, 20 nt, Human
aaaaaaaaaaaacaaaaagg

SEQ ID NO: 124775 - RNA, 18 nt, Human
aaaaaaaacaaaaaggcu

SEQ ID NO: 124776 - RNA, 22 nt, Human
aaaaaaaacaaaaaggcugggc

SEQ ID NO: 124777 - RNA, 22 nt, Human
aaaaaaacaaaaaggcugggcg

SEQ ID NO: 124778 - RNA, 20 nt, Human
aaaaaaagaaaggaagagaa

SEQ ID NO: 124779 - RNA, 22 nt, Human
aaaaaacaaaaaggcugggcgc

SEQ ID NO: 124780 - RNA, 19 nt, Human
aaaaugcugggauuacagg

SEQ ID NO: 124781 - RNA, 22 nt, Human
aaagaaggugaauuauauggca

SEQ ID NO: 124782 - RNA, 20 nt, Human
aaaggaagagaaacaagggc

SEQ ID NO: 124783 - RNA, 19 nt, Human
aaaugcugggauuacaggc

SEQ ID NO: 124784 - RNA, 20 nt, Human
aacacagugaaaccucgucu

SEQ ID NO: 124785 - RNA, 21 nt, Human
aacacagugaaaccucgucuc

SEQ ID NO: 124786 - RNA, 24 nt, Human
aacagaguaagacucugucucaaa

SEQ ID NO: 124787 - RNA, 19 nt, Human
aacauggugaaaccccauc

SEQ ID NO: 124788 - RNA, 20 nt, Human
aacauggugaaaccccaucu

SEQ ID NO: 124789 - RNA, 20 nt, Human
aacauggugaaaccccaucu

SEQ ID NO: 124790 - RNA, 21 nt, Human
aacauggugaaaccccaucuc

SEQ ID NO: 124791 - RNA, 19 nt, Human
aacauggugaaacccgucu

SEQ ID NO: 124792 - RNA, 20 nt, Human
aacauggugaaacccgucuc

SEQ ID NO: 124793 - RNA, 21 nt, Human
aacccgucucuaccaaaaaua

SEQ ID NO: 124794 - RNA, 24 nt, Human
aaccugggugacagacugagauuc

SEQ ID NO: 124795 - RNA, 24 nt, Human
aagcacuugaaccugggaggcaga

SEQ ID NO: 124796 - RNA, 25 nt, Human
aaggcagguggauaacuugggguca

SEQ ID NO: 124797 - RNA, 24 nt, Human
aagugggaggauugcuugaaccug

SEQ ID NO: 124798 - RNA, 22 nt, Human
acaaaaaaaaaaaagaagguga

SEQ ID NO: 124799 - RNA, 21 nt, Human
acaaaaaggcugggcgcggug

SEQ ID NO: 124800 - RNA, 23 nt, Human
acacagaaaguagauuagcaguu

SEQ ID NO: 124801 - RNA, 18 nt, Human
acacagugaaaccucguc

SEQ ID NO: 124802 - RNA, 19 nt, Human
acacagugaaaccucgucu

SEQ ID NO: 124803 - RNA, 23 nt, Human
acagacugagauucugucucaga

SEQ ID NO: 124804 - RNA, 24 nt, Human
acagaggaagacucugucucaaaa

SEQ ID NO: 124805 - RNA, 24 nt, Human
acagaguaagacucugucucaaaa

SEQ ID NO: 124806 - RNA, 18 nt, Human
acaggcccugcacuuggc

SEQ ID NO: 124807 - RNA, 24 nt, Human
acagggucccacuauguuggccag

SEQ ID NO: 124808 - RNA, 24 nt, Human
accccaucuccacuaaaacuacaa

SEQ ID NO: 124809 - RNA, 24 nt, Human
accucgucucuacuaaaaauacaa

SEQ ID NO: 124810 - RNA, 23 nt, Human
accugggugacagacugagauuc

SEQ ID NO: 124811 - RNA, 22 nt, Human
acgccacugcacuccaaccugg

SEQ ID NO: 124812 - RNA, 18 nt, Human
acuauguuggccaggcug

SEQ ID NO: 124813 - RNA, 18 nt, Human
acugcacuccaaccuggg

SEQ ID NO: 124814 - RNA, 24 nt, Human
acugcacuccaaccugggugacag

SEQ ID NO: 124815 - RNA, 23 nt, Human
acugcacuccagccuggcaacag

SEQ ID NO: 124816 - RNA, 23 nt, Human
acugcacuccagccuggcaacag

SEQ ID NO: 124817 - RNA, 18 nt, Human
acugcacuccagcuuagg

SEQ ID NO: 124818 - RNA, 26 nt, Human
acugcacuccagcuuaggacaucggg

SEQ ID NO: 124819 - RNA, 24 nt, Human
acugcacuccagcuuaggagacag

SEQ ID NO: 124820 - RNA, 24 nt, Human
acuugaggucaggaguuugagacu

SEQ ID NO: 124821 - RNA, 18 nt, Human
acuuggggucaggaguuc

SEQ ID NO: 124822 - RNA, 24 nt, Human
agaaaguagauuagcaguugccag

SEQ ID NO: 124823 - RNA, 18 nt, Human
agacaaaaaaaaaaaaga

SEQ ID NO: 124824 - RNA, 26 nt, Human
agagaaggcaaauccauagacacaga

SEQ ID NO: 124825 - RNA, 18 nt, Human
agagguugcagugagcug

SEQ ID NO: 124826 - RNA, 22 nt, Human
agagguugcagugagcugagau

SEQ ID NO: 124827 - RNA, 23 nt, Human
agagguugcagugagcugagaug

SEQ ID NO: 124828 - RNA, 20 nt, Human
agagguugcagugagcuggc

SEQ ID NO: 124829 - RNA, 22 nt, Human
agaucacuugaggucaggaguu

SEQ ID NO: 124830 - RNA, 25 nt, Human
agaucacuugaggucaggaguuuga

SEQ ID NO: 124831 - RNA, 24 nt, Human
agcacuuugggaggcugaggcggg

SEQ ID NO: 124832 - RNA, 23 nt, Human
agccaggcgugguggugugugcc

SEQ ID NO: 124833 - RNA, 21 nt, Human
agccuggcaacagaguaagac

SEQ ID NO: 124834 - RNA, 23 nt, Human
agccuggcaacagaguaagacuc

SEQ ID NO: 124835 - RNA, 22 nt, Human
agccuggccaacauggugaaac

SEQ ID NO: 124836 - RNA, 24 nt, Human
agccuggccaacauggugaaaccc

SEQ ID NO: 124837 - RNA, 24 nt, Human
agcugcuauuuuuuaaaaaaagaa

SEQ ID NO: 124838 - RNA, 21 nt, Human
agcuggccaugguggcgcauc

SEQ ID NO: 124839 - RNA, 23 nt, Human
aggaguucgagacaagccuggcc

SEQ ID NO: 124840 - RNA, 20 nt, Human
aggcagagguugcagugagc

SEQ ID NO: 124841 - RNA, 24 nt, Human
aggcagagguugcagugagcugag

SEQ ID NO: 124842 - RNA, 21 nt, Human
aggcaggagaaucgcuugaac

SEQ ID NO: 124843 - RNA, 24 nt, Human
aggcaggagaaucgcuugaacaug

SEQ ID NO: 124844 - RNA, 23 nt, Human
aggcaggggaggcaggcuagggg

SEQ ID NO: 124845 - RNA, 26 nt, Human
aggcagguggauaacuuggggucagg

SEQ ID NO: 124846 - RNA, 20 nt, Human
aggcggagguuguagugagc

SEQ ID NO: 124847 - RNA, 21 nt, Human
aggcgggcagaucacuugagg

SEQ ID NO: 124848 - RNA, 22 nt, Human
aggcgggcagaucacuugaggu

SEQ ID NO: 124849 - RNA, 23 nt, Human
aggcgggcagaucacuugagguc

SEQ ID NO: 124850 - RNA, 26 nt, Human
aggcgggcagaucacuugaggucagg

SEQ ID NO: 124851 - RNA, 24 nt, Human
aggcggguggaucacgaggucaag

SEQ ID NO: 124852 - RNA, 24 nt, Human
aggcguagugacucaugcuuguaa

SEQ ID NO: 124853 - RNA, 19 nt, Human
aggcgugguggugugugcc

SEQ ID NO: 124854 - RNA, 24 nt, Human
aggcugaagugggaggauugcuug

SEQ ID NO: 124855 - RNA, 20 nt, Human
aggcugaggcaggagaaucg

SEQ ID NO: 124856 - RNA, 24 nt, Human
aggcugaggcaggagaaucgcuug

SEQ ID NO: 124857 - RNA, 21 nt, Human
aggcugaggcggguggaucac

SEQ ID NO: 124858 - RNA, 22 nt, Human
aggcugaggcggguggaucacg

SEQ ID NO: 124859 - RNA, 22 nt, Human
aggcuggagaagcacuugaacc

SEQ ID NO: 124860 - RNA, 24 nt, Human
aggcuggagaagcacuugaaccug

SEQ ID NO: 124861 - RNA, 22 nt, Human
aggcuggaugugguggcucaca

SEQ ID NO: 124862 - RNA, 20 nt, Human
agguggagguugcagugagc

SEQ ID NO: 124863 - RNA, 24 nt, Human
agguggagguugcagugagcugag

SEQ ID NO: 124864 - RNA, 24 nt, Human
agucugaccaacauggugaaaccc

SEQ ID NO: 124865 - RNA, 24 nt, Human
agugacucaugcuuguaaucccag

SEQ ID NO: 124866 - RNA, 19 nt, Human
aguuaggcuggauguggug

SEQ ID NO: 124867 - RNA, 24 nt, Human
auaccuguuaaucccagcacuuug

SEQ ID NO: 124868 - RNA, 24 nt, Human
aucacgccacugcacuccaaccug

SEQ ID NO: 124869 - RNA, 24 nt, Human
aucgcgccacugcacuccagccug

SEQ ID NO: 124870 - RNA, 23 nt, Human
aucuauagucccagcuacucggg

SEQ ID NO: 124871 - RNA, 22 nt, Human
auggcauaagaauuauaucucc

SEQ ID NO: 124872 - RNA, 23 nt, Human
auugcuugaaccugcgaggugga

SEQ ID NO: 124873 - RNA, 21 nt, Human
caaaaaaaaaaaaacaaaaag

SEQ ID NO: 124874 - RNA, 21 nt, Human
caaaaauacaaaaauuagcca

SEQ ID NO: 124875 - RNA, 26 nt, Human
caaaaugcugggauuacaggcccugc

SEQ ID NO: 124876 - RNA, 24 nt, Human
caacacagugaaaccucgucucua

SEQ ID NO: 124877 - RNA, 18 nt, Human
caacauggugaaacccca

SEQ ID NO: 124878 - RNA, 23 nt, Human
caacauggugaaacccgucucua

SEQ ID NO: 124879 - RNA, 18 nt, Human
caagagauggagaccauc

SEQ ID NO: 124880 - RNA, 24 nt, Human
caaggcagguggauaacuuggggu

SEQ ID NO: 124881 - RNA, 24 nt, Human
cacaccuguaaucccaggacuuug

SEQ ID NO: 124882 - RNA, 24 nt, Human
cacaccuguaaugccagcauuuug

SEQ ID NO: 124883 - RNA, 19 nt, Human
caccuguaaucccaggacu

SEQ ID NO: 124884 - RNA, 24 nt, Human
caccuguaaucccaggacuuuggg

SEQ ID NO: 124885 - RNA, 22 nt, Human
cacuaaaacuacaaaaaucagc

SEQ ID NO: 124886 - RNA, 18 nt, Human
cacuauguuggccaggcu

SEQ ID NO: 124887 - RNA, 24 nt, Human
cacuauguuggccaggcugcuuuc

SEQ ID NO: 124888 - RNA, 21 nt, Human
cacuccagccuggcaacagag

SEQ ID NO: 124889 - RNA, 22 nt, Human
cacuccagccuggcaacagagu

SEQ ID NO: 124890 - RNA, 23 nt, Human
cacugcacuccaaccugggugac

SEQ ID NO: 124891 - RNA, 24 nt, Human
cacugcacuccaaccugggugaca

SEQ ID NO: 124892 - RNA, 18 nt, Human
cacugcacuccagccugg

SEQ ID NO: 124893 - RNA, 20 nt, Human
cacugcacuccagccuggca

SEQ ID NO: 124894 - RNA, 23 nt, Human
cacugcacuccagccuggcaaca

SEQ ID NO: 124895 - RNA, 24 nt, Human
cacugcacuccagccuggcaacag

SEQ ID NO: 124896 - RNA, 26 nt, Human
cacugcacuccagcuuagaacagugg

SEQ ID NO: 124897 - RNA, 19 nt, Human
cacugcacuccagcuuagg

SEQ ID NO: 124898 - RNA, 19 nt, Human
cacugcacuccagcuuagg

SEQ ID NO: 124899 - RNA, 24 nt, Human
cacugcacuccagcuuaggagaca

SEQ ID NO: 124900 - RNA, 23 nt, Human
cacuugaggucaggaguuugaga

SEQ ID NO: 124901 - RNA, 24 nt, Human
cagaucacuugaggucaggaguuu

SEQ ID NO: 124902 - RNA, 24 nt, Human
cagcacuuugggaggcugaggcgg

SEQ ID NO: 124903 - RNA, 26 nt, Human
cagcauuuugagagaggucgaggcgg

SEQ ID NO: 124904 - RNA, 24 nt, Human
cagcuacucgggaggcugaggcag

SEQ ID NO: 124905 - RNA, 24 nt, Human
cagggucccacuauguuggccagg

SEQ ID NO: 124906 - RNA, 18 nt, Human
caggugcuugagauuggc

SEQ ID NO: 124907 - RNA, 23 nt, Human
cauaccuguuaaucccagcacuu

SEQ ID NO: 124908 - RNA, 24 nt, Human
caucuauagucccagcuacucggg

SEQ ID NO: 124909 - RNA, 23 nt, Human
ccaaaaugcugggauuacaggcc

SEQ ID NO: 124910 - RNA, 23 nt, Human
ccaaccccggccucccaaaaugc

SEQ ID NO: 124911 - RNA, 20 nt, Human
ccacugcacuccaaccuggg

SEQ ID NO: 124912 - RNA, 24 nt, Human
ccacugcacuccaaccugggugac

SEQ ID NO: 124913 - RNA, 18 nt, Human
ccacugcacuccagccug

SEQ ID NO: 124914 - RNA, 19 nt, Human
ccacugcacuccagccugg

SEQ ID NO: 124915 - RNA, 19 nt, Human
ccacugcacuccagccugg

SEQ ID NO: 124916 - RNA, 20 nt, Human
ccacugcacuccagccuggc

SEQ ID NO: 124917 - RNA, 22 nt, Human
ccacugcacuccagccuggcaa

SEQ ID NO: 124918 - RNA, 23 nt, Human
ccacugcacuccagccuggcaac

SEQ ID NO: 124919 - RNA, 20 nt, Human
ccacugcacuccagcuuagg

SEQ ID NO: 124920 - RNA, 22 nt, Human
ccacugcacuccagcuuaggag

SEQ ID NO: 124921 - RNA, 24 nt, Human
ccacugcacuccagcuuaggagac

SEQ ID NO: 124922 - RNA, 19 nt, Human
ccaggacuuugggaagcca

SEQ ID NO: 124923 - RNA, 22 nt, Human
ccugcacuuggcuaaagcugcu

SEQ ID NO: 124924 - RNA, 21 nt, Human
ccugcgagguggagguugcag

SEQ ID NO: 124925 - RNA, 21 nt, Human
ccuggcaacagaguaagacuc

SEQ ID NO: 124926 - RNA, 21 nt, Human
ccuggccaacacagugaaacc

SEQ ID NO: 124927 - RNA, 24 nt, Human
ccuggccaacacagugaaaccucg

SEQ ID NO: 124928 - RNA, 23 nt, Human
ccuggccaacauggugaaacccc

SEQ ID NO: 124929 - RNA, 24 nt, Human
ccuggccaacauggugaaacccca

SEQ ID NO: 124930 - RNA, 25 nt, Human
ccugggaggcagagguugcagugag

SEQ ID NO: 124931 - RNA, 21 nt, Human
ccuguagucucagcuacuugg

SEQ ID NO: 124932 - RNA, 24 nt, Human
cgagacaagccuggccaacauggu

SEQ ID NO: 124933 - RNA, 24 nt, Human
cgaggcgggcagaucacuugaggu

SEQ ID NO: 124934 - RNA, 26 nt, Human
cgaggcgggcagaucacuugagguca

SEQ ID NO: 124935 - RNA, 24 nt, Human
cgaggcuggagaagcacuugaacc

SEQ ID NO: 124936 - RNA, 26 nt, Human
cgccacugcacuccaaccugggugac

SEQ ID NO: 124937 - RNA, 24 nt, Human
cgggcagaucacuugaggucagga

SEQ ID NO: 124938 - RNA, 24 nt, Human
cguggcucacaccuguaaugccag

SEQ ID NO: 124939 - RNA, 21 nt, Human
cuaaaacuacaaaaaucagcc

SEQ ID NO: 124940 - RNA, 18 nt, Human
cuauagucccagcuacuc

SEQ ID NO: 124941 - RNA, 20 nt, Human
cuauagucccagcuacucgg

SEQ ID NO: 124942 - RNA, 18 nt, Human
cucaaaaaaaaaaaaaca

SEQ ID NO: 124943 - RNA, 23 nt, Human
cucaaaaaaaaaaaaacaaaaag

SEQ ID NO: 124944 - RNA, 24 nt, Human
cucaaaugauccuccaaccccggc

SEQ ID NO: 124945 - RNA, 22 nt, Human
cucacaccuguaaucccaggac

SEQ ID NO: 124946 - RNA, 24 nt, Human
cucacaccuguaaucccaggacuu

SEQ ID NO: 124947 - RNA, 21 nt, Human
cucacaccuguaaugccagca

SEQ ID NO: 124948 - RNA, 25 nt, Human
cucaugcuuguaaucccaggugcuu

SEQ ID NO: 124949 - RNA, 23 nt, Human
cucugucucaaaaaaaaaaaaac

SEQ ID NO: 124950 - RNA, 21 nt, Human
cugaccaacauggugaaaccc

SEQ ID NO: 124951 - RNA, 31 nt, Human
cugcacuccagcuuaggagacagaggaagag

SEQ ID NO: 124952 - RNA, 18 nt, Human
cuggccaacacagugaaa

SEQ ID NO: 124953 - RNA, 23 nt, Human
cuggccaacauggugaaacccca

SEQ ID NO: 124954 - RNA, 25 nt, Human
cugucucaaaaaaaaaaaaacaaaa

SEQ ID NO: 124955 - RNA, 19 nt, Human
gaagacucugucucaaaaa

SEQ ID NO: 124956 - RNA, 24 nt, Human
gaagugggaggauugcuugaaccu

SEQ ID NO: 124957 - RNA, 24 nt, Human
gacagaggaagacucugucucaaa

SEQ ID NO: 124958 - RNA, 24 nt, Human
gaccaacauggugaaacccgucuc

SEQ ID NO: 124959 - RNA, 23 nt, Human
gagaaucgcuugaacaugggagg

SEQ ID NO: 124960 - RNA, 19 nt, Human
gagacagaggaagacucug

SEQ ID NO: 124961 - RNA, 23 nt, Human
gagaggucgaggcgggcagauca

SEQ ID NO: 124962 - RNA, 18 nt, Human
gagaucacgccacugcac

SEQ ID NO: 124963 - RNA, 23 nt, Human
gagaugaugccacugcacuccag

SEQ ID NO: 124964 - RNA, 18 nt, Human
gagguggagguugcagug

SEQ ID NO: 124965 - RNA, 22 nt, Human
gagguugcagugagcugagauc

SEQ ID NO: 124966 - RNA, 21 nt, Human
gauaacuuggggucaggaguu

SEQ ID NO: 124967 - RNA, 24 nt, Human
gauaacuuggggucaggaguucga

SEQ ID NO: 124968 - RNA, 24 nt, Human
gaucacuugaggucaggaguuuga

SEQ ID NO: 124969 - RNA, 23 nt, Human
gcacuccagccuggcaacagagu

SEQ ID NO: 124970 - RNA, 21 nt, Human
gccaacacagugaaaccucgu

SEQ ID NO: 124971 - RNA, 24 nt, Human
gccaacauggugaaaccccaucuc

SEQ ID NO: 124972 - RNA, 24 nt, Human
gccacugcacuccaaccuggguga

SEQ ID NO: 124973 - RNA, 20 nt, Human
gcugagaucacgccacugca

SEQ ID NO: 124974 - RNA, 20 nt, Human
gcugagaucgcgccacugca

SEQ ID NO: 124975 - RNA, 20 nt, Human
gcuugggaggcugaaguggg

SEQ ID NO: 124976 - RNA, 19 nt, Human
ggaaauguggagggacugc

SEQ ID NO: 124977 - RNA, 21 nt, Human
ggagaagcacuugaaccuggg

SEQ ID NO: 124978 - RNA, 24 nt, Human
ggagaccauccuggccaacacagu

SEQ ID NO: 124979 - RNA, 22 nt, Human
ggagguugcagugagcugagau

SEQ ID NO: 124980 - RNA, 23 nt, Human
ggagguugcagugagcugagauc

SEQ ID NO: 124981 - RNA, 24 nt, Human
ggagguugcagugagcugagauca

SEQ ID NO: 124982 - RNA, 22 nt, Human
ggagguuguagugagcugagau

SEQ ID NO: 124983 - RNA, 24 nt, Human
ggagguuguagugagcugagaucg

SEQ ID NO: 124984 - RNA, 24 nt, Human
ggaugugguggcucacaccuguaa

SEQ ID NO: 124985 - RNA, 22 nt, Human
ggcuggugaggcaggggaggca

SEQ ID NO: 124986 - RNA, 24 nt, Human
gggcaccguggcucacaccuguaa

SEQ ID NO: 124987 - RNA, 26 nt, Human
gggcagaucacuugaggucaggaguu

SEQ ID NO: 124988 - RNA, 22 nt, Human
gggucccacuauguuggccagg

SEQ ID NO: 124989 - RNA, 22 nt, Human
ggugcuugagauuggcaggguu

SEQ ID NO: 124990 - RNA, 19 nt, Human
gguggagguugcagugagc

SEQ ID NO: 124991 - RNA, 18 nt, Human
gguggaucacgaggucaa

SEQ ID NO: 124992 - RNA, 24 nt, Human
gguggcucacaccuguaaucccag

SEQ ID NO: 124993 - RNA, 25 nt, Human
ggugguucauaccuguuaaucccag

SEQ ID NO: 124994 - RNA, 22 nt, Human
gguucauaccuguuaaucccag

SEQ ID NO: 124995 - RNA, 18 nt, Human
guagagacagggucccac

SEQ ID NO: 124996 - RNA, 21 nt, Human
gugaaaccucgucucuacuaa

SEQ ID NO: 124997 - RNA, 23 nt, Human
guggcucacaccuguaaucccag

SEQ ID NO: 124998 - RNA, 24 nt, Human
guggugugugccuguagucucagc

SEQ ID NO: 124999 - RNA, 24 nt, Human
gugguucauaccuguuaaucccag

SEQ ID NO: 125000 - RNA, 19 nt, Human
guugcagugagcugagauc

SEQ ID NO: 125001 - RNA, 24 nt, Human
guugcagugagcugagaugaugcc

SEQ ID NO: 125002 - RNA, 21 nt, Human
uaaaaaaagaaaggaagagaa

SEQ ID NO: 125003 - RNA, 21 nt, Human
uaaaacuacaaaaaucagcca

SEQ ID NO: 125004 - RNA, 19 nt, Human
uaagaauaauaaaauuaau

SEQ ID NO: 125005 - RNA, 22 nt, Human
uaagaauaauaaaauuaauucu

SEQ ID NO: 125006 - RNA, 25 nt, Human
uaccaaaaauacaaaaauuagccag

SEQ ID NO: 125007 - RNA, 18 nt, Human
uacuugggaggccgaggc

SEQ ID NO: 125008 - RNA, 22 nt, Human
uagagacagggucccacuaugu

SEQ ID NO: 125009 - RNA, 24 nt, Human
uagugacucaugcuuguaauccca

SEQ ID NO: 125010 - RNA, 18 nt, Human
uauauauauguauauaua

SEQ ID NO: 125011 - RNA, 24 nt, Human
ucacgaggucaagagauggagacc

SEQ ID NO: 125012 - RNA, 23 nt, Human
ucacgccacugcacuccaaccug

SEQ ID NO: 125013 - RNA, 19 nt, Human
ucacuugaggucaggaguu

SEQ ID NO: 125014 - RNA, 18 nt, Human
ucagaaugguggugucuu

SEQ ID NO: 125015 - RNA, 22 nt, Human
ucagacaaaaaaaaaaaagaaa

SEQ ID NO: 125016 - RNA, 26 nt, Human
ucagacaaaaaaaaaaaagaagguga

SEQ ID NO: 125017 - RNA, 23 nt, Human
ucagccaggcguagugacucaug

SEQ ID NO: 125018 - RNA, 23 nt, Human
ucauaccuguuaaucccagcacu

SEQ ID NO: 125019 - RNA, 23 nt, Human
ucaugcuuguaaucccaggugcu

SEQ ID NO: 125020 - RNA, 24 nt, Human
ucccaaaaugcugggauuacaggc

SEQ ID NO: 125021 - RNA, 27 nt, Human
ucccaaaaugcugggauuacaggcccu

SEQ ID NO: 125022 - RNA, 22 nt, Human
uccugggcucaaaugauccucc

SEQ ID NO: 125023 - RNA, 24 nt, Human
ucgcuugaacaugggaggcggagg

SEQ ID NO: 125024 - RNA, 24 nt, Human
ucgggaggcugaggcaggagaauc

SEQ ID NO: 125025 - RNA, 23 nt, Human
ucucaaaaaaaaaaaaacaaaaa

SEQ ID NO: 125026 - RNA, 20 nt, Human
ucucagacaaaaaaaaaaaa

SEQ ID NO: 125027 - RNA, 18 nt, Human
ucuccauaaagcugcuau

SEQ ID NO: 125028 - RNA, 21 nt, Human
ucucuacuaaaaauacaaaaa

SEQ ID NO: 125029 - RNA, 23 nt, Human
ucugaccaacauggugaaacccg

SEQ ID NO: 125030 - RNA, 21 nt, Human
ucugucucaaaaaaaaaaaaa

SEQ ID NO: 125031 - RNA, 18 nt, Human
ucuugcucugucacucag

SEQ ID NO: 125032 - RNA, 19 nt, Human
ucuugcucugucacucagg

SEQ ID NO: 125033 - RNA, 19 nt, Human
ugaaaccccaucuccacua

SEQ ID NO: 125034 - RNA, 22 nt, Human
ugaaaccccaucuccacuaaaa

SEQ ID NO: 125035 - RNA, 24 nt, Human
ugaaccugggaggcagagguugca

SEQ ID NO: 125036 - RNA, 19 nt, Human
ugaagugggaggauugcuu

SEQ ID NO: 125037 - RNA, 23 nt, Human
ugaccaacauggugaaacccguc

SEQ ID NO: 125038 - RNA, 21 nt, Human
ugacucaugcuuguaauccca

SEQ ID NO: 125039 - RNA, 23 nt, Human
ugagacuagucugaccaacaugg

SEQ ID NO: 125040 - RNA, 24 nt, Human
ugagacuagucugaccaacauggu

SEQ ID NO: 125041 - RNA, 24 nt, Human
ugagaucgcgccacugcacuccag

SEQ ID NO: 125042 - RNA, 22 nt, Human
ugagauggggucuugcucuguc

SEQ ID NO: 125043 - RNA, 22 nt, Human
ugagcugagaucacgccacugc

SEQ ID NO: 125044 - RNA, 22 nt, Human
ugagcugagaucgcgccacugc

SEQ ID NO: 125045 - RNA, 20 nt, Human
ugaggcaggagaaucgcuug

SEQ ID NO: 125046 - RNA, 23 nt, Human
ugaggcaggagaaucgcuugaac

SEQ ID NO: 125047 - RNA, 24 nt, Human
ugaggcggguggaucacgagguca

SEQ ID NO: 125048 - RNA, 18 nt, Human
ugaggucaggaguuugag

SEQ ID NO: 125049 - RNA, 21 nt, Human
ugauccuccaaccccggccuc

SEQ ID NO: 125050 - RNA, 25 nt, Human
ugauccuccaaccccggccucccaa

SEQ ID NO: 125051 - RNA, 23 nt, Human
ugccuguagucucagcuacuugg

SEQ ID NO: 125052 - RNA, 24 nt, Human
ugccuguagucucagcuacuuggg

SEQ ID NO: 125053 - RNA, 24 nt, Human
ugcgagguggagguugcagugagc

SEQ ID NO: 125054 - RNA, 22 nt, Human
ugcugggauuacaggcccugca

SEQ ID NO: 125055 - RNA, 24 nt, Human
ugcuuguaaucccaggugcuuggg

SEQ ID NO: 125056 - RNA, 24 nt, Human
uggauaacuuggggucaggaguuc

SEQ ID NO: 125057 - RNA, 21 nt, Human
uggcaggguuguaauggcugg

SEQ ID NO: 125058 - RNA, 24 nt, Human
uggccaacauggugaaaccccauc

SEQ ID NO: 125059 - RNA, 24 nt, Human
uggccaggcugcuuuccaauuccu

SEQ ID NO: 125060 - RNA, 21 nt, Human
uggcucacaccuguaauccca

SEQ ID NO: 125061 - RNA, 22 nt, Human
uggcucacaccuguaaucccag

SEQ ID NO: 125062 - RNA, 24 nt, Human
uggcucacaccuguaaugccagca

SEQ ID NO: 125063 - RNA, 19 nt, Human
uggcuggcccccacucgcu

SEQ ID NO: 125064 - RNA, 24 nt, Human
ugggaggcagagguugcagugagc

SEQ ID NO: 125065 - RNA, 18 nt, Human
ugggaggccgaggcugga

SEQ ID NO: 125066 - RNA, 23 nt, Human
ugggaggccgaggcuggagaagc

SEQ ID NO: 125067 - RNA, 21 nt, Human
ugggaggcggagguuguagug

SEQ ID NO: 125068 - RNA, 24 nt, Human
ugggaggcggagguuguagugagc

SEQ ID NO: 125069 - RNA, 22 nt, Human
ugggaggcugaagugggaggau

SEQ ID NO: 125070 - RNA, 24 nt, Human
ugggaggcugaagugggaggauug

SEQ ID NO: 125071 - RNA, 20 nt, Human
ugggaggcugaggcgggugg

SEQ ID NO: 125072 - RNA, 23 nt, Human
ugggaggcugaggcggguggauc

SEQ ID NO: 125073 - RNA, 24 nt, Human
ugggaggcugaggcggguggauca

SEQ ID NO: 125074 - RNA, 19 nt, Human
uggggucuugcucugucac

SEQ ID NO: 125075 - RNA, 24 nt, Human
ugguggcucacaccuguaauccca

SEQ ID NO: 125076 - RNA, 24 nt, Human
ugguggugugugccuguagucuca

SEQ ID NO: 125077 - RNA, 18 nt, Human
uggugugugccuguaguc

SEQ ID NO: 125078 - RNA, 24 nt, Human
uggugugugccuguagucucagcu

SEQ ID NO: 125079 - RNA, 24 nt, Human
uguagagacagggucccacuaugu

SEQ ID NO: 125080 - RNA, 24 nt, Human
uguuuguuuuuuuuuugagauggg

SEQ ID NO: 125081 - RNA, 24 nt, Human
uguuuuuuuuuugagauggggucu

SEQ ID NO: 125082 - RNA, 24 nt, Human
uuagccaggcgugguggugugugc

SEQ ID NO: 125083 - RNA, 18 nt, Human
uuagcuggccaugguggc

SEQ ID NO: 125084 - RNA, 23 nt, Human
uuccugggcucaaaugauccucc

SEQ ID NO: 125085 - RNA, 23 nt, Human
uugaacaugggaggcggagguug

SEQ ID NO: 125086 - RNA, 24 nt, Human
uugaaccugcgagguggagguugc

SEQ ID NO: 125087 - RNA, 24 nt, Human
uugaaccugggaggcagagguugc

SEQ ID NO: 125088 - RNA, 21 nt, Human
uugagauggggucuugcucug

SEQ ID NO: 125089 - RNA, 18 nt, Human
uugcagugagcugagauc

SEQ ID NO: 125090 - RNA, 19 nt, Human
uugcagugagcugagauca

SEQ ID NO: 125091 - RNA, 20 nt, Human
uugcagugagcugagaucac

SEQ ID NO: 125092 - RNA, 20 nt, Human
uugcagugagcugagaugau

SEQ ID NO: 125093 - RNA, 24 nt, Human
uugcuugaaccugcgagguggagg

SEQ ID NO: 125094 - RNA, 20 nt, Human
uugggaggcugaagugggag

SEQ ID NO: 125095 - RNA, 25 nt, Human
uugggaggcugaggcggguggauca

SEQ ID NO: 125096 - RNA, 24 nt, Human
uuguagagacagggucccacuaug

SEQ ID NO: 125097 - RNA, 19 nt, Human
uuguagugagcugagaucg

SEQ ID NO: 125098 - RNA, 20 nt, Human
uuguagugagcugagaucgc

SEQ ID NO: 125099 - RNA, 20 nt, Human
uuguuuguuuguuuuuuuuu

SEQ ID NO: 125100 - RNA, 22 nt, Human
uuuagagaaggcaaauccauag

SEQ ID NO: 125101 - RNA, 22 nt, Human
uuugagauggggucuugcucug

SEQ ID NO: 125102 - RNA, 18 nt, Human
uuuguagagacagggucc

SEQ ID NO: 125103 - RNA, 18 nt, Human
uuuuuuuguagagacagg

SEQ ID NO: 125104 - RNA, 22 nt, Human
uuuuuuuguuuguuuguuuuuu

SEQ ID NO: 125105 - RNA, 22 nt, Human
uuuuuuuuuugagauggggucu

SEQ ID NO: 125106 - RNA, 24 nt, Human
uuuuuuuuuugagauggggucuug

SEQ ID NO: 125107 - RNA, 22 nt, Human
uuuuuuuuuuguagagacaggg

SEQ ID NO: 125108 - RNA, 21 nt, Human
aaaaaacacaacugaccucau

SEQ ID NO: 125109 - RNA, 28 nt, Human
aaaaagcaggcauuaauguuccagucgg

SEQ ID NO: 125110 - RNA, 22 nt, Human
aaaagaacauccagguaauuca

SEQ ID NO: 125111 - RNA, 24 nt, Human
aaaauaggcuacagcagcccaaau

SEQ ID NO: 125112 - RNA, 22 nt, Human
aaaauuuugguacaaagauucc

SEQ ID NO: 125113 - RNA, 21 nt, Human
aaagaaugcuaccuucagaaa

SEQ ID NO: 125114 - RNA, 20 nt, Human
aacacaacugaccucaucuc

SEQ ID NO: 125115 - RNA, 20 nt, Human
aacaggaacccgcaggcccg

SEQ ID NO: 125116 - RNA, 20 nt, Human
aacuuggucaguuguaaugg

SEQ ID NO: 125117 - RNA, 21 nt, Human
aagcucauuuuuagcacacuu

SEQ ID NO: 125118 - RNA, 23 nt, Human
aagugccaaaaaauuuaaaugua

SEQ ID NO: 125119 - RNA, 24 nt, Human
aauucccaugcccuugcggcucuc

SEQ ID NO: 125120 - RNA, 18 nt, Human
acaaaacagaucugcuau

SEQ ID NO: 125121 - RNA, 22 nt, Human
acaaagauuccaaaaagcuuaa

SEQ ID NO: 125122 - RNA, 24 nt, Human
acaaagauuccaaaaagcuuaaua

SEQ ID NO: 125123 - RNA, 24 nt, Human
accauccccccaccccacacacac

SEQ ID NO: 125124 - RNA, 18 nt, Human
accuggaguaaaacuucu

SEQ ID NO: 125125 - RNA, 22 nt, Human
acuggagucgcagaagcgcucg

SEQ ID NO: 125126 - RNA, 22 nt, Human
agaagcagcacaaaagaggaac

SEQ ID NO: 125127 - RNA, 18 nt, Human
agaagcuccugcauagcc

SEQ ID NO: 125128 - RNA, 19 nt, Human
agaauguacuuugucuaca

SEQ ID NO: 125129 - RNA, 18 nt, Human
agacgucaacaggaaccc

SEQ ID NO: 125130 - RNA, 24 nt, Human
agccggcuccgagaaggaacuggg

SEQ ID NO: 125131 - RNA, 23 nt, Human
agcuaccaaaguaauugccaucu

SEQ ID NO: 125132 - RNA, 19 nt, Human
aggaacccgcaggcccggc

SEQ ID NO: 125133 - RNA, 21 nt, Human
agggaauuucuggucuuuauc

SEQ ID NO: 125134 - RNA, 23 nt, Human
aguaaucugauuacuccagccuc

SEQ ID NO: 125135 - RNA, 19 nt, Human
aucuuaaaaaacacaacug

SEQ ID NO: 125136 - RNA, 19 nt, Human
augaacuuuaaaacuugaa

SEQ ID NO: 125137 - RNA, 18 nt, Human
auguuaacuuucaaaaaa

SEQ ID NO: 125138 - RNA, 24 nt, Human
caaaaaauuuaaauguacugggca

SEQ ID NO: 125139 - RNA, 24 nt, Human
caaacaucuuucuucuaaaugucc

SEQ ID NO: 125140 - RNA, 19 nt, Human
caacaggaacccgcaggcc

SEQ ID NO: 125141 - RNA, 23 nt, Human
cacacuuuacacugaaauuacuu

SEQ ID NO: 125142 - RNA, 25 nt, Human
caccccacacacacauacacacaac

SEQ ID NO: 125143 - RNA, 24 nt, Human
cagcagcccaaauucacugucuuc

SEQ ID NO: 125144 - RNA, 24 nt, Human
cagcguugagauugagacuggggg

SEQ ID NO: 125145 - RNA, 22 nt, Human
caggaacccgcaggcccggccu

SEQ ID NO: 125146 - RNA, 21 nt, Human
cauccagauugguucaugauu

SEQ ID NO: 125147 - RNA, 21 nt, Human
caugcccuugcggcucucaca

SEQ ID NO: 125148 - RNA, 19 nt, Human
ccacacacacauacacaca

SEQ ID NO: 125149 - RNA, 18 nt, Human
ccacucgagucucuuggc

SEQ ID NO: 125150 - RNA, 20 nt, Human
cccacacacacauacacaca

SEQ ID NO: 125151 - RNA, 21 nt, Human
cccaccccacacacacauaca

SEQ ID NO: 125152 - RNA, 28 nt, Human
ccccaccccacacacacauacacacaac

SEQ ID NO: 125153 - RNA, 21 nt, Human
cccccaccccacacacacaua

SEQ ID NO: 125154 - RNA, 24 nt, Human
ccccgcugcccuuggggaccuggu

SEQ ID NO: 125155 - RNA, 18 nt, Human
cccgcaggcccggccugg

SEQ ID NO: 125156 - RNA, 19 nt, Human
cccggccuggacaccugcu

SEQ ID NO: 125157 - RNA, 20 nt, Human
ccugguuaccaaaauacuuc

SEQ ID NO: 125158 - RNA, 24 nt, Human
ccuucagaaauaaccaagaugcag

SEQ ID NO: 125159 - RNA, 21 nt, Human
cggggaggugcgguuuccagu

SEQ ID NO: 125160 - RNA, 23 nt, Human
cucacuggaagcuuuaacuccca

SEQ ID NO: 125161 - RNA, 21 nt, Human
cucuucaacaauauacucuga

SEQ ID NO: 125162 - RNA, 20 nt, Human
cugacuuuccaaaaagcagg

SEQ ID NO: 125163 - RNA, 21 nt, Human
cugcggggaggugcgguuucc

SEQ ID NO: 125164 - RNA, 20 nt, Human
cugcugcccucacuggaagc

SEQ ID NO: 125165 - RNA, 20 nt, Human
cuuaccauccccccaccccc

SEQ ID NO: 125166 - RNA, 25 nt, Human
cuuuccuucuuuucaguguuucucu

SEQ ID NO: 125167 - RNA, 19 nt, Human
gaagcuccugcauagcccu

SEQ ID NO: 125168 - RNA, 21 nt, Human
gagcacaccucaccugaugga

SEQ ID NO: 125169 - RNA, 21 nt, Human
gcccucacuggaagcuuuaac

SEQ ID NO: 125170 - RNA, 18 nt, Human
ggagaagggugccucgcu

SEQ ID NO: 125171 - RNA, 20 nt, Human
gguagaaacacaaugagggu

SEQ ID NO: 125172 - RNA, 20 nt, Human
ggugcgguuuccaguggcgc

SEQ ID NO: 125173 - RNA, 20 nt, Human
guaaaggcuacauauaaaug

SEQ ID NO: 125174 - RNA, 19 nt, Human
guauaccuuuuaaucacac

SEQ ID NO: 125175 - RNA, 19 nt, Human
gucgucagugccaggagcg

SEQ ID NO: 125176 - RNA, 25 nt, Human
uaaaaaaauaggcuacagcagccca

SEQ ID NO: 125177 - RNA, 18 nt, Human
uaaaaaacacaacugacc

SEQ ID NO: 125178 - RNA, 22 nt, Human
uaaagcaguaaucugauuacuc

SEQ ID NO: 125179 - RNA, 19 nt, Human
uaaaggcuaaguucuggga

SEQ ID NO: 125180 - RNA, 20 nt, Human
uaaauccacccauaaauacu

SEQ ID NO: 125181 - RNA, 23 nt, Human
uaaaugugaaugcauacauuuca

SEQ ID NO: 125182 - RNA, 22 nt, Human
uaagaaaagauuaaauaagaag

SEQ ID NO: 125183 - RNA, 23 nt, Human
uaagccagguaaacuccaagcac

SEQ ID NO: 125184 - RNA, 22 nt, Human
uaaguguuuggguguauguguc

SEQ ID NO: 125185 - RNA, 25 nt, Human
uaaguucugggacaugaaagcuuuu

SEQ ID NO: 125186 - RNA, 19 nt, Human
uaauucauggcauuuucca

SEQ ID NO: 125187 - RNA, 22 nt, Human
uacaacaucaccuuggaguuuu

SEQ ID NO: 125188 - RNA, 26 nt, Human
uaccaaaguaauugccaucuuaaaaa

SEQ ID NO: 125189 - RNA, 20 nt, Human
uacugggcaagccugcuuug

SEQ ID NO: 125190 - RNA, 20 nt, Human
uagaaaauucacaaaacaaa

SEQ ID NO: 125191 - RNA, 18 nt, Human
uaggcuacagcagcccaa

SEQ ID NO: 125192 - RNA, 20 nt, Human
ucaaaaaaucaucuagaaga

SEQ ID NO: 125193 - RNA, 19 nt, Human
ucaaucuaaaaaaauaggc

SEQ ID NO: 125194 - RNA, 19 nt, Human
ucaauucacuuuucuaaau

SEQ ID NO: 125195 - RNA, 28 nt, Human
ucaauucccaugcccuugcggcucucaa

SEQ ID NO: 125196 - RNA, 21 nt, Human
ucacagcguugagauugagac

SEQ ID NO: 125197 - RNA, 21 nt, Human
ucacagcuaaaaacacacaaa

SEQ ID NO: 125198 - RNA, 25 nt, Human
ucacagcuaaaaacacacaaauuaa

SEQ ID NO: 125199 - RNA, 24 nt, Human
ucacagguaaaggcuaaguucugg

SEQ ID NO: 125200 - RNA, 21 nt, Human
uccaaaaagcaggcauuaaug

SEQ ID NO: 125201 - RNA, 25 nt, Human
uccaaaccacaaaacagaucugcua

SEQ ID NO: 125202 - RNA, 25 nt, Human
ucccaccaaaaauggccugguuacc

SEQ ID NO: 125203 - RNA, 18 nt, Human
ucgcucccacucccacuc

SEQ ID NO: 125204 - RNA, 25 nt, Human
ucuacaacuaugcacuguagcuauu

SEQ ID NO: 125205 - RNA, 22 nt, Human
ucucucuuuucucuuaccaucc

SEQ ID NO: 125206 - RNA, 25 nt, Human
ucuucauucaguaguuugguguaac

SEQ ID NO: 125207 - RNA, 23 nt, Human
ucuuuccuucuuuucaguguuuc

SEQ ID NO: 125208 - RNA, 22 nt, Human
ucuuuuuguuuuggaaaaaagc

SEQ ID NO: 125209 - RNA, 18 nt, Human
ugaaaucaguacauuaug

SEQ ID NO: 125210 - RNA, 21 nt, Human
ugacauaaugaggcauccaga

SEQ ID NO: 125211 - RNA, 26 nt, Human
ugagaagcagcacaaaagaggaaaac

SEQ ID NO: 125212 - RNA, 19 nt, Human
ugagugaagaaaagaaacc

SEQ ID NO: 125213 - RNA, 24 nt, Human
ugaguuauaaaugucuacuaaagu

SEQ ID NO: 125214 - RNA, 27 nt, Human
ugccuagggcaagacgucaacaggaac

SEQ ID NO: 125215 - RNA, 22 nt, Human
uggaaaaaaacugaauuuuacu

SEQ ID NO: 125216 - RNA, 19 nt, Human
uggaauggcaagugccaaa

SEQ ID NO: 125217 - RNA, 20 nt, Human
uggaauggcaagugccaaaa

SEQ ID NO: 125218 - RNA, 22 nt, Human
uggaauggcaagugccaaaaaa

SEQ ID NO: 125219 - RNA, 18 nt, Human
uggacaguugauuuaugc

SEQ ID NO: 125220 - RNA, 27 nt, Human
uggccugguuaccaaaauacuucuuca

SEQ ID NO: 125221 - RNA, 21 nt, Human
uggcgcgggacagccggcucc

SEQ ID NO: 125222 - RNA, 18 nt, Human
uggcgucaauucccaugc

SEQ ID NO: 125223 - RNA, 19 nt, Human
uggguguaugugucuauau

SEQ ID NO: 125224 - RNA, 19 nt, Human
uguagaacuuucuuuggaa

SEQ ID NO: 125225 - RNA, 19 nt, Human
ugucacagcuaaaaacaca

SEQ ID NO: 125226 - RNA, 18 nt, Human
ugucucagccuugguggg

SEQ ID NO: 125227 - RNA, 23 nt, Human
ugucucagccuugguggggcaua

SEQ ID NO: 125228 - RNA, 22 nt, Human
uuaaaaaacacaacugaccuca

SEQ ID NO: 125229 - RNA, 18 nt, Human
uucacugucucagccuug

SEQ ID NO: 125230 - RNA, 22 nt, Human
uucccuuaucaccuucaaucac

SEQ ID NO: 125231 - RNA, 19 nt, Human
uucuuccauauaaacacag

SEQ ID NO: 125232 - RNA, 23 nt, Human
uucuuuggaaguuuaauugcaau

SEQ ID NO: 125233 - RNA, 23 nt, Human
uugagauugagacugggggucgg

SEQ ID NO: 125234 - RNA, 20 nt, Human
uugccgcaagcaucugauga

SEQ ID NO: 125235 - RNA, 22 nt, Human
uuggcaagcaaaagagguacaa

SEQ ID NO: 125236 - RNA, 25 nt, Human
uuuaaaauucaugauaacucaugga

SEQ ID NO: 125237 - RNA, 19 nt, Human
uuuaauagccuauuugaga

SEQ ID NO: 125238 - RNA, 24 nt, Human
uuucuuuuccuuucuuuaacuagg

SEQ ID NO: 125239 - RNA, 18 nt, Human
uuuuagcacacuugguug

SEQ ID NO: 125240 - RNA, 21 nt, Human
uuuuccuuucuuuaacuaggu

SEQ ID NO: 125241 - RNA, 28 nt, Human
aggagcaauaaaggagaaaccgguaccc

SEQ ID NO: 125242 - RNA, 20 nt, Human
agggagcucugcggggaggu

SEQ ID NO: 125243 - RNA, 23 nt, Human
caccacccagccgcuggaggaag

SEQ ID NO: 125244 - RNA, 25 nt, Human
cagcggagggucaggaagggagcuc

SEQ ID NO: 125245 - RNA, 21 nt, Human
cagggcccugaggugccacuu

SEQ ID NO: 125246 - RNA, 19 nt, Human
cccaccucucucgcacccc

SEQ ID NO: 125247 - RNA, 21 nt, Human
cccaguaugacugccgagcac

SEQ ID NO: 125248 - RNA, 21 nt, Human
ccucaauccucugcagcggag

SEQ ID NO: 125249 - RNA, 21 nt, Human
cggaaaugaagcugagaccaa

SEQ ID NO: 125250 - RNA, 23 nt, Human
cucuugacaaccccuuucccagg

SEQ ID NO: 125251 - RNA, 18 nt, Human
cuggaagggcuucgaguu

SEQ ID NO: 125252 - RNA, 21 nt, Human
cuugacaaccccuuucccagg

SEQ ID NO: 125253 - RNA, 23 nt, Human
cuugacaaccccuuucccaggga

SEQ ID NO: 125254 - RNA, 21 nt, Human
gaaaugaagcugagaccaaga

SEQ ID NO: 125255 - RNA, 21 nt, Human
gagcaauaaaggagaaacuga

SEQ ID NO: 125256 - RNA, 24 nt, Human
gagccccagccaucccuccugcug

SEQ ID NO: 125257 - RNA, 21 nt, Human
gaggagcagaugggacauccg

SEQ ID NO: 125258 - RNA, 24 nt, Human
gcucugcggggagguugguugagu

SEQ ID NO: 125259 - RNA, 23 nt, Human
ggagugagcugguaccacuggaa

SEQ ID NO: 125260 - RNA, 20 nt, Human
uaagccucaauccucugcag

SEQ ID NO: 125261 - RNA, 22 nt, Human
uccugcuguguagacuguuuug

SEQ ID NO: 125262 - RNA, 23 nt, Human
ucucuugacaaccccuuucccag

SEQ ID NO: 125263 - RNA, 22 nt, Human
ugaggugccacuuauagcucaa

SEQ ID NO: 125264 - RNA, 23 nt, Human
uggaaagggccagcucagaauua

SEQ ID NO: 125265 - RNA, 19 nt, Human
ugggaggagcagaugggac

SEQ ID NO: 125266 - RNA, 25 nt, Human
ugggaggagcagaugggacauccgg

SEQ ID NO: 125267 - RNA, 20 nt, Human
uuaaggggaaugggaggagc

SEQ ID NO: 125268 - RNA, 18 nt, Human
uuacaggggggaggggag

SEQ ID NO: 125269 - RNA, 22 nt, Human
aaaauaaacaauuuuaaggucc

SEQ ID NO: 125270 - RNA, 19 nt, Human
aacaugcccugcaccacag

SEQ ID NO: 125271 - RNA, 20 nt, Human
aagcaguaguaaaaauaugc

SEQ ID NO: 125272 - RNA, 19 nt, Human
aagugccagccucccuuuc

SEQ ID NO: 125273 - RNA, 24 nt, Human
acacacacacagacacacacacac

SEQ ID NO: 125274 - RNA, 26 nt, Human
acacacacauacacggacacacacaa

SEQ ID NO: 125275 - RNA, 28 nt, Human
acacacacauacacggacacacacacac

SEQ ID NO: 125276 - RNA, 22 nt, Human
acacagacacacacacacaugc

SEQ ID NO: 125277 - RNA, 21 nt, Human
acagaaaaauuauggcauggg

SEQ ID NO: 125278 - RNA, 19 nt, Human
acccuguagaaugccuugg

SEQ ID NO: 125279 - RNA, 24 nt, Human
acugaggcaaauuaccauuagaac

SEQ ID NO: 125280 - RNA, 22 nt, Human
agagagaaagcauauaccuaga

SEQ ID NO: 125281 - RNA, 20 nt, Human
agagcuacaguaaauggauu

SEQ ID NO: 125282 - RNA, 23 nt, Human
agcaguaguaaaaauaugcacaa

SEQ ID NO: 125283 - RNA, 23 nt, Human
aggaaaagcaguaguaaaaauau

SEQ ID NO: 125284 - RNA, 22 nt, Human
aggcagcagaaggacucggcga

SEQ ID NO: 125285 - RNA, 21 nt, Human
aggcaggaggauggggugggg

SEQ ID NO: 125286 - RNA, 23 nt, Human
aggcaggaggaugggguggggcg

SEQ ID NO: 125287 - RNA, 29 nt, Human
aggcaggaggauggggugggggggacccc

SEQ ID NO: 125288 - RNA, 23 nt, Human
aguccuuuuaaaaauagaggugu

SEQ ID NO: 125289 - RNA, 24 nt, Human
caaagagggccagcuggugugaug

SEQ ID NO: 125290 - RNA, 22 nt, Human
caaauaaaccaucuguaaacac

SEQ ID NO: 125291 - RNA, 24 nt, Human
caaauaaaccaucuguaaacacaa

SEQ ID NO: 125292 - RNA, 22 nt, Human
cacacacacacagacacacaca

SEQ ID NO: 125293 - RNA, 24 nt, Human
cacacacacacagacacacacaca

SEQ ID NO: 125294 - RNA, 20 nt, Human
caccacagauccuaaaucaa

SEQ ID NO: 125295 - RNA, 22 nt, Human
caccacgcgacagccucagagc

SEQ ID NO: 125296 - RNA, 25 nt, Human
cagaacaggcucccaggccauucua

SEQ ID NO: 125297 - RNA, 28 nt, Human
cagacacacacacacaugcaugucugug

SEQ ID NO: 125298 - RNA, 23 nt, Human
cagagaauuugaagguauacaga

SEQ ID NO: 125299 - RNA, 22 nt, Human
cagcagagagaaagcauauacc

SEQ ID NO: 125300 - RNA, 25 nt, Human
caucuuuacccuaaugccauaaagg

SEQ ID NO: 125301 - RNA, 22 nt, Human
ccacacacacauacacggacac

SEQ ID NO: 125302 - RNA, 26 nt, Human
ccacacacacauacacggacacacac

SEQ ID NO: 125303 - RNA, 19 nt, Human
ccacagauccuaaaucaag

SEQ ID NO: 125304 - RNA, 31 nt, Human
cccacacacacauacacggacacacacacaa

SEQ ID NO: 125305 - RNA, 19 nt, Human
cccagaaaauuuagcuguu

SEQ ID NO: 125306 - RNA, 19 nt, Human
ccucuugaaaagggaaagc

SEQ ID NO: 125307 - RNA, 20 nt, Human
ccugauaacuuuaaccauca

SEQ ID NO: 125308 - RNA, 18 nt, Human
ccuuggaucccagcacuc

SEQ ID NO: 125309 - RNA, 23 nt, Human
ccuuggaucccagcacucagucc

SEQ ID NO: 125310 - RNA, 18 nt, Human
cgaggaugcucgacgcug

SEQ ID NO: 125311 - RNA, 28 nt, Human
cggacacacacacacagacacacacaca

SEQ ID NO: 125312 - RNA, 21 nt, Human
cgggaaggcaggaggaugggg

SEQ ID NO: 125313 - RNA, 21 nt, Human
cugaccucuagggcuugcugg

SEQ ID NO: 125314 - RNA, 21 nt, Human
cuguagaaugccuuggauccc

SEQ ID NO: 125315 - RNA, 21 nt, Human
gaacaggcucccaggccauuc

SEQ ID NO: 125316 - RNA, 25 nt, Human
gaaggcaggaggaugggguggggcg

SEQ ID NO: 125317 - RNA, 21 nt, Human
gacagccucagagcauuggug

SEQ ID NO: 125318 - RNA, 19 nt, Human
gagccacggggagguguca

SEQ ID NO: 125319 - RNA, 24 nt, Human
gaguccuccuguugguccgcaagg

SEQ ID NO: 125320 - RNA, 26 nt, Human
gcacaaauaaaccaucuguaaacaca

SEQ ID NO: 125321 - RNA, 24 nt, Human
gcagagagaaagcauauaccuaga

SEQ ID NO: 125322 - RNA, 22 nt, Human
gcagggacauuuuccuaaguag

SEQ ID NO: 125323 - RNA, 18 nt, Human
gcgcugcguuuccuccug

SEQ ID NO: 125324 - RNA, 23 nt, Human
ggaaagcugggaguccuccuguu

SEQ ID NO: 125325 - RNA, 26 nt, Human
ggaagaaauauuuaucaaauacacag

SEQ ID NO: 125326 - RNA, 19 nt, Human
ggaggugucaaggagggua

SEQ ID NO: 125327 - RNA, 21 nt, Human
ggccagcuggugugauggagc

SEQ ID NO: 125328 - RNA, 18 nt, Human
gggaaaaggaagcaaaga

SEQ ID NO: 125329 - RNA, 22 nt, Human
uaacaaauaaugccccagugaa

SEQ ID NO: 125330 - RNA, 22 nt, Human
uaacuuuugcaugcuuuacacu

SEQ ID NO: 125331 - RNA, 23 nt, Human
uaagcagagcuacaguaaaugga

SEQ ID NO: 125332 - RNA, 23 nt, Human
uaauuucacagcagagagaaagc

SEQ ID NO: 125333 - RNA, 21 nt, Human
uacaguaugcauuuaggaaaa

SEQ ID NO: 125334 - RNA, 19 nt, Human
uacauuaagcagagcuaca

SEQ ID NO: 125335 - RNA, 20 nt, Human
uacauuaagcagagcuacag

SEQ ID NO: 125336 - RNA, 18 nt, Human
uaccugacugacaagugc

SEQ ID NO: 125337 - RNA, 18 nt, Human
uacugcaaauauuaaaaa

SEQ ID NO: 125338 - RNA, 18 nt, Human
uagaacccacacacacau

SEQ ID NO: 125339 - RNA, 23 nt, Human
uagauauguacauauuuauuaca

SEQ ID NO: 125340 - RNA, 22 nt, Human
uaugcacauacacaauuuaaaa

SEQ ID NO: 125341 - RNA, 21 nt, Human
uauugcaugcauuucugugca

SEQ ID NO: 125342 - RNA, 19 nt, Human
ucaaacagugaauguggua

SEQ ID NO: 125343 - RNA, 22 nt, Human
ucccagccccagaaaauuuagc

SEQ ID NO: 125344 - RNA, 20 nt, Human
ucccaggccauucuaagcac

SEQ ID NO: 125345 - RNA, 23 nt, Human
ucccuuucaugucauggaagaug

SEQ ID NO: 125346 - RNA, 19 nt, Human
uccuaaaucaaguacugca

SEQ ID NO: 125347 - RNA, 20 nt, Human
ucuaaaaauauaauguagga

SEQ ID NO: 125348 - RNA, 18 nt, Human
ugaaucacuagucuuaga

SEQ ID NO: 125349 - RNA, 20 nt, Human
ugaauguuuuuaagcuguga

SEQ ID NO: 125350 - RNA, 23 nt, Human
ugacuaaacuuugaaacaugccc

SEQ ID NO: 125351 - RNA, 19 nt, Human
ugagaugcugcuggcgcug

SEQ ID NO: 125352 - RNA, 23 nt, Human
ugcaaauauuaaaaaaaugacug

SEQ ID NO: 125353 - RNA, 23 nt, Human
ugcaagacagaacaggcucccag

SEQ ID NO: 125354 - RNA, 19 nt, Human
ugcaggaagaacgcaauuu

SEQ ID NO: 125355 - RNA, 19 nt, Human
ugcaugcuuuacacuuguc

SEQ ID NO: 125356 - RNA, 23 nt, Human
ugcccugcaccacagauccuaaa

SEQ ID NO: 125357 - RNA, 21 nt, Human
ugcuggcgcugcguuuccucc

SEQ ID NO: 125358 - RNA, 19 nt, Human
uggagccacggggaggugu

SEQ ID NO: 125359 - RNA, 19 nt, Human
uggaucccagcacucaguc

SEQ ID NO: 125360 - RNA, 18 nt, Human
uggugugauggagcgggg

SEQ ID NO: 125361 - RNA, 21 nt, Human
uggugugauggagcgggguga

SEQ ID NO: 125362 - RNA, 20 nt, Human
ugucaaggaggguagaugag

SEQ ID NO: 125363 - RNA, 19 nt, Human
ugucauggaagaugcaaga

SEQ ID NO: 125364 - RNA, 19 nt, Human
ugugcuucauaugcacaua

SEQ ID NO: 125365 - RNA, 24 nt, Human
uguuagcaaauaccaccaucugag

SEQ ID NO: 125366 - RNA, 19 nt, Human
uugcaugcauuucugugcc

SEQ ID NO: 125367 - RNA, 22 nt, Human
uuggaucccagcacucaguccg

SEQ ID NO: 125368 - RNA, 21 nt, Human
aaacagaugcaaagaugacaa

SEQ ID NO: 125369 - RNA, 23 nt, Human
aaacagaugcaaagaugacaaau

SEQ ID NO: 125370 - RNA, 24 nt, Human
aaacagaugcaaagaugacaaauu

SEQ ID NO: 125371 - RNA, 26 nt, Human
aacacaacacuccuuaaaaacucaua

SEQ ID NO: 125372 - RNA, 20 nt, Human
aagcagccuucacuggcuuu

SEQ ID NO: 125373 - RNA, 19 nt, Human
accuuuucagguucaucuu

SEQ ID NO: 125374 - RNA, 18 nt, Human
agaaaacagaugcaaaga

SEQ ID NO: 125375 - RNA, 21 nt, Human
aguacagcaaaccaaaaaaaa

SEQ ID NO: 125376 - RNA, 19 nt, Human
caaagcagccuucacuggc

SEQ ID NO: 125377 - RNA, 23 nt, Human
cacccgcugccccggcccaaagc

SEQ ID NO: 125378 - RNA, 21 nt, Human
cagcuaagauuucuucucaca

SEQ ID NO: 125379 - RNA, 24 nt, Human
caggacuccgaggagccggaauuc

SEQ ID NO: 125380 - RNA, 20 nt, Human
cccgcccggucccacccgcu

SEQ ID NO: 125381 - RNA, 21 nt, Human
cccgcugccccggcccaaagc

SEQ ID NO: 125382 - RNA, 19 nt, Human
cccuaaaguacagcaaacc

SEQ ID NO: 125383 - RNA, 19 nt, Human
ccgaggagccggaauucca

SEQ ID NO: 125384 - RNA, 23 nt, Human
ccgcccggucccacccgcugccc

SEQ ID NO: 125385 - RNA, 20 nt, Human
ccggcccaaagcagccuuca

SEQ ID NO: 125386 - RNA, 25 nt, Human
ccggcggucucuuuggaaucccucc

SEQ ID NO: 125387 - RNA, 18 nt, Human
ccuaaaguacagcaaacc

SEQ ID NO: 125388 - RNA, 20 nt, Human
cucaguguuaccuuuucagg

SEQ ID NO: 125389 - RNA, 24 nt, Human
gacaauuaguucacccaaaguuca

SEQ ID NO: 125390 - RNA, 19 nt, Human
gcgccgaggcagaggcggc

SEQ ID NO: 125391 - RNA, 23 nt, Human
gcggcgcgguggcggcuucccuc

SEQ ID NO: 125392 - RNA, 19 nt, Human
gcugagcuccgaggcggcg

SEQ ID NO: 125393 - RNA, 26 nt, Human
ggaaucccucccgcccggucccaccc

SEQ ID NO: 125394 - RNA, 20 nt, Human
ggcggcggugggggagggcc

SEQ ID NO: 125395 - RNA, 19 nt, Human
ggggcuaggagcugcccgc

SEQ ID NO: 125396 - RNA, 24 nt, Human
uaaaaacucauauguacacuucca

SEQ ID NO: 125397 - RNA, 19 nt, Human
uaacacacacagacauaua

SEQ ID NO: 125398 - RNA, 20 nt, Human
uacacuaagaaaauacuaaa

SEQ ID NO: 125399 - RNA, 21 nt, Human
uacacuaagaaaauacuaaac

SEQ ID NO: 125400 - RNA, 25 nt, Human
ucacccaaaguucaucuuuaauugc

SEQ ID NO: 125401 - RNA, 18 nt, Human
ucacuggcuuuccauuuc

SEQ ID NO: 125402 - RNA, 21 nt, Human
ucccacccgcugccccggccc

SEQ ID NO: 125403 - RNA, 23 nt, Human
ucccacccgcugccccggcccaa

SEQ ID NO: 125404 - RNA, 27 nt, Human
ugacaaauaaguccaggucgugacaca

SEQ ID NO: 125405 - RNA, 20 nt, Human
ugcaaagaugacaaauaagu

SEQ ID NO: 125406 - RNA, 22 nt, Human
ugcaggaacuuccuccgcuugg

SEQ ID NO: 125407 - RNA, 19 nt, Human
ugccccggcccaaagcagc

SEQ ID NO: 125408 - RNA, 21 nt, Human
ugcugagcuccgaggcggcgg

SEQ ID NO: 125409 - RNA, 19 nt, Human
uggaauaacacacacagac

SEQ ID NO: 125410 - RNA, 20 nt, Human
uggagagguuagagugacag

SEQ ID NO: 125411 - RNA, 24 nt, Human
ugggccccuggcuccuccccccgg

SEQ ID NO: 125412 - RNA, 18 nt, Human
ugugguaguauagucaaa

SEQ ID NO: 125413 - RNA, 24 nt, Human
ugugguaguauagucaaaacacau

SEQ ID NO: 125414 - RNA, 21 nt, Human
uguuaacauaaaaaacagcua

SEQ ID NO: 125415 - RNA, 24 nt, Human
uuaguucacccaaaguucaucuuu

SEQ ID NO: 125416 - RNA, 19 nt, Human
uuuggaaucccucccgccc

SEQ ID NO: 125417 - RNA, 23 nt, Human
aaaugauagaaguggcaaaagcu

SEQ ID NO: 125418 - RNA, 24 nt, Human
agcagccaggaaccacugugccag

SEQ ID NO: 125419 - RNA, 18 nt, Human
caagccccagcaaggcgg

SEQ ID NO: 125420 - RNA, 19 nt, Human
caaggacagcaaugcgaua

SEQ ID NO: 125421 - RNA, 22 nt, Human
cagcagccaggaaccacugugc

SEQ ID NO: 125422 - RNA, 24 nt, Human
cagcuagaccccuucccgcucgcu

SEQ ID NO: 125423 - RNA, 22 nt, Human
ccaaggacagcaaugcgauaaa

SEQ ID NO: 125424 - RNA, 21 nt, Human
ccagcgacgcgggagcugcag

SEQ ID NO: 125425 - RNA, 22 nt, Human
cccaaggacagcaaugcgauaa

SEQ ID NO: 125426 - RNA, 19 nt, Human
ccucccagcgacgcgggag

SEQ ID NO: 125427 - RNA, 19 nt, Human
ccuccuucucucccuccuc

SEQ ID NO: 125428 - RNA, 19 nt, Human
cgcccagacagcagugcag

SEQ ID NO: 125429 - RNA, 22 nt, Human
cggguucaaagccgggcgcugg

SEQ ID NO: 125430 - RNA, 23 nt, Human
cuucucucccuccucaucugaga

SEQ ID NO: 125431 - RNA, 24 nt, Human
gacgcgggagcugcaggagaggga

SEQ ID NO: 125432 - RNA, 21 nt, Human
gcaaaagcucagggugugugc

SEQ ID NO: 125433 - RNA, 19 nt, Human
gcaggagagggacgcggug

SEQ ID NO: 125434 - RNA, 22 nt, Human
gcucgcucccucgcuccuccca

SEQ ID NO: 125435 - RNA, 18 nt, Human
ggaguuccucccaccucu

SEQ ID NO: 125436 - RNA, 19 nt, Human
ggcaaaagcucagggugug

SEQ ID NO: 125437 - RNA, 20 nt, Human
ggcagcagccaggaaccacu

SEQ ID NO: 125438 - RNA, 19 nt, Human
gggccgagcaaaggccagc

SEQ ID NO: 125439 - RNA, 18 nt, Human
ucaaaaaugauagaagug

SEQ ID NO: 125440 - RNA, 18 nt, Human
uccccggacccgcccaga

SEQ ID NO: 125441 - RNA, 21 nt, Human
ugaguccccggacccgcccag

SEQ ID NO: 125442 - RNA, 20 nt, Human
ugcaaggaguuccucccacc

SEQ ID NO: 125443 - RNA, 21 nt, Human
aaaaagccagaggccugggca

SEQ ID NO: 125444 - RNA, 21 nt, Human
aaaacaaauaaggcuucaccc

SEQ ID NO: 125445 - RNA, 18 nt, Human
aaaaucuuaucccuauga

SEQ ID NO: 125446 - RNA, 21 nt, Human
aaagcccaaaaagagaggcag

SEQ ID NO: 125447 - RNA, 21 nt, Human
aagaaggaaggggguagacag

SEQ ID NO: 125448 - RNA, 23 nt, Human
aaggaccaaccagguacagacca

SEQ ID NO: 125449 - RNA, 25 nt, Human
aauuuucaauauaaaaagccagagg

SEQ ID NO: 125450 - RNA, 22 nt, Human
acuaugaaagcccaaaaagaga

SEQ ID NO: 125451 - RNA, 23 nt, Human
agaaggaaggggguagacagagc

SEQ ID NO: 125452 - RNA, 19 nt, Human
agacagagccuacuaagua

SEQ ID NO: 125453 - RNA, 25 nt, Human
agcccaaaaagagaggcaguugaau

SEQ ID NO: 125454 - RNA, 19 nt, Human
caauauaaaaagccagagg

SEQ ID NO: 125455 - RNA, 23 nt, Human
caguuacugagcuuaugcuuuga

SEQ ID NO: 125456 - RNA, 24 nt, Human
caguugaaucuuuccucaggccau

SEQ ID NO: 125457 - RNA, 20 nt, Human
caugcaaagacgaaggaccc

SEQ ID NO: 125458 - RNA, 27 nt, Human
ccaaagaugucucugccugagaacuaa

SEQ ID NO: 125459 - RNA, 20 nt, Human
ccaagcaagcagagagacca

SEQ ID NO: 125460 - RNA, 23 nt, Human
cccaaaaagagaggcaguugaau

SEQ ID NO: 125461 - RNA, 18 nt, Human
ccuaugaugaaugaaagg

SEQ ID NO: 125462 - RNA, 24 nt, Human
ccucacacuucacuauggugguuc

SEQ ID NO: 125463 - RNA, 20 nt, Human
ccugagucaggccaagugca

SEQ ID NO: 125464 - RNA, 20 nt, Human
cgaaggaccaaccagguaca

SEQ ID NO: 125465 - RNA, 23 nt, Human
cugcuuaucccuucugccacaug

SEQ ID NO: 125466 - RNA, 24 nt, Human
cuggcaggggacauaaaaaacaaa

SEQ ID NO: 125467 - RNA, 25 nt, Human
cuucuccugagcaucauaucucaac

SEQ ID NO: 125468 - RNA, 18 nt, Human
gaaagcccaaaaagagag

SEQ ID NO: 125469 - RNA, 22 nt, Human
gaacacuaugaaagcccaaaaa

SEQ ID NO: 125470 - RNA, 19 nt, Human
gaagauguauaccuugguc

SEQ ID NO: 125471 - RNA, 20 nt, Human
gaccaugguuuucucaccug

SEQ ID NO: 125472 - RNA, 22 nt, Human
ggccauccagcauuauuaguua

SEQ ID NO: 125473 - RNA, 23 nt, Human
gucugguucagggugcucgcgaa

SEQ ID NO: 125474 - RNA, 18 nt, Human
guggccagagagcaaagg

SEQ ID NO: 125475 - RNA, 19 nt, Human
uaaaaaacaaauaaggcuu

SEQ ID NO: 125476 - RNA, 21 nt, Human
uaaguaagcugcuuaucccuu

SEQ ID NO: 125477 - RNA, 18 nt, Human
uauaaaaagccagaggcc

SEQ ID NO: 125478 - RNA, 24 nt, Human
uauaaaaagccagaggccugggca

SEQ ID NO: 125479 - RNA, 23 nt, Human
ucaauauaaaaagccagaggccu

SEQ ID NO: 125480 - RNA, 24 nt, Human
ucacacauuggucagggccgccuc

SEQ ID NO: 125481 - RNA, 20 nt, Human
ucacccuuccucucaaagag

SEQ ID NO: 125482 - RNA, 23 nt, Human
ucaggccaagugcauacuucaca

SEQ ID NO: 125483 - RNA, 21 nt, Human
ugaaagcccaaaaagagaggc

SEQ ID NO: 125484 - RNA, 21 nt, Human
ugaaagggugaugaugacagu

SEQ ID NO: 125485 - RNA, 24 nt, Human
ugaugaaugaaagggugaugauga

SEQ ID NO: 125486 - RNA, 20 nt, Human
ugcaaagacgaaggaccaac

SEQ ID NO: 125487 - RNA, 23 nt, Human
ugcauacaugaucagaagggcca

SEQ ID NO: 125488 - RNA, 24 nt, Human
ugcauacaugaucagaagggccaa

SEQ ID NO: 125489 - RNA, 23 nt, Human
ugccugagaacuaagugaugggg

SEQ ID NO: 125490 - RNA, 21 nt, Human
uggcuuccugagucaggccuc

SEQ ID NO: 125491 - RNA, 21 nt, Human
uggucagggccgccucacacu

SEQ ID NO: 125492 - RNA, 19 nt, Human
uuccuaggggcaagacaaa

SEQ ID NO: 125493 - RNA, 21 nt, Human
aagagcugcuauuauuacuac

SEQ ID NO: 125494 - RNA, 20 nt, Human
aagcccggucuuggcccugc

SEQ ID NO: 125495 - RNA, 18 nt, Human
caaggugaacugagccgc

SEQ ID NO: 125496 - RNA, 18 nt, Human
caccggcacagcccucgc

SEQ ID NO: 125497 - RNA, 21 nt, Human
ccaagcccggucuuggcccug

SEQ ID NO: 125498 - RNA, 19 nt, Human
ccccagucuuagcugcgcc

SEQ ID NO: 125499 - RNA, 24 nt, Human
ccccagucuuagcugcgccccucu

SEQ ID NO: 125500 - RNA, 30 nt, Human
cccggucuuggcccugcccuuucccuggcc

SEQ ID NO: 125501 - RNA, 19 nt, Human
ccuggccccgcccaccaga

SEQ ID NO: 125502 - RNA, 23 nt, Human
ccuggccccgcccaccagaccug

SEQ ID NO: 125503 - RNA, 22 nt, Human
cgccccuuccuuuccgccaucc

SEQ ID NO: 125504 - RNA, 18 nt, Human
cugcgccccucucccaag

SEQ ID NO: 125505 - RNA, 18 nt, Human
cuggccccgcccaccaga

SEQ ID NO: 125506 - RNA, 23 nt, Human
cuuuccgccauccugcccccagu

SEQ ID NO: 125507 - RNA, 19 nt, Human
ggaagcaccuuaucaaggu

SEQ ID NO: 125508 - RNA, 23 nt, Human
uacuacucuucauagcauaaugu

SEQ ID NO: 125509 - RNA, 19 nt, Human
uagcugcgccccucuccca

SEQ ID NO: 125510 - RNA, 21 nt, Human
uagcugcgccccucucccaag

SEQ ID NO: 125511 - RNA, 18 nt, Human
uaucaaggugaacugagc

SEQ ID NO: 125512 - RNA, 21 nt, Human
ucccaagcccggucuuggccc

SEQ ID NO: 125513 - RNA, 19 nt, Human
ucccagcucggaagcaccu

SEQ ID NO: 125514 - RNA, 21 nt, Human
ucccucuagccaccacgcccc

SEQ ID NO: 125515 - RNA, 18 nt, Human
ucccuggccccgcccacc

SEQ ID NO: 125516 - RNA, 25 nt, Human
ucggaagcaccuuaucaaggugaac

SEQ ID NO: 125517 - RNA, 18 nt, Human
ucuguuucuucucuuccc

SEQ ID NO: 125518 - RNA, 23 nt, Human
ugcccccagucuuagcugcgccc

SEQ ID NO: 125519 - RNA, 20 nt, Human
uuccgccauccugcccccag

SEQ ID NO: 125520 - RNA, 20 nt, Human
uuccuuccucucaucccagc

SEQ ID NO: 125521 - RNA, 21 nt, Human
aaaaaaaucaaauauuguaug

SEQ ID NO: 125522 - RNA, 18 nt, Human
aaaacauuuggagcuagg

SEQ ID NO: 125523 - RNA, 22 nt, Human
aaaaccagauugacaggggccg

SEQ ID NO: 125524 - RNA, 22 nt, Human
aaauagcauucaacaugaaagc

SEQ ID NO: 125525 - RNA, 24 nt, Human
aacagugugagacucugucucaaa

SEQ ID NO: 125526 - RNA, 27 nt, Human
aacaugaaagcaaccagacacaaaaga

SEQ ID NO: 125527 - RNA, 24 nt, Human
aaccugggugacagagugagacuc

SEQ ID NO: 125528 - RNA, 24 nt, Human
aacucgaaccugggugacagagug

SEQ ID NO: 125529 - RNA, 22 nt, Human
aagcaccagugcagaaucccac

SEQ ID NO: 125530 - RNA, 24 nt, Human
aagcgugguagugcaugccuguaa

SEQ ID NO: 125531 - RNA, 24 nt, Human
aaucaccugacaucaggaguucaa

SEQ ID NO: 125532 - RNA, 22 nt, Human
aaucacuugaacccaggaugug

SEQ ID NO: 125533 - RNA, 24 nt, Human
aaucacuugaacccaggaugugga

SEQ ID NO: 125534 - RNA, 24 nt, Human
aaucacuugaguucaggaguucga

SEQ ID NO: 125535 - RNA, 23 nt, Human
aaucccacagcucagggaaccug

SEQ ID NO: 125536 - RNA, 24 nt, Human
aaucucuugaucuuggaaggcaga

SEQ ID NO: 125537 - RNA, 19 nt, Human
aaugaggacuggggaagac

SEQ ID NO: 125538 - RNA, 18 nt, Human
aauuagccaggcauggua

SEQ ID NO: 125539 - RNA, 18 nt, Human
acacagugaaaccccauc

SEQ ID NO: 125540 - RNA, 19 nt, Human
acacagugaaaccccaucu

SEQ ID NO: 125541 - RNA, 20 nt, Human
acacagugaaaccccaucuc

SEQ ID NO: 125542 - RNA, 24 nt, Human
acagagcaaggcuuaguuucaaaa

SEQ ID NO: 125543 - RNA, 21 nt, Human
acagagugagacuccaucuca

SEQ ID NO: 125544 - RNA, 24 nt, Human
acagagugagacuccaucucagaa

SEQ ID NO: 125545 - RNA, 24 nt, Human
acagugugagacucugucucaaaa

SEQ ID NO: 125546 - RNA, 24 nt, Human
accccaucucuacuaaaaauacaa

SEQ ID NO: 125547 - RNA, 19 nt, Human
acccuggaauccuuugacc

SEQ ID NO: 125548 - RNA, 23 nt, Human
accugggugacagagugagacuc

SEQ ID NO: 125549 - RNA, 24 nt, Human
acgccacugcacuccagccugggc

SEQ ID NO: 125550 - RNA, 24 nt, Human
acgccacugcacuccagccugggc

SEQ ID NO: 125551 - RNA, 23 nt, Human
acuccagccugggagacagagca

SEQ ID NO: 125552 - RNA, 21 nt, Human
acucgaaccugggugacagag

SEQ ID NO: 125553 - RNA, 24 nt, Human
acugaacucgaaccugggugacag

SEQ ID NO: 125554 - RNA, 24 nt, Human
acugcacuccagccugggcaacag

SEQ ID NO: 125555 - RNA, 19 nt, Human
agaaugggguauggggagu

SEQ ID NO: 125556 - RNA, 26 nt, Human
agacacaaaagaucacauauuaugcc

SEQ ID NO: 125557 - RNA, 24 nt, Human
agagguugcagugaacaaaaauug

SEQ ID NO: 125558 - RNA, 20 nt, Human
agaugaaaaagagaaugggg

SEQ ID NO: 125559 - RNA, 23 nt, Human
agaugguggugguuguacagcuu

SEQ ID NO: 125560 - RNA, 24 nt, Human
agcacuuuggaacacugagguggg

SEQ ID NO: 125561 - RNA, 24 nt, Human
agcacuuugggaggcuaagguggg

SEQ ID NO: 125562 - RNA, 23 nt, Human
agccaagcgugguagugcaugcc

SEQ ID NO: 125563 - RNA, 23 nt, Human
agccaggcaugguaguacaugcc

SEQ ID NO: 125564 - RNA, 23 nt, Human
agccugggagacagagcaaggcu

SEQ ID NO: 125565 - RNA, 24 nt, Human
agccugggcaacagugugagacuc

SEQ ID NO: 125566 - RNA, 18 nt, Human
agcuaggagaaucaccug

SEQ ID NO: 125567 - RNA, 19 nt, Human
agcuaggagaaucaccuga

SEQ ID NO: 125568 - RNA, 18 nt, Human
aggaagaggcagcuggga

SEQ ID NO: 125569 - RNA, 19 nt, Human
aggcagagguugcagugaa

SEQ ID NO: 125570 - RNA, 21 nt, Human
aggcaggaaguugcggggagg

SEQ ID NO: 125571 - RNA, 18 nt, Human
aggcaggagaaucacuug

SEQ ID NO: 125572 - RNA, 23 nt, Human
aggcaggagaaucacuugaaccc

SEQ ID NO: 125573 - RNA, 24 nt, Human
aggcaggagaaucacuugaaccca

SEQ ID NO: 125574 - RNA, 18 nt, Human
aggcaggagaguugcuug

SEQ ID NO: 125575 - RNA, 25 nt, Human
aggcaggagaguugcuugauccccg

SEQ ID NO: 125576 - RNA, 24 nt, Human
aggcaugguaguacaugccuguaa

SEQ ID NO: 125577 - RNA, 24 nt, Human
aggcguggugggggacgccuguga

SEQ ID NO: 125578 - RNA, 24 nt, Human
aggcugaggcaggagaaucacuug

SEQ ID NO: 125579 - RNA, 21 nt, Human
aggcugaggcaggagaguugc

SEQ ID NO: 125580 - RNA, 24 nt, Human
aggcugaggcaggagaguugcuug

SEQ ID NO: 125581 - RNA, 21 nt, Human
agggaggcugaggcaggagag

SEQ ID NO: 125582 - RNA, 18 nt, Human
aggugggugaaucacuug

SEQ ID NO: 125583 - RNA, 21 nt, Human
agguggguggaucaccugagg

SEQ ID NO: 125584 - RNA, 18 nt, Human
aguucaggaguucgagac

SEQ ID NO: 125585 - RNA, 28 nt, Human
auacauggcugggcacggugacucacgc

SEQ ID NO: 125586 - RNA, 24 nt, Human
auagcacuccagccugggagacag

SEQ ID NO: 125587 - RNA, 20 nt, Human
auaucagggaauccaaagca

SEQ ID NO: 125588 - RNA, 24 nt, Human
aucacgccacugcacuccagccug

SEQ ID NO: 125589 - RNA, 24 nt, Human
auugcaccauagcacuccagccug

SEQ ID NO: 125590 - RNA, 22 nt, Human
caaagcaccagugcagaauccc

SEQ ID NO: 125591 - RNA, 22 nt, Human
caacaggcaugaaccucaaaaa

SEQ ID NO: 125592 - RNA, 21 nt, Human
caaccagacacaaaagaucac

SEQ ID NO: 125593 - RNA, 26 nt, Human
caagaccaccuaaaaauacaaaauuu

SEQ ID NO: 125594 - RNA, 23 nt, Human
caccauagcacuccagccuggga

SEQ ID NO: 125595 - RNA, 24 nt, Human
cacgccuguaaucccagcacuuug

SEQ ID NO: 125596 - RNA, 20 nt, Human
cacuccagccugggcaacag

SEQ ID NO: 125597 - RNA, 21 nt, Human
cacuccagccugggcaacagu

SEQ ID NO: 125598 - RNA, 18 nt, Human
cacugcacuccagccugg

SEQ ID NO: 125599 - RNA, 19 nt, Human
cacugcacuccagccuggg

SEQ ID NO: 125600 - RNA, 21 nt, Human
cacugcacuccagccugggca

SEQ ID NO: 125601 - RNA, 23 nt, Human
cacugcacuccagccugggcaac

SEQ ID NO: 125602 - RNA, 24 nt, Human
cacugcacuccagccugggcaaca

SEQ ID NO: 125603 - RNA, 24 nt, Human
cagaaucccacagcucagggaacc

SEQ ID NO: 125604 - RNA, 18 nt, Human
cagaggcaggaaguugcg

SEQ ID NO: 125605 - RNA, 22 nt, Human
cagaggcaggaaguugcgggga

SEQ ID NO: 125606 - RNA, 24 nt, Human
cagcacuuuggaacacugaggugg

SEQ ID NO: 125607 - RNA, 24 nt, Human
cagcacuuugggaggcuaaggugg

SEQ ID NO: 125608 - RNA, 19 nt, Human
cagcagauuugaaggaaca

SEQ ID NO: 125609 - RNA, 19 nt, Human
cagcagugugugacugugg

SEQ ID NO: 125610 - RNA, 18 nt, Human
cagcuuaauuuuuaaaau

SEQ ID NO: 125611 - RNA, 18 nt, Human
cauagcacuccagccugg

SEQ ID NO: 125612 - RNA, 20 nt, Human
cauagcacuccagccuggga

SEQ ID NO: 125613 - RNA, 24 nt, Human
cauagcacuccagccugggagaca

SEQ ID NO: 125614 - RNA, 24 nt, Human
caucaggaguucaagaccaccuaa

SEQ ID NO: 125615 - RNA, 24 nt, Human
ccacugaacucgaaccugggugac

SEQ ID NO: 125616 - RNA, 20 nt, Human
ccacugcacuccagccuggg

SEQ ID NO: 125617 - RNA, 20 nt, Human
ccacugcacuccagccuggg

SEQ ID NO: 125618 - RNA, 21 nt, Human
ccacugcacuccagccugggc

SEQ ID NO: 125619 - RNA, 23 nt, Human
ccacugcacuccagccugggcaa

SEQ ID NO: 125620 - RNA, 24 nt, Human
ccacugcacuccagccugggcaac

SEQ ID NO: 125621 - RNA, 24 nt, Human
ccagaggcugaggcaggagaauca

SEQ ID NO: 125622 - RNA, 19 nt, Human
ccaggagcucaccaccagc

SEQ ID NO: 125623 - RNA, 20 nt, Human
ccauagcacuccagccuggg

SEQ ID NO: 125624 - RNA, 24 nt, Human
ccauagcacuccagccugggagac

SEQ ID NO: 125625 - RNA, 21 nt, Human
ccauggaggggaaggaagcug

SEQ ID NO: 125626 - RNA, 20 nt, Human
cccggggguggagguugcag

SEQ ID NO: 125627 - RNA, 24 nt, Human
ccuggccuacacagugaaacccca

SEQ ID NO: 125628 - RNA, 21 nt, Human
ccugggagacagagcaaggcu

SEQ ID NO: 125629 - RNA, 20 nt, Human
ccuguaauaucagcacuuug

SEQ ID NO: 125630 - RNA, 22 nt, Human
ccuguaaucccagcacuuuggg

SEQ ID NO: 125631 - RNA, 22 nt, Human
ccuguaaucccagcuacuaggg

SEQ ID NO: 125632 - RNA, 19 nt, Human
ccuguaaucccagcuacuu

SEQ ID NO: 125633 - RNA, 21 nt, Human
ccuguaaucccagcuacuugg

SEQ ID NO: 125634 - RNA, 22 nt, Human
ccuguaaucccagcuacuuggg

SEQ ID NO: 125635 - RNA, 24 nt, Human
cgagaccagccuggccuacacagu

SEQ ID NO: 125636 - RNA, 24 nt, Human
cgagaucacgccacugcacuccag

SEQ ID NO: 125637 - RNA, 24 nt, Human
cgccacugcacuccagccugggca

SEQ ID NO: 125638 - RNA, 23 nt, Human
cuacagcagugugugacuguggu

SEQ ID NO: 125639 - RNA, 25 nt, Human
cuagaugguggugguuguacagcuu

SEQ ID NO: 125640 - RNA, 22 nt, Human
cucacgccuguaaucccagcac

SEQ ID NO: 125641 - RNA, 24 nt, Human
cucacgccuguaaucccagcacuu

SEQ ID NO: 125642 - RNA, 21 nt, Human
cucagcagauuugaaggaaca

SEQ ID NO: 125643 - RNA, 22 nt, Human
cugacaucaggaguucaagacc

SEQ ID NO: 125644 - RNA, 20 nt, Human
cugucucaaaaaacaagaac

SEQ ID NO: 125645 - RNA, 23 nt, Human
cugucucaaaaaacaagaacaua

SEQ ID NO: 125646 - RNA, 23 nt, Human
cuugaguucaggaguucgagacc

SEQ ID NO: 125647 - RNA, 20 nt, Human
gaaagcaaccagacacaaaa

SEQ ID NO: 125648 - RNA, 23 nt, Human
gaaucaccugacaucaggaguuc

SEQ ID NO: 125649 - RNA, 19 nt, Human
gaaugaggacuggggaaga

SEQ ID NO: 125650 - RNA, 18 nt, Human
gagaaugggguaugggga

SEQ ID NO: 125651 - RNA, 22 nt, Human
gagguugcagugagccgagauc

SEQ ID NO: 125652 - RNA, 18 nt, Human
gaucaccugaggccagga

SEQ ID NO: 125653 - RNA, 24 nt, Human
gaucaccugaggccaggagcucac

SEQ ID NO: 125654 - RNA, 19 nt, Human
gauuugaaggaacauauca

SEQ ID NO: 125655 - RNA, 20 nt, Human
gcaaugugaccucagacaac

SEQ ID NO: 125656 - RNA, 24 nt, Human
gcacuccagccugggagacagagc

SEQ ID NO: 125657 - RNA, 19 nt, Human
gcagaaucccacagcucag

SEQ ID NO: 125658 - RNA, 22 nt, Human
gcaggagaaucacuugaaccca

SEQ ID NO: 125659 - RNA, 22 nt, Human
gccacugcacuccagccugggc

SEQ ID NO: 125660 - RNA, 24 nt, Human
gccacugcacuccagccugggcaa

SEQ ID NO: 125661 - RNA, 19 nt, Human
gccaggagcucaccaccag

SEQ ID NO: 125662 - RNA, 20 nt, Human
gccgagaucacgccacugca

SEQ ID NO: 125663 - RNA, 19 nt, Human
gccuguaauaucagcacuu

SEQ ID NO: 125664 - RNA, 20 nt, Human
gccuguaaucccagcuacuu

SEQ ID NO: 125665 - RNA, 19 nt, Human
gcucagggaaccugggcca

SEQ ID NO: 125666 - RNA, 22 nt, Human
ggacgccugugauaccagcucc

SEQ ID NO: 125667 - RNA, 20 nt, Human
ggagcuaggagaaucaccug

SEQ ID NO: 125668 - RNA, 20 nt, Human
ggagguugcagugagccgag

SEQ ID NO: 125669 - RNA, 22 nt, Human
ggagguugcagugagccgagau

SEQ ID NO: 125670 - RNA, 23 nt, Human
ggagguugcagugagccgagauc

SEQ ID NO: 125671 - RNA, 24 nt, Human
ggagguugcagugagccgagauca

SEQ ID NO: 125672 - RNA, 18 nt, Human
ggagguugcaguggacag

SEQ ID NO: 125673 - RNA, 24 nt, Human
ggagguugcaguggacagagaugg

SEQ ID NO: 125674 - RNA, 21 nt, Human
ggcugggcacggugacucacg

SEQ ID NO: 125675 - RNA, 18 nt, Human
gggaaugaggacugggga

SEQ ID NO: 125676 - RNA, 19 nt, Human
gggaaugaggacuggggaa

SEQ ID NO: 125677 - RNA, 19 nt, Human
gggaggcugaggcaggaga

SEQ ID NO: 125678 - RNA, 24 nt, Human
gggcacggugacucacgccuguaa

SEQ ID NO: 125679 - RNA, 18 nt, Human
ggguauggggagugacag

SEQ ID NO: 125680 - RNA, 24 nt, Human
gguaguacaugccuguaaucccag

SEQ ID NO: 125681 - RNA, 24 nt, Human
gguagugcaugccuguaaucccag

SEQ ID NO: 125682 - RNA, 24 nt, Human
ggugacucacgccuguaaucccag

SEQ ID NO: 125683 - RNA, 19 nt, Human
gguggagguugcagugagc

SEQ ID NO: 125684 - RNA, 20 nt, Human
gguggagguugcagugagcc

SEQ ID NO: 125685 - RNA, 23 nt, Human
gguggagguugcagugagccgag

SEQ ID NO: 125686 - RNA, 19 nt, Human
gucccuacuaaaacuacaa

SEQ ID NO: 125687 - RNA, 23 nt, Human
gugacucacgccuguaaucccag

SEQ ID NO: 125688 - RNA, 22 nt, Human
guggaucaccugaggccaggag

SEQ ID NO: 125689 - RNA, 20 nt, Human
gugugagacucugucucaaa

SEQ ID NO: 125690 - RNA, 19 nt, Human
guugcagugagccgagauc

SEQ ID NO: 125691 - RNA, 21 nt, Human
uaaaaauacaaaaauuagcca

SEQ ID NO: 125692 - RNA, 20 nt, Human
uaaaaauacaaaauuuagcc

SEQ ID NO: 125693 - RNA, 21 nt, Human
uaaaaauacaaaauuuagcca

SEQ ID NO: 125694 - RNA, 18 nt, Human
uaaaauuauauauauaca

SEQ ID NO: 125695 - RNA, 20 nt, Human
uaaguccauagugacaaaaa

SEQ ID NO: 125696 - RNA, 24 nt, Human
uaaguccauagugacaaaaaccag

SEQ ID NO: 125697 - RNA, 20 nt, Human
uacagcuuugugaaugaacc

SEQ ID NO: 125698 - RNA, 18 nt, Human
uacuaaaacuacaagaaa

SEQ ID NO: 125699 - RNA, 18 nt, Human
uacuagggaggcugaggc

SEQ ID NO: 125700 - RNA, 19 nt, Human
uacuagggaggcugaggca

SEQ ID NO: 125701 - RNA, 21 nt, Human
uagcaggucucucagaggcag

SEQ ID NO: 125702 - RNA, 24 nt, Human
uagcauucaacaugaaagcaacca

SEQ ID NO: 125703 - RNA, 25 nt, Human
uauauauauacauggcugggcacgg

SEQ ID NO: 125704 - RNA, 23 nt, Human
uaucagggaauccaaagcaccag

SEQ ID NO: 125705 - RNA, 20 nt, Human
ucaacaugaaagcaaccaga

SEQ ID NO: 125706 - RNA, 23 nt, Human
ucaccugacaucaggaguucaag

SEQ ID NO: 125707 - RNA, 23 nt, Human
ucacgccacugcacuccagccug

SEQ ID NO: 125708 - RNA, 20 nt, Human
ucacuugaguucaggaguuc

SEQ ID NO: 125709 - RNA, 19 nt, Human
ucacuugcaaugugaccuc

SEQ ID NO: 125710 - RNA, 20 nt, Human
ucagaaaaaaagaaaauguu

SEQ ID NO: 125711 - RNA, 25 nt, Human
uccccggggguggagguugcaguga

SEQ ID NO: 125712 - RNA, 23 nt, Human
ucccuacuaaaacuacaagaaaa

SEQ ID NO: 125713 - RNA, 24 nt, Human
ucgaaccugggugacagagugaga

SEQ ID NO: 125714 - RNA, 22 nt, Human
ucuacagaggcggggacacuga

SEQ ID NO: 125715 - RNA, 23 nt, Human
ucucuacuaaaaauacaaaaauu

SEQ ID NO: 125716 - RNA, 29 nt, Human
ucucucagaggcaggaaguugcggggagu

SEQ ID NO: 125717 - RNA, 23 nt, Human
ugaaaaagagaaugggguauggg

SEQ ID NO: 125718 - RNA, 24 nt, Human
ugaaaaagagaaugggguaugggg

SEQ ID NO: 125719 - RNA, 19 nt, Human
ugaaaccccaucucuacua

SEQ ID NO: 125720 - RNA, 25 nt, Human
ugaacaaaaauugcaccaaccccgg

SEQ ID NO: 125721 - RNA, 20 nt, Human
ugaaucacuugaguucagga

SEQ ID NO: 125722 - RNA, 24 nt, Human
ugaaucacuugaguucaggaguuc

SEQ ID NO: 125723 - RNA, 19 nt, Human
ugacaggggccgagaugaa

SEQ ID NO: 125724 - RNA, 21 nt, Human
ugacccccuucccucagcccc

SEQ ID NO: 125725 - RNA, 21 nt, Human
ugacucacgccuguaauccca

SEQ ID NO: 125726 - RNA, 24 nt, Human
ugacucacgccuguaaucccagca

SEQ ID NO: 125727 - RNA, 22 nt, Human
ugagccgagaucacgccacugc

SEQ ID NO: 125728 - RNA, 24 nt, Human
ugaggacuggggaagacuacagca

SEQ ID NO: 125729 - RNA, 24 nt, Human
ugaggcaggagaaucacuugaacc

SEQ ID NO: 125730 - RNA, 25 nt, Human
ugaggcaggagaaucacuugaaccc

SEQ ID NO: 125731 - RNA, 23 nt, Human
ugaggcaggagaguugcuugauc

SEQ ID NO: 125732 - RNA, 24 nt, Human
ugaggcaggagaguugcuugaucc

SEQ ID NO: 125733 - RNA, 23 nt, Human
ugaggccaggagcucaccaccag

SEQ ID NO: 125734 - RNA, 19 nt, Human
ugagguggguggaucaccu

SEQ ID NO: 125735 - RNA, 20 nt, Human
ugagguggguggaucaccug

SEQ ID NO: 125736 - RNA, 23 nt, Human
ugagguggguggaucaccugagg

SEQ ID NO: 125737 - RNA, 24 nt, Human
ugagguggguggaucaccugaggc

SEQ ID NO: 125738 - RNA, 25 nt, Human
ugagguggguggaucaccugaggcc

SEQ ID NO: 125739 - RNA, 26 nt, Human
ugagguggguggaucaccugaggcca

SEQ ID NO: 125740 - RNA, 24 nt, Human
ugccauggaggggaaggaagcugg

SEQ ID NO: 125741 - RNA, 18 nt, Human
ugccuguaauaucagcac

SEQ ID NO: 125742 - RNA, 23 nt, Human
ugccuguaaucccagcuacuagg

SEQ ID NO: 125743 - RNA, 23 nt, Human
ugccuguaaucccagcuacuugg

SEQ ID NO: 125744 - RNA, 24 nt, Human
ugccuguaaucccagcuacuuggg

SEQ ID NO: 125745 - RNA, 23 nt, Human
uggaaggcagagguugcagugaa

SEQ ID NO: 125746 - RNA, 19 nt, Human
uggaucaccugaggccagg

SEQ ID NO: 125747 - RNA, 26 nt, Human
uggaucaccugaggccaggagcucac

SEQ ID NO: 125748 - RNA, 23 nt, Human
uggcugggcacggugacucacgc

SEQ ID NO: 125749 - RNA, 22 nt, Human
uggcuuguagcaggucucucag

SEQ ID NO: 125750 - RNA, 19 nt, Human
ugggaaauauucagaauug

SEQ ID NO: 125751 - RNA, 19 nt, Human
ugggaggcuaaggugggug

SEQ ID NO: 125752 - RNA, 24 nt, Human
ugggaggcuaaggugggugaauca

SEQ ID NO: 125753 - RNA, 18 nt, Human
ugggggagagauaaugaa

SEQ ID NO: 125754 - RNA, 18 nt, Human
ugggguauggggagugac

SEQ ID NO: 125755 - RNA, 24 nt, Human
uggguggaucaccugaggccagga

SEQ ID NO: 125756 - RNA, 24 nt, Human
ugguaguacaugccuguaauccca

SEQ ID NO: 125757 - RNA, 24 nt, Human
ugguagugcaugccuguaauccca

SEQ ID NO: 125758 - RNA, 18 nt, Human
uguugggggagagauaau

SEQ ID NO: 125759 - RNA, 24 nt, Human
uguuuaugggaaauauucagaauu

SEQ ID NO: 125760 - RNA, 24 nt, Human
uuaguuucaaaaaaaaaaaaaaaa

SEQ ID NO: 125761 - RNA, 21 nt, Human
uucgagaccagccuggccuac

SEQ ID NO: 125762 - RNA, 24 nt, Human
uugauccccggggguggagguugc

SEQ ID NO: 125763 - RNA, 18 nt, Human
uugcagugagccgagauc

SEQ ID NO: 125764 - RNA, 20 nt, Human
uugcagugagccgagaucac

SEQ ID NO: 125765 - RNA, 21 nt, Human
uugcagugagccgagaucacg

SEQ ID NO: 125766 - RNA, 22 nt, Human
uugcuugauccccgggggugga

SEQ ID NO: 125767 - RNA, 24 nt, Human
uugcuugauccccggggguggagg

SEQ ID NO: 125768 - RNA, 21 nt, Human
uuggaaggcagagguugcagu

SEQ ID NO: 125769 - RNA, 25 nt, Human
uugggaggcuaaggugggugaauca

SEQ ID NO: 125770 - RNA, 22 nt, Human
uuguugggggagagauaaugaa

SEQ ID NO: 125771 - RNA, 26 nt, Human
uuuuaaaauuauauauauacauggcu

SEQ ID NO: 125772 - RNA, 20 nt, Human
agaugacaggugagaaaagg

SEQ ID NO: 125773 - RNA, 23 nt, Human
agggaagggaaaaugugagauga

SEQ ID NO: 125774 - RNA, 22 nt, Human
cagggacugcacagcagcagcc

SEQ ID NO: 125775 - RNA, 20 nt, Human
caugcagaaaagaaaugccu

SEQ ID NO: 125776 - RNA, 21 nt, Human
cugcagggacugcacagcagc

SEQ ID NO: 125777 - RNA, 24 nt, Human
ugagaaaaggcauuacagauagug

SEQ ID NO: 125778 - RNA, 22 nt, Human
ugcagaaaagaaaugccuuuga

SEQ ID NO: 125779 - RNA, 18 nt, Human
uggauaaugccccagagg

SEQ ID NO: 125780 - RNA, 23 nt, Human
uucagggaagggaaaaugugaga

SEQ ID NO: 125781 - RNA, 24 nt, Human
aaagacaugccacaucugccucuu

SEQ ID NO: 125782 - RNA, 20 nt, Human
aacccgcaugggcgggccuc

SEQ ID NO: 125783 - RNA, 26 nt, Human
acagcaugcagggaagacagcgugac

SEQ ID NO: 125784 - RNA, 23 nt, Human
acaucugccucugcccugcagac

SEQ ID NO: 125785 - RNA, 21 nt, Human
acuguggaccaagaaggggac

SEQ ID NO: 125786 - RNA, 22 nt, Human
auagaacaagcucuguggguac

SEQ ID NO: 125787 - RNA, 20 nt, Human
cagauuggagggauggggga

SEQ ID NO: 125788 - RNA, 18 nt, Human
caggagacacuggcuggg

SEQ ID NO: 125789 - RNA, 18 nt, Human
cggggcacagauuggagg

SEQ ID NO: 125790 - RNA, 18 nt, Human
cugccagagggaugaggg

SEQ ID NO: 125791 - RNA, 19 nt, Human
gacuguggaccaagaaggg

SEQ ID NO: 125792 - RNA, 18 nt, Human
gagggaugggggaagggc

SEQ ID NO: 125793 - RNA, 21 nt, Human
ggaagacagcgugacugccag

SEQ ID NO: 125794 - RNA, 19 nt, Human
gggaagacagcgugacugc

SEQ ID NO: 125795 - RNA, 24 nt, Human
gggcagacuguggaccaagaaggg

SEQ ID NO: 125796 - RNA, 23 nt, Human
gugccauagaacaagcucugugg

SEQ ID NO: 125797 - RNA, 22 nt, Human
uacaaaaagacaugccacaucu

SEQ ID NO: 125798 - RNA, 26 nt, Human
uacaaaaagccuagaaaagggcgugc

SEQ ID NO: 125799 - RNA, 19 nt, Human
uagaacaagcucugugggu

SEQ ID NO: 125800 - RNA, 24 nt, Human
ucaucgcucacaggcgaaucugga

SEQ ID NO: 125801 - RNA, 22 nt, Human
ugaaggcagcugcugagcugca

SEQ ID NO: 125802 - RNA, 22 nt, Human
ugagggcagacuguggaccaag

SEQ ID NO: 125803 - RNA, 24 nt, Human
ugagggcagacuguggaccaaggg

SEQ ID NO: 125804 - RNA, 24 nt, Human
ugccauagaacaagcucugugggu

SEQ ID NO: 125805 - RNA, 18 nt, Human
ugggggaagggcacgcgg

SEQ ID NO: 125806 - RNA, 24 nt, Human
uguacuaagaaaugauacaaaaag

SEQ ID NO: 125807 - RNA, 20 nt, Human
agagcugggauuuggaucua

SEQ ID NO: 125808 - RNA, 27 nt, Human
agcagacaccagugguuucagaacacg

SEQ ID NO: 125809 - RNA, 24 nt, Human
agucaaauuccucugaucuuucuu

SEQ ID NO: 125810 - RNA, 24 nt, Human
caaaccacuuaaagcucaccauuu

SEQ ID NO: 125811 - RNA, 25 nt, Human
caccagugguuucagaacacgugcc

SEQ ID NO: 125812 - RNA, 24 nt, Human
caguagagcugggauuuggaucua

SEQ ID NO: 125813 - RNA, 19 nt, Human
ccuugccccuuucuuucuu

SEQ ID NO: 125814 - RNA, 20 nt, Human
cuccuagauaaaaagguaaa

SEQ ID NO: 125815 - RNA, 26 nt, Human
ggaaacauuauccucuuuucaucucc

SEQ ID NO: 125816 - RNA, 19 nt, Human
uaaagcucaccauuucuuu

SEQ ID NO: 125817 - RNA, 21 nt, Human
uauagauagaacuuuuaugau

SEQ ID NO: 125818 - RNA, 24 nt, Human
uaugguuuacaaaccacuuaaagc

SEQ ID NO: 125819 - RNA, 20 nt, Human
ucuucuuacuuuccuugccc

SEQ ID NO: 125820 - RNA, 21 nt, Human
uuccuugccccuuucuuucuu

SEQ ID NO: 125821 - RNA, 24 nt, Human
aaacacaugcaccauuugaaugug

SEQ ID NO: 125822 - RNA, 20 nt, Human
acaugcaccauuugaaugug

SEQ ID NO: 125823 - RNA, 19 nt, Human
agagcucaggucuaggugc

SEQ ID NO: 125824 - RNA, 22 nt, Human
cauuuuauuacuuuuagcauua

SEQ ID NO: 125825 - RNA, 20 nt, Human
cccugguccuugugaggccc

SEQ ID NO: 125826 - RNA, 19 nt, Human
ccuccagaaggcccugguc

SEQ ID NO: 125827 - RNA, 20 nt, Human
cuaggaguuccaauugcuag

SEQ ID NO: 125828 - RNA, 18 nt, Human
cuccuccagaaggcccug

SEQ ID NO: 125829 - RNA, 19 nt, Human
gcccugguccuugugaggc

SEQ ID NO: 125830 - RNA, 18 nt, Human
gguagugccacuccucca

SEQ ID NO: 125831 - RNA, 20 nt, Human
guccagcaccuuccagaagc

SEQ ID NO: 125832 - RNA, 22 nt, Human
uaaguccuaaaacaaagugaag

SEQ ID NO: 125833 - RNA, 26 nt, Human
uccagaagcagaaaagugugaaacag

SEQ ID NO: 125834 - RNA, 27 nt, Human
ugaagauaccaaacacaugcaccaguc

SEQ ID NO: 125835 - RNA, 22 nt, Human
ugcugccaggugggguagugcc

SEQ ID NO: 125836 - RNA, 22 nt, Human
ugggguagugccacuccuccag

SEQ ID NO: 125837 - RNA, 21 nt, Human
uguugaagauaccaaacacau

SEQ ID NO: 125838 - RNA, 22 nt, Human
uuaauguuuuaauacaguuaug

SEQ ID NO: 125839 - RNA, 22 nt, Human
uuaauguuuuaauacaguuaug

SEQ ID NO: 125840 - RNA, 19 nt, Human
uuggaucauuugaucauuu

SEQ ID NO: 125841 - RNA, 22 nt, Human
uuuccuauaaaccauguauucc

SEQ ID NO: 125842 - RNA, 24 nt, Human
aaaaaggcauauuuuuuuaagacu

SEQ ID NO: 125843 - RNA, 21 nt, Human
aaaacauuaaaucaaaacuaa

SEQ ID NO: 125844 - RNA, 24 nt, Human
aaacugcuaggauuacaggcguga

SEQ ID NO: 125845 - RNA, 23 nt, Human
aacacucuacacagacaaugaga

SEQ ID NO: 125846 - RNA, 19 nt, Human
aagagcuucaguucuuugu

SEQ ID NO: 125847 - RNA, 19 nt, Human
aagcagaggagccaaaucu

SEQ ID NO: 125848 - RNA, 22 nt, Human
acuccagagaaaacaugugaua

SEQ ID NO: 125849 - RNA, 20 nt, Human
agaaauaugaaaggagaugg

SEQ ID NO: 125850 - RNA, 24 nt, Human
agaagcagaggagccaaaucuacc

SEQ ID NO: 125851 - RNA, 18 nt, Human
agacuggagugcaguggu

SEQ ID NO: 125852 - RNA, 18 nt, Human
agccaucaaaauaauucu

SEQ ID NO: 125853 - RNA, 24 nt, Human
aggccaggcuugucuugaacuccu

SEQ ID NO: 125854 - RNA, 24 nt, Human
aggcgauccacccggcucagccuc

SEQ ID NO: 125855 - RNA, 21 nt, Human
agguucaagugauucuccugc

SEQ ID NO: 125856 - RNA, 22 nt, Human
agguucaagugauucuccugcc

SEQ ID NO: 125857 - RNA, 23 nt, Human
agguucaagugauucuccugccu

SEQ ID NO: 125858 - RNA, 24 nt, Human
agugauucuccugccucagccucc

SEQ ID NO: 125859 - RNA, 21 nt, Human
agugcaguggugcaaucucag

SEQ ID NO: 125860 - RNA, 20 nt, Human
aucuucauuucagaguucua

SEQ ID NO: 125861 - RNA, 22 nt, Human
augcaguccauuggaugaagcc

SEQ ID NO: 125862 - RNA, 25 nt, Human
augggguuucaaccauguaggccag

SEQ ID NO: 125863 - RNA, 18 nt, Human
auucuccugccucagccu

SEQ ID NO: 125864 - RNA, 24 nt, Human
auuuguguauuuuuaguagagaug

SEQ ID NO: 125865 - RNA, 24 nt, Human
caaacugcuaggauuacaggcgug

SEQ ID NO: 125866 - RNA, 18 nt, Human
caacauccgccucccagg

SEQ ID NO: 125867 - RNA, 22 nt, Human
caagugauucuccugccucagc

SEQ ID NO: 125868 - RNA, 24 nt, Human
cacccagacuggagugcaguggug

SEQ ID NO: 125869 - RNA, 21 nt, Human
caucuucauuucagaguucua

SEQ ID NO: 125870 - RNA, 20 nt, Human
ccaaacugcuaggauuacag

SEQ ID NO: 125871 - RNA, 22 nt, Human
ccaaacugcuaggauuacaggc

SEQ ID NO: 125872 - RNA, 24 nt, Human
ccaaacugcuaggauuacaggcgu

SEQ ID NO: 125873 - RNA, 20 nt, Human
ccaaaucuaccuccucacac

SEQ ID NO: 125874 - RNA, 24 nt, Human
ccaacagugauuacaaugaccaaa

SEQ ID NO: 125875 - RNA, 23 nt, Human
cccagguucaagugauucuccuc

SEQ ID NO: 125876 - RNA, 23 nt, Human
cccagguucaagugauucuccug

SEQ ID NO: 125877 - RNA, 19 nt, Human
cccggcucagccucccaaa

SEQ ID NO: 125878 - RNA, 24 nt, Human
ccgccucccagguucaagugauuc

SEQ ID NO: 125879 - RNA, 22 nt, Human
ccucaggcgauccacccggcuc

SEQ ID NO: 125880 - RNA, 24 nt, Human
ccucccagguucaagugauucucc

SEQ ID NO: 125881 - RNA, 20 nt, Human
ccugaccucaggcgauccac

SEQ ID NO: 125882 - RNA, 24 nt, Human
ccugaccucaggcgauccacccgg

SEQ ID NO: 125883 - RNA, 25 nt, Human
ccugaccucaggcgauccacccggc

SEQ ID NO: 125884 - RNA, 22 nt, Human
ccuguguagugagauuacaggc

SEQ ID NO: 125885 - RNA, 22 nt, Human
ccuuacuuaucucucuccucug

SEQ ID NO: 125886 - RNA, 23 nt, Human
cgccaacagugauuacaaugacc

SEQ ID NO: 125887 - RNA, 22 nt, Human
cgccucccagguucaagugauu

SEQ ID NO: 125888 - RNA, 24 nt, Human
cggcucagccucccaaacugcuag

SEQ ID NO: 125889 - RNA, 21 nt, Human
cucacucucacccagacugga

SEQ ID NO: 125890 - RNA, 21 nt, Human
cucccaaacugcuaggauuac

SEQ ID NO: 125891 - RNA, 19 nt, Human
cucccagguucaagugauu

SEQ ID NO: 125892 - RNA, 23 nt, Human
cuucaacauccgccucccagguu

SEQ ID NO: 125893 - RNA, 24 nt, Human
cuucaacauccgccucccagguuc

SEQ ID NO: 125894 - RNA, 21 nt, Human
cuugaagagcaaagcagaagu

SEQ ID NO: 125895 - RNA, 22 nt, Human
gaaaacauuaaaucaaaacuaa

SEQ ID NO: 125896 - RNA, 24 nt, Human
gaccucaggcgauccacccggcuc

SEQ ID NO: 125897 - RNA, 19 nt, Human
gagaagcagaggagccaaa

SEQ ID NO: 125898 - RNA, 21 nt, Human
gagaugggguuucaaccaugu

SEQ ID NO: 125899 - RNA, 23 nt, Human
gauuacaggcgaguccaccaugc

SEQ ID NO: 125900 - RNA, 18 nt, Human
gauuacaggcgugagcca

SEQ ID NO: 125901 - RNA, 19 nt, Human
gauuacaggcgugagccac

SEQ ID NO: 125902 - RNA, 21 nt, Human
gauuacaggcgugagccacug

SEQ ID NO: 125903 - RNA, 24 nt, Human
gcagaggagccaaaucuaccuccu

SEQ ID NO: 125904 - RNA, 24 nt, Human
gcgauccacccggcucagccuccc

SEQ ID NO: 125905 - RNA, 21 nt, Human
ggaaacauguuuucugucucc

SEQ ID NO: 125906 - RNA, 22 nt, Human
ggauuacaggcgugagccacug

SEQ ID NO: 125907 - RNA, 24 nt, Human
ggcuugucuugaacuccugaccuc

SEQ ID NO: 125908 - RNA, 23 nt, Human
ggguuucaaccauguaggccagg

SEQ ID NO: 125909 - RNA, 22 nt, Human
guauaacacucuacacagacaa

SEQ ID NO: 125910 - RNA, 23 nt, Human
gugauucuccugccucagccucc

SEQ ID NO: 125911 - RNA, 19 nt, Human
gugccugaucaaaaaaggc

SEQ ID NO: 125912 - RNA, 23 nt, Human
guguagugagauuacaggcgagu

SEQ ID NO: 125913 - RNA, 20 nt, Human
uaaaugucauuguuagagcc

SEQ ID NO: 125914 - RNA, 24 nt, Human
uaacauaaaacuuauagaauacuc

SEQ ID NO: 125915 - RNA, 19 nt, Human
uaagagcuucaguucuuug

SEQ ID NO: 125916 - RNA, 23 nt, Human
uaauuuguguauuuuuaguagag

SEQ ID NO: 125917 - RNA, 24 nt, Human
uaauuuguguauuuuuaguagaga

SEQ ID NO: 125918 - RNA, 22 nt, Human
uacaggcgugagccacugugcc

SEQ ID NO: 125919 - RNA, 23 nt, Human
uacaggcgugagccacugugccu

SEQ ID NO: 125920 - RNA, 22 nt, Human
uagaauacuccagagaaaacau

SEQ ID NO: 125921 - RNA, 21 nt, Human
uaggauuacaggcgugagcca

SEQ ID NO: 125922 - RNA, 22 nt, Human
uaggauuacaggcgugagccac

SEQ ID NO: 125923 - RNA, 22 nt, Human
uaggauuacaggcgugagccac

SEQ ID NO: 125924 - RNA, 22 nt, Human
uaggauuacaggcgugagccac

SEQ ID NO: 125925 - RNA, 23 nt, Human
uaggauuacaggcgugagccacu

SEQ ID NO: 125926 - RNA, 24 nt, Human
uaggauuacaggcgugagccacug

SEQ ID NO: 125927 - RNA, 25 nt, Human
uaguagagaugggguuucaaccaug

SEQ ID NO: 125928 - RNA, 19 nt, Human
uaguucugacaaaggcccc

SEQ ID NO: 125929 - RNA, 19 nt, Human
ucaagugauucuccugccu

SEQ ID NO: 125930 - RNA, 24 nt, Human
ucacacugauuuggucaccuccuu

SEQ ID NO: 125931 - RNA, 24 nt, Human
ucacuucaacauccgccucccagg

SEQ ID NO: 125932 - RNA, 24 nt, Human
ucccaaacugcuaggauuacaggc

SEQ ID NO: 125933 - RNA, 21 nt, Human
ucccagguucaagugauucuc

SEQ ID NO: 125934 - RNA, 24 nt, Human
ucccagguucaagugauucuccug

SEQ ID NO: 125935 - RNA, 22 nt, Human
ucucacucucacccagacugga

SEQ ID NO: 125936 - RNA, 24 nt, Human
ucucacucucacccagacuggagu

SEQ ID NO: 125937 - RNA, 18 nt, Human
ucuccugccucagccucc

SEQ ID NO: 125938 - RNA, 23 nt, Human
ucugagucuuccuuucagcucug

SEQ ID NO: 125939 - RNA, 23 nt, Human
ucuugaacuccugaccucaggcg

SEQ ID NO: 125940 - RNA, 25 nt, Human
ucuuugcugggcuaugugcauggag

SEQ ID NO: 125941 - RNA, 21 nt, Human
ugaccucaggcgauccacccg

SEQ ID NO: 125942 - RNA, 25 nt, Human
ugaccucaggcgauccacccggcuc

SEQ ID NO: 125943 - RNA, 19 nt, Human
ugagaagcagaggagccaa

SEQ ID NO: 125944 - RNA, 21 nt, Human
ugagauuacaggcgaguccac

SEQ ID NO: 125945 - RNA, 23 nt, Human
ugagauuacaggcgaguccacca

SEQ ID NO: 125946 - RNA, 24 nt, Human
ugagauuacaggcgaguccaccau

SEQ ID NO: 125947 - RNA, 21 nt, Human
ugagucucacucucacccaga

SEQ ID NO: 125948 - RNA, 24 nt, Human
ugcaaucucagcucacuucaacau

SEQ ID NO: 125949 - RNA, 22 nt, Human
ugcaguggugcaaucucagcuc

SEQ ID NO: 125950 - RNA, 20 nt, Human
ugccucagccuccuguguag

SEQ ID NO: 125951 - RNA, 24 nt, Human
ugcuaggauuacaggcgugagcca

SEQ ID NO: 125952 - RNA, 18 nt, Human
uggagugcaguggugcaa

SEQ ID NO: 125953 - RNA, 23 nt, Human
uggagugcaguggugcaaucuca

SEQ ID NO: 125954 - RNA, 24 nt, Human
uggagugcaguggugcaaucucag

SEQ ID NO: 125955 - RNA, 24 nt, Human
uggugcaaucucagcucacuucaa

SEQ ID NO: 125956 - RNA, 22 nt, Human
uguguugcucuuugcugggcua

SEQ ID NO: 125957 - RNA, 18 nt, Human
uuaguagagaugggguuu

SEQ ID NO: 125958 - RNA, 23 nt, Human
uuaguagagaugggguuucaacc

SEQ ID NO: 125959 - RNA, 25 nt, Human
uuaguagagaugggguuucaaccau

SEQ ID NO: 125960 - RNA, 21 nt, Human
uucaacauccgccucccaggu

SEQ ID NO: 125961 - RNA, 21 nt, Human
uucaagugauucuccugccuc

SEQ ID NO: 125962 - RNA, 23 nt, Human
uucaagugauucuccugccucag

SEQ ID NO: 125963 - RNA, 24 nt, Human
uucaagugauucuccugccucagc

SEQ ID NO: 125964 - RNA, 24 nt, Human
uucuaguucugacaaaggccccac

SEQ ID NO: 125965 - RNA, 19 nt, Human
uuggaugaagcccaucuuc

SEQ ID NO: 125966 - RNA, 19 nt, Human
uuucagcucuguguugcuc

SEQ ID NO: 125967 - RNA, 23 nt, Human
uuucuugaagagcaaagcagaag

SEQ ID NO: 125968 - RNA, 22 nt, Human
uuuuuaguagagaugggguuuc

SEQ ID NO: 125969 - RNA, 23 nt, Human
acuuauuuggcauugauuuguca

SEQ ID NO: 125970 - RNA, 23 nt, Human
acuuauuuggcauugauuuguca

SEQ ID NO: 125971 - RNA, 25 nt, Human
agaaauguuuauucucugaucacag

SEQ ID NO: 125972 - RNA, 26 nt, Human
agaaauguuuauucucugaucacagc

SEQ ID NO: 125973 - RNA, 22 nt, Human
cauugauuugucaccugcuuug

SEQ ID NO: 125974 - RNA, 22 nt, Human
cauugauuugucaccugcuuug

SEQ ID NO: 125975 - RNA, 23 nt, Human
cuaauuauucacccaguauacua

SEQ ID NO: 125976 - RNA, 23 nt, Human
cuaauuauucacccaguauacua

SEQ ID NO: 125977 - RNA, 20 nt, Human
cuaauucuguagauucaucc

SEQ ID NO: 125978 - RNA, 20 nt, Human
cuaauucuguagauucaucc

SEQ ID NO: 125979 - RNA, 18 nt, Human
gaacuagagaagaugacu

SEQ ID NO: 125980 - RNA, 18 nt, Human
gaacuagagaagaugacu

SEQ ID NO: 125981 - RNA, 18 nt, Human
gagauagucuuaugagaa

SEQ ID NO: 125982 - RNA, 18 nt, Human
gagauagucuuaugagaa

SEQ ID NO: 125983 - RNA, 22 nt, Human
gaucacagcucaggaggacuug

SEQ ID NO: 125984 - RNA, 22 nt, Human
gaucacagcucaggaggacuug

SEQ ID NO: 125985 - RNA, 20 nt, Human
uacgagaaucacaaguauaa

SEQ ID NO: 125986 - RNA, 20 nt, Human
uacgagaaucacaaguauaa

SEQ ID NO: 125987 - RNA, 27 nt, Human
uacuagguuaauuaagcucaucuucau

SEQ ID NO: 125988 - RNA, 27 nt, Human
uacuagguuaauuaagcucaucuucau

SEQ ID NO: 125989 - RNA, 22 nt, Human
uagggaaagucaggguccacuu

SEQ ID NO: 125990 - RNA, 23 nt, Human
uagucuuaugagaacuagagaag

SEQ ID NO: 125991 - RNA, 23 nt, Human
uagucuuaugagaacuagagaag

SEQ ID NO: 125992 - RNA, 24 nt, Human
uaugagaacuagagaagaugacug

SEQ ID NO: 125993 - RNA, 24 nt, Human
uaugagaacuagagaagaugacug

SEQ ID NO: 125994 - RNA, 24 nt, Human
uauuauagaauaucacaaauggaa

SEQ ID NO: 125995 - RNA, 24 nt, Human
uauuauagaauaucacaaauggaa

SEQ ID NO: 125996 - RNA, 23 nt, Human
uccuuagggaaagucaggggaaa

SEQ ID NO: 125997 - RNA, 21 nt, Human
ucucugaucacagcucaggag

SEQ ID NO: 125998 - RNA, 21 nt, Human
ucucugaucacagcucaggag

SEQ ID NO: 125999 - RNA, 24 nt, Human
ucucuuaagugcacuuuuagaaca

SEQ ID NO: 126000 - RNA, 22 nt, Human
ucuuaagugcacuuuuagaaca

SEQ ID NO: 126001 - RNA, 25 nt, Human
ucuuugcugggcugugcauauagag

SEQ ID NO: 126002 - RNA, 20 nt, Human
ugaacaaaguggaaguccuu

SEQ ID NO: 126003 - RNA, 20 nt, Human
ugaacaaaguggaaguccuu

SEQ ID NO: 126004 - RNA, 23 nt, Human
ugcugggcugugcauauagagcu

SEQ ID NO: 126005 - RNA, 23 nt, Human
uucagcugugugcugcucuuugc

SEQ ID NO: 126006 - RNA, 21 nt, Human
uugaagaauugguagauuguc

SEQ ID NO: 126007 - RNA, 27 nt, Human
uuuuccuuuucauuaaaaauuguuggu

SEQ ID NO: 126008 - RNA, 27 nt, Human
uuuuccuuuucauuaaaaauuguuggu

SEQ ID NO: 126009 - RNA, 24 nt, Human
uuuuucagcucugucuucugaguu

SEQ ID NO: 126010 - RNA, 23 nt, Human
caucuuuauuucaagguuuuauu

SEQ ID NO: 126011 - RNA, 22 nt, Human
cugcuguuugcugggcuguuug

SEQ ID NO: 126012 - RNA, 24 nt, Human
guucugugagucuuccuuuuagcu

SEQ ID NO: 126013 - RNA, 27 nt, Human
guuugcugggcuguuugccccgucacg

SEQ ID NO: 126014 - RNA, 21 nt, Human
ugcugcuguuugcugggcugu

SEQ ID NO: 126015 - RNA, 24 nt, Human
ugcugggcuguuugccccgucacg

SEQ ID NO: 126016 - RNA, 21 nt, Human
ugcugggcuguuugccuggag

SEQ ID NO: 126017 - RNA, 21 nt, Human
ugugagucuuccuuuuagcug

SEQ ID NO: 126018 - RNA, 25 nt, Human
uguuugcugggcuguuugccuggag

SEQ ID NO: 126019 - RNA, 19 nt, Human
uucuucaacuguguucugu

SEQ ID NO: 126020 - RNA, 24 nt, Human
aagcaggcggucggcagagggccc

SEQ ID NO: 126021 - RNA, 21 nt, Human
aaggagggcuucuuggaggag

SEQ ID NO: 126022 - RNA, 18 nt, Human
acucugugccgggcccug

SEQ ID NO: 126023 - RNA, 19 nt, Human
agacaaaucacacgcagac

SEQ ID NO: 126024 - RNA, 22 nt, Human
aggagggcuucuuggaggaggu

SEQ ID NO: 126025 - RNA, 20 nt, Human
aggaggggccccugccggcg

SEQ ID NO: 126026 - RNA, 23 nt, Human
aggaggugaccccugaagagggc

SEQ ID NO: 126027 - RNA, 21 nt, Human
aggagucucguccugccugga

SEQ ID NO: 126028 - RNA, 30 nt, Human
aggcggucggcagagggcccgcuggaagcc

SEQ ID NO: 126029 - RNA, 22 nt, Human
agggagcacagaggaggggccc

SEQ ID NO: 126030 - RNA, 21 nt, Human
aggugaccccugaagagggcu

SEQ ID NO: 126031 - RNA, 19 nt, Human
caguggugguggcugggag

SEQ ID NO: 126032 - RNA, 20 nt, Human
ccagcgugaaggguggccca

SEQ ID NO: 126033 - RNA, 20 nt, Human
cccugccggcgggggguggc

SEQ ID NO: 126034 - RNA, 19 nt, Human
cccugggugggcacagggg

SEQ ID NO: 126035 - RNA, 21 nt, Human
cccuugaggcgcugacagccu

SEQ ID NO: 126036 - RNA, 23 nt, Human
cggcagagggcccgcuggaagcc

SEQ ID NO: 126037 - RNA, 19 nt, Human
cgugggcagcagagguggg

SEQ ID NO: 126038 - RNA, 23 nt, Human
cucugugccgggcccuggguggg

SEQ ID NO: 126039 - RNA, 25 nt, Human
gaagcaggcggucggcagagggccc

SEQ ID NO: 126040 - RNA, 23 nt, Human
gacggggcaggggagaagggugg

SEQ ID NO: 126041 - RNA, 18 nt, Human
gaggagucucguccugcc

SEQ ID NO: 126042 - RNA, 18 nt, Human
gagggagcacagaggagg

SEQ ID NO: 126043 - RNA, 20 nt, Human
gcagcagaggugggcgggca

SEQ ID NO: 126044 - RNA, 19 nt, Human
gccgggcccugggugggca

SEQ ID NO: 126045 - RNA, 21 nt, Human
ggcacagggggcucagagaca

SEQ ID NO: 126046 - RNA, 18 nt, Human
ggcuucuuggaggaggug

SEQ ID NO: 126047 - RNA, 22 nt, Human
gggacaguggugguggcuggga

SEQ ID NO: 126048 - RNA, 24 nt, Human
gggacaguggugguggcugggagu

SEQ ID NO: 126049 - RNA, 21 nt, Human
gggcaagggccaguccaggaa

SEQ ID NO: 126050 - RNA, 18 nt, Human
ggggacggggcaggggag

SEQ ID NO: 126051 - RNA, 23 nt, Human
ggggagaaggguggguggccgug

SEQ ID NO: 126052 - RNA, 19 nt, Human
gggggguggcaaggagggc

SEQ ID NO: 126053 - RNA, 22 nt, Human
gguggcccaggggacggggcag

SEQ ID NO: 126054 - RNA, 22 nt, Human
gugccgggcccugggugggcac

SEQ ID NO: 126055 - RNA, 25 nt, Human
gugggcagcagaggugggcgggcac

SEQ ID NO: 126056 - RNA, 18 nt, Human
ucacacgcagacccuacc

SEQ ID NO: 126057 - RNA, 23 nt, Human
ucagugguagggacagugguggu

SEQ ID NO: 126058 - RNA, 26 nt, Human
uccaggaagggccauggaguccgcag

SEQ ID NO: 126059 - RNA, 23 nt, Human
ucucguccugccuggaggccccc

SEQ ID NO: 126060 - RNA, 18 nt, Human
ugagcaaguggccugugc

SEQ ID NO: 126061 - RNA, 18 nt, Human
ugaggggugugaagcagg

SEQ ID NO: 126062 - RNA, 21 nt, Human
uggcaaggagggcuucuugga

SEQ ID NO: 126063 - RNA, 20 nt, Human
uggcccaggggacggggcag

SEQ ID NO: 126064 - RNA, 20 nt, Human
uggcugggaguugggcaagg

SEQ ID NO: 126065 - RNA, 23 nt, Human
ugggaguugggcaagggccaguc

SEQ ID NO: 126066 - RNA, 20 nt, Human
ugguagggacagugguggug

SEQ ID NO: 126067 - RNA, 22 nt, Human
ugguguuagagguagcacaggu

SEQ ID NO: 126068 - RNA, 20 nt, Human
uugagcaucgacucugugcc

SEQ ID NO: 126069 - RNA, 18 nt, Human
uuuuuuuuuuuuuuuuug

SEQ ID NO: 126070 - RNA, 21 nt, Human
uuuuuuuuuuuuuuuuugcag

SEQ ID NO: 126071 - RNA, 22 nt, Human
uuuuuuuuuuuuuuuuugcagu

SEQ ID NO: 126072 - RNA, 23 nt, Human
aaacaggauaugggcagacagga

SEQ ID NO: 126073 - RNA, 23 nt, Human
aaacagguggugagaaugggugg

SEQ ID NO: 126074 - RNA, 23 nt, Human
aacaaagaaacagguggugagaa

SEQ ID NO: 126075 - RNA, 18 nt, Human
aagcgggggucaggaaga

SEQ ID NO: 126076 - RNA, 21 nt, Human
aauauuuaaugagcauuuacu

SEQ ID NO: 126077 - RNA, 18 nt, Human
acaagggguuuuagaccc

SEQ ID NO: 126078 - RNA, 23 nt, Human
acagguggugagaaugggugggu

SEQ ID NO: 126079 - RNA, 23 nt, Human
agaaggagacagguguaugggca

SEQ ID NO: 126080 - RNA, 18 nt, Human
agacaagccaggcaggaa

SEQ ID NO: 126081 - RNA, 21 nt, Human
agacagaaaacaggauauggg

SEQ ID NO: 126082 - RNA, 24 nt, Human
agacagaaaacaggauaugggcag

SEQ ID NO: 126083 - RNA, 29 nt, Human
agacagaaaacaggauauggggggacccc

SEQ ID NO: 126084 - RNA, 23 nt, Human
agacaggaaggggacagaagcgg

SEQ ID NO: 126085 - RNA, 25 nt, Human
agacaggaaggggacagaagggacc

SEQ ID NO: 126086 - RNA, 21 nt, Human
agacagguguaugggcagaca

SEQ ID NO: 126087 - RNA, 25 nt, Human
agacagguguaugggcagacagucu

SEQ ID NO: 126088 - RNA, 25 nt, Human
agacagguguaugggcagacaguuu

SEQ ID NO: 126089 - RNA, 20 nt, Human
agagagaaaguggguccagg

SEQ ID NO: 126090 - RNA, 21 nt, Human
agagagaaaguggguccaggg

SEQ ID NO: 126091 - RNA, 18 nt, Human
agagugaagggggagggc

SEQ ID NO: 126092 - RNA, 19 nt, Human
agcaggcaggugggaagaa

SEQ ID NO: 126093 - RNA, 24 nt, Human
agcaggcaggugggaagaagggaa

SEQ ID NO: 126094 - RNA, 18 nt, Human
aggcaggaagaaggagac

SEQ ID NO: 126095 - RNA, 22 nt, Human
aggcaggaagaaggagacaggu

SEQ ID NO: 126096 - RNA, 18 nt, Human
aggcaggaguuugggagg

SEQ ID NO: 126097 - RNA, 19 nt, Human
aggcaggaguuugggaggu

SEQ ID NO: 126098 - RNA, 21 nt, Human
aggcaggaguuugggaggugg

SEQ ID NO: 126099 - RNA, 20 nt, Human
aggggugugggcaccgcugc

SEQ ID NO: 126100 - RNA, 18 nt, Human
caaagaaacaggugguga

SEQ ID NO: 126101 - RNA, 19 nt, Human
caacaagagauacaggugg

SEQ ID NO: 126102 - RNA, 21 nt, Human
caagccacgagggguuuuaug

SEQ ID NO: 126103 - RNA, 19 nt, Human
caaggagcaaggagccagc

SEQ ID NO: 126104 - RNA, 23 nt, Human
caaguccagacacauuccagagc

SEQ ID NO: 126105 - RNA, 21 nt, Human
caccuaggggaacagugggag

SEQ ID NO: 126106 - RNA, 23 nt, Human
cagacagucuggagggcaggcag

SEQ ID NO: 126107 - RNA, 23 nt, Human
caggcaggaguuugggagguggg

SEQ ID NO: 126108 - RNA, 18 nt, Human
cagguggugagaaugggu

SEQ ID NO: 126109 - RNA, 19 nt, Human
caucugcucuguuacuuga

SEQ ID NO: 126110 - RNA, 20 nt, Human
ccacccuucagcacagagcu

SEQ ID NO: 126111 - RNA, 24 nt, Human
ccacgagggguuuuaugccccggg

SEQ ID NO: 126112 - RNA, 21 nt, Human
ccagacacauuccagagccac

SEQ ID NO: 126113 - RNA, 24 nt, Human
cccaacacucagcuuuucucccaa

SEQ ID NO: 126114 - RNA, 21 nt, Human
cccuguccauguaccucacaa

SEQ ID NO: 126115 - RNA, 20 nt, Human
ccucacaaauauuuaaugag

SEQ ID NO: 126116 - RNA, 18 nt, Human
ccuggacaugauucaaga

SEQ ID NO: 126117 - RNA, 21 nt, Human
ccugggagagcaaggagcaag

SEQ ID NO: 126118 - RNA, 19 nt, Human
cgagggguuuuaugccccg

SEQ ID NO: 126119 - RNA, 22 nt, Human
cgccaaagcuaaggauggaggc

SEQ ID NO: 126120 - RNA, 19 nt, Human
cgcugcgaggaaaacagac

SEQ ID NO: 126121 - RNA, 25 nt, Human
cucagcuuuucucccaacaagagau

SEQ ID NO: 126122 - RNA, 24 nt, Human
cucucucugaccaccccuguccac

SEQ ID NO: 126123 - RNA, 20 nt, Human
gagauacagguggguaggag

SEQ ID NO: 126124 - RNA, 20 nt, Human
gaguuugggaggugggugga

SEQ ID NO: 126125 - RNA, 21 nt, Human
gcaggaagaaggagacaggug

SEQ ID NO: 126126 - RNA, 23 nt, Human
gcagguagggagcccuggagaaa

SEQ ID NO: 126127 - RNA, 18 nt, Human
gccacgagcccuggauuc

SEQ ID NO: 126128 - RNA, 23 nt, Human
gcucggccucagcuucucccaac

SEQ ID NO: 126129 - RNA, 21 nt, Human
ggacaugauucaagacucuuu

SEQ ID NO: 126130 - RNA, 18 nt, Human
ggucaggaagacaggacg

SEQ ID NO: 126131 - RNA, 18 nt, Human
ggugagagagagaagggc

SEQ ID NO: 126132 - RNA, 23 nt, Human
uaaggauggaggcugugaaggcc

SEQ ID NO: 126133 - RNA, 24 nt, Human
uaauaggaaacuaauauaggaaca

SEQ ID NO: 126134 - RNA, 18 nt, Human
uacagcaguaauaggaaa

SEQ ID NO: 126135 - RNA, 24 nt, Human
uacagguggguaggagacaggaaa

SEQ ID NO: 126136 - RNA, 24 nt, Human
uacagguggguaggagacagguag

SEQ ID NO: 126137 - RNA, 24 nt, Human
uaccucacaaauauuuaaugagca

SEQ ID NO: 126138 - RNA, 22 nt, Human
uagggagcccuggagaaaggug

SEQ ID NO: 126139 - RNA, 18 nt, Human
uaugggcagacaggaagg

SEQ ID NO: 126140 - RNA, 22 nt, Human
ucagaguucagaaucgauugac

SEQ ID NO: 126141 - RNA, 22 nt, Human
ucagcugucuaccacauucccc

SEQ ID NO: 126142 - RNA, 22 nt, Human
ucucugagugccccuuccucuc

SEQ ID NO: 126143 - RNA, 19 nt, Human
ugaagggggagggcagaac

SEQ ID NO: 126144 - RNA, 19 nt, Human
ugagaaaagacaguuugag

SEQ ID NO: 126145 - RNA, 23 nt, Human
ugagagagaaaguggguccaggg

SEQ ID NO: 126146 - RNA, 18 nt, Human
ugagauaauggagagcag

SEQ ID NO: 126147 - RNA, 24 nt, Human
ugccaggcaguaugcuaggggugg

SEQ ID NO: 126148 - RNA, 19 nt, Human
ugcuggaucucugagugcc

SEQ ID NO: 126149 - RNA, 24 nt, Human
uggagagcagguucuuuuaacuca

SEQ ID NO: 126150 - RNA, 20 nt, Human
uggagggcaggcaggaguuu

SEQ ID NO: 126151 - RNA, 21 nt, Human
ugggagguggguggagauuca

SEQ ID NO: 126152 - RNA, 18 nt, Human
uggggagagugaaggggg

SEQ ID NO: 126153 - RNA, 20 nt, Human
uggggagagugaagggggag

SEQ ID NO: 126154 - RNA, 25 nt, Human
uggggagagugaagggggagggcag

SEQ ID NO: 126155 - RNA, 22 nt, Human
ugggggacagcaggcagguggg

SEQ ID NO: 126156 - RNA, 23 nt, Human
ugguguuccaaaggccacaaggg

SEQ ID NO: 126157 - RNA, 21 nt, Human
ugugaaggccccgagcucugg

SEQ ID NO: 126158 - RNA, 19 nt, Human
uguugggguguucagaccc

SEQ ID NO: 126159 - RNA, 19 nt, Human
uucagacccaacaccaggu

SEQ ID NO: 126160 - RNA, 19 nt, Human
uuuauuacagcaguaauag

SEQ ID NO: 126161 - RNA, 23 nt, Human
aaaugaaguuucucgaaccgaaa

SEQ ID NO: 126162 - RNA, 24 nt, Human
acacaaaguucaacaaagaaacac

SEQ ID NO: 126163 - RNA, 28 nt, Human
acacacacacaaaguucaacaaagaaac

SEQ ID NO: 126164 - RNA, 23 nt, Human
acauagcacuguccucuaggagu

SEQ ID NO: 126165 - RNA, 23 nt, Human
agagagucugcuucagaauuauu

SEQ ID NO: 126166 - RNA, 18 nt, Human
agggaggucacagccuga

SEQ ID NO: 126167 - RNA, 21 nt, Human
auaaccaugaaucucagggca

SEQ ID NO: 126168 - RNA, 21 nt, Human
auucuucuauuuggugguacc

SEQ ID NO: 126169 - RNA, 22 nt, Human
cacaaaguucaacaaagaaaca

SEQ ID NO: 126170 - RNA, 27 nt, Human
cacacacaaaguucaacaaagaaacac

SEQ ID NO: 126171 - RNA, 19 nt, Human
cacacacacaaaguucaac

SEQ ID NO: 126172 - RNA, 22 nt, Human
cacacacacacaaaguucaaca

SEQ ID NO: 126173 - RNA, 19 nt, Human
cagccauaaccaugaaucu

SEQ ID NO: 126174 - RNA, 19 nt, Human
cagggcaaaacuuuccuug

SEQ ID NO: 126175 - RNA, 24 nt, Human
cauaaccaugaaucucagggcaaa

SEQ ID NO: 126176 - RNA, 19 nt, Human
ccauaaccaugaaucucag

SEQ ID NO: 126177 - RNA, 21 nt, Human
ccccaacuccuccacacccag

SEQ ID NO: 126178 - RNA, 24 nt, Human
ccccaacuccuccacacccagccu

SEQ ID NO: 126179 - RNA, 18 nt, Human
ccccuaagccauucuucu

SEQ ID NO: 126180 - RNA, 25 nt, Human
ccuccugaaggcagggggccccaac

SEQ ID NO: 126181 - RNA, 21 nt, Human
cugcauuuuuaaguuugccaa

SEQ ID NO: 126182 - RNA, 20 nt, Human
gaaguuucucgaaccgaaau

SEQ ID NO: 126183 - RNA, 19 nt, Human
gucugcuucagaauuauuu

SEQ ID NO: 126184 - RNA, 23 nt, Human
uaaaugaaguuucucgaaccgaa

SEQ ID NO: 126185 - RNA, 22 nt, Human
uaaugccuacuucccuucuaaa

SEQ ID NO: 126186 - RNA, 20 nt, Human
uacagucuucauuuagguaa

SEQ ID NO: 126187 - RNA, 21 nt, Human
ucuaugguaaugccuacuucc

SEQ ID NO: 126188 - RNA, 19 nt, Human
ucucagggcaaaacuuucc

SEQ ID NO: 126189 - RNA, 25 nt, Human
ugcccagggaggucacagccugagc

SEQ ID NO: 126190 - RNA, 20 nt, Human
uggggaggguggugcccagg

SEQ ID NO: 126191 - RNA, 21 nt, Human
uggggaggguggugcccaggg

SEQ ID NO: 126192 - RNA, 19 nt, Human
uguugaauaaaugaaugag

SEQ ID NO: 126193 - RNA, 20 nt, Human
uucuugacuucagugauggu

SEQ ID NO: 126194 - RNA, 19 nt, Human
aaagaaacuucagagucua

SEQ ID NO: 126195 - RNA, 19 nt, Human
aaagugcugggauuacagg

SEQ ID NO: 126196 - RNA, 24 nt, Human
aaagugcugggauuacagguguga

SEQ ID NO: 126197 - RNA, 26 nt, Human
aaauccaacaauaagaaggcaaacaa

SEQ ID NO: 126198 - RNA, 23 nt, Human
aaauccagaaauuuauccaccca

SEQ ID NO: 126199 - RNA, 21 nt, Human
aacaccagccaguguaacaug

SEQ ID NO: 126200 - RNA, 20 nt, Human
aacagagcgagacuccaucu

SEQ ID NO: 126201 - RNA, 25 nt, Human
aacaugauaacaaacuaucaaacug

SEQ ID NO: 126202 - RNA, 18 nt, Human
aacauggcgaaaccccgc

SEQ ID NO: 126203 - RNA, 20 nt, Human
aacauggcgaaaccccgccu

SEQ ID NO: 126204 - RNA, 21 nt, Human
aacauggcgaaaccccgccuc

SEQ ID NO: 126205 - RNA, 23 nt, Human
aagcgauucuccugccucagcca

SEQ ID NO: 126206 - RNA, 18 nt, Human
aagugcugggauuacagg

SEQ ID NO: 126207 - RNA, 19 nt, Human
aagugcugggauuacaggu

SEQ ID NO: 126208 - RNA, 18 nt, Human
aaucacacgacugacaaa

SEQ ID NO: 126209 - RNA, 24 nt, Human
aaucacccgaacgcaggaggcgga

SEQ ID NO: 126210 - RNA, 25 nt, Human
acaaaacaaugauaaaagaaauuca

SEQ ID NO: 126211 - RNA, 21 nt, Human
acaccccacacaaaauuuaac

SEQ ID NO: 126212 - RNA, 22 nt, Human
acagacucuucuccaaagaaaa

SEQ ID NO: 126213 - RNA, 24 nt, Human
acagagcgagacuccaucucaaaa

SEQ ID NO: 126214 - RNA, 21 nt, Human
acaggcccgcaccaccacgac

SEQ ID NO: 126215 - RNA, 19 nt, Human
acccaggcuggagugcagu

SEQ ID NO: 126216 - RNA, 20 nt, Human
accgagaucaugccaccgca

SEQ ID NO: 126217 - RNA, 24 nt, Human
accgcacuccagccugggcaacag

SEQ ID NO: 126218 - RNA, 24 nt, Human
accgcacuccagccugggcaacag

SEQ ID NO: 126219 - RNA, 20 nt, Human
acgugguuucaccauauugg

SEQ ID NO: 126220 - RNA, 24 nt, Human
acgugguuucaccauauuggccag

SEQ ID NO: 126221 - RNA, 24 nt, Human
acuccuggguucaagcgauucucc

SEQ ID NO: 126222 - RNA, 18 nt, Human
agaaacacaaaagaagca

SEQ ID NO: 126223 - RNA, 26 nt, Human
agacuugcaaaucacacgacugacag

SEQ ID NO: 126224 - RNA, 24 nt, Human
agcacuuugggaggccgaggcagg

SEQ ID NO: 126225 - RNA, 23 nt, Human
agcagcugugaauacaggcacac

SEQ ID NO: 126226 - RNA, 24 nt, Human
agccugggcaacagagcgagacuc

SEQ ID NO: 126227 - RNA, 24 nt, Human
agcucuuucacccaggcuggagug

SEQ ID NO: 126228 - RNA, 23 nt, Human
agcuggacgugguggugggugcc

SEQ ID NO: 126229 - RNA, 21 nt, Human
aggcaccccugucaaagucuu

SEQ ID NO: 126230 - RNA, 18 nt, Human
aggcagguggaucaccug

SEQ ID NO: 126231 - RNA, 22 nt, Human
aggcagguggaucaccugaggg

SEQ ID NO: 126232 - RNA, 22 nt, Human
aggcagguggaucaccugaggu

SEQ ID NO: 126233 - RNA, 20 nt, Human
aggcccgcaccaccacgacc

SEQ ID NO: 126234 - RNA, 21 nt, Human
aggccgaggcagguggaucac

SEQ ID NO: 126235 - RNA, 21 nt, Human
aggcggagguugcaaugaacc

SEQ ID NO: 126236 - RNA, 24 nt, Human
aggcggagguugcaaugaaccgag

SEQ ID NO: 126237 - RNA, 25 nt, Human
aggcuggagugcaguggcacaaucu

SEQ ID NO: 126238 - RNA, 18 nt, Human
agggauuuucuuuucuuu

SEQ ID NO: 126239 - RNA, 23 nt, Human
agguccggaacauuuucaccauc

SEQ ID NO: 126240 - RNA, 24 nt, Human
agucuuaccucauaaaaauuuaaa

SEQ ID NO: 126241 - RNA, 20 nt, Human
agugcaguggcacaaucucg

SEQ ID NO: 126242 - RNA, 24 nt, Human
agugcaguggcacaaucucggcuc

SEQ ID NO: 126243 - RNA, 21 nt, Human
aguggggucagagugggucuc

SEQ ID NO: 126244 - RNA, 19 nt, Human
auacaacaauuagcuggac

SEQ ID NO: 126245 - RNA, 19 nt, Human
auacaacaauuagcuggac

SEQ ID NO: 126246 - RNA, 23 nt, Human
aucaccugagguuaggaguucaa

SEQ ID NO: 126247 - RNA, 24 nt, Human
aucaugccaccgcacuccagccug

SEQ ID NO: 126248 - RNA, 24 nt, Human
auccauauacaagaaaacaguuaa

SEQ ID NO: 126249 - RNA, 24 nt, Human
augccaccgcacuccagccugggc

SEQ ID NO: 126250 - RNA, 21 nt, Human
auggaccauauuguguuuauc

SEQ ID NO: 126251 - RNA, 22 nt, Human
augucaccuucucccuucucag

SEQ ID NO: 126252 - RNA, 20 nt, Human
caaaagaagcagaauagcca

SEQ ID NO: 126253 - RNA, 22 nt, Human
caaaagaagcagaauagccaaa

SEQ ID NO: 126254 - RNA, 24 nt, Human
caaaagaagcagaauagccaaaaa

SEQ ID NO: 126255 - RNA, 21 nt, Human
caaagaaaauauaggaguguc

SEQ ID NO: 126256 - RNA, 19 nt, Human
caaauaggcacaggaaggc

SEQ ID NO: 126257 - RNA, 25 nt, Human
caaauaggcacaggaaggcacgagu

SEQ ID NO: 126258 - RNA, 18 nt, Human
caaccuccucuccccuuc

SEQ ID NO: 126259 - RNA, 26 nt, Human
caagaaaacaaauaaauacaggggua

SEQ ID NO: 126260 - RNA, 22 nt, Human
caagcgauucuccugccucagc

SEQ ID NO: 126261 - RNA, 23 nt, Human
caaggauauucuuuucaaaaaaa

SEQ ID NO: 126262 - RNA, 23 nt, Human
cacacaccaccacgccuggcuaa

SEQ ID NO: 126263 - RNA, 24 nt, Human
cacaccaccacgccuggcuaauuu

SEQ ID NO: 126264 - RNA, 24 nt, Human
cacaccccacacaaaauuuaacua

SEQ ID NO: 126265 - RNA, 23 nt, Human
caccaauccacuauacaucucuu

SEQ ID NO: 126266 - RNA, 23 nt, Human
caccaccccagcccaccgcaacc

SEQ ID NO: 126267 - RNA, 21 nt, Human
caccauauuggccaggcuggu

SEQ ID NO: 126268 - RNA, 24 nt, Human
caccauauuggccaggcuggucuc

SEQ ID NO: 126269 - RNA, 27 nt, Human
caccauauuggccaggcuggucucaaa

SEQ ID NO: 126270 - RNA, 23 nt, Human
caccaucccaggagaaaacccca

SEQ ID NO: 126271 - RNA, 24 nt, Human
caccccugucaaagucuugucuac

SEQ ID NO: 126272 - RNA, 24 nt, Human
caccgcacuccagccugggcaaca

SEQ ID NO: 126273 - RNA, 18 nt, Human
caccuccccacagcugcu

SEQ ID NO: 126274 - RNA, 23 nt, Human
cacuccagccugggcaacagagc

SEQ ID NO: 126275 - RNA, 24 nt, Human
cacuccagccugggcaacagagcg

SEQ ID NO: 126276 - RNA, 22 nt, Human
cagaaaucccaauucaaacccu

SEQ ID NO: 126277 - RNA, 24 nt, Human
cagcacuuugggaggccgaggcag

SEQ ID NO: 126278 - RNA, 24 nt, Human
cagcacuuugggaggccgaggcag

SEQ ID NO: 126279 - RNA, 23 nt, Human
cagcccaccgcaaccuccgccug

SEQ ID NO: 126280 - RNA, 24 nt, Human
caggccuguaaucccagcacuuug

SEQ ID NO: 126281 - RNA, 24 nt, Human
cagguggaucaccugagguuagga

SEQ ID NO: 126282 - RNA, 22 nt, Human
caguuaaaccacaguucacacc

SEQ ID NO: 126283 - RNA, 20 nt, Human
cauagaaacacaaaagaagc

SEQ ID NO: 126284 - RNA, 24 nt, Human
cauagaacucucaaaauccaacaa

SEQ ID NO: 126285 - RNA, 24 nt, Human
cauauuggccaggcuggucucaaa

SEQ ID NO: 126286 - RNA, 20 nt, Human
cauggaaagaugcucacaac

SEQ ID NO: 126287 - RNA, 22 nt, Human
cauuuuauuagcauuguacacc

SEQ ID NO: 126288 - RNA, 24 nt, Human
ccaacaauaagaaggcaaacaauc

SEQ ID NO: 126289 - RNA, 22 nt, Human
ccaagcagcugugaauacaggc

SEQ ID NO: 126290 - RNA, 23 nt, Human
ccaccgcaaccuccgccuguggg

SEQ ID NO: 126291 - RNA, 20 nt, Human
ccaccgcacuccagccuggg

SEQ ID NO: 126292 - RNA, 20 nt, Human
ccaccgcacuccagccuggg

SEQ ID NO: 126293 - RNA, 21 nt, Human
ccaccgcacuccagccugggc

SEQ ID NO: 126294 - RNA, 24 nt, Human
ccaccgcacuccagccugggcaac

SEQ ID NO: 126295 - RNA, 23 nt, Human
ccaggccuguaaucccagcacuu

SEQ ID NO: 126296 - RNA, 24 nt, Human
ccaucucaaaaaaaaaaaaaaaaa

SEQ ID NO: 126297 - RNA, 19 nt, Human
cccaccuugaccuccuaaa

SEQ ID NO: 126298 - RNA, 21 nt, Human
ccccacucuuccacucacaga

SEQ ID NO: 126299 - RNA, 22 nt, Human
ccccacucuuccacucacagaa

SEQ ID NO: 126300 - RNA, 23 nt, Human
ccccagcccaccgcaaccuccgc

SEQ ID NO: 126301 - RNA, 19 nt, Human
cccucccccaggcuggagc

SEQ ID NO: 126302 - RNA, 23 nt, Human
ccgcaaccuccgccuguggguuu

SEQ ID NO: 126303 - RNA, 24 nt, Human
ccgcaaccuccgccuguggguuuc

SEQ ID NO: 126304 - RNA, 19 nt, Human
ccggaacauuuucaccauc

SEQ ID NO: 126305 - RNA, 22 nt, Human
ccuaaagugcugggauuacagg

SEQ ID NO: 126306 - RNA, 24 nt, Human
ccuaaagugcugggauuacaggug

SEQ ID NO: 126307 - RNA, 18 nt, Human
ccuccucuccccuucuuc

SEQ ID NO: 126308 - RNA, 19 nt, Human
ccuccucuccccuucuucu

SEQ ID NO: 126309 - RNA, 24 nt, Human
ccugcaaucccagccacccgggag

SEQ ID NO: 126310 - RNA, 22 nt, Human
ccugggcaacagagcgagacuc

SEQ ID NO: 126311 - RNA, 23 nt, Human
ccuggguucaagcgauucuccug

SEQ ID NO: 126312 - RNA, 25 nt, Human
ccuugucccacacaaccuccucucc

SEQ ID NO: 126313 - RNA, 18 nt, Human
cgagacaggucaaucacc

SEQ ID NO: 126314 - RNA, 21 nt, Human
cgagacaggucaaucacccga

SEQ ID NO: 126315 - RNA, 22 nt, Human
cgagcagcugggaccacaggcc

SEQ ID NO: 126316 - RNA, 20 nt, Human
cgaggcagguggaucaccug

SEQ ID NO: 126317 - RNA, 21 nt, Human
cuaaagugcugggauuacagg

SEQ ID NO: 126318 - RNA, 24 nt, Human
cuaaagugcugggauuacaggugu

SEQ ID NO: 126319 - RNA, 20 nt, Human
cuagaaaagugucuaaccaa

SEQ ID NO: 126320 - RNA, 24 nt, Human
cuagggcagagacuuacuuugaaa

SEQ ID NO: 126321 - RNA, 24 nt, Human
cucacugaaaccucugacuccugg

SEQ ID NO: 126322 - RNA, 22 nt, Human
cuccaaagaaaauauaggagug

SEQ ID NO: 126323 - RNA, 19 nt, Human
cuccaucucaaaaaaaaaa

SEQ ID NO: 126324 - RNA, 20 nt, Human
cuccugaccucaugaucugc

SEQ ID NO: 126325 - RNA, 22 nt, Human
cuccugccucagccauccaagc

SEQ ID NO: 126326 - RNA, 21 nt, Human
cuccuggguucaagcgauucu

SEQ ID NO: 126327 - RNA, 18 nt, Human
cugaaacaaaaacugacc

SEQ ID NO: 126328 - RNA, 21 nt, Human
cugcaucaaccucccgagcag

SEQ ID NO: 126329 - RNA, 23 nt, Human
gaaaacaaauaaauacaggggua

SEQ ID NO: 126330 - RNA, 21 nt, Human
gaaacaguuuggcaguguuuu

SEQ ID NO: 126331 - RNA, 24 nt, Human
gaaagaugcucacaacauauucuu

SEQ ID NO: 126332 - RNA, 19 nt, Human
gaacacuugucucaauuau

SEQ ID NO: 126333 - RNA, 22 nt, Human
gaacagacucuucuccaaagaa

SEQ ID NO: 126334 - RNA, 21 nt, Human
gaauacaggcacacaccacca

SEQ ID NO: 126335 - RNA, 22 nt, Human
gacgugguggugggugccugca

SEQ ID NO: 126336 - RNA, 23 nt, Human
gagaucaugccaccgcacuccag

SEQ ID NO: 126337 - RNA, 24 nt, Human
gagcagcugggaccacaggcccgc

SEQ ID NO: 126338 - RNA, 23 nt, Human
gaggcagguggaucaccugaggu

SEQ ID NO: 126339 - RNA, 23 nt, Human
gaucaccugagguuaggaguuca

SEQ ID NO: 126340 - RNA, 24 nt, Human
gaucaccugagguuaggaguucaa

SEQ ID NO: 126341 - RNA, 21 nt, Human
gauuacaggugugagcuaccg

SEQ ID NO: 126342 - RNA, 24 nt, Human
gauuacaggugugagcuaccgugc

SEQ ID NO: 126343 - RNA, 24 nt, Human
gcacuccagccugggcaacagagc

SEQ ID NO: 126344 - RNA, 20 nt, Human
gcaucaaccucccgagcagc

SEQ ID NO: 126345 - RNA, 22 nt, Human
gccaccgcacuccagccugggc

SEQ ID NO: 126346 - RNA, 19 nt, Human
gcuaccgugcccugccaag

SEQ ID NO: 126347 - RNA, 22 nt, Human
gcucuuucacccaggcuggagu

SEQ ID NO: 126348 - RNA, 22 nt, Human
gcugaaacaaaaacugacccua

SEQ ID NO: 126349 - RNA, 18 nt, Human
gcugaaagccaccaaucc

SEQ ID NO: 126350 - RNA, 25 nt, Human
gcuggagcgcaguggcaccacccca

SEQ ID NO: 126351 - RNA, 19 nt, Human
gcuggagugcaguggcaca

SEQ ID NO: 126352 - RNA, 23 nt, Human
gcuggucucaaacuccugaccuc

SEQ ID NO: 126353 - RNA, 18 nt, Human
ggaaagaugcucacaaca

SEQ ID NO: 126354 - RNA, 24 nt, Human
ggagguugcaaugaaccgagauca

SEQ ID NO: 126355 - RNA, 20 nt, Human
ggccaggccuguaaucccag

SEQ ID NO: 126356 - RNA, 23 nt, Human
ggccuguaaucccagcacuuugg

SEQ ID NO: 126357 - RNA, 24 nt, Human
ggccuguaaucccagcacuuuggg

SEQ ID NO: 126358 - RNA, 24 nt, Human
ggcuggucucaaacuccugaccuc

SEQ ID NO: 126359 - RNA, 23 nt, Human
gggaggccgagacaggucaauca

SEQ ID NO: 126360 - RNA, 22 nt, Human
ggggccaggccuguaaucccag

SEQ ID NO: 126361 - RNA, 24 nt, Human
ggggccaggccuguaaucccagca

SEQ ID NO: 126362 - RNA, 21 nt, Human
gguuucaccauauuggccagg

SEQ ID NO: 126363 - RNA, 23 nt, Human
guauugguccaacauggaauaga

SEQ ID NO: 126364 - RNA, 24 nt, Human
gugaauacaggcacacaccaccac

SEQ ID NO: 126365 - RNA, 24 nt, Human
gugauucuccugcaucaaccuccc

SEQ ID NO: 126366 - RNA, 19 nt, Human
gugugagcuaccgugcccu

SEQ ID NO: 126367 - RNA, 18 nt, Human
uaaagucaccauuuuauu

SEQ ID NO: 126368 - RNA, 24 nt, Human
uaaagugcugggauuacaggugug

SEQ ID NO: 126369 - RNA, 18 nt, Human
uaaauucucagcuguaca

SEQ ID NO: 126370 - RNA, 21 nt, Human
uaaauucucagcuguacauuu

SEQ ID NO: 126371 - RNA, 20 nt, Human
uaacaugauaacaaacuauc

SEQ ID NO: 126372 - RNA, 27 nt, Human
uaacaugauaacaaacuaucaaacugg

SEQ ID NO: 126373 - RNA, 24 nt, Human
uaacauggcgaaaccccgccucua

SEQ ID NO: 126374 - RNA, 19 nt, Human
uaaccacaccuguaucuua

SEQ ID NO: 126375 - RNA, 23 nt, Human
uaacuuuuguacuuuaguagaga

SEQ ID NO: 126376 - RNA, 22 nt, Human
uaaggaaggcugaaacaaaaac

SEQ ID NO: 126377 - RNA, 24 nt, Human
uaauuuuucuauuuuuaauagaga

SEQ ID NO: 126378 - RNA, 18 nt, Human
uacaacaauuagcuggac

SEQ ID NO: 126379 - RNA, 19 nt, Human
uacugugaauagggcugcc

SEQ ID NO: 126380 - RNA, 24 nt, Human
uacugugaauagggcugccaugaa

SEQ ID NO: 126381 - RNA, 20 nt, Human
uagagacgugguuucaccau

SEQ ID NO: 126382 - RNA, 20 nt, Human
uagcauuuagugcacucaca

SEQ ID NO: 126383 - RNA, 18 nt, Human
uagcuggacgugguggug

SEQ ID NO: 126384 - RNA, 25 nt, Human
uaggagugucaaauaggcacaggaa

SEQ ID NO: 126385 - RNA, 19 nt, Human
uaggaguucaacaccagcc

SEQ ID NO: 126386 - RNA, 21 nt, Human
uaggcacaggaaggcacgagu

SEQ ID NO: 126387 - RNA, 18 nt, Human
uauagauucacagaaauc

SEQ ID NO: 126388 - RNA, 22 nt, Human
ucaagccauuaaagugccagaa

SEQ ID NO: 126389 - RNA, 19 nt, Human
ucaagcgauucuccugccu

SEQ ID NO: 126390 - RNA, 21 nt, Human
ucacagaaaucccaauucaaa

SEQ ID NO: 126391 - RNA, 20 nt, Human
ucaccaucccaggagaaaac

SEQ ID NO: 126392 - RNA, 19 nt, Human
ucacccaggcuggagugca

SEQ ID NO: 126393 - RNA, 24 nt, Human
ucacccaggcuggagugcaguggc

SEQ ID NO: 126394 - RNA, 24 nt, Human
ucacugaaaccucugacuccuggg

SEQ ID NO: 126395 - RNA, 23 nt, Human
ucaguaucaugcauucaagguuc

SEQ ID NO: 126396 - RNA, 23 nt, Human
uccagccugggcaacagagcgag

SEQ ID NO: 126397 - RNA, 24 nt, Human
uccagccugggcaacagagcgaga

SEQ ID NO: 126398 - RNA, 23 nt, Human
uccaucucaaaaaaaaaaaaaaa

SEQ ID NO: 126399 - RNA, 19 nt, Human
ucccccucccccaggcugg

SEQ ID NO: 126400 - RNA, 23 nt, Human
ucccgagcagcugggaccacagg

SEQ ID NO: 126401 - RNA, 24 nt, Human
uccuaaagugcugggauuacaggu

SEQ ID NO: 126402 - RNA, 22 nt, Human
uccucagucccaccuccccaca

SEQ ID NO: 126403 - RNA, 22 nt, Human
uccugcaucaaccucccgagca

SEQ ID NO: 126404 - RNA, 21 nt, Human
uccuggguucaagcgauucuc

SEQ ID NO: 126405 - RNA, 24 nt, Human
uccuggguucaagcgauucuccug

SEQ ID NO: 126406 - RNA, 24 nt, Human
ucuaaagugucuaauucaauagca

SEQ ID NO: 126407 - RNA, 23 nt, Human
ucuagcucuuucacccaggcugg

SEQ ID NO: 126408 - RNA, 24 nt, Human
ucuagcucuuucacccaggcugga

SEQ ID NO: 126409 - RNA, 21 nt, Human
ucuaggauggaauacaggacu

SEQ ID NO: 126410 - RNA, 22 nt, Human
ucuuaggguaauucuaggccuc

SEQ ID NO: 126411 - RNA, 18 nt, Human
ugaaacaaaaacugaccc

SEQ ID NO: 126412 - RNA, 21 nt, Human
ugaaacaaaaacugacccuac

SEQ ID NO: 126413 - RNA, 23 nt, Human
ugaaagaaagaaacuucagaguc

SEQ ID NO: 126414 - RNA, 23 nt, Human
ugaagaauaacucaauuuguaac

SEQ ID NO: 126415 - RNA, 28 nt, Human
ugacuccuggguucaagcgauucuccuu

SEQ ID NO: 126416 - RNA, 23 nt, Human
ugaucugcccaccuugaccuccu

SEQ ID NO: 126417 - RNA, 18 nt, Human
ugaugccaaacgaaccag

SEQ ID NO: 126418 - RNA, 22 nt, Human
ugcaaugaaccgagaucaugcc

SEQ ID NO: 126419 - RNA, 22 nt, Human
ugcaguggcacaaucucggcuc

SEQ ID NO: 126420 - RNA, 24 nt, Human
ugcaucaaccucccgagcagcugg

SEQ ID NO: 126421 - RNA, 24 nt, Human
ugccaccgcacuccagccugggca

SEQ ID NO: 126422 - RNA, 22 nt, Human
ugccagaaaagaaaucuuacaa

SEQ ID NO: 126423 - RNA, 23 nt, Human
ugccugcaaucccagccacccgg

SEQ ID NO: 126424 - RNA, 24 nt, Human
ugccugcaaucccagccacccggg

SEQ ID NO: 126425 - RNA, 20 nt, Human
ugcugggauuacagguguga

SEQ ID NO: 126426 - RNA, 21 nt, Human
ugcuucauuccuuuuuauggc

SEQ ID NO: 126427 - RNA, 23 nt, Human
uggagugcaguggcacaaucucg

SEQ ID NO: 126428 - RNA, 24 nt, Human
uggagugcaguggcacaaucucgg

SEQ ID NO: 126429 - RNA, 24 nt, Human
uggaucaccugagguuaggaguuc

SEQ ID NO: 126430 - RNA, 22 nt, Human
uggcacaaucucggcucacuga

SEQ ID NO: 126431 - RNA, 24 nt, Human
uggcaguauaaacauaauucacca

SEQ ID NO: 126432 - RNA, 24 nt, Human
uggccaggcuggucucaaacuccu

SEQ ID NO: 126433 - RNA, 21 nt, Human
ugggaccacaggcccgcacca

SEQ ID NO: 126434 - RNA, 24 nt, Human
ugggaccacaggcccgcaccacca

SEQ ID NO: 126435 - RNA, 24 nt, Human
ugggaggccgaggcagguggauca

SEQ ID NO: 126436 - RNA, 21 nt, Human
ugggauuacaggugugagcua

SEQ ID NO: 126437 - RNA, 22 nt, Human
ugggauuacaggugugagcuac

SEQ ID NO: 126438 - RNA, 23 nt, Human
ugggauuacaggugugagcuacc

SEQ ID NO: 126439 - RNA, 23 nt, Human
ugggauuacaggugugagcuacc

SEQ ID NO: 126440 - RNA, 24 nt, Human
ugggauuacaggugugagcuaccg

SEQ ID NO: 126441 - RNA, 22 nt, Human
uggggccaggccuguaauccca

SEQ ID NO: 126442 - RNA, 23 nt, Human
uggguucaagcgauucuccugcc

SEQ ID NO: 126443 - RNA, 24 nt, Human
uggguucaagcgauucuccugccu

SEQ ID NO: 126444 - RNA, 20 nt, Human
uggguuucaagugauucucc

SEQ ID NO: 126445 - RNA, 24 nt, Human
ugguggugggugccugcaauccca

SEQ ID NO: 126446 - RNA, 23 nt, Human
ugucaggagcaccuugucccaca

SEQ ID NO: 126447 - RNA, 21 nt, Human
ugucuaaccacaccuguaucu

SEQ ID NO: 126448 - RNA, 21 nt, Human
ugugaagaauccagauggaaa

SEQ ID NO: 126449 - RNA, 24 nt, Human
uguggguuucaagugauucuccug

SEQ ID NO: 126450 - RNA, 25 nt, Human
uguuuuguuuuguuuuguuuugauu

SEQ ID NO: 126451 - RNA, 25 nt, Human
uguuuuguuuuguuuuguuuugauu

SEQ ID NO: 126452 - RNA, 25 nt, Human
uguuuuguuuuguuuuguuuugauu

SEQ ID NO: 126453 - RNA, 23 nt, Human
uuaaaccacaguucacaccccac

SEQ ID NO: 126454 - RNA, 24 nt, Human
uuaauagagacgugguuucaccau

SEQ ID NO: 126455 - RNA, 24 nt, Human
uuagcuggacgugguggugggugc

SEQ ID NO: 126456 - RNA, 21 nt, Human
uucaagcgauucuccugccuc

SEQ ID NO: 126457 - RNA, 23 nt, Human
uucaagcgauucuccugccucag

SEQ ID NO: 126458 - RNA, 24 nt, Human
uucaagcgauucuccugccucagc

SEQ ID NO: 126459 - RNA, 22 nt, Human
uucaagugauucuccugcauca

SEQ ID NO: 126460 - RNA, 24 nt, Human
uucaagugauucuccugcaucaac

SEQ ID NO: 126461 - RNA, 18 nt, Human
uucuccugcaucaaccuc

SEQ ID NO: 126462 - RNA, 22 nt, Human
uugaauacuuaacaugcacauu

SEQ ID NO: 126463 - RNA, 20 nt, Human
uuggccuguucuggaaauuu

SEQ ID NO: 126464 - RNA, 25 nt, Human
uugggaggccgaggcagguggauca

SEQ ID NO: 126465 - RNA, 24 nt, Human
uuucaccauauuggccaggcuggu

SEQ ID NO: 126466 - RNA, 24 nt, Human
uuugaauacuuaacaugcacauuu

SEQ ID NO: 126467 - RNA, 25 nt, Human
uuugaugaagaauaacucaauuugu

SEQ ID NO: 126468 - RNA, 19 nt, Human
uuuguuuuguuuuguuuug

SEQ ID NO: 126469 - RNA, 19 nt, Human
uuuguuuuguuuuguuuug

SEQ ID NO: 126470 - RNA, 19 nt, Human
uuuguuuuguuuuguuuug

SEQ ID NO: 126471 - RNA, 20 nt, Human
uuuguuuuguuuuguuuuug

SEQ ID NO: 126472 - RNA, 24 nt, Human
uuuuuaauagagacgugguuucac

SEQ ID NO: 126473 - RNA, 21 nt, Human
aaaaaaacaguaaacuacaag

SEQ ID NO: 126474 - RNA, 21 nt, Human
aaaaagaaaaaaguuuguuaa

SEQ ID NO: 126475 - RNA, 18 nt, Human
aaaaauuagcagagauuc

SEQ ID NO: 126476 - RNA, 20 nt, Human
aaacccagccccaccccucg

SEQ ID NO: 126477 - RNA, 21 nt, Human
aaacccagccccaccccucgg

SEQ ID NO: 126478 - RNA, 22 nt, Human
aaagaacuguaauauacauaaa

SEQ ID NO: 126479 - RNA, 19 nt, Human
aaauaauaauaaacugugg

SEQ ID NO: 126480 - RNA, 20 nt, Human
aacagagcgagacuccaucu

SEQ ID NO: 126481 - RNA, 21 nt, Human
aacauagugaaacccccgucu

SEQ ID NO: 126482 - RNA, 22 nt, Human
aacauagugaaacccccgucuc

SEQ ID NO: 126483 - RNA, 18 nt, Human
aagaggcggaucaauccc

SEQ ID NO: 126484 - RNA, 22 nt, Human
aagcagggaacaacugagccca

SEQ ID NO: 126485 - RNA, 25 nt, Human
aagcagggaacaacugagcccaaaa

SEQ ID NO: 126486 - RNA, 19 nt, Human
aagcgggcugcgccugugg

SEQ ID NO: 126487 - RNA, 18 nt, Human
aauuagccaggcauggug

SEQ ID NO: 126488 - RNA, 24 nt, Human
aauugcuugaacccgggaggcaga

SEQ ID NO: 126489 - RNA, 24 nt, Human
acagagcgagacuccaucucaaaa

SEQ ID NO: 126490 - RNA, 22 nt, Human
accacugcacuccagccugggc

SEQ ID NO: 126491 - RNA, 24 nt, Human
accagaguucacugaucucacauu

SEQ ID NO: 126492 - RNA, 21 nt, Human
accccgugcgucacagaaugg

SEQ ID NO: 126493 - RNA, 23 nt, Human
acccuuccauccucacacacaca

SEQ ID NO: 126494 - RNA, 28 nt, Human
acuccaucucaaaaaaaaaaaaaaaaaa

SEQ ID NO: 126495 - RNA, 24 nt, Human
acugcacuccagccugggcaacag

SEQ ID NO: 126496 - RNA, 24 nt, Human
acugcacuccagccugggcaacag

SEQ ID NO: 126497 - RNA, 18 nt, Human
agaaucugccaauuaccu

SEQ ID NO: 126498 - RNA, 24 nt, Human
agaggaugcagugagcugagaucg

SEQ ID NO: 126499 - RNA, 21 nt, Human
agcacauguauaaguaucaua

SEQ ID NO: 126500 - RNA, 19 nt, Human
agcagggaaggccaggugc

SEQ ID NO: 126501 - RNA, 23 nt, Human
agccaggcaugguggcaggugcc

SEQ ID NO: 126502 - RNA, 24 nt, Human
agccugggcaacagagcgagacuc

SEQ ID NO: 126503 - RNA, 18 nt, Human
aggaagcagggaaggcca

SEQ ID NO: 126504 - RNA, 23 nt, Human
aggcagagaauugcuugaacccg

SEQ ID NO: 126505 - RNA, 20 nt, Human
aggcagaggaugcagugagc

SEQ ID NO: 126506 - RNA, 24 nt, Human
aggcagaggaugcagugagcugag

SEQ ID NO: 126507 - RNA, 24 nt, Human
aggcaugguggcaggugccuguaa

SEQ ID NO: 126508 - RNA, 22 nt, Human
aggccaaggcggguggacucac

SEQ ID NO: 126509 - RNA, 22 nt, Human
aggccaggugcgguggcucaug

SEQ ID NO: 126510 - RNA, 23 nt, Human
aggcugaggcagagaauugcuug

SEQ ID NO: 126511 - RNA, 22 nt, Human
agggaacaacugagcccaaaac

SEQ ID NO: 126512 - RNA, 21 nt, Human
aggugccuguaaucccaacua

SEQ ID NO: 126513 - RNA, 24 nt, Human
aggugcgguggcucaugccuguaa

SEQ ID NO: 126514 - RNA, 20 nt, Human
aucaaauaugguccuggauc

SEQ ID NO: 126515 - RNA, 18 nt, Human
aucaccuagugaaaacag

SEQ ID NO: 126516 - RNA, 22 nt, Human
aucccagcacuuugggaggcca

SEQ ID NO: 126517 - RNA, 24 nt, Human
aucgcaccacugcacuccagccug

SEQ ID NO: 126518 - RNA, 28 nt, Human
aucgcaccacugcacuccagccugggca

SEQ ID NO: 126519 - RNA, 19 nt, Human
augcagugagcugagaucg

SEQ ID NO: 126520 - RNA, 22 nt, Human
augcagugagcugagaucgcac

SEQ ID NO: 126521 - RNA, 19 nt, Human
augccuguaaucccagcac

SEQ ID NO: 126522 - RNA, 18 nt, Human
caaaacaaaauuaucccc

SEQ ID NO: 126523 - RNA, 24 nt, Human
caacuacuugggaggcugaggcag

SEQ ID NO: 126524 - RNA, 22 nt, Human
caacugagcccaaaacaaaauu

SEQ ID NO: 126525 - RNA, 26 nt, Human
caaggcggguggacucacgaggcuca

SEQ ID NO: 126526 - RNA, 24 nt, Human
caauuaccuagauccccccucaac

SEQ ID NO: 126527 - RNA, 23 nt, Human
cacacuuaaaaaaacaguaaacu

SEQ ID NO: 126528 - RNA, 19 nt, Human
cacauguauaaguaucaua

SEQ ID NO: 126529 - RNA, 24 nt, Human
cacgaggcucaggaguucaagacc

SEQ ID NO: 126530 - RNA, 21 nt, Human
cacgcccuuaaauaacacucu

SEQ ID NO: 126531 - RNA, 24 nt, Human
cacuccagccugggcaacagagcg

SEQ ID NO: 126532 - RNA, 18 nt, Human
cacugcacuccagccugg

SEQ ID NO: 126533 - RNA, 19 nt, Human
cacugcacuccagccuggg

SEQ ID NO: 126534 - RNA, 21 nt, Human
cacugcacuccagccugggca

SEQ ID NO: 126535 - RNA, 23 nt, Human
cacugcacuccagccugggcaac

SEQ ID NO: 126536 - RNA, 24 nt, Human
cacugcacuccagccugggcaaca

SEQ ID NO: 126537 - RNA, 25 nt, Human
cacugcacuccagccugggcaacaa

SEQ ID NO: 126538 - RNA, 24 nt, Human
cagcacuuugggaggccaaggcgg

SEQ ID NO: 126539 - RNA, 18 nt, Human
caggcaugguggcaggug

SEQ ID NO: 126540 - RNA, 20 nt, Human
cagguaaauaaauauguaau

SEQ ID NO: 126541 - RNA, 21 nt, Human
caguuaacaaaauccuaaauc

SEQ ID NO: 126542 - RNA, 20 nt, Human
caugccuguaaucccagcac

SEQ ID NO: 126543 - RNA, 24 nt, Human
caugccuguaaucccagcacuuug

SEQ ID NO: 126544 - RNA, 22 nt, Human
caugguggcaggugccuguaau

SEQ ID NO: 126545 - RNA, 24 nt, Human
ccaaaacaaaauuauccccuaagg

SEQ ID NO: 126546 - RNA, 19 nt, Human
ccaaggcggguggacucac

SEQ ID NO: 126547 - RNA, 21 nt, Human
ccacagggggccuugccccag

SEQ ID NO: 126548 - RNA, 20 nt, Human
ccacugcacuccagccuggg

SEQ ID NO: 126549 - RNA, 20 nt, Human
ccacugcacuccagccuggg

SEQ ID NO: 126550 - RNA, 21 nt, Human
ccacugcacuccagccugggc

SEQ ID NO: 126551 - RNA, 23 nt, Human
ccacugcacuccagccugggcaa

SEQ ID NO: 126552 - RNA, 24 nt, Human
ccacugcacuccagccugggcaac

SEQ ID NO: 126553 - RNA, 20 nt, Human
ccagaguucacugaucucac

SEQ ID NO: 126554 - RNA, 22 nt, Human
cccacgcgcgccaccccgugcg

SEQ ID NO: 126555 - RNA, 25 nt, Human
cccacgcgcgccaccccgugcguca

SEQ ID NO: 126556 - RNA, 26 nt, Human
cccacgcgcgccaccccgugcgucac

SEQ ID NO: 126557 - RNA, 22 nt, Human
ccccaggucuccuacuaaaccc

SEQ ID NO: 126558 - RNA, 23 nt, Human
ccccgucucuacuaaaaauacaa

SEQ ID NO: 126559 - RNA, 18 nt, Human
ccccuaaggacuugacuu

SEQ ID NO: 126560 - RNA, 22 nt, Human
ccugggcaacagagcgagacuc

SEQ ID NO: 126561 - RNA, 18 nt, Human
ccuguaaucccaacuacu

SEQ ID NO: 126562 - RNA, 19 nt, Human
ccuguaaucccaacuacuu

SEQ ID NO: 126563 - RNA, 22 nt, Human
ccuguaaucccaacuacuuggg

SEQ ID NO: 126564 - RNA, 20 nt, Human
ccuugccccaggucuccuac

SEQ ID NO: 126565 - RNA, 25 nt, Human
cgacggaacgagagaagcuggcaga

SEQ ID NO: 126566 - RNA, 23 nt, Human
cgagacuccaucucaaaaaaaaa

SEQ ID NO: 126567 - RNA, 19 nt, Human
cgagagaagcuggcagaug

SEQ ID NO: 126568 - RNA, 21 nt, Human
cgcaccacugcacuccagccu

SEQ ID NO: 126569 - RNA, 21 nt, Human
cgggaggcagaggaugcagug

SEQ ID NO: 126570 - RNA, 21 nt, Human
cuaaacccagccccaccccuc

SEQ ID NO: 126571 - RNA, 18 nt, Human
cuacuaaacccagcccca

SEQ ID NO: 126572 - RNA, 23 nt, Human
cuacuaaacccagccccaccccu

SEQ ID NO: 126573 - RNA, 18 nt, Human
cucaaaaaaaaaaaaaaa

SEQ ID NO: 126574 - RNA, 23 nt, Human
cucaaaaaaaaaaaaaaaaaaaa

SEQ ID NO: 126575 - RNA, 24 nt, Human
cucaugccuguaaucccagcacuu

SEQ ID NO: 126576 - RNA, 19 nt, Human
cuccaucucaaaaaaaaaa

SEQ ID NO: 126577 - RNA, 24 nt, Human
gaaacacugaaggccgaggucgcc

SEQ ID NO: 126578 - RNA, 18 nt, Human
gaacccgggaggcagagg

SEQ ID NO: 126579 - RNA, 23 nt, Human
gagaucgcaccacugcacuccag

SEQ ID NO: 126580 - RNA, 24 nt, Human
gaggaagcagggaaggccaggugc

SEQ ID NO: 126581 - RNA, 19 nt, Human
gaguaucaucauaccaaaa

SEQ ID NO: 126582 - RNA, 20 nt, Human
gcaccacugcacuccagccu

SEQ ID NO: 126583 - RNA, 24 nt, Human
gcacuccagccugggcaacagagc

SEQ ID NO: 126584 - RNA, 25 nt, Human
gccaacauagugaaacccccgucuc

SEQ ID NO: 126585 - RNA, 25 nt, Human
gccaauuaccuagauccccccucaa

SEQ ID NO: 126586 - RNA, 18 nt, Human
gccuguggcacaguggua

SEQ ID NO: 126587 - RNA, 22 nt, Human
gcgggauagggcaccugaggaa

SEQ ID NO: 126588 - RNA, 20 nt, Human
gcugagaucgcaccacugca

SEQ ID NO: 126589 - RNA, 23 nt, Human
ggaaggccaggugcgguggcuca

SEQ ID NO: 126590 - RNA, 19 nt, Human
gggaaggccaggugcggug

SEQ ID NO: 126591 - RNA, 23 nt, Human
gguggcucaugccuguaauccca

SEQ ID NO: 126592 - RNA, 24 nt, Human
gguggcucaugccuguaaucccag

SEQ ID NO: 126593 - RNA, 24 nt, Human
guuacaauuugagauaaguugauu

SEQ ID NO: 126594 - RNA, 20 nt, Human
uaaaaaaacaguaaacuaca

SEQ ID NO: 126595 - RNA, 22 nt, Human
uaaaaagaacuguaauauacau

SEQ ID NO: 126596 - RNA, 26 nt, Human
uaaaaagaacuguaauauacauaaag

SEQ ID NO: 126597 - RNA, 20 nt, Human
uaaacccagccccaccccuc

SEQ ID NO: 126598 - RNA, 26 nt, Human
uaaauaauaauaaacugugguuucca

SEQ ID NO: 126599 - RNA, 20 nt, Human
uaaguugauuccuaaacaga

SEQ ID NO: 126600 - RNA, 18 nt, Human
uaccuagauccccccuca

SEQ ID NO: 126601 - RNA, 20 nt, Human
uaccuagauccccccucaac

SEQ ID NO: 126602 - RNA, 19 nt, Human
uaguaauuagaucaagaua

SEQ ID NO: 126603 - RNA, 18 nt, Human
uaucaaauaugguccugg

SEQ ID NO: 126604 - RNA, 23 nt, Human
ucaaaaaaaaaaaaaaaaaaaaa

SEQ ID NO: 126605 - RNA, 21 nt, Human
ucacugaucucacauuuuaaa

SEQ ID NO: 126606 - RNA, 22 nt, Human
ucaugccuguaaucccagcacu

SEQ ID NO: 126607 - RNA, 28 nt, Human
uccaaaggauuucuuuuuccuauaauau

SEQ ID NO: 126608 - RNA, 25 nt, Human
uccaagauuugaauacccugaacuu

SEQ ID NO: 126609 - RNA, 23 nt, Human
uccagccugggcaacagagcgag

SEQ ID NO: 126610 - RNA, 24 nt, Human
uccagccugggcaacagagcgaga

SEQ ID NO: 126611 - RNA, 23 nt, Human
uccaucucaaaaaaaaaaaaaaa

SEQ ID NO: 126612 - RNA, 23 nt, Human
uccuacuaaacccagccccaccc

SEQ ID NO: 126613 - RNA, 21 nt, Human
uccucacacacacaauaauug

SEQ ID NO: 126614 - RNA, 23 nt, Human
ucgcaccacugcacuccagccug

SEQ ID NO: 126615 - RNA, 22 nt, Human
ucucuacuaaaaauacaaaaaa

SEQ ID NO: 126616 - RNA, 20 nt, Human
ugaaaacagacgauguggua

SEQ ID NO: 126617 - RNA, 23 nt, Human
ugaaggccgaggucgccaccgcu

SEQ ID NO: 126618 - RNA, 19 nt, Human
ugagcccaaaacaaaauua

SEQ ID NO: 126619 - RNA, 22 nt, Human
ugagcugagaucgcaccacugc

SEQ ID NO: 126620 - RNA, 23 nt, Human
ugaggcagagaauugcuugaacc

SEQ ID NO: 126621 - RNA, 23 nt, Human
ugaggcagagaauugcuugaacc

SEQ ID NO: 126622 - RNA, 24 nt, Human
ugaggcagagaauugcuugaaccc

SEQ ID NO: 126623 - RNA, 22 nt, Human
ugccccaggucuccuacuaaac

SEQ ID NO: 126624 - RNA, 24 nt, Human
ugccuguaaucccaacuacuuggg

SEQ ID NO: 126625 - RNA, 23 nt, Human
ugccuguaaucccagcacuuugg

SEQ ID NO: 126626 - RNA, 23 nt, Human
ugccuguaaucccagcacuuugg

SEQ ID NO: 126627 - RNA, 24 nt, Human
ugccuguaaucccagcacuuuggg

SEQ ID NO: 126628 - RNA, 24 nt, Human
uggcucaugccuguaaucccagca

SEQ ID NO: 126629 - RNA, 22 nt, Human
ugggaggccaaggcggguggac

SEQ ID NO: 126630 - RNA, 19 nt, Human
ugggaggcugaggcagaga

SEQ ID NO: 126631 - RNA, 21 nt, Human
ugggaggcugaggcagagaau

SEQ ID NO: 126632 - RNA, 24 nt, Human
ugguggcaggugccuguaauccca

SEQ ID NO: 126633 - RNA, 20 nt, Human
ugugguauuuuuucagccau

SEQ ID NO: 126634 - RNA, 18 nt, Human
uugcuugaacccgggagg

SEQ ID NO: 126635 - RNA, 24 nt, Human
uugcuugaacccgggaggcagagg

SEQ ID NO: 126636 - RNA, 19 nt, Human
uugggaggcugaggcagag

SEQ ID NO: 126637 - RNA, 22 nt, Human
uugggaggcugaggcagagaau

SEQ ID NO: 126638 - RNA, 23 nt, Human
aaauaaugcaguuucacuagaac

SEQ ID NO: 126639 - RNA, 19 nt, Human
aacaaauuauugugcuccu

SEQ ID NO: 126640 - RNA, 20 nt, Human
aagaaccccaccaucuaguc

SEQ ID NO: 126641 - RNA, 25 nt, Human
aagcaaaaagguaaauauaauuuaa

SEQ ID NO: 126642 - RNA, 19 nt, Human
aauaucaucuaguguccuc

SEQ ID NO: 126643 - RNA, 20 nt, Human
acacuccacauguuucauaa

SEQ ID NO: 126644 - RNA, 22 nt, Human
acauagagcugauaacucauac

SEQ ID NO: 126645 - RNA, 19 nt, Human
acuacaggugccugcuacc

SEQ ID NO: 126646 - RNA, 20 nt, Human
acuguguggugaggguguuc

SEQ ID NO: 126647 - RNA, 22 nt, Human
agacuacaggugccugcuacca

SEQ ID NO: 126648 - RNA, 18 nt, Human
agcuguccaggcuggucu

SEQ ID NO: 126649 - RNA, 22 nt, Human
aggaaaaaacaaucugccaauu

SEQ ID NO: 126650 - RNA, 18 nt, Human
aguagcuaagacuacagg

SEQ ID NO: 126651 - RNA, 20 nt, Human
aucaauugacauagagcuga

SEQ ID NO: 126652 - RNA, 19 nt, Human
auugugcuccuagaaacua

SEQ ID NO: 126653 - RNA, 23 nt, Human
auuuuggauauagaagaaguuga

SEQ ID NO: 126654 - RNA, 23 nt, Human
caaagcuuccaaauggcuauuuc

SEQ ID NO: 126655 - RNA, 23 nt, Human
caagucauuuagcgauaaaaagc

SEQ ID NO: 126656 - RNA, 20 nt, Human
cacuuaauacacuccacaug

SEQ ID NO: 126657 - RNA, 24 nt, Human
caggugccugcuaccacaccuggc

SEQ ID NO: 126658 - RNA, 20 nt, Human
ccugggcucaagccauccuc

SEQ ID NO: 126659 - RNA, 24 nt, Human
cgggaucucacuaagcuguccagg

SEQ ID NO: 126660 - RNA, 21 nt, Human
cuaccacaccuggcuguaaug

SEQ ID NO: 126661 - RNA, 23 nt, Human
cuccugggcucaagccauccucc

SEQ ID NO: 126662 - RNA, 19 nt, Human
cuggucuugaacuccuggg

SEQ ID NO: 126663 - RNA, 19 nt, Human
cuguccaggcuggucuuga

SEQ ID NO: 126664 - RNA, 23 nt, Human
cuucuuuggccucucgaguagcu

SEQ ID NO: 126665 - RNA, 23 nt, Human
gaaaaaacaaucugccaauuaga

SEQ ID NO: 126666 - RNA, 18 nt, Human
gaaaucaagauaaucaug

SEQ ID NO: 126667 - RNA, 19 nt, Human
gacuguguggugagggugu

SEQ ID NO: 126668 - RNA, 21 nt, Human
gagcugauaacucauaccuua

SEQ ID NO: 126669 - RNA, 21 nt, Human
gaggaagaaaaucucugauua

SEQ ID NO: 126670 - RNA, 23 nt, Human
gaggguguucugcaguccuguaa

SEQ ID NO: 126671 - RNA, 23 nt, Human
gcaacaauaaguuaaaacaugaa

SEQ ID NO: 126672 - RNA, 18 nt, Human
gccucucgaguagcuaag

SEQ ID NO: 126673 - RNA, 20 nt, Human
gcugcacuuaauacacucca

SEQ ID NO: 126674 - RNA, 18 nt, Human
ggcuggucuugaacuccu

SEQ ID NO: 126675 - RNA, 21 nt, Human
uaaaacauacaucauaaaagc

SEQ ID NO: 126676 - RNA, 24 nt, Human
uaaaagacauaacuaaucauaauc

SEQ ID NO: 126677 - RNA, 21 nt, Human
uaaaauaagcaaaaagguaaa

SEQ ID NO: 126678 - RNA, 24 nt, Human
uaagacuacaggugccugcuacca

SEQ ID NO: 126679 - RNA, 24 nt, Human
uaaucucugagaaaacucuucuca

SEQ ID NO: 126680 - RNA, 21 nt, Human
uacacaggcauuuaaacacuc

SEQ ID NO: 126681 - RNA, 22 nt, Human
uacaggugccugcuaccacacc

SEQ ID NO: 126682 - RNA, 24 nt, Human
uagaauacauaucuuuucuucgga

SEQ ID NO: 126683 - RNA, 22 nt, Human
uagucaacaaauaaugcaguuu

SEQ ID NO: 126684 - RNA, 19 nt, Human
ucaagccauccuccuucuu

SEQ ID NO: 126685 - RNA, 18 nt, Human
uccugggcucaagccauc

SEQ ID NO: 126686 - RNA, 23 nt, Human
ucuaguguccucuuauuccagcc

SEQ ID NO: 126687 - RNA, 22 nt, Human
ucucacuaagcuguccaggcug

SEQ ID NO: 126688 - RNA, 23 nt, Human
ucucacuaagcuguccaggcugg

SEQ ID NO: 126689 - RNA, 23 nt, Human
ucucgaguagcuaagacuacagg

SEQ ID NO: 126690 - RNA, 19 nt, Human
ucuugaacuccugggcuca

SEQ ID NO: 126691 - RNA, 23 nt, Human
ucuugaacuccugggcucaagcc

SEQ ID NO: 126692 - RNA, 20 nt, Human
ugacauagagcugauaacuc

SEQ ID NO: 126693 - RNA, 24 nt, Human
uguccaggcuggucuugaacuccu

SEQ ID NO: 126694 - RNA, 23 nt, Human
uuaaaagacauaacuaaucauaa

SEQ ID NO: 126695 - RNA, 18 nt, Human
uuaguguuuuugggaaau

SEQ ID NO: 126696 - RNA, 18 nt, Human
uuuaaaacauacaucaua

SEQ ID NO: 126697 - RNA, 23 nt, Human
aaaaacaacaacaacccuguuuu

SEQ ID NO: 126698 - RNA, 22 nt, Human
aaucacaacaaggagaaacuaa

SEQ ID NO: 126699 - RNA, 23 nt, Human
acaaaaguucguggacugccccc

SEQ ID NO: 126700 - RNA, 24 nt, Human
acaaggagaaacuaaaaaaacaac

SEQ ID NO: 126701 - RNA, 22 nt, Human
acuaaaaaaacaacaacaaccc

SEQ ID NO: 126702 - RNA, 23 nt, Human
acuuugcagaaauuaaaaagaaa

SEQ ID NO: 126703 - RNA, 23 nt, Human
agaaauuagcgcuuuuuaaacaa

SEQ ID NO: 126704 - RNA, 18 nt, Human
agacaggaaugucaccgu

SEQ ID NO: 126705 - RNA, 27 nt, Human
aggagaaacuaaaaaaacaacaacaac

SEQ ID NO: 126706 - RNA, 21 nt, Human
caauuuccuucuucugugaga

SEQ ID NO: 126707 - RNA, 24 nt, Human
cacaacaaggagaaacuaaaaaaa

SEQ ID NO: 126708 - RNA, 21 nt, Human
cagcccggggucugccugcga

SEQ ID NO: 126709 - RNA, 21 nt, Human
caggaaugucaccguggucuc

SEQ ID NO: 126710 - RNA, 22 nt, Human
ccgcggugggcagcccgggguc

SEQ ID NO: 126711 - RNA, 24 nt, Human
ccuacccuuaaguugauuuugaug

SEQ ID NO: 126712 - RNA, 23 nt, Human
ccugcccgcagcgcagacaggaa

SEQ ID NO: 126713 - RNA, 24 nt, Human
ccugcccgcagcgcagacaggaau

SEQ ID NO: 126714 - RNA, 22 nt, Human
cggggucugccugcgaacagcg

SEQ ID NO: 126715 - RNA, 22 nt, Human
cggucggcgacucugcagccug

SEQ ID NO: 126716 - RNA, 24 nt, Human
gagugauuuaaauuccacagugcc

SEQ ID NO: 126717 - RNA, 18 nt, Human
gauuuauuuucuuuccuu

SEQ ID NO: 126718 - RNA, 19 nt, Human
gcgcuaggccgcggugggc

SEQ ID NO: 126719 - RNA, 19 nt, Human
gguauuauuaauauaugcu

SEQ ID NO: 126720 - RNA, 20 nt, Human
gucggcgacucugcagccug

SEQ ID NO: 126721 - RNA, 24 nt, Human
uaaaaaaacaacaacaacccuguu

SEQ ID NO: 126722 - RNA, 25 nt, Human
uaacucauggaaauucaauuuccuu

SEQ ID NO: 126723 - RNA, 20 nt, Human
ucaauuuccuucuucuguga

SEQ ID NO: 126724 - RNA, 20 nt, Human
ucaccguggucucccaggcu

SEQ ID NO: 126725 - RNA, 24 nt, Human
ucucucggcggcgcccccuagucc

SEQ ID NO: 126726 - RNA, 25 nt, Human
ucugcagccugcggcggcuucucuc

SEQ ID NO: 126727 - RNA, 22 nt, Human
ucugugagaauuuggaauuugu

SEQ ID NO: 126728 - RNA, 23 nt, Human
uucaauuuccuucuucugugaga

SEQ ID NO: 126729 - RNA, 24 nt, Human
aaaaaaaagguaucauuucucuag

SEQ ID NO: 126730 - RNA, 21 nt, Human
aaaacaaacaaacaaaaccaa

SEQ ID NO: 126731 - RNA, 23 nt, Human
aaaacuauuacguuaaaauuuuu

SEQ ID NO: 126732 - RNA, 23 nt, Human
aaacaaacaaaaccaaaaaaccc

SEQ ID NO: 126733 - RNA, 24 nt, Human
aaacaaacaaaaccaaaaaacccc

SEQ ID NO: 126734 - RNA, 22 nt, Human
aaacaaacaaacaaaaccaaaa

SEQ ID NO: 126735 - RNA, 21 nt, Human
aaacaucagguaugugaaggc

SEQ ID NO: 126736 - RNA, 24 nt, Human
aacaaaaccaaaaaaccccacuac

SEQ ID NO: 126737 - RNA, 23 nt, Human
aacaaacaaaaccaaaaaacccc

SEQ ID NO: 126738 - RNA, 24 nt, Human
aacagagugagacucugucucaaa

SEQ ID NO: 126739 - RNA, 24 nt, Human
aaccaaguugcccacagauacucc

SEQ ID NO: 126740 - RNA, 21 nt, Human
aaccgugacaaaauuuaaaca

SEQ ID NO: 126741 - RNA, 18 nt, Human
aagagaaacgcagagauc

SEQ ID NO: 126742 - RNA, 24 nt, Human
aaggcaggcaucaucucccaaacc

SEQ ID NO: 126743 - RNA, 22 nt, Human
aaggcuuccaggaaggaguagc

SEQ ID NO: 126744 - RNA, 18 nt, Human
aauuacuugaacccggga

SEQ ID NO: 126745 - RNA, 24 nt, Human
aauugcuuaaacccaggaggcaga

SEQ ID NO: 126746 - RNA, 24 nt, Human
acaaacaaaaccaaaaaaccccac

SEQ ID NO: 126747 - RNA, 21 nt, Human
acacgcacacuguucccuggg

SEQ ID NO: 126748 - RNA, 23 nt, Human
acagagcaagacucugucucaaa

SEQ ID NO: 126749 - RNA, 24 nt, Human
acagagcaagacucugucucaaaa

SEQ ID NO: 126750 - RNA, 21 nt, Human
acagagugagacucugucuca

SEQ ID NO: 126751 - RNA, 24 nt, Human
acagagugagacucugucucaaaa

SEQ ID NO: 126752 - RNA, 22 nt, Human
accaagacacagaaagcaacga

SEQ ID NO: 126753 - RNA, 24 nt, Human
acgccgucucuacuaaaaauacag

SEQ ID NO: 126754 - RNA, 19 nt, Human
acuaaaaauacagaaacua

SEQ ID NO: 126755 - RNA, 23 nt, Human
acuaaaaauacagaaacuagccg

SEQ ID NO: 126756 - RNA, 24 nt, Human
acucugucucaaaacaaacaaacc

SEQ ID NO: 126757 - RNA, 20 nt, Human
acugauaggacgggggccug

SEQ ID NO: 126758 - RNA, 18 nt, Human
acugcacugcagccuggg

SEQ ID NO: 126759 - RNA, 24 nt, Human
acugcacugcagccugggcaacag

SEQ ID NO: 126760 - RNA, 24 nt, Human
acugcacugcagccugggcaacag

SEQ ID NO: 126761 - RNA, 24 nt, Human
acugcagccugggcaacagaguga

SEQ ID NO: 126762 - RNA, 20 nt, Human
acuugaacccgggaggcaga

SEQ ID NO: 126763 - RNA, 20 nt, Human
acuuggcugacuggucacgu

SEQ ID NO: 126764 - RNA, 18 nt, Human
agaaaccaagacacagaa

SEQ ID NO: 126765 - RNA, 22 nt, Human
agaagaaagcucugaguucagc

SEQ ID NO: 126766 - RNA, 18 nt, Human
agacaggaugaaaaaggg

SEQ ID NO: 126767 - RNA, 18 nt, Human
agagcaagacucugucuc

SEQ ID NO: 126768 - RNA, 19 nt, Human
agagcuuugggaggccuug

SEQ ID NO: 126769 - RNA, 25 nt, Human
agagggagggguggccagugggguc

SEQ ID NO: 126770 - RNA, 24 nt, Human
agagguagggggugccacaggacc

SEQ ID NO: 126771 - RNA, 18 nt, Human
agagguugcagugagcag

SEQ ID NO: 126772 - RNA, 23 nt, Human
agagguugcagugagcagagauc

SEQ ID NO: 126773 - RNA, 24 nt, Human
agagguugcagugagcagagaucg

SEQ ID NO: 126774 - RNA, 20 nt, Human
agagguuguagugagccaag

SEQ ID NO: 126775 - RNA, 23 nt, Human
agagguuguagugagccaagauc

SEQ ID NO: 126776 - RNA, 24 nt, Human
agagguuguagugagccaagauca

SEQ ID NO: 126777 - RNA, 18 nt, Human
agccgggugugguggugc

SEQ ID NO: 126778 - RNA, 18 nt, Human
agccgggugugguggugc

SEQ ID NO: 126779 - RNA, 24 nt, Human
agccucggcgacagagcaagacuc

SEQ ID NO: 126780 - RNA, 24 nt, Human
agccugggcaacagagugagacuc

SEQ ID NO: 126781 - RNA, 21 nt, Human
agcuuugggaggccuuggaaa

SEQ ID NO: 126782 - RNA, 26 nt, Human
aggaggagggagagugucucugggau

SEQ ID NO: 126783 - RNA, 22 nt, Human
aggagggaucuugaaugauucc

SEQ ID NO: 126784 - RNA, 20 nt, Human
aggcaagggggaccaacugu

SEQ ID NO: 126785 - RNA, 19 nt, Human
aggcagaaaccaagacaca

SEQ ID NO: 126786 - RNA, 23 nt, Human
aggcagaaaccaagacacagaaa

SEQ ID NO: 126787 - RNA, 18 nt, Human
aggcagaacagagguagg

SEQ ID NO: 126788 - RNA, 20 nt, Human
aggcagagguugcagugagc

SEQ ID NO: 126789 - RNA, 24 nt, Human
aggcagagguugcagugagcagag

SEQ ID NO: 126790 - RNA, 24 nt, Human
aggcagagguuguagugagccaag

SEQ ID NO: 126791 - RNA, 18 nt, Human
aggcaggagaauuacuug

SEQ ID NO: 126792 - RNA, 24 nt, Human
aggcaggagaauuacuugaacccg

SEQ ID NO: 126793 - RNA, 23 nt, Human
aggcaggagaauugcuuaaaccc

SEQ ID NO: 126794 - RNA, 24 nt, Human
aggcaggagaauugcuuaaaccca

SEQ ID NO: 126795 - RNA, 18 nt, Human
aggcagggguucagaugc

SEQ ID NO: 126796 - RNA, 20 nt, Human
aggcugaggcaggagaauug

SEQ ID NO: 126797 - RNA, 21 nt, Human
aggcugaggcaggagaauugc

SEQ ID NO: 126798 - RNA, 23 nt, Human
aggguugacagcacccugaggug

SEQ ID NO: 126799 - RNA, 23 nt, Human
aguggcucaugccuguaauccca

SEQ ID NO: 126800 - RNA, 24 nt, Human
aguggcucaugccuguaaucccag

SEQ ID NO: 126801 - RNA, 21 nt, Human
agugguucagggaagaggcag

SEQ ID NO: 126802 - RNA, 24 nt, Human
aucacaccacugcacugcagccug

SEQ ID NO: 126803 - RNA, 19 nt, Human
augccuguaaucccagaac

SEQ ID NO: 126804 - RNA, 18 nt, Human
augcuaugauacaaaugg

SEQ ID NO: 126805 - RNA, 23 nt, Human
caaaaaaccccacuacucaugua

SEQ ID NO: 126806 - RNA, 19 nt, Human
caaaacaaacaaacaaaac

SEQ ID NO: 126807 - RNA, 25 nt, Human
caaaaccaaaaaaccccacuacuca

SEQ ID NO: 126808 - RNA, 19 nt, Human
caagacacagaaagcaacg

SEQ ID NO: 126809 - RNA, 24 nt, Human
caaucagcagugcuuuuggcaaaa

SEQ ID NO: 126810 - RNA, 20 nt, Human
cacccugaggugggggagac

SEQ ID NO: 126811 - RNA, 18 nt, Human
caccuauaaucccagcua

SEQ ID NO: 126812 - RNA, 19 nt, Human
caccuauaaucccagcuac

SEQ ID NO: 126813 - RNA, 20 nt, Human
cacugcacugcagccugggc

SEQ ID NO: 126814 - RNA, 23 nt, Human
cacugcacugcagccugggcaac

SEQ ID NO: 126815 - RNA, 24 nt, Human
cacugcacugcagccugggcaaca

SEQ ID NO: 126816 - RNA, 23 nt, Human
cacugcagccucggcgacagagc

SEQ ID NO: 126817 - RNA, 23 nt, Human
cacugcagccugggcaacagagu

SEQ ID NO: 126818 - RNA, 24 nt, Human
cacugggaugggcaggaacagcaa

SEQ ID NO: 126819 - RNA, 24 nt, Human
cacuguucuagaaccugaauucca

SEQ ID NO: 126820 - RNA, 18 nt, Human
cagaacuuugggaggccg

SEQ ID NO: 126821 - RNA, 20 nt, Human
cagaacuuugggaggccgag

SEQ ID NO: 126822 - RNA, 21 nt, Human
cagagguagggggugccacag

SEQ ID NO: 126823 - RNA, 18 nt, Human
cagaugccaaguucugca

SEQ ID NO: 126824 - RNA, 22 nt, Human
cagcacccugaggugggggaga

SEQ ID NO: 126825 - RNA, 24 nt, Human
cagcaggcagaaaccaagacacag

SEQ ID NO: 126826 - RNA, 20 nt, Human
caugccuguaaucccagaac

SEQ ID NO: 126827 - RNA, 24 nt, Human
caugccuguaaucccagaacuuug

SEQ ID NO: 126828 - RNA, 19 nt, Human
ccaaaaaaccccacuacuc

SEQ ID NO: 126829 - RNA, 18 nt, Human
ccaaaccaaguugcccac

SEQ ID NO: 126830 - RNA, 20 nt, Human
ccacugcacugcagccuggg

SEQ ID NO: 126831 - RNA, 21 nt, Human
ccacugcacugcagccugggc

SEQ ID NO: 126832 - RNA, 22 nt, Human
ccacugcacugcagccugggca

SEQ ID NO: 126833 - RNA, 24 nt, Human
ccacugcacugcagccugggcaac

SEQ ID NO: 126834 - RNA, 25 nt, Human
ccacugcacugcagccugggcaaca

SEQ ID NO: 126835 - RNA, 22 nt, Human
ccaggaggcagagguugcagug

SEQ ID NO: 126836 - RNA, 25 nt, Human
ccagucucuguacucaggacuucuc

SEQ ID NO: 126837 - RNA, 19 nt, Human
cccacagauacucccccuu

SEQ ID NO: 126838 - RNA, 24 nt, Human
cccagcuacucagaagccugaggc

SEQ ID NO: 126839 - RNA, 18 nt, Human
cccugggugccagagagc

SEQ ID NO: 126840 - RNA, 21 nt, Human
ccuauaaucccagcuacucag

SEQ ID NO: 126841 - RNA, 22 nt, Human
ccucggcgacagagcaagacuc

SEQ ID NO: 126842 - RNA, 24 nt, Human
ccugacugggcacaguggcucaug

SEQ ID NO: 126843 - RNA, 22 nt, Human
ccugggcaacagagugagacuc

SEQ ID NO: 126844 - RNA, 22 nt, Human
ccuguaaucccagcuacugggg

SEQ ID NO: 126845 - RNA, 20 nt, Human
cgacacauaacagauaugcu

SEQ ID NO: 126846 - RNA, 19 nt, Human
cgcaccuauaaucccagcu

SEQ ID NO: 126847 - RNA, 21 nt, Human
cggccaaaauggugaaacgcc

SEQ ID NO: 126848 - RNA, 24 nt, Human
cgggaggcagagguuguagugagc

SEQ ID NO: 126849 - RNA, 24 nt, Human
cucaugccuguaaucccagaacuu

SEQ ID NO: 126850 - RNA, 18 nt, Human
cucugggagaugggguga

SEQ ID NO: 126851 - RNA, 19 nt, Human
cucugucucaaaaaaaaaa

SEQ ID NO: 126852 - RNA, 19 nt, Human
cugagcaccuggaccuugc

SEQ ID NO: 126853 - RNA, 20 nt, Human
cugagcaccuggaccuugcc

SEQ ID NO: 126854 - RNA, 20 nt, Human
gaaaugccaauauuuuggau

SEQ ID NO: 126855 - RNA, 22 nt, Human
gaagcuuccagcuauggucaca

SEQ ID NO: 126856 - RNA, 19 nt, Human
gaauaaaauaccaugcccc

SEQ ID NO: 126857 - RNA, 21 nt, Human
gaauuggaggucagaaaugaa

SEQ ID NO: 126858 - RNA, 19 nt, Human
gacaaaauuuaaacaucag

SEQ ID NO: 126859 - RNA, 23 nt, Human
gagaauuacuugaacccgggagg

SEQ ID NO: 126860 - RNA, 19 nt, Human
gaugacuaggcggggagag

SEQ ID NO: 126861 - RNA, 24 nt, Human
gcaacagagugagacucugucuca

SEQ ID NO: 126862 - RNA, 22 nt, Human
gcacugggaugggcaggaacag

SEQ ID NO: 126863 - RNA, 18 nt, Human
gcagagagagcagggaaa

SEQ ID NO: 126864 - RNA, 21 nt, Human
gcagcaaaauguuccccugga

SEQ ID NO: 126865 - RNA, 24 nt, Human
gcagccaccugccacacacggcaa

SEQ ID NO: 126866 - RNA, 22 nt, Human
gcaggagaauugcuuaaaccca

SEQ ID NO: 126867 - RNA, 23 nt, Human
gcaggcagaaaccaagacacaga

SEQ ID NO: 126868 - RNA, 24 nt, Human
gccaaaauggugaaacgccgucuc

SEQ ID NO: 126869 - RNA, 20 nt, Human
gccaagaucacaccacugca

SEQ ID NO: 126870 - RNA, 24 nt, Human
gccauguuacucgugucugggggg

SEQ ID NO: 126871 - RNA, 22 nt, Human
gcucagagagaagcuuccagcu

SEQ ID NO: 126872 - RNA, 19 nt, Human
gcugaaaaaacuaaagcaa

SEQ ID NO: 126873 - RNA, 19 nt, Human
gcugcacugcagccucggc

SEQ ID NO: 126874 - RNA, 22 nt, Human
ggaggcagagguugcagugagc

SEQ ID NO: 126875 - RNA, 22 nt, Human
ggaugggaugcgugaaauccag

SEQ ID NO: 126876 - RNA, 23 nt, Human
ggcaaggugguaggugccuguaa

SEQ ID NO: 126877 - RNA, 23 nt, Human
gggaauuggaggucagaaaugaa

SEQ ID NO: 126878 - RNA, 22 nt, Human
gggagagagcgaggacaggcag

SEQ ID NO: 126879 - RNA, 21 nt, Human
gggaggcugaggcaggagaau

SEQ ID NO: 126880 - RNA, 18 nt, Human
gggaugggcaggaacagc

SEQ ID NO: 126881 - RNA, 18 nt, Human
gggcacaguggcucaugc

SEQ ID NO: 126882 - RNA, 24 nt, Human
gggcacaguggcucaugccuguaa

SEQ ID NO: 126883 - RNA, 18 nt, Human
ggggggaaccagucucug

SEQ ID NO: 126884 - RNA, 21 nt, Human
gguaggugccuguaaucccag

SEQ ID NO: 126885 - RNA, 23 nt, Human
ggugccuguaaucccagcuacug

SEQ ID NO: 126886 - RNA, 23 nt, Human
ggugguaggugccuguaauccca

SEQ ID NO: 126887 - RNA, 24 nt, Human
ggugguaggugccuguaaucccag

SEQ ID NO: 126888 - RNA, 20 nt, Human
gucucaaaaaaaaaaaaaag

SEQ ID NO: 126889 - RNA, 22 nt, Human
gucugagcaccuggaccuugcc

SEQ ID NO: 126890 - RNA, 21 nt, Human
uaaaaauacagaaacuagccg

SEQ ID NO: 126891 - RNA, 18 nt, Human
uaaaauaccaugccccag

SEQ ID NO: 126892 - RNA, 22 nt, Human
uaaaauaccaugccccaguagg

SEQ ID NO: 126893 - RNA, 23 nt, Human
uaaaauaccaugccccaguaggc

SEQ ID NO: 126894 - RNA, 18 nt, Human
uaaaggucugagcaccug

SEQ ID NO: 126895 - RNA, 25 nt, Human
uaagcucucgacacgcacacuguuc

SEQ ID NO: 126896 - RNA, 21 nt, Human
uagcuggcacugggaugggca

SEQ ID NO: 126897 - RNA, 21 nt, Human
uaugauacaaauggugccgca

SEQ ID NO: 126898 - RNA, 20 nt, Human
ucaaaacaaacaaacaaaac

SEQ ID NO: 126899 - RNA, 23 nt, Human
ucacaccacugcacugcagccug

SEQ ID NO: 126900 - RNA, 24 nt, Human
ucagcaaugaucauggaaaccaag

SEQ ID NO: 126901 - RNA, 22 nt, Human
ucaugccuguaaucccagaacu

SEQ ID NO: 126902 - RNA, 25 nt, Human
ucaugcuuugcucugaccuuuucag

SEQ ID NO: 126903 - RNA, 18 nt, Human
ucauggaaaccaagggag

SEQ ID NO: 126904 - RNA, 21 nt, Human
ucccugggugccagagagcuu

SEQ ID NO: 126905 - RNA, 20 nt, Human
uccucuggacuuccugugag

SEQ ID NO: 126906 - RNA, 23 nt, Human
ucucuacuaaaaauacagaaacu

SEQ ID NO: 126907 - RNA, 19 nt, Human
ucucugggagaugggguga

SEQ ID NO: 126908 - RNA, 18 nt, Human
ucuggcagcaguguagaa

SEQ ID NO: 126909 - RNA, 20 nt, Human
ucuggccagguuugcagcug

SEQ ID NO: 126910 - RNA, 21 nt, Human
ucuggggauagaagaaagcuc

SEQ ID NO: 126911 - RNA, 22 nt, Human
ucugucucaaaaaaaaaaaaaa

SEQ ID NO: 126912 - RNA, 23 nt, Human
ucugucucaaaaaaaaaaaaaag

SEQ ID NO: 126913 - RNA, 18 nt, Human
ugaaaaaacuaaagcaag

SEQ ID NO: 126914 - RNA, 22 nt, Human
ugaaaugccaauauuuuggaua

SEQ ID NO: 126915 - RNA, 19 nt, Human
ugaaggugaaagaggagga

SEQ ID NO: 126916 - RNA, 21 nt, Human
ugacaaaauguaaacgucaag

SEQ ID NO: 126917 - RNA, 21 nt, Human
ugacaaaauuuaaacaucagg

SEQ ID NO: 126918 - RNA, 19 nt, Human
ugacagcacccugaggugg

SEQ ID NO: 126919 - RNA, 24 nt, Human
ugacugggcacaguggcucaugcc

SEQ ID NO: 126920 - RNA, 22 nt, Human
ugagcagagagagcagggaaau

SEQ ID NO: 126921 - RNA, 20 nt, Human
ugaggcaggagaauuacuug

SEQ ID NO: 126922 - RNA, 24 nt, Human
ugaggcaggagaauuacuugaacc

SEQ ID NO: 126923 - RNA, 25 nt, Human
ugaggcaggagaauuacuugaaccc

SEQ ID NO: 126924 - RNA, 24 nt, Human
ugaggcaggagaauugcuuaaacc

SEQ ID NO: 126925 - RNA, 25 nt, Human
ugaggcaggagaauugcuuaaaccc

SEQ ID NO: 126926 - RNA, 18 nt, Human
ugaggugggggagacaug

SEQ ID NO: 126927 - RNA, 21 nt, Human
ugaggugggggagacaugggc

SEQ ID NO: 126928 - RNA, 18 nt, Human
ugccacaggaccagaggg

SEQ ID NO: 126929 - RNA, 21 nt, Human
ugccauguuacucgugucugg

SEQ ID NO: 126930 - RNA, 23 nt, Human
ugccuguaaucccagaacuuugg

SEQ ID NO: 126931 - RNA, 24 nt, Human
ugccuguaaucccagaacuuuggg

SEQ ID NO: 126932 - RNA, 22 nt, Human
ugccuguaaucccagcuacugg

SEQ ID NO: 126933 - RNA, 23 nt, Human
ugccuguaaucccagcuacuggg

SEQ ID NO: 126934 - RNA, 24 nt, Human
ugcucugaccuuuucagacagcuc

SEQ ID NO: 126935 - RNA, 22 nt, Human
uggaaaguccaggauguaaagg

SEQ ID NO: 126936 - RNA, 22 nt, Human
uggaagcagcaaaauguucccc

SEQ ID NO: 126937 - RNA, 18 nt, Human
uggcacugggaugggcag

SEQ ID NO: 126938 - RNA, 20 nt, Human
uggccaagcugagucagagg

SEQ ID NO: 126939 - RNA, 18 nt, Human
uggccagguuugcagcug

SEQ ID NO: 126940 - RNA, 20 nt, Human
uggccagguuugcagcuggc

SEQ ID NO: 126941 - RNA, 21 nt, Human
uggcucaugccuguaauccca

SEQ ID NO: 126942 - RNA, 22 nt, Human
uggcucaugccuguaaucccag

SEQ ID NO: 126943 - RNA, 21 nt, Human
ugggaagaacugcaaaaguac

SEQ ID NO: 126944 - RNA, 21 nt, Human
ugggaggccgaggaggccggc

SEQ ID NO: 126945 - RNA, 21 nt, Human
ugggauaaguguugcugaaaa

SEQ ID NO: 126946 - RNA, 21 nt, Human
ugggcaacagagugagacucu

SEQ ID NO: 126947 - RNA, 21 nt, Human
ugggugccagagagcuuuggg

SEQ ID NO: 126948 - RNA, 22 nt, Human
uggugcgcaccuauaaucccag

SEQ ID NO: 126949 - RNA, 21 nt, Human
ugucucaaaacaaacaaacaa

SEQ ID NO: 126950 - RNA, 26 nt, Human
uguucuagaaccugaauuccauagga

SEQ ID NO: 126951 - RNA, 20 nt, Human
uguugcugaaaaaacuaaag

SEQ ID NO: 126952 - RNA, 24 nt, Human
uuacuugaacccgggaggcagagg

SEQ ID NO: 126953 - RNA, 24 nt, Human
uuagcugggcaaggugguaggugc

SEQ ID NO: 126954 - RNA, 20 nt, Human
uucagcaaugaucauggaaa

SEQ ID NO: 126955 - RNA, 20 nt, Human
uucccugggugccagagagc

SEQ ID NO: 126956 - RNA, 19 nt, Human
uugcagugagcagagaucg

SEQ ID NO: 126957 - RNA, 22 nt, Human
uugcagugagcagagaucgcac

SEQ ID NO: 126958 - RNA, 24 nt, Human
uuggaagcagcaaaauguuccccu

SEQ ID NO: 126959 - RNA, 20 nt, Human
uuguagugagccaagaucac

SEQ ID NO: 126960 - RNA, 22 nt, Human
uuuaauagugaucacguugaaa

SEQ ID NO: 126961 - RNA, 20 nt, Human
uuucuggccagaggauggga

SEQ ID NO: 126962 - RNA, 24 nt, Human
aaaaggaaaaaagccuagagaaaa

SEQ ID NO: 126963 - RNA, 22 nt, Human
aaacagaaaacagaaagucauc

SEQ ID NO: 126964 - RNA, 21 nt, Human
aaaggaaaaaagccuagagaa

SEQ ID NO: 126965 - RNA, 22 nt, Human
aaccccaaaaggaaaaaagccu

SEQ ID NO: 126966 - RNA, 21 nt, Human
aaugagcaaggcuuccuuucu

SEQ ID NO: 126967 - RNA, 23 nt, Human
acagacacucauggagugucccc

SEQ ID NO: 126968 - RNA, 22 nt, Human
accccaaaaggaaaaaagccua

SEQ ID NO: 126969 - RNA, 22 nt, Human
acuccacaagcuccaaaaugag

SEQ ID NO: 126970 - RNA, 21 nt, Human
agacacucauggagugucccc

SEQ ID NO: 126971 - RNA, 21 nt, Human
caacuccacaagcuccaaaau

SEQ ID NO: 126972 - RNA, 20 nt, Human
caaugagucccaucacccac

SEQ ID NO: 126973 - RNA, 26 nt, Human
caaugagucccaucacccacaccacc

SEQ ID NO: 126974 - RNA, 24 nt, Human
cagauagcugccucucacagacac

SEQ ID NO: 126975 - RNA, 24 nt, Human
ccaaaaggaaaaaagccuagagaa

SEQ ID NO: 126976 - RNA, 25 nt, Human
ccaaaaggaaaaaagccuagagaaa

SEQ ID NO: 126977 - RNA, 21 nt, Human
cccccgcccauuuucuccaug

SEQ ID NO: 126978 - RNA, 18 nt, Human
ccccucccuccccaaaag

SEQ ID NO: 126979 - RNA, 19 nt, Human
ccggggcgagcgcggcgac

SEQ ID NO: 126980 - RNA, 25 nt, Human
ccuagagaaaauaugcuuagcaaau

SEQ ID NO: 126981 - RNA, 23 nt, Human
ccucucacagacacucauggagu

SEQ ID NO: 126982 - RNA, 22 nt, Human
cuacaaugagucccaucacccc

SEQ ID NO: 126983 - RNA, 21 nt, Human
gagcgcggcgacgaagacgcc

SEQ ID NO: 126984 - RNA, 18 nt, Human
gagucccaucacccacac

SEQ ID NO: 126985 - RNA, 22 nt, Human
gagucccaucacccacaccacc

SEQ ID NO: 126986 - RNA, 19 nt, Human
gcaaaguauucuccaaucg

SEQ ID NO: 126987 - RNA, 18 nt, Human
gcgcaggaguagcccggg

SEQ ID NO: 126988 - RNA, 20 nt, Human
ggcgacgaagacgccaacaa

SEQ ID NO: 126989 - RNA, 18 nt, Human
gucccaucacccacacca

SEQ ID NO: 126990 - RNA, 20 nt, Human
uaauuuacaaacagaaaaca

SEQ ID NO: 126991 - RNA, 24 nt, Human
uacaaacagaaaacagaaagucaa

SEQ ID NO: 126992 - RNA, 24 nt, Human
uacauuuccccucccuccccaaaa

SEQ ID NO: 126993 - RNA, 19 nt, Human
uaccuuaaugcuccucaag

SEQ ID NO: 126994 - RNA, 21 nt, Human
uacgacuguagaaccccaaaa

SEQ ID NO: 126995 - RNA, 18 nt, Human
uagagugcagauagcugc

SEQ ID NO: 126996 - RNA, 24 nt, Human
uagagugcagauagcugccucuca

SEQ ID NO: 126997 - RNA, 20 nt, Human
uagcccggggcgagcgcggc

SEQ ID NO: 126998 - RNA, 19 nt, Human
uauuacauuuccccucccu

SEQ ID NO: 126999 - RNA, 23 nt, Human
ucacccacaccacccccgcccau

SEQ ID NO: 127000 - RNA, 22 nt, Human
ucacugaauauaaaauuaaaau

SEQ ID NO: 127001 - RNA, 20 nt, Human
uccaaaaugaagcaguaaca

SEQ ID NO: 127002 - RNA, 19 nt, Human
uccaugauucugauucuga

SEQ ID NO: 127003 - RNA, 21 nt, Human
ucuuuuacgacuguagaaccc

SEQ ID NO: 127004 - RNA, 20 nt, Human
ugauaaauaaaacauucagu

SEQ ID NO: 127005 - RNA, 22 nt, Human
ugauucugacacucuucucccu

SEQ ID NO: 127006 - RNA, 21 nt, Human
uggaaugcccucccauuuacu

SEQ ID NO: 127007 - RNA, 23 nt, Human
uggcaguuucgaaauaccuuaau

SEQ ID NO: 127008 - RNA, 25 nt, Human
uguagaaccccaaaaggaaaaaagc

SEQ ID NO: 127009 - RNA, 22 nt, Human
ugucuaggugugcccuggaaac

SEQ ID NO: 127010 - RNA, 22 nt, Human
aaaagagugacucaguguucca

SEQ ID NO: 127011 - RNA, 18 nt, Human
aaaauauacauucucuag

SEQ ID NO: 127012 - RNA, 19 nt, Human
accaaaguacaaaacagca

SEQ ID NO: 127013 - RNA, 23 nt, Human
accaaaguacaaaacagcaacug

SEQ ID NO: 127014 - RNA, 22 nt, Human
aggugguaaaaaucacuucacu

SEQ ID NO: 127015 - RNA, 20 nt, Human
aguuauuuucugcagauucc

SEQ ID NO: 127016 - RNA, 22 nt, Human
auggaaaaaaauauaaaaaaga

SEQ ID NO: 127017 - RNA, 21 nt, Human
auuuauuugugcuaaaugaau

SEQ ID NO: 127018 - RNA, 18 nt, Human
caaaacagcaacugcuga

SEQ ID NO: 127019 - RNA, 23 nt, Human
caaaacagcaacugcugaaaaac

SEQ ID NO: 127020 - RNA, 27 nt, Human
caaaacagcaacugcugaaaaacaaaa

SEQ ID NO: 127021 - RNA, 18 nt, Human
caaacacaggugguaaaa

SEQ ID NO: 127022 - RNA, 24 nt, Human
caacagauacacauucuugucaua

SEQ ID NO: 127023 - RNA, 22 nt, Human
cagcaacugcugaaaaacaaaa

SEQ ID NO: 127024 - RNA, 21 nt, Human
cagcagaaaucaaauaacaca

SEQ ID NO: 127025 - RNA, 23 nt, Human
cagcagaaaucaaauaacacauu

SEQ ID NO: 127026 - RNA, 23 nt, Human
cauucgaaggcaaaaaucggagg

SEQ ID NO: 127027 - RNA, 23 nt, Human
cgcauuguuuuuguuacaaucac

SEQ ID NO: 127028 - RNA, 20 nt, Human
ggaaaaaaauauaaaaaaga

SEQ ID NO: 127029 - RNA, 19 nt, Human
gggcugggaaaggaggagg

SEQ ID NO: 127030 - RNA, 21 nt, Human
guuacaaucacacugccuucu

SEQ ID NO: 127031 - RNA, 19 nt, Human
uaaaaaagagaaucacauc

SEQ ID NO: 127032 - RNA, 27 nt, Human
uaaaaaagagaaucacaucuuaauaua

SEQ ID NO: 127033 - RNA, 20 nt, Human
uaaaaaucacuucacuacca

SEQ ID NO: 127034 - RNA, 21 nt, Human
uaaauaucuacaaucgucaug

SEQ ID NO: 127035 - RNA, 20 nt, Human
uaacacaaugaaaauaaccu

SEQ ID NO: 127036 - RNA, 24 nt, Human
uaacauuaaggauaaaaaagagaa

SEQ ID NO: 127037 - RNA, 21 nt, Human
uaaccuguaaaaaauguaucu

SEQ ID NO: 127038 - RNA, 25 nt, Human
uaaguagauuaacauuaaggauaaa

SEQ ID NO: 127039 - RNA, 22 nt, Human
uacaaaacagcaacugcugaaa

SEQ ID NO: 127040 - RNA, 26 nt, Human
uacaaaacagcaacugcugaaaaaca

SEQ ID NO: 127041 - RNA, 21 nt, Human
uaccaaaguacaaaacagcaa

SEQ ID NO: 127042 - RNA, 22 nt, Human
uaccaaaguacaaaacagcaac

SEQ ID NO: 127043 - RNA, 18 nt, Human
ucaucuaacuuucuguuc

SEQ ID NO: 127044 - RNA, 23 nt, Human
ucuacaaucgucaugguuccuua

SEQ ID NO: 127045 - RNA, 18 nt, Human
ugaaaugaacagccauca

SEQ ID NO: 127046 - RNA, 21 nt, Human
uggaaaaaaauauaaaaaaga

SEQ ID NO: 127047 - RNA, 23 nt, Human
uguugcacguauuaagaaaagag

SEQ ID NO: 127048 - RNA, 21 nt, Human
uucuguucuacacugaaagcc

SEQ ID NO: 127049 - RNA, 23 nt, Human
uugcaccuuuaaaauauuuguuc

SEQ ID NO: 127050 - RNA, 25 nt, Human
uugcacguauuaagaaaagagugac

SEQ ID NO: 127051 - RNA, 20 nt, Human
uuucuguucuacacugaaag

SEQ ID NO: 127052 - RNA, 24 nt, Human
uuuucaguucucugauuauauccc

SEQ ID NO: 127053 - RNA, 24 nt, Human
aaacagcaccccucccccagccca

SEQ ID NO: 127054 - RNA, 20 nt, Human
aaacuagaaaauuuagauau

SEQ ID NO: 127055 - RNA, 20 nt, Human
aacagcaccccucccccagc

SEQ ID NO: 127056 - RNA, 18 nt, Human
aacugggaaguccccaca

SEQ ID NO: 127057 - RNA, 22 nt, Human
aacugggaaguccccacacaua

SEQ ID NO: 127058 - RNA, 20 nt, Human
aagcaaguacaaaucauagc

SEQ ID NO: 127059 - RNA, 23 nt, Human
aaguggcagcaugacccccacag

SEQ ID NO: 127060 - RNA, 19 nt, Human
aaucaugcauguuugcagu

SEQ ID NO: 127061 - RNA, 20 nt, Human
accgcagagaggaaucuaaa

SEQ ID NO: 127062 - RNA, 24 nt, Human
agagaaacagucaugggacucaag

SEQ ID NO: 127063 - RNA, 19 nt, Human
agcaccccucccccagccc

SEQ ID NO: 127064 - RNA, 22 nt, Human
aggaagaaagagaggaagagaa

SEQ ID NO: 127065 - RNA, 23 nt, Human
agggaagaucuugauucuugugg

SEQ ID NO: 127066 - RNA, 20 nt, Human
caaaauacaauagugggaca

SEQ ID NO: 127067 - RNA, 21 nt, Human
caaauggcaacuuacagccaa

SEQ ID NO: 127068 - RNA, 25 nt, Human
cagcaaacucuuucuucccaaguuc

SEQ ID NO: 127069 - RNA, 18 nt, Human
caugacccccacaggcag

SEQ ID NO: 127070 - RNA, 24 nt, Human
caugcugugucucucugcuguggu

SEQ ID NO: 127071 - RNA, 19 nt, Human
ccacaggcagggaaggcac

SEQ ID NO: 127072 - RNA, 18 nt, Human
cccacuggggcagcacca

SEQ ID NO: 127073 - RNA, 24 nt, Human
cccacuggggcagcaccaccuccc

SEQ ID NO: 127074 - RNA, 23 nt, Human
cccccagcccauccacucugggc

SEQ ID NO: 127075 - RNA, 24 nt, Human
ccuuuaggaucucucuucuuuugu

SEQ ID NO: 127076 - RNA, 21 nt, Human
cucagagagggaagaucuuga

SEQ ID NO: 127077 - RNA, 19 nt, Human
cucccccagcccauccacu

SEQ ID NO: 127078 - RNA, 22 nt, Human
cugaauugccuuuaggaucucu

SEQ ID NO: 127079 - RNA, 18 nt, Human
cuggccuucucuuccuuc

SEQ ID NO: 127080 - RNA, 23 nt, Human
cugugucucucugcuguggcccu

SEQ ID NO: 127081 - RNA, 22 nt, Human
gaagaaagagaggaagagaaac

SEQ ID NO: 127082 - RNA, 18 nt, Human
gauuccugcucagagagg

SEQ ID NO: 127083 - RNA, 22 nt, Human
gcaaaggaaacguccuaagauc

SEQ ID NO: 127084 - RNA, 21 nt, Human
gcagcaccaccucccugaccc

SEQ ID NO: 127085 - RNA, 22 nt, Human
gccagcaaacucuuucuuccca

SEQ ID NO: 127086 - RNA, 21 nt, Human
gcccacuggggcagcaccacc

SEQ ID NO: 127087 - RNA, 20 nt, Human
gcccaugcugugucucucug

SEQ ID NO: 127088 - RNA, 20 nt, Human
ggaagaucuugauucuugug

SEQ ID NO: 127089 - RNA, 23 nt, Human
gggcagcaccaccucccugaccc

SEQ ID NO: 127090 - RNA, 23 nt, Human
gggcagcaccaccucccugacug

SEQ ID NO: 127091 - RNA, 23 nt, Human
gugaaccugugaaaccaaacaag

SEQ ID NO: 127092 - RNA, 22 nt, Human
uaaaagccuucuauaaaacuag

SEQ ID NO: 127093 - RNA, 23 nt, Human
uaaucauggcccacuggggcagc

SEQ ID NO: 127094 - RNA, 26 nt, Human
uacaaaucauagcaaaggaaacgucc

SEQ ID NO: 127095 - RNA, 24 nt, Human
uagaaagcagaucagaguucuucg

SEQ ID NO: 127096 - RNA, 21 nt, Human
uauguccucaguuccugaucu

SEQ ID NO: 127097 - RNA, 19 nt, Human
ucaagcaaguacaaaucau

SEQ ID NO: 127098 - RNA, 21 nt, Human
ucagagagggaagaucuugau

SEQ ID NO: 127099 - RNA, 21 nt, Human
ucagaguucuucgaagcacag

SEQ ID NO: 127100 - RNA, 21 nt, Human
ucauuuuguccuguuuuuguu

SEQ ID NO: 127101 - RNA, 19 nt, Human
uccaaaaggaagaaagaga

SEQ ID NO: 127102 - RNA, 22 nt, Human
uccaaaaggaagaaagagagga

SEQ ID NO: 127103 - RNA, 19 nt, Human
ucccccagcccauccacuc

SEQ ID NO: 127104 - RNA, 22 nt, Human
ucccccagcccauccacucugg

SEQ ID NO: 127105 - RNA, 22 nt, Human
uccucaguuccugaucuauuuc

SEQ ID NO: 127106 - RNA, 19 nt, Human
ucgaagcacaggccagcaa

SEQ ID NO: 127107 - RNA, 21 nt, Human
ucugcuguggcccugcccaug

SEQ ID NO: 127108 - RNA, 20 nt, Human
ucuuucuucccaaguucuuc

SEQ ID NO: 127109 - RNA, 25 nt, Human
ugacccccacaggcagggaaggcac

SEQ ID NO: 127110 - RNA, 25 nt, Human
ugaggcaauuuccuguggagggugg

SEQ ID NO: 127111 - RNA, 24 nt, Human
ugaucugcuggccuucucuuccuu

SEQ ID NO: 127112 - RNA, 21 nt, Human
ugcccaugaggcaauuuccug

SEQ ID NO: 127113 - RNA, 26 nt, Human
ugucuuggagaaucaugcauguuugc

SEQ ID NO: 127114 - RNA, 18 nt, Human
uuaaaacagcaccccucc

SEQ ID NO: 127115 - RNA, 21 nt, Human
uuaaaacagcaccccuccccc

SEQ ID NO: 127116 - RNA, 18 nt, Human
uucgaagcacaggccagc

SEQ ID NO: 127117 - RNA, 18 nt, Human
uuuuuuuuuuuuuuuuug

SEQ ID NO: 127118 - RNA, 21 nt, Human
uuuuuuuuuuuuuuuuugcau

SEQ ID NO: 127119 - RNA, 24 nt, Human
uuuuuuuuuuuuuuuuuugcauga

SEQ ID NO: 127120 - RNA, 23 nt, Human
aaaaaggaaaagaaugcaacuga

SEQ ID NO: 127121 - RNA, 24 nt, Human
aaaaccgcccucccccacaucccc

SEQ ID NO: 127122 - RNA, 21 nt, Human
aaaagaaaccggguccuagaa

SEQ ID NO: 127123 - RNA, 19 nt, Human
aaccgcccucccccacauc

SEQ ID NO: 127124 - RNA, 19 nt, Human
aagaaaacaaagacuacua

SEQ ID NO: 127125 - RNA, 22 nt, Human
aagaaaugguuugccuauacaa

SEQ ID NO: 127126 - RNA, 19 nt, Human
aagcugcagugaucuaagc

SEQ ID NO: 127127 - RNA, 23 nt, Human
aaugaucuaccaagcuaauaaag

SEQ ID NO: 127128 - RNA, 21 nt, Human
aauucugcaccauacuuacua

SEQ ID NO: 127129 - RNA, 25 nt, Human
acaggacacaguaaccaggcggcua

SEQ ID NO: 127130 - RNA, 21 nt, Human
accgcccucccccacaucccc

SEQ ID NO: 127131 - RNA, 18 nt, Human
aggaagaaaaaggaaaag

SEQ ID NO: 127132 - RNA, 21 nt, Human
aggaagaaaaaggaaaagaau

SEQ ID NO: 127133 - RNA, 25 nt, Human
aggaagaaaaaggaaaagaaugcaa

SEQ ID NO: 127134 - RNA, 23 nt, Human
aguugcuaguauuaaaaaaaaga

SEQ ID NO: 127135 - RNA, 20 nt, Human
auuugcaugaaauucugcac

SEQ ID NO: 127136 - RNA, 18 nt, Human
caaaaccucaaacgacaa

SEQ ID NO: 127137 - RNA, 24 nt, Human
caacccacgaaaaaaaaccuacuc

SEQ ID NO: 127138 - RNA, 18 nt, Human
caacuuuaagaaaugguu

SEQ ID NO: 127139 - RNA, 23 nt, Human
caagaagagggccaagaaaucag

SEQ ID NO: 127140 - RNA, 20 nt, Human
caagcuaauaaagaauacaa

SEQ ID NO: 127141 - RNA, 21 nt, Human
cacaguacagcacugaagaaa

SEQ ID NO: 127142 - RNA, 23 nt, Human
cacaguacagcacugaagaaaac

SEQ ID NO: 127143 - RNA, 23 nt, Human
cagauuccccccaacuugaucau

SEQ ID NO: 127144 - RNA, 18 nt, Human
cagcgcccccucuccagc

SEQ ID NO: 127145 - RNA, 21 nt, Human
caggacacaguaaccaggcgg

SEQ ID NO: 127146 - RNA, 19 nt, Human
cauccccugagcugacccu

SEQ ID NO: 127147 - RNA, 19 nt, Human
cccaacccacgaaaaaaaa

SEQ ID NO: 127148 - RNA, 21 nt, Human
cccacgaaaaaaaaccuacuc

SEQ ID NO: 127149 - RNA, 25 nt, Human
cccacgaaaaaaaaccuacucugga

SEQ ID NO: 127150 - RNA, 22 nt, Human
cccccaacccacgaaaaaaaac

SEQ ID NO: 127151 - RNA, 21 nt, Human
ccccccaacccacgaaaaaaa

SEQ ID NO: 127152 - RNA, 26 nt, Human
ccccccaacccacgaaaaaaaaccua

SEQ ID NO: 127153 - RNA, 21 nt, Human
ccucauuugcaugaaauucug

SEQ ID NO: 127154 - RNA, 21 nt, Human
ccucccccacauccccugagc

SEQ ID NO: 127155 - RNA, 19 nt, Human
cgcccucccccacaucccc

SEQ ID NO: 127156 - RNA, 20 nt, Human
cuccuaaaauugauacuaua

SEQ ID NO: 127157 - RNA, 20 nt, Human
cugaagaaaacaaagacuac

SEQ ID NO: 127158 - RNA, 25 nt, Human
cugauucuucuuuuucagcacacgu

SEQ ID NO: 127159 - RNA, 22 nt, Human
gaaaaaaaaccuacucuggaag

SEQ ID NO: 127160 - RNA, 18 nt, Human
gaagaaaaaggaaaagaa

SEQ ID NO: 127161 - RNA, 23 nt, Human
gccauuaacagaaaacuggagaa

SEQ ID NO: 127162 - RNA, 19 nt, Human
gcccccucuccagcgccgc

SEQ ID NO: 127163 - RNA, 19 nt, Human
gcucagcgcccccucucca

SEQ ID NO: 127164 - RNA, 19 nt, Human
gguccuagaagcugcagug

SEQ ID NO: 127165 - RNA, 19 nt, Human
guuuguuccuugccugauc

SEQ ID NO: 127166 - RNA, 24 nt, Human
uaaaaaaaaacaagauucauuuca

SEQ ID NO: 127167 - RNA, 22 nt, Human
uaaggcagaacaucuugccaga

SEQ ID NO: 127168 - RNA, 18 nt, Human
uaauuguaguaaaguuac

SEQ ID NO: 127169 - RNA, 26 nt, Human
uacagcacugaagaaaacaaagacua

SEQ ID NO: 127170 - RNA, 21 nt, Human
uaccaguugcguuaaaugcac

SEQ ID NO: 127171 - RNA, 24 nt, Human
ucaaacgacaagggggaagauaaa

SEQ ID NO: 127172 - RNA, 25 nt, Human
ucaggcacaacuuuuuuauuuuuuu

SEQ ID NO: 127173 - RNA, 25 nt, Human
ucaguaguauuugcugauucuucuu

SEQ ID NO: 127174 - RNA, 19 nt, Human
ucauacccaacagcucagc

SEQ ID NO: 127175 - RNA, 18 nt, Human
ucauagggccaacaagau

SEQ ID NO: 127176 - RNA, 24 nt, Human
ucucaaaaaucaguaaaacuuuau

SEQ ID NO: 127177 - RNA, 23 nt, Human
ucuuucaaagcuguugaguaggc

SEQ ID NO: 127178 - RNA, 19 nt, Human
ugaaaagugcagaauuuca

SEQ ID NO: 127179 - RNA, 25 nt, Human
ugaacagaagcuacaccaaccccgg

SEQ ID NO: 127180 - RNA, 19 nt, Human
ugaacaggaagaaaaagga

SEQ ID NO: 127181 - RNA, 19 nt, Human
ugaacuugaagcagcaguu

SEQ ID NO: 127182 - RNA, 23 nt, Human
ugaacuugaagcagcaguuucaa

SEQ ID NO: 127183 - RNA, 19 nt, Human
ugacaagauuauaaaugag

SEQ ID NO: 127184 - RNA, 21 nt, Human
ugcaacugagugcuaaggcag

SEQ ID NO: 127185 - RNA, 20 nt, Human
uggugugcuuuguggaugug

SEQ ID NO: 127186 - RNA, 20 nt, Human
uuaaaaaaaagagcgagaga

SEQ ID NO: 127187 - RNA, 21 nt, Human
uuauuuaaaaugguuuucuua

SEQ ID NO: 127188 - RNA, 19 nt, Human
uucaaaggaugaaaguugc

SEQ ID NO: 127189 - RNA, 20 nt, Human
uucaaaggaugaaaguugcu

SEQ ID NO: 127190 - RNA, 19 nt, Human
uucugcaccauacuuacua

SEQ ID NO: 127191 - RNA, 22 nt, Human
uugcaugaaauucugcaccaua

SEQ ID NO: 127192 - RNA, 20 nt, Human
uugcuaguauuaaaaaaaag

SEQ ID NO: 127193 - RNA, 24 nt, Human
uugggaagugcucuuucaaagcug

SEQ ID NO: 127194 - RNA, 18 nt, Human
uuuaaaaugguuuucuua

SEQ ID NO: 127195 - RNA, 23 nt, Human
uuuguuuuguuuuuaaaucagua

SEQ ID NO: 127196 - RNA, 24 nt, Human
uuuuuguuuuuguuuaaauauguu

SEQ ID NO: 127197 - RNA, 24 nt, Human
uuuuuuauuuuuuuuuguuuuguu

SEQ ID NO: 127198 - RNA, 25 nt, Human
acacccaacagaaagaacuuuaaag

SEQ ID NO: 127199 - RNA, 25 nt, Human
acuuugaagaauuugaaucaugaaa

SEQ ID NO: 127200 - RNA, 18 nt, Human
agcugggaaaaaauacca

SEQ ID NO: 127201 - RNA, 21 nt, Human
aggcagaaaggaaaguucuaa

SEQ ID NO: 127202 - RNA, 23 nt, Human
aggcagaaaggaaaguucuaagg

SEQ ID NO: 127203 - RNA, 21 nt, Human
auagaaagcaauccuuuucua

SEQ ID NO: 127204 - RNA, 27 nt, Human
caacagaaagaacuuuaaagccuccaa

SEQ ID NO: 127205 - RNA, 23 nt, Human
cagaaagaacuuuaaagccucca

SEQ ID NO: 127206 - RNA, 18 nt, Human
cauaacugacuucaugca

SEQ ID NO: 127207 - RNA, 24 nt, Human
cuucaugcaaacagggagcucucc

SEQ ID NO: 127208 - RNA, 21 nt, Human
gaaagaacuuuaaagccucca

SEQ ID NO: 127209 - RNA, 21 nt, Human
uaaaauggcacaguccacaga

SEQ ID NO: 127210 - RNA, 21 nt, Human
uaaaucgcaaacaucaguuaa

SEQ ID NO: 127211 - RNA, 22 nt, Human
uaacugacuucaugcaaacagg

SEQ ID NO: 127212 - RNA, 26 nt, Human
uaacugacuucaugcaaacagggagc

SEQ ID NO: 127213 - RNA, 20 nt, Human
uaagauggauugaagaggca

SEQ ID NO: 127214 - RNA, 19 nt, Human
ucagcugggaaaaaauacc

SEQ ID NO: 127215 - RNA, 23 nt, Human
ucaugaaauauugugugguaaga

SEQ ID NO: 127216 - RNA, 27 nt, Human
ugcaaacagggagcucucccuucuuuc

SEQ ID NO: 127217 - RNA, 20 nt, Human
ugccaugagcucaaucaagg

SEQ ID NO: 127218 - RNA, 20 nt, Human
uucacagaaauacagcagaa

SEQ ID NO: 127219 - RNA, 23 nt, Human
uucacagaaauacagcagaauaa

SEQ ID NO: 127220 - RNA, 19 nt, Human
uuuaaagccuccaagagcu

SEQ ID NO: 127221 - RNA, 22 nt, Human
uuuauugugccagaaggucaua

SEQ ID NO: 127222 - RNA, 18 nt, Human
uuugaagcuucuuccaag

SEQ ID NO: 127223 - RNA, 20 nt, Human
aaaaaaagcauggauugcau

SEQ ID NO: 127224 - RNA, 24 nt, Human
aacauuuacagacuguauccccac

SEQ ID NO: 127225 - RNA, 22 nt, Human
aaugugaaugcauacacgaaag

SEQ ID NO: 127226 - RNA, 23 nt, Human
acauuuacagacuguauccccac

SEQ ID NO: 127227 - RNA, 19 nt, Human
aguauugugcuucugaaca

SEQ ID NO: 127228 - RNA, 25 nt, Human
auauauacacacauacauuuacaua

SEQ ID NO: 127229 - RNA, 28 nt, Human
auauauacacacauacauuuacauacac

SEQ ID NO: 127230 - RNA, 19 nt, Human
auuuacagacuguaucccc

SEQ ID NO: 127231 - RNA, 19 nt, Human
caacacucagacaucuaua

SEQ ID NO: 127232 - RNA, 23 nt, Human
cagagaauucuuccuuuaagucu

SEQ ID NO: 127233 - RNA, 18 nt, Human
cagccccugcaugcugga

SEQ ID NO: 127234 - RNA, 24 nt, Human
ccauacguauaggucuccagacaa

SEQ ID NO: 127235 - RNA, 23 nt, Human
cuccagacaacacucagacaucu

SEQ ID NO: 127236 - RNA, 19 nt, Human
cugaacagucauggcguuc

SEQ ID NO: 127237 - RNA, 19 nt, Human
gaaggaaaaaauugccacu

SEQ ID NO: 127238 - RNA, 19 nt, Human
gagaauucuuccuuuaagu

SEQ ID NO: 127239 - RNA, 19 nt, Human
gggaaagaaaaugagccac

SEQ ID NO: 127240 - RNA, 22 nt, Human
uaauauauacacacauacagug

SEQ ID NO: 127241 - RNA, 20 nt, Human
uaggucuccagacaacacuc

SEQ ID NO: 127242 - RNA, 26 nt, Human
uauauacacacauacauuuacauaca

SEQ ID NO: 127243 - RNA, 21 nt, Human
uccgguuaaacaguuuccuuc

SEQ ID NO: 127244 - RNA, 19 nt, Human
ucuccagacaacacucaga

SEQ ID NO: 127245 - RNA, 22 nt, Human
ucuccagacaacacucagacau

SEQ ID NO: 127246 - RNA, 18 nt, Human
ucugcacucuggguacaa

SEQ ID NO: 127247 - RNA, 18 nt, Human
ugaagaaauuaucaagag

SEQ ID NO: 127248 - RNA, 22 nt, Human
ugaaugcauacacgaaagguuu

SEQ ID NO: 127249 - RNA, 21 nt, Human
ugaauucuguucuauuucuug

SEQ ID NO: 127250 - RNA, 21 nt, Human
ugacuaaacgcugagcagccc

SEQ ID NO: 127251 - RNA, 24 nt, Human
ugacuaaacgcugagcagccccug

SEQ ID NO: 127252 - RNA, 24 nt, Human
ugccuuugaaucuagggaaugucu

SEQ ID NO: 127253 - RNA, 19 nt, Human
uggaaaggcggcucugcac

SEQ ID NO: 127254 - RNA, 23 nt, Human
ugggauccgguuaaacaguuucc

SEQ ID NO: 127255 - RNA, 21 nt, Human
ugucagaaauucaaagcuggu

SEQ ID NO: 127256 - RNA, 19 nt, Human
ugugacuaaacgcugagca

SEQ ID NO: 127257 - RNA, 22 nt, Human
uguuuguuuguuuguuucuucu

SEQ ID NO: 127258 - RNA, 20 nt, Human
uuaaaaaaagcauggauugc

SEQ ID NO: 127259 - RNA, 22 nt, Human
uuuaaaggauaucaagcuugga

SEQ ID NO: 127260 - RNA, 21 nt, Human
uuuguuucuucuguuuugccu

SEQ ID NO: 127261 - RNA, 18 nt, Human
aaauaucaccaccuccuc

SEQ ID NO: 127262 - RNA, 20 nt, Human
aacagccuuggcgugaaggc

SEQ ID NO: 127263 - RNA, 22 nt, Human
aacagcuuccauaguccuuuug

SEQ ID NO: 127264 - RNA, 26 nt, Human
aaggaaccccuugcaaguugggcuga

SEQ ID NO: 127265 - RNA, 21 nt, Human
aagggccaagagcucauugau

SEQ ID NO: 127266 - RNA, 19 nt, Human
aauaccuggggccagggca

SEQ ID NO: 127267 - RNA, 19 nt, Human
aauggccagguguccagga

SEQ ID NO: 127268 - RNA, 18 nt, Human
acaaccucccaucuuccc

SEQ ID NO: 127269 - RNA, 18 nt, Human
acacacagccccccaucc

SEQ ID NO: 127270 - RNA, 19 nt, Human
acacagcacccaggaucuc

SEQ ID NO: 127271 - RNA, 18 nt, Human
acaggaacucuggacaag

SEQ ID NO: 127272 - RNA, 23 nt, Human
accagucccugucucccggccuc

SEQ ID NO: 127273 - RNA, 23 nt, Human
accgacccuguguuucuuccccc

SEQ ID NO: 127274 - RNA, 18 nt, Human
acuuaucuaaagguggca

SEQ ID NO: 127275 - RNA, 22 nt, Human
agaaggaaucaugugaagggga

SEQ ID NO: 127276 - RNA, 18 nt, Human
agagaagggagucuggau

SEQ ID NO: 127277 - RNA, 24 nt, Human
agagccacuggccagauguagaaa

SEQ ID NO: 127278 - RNA, 20 nt, Human
agaggcuggaacagacccuu

SEQ ID NO: 127279 - RNA, 21 nt, Human
agagugagaaggcugagcucu

SEQ ID NO: 127280 - RNA, 23 nt, Human
agauacagccaucccauccacca

SEQ ID NO: 127281 - RNA, 21 nt, Human
agccaaacucucugcagcugu

SEQ ID NO: 127282 - RNA, 25 nt, Human
agccuggucaguuugggagaggacc

SEQ ID NO: 127283 - RNA, 21 nt, Human
agcuacuacggucccagcccc

SEQ ID NO: 127284 - RNA, 18 nt, Human
agcuggugagaacagccu

SEQ ID NO: 127285 - RNA, 20 nt, Human
aggaaucaugugaaggggag

SEQ ID NO: 127286 - RNA, 18 nt, Human
aggaccagaaggaacccc

SEQ ID NO: 127287 - RNA, 21 nt, Human
aggagccccuuaagguaagcg

SEQ ID NO: 127288 - RNA, 22 nt, Human
aggcagaagauaggcagcugag

SEQ ID NO: 127289 - RNA, 22 nt, Human
aggcagggccagucucaaagaa

SEQ ID NO: 127290 - RNA, 22 nt, Human
aggugaggguagagaaggaagg

SEQ ID NO: 127291 - RNA, 22 nt, Human
aggugagucuucuaggacugug

SEQ ID NO: 127292 - RNA, 22 nt, Human
agguguggugaugcaugagguc

SEQ ID NO: 127293 - RNA, 24 nt, Human
agugagaaacacagggaagggcag

SEQ ID NO: 127294 - RNA, 20 nt, Human
auggccucaggcugugccag

SEQ ID NO: 127295 - RNA, 18 nt, Human
augguaggggauggggag

SEQ ID NO: 127296 - RNA, 24 nt, Human
caaaauggaagguggcaguggaug

SEQ ID NO: 127297 - RNA, 22 nt, Human
caagaaacaaccuauuaaggac

SEQ ID NO: 127298 - RNA, 25 nt, Human
caagaccaagaaacaaccuauuaag

SEQ ID NO: 127299 - RNA, 18 nt, Human
caagugaaaggcagaaga

SEQ ID NO: 127300 - RNA, 21 nt, Human
cacacacaccgcccgcccccu

SEQ ID NO: 127301 - RNA, 18 nt, Human
cacacaccgcccgccccc

SEQ ID NO: 127302 - RNA, 22 nt, Human
cacagcacccaggaucuccagc

SEQ ID NO: 127303 - RNA, 22 nt, Human
cacaugguuccaaguggccacc

SEQ ID NO: 127304 - RNA, 18 nt, Human
caccgcccgcccccucaa

SEQ ID NO: 127305 - RNA, 22 nt, Human
cagaucccucccaccagaacac

SEQ ID NO: 127306 - RNA, 19 nt, Human
cagcacagccaccuugguc

SEQ ID NO: 127307 - RNA, 23 nt, Human
cagcaugagauggacaaaaugga

SEQ ID NO: 127308 - RNA, 22 nt, Human
cagccaccuuggucuugcuguu

SEQ ID NO: 127309 - RNA, 20 nt, Human
cagccugggguuaccuggcc

SEQ ID NO: 127310 - RNA, 24 nt, Human
cagccugggguuaccuggccugag

SEQ ID NO: 127311 - RNA, 19 nt, Human
caugaagaaagcaagacca

SEQ ID NO: 127312 - RNA, 18 nt, Human
caugagguguggugaugc

SEQ ID NO: 127313 - RNA, 21 nt, Human
cauguuaauguagagggcagc

SEQ ID NO: 127314 - RNA, 24 nt, Human
ccaaggcucuaaaccaagcaccaa

SEQ ID NO: 127315 - RNA, 21 nt, Human
ccacacacagccccccauccc

SEQ ID NO: 127316 - RNA, 21 nt, Human
ccaccuccuccacucagcccc

SEQ ID NO: 127317 - RNA, 18 nt, Human
ccaggucaauguucuguu

SEQ ID NO: 127318 - RNA, 18 nt, Human
ccagucuuccaugguggg

SEQ ID NO: 127319 - RNA, 20 nt, Human
ccaguugguggaaaugggau

SEQ ID NO: 127320 - RNA, 24 nt, Human
cccacaaccucccaucuuccccaa

SEQ ID NO: 127321 - RNA, 21 nt, Human
cccacugcccuaaacacuuua

SEQ ID NO: 127322 - RNA, 19 nt, Human
cccaggacccagcccaagg

SEQ ID NO: 127323 - RNA, 22 nt, Human
cccaucuuccccaacacuuguc

SEQ ID NO: 127324 - RNA, 19 nt, Human
cccaugguaggggaugggg

SEQ ID NO: 127325 - RNA, 22 nt, Human
cccccaucccaggacccagccc

SEQ ID NO: 127326 - RNA, 21 nt, Human
ccccccgcagcuacuacgguc

SEQ ID NO: 127327 - RNA, 26 nt, Human
ccccccucucagccuuccuccuuggc

SEQ ID NO: 127328 - RNA, 19 nt, Human
ccccgugcuacacaggaac

SEQ ID NO: 127329 - RNA, 21 nt, Human
ccccgugcuacacaggaacuc

SEQ ID NO: 127330 - RNA, 20 nt, Human
cccuaaacacuuuauuucca

SEQ ID NO: 127331 - RNA, 24 nt, Human
cccucagaccucucaggaaccaac

SEQ ID NO: 127332 - RNA, 20 nt, Human
ccucauuugucaucugaggc

SEQ ID NO: 127333 - RNA, 21 nt, Human
ccucucagccuuccuccuugg

SEQ ID NO: 127334 - RNA, 21 nt, Human
ccugcagcaccuucuuguggc

SEQ ID NO: 127335 - RNA, 23 nt, Human
ccuggagaauuuucuccucccac

SEQ ID NO: 127336 - RNA, 23 nt, Human
ccugggguuaccuggccugaggc

SEQ ID NO: 127337 - RNA, 25 nt, Human
ccuuccaacauugacuguucucugg

SEQ ID NO: 127338 - RNA, 21 nt, Human
cgcccgcccccucaaaccaac

SEQ ID NO: 127339 - RNA, 25 nt, Human
cguucagcagggucuggaagcgggu

SEQ ID NO: 127340 - RNA, 19 nt, Human
cucaaaccaacgcacaugc

SEQ ID NO: 127341 - RNA, 18 nt, Human
cucaggaaccaacucccc

SEQ ID NO: 127342 - RNA, 19 nt, Human
cucaggaaccaacucccca

SEQ ID NO: 127343 - RNA, 22 nt, Human
cuccauccccaucuccccaguu

SEQ ID NO: 127344 - RNA, 19 nt, Human
cucccacugcccuaaacac

SEQ ID NO: 127345 - RNA, 21 nt, Human
cucccggccuccuguguggcc

SEQ ID NO: 127346 - RNA, 22 nt, Human
cucucaggaaccaacuccccaa

SEQ ID NO: 127347 - RNA, 20 nt, Human
cugaggcagcuggugagaac

SEQ ID NO: 127348 - RNA, 18 nt, Human
cuggauucccucaccaga

SEQ ID NO: 127349 - RNA, 22 nt, Human
cuggccagauguagaaaauaaa

SEQ ID NO: 127350 - RNA, 23 nt, Human
cugggcaccagccccuucuuacu

SEQ ID NO: 127351 - RNA, 20 nt, Human
cugguagugcagcauggccu

SEQ ID NO: 127352 - RNA, 25 nt, Human
gaacacacacacaccgcccgccccc

SEQ ID NO: 127353 - RNA, 18 nt, Human
gaacuguucugugccagc

SEQ ID NO: 127354 - RNA, 24 nt, Human
gaagguggcaguggaugggaggac

SEQ ID NO: 127355 - RNA, 20 nt, Human
gaauauauaaugccuccucu

SEQ ID NO: 127356 - RNA, 18 nt, Human
gacaggauggaggugagg

SEQ ID NO: 127357 - RNA, 23 nt, Human
gaccaagaaacaaccuauuaagg

SEQ ID NO: 127358 - RNA, 19 nt, Human
gacccuguguuucuucccc

SEQ ID NO: 127359 - RNA, 20 nt, Human
gagcagggccccuucagccu

SEQ ID NO: 127360 - RNA, 21 nt, Human
gaggcugcuguggcuucugcc

SEQ ID NO: 127361 - RNA, 18 nt, Human
gcagggagaggccagagg

SEQ ID NO: 127362 - RNA, 19 nt, Human
gcaguggaugggaggacca

SEQ ID NO: 127363 - RNA, 18 nt, Human
gccaucccauccaccaag

SEQ ID NO: 127364 - RNA, 23 nt, Human
gccuggucaguuugggagaggac

SEQ ID NO: 127365 - RNA, 22 nt, Human
gcucuggcccucagaccucuca

SEQ ID NO: 127366 - RNA, 26 nt, Human
gcuguucucugugcguaggcucuggg

SEQ ID NO: 127367 - RNA, 25 nt, Human
ggaaacccaaggugagucuucuagg

SEQ ID NO: 127368 - RNA, 20 nt, Human
ggaagggcagaagggccaag

SEQ ID NO: 127369 - RNA, 18 nt, Human
ggaagguggcaguggaug

SEQ ID NO: 127370 - RNA, 23 nt, Human
ggacagaggcugcuguggcuucu

SEQ ID NO: 127371 - RNA, 24 nt, Human
ggagcccuccccuguucccugccc

SEQ ID NO: 127372 - RNA, 23 nt, Human
ggaggugaggguagagaaggaag

SEQ ID NO: 127373 - RNA, 19 nt, Human
ggcacuguuggagaucugg

SEQ ID NO: 127374 - RNA, 20 nt, Human
ggcugaagaaccaaauuggg

SEQ ID NO: 127375 - RNA, 22 nt, Human
ggcugaagaaccaaauugggua

SEQ ID NO: 127376 - RNA, 18 nt, Human
ggcuguggaccucuccag

SEQ ID NO: 127377 - RNA, 21 nt, Human
gggagcucuuggggcugcaga

SEQ ID NO: 127378 - RNA, 20 nt, Human
gggccagggcacagaaggaa

SEQ ID NO: 127379 - RNA, 21 nt, Human
gggcugcagaugcauauagcc

SEQ ID NO: 127380 - RNA, 23 nt, Human
guagagggcagcucuggcccuca

SEQ ID NO: 127381 - RNA, 19 nt, Human
guccagccacacacagccc

SEQ ID NO: 127382 - RNA, 19 nt, Human
gugcugcccucugcugagg

SEQ ID NO: 127383 - RNA, 23 nt, Human
guggcaguggaugggaggaccag

SEQ ID NO: 127384 - RNA, 22 nt, Human
guggccccccucucagccuucc

SEQ ID NO: 127385 - RNA, 24 nt, Human
uaacuagaauauauaaugccuccu

SEQ ID NO: 127386 - RNA, 23 nt, Human
uacaguggcaucuagcaccagag

SEQ ID NO: 127387 - RNA, 21 nt, Human
uaccagaaaugggguggcccc

SEQ ID NO: 127388 - RNA, 24 nt, Human
uaccagaaaugggguggccccccu

SEQ ID NO: 127389 - RNA, 25 nt, Human
uaccuggccugaggccauccaaggc

SEQ ID NO: 127390 - RNA, 20 nt, Human
uagacaggauggaggugagg

SEQ ID NO: 127391 - RNA, 21 nt, Human
uagaggccucacccacaaccu

SEQ ID NO: 127392 - RNA, 23 nt, Human
uagauacagccaucccauccacc

SEQ ID NO: 127393 - RNA, 24 nt, Human
uagauacagccaucccauccacca

SEQ ID NO: 127394 - RNA, 20 nt, Human
uagcaccagagccacuggcc

SEQ ID NO: 127395 - RNA, 19 nt, Human
uagccaaacucucugcagc

SEQ ID NO: 127396 - RNA, 22 nt, Human
uaggcccagcucaccagucucc

SEQ ID NO: 127397 - RNA, 24 nt, Human
uaguguuagagaaggggugggagg

SEQ ID NO: 127398 - RNA, 18 nt, Human
uaucagccuuccuccucc

SEQ ID NO: 127399 - RNA, 24 nt, Human
uaugggauggagcuaagcauucaa

SEQ ID NO: 127400 - RNA, 18 nt, Human
uauuaaggaccagcucag

SEQ ID NO: 127401 - RNA, 19 nt, Human
ucacaacaauggccaggug

SEQ ID NO: 127402 - RNA, 19 nt, Human
ucacaccugugucagccag

SEQ ID NO: 127403 - RNA, 19 nt, Human
ucacaggggagaaaugcug

SEQ ID NO: 127404 - RNA, 28 nt, Human
ucaccuggagaauuuucuccuccccccu

SEQ ID NO: 127405 - RNA, 23 nt, Human
ucaccuggguuccaggauggccu

SEQ ID NO: 127406 - RNA, 21 nt, Human
ucagaauaauaccuggggcca

SEQ ID NO: 127407 - RNA, 23 nt, Human
uccaaguggccaccugcaggcug

SEQ ID NO: 127408 - RNA, 20 nt, Human
uccacuggcaauaacccuga

SEQ ID NO: 127409 - RNA, 23 nt, Human
uccauaguccuuuuguuuccagg

SEQ ID NO: 127410 - RNA, 21 nt, Human
ucccaccagaacacacacaca

SEQ ID NO: 127411 - RNA, 18 nt, Human
ucccacugcccuaaacac

SEQ ID NO: 127412 - RNA, 23 nt, Human
ucccaggacccagcccaaggcuc

SEQ ID NO: 127413 - RNA, 23 nt, Human
ucccauccaccaaggccagcaug

SEQ ID NO: 127414 - RNA, 18 nt, Human
uccccaguuucccuugcc

SEQ ID NO: 127415 - RNA, 22 nt, Human
ucccucaccagauucccucuca

SEQ ID NO: 127416 - RNA, 18 nt, Human
uccuguguggcuaguucc

SEQ ID NO: 127417 - RNA, 19 nt, Human
ucucaccagucccugucuc

SEQ ID NO: 127418 - RNA, 26 nt, Human
ucucaggggcucccuccaucauugcu

SEQ ID NO: 127419 - RNA, 24 nt, Human
ucuccagcacagccaccuuggucu

SEQ ID NO: 127420 - RNA, 19 nt, Human
ucucugcagcuguucugcc

SEQ ID NO: 127421 - RNA, 21 nt, Human
ucucuggaaccuaccagagcu

SEQ ID NO: 127422 - RNA, 21 nt, Human
ucugcagcuguucugccugga

SEQ ID NO: 127423 - RNA, 21 nt, Human
ucuuguggccaccaggcacga

SEQ ID NO: 127424 - RNA, 21 nt, Human
ugaaaggcagaagauaggcag

SEQ ID NO: 127425 - RNA, 19 nt, Human
ugaacagcuuccauagucc

SEQ ID NO: 127426 - RNA, 26 nt, Human
ugaagaaagcaagaccaaggaaaagu

SEQ ID NO: 127427 - RNA, 19 nt, Human
ugaaggggagauaagagga

SEQ ID NO: 127428 - RNA, 18 nt, Human
ugagaagguuguguuugu

SEQ ID NO: 127429 - RNA, 20 nt, Human
ugagaggaggggccacccuu

SEQ ID NO: 127430 - RNA, 23 nt, Human
ugagauggacaaaauggaaggug

SEQ ID NO: 127431 - RNA, 19 nt, Human
ugaggcagcuggugagaac

SEQ ID NO: 127432 - RNA, 22 nt, Human
ugaggguagagaaggaagggaa

SEQ ID NO: 127433 - RNA, 23 nt, Human
ugaggucugucuugagccccucg

SEQ ID NO: 127434 - RNA, 23 nt, Human
ugcacuugcucagaucccuccca

SEQ ID NO: 127435 - RNA, 24 nt, Human
ugcagggagaggccagaggacuug

SEQ ID NO: 127436 - RNA, 22 nt, Human
ugccuggaagccuucaucuugc

SEQ ID NO: 127437 - RNA, 22 nt, Human
ugcuacacaggaacucuggaca

SEQ ID NO: 127438 - RNA, 23 nt, Human
ugcucagaucccucccaccagaa

SEQ ID NO: 127439 - RNA, 27 nt, Human
uggaaaugggaugggaguagggagagg

SEQ ID NO: 127440 - RNA, 19 nt, Human
uggaacuguucugugccag

SEQ ID NO: 127441 - RNA, 21 nt, Human
uggagcccuccccuguucccu

SEQ ID NO: 127442 - RNA, 22 nt, Human
uggaugcaagugaaaggcagaa

SEQ ID NO: 127443 - RNA, 23 nt, Human
uggcaguggaugggaggaccaga

SEQ ID NO: 127444 - RNA, 24 nt, Human
uggccccccucucagccuuccucc

SEQ ID NO: 127445 - RNA, 21 nt, Human
uggccugaggccauccaaggc

SEQ ID NO: 127446 - RNA, 18 nt, Human
ugggagggccugagcaau

SEQ ID NO: 127447 - RNA, 21 nt, Human
ugggaguagggagaggcugga

SEQ ID NO: 127448 - RNA, 19 nt, Human
ugggaugggaguagggaga

SEQ ID NO: 127449 - RNA, 23 nt, Human
ugggaugggaguagggagaggcu

SEQ ID NO: 127450 - RNA, 23 nt, Human
ugggcugaagaaccaaauugggu

SEQ ID NO: 127451 - RNA, 21 nt, Human
uggggagacaccugguccagc

SEQ ID NO: 127452 - RNA, 23 nt, Human
uggggagacaccugguccagcca

SEQ ID NO: 127453 - RNA, 22 nt, Human
ugggguggccccccucucagcc

SEQ ID NO: 127454 - RNA, 25 nt, Human
ugggugcccaugguaggggaugggg

SEQ ID NO: 127455 - RNA, 20 nt, Human
ugguaggggauggggagcag

SEQ ID NO: 127456 - RNA, 19 nt, Human
ugguauugaauaagagccu

SEQ ID NO: 127457 - RNA, 19 nt, Human
uggugggugggaaugccag

SEQ ID NO: 127458 - RNA, 18 nt, Human
ugucuugagccccucgcc

SEQ ID NO: 127459 - RNA, 19 nt, Human
uguggauuaguagacagga

SEQ ID NO: 127460 - RNA, 23 nt, Human
uguuagagaaggggugggagggc

SEQ ID NO: 127461 - RNA, 20 nt, Human
uguucuguugagccuccccu

SEQ ID NO: 127462 - RNA, 24 nt, Human
uuaagguaagcguggggagacacc

SEQ ID NO: 127463 - RNA, 21 nt, Human
uucuaggacuguggauuagua

SEQ ID NO: 127464 - RNA, 22 nt, Human
uuggaugcaagugaaaggcaga

SEQ ID NO: 127465 - RNA, 22 nt, Human
uuggcaccuucaggugauguga

SEQ ID NO: 127466 - RNA, 20 nt, Human
aaaugcuuaguucccucuuu

SEQ ID NO: 127467 - RNA, 21 nt, Human
aagaauacaagagagccuguc

SEQ ID NO: 127468 - RNA, 22 nt, Human
aagacuccucccuucagggcac

SEQ ID NO: 127469 - RNA, 21 nt, Human
acagaucccgggccucggcca

SEQ ID NO: 127470 - RNA, 20 nt, Human
caagagagccugucgugaug

SEQ ID NO: 127471 - RNA, 21 nt, Human
cacagaucccgggccucggcc

SEQ ID NO: 127472 - RNA, 23 nt, Human
cauuucauucacucuuuuugagu

SEQ ID NO: 127473 - RNA, 20 nt, Human
ccaagagaaagacuccuccc

SEQ ID NO: 127474 - RNA, 21 nt, Human
cccaccacgagcucgcaucga

SEQ ID NO: 127475 - RNA, 22 nt, Human
cccuucagaaaugacacucuga

SEQ ID NO: 127476 - RNA, 19 nt, Human
cuuaggucuguugaucugc

SEQ ID NO: 127477 - RNA, 22 nt, Human
gagaaagacuccucccuucaga

SEQ ID NO: 127478 - RNA, 18 nt, Human
ggccaggcucauugagga

SEQ ID NO: 127479 - RNA, 20 nt, Human
ucagaaaugacacucugagc

SEQ ID NO: 127480 - RNA, 21 nt, Human
ucccgggccucggccaggcuc

SEQ ID NO: 127481 - RNA, 20 nt, Human
ugaauuucuugugggaagag

SEQ ID NO: 127482 - RNA, 24 nt, Human
ugaucugcgcguacagaggcucug

SEQ ID NO: 127483 - RNA, 21 nt, Human
ugcugauguccaugccagucu

SEQ ID NO: 127484 - RNA, 18 nt, Human
uuuuuugugugcugccau

SEQ ID NO: 127485 - RNA, 20 nt, Human
uuuuuugugugcugccauag

SEQ ID NO: 127486 - RNA, 23 nt, Human
uuuuuuuuuuuuuuuugugugcu

SEQ ID NO: 127487 - RNA, 18 nt, Human
uuuuuuuuuuuuuuuuug

SEQ ID NO: 127488 - RNA, 19 nt, Human
uuuuuuuuuuuuuuuuugu

SEQ ID NO: 127489 - RNA, 23 nt, Human
aaacaacucugaacaauaaggau

SEQ ID NO: 127490 - RNA, 20 nt, Human
aaacagaacccccaaacaac

SEQ ID NO: 127491 - RNA, 22 nt, Human
aaagaaucagaaaaaaaagggg

SEQ ID NO: 127492 - RNA, 18 nt, Human
aaagcuggaacaagggca

SEQ ID NO: 127493 - RNA, 18 nt, Human
aacagaacccccaaacaa

SEQ ID NO: 127494 - RNA, 23 nt, Human
aacccccaaacaacucugaacaa

SEQ ID NO: 127495 - RNA, 20 nt, Human
aaggcaacagauaauacguc

SEQ ID NO: 127496 - RNA, 19 nt, Human
acagaacccccaaacaacu

SEQ ID NO: 127497 - RNA, 24 nt, Human
accuuuuuauuccucuggaugguc

SEQ ID NO: 127498 - RNA, 19 nt, Human
agacagaaagugaaaagca

SEQ ID NO: 127499 - RNA, 21 nt, Human
aggcagcaaaccucaguacca

SEQ ID NO: 127500 - RNA, 20 nt, Human
agggaaacuacuguacuuca

SEQ ID NO: 127501 - RNA, 18 nt, Human
auaaacauaaccucccac

SEQ ID NO: 127502 - RNA, 24 nt, Human
auaaggcaacagauaauacgucaa

SEQ ID NO: 127503 - RNA, 19 nt, Human
caaaacaguaugauaugaa

SEQ ID NO: 127504 - RNA, 24 nt, Human
caacagauaauacgucaaagcugg

SEQ ID NO: 127505 - RNA, 24 nt, Human
caagaaggcaggcagcaaaccuca

SEQ ID NO: 127506 - RNA, 24 nt, Human
cagaaaaaaaaggggaggagagau

SEQ ID NO: 127507 - RNA, 26 nt, Human
cagaacccccaaacaacucugaacaa

SEQ ID NO: 127508 - RNA, 21 nt, Human
caggcgaucccgauggagaag

SEQ ID NO: 127509 - RNA, 19 nt, Human
caguggacacuuggugaca

SEQ ID NO: 127510 - RNA, 21 nt, Human
ccaaagugucuaaggagaagu

SEQ ID NO: 127511 - RNA, 23 nt, Human
ccaggagcaaaacugacugaaaa

SEQ ID NO: 127512 - RNA, 25 nt, Human
ccaggagcaaaacugacugaaaaaa

SEQ ID NO: 127513 - RNA, 21 nt, Human
cccacagacaccggcuagcua

SEQ ID NO: 127514 - RNA, 20 nt, Human
ccccaaacaacucugaacaa

SEQ ID NO: 127515 - RNA, 20 nt, Human
ccccaaacaacucugaacaa

SEQ ID NO: 127516 - RNA, 20 nt, Human
ccucccacagacaccggcua

SEQ ID NO: 127517 - RNA, 19 nt, Human
cucccaaccagaggguaga

SEQ ID NO: 127518 - RNA, 22 nt, Human
cugacugaaaaaagaaucagaa

SEQ ID NO: 127519 - RNA, 21 nt, Human
gaaaaaagaaucagaaaaaaa

SEQ ID NO: 127520 - RNA, 20 nt, Human
gaaaagcauuuuacaaguag

SEQ ID NO: 127521 - RNA, 18 nt, Human
gaacccccaaacaacucu

SEQ ID NO: 127522 - RNA, 22 nt, Human
gcuaucagcuuuguuuuugacu

SEQ ID NO: 127523 - RNA, 19 nt, Human
ggcgaucccgauggagaag

SEQ ID NO: 127524 - RNA, 19 nt, Human
guucuagaagguuccaggg

SEQ ID NO: 127525 - RNA, 24 nt, Human
uaaacauaaccucccacagacacc

SEQ ID NO: 127526 - RNA, 21 nt, Human
uaaccucccacagacaccggc

SEQ ID NO: 127527 - RNA, 19 nt, Human
uacuguacuucauuuacac

SEQ ID NO: 127528 - RNA, 19 nt, Human
uagaagaggcaaugagaaa

SEQ ID NO: 127529 - RNA, 24 nt, Human
uagaagguuccagggacacaagag

SEQ ID NO: 127530 - RNA, 22 nt, Human
uagauuccaaagugucuaagga

SEQ ID NO: 127531 - RNA, 18 nt, Human
uagcaagaaaugggagaa

SEQ ID NO: 127532 - RNA, 20 nt, Human
uagcaagaaaugggagaaaa

SEQ ID NO: 127533 - RNA, 23 nt, Human
uagcaagaaaugggagaaaagga

SEQ ID NO: 127534 - RNA, 21 nt, Human
uaggaaauucucuguaacuga

SEQ ID NO: 127535 - RNA, 21 nt, Human
uaugaagggaugugguggcug

SEQ ID NO: 127536 - RNA, 22 nt, Human
uaugcucugaaacagaaccccc

SEQ ID NO: 127537 - RNA, 20 nt, Human
ucagaaaaaaaaggggagga

SEQ ID NO: 127538 - RNA, 21 nt, Human
ucaguaccaguggacacuugg

SEQ ID NO: 127539 - RNA, 22 nt, Human
ucaguuuagcuuuaaccuagac

SEQ ID NO: 127540 - RNA, 21 nt, Human
ucccucauuugcaauagcuag

SEQ ID NO: 127541 - RNA, 22 nt, Human
ucuguaacugauggucugaagc

SEQ ID NO: 127542 - RNA, 22 nt, Human
ugaaaaaagaaucagaaaaaaa

SEQ ID NO: 127543 - RNA, 20 nt, Human
ugaaacagaacccccaaacc

SEQ ID NO: 127544 - RNA, 21 nt, Human
ugaacccaggagcaaaacuga

SEQ ID NO: 127545 - RNA, 22 nt, Human
ugaacccaggagcaaaacugac

SEQ ID NO: 127546 - RNA, 19 nt, Human
ugacuacuaaggccaaccu

SEQ ID NO: 127547 - RNA, 23 nt, Human
ugauaugaagggaugugguggcu

SEQ ID NO: 127548 - RNA, 19 nt, Human
ugcccugugagagucuguu

SEQ ID NO: 127549 - RNA, 21 nt, Human
ugccuuguucuacuauaaccu

SEQ ID NO: 127550 - RNA, 23 nt, Human
ugccuuguucuacuauaaccuuu

SEQ ID NO: 127551 - RNA, 18 nt, Human
uggacacuuggugacacc

SEQ ID NO: 127552 - RNA, 20 nt, Human
uuuacaaguagaagaggcaa

SEQ ID NO: 127553 - RNA, 18 nt, Human
uuuuuuuuuuuuuugccc

SEQ ID NO: 127554 - RNA, 22 nt, Human
uuuuuuuuuuuuuuuugcccug

SEQ ID NO: 127555 - RNA, 18 nt, Human
uuuuuuuuuuuuuuuuug

SEQ ID NO: 127556 - RNA, 22 nt, Human
uuuuuuuuuuuuuuuuugcccu

SEQ ID NO: 127557 - RNA, 21 nt, Human
aaaaggaggagguuugaagga

SEQ ID NO: 127558 - RNA, 19 nt, Human
aaaaguugccacacacccc

SEQ ID NO: 127559 - RNA, 22 nt, Human
aaacaaacacauagaacuagga

SEQ ID NO: 127560 - RNA, 22 nt, Human
aaacagacggaggagaagcgag

SEQ ID NO: 127561 - RNA, 18 nt, Human
aaauaaugcucccuuugu

SEQ ID NO: 127562 - RNA, 26 nt, Human
aacagacggaggagaagcgagaggaa

SEQ ID NO: 127563 - RNA, 18 nt, Human
aacuaggaaaagaauccc

SEQ ID NO: 127564 - RNA, 22 nt, Human
aagaaucccuugugcucaaaca

SEQ ID NO: 127565 - RNA, 21 nt, Human
aagcacuguuugccgcuuuac

SEQ ID NO: 127566 - RNA, 25 nt, Human
aauaaauaauguuacgaucauacaa

SEQ ID NO: 127567 - RNA, 18 nt, Human
aauauuucugguguuuug

SEQ ID NO: 127568 - RNA, 19 nt, Human
acaaacauucucaggucuc

SEQ ID NO: 127569 - RNA, 23 nt, Human
acauagaacuaggaaaagaaucc

SEQ ID NO: 127570 - RNA, 20 nt, Human
accauaaaaugggcacauuu

SEQ ID NO: 127571 - RNA, 23 nt, Human
acuccgggagagaacgagaagga

SEQ ID NO: 127572 - RNA, 18 nt, Human
agaaaaaaaaaccuucag

SEQ ID NO: 127573 - RNA, 21 nt, Human
agaaaaccaaguuucuacaaa

SEQ ID NO: 127574 - RNA, 19 nt, Human
agaaagggagagaaggggg

SEQ ID NO: 127575 - RNA, 18 nt, Human
agaaggagcgaggggggc

SEQ ID NO: 127576 - RNA, 25 nt, Human
agaagggggagaaaaggaggugaag

SEQ ID NO: 127577 - RNA, 23 nt, Human
agaauccucuaugcccccuacaa

SEQ ID NO: 127578 - RNA, 22 nt, Human
agaccuaaaagguauagaagcg

SEQ ID NO: 127579 - RNA, 19 nt, Human
agacggaggagaagcgaga

SEQ ID NO: 127580 - RNA, 18 nt, Human
agagaagggggagaaaag

SEQ ID NO: 127581 - RNA, 18 nt, Human
aggaugaaggugaaaagg

SEQ ID NO: 127582 - RNA, 24 nt, Human
aggcuaccauagaaaaauuuccaa

SEQ ID NO: 127583 - RNA, 24 nt, Human
agggaaacaaacacauagaacuag

SEQ ID NO: 127584 - RNA, 20 nt, Human
aggggaaggggaaaaaaggg

SEQ ID NO: 127585 - RNA, 22 nt, Human
aggggggagaaggagcgagggg

SEQ ID NO: 127586 - RNA, 23 nt, Human
aggggggagaaggagcgaggggg

SEQ ID NO: 127587 - RNA, 23 nt, Human
aggggggagaaggagcgaggggg

SEQ ID NO: 127588 - RNA, 20 nt, Human
augaaggugaaaaggaggag

SEQ ID NO: 127589 - RNA, 19 nt, Human
caacuccgggagagaacga

SEQ ID NO: 127590 - RNA, 21 nt, Human
cacauagccacccuucccucu

SEQ ID NO: 127591 - RNA, 21 nt, Human
cagaagaggaaaaugguucau

SEQ ID NO: 127592 - RNA, 21 nt, Human
ccacacacccccgggagggga

SEQ ID NO: 127593 - RNA, 19 nt, Human
ccacaggugaaaaucaaug

SEQ ID NO: 127594 - RNA, 18 nt, Human
ccccgggaggggaagggg

SEQ ID NO: 127595 - RNA, 23 nt, Human
cgaaugucugacugcaaaguucu

SEQ ID NO: 127596 - RNA, 23 nt, Human
cgggaggggaaggggaaaaaagg

SEQ ID NO: 127597 - RNA, 21 nt, Human
cuaaagcauucucaaaggucu

SEQ ID NO: 127598 - RNA, 25 nt, Human
cuauauaccacuaccaguuuggaau

SEQ ID NO: 127599 - RNA, 20 nt, Human
cucuaugccaggagcagagc

SEQ ID NO: 127600 - RNA, 24 nt, Human
cugaccaacagggugacaaaacau

SEQ ID NO: 127601 - RNA, 19 nt, Human
cugcuacaagagucucuug

SEQ ID NO: 127602 - RNA, 21 nt, Human
cuuaaucaaguaauuaauacc

SEQ ID NO: 127603 - RNA, 20 nt, Human
cuugcuaaaauuuccuuuua

SEQ ID NO: 127604 - RNA, 18 nt, Human
cuuucugaccaacagggu

SEQ ID NO: 127605 - RNA, 18 nt, Human
gaacuuagcuggcuaaua

SEQ ID NO: 127606 - RNA, 23 nt, Human
gaccaacagggugacaaaacaua

SEQ ID NO: 127607 - RNA, 22 nt, Human
gagaacgagaaggagaaaggga

SEQ ID NO: 127608 - RNA, 19 nt, Human
gagagaagggggagaaaag

SEQ ID NO: 127609 - RNA, 18 nt, Human
gcaaaaaacaaagagaag

SEQ ID NO: 127610 - RNA, 21 nt, Human
gcaaaaaacaaagagaaggua

SEQ ID NO: 127611 - RNA, 19 nt, Human
gcacuguuugccgcuuuac

SEQ ID NO: 127612 - RNA, 18 nt, Human
gccacaauccauucccaa

SEQ ID NO: 127613 - RNA, 18 nt, Human
gccaggagcagagcaaug

SEQ ID NO: 127614 - RNA, 19 nt, Human
gcucaaauaacuaggcuac

SEQ ID NO: 127615 - RNA, 20 nt, Human
ggaaaagaaucccuugugcu

SEQ ID NO: 127616 - RNA, 22 nt, Human
ggaaaaguugccacacaccccc

SEQ ID NO: 127617 - RNA, 25 nt, Human
ggaagaccuaaaagguauagaagcg

SEQ ID NO: 127618 - RNA, 21 nt, Human
ggagagaagggggagaaaagg

SEQ ID NO: 127619 - RNA, 23 nt, Human
ggaggagguuugaaggacuuggg

SEQ ID NO: 127620 - RNA, 22 nt, Human
ggaggggaaggggaaaaaaggg

SEQ ID NO: 127621 - RNA, 23 nt, Human
ggaggggaaggggaaaaaagggg

SEQ ID NO: 127622 - RNA, 23 nt, Human
ggcaacaacaacuccgggagaga

SEQ ID NO: 127623 - RNA, 27 nt, Human
ggggagggucggcuguuguuguguggg

SEQ ID NO: 127624 - RNA, 23 nt, Human
gggucggcuguuguugugugggu

SEQ ID NO: 127625 - RNA, 26 nt, Human
ggguggggguggggcggggagggucc

SEQ ID NO: 127626 - RNA, 25 nt, Human
guacaacaaaauucguaauaaccuu

SEQ ID NO: 127627 - RNA, 23 nt, Human
uaaauaaaaauaaugcucccuuu

SEQ ID NO: 127628 - RNA, 21 nt, Human
uaaccacugcuacaagagucu

SEQ ID NO: 127629 - RNA, 18 nt, Human
uaacuaggcuaccauaga

SEQ ID NO: 127630 - RNA, 22 nt, Human
uaacuaggcuaccauagaaaaa

SEQ ID NO: 127631 - RNA, 20 nt, Human
uaagaaaaaaaaaccuucag

SEQ ID NO: 127632 - RNA, 21 nt, Human
uaagaaaaaaaaaccuucagu

SEQ ID NO: 127633 - RNA, 18 nt, Human
uacaugccugcaugcguu

SEQ ID NO: 127634 - RNA, 20 nt, Human
uacugugacuccagacaaau

SEQ ID NO: 127635 - RNA, 25 nt, Human
uagaaaaaaacaaagcuaggucuua

SEQ ID NO: 127636 - RNA, 20 nt, Human
uagaaaacuuuaaauauaua

SEQ ID NO: 127637 - RNA, 22 nt, Human
uagguccuacaugaagaugagu

SEQ ID NO: 127638 - RNA, 22 nt, Human
uaguauacuacugcauacauaa

SEQ ID NO: 127639 - RNA, 24 nt, Human
uauauaccacuaccaguuuggaau

SEQ ID NO: 127640 - RNA, 20 nt, Human
uauuuacaugccugcaugcg

SEQ ID NO: 127641 - RNA, 22 nt, Human
ucaagaauccucuaugcccccu

SEQ ID NO: 127642 - RNA, 21 nt, Human
ucaauggagaaaacuuuuuuu

SEQ ID NO: 127643 - RNA, 19 nt, Human
ucaggagaaaacccacaau

SEQ ID NO: 127644 - RNA, 22 nt, Human
ucccuugugcucaaacaacaaa

SEQ ID NO: 127645 - RNA, 23 nt, Human
uccgggggcugggaucgagggcu

SEQ ID NO: 127646 - RNA, 22 nt, Human
ucgcucuagcacaaaguuaagg

SEQ ID NO: 127647 - RNA, 26 nt, Human
ucuaaaauuuucauuuuccuaaacuc

SEQ ID NO: 127648 - RNA, 18 nt, Human
ugaaaacacauacuguaa

SEQ ID NO: 127649 - RNA, 21 nt, Human
ugaaaacacauacuguaacuu

SEQ ID NO: 127650 - RNA, 20 nt, Human
ugaaaacauguuacauuuau

SEQ ID NO: 127651 - RNA, 22 nt, Human
ugaaaauaacacauagccaccc

SEQ ID NO: 127652 - RNA, 18 nt, Human
ugaaggugaaaaggagga

SEQ ID NO: 127653 - RNA, 19 nt, Human
ugaaggugaaaaggaggag

SEQ ID NO: 127654 - RNA, 18 nt, Human
ugaauaagaagcaacauu

SEQ ID NO: 127655 - RNA, 20 nt, Human
ugaauaagaagcaacauuau

SEQ ID NO: 127656 - RNA, 23 nt, Human
ugacuccagacaaauauuuacau

SEQ ID NO: 127657 - RNA, 19 nt, Human
ugagcuacacaaaagaauu

SEQ ID NO: 127658 - RNA, 23 nt, Human
ugcaaaaaacaaagagaagguaa

SEQ ID NO: 127659 - RNA, 25 nt, Human
ugcaaaguucuuuucuauaacaugg

SEQ ID NO: 127660 - RNA, 22 nt, Human
ugcagcuuggggcacuagccua

SEQ ID NO: 127661 - RNA, 26 nt, Human
ugcauacauaauaccuuccuugugug

SEQ ID NO: 127662 - RNA, 24 nt, Human
ugccaaaacacaaauuuccaaacc

SEQ ID NO: 127663 - RNA, 19 nt, Human
ugcugguuucuggaggaca

SEQ ID NO: 127664 - RNA, 20 nt, Human
ugcuguucagccacaaucca

SEQ ID NO: 127665 - RNA, 21 nt, Human
ugggaucgagggcugguuugg

SEQ ID NO: 127666 - RNA, 18 nt, Human
uggggguggggcggggag

SEQ ID NO: 127667 - RNA, 18 nt, Human
uggggguggggguggggc

SEQ ID NO: 127668 - RNA, 21 nt, Human
uggguaaccacugcuacaaga

SEQ ID NO: 127669 - RNA, 19 nt, Human
ugguauuaaaaagaugaac

SEQ ID NO: 127670 - RNA, 21 nt, Human
ugguuuggggguggggguggg

SEQ ID NO: 127671 - RNA, 23 nt, Human
uguacagauuuuguacaacaaaa

SEQ ID NO: 127672 - RNA, 22 nt, Human
uguagaauacuuaaacuuuuaa

SEQ ID NO: 127673 - RNA, 18 nt, Human
uguccagcagcaaguugc

SEQ ID NO: 127674 - RNA, 23 nt, Human
uguucuugcugguuucuggagga

SEQ ID NO: 127675 - RNA, 19 nt, Human
uuaaaaccagaaagacauc

SEQ ID NO: 127676 - RNA, 22 nt, Human
uuaaauacaauaacaguaaacg

SEQ ID NO: 127677 - RNA, 19 nt, Human
uuagaaaaaaacaaagcua

SEQ ID NO: 127678 - RNA, 23 nt, Human
uuccauuagaaaaaaacaaagcu

SEQ ID NO: 127679 - RNA, 21 nt, Human
uugaagauuuugcuguuuugu

SEQ ID NO: 127680 - RNA, 20 nt, Human
uugacacaaguccauucaau

SEQ ID NO: 127681 - RNA, 22 nt, Human
uuuaacucuguauacaauuguc

SEQ ID NO: 127682 - RNA, 21 nt, Human
uuuacaaacauucucaggucu

SEQ ID NO: 127683 - RNA, 19 nt, Human
uuuucagaagaggaaaaug

SEQ ID NO: 127684 - RNA, 18 nt, Human
aagcugccaucuccagaa

SEQ ID NO: 127685 - RNA, 22 nt, Human
aagcugccaucuccagaacucu

SEQ ID NO: 127686 - RNA, 19 nt, Human
agguacuccgguccgcgcc

SEQ ID NO: 127687 - RNA, 22 nt, Human
auaagcugccaucuccagaacu

SEQ ID NO: 127688 - RNA, 22 nt, Human
ccgguccgcgccccaaacucuu

SEQ ID NO: 127689 - RNA, 23 nt, Human
cgcaagguacuccgguccgcgcc

SEQ ID NO: 127690 - RNA, 22 nt, Human
gaacucuuauccaggaaauuca

SEQ ID NO: 127691 - RNA, 24 nt, Human
gcaagguacuccgguccgcgcccc

SEQ ID NO: 127692 - RNA, 22 nt, Human
gccccaaacucuuggaggaccc

SEQ ID NO: 127693 - RNA, 21 nt, Human
uagcaguaagugucaaauccu

SEQ ID NO: 127694 - RNA, 22 nt, Human
uccauguguccaauaagcugcc

SEQ ID NO: 127695 - RNA, 21 nt, Human
ucuuauccaggaaauucaaag

SEQ ID NO: 127696 - RNA, 21 nt, Human
ugaacucugggcuuuucuccu

SEQ ID NO: 127697 - RNA, 25 nt, Human
uguucugacacacagugaacucugg

SEQ ID NO: 127698 - RNA, 20 nt, Human
uuuuuuuuuuuuugaggagu

SEQ ID NO: 127699 - RNA, 22 nt, Human
aaaucacuuuccuucucuuuuc

SEQ ID NO: 127700 - RNA, 22 nt, Human
aagaagacaccuuucacaggcu

SEQ ID NO: 127701 - RNA, 21 nt, Human
aaguggaaauaacauuacaga

SEQ ID NO: 127702 - RNA, 27 nt, Human
acuuuuaaagacauuaagucaaagaag

SEQ ID NO: 127703 - RNA, 20 nt, Human
agaauguucacugucauaaa

SEQ ID NO: 127704 - RNA, 20 nt, Human
agacaccuuucacaggcuuu

SEQ ID NO: 127705 - RNA, 21 nt, Human
aggaaaggaaucacucucaau

SEQ ID NO: 127706 - RNA, 21 nt, Human
aggaaucacucucaauucugc

SEQ ID NO: 127707 - RNA, 24 nt, Human
aucaccaucaacaccccugguuca

SEQ ID NO: 127708 - RNA, 23 nt, Human
caaacucuauuugugcaacaaag

SEQ ID NO: 127709 - RNA, 24 nt, Human
caccagcauguuuuaccuuuaaaa

SEQ ID NO: 127710 - RNA, 19 nt, Human
cccgaaggaaagaugaaaa

SEQ ID NO: 127711 - RNA, 25 nt, Human
cuaaauacgaacaaaucucuaugcu

SEQ ID NO: 127712 - RNA, 23 nt, Human
cucccuuaucaccaucaacaccc

SEQ ID NO: 127713 - RNA, 26 nt, Human
cuccuugcucuguugacauuccuaac

SEQ ID NO: 127714 - RNA, 18 nt, Human
cuugcucuguugacauuc

SEQ ID NO: 127715 - RNA, 19 nt, Human
gagucgcagcuacgcccag

SEQ ID NO: 127716 - RNA, 21 nt, Human
ggacaucucgauucagaaaua

SEQ ID NO: 127717 - RNA, 19 nt, Human
uaaagacaaugaaagcauc

SEQ ID NO: 127718 - RNA, 22 nt, Human
uaagaaacuaggaacagucugu

SEQ ID NO: 127719 - RNA, 20 nt, Human
uaaguggaaauaacauuaca

SEQ ID NO: 127720 - RNA, 24 nt, Human
uacauguaaaaucagaauguucac

SEQ ID NO: 127721 - RNA, 22 nt, Human
uagaagagacugaauuggguuu

SEQ ID NO: 127722 - RNA, 19 nt, Human
ucacuuuccuucucuuuuc

SEQ ID NO: 127723 - RNA, 22 nt, Human
ucccauucuaaauacgaacaaa

SEQ ID NO: 127724 - RNA, 22 nt, Human
ucuucacauaucuucuucaacu

SEQ ID NO: 127725 - RNA, 21 nt, Human
uuaaagacaaugaaagcaucc

SEQ ID NO: 127726 - RNA, 22 nt, Human
uuaaagacaaugaaagcauccc

SEQ ID NO: 127727 - RNA, 21 nt, Human
uuccuaacacaucuuaaagac

SEQ ID NO: 127728 - RNA, 19 nt, Human
uuuauuucuauuuaggaaa

SEQ ID NO: 127729 - RNA, 18 nt, Human
uuucacaggcuuuuucca

SEQ ID NO: 127730 - RNA, 24 nt, Human
aaaaaaaaaaacaaugcacagaaa

SEQ ID NO: 127731 - RNA, 25 nt, Human
aaaaaaaaaaacaaugcacagaaaa

SEQ ID NO: 127732 - RNA, 22 nt, Human
aaaaaaaaaacaaugcacagaa

SEQ ID NO: 127733 - RNA, 22 nt, Human
aaaaaaggcaaaagaaccccag

SEQ ID NO: 127734 - RNA, 25 nt, Human
aaacaagcaaagccgucaguuccau

SEQ ID NO: 127735 - RNA, 25 nt, Human
aaaccaaaagcuguuaggcaaaaaa

SEQ ID NO: 127736 - RNA, 18 nt, Human
aaagucucuccagcugcu

SEQ ID NO: 127737 - RNA, 21 nt, Human
aacagcgggagagcaaaccca

SEQ ID NO: 127738 - RNA, 23 nt, Human
aagcaagugacuuggucccagag

SEQ ID NO: 127739 - RNA, 23 nt, Human
aagcaguuggcccacccuggagc

SEQ ID NO: 127740 - RNA, 27 nt, Human
aaguagcugcucuguguugugcacgcg

SEQ ID NO: 127741 - RNA, 28 nt, Human
acagacaacaccaugucguccgaggucc

SEQ ID NO: 127742 - RNA, 23 nt, Human
acagaguccaacggccaucacca

SEQ ID NO: 127743 - RNA, 19 nt, Human
acagcgggagagcaaaccc

SEQ ID NO: 127744 - RNA, 23 nt, Human
acccaaaauaacgcuucagacau

SEQ ID NO: 127745 - RNA, 21 nt, Human
acccucaaucaggggaaugga

SEQ ID NO: 127746 - RNA, 20 nt, Human
acccuggagcaccaaaguug

SEQ ID NO: 127747 - RNA, 20 nt, Human
accgugauauuccuuuuagg

SEQ ID NO: 127748 - RNA, 19 nt, Human
accuggaacauugggaauu

SEQ ID NO: 127749 - RNA, 24 nt, Human
acugcuuuuauuuaguuugauaug

SEQ ID NO: 127750 - RNA, 19 nt, Human
agaaaaaggguaaaacaaa

SEQ ID NO: 127751 - RNA, 23 nt, Human
agaaggaaauaaaaacacaucag

SEQ ID NO: 127752 - RNA, 21 nt, Human
agagaaaagggaugggguggg

SEQ ID NO: 127753 - RNA, 25 nt, Human
agagaacucucccccccuccuacca

SEQ ID NO: 127754 - RNA, 21 nt, Human
agagugggcgccccugaguca

SEQ ID NO: 127755 - RNA, 27 nt, Human
agccaauccagcggccagcuccgcgcg

SEQ ID NO: 127756 - RNA, 18 nt, Human
aggcaaaacgcagagagc

SEQ ID NO: 127757 - RNA, 23 nt, Human
aggcaaaacgcagagagccaggg

SEQ ID NO: 127758 - RNA, 19 nt, Human
aggcaugagcccagucacc

SEQ ID NO: 127759 - RNA, 21 nt, Human
aggccccugugucaggacccu

SEQ ID NO: 127760 - RNA, 25 nt, Human
aggcucccccacagggggacugcuc

SEQ ID NO: 127761 - RNA, 22 nt, Human
agggauggggugggucggggca

SEQ ID NO: 127762 - RNA, 21 nt, Human
agggcgcugagcgcaagggcg

SEQ ID NO: 127763 - RNA, 21 nt, Human
aguuugauauguuucuuuaca

SEQ ID NO: 127764 - RNA, 24 nt, Human
caaaacgcagagagccagggggcc

SEQ ID NO: 127765 - RNA, 25 nt, Human
caaaaugucccccacugaguguuuc

SEQ ID NO: 127766 - RNA, 21 nt, Human
caaaccaaaagcuguuaggca

SEQ ID NO: 127767 - RNA, 23 nt, Human
caaccaaguugacguagugugaa

SEQ ID NO: 127768 - RNA, 21 nt, Human
caagaaaagucaugcucaaaa

SEQ ID NO: 127769 - RNA, 19 nt, Human
caauggucugcaggccacc

SEQ ID NO: 127770 - RNA, 22 nt, Human
cacacagagcccagcgccggcg

SEQ ID NO: 127771 - RNA, 20 nt, Human
cacagaguccaacggccauc

SEQ ID NO: 127772 - RNA, 24 nt, Human
caccagggacuuggcgugagccag

SEQ ID NO: 127773 - RNA, 18 nt, Human
cacccucugcacaccugc

SEQ ID NO: 127774 - RNA, 24 nt, Human
caccuggaacauugggaauuguuu

SEQ ID NO: 127775 - RNA, 23 nt, Human
cagaaugcagaaaacacaucuua

SEQ ID NO: 127776 - RNA, 21 nt, Human
cagagaacucucccccccucc

SEQ ID NO: 127777 - RNA, 22 nt, Human
cagcugcuuugggguuugggag

SEQ ID NO: 127778 - RNA, 21 nt, Human
cagguccaaguuugcucaagu

SEQ ID NO: 127779 - RNA, 18 nt, Human
caguuccauggaaucaaa

SEQ ID NO: 127780 - RNA, 22 nt, Human
caucagaaauaaucucaccagg

SEQ ID NO: 127781 - RNA, 23 nt, Human
caucagaaauaaucucaccaggu

SEQ ID NO: 127782 - RNA, 20 nt, Human
cauggugcuuucagagccag

SEQ ID NO: 127783 - RNA, 20 nt, Human
ccaagagaccccuccagcuu

SEQ ID NO: 127784 - RNA, 23 nt, Human
ccacaggaggagaaucgaagcag

SEQ ID NO: 127785 - RNA, 24 nt, Human
ccacccaaaaauuauacauacaag

SEQ ID NO: 127786 - RNA, 23 nt, Human
ccacccacccacccucaaucagg

SEQ ID NO: 127787 - RNA, 21 nt, Human
ccacugagcccgcauuuacag

SEQ ID NO: 127788 - RNA, 24 nt, Human
ccagcccagcgcucaggggagcag

SEQ ID NO: 127789 - RNA, 18 nt, Human
ccaggacgccgccaccgc

SEQ ID NO: 127790 - RNA, 18 nt, Human
ccauguuacauccugcag

SEQ ID NO: 127791 - RNA, 26 nt, Human
cccacaagcaguuggcccacccugga

SEQ ID NO: 127792 - RNA, 27 nt, Human
ccccaggacgccgccaccgccgcuccc

SEQ ID NO: 127793 - RNA, 19 nt, Human
ccccaucgccuccaguugc

SEQ ID NO: 127794 - RNA, 20 nt, Human
ccccaucgccuccaguugcu

SEQ ID NO: 127795 - RNA, 21 nt, Human
cccccacaagcaguuggccca

SEQ ID NO: 127796 - RNA, 24 nt, Human
cccccacaagcaguuggcccaccc

SEQ ID NO: 127797 - RNA, 21 nt, Human
cccuaaaaaguacccaaaaua

SEQ ID NO: 127798 - RNA, 21 nt, Human
ccgccagaccuuuuccaguaa

SEQ ID NO: 127799 - RNA, 22 nt, Human
ccgccgccaccgccaagccuaa

SEQ ID NO: 127800 - RNA, 22 nt, Human
ccgccgccgccaccgccaagcc

SEQ ID NO: 127801 - RNA, 28 nt, Human
ccgccgccgccaccgccaaggccucggc

SEQ ID NO: 127802 - RNA, 21 nt, Human
ccuaccaggccuccccuccug

SEQ ID NO: 127803 - RNA, 21 nt, Human
ccucccaggugcccccacaag

SEQ ID NO: 127804 - RNA, 22 nt, Human
ccucccuaaaaaguacccaaaa

SEQ ID NO: 127805 - RNA, 21 nt, Human
ccuccuaccaggccuccccuc

SEQ ID NO: 127806 - RNA, 21 nt, Human
ccugcuccaucccggagcaca

SEQ ID NO: 127807 - RNA, 22 nt, Human
ccuggccccaggacgccgccac

SEQ ID NO: 127808 - RNA, 18 nt, Human
ccuggguccacccaccca

SEQ ID NO: 127809 - RNA, 23 nt, Human
ccuggguccacccacccacccuc

SEQ ID NO: 127810 - RNA, 22 nt, Human
cgcauuuacaggcucccccaca

SEQ ID NO: 127811 - RNA, 18 nt, Human
cgccgccaccgccgcucc

SEQ ID NO: 127812 - RNA, 21 nt, Human
cgccgccaccgccgcuccccg

SEQ ID NO: 127813 - RNA, 22 nt, Human
cgccgccaccgccgcuccccgg

SEQ ID NO: 127814 - RNA, 19 nt, Human
cgcggcagguguucgcucc

SEQ ID NO: 127815 - RNA, 21 nt, Human
cggccaucaccagcccagcgc

SEQ ID NO: 127816 - RNA, 23 nt, Human
cuaaaaaaggcaaaagaacccca

SEQ ID NO: 127817 - RNA, 22 nt, Human
cuaccaggccuccccuccugag

SEQ ID NO: 127818 - RNA, 24 nt, Human
cuacccugccuccacccaggcgcu

SEQ ID NO: 127819 - RNA, 23 nt, Human
cucuccaucucacagaguccaac

SEQ ID NO: 127820 - RNA, 22 nt, Human
cuggagcaccaaaguugggggg

SEQ ID NO: 127821 - RNA, 22 nt, Human
cuggcaacagcgggagagcaaa

SEQ ID NO: 127822 - RNA, 23 nt, Human
cuucucuaaguuugaaacacccu

SEQ ID NO: 127823 - RNA, 24 nt, Human
gaaaaaaaaaaacaaugcacagaa

SEQ ID NO: 127824 - RNA, 22 nt, Human
gaacaaaccaaaagcuguuagg

SEQ ID NO: 127825 - RNA, 20 nt, Human
gacuugggcaggggagaggg

SEQ ID NO: 127826 - RNA, 24 nt, Human
gagccagggccgggaggcccccaa

SEQ ID NO: 127827 - RNA, 19 nt, Human
gagccuagcaaccgccuga

SEQ ID NO: 127828 - RNA, 25 nt, Human
gaggcccccaaucaggcucuggggu

SEQ ID NO: 127829 - RNA, 19 nt, Human
gagugccagagaaaaggga

SEQ ID NO: 127830 - RNA, 20 nt, Human
gcaaacccagcaccagggac

SEQ ID NO: 127831 - RNA, 28 nt, Human
gcaaagcaauuccccauacccacccaaa

SEQ ID NO: 127832 - RNA, 20 nt, Human
gcaacaggccauucugggcc

SEQ ID NO: 127833 - RNA, 20 nt, Human
gcauuuacaggcucccccac

SEQ ID NO: 127834 - RNA, 21 nt, Human
gccacagccaccacugccucu

SEQ ID NO: 127835 - RNA, 18 nt, Human
gccaccacugccucuugg

SEQ ID NO: 127836 - RNA, 23 nt, Human
gccagccaucaaaaaugaagcga

SEQ ID NO: 127837 - RNA, 19 nt, Human
gcgacggagcuguuuggaa

SEQ ID NO: 127838 - RNA, 23 nt, Human
gcggccggagccuagcaaccgcc

SEQ ID NO: 127839 - RNA, 21 nt, Human
gcugagcgcaagggcggggcg

SEQ ID NO: 127840 - RNA, 24 nt, Human
ggacacacaaauccucugcaaaac

SEQ ID NO: 127841 - RNA, 19 nt, Human
ggagcacacagagcccagc

SEQ ID NO: 127842 - RNA, 23 nt, Human
ggcaaaaaauaaaaauaaaaaag

SEQ ID NO: 127843 - RNA, 20 nt, Human
ggcaaaacgcagagagccag

SEQ ID NO: 127844 - RNA, 21 nt, Human
ggcaccaggggaaacucugac

SEQ ID NO: 127845 - RNA, 18 nt, Human
gggcaggggagaggggcu

SEQ ID NO: 127846 - RNA, 21 nt, Human
gggcccugcccuacccugccu

SEQ ID NO: 127847 - RNA, 20 nt, Human
ggggcugggcccugugggag

SEQ ID NO: 127848 - RNA, 19 nt, Human
ggucggggcaggacugugg

SEQ ID NO: 127849 - RNA, 23 nt, Human
gguuccucggucccuccaccucc

SEQ ID NO: 127850 - RNA, 21 nt, Human
gguuugggaggaccagagagg

SEQ ID NO: 127851 - RNA, 23 nt, Human
guaaaacaaaauagguugaugug

SEQ ID NO: 127852 - RNA, 23 nt, Human
guaggacagagaacucucccccc

SEQ ID NO: 127853 - RNA, 21 nt, Human
gugaacacuugaaugugagau

SEQ ID NO: 127854 - RNA, 20 nt, Human
gugaauagaaaaaacaguac

SEQ ID NO: 127855 - RNA, 21 nt, Human
gugagccagggccgggaggcc

SEQ ID NO: 127856 - RNA, 22 nt, Human
guggagaccuuugaccucccag

SEQ ID NO: 127857 - RNA, 20 nt, Human
uaaaaaaggcaaaagaaccc

SEQ ID NO: 127858 - RNA, 26 nt, Human
uaaaaaaggcaaaagaaccccagugu

SEQ ID NO: 127859 - RNA, 18 nt, Human
uaaaaacacaucaguggu

SEQ ID NO: 127860 - RNA, 20 nt, Human
uacaggcucccccacagggg

SEQ ID NO: 127861 - RNA, 23 nt, Human
uacccacccaaaaauuauacaua

SEQ ID NO: 127862 - RNA, 19 nt, Human
uagaaggaaauaaaaacac

SEQ ID NO: 127863 - RNA, 23 nt, Human
uagacacacgugaauagaaaaaa

SEQ ID NO: 127864 - RNA, 22 nt, Human
uaggucaggugucggcucccgg

SEQ ID NO: 127865 - RNA, 24 nt, Human
uauggcaacaggccauucugggcc

SEQ ID NO: 127866 - RNA, 18 nt, Human
uauucuguucacugcccc

SEQ ID NO: 127867 - RNA, 25 nt, Human
ucaccaggucagaucccacuugugc

SEQ ID NO: 127868 - RNA, 23 nt, Human
ucaccuggaacauugggaauugu

SEQ ID NO: 127869 - RNA, 25 nt, Human
ucagugguuggugaacacuugaaug

SEQ ID NO: 127870 - RNA, 21 nt, Human
uccacagacaacaccaugucg

SEQ ID NO: 127871 - RNA, 27 nt, Human
uccacagacaacaccaugucgucucca

SEQ ID NO: 127872 - RNA, 21 nt, Human
uccacauggugcuuucagagc

SEQ ID NO: 127873 - RNA, 19 nt, Human
uccacccacccacccucaa

SEQ ID NO: 127874 - RNA, 23 nt, Human
uccauggaaucaacacuuaagag

SEQ ID NO: 127875 - RNA, 18 nt, Human
ucccaggugcccccacaa

SEQ ID NO: 127876 - RNA, 22 nt, Human
uccccaaagucucuccagcugc

SEQ ID NO: 127877 - RNA, 18 nt, Human
uccccagccgccagaccu

SEQ ID NO: 127878 - RNA, 18 nt, Human
uccccggggauucggcgc

SEQ ID NO: 127879 - RNA, 19 nt, Human
ucccuaaaaaguacccaaa

SEQ ID NO: 127880 - RNA, 18 nt, Human
ucccuccaccuccacucc

SEQ ID NO: 127881 - RNA, 18 nt, Human
uccuggccccaggacgcc

SEQ ID NO: 127882 - RNA, 23 nt, Human
ucggcgcgaagcugccgccgccg

SEQ ID NO: 127883 - RNA, 22 nt, Human
ucuccacagacaacaccauguc

SEQ ID NO: 127884 - RNA, 18 nt, Human
ucugcacaccugcuccau

SEQ ID NO: 127885 - RNA, 20 nt, Human
ucugcauggcagugcccaau

SEQ ID NO: 127886 - RNA, 22 nt, Human
ucugcuaaaaaaggcaaaagaa

SEQ ID NO: 127887 - RNA, 23 nt, Human
ugaauagaaaaaacaguacaguu

SEQ ID NO: 127888 - RNA, 19 nt, Human
ugaccucccaggugccccc

SEQ ID NO: 127889 - RNA, 20 nt, Human
ugacuuggucccagagcugg

SEQ ID NO: 127890 - RNA, 18 nt, Human
ugagagcaguaggacaga

SEQ ID NO: 127891 - RNA, 24 nt, Human
ugauauguuucuuuacagaaugca

SEQ ID NO: 127892 - RNA, 23 nt, Human
ugcacagaaaaaggguaaaacaa

SEQ ID NO: 127893 - RNA, 21 nt, Human
ugcagaaaacacaucuuaaaa

SEQ ID NO: 127894 - RNA, 24 nt, Human
ugcagaaaacacaucuuaaaauca

SEQ ID NO: 127895 - RNA, 24 nt, Human
ugcagauggacggacggauguucu

SEQ ID NO: 127896 - RNA, 20 nt, Human
uggaaggccuuucaaagccc

SEQ ID NO: 127897 - RNA, 24 nt, Human
uggaaggccuuucaaagcccucac

SEQ ID NO: 127898 - RNA, 23 nt, Human
uggagcaccaaaguugggggcca

SEQ ID NO: 127899 - RNA, 23 nt, Human
uggauacauuauugcgaaaggca

SEQ ID NO: 127900 - RNA, 22 nt, Human
ugggcaggggagaggggcuggg

SEQ ID NO: 127901 - RNA, 22 nt, Human
uggggcaccaggggaaacucug

SEQ ID NO: 127902 - RNA, 18 nt, Human
uggugcuuucagagccag

SEQ ID NO: 127903 - RNA, 18 nt, Human
ugguggagaccuuugacc

SEQ ID NO: 127904 - RNA, 24 nt, Human
ugguggagaccuuugaccucccag

SEQ ID NO: 127905 - RNA, 21 nt, Human
ugugaaaaaauaguauuccuu

SEQ ID NO: 127906 - RNA, 18 nt, Human
ugugguggagaccuuuga

SEQ ID NO: 127907 - RNA, 21 nt, Human
uguucgcuccuccuggcccca

SEQ ID NO: 127908 - RNA, 22 nt, Human
uuccauguuacauccugcagcu

SEQ ID NO: 127909 - RNA, 23 nt, Human
uuccucggucccuccaccuccac

SEQ ID NO: 127910 - RNA, 23 nt, Human
uucugggccagccacgucucugc

SEQ ID NO: 127911 - RNA, 19 nt, Human
uugcuggcacuccucccca

SEQ ID NO: 127912 - RNA, 21 nt, Human
uuggagucccuuuuucaugga

SEQ ID NO: 127913 - RNA, 21 nt, Human
uuuggaaggccuuucaaagcc

SEQ ID NO: 127914 - RNA, 22 nt, Human
uuuuccauguuacauccugcag

SEQ ID NO: 127915 - RNA, 20 nt, Human
aacccucuggcuuuucgagg

SEQ ID NO: 127916 - RNA, 30 nt, Human
aacucauucccuuaguucuuacucucccag

SEQ ID NO: 127917 - RNA, 24 nt, Human
agagggaaauuuggcauugcuguu

SEQ ID NO: 127918 - RNA, 23 nt, Human
agcagacuaggacaucucuagac

SEQ ID NO: 127919 - RNA, 19 nt, Human
agccagugagcagacuagg

SEQ ID NO: 127920 - RNA, 19 nt, Human
agcuaccugucuccagccu

SEQ ID NO: 127921 - RNA, 22 nt, Human
aggaucccccaucucacgagag

SEQ ID NO: 127922 - RNA, 24 nt, Human
caaccugaugcacccaagugacaa

SEQ ID NO: 127923 - RNA, 18 nt, Human
cacaggaucccccaucuc

SEQ ID NO: 127924 - RNA, 22 nt, Human
caucagccugcacaggaucccc

SEQ ID NO: 127925 - RNA, 19 nt, Human
ccagaaaggcuggugguug

SEQ ID NO: 127926 - RNA, 19 nt, Human
cccaggcagcugugccgag

SEQ ID NO: 127927 - RNA, 18 nt, Human
ccuaaccuuaaucucauc

SEQ ID NO: 127928 - RNA, 19 nt, Human
ccucggagcuaccugucuc

SEQ ID NO: 127929 - RNA, 20 nt, Human
ccucuaagguccuuuaugag

SEQ ID NO: 127930 - RNA, 19 nt, Human
ccugcagcagaucggcugu

SEQ ID NO: 127931 - RNA, 22 nt, Human
cgaggacgcaggguacccuacu

SEQ ID NO: 127932 - RNA, 18 nt, Human
cggaggacaaccugaugc

SEQ ID NO: 127933 - RNA, 20 nt, Human
cuccagccucauucuuuggc

SEQ ID NO: 127934 - RNA, 18 nt, Human
cucuucuuuggugucucc

SEQ ID NO: 127935 - RNA, 19 nt, Human
cuggagaacagcaccagaa

SEQ ID NO: 127936 - RNA, 23 nt, Human
gaaguccucccucggagcuaccu

SEQ ID NO: 127937 - RNA, 18 nt, Human
gacacaguugcugaccug

SEQ ID NO: 127938 - RNA, 22 nt, Human
gacccaggcagcugugccgaga

SEQ ID NO: 127939 - RNA, 24 nt, Human
gagcaggacagucaggcccuccac

SEQ ID NO: 127940 - RNA, 18 nt, Human
gcaccagaaaggcuggug

SEQ ID NO: 127941 - RNA, 25 nt, Human
ggaaauuuggcauugcuguucccug

SEQ ID NO: 127942 - RNA, 22 nt, Human
gugagcaggacagucaggcccu

SEQ ID NO: 127943 - RNA, 22 nt, Human
guggguguuucugcacaauucg

SEQ ID NO: 127944 - RNA, 18 nt, Human
uacccuacugccaccagc

SEQ ID NO: 127945 - RNA, 18 nt, Human
uaccugucuccagccuca

SEQ ID NO: 127946 - RNA, 22 nt, Human
uaggacaucucuagacaggaaa

SEQ ID NO: 127947 - RNA, 19 nt, Human
uccacaagcacuguucugg

SEQ ID NO: 127948 - RNA, 22 nt, Human
ucugcacaauucgcauuccacc

SEQ ID NO: 127949 - RNA, 23 nt, Human
ucuuucucuucuuuggugucucc

SEQ ID NO: 127950 - RNA, 24 nt, Human
ucuuucucuucuuuggugucuccu

SEQ ID NO: 127951 - RNA, 19 nt, Human
ugacuaggugaacccucug

SEQ ID NO: 127952 - RNA, 22 nt, Human
ugccagaaguccucccucggag

SEQ ID NO: 127953 - RNA, 18 nt, Human
ugccgagaucucaugcca

SEQ ID NO: 127954 - RNA, 19 nt, Human
uggagaacagcaccagaaa

SEQ ID NO: 127955 - RNA, 23 nt, Human
uggcagacgugaacuggagaaaa

SEQ ID NO: 127956 - RNA, 23 nt, Human
uucuuuggcauguugacuccugg

SEQ ID NO: 127957 - RNA, 18 nt, Human
acaugcugugaucuuggc

SEQ ID NO: 127958 - RNA, 18 nt, Human
augcagguccagagccaa

SEQ ID NO: 127959 - RNA, 24 nt, Human
caagggccuggcuccucuuccugu

SEQ ID NO: 127960 - RNA, 20 nt, Human
cacgcauucacagugaaacc

SEQ ID NO: 127961 - RNA, 21 nt, Human
cagauguccacugucuuccuc

SEQ ID NO: 127962 - RNA, 24 nt, Human
cagauguccacugucuuccucaca

SEQ ID NO: 127963 - RNA, 22 nt, Human
cagcauaaagcagauguccacu

SEQ ID NO: 127964 - RNA, 23 nt, Human
cagguccagagccaacugcaguc

SEQ ID NO: 127965 - RNA, 20 nt, Human
caguccuguccaaucccaua

SEQ ID NO: 127966 - RNA, 24 nt, Human
cauucccucaccgugagucgagga

SEQ ID NO: 127967 - RNA, 24 nt, Human
cccauagguacaagggccuggcuc

SEQ ID NO: 127968 - RNA, 23 nt, Human
ccgacacacgcugccuggggccg

SEQ ID NO: 127969 - RNA, 18 nt, Human
ccucaccgugagucgagg

SEQ ID NO: 127970 - RNA, 19 nt, Human
ccuggcuccucuuccugug

SEQ ID NO: 127971 - RNA, 19 nt, Human
cgacacacgcugccugggg

SEQ ID NO: 127972 - RNA, 19 nt, Human
ggccuggcuccucuuccug

SEQ ID NO: 127973 - RNA, 25 nt, Human
uaggaaaagagccauaauuaucuua

SEQ ID NO: 127974 - RNA, 19 nt, Human
ucccauagguacaagggcc

SEQ ID NO: 127975 - RNA, 20 nt, Human
ucccucaccgugagucgagg

SEQ ID NO: 127976 - RNA, 25 nt, Human
ugaaaaaccacauccaauaaacuga

SEQ ID NO: 127977 - RNA, 18 nt, Human
ugagucgaggacuaguuc

SEQ ID NO: 127978 - RNA, 24 nt, Human
ugauauaaaguuuuaggaacaagg

SEQ ID NO: 127979 - RNA, 18 nt, Human
uuaaaugugaaaaaccac

SEQ ID NO: 127980 - RNA, 19 nt, Human
uuaaaugugaaaaaccaca

SEQ ID NO: 127981 - RNA, 24 nt, Human
uuccucacaugcugugaucuuggc

SEQ ID NO: 127982 - RNA, 22 nt, Human
aaaaaaagaaaaaaacaaacaa

SEQ ID NO: 127983 - RNA, 23 nt, Human
aaaacagaaaaacugucagaaaa

SEQ ID NO: 127984 - RNA, 23 nt, Human
aaaugucuuccuagagcaacaac

SEQ ID NO: 127985 - RNA, 18 nt, Human
aaauuaucaguaagaagc

SEQ ID NO: 127986 - RNA, 21 nt, Human
aacacccucagcaucuccaaa

SEQ ID NO: 127987 - RNA, 23 nt, Human
aacccuacaacugugucaaccuu

SEQ ID NO: 127988 - RNA, 22 nt, Human
aaguacaggaaguuaugaaacc

SEQ ID NO: 127989 - RNA, 19 nt, Human
aaugaccauccacagacaa

SEQ ID NO: 127990 - RNA, 23 nt, Human
acaaaacagaaaaacugucagaa

SEQ ID NO: 127991 - RNA, 24 nt, Human
acaaaacagaaaaacugucagaaa

SEQ ID NO: 127992 - RNA, 29 nt, Human
acaaaacagaaaaacugucagaaaacaag

SEQ ID NO: 127993 - RNA, 19 nt, Human
acccucuucugcaaaaggc

SEQ ID NO: 127994 - RNA, 22 nt, Human
acccuguccaagccagaggcug

SEQ ID NO: 127995 - RNA, 22 nt, Human
agaagaauuaggacauguuccc

SEQ ID NO: 127996 - RNA, 21 nt, Human
agagauggaguccaaaacacu

SEQ ID NO: 127997 - RNA, 20 nt, Human
agagcaacaacacugaucau

SEQ ID NO: 127998 - RNA, 18 nt, Human
agccggggcggcggcggg

SEQ ID NO: 127999 - RNA, 18 nt, Human
agcucccccggucccucc

SEQ ID NO: 128000 - RNA, 23 nt, Human
aggggacuucagcuccgcuuccc

SEQ ID NO: 128001 - RNA, 22 nt, Human
agguacuggaggaugagagaug

SEQ ID NO: 128002 - RNA, 23 nt, Human
aguaagaagcaagguacuggagg

SEQ ID NO: 128003 - RNA, 23 nt, Human
auaggucucuguaacccuacaac

SEQ ID NO: 128004 - RNA, 23 nt, Human
caaaacaaaacucagggugaagc

SEQ ID NO: 128005 - RNA, 26 nt, Human
caaacaaaacagaaaaacugucagaa

SEQ ID NO: 128006 - RNA, 21 nt, Human
caaacacacccucuucugcaa

SEQ ID NO: 128007 - RNA, 23 nt, Human
cacccucuucugcaaaaggcaac

SEQ ID NO: 128008 - RNA, 23 nt, Human
cacugaucauaaaaucacccugg

SEQ ID NO: 128009 - RNA, 21 nt, Human
cagaaaaacugucagaaaaca

SEQ ID NO: 128010 - RNA, 21 nt, Human
cagaaaacaauacaaaacaaa

SEQ ID NO: 128011 - RNA, 24 nt, Human
cagaaaacaauacaaaacaaaacu

SEQ ID NO: 128012 - RNA, 22 nt, Human
cagacccuguccaagccagagg

SEQ ID NO: 128013 - RNA, 22 nt, Human
cagcauacagcaagggacagag

SEQ ID NO: 128014 - RNA, 21 nt, Human
caguccaaacagacccugucc

SEQ ID NO: 128015 - RNA, 18 nt, Human
caucaccaccgcuccugc

SEQ ID NO: 128016 - RNA, 22 nt, Human
ccagcgccggagacuagccggg

SEQ ID NO: 128017 - RNA, 19 nt, Human
cccgggcgccugggagcuc

SEQ ID NO: 128018 - RNA, 26 nt, Human
cccuacaacugugucaaccuucuacc

SEQ ID NO: 128019 - RNA, 24 nt, Human
cccucagcaucuccaaagggaagg

SEQ ID NO: 128020 - RNA, 18 nt, Human
ccggagggaggaguggca

SEQ ID NO: 128021 - RNA, 18 nt, Human
ccggccccagacccugcc

SEQ ID NO: 128022 - RNA, 18 nt, Human
ccggccccagacccugcc

SEQ ID NO: 128023 - RNA, 25 nt, Human
ccugccgcugcgaguugccgagucc

SEQ ID NO: 128024 - RNA, 22 nt, Human
ccuggcugugggugcaggaaga

SEQ ID NO: 128025 - RNA, 18 nt, Human
ccuucuccccuuuccuug

SEQ ID NO: 128026 - RNA, 18 nt, Human
cgccugggagcucccccg

SEQ ID NO: 128027 - RNA, 19 nt, Human
cggcguuggcucgguccgg

SEQ ID NO: 128028 - RNA, 24 nt, Human
cuaccugagaugagagggaaugau

SEQ ID NO: 128029 - RNA, 20 nt, Human
cucaggacagaagaauuagg

SEQ ID NO: 128030 - RNA, 19 nt, Human
cuccccuuuccuugccaaa

SEQ ID NO: 128031 - RNA, 24 nt, Human
cuccugcgccuccguaggccccuc

SEQ ID NO: 128032 - RNA, 20 nt, Human
gaaacacccucagcaucucc

SEQ ID NO: 128033 - RNA, 25 nt, Human
gacaacggaaugagacggggaggga

SEQ ID NO: 128034 - RNA, 22 nt, Human
gaccauaggcgccagcgccgga

SEQ ID NO: 128035 - RNA, 24 nt, Human
gcaaugaccauccacagacaacgg

SEQ ID NO: 128036 - RNA, 22 nt, Human
ggaacaaaagcaaacggaaaaa

SEQ ID NO: 128037 - RNA, 22 nt, Human
ggaggaugagagauggagucca

SEQ ID NO: 128038 - RNA, 18 nt, Human
ggagggaacaaagucccc

SEQ ID NO: 128039 - RNA, 23 nt, Human
ggcggcgggaacacagcuaggga

SEQ ID NO: 128040 - RNA, 19 nt, Human
gggaacacagcuagggagu

SEQ ID NO: 128041 - RNA, 19 nt, Human
gugcauauauauauauaca

SEQ ID NO: 128042 - RNA, 21 nt, Human
uaaaggacaaucaauaugaua

SEQ ID NO: 128043 - RNA, 19 nt, Human
uaagaagcaagguacugga

SEQ ID NO: 128044 - RNA, 19 nt, Human
uacauagugcauauauaua

SEQ ID NO: 128045 - RNA, 23 nt, Human
uaggacauguucccuccuaucaa

SEQ ID NO: 128046 - RNA, 19 nt, Human
uaggccccucaugcaucag

SEQ ID NO: 128047 - RNA, 18 nt, Human
uagggagugagugggggg

SEQ ID NO: 128048 - RNA, 22 nt, Human
uagugcauauauauauauacau

SEQ ID NO: 128049 - RNA, 23 nt, Human
uagugcauauauauauauacaua

SEQ ID NO: 128050 - RNA, 19 nt, Human
uauaacacagaaaagcgua

SEQ ID NO: 128051 - RNA, 20 nt, Human
uauaagaaauacacauuuug

SEQ ID NO: 128052 - RNA, 24 nt, Human
uauaagggacugccacaaaugaug

SEQ ID NO: 128053 - RNA, 23 nt, Human
uauauacauagugcauauauaua

SEQ ID NO: 128054 - RNA, 24 nt, Human
uauauauauacauaugauauaaca

SEQ ID NO: 128055 - RNA, 18 nt, Human
uauauauguauauacaua

SEQ ID NO: 128056 - RNA, 25 nt, Human
uauguauauacauagugcauauaua

SEQ ID NO: 128057 - RNA, 25 nt, Human
ucaggacagaagaauuaggacaaca

SEQ ID NO: 128058 - RNA, 24 nt, Human
ucccagaccaucaccaccgcuccu

SEQ ID NO: 128059 - RNA, 23 nt, Human
ucccaggcgccggccccagaccc

SEQ ID NO: 128060 - RNA, 24 nt, Human
ucccaggcgccggccccagacccu

SEQ ID NO: 128061 - RNA, 21 nt, Human
uccccggcguuggcucggucc

SEQ ID NO: 128062 - RNA, 20 nt, Human
ucccgggcgccugggagcuc

SEQ ID NO: 128063 - RNA, 25 nt, Human
ucugcaguccaaacagaccgggguc

SEQ ID NO: 128064 - RNA, 21 nt, Human
ugaaaaguuaggaauuccagc

SEQ ID NO: 128065 - RNA, 25 nt, Human
ugacaguguguagguuucaugugga

SEQ ID NO: 128066 - RNA, 23 nt, Human
ugagaggagguacacuagcuuuu

SEQ ID NO: 128067 - RNA, 25 nt, Human
ugagaggagguacacuagcuuuuca

SEQ ID NO: 128068 - RNA, 22 nt, Human
ugagagggaaugaugaagcaug

SEQ ID NO: 128069 - RNA, 21 nt, Human
ugaguggggggcgcagauccc

SEQ ID NO: 128070 - RNA, 18 nt, Human
ugaugagucaggggucuu

SEQ ID NO: 128071 - RNA, 22 nt, Human
ugcaggaagaaacacccucagc

SEQ ID NO: 128072 - RNA, 18 nt, Human
uggaacaaaagcaaacgg

SEQ ID NO: 128073 - RNA, 24 nt, Human
uggaagaaaacuugcuuccuuuau

SEQ ID NO: 128074 - RNA, 18 nt, Human
uggaguccaaaacacuga

SEQ ID NO: 128075 - RNA, 20 nt, Human
uggcugacuccgaugauuuc

SEQ ID NO: 128076 - RNA, 19 nt, Human
uggcugugggugcaggaag

SEQ ID NO: 128077 - RNA, 19 nt, Human
ugucagaaaacaauacaaa

SEQ ID NO: 128078 - RNA, 22 nt, Human
ugucagaaaacaauacaaaaca

SEQ ID NO: 128079 - RNA, 24 nt, Human
ugucagaaaacaauacaaaacaaa

SEQ ID NO: 128080 - RNA, 24 nt, Human
ugugucaaccuucuaccugagaug

SEQ ID NO: 128081 - RNA, 23 nt, Human
uuaaaacucgaucacaauuuaaa

SEQ ID NO: 128082 - RNA, 27 nt, Human
uuaaaggacaaucaauaugauaguuaa

SEQ ID NO: 128083 - RNA, 19 nt, Human
uucccuucuccccuuuccu

SEQ ID NO: 128084 - RNA, 23 nt, Human
uuuagacuucaaguacaggaagu

SEQ ID NO: 128085 - RNA, 20 nt, Human
uuuccuuggugacagcuccu

SEQ ID NO: 128086 - RNA, 18 nt, Human
aaaaagcuuuggaacaca

SEQ ID NO: 128087 - RNA, 22 nt, Human
aaacaacacaauacauuuuaac

SEQ ID NO: 128088 - RNA, 24 nt, Human
aaaguccugggauuacaggcauga

SEQ ID NO: 128089 - RNA, 20 nt, Human
aacaaacauaaaacuauaca

SEQ ID NO: 128090 - RNA, 19 nt, Human
aacacaauauuacccaccc

SEQ ID NO: 128091 - RNA, 19 nt, Human
aacagggugaaaauaaugg

SEQ ID NO: 128092 - RNA, 21 nt, Human
aaccuggaugucagacaggcu

SEQ ID NO: 128093 - RNA, 18 nt, Human
aagaaaacaaacauaaaa

SEQ ID NO: 128094 - RNA, 25 nt, Human
aagaaaacaaacauaaaacuauaca

SEQ ID NO: 128095 - RNA, 20 nt, Human
aagcauuuucuauuuuaguu

SEQ ID NO: 128096 - RNA, 18 nt, Human
aaggaccugccaaauuuc

SEQ ID NO: 128097 - RNA, 21 nt, Human
acaagguuucaucauguuggc

SEQ ID NO: 128098 - RNA, 24 nt, Human
acaagguuucaucauguuggccag

SEQ ID NO: 128099 - RNA, 22 nt, Human
acagagguagagagagagacac

SEQ ID NO: 128100 - RNA, 24 nt, Human
accaaaguccugggauuacaggca

SEQ ID NO: 128101 - RNA, 22 nt, Human
acccaaagaaacacauuuguuu

SEQ ID NO: 128102 - RNA, 20 nt, Human
accuuuuaaaaagagaaaau

SEQ ID NO: 128103 - RNA, 18 nt, Human
acucugucacccaggcua

SEQ ID NO: 128104 - RNA, 24 nt, Human
acucugucacccaggcuagagugc

SEQ ID NO: 128105 - RNA, 25 nt, Human
agaaaacaaacauaaaacuauacau

SEQ ID NO: 128106 - RNA, 25 nt, Human
agacaggcugaccaugaccggaccc

SEQ ID NO: 128107 - RNA, 22 nt, Human
agguuucaucauguuggccagg

SEQ ID NO: 128108 - RNA, 23 nt, Human
aguaacuucuuacuuuacaaaca

SEQ ID NO: 128109 - RNA, 19 nt, Human
aguagcugggauuacaggc

SEQ ID NO: 128110 - RNA, 24 nt, Human
agugcagcgccgcgaucuugguuc

SEQ ID NO: 128111 - RNA, 21 nt, Human
aucuauuuaaagaugaacgac

SEQ ID NO: 128112 - RNA, 24 nt, Human
caaaguccugggauuacaggcaug

SEQ ID NO: 128113 - RNA, 23 nt, Human
caaccuccaccucccggguucaa

SEQ ID NO: 128114 - RNA, 22 nt, Human
caagcaauucuccugccucagc

SEQ ID NO: 128115 - RNA, 24 nt, Human
caagguuucaucauguuggccagg

SEQ ID NO: 128116 - RNA, 24 nt, Human
caccaugcccagcuaauuuuugua

SEQ ID NO: 128117 - RNA, 21 nt, Human
cacugcaaccuccaccucccg

SEQ ID NO: 128118 - RNA, 23 nt, Human
cacugcaaccuccaccucccggg

SEQ ID NO: 128119 - RNA, 22 nt, Human
cagaagucaucuaagccuccaa

SEQ ID NO: 128120 - RNA, 20 nt, Human
cagcaacgugagucagcaac

SEQ ID NO: 128121 - RNA, 20 nt, Human
cagccuccugaguagcuggg

SEQ ID NO: 128122 - RNA, 20 nt, Human
caucauggaagggcagcaac

SEQ ID NO: 128123 - RNA, 21 nt, Human
caucauggaagggcagcaacg

SEQ ID NO: 128124 - RNA, 31 nt, Human
caucauguuggccaggcugauguugaacucc

SEQ ID NO: 128125 - RNA, 24 nt, Human
cauguuggccaggcugauguugaa

SEQ ID NO: 128126 - RNA, 22 nt, Human
ccaaaguccugggauuacaggc

SEQ ID NO: 128127 - RNA, 24 nt, Human
ccaaaguccugggauuacaggcau

SEQ ID NO: 128128 - RNA, 21 nt, Human
ccacccaaagaaacacauuug

SEQ ID NO: 128129 - RNA, 27 nt, Human
ccaccucccggguucaagcaauucuuu

SEQ ID NO: 128130 - RNA, 23 nt, Human
cccggguucaagcaauucuccug

SEQ ID NO: 128131 - RNA, 21 nt, Human
ccgacuggaaauagaaguugc

SEQ ID NO: 128132 - RNA, 24 nt, Human
ccucccggguucaagcaauucucc

SEQ ID NO: 128133 - RNA, 23 nt, Human
ccugaccucaagugaucugcuug

SEQ ID NO: 128134 - RNA, 23 nt, Human
ccugaguagcugggauuacaggc

SEQ ID NO: 128135 - RNA, 23 nt, Human
ccugaguagcugggauuacaggc

SEQ ID NO: 128136 - RNA, 23 nt, Human
ccugccucagccuccugaguagc

SEQ ID NO: 128137 - RNA, 19 nt, Human
cucaagugaucugcuuguc

SEQ ID NO: 128138 - RNA, 24 nt, Human
cucagccuccugaguagcugggau

SEQ ID NO: 128139 - RNA, 26 nt, Human
cuccugaccucaagugaucugcuugu

SEQ ID NO: 128140 - RNA, 22 nt, Human
cuccugccucagccuccugagu

SEQ ID NO: 128141 - RNA, 22 nt, Human
cugaguagcugggauuacaggc

SEQ ID NO: 128142 - RNA, 18 nt, Human
cugcaaccuccaccuccc

SEQ ID NO: 128143 - RNA, 23 nt, Human
cugcaaccuccaccucccggguu

SEQ ID NO: 128144 - RNA, 23 nt, Human
cugccucagccuccugaguagcu

SEQ ID NO: 128145 - RNA, 21 nt, Human
cugcugcagaucacagcguca

SEQ ID NO: 128146 - RNA, 22 nt, Human
gaaacuucuaucuaaacaaaaa

SEQ ID NO: 128147 - RNA, 25 nt, Human
gacacaacugggcugcuccugacac

SEQ ID NO: 128148 - RNA, 26 nt, Human
gaccacaaugagugaaaacaaaaacc

SEQ ID NO: 128149 - RNA, 24 nt, Human
gacucugucacccaggcuagagug

SEQ ID NO: 128150 - RNA, 26 nt, Human
gaguagcugggauuacaggcgccugc

SEQ ID NO: 128151 - RNA, 19 nt, Human
gaucgugccuuccccuugg

SEQ ID NO: 128152 - RNA, 20 nt, Human
gauuacaggcaugagccgcc

SEQ ID NO: 128153 - RNA, 21 nt, Human
gauuacaggcaugagccgccg

SEQ ID NO: 128154 - RNA, 18 nt, Human
gauuacaggcgccugcca

SEQ ID NO: 128155 - RNA, 24 nt, Human
gauuacaggcgccugccaccaugc

SEQ ID NO: 128156 - RNA, 22 nt, Human
gcaaccuccaccucccggguuc

SEQ ID NO: 128157 - RNA, 22 nt, Human
gcccagcuaauuuuuguauuuu

SEQ ID NO: 128158 - RNA, 20 nt, Human
gcucuuuaauaaggcccagg

SEQ ID NO: 128159 - RNA, 23 nt, Human
gcugauguugaacuccugaccuc

SEQ ID NO: 128160 - RNA, 19 nt, Human
ggauuacaggcaugagccg

SEQ ID NO: 128161 - RNA, 21 nt, Human
ggccagagcauuccuuggcaa

SEQ ID NO: 128162 - RNA, 24 nt, Human
ggcugauguugaacuccugaccuc

SEQ ID NO: 128163 - RNA, 26 nt, Human
gggccagagcauuccuuggcaagaaa

SEQ ID NO: 128164 - RNA, 19 nt, Human
guaaacauaguaaaacaca

SEQ ID NO: 128165 - RNA, 19 nt, Human
uaaaaaagauaacagaagg

SEQ ID NO: 128166 - RNA, 20 nt, Human
uaaaacacaauauuacccac

SEQ ID NO: 128167 - RNA, 20 nt, Human
uaaacaaagccaaagaauau

SEQ ID NO: 128168 - RNA, 24 nt, Human
uaagaaaacaaacauaaaacuaua

SEQ ID NO: 128169 - RNA, 19 nt, Human
uaagaaacuucuuuaauca

SEQ ID NO: 128170 - RNA, 24 nt, Human
uaauuuuuguauuuuuaguaaaga

SEQ ID NO: 128171 - RNA, 22 nt, Human
uacaggcaugagccgccgcucc

SEQ ID NO: 128172 - RNA, 21 nt, Human
uacaugcacagcaaaaucaug

SEQ ID NO: 128173 - RNA, 23 nt, Human
uagagugcagcgccgcgaucuug

SEQ ID NO: 128174 - RNA, 24 nt, Human
uagagugcagcgccgcgaucuugg

SEQ ID NO: 128175 - RNA, 20 nt, Human
uaggacaucuagcucucaca

SEQ ID NO: 128176 - RNA, 24 nt, Human
uaguaaagacaagguuucaucaug

SEQ ID NO: 128177 - RNA, 23 nt, Human
ucacugcaaccuccaccucccgg

SEQ ID NO: 128178 - RNA, 23 nt, Human
ucacugcaaccuccaccucccgg

SEQ ID NO: 128179 - RNA, 24 nt, Human
ucacugcaaccuccaccucccggg

SEQ ID NO: 128180 - RNA, 25 nt, Human
ucacugcaaccuccaccucccgggu

SEQ ID NO: 128181 - RNA, 27 nt, Human
ucacugcaaccuccaccucccggguuc

SEQ ID NO: 128182 - RNA, 18 nt, Human
ucagacaggcugaccaug

SEQ ID NO: 128183 - RNA, 20 nt, Human
ucagccuccugaguagcugg

SEQ ID NO: 128184 - RNA, 22 nt, Human
ucauggaagggcagcaacguga

SEQ ID NO: 128185 - RNA, 21 nt, Human
uccccugaaaauauuugaugu

SEQ ID NO: 128186 - RNA, 21 nt, Human
ucccggguucaagcaauucuc

SEQ ID NO: 128187 - RNA, 24 nt, Human
ucccggguucaagcaauucuccug

SEQ ID NO: 128188 - RNA, 22 nt, Human
ucccuuuggacugcaagagcag

SEQ ID NO: 128189 - RNA, 24 nt, Human
uccugaguagcugggauuacaggc

SEQ ID NO: 128190 - RNA, 24 nt, Human
ucugacucugucacccaggcuaga

SEQ ID NO: 128191 - RNA, 24 nt, Human
ucugucacccaggcuagagugcag

SEQ ID NO: 128192 - RNA, 20 nt, Human
ucuuggccuaccaaaguccu

SEQ ID NO: 128193 - RNA, 21 nt, Human
ucuuguagcuuuaguguuacu

SEQ ID NO: 128194 - RNA, 22 nt, Human
ucuuguagcuuuaguguuacuc

SEQ ID NO: 128195 - RNA, 25 nt, Human
ugaaaacaaaaacccuuccucuucc

SEQ ID NO: 128196 - RNA, 23 nt, Human
ugaccucaagugaucugcuuguc

SEQ ID NO: 128197 - RNA, 24 nt, Human
ugaccucaagugaucugcuugucu

SEQ ID NO: 128198 - RNA, 18 nt, Human
ugagcagaccuaagagug

SEQ ID NO: 128199 - RNA, 21 nt, Human
ugaguauucauuuguaacuuc

SEQ ID NO: 128200 - RNA, 20 nt, Human
ugagugaaaacaaaaacccu

SEQ ID NO: 128201 - RNA, 24 nt, Human
ugccucagccuccugaguagcugg

SEQ ID NO: 128202 - RNA, 24 nt, Human
uggccaggcugauguugaacuccu

SEQ ID NO: 128203 - RNA, 19 nt, Human
ugggacggagucugacucu

SEQ ID NO: 128204 - RNA, 20 nt, Human
ugggacggagucugacucug

SEQ ID NO: 128205 - RNA, 22 nt, Human
ugggacggagucugacucuguc

SEQ ID NO: 128206 - RNA, 18 nt, Human
ugggauuacaggcaugag

SEQ ID NO: 128207 - RNA, 19 nt, Human
ugggauuacaggcaugagc

SEQ ID NO: 128208 - RNA, 20 nt, Human
ugggauuacaggcaugagcc

SEQ ID NO: 128209 - RNA, 20 nt, Human
ugggauuacaggcaugagcc

SEQ ID NO: 128210 - RNA, 21 nt, Human
ugggauuacaggcaugagccg

SEQ ID NO: 128211 - RNA, 22 nt, Human
ugggauuacaggcaugagccgc

SEQ ID NO: 128212 - RNA, 23 nt, Human
ugggauuacaggcaugagccgcc

SEQ ID NO: 128213 - RNA, 24 nt, Human
ugggauuacaggcaugagccgccg

SEQ ID NO: 128214 - RNA, 21 nt, Human
ugggauuacaggcgccugcca

SEQ ID NO: 128215 - RNA, 22 nt, Human
ugggauuacaggcgccugccac

SEQ ID NO: 128216 - RNA, 24 nt, Human
ugggauuacaggcgccugccacca

SEQ ID NO: 128217 - RNA, 25 nt, Human
ugggauuacaggcgccugccaccau

SEQ ID NO: 128218 - RNA, 18 nt, Human
ugggccaacccuauacaa

SEQ ID NO: 128219 - RNA, 21 nt, Human
ugucacccaggcuagagugca

SEQ ID NO: 128220 - RNA, 19 nt, Human
ugucuuggccuaccaaagu

SEQ ID NO: 128221 - RNA, 21 nt, Human
ugucuuggccuaccaaagucc

SEQ ID NO: 128222 - RNA, 24 nt, Human
uuaguaaagacaagguuucaucau

SEQ ID NO: 128223 - RNA, 21 nt, Human
uucaagcaauucuccugccuc

SEQ ID NO: 128224 - RNA, 24 nt, Human
uucaagcaauucuccugccucagc

SEQ ID NO: 128225 - RNA, 19 nt, Human
uuccaccuugcuccugggc

SEQ ID NO: 128226 - RNA, 23 nt, Human
uuccccuugguugagcuguuuuc

SEQ ID NO: 128227 - RNA, 23 nt, Human
uuccuucuugguuaauagcacaa

SEQ ID NO: 128228 - RNA, 24 nt, Human
uucuuacuuuacaaacaacacaau

SEQ ID NO: 128229 - RNA, 21 nt, Human
uuuaauaaacaaagccaaaga

SEQ ID NO: 128230 - RNA, 21 nt, Human
uuucaucauguuggccaggcu

SEQ ID NO: 128231 - RNA, 24 nt, Human
uuucuauuuuaguuuuggaaaugu

SEQ ID NO: 128232 - RNA, 18 nt, Human
uuuguuuuguuuuguuug

SEQ ID NO: 128233 - RNA, 19 nt, Human
uuuuacucucaggcucuuc

SEQ ID NO: 128234 - RNA, 20 nt, Human
uuuuguuuguuuguuuuuuu

SEQ ID NO: 128235 - RNA, 23 nt, Human
uuuuuaguaaagacaagguuuca

SEQ ID NO: 128236 - RNA, 20 nt, Human
uuuuuguauuuuuaguaaag

SEQ ID NO: 128237 - RNA, 23 nt, Human
uuuuuguauuuuuaguaaagaca

SEQ ID NO: 128238 - RNA, 19 nt, Human
aaacaccaccaaaagggga

SEQ ID NO: 128239 - RNA, 21 nt, Human
aggaagugguggggauuucag

SEQ ID NO: 128240 - RNA, 21 nt, Human
aggcagggagaaggggaggca

SEQ ID NO: 128241 - RNA, 18 nt, Human
agggaggaaguggugggg

SEQ ID NO: 128242 - RNA, 22 nt, Human
aggggaucaaaucccccggagg

SEQ ID NO: 128243 - RNA, 18 nt, Human
caaauguuaucccagaac

SEQ ID NO: 128244 - RNA, 21 nt, Human
ccagaacauucuggaggcagg

SEQ ID NO: 128245 - RNA, 18 nt, Human
cccaccuuccuccaaaug

SEQ ID NO: 128246 - RNA, 20 nt, Human
ccgccuuccuucccacuccc

SEQ ID NO: 128247 - RNA, 18 nt, Human
ccuuccuucccacuccca

SEQ ID NO: 128248 - RNA, 21 nt, Human
ccuuccuucccacucccaccg

SEQ ID NO: 128249 - RNA, 18 nt, Human
cuggaggcagggagaagg

SEQ ID NO: 128250 - RNA, 19 nt, Human
cuucccaccuuccuccaaa

SEQ ID NO: 128251 - RNA, 21 nt, Human
gcaugguucccuccgccuucc

SEQ ID NO: 128252 - RNA, 19 nt, Human
ggaagugguggggauuuca

SEQ ID NO: 128253 - RNA, 18 nt, Human
uaucccagaacauucugg

SEQ ID NO: 128254 - RNA, 23 nt, Human
ucccagaacauucuggaggcagg

SEQ ID NO: 128255 - RNA, 18 nt, Human
ucgcaugguucccuccgc

SEQ ID NO: 128256 - RNA, 21 nt, Human
ugcuucccaccuuccuccaaa

SEQ ID NO: 128257 - RNA, 25 nt, Human
ugguggggauuucagaauuccugcu

SEQ ID NO: 128258 - RNA, 22 nt, Human
uuagcuuaguccaucccuuccu

SEQ ID NO: 128259 - RNA, 19 nt, Human
uuaguccaucccuuccuuc

SEQ ID NO: 128260 - RNA, 18 nt, Human
uucccuccgccuuccuuc

SEQ ID NO: 128261 - RNA, 25 nt, Human
uuucagaauuccugcuccucauuug

SEQ ID NO: 128262 - RNA, 20 nt, Human
aaaacaaaaauaaaaaucua

SEQ ID NO: 128263 - RNA, 24 nt, Human
aaaagaggcugggaaaacaagacu

SEQ ID NO: 128264 - RNA, 23 nt, Human
aaacacuuuaaaaugcaaguuuc

SEQ ID NO: 128265 - RNA, 27 nt, Human
aaaccaagggcgggcgaacccucggaa

SEQ ID NO: 128266 - RNA, 21 nt, Human
aaacgaaacaaauccauagcc

SEQ ID NO: 128267 - RNA, 21 nt, Human
aaacgaaacaaauccauagcc

SEQ ID NO: 128268 - RNA, 21 nt, Human
aaacgaaacaaauccauagcc

SEQ ID NO: 128269 - RNA, 22 nt, Human
aaagacuguauccuucggauuc

SEQ ID NO: 128270 - RNA, 19 nt, Human
aacaagacugugaguauag

SEQ ID NO: 128271 - RNA, 20 nt, Human
aacuuggauaagcaggaaau

SEQ ID NO: 128272 - RNA, 20 nt, Human
aacuuggauaagcaggaaau

SEQ ID NO: 128273 - RNA, 19 nt, Human
aagacuaguaaaagaggcc

SEQ ID NO: 128274 - RNA, 24 nt, Human
aagcuaacuauacauugaguuccu

SEQ ID NO: 128275 - RNA, 22 nt, Human
aaggacguggcugcacaugacg

SEQ ID NO: 128276 - RNA, 22 nt, Human
aaggacguggcugcacaugacg

SEQ ID NO: 128277 - RNA, 22 nt, Human
aaggacguggcugcacaugacg

SEQ ID NO: 128278 - RNA, 20 nt, Human
aaggaggaacagaggcagug

SEQ ID NO: 128279 - RNA, 24 nt, Human
aauauaacaggcuaaaaaacaaaa

SEQ ID NO: 128280 - RNA, 20 nt, Human
accucauugagaagguuaua

SEQ ID NO: 128281 - RNA, 27 nt, Human
acgauuuugccuucugguaacacccag

SEQ ID NO: 128282 - RNA, 27 nt, Human
acgauuuugccuucugguaacacccag

SEQ ID NO: 128283 - RNA, 18 nt, Human
acugaaccguaucuacca

SEQ ID NO: 128284 - RNA, 25 nt, Human
acuucaauaaagcuaacuauacauu

SEQ ID NO: 128285 - RNA, 20 nt, Human
agaaggaaauauaacaggcu

SEQ ID NO: 128286 - RNA, 21 nt, Human
agcugcagcugaugaagacug

SEQ ID NO: 128287 - RNA, 21 nt, Human
agcugcagcugaugaagacug

SEQ ID NO: 128288 - RNA, 19 nt, Human
aggaggaggauuaacuacc

SEQ ID NO: 128289 - RNA, 19 nt, Human
aggaggaggauuaacuacc

SEQ ID NO: 128290 - RNA, 19 nt, Human
aggaggaggauuaacuacc

SEQ ID NO: 128291 - RNA, 18 nt, Human
aggcucaaggaggaacag

SEQ ID NO: 128292 - RNA, 22 nt, Human
agggcacugcgguggcaucugg

SEQ ID NO: 128293 - RNA, 22 nt, Human
auaaaaacaauuccuuucagau

SEQ ID NO: 128294 - RNA, 24 nt, Human
auaaaaacaauuccuuucagauac

SEQ ID NO: 128295 - RNA, 23 nt, Human
auauaacaggcuaaaaaacaaaa

SEQ ID NO: 128296 - RNA, 20 nt, Human
aucuauuuauagcaaguaac

SEQ ID NO: 128297 - RNA, 19 nt, Human
aucucaguuucauccaucc

SEQ ID NO: 128298 - RNA, 21 nt, Human
auggcagaucaaaugauacug

SEQ ID NO: 128299 - RNA, 19 nt, Human
auuuggggcugcagguagg

SEQ ID NO: 128300 - RNA, 19 nt, Human
auuuggggcugcagguagg

SEQ ID NO: 128301 - RNA, 19 nt, Human
auuuggggcugcagguagg

SEQ ID NO: 128302 - RNA, 23 nt, Human
caaagacaaaaauuuauuccuuu

SEQ ID NO: 128303 - RNA, 30 nt, Human
caaaggacguggcugcacaugacgagcacc

SEQ ID NO: 128304 - RNA, 30 nt, Human; identical to SEQ ID NO: 128303

SEQ ID NO: 128305 - RNA, 30 nt, Human; identical to SEQ ID NO: 128303

SEQ ID NO: 128306 - RNA, 19 nt, Human
caaguaacuaauacuucaa

SEQ ID NO: 128307 - RNA, 19 nt, Human
cacaccaguucgauucgug

SEQ ID NO: 128308 - RNA, 19 nt, Human
cacugaaccguaucuacca

SEQ ID NO: 128309 - RNA, 20 nt, Human
cacuucugggucugcuggug

SEQ ID NO: 128310 - RNA, 20 nt, Human
cagaaagccacuuuaaacac

SEQ ID NO: 128311 - RNA, 22 nt, Human
cagaaggaaauauaacaggcua

SEQ ID NO: 128312 - RNA, 19 nt, Human
cagcagacugaacgugcug

SEQ ID NO: 128313 - RNA, 19 nt, Human
cagcagacugaacgugcug

SEQ ID NO: 128314 - RNA, 20 nt, Human
cagcugaugaagacugggug

SEQ ID NO: 128315 - RNA, 20 nt, Human
cagcugaugaagacugggug

SEQ ID NO: 128316 - RNA, 22 nt, Human
caguggugaccugaacugcuga

SEQ ID NO: 128317 - RNA, 20 nt, Human
cauccagugaugaccugacc

SEQ ID NO: 128318 - RNA, 24 nt, Human
cauuaugacucacugauuggacug

SEQ ID NO: 128319 - RNA, 26 nt, Human
ccaaucaaauuggacauagauaugug

SEQ ID NO: 128320 - RNA, 22 nt, Human
ccagacguucugaaacuguggu

SEQ ID NO: 128321 - RNA, 22 nt, Human
ccagacguucugaaacuguggu

SEQ ID NO: 128322 - RNA, 22 nt, Human
ccagacguucugaaacuguggu

SEQ ID NO: 128323 - RNA, 20 nt, Human
cccauugcuaccauuccacg

SEQ ID NO: 128324 - RNA, 24 nt, Human
ccugauaauuguauacaggcaacu

SEQ ID NO: 128325 - RNA, 20 nt, Human
cgaaacaaauccauagccuu

SEQ ID NO: 128326 - RNA, 20 nt, Human
cgaaacaaauccauagccuu

SEQ ID NO: 128327 - RNA, 20 nt, Human
cgaaacaaauccauagccuu

SEQ ID NO: 128328 - RNA, 21 nt, Human
cgauuaaccuuugagugacau

SEQ ID NO: 128329 - RNA, 23 nt, Human
cucaguuucauccauccuagcau

SEQ ID NO: 128330 - RNA, 23 nt, Human
cucaguuucauccauccuagcau

SEQ ID NO: 128331 - RNA, 20 nt, Human
cuccugaaagacuaguaaaa

SEQ ID NO: 128332 - RNA, 23 nt, Human
cucuggugcucuagcuguguggu

SEQ ID NO: 128333 - RNA, 23 nt, Human
cugauaauuguauacaggcaacu

SEQ ID NO: 128334 - RNA, 24 nt, Human
cuuccaaucucaguuucauccauc

SEQ ID NO: 128335 - RNA, 24 nt, Human
cuuccaaucucaguuucauccauc

SEQ ID NO: 128336 - RNA, 24 nt, Human
cuucggauuccgaaugaaaauuuu

SEQ ID NO: 128337 - RNA, 18 nt, Human
gaaacaacaugccucuuc

SEQ ID NO: 128338 - RNA, 21 nt, Human
gaauguuaaaagcacuaaaaa

SEQ ID NO: 128339 - RNA, 24 nt, Human
gaguauagcaaaagggcucuggug

SEQ ID NO: 128340 - RNA, 20 nt, Human
gauccuacuaucuucuggac

SEQ ID NO: 128341 - RNA, 20 nt, Human
gauccuacuaucuucuggac

SEQ ID NO: 128342 - RNA, 20 nt, Human
gauccuacuaucuucuggac

SEQ ID NO: 128343 - RNA, 20 nt, Human
gcaaagcucaauacugaaau

SEQ ID NO: 128344 - RNA, 23 nt, Human
gcccagcuucagcuuuuuaccau

SEQ ID NO: 128345 - RNA, 23 nt, Human
gcccagcuucagcuuuuuaccau

SEQ ID NO: 128346 - RNA, 23 nt, Human
gcccagcuucagcuuuuuaccau

SEQ ID NO: 128347 - RNA, 21 nt, Human
gcgaacccucggagguagaac

SEQ ID NO: 128348 - RNA, 18 nt, Human
ggaggaacagaggcagug

SEQ ID NO: 128349 - RNA, 20 nt, Human
ggauuccgccagacguucug

SEQ ID NO: 128350 - RNA, 20 nt, Human
ggauuccgccagacguucug

SEQ ID NO: 128351 - RNA, 20 nt, Human
ggauuccgccagacguucug

SEQ ID NO: 128352 - RNA, 22 nt, Human
ggccucucuggagaugguugag

SEQ ID NO: 128353 - RNA, 22 nt, Human
ggccucucuggagaugguugag

SEQ ID NO: 128354 - RNA, 20 nt, Human
gggcgcgugguaucggccug

SEQ ID NO: 128355 - RNA, 21 nt, Human
ggggcugcagguagguuucag

SEQ ID NO: 128356 - RNA, 21 nt, Human
ggggcugcagguagguuucag

SEQ ID NO: 128357 - RNA, 22 nt, Human
gguaguaggaacauuuuucuca

SEQ ID NO: 128358 - RNA, 21 nt, Human
ggugcucuagcugugugguca

SEQ ID NO: 128359 - RNA, 18 nt, Human
gucaaaggagccaaaggc

SEQ ID NO: 128360 - RNA, 21 nt, Human
uaaaaaagaaugguaccucau

SEQ ID NO: 128361 - RNA, 20 nt, Human
uaaaaugaggacacuaccua

SEQ ID NO: 128362 - RNA, 21 nt, Human
uaaauaaacaucuaaugaaga

SEQ ID NO: 128363 - RNA, 26 nt, Human
uaacuaauacuucaauguuuuuauaa

SEQ ID NO: 128364 - RNA, 20 nt, Human
uaagauaaaacuagagaguc

SEQ ID NO: 128365 - RNA, 21 nt, Human
uaaguuuagcauuucaaggaa

SEQ ID NO: 128366 - RNA, 19 nt, Human
uaauacaaguuauacagaa

SEQ ID NO: 128367 - RNA, 19 nt, Human
uacaaauguuucccuuaga

SEQ ID NO: 128368 - RNA, 21 nt, Human
uaccuaaucuagaaacaacau

SEQ ID NO: 128369 - RNA, 21 nt, Human
uaccucauugagaagguuaua

SEQ ID NO: 128370 - RNA, 20 nt, Human
uagaaccgccaggcugagga

SEQ ID NO: 128371 - RNA, 26 nt, Human
uaguuugucuuggauucuuuaaaaaa

SEQ ID NO: 128372 - RNA, 23 nt, Human
uauaaaaugaggacacuaccuaa

SEQ ID NO: 128373 - RNA, 21 nt, Human
uauauacaagcaacugacauc

SEQ ID NO: 128374 - RNA, 23 nt, Human
ucaaaaccagcaacuucccauga

SEQ ID NO: 128375 - RNA, 24 nt, Human
ucaaaaccagcaacuucccaugaa

SEQ ID NO: 128376 - RNA, 24 nt, Human
ucaaaggagccaaaggcuaaggug

SEQ ID NO: 128377 - RNA, 21 nt, Human
ucaauuccaccaacaaaaaca

SEQ ID NO: 128378 - RNA, 21 nt, Human
ucaauuccaccaacaaaaaca

SEQ ID NO: 128379 - RNA, 21 nt, Human
uccacggcuuggccuuggaac

SEQ ID NO: 128380 - RNA, 21 nt, Human
uccaguggugaccugaaaugg

SEQ ID NO: 128381 - RNA, 21 nt, Human
ucccauugcuaccauuccacg

SEQ ID NO: 128382 - RNA, 19 nt, Human
uccccaacagggcacugcg

SEQ ID NO: 128383 - RNA, 18 nt, Human
ucugguaacacccagccu

SEQ ID NO: 128384 - RNA, 18 nt, Human
ucugguaacacccagccu

SEQ ID NO: 128385 - RNA, 21 nt, Human
ucugugauccuacuaucuucu

SEQ ID NO: 128386 - RNA, 21 nt, Human
ucugugauccuacuaucuucu

SEQ ID NO: 128387 - RNA, 21 nt, Human
ucugugauccuacuaucuucu

SEQ ID NO: 128388 - RNA, 19 nt, Human
ugaaacuagauagcugaga

SEQ ID NO: 128389 - RNA, 21 nt, Human
ugaaagucaguaauuugcuuu

SEQ ID NO: 128390 - RNA, 20 nt, Human
ugaaaugcugaaucgggaua

SEQ ID NO: 128391 - RNA, 20 nt, Human
ugaaauggugaacuuggaua

SEQ ID NO: 128392 - RNA, 20 nt, Human
ugaaauggugaacuuggaua

SEQ ID NO: 128393 - RNA, 23 nt, Human
ugaaauggugaacuuggauaagc

SEQ ID NO: 128394 - RNA, 23 nt, Human
ugaaauggugaacuuggauaagc

SEQ ID NO: 128395 - RNA, 19 nt, Human
ugaaauggugaucuuggau

SEQ ID NO: 128396 - RNA, 23 nt, Human
ugaacuuggauaagcaggaaaug

SEQ ID NO: 128397 - RNA, 23 nt, Human
ugaacuuggauaagcaggaaaug

SEQ ID NO: 128398 - RNA, 20 nt, Human
ugagaggauccaacagauuu

SEQ ID NO: 128399 - RNA, 19 nt, Human
ugauacaaauguuucccuu

SEQ ID NO: 128400 - RNA, 24 nt, Human
ugauuuggggcugcagguagguuu

SEQ ID NO: 128401 - RNA, 24 nt, Human
ugauuuggggcugcagguagguuu

SEQ ID NO: 128402 - RNA, 24 nt, Human
ugauuuggggcugcagguagguuu

SEQ ID NO: 128403 - RNA, 20 nt, Human
ugcaaauuucacauacagcc

SEQ ID NO: 128404 - RNA, 18 nt, Human
ugcuggccucucuggaga

SEQ ID NO: 128405 - RNA, 18 nt, Human
ugcuggccucucuggaga

SEQ ID NO: 128406 - RNA, 18 nt, Human
uggccuuggaacugcuca

SEQ ID NO: 128407 - RNA, 18 nt, Human
uggcuagcugcagcugau

SEQ ID NO: 128408 - RNA, 18 nt, Human
uggcuagcugcagcugau

SEQ ID NO: 128409 - RNA, 19 nt, Human
uggcugcacaugacgagca

SEQ ID NO: 128410 - RNA, 19 nt, Human
uggcugcacaugacgagca

SEQ ID NO: 128411 - RNA, 19 nt, Human
uggcugcacaugacgagca

SEQ ID NO: 128412 - RNA, 24 nt, Human
uggggcugcagguagguuucagug

SEQ ID NO: 128413 - RNA, 19 nt, Human
uguaauaaagccuucuugg

SEQ ID NO: 128414 - RNA, 21 nt, Human
uguaauaaagccuucuuggga

SEQ ID NO: 128415 - RNA, 24 nt, Human
uguggggcuucgaguggucaaagg

SEQ ID NO: 128416 - RNA, 19 nt, Human
uguuucacccaccacuucu

SEQ ID NO: 128417 - RNA, 18 nt, Human
uuaauaccaguauuuugc

SEQ ID NO: 128418 - RNA, 24 nt, Human
uuggacuguuugcuuagaaucugu

SEQ ID NO: 128419 - RNA, 19 nt, Human
uuuacagagaucuggagau

SEQ ID NO: 128420 - RNA, 25 nt, Human
uuuggcacgauuuugccuucuggua

SEQ ID NO: 128421 - RNA, 25 nt, Human
uuuggcacgauuuugccuucuggua

SEQ ID NO: 128422 - RNA, 22 nt, Human
uuuugcaaauuucacauacagc

SEQ ID NO: 128423 - RNA, 22 nt, Human
aaaaagaagaauggugacucau

SEQ ID NO: 128424 - RNA, 28 nt, Human
aaaaggaaaaccaagagcgggugacaag

SEQ ID NO: 128425 - RNA, 20 nt, Human
aaaaggaaauauaacagacu

SEQ ID NO: 128426 - RNA, 19 nt, Human
aagaagacuucaauaaagc

SEQ ID NO: 128427 - RNA, 21 nt, Human
aagaagacuucaauaaagcua

SEQ ID NO: 128428 - RNA, 20 nt, Human
aagagacauaaaaaaguugc

SEQ ID NO: 128429 - RNA, 18 nt, Human
acaaggcugaggagcccc

SEQ ID NO: 128430 - RNA, 19 nt, Human
agaaaaggaaaaccaagag

SEQ ID NO: 128431 - RNA, 23 nt, Human
agacaccagcuaaucuagaaaca

SEQ ID NO: 128432 - RNA, 26 nt, Human
agacuaaaucuauuuauagcaaguaa

SEQ ID NO: 128433 - RNA, 24 nt, Human
agagacauaaaaaaguuccguuuc

SEQ ID NO: 128434 - RNA, 24 nt, Human
agcaacuucccauguaacuagaua

SEQ ID NO: 128435 - RNA, 19 nt, Human
aggaggagcagaggcugug

SEQ ID NO: 128436 - RNA, 21 nt, Human
agugacaaaggcuggaaacga

SEQ ID NO: 128437 - RNA, 22 nt, Human
auaaaaacaauucccuucagau

SEQ ID NO: 128438 - RNA, 20 nt, Human
aucuauuuauagcaaguaac

SEQ ID NO: 128439 - RNA, 19 nt, Human
auggcggcaggcagcaguu

SEQ ID NO: 128440 - RNA, 25 nt, Human
caaaaaaacuacagaucauuuuuaa

SEQ ID NO: 128441 - RNA, 22 nt, Human
caaaaggaaauauaacagacua

SEQ ID NO: 128442 - RNA, 23 nt, Human
caaagacaaaaauuuauucccuu

SEQ ID NO: 128443 - RNA, 21 nt, Human
caaggcugaggagccccgaaa

SEQ ID NO: 128444 - RNA, 19 nt, Human
caaguaacuaauauuucaa

SEQ ID NO: 128445 - RNA, 23 nt, Human
cacaauguaaaaugaagacacca

SEQ ID NO: 128446 - RNA, 20 nt, Human
cacuccaacaaagacaaaaa

SEQ ID NO: 128447 - RNA, 18 nt, Human
cagcaguucccgaccggc

SEQ ID NO: 128448 - RNA, 19 nt, Human
cauagugcuuucaauuucu

SEQ ID NO: 128449 - RNA, 22 nt, Human
cauggcagaucaaaugguacug

SEQ ID NO: 128450 - RNA, 19 nt, Human
cauuuauaguaagcuggag

SEQ ID NO: 128451 - RNA, 21 nt, Human
ccuucagauucagaaugaaaa

SEQ ID NO: 128452 - RNA, 24 nt, Human
cuucuggggcugcugugagguccu

SEQ ID NO: 128453 - RNA, 22 nt, Human
gaacaguuuaagauaaaacuag

SEQ ID NO: 128454 - RNA, 18 nt, Human
gagccaaagaugaagaga

SEQ ID NO: 128455 - RNA, 19 nt, Human
gcaccaaaaaaacuacaga

SEQ ID NO: 128456 - RNA, 21 nt, Human
gcaccaaaaaaacuacagauc

SEQ ID NO: 128457 - RNA, 21 nt, Human
uaaauaaacaucuaaugaaga

SEQ ID NO: 128458 - RNA, 21 nt, Human
uaagauaaaacuagagagucu

SEQ ID NO: 128459 - RNA, 24 nt, Human
uagcauuucaaagaaaaaaguuuu

SEQ ID NO: 128460 - RNA, 21 nt, Human
uagggaagaagucacugaaag

SEQ ID NO: 128461 - RNA, 26 nt, Human
uaguuugucuuggauucuuuaaaaaa

SEQ ID NO: 128462 - RNA, 23 nt, Human
uauuugcuuuuaaacacuuaaaa

SEQ ID NO: 128463 - RNA, 24 nt, Human
ucaaaaccagcaacuucccaugua

SEQ ID NO: 128464 - RNA, 25 nt, Human
ucaaaaccagcaacuucccauguaa

SEQ ID NO: 128465 - RNA, 18 nt, Human
ucauugagaagcuuaugu

SEQ ID NO: 128466 - RNA, 22 nt, Human
ucuaggagcaaaccuccucaaa

SEQ ID NO: 128467 - RNA, 20 nt, Human
ucugaccuuucaaaauaggu

SEQ ID NO: 128468 - RNA, 25 nt, Human
ugaagacaccagcuaaucuagaaac

SEQ ID NO: 128469 - RNA, 18 nt, Human
ugaauaaacauaugaccc

SEQ ID NO: 128470 - RNA, 19 nt, Human
ugaauaaacauaugaccca

SEQ ID NO: 128471 - RNA, 25 nt, Human
ugcucugcucauacagcuacuuuca

SEQ ID NO: 128472 - RNA, 23 nt, Human
uguaaaaugaagacaccagcuaa

SEQ ID NO: 128473 - RNA, 21 nt, Human
uguaauaaagcccucuuggga

SEQ ID NO: 128474 - RNA, 19 nt, Human
ugugucagaauguuauagc

SEQ ID NO: 128475 - RNA, 19 nt, Human
uguuugucacaauguaaaa

SEQ ID NO: 128476 - RNA, 22 nt, Human
uuaaauggacaaauucauagug

SEQ ID NO: 128477 - RNA, 18 nt, Human
uuaguuauccuaauuacu

SEQ ID NO: 128478 - RNA, 25 nt, Human
uucuaaauaaacaucuaaugaagaa

SEQ ID NO: 128479 - RNA, 24 nt, Human
uucugagguguaauaaagcccucu

SEQ ID NO: 128480 - RNA, 20 nt, Human
uucuggggcugcugugaggu

SEQ ID NO: 128481 - RNA, 23 nt, Human
uuuacaaaaaagaagaaugguga

SEQ ID NO: 128482 - RNA, 24 nt, Human
uuucugagguguaauaaagcccuc

SEQ ID NO: 128483 - RNA, 22 nt, Human
uuugcacaauuugacauacagc

SEQ ID NO: 128484 - RNA, 23 nt, Human
uuuuaaaaauuuugcuuuugugg

SEQ ID NO: 128485 - RNA, 22 nt, Human
aauacagcaccugaggccuaag

SEQ ID NO: 128486 - RNA, 23 nt, Human
aauacagcaccugaggccuaaga

SEQ ID NO: 128487 - RNA, 23 nt, Human
acaaaaggcugagacccuucuuc

SEQ ID NO: 128488 - RNA, 18 nt, Human
acaacaacaggaaaaguc

SEQ ID NO: 128489 - RNA, 22 nt, Human
acauuuuacaaauuuuuguggg

SEQ ID NO: 128490 - RNA, 19 nt, Human
acuacucccucugccuccc

SEQ ID NO: 128491 - RNA, 20 nt, Human
acucccucugccucccggcu

SEQ ID NO: 128492 - RNA, 23 nt, Human
caaaaggcugagacccuucuuca

SEQ ID NO: 128493 - RNA, 23 nt, Human
caaaaggcugagacccuucuuca

SEQ ID NO: 128494 - RNA, 20 nt, Human
caacaacaggaaaaguccau

SEQ ID NO: 128495 - RNA, 20 nt, Human
cacggcgcggggacugcagg

SEQ ID NO: 128496 - RNA, 22 nt, Human
cacggcgcggggacugcaggcg

SEQ ID NO: 128497 - RNA, 21 nt, Human
cacuacucccucugccucccg

SEQ ID NO: 128498 - RNA, 18 nt, Human
caggaaaaguccauggca

SEQ ID NO: 128499 - RNA, 18 nt, Human
cauggcaaggagucccgg

SEQ ID NO: 128500 - RNA, 29 nt, Human
ccggaaggcggucacuacucccucugccc

SEQ ID NO: 128501 - RNA, 19 nt, Human
cggcucggugggaacuugg

SEQ ID NO: 128502 - RNA, 19 nt, Human
cggcucucucgcucucgcu

SEQ ID NO: 128503 - RNA, 22 nt, Human
cuccaaaaaggaaaaauggcag

SEQ ID NO: 128504 - RNA, 22 nt, Human
cucccucaaugcuccacaaaag

SEQ ID NO: 128505 - RNA, 18 nt, Human
cucgccugcgcucuccuc

SEQ ID NO: 128506 - RNA, 20 nt, Human
cucgccugcgcucuccuccu

SEQ ID NO: 128507 - RNA, 20 nt, Human
cucgcucgcucucucccucu

SEQ ID NO: 128508 - RNA, 21 nt, Human
cuggucccgaggacaggcaug

SEQ ID NO: 128509 - RNA, 23 nt, Human
cuuuacaauucauugcauaugcu

SEQ ID NO: 128510 - RNA, 23 nt, Human
gagcccugcguccagcucgcauu

SEQ ID NO: 128511 - RNA, 20 nt, Human
gccucccggcucucucgcuc

SEQ ID NO: 128512 - RNA, 23 nt, Human
gcgcggggacugcaggcgugggg

SEQ ID NO: 128513 - RNA, 18 nt, Human
gcucgcucucucccucuc

SEQ ID NO: 128514 - RNA, 23 nt, Human
ggcacggcgcggggacugcaggc

SEQ ID NO: 128515 - RNA, 23 nt, Human
gggguaccuggcuccuagcagcc

SEQ ID NO: 128516 - RNA, 26 nt, Human
uaacaaacaugcccaacgcuuuuaua

SEQ ID NO: 128517 - RNA, 20 nt, Human
uacagcaccugaggccuaag

SEQ ID NO: 128518 - RNA, 19 nt, Human
uaccuggcuccuagcagcc

SEQ ID NO: 128519 - RNA, 21 nt, Human
uagaaauaacaaacaugccca

SEQ ID NO: 128520 - RNA, 20 nt, Human
uaucuauguccauuuccucc

SEQ ID NO: 128521 - RNA, 23 nt, Human
ucacuacucccucugccucccgg

SEQ ID NO: 128522 - RNA, 19 nt, Human
ucccggcucucucgcucuc

SEQ ID NO: 128523 - RNA, 19 nt, Human
ucccucugccucccggcuc

SEQ ID NO: 128524 - RNA, 18 nt, Human
uccgggcacggcgcgggg

SEQ ID NO: 128525 - RNA, 24 nt, Human
uccuggagucaauguccgucuuug

SEQ ID NO: 128526 - RNA, 25 nt, Human
ucgcucgcucucucccucucucgcg

SEQ ID NO: 128527 - RNA, 22 nt, Human
ugaagauuuuccuccuuuucuu

SEQ ID NO: 128528 - RNA, 22 nt, Human
ugacagagugaguauagaaaua

SEQ ID NO: 128529 - RNA, 21 nt, Human
ugcuuucucccuucuccccca

SEQ ID NO: 128530 - RNA, 19 nt, Human
uggcucauacucagccgua

SEQ ID NO: 128531 - RNA, 23 nt, Human
ugggaacuugggagagcccugcg

SEQ ID NO: 128532 - RNA, 24 nt, Human
ugggaacuugggagagcccugcgu

SEQ ID NO: 128533 - RNA, 21 nt, Human
uugcagccgugggguccggga

SEQ ID NO: 128534 - RNA, 25 nt, Human
uugcauaugcuuucucccuucuccc

SEQ ID NO: 128535 - RNA, 18 nt, Human
aaauggcccgcccaaggc

SEQ ID NO: 128536 - RNA, 19 nt, Human
aagcacagcccugacucca

SEQ ID NO: 128537 - RNA, 26 nt, Human
acagugccggugugagcccacaggga

SEQ ID NO: 128538 - RNA, 19 nt, Human
agcagcggggcgggggcgg

SEQ ID NO: 128539 - RNA, 22 nt, Human
agcauggugccugucccagaag

SEQ ID NO: 128540 - RNA, 19 nt, Human
agccacucagcagggaaau

SEQ ID NO: 128541 - RNA, 19 nt, Human
agcggggcgggggcggggg

SEQ ID NO: 128542 - RNA, 19 nt, Human
aggcaggggcguggucugg

SEQ ID NO: 128543 - RNA, 24 nt, Human
aggggacccugggggaagaaggcu

SEQ ID NO: 128544 - RNA, 21 nt, Human
caacagggcacccacacccuc

SEQ ID NO: 128545 - RNA, 20 nt, Human
caccccacguggaaccggcg

SEQ ID NO: 128546 - RNA, 19 nt, Human
cacccgcacccgcugcaca

SEQ ID NO: 128547 - RNA, 19 nt, Human
cagggacagcauggaggag

SEQ ID NO: 128548 - RNA, 27 nt, Human
ccacacccucucagccaugcaggggac

SEQ ID NO: 128549 - RNA, 21 nt, Human
cccagaagccccgcuggaucu

SEQ ID NO: 128550 - RNA, 20 nt, Human
ccgcugcacaccgggagcag

SEQ ID NO: 128551 - RNA, 25 nt, Human
ccgcugcacaccgggagcagcgggg

SEQ ID NO: 128552 - RNA, 20 nt, Human
cgccucgucuuuuggugaua

SEQ ID NO: 128553 - RNA, 19 nt, Human
cgggagcagcggggcgggg

SEQ ID NO: 128554 - RNA, 19 nt, Human
cggggcgggggcgggggcg

SEQ ID NO: 128555 - RNA, 25 nt, Human
cuggccccaccggcagagaagcaag

SEQ ID NO: 128556 - RNA, 18 nt, Human
cuggccccuucauccugg

SEQ ID NO: 128557 - RNA, 20 nt, Human
cuggccccuucauccugggc

SEQ ID NO: 128558 - RNA, 18 nt, Human
cugguccugccuccgucg

SEQ ID NO: 128559 - RNA, 24 nt, Human
gaaccacgcggaaagcacagcccu

SEQ ID NO: 128560 - RNA, 21 nt, Human
gaaccggcgcccagaagcccc

SEQ ID NO: 128561 - RNA, 18 nt, Human
gagcagcggggcgggggc

SEQ ID NO: 128562 - RNA, 19 nt, Human
gaggagggggaggaguagg

SEQ ID NO: 128563 - RNA, 20 nt, Human
gcacccgcacccgcugcaca

SEQ ID NO: 128564 - RNA, 19 nt, Human
gcccagaagccccgcugga

SEQ ID NO: 128565 - RNA, 21 nt, Human
gcccugacuccaccccggucu

SEQ ID NO: 128566 - RNA, 21 nt, Human
ggaacagggcuggcggagggc

SEQ ID NO: 128567 - RNA, 21 nt, Human
gggagcagcggggcgggggcg

SEQ ID NO: 128568 - RNA, 19 nt, Human
ggggcgggggcguucccgg

SEQ ID NO: 128569 - RNA, 22 nt, Human
ggugauaguuguugucagggcu

SEQ ID NO: 128570 - RNA, 19 nt, Human
guucagcgcuggccccacc

SEQ ID NO: 128571 - RNA, 23 nt, Human
uaagcggcacccgcacccgcugc

SEQ ID NO: 128572 - RNA, 18 nt, Human
ucccggugauuccacacc

SEQ ID NO: 128573 - RNA, 21 nt, Human
ucccuuuaggugggcgaaaau

SEQ ID NO: 128574 - RNA, 26 nt, Human
ucucuaacuagcuaaaugccuggucc

SEQ ID NO: 128575 - RNA, 19 nt, Human
ugaaauggcccgcccaagg

SEQ ID NO: 128576 - RNA, 20 nt, Human
uggaggagggggaggaguag

SEQ ID NO: 128577 - RNA, 19 nt, Human
uggcagaaccacgcggaaa

SEQ ID NO: 128578 - RNA, 21 nt, Human
uggcccagcgacugagggcgg

SEQ ID NO: 128579 - RNA, 22 nt, Human
uggcccagcgacugagggcggg

SEQ ID NO: 128580 - RNA, 22 nt, Human
ugggggaagaaggcuggauugg

SEQ ID NO: 128581 - RNA, 22 nt, Human
ugugcaggcugucccugcacug

SEQ ID NO: 128582 - RNA, 19 nt, Human
uguuccauggggaucgucg

SEQ ID NO: 128583 - RNA, 22 nt, Human
uuccauggggaucgucgcagaa

SEQ ID NO: 128584 - RNA, 19 nt, Human
uuuacagaugagaaaagug

SEQ ID NO: 128585 - RNA, 21 nt, Human
uuuaggugggcgaaaauaucu

SEQ ID NO: 128586 - RNA, 19 nt, Human
acauggcacaguaaccaaa

SEQ ID NO: 128587 - RNA, 21 nt, Human
agccguauggugagcagccuu

SEQ ID NO: 128588 - RNA, 18 nt, Human
aguaaccaaauccagucu

SEQ ID NO: 128589 - RNA, 19 nt, Human
gccguauggugagcagccu

SEQ ID NO: 128590 - RNA, 25 nt, Human
uagaaaaaaacaaggcauugucuca

SEQ ID NO: 128591 - RNA, 18 nt, Human
uaggauaaacacauggca

SEQ ID NO: 128592 - RNA, 24 nt, Human
uaggauaaacacauggcacaguaa

SEQ ID NO: 128593 - RNA, 21 nt, Human
uccacgguauuagaaaaaaac

SEQ ID NO: 128594 - RNA, 19 nt, Human
ugagcagccuugaguagcu

SEQ ID NO: 128595 - RNA, 20 nt, Human
ugaguagcugguuuaacugg

SEQ ID NO: 128596 - RNA, 24 nt, Human
uuagagccguauggugagcagccu

SEQ ID NO: 128597 - RNA, 23 nt, Human
uucagauaaaaacuacucaagga

SEQ ID NO: 128598 - RNA, 23 nt, Human
aaaaaaaacaguuacuaaacgug

SEQ ID NO: 128599 - RNA, 24 nt, Human
aaaaaggaacccaagcaaagagga

SEQ ID NO: 128600 - RNA, 21 nt, Human
aaaagaagggcggggaggggg

SEQ ID NO: 128601 - RNA, 25 nt, Human
aaacauaaaacuaggaaaagaggug

SEQ ID NO: 128602 - RNA, 18 nt, Human
aaacuaggaaaagaggug

SEQ ID NO: 128603 - RNA, 20 nt, Human
aaagagaaaagcuguaaaag

SEQ ID NO: 128604 - RNA, 20 nt, Human
aacauccuuccaccucacuc

SEQ ID NO: 128605 - RNA, 18 nt, Human
aaccugggaccugcccgg

SEQ ID NO: 128606 - RNA, 20 nt, Human
aaccugggaccugcccggca

SEQ ID NO: 128607 - RNA, 19 nt, Human
aagaagaaccuguucccau

SEQ ID NO: 128608 - RNA, 19 nt, Human
aagaggaaggaguugggga

SEQ ID NO: 128609 - RNA, 19 nt, Human
aagccagucaacuguacaa

SEQ ID NO: 128610 - RNA, 27 nt, Human
aaggaacccaagcaaagaggaaggagu

SEQ ID NO: 128611 - RNA, 20 nt, Human
aaggugcccuuggccgcccc

SEQ ID NO: 128612 - RNA, 20 nt, Human
aaguccccagccagggccgg

SEQ ID NO: 128613 - RNA, 20 nt, Human
acagacaugagcacgacccg

SEQ ID NO: 128614 - RNA, 20 nt, Human
acagcgucucaacuaccaac

SEQ ID NO: 128615 - RNA, 21 nt, Human
acaucgggaccccgcgccucc

SEQ ID NO: 128616 - RNA, 18 nt, Human
accccgcgccuccgggcc

SEQ ID NO: 128617 - RNA, 23 nt, Human
accugaaccgcgccuagggccuc

SEQ ID NO: 128618 - RNA, 18 nt, Human
acgcgcggacggacgggc

SEQ ID NO: 128619 - RNA, 23 nt, Human
acuccgagaggccccccgguggg

SEQ ID NO: 128620 - RNA, 18 nt, Human
agaagggcggggaggggg

SEQ ID NO: 128621 - RNA, 18 nt, Human
agaagggcggggaggggg

SEQ ID NO: 128622 - RNA, 26 nt, Human
agacaggaaggggucaaaagggaccc

SEQ ID NO: 128623 - RNA, 23 nt, Human
agagcuccccccacgccaggccc

SEQ ID NO: 128624 - RNA, 18 nt, Human
agaggaaggaguugggga

SEQ ID NO: 128625 - RNA, 24 nt, Human
agaggaaggaguuggggaggggcc

SEQ ID NO: 128626 - RNA, 23 nt, Human
agcagggaggacuaagagcuaca

SEQ ID NO: 128627 - RNA, 18 nt, Human
agcccgcuccgcuccucc

SEQ ID NO: 128628 - RNA, 18 nt, Human
aggaaggaguuggggagg

SEQ ID NO: 128629 - RNA, 18 nt, Human
aggaaggaguuggggagg

SEQ ID NO: 128630 - RNA, 19 nt, Human
aggaaggaguuggggaggg

SEQ ID NO: 128631 - RNA, 20 nt, Human
aggaggagggagggaaagag

SEQ ID NO: 128632 - RNA, 21 nt, Human
aggcacggcgggccgucuggc

SEQ ID NO: 128633 - RNA, 19 nt, Human
aggccuccaacccggccag

SEQ ID NO: 128634 - RNA, 19 nt, Human
agggaaggagggguggaau

SEQ ID NO: 128635 - RNA, 23 nt, Human
agggcggggagggggucccaggg

SEQ ID NO: 128636 - RNA, 18 nt, Human
aggggccccagcugggcc

SEQ ID NO: 128637 - RNA, 20 nt, Human
agugggugccaggcggagcu

SEQ ID NO: 128638 - RNA, 21 nt, Human
auccucuccuccagaagcccc

SEQ ID NO: 128639 - RNA, 18 nt, Human
caacgagaggaaagccag

SEQ ID NO: 128640 - RNA, 23 nt, Human
caacuuuuuaaaaaaagagaaaa

SEQ ID NO: 128641 - RNA, 24 nt, Human
caacuuuuuaaaaaaagagaaaag

SEQ ID NO: 128642 - RNA, 26 nt, Human
caaguccccagccagggccggaaucc

SEQ ID NO: 128643 - RNA, 20 nt, Human
caccucacuccagcccaggu

SEQ ID NO: 128644 - RNA, 23 nt, Human
cacuccagcccagguuucggggg

SEQ ID NO: 128645 - RNA, 25 nt, Human
cagaguccccaccuggcugcccucc

SEQ ID NO: 128646 - RNA, 20 nt, Human
cagcccaagcggggucccuc

SEQ ID NO: 128647 - RNA, 21 nt, Human
caggccccaagcagggugagg

SEQ ID NO: 128648 - RNA, 21 nt, Human
caggucagaguccccaccugg

SEQ ID NO: 128649 - RNA, 19 nt, Human
caggugggcggccuuggca

SEQ ID NO: 128650 - RNA, 28 nt, Human
cagugugcgggugaggccagcccaagcg

SEQ ID NO: 128651 - RNA, 23 nt, Human
caguuacuaaacgugaaaaagga

SEQ ID NO: 128652 - RNA, 23 nt, Human
ccaaaaaaaaaaaaaaaaaaaaa

SEQ ID NO: 128653 - RNA, 25 nt, Human
ccaagcggggucccucagaccugcc

SEQ ID NO: 128654 - RNA, 20 nt, Human
ccacaucgggaccccgcgcc

SEQ ID NO: 128655 - RNA, 22 nt, Human
ccagccagggccggaauccgga

SEQ ID NO: 128656 - RNA, 19 nt, Human
ccagggccggaauccggag

SEQ ID NO: 128657 - RNA, 22 nt, Human
ccauccauagcccugaccugaa

SEQ ID NO: 128658 - RNA, 19 nt, Human
cccacgccaggccccaagc

SEQ ID NO: 128659 - RNA, 19 nt, Human
ccccaccuggcugcccucc

SEQ ID NO: 128660 - RNA, 21 nt, Human
ccccagcugggccugcuacuu

SEQ ID NO: 128661 - RNA, 22 nt, Human
ccccagcugggccugcuacuuc

SEQ ID NO: 128662 - RNA, 18 nt, Human
ccccaggucagagucccc

SEQ ID NO: 128663 - RNA, 22 nt, Human
ccccccacgccaggccccaagc

SEQ ID NO: 128664 - RNA, 22 nt, Human
ccccgccccguccccgcccgga

SEQ ID NO: 128665 - RNA, 19 nt, Human
ccccgcccggaccucgccc

SEQ ID NO: 128666 - RNA, 24 nt, Human
ccccgcgccuccgggccgcguccg

SEQ ID NO: 128667 - RNA, 19 nt, Human
ccccgggccccacaucggg

SEQ ID NO: 128668 - RNA, 24 nt, Human
ccccgggccccacaucgggacccc

SEQ ID NO: 128669 - RNA, 21 nt, Human
ccccugggccccauccauagc

SEQ ID NO: 128670 - RNA, 18 nt, Human
cccgccccguccccgccc

SEQ ID NO: 128671 - RNA, 21 nt, Human
cccgcccggaccucgcccgcu

SEQ ID NO: 128672 - RNA, 21 nt, Human
cccgugcacaccugucccccg

SEQ ID NO: 128673 - RNA, 20 nt, Human
cccugggccccauccauagc

SEQ ID NO: 128674 - RNA, 22 nt, Human
cccugggccccauccauagccc

SEQ ID NO: 128675 - RNA, 23 nt, Human
cccugggccccauccauagcccu

SEQ ID NO: 128676 - RNA, 21 nt, Human
ccgccccguccccgcccggac

SEQ ID NO: 128677 - RNA, 23 nt, Human
ccgccccgugcacaccugucccc

SEQ ID NO: 128678 - RNA, 18 nt, Human
ccgccgccgccucggagc

SEQ ID NO: 128679 - RNA, 22 nt, Human
ccgcgccuagggccuccaaccu

SEQ ID NO: 128680 - RNA, 22 nt, Human
ccgcgccuccgggccgcguccg

SEQ ID NO: 128681 - RNA, 20 nt, Human
ccuagggccuccaaccuggg

SEQ ID NO: 128682 - RNA, 20 nt, Human
ccuccagaagcccccagguc

SEQ ID NO: 128683 - RNA, 22 nt, Human
ccucccagugugcgggugaggc

SEQ ID NO: 128684 - RNA, 20 nt, Human
ccucgcuuuccuuugugcug

SEQ ID NO: 128685 - RNA, 20 nt, Human
ccuggacagagaauacaaag

SEQ ID NO: 128686 - RNA, 22 nt, Human
ccuggcccccagcccgcuccgc

SEQ ID NO: 128687 - RNA, 20 nt, Human
cgagccgagcgacgcagcgg

SEQ ID NO: 128688 - RNA, 20 nt, Human
cgccucggagccucugcagc

SEQ ID NO: 128689 - RNA, 21 nt, Human
cggaauccggagugggugccg

SEQ ID NO: 128690 - RNA, 18 nt, Human
cggccccgggccccacau

SEQ ID NO: 128691 - RNA, 19 nt, Human
cggcgguaagggagucacu

SEQ ID NO: 128692 - RNA, 25 nt, Human
cgggcggacggaggaggagggaggg

SEQ ID NO: 128693 - RNA, 19 nt, Human
cgguccccgccccgucccc

SEQ ID NO: 128694 - RNA, 22 nt, Human
cggugggcggggcgcccuggcc

SEQ ID NO: 128695 - RNA, 22 nt, Human
cuccccccacgccaggccccaa

SEQ ID NO: 128696 - RNA, 18 nt, Human
cugccuccuccgcgaccc

SEQ ID NO: 128697 - RNA, 20 nt, Human
cuggaccagggaaggagggg

SEQ ID NO: 128698 - RNA, 24 nt, Human
cugggccccauccauagcccugac

SEQ ID NO: 128699 - RNA, 19 nt, Human
cuucgggccggaccgggcc

SEQ ID NO: 128700 - RNA, 22 nt, Human
cuuugccucaguuuccucaaga

SEQ ID NO: 128701 - RNA, 20 nt, Human
cuuugugcuguggccgggcc

SEQ ID NO: 128702 - RNA, 25 nt, Human
gaaaaaggaacccaagcaaagagga

SEQ ID NO: 128703 - RNA, 21 nt, Human
gaacggacagacgcgcggacg

SEQ ID NO: 128704 - RNA, 22 nt, Human
gaccugcccuccucuuugccuc

SEQ ID NO: 128705 - RNA, 21 nt, Human
gagaaaagcuguaaaagucag

SEQ ID NO: 128706 - RNA, 24 nt, Human
gagcagggaggacuaagagcuaca

SEQ ID NO: 128707 - RNA, 18 nt, Human
gaggaaggaguuggggag

SEQ ID NO: 128708 - RNA, 19 nt, Human
gaggaaggaguuggggagg

SEQ ID NO: 128709 - RNA, 19 nt, Human
gagggaaagagggagucgc

SEQ ID NO: 128710 - RNA, 20 nt, Human
gagucgccgccgccgccucg

SEQ ID NO: 128711 - RNA, 22 nt, Human
gccauguggcagcaaacauccu

SEQ ID NO: 128712 - RNA, 24 nt, Human
gccccaagcagggugaggccucca

SEQ ID NO: 128713 - RNA, 18 nt, Human
gccccagcugggccugcu

SEQ ID NO: 128714 - RNA, 21 nt, Human
gcccccaggucagagucccca

SEQ ID NO: 128715 - RNA, 24 nt, Human
gccccgggccccacaucgggaccc

SEQ ID NO: 128716 - RNA, 18 nt, Human
gcccuggacagagaauac

SEQ ID NO: 128717 - RNA, 19 nt, Human
gccucggagccucugcagc

SEQ ID NO: 128718 - RNA, 18 nt, Human
gcuuuccuuugugcugug

SEQ ID NO: 128719 - RNA, 21 nt, Human
ggaccgggccgaacggacaga

SEQ ID NO: 128720 - RNA, 20 nt, Human
ggaggaggagggagggaaag

SEQ ID NO: 128721 - RNA, 22 nt, Human
ggaggagggagggaaagaggga

SEQ ID NO: 128722 - RNA, 21 nt, Human
ggccacgcggccccgggcccc

SEQ ID NO: 128723 - RNA, 19 nt, Human
ggccccagcugggccugcu

SEQ ID NO: 128724 - RNA, 22 nt, Human
ggccuuggcaaggguagccuag

SEQ ID NO: 128725 - RNA, 20 nt, Human
gggcggggagggggucccag

SEQ ID NO: 128726 - RNA, 21 nt, Human
gggcugagccgggcaggcugc

SEQ ID NO: 128727 - RNA, 20 nt, Human
ggggagggcggcccacuccg

SEQ ID NO: 128728 - RNA, 20 nt, Human
gggguagggugggggauggg

SEQ ID NO: 128729 - RNA, 21 nt, Human
gggugccaggcggagcugcug

SEQ ID NO: 128730 - RNA, 19 nt, Human
gguagggaagcggccaagu

SEQ ID NO: 128731 - RNA, 20 nt, Human
gucccucagaccugcccucc

SEQ ID NO: 128732 - RNA, 27 nt, Human
gugcuuuccaaaaaaaaaaaaaaaaaa

SEQ ID NO: 128733 - RNA, 22 nt, Human
guuggggaggggccaccaaagc

SEQ ID NO: 128734 - RNA, 22 nt, Human
uaaaaaaagagaaaagcuguaa

SEQ ID NO: 128735 - RNA, 18 nt, Human
uaagagcuacaaucugga

SEQ ID NO: 128736 - RNA, 22 nt, Human
uacaaagugauauuuucccaag

SEQ ID NO: 128737 - RNA, 19 nt, Human
uagcucgguccccgccccg

SEQ ID NO: 128738 - RNA, 18 nt, Human
uaggaaaagagguggggg

SEQ ID NO: 128739 - RNA, 25 nt, Human
uagggugggggaugggcucccgcag

SEQ ID NO: 128740 - RNA, 18 nt, Human
ucaggcccuguggguagg

SEQ ID NO: 128741 - RNA, 20 nt, Human
ucauccucuccuccagaagc

SEQ ID NO: 128742 - RNA, 23 nt, Human
uccaaaaaaaaaaaaaaaaaaaa

SEQ ID NO: 128743 - RNA, 18 nt, Human
ucccaccagagcuccccc

SEQ ID NO: 128744 - RNA, 21 nt, Human
ucccaccagagcuccccccac

SEQ ID NO: 128745 - RNA, 19 nt, Human
uccccccacgccaggcccc

SEQ ID NO: 128746 - RNA, 19 nt, Human
ucccucagaccugcccucc

SEQ ID NO: 128747 - RNA, 22 nt, Human
uccgcuagcucgguccccgccc

SEQ ID NO: 128748 - RNA, 19 nt, Human
uccgcuccucccccgcccu

SEQ ID NO: 128749 - RNA, 25 nt, Human
uccuccagaagcccccaggucagag

SEQ ID NO: 128750 - RNA, 19 nt, Human
uccuuccaccucacuccag

SEQ ID NO: 128751 - RNA, 23 nt, Human
ugaaaaaggaacccaagcaaaga

SEQ ID NO: 128752 - RNA, 18 nt, Human
ugaagcccuggacagaga

SEQ ID NO: 128753 - RNA, 20 nt, Human
ugaagcccuggacagagaau

SEQ ID NO: 128754 - RNA, 19 nt, Human
ugagcacgacccguuacag

SEQ ID NO: 128755 - RNA, 21 nt, Human
ugcaaaauaucugaagcccug

SEQ ID NO: 128756 - RNA, 23 nt, Human
ugcaggugggcggccuuggcaag

SEQ ID NO: 128757 - RNA, 18 nt, Human
ugccagcagggagaggag

SEQ ID NO: 128758 - RNA, 20 nt, Human
uggccagaggcugaugcagg

SEQ ID NO: 128759 - RNA, 21 nt, Human
uggccagaggcugaugcaggu

SEQ ID NO: 128760 - RNA, 24 nt, Human
uggcccccagcccgcuccgcuccu

SEQ ID NO: 128761 - RNA, 19 nt, Human
uggcgaaggugcccuuggc

SEQ ID NO: 128762 - RNA, 19 nt, Human
ugggaccugcccggcagga

SEQ ID NO: 128763 - RNA, 21 nt, Human
ugggcaccuucccccugccuc

SEQ ID NO: 128764 - RNA, 19 nt, Human
ugggccagacaggaagggg

SEQ ID NO: 128765 - RNA, 21 nt, Human
ugggggacauuuucccaccag

SEQ ID NO: 128766 - RNA, 22 nt, Human
uguggccgggccgggcugagcc

SEQ ID NO: 128767 - RNA, 21 nt, Human
uuaaaaaaagagaaaagcugu

SEQ ID NO: 128768 - RNA, 23 nt, Human
uuccucaagaagaaccuguuccc

SEQ ID NO: 128769 - RNA, 19 nt, Human
uuucggggggagggcggcc

SEQ ID NO: 128770 - RNA, 27 nt, Human
aaccacaguaucagaaccugcaaaucu

SEQ ID NO: 128771 - RNA, 23 nt, Human
acagagaacccuccccgcccccg

SEQ ID NO: 128772 - RNA, 24 nt, Human
acuccagugguuuggacgaguguc

SEQ ID NO: 128773 - RNA, 20 nt, Human
agaacccuccccgcccccgc

SEQ ID NO: 128774 - RNA, 20 nt, Human
agagaacccuccccgccccc

SEQ ID NO: 128775 - RNA, 22 nt, Human
aggcgaagggcuggcugcgauc

SEQ ID NO: 128776 - RNA, 19 nt, Human
aggcggugggaggauaggg

SEQ ID NO: 128777 - RNA, 21 nt, Human
cacaguaucagaaccugcaaa

SEQ ID NO: 128778 - RNA, 23 nt, Human
caccugccccaggcucacggguu

SEQ ID NO: 128779 - RNA, 21 nt, Human
cccuccccgcccccgcaagag

SEQ ID NO: 128780 - RNA, 23 nt, Human
ccuggcaccugccccaggcucac

SEQ ID NO: 128781 - RNA, 24 nt, Human
ccuggcaccugccccaggcucacc

SEQ ID NO: 128782 - RNA, 22 nt, Human
cgccugccagguggggaugugg

SEQ ID NO: 128783 - RNA, 20 nt, Human
cucgaaccacaguaucagaa

SEQ ID NO: 128784 - RNA, 24 nt, Human
ggaggauagggucccugacgugcc

SEQ ID NO: 128785 - RNA, 22 nt, Human
ggaggcggugggaggauagggu

SEQ ID NO: 128786 - RNA, 19 nt, Human
ucccuggggcacccagcug

SEQ ID NO: 128787 - RNA, 19 nt, Human
ucgaaccacaguaucagaa

SEQ ID NO: 128788 - RNA, 18 nt, Human
uggagaggcgaagggcug

SEQ ID NO: 128789 - RNA, 19 nt, Human
uggagaggcgaagggcugg

SEQ ID NO: 128790 - RNA, 24 nt, Human
aaaacuguagagaugggguuucac

SEQ ID NO: 128791 - RNA, 27 nt, Human
aaaacuguagagaugggguuucaccau

SEQ ID NO: 128792 - RNA, 28 nt, Human
aaaacuguagagaugggguuucaccaug

SEQ ID NO: 128793 - RNA, 22 nt, Human
aaaaggaaguagacuucucaaa

SEQ ID NO: 128794 - RNA, 23 nt, Human
aaacaaacaccuuuaauagacug

SEQ ID NO: 128795 - RNA, 18 nt, Human
aaagugcuggauuacagg

SEQ ID NO: 128796 - RNA, 23 nt, Human
aaagugcuggauuacaggcguga

SEQ ID NO: 128797 - RNA, 24 nt, Human
aaagugcugggauuacaggcguga

SEQ ID NO: 128798 - RNA, 20 nt, Human
aacaaacaccuuuaauagac

SEQ ID NO: 128799 - RNA, 25 nt, Human
aagcaauucuccugccucagccucc

SEQ ID NO: 128800 - RNA, 25 nt, Human
aagcgauucuccugccucagccucc

SEQ ID NO: 128801 - RNA, 20 nt, Human
aaguagcugggacuacaggc

SEQ ID NO: 128802 - RNA, 24 nt, Human
aaguagcugggacuacaggccugu

SEQ ID NO: 128803 - RNA, 25 nt, Human
aaguagcugggacuacaggccugug

SEQ ID NO: 128804 - RNA, 19 nt, Human
aagugcugggauuacaggc

SEQ ID NO: 128805 - RNA, 19 nt, Human
aagugcugggauuacaggc

SEQ ID NO: 128806 - RNA, 26 nt, Human
aagugcugggauuacaggcgugagcc

SEQ ID NO: 128807 - RNA, 20 nt, Human
aauauuagaaacaacaugga

SEQ ID NO: 128808 - RNA, 18 nt, Human
aauuuuguuaaucuugcc

SEQ ID NO: 128809 - RNA, 31 nt, Human
acaaaacuguagagaugggguuucaccaugg

SEQ ID NO: 128810 - RNA, 18 nt, Human
acaaaacuucacuuaaac

SEQ ID NO: 128811 - RNA, 19 nt, Human
acagagcaagaauauacuc

SEQ ID NO: 128812 - RNA, 21 nt, Human
accaugcccggccuaauuuug

SEQ ID NO: 128813 - RNA, 18 nt, Human
accauguuggccaggcug

SEQ ID NO: 128814 - RNA, 24 nt, Human
accauguuggccaggguggucucg

SEQ ID NO: 128815 - RNA, 23 nt, Human
acccaggcuggagugcaguggug

SEQ ID NO: 128816 - RNA, 22 nt, Human
accuccaccucuugggcucaag

SEQ ID NO: 128817 - RNA, 25 nt, Human
acuauauccauuuuaaacaaacacc

SEQ ID NO: 128818 - RNA, 25 nt, Human
acuauguugcccaggcuggucucaa

SEQ ID NO: 128819 - RNA, 25 nt, Human
acucugucacccauacuggaggaua

SEQ ID NO: 128820 - RNA, 24 nt, Human
agaaaauaccaaagcauuaccagu

SEQ ID NO: 128821 - RNA, 24 nt, Human
agcgauucuccugccucagccucc

SEQ ID NO: 128822 - RNA, 18 nt, Human
aggagaaccauuacacca

SEQ ID NO: 128823 - RNA, 25 nt, Human
aggcuggagugcaguggugugaucu

SEQ ID NO: 128824 - RNA, 24 nt, Human
agguagaggccagguuucaccaug

SEQ ID NO: 128825 - RNA, 21 nt, Human
aggugaaggucuuccccaaga

SEQ ID NO: 128826 - RNA, 22 nt, Human
agguuucaccauguuggccagg

SEQ ID NO: 128827 - RNA, 18 nt, Human
aguagcugggacuauagg

SEQ ID NO: 128828 - RNA, 25 nt, Human
aguagcugggacuauaggugcacac

SEQ ID NO: 128829 - RNA, 18 nt, Human
agugcaguggugugaucu

SEQ ID NO: 128830 - RNA, 19 nt, Human
agugcaguggugugaucuc

SEQ ID NO: 128831 - RNA, 19 nt, Human
agugcaguggugugaucuc

SEQ ID NO: 128832 - RNA, 24 nt, Human
agugcaguggugugaucucugcuc

SEQ ID NO: 128833 - RNA, 18 nt, Human
agugcugggauuacaggc

SEQ ID NO: 128834 - RNA, 18 nt, Human
auaaaaugugacagcccc

SEQ ID NO: 128835 - RNA, 25 nt, Human
auauuagaaacaacauggauuuccg

SEQ ID NO: 128836 - RNA, 22 nt, Human
augggguuucaccauguuggcc

SEQ ID NO: 128837 - RNA, 23 nt, Human
augggguuucaccauguuggcca

SEQ ID NO: 128838 - RNA, 24 nt, Human
augggguuucaccauguuggccag

SEQ ID NO: 128839 - RNA, 25 nt, Human
auuaaaacaaccuuuuuucugucac

SEQ ID NO: 128840 - RNA, 21 nt, Human
auucuccugccucagccuccc

SEQ ID NO: 128841 - RNA, 18 nt, Human
auugugccuuagauccuu

SEQ ID NO: 128842 - RNA, 23 nt, Human
caaagugcuggauuacaggcgug

SEQ ID NO: 128843 - RNA, 24 nt, Human
caaagugcugggauuacaggcgug

SEQ ID NO: 128844 - RNA, 25 nt, Human
caaauugaaauguuggauacauuca

SEQ ID NO: 128845 - RNA, 23 nt, Human
caaccuccaccucccagguucaa

SEQ ID NO: 128846 - RNA, 22 nt, Human
caagcaauucuccugccucagc

SEQ ID NO: 128847 - RNA, 22 nt, Human
caagcgauucuccugccucagc

SEQ ID NO: 128848 - RNA, 21 nt, Human
caagucaucacaccuggcuga

SEQ ID NO: 128849 - RNA, 22 nt, Human
caagugauccuccugcuucagc

SEQ ID NO: 128850 - RNA, 27 nt, Human
caagugauccuccugcuucagccuccc

SEQ ID NO: 128851 - RNA, 24 nt, Human
caccaggcccagguaauuuuugua

SEQ ID NO: 128852 - RNA, 21 nt, Human
caccauguuggccaggcuggu

SEQ ID NO: 128853 - RNA, 24 nt, Human
caccauguuggccaggcuggucuc

SEQ ID NO: 128854 - RNA, 18 nt, Human
caccauguuggccagggu

SEQ ID NO: 128855 - RNA, 22 nt, Human
caccauguuggccagggugguc

SEQ ID NO: 128856 - RNA, 24 nt, Human
caccauguuggccaggguggucuc

SEQ ID NO: 128857 - RNA, 21 nt, Human
cacccaggcuggagugcagug

SEQ ID NO: 128858 - RNA, 24 nt, Human
caccucggccucccaaagugcugg

SEQ ID NO: 128859 - RNA, 21 nt, Human
caccugggccucccaaagugc

SEQ ID NO: 128860 - RNA, 19 nt, Human
cacuauguugcccaggcug

SEQ ID NO: 128861 - RNA, 24 nt, Human
cacuauguugcccaggcuggucuc

SEQ ID NO: 128862 - RNA, 27 nt, Human
cacuauguugcccaggcuggucucaaa

SEQ ID NO: 128863 - RNA, 25 nt, Human
cacucugucacccauacuggaggau

SEQ ID NO: 128864 - RNA, 21 nt, Human
cacugcaaccuccaccuccca

SEQ ID NO: 128865 - RNA, 23 nt, Human
cacuguaaccuccaccucuuggg

SEQ ID NO: 128866 - RNA, 20 nt, Human
cagcuuccugaguagcuggg

SEQ ID NO: 128867 - RNA, 22 nt, Human
cagguuucaccauguuggccag

SEQ ID NO: 128868 - RNA, 24 nt, Human
cauguuggccaggcuggucucaaa

SEQ ID NO: 128869 - RNA, 19 nt, Human
ccaaagugcuggauuacag

SEQ ID NO: 128870 - RNA, 21 nt, Human
ccaaagugcuggauuacaggc

SEQ ID NO: 128871 - RNA, 23 nt, Human
ccaaagugcuggauuacaggcgu

SEQ ID NO: 128872 - RNA, 22 nt, Human
ccaaagugcugggauuacaggc

SEQ ID NO: 128873 - RNA, 22 nt, Human
ccaaagugcugggauuacaggc

SEQ ID NO: 128874 - RNA, 24 nt, Human
ccaaagugcugggauuacaggcgu

SEQ ID NO: 128875 - RNA, 22 nt, Human
ccaccacacuuggcuuuuuggu

SEQ ID NO: 128876 - RNA, 26 nt, Human
ccaccaggcuaauuuuaaaaauaaug

SEQ ID NO: 128877 - RNA, 24 nt, Human
ccaccucccagguucaagcgauuc

SEQ ID NO: 128878 - RNA, 24 nt, Human
ccagguuucaccauguuggccagg

SEQ ID NO: 128879 - RNA, 24 nt, Human
cccaaagugcuggauuacaggcgu

SEQ ID NO: 128880 - RNA, 20 nt, Human
cccaagaaaauaccaaagca

SEQ ID NO: 128881 - RNA, 25 nt, Human
cccaaguagcugggacuacaggccu

SEQ ID NO: 128882 - RNA, 20 nt, Human
cccaggcuggagugcagugg

SEQ ID NO: 128883 - RNA, 20 nt, Human
cccagguucaagcgauucuc

SEQ ID NO: 128884 - RNA, 23 nt, Human
cccagguucaagcgauucuccug

SEQ ID NO: 128885 - RNA, 20 nt, Human
ccccaggagaaccauuacac

SEQ ID NO: 128886 - RNA, 24 nt, Human
ccucccagguucaagcgauucucc

SEQ ID NO: 128887 - RNA, 22 nt, Human
ccuccugcuucagccuccccua

SEQ ID NO: 128888 - RNA, 24 nt, Human
ccuccugcuucagccuccccuaua

SEQ ID NO: 128889 - RNA, 24 nt, Human
ccucuugggcucaagcaauucucc

SEQ ID NO: 128890 - RNA, 24 nt, Human
ccugaccucaggugaucuggccac

SEQ ID NO: 128891 - RNA, 19 nt, Human
ccugaguagcugggacuau

SEQ ID NO: 128892 - RNA, 24 nt, Human
ccugaguagcugggacuauaggug

SEQ ID NO: 128893 - RNA, 23 nt, Human
ccugccucagccucccaaguagc

SEQ ID NO: 128894 - RNA, 18 nt, Human
ccuggccucaagugaucc

SEQ ID NO: 128895 - RNA, 21 nt, Human
ccuggccucaagugauccucc

SEQ ID NO: 128896 - RNA, 22 nt, Human
ccuggccucaagugauccuccu

SEQ ID NO: 128897 - RNA, 23 nt, Human
ccuggccucaagugauccuccug

SEQ ID NO: 128898 - RNA, 22 nt, Human
ccugggcucaauugauccucuu

SEQ ID NO: 128899 - RNA, 22 nt, Human
cgccccaccugggccucccaaa

SEQ ID NO: 128900 - RNA, 20 nt, Human
cgguacccaccaccacaccc

SEQ ID NO: 128901 - RNA, 24 nt, Human
cucaagcaauucuccugccucagc

SEQ ID NO: 128902 - RNA, 24 nt, Human
cucaagugauccuccugcuucagc

SEQ ID NO: 128903 - RNA, 24 nt, Human
cucacugcaaccuccaccucccag

SEQ ID NO: 128904 - RNA, 24 nt, Human
cucacuguaaccuccaccucuugg

SEQ ID NO: 128905 - RNA, 24 nt, Human
cucagccucccaaguagcugggac

SEQ ID NO: 128906 - RNA, 22 nt, Human
cucagcuuccugaguagcuggg

SEQ ID NO: 128907 - RNA, 24 nt, Human
cucagcuuccugaguagcugggac

SEQ ID NO: 128908 - RNA, 23 nt, Human
cuccugggcucaauugauccucu

SEQ ID NO: 128909 - RNA, 19 nt, Human
cucugccacccaggcugga

SEQ ID NO: 128910 - RNA, 23 nt, Human
cugcaaccuccaccucccagguu

SEQ ID NO: 128911 - RNA, 24 nt, Human
cugcaaccuccaccucccagguuc

SEQ ID NO: 128912 - RNA, 19 nt, Human
cugccacccaggcuggagu

SEQ ID NO: 128913 - RNA, 23 nt, Human
cugccucagccucccaaguagcu

SEQ ID NO: 128914 - RNA, 21 nt, Human
cugggccucccaaagugcugg

SEQ ID NO: 128915 - RNA, 24 nt, Human
cuguaaccuccaccucuugggcuc

SEQ ID NO: 128916 - RNA, 21 nt, Human
cuugcucugucgcccaggcug

SEQ ID NO: 128917 - RNA, 24 nt, Human
cuugucucagcuuccugaguagcu

SEQ ID NO: 128918 - RNA, 24 nt, Human
gaccucaggugaucuggccaccuc

SEQ ID NO: 128919 - RNA, 20 nt, Human
gagaugggguuucaccaugu

SEQ ID NO: 128920 - RNA, 24 nt, Human
gagaugggguuucaccauguuggc

SEQ ID NO: 128921 - RNA, 21 nt, Human
gaugggguuucaccauguugg

SEQ ID NO: 128922 - RNA, 20 nt, Human
gaugggguuucaccauguuu

SEQ ID NO: 128923 - RNA, 18 nt, Human
gauuacaggcgugagcca

SEQ ID NO: 128924 - RNA, 18 nt, Human
gauuacaggcgugagcca

SEQ ID NO: 128925 - RNA, 21 nt, Human
gauuacaggcgugagccacca

SEQ ID NO: 128926 - RNA, 21 nt, Human
gauuacaggcgugagccacca

SEQ ID NO: 128927 - RNA, 21 nt, Human
gauuacaggcgugagccacca

SEQ ID NO: 128928 - RNA, 24 nt, Human
gauuacaggcgugagccaccaugc

SEQ ID NO: 128929 - RNA, 22 nt, Human
gcaaccuccaccucccagguuc

SEQ ID NO: 128930 - RNA, 24 nt, Human
gccagguuucaccauguuggccag

SEQ ID NO: 128931 - RNA, 19 nt, Human
gcccaggcuggagugcaau

SEQ ID NO: 128932 - RNA, 20 nt, Human
gccucagccucccaaguagc

SEQ ID NO: 128933 - RNA, 24 nt, Human
gcgauucuccugccucagccuccc

SEQ ID NO: 128934 - RNA, 19 nt, Human
gcgugagccaccaugcccg

SEQ ID NO: 128935 - RNA, 20 nt, Human
gcucugccacccaggcugga

SEQ ID NO: 128936 - RNA, 25 nt, Human
gcucugccacccaggcuggagugca

SEQ ID NO: 128937 - RNA, 27 nt, Human
gcucugucgcccaggcuggagugcaau

SEQ ID NO: 128938 - RNA, 19 nt, Human
gcuggagugcaauagcacg

SEQ ID NO: 128939 - RNA, 23 nt, Human
gcuggucucaaacuccuggccuc

SEQ ID NO: 128940 - RNA, 24 nt, Human
ggagaaccauuacaccauuauuca

SEQ ID NO: 128941 - RNA, 22 nt, Human
ggagugcaguggugugaucucu

SEQ ID NO: 128942 - RNA, 22 nt, Human
ggaucucacuauguugcccagg

SEQ ID NO: 128943 - RNA, 19 nt, Human
ggauuacaggcgugagcca

SEQ ID NO: 128944 - RNA, 22 nt, Human
ggauuacaggcgugagccacca

SEQ ID NO: 128945 - RNA, 23 nt, Human
ggauuacaggcgugagccaccau

SEQ ID NO: 128946 - RNA, 24 nt, Human
ggauuacaggcgugagccaccaug

SEQ ID NO: 128947 - RNA, 21 nt, Human
ggauuuccgaaugcaaauuga

SEQ ID NO: 128948 - RNA, 20 nt, Human
ggcauacaguuuucaacugg

SEQ ID NO: 128949 - RNA, 19 nt, Human
ggccucaagugauccuccu

SEQ ID NO: 128950 - RNA, 24 nt, Human
ggccucaagugauccuccugcuuc

SEQ ID NO: 128951 - RNA, 23 nt, Human
ggcgucuugcucugucgcccagg

SEQ ID NO: 128952 - RNA, 22 nt, Human
ggcuggagugcaguggugugau

SEQ ID NO: 128953 - RNA, 24 nt, Human
ggcuggucucaaacuccuggccuc

SEQ ID NO: 128954 - RNA, 20 nt, Human
gggcucaagcaauucuccug

SEQ ID NO: 128955 - RNA, 22 nt, Human
gggcucaagcaauucuccugcc

SEQ ID NO: 128956 - RNA, 23 nt, Human
gggguuucaccauguuggccagg

SEQ ID NO: 128957 - RNA, 18 nt, Human
gguacccaccaccacacc

SEQ ID NO: 128958 - RNA, 21 nt, Human
gguagaggccagguuucacca

SEQ ID NO: 128959 - RNA, 23 nt, Human
gguggucucgaacuccugaccuc

SEQ ID NO: 128960 - RNA, 21 nt, Human
guagagaugggguuucaccau

SEQ ID NO: 128961 - RNA, 22 nt, Human
guagagaugggguuucaccaug

SEQ ID NO: 128962 - RNA, 31 nt, Human
guagagaugggguuucaccauguuggccagg

SEQ ID NO: 128963 - RNA, 21 nt, Human
guagaggccagguuucaccau

SEQ ID NO: 128964 - RNA, 24 nt, Human
gugauccuccugcuucagccuccc

SEQ ID NO: 128965 - RNA, 18 nt, Human
guuggccaggguggucuc

SEQ ID NO: 128966 - RNA, 22 nt, Human
uaaaaaaagaaaugucaguggc

SEQ ID NO: 128967 - RNA, 20 nt, Human
uaaccucaggugaucgcccc

SEQ ID NO: 128968 - RNA, 24 nt, Human
uaagaagucacacucugaccuaua

SEQ ID NO: 128969 - RNA, 19 nt, Human
uaauuuuuguauuuuuaca

SEQ ID NO: 128970 - RNA, 19 nt, Human
uacaggccugugcaccagg

SEQ ID NO: 128971 - RNA, 22 nt, Human
uacaggccugugcaccaggccc

SEQ ID NO: 128972 - RNA, 18 nt, Human
uacaggcgugagccacca

SEQ ID NO: 128973 - RNA, 22 nt, Human
uacaggcgugagccaccaggcu

SEQ ID NO: 128974 - RNA, 23 nt, Human
uacaggcgugagccaccaugccc

SEQ ID NO: 128975 - RNA, 19 nt, Human
uaccaaagcauuaccacaa

SEQ ID NO: 128976 - RNA, 22 nt, Human
uaccaaagcauuaccacaaauc

SEQ ID NO: 128977 - RNA, 20 nt, Human
uacccaccaccacacccggu

SEQ ID NO: 128978 - RNA, 22 nt, Human
uagagaugggguuucaccaugu

SEQ ID NO: 128979 - RNA, 21 nt, Human
uagaggccagguuucaccaug

SEQ ID NO: 128980 - RNA, 24 nt, Human
uagcacgaucucagcucacugcaa

SEQ ID NO: 128981 - RNA, 20 nt, Human
uagcauaauaacggaaaugg

SEQ ID NO: 128982 - RNA, 24 nt, Human
uagguagaggccagguuucaccau

SEQ ID NO: 128983 - RNA, 21 nt, Human
uaggugcacaccaccacacuu

SEQ ID NO: 128984 - RNA, 24 nt, Human
uaggugcacaccaccacacuuggc

SEQ ID NO: 128985 - RNA, 23 nt, Human
uauguugcccaggcuggucucaa

SEQ ID NO: 128986 - RNA, 24 nt, Human
uauguugcccaggcuggucucaaa

SEQ ID NO: 128987 - RNA, 24 nt, Human
ucaccauguuggccaggguggucu

SEQ ID NO: 128988 - RNA, 24 nt, Human
ucacuacagcuuugaacuccuggg

SEQ ID NO: 128989 - RNA, 24 nt, Human
ucacugcaaccuccaccucccagg

SEQ ID NO: 128990 - RNA, 25 nt, Human
ucacugcaaccuccaccucccaggu

SEQ ID NO: 128991 - RNA, 27 nt, Human
ucacugcaaccuccaccucccagguuc

SEQ ID NO: 128992 - RNA, 23 nt, Human
ucacuguaaccuccaccucuugg

SEQ ID NO: 128993 - RNA, 24 nt, Human
ucacuguaaccuccaccucuuggg

SEQ ID NO: 128994 - RNA, 25 nt, Human
ucacuguaaccuccaccucuugggc

SEQ ID NO: 128995 - RNA, 20 nt, Human
ucagccucccaaguagcugg

SEQ ID NO: 128996 - RNA, 25 nt, Human
ucagcucacugcaaccuccaccucc

SEQ ID NO: 128997 - RNA, 23 nt, Human
ucagcuuccugaguagcugggac

SEQ ID NO: 128998 - RNA, 19 nt, Human
ucaguuaaaaaaaauaggg

SEQ ID NO: 128999 - RNA, 20 nt, Human
ucaguuaaaaaaaauagggc

SEQ ID NO: 129000 - RNA, 23 nt, Human
ucccaaagugcuggauuacaggc

SEQ ID NO: 129001 - RNA, 24 nt, Human
ucccaaagugcugggauuacaggc

SEQ ID NO: 129002 - RNA, 24 nt, Human
ucccaaguagcugggacuacaggc

SEQ ID NO: 129003 - RNA, 21 nt, Human
ucccagguucaagcgauucuc

SEQ ID NO: 129004 - RNA, 24 nt, Human
ucccagguucaagcgauucuccug

SEQ ID NO: 129005 - RNA, 24 nt, Human
uccugaguagcugggacuauaggu

SEQ ID NO: 129006 - RNA, 18 nt, Human
ucgcccaggcuggagugc

SEQ ID NO: 129007 - RNA, 18 nt, Human
ucggccucccaaagugcu

SEQ ID NO: 129008 - RNA, 18 nt, Human
ucucacuauguugcccag

SEQ ID NO: 129009 - RNA, 19 nt, Human
ucucacuauguugcccagg

SEQ ID NO: 129010 - RNA, 23 nt, Human
ucucacuauguugcccaggcugg

SEQ ID NO: 129011 - RNA, 24 nt, Human
ucucacuauguugcccaggcuggu

SEQ ID NO: 129012 - RNA, 26 nt, Human
ucucacuauguugcccaggcuggucu

SEQ ID NO: 129013 - RNA, 27 nt, Human
ucucacuauguugcccaggcuggucuc

SEQ ID NO: 129014 - RNA, 24 nt, Human
ucucacucugucacccauacugga

SEQ ID NO: 129015 - RNA, 26 nt, Human
ucuccugccucagccucccaaguagc

SEQ ID NO: 129016 - RNA, 26 nt, Human
ucuccugccucagccucccaaguagc

SEQ ID NO: 129017 - RNA, 23 nt, Human
ucucgaacuccugaccucaggug

SEQ ID NO: 129018 - RNA, 24 nt, Human
ucugccacccaggcuggagugcag

SEQ ID NO: 129019 - RNA, 24 nt, Human
ucugucgcccaggcuggagugcaa

SEQ ID NO: 129020 - RNA, 23 nt, Human
ucuugcucugucgcccaggcugg

SEQ ID NO: 129021 - RNA, 24 nt, Human
ucuugcucugucgcccaggcugga

SEQ ID NO: 129022 - RNA, 24 nt, Human
ucuugggcucaagcaauucuccug

SEQ ID NO: 129023 - RNA, 22 nt, Human
ucuuuccugauuuuaaaauuau

SEQ ID NO: 129024 - RNA, 21 nt, Human
ugaaaccuucauuucuauaca

SEQ ID NO: 129025 - RNA, 25 nt, Human
ugaacuccugggcucaauugauccu

SEQ ID NO: 129026 - RNA, 23 nt, Human
ugaccucaggugaucuggccacc

SEQ ID NO: 129027 - RNA, 24 nt, Human
ugaccucaggugaucuggccaccu

SEQ ID NO: 129028 - RNA, 25 nt, Human
ugaccucaggugaucuggccaccuc

SEQ ID NO: 129029 - RNA, 22 nt, Human
ugagauggcgucuugcucuguc

SEQ ID NO: 129030 - RNA, 20 nt, Human
ugaucgccccaccugggccu

SEQ ID NO: 129031 - RNA, 23 nt, Human
ugaucucugcucacuguaaccuc

SEQ ID NO: 129032 - RNA, 24 nt, Human
ugaucuggccaccucggccuccca

SEQ ID NO: 129033 - RNA, 24 nt, Human
ugcccaggcuggucucaaacuccu

SEQ ID NO: 129034 - RNA, 19 nt, Human
ugcccggccuaauuuuguu

SEQ ID NO: 129035 - RNA, 23 nt, Human
ugccucagccucccaaguagcgg

SEQ ID NO: 129036 - RNA, 24 nt, Human
ugccucagccucccaaguagcugg

SEQ ID NO: 129037 - RNA, 22 nt, Human
ugccuuagauccuuaaucauac

SEQ ID NO: 129038 - RNA, 24 nt, Human
ugcucugccacccaggcuggagug

SEQ ID NO: 129039 - RNA, 24 nt, Human
ugcucugucgcccaggcuggagug

SEQ ID NO: 129040 - RNA, 24 nt, Human
ugcugggauuacaggcgugagcca

SEQ ID NO: 129041 - RNA, 24 nt, Human
ugcuucagccuccccuauaacugg

SEQ ID NO: 129042 - RNA, 23 nt, Human
uggagugcaauagcacgaucuca

SEQ ID NO: 129043 - RNA, 19 nt, Human
uggagugcaguggugugau

SEQ ID NO: 129044 - RNA, 22 nt, Human
uggagugcaguggugugaucuc

SEQ ID NO: 129045 - RNA, 23 nt, Human
uggagugcaguggugugaucucu

SEQ ID NO: 129046 - RNA, 24 nt, Human
uggagugcaguggugugaucucug

SEQ ID NO: 129047 - RNA, 21 nt, Human
uggauuacaggcgugagccac

SEQ ID NO: 129048 - RNA, 23 nt, Human
uggauuacaggcgugagccacca

SEQ ID NO: 129049 - RNA, 23 nt, Human
uggcacaaugacagcucacuaca

SEQ ID NO: 129050 - RNA, 24 nt, Human
uggccaggcuggucucaaacuucu

SEQ ID NO: 129051 - RNA, 24 nt, Human
uggccaggguggucucgaacuccu

SEQ ID NO: 129052 - RNA, 18 nt, Human
uggccucaagugauccuc

SEQ ID NO: 129053 - RNA, 20 nt, Human
uggccucaagugauccuccu

SEQ ID NO: 129054 - RNA, 24 nt, Human
uggccucaagugauccuccugcuu

SEQ ID NO: 129055 - RNA, 24 nt, Human
uggcgucuugcucugucgcccagg

SEQ ID NO: 129056 - RNA, 23 nt, Human
ugggacuacaggccugugcacca

SEQ ID NO: 129057 - RNA, 24 nt, Human
ugggacuauaggugcacaccacca

SEQ ID NO: 129058 - RNA, 24 nt, Human
ugggaucucacuauguugcccagg

SEQ ID NO: 129059 - RNA, 18 nt, Human
ugggauuacaggcgugag

SEQ ID NO: 129060 - RNA, 19 nt, Human
ugggauuacaggcgugagc

SEQ ID NO: 129061 - RNA, 22 nt, Human
ugggauuacaggcgugagccac

SEQ ID NO: 129062 - RNA, 23 nt, Human
ugggauuacaggcgugagccacc

SEQ ID NO: 129063 - RNA, 24 nt, Human
ugggauuacaggcgugagccacca

SEQ ID NO: 129064 - RNA, 21 nt, Human
ugggauuacaguuacaaguca

SEQ ID NO: 129065 - RNA, 22 nt, Human
ugggauuacaguuacaagucau

SEQ ID NO: 129066 - RNA, 24 nt, Human
ugggauuacaguuacaagucauca

SEQ ID NO: 129067 - RNA, 24 nt, Human
ugggcucaagcaauucuccugccu

SEQ ID NO: 129068 - RNA, 24 nt, Human
ugggcucaauugauccucuugucu

SEQ ID NO: 129069 - RNA, 24 nt, Human
ugggguuucaccauguuggccagg

SEQ ID NO: 129070 - RNA, 24 nt, Human
uggugugaucucugcucacuguaa

SEQ ID NO: 129071 - RNA, 24 nt, Human
uguagagaugggguuucaccaugu

SEQ ID NO: 129072 - RNA, 20 nt, Human
ugucgcccaggcuggagugc

SEQ ID NO: 129073 - RNA, 24 nt, Human
ugucucagcuuccugaguagcugg

SEQ ID NO: 129074 - RNA, 23 nt, Human
uguugcucugccacccaggcugg

SEQ ID NO: 129075 - RNA, 24 nt, Human
uguugcucugccacccaggcugga

SEQ ID NO: 129076 - RNA, 24 nt, Human
uuacaaaacuguagagaugggguu

SEQ ID NO: 129077 - RNA, 19 nt, Human
uuagcugaagaccaaaaaa

SEQ ID NO: 129078 - RNA, 19 nt, Human
uucaagaaugucuuaucag

SEQ ID NO: 129079 - RNA, 21 nt, Human
uucaagcgauucuccugccuc

SEQ ID NO: 129080 - RNA, 23 nt, Human
uucaagcgauucuccugccucag

SEQ ID NO: 129081 - RNA, 24 nt, Human
uucaagcgauucuccugccucagc

SEQ ID NO: 129082 - RNA, 22 nt, Human
uugagaugggaucucacuaugu

SEQ ID NO: 129083 - RNA, 20 nt, Human
uugcucugccacccaggcug

SEQ ID NO: 129084 - RNA, 22 nt, Human
uugcucugccacccaggcugga

SEQ ID NO: 129085 - RNA, 24 nt, Human
uugcucugucgcccaggcuggagu

SEQ ID NO: 129086 - RNA, 22 nt, Human
uuggcauacaguuuucaacugg

SEQ ID NO: 129087 - RNA, 20 nt, Human
uuuacauacucuuuggaagc

SEQ ID NO: 129088 - RNA, 19 nt, Human
uuucaccauguuggccagg

SEQ ID NO: 129089 - RNA, 24 nt, Human
uuucaccauguuggccaggcuggu

SEQ ID NO: 129090 - RNA, 24 nt, Human
uuuuagguagaggccagguuucac

SEQ ID NO: 129091 - RNA, 24 nt, Human
uuuuugagauggcgucuugcucug

SEQ ID NO: 129092 - RNA, 19 nt, Human
uuuuugguuuuugguuuuu

SEQ ID NO: 129093 - RNA, 18 nt, Human
uuuuuuuuuuuuuuucug

SEQ ID NO: 129094 - RNA, 21 nt, Human
aaaacacauaacaaaacucaa

SEQ ID NO: 129095 - RNA, 18 nt, Human
aaauaaccauguuugagg

SEQ ID NO: 129096 - RNA, 23 nt, Human
aaaucucccccauuuuaucaaag

SEQ ID NO: 129097 - RNA, 22 nt, Human
aaccaauuucugaauagggcug

SEQ ID NO: 129098 - RNA, 22 nt, Human
aagcaggaggggaagaggggac

SEQ ID NO: 129099 - RNA, 27 nt, Human
aagcaggaggggaagaguuuaauccaa

SEQ ID NO: 129100 - RNA, 20 nt, Human
aagcuacacaauauagucug

SEQ ID NO: 129101 - RNA, 19 nt, Human
aaggcacaauaacuugaaa

SEQ ID NO: 129102 - RNA, 20 nt, Human
aaucacugaaaaucaaacac

SEQ ID NO: 129103 - RNA, 25 nt, Human
aaucacugaaaaucaaacacagcaa

SEQ ID NO: 129104 - RNA, 26 nt, Human
acacagcaaaacacauaacaaaacuc

SEQ ID NO: 129105 - RNA, 21 nt, Human
acacccacacaagacauauau

SEQ ID NO: 129106 - RNA, 21 nt, Human
acaguacguuaacaaacaaac

SEQ ID NO: 129107 - RNA, 21 nt, Human
acauauagaacacacaccuug

SEQ ID NO: 129108 - RNA, 24 nt, Human
accaaaaaacaucaacacuagcau

SEQ ID NO: 129109 - RNA, 21 nt, Human
acugaaaaucaaacacagcag

SEQ ID NO: 129110 - RNA, 23 nt, Human
acugcacauauagaacacacacc

SEQ ID NO: 129111 - RNA, 19 nt, Human
acuuuuacagugacucgag

SEQ ID NO: 129112 - RNA, 21 nt, Human
agacaaguauaucaaaaccuu

SEQ ID NO: 129113 - RNA, 22 nt, Human
agacaaucacugaaaaucaaac

SEQ ID NO: 129114 - RNA, 23 nt, Human
agaccagaauccaaccaggccug

SEQ ID NO: 129115 - RNA, 18 nt, Human
agagcacaugcggugcca

SEQ ID NO: 129116 - RNA, 23 nt, Human
auuaaaagcucacacuaccccaa

SEQ ID NO: 129117 - RNA, 26 nt, Human
auuaaaucucccccauuuuaucaaag

SEQ ID NO: 129118 - RNA, 22 nt, Human
auuugacucaaguuuaacagac

SEQ ID NO: 129119 - RNA, 21 nt, Human
auuuuuagugguggacaauca

SEQ ID NO: 129120 - RNA, 18 nt, Human
caaaacucaaacaguccu

SEQ ID NO: 129121 - RNA, 22 nt, Human
caaacuagagcaauuacaucuu

SEQ ID NO: 129122 - RNA, 22 nt, Human
caacaaucuccaagagacgaaa

SEQ ID NO: 129123 - RNA, 24 nt, Human
caacaaucuccaagagacgaaaua

SEQ ID NO: 129124 - RNA, 24 nt, Human
cacaaaaucaguacagaauuccaa

SEQ ID NO: 129125 - RNA, 22 nt, Human
cacacuaccccaaaauauauua

SEQ ID NO: 129126 - RNA, 18 nt, Human
cacauacggugacauuca

SEQ ID NO: 129127 - RNA, 19 nt, Human
cacauauagaacacacacc

SEQ ID NO: 129128 - RNA, 23 nt, Human
cacccacacaagacauauauaua

SEQ ID NO: 129129 - RNA, 25 nt, Human
cagaauaaacagagcacaugcggug

SEQ ID NO: 129130 - RNA, 18 nt, Human
cagcuacauugccaaugc

SEQ ID NO: 129131 - RNA, 22 nt, Human
cauuucaaugcagcuuuaacag

SEQ ID NO: 129132 - RNA, 22 nt, Human
ccaaccccaagucugcaaaacu

SEQ ID NO: 129133 - RNA, 25 nt, Human
ccaagguuugauuuuaggccaaguu

SEQ ID NO: 129134 - RNA, 21 nt, Human
cccacacaagacauauauaua

SEQ ID NO: 129135 - RNA, 23 nt, Human
ccccaagucugcaaaacucaaac

SEQ ID NO: 129136 - RNA, 21 nt, Human
ccgaauguuaagucacugaca

SEQ ID NO: 129137 - RNA, 20 nt, Human
ccugcugcacaauccuuccu

SEQ ID NO: 129138 - RNA, 24 nt, Human
cgcuaaaacugcacauauagaaca

SEQ ID NO: 129139 - RNA, 21 nt, Human
cuacuuaaaauuuuagaacaa

SEQ ID NO: 129140 - RNA, 21 nt, Human
cucaauacugucaagugcccu

SEQ ID NO: 129141 - RNA, 18 nt, Human
cucccccauuuuaucaaa

SEQ ID NO: 129142 - RNA, 25 nt, Human
cucccccauuuuaucaaagcuuuaa

SEQ ID NO: 129143 - RNA, 22 nt, Human
cucccuaaacauuacaugagaa

SEQ ID NO: 129144 - RNA, 23 nt, Human
cugcacauauagaacacacaccu

SEQ ID NO: 129145 - RNA, 23 nt, Human
cuugaccaaaaaacaucaacacu

SEQ ID NO: 129146 - RNA, 20 nt, Human
gacacccacacaagacauau

SEQ ID NO: 129147 - RNA, 21 nt, Human
gcaacuaaaauacgcuaaaac

SEQ ID NO: 129148 - RNA, 23 nt, Human
gcacaauccuuccuguuuaaacc

SEQ ID NO: 129149 - RNA, 18 nt, Human
gcagcaaaaaguaucuaa

SEQ ID NO: 129150 - RNA, 21 nt, Human
gcuuuaaugcuuuaagauguu

SEQ ID NO: 129151 - RNA, 19 nt, Human
gucuuaaauuuugucagaa

SEQ ID NO: 129152 - RNA, 22 nt, Human
gugguuuccauauuagcuucuu

SEQ ID NO: 129153 - RNA, 20 nt, Human
uaaaagaacucuuucaaaaa

SEQ ID NO: 129154 - RNA, 19 nt, Human
uaaaauucucugaaugugc

SEQ ID NO: 129155 - RNA, 21 nt, Human
uaaaauuuuagaacaaggcac

SEQ ID NO: 129156 - RNA, 24 nt, Human
uaaacagagcacaugcggugccaa

SEQ ID NO: 129157 - RNA, 20 nt, Human
uaaacucccuaaacauuaca

SEQ ID NO: 129158 - RNA, 28 nt, Human
uaaaucucccccauuuuaucaaagcuuu

SEQ ID NO: 129159 - RNA, 21 nt, Human
uaacaaacaaacgauccucag

SEQ ID NO: 129160 - RNA, 19 nt, Human
uaacauuaaaagcucacac

SEQ ID NO: 129161 - RNA, 28 nt, Human
uaaccuaaaagaacucuuucaaaaauau

SEQ ID NO: 129162 - RNA, 20 nt, Human
uaagacaaguauaucaaaac

SEQ ID NO: 129163 - RNA, 19 nt, Human
uaagauguucucccaaccc

SEQ ID NO: 129164 - RNA, 21 nt, Human
uaagggugacuuugcugcaaa

SEQ ID NO: 129165 - RNA, 21 nt, Human
uacacaauauagucuggcuaa

SEQ ID NO: 129166 - RNA, 19 nt, Human
uacagaauuccaaguggga

SEQ ID NO: 129167 - RNA, 29 nt, Human
uaccagacaaucacugaaaaucaaacacc

SEQ ID NO: 129168 - RNA, 20 nt, Human
uacuuaaaauuuuagaacaa

SEQ ID NO: 129169 - RNA, 21 nt, Human
uagcacaagagacuauaaaua

SEQ ID NO: 129170 - RNA, 24 nt, Human
uagcagcaaaaaguaucuaaaauc

SEQ ID NO: 129171 - RNA, 22 nt, Human
uagcaggcauuaaaaaaacuga

SEQ ID NO: 129172 - RNA, 21 nt, Human
uagcaugcauuaaagaccaga

SEQ ID NO: 129173 - RNA, 23 nt, Human
uauuugcaagcugugugauuuca

SEQ ID NO: 129174 - RNA, 20 nt, Human
ucaacacuagcaugcauuaa

SEQ ID NO: 129175 - RNA, 18 nt, Human
uccaagagacgaaauaag

SEQ ID NO: 129176 - RNA, 24 nt, Human
uccaagugggagaggcauuuuuag

SEQ ID NO: 129177 - RNA, 25 nt, Human
ucccaaccccaagucugcaaaacuc

SEQ ID NO: 129178 - RNA, 25 nt, Human
uccccaauaaaauuuaggaaucuac

SEQ ID NO: 129179 - RNA, 18 nt, Human
ucuguugugugcaaauag

SEQ ID NO: 129180 - RNA, 23 nt, Human
ucuuuauuuacugaagaauacug

SEQ ID NO: 129181 - RNA, 18 nt, Human
ugaaaaucaaacacagca

SEQ ID NO: 129182 - RNA, 23 nt, Human
ugaaaaucaaacacagcaaaaca

SEQ ID NO: 129183 - RNA, 18 nt, Human
ugaaauagcaccuuaaca

SEQ ID NO: 129184 - RNA, 28 nt, Human
ugaccaaaaaacaucaacacuagcaugc

SEQ ID NO: 129185 - RNA, 18 nt, Human
ugacucgagguucaauga

SEQ ID NO: 129186 - RNA, 21 nt, Human
ugagcaagucagaacuuaauu

SEQ ID NO: 129187 - RNA, 20 nt, Human
ugaggccuggucacugccau

SEQ ID NO: 129188 - RNA, 24 nt, Human
ugauuaaaucucccccauuuuauc

SEQ ID NO: 129189 - RNA, 20 nt, Human
ugcggugccagcaucuaaaa

SEQ ID NO: 129190 - RNA, 26 nt, Human
ugcuguacuuaaauuaaccuaaaaga

SEQ ID NO: 129191 - RNA, 23 nt, Human
uggcugguaaaaccgaauguuaa

SEQ ID NO: 129192 - RNA, 19 nt, Human
ugguggacaaucaucuuug

SEQ ID NO: 129193 - RNA, 26 nt, Human
ugucagaaaauuacagcuacauugcc

SEQ ID NO: 129194 - RNA, 23 nt, Human
uuaaaguuguaucauaccucugu

SEQ ID NO: 129195 - RNA, 22 nt, Human
uuaagacaaguauaucaaaacc

SEQ ID NO: 129196 - RNA, 22 nt, Human
uucaauaaauauuacacaacua

SEQ ID NO: 129197 - RNA, 21 nt, Human
uucacuggcugcauucaacaa

SEQ ID NO: 129198 - RNA, 23 nt, Human
uugaagcuacacaauauagucug

SEQ ID NO: 129199 - RNA, 23 nt, Human
uuuaagauguucucccaacccuu

SEQ ID NO: 129200 - RNA, 19 nt, Human
uuuguacugucuuuugguc

SEQ ID NO: 129201 - RNA, 22 nt, Human
uuugucuuaaauuuugucagaa

SEQ ID NO: 129202 - RNA, 20 nt, Human
uuuuuuccuuucauuuuucu

SEQ ID NO: 129203 - RNA, 25 nt, Human
aaacuuugacauugcagugaaaaug

SEQ ID NO: 129204 - RNA, 22 nt, Human
caucuuugcuuuuguuuaggga

SEQ ID NO: 129205 - RNA, 22 nt, Human
cuaaacuuugacauugcaguga

SEQ ID NO: 129206 - RNA, 23 nt, Human
cucauaaucaucauuugacaauu

SEQ ID NO: 129207 - RNA, 19 nt, Human
guucccggaaaauucaccu

SEQ ID NO: 129208 - RNA, 19 nt, Human
ucaggaucuuccuuaacug

SEQ ID NO: 129209 - RNA, 19 nt, Human
uggguaauugguaugcugc

SEQ ID NO: 129210 - RNA, 23 nt, Human
ccuggguaucauuucucagcuuc

SEQ ID NO: 129211 - RNA, 18 nt, Human
cuccuggguaucauuucu

SEQ ID NO: 129212 - RNA, 24 nt, Human
uggaguggguaugccaccaaaucc

SEQ ID NO: 129213 - RNA, 21 nt, Human
uggguaucauuucucagcuuc

SEQ ID NO: 129214 - RNA, 22 nt, Human
aagaccucccugggacccacag

SEQ ID NO: 129215 - RNA, 24 nt, Human
ccucccugggacccacaggggcug

SEQ ID NO: 129216 - RNA, 23 nt, Human
uaccuuguuuaagaccucccugg

SEQ ID NO: 129217 - RNA, 22 nt, Human
uggccguaagccuguggcagcc

SEQ ID NO: 129218 - RNA, 23 nt, Human
uuuaagaccucccugggacccuu

SEQ ID NO: 129219 - RNA, 23 nt, Human
aaaaaaaaaacaaaagaaaagaa

SEQ ID NO: 129220 - RNA, 21 nt, Human
aaaaaacaaaagaaaagaaac

SEQ ID NO: 129221 - RNA, 19 nt, Human
aaaaaagccaaccugcuga

SEQ ID NO: 129222 - RNA, 22 nt, Human
aaaaacaaaagaaaagaaacug

SEQ ID NO: 129223 - RNA, 21 nt, Human
aaaaacaaacuaaaaaaaugc

SEQ ID NO: 129224 - RNA, 26 nt, Human
aaaaagagaaaaacuuaaaagcagaa

SEQ ID NO: 129225 - RNA, 24 nt, Human
aaaaaucacugaaauaugucucca

SEQ ID NO: 129226 - RNA, 25 nt, Human
aaaagaaaagaaacugaucaaaaag

SEQ ID NO: 129227 - RNA, 23 nt, Human
aaacuagaaagaaaauauauuua

SEQ ID NO: 129228 - RNA, 21 nt, Human
aaagcagacugaggcaggaag

SEQ ID NO: 129229 - RNA, 22 nt, Human
aaagcagacugaggcaggaagu

SEQ ID NO: 129230 - RNA, 24 nt, Human
aaccaaaaacaaaaaugacuugga

SEQ ID NO: 129231 - RNA, 23 nt, Human
aagaaaccaaaaacaaaaaugac

SEQ ID NO: 129232 - RNA, 21 nt, Human
aagcaaacuacaaagcaaaga

SEQ ID NO: 129233 - RNA, 18 nt, Human
aagcaaagaguaaucaca

SEQ ID NO: 129234 - RNA, 23 nt, Human
aagcaaagcaaacuacaaagcaa

SEQ ID NO: 129235 - RNA, 21 nt, Human
aagugugucucauuaauuaau

SEQ ID NO: 129236 - RNA, 21 nt, Human
acaaaagaaaagaaacugauc

SEQ ID NO: 129237 - RNA, 22 nt, Human
acaaaagaaaagaaacugauca

SEQ ID NO: 129238 - RNA, 21 nt, Human
acaaagcaaagcaaacuacaa

SEQ ID NO: 129239 - RNA, 21 nt, Human
acaaauuaauuuauaccaaac

SEQ ID NO: 129240 - RNA, 21 nt, Human
acccuacaaagcaaagcaaac

SEQ ID NO: 129241 - RNA, 23 nt, Human
acuaccauuuacuauguaacauu

SEQ ID NO: 129242 - RNA, 20 nt, Human
agaacuaagaugaguccauu

SEQ ID NO: 129243 - RNA, 24 nt, Human
agaaggaagcuggaucuuuuauaa

SEQ ID NO: 129244 - RNA, 24 nt, Human
agacugaggcaggaaguaagaggu

SEQ ID NO: 129245 - RNA, 29 nt, Human
aggcaggaaguaagagguggggggacccc

SEQ ID NO: 129246 - RNA, 24 nt, Human
agggcugggaggcggccacgggug

SEQ ID NO: 129247 - RNA, 22 nt, Human
agugagaggcaccagggaaaaa

SEQ ID NO: 129248 - RNA, 19 nt, Human
auacuggaaccaucuaccu

SEQ ID NO: 129249 - RNA, 26 nt, Human
caaacuaaaaaaaugcauacguauaa

SEQ ID NO: 129250 - RNA, 23 nt, Human
caaagcaaacuacaaagcaaaga

SEQ ID NO: 129251 - RNA, 19 nt, Human
caaagcaaagaguaaucac

SEQ ID NO: 129252 - RNA, 24 nt, Human
caacaaaaaauaaugcuuucagga

SEQ ID NO: 129253 - RNA, 22 nt, Human
cacaggaaaaacacugcacacc

SEQ ID NO: 129254 - RNA, 23 nt, Human
caggaaaaacacugcacaccuua

SEQ ID NO: 129255 - RNA, 18 nt, Human
ccacuaaauuaucaucuu

SEQ ID NO: 129256 - RNA, 24 nt, Human
ccagagcucguccggcaaagaggg

SEQ ID NO: 129257 - RNA, 21 nt, Human
ccgccgcggugucgggguuug

SEQ ID NO: 129258 - RNA, 21 nt, Human
ccgcuaagccagauccugacc

SEQ ID NO: 129259 - RNA, 18 nt, Human
cgaagauacacaaagcug

SEQ ID NO: 129260 - RNA, 23 nt, Human
cgcuaagccagauccugaccugc

SEQ ID NO: 129261 - RNA, 22 nt, Human
cggcccagagcucguccggcaa

SEQ ID NO: 129262 - RNA, 23 nt, Human
cguauaaugagacaguuuaugua

SEQ ID NO: 129263 - RNA, 18 nt, Human
cuccacuuaaaauggaau

SEQ ID NO: 129264 - RNA, 20 nt, Human
cugaaauuacauuucaauga

SEQ ID NO: 129265 - RNA, 20 nt, Human
gacaguagagaaagcagacu

SEQ ID NO: 129266 - RNA, 19 nt, Human
gcaaagcaaacuacaaagc

SEQ ID NO: 129267 - RNA, 21 nt, Human
gcaaagcaaacuacaaagcaa

SEQ ID NO: 129268 - RNA, 18 nt, Human
ggaaaaaagccaaccugc

SEQ ID NO: 129269 - RNA, 20 nt, Human
ggcugggaggcggccacggg

SEQ ID NO: 129270 - RNA, 27 nt, Human
gggaaugacagaaggaagccgguaccc

SEQ ID NO: 129271 - RNA, 21 nt, Human
uaaaaacuuggguuuucuaaa

SEQ ID NO: 129272 - RNA, 24 nt, Human
uaaaagcagaacccuacaaagcaa

SEQ ID NO: 129273 - RNA, 23 nt, Human
uaacuaaacaaacuagaaagaaa

SEQ ID NO: 129274 - RNA, 23 nt, Human
uaagaaaccaaaaacaaaaauga

SEQ ID NO: 129275 - RNA, 18 nt, Human
uaaguaguuaaguguguc

SEQ ID NO: 129276 - RNA, 18 nt, Human
uaauuacagauuugaaau

SEQ ID NO: 129277 - RNA, 23 nt, Human
uacaaagcaaagaguaaucacag

SEQ ID NO: 129278 - RNA, 24 nt, Human
uacacaggaaaaacacugcacacc

SEQ ID NO: 129279 - RNA, 18 nt, Human
uaccaaacaaaaacaaac

SEQ ID NO: 129280 - RNA, 26 nt, Human
uaccaaacaaaaacaaacuaaaaaaa

SEQ ID NO: 129281 - RNA, 22 nt, Human
uaucaguaauuugucugaaaaa

SEQ ID NO: 129282 - RNA, 21 nt, Human
uaucuggaaccauuuggcugc

SEQ ID NO: 129283 - RNA, 22 nt, Human
ucaguaauuugucugaaaaaga

SEQ ID NO: 129284 - RNA, 21 nt, Human
ugaaaaagagaaaaacuuaaa

SEQ ID NO: 129285 - RNA, 21 nt, Human
ugaauaagaaaccaaaaacaa

SEQ ID NO: 129286 - RNA, 18 nt, Human
ugacagaaggaagcugga

SEQ ID NO: 129287 - RNA, 21 nt, Human
ugacuuggaaagaaaaauagu

SEQ ID NO: 129288 - RNA, 23 nt, Human
ugagaaauaaugucuuugucuuu

SEQ ID NO: 129289 - RNA, 23 nt, Human
ugagaggcaccagggaaaaaagc

SEQ ID NO: 129290 - RNA, 20 nt, Human
ugcaaaauagaaauguguga

SEQ ID NO: 129291 - RNA, 19 nt, Human
ugcugaggaagacaaaaga

SEQ ID NO: 129292 - RNA, 19 nt, Human
ugguuuagagauaaguagu

SEQ ID NO: 129293 - RNA, 22 nt, Human
ugucuccacuuaaaauggaauc

SEQ ID NO: 129294 - RNA, 23 nt, Human
uuaaaagcagaacccuacaaagc

SEQ ID NO: 129295 - RNA, 22 nt, Human
uuaauacacaggaaaaacacug

SEQ ID NO: 129296 - RNA, 25 nt, Human
uucaccuuuaauauucauaauuuau

SEQ ID NO: 129297 - RNA, 20 nt, Human
uuuaaaaaucuuuuuuccuu

SEQ ID NO: 129298 - RNA, 20 nt, Human
aaaaccgcagcugaagccaa

SEQ ID NO: 129299 - RNA, 18 nt, Human
aaagugcugggauuacaa

SEQ ID NO: 129300 - RNA, 24 nt, Human
aaagugcugggauuacaaguguga

SEQ ID NO: 129301 - RNA, 23 nt, Human
aaguagagacacauuucacugug

SEQ ID NO: 129302 - RNA, 18 nt, Human
aagugcugggauuacaag

SEQ ID NO: 129303 - RNA, 19 nt, Human
aagugcugggauuacaagu

SEQ ID NO: 129304 - RNA, 26 nt, Human
aagugcugggauuacaagugugagcc

SEQ ID NO: 129305 - RNA, 24 nt, Human
acacaaucucagcucacugcaacc

SEQ ID NO: 129306 - RNA, 23 nt, Human
acacauuucacuguguuggccag

SEQ ID NO: 129307 - RNA, 24 nt, Human
acacauuucacuguguuggccagg

SEQ ID NO: 129308 - RNA, 26 nt, Human
accccaaaaccgcagcugaagccaag

SEQ ID NO: 129309 - RNA, 19 nt, Human
acugcaaccaccaccuccc

SEQ ID NO: 129310 - RNA, 19 nt, Human
acugcagccucaaucuccu

SEQ ID NO: 129311 - RNA, 24 nt, Human
acuguguuggccaggcuggugucg

SEQ ID NO: 129312 - RNA, 24 nt, Human
agccaaggccagcccugaccgcgc

SEQ ID NO: 129313 - RNA, 22 nt, Human
agcccugaccgcgccgccacuu

SEQ ID NO: 129314 - RNA, 22 nt, Human
agcugggauuacaggcaugagc

SEQ ID NO: 129315 - RNA, 20 nt, Human
aggcaugagccaccgugccu

SEQ ID NO: 129316 - RNA, 23 nt, Human
aggcaugagccaccgugccuggc

SEQ ID NO: 129317 - RNA, 21 nt, Human
agguucaagugauucuccugc

SEQ ID NO: 129318 - RNA, 22 nt, Human
agguucaagugauucuccugcc

SEQ ID NO: 129319 - RNA, 23 nt, Human
agguucaagugauucuccugccu

SEQ ID NO: 129320 - RNA, 23 nt, Human
aguacuguauuuucucuauugua

SEQ ID NO: 129321 - RNA, 18 nt, Human
aguagagacacauuucac

SEQ ID NO: 129322 - RNA, 19 nt, Human
agucauggcucacugcagc

SEQ ID NO: 129323 - RNA, 21 nt, Human
aguccgggaccccaaaaccgc

SEQ ID NO: 129324 - RNA, 24 nt, Human
agugcugggauuacaagugugagc

SEQ ID NO: 129325 - RNA, 18 nt, Human
auucuccugccuuggccu

SEQ ID NO: 129326 - RNA, 20 nt, Human
auuucacuguguuggccagg

SEQ ID NO: 129327 - RNA, 20 nt, Human
caaagugcugggauuacaag

SEQ ID NO: 129328 - RNA, 23 nt, Human
caaagugcugggauuacaagugu

SEQ ID NO: 129329 - RNA, 24 nt, Human
caaagugcugggauuacaagugug

SEQ ID NO: 129330 - RNA, 19 nt, Human
caagugauucuccugccuu

SEQ ID NO: 129331 - RNA, 22 nt, Human
caagugauucuccugccuuggc

SEQ ID NO: 129332 - RNA, 21 nt, Human
cacugcaaccaccaccuccca

SEQ ID NO: 129333 - RNA, 19 nt, Human
cacugcagccucaaucucc

SEQ ID NO: 129334 - RNA, 18 nt, Human
cacuguguuggccaggcu

SEQ ID NO: 129335 - RNA, 19 nt, Human
cacuguguuggccaggcug

SEQ ID NO: 129336 - RNA, 21 nt, Human
cacuguguuggccaggcuggu

SEQ ID NO: 129337 - RNA, 24 nt, Human
cacuguguuggccaggcugguguc

SEQ ID NO: 129338 - RNA, 23 nt, Human
cagccucaaucuccugggcucaa

SEQ ID NO: 129339 - RNA, 24 nt, Human
cagccucaaucuccugggcucaag

SEQ ID NO: 129340 - RNA, 24 nt, Human
caggcuggugucgaacuccugggc

SEQ ID NO: 129341 - RNA, 18 nt, Human
caguggcacagucauggc

SEQ ID NO: 129342 - RNA, 21 nt, Human
caguggcacagucauggcuca

SEQ ID NO: 129343 - RNA, 19 nt, Human
ccaccucccagguucaagu

SEQ ID NO: 129344 - RNA, 24 nt, Human
ccaccucccagguucaagugauuc

SEQ ID NO: 129345 - RNA, 19 nt, Human
ccacuaaagauaucugggu

SEQ ID NO: 129346 - RNA, 23 nt, Human
cccagguucaagugauucuccuc

SEQ ID NO: 129347 - RNA, 23 nt, Human
cccagguucaagugauucuccug

SEQ ID NO: 129348 - RNA, 18 nt, Human
ccucaaagugcugggauu

SEQ ID NO: 129349 - RNA, 22 nt, Human
ccucaaucuccugggcucaagu

SEQ ID NO: 129350 - RNA, 23 nt, Human
ccuccagaguagcccaccaccau

SEQ ID NO: 129351 - RNA, 24 nt, Human
ccucccagguucaagugauucucc

SEQ ID NO: 129352 - RNA, 23 nt, Human
ccugccuuggccuccugcguagc

SEQ ID NO: 129353 - RNA, 19 nt, Human
ccugcguagcugggauuac

SEQ ID NO: 129354 - RNA, 20 nt, Human
ccugggcucaagugguccuc

SEQ ID NO: 129355 - RNA, 20 nt, Human
cgaacuccugggcucaagcc

SEQ ID NO: 129356 - RNA, 19 nt, Human
cgggaccccaaaaccgcag

SEQ ID NO: 129357 - RNA, 21 nt, Human
cguagcugggauuacaggcau

SEQ ID NO: 129358 - RNA, 24 nt, Human
cucacugcaaccaccaccucccag

SEQ ID NO: 129359 - RNA, 21 nt, Human
cucacugcagccucaaucucc

SEQ ID NO: 129360 - RNA, 24 nt, Human
cucacugcagccucaaucuccugg

SEQ ID NO: 129361 - RNA, 22 nt, Human
cucagcucacugcaaccaccac

SEQ ID NO: 129362 - RNA, 25 nt, Human
cucauagcgccgccgaucccagagu

SEQ ID NO: 129363 - RNA, 19 nt, Human
cucccagguucaagugauu

SEQ ID NO: 129364 - RNA, 20 nt, Human
cucuuguugcccaggcugga

SEQ ID NO: 129365 - RNA, 22 nt, Human
cucuuguugcccaggcuggagu

SEQ ID NO: 129366 - RNA, 21 nt, Human
cugaagccaaggccagcccug

SEQ ID NO: 129367 - RNA, 23 nt, Human
cugcaaccaccaccucccagguu

SEQ ID NO: 129368 - RNA, 24 nt, Human
cugcaaccaccaccucccagguuc

SEQ ID NO: 129369 - RNA, 24 nt, Human
cugcguagcugggauuacaggcau

SEQ ID NO: 129370 - RNA, 24 nt, Human
cuuggccuccugcguagcugggau

SEQ ID NO: 129371 - RNA, 24 nt, Human
cuuguugcccaggcuggagugcaa

SEQ ID NO: 129372 - RNA, 24 nt, Human
gaacucauagcgccgccgauccca

SEQ ID NO: 129373 - RNA, 24 nt, Human
gacacauuucacuguguuggccag

SEQ ID NO: 129374 - RNA, 22 nt, Human
gagacagaguuuugcucuuguu

SEQ ID NO: 129375 - RNA, 18 nt, Human
gauuacaagugugagcca

SEQ ID NO: 129376 - RNA, 18 nt, Human
gauuacaggcaugagcca

SEQ ID NO: 129377 - RNA, 21 nt, Human
gauuacaggcaugagccaccg

SEQ ID NO: 129378 - RNA, 24 nt, Human
gauuacaggcaugagccaccgugc

SEQ ID NO: 129379 - RNA, 19 nt, Human
gcccaggcuggagugcaau

SEQ ID NO: 129380 - RNA, 24 nt, Human
gcguagcugggauuacaggcauga

SEQ ID NO: 129381 - RNA, 21 nt, Human
gcucacugcagccucaaucuc

SEQ ID NO: 129382 - RNA, 26 nt, Human
gcucugucacccagacuagaggugca

SEQ ID NO: 129383 - RNA, 20 nt, Human
gcucuuguugcccaggcugg

SEQ ID NO: 129384 - RNA, 21 nt, Human
gcucuuguugcccaggcugga

SEQ ID NO: 129385 - RNA, 24 nt, Human
gcucuuguugcccaggcuggagug

SEQ ID NO: 129386 - RNA, 19 nt, Human
gcuggagugcaaugacaca

SEQ ID NO: 129387 - RNA, 19 nt, Human
ggacaggaaguaggcgcgg

SEQ ID NO: 129388 - RNA, 24 nt, Human
ggauuacaggcaugagccaccgug

SEQ ID NO: 129389 - RNA, 19 nt, Human
ggccaggcuggugucgaac

SEQ ID NO: 129390 - RNA, 23 nt, Human
gggcucaagccauugcccaccuc

SEQ ID NO: 129391 - RNA, 18 nt, Human
gggcucguuaacaacaac

SEQ ID NO: 129392 - RNA, 20 nt, Human
ggugcaguggcacagucaug

SEQ ID NO: 129393 - RNA, 23 nt, Human
ggugcaguggcacagucauggcu

SEQ ID NO: 129394 - RNA, 19 nt, Human
guagcugggauuacaggca

SEQ ID NO: 129395 - RNA, 20 nt, Human
guagcugggauuacaggcau

SEQ ID NO: 129396 - RNA, 22 nt, Human
guagcugggauuacaggcauga

SEQ ID NO: 129397 - RNA, 23 nt, Human
guagcugggauuacaggcaugag

SEQ ID NO: 129398 - RNA, 23 nt, Human
uaaguagagacacauuucacugu

SEQ ID NO: 129399 - RNA, 24 nt, Human
uacaagugugagccaccacaccca

SEQ ID NO: 129400 - RNA, 22 nt, Human
uacaggcaugagccaccgugcc

SEQ ID NO: 129401 - RNA, 19 nt, Human
uacuguauuuucucuauug

SEQ ID NO: 129402 - RNA, 21 nt, Human
uagauaaaccuucaagcugca

SEQ ID NO: 129403 - RNA, 20 nt, Human
ucaaagugcugggauuacaa

SEQ ID NO: 129404 - RNA, 24 nt, Human
ucaaagugcugggauuacaagugu

SEQ ID NO: 129405 - RNA, 19 nt, Human
ucaagugauucuccugccu

SEQ ID NO: 129406 - RNA, 19 nt, Human
ucacugcaaccaccaccuc

SEQ ID NO: 129407 - RNA, 24 nt, Human
ucacugcaaccaccaccucccagg

SEQ ID NO: 129408 - RNA, 23 nt, Human
ucacugcagccucaaucuccugg

SEQ ID NO: 129409 - RNA, 24 nt, Human
ucacugcagccucaaucuccuggg

SEQ ID NO: 129410 - RNA, 22 nt, Human
ucacuguguuggccaggcuggu

SEQ ID NO: 129411 - RNA, 27 nt, Human
ucagcucacugcaaccaccaccuccca

SEQ ID NO: 129412 - RNA, 21 nt, Human
ucccagguucaagugauucuc

SEQ ID NO: 129413 - RNA, 24 nt, Human
ucccagguucaagugauucuccug

SEQ ID NO: 129414 - RNA, 24 nt, Human
uccugcguagcugggauuacaggc

SEQ ID NO: 129415 - RNA, 18 nt, Human
uccugggcucaagccauu

SEQ ID NO: 129416 - RNA, 21 nt, Human
uccugggcucaagugguccuc

SEQ ID NO: 129417 - RNA, 21 nt, Human
ucuggguaggagucucgauuu

SEQ ID NO: 129418 - RNA, 25 nt, Human
ucugucacccagacuagaggugcag

SEQ ID NO: 129419 - RNA, 18 nt, Human
ucuugcucugucacccag

SEQ ID NO: 129420 - RNA, 19 nt, Human
ucuugcucugucacccaga

SEQ ID NO: 129421 - RNA, 24 nt, Human
ucuugcucugucacccagacuaga

SEQ ID NO: 129422 - RNA, 22 nt, Human
ucuuguugcccaggcuggagug

SEQ ID NO: 129423 - RNA, 24 nt, Human
ugacacaaucucagcucacugcaa

SEQ ID NO: 129424 - RNA, 23 nt, Human
ugcaaugacacaaucucagcuca

SEQ ID NO: 129425 - RNA, 18 nt, Human
ugcccaggcuggagugca

SEQ ID NO: 129426 - RNA, 21 nt, Human
ugcccaggcuggagugcaaug

SEQ ID NO: 129427 - RNA, 24 nt, Human
ugcccaggcuggagugcaaugaca

SEQ ID NO: 129428 - RNA, 25 nt, Human
ugccuggcuuuuuuuuuuuuuuuuu

SEQ ID NO: 129429 - RNA, 26 nt, Human
ugcugggauuacaagugugagccacc

SEQ ID NO: 129430 - RNA, 23 nt, Human
uggagugcaaugacacaaucuca

SEQ ID NO: 129431 - RNA, 24 nt, Human
uggccaggcuggugucgaacuccu

SEQ ID NO: 129432 - RNA, 24 nt, Human
uggcucacugcagccucaaucucc

SEQ ID NO: 129433 - RNA, 22 nt, Human
uggcuuuuuuuuuuuuuuuuuu

SEQ ID NO: 129434 - RNA, 18 nt, Human
ugggauuacaagugugag

SEQ ID NO: 129435 - RNA, 19 nt, Human
ugggauuacaagugugagc

SEQ ID NO: 129436 - RNA, 22 nt, Human
ugggauuacaagugugagccac

SEQ ID NO: 129437 - RNA, 23 nt, Human
ugggauuacaagugugagccacc

SEQ ID NO: 129438 - RNA, 24 nt, Human
ugggauuacaagugugagccacca

SEQ ID NO: 129439 - RNA, 18 nt, Human
ugggauuacaggcaugag

SEQ ID NO: 129440 - RNA, 21 nt, Human
ugggauuacaggcaugagcca

SEQ ID NO: 129441 - RNA, 22 nt, Human
ugggauuacaggcaugagccac

SEQ ID NO: 129442 - RNA, 23 nt, Human
ugggauuacaggcaugagccacc

SEQ ID NO: 129443 - RNA, 23 nt, Human
ugggauuacaggcaugagccacc

SEQ ID NO: 129444 - RNA, 24 nt, Human
ugggauuacaggcaugagccaccg

SEQ ID NO: 129445 - RNA, 19 nt, Human
ugggcucaagugguccuca

SEQ ID NO: 129446 - RNA, 21 nt, Human
ugucgaacuccugggcucaag

SEQ ID NO: 129447 - RNA, 24 nt, Human
uguguuggccaggcuggugucgaa

SEQ ID NO: 129448 - RNA, 20 nt, Human
uguugcccaggcuggagugc

SEQ ID NO: 129449 - RNA, 20 nt, Human
uucaagugauucuccugccu

SEQ ID NO: 129450 - RNA, 24 nt, Human
uucaagugauucuccugccuuggc

SEQ ID NO: 129451 - RNA, 18 nt, Human
uugcccaggcuggagugc

SEQ ID NO: 129452 - RNA, 22 nt, Human
uugcucuuguugcccaggcugg

SEQ ID NO: 129453 - RNA, 23 nt, Human
uugcucuuguugcccaggcugga

SEQ ID NO: 129454 - RNA, 24 nt, Human
uuggccuccugcguagcugggauu

SEQ ID NO: 129455 - RNA, 23 nt, Human
uuucacuguguuggccaggcugu

SEQ ID NO: 129456 - RNA, 24 nt, Human
uuugcucuuguugcccaggcugga

SEQ ID NO: 129457 - RNA, 21 nt, Human
uuuguggcagugggacaggaa

SEQ ID NO: 129458 - RNA, 23 nt, Human
uuuugcucuuguugcccaggcug

SEQ ID NO: 129459 - RNA, 24 nt, Human
uuuugcucuuguugcccaggcugg

SEQ ID NO: 129460 - RNA, 19 nt, Human
uuuuucuuuuuuaaacagg

SEQ ID NO: 129461 - RNA, 23 nt, Human
uuuuucuuuuuuaaacagggucu

SEQ ID NO: 129462 - RNA, 19 nt, Human
uuuuuuuuuguaaguagag

SEQ ID NO: 129463 - RNA, 18 nt, Human
uuuuuuuuuuuuuuuuug

SEQ ID NO: 129464 - RNA, 19 nt, Human
uuuuuuuuuuuuuuuuugu

SEQ ID NO: 129465 - RNA, 22 nt, Human
aaaaaagaaaagcuuuacuaaa

SEQ ID NO: 129466 - RNA, 22 nt, Human
aaaaaagaaaagcuuuacuaaa

SEQ ID NO: 129467 - RNA, 19 nt, Human
aacagaaagcuucaaaaga

SEQ ID NO: 129468 - RNA, 23 nt, Human
aacaucaacagaaagcuucaaaa

SEQ ID NO: 129469 - RNA, 23 nt, Human
aacaucaacagaaagcuucaaaa

SEQ ID NO: 129470 - RNA, 25 nt, Human
agaaagcuucaaaagaugauucuga

SEQ ID NO: 129471 - RNA, 25 nt, Human
agaaagcuucaaaagaugauucuga

SEQ ID NO: 129472 - RNA, 18 nt, Human
aggagcccucaaagcuga

SEQ ID NO: 129473 - RNA, 23 nt, Human
aggaggaggggguaggugcugcu

SEQ ID NO: 129474 - RNA, 20 nt, Human
aguuaacaucaacagaaagc

SEQ ID NO: 129475 - RNA, 20 nt, Human
aguuaacaucaacagaaagc

SEQ ID NO: 129476 - RNA, 23 nt, Human
caaaauuucuuuuuauuguaggc

SEQ ID NO: 129477 - RNA, 23 nt, Human
caaaauuucuuuuuauuguaggc

SEQ ID NO: 129478 - RNA, 20 nt, Human
caacagaaagcuucaaaaga

SEQ ID NO: 129479 - RNA, 20 nt, Human
caacagaaagcuucaaaaga

SEQ ID NO: 129480 - RNA, 21 nt, Human
caguuaacaucaacagaaagc

SEQ ID NO: 129481 - RNA, 23 nt, Human
cauagccuguauugaauucacac

SEQ ID NO: 129482 - RNA, 23 nt, Human
cauagccuguauugaauucacac

SEQ ID NO: 129483 - RNA, 21 nt, Human
ccaguaaugauggggauuaau

SEQ ID NO: 129484 - RNA, 21 nt, Human
ccaguaaugauggggauuaau

SEQ ID NO: 129485 - RNA, 22 nt, Human
ccuccugcuucuacuccauagc

SEQ ID NO: 129486 - RNA, 23 nt, Human
cgggaauuugccacaggagcccu

SEQ ID NO: 129487 - RNA, 21 nt, Human
cuccugcuucuacuccauagc

SEQ ID NO: 129488 - RNA, 19 nt, Human
cugaaaagacucacacccg

SEQ ID NO: 129489 - RNA, 27 nt, Human
cugaaaauggcaggcaaaauuucuuuu

SEQ ID NO: 129490 - RNA, 27 nt, Human
cugaaaauggcaggcaaaauuucuuuu

SEQ ID NO: 129491 - RNA, 20 nt, Human
cuucuguguccccuggcuca

SEQ ID NO: 129492 - RNA, 24 nt, Human
gccacaggagcccucaaagcugag

SEQ ID NO: 129493 - RNA, 19 nt, Human
ggaggaggggguaggugcu

SEQ ID NO: 129494 - RNA, 20 nt, Human
guaaugauggggauuaauac

SEQ ID NO: 129495 - RNA, 20 nt, Human
guaaugauggggauuaauac

SEQ ID NO: 129496 - RNA, 21 nt, Human
uaaaaaugagggcuuucuuga

SEQ ID NO: 129497 - RNA, 21 nt, Human
uaaaaaugagggcuuucuuga

SEQ ID NO: 129498 - RNA, 24 nt, Human
uaaaugagauagugggcuucucuu

SEQ ID NO: 129499 - RNA, 18 nt, Human
uaacaagauuuugccagg

SEQ ID NO: 129500 - RNA, 18 nt, Human
uaacaagauuuugccagg

SEQ ID NO: 129501 - RNA, 22 nt, Human
uaagucauguggguaaaacauc

SEQ ID NO: 129502 - RNA, 22 nt, Human
uaagucauguggguaaaacauc

SEQ ID NO: 129503 - RNA, 19 nt, Human
uagguuuccaguaucuagc

SEQ ID NO: 129504 - RNA, 19 nt, Human
uagguuuccaguaucuagc

SEQ ID NO: 129505 - RNA, 23 nt, Human
uagugggcuucucuucugugucc

SEQ ID NO: 129506 - RNA, 24 nt, Human
ucacaaccagggaaccuuuuaauc

SEQ ID NO: 129507 - RNA, 18 nt, Human
uccaguaucuagcuuuua

SEQ ID NO: 129508 - RNA, 18 nt, Human
uccaguaucuagcuuuua

SEQ ID NO: 129509 - RNA, 20 nt, Human
uccccuggcucauccaggca

SEQ ID NO: 129510 - RNA, 28 nt, Human
ucugugacuagguugaaaaccggggucc

SEQ ID NO: 129511 - RNA, 23 nt, Human
ugaaaaccuccugcuucuacucc

SEQ ID NO: 129512 - RNA, 20 nt, Human
ugaaaagacucacacccgaa

SEQ ID NO: 129513 - RNA, 25 nt, Human
ugaauggcagagcgcacguagacac

SEQ ID NO: 129514 - RNA, 25 nt, Human
ugcagguguggaaaggaggaggggg

SEQ ID NO: 129515 - RNA, 26 nt, Human
ugccacaggagcccucaaagcugaga

SEQ ID NO: 129516 - RNA, 24 nt, Human
uggaaauuaaaaaagaaaagcuuu

SEQ ID NO: 129517 - RNA, 24 nt, Human
uggaaauuaaaaaagaaaagcuuu

SEQ ID NO: 129518 - RNA, 19 nt, Human
uggguaaaacauccacauu

SEQ ID NO: 129519 - RNA, 19 nt, Human
uggguaaaacauccacauu

SEQ ID NO: 129520 - RNA, 18 nt, Human
uguggaaaggaggagggg

SEQ ID NO: 129521 - RNA, 19 nt, Human
uguggaaaggaggaggggg

SEQ ID NO: 129522 - RNA, 20 nt, Human
uucacacauucaaaugaggc

SEQ ID NO: 129523 - RNA, 20 nt, Human
uucacacauucaaaugaggc

SEQ ID NO: 129524 - RNA, 23 nt, Human
uuccuggaaauuaaaaaagaaaa

SEQ ID NO: 129525 - RNA, 23 nt, Human
uuccuggaaauuaaaaaagaaaa

SEQ ID NO: 129526 - RNA, 23 nt, Human
uugcagguguggaaaggaggagg

SEQ ID NO: 129527 - RNA, 24 nt, Human
uugccagguuauaaaaaugagggc

SEQ ID NO: 129528 - RNA, 24 nt, Human
uugccagguuauaaaaaugagggc

SEQ ID NO: 129529 - RNA, 21 nt, Human
aaaaggaggaggcuuaaucaa

SEQ ID NO: 129530 - RNA, 24 nt, Human
aacgugcacacacaauuuuaugug

SEQ ID NO: 129531 - RNA, 22 nt, Human
aaucacagagguuacaugugug

SEQ ID NO: 129532 - RNA, 24 nt, Human
acucuuucagucuuuucuuuucag

SEQ ID NO: 129533 - RNA, 26 nt, Human
caacuaacagacuuaauuuccuuaga

SEQ ID NO: 129534 - RNA, 21 nt, Human
cacacaauuuuaugugauuca

SEQ ID NO: 129535 - RNA, 18 nt, Human
cccacaagaaucacagag

SEQ ID NO: 129536 - RNA, 18 nt, Human
cccucucccucccuccuu

SEQ ID NO: 129537 - RNA, 23 nt, Human
ccucccuccuuagcucuugacuu

SEQ ID NO: 129538 - RNA, 22 nt, Human
cgugcacacacaauuuuaugug

SEQ ID NO: 129539 - RNA, 21 nt, Human
cuaaacccucucccucccucc

SEQ ID NO: 129540 - RNA, 21 nt, Human
cucucucucucuuacuuuccu

SEQ ID NO: 129541 - RNA, 23 nt, Human
cuguggcuuggccagccucuucu

SEQ ID NO: 129542 - RNA, 25 nt, Human
gaaacuacagcuaagcaucuucuga

SEQ ID NO: 129543 - RNA, 23 nt, Human
ggaggcuuaaucaauauuggggg

SEQ ID NO: 129544 - RNA, 21 nt, Human
ggcuuaaucaauauugggggg

SEQ ID NO: 129545 - RNA, 23 nt, Human
uaaaaaaauacccacaagaauca

SEQ ID NO: 129546 - RNA, 26 nt, Human
uaacaaccaaauuuaaugaggguagc

SEQ ID NO: 129547 - RNA, 20 nt, Human
uacaugugugcacaugugua

SEQ ID NO: 129548 - RNA, 22 nt, Human
uauagaagaaccuaugucaaag

SEQ ID NO: 129549 - RNA, 24 nt, Human
uauuaugcugguauuucuaaaccc

SEQ ID NO: 129550 - RNA, 19 nt, Human
ucaaagaucuucaacucaa

SEQ ID NO: 129551 - RNA, 19 nt, Human
ucagaaaaggaggaggcuu

SEQ ID NO: 129552 - RNA, 22 nt, Human
ucuuucagucuuuucuuuucag

SEQ ID NO: 129553 - RNA, 21 nt, Human
ugaguuaauuuacagagcacc

SEQ ID NO: 129554 - RNA, 18 nt, Human
uggccagccucuucucuu

SEQ ID NO: 129555 - RNA, 21 nt, Human
ugucaaagaucuucaacucaa

SEQ ID NO: 129556 - RNA, 22 nt, Human
uguguacaugaacgugcacaca

SEQ ID NO: 129557 - RNA, 19 nt, Human
ugugugcacauguguacau

SEQ ID NO: 129558 - RNA, 20 nt, Human
ugugugcacauguguacaug

SEQ ID NO: 129559 - RNA, 21 nt, Human
uuaaugaggguagcgcuucuc

SEQ ID NO: 129560 - RNA, 20 nt, Human
uuacagagcacccagucaua

SEQ ID NO: 129561 - RNA, 23 nt, Human
uuagaagcgccucuaacaaccaa

SEQ ID NO: 129562 - RNA, 29 nt, Human
uucaaacaacuaacagacuuaauuuccuu

SEQ ID NO: 129563 - RNA, 19 nt, Human
uuccuugucucugucguac

SEQ ID NO: 129564 - RNA, 18 nt, Human
uuuccuugucucugucgu

SEQ ID NO: 129565 - RNA, 20 nt, Human
aagagaagggcaguaaugaa

SEQ ID NO: 129566 - RNA, 24 nt, Human
aagcaucaagugacacuucaaagc

SEQ ID NO: 129567 - RNA, 21 nt, Human
aagccaaguacccuagccccc

SEQ ID NO: 129568 - RNA, 21 nt, Human
aagcgaucagcugccuagagc

SEQ ID NO: 129569 - RNA, 22 nt, Human
acacggguaggggugggggcag

SEQ ID NO: 129570 - RNA, 23 nt, Human
acccacucaccaucacuguuccc

SEQ ID NO: 129571 - RNA, 19 nt, Human
acccacucccccagcuggc

SEQ ID NO: 129572 - RNA, 19 nt, Human
acccucagcacucaacucu

SEQ ID NO: 129573 - RNA, 21 nt, Human
accuuuggugguggggucuca

SEQ ID NO: 129574 - RNA, 20 nt, Human
acggggcaggaagagcuuaa

SEQ ID NO: 129575 - RNA, 21 nt, Human
acucaccaucacuguuccccu

SEQ ID NO: 129576 - RNA, 22 nt, Human
acucccccagcuggccaaagac

SEQ ID NO: 129577 - RNA, 27 nt, Human
agagaaaagguagaaaccuaggcagga

SEQ ID NO: 129578 - RNA, 23 nt, Human
agagagaaaagguagaaaccuag

SEQ ID NO: 129579 - RNA, 22 nt, Human
agaggaggcaggcccugcccag

SEQ ID NO: 129580 - RNA, 21 nt, Human
agcaaguccccucugcugccu

SEQ ID NO: 129581 - RNA, 21 nt, Human
agccaaaauaagggucucuca

SEQ ID NO: 129582 - RNA, 18 nt, Human
agccaaguacccuagccc

SEQ ID NO: 129583 - RNA, 20 nt, Human
agugaugggggcugaggagg

SEQ ID NO: 129584 - RNA, 18 nt, Human
caaagcaagccaaguacc

SEQ ID NO: 129585 - RNA, 19 nt, Human
caagccaaguacccuagcc

SEQ ID NO: 129586 - RNA, 21 nt, Human
caagcccugaggccccucagg

SEQ ID NO: 129587 - RNA, 27 nt, Human
caaggggaccucacuuaaccuuuggug

SEQ ID NO: 129588 - RNA, 24 nt, Human
caaguacccuagcccccucccaca

SEQ ID NO: 129589 - RNA, 22 nt, Human
cacacauagcaaagcaagccaa

SEQ ID NO: 129590 - RNA, 20 nt, Human
cacccggccucuacccacuc

SEQ ID NO: 129591 - RNA, 23 nt, Human
cacgugggccagaaacuaagggc

SEQ ID NO: 129592 - RNA, 19 nt, Human
cagagcggcaccagagggc

SEQ ID NO: 129593 - RNA, 21 nt, Human
cagccaaaauaagggucucuc

SEQ ID NO: 129594 - RNA, 18 nt, Human
cagccuaccccccacaag

SEQ ID NO: 129595 - RNA, 18 nt, Human
cagccuaccccccacaag

SEQ ID NO: 129596 - RNA, 19 nt, Human
cagcugccuagagccucca

SEQ ID NO: 129597 - RNA, 24 nt, Human
cagcuggccaaagacagagagaaa

SEQ ID NO: 129598 - RNA, 20 nt, Human
caggaagagcuuaacccacg

SEQ ID NO: 129599 - RNA, 18 nt, Human
ccacacagccaaaauaag

SEQ ID NO: 129600 - RNA, 21 nt, Human
cccacaagcccugaggccccu

SEQ ID NO: 129601 - RNA, 24 nt, Human
cccccacaagcccugaggccccuc

SEQ ID NO: 129602 - RNA, 21 nt, Human
cccccaggauguaaggccuca

SEQ ID NO: 129603 - RNA, 22 nt, Human
ccccccacaagcccugaggccc

SEQ ID NO: 129604 - RNA, 26 nt, Human
ccccccugcuucacgugggccagaaa

SEQ ID NO: 129605 - RNA, 21 nt, Human
cccggccucuacccacucccc

SEQ ID NO: 129606 - RNA, 25 nt, Human
cccggccucuacccacucccccagc

SEQ ID NO: 129607 - RNA, 21 nt, Human
cccgggucaaggugaaggggc

SEQ ID NO: 129608 - RNA, 19 nt, Human
ccuaccccccacaagcccu

SEQ ID NO: 129609 - RNA, 21 nt, Human
ccucacucgguggccuacacg

SEQ ID NO: 129610 - RNA, 24 nt, Human
ccuccacacagccaaaauaagggu

SEQ ID NO: 129611 - RNA, 23 nt, Human
ccucccacaaggcuggcaaaggu

SEQ ID NO: 129612 - RNA, 24 nt, Human
ccuccuagucuguacccacucacc

SEQ ID NO: 129613 - RNA, 18 nt, Human
cuacccacucccccagcu

SEQ ID NO: 129614 - RNA, 18 nt, Human
cuaccccccacaagcccu

SEQ ID NO: 129615 - RNA, 19 nt, Human
cuagagccuccacacagcc

SEQ ID NO: 129616 - RNA, 23 nt, Human
cuccuagucuguacccacucacc

SEQ ID NO: 129617 - RNA, 19 nt, Human
cucugcgcuagugcugcuc

SEQ ID NO: 129618 - RNA, 23 nt, Human
cucugcgcuagugcugcucuaga

SEQ ID NO: 129619 - RNA, 18 nt, Human
cugcccaggaggcagcaa

SEQ ID NO: 129620 - RNA, 23 nt, Human
cuggugcucuucucucucccucc

SEQ ID NO: 129621 - RNA, 18 nt, Human
cuguuccccucuccccca

SEQ ID NO: 129622 - RNA, 21 nt, Human
cuuuggugguggggucucagc

SEQ ID NO: 129623 - RNA, 19 nt, Human
gaaggcaacuucacacaca

SEQ ID NO: 129624 - RNA, 24 nt, Human
gaaggggacagcaggggaaaggag

SEQ ID NO: 129625 - RNA, 22 nt, Human
gagaaaagguagaaaccuaggc

SEQ ID NO: 129626 - RNA, 24 nt, Human
gagcaguugaacaacaaauuaugg

SEQ ID NO: 129627 - RNA, 22 nt, Human
gagguggcugugcaucgggcag

SEQ ID NO: 129628 - RNA, 22 nt, Human
gcaagagaagggcaguaaugaa

SEQ ID NO: 129629 - RNA, 24 nt, Human
gcaguaaugaaggcaacuucacac

SEQ ID NO: 129630 - RNA, 22 nt, Human
gccuagagccuccacacagcca

SEQ ID NO: 129631 - RNA, 18 nt, Human
gccuccacacagccaaaa

SEQ ID NO: 129632 - RNA, 20 nt, Human
ggcagugaugggggcugagg

SEQ ID NO: 129633 - RNA, 19 nt, Human
ggccagaaacuaagggcug

SEQ ID NO: 129634 - RNA, 20 nt, Human
ggcugugcaucgggcagagc

SEQ ID NO: 129635 - RNA, 18 nt, Human
gggaaugggaguggggga

SEQ ID NO: 129636 - RNA, 19 nt, Human
gggagugggggaacccggg

SEQ ID NO: 129637 - RNA, 19 nt, Human
gggagugggggaacccggg

SEQ ID NO: 129638 - RNA, 20 nt, Human
gggagugggggaacccgggg

SEQ ID NO: 129639 - RNA, 22 nt, Human
ggggugggggcagugauggggg

SEQ ID NO: 129640 - RNA, 24 nt, Human
ggggugggggcagugaugggggcu

SEQ ID NO: 129641 - RNA, 22 nt, Human
ggguccuagugccccccugcuu

SEQ ID NO: 129642 - RNA, 23 nt, Human
gggucgaaggggacagcagggga

SEQ ID NO: 129643 - RNA, 21 nt, Human
gggugggggcagugauggggg

SEQ ID NO: 129644 - RNA, 19 nt, Human
gugaagcugaacggggcag

SEQ ID NO: 129645 - RNA, 25 nt, Human
guggccuacacggguaggggugggg

SEQ ID NO: 129646 - RNA, 21 nt, Human
uaagggucucucaucuaccuu

SEQ ID NO: 129647 - RNA, 19 nt, Human
uacccuagcccccucccac

SEQ ID NO: 129648 - RNA, 24 nt, Human
uagccucuggguccuagugccccc

SEQ ID NO: 129649 - RNA, 23 nt, Human
uaggggugggggcagugaugggg

SEQ ID NO: 129650 - RNA, 24 nt, Human
ucacacacauagcaaagcaagcca

SEQ ID NO: 129651 - RNA, 22 nt, Human
ucacacugagccagaggaggca

SEQ ID NO: 129652 - RNA, 27 nt, Human
ucagcacucaacucuugaauacacugu

SEQ ID NO: 129653 - RNA, 22 nt, Human
ucagccuaccccccacaagccc

SEQ ID NO: 129654 - RNA, 21 nt, Human
uccccaguccaugggccucac

SEQ ID NO: 129655 - RNA, 22 nt, Human
ucccccagcuggccaaagacag

SEQ ID NO: 129656 - RNA, 20 nt, Human
uccccucugcugccugagga

SEQ ID NO: 129657 - RNA, 19 nt, Human
ucucagccuaccccccaca

SEQ ID NO: 129658 - RNA, 19 nt, Human
ugagccagaggaggcaggc

SEQ ID NO: 129659 - RNA, 18 nt, Human
ugaggauuccugaaccca

SEQ ID NO: 129660 - RNA, 19 nt, Human
ugagucucacucugcgcua

SEQ ID NO: 129661 - RNA, 18 nt, Human
ugccuagagccuccacac

SEQ ID NO: 129662 - RNA, 20 nt, Human
ugccuagagccuccacacag

SEQ ID NO: 129663 - RNA, 23 nt, Human
ugccuagagccuccacacagcca

SEQ ID NO: 129664 - RNA, 21 nt, Human
ugcucuagacuugucaggaac

SEQ ID NO: 129665 - RNA, 18 nt, Human
ugcucuucucucucccuc

SEQ ID NO: 129666 - RNA, 20 nt, Human
uggcagaggccagggaaugg

SEQ ID NO: 129667 - RNA, 24 nt, Human
ugggagugggggaacccgggucaa

SEQ ID NO: 129668 - RNA, 21 nt, Human
ugggggcugaggagcaagucc

SEQ ID NO: 129669 - RNA, 23 nt, Human
ugggggcuggcugagguggcugu

SEQ ID NO: 129670 - RNA, 22 nt, Human
uucacacacauagcaaagcaag

SEQ ID NO: 129671 - RNA, 18 nt, Human
aacccuuuccccaccaag

SEQ ID NO: 129672 - RNA, 22 nt, Human
aaggagcuacccaagguuagca

SEQ ID NO: 129673 - RNA, 21 nt, Human
acagccuccagggaacagcca

SEQ ID NO: 129674 - RNA, 22 nt, Human
augaauccauagccugacaaaa

SEQ ID NO: 129675 - RNA, 19 nt, Human
caagcccucuuuccuacuc

SEQ ID NO: 129676 - RNA, 21 nt, Human
cacacaugcccacaugacuaa

SEQ ID NO: 129677 - RNA, 23 nt, Human
cacacaugcccacaugacuaaca

SEQ ID NO: 129678 - RNA, 18 nt, Human
cagccuccagggaacagc

SEQ ID NO: 129679 - RNA, 18 nt, Human
ccccagaauaaacuaaga

SEQ ID NO: 129680 - RNA, 26 nt, Human
ccuaucaaauuggaacuucgggcuaa

SEQ ID NO: 129681 - RNA, 24 nt, Human
ccucagagacugacaguggcuccu

SEQ ID NO: 129682 - RNA, 20 nt, Human
ccuugaagagaacagaagga

SEQ ID NO: 129683 - RNA, 21 nt, Human
cuaaugugugcauccccuccc

SEQ ID NO: 129684 - RNA, 18 nt, Human
gcauccccuccccccaga

SEQ ID NO: 129685 - RNA, 21 nt, Human
guaaaugaauccauagccuga

SEQ ID NO: 129686 - RNA, 21 nt, Human
uacccaagguuagcaucucca

SEQ ID NO: 129687 - RNA, 24 nt, Human
uagccugacaaaauuccccuugaa

SEQ ID NO: 129688 - RNA, 24 nt, Human
uccucacacaugcccacaugacua

SEQ ID NO: 129689 - RNA, 24 nt, Human
uccuuuaaagggacagccuccagg

SEQ ID NO: 129690 - RNA, 21 nt, Human
ucgggcuaaauacauuaaaac

SEQ ID NO: 129691 - RNA, 22 nt, Human
ucuguuuccucacacaugccca

SEQ ID NO: 129692 - RNA, 19 nt, Human
ugcauccccuccccccaga

SEQ ID NO: 129693 - RNA, 18 nt, Human
uggaaccucagagacuga

SEQ ID NO: 129694 - RNA, 24 nt, Human
uguuuccucacacaugcccacaug

SEQ ID NO: 129695 - RNA, 21 nt, Human
aggacagaguugguggagaag

SEQ ID NO: 129696 - RNA, 21 nt, Human
auggggcaggggcgcgacggu

SEQ ID NO: 129697 - RNA, 19 nt, Human
cagcaguaccccaaggcca

SEQ ID NO: 129698 - RNA, 20 nt, Human
cagcggccacccccacuccu

SEQ ID NO: 129699 - RNA, 20 nt, Human
cagcggccacccccacuccu

SEQ ID NO: 129700 - RNA, 23 nt, Human
cauauacuacgauggggcagggg

SEQ ID NO: 129701 - RNA, 18 nt, Human
ccacacagacucccccuc

SEQ ID NO: 129702 - RNA, 25 nt, Human
ccaguggauccuuuucccuacacuc

SEQ ID NO: 129703 - RNA, 20 nt, Human
ccccaccccccgaggacaga

SEQ ID NO: 129704 - RNA, 21 nt, Human
ccccccgaggacagaguuggu

SEQ ID NO: 129705 - RNA, 18 nt, Human
ccccgucuucaagccucg

SEQ ID NO: 129706 - RNA, 22 nt, Human
cccgucuucaagccucggggac

SEQ ID NO: 129707 - RNA, 20 nt, Human
cccuccuuccccuucuacuu

SEQ ID NO: 129708 - RNA, 23 nt, Human
cccuccuuccccuucuacuuccu

SEQ ID NO: 129709 - RNA, 18 nt, Human
ccucggggacugggagcu

SEQ ID NO: 129710 - RNA, 22 nt, Human
ccucggggacugggagcucugg

SEQ ID NO: 129711 - RNA, 19 nt, Human
cggcuggggccccaccccc

SEQ ID NO: 129712 - RNA, 22 nt, Human
cuccggggcauugucuaagcgg

SEQ ID NO: 129713 - RNA, 25 nt, Human
cucggggacugggagcucuggcuuu

SEQ ID NO: 129714 - RNA, 18 nt, Human
gcggccacccccacuccu

SEQ ID NO: 129715 - RNA, 18 nt, Human
gggacugggagcucuggc

SEQ ID NO: 129716 - RNA, 23 nt, Human
ucagcauucucuaucuaacccuc

SEQ ID NO: 129717 - RNA, 21 nt, Human
uccacacagacucccccucca

SEQ ID NO: 129718 - RNA, 22 nt, Human
ucccaacuacugccuauucagc

SEQ ID NO: 129719 - RNA, 22 nt, Human
ucccuacacucuccccuccccc

SEQ ID NO: 129720 - RNA, 24 nt, Human
ucccuacacucuccccucccccaa

SEQ ID NO: 129721 - RNA, 21 nt, Human
ucuacuuccuauacuauccua

SEQ ID NO: 129722 - RNA, 23 nt, Human
ucuucaccugucuccagcggcca

SEQ ID NO: 129723 - RNA, 21 nt, Human
uggggccccaccccccgagga

SEQ ID NO: 129724 - RNA, 19 nt, Human
uguuucuucaccugucucc

SEQ ID NO: 129725 - RNA, 21 nt, Human
uuuuuuuuuuuuuaaaagguc

SEQ ID NO: 129726 - RNA, 24 nt, Human
uuuuuuuuuuuuuuuuuuaaaagg

SEQ ID NO: 129727 - RNA, 21 nt, Human
aaaaagaggacaaugcaugag

SEQ ID NO: 129728 - RNA, 24 nt, Human
aaacuaacaauucacauccuccca

SEQ ID NO: 129729 - RNA, 21 nt, Human
aacccucuuccccacuaccca

SEQ ID NO: 129730 - RNA, 22 nt, Human
aacccucuuccccacuacccac

SEQ ID NO: 129731 - RNA, 23 nt, Human
aacccucuuccccacuacccaca

SEQ ID NO: 129732 - RNA, 22 nt, Human
aagaagacgaugguggagagga

SEQ ID NO: 129733 - RNA, 18 nt, Human
aaggggcccccugcccuu

SEQ ID NO: 129734 - RNA, 18 nt, Human
acaacucccuacacugcc

SEQ ID NO: 129735 - RNA, 19 nt, Human
acaagcgaaaagacaggug

SEQ ID NO: 129736 - RNA, 23 nt, Human
acacacacacacauacacacaca

SEQ ID NO: 129737 - RNA, 23 nt, Human
acacacacacauacacacacaca

SEQ ID NO: 129738 - RNA, 23 nt, Human
acacacauacacacacacacacg

SEQ ID NO: 129739 - RNA, 21 nt, Human
acacauacacacacacacaua

SEQ ID NO: 129740 - RNA, 18 nt, Human
acagguggcccccaacag

SEQ ID NO: 129741 - RNA, 22 nt, Human
acccucuuccccacuacccacu

SEQ ID NO: 129742 - RNA, 20 nt, Human
agaaagagggacacaagcga

SEQ ID NO: 129743 - RNA, 22 nt, Human
agaggagggggagggcagcagg

SEQ ID NO: 129744 - RNA, 21 nt, Human
agagggacacaagcgaaaaga

SEQ ID NO: 129745 - RNA, 18 nt, Human
agggcaaagccuuugggg

SEQ ID NO: 129746 - RNA, 23 nt, Human
agggucagcaaaggggcccccug

SEQ ID NO: 129747 - RNA, 23 nt, Human
auacacacacacacauacacaca

SEQ ID NO: 129748 - RNA, 24 nt, Human
auacacacacacacauacacacac

SEQ ID NO: 129749 - RNA, 24 nt, Human
cacacacacacauacacacacaca

SEQ ID NO: 129750 - RNA, 22 nt, Human
cacacacauacacacacacaca

SEQ ID NO: 129751 - RNA, 28 nt, Human
cacacacauacacacacacacacgcaca

SEQ ID NO: 129752 - RNA, 22 nt, Human
cagcaaaggggcccccugcccu

SEQ ID NO: 129753 - RNA, 23 nt, Human
cagcagggcaaagccuuugggga

SEQ ID NO: 129754 - RNA, 22 nt, Human
cagcuuccuuucagccaaagaa

SEQ ID NO: 129755 - RNA, 22 nt, Human
cauacacacacacacacgcaca

SEQ ID NO: 129756 - RNA, 20 nt, Human
cauccaccaucuccagguuu

SEQ ID NO: 129757 - RNA, 25 nt, Human
ccacaacucccuacacugccaaucu

SEQ ID NO: 129758 - RNA, 19 nt, Human
cccacuuccacauagggga

SEQ ID NO: 129759 - RNA, 23 nt, Human
cccauggccaagaagaccggggc

SEQ ID NO: 129760 - RNA, 25 nt, Human
ccccaacagcgcgcagcgaacucca

SEQ ID NO: 129761 - RNA, 20 nt, Human
ccccacuacccacaacuccc

SEQ ID NO: 129762 - RNA, 24 nt, Human
ccccacuacccacaacucccuaca

SEQ ID NO: 129763 - RNA, 21 nt, Human
ccccggaaggaggacaacugg

SEQ ID NO: 129764 - RNA, 23 nt, Human
cccuccuaacccucuuccccacu

SEQ ID NO: 129765 - RNA, 22 nt, Human
ccuaacccucuuccccacuacc

SEQ ID NO: 129766 - RNA, 23 nt, Human
ccucccaccuucuucuuuccgaa

SEQ ID NO: 129767 - RNA, 19 nt, Human
ccucuaggccugaugcucu

SEQ ID NO: 129768 - RNA, 22 nt, Human
ccuuuggggagggucagcaaag

SEQ ID NO: 129769 - RNA, 20 nt, Human
cuaaauaaaaagaggacaau

SEQ ID NO: 129770 - RNA, 21 nt, Human
cucagaaacuaacaauucaca

SEQ ID NO: 129771 - RNA, 22 nt, Human
cuugguggucuaaggugauggc

SEQ ID NO: 129772 - RNA, 23 nt, Human
gagacugguaaaaauccagggag

SEQ ID NO: 129773 - RNA, 29 nt, Human
gagauacacauacacacacacacauacac

SEQ ID NO: 129774 - RNA, 23 nt, Human
gcacagcuuccuuucagccaaag

SEQ ID NO: 129775 - RNA, 19 nt, Human
gcgaaaagacagguggccc

SEQ ID NO: 129776 - RNA, 22 nt, Human
gcgaaaagacagguggccccca

SEQ ID NO: 129777 - RNA, 22 nt, Human
gcgacacuagaaagagggacac

SEQ ID NO: 129778 - RNA, 18 nt, Human
ggaggacaacuggcaaca

SEQ ID NO: 129779 - RNA, 25 nt, Human
ggcaauagaagaaaaguaaaaggaa

SEQ ID NO: 129780 - RNA, 19 nt, Human
gggaacuguggcucugggg

SEQ ID NO: 129781 - RNA, 18 nt, Human
gucucacuucacagacaa

SEQ ID NO: 129782 - RNA, 31 nt, Human
gugugagauacacauacacacacacacauag

SEQ ID NO: 129783 - RNA, 22 nt, Human
uacacacacacacacgcacagc

SEQ ID NO: 129784 - RNA, 23 nt, Human
uacacacacacacacgcacagcu

SEQ ID NO: 129785 - RNA, 21 nt, Human
uacacugccaaucuaaauaaa

SEQ ID NO: 129786 - RNA, 22 nt, Human
uagaagaaaaguaaaaggaagg

SEQ ID NO: 129787 - RNA, 19 nt, Human
uaugaagcccgccccacuu

SEQ ID NO: 129788 - RNA, 18 nt, Human
ucacauccucccaccuuc

SEQ ID NO: 129789 - RNA, 22 nt, Human
ucagccaaagaacugcaaaauc

SEQ ID NO: 129790 - RNA, 18 nt, Human
ucucagaggcaauagaag

SEQ ID NO: 129791 - RNA, 21 nt, Human
uggagaggagggggagggcag

SEQ ID NO: 129792 - RNA, 22 nt, Human
uggggagggucagcaaaggggc

SEQ ID NO: 129793 - RNA, 23 nt, Human
uggggagggucagcaaaggggcc

SEQ ID NO: 129794 - RNA, 21 nt, Human
ugguaaaaauccagggagaaa

SEQ ID NO: 129795 - RNA, 18 nt, Human
ugguggagaggaggggga

SEQ ID NO: 129796 - RNA, 22 nt, Human
ugguggagaggagggggagggc

SEQ ID NO: 129797 - RNA, 24 nt, Human
ugguggagaggagggggagggcag

SEQ ID NO: 129798 - RNA, 24 nt, Human
uucuucuuuccgaagaaggcaguu

SEQ ID NO: 129799 - RNA, 21 nt, Human
aagagcacaaaucaaauaacu

SEQ ID NO: 129800 - RNA, 23 nt, Human
acuacaaaacugcggggccacag

SEQ ID NO: 129801 - RNA, 24 nt, Human
agaaacaaggcggggacuacaaaa

SEQ ID NO: 129802 - RNA, 22 nt, Human
agcuaagccaacuucccgccaa

SEQ ID NO: 129803 - RNA, 23 nt, Human
agggcuuguucaaaccagcuugg

SEQ ID NO: 129804 - RNA, 20 nt, Human
aggggcccuugggacagcug

SEQ ID NO: 129805 - RNA, 20 nt, Human
augugugggcuccaaggccu

SEQ ID NO: 129806 - RNA, 20 nt, Human
caaauaacugcuugaucccc

SEQ ID NO: 129807 - RNA, 28 nt, Human
caacccuaaccuuggauacuuuuggccc

SEQ ID NO: 129808 - RNA, 20 nt, Human
caaggcggggacuacaaaac

SEQ ID NO: 129809 - RNA, 23 nt, Human
caccccugcuccaacccuaaccu

SEQ ID NO: 129810 - RNA, 21 nt, Human
cagcaccccugcuccaacccu

SEQ ID NO: 129811 - RNA, 18 nt, Human
cccacaccuucuuuagug

SEQ ID NO: 129812 - RNA, 21 nt, Human
cccagcaccccugcuccaacc

SEQ ID NO: 129813 - RNA, 18 nt, Human
ccccaggucccagcaccc

SEQ ID NO: 129814 - RNA, 24 nt, Human
ccccaggucccagcaccccugcuc

SEQ ID NO: 129815 - RNA, 18 nt, Human
cccucugcuaccacccac

SEQ ID NO: 129816 - RNA, 30 nt, Human
cuccaacccuaaccuuggauacuuuuggcc

SEQ ID NO: 129817 - RNA, 19 nt, Human
cuucccgccaaacaugccc

SEQ ID NO: 129818 - RNA, 20 nt, Human
gagcagucucuggaggcaag

SEQ ID NO: 129819 - RNA, 18 nt, Human
gagggaggauugagaggc

SEQ ID NO: 129820 - RNA, 21 nt, Human
gaucccucugcuaccacccac

SEQ ID NO: 129821 - RNA, 23 nt, Human
gcccagggcuuguucaaaccagc

SEQ ID NO: 129822 - RNA, 22 nt, Human
ggacuacaaaacugcggggcca

SEQ ID NO: 129823 - RNA, 21 nt, Human
ggaggauugagaggccucugg

SEQ ID NO: 129824 - RNA, 20 nt, Human
gugugggcuccaaggccuug

SEQ ID NO: 129825 - RNA, 20 nt, Human
ucaaaagagcacaaaucaaa

SEQ ID NO: 129826 - RNA, 19 nt, Human
uccaacccuaaccuuggau

SEQ ID NO: 129827 - RNA, 18 nt, Human
ucccagucccacagugcc

SEQ ID NO: 129828 - RNA, 25 nt, Human
ucccagucccacagugccccagguc

SEQ ID NO: 129829 - RNA, 20 nt, Human
ucuggagcagucucuggagg

SEQ ID NO: 129830 - RNA, 21 nt, Human
ugagaggagaaaagucauuua

SEQ ID NO: 129831 - RNA, 20 nt, Human
ugaucccucugcuaccaccc

SEQ ID NO: 129832 - RNA, 19 nt, Human
ugcaggacuugaucccaug

SEQ ID NO: 129833 - RNA, 25 nt, Human
ugcuugaucccucugcuaccaccca

SEQ ID NO: 129834 - RNA, 27 nt, Human
ugcuugaucccucugcuaccacccacu

SEQ ID NO: 129835 - RNA, 18 nt, Human
ugggcuccaaggccuugu

SEQ ID NO: 129836 - RNA, 22 nt, Human
ugucuggcccacaccuucuuua

SEQ ID NO: 129837 - RNA, 24 nt, Human
aacccucuggauggcuuuggagaa

SEQ ID NO: 129838 - RNA, 20 nt, Human
aagcagacaaaaucacaacc

SEQ ID NO: 129839 - RNA, 24 nt, Human
acaaaagacaauuugaagaccaca

SEQ ID NO: 129840 - RNA, 24 nt, Human
agacaugggaagccacagacagcu

SEQ ID NO: 129841 - RNA, 18 nt, Human
caaaaucacaacccucug

SEQ ID NO: 129842 - RNA, 24 nt, Human
cacagcuaaugaauaaaagcuaug

SEQ ID NO: 129843 - RNA, 19 nt, Human
cagugaggcuuuccuacca

SEQ ID NO: 129844 - RNA, 24 nt, Human
ggugaaaaaggcagccgggaguga

SEQ ID NO: 129845 - RNA, 22 nt, Human
uagccacaugacaaaagacaau

SEQ ID NO: 129846 - RNA, 24 nt, Human
ugcgugaacauugauugcccugga

SEQ ID NO: 129847 - RNA, 24 nt, Human
uggagaaagacaugggaagccaca

SEQ ID NO: 129848 - RNA, 24 nt, Human
ugucagaggugaaaaaggcagccg

SEQ ID NO: 129849 - RNA, 22 nt, Human
uucaaguugcgugaacauugau

SEQ ID NO: 129850 - RNA, 22 nt, Human
uuccaguuuucagauauaucuc

SEQ ID NO: 129851 - RNA, 20 nt, Human
uuuccuaccacuucugauga

SEQ ID NO: 129852 - RNA, 20 nt, Human
aaacauggcugggaugaaaa

SEQ ID NO: 129853 - RNA, 21 nt, Human
aacaaagagcaugggaaaaga

SEQ ID NO: 129854 - RNA, 20 nt, Human
aagcaaauguagugccagaa

SEQ ID NO: 129855 - RNA, 22 nt, Human
aagcaaauguagugccagaaug

SEQ ID NO: 129856 - RNA, 24 nt, Human
aagugcuagaugccaaggauggcu

SEQ ID NO: 129857 - RNA, 23 nt, Human
acugacuguggaguacaacuauu

SEQ ID NO: 129858 - RNA, 21 nt, Human
agaaagccagugauuagaaac

SEQ ID NO: 129859 - RNA, 19 nt, Human
agagcaugggaaaagaaac

SEQ ID NO: 129860 - RNA, 23 nt, Human
agcagaacuaaauuaauauucac

SEQ ID NO: 129861 - RNA, 24 nt, Human
auaacacaauaugucaauccauac

SEQ ID NO: 129862 - RNA, 20 nt, Human
auacugcauuguuaggaaca

SEQ ID NO: 129863 - RNA, 23 nt, Human
auacuggugaaggcagaaaacca

SEQ ID NO: 129864 - RNA, 21 nt, Human
augaguuucuuacucuguaac

SEQ ID NO: 129865 - RNA, 18 nt, Human
caaauguagugccagaau

SEQ ID NO: 129866 - RNA, 23 nt, Human
caaauguagugccagaaugacac

SEQ ID NO: 129867 - RNA, 22 nt, Human
caacacacauuauaucccccuc

SEQ ID NO: 129868 - RNA, 25 nt, Human
caagauucucugcuuaaaaauauua

SEQ ID NO: 129869 - RNA, 20 nt, Human
caaguuuaaaaaauguacaa

SEQ ID NO: 129870 - RNA, 19 nt, Human
cacugagcacuguaacgau

SEQ ID NO: 129871 - RNA, 26 nt, Human
cagaacccaccucuuugcuaauguug

SEQ ID NO: 129872 - RNA, 27 nt, Human
cagagcuuaagacuggaaaaauuaucu

SEQ ID NO: 129873 - RNA, 22 nt, Human
cagagucaauucuaugccuuuc

SEQ ID NO: 129874 - RNA, 24 nt, Human
cauacaguagggaaacugugugaa

SEQ ID NO: 129875 - RNA, 18 nt, Human
cauagcagcguucaaaaa

SEQ ID NO: 129876 - RNA, 19 nt, Human
ccugaaauuugaacuucau

SEQ ID NO: 129877 - RNA, 24 nt, Human
ccuggaaaacagaacccaccucuu

SEQ ID NO: 129878 - RNA, 18 nt, Human
ccuggauucuacauacag

SEQ ID NO: 129879 - RNA, 20 nt, Human
ccuuucaacgguugcuggag

SEQ ID NO: 129880 - RNA, 25 nt, Human
cucacucauugccaagauucucugc

SEQ ID NO: 129881 - RNA, 22 nt, Human
cucauugccaagauucucugcu

SEQ ID NO: 129882 - RNA, 22 nt, Human
cugagguggcccuuccaugagu

SEQ ID NO: 129883 - RNA, 24 nt, Human
cugucauggagcuaaaaguuucac

SEQ ID NO: 129884 - RNA, 18 nt, Human
gaaaacagaacccaccuc

SEQ ID NO: 129885 - RNA, 23 nt, Human
gaaacaaauauuguugcaaccuu

SEQ ID NO: 129886 - RNA, 18 nt, Human
gagcaaccucagaugcag

SEQ ID NO: 129887 - RNA, 19 nt, Human
gaggcuaauauuuucuggc

SEQ ID NO: 129888 - RNA, 23 nt, Human
gaugaaaagaaaacugagaggga

SEQ ID NO: 129889 - RNA, 23 nt, Human
gaugcagacuuccauccggacac

SEQ ID NO: 129890 - RNA, 20 nt, Human
gcuauucaaaguuuguauag

SEQ ID NO: 129891 - RNA, 18 nt, Human
guuacaugaaggcagcag

SEQ ID NO: 129892 - RNA, 18 nt, Human
uaaaagacugaaauacaa

SEQ ID NO: 129893 - RNA, 21 nt, Human
uaaaaugccauaaagaguuuu

SEQ ID NO: 129894 - RNA, 23 nt, Human
uaacaaagagcaugggaaaagaa

SEQ ID NO: 129895 - RNA, 19 nt, Human
uaacacaauaugucaaucc

SEQ ID NO: 129896 - RNA, 22 nt, Human
uaacagcagcuauauacacacu

SEQ ID NO: 129897 - RNA, 18 nt, Human
uaauauucacugagcacu

SEQ ID NO: 129898 - RNA, 21 nt, Human
uacaacacacauuauaucccc

SEQ ID NO: 129899 - RNA, 22 nt, Human
uacaacacacauuauauccccc

SEQ ID NO: 129900 - RNA, 23 nt, Human
uauagcaaccacuuaagcagaac

SEQ ID NO: 129901 - RNA, 22 nt, Human
ucaaaguuuguauagcaaccac

SEQ ID NO: 129902 - RNA, 21 nt, Human
ucaccuggaaaacagaacccu

SEQ ID NO: 129903 - RNA, 21 nt, Human
ucagugaauauuuugcugaag

SEQ ID NO: 129904 - RNA, 23 nt, Human
uccaagaacaaaacuaagaaaau

SEQ ID NO: 129905 - RNA, 18 nt, Human
ucucacucauugccaaga

SEQ ID NO: 129906 - RNA, 19 nt, Human
ugaaggcagaaaaccacag

SEQ ID NO: 129907 - RNA, 18 nt, Human
ugacuugaagguggacag

SEQ ID NO: 129908 - RNA, 21 nt, Human
uggaagagggcuuuuccuaaa

SEQ ID NO: 129909 - RNA, 22 nt, Human
uguaaaagacugaaauacaaug

SEQ ID NO: 129910 - RNA, 19 nt, Human
ugucuaaacuugcaugagg

SEQ ID NO: 129911 - RNA, 21 nt, Human
uuaacugagcacuuuucugua

SEQ ID NO: 129912 - RNA, 23 nt, Human
uuaauauucacugagcacuguaa

SEQ ID NO: 129913 - RNA, 23 nt, Human
uucacaugugcccugacacugag

SEQ ID NO: 129914 - RNA, 23 nt, Human
uucuuacucuguaacagcagcua

SEQ ID NO: 129915 - RNA, 25 nt, Human
uucuuugcuauuugucaauacugau

SEQ ID NO: 129916 - RNA, 23 nt, Human
uugguuccugaaauuugaacuuc

SEQ ID NO: 129917 - RNA, 27 nt, Human
aaaaaaacaaaaacaaaaaacuacaga

SEQ ID NO: 129918 - RNA, 22 nt, Human
aaaaacuacagauauaacacau

SEQ ID NO: 129919 - RNA, 21 nt, Human
aaaacaccuaaagcauauaaa

SEQ ID NO: 129920 - RNA, 23 nt, Human
aaaacaccuaaagcauauaaacu

SEQ ID NO: 129921 - RNA, 21 nt, Human
aaaauagcauccuaagcugca

SEQ ID NO: 129922 - RNA, 20 nt, Human
aaaaugccagaauccugcag

SEQ ID NO: 129923 - RNA, 23 nt, Human
aaacaaaaacaaaaaacuacaga

SEQ ID NO: 129924 - RNA, 23 nt, Human
aaacaaaaaguacaaugccaaaa

SEQ ID NO: 129925 - RNA, 21 nt, Human
aaaugccagaauccugcagcu

SEQ ID NO: 129926 - RNA, 24 nt, Human
aacaaaaaguacaaugccaaaaaa

SEQ ID NO: 129927 - RNA, 26 nt, Human
aacaaaaaguacaaugccaaaaaaaa

SEQ ID NO: 129928 - RNA, 19 nt, Human
aacagauguagugcuuuaa

SEQ ID NO: 129929 - RNA, 27 nt, Human
aaggcaaauuccaaaacaccuaaagca

SEQ ID NO: 129930 - RNA, 19 nt, Human
aaguaaucaggugaaugaa

SEQ ID NO: 129931 - RNA, 18 nt, Human
aauacagaugcaggagga

SEQ ID NO: 129932 - RNA, 19 nt, Human
aaucaaaugcaccaucaca

SEQ ID NO: 129933 - RNA, 24 nt, Human
aaugcaggaagaauuuauucauua

SEQ ID NO: 129934 - RNA, 22 nt, Human
acaaaaacaaaaaguacaaugc

SEQ ID NO: 129935 - RNA, 22 nt, Human
acaaaaaguacaaugccaaaaa

SEQ ID NO: 129936 - RNA, 18 nt, Human
acaaacaguucaugaaac

SEQ ID NO: 129937 - RNA, 21 nt, Human
acagcauggucugcgccacag

SEQ ID NO: 129938 - RNA, 23 nt, Human
acaguugugcugcaaccaaagua

SEQ ID NO: 129939 - RNA, 22 nt, Human
agcagcaguucacuggccgccu

SEQ ID NO: 129940 - RNA, 21 nt, Human
agcgagccccgaggcgggcgc

SEQ ID NO: 129941 - RNA, 18 nt, Human
agcuggcaccaggugguc

SEQ ID NO: 129942 - RNA, 24 nt, Human
aggaaacagcaagugauguguuaa

SEQ ID NO: 129943 - RNA, 18 nt, Human
aggaaguucaagaaggca

SEQ ID NO: 129944 - RNA, 22 nt, Human
auaacaaaaacaaaaaguacaa

SEQ ID NO: 129945 - RNA, 21 nt, Human
auacagcauggucugcgccac

SEQ ID NO: 129946 - RNA, 21 nt, Human
auacaucucaaaauagcaucc

SEQ ID NO: 129947 - RNA, 23 nt, Human
auccaccccuuaacagaucacac

SEQ ID NO: 129948 - RNA, 21 nt, Human
augccaaaaaaaaaaaaaacu

SEQ ID NO: 129949 - RNA, 22 nt, Human
augccaaaaaaaaaaaaaacuc

SEQ ID NO: 129950 - RNA, 23 nt, Human
augccuauuuauucucagagugc

SEQ ID NO: 129951 - RNA, 23 nt, Human
caaaacaccuaaagcauauaaac

SEQ ID NO: 129952 - RNA, 22 nt, Human
caaaaggcugacuauaaaauac

SEQ ID NO: 129953 - RNA, 18 nt, Human
caaaauagcauccuaagc

SEQ ID NO: 129954 - RNA, 20 nt, Human
caaaauagcauccuaagcug

SEQ ID NO: 129955 - RNA, 21 nt, Human
caaaaugccagaauccugcag

SEQ ID NO: 129956 - RNA, 18 nt, Human
caauagcaccaaauugua

SEQ ID NO: 129957 - RNA, 19 nt, Human
caccagguggucaaaaggc

SEQ ID NO: 129958 - RNA, 20 nt, Human
caccgccgcugccgccgccg

SEQ ID NO: 129959 - RNA, 20 nt, Human
caccgccgcugccgccgccg

SEQ ID NO: 129960 - RNA, 18 nt, Human
caccuaaagcauauaaac

SEQ ID NO: 129961 - RNA, 23 nt, Human
caccuaaagcauauaaacuaauu

SEQ ID NO: 129962 - RNA, 20 nt, Human
cacucaguaggaaacagcaa

SEQ ID NO: 129963 - RNA, 22 nt, Human
cagaauccugcagcugcaguuc

SEQ ID NO: 129964 - RNA, 18 nt, Human
cagagcaguggcauuaga

SEQ ID NO: 129965 - RNA, 22 nt, Human
cagagugccaaaauuuccaaua

SEQ ID NO: 129966 - RNA, 23 nt, Human
cagccgcaggggcgccgccgccu

SEQ ID NO: 129967 - RNA, 21 nt, Human
cauaugccuauuuauucucag

SEQ ID NO: 129968 - RNA, 30 nt, Human
ccgccgcucggacaccgccgcugccgccgg

SEQ ID NO: 129969 - RNA, 19 nt, Human
ccgccgcugccgccgccgc

SEQ ID NO: 129970 - RNA, 19 nt, Human
ccucccgcggagaggggcg

SEQ ID NO: 129971 - RNA, 19 nt, Human
ccugggcuagaagggaagg

SEQ ID NO: 129972 - RNA, 20 nt, Human
cgaggcgggcgcgcacagcc

SEQ ID NO: 129973 - RNA, 22 nt, Human
cgccgcugccgccgccgcuccg

SEQ ID NO: 129974 - RNA, 20 nt, Human
cggcccgcggacaaagggga

SEQ ID NO: 129975 - RNA, 21 nt, Human
cuaguuaacaagaagaguaaa

SEQ ID NO: 129976 - RNA, 18 nt, Human
cugcauuaaggacaauga

SEQ ID NO: 129977 - RNA, 18 nt, Human
cugccucacuuuccaagc

SEQ ID NO: 129978 - RNA, 20 nt, Human
cugcgccacagaauucuacu

SEQ ID NO: 129979 - RNA, 18 nt, Human
cugcgcgccgagggcucc

SEQ ID NO: 129980 - RNA, 20 nt, Human
cuggcgcacagccgcagggg

SEQ ID NO: 129981 - RNA, 22 nt, Human
cuuaacagaucacacaguuacu

SEQ ID NO: 129982 - RNA, 25 nt, Human
gaacagaaugaacuguaguuacuac

SEQ ID NO: 129983 - RNA, 24 nt, Human
gccacccagccgcgggccccgacg

SEQ ID NO: 129984 - RNA, 20 nt, Human
gccgcaggggcgccgccgcc

SEQ ID NO: 129985 - RNA, 18 nt, Human
gcgcgggagccgcgcggg

SEQ ID NO: 129986 - RNA, 20 nt, Human
ggacaaaggggagcgccggg

SEQ ID NO: 129987 - RNA, 20 nt, Human
ggucaaaaggcugacuauaa

SEQ ID NO: 129988 - RNA, 24 nt, Human
uaaaaaaaaacaaaaacaaaaaac

SEQ ID NO: 129989 - RNA, 18 nt, Human
uaaauagauaucuacaau

SEQ ID NO: 129990 - RNA, 28 nt, Human
uaacaaaaacaaaaaguacaaugccaaa

SEQ ID NO: 129991 - RNA, 19 nt, Human
uaacaagaagaguaaacuu

SEQ ID NO: 129992 - RNA, 21 nt, Human
uaacagcauugcugccucacu

SEQ ID NO: 129993 - RNA, 22 nt, Human
uaagaguacuauuaguuacugc

SEQ ID NO: 129994 - RNA, 22 nt, Human
uaauaaagacaagcugcuucag

SEQ ID NO: 129995 - RNA, 21 nt, Human
uaaucaggugaaugaacugaa

SEQ ID NO: 129996 - RNA, 23 nt, Human
uacaaugccaaaaaaaaaaaaaa

SEQ ID NO: 129997 - RNA, 25 nt, Human
uacaaugccaaaaaaaaaaaaaacu

SEQ ID NO: 129998 - RNA, 27 nt, Human
uacaaugccaaaaaaaaaaaaaacucu

SEQ ID NO: 129999 - RNA, 19 nt, Human
uagaagggaaggcaguggu

SEQ ID NO: 130000 - RNA, 23 nt, Human
uagaggcaggaucuugauuaugu

SEQ ID NO: 130001 - RNA, 22 nt, Human
uaguugcuuuuuuaauuugcaa

SEQ ID NO: 130002 - RNA, 18 nt, Human
uccaucauccuuaguuuu

SEQ ID NO: 130003 - RNA, 24 nt, Human
uccucuacuaccaccccaaguagc

SEQ ID NO: 130004 - RNA, 19 nt, Human
ugaaaaccacaaauuauaa

SEQ ID NO: 130005 - RNA, 20 nt, Human
ugauagcugcaaccucacaa

SEQ ID NO: 130006 - RNA, 21 nt, Human
ugccaaaaaaaaaaaaaacuc

SEQ ID NO: 130007 - RNA, 21 nt, Human
uggaaaaauauuuccuaggua

SEQ ID NO: 130008 - RNA, 21 nt, Human
uggcgcacagccgcaggggcg

SEQ ID NO: 130009 - RNA, 23 nt, Human
ugggaaauucaguuuuuccuaau

SEQ ID NO: 130010 - RNA, 22 nt, Human
ugggaguauuaccugggaccua

SEQ ID NO: 130011 - RNA, 22 nt, Human
uguaaauuuccaaguugcuuuc

SEQ ID NO: 130012 - RNA, 23 nt, Human
uguguacaguugcuuucugugug

SEQ ID NO: 130013 - RNA, 20 nt, Human
uguuaaaaguccaagugggu

SEQ ID NO: 130014 - RNA, 22 nt, Human
uuauacauacaugcagaauaua

SEQ ID NO: 130015 - RNA, 23 nt, Human
uuauauaaccuggaacagaauga

SEQ ID NO: 130016 - RNA, 20 nt, Human
uuauucucagagugccaaaa

SEQ ID NO: 130017 - RNA, 18 nt, Human
uucaaaggaauguguguc

SEQ ID NO: 130018 - RNA, 24 nt, Human
uucacuggccgccuaaaauaauaa

SEQ ID NO: 130019 - RNA, 24 nt, Human
uucagagcugggcuauggacuucu

SEQ ID NO: 130020 - RNA, 23 nt, Human
uuguagacuggaaaaauauuucc

SEQ ID NO: 130021 - RNA, 19 nt, Human
aagucucucucucucccuc

SEQ ID NO: 130022 - RNA, 22 nt, Human
agguguggugauguaugaagau

SEQ ID NO: 130023 - RNA, 18 nt, Human
cauagaaagucacuuuaa

SEQ ID NO: 130024 - RNA, 20 nt, Human
cauagaaagucacuuuaaua

SEQ ID NO: 130025 - RNA, 23 nt, Human
cccaagugggggacugaugcucc

SEQ ID NO: 130026 - RNA, 21 nt, Human
ccuuagacuuaagucucucuc

SEQ ID NO: 130027 - RNA, 22 nt, Human
ccuucuugaacacucucuccuc

SEQ ID NO: 130028 - RNA, 21 nt, Human
gguguggugauguaugaagau

SEQ ID NO: 130029 - RNA, 20 nt, Human
uaagucucucucucucccuc

SEQ ID NO: 130030 - RNA, 24 nt, Human
uaagucucucucucucccucgugc

SEQ ID NO: 130031 - RNA, 18 nt, Human
uaguguggcccaaguggg

SEQ ID NO: 130032 - RNA, 18 nt, Human
ucagguguggugauguau

SEQ ID NO: 130033 - RNA, 26 nt, Human
ucugcaguuggaucagucuggaaaag

SEQ ID NO: 130034 - RNA, 25 nt, Human
uggcacuagugagaggguagucagu

SEQ ID NO: 130035 - RNA, 18 nt, Human
ugggaaagguggguagug

SEQ ID NO: 130036 - RNA, 20 nt, Human
uguggugauguaugaagaua

SEQ ID NO: 130037 - RNA, 25 nt, Human
aaaaauuaucccaacucccaccccu

SEQ ID NO: 130038 - RNA, 18 nt, Human
aaacaaagcaaaacaaaa

SEQ ID NO: 130039 - RNA, 24 nt, Human
aaagugcugggauuacaggcauga

SEQ ID NO: 130040 - RNA, 23 nt, Human
aacaaaaccaccaauccuaauaa

SEQ ID NO: 130041 - RNA, 24 nt, Human
aacacuguugcccaggcuggagug

SEQ ID NO: 130042 - RNA, 21 nt, Human
aacucccaccccuuggcucuc

SEQ ID NO: 130043 - RNA, 18 nt, Human
aagcaaaacaaaaccacc

SEQ ID NO: 130044 - RNA, 20 nt, Human
aagcaaaacaaaaccaccaa

SEQ ID NO: 130045 - RNA, 19 nt, Human
aagugcugggauuacaggc

SEQ ID NO: 130046 - RNA, 21 nt, Human
aagugcugggauuacaggcau

SEQ ID NO: 130047 - RNA, 26 nt, Human
aagugcugggauuacaggcaugagcc

SEQ ID NO: 130048 - RNA, 18 nt, Human
acaaagcaaaacaaaacc

SEQ ID NO: 130049 - RNA, 23 nt, Human
acaaagcaaaacaaaaccaccaa

SEQ ID NO: 130050 - RNA, 20 nt, Human
acacuguugcccaggcugga

SEQ ID NO: 130051 - RNA, 27 nt, Human
acacuguugcccaggcuggagugcaau

SEQ ID NO: 130052 - RNA, 18 nt, Human
acaggguuuuaccguguu

SEQ ID NO: 130053 - RNA, 19 nt, Human
acaggguuuuaccguguua

SEQ ID NO: 130054 - RNA, 20 nt, Human
acaggguuuuaccguguuag

SEQ ID NO: 130055 - RNA, 24 nt, Human
acaggguuuuaccguguuagccag

SEQ ID NO: 130056 - RNA, 23 nt, Human
accguguuagccaggauagucuc

SEQ ID NO: 130057 - RNA, 18 nt, Human
agacaggguuuuaccgug

SEQ ID NO: 130058 - RNA, 19 nt, Human
agagacaggguuuuaccgu

SEQ ID NO: 130059 - RNA, 25 nt, Human
agcaaaacaaaaccaccaauccuaa

SEQ ID NO: 130060 - RNA, 20 nt, Human
aggcaugagccaccgugccu

SEQ ID NO: 130061 - RNA, 23 nt, Human
aggcaugagccaccgugccuggc

SEQ ID NO: 130062 - RNA, 18 nt, Human
aguagcugggacuacagg

SEQ ID NO: 130063 - RNA, 21 nt, Human
agugcaauggcgugaucucag

SEQ ID NO: 130064 - RNA, 24 nt, Human
agugcaauggcgugaucucagcuc

SEQ ID NO: 130065 - RNA, 18 nt, Human
agugcugggauuacaggc

SEQ ID NO: 130066 - RNA, 24 nt, Human
caaagugcugggauuacaggcaug

SEQ ID NO: 130067 - RNA, 20 nt, Human
cacauaggaaaaaugccacu

SEQ ID NO: 130068 - RNA, 19 nt, Human
caccaauccuaauaacccc

SEQ ID NO: 130069 - RNA, 24 nt, Human
caggguuuuaccguguuagccagg

SEQ ID NO: 130070 - RNA, 19 nt, Human
caggugcccaccaccacgc

SEQ ID NO: 130071 - RNA, 21 nt, Human
caggugcccaccaccacgccc

SEQ ID NO: 130072 - RNA, 22 nt, Human
caugccuuucuccugccucagc

SEQ ID NO: 130073 - RNA, 23 nt, Human
ccaaagugcugggauuacaggca

SEQ ID NO: 130074 - RNA, 24 nt, Human
ccaaagugcugggauuacaggcau

SEQ ID NO: 130075 - RNA, 24 nt, Human
ccaacucccaccccuuggcucuca

SEQ ID NO: 130076 - RNA, 24 nt, Human
cccaaagugcugggauuacaggca

SEQ ID NO: 130077 - RNA, 21 nt, Human
cccaccaccacgcccagcuaa

SEQ ID NO: 130078 - RNA, 21 nt, Human
cccaggcuggagugcaauggc

SEQ ID NO: 130079 - RNA, 22 nt, Human
cccaggcuggagugcaauggcg

SEQ ID NO: 130080 - RNA, 23 nt, Human
cccgaguagcugggacuacaggu

SEQ ID NO: 130081 - RNA, 24 nt, Human
cccgaguagcugggacuacaggug

SEQ ID NO: 130082 - RNA, 23 nt, Human
ccugccucagccucccgaguagc

SEQ ID NO: 130083 - RNA, 18 nt, Human
cuaauaaccccccucccu

SEQ ID NO: 130084 - RNA, 24 nt, Human
cucacugcaagcucugccuccugg

SEQ ID NO: 130085 - RNA, 24 nt, Human
cucagccucccgaguagcugggac

SEQ ID NO: 130086 - RNA, 19 nt, Human
cucccaccccuuggcucuc

SEQ ID NO: 130087 - RNA, 24 nt, Human
cuccugaccucgugagccgccugc

SEQ ID NO: 130088 - RNA, 22 nt, Human
cuccugccucagccucccgagu

SEQ ID NO: 130089 - RNA, 21 nt, Human
cuccuggauucaugccuuucu

SEQ ID NO: 130090 - RNA, 19 nt, Human
cugcaagcucugccuccug

SEQ ID NO: 130091 - RNA, 23 nt, Human
cugccucagccucccgaguagcu

SEQ ID NO: 130092 - RNA, 23 nt, Human
cugccucggccucccaaagugcu

SEQ ID NO: 130093 - RNA, 24 nt, Human
cuggagugcaauggcgugaucuca

SEQ ID NO: 130094 - RNA, 24 nt, Human
cuuaacacuguugcccaggcugga

SEQ ID NO: 130095 - RNA, 22 nt, Human
cuuucuccugccucagccuccc

SEQ ID NO: 130096 - RNA, 21 nt, Human
cuuuuaguagagacaggguuu

SEQ ID NO: 130097 - RNA, 22 nt, Human
gaccucgugagccgccugccuc

SEQ ID NO: 130098 - RNA, 24 nt, Human
gaccucgugagccgccugccucgg

SEQ ID NO: 130099 - RNA, 21 nt, Human
gagacagagucuuaacacugu

SEQ ID NO: 130100 - RNA, 18 nt, Human
gagucuuaacacuguugc

SEQ ID NO: 130101 - RNA, 18 nt, Human
gauuacaggcaugagcca

SEQ ID NO: 130102 - RNA, 20 nt, Human
gauuacaggcaugagccacc

SEQ ID NO: 130103 - RNA, 21 nt, Human
gauuacaggcaugagccaccg

SEQ ID NO: 130104 - RNA, 19 nt, Human
gcuggagugcaauggcgug

SEQ ID NO: 130105 - RNA, 24 nt, Human
ggauuacaggcaugagccaccgug

SEQ ID NO: 130106 - RNA, 22 nt, Human
ggcuggagugcaauggcgugau

SEQ ID NO: 130107 - RNA, 24 nt, Human
uaacacuguugcccaggcuggagu

SEQ ID NO: 130108 - RNA, 19 nt, Human
uaaccccccucccugcccc

SEQ ID NO: 130109 - RNA, 24 nt, Human
uaaccccccucccugccccgucuc

SEQ ID NO: 130110 - RNA, 26 nt, Human
uaauaaccccccucccugccccgucu

SEQ ID NO: 130111 - RNA, 24 nt, Human
uaauuuuuuguacuuuuaguagag

SEQ ID NO: 130112 - RNA, 25 nt, Human
uaauuuuuuguacuuuuaguagaga

SEQ ID NO: 130113 - RNA, 22 nt, Human
uacaggcaugagccaccgugcc

SEQ ID NO: 130114 - RNA, 24 nt, Human
uacaggugcccaccaccacgccca

SEQ ID NO: 130115 - RNA, 24 nt, Human
uaccguguuagccaggauagucuc

SEQ ID NO: 130116 - RNA, 22 nt, Human
uagagacaggguuuuaccgugu

SEQ ID NO: 130117 - RNA, 22 nt, Human
uagcccaaucgcggcucgugcc

SEQ ID NO: 130118 - RNA, 21 nt, Human
uaguagagacaggguuuuacc

SEQ ID NO: 130119 - RNA, 24 nt, Human
uaguagagacaggguuuuaccgug

SEQ ID NO: 130120 - RNA, 18 nt, Human
ucacugcaagcucugccu

SEQ ID NO: 130121 - RNA, 19 nt, Human
ucacugcaagcucugccuc

SEQ ID NO: 130122 - RNA, 23 nt, Human
ucacugcaagcucugccuccugg

SEQ ID NO: 130123 - RNA, 23 nt, Human
ucagccucccgaguagcugggac

SEQ ID NO: 130124 - RNA, 24 nt, Human
ucccaaagugcugggauuacaggc

SEQ ID NO: 130125 - RNA, 23 nt, Human
ucccgaguagcugggacuacagg

SEQ ID NO: 130126 - RNA, 23 nt, Human
ucccuauuuuagaaaugagagga

SEQ ID NO: 130127 - RNA, 22 nt, Human
uccuaauaaccccccucccugc

SEQ ID NO: 130128 - RNA, 24 nt, Human
uccuggauucaugccuuucuccug

SEQ ID NO: 130129 - RNA, 18 nt, Human
ucggccucccaaagugcu

SEQ ID NO: 130130 - RNA, 24 nt, Human
ucuuaacacuguugcccaggcugg

SEQ ID NO: 130131 - RNA, 19 nt, Human
ugagacagagucuuaacac

SEQ ID NO: 130132 - RNA, 19 nt, Human
ugagaggagugacugcaca

SEQ ID NO: 130133 - RNA, 19 nt, Human
ugagaggagugacugcaca

SEQ ID NO: 130134 - RNA, 20 nt, Human
ugcacauaggaaaaaugcca

SEQ ID NO: 130135 - RNA, 18 nt, Human
ugcccaggcuggagugca

SEQ ID NO: 130136 - RNA, 21 nt, Human
ugcccaggcuggagugcaaug

SEQ ID NO: 130137 - RNA, 21 nt, Human
ugcccaggcuggagugcaaug

SEQ ID NO: 130138 - RNA, 24 nt, Human
ugccucagccucccgaguagcugg

SEQ ID NO: 130139 - RNA, 19 nt, Human
ugccuccuggauucaugcc

SEQ ID NO: 130140 - RNA, 20 nt, Human
ugccuccuggauucaugccu

SEQ ID NO: 130141 - RNA, 21 nt, Human
ugccucggccucccaaagugc

SEQ ID NO: 130142 - RNA, 24 nt, Human
ugccucggccucccaaagugcugg

SEQ ID NO: 130143 - RNA, 20 nt, Human
ugccuuucuccugccucagc

SEQ ID NO: 130144 - RNA, 19 nt, Human
uggagugcaauggcgugau

SEQ ID NO: 130145 - RNA, 24 nt, Human
uggagugcaauggcgugaucucag

SEQ ID NO: 130146 - RNA, 24 nt, Human
uggcgugaucucagcucacugcaa

SEQ ID NO: 130147 - RNA, 21 nt, Human
ugggacuacaggugcccacca

SEQ ID NO: 130148 - RNA, 24 nt, Human
ugggacuacaggugcccaccacca

SEQ ID NO: 130149 - RNA, 18 nt, Human
ugggauuacaggcaugag

SEQ ID NO: 130150 - RNA, 21 nt, Human
ugggauuacaggcaugagcca

SEQ ID NO: 130151 - RNA, 22 nt, Human
ugggauuacaggcaugagccac

SEQ ID NO: 130152 - RNA, 23 nt, Human
ugggauuacaggcaugagccacc

SEQ ID NO: 130153 - RNA, 23 nt, Human
ugggauuacaggcaugagccacc

SEQ ID NO: 130154 - RNA, 24 nt, Human
ugggauuacaggcaugagccaccg

SEQ ID NO: 130155 - RNA, 20 nt, Human
uguugcccaggcuggagugc

SEQ ID NO: 130156 - RNA, 22 nt, Human
uguugcccaggcuggagugcaa

SEQ ID NO: 130157 - RNA, 24 nt, Human
uuaccguguuagccaggauagucu

SEQ ID NO: 130158 - RNA, 22 nt, Human
uuaguagagacaggguuuuacc

SEQ ID NO: 130159 - RNA, 24 nt, Human
uuaguagagacaggguuuuaccgu

SEQ ID NO: 130160 - RNA, 18 nt, Human
uuauuuauuuauuuauuu

SEQ ID NO: 130161 - RNA, 25 nt, Human
uuauuuauuuauuuauuuauauuug

SEQ ID NO: 130162 - RNA, 18 nt, Human
uugcccaggcuggagugc

SEQ ID NO: 130163 - RNA, 24 nt, Human
uuuaaacaaagcaaaacaaaacca

SEQ ID NO: 130164 - RNA, 23 nt, Human
uuuauuuauuuauuuauuuauuu

SEQ ID NO: 130165 - RNA, 18 nt, Human
uuugagggcaacaucucg

SEQ ID NO: 130166 - RNA, 21 nt, Human
uuuuuguacuuuuaguagaga

SEQ ID NO: 130167 - RNA, 24 nt, Human
uuuuuugagggcaacaucucgcuu

SEQ ID NO: 130168 - RNA, 24 nt, Human
uuuuuuguacuuuuaguagagaca

SEQ ID NO: 130169 - RNA, 19 nt, Human
uuuuuuuuuuuuugagggc

SEQ ID NO: 130170 - RNA, 28 nt, Human
uuuuuuuuuuuuuuuuuuuuuuugaggg

SEQ ID NO: 130171 - RNA, 19 nt, Human
aagcagccaguucacagau

SEQ ID NO: 130172 - RNA, 20 nt, Human
cccuggaucccuccgugccc

SEQ ID NO: 130173 - RNA, 22 nt, Human
cgggcagaggaacggaaacagc

SEQ ID NO: 130174 - RNA, 20 nt, Human
cuccaggcccucacucugcc

SEQ ID NO: 130175 - RNA, 19 nt, Human
gccaguucacagaugcccu

SEQ ID NO: 130176 - RNA, 22 nt, Human
gccaguucacagaugcccugga

SEQ ID NO: 130177 - RNA, 21 nt, Human
gcccuggaucccuccgugccc

SEQ ID NO: 130178 - RNA, 18 nt, Human
gccuggaacugggcaggg

SEQ ID NO: 130179 - RNA, 22 nt, Human
ggaacggaaacagcuccucaga

SEQ ID NO: 130180 - RNA, 18 nt, Human
ggcagggucccuggcacc

SEQ ID NO: 130181 - RNA, 20 nt, Human
ucucuggaagaagcagccag

SEQ ID NO: 130182 - RNA, 24 nt, Human
ucuggguuaggcgacgccuggaac

SEQ ID NO: 130183 - RNA, 21 nt, Human
uggaagaagcagccaguucac

SEQ ID NO: 130184 - RNA, 21 nt, Human
uucacagaugcccuggauccc

SEQ ID NO: 130185 - RNA, 22 nt, Human
acagacuuucauuacucaaauc

SEQ ID NO: 130186 - RNA, 22 nt, Human
aguccgggcagggacucagccc

SEQ ID NO: 130187 - RNA, 19 nt, Human
ccggccccuggucuucggc

SEQ ID NO: 130188 - RNA, 22 nt, Human
ccucugggaccuagggcuucug

SEQ ID NO: 130189 - RNA, 20 nt, Human
ccugcucgcucccucccucc

SEQ ID NO: 130190 - RNA, 23 nt, Human
ccuggucuucggcguucggaguc

SEQ ID NO: 130191 - RNA, 21 nt, Human
cgccggccccgccuuaugcgc

SEQ ID NO: 130192 - RNA, 25 nt, Human
cguggcaguggcggcgcgcgcuucc

SEQ ID NO: 130193 - RNA, 20 nt, Human
cguucggaguccgggcaggg

SEQ ID NO: 130194 - RNA, 22 nt, Human
cucccgacugacacggcguggc

SEQ ID NO: 130195 - RNA, 21 nt, Human
cugcucgcucccucccucccg

SEQ ID NO: 130196 - RNA, 18 nt, Human
gcccgcgccggccccgcc

SEQ ID NO: 130197 - RNA, 20 nt, Human
ggccccuggucuucggcguc

SEQ ID NO: 130198 - RNA, 20 nt, Human
ggcggcgcgcgcuuccggcc

SEQ ID NO: 130199 - RNA, 18 nt, Human
gggcaccauguguucgga

SEQ ID NO: 130200 - RNA, 18 nt, Human
ucauugggaugccauuuu

SEQ ID NO: 130201 - RNA, 21 nt, Human
ucgccugcucgcucccucccu

SEQ ID NO: 130202 - RNA, 23 nt, Human
ugcugcuuggaagcaguacaacu

SEQ ID NO: 130203 - RNA, 22 nt, Human
uggaaggaaaggcccgcgccgg

SEQ ID NO: 130204 - RNA, 21 nt, Human
uuccgauggaaggaaaggccc

SEQ ID NO: 130205 - RNA, 19 nt, Human
aaagcauguccugugagag

SEQ ID NO: 130206 - RNA, 21 nt, Human
aagcaagacagggauuucuaa

SEQ ID NO: 130207 - RNA, 22 nt, Human
acagcaacagaaacuucuguac

SEQ ID NO: 130208 - RNA, 22 nt, Human
agcucggaucaaccccagacac

SEQ ID NO: 130209 - RNA, 21 nt, Human
aggagaaggcaggcgcaggaa

SEQ ID NO: 130210 - RNA, 22 nt, Human
caagacagggauuucuaacaau

SEQ ID NO: 130211 - RNA, 20 nt, Human
cacaugcuggaaaacggggu

SEQ ID NO: 130212 - RNA, 22 nt, Human
cacccucgaucugaguaugcuc

SEQ ID NO: 130213 - RNA, 25 nt, Human
cacgagacaccuaaggucagacuca

SEQ ID NO: 130214 - RNA, 23 nt, Human
cagcucggaucaaccccagacac

SEQ ID NO: 130215 - RNA, 23 nt, Human
cagcucggaucaaccccagacac

SEQ ID NO: 130216 - RNA, 20 nt, Human
caggaaaugguaucauccac

SEQ ID NO: 130217 - RNA, 23 nt, Human
ccccaaaucaacuguuuuucaac

SEQ ID NO: 130218 - RNA, 21 nt, Human
cuuggagauacgaucgcuucu

SEQ ID NO: 130219 - RNA, 20 nt, Human
gacaccuaaggucagacuca

SEQ ID NO: 130220 - RNA, 23 nt, Human
gagacaccuaaggucagacucac

SEQ ID NO: 130221 - RNA, 24 nt, Human
gcggcggcggcgacagcucggauc

SEQ ID NO: 130222 - RNA, 21 nt, Human
uaacagaacacaugcuggaaa

SEQ ID NO: 130223 - RNA, 21 nt, Human
uaagugcccccaaaucaacug

SEQ ID NO: 130224 - RNA, 27 nt, Human
ucagugauggcacaaagcauguccuuu

SEQ ID NO: 130225 - RNA, 20 nt, Human
ucaugagcaauuuuaacagc

SEQ ID NO: 130226 - RNA, 19 nt, Human
ucggaucaaccccagacac

SEQ ID NO: 130227 - RNA, 19 nt, Human
ugagagggacuuggagaua

SEQ ID NO: 130228 - RNA, 20 nt, Human
ugcccuuugggaauggggca

SEQ ID NO: 130229 - RNA, 18 nt, Human
ugggaauggggcauaugg

SEQ ID NO: 130230 - RNA, 18 nt, Human
uucaaggagaaggcaggc

SEQ ID NO: 130231 - RNA, 26 nt, Human
uuccaaugacaaggcguaggguaccc

SEQ ID NO: 130232 - RNA, 19 nt, Human
uuuuuuuuuuuuauaggaa

SEQ ID NO: 130233 - RNA, 19 nt, Human
aaaacuccaccacgcgcuc

SEQ ID NO: 130234 - RNA, 21 nt, Human
aaacagaccaccccuccagga

SEQ ID NO: 130235 - RNA, 20 nt, Human
aaacgccacugaguuugaaa

SEQ ID NO: 130236 - RNA, 20 nt, Human
aacgccccaaggacagccag

SEQ ID NO: 130237 - RNA, 20 nt, Human
aacgccccaaggacagccag

SEQ ID NO: 130238 - RNA, 23 nt, Human
aagaaacagaccaccccuccagg

SEQ ID NO: 130239 - RNA, 20 nt, Human
aagccccugggcaggagccu

SEQ ID NO: 130240 - RNA, 18 nt, Human
aagggccagcagcugcuc

SEQ ID NO: 130241 - RNA, 25 nt, Human
aaugugaucucgggguggggaggcu

SEQ ID NO: 130242 - RNA, 23 nt, Human
acagcagcaauggcggggccaaa

SEQ ID NO: 130243 - RNA, 21 nt, Human
accacgcccacgacaaacacu

SEQ ID NO: 130244 - RNA, 21 nt, Human
accacgcccacgacaaacacu

SEQ ID NO: 130245 - RNA, 20 nt, Human
accuggaauaugccagcagc

SEQ ID NO: 130246 - RNA, 28 nt, Human
acugaaggagugacucaggaaggaggag

SEQ ID NO: 130247 - RNA, 28 nt, Human
acugaaggagugacucaggaaggaggag

SEQ ID NO: 130248 - RNA, 19 nt, Human
acugaggcugccuuggcgg

SEQ ID NO: 130249 - RNA, 18 nt, Human
agaaacagaccaccccuc

SEQ ID NO: 130250 - RNA, 22 nt, Human
agaaagaaaaagguaggacuga

SEQ ID NO: 130251 - RNA, 19 nt, Human
agacuuggaggaacuggca

SEQ ID NO: 130252 - RNA, 19 nt, Human
agacuuggaggaacuggca

SEQ ID NO: 130253 - RNA, 24 nt, Human
agagggagaagacaggcgcaguca

SEQ ID NO: 130254 - RNA, 24 nt, Human
agagggagaagacaggcgcaguca

SEQ ID NO: 130255 - RNA, 22 nt, Human
agcacagccacgaauuucucca

SEQ ID NO: 130256 - RNA, 22 nt, Human
agcagcaccugcuccaccuggu

SEQ ID NO: 130257 - RNA, 21 nt, Human
agcagcugcuccauguccuuc

SEQ ID NO: 130258 - RNA, 19 nt, Human
agccuaauggcccuuggca

SEQ ID NO: 130259 - RNA, 19 nt, Human
agcuaacgccugugccugg

SEQ ID NO: 130260 - RNA, 19 nt, Human
agcuaacgccugugccugg

SEQ ID NO: 130261 - RNA, 18 nt, Human
agcuccuuucuucuucuc

SEQ ID NO: 130262 - RNA, 19 nt, Human
agcuccuuucuucuucucu

SEQ ID NO: 130263 - RNA, 22 nt, Human
agcuggucgcagggugcuggcc

SEQ ID NO: 130264 - RNA, 21 nt, Human
aggaacuggcacgaagccaag

SEQ ID NO: 130265 - RNA, 21 nt, Human
aggaacuggcacgaagccaag

SEQ ID NO: 130266 - RNA, 18 nt, Human
aggaaggaggaggggaag

SEQ ID NO: 130267 - RNA, 18 nt, Human
aggaaggaggaggggaag

SEQ ID NO: 130268 - RNA, 22 nt, Human
aggccagcagcugcugccggaa

SEQ ID NO: 130269 - RNA, 24 nt, Human
agggacaggcccgggccuccuucc

SEQ ID NO: 130270 - RNA, 18 nt, Human
agugguugagagggaggg

SEQ ID NO: 130271 - RNA, 18 nt, Human
agugguugagagggaggg

SEQ ID NO: 130272 - RNA, 20 nt, Human
aucugcuucagguacaucag

SEQ ID NO: 130273 - RNA, 23 nt, Human
augagaacacugcuccguaccgu

SEQ ID NO: 130274 - RNA, 23 nt, Human
augcaggauggaaagaaagauuc

SEQ ID NO: 130275 - RNA, 23 nt, Human
augcaggauggaaagaaagauuc

SEQ ID NO: 130276 - RNA, 21 nt, Human
caagccccugggcaggagccc

SEQ ID NO: 130277 - RNA, 22 nt, Human
caagccccugggcaggagcccu

SEQ ID NO: 130278 - RNA, 22 nt, Human
cacagaaccuaggcuuuucacg

SEQ ID NO: 130279 - RNA, 20 nt, Human
caccacacaccggccuaggu

SEQ ID NO: 130280 - RNA, 20 nt, Human
caccagagccuucccugggg

SEQ ID NO: 130281 - RNA, 18 nt, Human
caccaucaccacacaccg

SEQ ID NO: 130282 - RNA, 22 nt, Human
caccccggcacaggccagcagc

SEQ ID NO: 130283 - RNA, 20 nt, Human
caccgcacagguuacagaga

SEQ ID NO: 130284 - RNA, 22 nt, Human
caccucguccaucaucugaggc

SEQ ID NO: 130285 - RNA, 23 nt, Human
caccucugccagggccucauccc

SEQ ID NO: 130286 - RNA, 21 nt, Human
caccuucuucgccggcagaau

SEQ ID NO: 130287 - RNA, 21 nt, Human
cacguacugcagcagcuggga

SEQ ID NO: 130288 - RNA, 21 nt, Human
cagaagaucccagcugaccac

SEQ ID NO: 130289 - RNA, 21 nt, Human
cagaagaucccagcugaccac

SEQ ID NO: 130290 - RNA, 23 nt, Human
cagaccacgcccacgacaaacac

SEQ ID NO: 130291 - RNA, 20 nt, Human
cagagcugggagccgcugac

SEQ ID NO: 130292 - RNA, 20 nt, Human
cagcaccugcuccaccuggu

SEQ ID NO: 130293 - RNA, 20 nt, Human
cagcaccugcuccaccuggu

SEQ ID NO: 130294 - RNA, 22 nt, Human
cagcagcaauggcggggccaaa

SEQ ID NO: 130295 - RNA, 22 nt, Human
cagcagcugcuccauguccuuc

SEQ ID NO: 130296 - RNA, 20 nt, Human
cagcaggggcagcuguugca

SEQ ID NO: 130297 - RNA, 20 nt, Human
cagcaggggcagcuguugca

SEQ ID NO: 130298 - RNA, 27 nt, Human
cagccaguuugggcugcucccgggaug

SEQ ID NO: 130299 - RNA, 19 nt, Human
cagccgaacauccuugcca

SEQ ID NO: 130300 - RNA, 21 nt, Human
cagcugcugccggaagucaga

SEQ ID NO: 130301 - RNA, 23 nt, Human
cagcuuggccaggacagggggcc

SEQ ID NO: 130302 - RNA, 26 nt, Human
caggaaccacaccgcacaaccuucag

SEQ ID NO: 130303 - RNA, 23 nt, Human
cagguucuccaccagagccuucc

SEQ ID NO: 130304 - RNA, 26 nt, Human
cagugacuuuccuccugcccccguuu

SEQ ID NO: 130305 - RNA, 21 nt, Human
caguuugcgauuucaccaguc

SEQ ID NO: 130306 - RNA, 21 nt, Human
caguuugcgauuucaccaguc

SEQ ID NO: 130307 - RNA, 21 nt, Human
caucaggaagaggccgacuuc

SEQ ID NO: 130308 - RNA, 24 nt, Human
caugcaggauggaaagaaagauuc

SEQ ID NO: 130309 - RNA, 20 nt, Human
ccaaggacagccaggaccca

SEQ ID NO: 130310 - RNA, 20 nt, Human
ccaaggacagccaggaccca

SEQ ID NO: 130311 - RNA, 19 nt, Human
ccacaccgcacagguuaca

SEQ ID NO: 130312 - RNA, 22 nt, Human
ccacagagaggagcagggcccc

SEQ ID NO: 130313 - RNA, 22 nt, Human
ccacaggaacaaaggucuccgu

SEQ ID NO: 130314 - RNA, 22 nt, Human
ccacaggaacaaaggucuccgu

SEQ ID NO: 130315 - RNA, 19 nt, Human
ccaccaucaccacacaccg

SEQ ID NO: 130316 - RNA, 18 nt, Human
ccacgcccacgacaaaca

SEQ ID NO: 130317 - RNA, 18 nt, Human
ccacgcccacgacaaaca

SEQ ID NO: 130318 - RNA, 21 nt, Human
ccacugaguuagaacucgugc

SEQ ID NO: 130319 - RNA, 23 nt, Human
ccacugcccggcauuccuucacc

SEQ ID NO: 130320 - RNA, 28 nt, Human
ccacugcccggcauuccuucaccacuug

SEQ ID NO: 130321 - RNA, 20 nt, Human
ccagcagcugcuccaugucc

SEQ ID NO: 130322 - RNA, 19 nt, Human
cccaccaucaccacacacc

SEQ ID NO: 130323 - RNA, 23 nt, Human
cccaccaucaccacacaccggcc

SEQ ID NO: 130324 - RNA, 21 nt, Human
ccccaaggacagccaggaccc

SEQ ID NO: 130325 - RNA, 21 nt, Human
ccccaaggacagccaggaccc

SEQ ID NO: 130326 - RNA, 23 nt, Human
cccggcauuccuucaccacuugg

SEQ ID NO: 130327 - RNA, 24 nt, Human
cccguaauagggacaggcccgggc

SEQ ID NO: 130328 - RNA, 22 nt, Human
cccugaugguggcagaagaucc

SEQ ID NO: 130329 - RNA, 19 nt, Human
ccuccaaccacagagagga

SEQ ID NO: 130330 - RNA, 19 nt, Human
ccuccaggaaccacaccgc

SEQ ID NO: 130331 - RNA, 21 nt, Human
ccuccugcccccguuuguccc

SEQ ID NO: 130332 - RNA, 21 nt, Human
ccuccugcccccguuuguccc

SEQ ID NO: 130333 - RNA, 25 nt, Human
ccuccugcccccguuugucccugau

SEQ ID NO: 130334 - RNA, 19 nt, Human
ccucgucccgcugcuccuc

SEQ ID NO: 130335 - RNA, 19 nt, Human
ccucgucccgcugcuccuc

SEQ ID NO: 130336 - RNA, 23 nt, Human
ccugacucucgucugcaggggcu

SEQ ID NO: 130337 - RNA, 20 nt, Human
ccugcagcucugcagaccug

SEQ ID NO: 130338 - RNA, 26 nt, Human
ccugccuccuccucuuuggcuucucc

SEQ ID NO: 130339 - RNA, 20 nt, Human
ccuggguccuggcagcacuc

SEQ ID NO: 130340 - RNA, 20 nt, Human
ccuggguccuggcagcgcuc

SEQ ID NO: 130341 - RNA, 21 nt, Human
ccugugccuggguccuggcag

SEQ ID NO: 130342 - RNA, 21 nt, Human
ccugugccuggguccuggcag

SEQ ID NO: 130343 - RNA, 20 nt, Human
cggcacaggccagcagcugc

SEQ ID NO: 130344 - RNA, 21 nt, Human
cggcacaggccagcagcugcu

SEQ ID NO: 130345 - RNA, 21 nt, Human
cggcgccaggcaguggugugg

SEQ ID NO: 130346 - RNA, 21 nt, Human
cggcgccaggcaguggugugg

SEQ ID NO: 130347 - RNA, 22 nt, Human
cgucccgcugcuccucguccua

SEQ ID NO: 130348 - RNA, 22 nt, Human
cgucccgcugcuccucguccua

SEQ ID NO: 130349 - RNA, 24 nt, Human
cguccuaaggagcucugcugccac

SEQ ID NO: 130350 - RNA, 24 nt, Human
cguccuaaggagcucugcugccac

SEQ ID NO: 130351 - RNA, 20 nt, Human
cuauuccaggaggggagcug

SEQ ID NO: 130352 - RNA, 20 nt, Human
cuauuccaggaggggagcug

SEQ ID NO: 130353 - RNA, 18 nt, Human
cucaggaaggaggagggg

SEQ ID NO: 130354 - RNA, 18 nt, Human
cucaggaaggaggagggg

SEQ ID NO: 130355 - RNA, 21 nt, Human
cucaggaaggaggaggggaag

SEQ ID NO: 130356 - RNA, 21 nt, Human
cucaggaaggaggaggggaag

SEQ ID NO: 130357 - RNA, 20 nt, Human
cuccacacgggcucggaucc

SEQ ID NO: 130358 - RNA, 22 nt, Human
cuccacacucuccuccuggguu

SEQ ID NO: 130359 - RNA, 22 nt, Human
cuccacacucuccuccuggguu

SEQ ID NO: 130360 - RNA, 19 nt, Human
cuccacgcugugcaugccc

SEQ ID NO: 130361 - RNA, 24 nt, Human
cuccuggguuucaccuuuguaaca

SEQ ID NO: 130362 - RNA, 22 nt, Human
cucuauagucauguugagagcc

SEQ ID NO: 130363 - RNA, 20 nt, Human
cucuggacuccacacucucc

SEQ ID NO: 130364 - RNA, 20 nt, Human
cucuggacuccacacucucc

SEQ ID NO: 130365 - RNA, 24 nt, Human
cugaaacccagccaguuugggcug

SEQ ID NO: 130366 - RNA, 21 nt, Human
cugaggcugccuuggcggcuc

SEQ ID NO: 130367 - RNA, 22 nt, Human
cugaucaugcucuucucacagu

SEQ ID NO: 130368 - RNA, 19 nt, Human
cugcagaugacaaggggca

SEQ ID NO: 130369 - RNA, 19 nt, Human
cuucacucaucuuuccucc

SEQ ID NO: 130370 - RNA, 19 nt, Human
cuucuucaccucaugcaca

SEQ ID NO: 130371 - RNA, 22 nt, Human
cuuuccuccugcccccguuugu

SEQ ID NO: 130372 - RNA, 22 nt, Human
cuuucugcugaucaugcucuuc

SEQ ID NO: 130373 - RNA, 22 nt, Human
cuuucuucuucucugcuucucu

SEQ ID NO: 130374 - RNA, 23 nt, Human
gaaaacacaggaaaacuccacca

SEQ ID NO: 130375 - RNA, 22 nt, Human
gaaacagaccaccccuccagga

SEQ ID NO: 130376 - RNA, 20 nt, Human
gaagagaaagucguugaugg

SEQ ID NO: 130377 - RNA, 18 nt, Human
gaagaggccgacuucucc

SEQ ID NO: 130378 - RNA, 19 nt, Human
gaaggaggaggggaaggug

SEQ ID NO: 130379 - RNA, 19 nt, Human
gaaggaggaggggaaggug

SEQ ID NO: 130380 - RNA, 25 nt, Human
gacucuguguauugggauuuugcuu

SEQ ID NO: 130381 - RNA, 24 nt, Human
gagaagacaggcgcagucagcagg

SEQ ID NO: 130382 - RNA, 24 nt, Human
gagaagacaggcgcagucagcagg

SEQ ID NO: 130383 - RNA, 19 nt, Human
gagagggagggaggugcca

SEQ ID NO: 130384 - RNA, 19 nt, Human
gagagggagggaggugcca

SEQ ID NO: 130385 - RNA, 19 nt, Human
gagagggagggaggugcca

SEQ ID NO: 130386 - RNA, 19 nt, Human
gagggauauuuucccacag

SEQ ID NO: 130387 - RNA, 19 nt, Human
gagggauauuuucccacag

SEQ ID NO: 130388 - RNA, 23 nt, Human
gaucaugcucuucucacaguauc

SEQ ID NO: 130389 - RNA, 18 nt, Human
gcacuaugcuggcaaaau

SEQ ID NO: 130390 - RNA, 19 nt, Human
gcagaccacgcccacgaca

SEQ ID NO: 130391 - RNA, 19 nt, Human
gcagaccacgcccacgaca

SEQ ID NO: 130392 - RNA, 24 nt, Human
gcagaccacgcccacgacaaacac

SEQ ID NO: 130393 - RNA, 18 nt, Human
gccacaggccuggaugca

SEQ ID NO: 130394 - RNA, 20 nt, Human
gccacaguggaugccacagc

SEQ ID NO: 130395 - RNA, 20 nt, Human
gccacaguggaugccacagc

SEQ ID NO: 130396 - RNA, 21 nt, Human
gccagacggcccagcaggcca

SEQ ID NO: 130397 - RNA, 18 nt, Human
gccaggacagggggccgg

SEQ ID NO: 130398 - RNA, 20 nt, Human
gcccaucaggaagaggccga

SEQ ID NO: 130399 - RNA, 19 nt, Human
gccccugucaccuggccuc

SEQ ID NO: 130400 - RNA, 23 nt, Human
gcccgggccuccuucccaagggc

SEQ ID NO: 130401 - RNA, 19 nt, Human
gcccuguggccauggaucc

SEQ ID NO: 130402 - RNA, 20 nt, Human
gccggaagucagacaccggc

SEQ ID NO: 130403 - RNA, 24 nt, Human
gccugacucucgucugcaggggcu

SEQ ID NO: 130404 - RNA, 18 nt, Human
gcucgugguuguagaagg

SEQ ID NO: 130405 - RNA, 18 nt, Human
ggaacagacgcccaguuu

SEQ ID NO: 130406 - RNA, 18 nt, Human
ggaacagacgcccaguuu

SEQ ID NO: 130407 - RNA, 23 nt, Human
ggagaugccacaguggaugccac

SEQ ID NO: 130408 - RNA, 23 nt, Human
ggagaugccacaguggaugccac

SEQ ID NO: 130409 - RNA, 20 nt, Human
ggcaggacggagaugccaca

SEQ ID NO: 130410 - RNA, 22 nt, Human
ggcaggcugccugcuucuccug

SEQ ID NO: 130411 - RNA, 18 nt, Human
ggcauuccuucaccacuu

SEQ ID NO: 130412 - RNA, 25 nt, Human
ggcccgggccuccuucccaagggcc

SEQ ID NO: 130413 - RNA, 18 nt, Human
gggcagaggcagaugggc

SEQ ID NO: 130414 - RNA, 18 nt, Human
gggcagaggcagaugggc

SEQ ID NO: 130415 - RNA, 19 nt, Human
gggcaggagccuguggcca

SEQ ID NO: 130416 - RNA, 25 nt, Human
gggcaggauagggagcagggccuuc

SEQ ID NO: 130417 - RNA, 24 nt, Human
gggccaaagguagcuuugaccucc

SEQ ID NO: 130418 - RNA, 18 nt, Human
gggccuggcagagcuggg

SEQ ID NO: 130419 - RNA, 24 nt, Human
gggccuggcagagcugggagccgc

SEQ ID NO: 130420 - RNA, 20 nt, Human
gggcucuggggaggguuuga

SEQ ID NO: 130421 - RNA, 20 nt, Human
ggggaagaaacagaccaccc

SEQ ID NO: 130422 - RNA, 20 nt, Human
ggucagagggagaagacagg

SEQ ID NO: 130423 - RNA, 20 nt, Human
ggucagagggagaagacagg

SEQ ID NO: 130424 - RNA, 22 nt, Human
ggugugguugcccaucaggaag

SEQ ID NO: 130425 - RNA, 20 nt, Human
gucauguugagagccuaacg

SEQ ID NO: 130426 - RNA, 19 nt, Human
guccugguuggccguagug

SEQ ID NO: 130427 - RNA, 19 nt, Human
guuagaacucgugccgaau

SEQ ID NO: 130428 - RNA, 20 nt, Human
guucauucaggauuccccca

SEQ ID NO: 130429 - RNA, 23 nt, Human
uacaaauccaggcagggcugugg

SEQ ID NO: 130430 - RNA, 23 nt, Human
uacaaauccaggcagggcugugg

SEQ ID NO: 130431 - RNA, 19 nt, Human
uagcugugcaggaugcaaa

SEQ ID NO: 130432 - RNA, 19 nt, Human
uagcugugcaggaugcaaa

SEQ ID NO: 130433 - RNA, 20 nt, Human
ucaagugguugagagggagg

SEQ ID NO: 130434 - RNA, 20 nt, Human
ucaagugguugagagggagg

SEQ ID NO: 130435 - RNA, 24 nt, Human
ucaccaccugguccugcagccgga

SEQ ID NO: 130436 - RNA, 21 nt, Human
ucaccuggccucucuccuggc

SEQ ID NO: 130437 - RNA, 21 nt, Human
ucaccuucuucgccggcagaa

SEQ ID NO: 130438 - RNA, 21 nt, Human
ucaccuucuucgccggcagca

SEQ ID NO: 130439 - RNA, 22 nt, Human
ucacgucuucauuuacacaaag

SEQ ID NO: 130440 - RNA, 23 nt, Human
ucagaaagaaaaagguaggacug

SEQ ID NO: 130441 - RNA, 18 nt, Human
ucagugaauccaaagagc

SEQ ID NO: 130442 - RNA, 23 nt, Human
ucagugacuuuccuccugccccc

SEQ ID NO: 130443 - RNA, 23 nt, Human
ucagugacuuuccuccugccccc

SEQ ID NO: 130444 - RNA, 19 nt, Human
uccaaagagcuuucugcug

SEQ ID NO: 130445 - RNA, 24 nt, Human
uccacacucuccuccuggguuuca

SEQ ID NO: 130446 - RNA, 24 nt, Human
uccacacucuccuccuggguuuca

SEQ ID NO: 130447 - RNA, 18 nt, Human
uccaggaggggagcugcc

SEQ ID NO: 130448 - RNA, 18 nt, Human
uccaggaggggagcugcc

SEQ ID NO: 130449 - RNA, 23 nt, Human
uccaggaggggagcugcccugga

SEQ ID NO: 130450 - RNA, 23 nt, Human
uccaggaggggagcugcccugga

SEQ ID NO: 130451 - RNA, 18 nt, Human
ucccccauuuucuccuac

SEQ ID NO: 130452 - RNA, 21 nt, Human
ucccccauuuucuccuacggg

SEQ ID NO: 130453 - RNA, 21 nt, Human
ucccccauuuucuccuacggg

SEQ ID NO: 130454 - RNA, 24 nt, Human
ucccccauuuucuccuacgggaga

SEQ ID NO: 130455 - RNA, 24 nt, Human
ucccccauuuucuccuacgggaga

SEQ ID NO: 130456 - RNA, 21 nt, Human
ucccgcugcagaugacaaggg

SEQ ID NO: 130457 - RNA, 23 nt, Human
ucccugaugguggcagaagaucc

SEQ ID NO: 130458 - RNA, 24 nt, Human
uccgugaugacacggggucucuau

SEQ ID NO: 130459 - RNA, 24 nt, Human
uccgugaugacacggggucucuau

SEQ ID NO: 130460 - RNA, 22 nt, Human
uccuccugcccccguuuguccc

SEQ ID NO: 130461 - RNA, 22 nt, Human
uccuccugcccccguuuguccc

SEQ ID NO: 130462 - RNA, 24 nt, Human
uccugggcugcaggcucugcagga

SEQ ID NO: 130463 - RNA, 25 nt, Human
ucguccugggcugcaggcucugcag

SEQ ID NO: 130464 - RNA, 19 nt, Human
ucgugguuguagaaggggc

SEQ ID NO: 130465 - RNA, 28 nt, Human
ucuccagcgggcaggacaaaggaagggc

SEQ ID NO: 130466 - RNA, 24 nt, Human
ucuccuccucagcuccuuucuucu

SEQ ID NO: 130467 - RNA, 20 nt, Human
ucugcagaccugauguuggg

SEQ ID NO: 130468 - RNA, 20 nt, Human
ucugcccuuccucguccccc

SEQ ID NO: 130469 - RNA, 20 nt, Human
ucugcccuuccucguccccc

SEQ ID NO: 130470 - RNA, 19 nt, Human
ucugcuucagguacaucag

SEQ ID NO: 130471 - RNA, 23 nt, Human
ugacugaggcugccuuggcggcu

SEQ ID NO: 130472 - RNA, 19 nt, Human
ugagagggagggaggugcc

SEQ ID NO: 130473 - RNA, 21 nt, Human
ugagagggagggaggugccau

SEQ ID NO: 130474 - RNA, 18 nt, Human
ugaggcagcucucuuuuc

SEQ ID NO: 130475 - RNA, 19 nt, Human
ugaggcagcucucuuuucu

SEQ ID NO: 130476 - RNA, 25 nt, Human
ugcagccggaugcccgcggccugcc

SEQ ID NO: 130477 - RNA, 20 nt, Human
ugccacagccuccugcggag

SEQ ID NO: 130478 - RNA, 20 nt, Human
ugccacagccuccugcggag

SEQ ID NO: 130479 - RNA, 25 nt, Human
ugccacagccuccugcggagaccag

SEQ ID NO: 130480 - RNA, 25 nt, Human
ugccacagccuccugcggagaccag

SEQ ID NO: 130481 - RNA, 21 nt, Human
ugccacagcugccacagccuc

SEQ ID NO: 130482 - RNA, 21 nt, Human
ugccacagcugccacagccuc

SEQ ID NO: 130483 - RNA, 24 nt, Human
ugccacaguggaugccacagcugc

SEQ ID NO: 130484 - RNA, 24 nt, Human
ugccacaguggaugccacagcugc

SEQ ID NO: 130485 - RNA, 22 nt, Human
ugcccaccaucaccacacaccg

SEQ ID NO: 130486 - RNA, 22 nt, Human
ugcccuggaacgccccaaggac

SEQ ID NO: 130487 - RNA, 22 nt, Human
ugcccuggaacgccccaaggac

SEQ ID NO: 130488 - RNA, 19 nt, Human
ugcccuuccucgucccgcu

SEQ ID NO: 130489 - RNA, 19 nt, Human
ugcccuuccucgucccgcu

SEQ ID NO: 130490 - RNA, 22 nt, Human
ugccuggccgggggcucugggg

SEQ ID NO: 130491 - RNA, 25 nt, Human
ugccuggguccuggcagcacucugg

SEQ ID NO: 130492 - RNA, 25 nt, Human
ugccuggguccuggcagcgcucugg

SEQ ID NO: 130493 - RNA, 20 nt, Human
uggaauaucuucuuccuggc

SEQ ID NO: 130494 - RNA, 18 nt, Human
uggagaucccgcugcaga

SEQ ID NO: 130495 - RNA, 19 nt, Human
uggaugccacagcugccac

SEQ ID NO: 130496 - RNA, 19 nt, Human
uggaugccacagcugccac

SEQ ID NO: 130497 - RNA, 19 nt, Human
uggcagaagaucccagcug

SEQ ID NO: 130498 - RNA, 19 nt, Human
uggcagaagaucccagcug

SEQ ID NO: 130499 - RNA, 18 nt, Human
ugggauuuugcuuaaugu

SEQ ID NO: 130500 - RNA, 22 nt, Human
ugggcaggacggagaugccaca

SEQ ID NO: 130501 - RNA, 20 nt, Human
ugggcugcucccgggaugaa

SEQ ID NO: 130502 - RNA, 21 nt, Human
uggggaagggcaugcccacca

SEQ ID NO: 130503 - RNA, 22 nt, Human
uggggaggcucucagaaagaaa

SEQ ID NO: 130504 - RNA, 20 nt, Human
uggggucagagggagaagac

SEQ ID NO: 130505 - RNA, 20 nt, Human
uggggucagagggagaagac

SEQ ID NO: 130506 - RNA, 18 nt, Human
ugguuguagaaggggcag

SEQ ID NO: 130507 - RNA, 21 nt, Human
ugguuguagaaggggcaggcu

SEQ ID NO: 130508 - RNA, 23 nt, Human
ugugcaucaguggagaagcuggu

SEQ ID NO: 130509 - RNA, 20 nt, Human
ugugcgcucuuagguuccug

SEQ ID NO: 130510 - RNA, 18 nt, Human
uucacgucuucauuuaca

SEQ ID NO: 130511 - RNA, 20 nt, Human
uucagcuccgucccugucug

SEQ ID NO: 130512 - RNA, 19 nt, Human
uuccagcggcugguuggag

SEQ ID NO: 130513 - RNA, 26 nt, Human
uucccacaggaacaaaggucuccgug

SEQ ID NO: 130514 - RNA, 26 nt, Human
uucccacaggaacaaaggucuccgug

SEQ ID NO: 130515 - RNA, 20 nt, Human
uuccucgucccgcugcuccu

SEQ ID NO: 130516 - RNA, 21 nt, Human
uuccucgucccgcugcuccuc

SEQ ID NO: 130517 - RNA, 18 nt, Human
uuccuggaauaucuucuu

SEQ ID NO: 130518 - RNA, 19 nt, Human
uuucccacaggaacaaagg

SEQ ID NO: 130519 - RNA, 21 nt, Human
uuuccuccugcccccguuugu

SEQ ID NO: 130520 - RNA, 22 nt, Human
uuucuucuucucugcuucucuc

SEQ ID NO: 130521 - RNA, 24 nt, Human
uuuggcuucuccuccucagcuccu

SEQ ID NO: 130522 - RNA, 22 nt, Human
uuuucuggaacgugaauuccag

SEQ ID NO: 130523 - RNA, 22 nt, Human
aaaggccauuaucgaaccaacg

SEQ ID NO: 130524 - RNA, 19 nt, Human
aauaaacugcaaaacauug

SEQ ID NO: 130525 - RNA, 21 nt, Human
acuacagcccacacggugcgg

SEQ ID NO: 130526 - RNA, 21 nt, Human
agcuacagugucaacacaaaa

SEQ ID NO: 130527 - RNA, 20 nt, Human
aggacccccaccccucccgc

SEQ ID NO: 130528 - RNA, 22 nt, Human
caccccucccgcuacuacagcc

SEQ ID NO: 130529 - RNA, 24 nt, Human
caccccucccgcuacuacagccca

SEQ ID NO: 130530 - RNA, 26 nt, Human
cccacacggugcggccggaaccaaca

SEQ ID NO: 130531 - RNA, 21 nt, Human
ccccucccgcuacuacagccc

SEQ ID NO: 130532 - RNA, 23 nt, Human
ccccucccgcuacuacagcccac

SEQ ID NO: 130533 - RNA, 22 nt, Human
cucuggaggacccccaccccuc

SEQ ID NO: 130534 - RNA, 23 nt, Human
cuggaggacccccaccccucccg

SEQ ID NO: 130535 - RNA, 20 nt, Human
gaacgggcaguuauuaagga

SEQ ID NO: 130536 - RNA, 18 nt, Human
gacagccacuuaacucug

SEQ ID NO: 130537 - RNA, 20 nt, Human
ggaauauuuacuguaaagaa

SEQ ID NO: 130538 - RNA, 18 nt, Human
guaaagaaaaauuaaaaa

SEQ ID NO: 130539 - RNA, 24 nt, Human
uaauuuaugaaaucagaauggaau

SEQ ID NO: 130540 - RNA, 20 nt, Human
uaccauggucgauaaucaca

SEQ ID NO: 130541 - RNA, 23 nt, Human
uaccauggucgauaaucacauuu

SEQ ID NO: 130542 - RNA, 25 nt, Human
uaccauggucgauaaucacauuuua

SEQ ID NO: 130543 - RNA, 18 nt, Human
uaucgaaccaacgugaag

SEQ ID NO: 130544 - RNA, 21 nt, Human
uggaauauuuacuguaaagaa

SEQ ID NO: 130545 - RNA, 18 nt, Human
uuuuuuuuuuuuuuuccg

SEQ ID NO: 130546 - RNA, 21 nt, Human
uuuuuuuuuuuuuuuuuccgu

SEQ ID NO: 130547 - RNA, 19 nt, Human
aauguauagaaggaaaagg

SEQ ID NO: 130548 - RNA, 24 nt, Human
agcuuuauuccaaaaauaauuuua

SEQ ID NO: 130549 - RNA, 22 nt, Human
cagaggccuggagcccucggcu

SEQ ID NO: 130550 - RNA, 23 nt, Human
cagcuaccuugggaccucuagga

SEQ ID NO: 130551 - RNA, 22 nt, Human
cuggagccucagcuucgcaagu

SEQ ID NO: 130552 - RNA, 26 nt, Human
ggccuggagcccucggcuggagccuc

SEQ ID NO: 130553 - RNA, 22 nt, Human
guauagaaggaaaaggagcugg

SEQ ID NO: 130554 - RNA, 22 nt, Human
gucagcuaccuugggaccucua

SEQ ID NO: 130555 - RNA, 19 nt, Human
ucagaggccuggagcccuc

SEQ ID NO: 130556 - RNA, 21 nt, Human
ugcucccggcccugaagcguc

SEQ ID NO: 130557 - RNA, 27 nt, Human
uguauagaaggaaaaggagcugguuga

SEQ ID NO: 130558 - RNA, 21 nt, Human
uuaauagguauuaaauaaugu

SEQ ID NO: 130559 - RNA, 21 nt, Human
agggauggcacgagggaucgu

SEQ ID NO: 130560 - RNA, 24 nt, Human
caaguccaaacauaauuugaagug

SEQ ID NO: 130561 - RNA, 24 nt, Human
cacgagggaucgugggcuccgggg

SEQ ID NO: 130562 - RNA, 20 nt, Human
caucaguggcugguggagcu

SEQ ID NO: 130563 - RNA, 22 nt, Human
gugcugguggauucgagggaug

SEQ ID NO: 130564 - RNA, 22 nt, Human
uccaaacauaauuugaagugag

SEQ ID NO: 130565 - RNA, 24 nt, Human
ucucuguguauucaugccuaaucu

SEQ ID NO: 130566 - RNA, 21 nt, Human
ugggacgcucgugcuggugga

SEQ ID NO: 130567 - RNA, 21 nt, Human
uucgagggauggcacgaggga

SEQ ID NO: 130568 - RNA, 26 nt, Human
uucgagggauggcacgagggaucgug

SEQ ID NO: 130569 - RNA, 20 nt, Human
uuugaagugagguagguagu

SEQ ID NO: 130570 - RNA, 21 nt, Human
aaaagauaaacaacaaacaug

SEQ ID NO: 130571 - RNA, 18 nt, Human
aaagguaucauuuguuga

SEQ ID NO: 130572 - RNA, 19 nt, Human
aagcccuuuguaaagaacu

SEQ ID NO: 130573 - RNA, 21 nt, Human
aagcuaacagaucaaaucaaa

SEQ ID NO: 130574 - RNA, 22 nt, Human
aauuucuacaagaaugcaccuc

SEQ ID NO: 130575 - RNA, 18 nt, Human
acccugaaacuuucagcu

SEQ ID NO: 130576 - RNA, 23 nt, Human
aggcugagagacugcccagacac

SEQ ID NO: 130577 - RNA, 20 nt, Human
aggggaggcggggaucuugg

SEQ ID NO: 130578 - RNA, 19 nt, Human
auaccuggccuaaaucaaa

SEQ ID NO: 130579 - RNA, 23 nt, Human
auagaaaauggcacccugaaacu

SEQ ID NO: 130580 - RNA, 19 nt, Human
augcaccucuauagaagga

SEQ ID NO: 130581 - RNA, 24 nt, Human
caaaagacauucaaaagauaaaca

SEQ ID NO: 130582 - RNA, 19 nt, Human
cacagccucaaaagacauu

SEQ ID NO: 130583 - RNA, 25 nt, Human
cacagccucaaaagacauucaaaag

SEQ ID NO: 130584 - RNA, 27 nt, Human
cagcaaaaauguggacagcuuucacag

SEQ ID NO: 130585 - RNA, 20 nt, Human
caugcuacaaauuucuacaa

SEQ ID NO: 130586 - RNA, 22 nt, Human
ccaagagggaggagaggaaaga

SEQ ID NO: 130587 - RNA, 26 nt, Human
ccagacacacaaaaaauguggccuga

SEQ ID NO: 130588 - RNA, 21 nt, Human
ccccaagagggaggagaggaa

SEQ ID NO: 130589 - RNA, 21 nt, Human
ccucaaaagacauucaaaaga

SEQ ID NO: 130590 - RNA, 23 nt, Human
ccuuccugccuaaaaccuaagag

SEQ ID NO: 130591 - RNA, 19 nt, Human
cgcccggccuggaagugga

SEQ ID NO: 130592 - RNA, 21 nt, Human
gaggaggauggauauccaaag

SEQ ID NO: 130593 - RNA, 24 nt, Human
gccuaagcccuuuguaaagaacuc

SEQ ID NO: 130594 - RNA, 18 nt, Human
gcgggccugcgguggggg

SEQ ID NO: 130595 - RNA, 21 nt, Human
ggaagcuaacagaucaaauca

SEQ ID NO: 130596 - RNA, 24 nt, Human
ggugcuuaaggggaggcggggauc

SEQ ID NO: 130597 - RNA, 19 nt, Human
uaaacaacaaacauguaaa

SEQ ID NO: 130598 - RNA, 20 nt, Human
uaauacacagcaaaaaugug

SEQ ID NO: 130599 - RNA, 22 nt, Human
uacacagcaaaaauguggacag

SEQ ID NO: 130600 - RNA, 20 nt, Human
uaggaaaaucuaaagcaaug

SEQ ID NO: 130601 - RNA, 21 nt, Human
uaucagaaaugccacuauaca

SEQ ID NO: 130602 - RNA, 23 nt, Human
ucagaaaugccacuauacaccac

SEQ ID NO: 130603 - RNA, 22 nt, Human
ucauuuguugacaguuccugau

SEQ ID NO: 130604 - RNA, 21 nt, Human
ugacccacagcuauuuaauac

SEQ ID NO: 130605 - RNA, 18 nt, Human
ugaggaaagccccaagag

SEQ ID NO: 130606 - RNA, 21 nt, Human
ugccuguggccugcagagggc

SEQ ID NO: 130607 - RNA, 21 nt, Human
ugcuacaaauuucuacaagaa

SEQ ID NO: 130608 - RNA, 21 nt, Human
uggaagaaagggacgggaguc

SEQ ID NO: 130609 - RNA, 20 nt, Human
uguaaagaacuccacagcaa

SEQ ID NO: 130610 - RNA, 21 nt, Human
uguggacagcuuucacagccu

SEQ ID NO: 130611 - RNA, 21 nt, Human
uuuaaauauuccuuccugccu

SEQ ID NO: 130612 - RNA, 20 nt, Human
uuuguugacaguuccugaug

SEQ ID NO: 130613 - RNA, 21 nt, Human
aaauagccagagaacagaaac

SEQ ID NO: 130614 - RNA, 18 nt, Human
aacacugcaauacagaaa

SEQ ID NO: 130615 - RNA, 19 nt, Human
aacacugcaauacagaaaa

SEQ ID NO: 130616 - RNA, 20 nt, Human
acaagaagccuauaaacacu

SEQ ID NO: 130617 - RNA, 19 nt, Human
agccagagaacagaaacca

SEQ ID NO: 130618 - RNA, 18 nt, Human
agggugggagagguuuug

SEQ ID NO: 130619 - RNA, 21 nt, Human
caagaagccuauaaacacugc

SEQ ID NO: 130620 - RNA, 19 nt, Human
caauacagaaaaauuaagc

SEQ ID NO: 130621 - RNA, 22 nt, Human
cacacaagaagccuauaaacac

SEQ ID NO: 130622 - RNA, 19 nt, Human
ccuauaaacacugcaauac

SEQ ID NO: 130623 - RNA, 23 nt, Human
ccucagaaaccgccgcuguaccu

SEQ ID NO: 130624 - RNA, 26 nt, Human
cgccgcuguaccucagccgggugucc

SEQ ID NO: 130625 - RNA, 21 nt, Human
cugcaugaggucucucccgcu

SEQ ID NO: 130626 - RNA, 19 nt, Human
gaagagagggagacuuuuu

SEQ ID NO: 130627 - RNA, 18 nt, Human
gcaaaucugcaugagguc

SEQ ID NO: 130628 - RNA, 21 nt, Human
gccagagaacagaaaccaaug

SEQ ID NO: 130629 - RNA, 20 nt, Human
ggugguggagugaaacacaa

SEQ ID NO: 130630 - RNA, 22 nt, Human
uaacacacaagaagccuauaaa

SEQ ID NO: 130631 - RNA, 20 nt, Human
uaccucagcugcagcagcaa

SEQ ID NO: 130632 - RNA, 18 nt, Human
uagccagagaacagaaac

SEQ ID NO: 130633 - RNA, 21 nt, Human
uagccagagaacagaaaccaa

SEQ ID NO: 130634 - RNA, 28 nt, Human
ugcaauacagaaaaauuaagcugcugca

SEQ ID NO: 130635 - RNA, 31 nt, Human
uuuuuuuuuuuucugaccauuguuuuuaauu

SEQ ID NO: 130636 - RNA, 18 nt, Human
uuuuuuuuuuuuuuucug

SEQ ID NO: 130637 - RNA, 23 nt, Human
aaaauaacuguauauacaaaaca

SEQ ID NO: 130638 - RNA, 20 nt, Human
agaggggagugggcugaggg

SEQ ID NO: 130639 - RNA, 19 nt, Human
caaccuuaacagaggugac

SEQ ID NO: 130640 - RNA, 23 nt, Human
cacuguaaaaugauggaaaaagg

SEQ ID NO: 130641 - RNA, 19 nt, Human
caggaguggggaccuggga

SEQ ID NO: 130642 - RNA, 22 nt, Human
cagugcuccccgucguaccccc

SEQ ID NO: 130643 - RNA, 25 nt, Human
ccacccccgguacaggaguggggac

SEQ ID NO: 130644 - RNA, 22 nt, Human
ccccaccccacccccgguacag

SEQ ID NO: 130645 - RNA, 20 nt, Human
cccccgccuccgccuccucc

SEQ ID NO: 130646 - RNA, 19 nt, Human
cccccgguacaggaguggg

SEQ ID NO: 130647 - RNA, 21 nt, Human
ccccgccuccgccuccuccug

SEQ ID NO: 130648 - RNA, 18 nt, Human
ccccggccccugugugug

SEQ ID NO: 130649 - RNA, 22 nt, Human
ccggcugcggggaguuucuccc

SEQ ID NO: 130650 - RNA, 23 nt, Human
ccgucguacccccgccuccgccu

SEQ ID NO: 130651 - RNA, 22 nt, Human
cgcuggggcgggcgcccagccg

SEQ ID NO: 130652 - RNA, 23 nt, Human
cuccuccugccugccugcccgcu

SEQ ID NO: 130653 - RNA, 21 nt, Human
cuggcuccccaccccaccccc

SEQ ID NO: 130654 - RNA, 19 nt, Human
cugggagcuggcgaagagg

SEQ ID NO: 130655 - RNA, 21 nt, Human
cuguaaaaugauggaaaaagg

SEQ ID NO: 130656 - RNA, 21 nt, Human
cuuuuuuccccaaaaauuaca

SEQ ID NO: 130657 - RNA, 20 nt, Human
gaauaacaaaagugcuuuuc

SEQ ID NO: 130658 - RNA, 23 nt, Human
gaauaacaaaagugcuuuucuua

SEQ ID NO: 130659 - RNA, 26 nt, Human
gcccuggggcuguugggagaaguuuc

SEQ ID NO: 130660 - RNA, 20 nt, Human
gccuggcuccccaccccacc

SEQ ID NO: 130661 - RNA, 22 nt, Human
gcuguugggagaaguuucaggg

SEQ ID NO: 130662 - RNA, 18 nt, Human
ggaagauuggcccugggg

SEQ ID NO: 130663 - RNA, 24 nt, Human
ggaauaacaaaagugcuuuucuua

SEQ ID NO: 130664 - RNA, 22 nt, Human
ggagaaagaggagaugguagag

SEQ ID NO: 130665 - RNA, 23 nt, Human
ggcgaagaggggagugggcugag

SEQ ID NO: 130666 - RNA, 24 nt, Human
ggcuccccaccccacccccgguac

SEQ ID NO: 130667 - RNA, 26 nt, Human
gggaccugggagcuggcgaagagggg

SEQ ID NO: 130668 - RNA, 18 nt, Human
gggagugggcugagggaa

SEQ ID NO: 130669 - RNA, 19 nt, Human
ggggagugggcugagggaa

SEQ ID NO: 130670 - RNA, 21 nt, Human
gguggagaaagaggagauggu

SEQ ID NO: 130671 - RNA, 21 nt, Human
guagagguggaggcgccggug

SEQ ID NO: 130672 - RNA, 20 nt, Human
uaagaaaauagaaccugagg

SEQ ID NO: 130673 - RNA, 20 nt, Human
uaaguggccacauucuauuu

SEQ ID NO: 130674 - RNA, 22 nt, Human
uacaaaaauaaaccaaaaugaa

SEQ ID NO: 130675 - RNA, 23 nt, Human
uagagguggaggcgccgguggcg

SEQ ID NO: 130676 - RNA, 20 nt, Human
uagugaaauaaguggccaca

SEQ ID NO: 130677 - RNA, 18 nt, Human
ucaaaauacauuuguaca

SEQ ID NO: 130678 - RNA, 22 nt, Human
ucguacccccgccuccgccucc

SEQ ID NO: 130679 - RNA, 22 nt, Human
ugaaauaaguggccacauucua

SEQ ID NO: 130680 - RNA, 21 nt, Human
ugagaggaaacuccccagacc

SEQ ID NO: 130681 - RNA, 20 nt, Human
ugccugcccgcuggggcggg

SEQ ID NO: 130682 - RNA, 23 nt, Human
uggagaaagaggagaugguagag

SEQ ID NO: 130683 - RNA, 20 nt, Human
uggcuccccaccccaccccc

SEQ ID NO: 130684 - RNA, 19 nt, Human
uggggaccugggagcuggc

SEQ ID NO: 130685 - RNA, 25 nt, Human
uggggcgggcgcccagccgucuguc

SEQ ID NO: 130686 - RNA, 26 nt, Human
uuaacagaggugacaauuuuaaaggu

SEQ ID NO: 130687 - RNA, 23 nt, Human
uuaauguaugugcuuuuuucccu

SEQ ID NO: 130688 - RNA, 26 nt, Human
uucaaauagccaacaaugcaugucag

SEQ ID NO: 130689 - RNA, 24 nt, Human
uucaaccuuaacagaggugacaau

SEQ ID NO: 130690 - RNA, 28 nt, Human
uugauggaauaacaaaagugcuuuucuu

SEQ ID NO: 130691 - RNA, 22 nt, Human
uuuucacauuacaaaaauaaac

SEQ ID NO: 130692 - RNA, 23 nt, Human
aaaaaaaacacacaacuaaacaa

SEQ ID NO: 130693 - RNA, 23 nt, Human
aaacauuaaaagcucacacuacc

SEQ ID NO: 130694 - RNA, 23 nt, Human
aaauaccuaaggcugccaugacu

SEQ ID NO: 130695 - RNA, 24 nt, Human
aaauagcaccauaacaaaugaccu

SEQ ID NO: 130696 - RNA, 21 nt, Human
aacagcucaggcugggcacgg

SEQ ID NO: 130697 - RNA, 22 nt, Human
aaccaccuucugaacagggcug

SEQ ID NO: 130698 - RNA, 18 nt, Human
aagcaggaaacgguggcu

SEQ ID NO: 130699 - RNA, 20 nt, Human
aagcaggaaacgguggcuug

SEQ ID NO: 130700 - RNA, 20 nt, Human
aaggcacaauacacuugaaa

SEQ ID NO: 130701 - RNA, 20 nt, Human
aaggcacaguacauuaacaa

SEQ ID NO: 130702 - RNA, 23 nt, Human
aaucuagucccauccccuuccua

SEQ ID NO: 130703 - RNA, 29 nt, Human
acaacaaagauaaccacauguuugaggaa

SEQ ID NO: 130704 - RNA, 19 nt, Human
acacgcacacaagacauau

SEQ ID NO: 130705 - RNA, 24 nt, Human
accaaaaaacaucaacacuagcau

SEQ ID NO: 130706 - RNA, 21 nt, Human
accacauguuugaggauugca

SEQ ID NO: 130707 - RNA, 21 nt, Human
acgcacacaagacauauauau

SEQ ID NO: 130708 - RNA, 28 nt, Human
acugaaaaaaaaaaaaacacacaacuaa

SEQ ID NO: 130709 - RNA, 18 nt, Human
agaagaaaacagcucagg

SEQ ID NO: 130710 - RNA, 21 nt, Human
agacaaguguaucaaaaccuu

SEQ ID NO: 130711 - RNA, 19 nt, Human
agaggaggagagaacagag

SEQ ID NO: 130712 - RNA, 21 nt, Human
agagggaaggggaggagaggg

SEQ ID NO: 130713 - RNA, 23 nt, Human
agagggaaggggaggagagggag

SEQ ID NO: 130714 - RNA, 23 nt, Human
agagggagggaaaagaggggagc

SEQ ID NO: 130715 - RNA, 23 nt, Human
agaugaauucuccuaaaaaccua

SEQ ID NO: 130716 - RNA, 22 nt, Human
agcacagaauucaaaguggcag

SEQ ID NO: 130717 - RNA, 19 nt, Human
agcaccauaacaaaugacc

SEQ ID NO: 130718 - RNA, 18 nt, Human
aggccucuucgccccccu

SEQ ID NO: 130719 - RNA, 23 nt, Human
aucacgcuccaaguucugcauga

SEQ ID NO: 130720 - RNA, 22 nt, Human
augauuuuugaaaccuuauuaa

SEQ ID NO: 130721 - RNA, 21 nt, Human
augcugucccaguucucucga

SEQ ID NO: 130722 - RNA, 24 nt, Human
auguaauaagagggccagaagaaa

SEQ ID NO: 130723 - RNA, 23 nt, Human
auuaaaagcucacacuaccccga

SEQ ID NO: 130724 - RNA, 23 nt, Human
auucuccuaaaaaccuauuuuca

SEQ ID NO: 130725 - RNA, 19 nt, Human
auugacaccuugugcaguu

SEQ ID NO: 130726 - RNA, 24 nt, Human
caacaaucuccaagagacaaagua

SEQ ID NO: 130727 - RNA, 22 nt, Human
caacuaaacaaaauccacacaa

SEQ ID NO: 130728 - RNA, 23 nt, Human
cacaaaauuagcacagaauucaa

SEQ ID NO: 130729 - RNA, 22 nt, Human
cacaacuaaacaaaauccacac

SEQ ID NO: 130730 - RNA, 22 nt, Human
cacacaacuaaacaaaauccac

SEQ ID NO: 130731 - RNA, 20 nt, Human
caccauaacaaaugaccuca

SEQ ID NO: 130732 - RNA, 23 nt, Human
caccgcauucuggccacaaaauu

SEQ ID NO: 130733 - RNA, 18 nt, Human
cagaauaugcacagcaca

SEQ ID NO: 130734 - RNA, 22 nt, Human
cagagggaaggggaggagaggg

SEQ ID NO: 130735 - RNA, 20 nt, Human
cagaugagcaugauccuucu

SEQ ID NO: 130736 - RNA, 22 nt, Human
cagcaaaaaguaucuagaaauc

SEQ ID NO: 130737 - RNA, 22 nt, Human
cagcacguacaacgugugcccu

SEQ ID NO: 130738 - RNA, 19 nt, Human
cagcaugcgguucucaucu

SEQ ID NO: 130739 - RNA, 19 nt, Human
cagcucaggcugggcacgg

SEQ ID NO: 130740 - RNA, 19 nt, Human
caguucacacacuucuggg

SEQ ID NO: 130741 - RNA, 18 nt, Human
cauaaacagacuauaaau

SEQ ID NO: 130742 - RNA, 25 nt, Human
cauaacaaaugaccucaauacuguc

SEQ ID NO: 130743 - RNA, 21 nt, Human
cauguaggcucacugaaaucu

SEQ ID NO: 130744 - RNA, 25 nt, Human
ccaagguuugauuuuagcccaaguu

SEQ ID NO: 130745 - RNA, 20 nt, Human
ccaaucugcaaguaucaaaa

SEQ ID NO: 130746 - RNA, 19 nt, Human
ccacacaacaaacaucuga

SEQ ID NO: 130747 - RNA, 21 nt, Human
ccaccgcgaaggcccucucac

SEQ ID NO: 130748 - RNA, 19 nt, Human
ccauaacaaaugaccucaa

SEQ ID NO: 130749 - RNA, 21 nt, Human
cccaaucugcaaguaucaaaa

SEQ ID NO: 130750 - RNA, 18 nt, Human
cccccaaucugcaaguau

SEQ ID NO: 130751 - RNA, 26 nt, Human
cccugaagaguaccgagaacucggag

SEQ ID NO: 130752 - RNA, 20 nt, Human
cccuguaauaguaugcccac

SEQ ID NO: 130753 - RNA, 21 nt, Human
ccgcuaaaacccuagucucag

SEQ ID NO: 130754 - RNA, 22 nt, Human
ccucucacgggagaacugcggc

SEQ ID NO: 130755 - RNA, 19 nt, Human
ccugugugccaagguuuga

SEQ ID NO: 130756 - RNA, 19 nt, Human
ccuuacgcauucgcucccc

SEQ ID NO: 130757 - RNA, 22 nt, Human
cgaaggcccucucacgggagaa

SEQ ID NO: 130758 - RNA, 23 nt, Human
cgccaauuuuguuuuuacuaaca

SEQ ID NO: 130759 - RNA, 18 nt, Human
cgccccccuuuccaaccu

SEQ ID NO: 130760 - RNA, 22 nt, Human
cgccugaaaauguuaaccuagg

SEQ ID NO: 130761 - RNA, 21 nt, Human
cucacugaaaucuccauucca

SEQ ID NO: 130762 - RNA, 24 nt, Human
cucauaauuaaugaucugccuaaa

SEQ ID NO: 130763 - RNA, 22 nt, Human
cucauguaauaagagggccaga

SEQ ID NO: 130764 - RNA, 19 nt, Human
cucggaguucucgagaucu

SEQ ID NO: 130765 - RNA, 22 nt, Human
cucuucuuccucucucaguucc

SEQ ID NO: 130766 - RNA, 20 nt, Human
cuggagcgcaccgcgcggcc

SEQ ID NO: 130767 - RNA, 22 nt, Human
cuucacucuucuuccucucuca

SEQ ID NO: 130768 - RNA, 19 nt, Human
cuucccaacuaucauuccc

SEQ ID NO: 130769 - RNA, 20 nt, Human
cuucuuccucucucaguucc

SEQ ID NO: 130770 - RNA, 19 nt, Human
gaagaggaggagagaacag

SEQ ID NO: 130771 - RNA, 19 nt, Human
gaaggggaggagagggagg

SEQ ID NO: 130772 - RNA, 25 nt, Human
gacacgcacacaagacauauauaua

SEQ ID NO: 130773 - RNA, 21 nt, Human
gaggagagggagggaaaagag

SEQ ID NO: 130774 - RNA, 18 nt, Human
gaggauugcaaugugcca

SEQ ID NO: 130775 - RNA, 20 nt, Human
gagggaaggggaggagaggg

SEQ ID NO: 130776 - RNA, 24 nt, Human
gaggggaagaggaggagagaacag

SEQ ID NO: 130777 - RNA, 18 nt, Human
gaggggaggggaagagga

SEQ ID NO: 130778 - RNA, 24 nt, Human
gcagauucccgaaacugagagggc

SEQ ID NO: 130779 - RNA, 18 nt, Human
gcagcaaaaaguaucuag

SEQ ID NO: 130780 - RNA, 26 nt, Human
gccucuucgccccccuuuccaaccuu

SEQ ID NO: 130781 - RNA, 23 nt, Human
gcgaguucuugaaacuacacaag

SEQ ID NO: 130782 - RNA, 26 nt, Human
gcuaaaacccuagucucagccucgga

SEQ ID NO: 130783 - RNA, 18 nt, Human
ggagagggagggaaaaga

SEQ ID NO: 130784 - RNA, 21 nt, Human
ggagagggagggaaaagaggg

SEQ ID NO: 130785 - RNA, 21 nt, Human
ggagcguuuugaucaccgcau

SEQ ID NO: 130786 - RNA, 24 nt, Human
ggaggagagggagggaaaagaggg

SEQ ID NO: 130787 - RNA, 19 nt, Human
ggaggggaggggaagagga

SEQ ID NO: 130788 - RNA, 21 nt, Human
ggaggggaggggaagaggagg

SEQ ID NO: 130789 - RNA, 21 nt, Human
ggauggggguaggcgggaggg

SEQ ID NO: 130790 - RNA, 20 nt, Human
ggcacuugcuccacagauga

SEQ ID NO: 130791 - RNA, 19 nt, Human
gggaaggggaggagaggga

SEQ ID NO: 130792 - RNA, 23 nt, Human
gggauggggguaggcgggagggg

SEQ ID NO: 130793 - RNA, 19 nt, Human
ggggaggggaagaggagga

SEQ ID NO: 130794 - RNA, 21 nt, Human
ggggaggggaggggaagagga

SEQ ID NO: 130795 - RNA, 22 nt, Human
gggggaggggaggggaagagga

SEQ ID NO: 130796 - RNA, 22 nt, Human
guuauguacauauuuccaaccu

SEQ ID NO: 130797 - RNA, 22 nt, Human
guuuuucguuuuuuuuguuuuu

SEQ ID NO: 130798 - RNA, 21 nt, Human
uaaaaaaaaaauuucagugga

SEQ ID NO: 130799 - RNA, 22 nt, Human
uaaaaaguuaugggcaaaaugu

SEQ ID NO: 130800 - RNA, 21 nt, Human
uaaaacccuagucucagccuc

SEQ ID NO: 130801 - RNA, 23 nt, Human
uaaaauaaagccugcugcauuua

SEQ ID NO: 130802 - RNA, 19 nt, Human
uaaaauucucugaaugugc

SEQ ID NO: 130803 - RNA, 22 nt, Human
uaaacaaaauccacacaacaaa

SEQ ID NO: 130804 - RNA, 19 nt, Human
uaaaugcaguuugggaugg

SEQ ID NO: 130805 - RNA, 21 nt, Human
uaacaaacaaaugauccucag

SEQ ID NO: 130806 - RNA, 23 nt, Human
uaaccuaggccucuucgcccccc

SEQ ID NO: 130807 - RNA, 20 nt, Human
uaagacaaguguaucaaaac

SEQ ID NO: 130808 - RNA, 19 nt, Human
uaagacgccugaaaauguu

SEQ ID NO: 130809 - RNA, 20 nt, Human
uaagcgaguguuuguuccac

SEQ ID NO: 130810 - RNA, 21 nt, Human
uacaauaagcaauuacuaaag

SEQ ID NO: 130811 - RNA, 23 nt, Human
uacacuucccgugcucuccgcua

SEQ ID NO: 130812 - RNA, 25 nt, Human
uagcagcaaaaaguaucuagaaauc

SEQ ID NO: 130813 - RNA, 19 nt, Human
uaggccucuucgccccccu

SEQ ID NO: 130814 - RNA, 20 nt, Human
uauauaauuucacgcauacg

SEQ ID NO: 130815 - RNA, 25 nt, Human
uauggcauuucaugggggcacuugc

SEQ ID NO: 130816 - RNA, 27 nt, Human
uauggcauuucaugggggcacuugcuc

SEQ ID NO: 130817 - RNA, 21 nt, Human
uauggcuacacugccaacgcc

SEQ ID NO: 130818 - RNA, 25 nt, Human
uauguacauauuuccaaccugugug

SEQ ID NO: 130819 - RNA, 18 nt, Human
ucacagaccaguucacac

SEQ ID NO: 130820 - RNA, 23 nt, Human
ucacugaaaucuccauuccacca

SEQ ID NO: 130821 - RNA, 20 nt, Human
ucagcaugcgguucucaucu

SEQ ID NO: 130822 - RNA, 26 nt, Human
ucaggcugggcacgggugucaccaug

SEQ ID NO: 130823 - RNA, 21 nt, Human
ucaguucccgggcuuggagau

SEQ ID NO: 130824 - RNA, 24 nt, Human
ucaguucccgggcuuggagauguc

SEQ ID NO: 130825 - RNA, 18 nt, Human
ucauacccucugaccaaa

SEQ ID NO: 130826 - RNA, 20 nt, Human
ucaugggggcacuugcucca

SEQ ID NO: 130827 - RNA, 24 nt, Human
uccacacaacaaacaucugagaaa

SEQ ID NO: 130828 - RNA, 24 nt, Human
uccacacaacaaacaucugagaau

SEQ ID NO: 130829 - RNA, 18 nt, Human
ucccauccccuuccuaga

SEQ ID NO: 130830 - RNA, 20 nt, Human
ucccuguaauaguaugccca

SEQ ID NO: 130831 - RNA, 21 nt, Human
ucccuuaaaaaaaaaauuuca

SEQ ID NO: 130832 - RNA, 21 nt, Human
uccgcuaaaacccuagucuca

SEQ ID NO: 130833 - RNA, 19 nt, Human
ucgccccccuuuccaaccu

SEQ ID NO: 130834 - RNA, 19 nt, Human
ucgcuccccuuuccaacuc

SEQ ID NO: 130835 - RNA, 20 nt, Human
ucuaauauacccgcuggaaa

SEQ ID NO: 130836 - RNA, 19 nt, Human
ucucacaccgcaauucccu

SEQ ID NO: 130837 - RNA, 22 nt, Human
ucucacgggagaacugcggcuc

SEQ ID NO: 130838 - RNA, 21 nt, Human
ucucccgcuuuccaccggcua

SEQ ID NO: 130839 - RNA, 23 nt, Human
ucugaccaaaaaacaucaacacu

SEQ ID NO: 130840 - RNA, 19 nt, Human
ucuucccaacuaucauucc

SEQ ID NO: 130841 - RNA, 22 nt, Human
ugaaaaaaaaaaaaacacacaa

SEQ ID NO: 130842 - RNA, 18 nt, Human
ugaaaccuuauuaacuga

SEQ ID NO: 130843 - RNA, 21 nt, Human
ugaaauagcaccauaacaaau

SEQ ID NO: 130844 - RNA, 26 nt, Human
ugaaauagcaccauaacaaaugaccu

SEQ ID NO: 130845 - RNA, 28 nt, Human
ugaccaaaaaacaucaacacuagcaugc

SEQ ID NO: 130846 - RNA, 18 nt, Human
ugcaaauaguuuucuucc

SEQ ID NO: 130847 - RNA, 18 nt, Human
ugcaaauaguuuucuucc

SEQ ID NO: 130848 - RNA, 18 nt, Human
ugcaugcacuuucuucac

SEQ ID NO: 130849 - RNA, 23 nt, Human
ugccaugacuacaugcuggacuc

SEQ ID NO: 130850 - RNA, 21 nt, Human
ugcugucccaguucucucgag

SEQ ID NO: 130851 - RNA, 20 nt, Human
ugcuucaagacauuuguugu

SEQ ID NO: 130852 - RNA, 19 nt, Human
uggagcgcaccgcgcggcc

SEQ ID NO: 130853 - RNA, 20 nt, Human
uggcagaggcauuuuagugg

SEQ ID NO: 130854 - RNA, 18 nt, Human
uggcuacacugccaacgc

SEQ ID NO: 130855 - RNA, 18 nt, Human
ugggagcuaggcagauuc

SEQ ID NO: 130856 - RNA, 20 nt, Human
uguaugcauguauucauaca

SEQ ID NO: 130857 - RNA, 18 nt, Human
ugucaaaauguucaauaa

SEQ ID NO: 130858 - RNA, 20 nt, Human
ugugccagacauucacugaa

SEQ ID NO: 130859 - RNA, 23 nt, Human
ugugcccucccucucacaccgca

SEQ ID NO: 130860 - RNA, 24 nt, Human
uguuccaccgcgaaggcccucuca

SEQ ID NO: 130861 - RNA, 22 nt, Human
uuaagacaaguguaucaaaacc

SEQ ID NO: 130862 - RNA, 23 nt, Human
uuaauccaaacuacagcaaugaa

SEQ ID NO: 130863 - RNA, 22 nt, Human
uuacgcauucgcuccccuuucc

SEQ ID NO: 130864 - RNA, 23 nt, Human
uucauacaucaccucaucaugac

SEQ ID NO: 130865 - RNA, 21 nt, Human
uucauacccucugaccaaaaa

SEQ ID NO: 130866 - RNA, 22 nt, Human
uucccgggcuuggagauguggu

SEQ ID NO: 130867 - RNA, 20 nt, Human
uucucauguaauaagagggc

SEQ ID NO: 130868 - RNA, 19 nt, Human
uuuaauuucaagucgccaa

SEQ ID NO: 130869 - RNA, 20 nt, Human
uuuagaaucuagucccaucc

SEQ ID NO: 130870 - RNA, 19 nt, Human
uuuguacugucuuuugguc

SEQ ID NO: 130871 - RNA, 25 nt, Human
uuuguuuuuacuaacaucagaaagu

SEQ ID NO: 130872 - RNA, 21 nt, Human
uuuuucguuuuuuuuguuuuu

SEQ ID NO: 130873 - RNA, 20 nt, Human
uuuuuuuuuugaggccaagg

SEQ ID NO: 130874 - RNA, 20 nt, Human
aaaaagacagccacagccaa

SEQ ID NO: 130875 - RNA, 21 nt, Human
aaaaagacagccacagccaag

SEQ ID NO: 130876 - RNA, 24 nt, Human
aagacagccacagccaagucacgc

SEQ ID NO: 130877 - RNA, 24 nt, Human
accaaguguccugggccaguuuua

SEQ ID NO: 130878 - RNA, 22 nt, Human
agaacuccaccuccucugccag

SEQ ID NO: 130879 - RNA, 22 nt, Human
caaggauuaaaaaagacagcca

SEQ ID NO: 130880 - RNA, 21 nt, Human
cacaaggauuaaaaaagacag

SEQ ID NO: 130881 - RNA, 20 nt, Human
caccucggauacucugcagc

SEQ ID NO: 130882 - RNA, 19 nt, Human
caugccgugcuccugcaug

SEQ ID NO: 130883 - RNA, 26 nt, Human
cccaauaccugcugccauccucucug

SEQ ID NO: 130884 - RNA, 18 nt, Human
ccucagggcucccgccag

SEQ ID NO: 130885 - RNA, 22 nt, Human
cucccgcugccccggcagcacc

SEQ ID NO: 130886 - RNA, 22 nt, Human
cuccugcauggaagaacuccac

SEQ ID NO: 130887 - RNA, 19 nt, Human
cucucaccaagcgcgacuc

SEQ ID NO: 130888 - RNA, 18 nt, Human
cuugggacccuucugucc

SEQ ID NO: 130889 - RNA, 22 nt, Human
cuugggacccuucugucccgga

SEQ ID NO: 130890 - RNA, 20 nt, Human
gaggacccaauaccugcugc

SEQ ID NO: 130891 - RNA, 22 nt, Human
gcauggaagaacuccaccuccu

SEQ ID NO: 130892 - RNA, 19 nt, Human
ggggcgccggcgcugccac

SEQ ID NO: 130893 - RNA, 26 nt, Human
uaaaaaagacagccacagccaaguca

SEQ ID NO: 130894 - RNA, 22 nt, Human
ucccuuuaggucuuuuuugcug

SEQ ID NO: 130895 - RNA, 18 nt, Human
uccugcauggaagaacuc

SEQ ID NO: 130896 - RNA, 18 nt, Human
uggggcgccggcgcugcc

SEQ ID NO: 130897 - RNA, 18 nt, Human
ugucccggauucuggggc

SEQ ID NO: 130898 - RNA, 26 nt, Human
uguccugggccaguuuuagaugcgau

SEQ ID NO: 130899 - RNA, 19 nt, Human
uuacacaaggauuaaaaaa

SEQ ID NO: 130900 - RNA, 18 nt, Human
uuuuuuuuuuuuuuuuug

SEQ ID NO: 130901 - RNA, 24 nt, Human
uuuuuuuuuuuuuuuuuuuguuuu

SEQ ID NO: 130902 - RNA, 19 nt, Human
caaaaccacagacuugaag

SEQ ID NO: 130903 - RNA, 26 nt, Human
cauuuagaaugcuuuaauauucccag

SEQ ID NO: 130904 - RNA, 26 nt, Human
cauuuagaaugcuuuaauauucccag

SEQ ID NO: 130905 - RNA, 22 nt, Human
cuucucugcaucaaaaccacag

SEQ ID NO: 130906 - RNA, 23 nt, Human
cuucuguuaaaaacucaaaaauc

SEQ ID NO: 130907 - RNA, 22 nt, Human
ggagcuaugagaauguuaaguu

SEQ ID NO: 130908 - RNA, 21 nt, Human
uagucaguaaggauuuuuuuu

SEQ ID NO: 130909 - RNA, 23 nt, Human
ugagaauacaaggacaggagcua

SEQ ID NO: 130910 - RNA, 19 nt, Human
ugcuuuaauauucccaguu

SEQ ID NO: 130911 - RNA, 19 nt, Human
ugcuuuaauauucccaguu

SEQ ID NO: 130912 - RNA, 19 nt, Human
uuuugacauuuagaaugcu

SEQ ID NO: 130913 - RNA, 19 nt, Human
uuuugacauuuagaaugcu

SEQ ID NO: 130914 - RNA, 18 nt, Human
uuuuuuuuuuuuuuuuug

SEQ ID NO: 130915 - RNA, 27 nt, Human
uuuuuuuuuuuuuuuuuuuuuuugggg

SEQ ID NO: 130916 - RNA, 24 nt, Human
aaauggccucgaugacggcgaagc

SEQ ID NO: 130917 - RNA, 21 nt, Human
aagagcaauuaugaaaaacag

SEQ ID NO: 130918 - RNA, 19 nt, Human
agagaccgguagaaaugaa

SEQ ID NO: 130919 - RNA, 18 nt, Human
agcugcacuacuagagac

SEQ ID NO: 130920 - RNA, 23 nt, Human
agcugcacuacuagagaccggua

SEQ ID NO: 130921 - RNA, 23 nt, Human
aggaauguagagaaauauccaac

SEQ ID NO: 130922 - RNA, 21 nt, Human
augacaccagccgaagcugca

SEQ ID NO: 130923 - RNA, 20 nt, Human
caaaaaaaaccuaaaaauug

SEQ ID NO: 130924 - RNA, 22 nt, Human
ggcggcagcggaggaaggacac

SEQ ID NO: 130925 - RNA, 18 nt, Human
gggcggcagcggaggaag

SEQ ID NO: 130926 - RNA, 22 nt, Human
uaaagagcaauuaugaaaaaca

SEQ ID NO: 130927 - RNA, 19 nt, Human
uaaauagcgaaaaagugca

SEQ ID NO: 130928 - RNA, 22 nt, Human
uaacacacaauauaaagagcaa

SEQ ID NO: 130929 - RNA, 22 nt, Human
uaguacaaaaaaaaccuaaaaa

SEQ ID NO: 130930 - RNA, 21 nt, Human
ucgaugacggcgaagccuugc

SEQ ID NO: 130931 - RNA, 22 nt, Human
ugacaccagccgaagcugcacu

SEQ ID NO: 130932 - RNA, 19 nt, Human
ugcaccauaauuacugcug

SEQ ID NO: 130933 - RNA, 21 nt, Human
ugccuucauuauuguauuuca

SEQ ID NO: 130934 - RNA, 24 nt, Human
ugcgacaagucgcuggaaauggcc

SEQ ID NO: 130935 - RNA, 21 nt, Human
ugcgggggcggcagcggagga

SEQ ID NO: 130936 - RNA, 22 nt, Human
uguagagaaauauccaacuuaa

SEQ ID NO: 130937 - RNA, 22 nt, Human
aaaaaacggaugaggaaucagg

SEQ ID NO: 130938 - RNA, 23 nt, Human
aaaaagguauauuccuucuuuuc

SEQ ID NO: 130939 - RNA, 25 nt, Human
aaaagaaaaaaaaaaugguguuuaa

SEQ ID NO: 130940 - RNA, 24 nt, Human
aaaagaugaaaaacccacaaagag

SEQ ID NO: 130941 - RNA, 23 nt, Human
aaagaugaaaaacccacaaagag

SEQ ID NO: 130942 - RNA, 26 nt, Human
aaauaaaagaugaaaaacccacaaag

SEQ ID NO: 130943 - RNA, 22 nt, Human
aaauacauguauuuacagugcg

SEQ ID NO: 130944 - RNA, 22 nt, Human
aacacauuuacacacuacagga

SEQ ID NO: 130945 - RNA, 19 nt, Human
aacuucuagcccugggcuc

SEQ ID NO: 130946 - RNA, 21 nt, Human
aagaaaaagaaaaaaaaagga

SEQ ID NO: 130947 - RNA, 20 nt, Human
aagaugaaaaacccacaaag

SEQ ID NO: 130948 - RNA, 24 nt, Human
aagaugaaaaacccacaaagagaa

SEQ ID NO: 130949 - RNA, 19 nt, Human
aagcuccagaacugcuaac

SEQ ID NO: 130950 - RNA, 19 nt, Human
aagcucuucaggcuuaaaa

SEQ ID NO: 130951 - RNA, 18 nt, Human
acaaugcaagagaauggc

SEQ ID NO: 130952 - RNA, 21 nt, Human
acacgcuuugccacagaggaa

SEQ ID NO: 130953 - RNA, 18 nt, Human
acagaaaauaugaggcuu

SEQ ID NO: 130954 - RNA, 23 nt, Human
acaggguaccauagaaaucugcu

SEQ ID NO: 130955 - RNA, 25 nt, Human
agaaaaagaaaaaaaaaggaaagaa

SEQ ID NO: 130956 - RNA, 21 nt, Human
agaaaacauuuuuuaaaaacc

SEQ ID NO: 130957 - RNA, 19 nt, Human
agaaaauaugaggcuuggg

SEQ ID NO: 130958 - RNA, 21 nt, Human
agaaaauuaagcuccagaacu

SEQ ID NO: 130959 - RNA, 20 nt, Human
agaggaaagagggccaaggc

SEQ ID NO: 130960 - RNA, 21 nt, Human
agaggugggggagaaagagag

SEQ ID NO: 130961 - RNA, 22 nt, Human
agcagcaguaacuugcucucuu

SEQ ID NO: 130962 - RNA, 23 nt, Human
aggaaagagggccaaggcucuga

SEQ ID NO: 130963 - RNA, 21 nt, Human
aggguuucuccccuucucuuc

SEQ ID NO: 130964 - RNA, 21 nt, Human
agguauauuccuucuuuucag

SEQ ID NO: 130965 - RNA, 20 nt, Human
auauguauauauauauauau

SEQ ID NO: 130966 - RNA, 18 nt, Human
auguauauauauauauau

SEQ ID NO: 130967 - RNA, 19 nt, Human
auguauauauauauauaua

SEQ ID NO: 130968 - RNA, 23 nt, Human
caaaaugacagguaacaauucuu

SEQ ID NO: 130969 - RNA, 27 nt, Human
caaaggucuuucaaacuucaaaacuuu

SEQ ID NO: 130970 - RNA, 23 nt, Human
caacuucaaguaauugauuccuu

SEQ ID NO: 130971 - RNA, 22 nt, Human
cacacagugcaaacaaguggaa

SEQ ID NO: 130972 - RNA, 19 nt, Human
cagcacacagugcaaacaa

SEQ ID NO: 130973 - RNA, 20 nt, Human
cagcacacagugcaaacaaa

SEQ ID NO: 130974 - RNA, 19 nt, Human
cagcaguaacuugcucucu

SEQ ID NO: 130975 - RNA, 20 nt, Human
cagccuuuuucucuucaccc

SEQ ID NO: 130976 - RNA, 21 nt, Human
cagugcaaacaaguggaacaa

SEQ ID NO: 130977 - RNA, 20 nt, Human
cauagaaaucugcucucuac

SEQ ID NO: 130978 - RNA, 19 nt, Human
ccaaaauaaaagaugaaaa

SEQ ID NO: 130979 - RNA, 25 nt, Human
ccaaacaucaagcauguugggaggg

SEQ ID NO: 130980 - RNA, 22 nt, Human
ccaguuaaaaaaagaaaauguc

SEQ ID NO: 130981 - RNA, 25 nt, Human
ccaguuaaaaaaagaaaaugucuga

SEQ ID NO: 130982 - RNA, 21 nt, Human
cccaaaaagaaaaaaaaaaug

SEQ ID NO: 130983 - RNA, 22 nt, Human
cccuggaaaaaaguuacuuccu

SEQ ID NO: 130984 - RNA, 23 nt, Human
ccucucccaccccucccuggaaa

SEQ ID NO: 130985 - RNA, 19 nt, Human
cguaaaacugagccccucu

SEQ ID NO: 130986 - RNA, 23 nt, Human
cgugcaguucuugcuacaguugu

SEQ ID NO: 130987 - RNA, 24 nt, Human
cguggcgccgccgaagucgccgcc

SEQ ID NO: 130988 - RNA, 22 nt, Human
cuaguacacuggguuaaaaggg

SEQ ID NO: 130989 - RNA, 20 nt, Human
cuccaaaaugaagagauaaa

SEQ ID NO: 130990 - RNA, 25 nt, Human
cugcuaacauuaccaaagcugguac

SEQ ID NO: 130991 - RNA, 20 nt, Human
cuggacagaaaauaugaggc

SEQ ID NO: 130992 - RNA, 21 nt, Human
cuucauaguuccaaaauaaaa

SEQ ID NO: 130993 - RNA, 25 nt, Human
cuuuccccagaaaacauuuuuuaaa

SEQ ID NO: 130994 - RNA, 24 nt, Human
cuuucuuuuccuuccuuguccccu

SEQ ID NO: 130995 - RNA, 18 nt, Human
cuuuuccuuccuuguccc

SEQ ID NO: 130996 - RNA, 19 nt, Human
gaggugggggagaaagaga

SEQ ID NO: 130997 - RNA, 22 nt, Human
gauucuucucuuuuuaggguuu

SEQ ID NO: 130998 - RNA, 21 nt, Human
gcagagggcaacacauuuaca

SEQ ID NO: 130999 - RNA, 25 nt, Human
gcagcaguaacuugcucucuugcac

SEQ ID NO: 131000 - RNA, 21 nt, Human
gccacucaauagaauuccuac

SEQ ID NO: 131001 - RNA, 19 nt, Human
gcguaaaacugagccccuc

SEQ ID NO: 131002 - RNA, 20 nt, Human
gcucaaugacacugccacuc

SEQ ID NO: 131003 - RNA, 19 nt, Human
gcuguuuuaauugcaaagg

SEQ ID NO: 131004 - RNA, 23 nt, Human
ggacacgcuuugccacagaggaa

SEQ ID NO: 131005 - RNA, 24 nt, Human
guaauaagcucuucaggcuuaaaa

SEQ ID NO: 131006 - RNA, 19 nt, Human
guauauauauauauauaua

SEQ ID NO: 131007 - RNA, 23 nt, Human
guauauauauauauauauaugaa

SEQ ID NO: 131008 - RNA, 26 nt, Human
guggaacaaaaaagguauauuccuuc

SEQ ID NO: 131009 - RNA, 18 nt, Human
uaaagcaacacuauugac

SEQ ID NO: 131010 - RNA, 25 nt, Human
uaaagcaucugccagcaauuuacag

SEQ ID NO: 131011 - RNA, 19 nt, Human
uaagcuccagaacugcuaa

SEQ ID NO: 131012 - RNA, 21 nt, Human
uaaggcacuucgcacaaauaa

SEQ ID NO: 131013 - RNA, 22 nt, Human
uaccgugcaguucuugcuacag

SEQ ID NO: 131014 - RNA, 22 nt, Human
uacuggguagaaagggaagaga

SEQ ID NO: 131015 - RNA, 18 nt, Human
uagaaagggaagagacuu

SEQ ID NO: 131016 - RNA, 19 nt, Human
uauauauauauauauauau

SEQ ID NO: 131017 - RNA, 18 nt, Human
uauauauauauguauaua

SEQ ID NO: 131018 - RNA, 20 nt, Human
uauauauauguauauauaua

SEQ ID NO: 131019 - RNA, 22 nt, Human
uauauguauauauauauauaua

SEQ ID NO: 131020 - RNA, 18 nt, Human
uauguauauauauauaua

SEQ ID NO: 131021 - RNA, 19 nt, Human
uauguauauauauauauau

SEQ ID NO: 131022 - RNA, 22 nt, Human
uauguauauauauauauauaua

SEQ ID NO: 131023 - RNA, 19 nt, Human
ucaaaaaagcaacuucaag

SEQ ID NO: 131024 - RNA, 23 nt, Human
ucagaaguaggcagagucaaaaa

SEQ ID NO: 131025 - RNA, 23 nt, Human
uccaaaauaaaagaugaaaaacc

SEQ ID NO: 131026 - RNA, 21 nt, Human
uccccaaaaagaaaaaaaaaa

SEQ ID NO: 131027 - RNA, 22 nt, Human
uccccuuaaucccagcaaccuu

SEQ ID NO: 131028 - RNA, 23 nt, Human
uccuccccaaaaagaaaaaaaaa

SEQ ID NO: 131029 - RNA, 26 nt, Human
ucguggcgccgccgaagucgccgccu

SEQ ID NO: 131030 - RNA, 23 nt, Human
ucuccccuucucuucuuucuuuu

SEQ ID NO: 131031 - RNA, 21 nt, Human
ucugaacgguaagcagcagua

SEQ ID NO: 131032 - RNA, 19 nt, Human
ucuggccgugcucaugcug

SEQ ID NO: 131033 - RNA, 19 nt, Human
ucugguaaaccuacuccaa

SEQ ID NO: 131034 - RNA, 21 nt, Human
ucuugcuacaguuguuaagga

SEQ ID NO: 131035 - RNA, 21 nt, Human
ugaacccagaaaaaaaacuua

SEQ ID NO: 131036 - RNA, 22 nt, Human
ugacuggacagaaaauaugagg

SEQ ID NO: 131037 - RNA, 26 nt, Human
ugagccccucucaucuuuagcugcuc

SEQ ID NO: 131038 - RNA, 24 nt, Human
ugauagacugcucuuuccuuuggg

SEQ ID NO: 131039 - RNA, 21 nt, Human
ugauccacagaaaauuaagcu

SEQ ID NO: 131040 - RNA, 26 nt, Human
ugcaaacaaguggaacaaaaaaggua

SEQ ID NO: 131041 - RNA, 20 nt, Human
ugcaguucuugcuacaguug

SEQ ID NO: 131042 - RNA, 22 nt, Human
ugccauacuacuacuggaggca

SEQ ID NO: 131043 - RNA, 18 nt, Human
ugcccccuguugcagagc

SEQ ID NO: 131044 - RNA, 22 nt, Human
uggcaagcagcuuucuguagca

SEQ ID NO: 131045 - RNA, 21 nt, Human
ugggggagaaagagagcugca

SEQ ID NO: 131046 - RNA, 18 nt, Human
uguauauauauauauaua

SEQ ID NO: 131047 - RNA, 22 nt, Human
uguauauauauauauauauaug

SEQ ID NO: 131048 - RNA, 22 nt, Human
ugucuacacaucaagugccaua

SEQ ID NO: 131049 - RNA, 23 nt, Human
uguugcguaaaacugagccccuc

SEQ ID NO: 131050 - RNA, 24 nt, Human
uguugcguaaaacugagccccucu

SEQ ID NO: 131051 - RNA, 22 nt, Human
uuaaaaaccagcaguuagugca

SEQ ID NO: 131052 - RNA, 23 nt, Human
uuaacagcucucagguugcccaa

SEQ ID NO: 131053 - RNA, 21 nt, Human
uuccuacacugcaagguagau

SEQ ID NO: 131054 - RNA, 18 nt, Human
uuccuucuuuucagccuu

SEQ ID NO: 131055 - RNA, 21 nt, Human
uuccuuguccccuuuccccag

SEQ ID NO: 131056 - RNA, 21 nt, Human
uucucuguucuggccgugcuc

SEQ ID NO: 131057 - RNA, 21 nt, Human
uugcccccuguugcagagcuu

SEQ ID NO: 131058 - RNA, 20 nt, Human
uuuaaagcaacacuauugac

SEQ ID NO: 131059 - RNA, 21 nt, Human
uuuacaaaguuuauacaagua

SEQ ID NO: 131060 - RNA, 28 nt, Human
uuuuaaauucccucucccaccccucccu

SEQ ID NO: 131061 - RNA, 19 nt, Human
uuuugaaagucaguagaga

SEQ ID NO: 131062 - RNA, 23 nt, Human
uuuuugcuuuuuucccccccuuu

SEQ ID NO: 131063 - RNA, 20 nt, Human
aaacgaaagccaggaaaaua

SEQ ID NO: 131064 - RNA, 22 nt, Human
acaaaaucacuaaugcaucuau

SEQ ID NO: 131065 - RNA, 23 nt, Human
acacacaggaacugacauaacca

SEQ ID NO: 131066 - RNA, 23 nt, Human
acauacgaggucaacaaacaaac

SEQ ID NO: 131067 - RNA, 21 nt, Human
acgaaagccaggaaaauacca

SEQ ID NO: 131068 - RNA, 27 nt, Human
cauuguaaaauuuucuaacauacgagg

SEQ ID NO: 131069 - RNA, 21 nt, Human
cguuauauuuuacauaauaua

SEQ ID NO: 131070 - RNA, 19 nt, Human
gaaaaaauacaaacugugg

SEQ ID NO: 131071 - RNA, 20 nt, Human
gacauuuaaaaucaacagau

SEQ ID NO: 131072 - RNA, 19 nt, Human
ggcaaauaaacauacugga

SEQ ID NO: 131073 - RNA, 19 nt, Human
uaaaaucaacagauguagc

SEQ ID NO: 131074 - RNA, 23 nt, Human
uaaagaaaaaauacaaacugugg

SEQ ID NO: 131075 - RNA, 21 nt, Human
uacaaguaguaucacuuagua

SEQ ID NO: 131076 - RNA, 23 nt, Human
uagcaugccuuuuuuuccuuacu

SEQ ID NO: 131077 - RNA, 25 nt, Human
uauaaacaaaaucacuaaugcaucu

SEQ ID NO: 131078 - RNA, 21 nt, Human
ucaacaaacaaacuacacggc

SEQ ID NO: 131079 - RNA, 21 nt, Human
uccuuaaagaaaaaauacaaa

SEQ ID NO: 131080 - RNA, 21 nt, Human
ucuauaugcuugguuuccuua

SEQ ID NO: 131081 - RNA, 23 nt, Human
uggaaaaaacacguaacacauag

SEQ ID NO: 131082 - RNA, 25 nt, Human
uggaaaaaacacguaacacauagca

SEQ ID NO: 131083 - RNA, 18 nt, Human
ugucuacacacaggaacu

SEQ ID NO: 131084 - RNA, 19 nt, Human
ugugguauuuuuaagagau

SEQ ID NO: 131085 - RNA, 23 nt, Human
ugugguauuuuuaagagaucguu

SEQ ID NO: 131086 - RNA, 20 nt, Human
uuccuuacugucuacacaca

SEQ ID NO: 131087 - RNA, 19 nt, Human
aagaagcccgguugaaugc

SEQ ID NO: 131088 - RNA, 21 nt, Human
aagaagcccgguugaaugcuc

SEQ ID NO: 131089 - RNA, 21 nt, Human
aagcaguacacauacccuaca

SEQ ID NO: 131090 - RNA, 22 nt, Human
acacauacccuacaaagaagcc

SEQ ID NO: 131091 - RNA, 19 nt, Human
agaaaagaauccuuguugg

SEQ ID NO: 131092 - RNA, 25 nt, Human
agcaagaguagcucugggauuccac

SEQ ID NO: 131093 - RNA, 26 nt, Human
agcuguuucuggcaacuccucuuccu

SEQ ID NO: 131094 - RNA, 21 nt, Human
agucaauugcucuggccaccu

SEQ ID NO: 131095 - RNA, 18 nt, Human
auagcccuucaaguuuuc

SEQ ID NO: 131096 - RNA, 24 nt, Human
aucugucuuccugggccaggguga

SEQ ID NO: 131097 - RNA, 22 nt, Human
cacauaggugugccucagggac

SEQ ID NO: 131098 - RNA, 20 nt, Human
cagcagcccaauguuguauu

SEQ ID NO: 131099 - RNA, 22 nt, Human
cuccuugucuuucucucccaca

SEQ ID NO: 131100 - RNA, 20 nt, Human
cugacugcaaauuaaucaga

SEQ ID NO: 131101 - RNA, 20 nt, Human
cuuccugggccagggugagg

SEQ ID NO: 131102 - RNA, 21 nt, Human
gaaacucuuucauauauucuu

SEQ ID NO: 131103 - RNA, 22 nt, Human
gagaagccgcagaguguucagg

SEQ ID NO: 131104 - RNA, 24 nt, Human
gccagggugagguagaaacaauag

SEQ ID NO: 131105 - RNA, 21 nt, Human
gcugaaccaggugaaaugauu

SEQ ID NO: 131106 - RNA, 23 nt, Human
ggcaguagccaucaaaaucugcu

SEQ ID NO: 131107 - RNA, 21 nt, Human
gucuuccugggccagggugag

SEQ ID NO: 131108 - RNA, 27 nt, Human
gugaaaugauuuucccaaggucaugcg

SEQ ID NO: 131109 - RNA, 19 nt, Human
uaacacacauaggugugcc

SEQ ID NO: 131110 - RNA, 20 nt, Human
uagaaaaagccuuucuagua

SEQ ID NO: 131111 - RNA, 25 nt, Human
uagauuuuuguggguucagcagccc

SEQ ID NO: 131112 - RNA, 23 nt, Human
uagcugauuuuuucugcaagccu

SEQ ID NO: 131113 - RNA, 21 nt, Human
ucaaguuuucccuuuuuccag

SEQ ID NO: 131114 - RNA, 22 nt, Human
ucaauagcccuucaaguuuucc

SEQ ID NO: 131115 - RNA, 19 nt, Human
ucccagucaauugcucugg

SEQ ID NO: 131116 - RNA, 20 nt, Human
ucugucuuccugggccaggg

SEQ ID NO: 131117 - RNA, 22 nt, Human
ugaaaugauuuucccaagguca

SEQ ID NO: 131118 - RNA, 19 nt, Human
ugcaugucucugaggaguu

SEQ ID NO: 131119 - RNA, 18 nt, Human
ugccucugacugcaaauu

SEQ ID NO: 131120 - RNA, 19 nt, Human
ugcucuggccaccuugcca

SEQ ID NO: 131121 - RNA, 20 nt, Human
ugguaaauuaacccccuccu

SEQ ID NO: 131122 - RNA, 19 nt, Human
uuccagguaacauuggcag

SEQ ID NO: 131123 - RNA, 18 nt, Human
uucuacugacauuuuagc

SEQ ID NO: 131124 - RNA, 22 nt, Human
uucuccuugucuuucucuccca

SEQ ID NO: 131125 - RNA, 24 nt, Human
acuugaaauagucaaaagaugaga

SEQ ID NO: 131126 - RNA, 21 nt, Human
aggcgguugggcgcagggggc

SEQ ID NO: 131127 - RNA, 23 nt, Human
agucuccagaacucgggccggaa

SEQ ID NO: 131128 - RNA, 25 nt, Human
auuagacuugaaauagucaaaagau

SEQ ID NO: 131129 - RNA, 20 nt, Human
cgcugccuaggccgccgggg

SEQ ID NO: 131130 - RNA, 19 nt, Human
gcgggacaaaaagaacaaa

SEQ ID NO: 131131 - RNA, 20 nt, Human
gcgggacaaaaagaacaaag

SEQ ID NO: 131132 - RNA, 24 nt, Human
gcuggaaacgcugccuaggccgcc

SEQ ID NO: 131133 - RNA, 22 nt, Human
uccagaacucgggccggaaggc

SEQ ID NO: 131134 - RNA, 22 nt, Human
ugaaauagucaaaagaugagag

SEQ ID NO: 131135 - RNA, 21 nt, Human
uggaaacgcugccuaggccgc

SEQ ID NO: 131136 - RNA, 21 nt, Human
uucucggggcuggaaacgcug

SEQ ID NO: 131137 - RNA, 19 nt, Human
aaaaaaaaaaaaaaaggca

SEQ ID NO: 131138 - RNA, 26 nt, Human
aaaauacacuucagagucccacuuuc

SEQ ID NO: 131139 - RNA, 24 nt, Human
aaacuuaauuucccaggucucuuc

SEQ ID NO: 131140 - RNA, 21 nt, Human
aaccucuucuccauccacccu

SEQ ID NO: 131141 - RNA, 23 nt, Human
aagaaagcaaaggggaaaagggc

SEQ ID NO: 131142 - RNA, 21 nt, Human
aaggagccacaucaggcagag

SEQ ID NO: 131143 - RNA, 19 nt, Human
aaucauaaagucugugucu

SEQ ID NO: 131144 - RNA, 23 nt, Human
acaaaccccagaacaguguaagc

SEQ ID NO: 131145 - RNA, 23 nt, Human
acaaaugggaaaaaggaaggagc

SEQ ID NO: 131146 - RNA, 18 nt, Human
accucuucuccauccacc

SEQ ID NO: 131147 - RNA, 22 nt, Human
agaaagcaaaggggaaaagggc

SEQ ID NO: 131148 - RNA, 24 nt, Human
agaacaguguaagcuccagaggug

SEQ ID NO: 131149 - RNA, 23 nt, Human
agaggugggugaugggaacaguc

SEQ ID NO: 131150 - RNA, 21 nt, Human
agcaccagaggccaggagaga

SEQ ID NO: 131151 - RNA, 20 nt, Human
agcucccuuacucacagccc

SEQ ID NO: 131152 - RNA, 21 nt, Human
aggaaggagccacaucaggca

SEQ ID NO: 131153 - RNA, 18 nt, Human
aggaguggaggaggggga

SEQ ID NO: 131154 - RNA, 19 nt, Human
aggggaaaagggcugcagg

SEQ ID NO: 131155 - RNA, 22 nt, Human
aucagcaaccucuucuccaucc

SEQ ID NO: 131156 - RNA, 22 nt, Human
augcccuuugcccaagccagaa

SEQ ID NO: 131157 - RNA, 23 nt, Human
auguguguacacauauaccacca

SEQ ID NO: 131158 - RNA, 20 nt, Human
caaaugggaaaaaggaagga

SEQ ID NO: 131159 - RNA, 19 nt, Human
caaccucuucuccauccac

SEQ ID NO: 131160 - RNA, 22 nt, Human
cacaucaaucccuuacaaagac

SEQ ID NO: 131161 - RNA, 22 nt, Human
cagcaccagaggccaggagaga

SEQ ID NO: 131162 - RNA, 25 nt, Human
cagccccauucucccaagcauggga

SEQ ID NO: 131163 - RNA, 19 nt, Human
cagcccuuugguuuuuuag

SEQ ID NO: 131164 - RNA, 20 nt, Human
caguccccaaagugagaaga

SEQ ID NO: 131165 - RNA, 20 nt, Human
cauggaaacugaaguucugc

SEQ ID NO: 131166 - RNA, 20 nt, Human
ccaagccagaagaaagcaaa

SEQ ID NO: 131167 - RNA, 23 nt, Human
ccacuuuccacauagcucccuua

SEQ ID NO: 131168 - RNA, 22 nt, Human
cccaagccagaagaaagcaaag

SEQ ID NO: 131169 - RNA, 23 nt, Human
cccagaacaguguaagcuccaga

SEQ ID NO: 131170 - RNA, 19 nt, Human
ccuuacucacagcccuuug

SEQ ID NO: 131171 - RNA, 18 nt, Human
ccuuugcccaagccagaa

SEQ ID NO: 131172 - RNA, 22 nt, Human
cugaaguucugcugagggcuga

SEQ ID NO: 131173 - RNA, 20 nt, Human
gaaguucugcugagggcuga

SEQ ID NO: 131174 - RNA, 22 nt, Human
gacaaaugggaaaaaggaagga

SEQ ID NO: 131175 - RNA, 19 nt, Human
gaguggaggagggggaagg

SEQ ID NO: 131176 - RNA, 21 nt, Human
gcagagaggagcagcaccaga

SEQ ID NO: 131177 - RNA, 22 nt, Human
gcccaggcacaugggugcaggg

SEQ ID NO: 131178 - RNA, 22 nt, Human
gcucauucaacaugccucccua

SEQ ID NO: 131179 - RNA, 26 nt, Human
ggaaaaaggaauuacuucacuuacac

SEQ ID NO: 131180 - RNA, 18 nt, Human
ggacaucgccuuugggaa

SEQ ID NO: 131181 - RNA, 23 nt, Human
ggacuaagcuccaguucuagacc

SEQ ID NO: 131182 - RNA, 20 nt, Human
ggagcagcaccagaggccag

SEQ ID NO: 131183 - RNA, 20 nt, Human
ggaguugguauuguaccagc

SEQ ID NO: 131184 - RNA, 22 nt, Human
ggcagagaggagcagcaccaga

SEQ ID NO: 131185 - RNA, 19 nt, Human
gggcguaggaguggaggag

SEQ ID NO: 131186 - RNA, 21 nt, Human
gggcguaggaguggaggaggg

SEQ ID NO: 131187 - RNA, 22 nt, Human
gguuugacaaaugggaaaaagg

SEQ ID NO: 131188 - RNA, 22 nt, Human
guagagaacaaaccccagaaca

SEQ ID NO: 131189 - RNA, 21 nt, Human
uaacuccuuagugcauccaaa

SEQ ID NO: 131190 - RNA, 19 nt, Human
uaagagcucucauaaagcc

SEQ ID NO: 131191 - RNA, 19 nt, Human
uacaccuaugaugcccuuu

SEQ ID NO: 131192 - RNA, 18 nt, Human
uauguguguacacauaua

SEQ ID NO: 131193 - RNA, 23 nt, Human
uauguguguacacauauaccacc

SEQ ID NO: 131194 - RNA, 22 nt, Human
ucaaaauacacuucagaguccc

SEQ ID NO: 131195 - RNA, 18 nt, Human
ucaacaugccucccuacc

SEQ ID NO: 131196 - RNA, 18 nt, Human
ucaaucccuuacaaagac

SEQ ID NO: 131197 - RNA, 21 nt, Human
ucccagccccauucucccaag

SEQ ID NO: 131198 - RNA, 21 nt, Human
ucccccuuccccuuuauaggg

SEQ ID NO: 131199 - RNA, 20 nt, Human
ucuuuaaaaaaaaaaaaaaa

SEQ ID NO: 131200 - RNA, 22 nt, Human
ugaaaaauauaauaaucauaaa

SEQ ID NO: 131201 - RNA, 20 nt, Human
ugacccagucuuaucuguuc

SEQ ID NO: 131202 - RNA, 19 nt, Human
ugcagggagggguggggaa

SEQ ID NO: 131203 - RNA, 19 nt, Human
ugcccuuugcccaagccag

SEQ ID NO: 131204 - RNA, 29 nt, Human
uggaauggaggaaaggcggcagagaggag

SEQ ID NO: 131205 - RNA, 21 nt, Human
uggaggagggggaaggaaaaa

SEQ ID NO: 131206 - RNA, 23 nt, Human
ugggaaaaaggaaggagccacau

SEQ ID NO: 131207 - RNA, 18 nt, Human
ugggaggcaugacuaggc

SEQ ID NO: 131208 - RNA, 27 nt, Human
uguacacauauaccaccacaguuggga

SEQ ID NO: 131209 - RNA, 20 nt, Human
uguauguguguacacauaua

SEQ ID NO: 131210 - RNA, 20 nt, Human
ugucccagccccauucuccc

SEQ ID NO: 131211 - RNA, 19 nt, Human
ugugauugguuggaagggu

SEQ ID NO: 131212 - RNA, 18 nt, Human
uguguauguguguacaca

SEQ ID NO: 131213 - RNA, 18 nt, Human
uguguauguguguacaca

SEQ ID NO: 131214 - RNA, 20 nt, Human
uguguauguguguacacauu

SEQ ID NO: 131215 - RNA, 21 nt, Human
uuaaaaaaaaaaaaaaaaagg

SEQ ID NO: 131216 - RNA, 22 nt, Human
uucacuugaacauggaaagaaa

SEQ ID NO: 131217 - RNA, 20 nt, Human
uucuccauccacccugugua

SEQ ID NO: 131218 - RNA, 23 nt, Human
uucuuuaaaaaaaaaaaaaaaaa

SEQ ID NO: 131219 - RNA, 24 nt, Human
uugguuggaaggguagagaacaaa

SEQ ID NO: 131220 - RNA, 20 nt, Human
uuuccagaaucccugcucag

SEQ ID NO: 131221 - RNA, 18 nt, Human
agcagaagguacaggagu

SEQ ID NO: 131222 - RNA, 23 nt, Human
aggcagggugaccagagagggca

SEQ ID NO: 131223 - RNA, 19 nt, Human
cuguagcucucaaagcaaa

SEQ ID NO: 131224 - RNA, 23 nt, Human
ggaaaggaaauugagcagaaggu

SEQ ID NO: 131225 - RNA, 22 nt, Human
ucaaagcaaauuuugagcucau

SEQ ID NO: 131226 - RNA, 21 nt, Human
ugaccagagagggcagacagc

SEQ ID NO: 131227 - RNA, 19 nt, Human
ugaggaaaggaaauugagc

SEQ ID NO: 131228 - RNA, 24 nt, Human
ugggaugaggaaaggaaauugagc

SEQ ID NO: 131229 - RNA, 23 nt, Human
uuugagcucauuuuucuuuuucu

SEQ ID NO: 131230 - RNA, 22 nt, Human
aggcagggcgagcagagagggc

SEQ ID NO: 131231 - RNA, 23 nt, Human
aggcagggcgagcagagagggca

SEQ ID NO: 131232 - RNA, 25 nt, Human
cgagauauauauuuaggaucaagaa

SEQ ID NO: 131233 - RNA, 19 nt, Human
cuguagcucucaaagcaaa

SEQ ID NO: 131234 - RNA, 27 nt, Human
gauguuaaggacaaaguauaggagaaa

SEQ ID NO: 131235 - RNA, 19 nt, Human
ggcgagcagagagggcaga

SEQ ID NO: 131236 - RNA, 20 nt, Human
ucaaagcaaauuaugagcuc

SEQ ID NO: 131237 - RNA, 21 nt, Human
ucaaagcaaauuaugagcuca

SEQ ID NO: 131238 - RNA, 22 nt, Human
ucaaagcaaauuaugagcucau

SEQ ID NO: 131239 - RNA, 26 nt, Human
ucagcugcagaagcaugugaagcuaa

SEQ ID NO: 131240 - RNA, 18 nt, Human
acuuuauuuuggagagag

SEQ ID NO: 131241 - RNA, 21 nt, Human
aggaccuugaacugaaucuug

SEQ ID NO: 131242 - RNA, 22 nt, Human
ggcuggggucaccugcaggagg

SEQ ID NO: 131243 - RNA, 26 nt, Human
ucaccugcaggagggagagcaggagu

SEQ ID NO: 131244 - RNA, 23 nt, Human
ugcaggagggagagcaggagugg

SEQ ID NO: 131245 - RNA, 25 nt, Human
uaugggacacacgacaguuuccuuc

SEQ ID NO: 131246 - RNA, 18 nt, Human
ugauggcaauguauggga

SEQ ID NO: 131247 - RNA, 22 nt, Human
uggaggagagagagcaggagca

SEQ ID NO: 131248 - RNA, 23 nt, Human
uggaggagagagagcaggagcag

SEQ ID NO: 131249 - RNA, 20 nt, Human
uaaaagaaugcuuauaaaaa

SEQ ID NO: 131250 - RNA, 19 nt, Human
ucaggaacuggggagaggc

SEQ ID NO: 131251 - RNA, 19 nt, Human
uggcaggcaacacucagga

SEQ ID NO: 131252 - RNA, 18 nt, Human
aagaaggcauuuccacac

SEQ ID NO: 131253 - RNA, 18 nt, Human
acacuuuacaacacucuc

SEQ ID NO: 131254 - RNA, 18 nt, Human
caccaugcagaacacacc

SEQ ID NO: 131255 - RNA, 21 nt, Human
caccaugcagaacacacccac

SEQ ID NO: 131256 - RNA, 22 nt, Human
caugcagaacacacccacucac

SEQ ID NO: 131257 - RNA, 23 nt, Human
ccaaugguaaggcagagcucccu

SEQ ID NO: 131258 - RNA, 24 nt, Human
cucaccaugcagaacacacccacu

SEQ ID NO: 131259 - RNA, 23 nt, Human
cuucaccccacgcugagacugga

SEQ ID NO: 131260 - RNA, 21 nt, Human
gcuaggcuucaccccacgcug

SEQ ID NO: 131261 - RNA, 21 nt, Human
ucaccccacgcugagacugga

SEQ ID NO: 131262 - RNA, 20 nt, Human
uuuauaaacuuuaagaaggc

SEQ ID NO: 131263 - RNA, 23 nt, Human
uuuuuuuuuuuugaaaaaaaaau

SEQ ID NO: 131264 - RNA, 22 nt, Human
caucagccacagcagcuucuug

SEQ ID NO: 131265 - RNA, 19 nt, Human
ucucugaugagggagcccu

SEQ ID NO: 131266 - RNA, 26 nt, Human
ugaauccgcaucagccacagcagcuu

SEQ ID NO: 131267 - RNA, 18 nt, Human
ugaugagggagcccuuuc

SEQ ID NO: 131268 - RNA, 24 nt, Human
uggacaccauaguuuaauuugguu

SEQ ID NO: 131269 - RNA, 18 nt, Human
uggcugggagcuucacca

SEQ ID NO: 131270 - RNA, 23 nt, Human
ugggaaaagccacuuuauuaaag

SEQ ID NO: 131271 - RNA, 24 nt, Human
ugggaaaagccacuuuauuaaaga

SEQ ID NO: 131272 - RNA, 19 nt, Human
accaggcagggaugggcua

SEQ ID NO: 131273 - RNA, 19 nt, Human
acccacuuucucuccuucu

SEQ ID NO: 131274 - RNA, 21 nt, Human
acccugggcuggggaaaggaa

SEQ ID NO: 131275 - RNA, 19 nt, Human
agaggugggagggacaggg

SEQ ID NO: 131276 - RNA, 21 nt, Human
agggagcagugaggacagggg

SEQ ID NO: 131277 - RNA, 20 nt, Human
aggggucagaggcugugagg

SEQ ID NO: 131278 - RNA, 20 nt, Human
aggugggagggacagggcca

SEQ ID NO: 131279 - RNA, 25 nt, Human
aucucacccacuuucucuccuucuc

SEQ ID NO: 131280 - RNA, 22 nt, Human
caacagccaaggcucacagcug

SEQ ID NO: 131281 - RNA, 18 nt, Human
caccgcucccgccugggc

SEQ ID NO: 131282 - RNA, 24 nt, Human
caccuccagcaccuucggggauuc

SEQ ID NO: 131283 - RNA, 20 nt, Human
cagcacaagagccaggcuca

SEQ ID NO: 131284 - RNA, 21 nt, Human
caucucacccacuuucucucc

SEQ ID NO: 131285 - RNA, 21 nt, Human
ccaacagccaaggcucacagc

SEQ ID NO: 131286 - RNA, 19 nt, Human
ccacaggggcuaguccccc

SEQ ID NO: 131287 - RNA, 19 nt, Human
ccaccagccugagaccgcu

SEQ ID NO: 131288 - RNA, 23 nt, Human
ccaccagccugagaccgcucucu

SEQ ID NO: 131289 - RNA, 19 nt, Human
cccaccagccugagaccgc

SEQ ID NO: 131290 - RNA, 18 nt, Human
ccccugcagcaggggagg

SEQ ID NO: 131291 - RNA, 22 nt, Human
ccccuggcuaccugccuggcuu

SEQ ID NO: 131292 - RNA, 21 nt, Human
cccugcucuggggcugucucc

SEQ ID NO: 131293 - RNA, 19 nt, Human
ccggagaguggaugcggcg

SEQ ID NO: 131294 - RNA, 21 nt, Human
ccuccagcaccuucggggauu

SEQ ID NO: 131295 - RNA, 18 nt, Human
ccugaggucacagaggug

SEQ ID NO: 131296 - RNA, 23 nt, Human
ccugcagcaggggaggggagggc

SEQ ID NO: 131297 - RNA, 24 nt, Human
ccugcaguaucccaacacccugcu

SEQ ID NO: 131298 - RNA, 18 nt, Human
ccuggcuuucucucuccu

SEQ ID NO: 131299 - RNA, 23 nt, Human
ccugugaccaggcagggaugggc

SEQ ID NO: 131300 - RNA, 19 nt, Human
cgccugggcuccauccagc

SEQ ID NO: 131301 - RNA, 27 nt, Human
cucacccacuuucucuccuucucaauc

SEQ ID NO: 131302 - RNA, 19 nt, Human
cucacucacugccaacagc

SEQ ID NO: 131303 - RNA, 21 nt, Human
cucuccugggcuaggggcugg

SEQ ID NO: 131304 - RNA, 23 nt, Human
cucucuccugggcuaggggcugg

SEQ ID NO: 131305 - RNA, 21 nt, Human
cugcaguaucccaacacccug

SEQ ID NO: 131306 - RNA, 24 nt, Human
cugccucucuccucuccucucuuc

SEQ ID NO: 131307 - RNA, 19 nt, Human
cugcggggcucaguccugg

SEQ ID NO: 131308 - RNA, 21 nt, Human
cugcucccaccuccagcaccu

SEQ ID NO: 131309 - RNA, 19 nt, Human
gaccaggcagggaugggcu

SEQ ID NO: 131310 - RNA, 20 nt, Human
gaggugggagggacagggcc

SEQ ID NO: 131311 - RNA, 22 nt, Human
gcaggggaggggagggcguggg

SEQ ID NO: 131312 - RNA, 21 nt, Human
gccccugcagcaggggagggg

SEQ ID NO: 131313 - RNA, 21 nt, Human
gccugaggucacagagguggg

SEQ ID NO: 131314 - RNA, 20 nt, Human
gccuggcuuucucucuccug

SEQ ID NO: 131315 - RNA, 19 nt, Human
gcgggcgcacggaggaggc

SEQ ID NO: 131316 - RNA, 27 nt, Human
gcucccaccuccagcaccuucggggau

SEQ ID NO: 131317 - RNA, 18 nt, Human
gcuuucucucuccugggc

SEQ ID NO: 131318 - RNA, 19 nt, Human
ggacaggggugaggacggu

SEQ ID NO: 131319 - RNA, 19 nt, Human
ggagcagugaggacagggg

SEQ ID NO: 131320 - RNA, 18 nt, Human
ggauggccagugaggagg

SEQ ID NO: 131321 - RNA, 18 nt, Human
ggccggggcaugcccugu

SEQ ID NO: 131322 - RNA, 23 nt, Human
ggcuaggggcuggggaggucugc

SEQ ID NO: 131323 - RNA, 21 nt, Human
ggcucaguccuggcccugcag

SEQ ID NO: 131324 - RNA, 19 nt, Human
ggcuggggaggucugcggg

SEQ ID NO: 131325 - RNA, 26 nt, Human
gggaggacugaggcuggguguggugg

SEQ ID NO: 131326 - RNA, 26 nt, Human
gggauucccucuuguagccccugcuu

SEQ ID NO: 131327 - RNA, 19 nt, Human
gggcuggggaaaggaaagu

SEQ ID NO: 131328 - RNA, 27 nt, Human
ggggaggacugaggcuggguguggugg

SEQ ID NO: 131329 - RNA, 18 nt, Human
ggggaggggagggcgugg

SEQ ID NO: 131330 - RNA, 19 nt, Human
ggucacagaggugggaggg

SEQ ID NO: 131331 - RNA, 18 nt, Human
guccugggauggaagaag

SEQ ID NO: 131332 - RNA, 23 nt, Human
uaaguccacccugggcuggggaa

SEQ ID NO: 131333 - RNA, 18 nt, Human
uaucccaacacccugcuc

SEQ ID NO: 131334 - RNA, 19 nt, Human
ucacccacuuucucuccuu

SEQ ID NO: 131335 - RNA, 21 nt, Human
ucagaggcugugaggggagga

SEQ ID NO: 131336 - RNA, 21 nt, Human
ucucaaucuccugcucccacc

SEQ ID NO: 131337 - RNA, 28 nt, Human
ucucacccacuuucucuccuucucaauc

SEQ ID NO: 131338 - RNA, 22 nt, Human
ucucugguggcagagggucucu

SEQ ID NO: 131339 - RNA, 21 nt, Human
ucugccucucuccucuccucc

SEQ ID NO: 131340 - RNA, 20 nt, Human
ucugcggggcucaguccugg

SEQ ID NO: 131341 - RNA, 18 nt, Human
ugaggggaggacugaggc

SEQ ID NO: 131342 - RNA, 18 nt, Human
ugcagcaggggaggggag

SEQ ID NO: 131343 - RNA, 22 nt, Human
ugcccugugaccaggcagggau

SEQ ID NO: 131344 - RNA, 26 nt, Human
ugcccugugaccaggcagggaugggc

SEQ ID NO: 131345 - RNA, 21 nt, Human
uggaagaaggcuggcuucagg

SEQ ID NO: 131346 - RNA, 23 nt, Human
ugggagggacagggccaccgcuc

SEQ ID NO: 131347 - RNA, 24 nt, Human
ugggauggaagaaggcuggcuuca

SEQ ID NO: 131348 - RNA, 20 nt, Human
ugguguccugggauggaaga

SEQ ID NO: 131349 - RNA, 24 nt, Human
uucucaaucuccugcucccaccuc

SEQ ID NO: 131350 - RNA, 20 nt, Human
uucuccagcaucucacccac

SEQ ID NO: 131351 - RNA, 23 nt, Human
aaaaaaaaaauugguggaacggc

SEQ ID NO: 131352 - RNA, 19 nt, Human
aaguagcugggauuacagg

SEQ ID NO: 131353 - RNA, 25 nt, Human
aaguagcugggauuacaggcgcccg

SEQ ID NO: 131354 - RNA, 23 nt, Human
aauuacuuuugaacagagaacau

SEQ ID NO: 131355 - RNA, 18 nt, Human
acaggguuucaccauguu

SEQ ID NO: 131356 - RNA, 19 nt, Human
acaggguuucaccauguua

SEQ ID NO: 131357 - RNA, 20 nt, Human
acaggguuucaccauguuag

SEQ ID NO: 131358 - RNA, 24 nt, Human
acaggguuucaccauguuagccag

SEQ ID NO: 131359 - RNA, 20 nt, Human
acugcaagcucugccuccca

SEQ ID NO: 131360 - RNA, 25 nt, Human
aggcuggagugcaguggcgcaaucu

SEQ ID NO: 131361 - RNA, 18 nt, Human
aguacauagguagucaaa

SEQ ID NO: 131362 - RNA, 21 nt, Human
agugcaguggcgcaaucucag

SEQ ID NO: 131363 - RNA, 18 nt, Human
agugcugggauuacaggc

SEQ ID NO: 131364 - RNA, 22 nt, Human
agugcugggauuacaggcguga

SEQ ID NO: 131365 - RNA, 22 nt, Human
aucacugccaauuacuuuugaa

SEQ ID NO: 131366 - RNA, 18 nt, Human
caccauguuagccaggau

SEQ ID NO: 131367 - RNA, 22 nt, Human
caccauguuagccaggaugguc

SEQ ID NO: 131368 - RNA, 24 nt, Human
caccauguuagccaggauggucuc

SEQ ID NO: 131369 - RNA, 24 nt, Human
caggguuucaccauguuagccagg

SEQ ID NO: 131370 - RNA, 25 nt, Human
cagugcugggauuacaggcgugagc

SEQ ID NO: 131371 - RNA, 22 nt, Human
caugccauucuccugccucagc

SEQ ID NO: 131372 - RNA, 22 nt, Human
ccaaguagcugggauuacaggc

SEQ ID NO: 131373 - RNA, 20 nt, Human
ccagugcugggauuacaggc

SEQ ID NO: 131374 - RNA, 24 nt, Human
ccagugcugggauuacaggcguga

SEQ ID NO: 131375 - RNA, 22 nt, Human
ccauggcuggcuaauuuuuuuu

SEQ ID NO: 131376 - RNA, 23 nt, Human
cccaaguagcugggauuacaggc

SEQ ID NO: 131377 - RNA, 23 nt, Human
cccaaguagcugggauuacaggc

SEQ ID NO: 131378 - RNA, 20 nt, Human
cccagguucaugccauucuc

SEQ ID NO: 131379 - RNA, 19 nt, Human
cccagugcugggauuacag

SEQ ID NO: 131380 - RNA, 21 nt, Human
cccagugcugggauuacaggc

SEQ ID NO: 131381 - RNA, 21 nt, Human
ccgccccccucggccucccag

SEQ ID NO: 131382 - RNA, 24 nt, Human
ccucccagguucaugccauucucc

SEQ ID NO: 131383 - RNA, 24 nt, Human
cgcucuguugcccaggcuggagug

SEQ ID NO: 131384 - RNA, 24 nt, Human
cggagucucgcucuguugcccagg

SEQ ID NO: 131385 - RNA, 20 nt, Human
cuaaaaaaaaaauuggugga

SEQ ID NO: 131386 - RNA, 24 nt, Human
cucagccucccaaguagcugggau

SEQ ID NO: 131387 - RNA, 24 nt, Human
cucgcucuguugcccaggcuggag

SEQ ID NO: 131388 - RNA, 24 nt, Human
cugcaagcucugccucccagguuc

SEQ ID NO: 131389 - RNA, 23 nt, Human
cugccucagccucccaaguagcu

SEQ ID NO: 131390 - RNA, 21 nt, Human
cuggcuaauuuuuuuuguauu

SEQ ID NO: 131391 - RNA, 19 nt, Human
cuguugcccaggcuggagu

SEQ ID NO: 131392 - RNA, 18 nt, Human
gacuucacgauccgcccc

SEQ ID NO: 131393 - RNA, 18 nt, Human
gauuacaggcgcccgcca

SEQ ID NO: 131394 - RNA, 18 nt, Human
gauuacaggcgugagcca

SEQ ID NO: 131395 - RNA, 19 nt, Human
gauuacaggcgugagccac

SEQ ID NO: 131396 - RNA, 22 nt, Human
gauuacaggcgugagccacugc

SEQ ID NO: 131397 - RNA, 23 nt, Human
gccacagagcuuccuuggcacac

SEQ ID NO: 131398 - RNA, 19 nt, Human
gcccaggcuggagugcagu

SEQ ID NO: 131399 - RNA, 20 nt, Human
gccucagccucccaaguagc

SEQ ID NO: 131400 - RNA, 22 nt, Human
gcuaaaaaaaaaauugguggaa

SEQ ID NO: 131401 - RNA, 20 nt, Human
gcucuaaggcaggggguaga

SEQ ID NO: 131402 - RNA, 25 nt, Human
gcucuguugcccaggcuggagugca

SEQ ID NO: 131403 - RNA, 19 nt, Human
gcuggagugcaguggcgca

SEQ ID NO: 131404 - RNA, 23 nt, Human
ggagucucgcucuguugcccagg

SEQ ID NO: 131405 - RNA, 24 nt, Human
ggauggucucgaucuccugacuuc

SEQ ID NO: 131406 - RNA, 20 nt, Human
ggggcuaaaaaaaaaauugg

SEQ ID NO: 131407 - RNA, 24 nt, Human
gguuucaccauguuagccaggaug

SEQ ID NO: 131408 - RNA, 24 nt, Human
gucucgcucuguugcccaggcugg

SEQ ID NO: 131409 - RNA, 24 nt, Human
guugagaccuggaauagcuucucu

SEQ ID NO: 131410 - RNA, 27 nt, Human
uaauuuuuuuuguauuuuuaguagaga

SEQ ID NO: 131411 - RNA, 22 nt, Human
uacaggcgugagccacugcgcc

SEQ ID NO: 131412 - RNA, 22 nt, Human
uacaggcgugagccacugcgcc

SEQ ID NO: 131413 - RNA, 23 nt, Human
uacaggcgugagccacugcgccu

SEQ ID NO: 131414 - RNA, 22 nt, Human
uagagacaggguuucaccaugu

SEQ ID NO: 131415 - RNA, 22 nt, Human
uagaggaggcgggauauuguug

SEQ ID NO: 131416 - RNA, 24 nt, Human
uaguagagacaggguuucaccaug

SEQ ID NO: 131417 - RNA, 26 nt, Human
uaguagagacaggguuucaccauguu

SEQ ID NO: 131418 - RNA, 24 nt, Human
ucaccauguuagccaggauggucu

SEQ ID NO: 131419 - RNA, 18 nt, Human
ucacugcaagcucugccu

SEQ ID NO: 131420 - RNA, 18 nt, Human
ucacugcaagcucugccu

SEQ ID NO: 131421 - RNA, 19 nt, Human
ucacugcaagcucugccuc

SEQ ID NO: 131422 - RNA, 24 nt, Human
ucacugcaagcucugccucccagg

SEQ ID NO: 131423 - RNA, 18 nt, Human
ucagccucccaaguagcu

SEQ ID NO: 131424 - RNA, 20 nt, Human
ucagccucccaaguagcugg

SEQ ID NO: 131425 - RNA, 26 nt, Human
ucagcucacugcaagcucugccuccc

SEQ ID NO: 131426 - RNA, 24 nt, Human
ucccaaguagcugggauuacaggc

SEQ ID NO: 131427 - RNA, 20 nt, Human
ucccagguucaugccauucu

SEQ ID NO: 131428 - RNA, 21 nt, Human
ucccagguucaugccauucuc

SEQ ID NO: 131429 - RNA, 24 nt, Human
ucccagguucaugccauucuccug

SEQ ID NO: 131430 - RNA, 22 nt, Human
ucccagugcugggauuacaggc

SEQ ID NO: 131431 - RNA, 22 nt, Human
ucccagugcugggauuacaggc

SEQ ID NO: 131432 - RNA, 24 nt, Human
ucccagugcugggauuacaggcgu

SEQ ID NO: 131433 - RNA, 22 nt, Human
uccgccccccucggccucccag

SEQ ID NO: 131434 - RNA, 26 nt, Human
ucuccugccucagccucccaaguagc

SEQ ID NO: 131435 - RNA, 19 nt, Human
ucucgcucuguugcccagg

SEQ ID NO: 131436 - RNA, 23 nt, Human
ucucgcucuguugcccaggcugg

SEQ ID NO: 131437 - RNA, 24 nt, Human
ucucgcucuguugcccaggcugga

SEQ ID NO: 131438 - RNA, 26 nt, Human
ucucgcucuguugcccaggcuggagu

SEQ ID NO: 131439 - RNA, 27 nt, Human
ucucgcucuguugcccaggcuggagug

SEQ ID NO: 131440 - RNA, 18 nt, Human
ucuguugcccaggcugga

SEQ ID NO: 131441 - RNA, 24 nt, Human
ucuguugcccaggcuggagugcag

SEQ ID NO: 131442 - RNA, 18 nt, Human
ugaacagagaacaucaua

SEQ ID NO: 131443 - RNA, 22 nt, Human
ugagacggagucucgcucuguu

SEQ ID NO: 131444 - RNA, 22 nt, Human
ugcaguggcgcaaucucagcuc

SEQ ID NO: 131445 - RNA, 23 nt, Human
ugcaguggcgcaaucucagcuca

SEQ ID NO: 131446 - RNA, 18 nt, Human
ugcccaggcuggagugca

SEQ ID NO: 131447 - RNA, 21 nt, Human
ugcccaggcuggagugcagug

SEQ ID NO: 131448 - RNA, 22 nt, Human
ugcccaggcuggagugcagugg

SEQ ID NO: 131449 - RNA, 24 nt, Human
ugcccaggcuggagugcaguggcg

SEQ ID NO: 131450 - RNA, 24 nt, Human
ugccucagccucccaaguagcugg

SEQ ID NO: 131451 - RNA, 24 nt, Human
ugcugggauuacaggcgugagcca

SEQ ID NO: 131452 - RNA, 18 nt, Human
uggagugcaguggcgcaa

SEQ ID NO: 131453 - RNA, 23 nt, Human
uggagugcaguggcgcaaucuca

SEQ ID NO: 131454 - RNA, 24 nt, Human
uggagugcaguggcgcaaucucag

SEQ ID NO: 131455 - RNA, 19 nt, Human
uggcacacuucccgcugcu

SEQ ID NO: 131456 - RNA, 19 nt, Human
uggcagaaguccugaagcu

SEQ ID NO: 131457 - RNA, 21 nt, Human
uggccaaucacugccaauuac

SEQ ID NO: 131458 - RNA, 24 nt, Human
uggcgcaaucucagcucacugcaa

SEQ ID NO: 131459 - RNA, 21 nt, Human
ugggauuacaggcgcccgcca

SEQ ID NO: 131460 - RNA, 22 nt, Human
ugggauuacaggcgcccgccac

SEQ ID NO: 131461 - RNA, 24 nt, Human
ugggauuacaggcgcccgccacca

SEQ ID NO: 131462 - RNA, 25 nt, Human
ugggauuacaggcgcccgccaccau

SEQ ID NO: 131463 - RNA, 18 nt, Human
ugggauuacaggcgugag

SEQ ID NO: 131464 - RNA, 19 nt, Human
ugggauuacaggcgugagc

SEQ ID NO: 131465 - RNA, 21 nt, Human
ugggauuacaggcgugagcca

SEQ ID NO: 131466 - RNA, 22 nt, Human
ugggauuacaggcgugagccac

SEQ ID NO: 131467 - RNA, 22 nt, Human
ugggauuacaggcgugagccac

SEQ ID NO: 131468 - RNA, 24 nt, Human
ugggauuacaggcgugagccacug

SEQ ID NO: 131469 - RNA, 24 nt, Human
ugggauuacaggcgugagccacug

SEQ ID NO: 131470 - RNA, 23 nt, Human
uggggcuaaaaaaaaaauuggug

SEQ ID NO: 131471 - RNA, 24 nt, Human
uggugcagcuauaucauucaaaau

SEQ ID NO: 131472 - RNA, 24 nt, Human
uuaguagagacaggguuucaccau

SEQ ID NO: 131473 - RNA, 19 nt, Human
uucaugccauucuccugcc

SEQ ID NO: 131474 - RNA, 24 nt, Human
uugcccaggcuggagugcaguggc

SEQ ID NO: 131475 - RNA, 19 nt, Human
uuucaccauguuagccagg

SEQ ID NO: 131476 - RNA, 20 nt, Human
uuucaccauguuagccagga

SEQ ID NO: 131477 - RNA, 24 nt, Human
uuuuuaguagagacaggguuucac

SEQ ID NO: 131478 - RNA, 21 nt, Human
uuuuuguauuuuuaguagaga

SEQ ID NO: 131479 - RNA, 21 nt, Human
uuuuuuguauuuuuaguagag

SEQ ID NO: 131480 - RNA, 24 nt, Human
uuuuuuguauuuuuaguagagaca

SEQ ID NO: 131481 - RNA, 25 nt, Human
uuuuuuuuuuuugagacggagucuc

SEQ ID NO: 131482 - RNA, 20 nt, Human
uuuuuuuuuuuuuuuuuugg

SEQ ID NO: 131483 - RNA, 22 nt, Human
aaaaaaaaaaaucagcagugaa

SEQ ID NO: 131484 - RNA, 18 nt, Human
aaaaaaacaaaaaaggca

SEQ ID NO: 131485 - RNA, 21 nt, Human
aaaaaaacaaaaaaggcaccu

SEQ ID NO: 131486 - RNA, 23 nt, Human
aaaaaaaccccaacaauucagaa

SEQ ID NO: 131487 - RNA, 20 nt, Human
aaaaaccccaacaauucaga

SEQ ID NO: 131488 - RNA, 25 nt, Human
aaaacaaaaaaacaaaaaaggcacc

SEQ ID NO: 131489 - RNA, 24 nt, Human
aaaacaaaacaaaacaacaaaaaa

SEQ ID NO: 131490 - RNA, 25 nt, Human
aaaacaaaacaacaaaaaaaacccc

SEQ ID NO: 131491 - RNA, 22 nt, Human
aaaacaacaaaaaaaaccccaa

SEQ ID NO: 131492 - RNA, 18 nt, Human
aaaacagcaguuucacgu

SEQ ID NO: 131493 - RNA, 20 nt, Human
aaaacagcaguuucacgugg

SEQ ID NO: 131494 - RNA, 21 nt, Human
aaaaccccaacaauucagaaa

SEQ ID NO: 131495 - RNA, 21 nt, Human
aaaagugaaacuccaucuaca

SEQ ID NO: 131496 - RNA, 22 nt, Human
aaacaaaaaaggcaccuguuaa

SEQ ID NO: 131497 - RNA, 21 nt, Human
aaacaaaacaaaacaacaaaa

SEQ ID NO: 131498 - RNA, 25 nt, Human
aaacaaaacaacaaaaaaaacccca

SEQ ID NO: 131499 - RNA, 19 nt, Human
aaacaacaaaaaaaacccc

SEQ ID NO: 131500 - RNA, 24 nt, Human
aaacaacaaaaaaaaccccaacaa

SEQ ID NO: 131501 - RNA, 23 nt, Human
aaacagcaguuucacgugguuca

SEQ ID NO: 131502 - RNA, 24 nt, Human
aaacaucguacccccaaagcauga

SEQ ID NO: 131503 - RNA, 22 nt, Human
aaaccccaacaauucagaaaug

SEQ ID NO: 131504 - RNA, 21 nt, Human
aacaaaagugaaacuccaucu

SEQ ID NO: 131505 - RNA, 22 nt, Human
aacaaaagugaaacuccaucua

SEQ ID NO: 131506 - RNA, 19 nt, Human
aacauggugaaaccccguc

SEQ ID NO: 131507 - RNA, 20 nt, Human
aacauggugaaaccccgucu

SEQ ID NO: 131508 - RNA, 21 nt, Human
aacauggugaaaccccgucuc

SEQ ID NO: 131509 - RNA, 19 nt, Human
aacauggugaaaccccguu

SEQ ID NO: 131510 - RNA, 20 nt, Human
aacauggugaaaccccguuu

SEQ ID NO: 131511 - RNA, 21 nt, Human
aacauggugaaaccccguuuc

SEQ ID NO: 131512 - RNA, 22 nt, Human
aagaauuccucagcccagagac

SEQ ID NO: 131513 - RNA, 21 nt, Human
aauucuuaucccuacugaccc

SEQ ID NO: 131514 - RNA, 23 nt, Human
acaaaaaaacaaaaaaggcaccu

SEQ ID NO: 131515 - RNA, 22 nt, Human
acaaaacaaaacaaaacaacaa

SEQ ID NO: 131516 - RNA, 25 nt, Human
acaaaacaaaacaaaacaacaaaaa

SEQ ID NO: 131517 - RNA, 22 nt, Human
acaaaacaacaaaaaaaacccc

SEQ ID NO: 131518 - RNA, 23 nt, Human
acaaaacaacaaaaaaaacccca

SEQ ID NO: 131519 - RNA, 23 nt, Human
acaaacaaaaaaaaaaaucagca

SEQ ID NO: 131520 - RNA, 23 nt, Human
acagagugagacccugucucaaa

SEQ ID NO: 131521 - RNA, 22 nt, Human
accaaaaaaacgaaaaacaaaa

SEQ ID NO: 131522 - RNA, 27 nt, Human
accaaaaaaacgaaaaacaaaaaaaca

SEQ ID NO: 131523 - RNA, 24 nt, Human
accaacauggugaaaccccgucuc

SEQ ID NO: 131524 - RNA, 19 nt, Human
accacauuacaugagcaaa

SEQ ID NO: 131525 - RNA, 23 nt, Human
accacauuacaugagcaaaccca

SEQ ID NO: 131526 - RNA, 18 nt, Human
acccccaaagcaugacac

SEQ ID NO: 131527 - RNA, 24 nt, Human
accccgucucuacuaaaaauacaa

SEQ ID NO: 131528 - RNA, 23 nt, Human
accccguuucuacuaaacauaca

SEQ ID NO: 131529 - RNA, 24 nt, Human
accccguuucuacuaaacauacaa

SEQ ID NO: 131530 - RNA, 24 nt, Human
accugaggucaggaguuugagacc

SEQ ID NO: 131531 - RNA, 18 nt, Human
acgaaaaacaaaaaaaca

SEQ ID NO: 131532 - RNA, 20 nt, Human
acggaguauaaacaucguac

SEQ ID NO: 131533 - RNA, 23 nt, Human
acggaguauaaacaucguacccc

SEQ ID NO: 131534 - RNA, 24 nt, Human
acuaaaaauacaaacauuagccgg

SEQ ID NO: 131535 - RNA, 18 nt, Human
acuacacuccagccuggg

SEQ ID NO: 131536 - RNA, 23 nt, Human
acuacacuccagccugggcaaca

SEQ ID NO: 131537 - RNA, 26 nt, Human
acucacagacauccaacgaguacccc

SEQ ID NO: 131538 - RNA, 24 nt, Human
acuccagccugagcgacagaguga

SEQ ID NO: 131539 - RNA, 18 nt, Human
acugcacuccagccugag

SEQ ID NO: 131540 - RNA, 24 nt, Human
acugcacuccagccugagcgacag

SEQ ID NO: 131541 - RNA, 20 nt, Human
agaaccacuugaaccugaga

SEQ ID NO: 131542 - RNA, 23 nt, Human
agaagagucaagaggauggagcu

SEQ ID NO: 131543 - RNA, 23 nt, Human
agaucaccugaggucaggaguuc

SEQ ID NO: 131544 - RNA, 19 nt, Human
agcaaacccaacgcuggug

SEQ ID NO: 131545 - RNA, 24 nt, Human
agcacuuugggaggcugagguggg

SEQ ID NO: 131546 - RNA, 23 nt, Human
agccgggcgugguggcacaugcc

SEQ ID NO: 131547 - RNA, 24 nt, Human
agccugaccaacauggugaaaccc

SEQ ID NO: 131548 - RNA, 22 nt, Human
agccuggccaacauggugaaac

SEQ ID NO: 131549 - RNA, 24 nt, Human
agccuggccaacauggugaaaccc

SEQ ID NO: 131550 - RNA, 21 nt, Human
agccugggcaacaaaagugaa

SEQ ID NO: 131551 - RNA, 23 nt, Human
agccugggcaacaaaagugaaac

SEQ ID NO: 131552 - RNA, 21 nt, Human
agcugccgaugcccugaacag

SEQ ID NO: 131553 - RNA, 24 nt, Human
aggaaggagaaccacuugaaccug

SEQ ID NO: 131554 - RNA, 20 nt, Human
aggaguuugagaccagccug

SEQ ID NO: 131555 - RNA, 24 nt, Human
aggcggagguugcagugagccaag

SEQ ID NO: 131556 - RNA, 22 nt, Human
aggcgggcagaucaccugaggu

SEQ ID NO: 131557 - RNA, 26 nt, Human
aggcgggcagaucaccugaggucagg

SEQ ID NO: 131558 - RNA, 24 nt, Human
aggcugaggaaggagaaccacuug

SEQ ID NO: 131559 - RNA, 24 nt, Human
aggcugaggugggcggaucaccug

SEQ ID NO: 131560 - RNA, 24 nt, Human
aggugcaguggcucaugccuguaa

SEQ ID NO: 131561 - RNA, 22 nt, Human
aggugggcggaucaccugaggu

SEQ ID NO: 131562 - RNA, 23 nt, Human
aguggcucaugccuguaauccca

SEQ ID NO: 131563 - RNA, 24 nt, Human
aguggcucaugccuguaaucccag

SEQ ID NO: 131564 - RNA, 20 nt, Human
aucaccugaggucaggaguu

SEQ ID NO: 131565 - RNA, 24 nt, Human
aucaccugaggucaggaguucgag

SEQ ID NO: 131566 - RNA, 24 nt, Human
aucaccugaggucaggaguuugag

SEQ ID NO: 131567 - RNA, 24 nt, Human
aucgcgccacuacacuccagccug

SEQ ID NO: 131568 - RNA, 19 nt, Human
augccuguaaucccagcac

SEQ ID NO: 131569 - RNA, 23 nt, Human
auucuuaucccuacugacccgua

SEQ ID NO: 131570 - RNA, 19 nt, Human
caaaaaaacaaaaaaggca

SEQ ID NO: 131571 - RNA, 22 nt, Human
caaaaaaacaaaaaaggcaccu

SEQ ID NO: 131572 - RNA, 24 nt, Human
caaaaaaacaaaaaaggcaccugu

SEQ ID NO: 131573 - RNA, 21 nt, Human
caaaaaaggcaccuguuaaaa

SEQ ID NO: 131574 - RNA, 25 nt, Human
caaaacaaaacaacaaaaaaaaccc

SEQ ID NO: 131575 - RNA, 24 nt, Human
caaaacaacaaaaaaaaccccaac

SEQ ID NO: 131576 - RNA, 19 nt, Human
caaagaccaggacguggug

SEQ ID NO: 131577 - RNA, 21 nt, Human
caaagaccaggacguggugug

SEQ ID NO: 131578 - RNA, 21 nt, Human
caaagcaugacaccucuuuug

SEQ ID NO: 131579 - RNA, 20 nt, Human
caacaaaaaaaaccccaaca

SEQ ID NO: 131580 - RNA, 25 nt, Human
caacaaauguaaaaauucaaauauu

SEQ ID NO: 131581 - RNA, 24 nt, Human
caacauggugaaaccccgucucua

SEQ ID NO: 131582 - RNA, 24 nt, Human
caacauggugaaaccccguuucua

SEQ ID NO: 131583 - RNA, 18 nt, Human
caacgcuggugaaaccag

SEQ ID NO: 131584 - RNA, 24 nt, Human
cacaccugucaucccagcacuuug

SEQ ID NO: 131585 - RNA, 21 nt, Human
cacauuacaugagcaaaccca

SEQ ID NO: 131586 - RNA, 23 nt, Human
caccugaggucaggaguucgaga

SEQ ID NO: 131587 - RNA, 23 nt, Human
caccugaggucaggaguuugaga

SEQ ID NO: 131588 - RNA, 23 nt, Human
caccugucaucccagcacuuugg

SEQ ID NO: 131589 - RNA, 24 nt, Human
caccugucaucccagcacuuuggg

SEQ ID NO: 131590 - RNA, 24 nt, Human
cacuacacuccagccugggcaaca

SEQ ID NO: 131591 - RNA, 19 nt, Human
cacuauguaaauguaucag

SEQ ID NO: 131592 - RNA, 22 nt, Human
cacuccagccugagcgacagag

SEQ ID NO: 131593 - RNA, 24 nt, Human
cacuccagccugagcgacagagug

SEQ ID NO: 131594 - RNA, 19 nt, Human
cacugcacuccagccugag

SEQ ID NO: 131595 - RNA, 20 nt, Human
cacugcacuccagccugagc

SEQ ID NO: 131596 - RNA, 21 nt, Human
cacugcacuccagccugagcg

SEQ ID NO: 131597 - RNA, 22 nt, Human
cacugcacuccagccugagcga

SEQ ID NO: 131598 - RNA, 24 nt, Human
cacugcacuccagccugagcgaca

SEQ ID NO: 131599 - RNA, 24 nt, Human
cagaucaccugaggucaggaguuc

SEQ ID NO: 131600 - RNA, 24 nt, Human
cagcacuuugggagaccgaggcgg

SEQ ID NO: 131601 - RNA, 21 nt, Human
cagcacuuugggaggcugagg

SEQ ID NO: 131602 - RNA, 24 nt, Human
cagcacuuugggaggcugaggugg

SEQ ID NO: 131603 - RNA, 19 nt, Human
cagcagugaauguccuugu

SEQ ID NO: 131604 - RNA, 20 nt, Human
caugccuguaaucccagcac

SEQ ID NO: 131605 - RNA, 24 nt, Human
caugccuguaaucccagcacuuug

SEQ ID NO: 131606 - RNA, 21 nt, Human
ccacuacacuccagccugggc

SEQ ID NO: 131607 - RNA, 23 nt, Human
ccacuacacuccagccugggcaa

SEQ ID NO: 131608 - RNA, 24 nt, Human
ccacuacacuccagccugggcaac

SEQ ID NO: 131609 - RNA, 24 nt, Human
ccacuugaaccugagaggcggagg

SEQ ID NO: 131610 - RNA, 24 nt, Human
ccaggagcuacuggagugaccaaa

SEQ ID NO: 131611 - RNA, 25 nt, Human
ccaucuacaaaacaaaacaaaacaa

SEQ ID NO: 131612 - RNA, 19 nt, Human
cccaacccccguauccccc

SEQ ID NO: 131613 - RNA, 23 nt, Human
cccaacccccguaucccccagga

SEQ ID NO: 131614 - RNA, 18 nt, Human
cccccaaagcaugacacc

SEQ ID NO: 131615 - RNA, 24 nt, Human
cccugucucaaacaaacaaaaaaa

SEQ ID NO: 131616 - RNA, 21 nt, Human
ccuagaaaacagcaguuucac

SEQ ID NO: 131617 - RNA, 22 nt, Human
ccucuguaaucuagcccaaccc

SEQ ID NO: 131618 - RNA, 23 nt, Human
ccugaccaacauggugaaacccc

SEQ ID NO: 131619 - RNA, 24 nt, Human
ccugaccaacauggugaaaccccg

SEQ ID NO: 131620 - RNA, 22 nt, Human
ccugaggucaggaguuugagac

SEQ ID NO: 131621 - RNA, 23 nt, Human
ccuggccaacauggugaaacccc

SEQ ID NO: 131622 - RNA, 24 nt, Human
ccuggccaacauggugaaaccccg

SEQ ID NO: 131623 - RNA, 25 nt, Human
ccugggcaacaaaagugaaacucca

SEQ ID NO: 131624 - RNA, 22 nt, Human
ccuguaaucccagcacuuuggg

SEQ ID NO: 131625 - RNA, 21 nt, Human
ccuguaaucccagcuacucgg

SEQ ID NO: 131626 - RNA, 22 nt, Human
ccuguaaucccagcuacucggg

SEQ ID NO: 131627 - RNA, 21 nt, Human
ccuguaaucccagcuacuugg

SEQ ID NO: 131628 - RNA, 18 nt, Human
ccuuccagaccgucucug

SEQ ID NO: 131629 - RNA, 24 nt, Human
cgagaacagccuggccaacauggu

SEQ ID NO: 131630 - RNA, 20 nt, Human
cgaggcgggcagaucaccug

SEQ ID NO: 131631 - RNA, 24 nt, Human
cgccacuacacuccagccugggca

SEQ ID NO: 131632 - RNA, 19 nt, Human
cggagcaggguucagcugc

SEQ ID NO: 131633 - RNA, 24 nt, Human
cggaucaccugaggucaggaguuu

SEQ ID NO: 131634 - RNA, 27 nt, Human
cggaucaccugaggucaggaguuugag

SEQ ID NO: 131635 - RNA, 24 nt, Human
cgggcagaucaccugaggucagga

SEQ ID NO: 131636 - RNA, 21 nt, Human
cuagcccaacccccguauccc

SEQ ID NO: 131637 - RNA, 24 nt, Human
cucacaccugucaucccagcacuu

SEQ ID NO: 131638 - RNA, 24 nt, Human
cucaugccuguaaucccagcacuu

SEQ ID NO: 131639 - RNA, 18 nt, Human
cugaaacugugacacagu

SEQ ID NO: 131640 - RNA, 20 nt, Human
cuguccucuggaaguugggc

SEQ ID NO: 131641 - RNA, 18 nt, Human
cugucucaaacaaacaaa

SEQ ID NO: 131642 - RNA, 22 nt, Human
cuuuuccugauuguacaacaaa

SEQ ID NO: 131643 - RNA, 18 nt, Human
gacaccauuugaguaugg

SEQ ID NO: 131644 - RNA, 21 nt, Human
gacagagugagacccugucuc

SEQ ID NO: 131645 - RNA, 24 nt, Human
gacagagugagacccugucucaaa

SEQ ID NO: 131646 - RNA, 23 nt, Human
gagaucgcgccacuacacuccag

SEQ ID NO: 131647 - RNA, 25 nt, Human
gaggcgggcagaucaccugagguca

SEQ ID NO: 131648 - RNA, 21 nt, Human
gaggcugagccgagaucgcgc

SEQ ID NO: 131649 - RNA, 18 nt, Human
gaggcugaggaaggagaa

SEQ ID NO: 131650 - RNA, 23 nt, Human
gaggugggcggaucaccugaggu

SEQ ID NO: 131651 - RNA, 18 nt, Human
gagguugcagugagccaa

SEQ ID NO: 131652 - RNA, 21 nt, Human
gagguugcagugagccaagau

SEQ ID NO: 131653 - RNA, 23 nt, Human
gagguugcagugagccaagauug

SEQ ID NO: 131654 - RNA, 18 nt, Human
gaguauaaacaucguacc

SEQ ID NO: 131655 - RNA, 24 nt, Human
gaucaccugaggucaggaguucga

SEQ ID NO: 131656 - RNA, 24 nt, Human
gaucaccugaggucaggaguuuga

SEQ ID NO: 131657 - RNA, 23 nt, Human
gcacuccagccugagcgacagag

SEQ ID NO: 131658 - RNA, 24 nt, Human
gcacuccagccugagcgacagagu

SEQ ID NO: 131659 - RNA, 24 nt, Human
gcaggucaggugcaguggcucaug

SEQ ID NO: 131660 - RNA, 21 nt, Human
gcaucacugcacuccagccug

SEQ ID NO: 131661 - RNA, 21 nt, Human
gccaacauggugaaaccccgu

SEQ ID NO: 131662 - RNA, 22 nt, Human
gccacuacacuccagccugggc

SEQ ID NO: 131663 - RNA, 20 nt, Human
gccgagaucgcgccacuaca

SEQ ID NO: 131664 - RNA, 23 nt, Human
gcgacagagugagacccugucuc

SEQ ID NO: 131665 - RNA, 18 nt, Human
gcgcaguggcucacaccu

SEQ ID NO: 131666 - RNA, 25 nt, Human
gcguguuuccuuccagaccgucucu

SEQ ID NO: 131667 - RNA, 21 nt, Human
ggagaaccacuugaaccugag

SEQ ID NO: 131668 - RNA, 22 nt, Human
ggagguugcagugagccaagau

SEQ ID NO: 131669 - RNA, 24 nt, Human
ggagguugcagugagccaagauug

SEQ ID NO: 131670 - RNA, 22 nt, Human
ggaucaccugaggucaggaguu

SEQ ID NO: 131671 - RNA, 22 nt, Human
ggaucaccugaggucaggaguu

SEQ ID NO: 131672 - RNA, 21 nt, Human
ggcacaugccuguaaucccag

SEQ ID NO: 131673 - RNA, 25 nt, Human
ggcagaucaccugaggucaggaguu

SEQ ID NO: 131674 - RNA, 21 nt, Human
ggcggaucaccugaggucagg

SEQ ID NO: 131675 - RNA, 23 nt, Human
ggcgugguggcacaugccuguaa

SEQ ID NO: 131676 - RNA, 19 nt, Human
gggaggcugagccgagauc

SEQ ID NO: 131677 - RNA, 20 nt, Human
gggaggcugaggugggcgga

SEQ ID NO: 131678 - RNA, 25 nt, Human
gggcaacaaaagugaaacuccaucc

SEQ ID NO: 131679 - RNA, 24 nt, Human
gggcgcaguggcucacaccuguca

SEQ ID NO: 131680 - RNA, 19 nt, Human
ggucaggaguuugagacca

SEQ ID NO: 131681 - RNA, 18 nt, Human
ggucaggugcaguggcuc

SEQ ID NO: 131682 - RNA, 24 nt, Human
ggugccuguaaucccagcuacuug

SEQ ID NO: 131683 - RNA, 24 nt, Human
ggugguaggugccuguaaucccag

SEQ ID NO: 131684 - RNA, 25 nt, Human
guaaaaauucaaauauuacaaaaug

SEQ ID NO: 131685 - RNA, 27 nt, Human
gugcacccgccacccacacggcugaca

SEQ ID NO: 131686 - RNA, 23 nt, Human
guggcacaugccuguaaucccag

SEQ ID NO: 131687 - RNA, 23 nt, Human
gugguaggugccuguaaucccag

SEQ ID NO: 131688 - RNA, 20 nt, Human
uaaaaauacaaacauuagcc

SEQ ID NO: 131689 - RNA, 19 nt, Human
uaaaagccugaaacuguga

SEQ ID NO: 131690 - RNA, 24 nt, Human
uaacauguuauaaaauaaaugccc

SEQ ID NO: 131691 - RNA, 20 nt, Human
uacaaaacaaaacaaaacaa

SEQ ID NO: 131692 - RNA, 24 nt, Human
uacaaaacaaaacaaaacaacaaa

SEQ ID NO: 131693 - RNA, 21 nt, Human
uacauaaacaacuugucccuc

SEQ ID NO: 131694 - RNA, 20 nt, Human
uacuaaaaauacaaacauua

SEQ ID NO: 131695 - RNA, 18 nt, Human
uagaaaacagcaguuuca

SEQ ID NO: 131696 - RNA, 22 nt, Human
uagccgggcgugguggcacaug

SEQ ID NO: 131697 - RNA, 21 nt, Human
uauaaacaucguacccccaaa

SEQ ID NO: 131698 - RNA, 25 nt, Human
uaugaccagguacucacagacaucc

SEQ ID NO: 131699 - RNA, 20 nt, Human
ucacugcacuccagccugag

SEQ ID NO: 131700 - RNA, 21 nt, Human
ucacugcacuccagccugagc

SEQ ID NO: 131701 - RNA, 24 nt, Human
ucacugcacuccagccugagcgac

SEQ ID NO: 131702 - RNA, 19 nt, Human
ucagaagguauaagaaaug

SEQ ID NO: 131703 - RNA, 20 nt, Human
ucagaagguauaagaaauga

SEQ ID NO: 131704 - RNA, 22 nt, Human
ucaggccucaaacaaagaccag

SEQ ID NO: 131705 - RNA, 24 nt, Human
ucaggcugggcgcaguggcucaca

SEQ ID NO: 131706 - RNA, 22 nt, Human
ucaugccuguaaucccagcacu

SEQ ID NO: 131707 - RNA, 24 nt, Human
uccagccugagcgacagagugaga

SEQ ID NO: 131708 - RNA, 20 nt, Human
uccaguuucuacacagaaac

SEQ ID NO: 131709 - RNA, 21 nt, Human
uccaucuacaaaacaaaacaa

SEQ ID NO: 131710 - RNA, 23 nt, Human
uccaucuacaaaacaaaacaaaa

SEQ ID NO: 131711 - RNA, 23 nt, Human
ucccccaggauuacugcuguuca

SEQ ID NO: 131712 - RNA, 25 nt, Human
ucccucaagcaagguggccaacuuu

SEQ ID NO: 131713 - RNA, 22 nt, Human
uccgagaugauaguaacgcuga

SEQ ID NO: 131714 - RNA, 19 nt, Human
ucucuacuaaaaauacaaa

SEQ ID NO: 131715 - RNA, 20 nt, Human
ucucugugcacccgccaccc

SEQ ID NO: 131716 - RNA, 24 nt, Human
ugaaaccagagaacagaagaauuc

SEQ ID NO: 131717 - RNA, 23 nt, Human
ugaaauaaaugaucgcucaccaa

SEQ ID NO: 131718 - RNA, 22 nt, Human
ugaccaaaaaaacgaaaaacaa

SEQ ID NO: 131719 - RNA, 23 nt, Human
ugaccaaaaaaacgaaaaacaaa

SEQ ID NO: 131720 - RNA, 24 nt, Human
ugaccaacauggugaaaccccguc

SEQ ID NO: 131721 - RNA, 19 nt, Human
ugaccacauuacaugagca

SEQ ID NO: 131722 - RNA, 19 nt, Human
ugaccagguacucacagac

SEQ ID NO: 131723 - RNA, 23 nt, Human
ugagaccagccugaccaacaugg

SEQ ID NO: 131724 - RNA, 24 nt, Human
ugagaccagccugaccaacauggu

SEQ ID NO: 131725 - RNA, 24 nt, Human
ugagaggcggagguugcagugagc

SEQ ID NO: 131726 - RNA, 23 nt, Human
ugagcaaacccaacgcuggugaa

SEQ ID NO: 131727 - RNA, 19 nt, Human
ugagccgagaucgcgccac

SEQ ID NO: 131728 - RNA, 21 nt, Human
ugagcgacagagugagacccu

SEQ ID NO: 131729 - RNA, 24 nt, Human
ugagcgacagagugagacccuguc

SEQ ID NO: 131730 - RNA, 20 nt, Human
ugaggaaggagaaccacuug

SEQ ID NO: 131731 - RNA, 24 nt, Human
ugaggaaggagaaccacuugaacc

SEQ ID NO: 131732 - RNA, 18 nt, Human
ugaggucaggaguuugag

SEQ ID NO: 131733 - RNA, 20 nt, Human
ugaggugggcggaucaccug

SEQ ID NO: 131734 - RNA, 23 nt, Human
ugaggugggcggaucaccugagg

SEQ ID NO: 131735 - RNA, 24 nt, Human
ugaggugggcggaucaccugaggu

SEQ ID NO: 131736 - RNA, 26 nt, Human
ugaggugggcggaucaccugagguca

SEQ ID NO: 131737 - RNA, 21 nt, Human
ugauagcuguucaacagacau

SEQ ID NO: 131738 - RNA, 20 nt, Human
ugauuguacaacaaauguaa

SEQ ID NO: 131739 - RNA, 21 nt, Human
ugcaucacugcacuccagccu

SEQ ID NO: 131740 - RNA, 19 nt, Human
ugcccugaacagcuuccag

SEQ ID NO: 131741 - RNA, 23 nt, Human
ugccuguaaucccagcacuuugg

SEQ ID NO: 131742 - RNA, 23 nt, Human
ugccuguaaucccagcacuuugg

SEQ ID NO: 131743 - RNA, 23 nt, Human
ugccuguaaucccagcuacucgg

SEQ ID NO: 131744 - RNA, 24 nt, Human
ugccuguaaucccagcuacucggg

SEQ ID NO: 131745 - RNA, 23 nt, Human
ugccuguaaucccagcuacuugg

SEQ ID NO: 131746 - RNA, 24 nt, Human
ugccuguaaucccagcuacuuggg

SEQ ID NO: 131747 - RNA, 23 nt, Human
uggaaguugggcugucagaaggu

SEQ ID NO: 131748 - RNA, 18 nt, Human
uggagcugcccauuugcc

SEQ ID NO: 131749 - RNA, 21 nt, Human
uggcacaugccuguaauccca

SEQ ID NO: 131750 - RNA, 22 nt, Human
uggcacaugccuguaaucccag

SEQ ID NO: 131751 - RNA, 24 nt, Human
uggccaacauggugaaaccccguu

SEQ ID NO: 131752 - RNA, 22 nt, Human
uggccaacuucagccaugacac

SEQ ID NO: 131753 - RNA, 18 nt, Human
uggccuagaaaacagcag

SEQ ID NO: 131754 - RNA, 22 nt, Human
uggcucacaccugucaucccag

SEQ ID NO: 131755 - RNA, 24 nt, Human
uggcucacaccugucaucccagca

SEQ ID NO: 131756 - RNA, 22 nt, Human
uggcucaugccuguaaucccag

SEQ ID NO: 131757 - RNA, 24 nt, Human
uggcucaugccuguaaucccagca

SEQ ID NO: 131758 - RNA, 24 nt, Human
ugggagaccgaggcgggcagauca

SEQ ID NO: 131759 - RNA, 19 nt, Human
ugggaggcugaggaaggag

SEQ ID NO: 131760 - RNA, 24 nt, Human
ugggaggcugaggaaggagaacca

SEQ ID NO: 131761 - RNA, 18 nt, Human
ugggaggcugaggugggc

SEQ ID NO: 131762 - RNA, 19 nt, Human
ugggaggcugaggugggcg

SEQ ID NO: 131763 - RNA, 24 nt, Human
ugggaggcugaggugggcggauca

SEQ ID NO: 131764 - RNA, 24 nt, Human
ugggcggaucaccugaggucagga

SEQ ID NO: 131765 - RNA, 21 nt, Human
ugggggguuuccuauuucuug

SEQ ID NO: 131766 - RNA, 22 nt, Human
ugguaggugccuguaaucccag

SEQ ID NO: 131767 - RNA, 24 nt, Human
ugguggcacaugccuguaauccca

SEQ ID NO: 131768 - RNA, 24 nt, Human
uggugguaggugccuguaauccca

SEQ ID NO: 131769 - RNA, 22 nt, Human
uguacaacaaauguaaaaauuc

SEQ ID NO: 131770 - RNA, 21 nt, Human
ugugcacccgccacccacacg

SEQ ID NO: 131771 - RNA, 23 nt, Human
uguuuccuuccagaccgucucug

SEQ ID NO: 131772 - RNA, 18 nt, Human
uuagccgggcgugguggc

SEQ ID NO: 131773 - RNA, 20 nt, Human
uuagccgggcgugguggcac

SEQ ID NO: 131774 - RNA, 24 nt, Human
uuagccgggcgugguggcacaugc

SEQ ID NO: 131775 - RNA, 25 nt, Human
uuccagaccgucucugugcacccgc

SEQ ID NO: 131776 - RNA, 23 nt, Human
uuccugauuguacaacaaaugua

SEQ ID NO: 131777 - RNA, 24 nt, Human
uugaaccugagaggcggagguugc

SEQ ID NO: 131778 - RNA, 21 nt, Human
uugcagugagccaagauugca

SEQ ID NO: 131779 - RNA, 23 nt, Human
uugcaucacugcacuccagccug

SEQ ID NO: 131780 - RNA, 25 nt, Human
uugggaggcugaggugggcggauca

SEQ ID NO: 131781 - RNA, 21 nt, Human
uuucuacuaaacauacaaaaa

SEQ ID NO: 131782 - RNA, 20 nt, Human
aacaaaaaguggaaugcaag

SEQ ID NO: 131783 - RNA, 20 nt, Human
acaugcuggaaccuaacuca

SEQ ID NO: 131784 - RNA, 20 nt, Human
agcuagggucccaagcaggg

SEQ ID NO: 131785 - RNA, 20 nt, Human
aucacuuccaaaacguagcc

SEQ ID NO: 131786 - RNA, 19 nt, Human
augcaaaaugucaccacuu

SEQ ID NO: 131787 - RNA, 22 nt, Human
caaaaugucaccacuucuuaaa

SEQ ID NO: 131788 - RNA, 22 nt, Human
caaggucacauaaaaugcauau

SEQ ID NO: 131789 - RNA, 19 nt, Human
cacugaagcauggcaaggu

SEQ ID NO: 131790 - RNA, 20 nt, Human
ccagaauacauaggaaauca

SEQ ID NO: 131791 - RNA, 23 nt, Human
cuaagaauucuccgcccucccag

SEQ ID NO: 131792 - RNA, 18 nt, Human
uaagaauucuccgcccuc

SEQ ID NO: 131793 - RNA, 25 nt, Human
uagaauacccagaauacauaggaaa

SEQ ID NO: 131794 - RNA, 19 nt, Human
ucaaaguuuccuuuaauag

SEQ ID NO: 131795 - RNA, 19 nt, Human
ucagacucuuucuauguaa

SEQ ID NO: 131796 - RNA, 23 nt, Human
ucagucaucaaauaacauacauc

SEQ ID NO: 131797 - RNA, 26 nt, Human
ugaaaaauagccuuggccaguaacac

SEQ ID NO: 131798 - RNA, 23 nt, Human
ugaauguaugcuaagaauucucc

SEQ ID NO: 131799 - RNA, 21 nt, Human
uggaaccuaacucagaugcug

SEQ ID NO: 131800 - RNA, 22 nt, Human
uggcaaggucacauaaaaugca

SEQ ID NO: 131801 - RNA, 21 nt, Human
uggcuaaaagucaggucauuc

SEQ ID NO: 131802 - RNA, 24 nt, Human
uuacaugcuggaaccuaacucaga

SEQ ID NO: 131803 - RNA, 25 nt, Human
uucaucaugcaaaaugucaccacuu

SEQ ID NO: 131804 - RNA, 27 nt, Human
acagagccccauaggggcagagaggcc

SEQ ID NO: 131805 - RNA, 21 nt, Human
agaagccaggcccucaggugc

SEQ ID NO: 131806 - RNA, 19 nt, Human
agcccgcacccggccgcag

SEQ ID NO: 131807 - RNA, 21 nt, Human
aggggcagagaggccucccug

SEQ ID NO: 131808 - RNA, 20 nt, Human
aggugggcucuggcagcggg

SEQ ID NO: 131809 - RNA, 20 nt, Human
cccgcacccggccgcagcca

SEQ ID NO: 131810 - RNA, 23 nt, Human
ccgcacccggccgcagccaagcg

SEQ ID NO: 131811 - RNA, 24 nt, Human
ccgccucaccagcgcguucaaccc

SEQ ID NO: 131812 - RNA, 23 nt, Human
ccugcugucgccaucccugaggg

SEQ ID NO: 131813 - RNA, 22 nt, Human
cgcagccaagcgugggccugcc

SEQ ID NO: 131814 - RNA, 24 nt, Human
cgccacugcccccugccggccgcc

SEQ ID NO: 131815 - RNA, 21 nt, Human
cggccgccacugcccccugcc

SEQ ID NO: 131816 - RNA, 22 nt, Human
cuaauggacggccgccucucuc

SEQ ID NO: 131817 - RNA, 19 nt, Human
cucagcccgcacccggccg

SEQ ID NO: 131818 - RNA, 23 nt, Human
gacaacggccgccacugcccccc

SEQ ID NO: 131819 - RNA, 21 nt, Human
gacccggggcagggucagcaa

SEQ ID NO: 131820 - RNA, 18 nt, Human
gagaagccaggcccucag

SEQ ID NO: 131821 - RNA, 20 nt, Human
gccucaccagcgcguucaac

SEQ ID NO: 131822 - RNA, 24 nt, Human
gcguucaacccgcccgcgucaggc

SEQ ID NO: 131823 - RNA, 18 nt, Human
ucccugaggggugcagga

SEQ ID NO: 131824 - RNA, 18 nt, Human
ucccugggaccagaggag

SEQ ID NO: 131825 - RNA, 22 nt, Human
ugagaagccaggcccucaggug

SEQ ID NO: 131826 - RNA, 26 nt, Human
ugagguggcagugagaagccaggccc

SEQ ID NO: 131827 - RNA, 22 nt, Human
ugcaggacagagccccauaggg

SEQ ID NO: 131828 - RNA, 18 nt, Human
uggcagugagaagccagg

SEQ ID NO: 131829 - RNA, 22 nt, Human
uggcagugagaagccaggcccu

SEQ ID NO: 131830 - RNA, 23 nt, Human
aaagcaaacugugaaaagcuuac

SEQ ID NO: 131831 - RNA, 18 nt, Human
aacccccucaggaaggca

SEQ ID NO: 131832 - RNA, 23 nt, Human
aagcuggaagugaaagaagggac

SEQ ID NO: 131833 - RNA, 25 nt, Human
aagggaagacaaguuucuagggaaa

SEQ ID NO: 131834 - RNA, 21 nt, Human
aagguaaacugaggccaccag

SEQ ID NO: 131835 - RNA, 20 nt, Human
acaaaagucugacauggugc

SEQ ID NO: 131836 - RNA, 25 nt, Human
acagacacccaugacacuuccaaau

SEQ ID NO: 131837 - RNA, 23 nt, Human
acuccuucuaggacuuuuuccac

SEQ ID NO: 131838 - RNA, 19 nt, Human
agacacccaugacacuucc

SEQ ID NO: 131839 - RNA, 24 nt, Human
agauuuagccaccaccuagaacag

SEQ ID NO: 131840 - RNA, 20 nt, Human
aggguuggguuuccuccccg

SEQ ID NO: 131841 - RNA, 23 nt, Human
agguagggguggcagaagggaga

SEQ ID NO: 131842 - RNA, 18 nt, Human
aggugggccagauaggga

SEQ ID NO: 131843 - RNA, 19 nt, Human
aucaagagauaacagaaca

SEQ ID NO: 131844 - RNA, 23 nt, Human
auguccaauuuuucaggaccagc

SEQ ID NO: 131845 - RNA, 21 nt, Human
caacggggcaacugugcucuc

SEQ ID NO: 131846 - RNA, 18 nt, Human
caccaccuagaacagggc

SEQ ID NO: 131847 - RNA, 21 nt, Human
caccaguaagcaugugcucca

SEQ ID NO: 131848 - RNA, 26 nt, Human
caccauguugagccuccuuugguuuc

SEQ ID NO: 131849 - RNA, 25 nt, Human
cacccaagaaaaaccaguuacucca

SEQ ID NO: 131850 - RNA, 23 nt, Human
cacccagauuaggcccagauuua

SEQ ID NO: 131851 - RNA, 23 nt, Human
cacccaugacacuuccaaauuua

SEQ ID NO: 131852 - RNA, 23 nt, Human
cacccccauccucauccuggagg

SEQ ID NO: 131853 - RNA, 20 nt, Human
cagcacaagggcaagggcag

SEQ ID NO: 131854 - RNA, 18 nt, Human
caugcucucuucucacca

SEQ ID NO: 131855 - RNA, 20 nt, Human
caugugcuccaggccaaggc

SEQ ID NO: 131856 - RNA, 19 nt, Human
ccaacuccuccccuuggca

SEQ ID NO: 131857 - RNA, 25 nt, Human
cccaagaaaaaccaguuacuccacc

SEQ ID NO: 131858 - RNA, 23 nt, Human
cccaaucuagcccuguucuagac

SEQ ID NO: 131859 - RNA, 23 nt, Human
cccacagacacccaugacacuuc

SEQ ID NO: 131860 - RNA, 27 nt, Human
cccacagacacccaugacacuuccaaa

SEQ ID NO: 131861 - RNA, 24 nt, Human
ccccaagaagacugaguuuccuuu

SEQ ID NO: 131862 - RNA, 18 nt, Human
ccccccagacucuacagg

SEQ ID NO: 131863 - RNA, 19 nt, Human
ccuccuuugguuucccaug

SEQ ID NO: 131864 - RNA, 21 nt, Human
ccucucaucccuaggggcaaa

SEQ ID NO: 131865 - RNA, 18 nt, Human
ccugaaaagggaagacuc

SEQ ID NO: 131866 - RNA, 22 nt, Human
ccugagccagccucuccccagg

SEQ ID NO: 131867 - RNA, 18 nt, Human
ccuggaggccaguccagg

SEQ ID NO: 131868 - RNA, 20 nt, Human
ccuggaggccaguccaggcu

SEQ ID NO: 131869 - RNA, 22 nt, Human
ccuuucuugggccugaaaaggg

SEQ ID NO: 131870 - RNA, 22 nt, Human
cucacauccagaaucuaggauc

SEQ ID NO: 131871 - RNA, 23 nt, Human
cuccccaggguagcuaaaaacag

SEQ ID NO: 131872 - RNA, 26 nt, Human
cugugugcccauucccuggugguccc

SEQ ID NO: 131873 - RNA, 19 nt, Human
cuuacuguucagcagucug

SEQ ID NO: 131874 - RNA, 26 nt, Human
cuuccucacauccagaaucuaggauc

SEQ ID NO: 131875 - RNA, 21 nt, Human
cuuguugggaggaacagugaa

SEQ ID NO: 131876 - RNA, 21 nt, Human
gaagaagagagguuagcugag

SEQ ID NO: 131877 - RNA, 23 nt, Human
gaaggcacagaaaagugaggcuc

SEQ ID NO: 131878 - RNA, 21 nt, Human
gcagaagggagaucaaacugg

SEQ ID NO: 131879 - RNA, 18 nt, Human
gcagcugguuccuccagg

SEQ ID NO: 131880 - RNA, 21 nt, Human
gccacccccauccucauccug

SEQ ID NO: 131881 - RNA, 22 nt, Human
gccucucaucccuaggggcaaa

SEQ ID NO: 131882 - RNA, 23 nt, Human
gcucuccaacuccuccccuuggc

SEQ ID NO: 131883 - RNA, 22 nt, Human
ggaagaagagagguuagcugag

SEQ ID NO: 131884 - RNA, 22 nt, Human
ggaagcaugugcagccuacaag

SEQ ID NO: 131885 - RNA, 21 nt, Human
ggcaagggcagcagguacuca

SEQ ID NO: 131886 - RNA, 20 nt, Human
ggccugaaaagggaagacuc

SEQ ID NO: 131887 - RNA, 24 nt, Human
ggggugagguagggguggcagaag

SEQ ID NO: 131888 - RNA, 18 nt, Human
gguuuccuccccggccca

SEQ ID NO: 131889 - RNA, 23 nt, Human
guagacucuccaugagccuaaag

SEQ ID NO: 131890 - RNA, 18 nt, Human
gugaauuucccacacugg

SEQ ID NO: 131891 - RNA, 20 nt, Human
guggggaggcaucuucuuug

SEQ ID NO: 131892 - RNA, 24 nt, Human
uaaaaaagaccuaacauuguaaug

SEQ ID NO: 131893 - RNA, 18 nt, Human
uaacagaacacacaggag

SEQ ID NO: 131894 - RNA, 20 nt, Human
uacaaaagucugacauggug

SEQ ID NO: 131895 - RNA, 25 nt, Human
uacagagcaaaaaagugauuugcag

SEQ ID NO: 131896 - RNA, 19 nt, Human
uacagagugacgagauguc

SEQ ID NO: 131897 - RNA, 19 nt, Human
uagacuccugagccagccu

SEQ ID NO: 131898 - RNA, 24 nt, Human
uagacuccugagccagccucuccc

SEQ ID NO: 131899 - RNA, 18 nt, Human
uagccccuuguugccccc

SEQ ID NO: 131900 - RNA, 19 nt, Human
uaggacuuuuuccacugcc

SEQ ID NO: 131901 - RNA, 24 nt, Human
uaggggugugacaucgcagaaggg

SEQ ID NO: 131902 - RNA, 22 nt, Human
ucagcagucugccugauucccu

SEQ ID NO: 131903 - RNA, 21 nt, Human
ucaggaagggaagaagagagg

SEQ ID NO: 131904 - RNA, 24 nt, Human
ucauacuuacuguucagcagucug

SEQ ID NO: 131905 - RNA, 18 nt, Human
ucauguuuggugggagaa

SEQ ID NO: 131906 - RNA, 21 nt, Human
uccaaauuuacagagcaaaaa

SEQ ID NO: 131907 - RNA, 19 nt, Human
uccaacuccuccccuuggc

SEQ ID NO: 131908 - RNA, 24 nt, Human
uccaugucaucagccacccaagaa

SEQ ID NO: 131909 - RNA, 20 nt, Human
ucccugguggucccaggugc

SEQ ID NO: 131910 - RNA, 18 nt, Human
uccuccccggcccaaccc

SEQ ID NO: 131911 - RNA, 22 nt, Human
uccuucuuccccaagaagacug

SEQ ID NO: 131912 - RNA, 21 nt, Human
ucuuccccaagaagacugagu

SEQ ID NO: 131913 - RNA, 21 nt, Human
ucuuccucacauccagaaucu

SEQ ID NO: 131914 - RNA, 24 nt, Human
ugaaauacugacuuuuuccuucuu

SEQ ID NO: 131915 - RNA, 23 nt, Human
ugagccacccagauuaggcccag

SEQ ID NO: 131916 - RNA, 21 nt, Human
ugagguagggguggcagaagg

SEQ ID NO: 131917 - RNA, 24 nt, Human
ugcagggugucauugccaccccca

SEQ ID NO: 131918 - RNA, 22 nt, Human
ugcccauucccuggugguccca

SEQ ID NO: 131919 - RNA, 20 nt, Human
ugcugugugcccauucccug

SEQ ID NO: 131920 - RNA, 21 nt, Human
uggaagugaaagaacuugaaa

SEQ ID NO: 131921 - RNA, 27 nt, Human
uggcaauccuucuuccccaagaagacu

SEQ ID NO: 131922 - RNA, 21 nt, Human
uggcacugcaggccacuccug

SEQ ID NO: 131923 - RNA, 20 nt, Human
uggcggcauccucccugcaa

SEQ ID NO: 131924 - RNA, 25 nt, Human
ugggagaagauaaggcuggauggug

SEQ ID NO: 131925 - RNA, 18 nt, Human
ugggaggaacagugaaua

SEQ ID NO: 131926 - RNA, 24 nt, Human
ugggaggaacagugaauacagagu

SEQ ID NO: 131927 - RNA, 19 nt, Human
uguugccccccaaucuagc

SEQ ID NO: 131928 - RNA, 20 nt, Human
uucaggaagggaagaagaga

SEQ ID NO: 131929 - RNA, 25 nt, Human
uuccccaagaagacugaguuuccuu

SEQ ID NO: 131930 - RNA, 20 nt, Human
uuccuccccggcccaacccc

SEQ ID NO: 131931 - RNA, 18 nt, Human
uucuugggccugaaaagg

SEQ ID NO: 131932 - RNA, 18 nt, Human
uugcugugugcccauucc

SEQ ID NO: 131933 - RNA, 23 nt, Human
uuggugggagaagcauggacucc

SEQ ID NO: 131934 - RNA, 20 nt, Human
uuuccuuugucacuucagga

SEQ ID NO: 131935 - RNA, 21 nt, Human
uuuuuuuuuuuuggauucuca

SEQ ID NO: 131936 - RNA, 22 nt, Human
uuuuuuuuuuuuuuuuuggauu

SEQ ID NO: 131937 - RNA, 20 nt, Human
uuuuuuuuuuuuuuuuuugg

SEQ ID NO: 131938 - RNA, 21 nt, Human
aaacauacaaaggaaagaucc

SEQ ID NO: 131939 - RNA, 27 nt, Human
aaagacacagugaagagcucaaccucc

SEQ ID NO: 131940 - RNA, 18 nt, Human
aacaggaggcaagagccc

SEQ ID NO: 131941 - RNA, 23 nt, Human
aaccaaaaacuaaaaacccuuaa

SEQ ID NO: 131942 - RNA, 19 nt, Human
aaccuccuuccaagcucuc

SEQ ID NO: 131943 - RNA, 23 nt, Human
aagagcucaaccuccuuccaagc

SEQ ID NO: 131944 - RNA, 24 nt, Human
aagcaacccuuuauggcacaaaug

SEQ ID NO: 131945 - RNA, 22 nt, Human
aagccugcccgcacacagccuc

SEQ ID NO: 131946 - RNA, 19 nt, Human
aagcggagggucaggcggg

SEQ ID NO: 131947 - RNA, 18 nt, Human
aagcucagggacaggcaa

SEQ ID NO: 131948 - RNA, 21 nt, Human
aaggagaagacagugauccaa

SEQ ID NO: 131949 - RNA, 23 nt, Human
aaggagaagacagugauccaaag

SEQ ID NO: 131950 - RNA, 24 nt, Human
aaggggccacccagcaaccccggc

SEQ ID NO: 131951 - RNA, 21 nt, Human
aauuuugucacucuucugcca

SEQ ID NO: 131952 - RNA, 22 nt, Human
acaggcaauucaguaacaaaac

SEQ ID NO: 131953 - RNA, 23 nt, Human
acaguggcagcgguguuccaggc

SEQ ID NO: 131954 - RNA, 19 nt, Human
acccagcaaccccggccag

SEQ ID NO: 131955 - RNA, 21 nt, Human
accccggccagcccaaggccc

SEQ ID NO: 131956 - RNA, 24 nt, Human
accccguuuccucacugcccccua

SEQ ID NO: 131957 - RNA, 21 nt, Human
acccgcuuaaucuccaaaccu

SEQ ID NO: 131958 - RNA, 22 nt, Human
acccuggaagagugggccccca

SEQ ID NO: 131959 - RNA, 19 nt, Human
acccugucccgcacacaca

SEQ ID NO: 131960 - RNA, 18 nt, Human
acgcgagcccgccaguga

SEQ ID NO: 131961 - RNA, 18 nt, Human
agaaguggacugugcaug

SEQ ID NO: 131962 - RNA, 21 nt, Human
agacagcacugccucagcaca

SEQ ID NO: 131963 - RNA, 20 nt, Human
agaggaggaggaccccugga

SEQ ID NO: 131964 - RNA, 23 nt, Human
agaguggagagacaggaggcagc

SEQ ID NO: 131965 - RNA, 20 nt, Human
aggaggcaagagcccagggc

SEQ ID NO: 131966 - RNA, 25 nt, Human
aggcagcccugccauguggaccuuc

SEQ ID NO: 131967 - RNA, 22 nt, Human
aggcccaggggcaauucaacag

SEQ ID NO: 131968 - RNA, 23 nt, Human
aggcgcggagaggcggcgggaaa

SEQ ID NO: 131969 - RNA, 22 nt, Human
aggcggcgggaaagagcuucgg

SEQ ID NO: 131970 - RNA, 19 nt, Human
agugcguggcguccaggcu

SEQ ID NO: 131971 - RNA, 26 nt, Human
aguucuggcacaaaggucaagucugu

SEQ ID NO: 131972 - RNA, 20 nt, Human
augcuucagacaggccuccc

SEQ ID NO: 131973 - RNA, 22 nt, Human
auggaguccauccccgagcagc

SEQ ID NO: 131974 - RNA, 24 nt, Human
augugcuaaaaaucgcacagaacc

SEQ ID NO: 131975 - RNA, 20 nt, Human
caaaaccacugcccaggagc

SEQ ID NO: 131976 - RNA, 19 nt, Human
caacagacaggugcuccca

SEQ ID NO: 131977 - RNA, 23 nt, Human
caacaggaggcaagagcccaggg

SEQ ID NO: 131978 - RNA, 24 nt, Human
caaccaaaaacuaaaaacccuuaa

SEQ ID NO: 131979 - RNA, 21 nt, Human
caacccaaccaaaaacuaaaa

SEQ ID NO: 131980 - RNA, 25 nt, Human
caacccaaccaaaaacuaaaaaccc

SEQ ID NO: 131981 - RNA, 20 nt, Human
caaccguugugacaaaguca

SEQ ID NO: 131982 - RNA, 22 nt, Human
caagagcccagggcuccagaaa

SEQ ID NO: 131983 - RNA, 21 nt, Human
cacacacaguucugaggccug

SEQ ID NO: 131984 - RNA, 21 nt, Human
cacacaguucugaggccuggc

SEQ ID NO: 131985 - RNA, 26 nt, Human
caccccuccugcaaugaagcaacccu

SEQ ID NO: 131986 - RNA, 19 nt, Human
cacccugucccgcacacac

SEQ ID NO: 131987 - RNA, 22 nt, Human
cacugcccaggagcaggcaaca

SEQ ID NO: 131988 - RNA, 23 nt, Human
cacugcccaggagcaggcaacag

SEQ ID NO: 131989 - RNA, 19 nt, Human
cacugugccugucccagac

SEQ ID NO: 131990 - RNA, 20 nt, Human
cagagccccaggggagcucc

SEQ ID NO: 131991 - RNA, 21 nt, Human
cagcagagcaucuggggccuc

SEQ ID NO: 131992 - RNA, 18 nt, Human
cagcccaggaugcaucga

SEQ ID NO: 131993 - RNA, 21 nt, Human
cagcucccacugugccugucc

SEQ ID NO: 131994 - RNA, 20 nt, Human
caggaggcagcucagucccc

SEQ ID NO: 131995 - RNA, 21 nt, Human
caggcaacaggguccgucagg

SEQ ID NO: 131996 - RNA, 22 nt, Human
caggcggggcugaaccugggcg

SEQ ID NO: 131997 - RNA, 25 nt, Human
caucuggggccucggccccacuccu

SEQ ID NO: 131998 - RNA, 18 nt, Human
cauucuggaugguggugc

SEQ ID NO: 131999 - RNA, 21 nt, Human
ccaaguaggcccaccaaaaac

SEQ ID NO: 132000 - RNA, 23 nt, Human
ccacacaucucgugccagccacc

SEQ ID NO: 132001 - RNA, 23 nt, Human
ccacccagcaaccccggccagcc

SEQ ID NO: 132002 - RNA, 23 nt, Human
ccagaguggagagacaggaggca

SEQ ID NO: 132003 - RNA, 25 nt, Human
ccagcaaccccggccagcccaaggc

SEQ ID NO: 132004 - RNA, 21 nt, Human
ccagcccaaggcccacccucu

SEQ ID NO: 132005 - RNA, 18 nt, Human
cccacacaucucgugcca

SEQ ID NO: 132006 - RNA, 19 nt, Human
cccagacugggucagcagg

SEQ ID NO: 132007 - RNA, 20 nt, Human
cccaggugcugccccgcugg

SEQ ID NO: 132008 - RNA, 25 nt, Human
cccauaaugcacaugccugcugcuc

SEQ ID NO: 132009 - RNA, 30 nt, Human
cccauaaugcacaugccugcugcucuggaa

SEQ ID NO: 132010 - RNA, 24 nt, Human
cccauaaugcacaugccugcuuug

SEQ ID NO: 132011 - RNA, 22 nt, Human
cccauggggaaggggccaccca

SEQ ID NO: 132012 - RNA, 23 nt, Human
ccccacuccagagcuucuuccug

SEQ ID NO: 132013 - RNA, 20 nt, Human
ccccggccagcccaaggccc

SEQ ID NO: 132014 - RNA, 20 nt, Human
cccggccagcccaaggcccc

SEQ ID NO: 132015 - RNA, 23 nt, Human
cccucacuggccaccuggcaccc

SEQ ID NO: 132016 - RNA, 21 nt, Human
cccuuuauggcacaaaugggg

SEQ ID NO: 132017 - RNA, 21 nt, Human
ccguugugacaaagucaagag

SEQ ID NO: 132018 - RNA, 19 nt, Human
ccguuuccucacugccccc

SEQ ID NO: 132019 - RNA, 20 nt, Human
ccuacgccacacugacgguc

SEQ ID NO: 132020 - RNA, 21 nt, Human
ccuacgccacacugacggucc

SEQ ID NO: 132021 - RNA, 26 nt, Human
ccuacgccacacugacgguccagagg

SEQ ID NO: 132022 - RNA, 23 nt, Human
ccucacugcccccuacgugucug

SEQ ID NO: 132023 - RNA, 21 nt, Human
ccuccugccacagagcugggc

SEQ ID NO: 132024 - RNA, 23 nt, Human
ccucugcagccaguaggggacuc

SEQ ID NO: 132025 - RNA, 26 nt, Human
ccugcaaugaagcaacccuuuauggc

SEQ ID NO: 132026 - RNA, 23 nt, Human
ccugcugcucuggaaccuggcug

SEQ ID NO: 132027 - RNA, 18 nt, Human
ccugggcgaggcgcggag

SEQ ID NO: 132028 - RNA, 24 nt, Human
cgaguccagcucuccucaugcucc

SEQ ID NO: 132029 - RNA, 25 nt, Human
cggccccuaauguuccucugguccc

SEQ ID NO: 132030 - RNA, 20 nt, Human
cggcgggaaagagcuucggc

SEQ ID NO: 132031 - RNA, 22 nt, Human
cguccaggcugggacaggggcc

SEQ ID NO: 132032 - RNA, 19 nt, Human
cguugggguacaggccagg

SEQ ID NO: 132033 - RNA, 22 nt, Human
cuaugcauguuucugaagcccu

SEQ ID NO: 132034 - RNA, 25 nt, Human
cuccugccacagagcugggcugcag

SEQ ID NO: 132035 - RNA, 19 nt, Human
cuccuucucagggcuucag

SEQ ID NO: 132036 - RNA, 21 nt, Human
cugcccaggagcaggcaacag

SEQ ID NO: 132037 - RNA, 21 nt, Human
cugcccugccccagugcaugu

SEQ ID NO: 132038 - RNA, 24 nt, Human
cuggagcacaagguucagcaaggg

SEQ ID NO: 132039 - RNA, 19 nt, Human
cugguccccaaaggaagcg

SEQ ID NO: 132040 - RNA, 19 nt, Human
cugugucaggcaacaaaac

SEQ ID NO: 132041 - RNA, 20 nt, Human
gacugcagcaggccuugcaa

SEQ ID NO: 132042 - RNA, 22 nt, Human
gaggcccgagugcuuguggagg

SEQ ID NO: 132043 - RNA, 22 nt, Human
gcagcaccacagaacugcaugc

SEQ ID NO: 132044 - RNA, 23 nt, Human
gcagggucaccuugauauucaca

SEQ ID NO: 132045 - RNA, 20 nt, Human
gcauguuucugaagcccuca

SEQ ID NO: 132046 - RNA, 23 nt, Human
gcauguuucugaagcccucaagg

SEQ ID NO: 132047 - RNA, 22 nt, Human
gcauucuggaugguggugcaag

SEQ ID NO: 132048 - RNA, 20 nt, Human
gccccagugcaugugggauc

SEQ ID NO: 132049 - RNA, 18 nt, Human
gcccgagugcuuguggag

SEQ ID NO: 132050 - RNA, 20 nt, Human
gcggccagcaaggggcacug

SEQ ID NO: 132051 - RNA, 18 nt, Human
gcucuccuucucagggcu

SEQ ID NO: 132052 - RNA, 21 nt, Human
gcugccccgcuggucuggaaa

SEQ ID NO: 132053 - RNA, 20 nt, Human
ggaaaaaaugggucuccagc

SEQ ID NO: 132054 - RNA, 18 nt, Human
ggaggccggaccgggccg

SEQ ID NO: 132055 - RNA, 20 nt, Human
ggaguggacuuuaaggagau

SEQ ID NO: 132056 - RNA, 20 nt, Human
ggccauggcccacaguaccu

SEQ ID NO: 132057 - RNA, 24 nt, Human
ggcgcggagaggcggcgggaaaga

SEQ ID NO: 132058 - RNA, 22 nt, Human
ggcggcgggaaagagcuucggc

SEQ ID NO: 132059 - RNA, 19 nt, Human
gggcuccagaguggagaga

SEQ ID NO: 132060 - RNA, 19 nt, Human
ggucaggcggggcugaacc

SEQ ID NO: 132061 - RNA, 21 nt, Human
gucagcaggucucucuggaca

SEQ ID NO: 132062 - RNA, 20 nt, Human
guccuagaggaggaggaccc

SEQ ID NO: 132063 - RNA, 18 nt, Human
gugcaugcggccacuggg

SEQ ID NO: 132064 - RNA, 21 nt, Human
gugcguggcguccaggcuggg

SEQ ID NO: 132065 - RNA, 20 nt, Human
uaaaaaaacaggcaucaaga

SEQ ID NO: 132066 - RNA, 21 nt, Human
uaaaaaaacaggcaucaagac

SEQ ID NO: 132067 - RNA, 22 nt, Human
uaccuucuucauucccugccuc

SEQ ID NO: 132068 - RNA, 24 nt, Human
uagugucaacccaaccaaaaacua

SEQ ID NO: 132069 - RNA, 21 nt, Human
uaugcauguuucugaagcccu

SEQ ID NO: 132070 - RNA, 24 nt, Human
ucaagucuccccagggaccggugu

SEQ ID NO: 132071 - RNA, 18 nt, Human
uccacaugggauggaaaa

SEQ ID NO: 132072 - RNA, 21 nt, Human
uccagagccccaggggagcuc

SEQ ID NO: 132073 - RNA, 21 nt, Human
uccagaguggagagacaggag

SEQ ID NO: 132074 - RNA, 22 nt, Human
uccagcaucaugcuccagcagg

SEQ ID NO: 132075 - RNA, 18 nt, Human
uccauccccgagcagcac

SEQ ID NO: 132076 - RNA, 23 nt, Human
ucccacacaucucgugccagcca

SEQ ID NO: 132077 - RNA, 23 nt, Human
ucccagacugggucagcaggucu

SEQ ID NO: 132078 - RNA, 24 nt, Human
uccccaaaggaagcgucccagucc

SEQ ID NO: 132079 - RNA, 25 nt, Human
uccccaaaggaagcgucccaguccc

SEQ ID NO: 132080 - RNA, 23 nt, Human
ucccugaagcagacccacugccu

SEQ ID NO: 132081 - RNA, 23 nt, Human
uccgucaggcaaaagggugccag

SEQ ID NO: 132082 - RNA, 18 nt, Human
uccuagaggaggaggacc

SEQ ID NO: 132083 - RNA, 18 nt, Human
uccucgggcccucacugg

SEQ ID NO: 132084 - RNA, 20 nt, Human
ucggccccacuccagagcuu

SEQ ID NO: 132085 - RNA, 20 nt, Human
ucuccuucucagggcuucag

SEQ ID NO: 132086 - RNA, 20 nt, Human
ucucucuggacagcacacug

SEQ ID NO: 132087 - RNA, 19 nt, Human
ucucuggacagcacacugc

SEQ ID NO: 132088 - RNA, 22 nt, Human
ucucuggacagcacacugcacc

SEQ ID NO: 132089 - RNA, 23 nt, Human
ucuggcacaaaggucaagucugu

SEQ ID NO: 132090 - RNA, 20 nt, Human
ucuuguggccaggacuuccu

SEQ ID NO: 132091 - RNA, 21 nt, Human
ugagugcuuguggaggcccga

SEQ ID NO: 132092 - RNA, 25 nt, Human
ugcaacagacaggugcucccagacc

SEQ ID NO: 132093 - RNA, 23 nt, Human
ugccaggaagggcccccagcccc

SEQ ID NO: 132094 - RNA, 19 nt, Human
ugccaguggccugagugcu

SEQ ID NO: 132095 - RNA, 20 nt, Human
ugccaguggccugagugcuu

SEQ ID NO: 132096 - RNA, 21 nt, Human
ugccauguggaccuucugccu

SEQ ID NO: 132097 - RNA, 20 nt, Human
ugccccagugcaugugggau

SEQ ID NO: 132098 - RNA, 23 nt, Human
ugccuggcccaacgugccagugg

SEQ ID NO: 132099 - RNA, 19 nt, Human
ugcuucguccucugcagcc

SEQ ID NO: 132100 - RNA, 18 nt, Human
uggaaagacacagugaag

SEQ ID NO: 132101 - RNA, 22 nt, Human
uggacugugcauggaguccauc

SEQ ID NO: 132102 - RNA, 22 nt, Human
uggaggcccauggggaaggggc

SEQ ID NO: 132103 - RNA, 19 nt, Human
uggaugguggugcaagaac

SEQ ID NO: 132104 - RNA, 20 nt, Human
uggaugugcuaaaaaucggu

SEQ ID NO: 132105 - RNA, 21 nt, Human
uggcacaaauggggccggggg

SEQ ID NO: 132106 - RNA, 25 nt, Human
uggcagaaggcgggcuguggucucu

SEQ ID NO: 132107 - RNA, 19 nt, Human
uggcgcacacucucggcug

SEQ ID NO: 132108 - RNA, 18 nt, Human
uggcguccaggcugggac

SEQ ID NO: 132109 - RNA, 23 nt, Human
ugggagagggacugauggggugg

SEQ ID NO: 132110 - RNA, 18 nt, Human
uggggacugcagcaggcc

SEQ ID NO: 132111 - RNA, 24 nt, Human
ugggguggggucaggccuccugcc

SEQ ID NO: 132112 - RNA, 24 nt, Human
uguggaccuucugccuggcccaac

SEQ ID NO: 132113 - RNA, 22 nt, Human
uguggccauggcccacaguacc

SEQ ID NO: 132114 - RNA, 19 nt, Human
uuggcagaaggcgggcugu

SEQ ID NO: 132115 - RNA, 19 nt, Human
uuuuggcagaaggcgggcu

SEQ ID NO: 132116 - RNA, 20 nt, Human
agaccagaacaagcacucga

SEQ ID NO: 132117 - RNA, 25 nt, Human
augaagggugacaggcagcuggggu

SEQ ID NO: 132118 - RNA, 25 nt, Human
caagucccagaugaagggugacagg

SEQ ID NO: 132119 - RNA, 22 nt, Human
cacacagagcuugggccuggga

SEQ ID NO: 132120 - RNA, 19 nt, Human
cacagagcuugggccuggg

SEQ ID NO: 132121 - RNA, 18 nt, Human
cacucgagugggccccag

SEQ ID NO: 132122 - RNA, 21 nt, Human
cacucgagugggccccagugc

SEQ ID NO: 132123 - RNA, 23 nt, Human
cagagcuugggccugggagccuc

SEQ ID NO: 132124 - RNA, 18 nt, Human
cagcaggcuggcccagcc

SEQ ID NO: 132125 - RNA, 21 nt, Human
cagcaggcuggcccagccucc

SEQ ID NO: 132126 - RNA, 22 nt, Human
cagcaggcuggcccagccuccc

SEQ ID NO: 132127 - RNA, 19 nt, Human
ccagugcagguugggaugu

SEQ ID NO: 132128 - RNA, 21 nt, Human
cccagccuccccuuuaugaga

SEQ ID NO: 132129 - RNA, 22 nt, Human
cccccagccucacucucugccu

SEQ ID NO: 132130 - RNA, 24 nt, Human
cccccugcgggcagcugggaaggc

SEQ ID NO: 132131 - RNA, 20 nt, Human
cccgaccgcggcgcgucccg

SEQ ID NO: 132132 - RNA, 22 nt, Human
cccgccccuuuuacgacagucc

SEQ ID NO: 132133 - RNA, 21 nt, Human
ccucacucucugccuggcccu

SEQ ID NO: 132134 - RNA, 22 nt, Human
ccucacucucugccuggcccug

SEQ ID NO: 132135 - RNA, 27 nt, Human
ccuggcccugaagcagacagcagcagg

SEQ ID NO: 132136 - RNA, 24 nt, Human
cgacgagcgcccccagcucacguc

SEQ ID NO: 132137 - RNA, 25 nt, Human
cggcugcagcgacgagcgcccccag

SEQ ID NO: 132138 - RNA, 18 nt, Human
cugaagcagacagcagca

SEQ ID NO: 132139 - RNA, 19 nt, Human
cugcagcgacgagcgcccc

SEQ ID NO: 132140 - RNA, 22 nt, Human
cugcaugggggcugcagcugcc

SEQ ID NO: 132141 - RNA, 23 nt, Human
cugggguccaccuggucucuccu

SEQ ID NO: 132142 - RNA, 18 nt, Human
cuugggccugggagccuc

SEQ ID NO: 132143 - RNA, 24 nt, Human
gaacaagcacucgagugggcccca

SEQ ID NO: 132144 - RNA, 18 nt, Human
gaagggugacaggcagcu

SEQ ID NO: 132145 - RNA, 19 nt, Human
gacagcagcaggcuggccc

SEQ ID NO: 132146 - RNA, 23 nt, Human
gagacuauccuaggguuugacag

SEQ ID NO: 132147 - RNA, 18 nt, Human
gccccuuuuacgacaguc

SEQ ID NO: 132148 - RNA, 20 nt, Human
gcugcagcgacgagcgcccc

SEQ ID NO: 132149 - RNA, 21 nt, Human
ggugugagaacccccagccuc

SEQ ID NO: 132150 - RNA, 26 nt, Human
ugaagcagacagcagcaggcuggccc

SEQ ID NO: 132151 - RNA, 24 nt, Human
ugagaccagaacaagcacucgagu

SEQ ID NO: 132152 - RNA, 19 nt, Human
ugcaugggggcugcagcug

SEQ ID NO: 132153 - RNA, 21 nt, Human
uggcccugaagcagacagcag

SEQ ID NO: 132154 - RNA, 21 nt, Human
ugggaaggcaguggccaaagg

SEQ ID NO: 132155 - RNA, 25 nt, Human
ugggagccucuucugcaugggggcu

SEQ ID NO: 132156 - RNA, 22 nt, Human
ugggccccagugcagguuggga

SEQ ID NO: 132157 - RNA, 23 nt, Human
ugggccugggagccucuucugca

SEQ ID NO: 132158 - RNA, 20 nt, Human
uuuuuugggccacugaggca

SEQ ID NO: 132159 - RNA, 20 nt, Human
acuuccguugcuuggaccuc

SEQ ID NO: 132160 - RNA, 20 nt, Human
aguagaguccagggacaggg

SEQ ID NO: 132161 - RNA, 21 nt, Human
auguggcagcaauguacagag

SEQ ID NO: 132162 - RNA, 18 nt, Human
cagagccucgggaguaga

SEQ ID NO: 132163 - RNA, 23 nt, Human
cagaucccaaagggaaacacaag

SEQ ID NO: 132164 - RNA, 22 nt, Human
ccagaaaggcagcuucguagua

SEQ ID NO: 132165 - RNA, 18 nt, Human
ccccaagcuggcaggagu

SEQ ID NO: 132166 - RNA, 18 nt, Human
cucaaggauggccagaaa

SEQ ID NO: 132167 - RNA, 21 nt, Human
gcagcaauguacagagccucg

SEQ ID NO: 132168 - RNA, 18 nt, Human
gccagaaaggcagcuucg

SEQ ID NO: 132169 - RNA, 27 nt, Human
gggaacagugagguggugccgguaccc

SEQ ID NO: 132170 - RNA, 22 nt, Human
gggaguagaguccagggacagg

SEQ ID NO: 132171 - RNA, 20 nt, Human
gguaggccugcuucagcugc

SEQ ID NO: 132172 - RNA, 21 nt, Human
gguggguucaaggcuggcuug

SEQ ID NO: 132173 - RNA, 20 nt, Human
gguguguguaugugugugcg

SEQ ID NO: 132174 - RNA, 22 nt, Human
uauguguuuuggggugugugua

SEQ ID NO: 132175 - RNA, 18 nt, Human
uggcaggaguauguggca

SEQ ID NO: 132176 - RNA, 21 nt, Human
ugggguguguguaugugugug

SEQ ID NO: 132177 - RNA, 18 nt, Human
ugugagggugaaggaaca

SEQ ID NO: 132178 - RNA, 19 nt, Human
uguguaugugugugcgcau

SEQ ID NO: 132179 - RNA, 18 nt, Human
ugugugcgcauggggaac

SEQ ID NO: 132180 - RNA, 19 nt, Human
uguguguaugugugugcgc

SEQ ID NO: 132181 - RNA, 21 nt, Human
uguguguaugugugugcgcau

SEQ ID NO: 132182 - RNA, 18 nt, Human
aaacugauacaaucauuu

SEQ ID NO: 132183 - RNA, 21 nt, Human
aacagugaucuaggcuguugu

SEQ ID NO: 132184 - RNA, 30 nt, Human
aacccauuucucucaagcauuguuuucugg

SEQ ID NO: 132185 - RNA, 20 nt, Human
aacucacucgcuuuccagca

SEQ ID NO: 132186 - RNA, 24 nt, Human
aagcaaaauaaaaaccgcguucua

SEQ ID NO: 132187 - RNA, 24 nt, Human
aaguuucuccucaagucauagguc

SEQ ID NO: 132188 - RNA, 20 nt, Human
aauuaaucacaggaacccua

SEQ ID NO: 132189 - RNA, 21 nt, Human
acuauguauauauagcaaggu

SEQ ID NO: 132190 - RNA, 27 nt, Human
agcuuaguaacaaaaacuguuaaacca

SEQ ID NO: 132191 - RNA, 21 nt, Human
aucacaaaauuaaucacagga

SEQ ID NO: 132192 - RNA, 20 nt, Human
aucauuuacuuccuucaagu

SEQ ID NO: 132193 - RNA, 20 nt, Human
augaaacacuaaaagaaaag

SEQ ID NO: 132194 - RNA, 19 nt, Human
augcagaguggagagaaac

SEQ ID NO: 132195 - RNA, 24 nt, Human
cacacugagaaucacguuucccau

SEQ ID NO: 132196 - RNA, 23 nt, Human
cacaggaacccuaaauuugcucc

SEQ ID NO: 132197 - RNA, 19 nt, Human
cacugagaaucacguuucc

SEQ ID NO: 132198 - RNA, 23 nt, Human
cagcaugagaaaaccuuaugccu

SEQ ID NO: 132199 - RNA, 27 nt, Human
cagcaugagaaaaccuuaugccugaua

SEQ ID NO: 132200 - RNA, 25 nt, Human
caucacaaaauuaaucacaggaacc

SEQ ID NO: 132201 - RNA, 21 nt, Human
caugcaccaaaaauaugcagu

SEQ ID NO: 132202 - RNA, 23 nt, Human
ccagcauauguguuccauggccc

SEQ ID NO: 132203 - RNA, 20 nt, Human
cuccucaagucauaggucac

SEQ ID NO: 132204 - RNA, 21 nt, Human
cucucaagcauuguuuucuga

SEQ ID NO: 132205 - RNA, 24 nt, Human
cugauacacugauucuaaaaggga

SEQ ID NO: 132206 - RNA, 18 nt, Human
gaaaacauaaaacaugca

SEQ ID NO: 132207 - RNA, 20 nt, Human
gcagaguggagagaaacuaa

SEQ ID NO: 132208 - RNA, 21 nt, Human
gcccaauuaugcuaauucaau

SEQ ID NO: 132209 - RNA, 19 nt, Human
gggaaacacauugauuagg

SEQ ID NO: 132210 - RNA, 23 nt, Human
uaaaucaugcaguucaggcacuc

SEQ ID NO: 132211 - RNA, 24 nt, Human
uaacugauccaugaaaaauuacac

SEQ ID NO: 132212 - RNA, 18 nt, Human
uaauaauuggaaucacac

SEQ ID NO: 132213 - RNA, 19 nt, Human
uaaugggcaacucacucgc

SEQ ID NO: 132214 - RNA, 24 nt, Human
uaaugggcaacucacucgcuuucc

SEQ ID NO: 132215 - RNA, 22 nt, Human
uacagguacccauuuauacuag

SEQ ID NO: 132216 - RNA, 25 nt, Human
uauguauauauagcaagguauugua

SEQ ID NO: 132217 - RNA, 22 nt, Human
ucaucuauugagcuuugauugu

SEQ ID NO: 132218 - RNA, 20 nt, Human
ucccaugguauuuccuuuuu

SEQ ID NO: 132219 - RNA, 20 nt, Human
ucucaugcagaaaggaacaa

SEQ ID NO: 132220 - RNA, 21 nt, Human
ucuucgaauuaaaaguuucuc

SEQ ID NO: 132221 - RNA, 19 nt, Human
ugaaaaaagcaagaaauca

SEQ ID NO: 132222 - RNA, 18 nt, Human
ugauucgcuuccaagagc

SEQ ID NO: 132223 - RNA, 21 nt, Human
ugcaguaucacuucagguaaa

SEQ ID NO: 132224 - RNA, 24 nt, Human
ugcaguucaggcacucguuuuccu

SEQ ID NO: 132225 - RNA, 21 nt, Human
ugcaugcaccaaaaauaugca

SEQ ID NO: 132226 - RNA, 24 nt, Human
ugccaugaacaccuucaacaguga

SEQ ID NO: 132227 - RNA, 21 nt, Human
uggaauuaaaaagaaaacuaa

SEQ ID NO: 132228 - RNA, 18 nt, Human
uggaguaggugaggagga

SEQ ID NO: 132229 - RNA, 20 nt, Human
ugugaaaggugagaauuuua

SEQ ID NO: 132230 - RNA, 24 nt, Human
uuaaaaguuucuccucaagucaua

SEQ ID NO: 132231 - RNA, 26 nt, Human
uuaaugaaacacuaaaagaaaaguac

SEQ ID NO: 132232 - RNA, 22 nt, Human
uuccagcauauguguuccaugg

SEQ ID NO: 132233 - RNA, 20 nt, Human
uuccaugauuuugcaugagc

SEQ ID NO: 132234 - RNA, 22 nt, Human
uuguguugucuggcuuauuguc

SEQ ID NO: 132235 - RNA, 22 nt, Human
uuugaaaugucauaaagauggg

SEQ ID NO: 132236 - RNA, 21 nt, Human
aaaaauguauacccauuauac

SEQ ID NO: 132237 - RNA, 22 nt, Human
aacugaaggcuggcugguuugg

SEQ ID NO: 132238 - RNA, 24 nt, Human
aauguauacccauuauacuacuag

SEQ ID NO: 132239 - RNA, 23 nt, Human
acugaaggcuggcugguuugggg

SEQ ID NO: 132240 - RNA, 21 nt, Human
acuuaucuguuucucuuuugg

SEQ ID NO: 132241 - RNA, 22 nt, Human
agcucagaaccuauaacuuaca

SEQ ID NO: 132242 - RNA, 20 nt, Human
caaaaauaagacaugagaca

SEQ ID NO: 132243 - RNA, 22 nt, Human
caaaguuuucacucccucaucc

SEQ ID NO: 132244 - RNA, 24 nt, Human
cagaggaugcucacaauuaaccau

SEQ ID NO: 132245 - RNA, 21 nt, Human
cugaaggcuggcugguuuggg

SEQ ID NO: 132246 - RNA, 22 nt, Human
cuuaaggggcaugcugcagagg

SEQ ID NO: 132247 - RNA, 22 nt, Human
gaaggcuggcugguuuggggau

SEQ ID NO: 132248 - RNA, 19 nt, Human
gauucuaugcaaaguuuuc

SEQ ID NO: 132249 - RNA, 24 nt, Human
uaauuugaucuuuccacccacacc

SEQ ID NO: 132250 - RNA, 18 nt, Human
uacacugguguuauaaaa

SEQ ID NO: 132251 - RNA, 19 nt, Human
uaccucgcgcggguggagg

SEQ ID NO: 132252 - RNA, 21 nt, Human
uacuacuagugaaauuaagag

SEQ ID NO: 132253 - RNA, 24 nt, Human
ucccacucucaaaacagucauaac

SEQ ID NO: 132254 - RNA, 19 nt, Human
ucuccuuuuggggguuccu

SEQ ID NO: 132255 - RNA, 20 nt, Human
ugagacagcacauacuucag

SEQ ID NO: 132256 - RNA, 21 nt, Human
ugcaaaguuuucacucccuca

SEQ ID NO: 132257 - RNA, 18 nt, Human
uggcugguuuggggaugc

SEQ ID NO: 132258 - RNA, 18 nt, Human
uguguccaucauaugcau

SEQ ID NO: 132259 - RNA, 20 nt, Human
uuaauacuauucauuugaag

SEQ ID NO: 132260 - RNA, 22 nt, Human
uuguagaaaaucuuaaggggca

SEQ ID NO: 132261 - RNA, 25 nt, Human
uuugaaguauuuugcugaaaaaagg

SEQ ID NO: 132262 - RNA, 18 nt, Human
aaacauguagacaccagg

SEQ ID NO: 132263 - RNA, 21 nt, Human
aagaggaaccgagagacagaa

SEQ ID NO: 132264 - RNA, 24 nt, Human
aagcuggccucuggccgugacaca

SEQ ID NO: 132265 - RNA, 21 nt, Human
acagaagggggaccgaagcug

SEQ ID NO: 132266 - RNA, 20 nt, Human
acccacuguugaaacagaau

SEQ ID NO: 132267 - RNA, 19 nt, Human
agaaguccuggcucuuccu

SEQ ID NO: 132268 - RNA, 18 nt, Human
agacagaagggggaccga

SEQ ID NO: 132269 - RNA, 21 nt, Human
agaggaaccgagagacagaag

SEQ ID NO: 132270 - RNA, 21 nt, Human
agcuggccucuggcgucuucc

SEQ ID NO: 132271 - RNA, 23 nt, Human
agcuggccucuggcgucuucccg

SEQ ID NO: 132272 - RNA, 19 nt, Human
aggaaacuugcagggcugg

SEQ ID NO: 132273 - RNA, 20 nt, Human
augcucugagagccggaggc

SEQ ID NO: 132274 - RNA, 24 nt, Human
caaaggacgaccaagaaaccaacg

SEQ ID NO: 132275 - RNA, 18 nt, Human
caagugcccaccgacggc

SEQ ID NO: 132276 - RNA, 28 nt, Human
caagugcccaccgacggcgcagaaaccc

SEQ ID NO: 132277 - RNA, 21 nt, Human
cacaaccucaugggcccuaag

SEQ ID NO: 132278 - RNA, 18 nt, Human
caccauaggcaggaaacc

SEQ ID NO: 132279 - RNA, 30 nt, Human
cacccugugcucggaguucagcagcuccaa

SEQ ID NO: 132280 - RNA, 21 nt, Human
cacucaaguguauacagcagc

SEQ ID NO: 132281 - RNA, 25 nt, Human
cagcagcagcaggcaccucucagaa

SEQ ID NO: 132282 - RNA, 19 nt, Human
cagcagcuccaaagcuguc

SEQ ID NO: 132283 - RNA, 22 nt, Human
cagcaggcaccucucagaagau

SEQ ID NO: 132284 - RNA, 19 nt, Human
cagccugcuccucgcgagc

SEQ ID NO: 132285 - RNA, 24 nt, Human
cagggcugguagaaagaaaggggg

SEQ ID NO: 132286 - RNA, 19 nt, Human
caguuucuccgcucucccu

SEQ ID NO: 132287 - RNA, 24 nt, Human
ccacaaccucaugggcccuaaguc

SEQ ID NO: 132288 - RNA, 21 nt, Human
ccagagcuccuucccuuggcc

SEQ ID NO: 132289 - RNA, 23 nt, Human
ccagguguucacagaacuaagaa

SEQ ID NO: 132290 - RNA, 23 nt, Human
cccaguuucuccgcucucccucc

SEQ ID NO: 132291 - RNA, 18 nt, Human
ccgagagacagaaggggg

SEQ ID NO: 132292 - RNA, 21 nt, Human
ccgcggagaccaggcugccag

SEQ ID NO: 132293 - RNA, 23 nt, Human
ccuggaaaauaacaagugcccac

SEQ ID NO: 132294 - RNA, 23 nt, Human
cgaccaagaaaccaacgugcgcc

SEQ ID NO: 132295 - RNA, 22 nt, Human
cgacggcgcagaaacccaagaa

SEQ ID NO: 132296 - RNA, 19 nt, Human
cgcuccuucuucgcgguuu

SEQ ID NO: 132297 - RNA, 19 nt, Human
cgcucucccucccaggugu

SEQ ID NO: 132298 - RNA, 22 nt, Human
cgcucucccucccagguguuca

SEQ ID NO: 132299 - RNA, 21 nt, Human
cuggaaccagagcuccuuccc

SEQ ID NO: 132300 - RNA, 21 nt, Human
cugugcucggaguucagcagc

SEQ ID NO: 132301 - RNA, 21 nt, Human
gaccaagaaaccaacgugcgc

SEQ ID NO: 132302 - RNA, 18 nt, Human
gagaagguuccuggaaaa

SEQ ID NO: 132303 - RNA, 18 nt, Human
gaggcccagcccagggcc

SEQ ID NO: 132304 - RNA, 18 nt, Human
gccugugggaauguggag

SEQ ID NO: 132305 - RNA, 22 nt, Human
gcugccaggcugugguugguag

SEQ ID NO: 132306 - RNA, 21 nt, Human
ggaaauacagcuuuccacagc

SEQ ID NO: 132307 - RNA, 20 nt, Human
ggcccuaaguccauucaaaa

SEQ ID NO: 132308 - RNA, 20 nt, Human
ggcgcagaaacccaagaaug

SEQ ID NO: 132309 - RNA, 22 nt, Human
gggaggaaagaggaaccgagag

SEQ ID NO: 132310 - RNA, 21 nt, Human
gggggaugcagccccaguggg

SEQ ID NO: 132311 - RNA, 26 nt, Human
gggugguuuuuuuuuuccuucccuuu

SEQ ID NO: 132312 - RNA, 20 nt, Human
ggugccgcggagaccaggcu

SEQ ID NO: 132313 - RNA, 22 nt, Human
gugugcacauaaauugugugug

SEQ ID NO: 132314 - RNA, 23 nt, Human
guguguaugugugugugugugug

SEQ ID NO: 132315 - RNA, 25 nt, Human
gugugugcaugugugagugugcaca

SEQ ID NO: 132316 - RNA, 22 nt, Human
uaaaucccaguuucuccgcucu

SEQ ID NO: 132317 - RNA, 21 nt, Human
uaagccagccacaaccucaug

SEQ ID NO: 132318 - RNA, 19 nt, Human
uaccacaucuaaggugugc

SEQ ID NO: 132319 - RNA, 23 nt, Human
uacuugggaggaaagaggaaccc

SEQ ID NO: 132320 - RNA, 18 nt, Human
uagaaagaaagggggauu

SEQ ID NO: 132321 - RNA, 23 nt, Human
uaugugugugugugugugcaugu

SEQ ID NO: 132322 - RNA, 18 nt, Human
uccaugaggaaacuugca

SEQ ID NO: 132323 - RNA, 19 nt, Human
ucccagguguucacagaac

SEQ ID NO: 132324 - RNA, 18 nt, Human
ucccgaaggguggcuuug

SEQ ID NO: 132325 - RNA, 19 nt, Human
uccuuaggcaacauccucc

SEQ ID NO: 132326 - RNA, 21 nt, Human
uccuuaggcaacauccuccug

SEQ ID NO: 132327 - RNA, 27 nt, Human
ucucaccauaggcaggaaaccugcagc

SEQ ID NO: 132328 - RNA, 18 nt, Human
ucucucuugguuuagcug

SEQ ID NO: 132329 - RNA, 25 nt, Human
ucuuggagccgccucuaagcaaaca

SEQ ID NO: 132330 - RNA, 22 nt, Human
ucuugguuuagcugguguuugg

SEQ ID NO: 132331 - RNA, 25 nt, Human
ugaaguggaggcccagcccagggcc

SEQ ID NO: 132332 - RNA, 24 nt, Human
ugauggaguuuuguucacuaggcu

SEQ ID NO: 132333 - RNA, 22 nt, Human
ugcaugugugagugugcacaua

SEQ ID NO: 132334 - RNA, 21 nt, Human
ugccaaggauuaugcucugag

SEQ ID NO: 132335 - RNA, 19 nt, Human
ugccaggcugugguuggua

SEQ ID NO: 132336 - RNA, 20 nt, Human
ugcccaccgacggcgcagaa

SEQ ID NO: 132337 - RNA, 21 nt, Human
ugcuaugcaggcagcucuggg

SEQ ID NO: 132338 - RNA, 18 nt, Human
ugcucugagagccggagg

SEQ ID NO: 132339 - RNA, 19 nt, Human
ugcuuucucucuugguuua

SEQ ID NO: 132340 - RNA, 24 nt, Human
uggaaaauaacaagugcccaccga

SEQ ID NO: 132341 - RNA, 23 nt, Human
uggaaauacagcuuuccacagcc

SEQ ID NO: 132342 - RNA, 21 nt, Human
uggaggcccagcccagggccu

SEQ ID NO: 132343 - RNA, 19 nt, Human
uggccucuggcgucuuccc

SEQ ID NO: 132344 - RNA, 23 nt, Human
uggccucuggcgucuucccgccu

SEQ ID NO: 132345 - RNA, 20 nt, Human
ugggaggaaagaggaaccga

SEQ ID NO: 132346 - RNA, 22 nt, Human
ugggcccuaaguccauucaaaa

SEQ ID NO: 132347 - RNA, 21 nt, Human
uguaagccuuucaggagacuu

SEQ ID NO: 132348 - RNA, 23 nt, Human
uguacccacuguugaaacagaau

SEQ ID NO: 132349 - RNA, 24 nt, Human
ugugcaaauucucuggaaccagag

SEQ ID NO: 132350 - RNA, 18 nt, Human
ugugcacauaaauugugu

SEQ ID NO: 132351 - RNA, 20 nt, Human
ugugcacauaaauugugugu

SEQ ID NO: 132352 - RNA, 22 nt, Human
ugugcauuauaguuucuugcuu

SEQ ID NO: 132353 - RNA, 23 nt, Human
uguggagguugcugccuaagcca

SEQ ID NO: 132354 - RNA, 20 nt, Human
uguguaugugugugugugug

SEQ ID NO: 132355 - RNA, 21 nt, Human
uguguaugugugugugugugu

SEQ ID NO: 132356 - RNA, 20 nt, Human
ugugugugugugugcaugug

SEQ ID NO: 132357 - RNA, 20 nt, Human
ugugugugugugugugcaug

SEQ ID NO: 132358 - RNA, 21 nt, Human
ugugugugugugugugcaugu

SEQ ID NO: 132359 - RNA, 18 nt, Human
uucacuaggcugaagugg

SEQ ID NO: 132360 - RNA, 22 nt, Human
uuccucaccaggcaacacuugg

SEQ ID NO: 132361 - RNA, 22 nt, Human
uuccuucccuuuuuacacaaua

SEQ ID NO: 132362 - RNA, 21 nt, Human
uucuccgcucucccucccagg

SEQ ID NO: 132363 - RNA, 22 nt, Human
uugcagggcugguagaaagaaa

SEQ ID NO: 132364 - RNA, 20 nt, Human
uugguagcgccggggucuuc

SEQ ID NO: 132365 - RNA, 18 nt, Human
uuucuccgcucucccucc

SEQ ID NO: 132366 - RNA, 19 nt, Human
uuucuugcuuucucucuug

SEQ ID NO: 132367 - RNA, 20 nt, Human
uuuuguucacuaggcugaag

SEQ ID NO: 132368 - RNA, 18 nt, Human
aaaaaaaccaaugcauag

SEQ ID NO: 132369 - RNA, 20 nt, Human
aaaaggcaaagauggcuaca

SEQ ID NO: 132370 - RNA, 23 nt, Human
aacauuguuagagugcuccauuu

SEQ ID NO: 132371 - RNA, 25 nt, Human
aagagaagagauaauauuuuucuuu

SEQ ID NO: 132372 - RNA, 21 nt, Human
aagcacagacaucucccaugc

SEQ ID NO: 132373 - RNA, 24 nt, Human
aagcacagacaucucccaugccac

SEQ ID NO: 132374 - RNA, 30 nt, Human
aagcauccuucugaaugauccaggcauccc

SEQ ID NO: 132375 - RNA, 19 nt, Human
aaguagauauuuggacaga

SEQ ID NO: 132376 - RNA, 19 nt, Human
aaugaaaaccaaaaaccua

SEQ ID NO: 132377 - RNA, 21 nt, Human
acaacaagccuuuguucuugg

SEQ ID NO: 132378 - RNA, 18 nt, Human
accacgccuggcuaauuu

SEQ ID NO: 132379 - RNA, 19 nt, Human
accgcguguuagccaggau

SEQ ID NO: 132380 - RNA, 20 nt, Human
agcaaaaggcaaagauggcu

SEQ ID NO: 132381 - RNA, 18 nt, Human
agcagccugggcugaccc

SEQ ID NO: 132382 - RNA, 18 nt, Human
agcuccgccuccuggguu

SEQ ID NO: 132383 - RNA, 18 nt, Human
agggggaggauggagcag

SEQ ID NO: 132384 - RNA, 24 nt, Human
agguagauucuugcaggagagaga

SEQ ID NO: 132385 - RNA, 18 nt, Human
aguaaugaaaaccaaaaa

SEQ ID NO: 132386 - RNA, 29 nt, Human
aguaaugaaaaccaaaaaccuaaaagaaa

SEQ ID NO: 132387 - RNA, 18 nt, Human
aguggcauggucucaggu

SEQ ID NO: 132388 - RNA, 24 nt, Human
aguggugugaucucagcucacugc

SEQ ID NO: 132389 - RNA, 23 nt, Human
aguugacauuauccauguggcac

SEQ ID NO: 132390 - RNA, 18 nt, Human
auccucccacuucuucag

SEQ ID NO: 132391 - RNA, 22 nt, Human
augaaaaccaaaaaccuaaaag

SEQ ID NO: 132392 - RNA, 22 nt, Human
auggggcuccucucaccacugu

SEQ ID NO: 132393 - RNA, 19 nt, Human
auugcaguggugugaucuc

SEQ ID NO: 132394 - RNA, 21 nt, Human
caauuuaaacagcacuuaaaa

SEQ ID NO: 132395 - RNA, 21 nt, Human
caccucaccauuccucagaga

SEQ ID NO: 132396 - RNA, 22 nt, Human
cacgccauucuccugccucagc

SEQ ID NO: 132397 - RNA, 19 nt, Human
cacuucuucagcuuuccca

SEQ ID NO: 132398 - RNA, 24 nt, Human
cacuucuucagcuuucccaguagc

SEQ ID NO: 132399 - RNA, 24 nt, Human
cagagucuugcuuugucgcccagg

SEQ ID NO: 132400 - RNA, 21 nt, Human
cagccugggcugaccccuggg

SEQ ID NO: 132401 - RNA, 20 nt, Human
cagggagggcagaugugaua

SEQ ID NO: 132402 - RNA, 24 nt, Human
caguagcugggacuacaggugugc

SEQ ID NO: 132403 - RNA, 22 nt, Human
ccaagcacagacaucucccaug

SEQ ID NO: 132404 - RNA, 24 nt, Human
ccaagcacagacaucucccaugcc

SEQ ID NO: 132405 - RNA, 20 nt, Human
ccaagcuauccucccacuuc

SEQ ID NO: 132406 - RNA, 18 nt, Human
ccaucagcuucuuccagg

SEQ ID NO: 132407 - RNA, 23 nt, Human
ccauguggcacuucccagcuccu

SEQ ID NO: 132408 - RNA, 21 nt, Human
cccauacauagaaaauggggu

SEQ ID NO: 132409 - RNA, 20 nt, Human
ccugggcccaagcuauccuc

SEQ ID NO: 132410 - RNA, 24 nt, Human
ccuguaaccacaguucccacacag

SEQ ID NO: 132411 - RNA, 20 nt, Human
ccuuuguucuugggucaagg

SEQ ID NO: 132412 - RNA, 19 nt, Human
cgccuccuggguucacgcc

SEQ ID NO: 132413 - RNA, 21 nt, Human
cgcguguuagccaggaugguc

SEQ ID NO: 132414 - RNA, 20 nt, Human
cggagcuguacagacagccc

SEQ ID NO: 132415 - RNA, 24 nt, Human
cucagccucccgaguagcugggac

SEQ ID NO: 132416 - RNA, 22 nt, Human
cucagcucacugccagcuccgc

SEQ ID NO: 132417 - RNA, 19 nt, Human
cucauacaacaagccuuug

SEQ ID NO: 132418 - RNA, 19 nt, Human
cuccagguauccugccucc

SEQ ID NO: 132419 - RNA, 19 nt, Human
cuccucucaccacuguauc

SEQ ID NO: 132420 - RNA, 21 nt, Human
cuccuggguucacgccauucu

SEQ ID NO: 132421 - RNA, 21 nt, Human
cugaccccuggguuaccucuc

SEQ ID NO: 132422 - RNA, 19 nt, Human
cugaccccuggguuaccuu

SEQ ID NO: 132423 - RNA, 19 nt, Human
cugagguaccuccaagcac

SEQ ID NO: 132424 - RNA, 23 nt, Human
cugccagcuccgccuccuggguu

SEQ ID NO: 132425 - RNA, 23 nt, Human
cugccucagccucccgaguagcu

SEQ ID NO: 132426 - RNA, 24 nt, Human
cuggauugcaguggugugaucuca

SEQ ID NO: 132427 - RNA, 22 nt, Human
cuugggucaagggcuacuugga

SEQ ID NO: 132428 - RNA, 23 nt, Human
cuugggucaagggcuacuuggag

SEQ ID NO: 132429 - RNA, 23 nt, Human
gaaaaugggguuaucaaguacga

SEQ ID NO: 132430 - RNA, 25 nt, Human
gacagagucuugcuuugucgcccag

SEQ ID NO: 132431 - RNA, 24 nt, Human
gcccaggcuggauugcaguggugu

SEQ ID NO: 132432 - RNA, 20 nt, Human
gccucagccucccgaguagc

SEQ ID NO: 132433 - RNA, 24 nt, Human
gccuggcuaauuuuuuuguauuuu

SEQ ID NO: 132434 - RNA, 18 nt, Human
gcuacagcccagcagccu

SEQ ID NO: 132435 - RNA, 18 nt, Human
gcuccuauauaaugaaac

SEQ ID NO: 132436 - RNA, 22 nt, Human
ggcuggauugcaguggugugau

SEQ ID NO: 132437 - RNA, 21 nt, Human
ggugagggggacaugcagaga

SEQ ID NO: 132438 - RNA, 22 nt, Human
gucuugauauauuuagucuuag

SEQ ID NO: 132439 - RNA, 24 nt, Human
gucuugcuuugucgcccaggcugg

SEQ ID NO: 132440 - RNA, 24 nt, Human
uaaaauggggcuccucucaccacu

SEQ ID NO: 132441 - RNA, 21 nt, Human
uaagagagguaccuguaagua

SEQ ID NO: 132442 - RNA, 21 nt, Human
uacaggugugcaccaccacac

SEQ ID NO: 132443 - RNA, 18 nt, Human
uacaguagaauuguaugg

SEQ ID NO: 132444 - RNA, 18 nt, Human
uaccccauacauagaaaa

SEQ ID NO: 132445 - RNA, 23 nt, Human
uaccgcguguuagccaggauggu

SEQ ID NO: 132446 - RNA, 22 nt, Human
uaccuccaagcacagacaucuc

SEQ ID NO: 132447 - RNA, 20 nt, Human
uagaaggccuucagacaauc

SEQ ID NO: 132448 - RNA, 24 nt, Human
uagagugcuccauuuccuguaacc

SEQ ID NO: 132449 - RNA, 23 nt, Human
uaucaaguacgaccuuuggaccu

SEQ ID NO: 132450 - RNA, 19 nt, Human
uaugguacagggaaaaaaa

SEQ ID NO: 132451 - RNA, 23 nt, Human
ucacugccagcuccgccuccugg

SEQ ID NO: 132452 - RNA, 24 nt, Human
ucacugccagcuccgccuccuggg

SEQ ID NO: 132453 - RNA, 21 nt, Human
ucagagauauagcacacaagu

SEQ ID NO: 132454 - RNA, 23 nt, Human
ucagccucccgaguagcugggac

SEQ ID NO: 132455 - RNA, 23 nt, Human
ucagcuuucccaguagcugggac

SEQ ID NO: 132456 - RNA, 22 nt, Human
ucccaguagcugggacuacagg

SEQ ID NO: 132457 - RNA, 24 nt, Human
ucccaguagcugggacuacaggug

SEQ ID NO: 132458 - RNA, 22 nt, Human
ucccaugccaccucaccauucc

SEQ ID NO: 132459 - RNA, 23 nt, Human
ucccgaguagcugggacaacagg

SEQ ID NO: 132460 - RNA, 24 nt, Human
ucccgaguagcugggacaacaggu

SEQ ID NO: 132461 - RNA, 20 nt, Human
uccugggcccaagcuauccu

SEQ ID NO: 132462 - RNA, 24 nt, Human
uccuggguucacgccauucuccug

SEQ ID NO: 132463 - RNA, 22 nt, Human
ucgcccaggcuggauugcagug

SEQ ID NO: 132464 - RNA, 24 nt, Human
ucuauugcagcaaaaggcaaagau

SEQ ID NO: 132465 - RNA, 24 nt, Human
ucuccugccucagccucccgagua

SEQ ID NO: 132466 - RNA, 22 nt, Human
ucugagguaccuccaagcacag

SEQ ID NO: 132467 - RNA, 22 nt, Human
ucuugcuuugucgcccaggcug

SEQ ID NO: 132468 - RNA, 23 nt, Human
ucuugcuuugucgcccaggcugg

SEQ ID NO: 132469 - RNA, 24 nt, Human
ucuugcuuugucgcccaggcugga

SEQ ID NO: 132470 - RNA, 24 nt, Human
ucuugggucaagggcuacuuggag

SEQ ID NO: 132471 - RNA, 19 nt, Human
ugaccccuggguuaccucu

SEQ ID NO: 132472 - RNA, 23 nt, Human
ugcagcaaaaggcaaagauggcu

SEQ ID NO: 132473 - RNA, 19 nt, Human
ugcagggagggcagaugug

SEQ ID NO: 132474 - RNA, 22 nt, Human
ugcaguggugugaucucagcuc

SEQ ID NO: 132475 - RNA, 21 nt, Human
ugccauuuauacgaacauccu

SEQ ID NO: 132476 - RNA, 24 nt, Human
ugccucagccucccgaguagcugg

SEQ ID NO: 132477 - RNA, 24 nt, Human
ugcuuugucgcccaggcuggauug

SEQ ID NO: 132478 - RNA, 19 nt, Human
uggaagugguuuuacaguu

SEQ ID NO: 132479 - RNA, 19 nt, Human
uggauugcaguggugugau

SEQ ID NO: 132480 - RNA, 19 nt, Human
uggauugcaguggugugau

SEQ ID NO: 132481 - RNA, 22 nt, Human
uggauugcaguggugugaucuc

SEQ ID NO: 132482 - RNA, 28 nt, Human
uggauugcaguggugugauggcucuagc

SEQ ID NO: 132483 - RNA, 25 nt, Human
uggcagguuuagauguuacaauucu

SEQ ID NO: 132484 - RNA, 21 nt, Human
ugggacuacaggugugcacca

SEQ ID NO: 132485 - RNA, 24 nt, Human
ugggacuacaggugugcaccacca

SEQ ID NO: 132486 - RNA, 21 nt, Human
ugggccucuguuuaauccuuu

SEQ ID NO: 132487 - RNA, 20 nt, Human
uggguucacgccauucuccu

SEQ ID NO: 132488 - RNA, 25 nt, Human
uggugugaucucagcucacugccag

SEQ ID NO: 132489 - RNA, 26 nt, Human
uguaaagagaagagauaauauuuuuc

SEQ ID NO: 132490 - RNA, 21 nt, Human
ugucgcccaggcuggauugca

SEQ ID NO: 132491 - RNA, 21 nt, Human
ugugaucucagcucacugcca

SEQ ID NO: 132492 - RNA, 21 nt, Human
uguggcacuucccagcuccua

SEQ ID NO: 132493 - RNA, 21 nt, Human
uuacaauucuaacuaucugac

SEQ ID NO: 132494 - RNA, 18 nt, Human
uuaguagagaugauguuu

SEQ ID NO: 132495 - RNA, 19 nt, Human
uuccaagucaauuagggug

SEQ ID NO: 132496 - RNA, 23 nt, Human
uuccacaaaucuccagguauccu

SEQ ID NO: 132497 - RNA, 22 nt, Human
uucccaguagcugggacuacag

SEQ ID NO: 132498 - RNA, 19 nt, Human
uuccucagagauauagcac

SEQ ID NO: 132499 - RNA, 24 nt, Human
uuuagucuuagaaauggaaguggu

SEQ ID NO: 132500 - RNA, 19 nt, Human
uuugcuguuuuuuuuuucc

SEQ ID NO: 132501 - RNA, 20 nt, Human
uuuuguauuuuuaguagaga

SEQ ID NO: 132502 - RNA, 21 nt, Human
uuuuuaguagagaugauguuu

SEQ ID NO: 132503 - RNA, 21 nt, Human
uuuuuguauuuuuaguagaga

SEQ ID NO: 132504 - RNA, 21 nt, Human
uuuuuuguauuuuuaguagag

SEQ ID NO: 132505 - RNA, 20 nt, Human
uuuuuuuuuuugagacagag

SEQ ID NO: 132506 - RNA, 24 nt, Human
uuuuuuuuuuuugagacagagucu

SEQ ID NO: 132507 - RNA, 21 nt, Human
aacaaggcuggcgggagcaga

SEQ ID NO: 132508 - RNA, 22 nt, Human
acaaggcuggcgggagcagaga

SEQ ID NO: 132509 - RNA, 21 nt, Human
agaccaccugaaaacaaggcu

SEQ ID NO: 132510 - RNA, 19 nt, Human
ccacugugugacguggagc

SEQ ID NO: 132511 - RNA, 22 nt, Human
cuccagaccaccugaaaacaag

SEQ ID NO: 132512 - RNA, 26 nt, Human
gccacugugugacguggagcugccgc

SEQ ID NO: 132513 - RNA, 21 nt, Human
ggcccgagcggcccgagcccc

SEQ ID NO: 132514 - RNA, 19 nt, Human
gggagcagagauggcucga

SEQ ID NO: 132515 - RNA, 19 nt, Human
ugggaagguaacuucaaua

SEQ ID NO: 132516 - RNA, 24 nt, Human
agaaggcuggaguccucugcuggg

SEQ ID NO: 132517 - RNA, 21 nt, Human
agcuuggcaaggcccuggggu

SEQ ID NO: 132518 - RNA, 23 nt, Human
aggcuggaguccucugcugggug

SEQ ID NO: 132519 - RNA, 21 nt, Human
cacagccccuuucuccaguga

SEQ ID NO: 132520 - RNA, 24 nt, Human
cagcaaacagcuuggcaaggcccu

SEQ ID NO: 132521 - RNA, 20 nt, Human
cagcacagccccuuucucca

SEQ ID NO: 132522 - RNA, 23 nt, Human
cagccccuuucuccagugacucc

SEQ ID NO: 132523 - RNA, 19 nt, Human
cagcuucuggcccaggccu

SEQ ID NO: 132524 - RNA, 19 nt, Human
cccuggggugugguguggg

SEQ ID NO: 132525 - RNA, 20 nt, Human
ccuugugccagucuggcccc

SEQ ID NO: 132526 - RNA, 20 nt, Human
cucugcuggguguacagcug

SEQ ID NO: 132527 - RNA, 24 nt, Human
cuugugccagucuggccccagccg

SEQ ID NO: 132528 - RNA, 23 nt, Human
gaaggcuggaguccucugcuggg

SEQ ID NO: 132529 - RNA, 24 nt, Human
gacuccugguauggucaacagcuu

SEQ ID NO: 132530 - RNA, 24 nt, Human
gccugggccccgagaaggcuggag

SEQ ID NO: 132531 - RNA, 24 nt, Human
gucuggccccagcacagccccuuu

SEQ ID NO: 132532 - RNA, 19 nt, Human
gugaagcgucuaugagccc

SEQ ID NO: 132533 - RNA, 21 nt, Human
ugaagcgucuaugagcccagc

SEQ ID NO: 132534 - RNA, 19 nt, Human
ugggccccgagaaggcugg

SEQ ID NO: 132535 - RNA, 23 nt, Human
ugggguguggugugggcacgagu

SEQ ID NO: 132536 - RNA, 20 nt, Human
aaacaauggcaaagucuaac

SEQ ID NO: 132537 - RNA, 20 nt, Human
aaacaauggcaaagucuaac

SEQ ID NO: 132538 - RNA, 20 nt, Human
aaacaauggcaaagucuaac

SEQ ID NO: 132539 - RNA, 20 nt, Human
aaacaauggcaaagucuaac

SEQ ID NO: 132540 - RNA, 23 nt, Human
aagcauaacuuaaguaaacuuua

SEQ ID NO: 132541 - RNA, 23 nt, Human
aagcauaacuuaaguaaacuuua

SEQ ID NO: 132542 - RNA, 23 nt, Human
aagcauaacuuaaguaaacuuua

SEQ ID NO: 132543 - RNA, 23 nt, Human
aagcauaacuuaaguaaacuuua

SEQ ID NO: 132544 - RNA, 24 nt, Human
aaguggagcuucguugucuuguga

SEQ ID NO: 132545 - RNA, 24 nt, Human
aaguggagcuucguugucuuguga

SEQ ID NO: 132546 - RNA, 19 nt, Human
aaugugauccggcuggcaa

SEQ ID NO: 132547 - RNA, 19 nt, Human
aaugugauccggcuggcaa

SEQ ID NO: 132548 - RNA, 19 nt, Human
acacaacauuuuucuagcu

SEQ ID NO: 132549 - RNA, 19 nt, Human
acacaacauuuuucuagcu

SEQ ID NO: 132550 - RNA, 19 nt, Human
acacaacauuuuucuagcu

SEQ ID NO: 132551 - RNA, 19 nt, Human
acacaacauuuuucuagcu

SEQ ID NO: 132552 - RNA, 24 nt, Human
acuuucaggcggcucaaaaaggaa

SEQ ID NO: 132553 - RNA, 22 nt, Human
agaaaaacaagcauaacuuaag

SEQ ID NO: 132554 - RNA, 22 nt, Human
agaaaaacaagcauaacuuaag

SEQ ID NO: 132555 - RNA, 22 nt, Human
agaaaaacaagcauaacuuaag

SEQ ID NO: 132556 - RNA, 22 nt, Human
agaaaaacaagcauaacuuaag

SEQ ID NO: 132557 - RNA, 24 nt, Human
agaaaaacaagcauaacuuaagua

SEQ ID NO: 132558 - RNA, 24 nt, Human
agaaaaacaagcauaacuuaagua

SEQ ID NO: 132559 - RNA, 24 nt, Human
agaaaaacaagcauaacuuaagua

SEQ ID NO: 132560 - RNA, 24 nt, Human
agaaaaacaagcauaacuuaagua

SEQ ID NO: 132561 - RNA, 24 nt, Human
agagcacuuccgcccuagguaucg

SEQ ID NO: 132562 - RNA, 22 nt, Human
agcacuuccgcccuagguaucg

SEQ ID NO: 132563 - RNA, 20 nt, Human
agcggcagagugcuccaggg

SEQ ID NO: 132564 - RNA, 20 nt, Human
agcggcagagugcuccaggg

SEQ ID NO: 132565 - RNA, 20 nt, Human
agcggcagagugcuccaggg

SEQ ID NO: 132566 - RNA, 20 nt, Human
agcggcagagugcuccaggg

SEQ ID NO: 132567 - RNA, 21 nt, Human
agggagcccagaucacagccu

SEQ ID NO: 132568 - RNA, 21 nt, Human
agggagcccagaucacagccu

SEQ ID NO: 132569 - RNA, 21 nt, Human
agggagcccagaucacagccu

SEQ ID NO: 132570 - RNA, 21 nt, Human
auuuuggucaggacagggguu

SEQ ID NO: 132571 - RNA, 19 nt, Human
caauuccuuucuccuccuc

SEQ ID NO: 132572 - RNA, 19 nt, Human
caauuccuuucuccuccuc

SEQ ID NO: 132573 - RNA, 19 nt, Human
cacugagggaaccauuuuc

SEQ ID NO: 132574 - RNA, 19 nt, Human
cacugagggaaccauuuuc

SEQ ID NO: 132575 - RNA, 19 nt, Human
cagagugcuccagggauga

SEQ ID NO: 132576 - RNA, 19 nt, Human
cagagugcuccagggauga

SEQ ID NO: 132577 - RNA, 19 nt, Human
cagagugcuccagggauga

SEQ ID NO: 132578 - RNA, 19 nt, Human
cagagugcuccagggauga

SEQ ID NO: 132579 - RNA, 23 nt, Human
cagcucaauuccuuucuccuccu

SEQ ID NO: 132580 - RNA, 23 nt, Human
cagcucaauuccuuucuccuccu

SEQ ID NO: 132581 - RNA, 21 nt, Human
ccaagacuuugggcagugcag

SEQ ID NO: 132582 - RNA, 24 nt, Human
cccacgauucacacagcgaucacu

SEQ ID NO: 132583 - RNA, 24 nt, Human
ccgcccuagguaucgcugcucacu

SEQ ID NO: 132584 - RNA, 20 nt, Human
ccggcuggcaaacucccaca

SEQ ID NO: 132585 - RNA, 20 nt, Human
ccggcuggcaaacucccaca

SEQ ID NO: 132586 - RNA, 22 nt, Human
cgauucacacagcgaucacuuc

SEQ ID NO: 132587 - RNA, 21 nt, Human
cggcagagugcuccagggaug

SEQ ID NO: 132588 - RNA, 21 nt, Human
cggcagagugcuccagggaug

SEQ ID NO: 132589 - RNA, 21 nt, Human
cggcagagugcuccagggaug

SEQ ID NO: 132590 - RNA, 19 nt, Human
cucaauuccuuucuccucc

SEQ ID NO: 132591 - RNA, 19 nt, Human
cucaauuccuuucuccucc

SEQ ID NO: 132592 - RNA, 18 nt, Human
cuccucccuggcccucug

SEQ ID NO: 132593 - RNA, 18 nt, Human
cucuagauaggccagcuc

SEQ ID NO: 132594 - RNA, 18 nt, Human
cucuagauaggccagcuc

SEQ ID NO: 132595 - RNA, 23 nt, Human
cucuagauaggccagcucaauuc

SEQ ID NO: 132596 - RNA, 23 nt, Human
cucuagauaggccagcucaauuc

SEQ ID NO: 132597 - RNA, 22 nt, Human
cuucaaacaaaccuggggagaa

SEQ ID NO: 132598 - RNA, 22 nt, Human
cuucaaacaaaccuggggagaa

SEQ ID NO: 132599 - RNA, 22 nt, Human
gaaaacaauggcaaagucuaac

SEQ ID NO: 132600 - RNA, 22 nt, Human
gaaaacaauggcaaagucuaac

SEQ ID NO: 132601 - RNA, 22 nt, Human
gaaaacaauggcaaagucuaac

SEQ ID NO: 132602 - RNA, 22 nt, Human
gaaaacaauggcaaagucuaac

SEQ ID NO: 132603 - RNA, 21 nt, Human
gaauguguaggaccaucgugc

SEQ ID NO: 132604 - RNA, 18 nt, Human
gagcggcagagugcucca

SEQ ID NO: 132605 - RNA, 18 nt, Human
gagcggcagagugcucca

SEQ ID NO: 132606 - RNA, 18 nt, Human
gagcggcagagugcucca

SEQ ID NO: 132607 - RNA, 18 nt, Human
gagcggcagagugcucca

SEQ ID NO: 132608 - RNA, 20 nt, Human
gcucaauuccuuucuccucc

SEQ ID NO: 132609 - RNA, 20 nt, Human
gcucaauuccuuucuccucc

SEQ ID NO: 132610 - RNA, 18 nt, Human
gcuccagggaugagaggg

SEQ ID NO: 132611 - RNA, 18 nt, Human
gcuccagggaugagaggg

SEQ ID NO: 132612 - RNA, 18 nt, Human
gcuccagggaugagaggg

SEQ ID NO: 132613 - RNA, 18 nt, Human
gcuccagggaugagaggg

SEQ ID NO: 132614 - RNA, 24 nt, Human
gcuucagguacaaaagaaaacaau

SEQ ID NO: 132615 - RNA, 24 nt, Human
gcuucagguacaaaagaaaacaau

SEQ ID NO: 132616 - RNA, 24 nt, Human
gcuucagguacaaaagaaaacaau

SEQ ID NO: 132617 - RNA, 20 nt, Human
ggagcuucguugucuuguga

SEQ ID NO: 132618 - RNA, 20 nt, Human
ggagcuucguugucuuguga

SEQ ID NO: 132619 - RNA, 20 nt, Human
ggcagagugcuccagggaug

SEQ ID NO: 132620 - RNA, 20 nt, Human
gggcagugcaggcccaauuu

SEQ ID NO: 132621 - RNA, 26 nt, Human
gguuacagauucuuuacaaagguguu

SEQ ID NO: 132622 - RNA, 26 nt, Human
gguuacagauucuuuacaaagguguu

SEQ ID NO: 132623 - RNA, 26 nt, Human
gguuacagauucuuuacaaagguguu

SEQ ID NO: 132624 - RNA, 24 nt, Human
guaaacuuuauuuucaaaaugcuu

SEQ ID NO: 132625 - RNA, 24 nt, Human
guaaacuuuauuuucaaaaugcuu

SEQ ID NO: 132626 - RNA, 24 nt, Human
guaaacuuuauuuucaaaaugcuu

SEQ ID NO: 132627 - RNA, 24 nt, Human
guaaacuuuauuuucaaaaugcuu

SEQ ID NO: 132628 - RNA, 19 nt, Human
guggagcuucguugucuug

SEQ ID NO: 132629 - RNA, 25 nt, Human
uagaaaaacaagcauaacuuaagua

SEQ ID NO: 132630 - RNA, 25 nt, Human
uagaaaaacaagcauaacuuaagua

SEQ ID NO: 132631 - RNA, 25 nt, Human
uagaaaaacaagcauaacuuaagua

SEQ ID NO: 132632 - RNA, 25 nt, Human
uagaaaaacaagcauaacuuaagua

SEQ ID NO: 132633 - RNA, 19 nt, Human
uagaugaagccauguaaug

SEQ ID NO: 132634 - RNA, 19 nt, Human
uagaugaagccauguaaug

SEQ ID NO: 132635 - RNA, 20 nt, Human
uccaacaccagcacuggaau

SEQ ID NO: 132636 - RNA, 20 nt, Human
uccaacaccagcacuggaau

SEQ ID NO: 132637 - RNA, 20 nt, Human
uccaacaccagcacuggaau

SEQ ID NO: 132638 - RNA, 20 nt, Human
uccuccucccuggcccucug

SEQ ID NO: 132639 - RNA, 19 nt, Human
ucucaugaggucuucuugu

SEQ ID NO: 132640 - RNA, 19 nt, Human
ucucaugaggucuucuugu

SEQ ID NO: 132641 - RNA, 19 nt, Human
ucucaugaggucuucuugu

SEQ ID NO: 132642 - RNA, 19 nt, Human
ucuuugcaaagauauaccu

SEQ ID NO: 132643 - RNA, 19 nt, Human
ucuuugcaaagauauaccu

SEQ ID NO: 132644 - RNA, 24 nt, Human
ugacauccaacaccagcacuggaa

SEQ ID NO: 132645 - RNA, 24 nt, Human
ugacauccaacaccagcacuggaa

SEQ ID NO: 132646 - RNA, 24 nt, Human
ugacauccaacaccagcacuggaa

SEQ ID NO: 132647 - RNA, 18 nt, Human
ugagaggggcuggggaug

SEQ ID NO: 132648 - RNA, 18 nt, Human
ugagaggggcuggggaug

SEQ ID NO: 132649 - RNA, 18 nt, Human
ugagaggggcuggggaug

SEQ ID NO: 132650 - RNA, 18 nt, Human
ugagaggggcuggggaug

SEQ ID NO: 132651 - RNA, 18 nt, Human
ugaggucuucuuguuugg

SEQ ID NO: 132652 - RNA, 18 nt, Human
ugaggucuucuuguuugg

SEQ ID NO: 132653 - RNA, 18 nt, Human
ugaggucuucuuguuugg

SEQ ID NO: 132654 - RNA, 25 nt, Human
ugcuucagguacaaaagaaaacaau

SEQ ID NO: 132655 - RNA, 21 nt, Human
uggaauguucaucagagccuc

SEQ ID NO: 132656 - RNA, 21 nt, Human
uggaauguucaucagagccuc

SEQ ID NO: 132657 - RNA, 21 nt, Human
uggaauguucaucagagccuc

SEQ ID NO: 132658 - RNA, 18 nt, Human
uggcccucugguacaguc

SEQ ID NO: 132659 - RNA, 18 nt, Human
uggcccucugguacaguc

SEQ ID NO: 132660 - RNA, 21 nt, Human
ugggagacacaacauuuuucu

SEQ ID NO: 132661 - RNA, 21 nt, Human
ugggagacacaacauuuuucu

SEQ ID NO: 132662 - RNA, 21 nt, Human
ugggagacacaacauuuuucu

SEQ ID NO: 132663 - RNA, 21 nt, Human
ugggagacacaacauuuuucu

SEQ ID NO: 132664 - RNA, 18 nt, Human
uggggagaagccuggagg

SEQ ID NO: 132665 - RNA, 18 nt, Human
uggggagaagccuggagg

SEQ ID NO: 132666 - RNA, 18 nt, Human
ugucuggaauguguagga

SEQ ID NO: 132667 - RNA, 21 nt, Human
uguguaggaccaucgugcugg

SEQ ID NO: 132668 - RNA, 23 nt, Human
uucaggcggcucaaaaaggaaaa

SEQ ID NO: 132669 - RNA, 24 nt, Human
uucagguacaaaagaaaacaaugg

SEQ ID NO: 132670 - RNA, 26 nt, Human
uucagguacaaaagaaaacaauggca

SEQ ID NO: 132671 - RNA, 26 nt, Human
uucagguacaaaagaaaacaauggca

SEQ ID NO: 132672 - RNA, 26 nt, Human
uucagguacaaaagaaaacaauggca

SEQ ID NO: 132673 - RNA, 19 nt, Human
uuccuggccuguaagaguu

SEQ ID NO: 132674 - RNA, 19 nt, Human
uuccuggccuguaagaguu

SEQ ID NO: 132675 - RNA, 23 nt, Human
aaagagggaugagugguuggaga

SEQ ID NO: 132676 - RNA, 19 nt, Human
aaaguguggaucuaggaaa

SEQ ID NO: 132677 - RNA, 20 nt, Human
aaccacagugucuaagacaa

SEQ ID NO: 132678 - RNA, 20 nt, Human
aaccuaggucuccugacuca

SEQ ID NO: 132679 - RNA, 20 nt, Human
acacagugccuguggcugua

SEQ ID NO: 132680 - RNA, 18 nt, Human
acaguagagaggggcuga

SEQ ID NO: 132681 - RNA, 19 nt, Human
acaugcacugcccacuggc

SEQ ID NO: 132682 - RNA, 19 nt, Human
acccaucuccaccccuccc

SEQ ID NO: 132683 - RNA, 21 nt, Human
acccaucuccaccccucccuu

SEQ ID NO: 132684 - RNA, 18 nt, Human
acgcaauuccuucucaga

SEQ ID NO: 132685 - RNA, 21 nt, Human
acuccguggcugcccuccucc

SEQ ID NO: 132686 - RNA, 22 nt, Human
acugggcugcccccuggaagcc

SEQ ID NO: 132687 - RNA, 23 nt, Human
agacacuggcagugugccaagcc

SEQ ID NO: 132688 - RNA, 21 nt, Human
agagaggggcugaaaccuagg

SEQ ID NO: 132689 - RNA, 19 nt, Human
agaugacaacaaccugcaa

SEQ ID NO: 132690 - RNA, 20 nt, Human
agaugggagcuggccuuggg

SEQ ID NO: 132691 - RNA, 21 nt, Human
agaugggagcuggccuugggg

SEQ ID NO: 132692 - RNA, 18 nt, Human
agccaggaggaagguggu

SEQ ID NO: 132693 - RNA, 21 nt, Human
agccuuucuggaaaugagaug

SEQ ID NO: 132694 - RNA, 24 nt, Human
agcugggguggggagugguggaag

SEQ ID NO: 132695 - RNA, 23 nt, Human
aggcacugaaauuaacuacagcu

SEQ ID NO: 132696 - RNA, 24 nt, Human
aggcaugaaggaggaaggggggag

SEQ ID NO: 132697 - RNA, 19 nt, Human
aggccugcaggguugguga

SEQ ID NO: 132698 - RNA, 23 nt, Human
agggguuaagggacucacccaga

SEQ ID NO: 132699 - RNA, 19 nt, Human
agggugggaguucuggagg

SEQ ID NO: 132700 - RNA, 22 nt, Human
aggguuggaggcuucacuggca

SEQ ID NO: 132701 - RNA, 19 nt, Human
agugguggaagaaagaaaa

SEQ ID NO: 132702 - RNA, 26 nt, Human
agugguggaagaaagaaaaagaggga

SEQ ID NO: 132703 - RNA, 21 nt, Human
auggguagggugguuccuuug

SEQ ID NO: 132704 - RNA, 18 nt, Human
caacucagaugacaacaa

SEQ ID NO: 132705 - RNA, 25 nt, Human
caagccagggaaggaccuagggagg

SEQ ID NO: 132706 - RNA, 20 nt, Human
caaggaagcacaugggucuc

SEQ ID NO: 132707 - RNA, 22 nt, Human
caaguagguauuacuaucccuu

SEQ ID NO: 132708 - RNA, 24 nt, Human
cacacaccauacacugccacaccc

SEQ ID NO: 132709 - RNA, 21 nt, Human
cacaccauacacugccacacc

SEQ ID NO: 132710 - RNA, 19 nt, Human
cacacccaucuccaccccu

SEQ ID NO: 132711 - RNA, 20 nt, Human
cacacccaucuccaccccuc

SEQ ID NO: 132712 - RNA, 20 nt, Human
cacaugcacugcccacuggc

SEQ ID NO: 132713 - RNA, 25 nt, Human
caccaagacaaaguggguuuuggga

SEQ ID NO: 132714 - RNA, 25 nt, Human
caccauacacugccacacccaucuc

SEQ ID NO: 132715 - RNA, 25 nt, Human
caccuucaaugugaccagugcucaa

SEQ ID NO: 132716 - RNA, 21 nt, Human
cacugccgccagcuccgcgcc

SEQ ID NO: 132717 - RNA, 19 nt, Human
cacuguuuaacuagcucgu

SEQ ID NO: 132718 - RNA, 25 nt, Human
cagagcggagaccacucucuccacc

SEQ ID NO: 132719 - RNA, 18 nt, Human
cagaggccaaauggguag

SEQ ID NO: 132720 - RNA, 21 nt, Human
caggaggaaggugguguuggg

SEQ ID NO: 132721 - RNA, 18 nt, Human
caucuggggccuccccac

SEQ ID NO: 132722 - RNA, 22 nt, Human
ccacaugcacugcccacuggca

SEQ ID NO: 132723 - RNA, 22 nt, Human
ccacugcagaugugacgcugaa

SEQ ID NO: 132724 - RNA, 24 nt, Human
ccacugggcugcccccuggaagcc

SEQ ID NO: 132725 - RNA, 24 nt, Human
cccacggugagaauccuacagaaa

SEQ ID NO: 132726 - RNA, 18 nt, Human
cccacucccaccaagaca

SEQ ID NO: 132727 - RNA, 21 nt, Human
cccacuccguggcugcccucc

SEQ ID NO: 132728 - RNA, 23 nt, Human
cccaucuccaccccucccuuuca

SEQ ID NO: 132729 - RNA, 23 nt, Human
ccccacuccguggcugcccuccu

SEQ ID NO: 132730 - RNA, 21 nt, Human
cccccagcccucacaagaccc

SEQ ID NO: 132731 - RNA, 19 nt, Human
ccccugcugcagagcagcg

SEQ ID NO: 132732 - RNA, 20 nt, Human
ccugaugcuguccacucccc

SEQ ID NO: 132733 - RNA, 21 nt, Human
ccugcaagccagguaugagcc

SEQ ID NO: 132734 - RNA, 23 nt, Human
ccugcaggguuggugagccaaga

SEQ ID NO: 132735 - RNA, 19 nt, Human
ccuggauccaauucagagc

SEQ ID NO: 132736 - RNA, 23 nt, Human
ccugugaggaccucgucuggcug

SEQ ID NO: 132737 - RNA, 25 nt, Human
ccuuucaacuaaugaagagacccgg

SEQ ID NO: 132738 - RNA, 19 nt, Human
ccuuucuggaaaugagaug

SEQ ID NO: 132739 - RNA, 21 nt, Human
cggaaauggaacuuucucuga

SEQ ID NO: 132740 - RNA, 18 nt, Human
cuacaaaaaaaagccaug

SEQ ID NO: 132741 - RNA, 23 nt, Human
cuacaaaaaaaagccaugaacuc

SEQ ID NO: 132742 - RNA, 23 nt, Human
cuaccacuuacccagcaccuuca

SEQ ID NO: 132743 - RNA, 21 nt, Human
cucaacucagaugacaacaac

SEQ ID NO: 132744 - RNA, 22 nt, Human
cuccaccuaggugucccaggcu

SEQ ID NO: 132745 - RNA, 24 nt, Human
cuccccacuccguggcugcccucc

SEQ ID NO: 132746 - RNA, 23 nt, Human
cuccgcgccuggcccgcucugcg

SEQ ID NO: 132747 - RNA, 24 nt, Human
cugauucuaaagaaaaccuucaug

SEQ ID NO: 132748 - RNA, 21 nt, Human
cuggagcaacauaaccggagg

SEQ ID NO: 132749 - RNA, 23 nt, Human
cuggccaaagaaacuggcuacaa

SEQ ID NO: 132750 - RNA, 20 nt, Human
cugggcugcccccuggaagc

SEQ ID NO: 132751 - RNA, 22 nt, Human
cugggguggggagugguggaag

SEQ ID NO: 132752 - RNA, 22 nt, Human
cuucccugcaagccagguauga

SEQ ID NO: 132753 - RNA, 20 nt, Human
gaaugccuucuccaggaaca

SEQ ID NO: 132754 - RNA, 20 nt, Human
gacacuggcagugugccaag

SEQ ID NO: 132755 - RNA, 19 nt, Human
gaccagugcucaacucaga

SEQ ID NO: 132756 - RNA, 22 nt, Human
gacgcaauuccuucucagauuc

SEQ ID NO: 132757 - RNA, 18 nt, Human
gagugaagggaagaugcc

SEQ ID NO: 132758 - RNA, 23 nt, Human
gagugguggaagaaagaaaaaga

SEQ ID NO: 132759 - RNA, 21 nt, Human
gcagcgcggacccacucccac

SEQ ID NO: 132760 - RNA, 21 nt, Human
gcagugugccaagccuugggu

SEQ ID NO: 132761 - RNA, 25 nt, Human
gccaagaagaaugagcccagguccc

SEQ ID NO: 132762 - RNA, 23 nt, Human
gccacacccaucuccaccccucc

SEQ ID NO: 132763 - RNA, 25 nt, Human
gccacacccaucuccaccccucccu

SEQ ID NO: 132764 - RNA, 21 nt, Human
gccccacggugagaauccuac

SEQ ID NO: 132765 - RNA, 22 nt, Human
gccuccugucacugccgccagc

SEQ ID NO: 132766 - RNA, 19 nt, Human
gccuguagcccacagcccg

SEQ ID NO: 132767 - RNA, 20 nt, Human
gcuccacugcagaugugacg

SEQ ID NO: 132768 - RNA, 19 nt, Human
ggaaagaugaggccugcag

SEQ ID NO: 132769 - RNA, 21 nt, Human
ggaagaaagaaaaagagggau

SEQ ID NO: 132770 - RNA, 20 nt, Human
ggagguucccuucccucugg

SEQ ID NO: 132771 - RNA, 21 nt, Human
ggccucggaccuggcuuuggc

SEQ ID NO: 132772 - RNA, 18 nt, Human
ggcucuggaggggagagg

SEQ ID NO: 132773 - RNA, 19 nt, Human
ggcugucagggugggaguu

SEQ ID NO: 132774 - RNA, 21 nt, Human
ggggugggccugcaggcccag

SEQ ID NO: 132775 - RNA, 22 nt, Human
guccacuggaucauuuuuccuc

SEQ ID NO: 132776 - RNA, 18 nt, Human
guggaagaaagaaaaaga

SEQ ID NO: 132777 - RNA, 18 nt, Human
guugcacagcucgcugac

SEQ ID NO: 132778 - RNA, 21 nt, Human
uaaacagaagcagcggcccca

SEQ ID NO: 132779 - RNA, 18 nt, Human
uaagggacucacccagag

SEQ ID NO: 132780 - RNA, 18 nt, Human
uacacugccacacccauc

SEQ ID NO: 132781 - RNA, 18 nt, Human
uagaaucaucaguuuugc

SEQ ID NO: 132782 - RNA, 21 nt, Human
uagaguugcauaaacaaccaa

SEQ ID NO: 132783 - RNA, 22 nt, Human
ucaacucagaugacaacaaccu

SEQ ID NO: 132784 - RNA, 19 nt, Human
ucacugccgccagcuccgc

SEQ ID NO: 132785 - RNA, 19 nt, Human
ucagugguggcuggggugg

SEQ ID NO: 132786 - RNA, 20 nt, Human
uccaaaauaccuuccuuucc

SEQ ID NO: 132787 - RNA, 21 nt, Human
uccaaaauaccuuccuuucca

SEQ ID NO: 132788 - RNA, 26 nt, Human
uccaaaucccacauucuuuccauucc

SEQ ID NO: 132789 - RNA, 23 nt, Human
uccacaugcacugcccacuggca

SEQ ID NO: 132790 - RNA, 18 nt, Human
uccaccccucccuuucaa

SEQ ID NO: 132791 - RNA, 21 nt, Human
uccacuggaucauuuuuccuc

SEQ ID NO: 132792 - RNA, 18 nt, Human
ucccaccugaugcugucc

SEQ ID NO: 132793 - RNA, 23 nt, Human
uccccaaguguccacuggaucau

SEQ ID NO: 132794 - RNA, 22 nt, Human
ucccuuaauuccagcuucccuu

SEQ ID NO: 132795 - RNA, 18 nt, Human
uccguggguuuugcaacc

SEQ ID NO: 132796 - RNA, 19 nt, Human
uccguggguuuugcaacca

SEQ ID NO: 132797 - RNA, 20 nt, Human
uccguggguuuugcaaccac

SEQ ID NO: 132798 - RNA, 19 nt, Human
uccugagaucccagggugg

SEQ ID NO: 132799 - RNA, 19 nt, Human
ucggguuuucagcugaggc

SEQ ID NO: 132800 - RNA, 19 nt, Human
ucucuggccaccgucccag

SEQ ID NO: 132801 - RNA, 21 nt, Human
ucuuucuuucuucugcccccu

SEQ ID NO: 132802 - RNA, 21 nt, Human
ugaaauuaacuacagcugggg

SEQ ID NO: 132803 - RNA, 22 nt, Human
ugacaacaaccugcaaguaggu

SEQ ID NO: 132804 - RNA, 20 nt, Human
ugacagauaauccccaagug

SEQ ID NO: 132805 - RNA, 20 nt, Human
ugaccaaagaagaaaauaaa

SEQ ID NO: 132806 - RNA, 18 nt, Human
ugacgcaauuccuucuca

SEQ ID NO: 132807 - RNA, 23 nt, Human
ugagaugggagcuggccuugggg

SEQ ID NO: 132808 - RNA, 22 nt, Human
ugaggaaacugcagcucagagg

SEQ ID NO: 132809 - RNA, 21 nt, Human
ugauuccaaaauaccuuccuu

SEQ ID NO: 132810 - RNA, 18 nt, Human
ugcacagcucgcugacag

SEQ ID NO: 132811 - RNA, 28 nt, Human
ugcacaggugaccuaauguuguaaugac

SEQ ID NO: 132812 - RNA, 19 nt, Human
ugcacugagcaaggaagca

SEQ ID NO: 132813 - RNA, 21 nt, Human
ugcagccaagaaacucagggc

SEQ ID NO: 132814 - RNA, 24 nt, Human
ugccgccagcuccgcgccuggccc

SEQ ID NO: 132815 - RNA, 18 nt, Human
ugccuggaugcccccagc

SEQ ID NO: 132816 - RNA, 22 nt, Human
ugccuguggcuguaagagccug

SEQ ID NO: 132817 - RNA, 20 nt, Human
uggaagaaagaaaaagaggg

SEQ ID NO: 132818 - RNA, 18 nt, Human
uggaagccaggaggaagg

SEQ ID NO: 132819 - RNA, 21 nt, Human
uggagcaacauaaccggaggg

SEQ ID NO: 132820 - RNA, 18 nt, Human
uggaugcccccagcccuc

SEQ ID NO: 132821 - RNA, 23 nt, Human
uggcacagcgcaucuggggccuc

SEQ ID NO: 132822 - RNA, 18 nt, Human
uggcagugugccaagccu

SEQ ID NO: 132823 - RNA, 21 nt, Human
uggcagugugccaagccuugg

SEQ ID NO: 132824 - RNA, 25 nt, Human
uggccagggacaggacuggcuacaa

SEQ ID NO: 132825 - RNA, 19 nt, Human
uggcuuaggguuggaggcu

SEQ ID NO: 132826 - RNA, 18 nt, Human
ugggaugggugaacaccc

SEQ ID NO: 132827 - RNA, 23 nt, Human
ugggaugggugaacacccuucaa

SEQ ID NO: 132828 - RNA, 23 nt, Human
ugguggaagaaagaaaaagaggg

SEQ ID NO: 132829 - RNA, 25 nt, Human
ugguggaagaaagaaaaagagggau

SEQ ID NO: 132830 - RNA, 20 nt, Human
ugucagggugggaguucugg

SEQ ID NO: 132831 - RNA, 22 nt, Human
ugucccaggcugaggcugggac

SEQ ID NO: 132832 - RNA, 18 nt, Human
uuaaacagaagcagcggc

SEQ ID NO: 132833 - RNA, 22 nt, Human
uuaauuccagcuucccuuacau

SEQ ID NO: 132834 - RNA, 23 nt, Human
uuggccucggaccuggcuuuggc

SEQ ID NO: 132835 - RNA, 21 nt, Human
uuuaaacagaagcagcggccc

SEQ ID NO: 132836 - RNA, 22 nt, Human
uuuaacuccauccaaaaccauc

SEQ ID NO: 132837 - RNA, 24 nt, Human
uuuggccucggaccuggcuuuggc

SEQ ID NO: 132838 - RNA, 21 nt, Human
aaccggccccuuaaaaguuuc

SEQ ID NO: 132839 - RNA, 20 nt, Human
acagggcgugggaagaccuc

SEQ ID NO: 132840 - RNA, 22 nt, Human
accugaaagccacagccagugg

SEQ ID NO: 132841 - RNA, 21 nt, Human
accugccuacaccugaaagcc

SEQ ID NO: 132842 - RNA, 19 nt, Human
accugcgcccaccuucccc

SEQ ID NO: 132843 - RNA, 21 nt, Human
agaaaaggaggugcccucccg

SEQ ID NO: 132844 - RNA, 18 nt, Human
agagcccaccugccuaca

SEQ ID NO: 132845 - RNA, 21 nt, Human
agcaagaguaaaugcagccua

SEQ ID NO: 132846 - RNA, 21 nt, Human
agcaggaaggaaacgacauga

SEQ ID NO: 132847 - RNA, 22 nt, Human
agcaggcaggggagggggaucu

SEQ ID NO: 132848 - RNA, 19 nt, Human
aggacuaguaaaggugacc

SEQ ID NO: 132849 - RNA, 22 nt, Human
aggcaaaagcaaggaacagagc

SEQ ID NO: 132850 - RNA, 23 nt, Human
agggaagaaagcacagaaaagga

SEQ ID NO: 132851 - RNA, 20 nt, Human
agggaaucgggaagcagagc

SEQ ID NO: 132852 - RNA, 18 nt, Human
agucugcacagucacagg

SEQ ID NO: 132853 - RNA, 24 nt, Human
agugcugggaccucucugaggucu

SEQ ID NO: 132854 - RNA, 23 nt, Human
caacacccuagggaugaggaaga

SEQ ID NO: 132855 - RNA, 22 nt, Human
caauacauggauaacgcgcacg

SEQ ID NO: 132856 - RNA, 20 nt, Human
caauacggcagugcuggaca

SEQ ID NO: 132857 - RNA, 20 nt, Human
cacaacacccuagggaugag

SEQ ID NO: 132858 - RNA, 18 nt, Human
cacagucacagggcaaga

SEQ ID NO: 132859 - RNA, 21 nt, Human
caccugccuacaccugaaagc

SEQ ID NO: 132860 - RNA, 30 nt, Human
cacucccacuuuuauuuagcaagagggggg

SEQ ID NO: 132861 - RNA, 20 nt, Human
cagaacacgcucuugacagc

SEQ ID NO: 132862 - RNA, 23 nt, Human
cagacuccaggcagagcacuccu

SEQ ID NO: 132863 - RNA, 18 nt, Human
cagcaggagcaggaagga

SEQ ID NO: 132864 - RNA, 21 nt, Human
cagccccacagggcuucuccc

SEQ ID NO: 132865 - RNA, 25 nt, Human
cagggacacugauuagagaaaaucc

SEQ ID NO: 132866 - RNA, 19 nt, Human
cagugcugggaccucucug

SEQ ID NO: 132867 - RNA, 23 nt, Human
ccaccugccuacaccugaaagcc

SEQ ID NO: 132868 - RNA, 25 nt, Human
ccagcccccauggaccuggcagaac

SEQ ID NO: 132869 - RNA, 22 nt, Human
cccaccugccuacaccugaaag

SEQ ID NO: 132870 - RNA, 20 nt, Human
ccccauggaccuggcagaac

SEQ ID NO: 132871 - RNA, 21 nt, Human
ccccuuucuccccaguguccc

SEQ ID NO: 132872 - RNA, 22 nt, Human
ccccuuucuccccaguguccca

SEQ ID NO: 132873 - RNA, 26 nt, Human
cccuccagccucuugccaaauaguuu

SEQ ID NO: 132874 - RNA, 24 nt, Human
ccucaccugcgcccaccuuccccu

SEQ ID NO: 132875 - RNA, 18 nt, Human
ccuucuugaaccggcccc

SEQ ID NO: 132876 - RNA, 18 nt, Human
cgcgcacgccccacuccc

SEQ ID NO: 132877 - RNA, 20 nt, Human
cggcuaaaguccugcgcaca

SEQ ID NO: 132878 - RNA, 23 nt, Human
cucagggaagaaagcacagaaaa

SEQ ID NO: 132879 - RNA, 25 nt, Human
cuugaaggcaaaagcaaggaacaga

SEQ ID NO: 132880 - RNA, 22 nt, Human
cuugauccuucucaaccggcua

SEQ ID NO: 132881 - RNA, 25 nt, Human
gcagcaggagcaggaaggaaacgac

SEQ ID NO: 132882 - RNA, 18 nt, Human
gcuggagaagguguggag

SEQ ID NO: 132883 - RNA, 21 nt, Human
ggaagaaagcacagaaaagga

SEQ ID NO: 132884 - RNA, 19 nt, Human
ggacaccugccaagugcug

SEQ ID NO: 132885 - RNA, 18 nt, Human
guugcucgagccagaguc

SEQ ID NO: 132886 - RNA, 20 nt, Human
uaaaguccugcgcacaccuc

SEQ ID NO: 132887 - RNA, 28 nt, Human
uaccaaggagaaacggcgcacgggcccc

SEQ ID NO: 132888 - RNA, 22 nt, Human
ucaacaccgugcacgcuaccaa

SEQ ID NO: 132889 - RNA, 24 nt, Human
ucccuugaaggcaaaagcaaggaa

SEQ ID NO: 132890 - RNA, 21 nt, Human
uccugcgcacaccucggcccc

SEQ ID NO: 132891 - RNA, 24 nt, Human
uccuucuugaaccggccccuuaaa

SEQ ID NO: 132892 - RNA, 23 nt, Human
ucgagccagagucugcacaguca

SEQ ID NO: 132893 - RNA, 26 nt, Human
ucuacacaacacccuagggaugagga

SEQ ID NO: 132894 - RNA, 21 nt, Human
ucugugcuggcaauacggcag

SEQ ID NO: 132895 - RNA, 21 nt, Human
ugaaagccacagccagugcug

SEQ ID NO: 132896 - RNA, 19 nt, Human
ugaaagccccuuucucccc

SEQ ID NO: 132897 - RNA, 22 nt, Human
ugaaggcaaaagcaaggaacag

SEQ ID NO: 132898 - RNA, 18 nt, Human
ugacagggcgugggaaga

SEQ ID NO: 132899 - RNA, 21 nt, Human
ugagaccuccucgcuggagaa

SEQ ID NO: 132900 - RNA, 23 nt, Human
ugaggaaacugaggcuccucgag

SEQ ID NO: 132901 - RNA, 22 nt, Human
ugauuagguacuggacaccugc

SEQ ID NO: 132902 - RNA, 18 nt, Human
ugcagacuccaggcagag

SEQ ID NO: 132903 - RNA, 22 nt, Human
uggcaauacggcagugcuggac

SEQ ID NO: 132904 - RNA, 23 nt, Human
uggcaauacggcagugcuggaca

SEQ ID NO: 132905 - RNA, 23 nt, Human
ugggaagaccuccugcucaccag

SEQ ID NO: 132906 - RNA, 20 nt, Human
ugggucauccuccugcccag

SEQ ID NO: 132907 - RNA, 20 nt, Human
uucccuugaaggcaaaagcu

SEQ ID NO: 132908 - RNA, 25 nt, Human
uuucacagcagaagggaacuuuucc

SEQ ID NO: 132909 - RNA, 18 nt, Human
uuuuuuuuuuugaacagg

SEQ ID NO: 132910 - RNA, 21 nt, Human
uuuuuuuuuuuuuugaacagg

SEQ ID NO: 132911 - RNA, 25 nt, Human
uuuuuuuuuuuuuuuuugaacaggg

SEQ ID NO: 132912 - RNA, 19 nt, Human
aaaaauacauacuuuuuuc

SEQ ID NO: 132913 - RNA, 22 nt, Human
aaaaauguauuauuuuaccuuc

SEQ ID NO: 132914 - RNA, 19 nt, Human
aaacaguguauuaugcucu

SEQ ID NO: 132915 - RNA, 25 nt, Human
aaaccaaagucaaacuccaucagaa

SEQ ID NO: 132916 - RNA, 24 nt, Human
aaagaaauagaugaaaaugguuaa

SEQ ID NO: 132917 - RNA, 19 nt, Human
aaagcgcugggauuacagg

SEQ ID NO: 132918 - RNA, 24 nt, Human
aaagcgcugggauuacagguguga

SEQ ID NO: 132919 - RNA, 19 nt, Human
aacauggugaaaccccauc

SEQ ID NO: 132920 - RNA, 20 nt, Human
aacauggugaaaccccaucu

SEQ ID NO: 132921 - RNA, 21 nt, Human
aacauggugaaaccccaucuc

SEQ ID NO: 132922 - RNA, 21 nt, Human
aacauggugaaaccccaucuc

SEQ ID NO: 132923 - RNA, 19 nt, Human
aacccuuuccccuuguuuu

SEQ ID NO: 132924 - RNA, 25 nt, Human
aacccuuuccccuuguuuuuuuuuu

SEQ ID NO: 132925 - RNA, 23 nt, Human
aacuccaucagaauauccugcua

SEQ ID NO: 132926 - RNA, 22 nt, Human
aagagcgaaacgcugucuaaaa

SEQ ID NO: 132927 - RNA, 18 nt, Human
aagcaaccaucaucccuc

SEQ ID NO: 132928 - RNA, 19 nt, Human
aagcgcugggauuacaggu

SEQ ID NO: 132929 - RNA, 26 nt, Human
aagcgcugggauuacaggugugagcc

SEQ ID NO: 132930 - RNA, 24 nt, Human
aagcuggucucaagucgugacaca

SEQ ID NO: 132931 - RNA, 24 nt, Human
aagguggcaacauuuaucuacaaa

SEQ ID NO: 132932 - RNA, 24 nt, Human
aagugaucugccugccuuagccuc

SEQ ID NO: 132933 - RNA, 18 nt, Human
aaucgcuugaaucuggga

SEQ ID NO: 132934 - RNA, 24 nt, Human
accaacauggugaaaccccaucuc

SEQ ID NO: 132935 - RNA, 24 nt, Human
accauugcaugcuagccugggcaa

SEQ ID NO: 132936 - RNA, 24 nt, Human
accccaucucuacuaaaaauacaa

SEQ ID NO: 132937 - RNA, 18 nt, Human
agaaauagaugaaaaugg

SEQ ID NO: 132938 - RNA, 19 nt, Human
agaaccugcucgcugacuu

SEQ ID NO: 132939 - RNA, 22 nt, Human
agaaucgcuugaaucugggaag

SEQ ID NO: 132940 - RNA, 19 nt, Human
agacgccugggaacugcgg

SEQ ID NO: 132941 - RNA, 18 nt, Human
agagagaagaguaguggg

SEQ ID NO: 132942 - RNA, 24 nt, Human
agcacuuugggaggcugagguggg

SEQ ID NO: 132943 - RNA, 24 nt, Human
agccugaccaacauggugaaaccc

SEQ ID NO: 132944 - RNA, 24 nt, Human
agccugaggcaggagaaucgcuug

SEQ ID NO: 132945 - RNA, 18 nt, Human
agcgcugggauuacaggu

SEQ ID NO: 132946 - RNA, 19 nt, Human
agcgggaggaccuccgagc

SEQ ID NO: 132947 - RNA, 20 nt, Human
aggcaggagaaucgcuugaa

SEQ ID NO: 132948 - RNA, 24 nt, Human
aggcaggagaaucgcuugaaucug

SEQ ID NO: 132949 - RNA, 21 nt, Human
aggcggagguugcaguaagcc

SEQ ID NO: 132950 - RNA, 24 nt, Human
aggcggagguugcaguaagccgag

SEQ ID NO: 132951 - RNA, 24 nt, Human
aggcugaggugggugaaucgcuug

SEQ ID NO: 132952 - RNA, 23 nt, Human
agguggccaggcuggucuggaac

SEQ ID NO: 132953 - RNA, 18 nt, Human
aggugggugaaucgcuug

SEQ ID NO: 132954 - RNA, 19 nt, Human
aguagcugggacuacaggc

SEQ ID NO: 132955 - RNA, 21 nt, Human
aguagcugggacuacaggcau

SEQ ID NO: 132956 - RNA, 20 nt, Human
agugcaguggcacaaucacg

SEQ ID NO: 132957 - RNA, 19 nt, Human
auggggcuuugccauguug

SEQ ID NO: 132958 - RNA, 19 nt, Human
auggguguggaauggcagc

SEQ ID NO: 132959 - RNA, 18 nt, Human
auuugggugaauauagau

SEQ ID NO: 132960 - RNA, 26 nt, Human
caaaauacaaaaauuagccgggcgug

SEQ ID NO: 132961 - RNA, 24 nt, Human
caaagcgcugggauuacaggugug

SEQ ID NO: 132962 - RNA, 22 nt, Human
caaaggcaucugaaacucccug

SEQ ID NO: 132963 - RNA, 19 nt, Human
caaauaaaccauguguggc

SEQ ID NO: 132964 - RNA, 24 nt, Human
caacauggugaaaccccaucucua

SEQ ID NO: 132965 - RNA, 24 nt, Human
caagccgguaaucccagcacuuug

SEQ ID NO: 132966 - RNA, 22 nt, Human
caagugaucugccugccuuagc

SEQ ID NO: 132967 - RNA, 24 nt, Human
caaugaacuucuuuccaaaugccc

SEQ ID NO: 132968 - RNA, 24 nt, Human
cacaaugcccagcuaauuuuugug

SEQ ID NO: 132969 - RNA, 18 nt, Human
cacacacaggacagggag

SEQ ID NO: 132970 - RNA, 25 nt, Human
caccuccuccuccacaggugcagcc

SEQ ID NO: 132971 - RNA, 25 nt, Human
caccugguccuagcuacuugggagc

SEQ ID NO: 132972 - RNA, 18 nt, Human
cagaggcaaauacuuuuc

SEQ ID NO: 132973 - RNA, 24 nt, Human
cagcacuuugggaggcugaggugg

SEQ ID NO: 132974 - RNA, 18 nt, Human
cagcggccgcagcgcccc

SEQ ID NO: 132975 - RNA, 19 nt, Human
cagcggccgcagcgccccc

SEQ ID NO: 132976 - RNA, 25 nt, Human
cagcugccgccgcacguaguagguu

SEQ ID NO: 132977 - RNA, 21 nt, Human
cagcuucuuacugcaaacacc

SEQ ID NO: 132978 - RNA, 19 nt, Human
caggcgaggccccgccccc

SEQ ID NO: 132979 - RNA, 24 nt, Human
caggcgaggccccgcccccccgcc

SEQ ID NO: 132980 - RNA, 18 nt, Human
caggugcuggggacucag

SEQ ID NO: 132981 - RNA, 24 nt, Human
caggugugagccacugugccuggc

SEQ ID NO: 132982 - RNA, 24 nt, Human
cauacucauuuucccaucacugga

SEQ ID NO: 132983 - RNA, 20 nt, Human
caucucagcuuccugacuag

SEQ ID NO: 132984 - RNA, 21 nt, Human
caucugaaacucccugggccc

SEQ ID NO: 132985 - RNA, 23 nt, Human
caugucauucucugguuugugua

SEQ ID NO: 132986 - RNA, 23 nt, Human
cauguugcccaagcuggucucaa

SEQ ID NO: 132987 - RNA, 23 nt, Human
cauguugcccaagcuggucucaa

SEQ ID NO: 132988 - RNA, 19 nt, Human
cauugcaugcuagccuggg

SEQ ID NO: 132989 - RNA, 23 nt, Human
cauugcaugcuagccugggcaac

SEQ ID NO: 132990 - RNA, 24 nt, Human
cauugcaugcuagccugggcaaca

SEQ ID NO: 132991 - RNA, 21 nt, Human
ccaaagcgcugggauuacagg

SEQ ID NO: 132992 - RNA, 23 nt, Human
ccaaagcgcugggauuacaggug

SEQ ID NO: 132993 - RNA, 24 nt, Human
ccaaagcgcugggauuacaggugu

SEQ ID NO: 132994 - RNA, 22 nt, Human
ccaaagucaaacuccaucagaa

SEQ ID NO: 132995 - RNA, 22 nt, Human
ccaaagucaaacuccaucagaa

SEQ ID NO: 132996 - RNA, 24 nt, Human
ccacaggugcagccgaccaggugg

SEQ ID NO: 132997 - RNA, 18 nt, Human
ccaccuccuccuccacag

SEQ ID NO: 132998 - RNA, 19 nt, Human
ccagcgcccgccuucccgc

SEQ ID NO: 132999 - RNA, 22 nt, Human
ccaguuguucuuuccagaggca

SEQ ID NO: 133000 - RNA, 22 nt, Human
ccauguugcccaagcuggucuc

SEQ ID NO: 133001 - RNA, 20 nt, Human
ccauugcaugcuagccuggg

SEQ ID NO: 133002 - RNA, 21 nt, Human
ccauugcaugcuagccugggc

SEQ ID NO: 133003 - RNA, 22 nt, Human
ccauugcaugcuagccugggca

SEQ ID NO: 133004 - RNA, 23 nt, Human
ccauugcaugcuagccugggcaa

SEQ ID NO: 133005 - RNA, 24 nt, Human
ccauugcaugcuagccugggcaac

SEQ ID NO: 133006 - RNA, 19 nt, Human
ccauuguuuucagauucgu

SEQ ID NO: 133007 - RNA, 21 nt, Human
cccacacacaggacagggagc

SEQ ID NO: 133008 - RNA, 22 nt, Human
cccauauugucccagaguaguu

SEQ ID NO: 133009 - RNA, 20 nt, Human
ccccaaucuaagacagaaac

SEQ ID NO: 133010 - RNA, 18 nt, Human
ccccagcgcccgccuucc

SEQ ID NO: 133011 - RNA, 23 nt, Human
ccccaucccuccuaauucuccag

SEQ ID NO: 133012 - RNA, 22 nt, Human
cccccagcgcccgccuucccgc

SEQ ID NO: 133013 - RNA, 18 nt, Human
ccccgcccccucgucccu

SEQ ID NO: 133014 - RNA, 23 nt, Human
cccgcagacgccugggaacugcg

SEQ ID NO: 133015 - RNA, 19 nt, Human
cccgcccccccgccccggc

SEQ ID NO: 133016 - RNA, 19 nt, Human
cccugcgcugcagcggccg

SEQ ID NO: 133017 - RNA, 21 nt, Human
cccugcgcugcagcggccgca

SEQ ID NO: 133018 - RNA, 20 nt, Human
ccgcagcgcccccagcgccc

SEQ ID NO: 133019 - RNA, 25 nt, Human
ccgcagcgcccccagcgcccgccuu

SEQ ID NO: 133020 - RNA, 18 nt, Human
ccgcccacacacaggaca

SEQ ID NO: 133021 - RNA, 21 nt, Human
ccgccccgcccccucgucccu

SEQ ID NO: 133022 - RNA, 24 nt, Human
ccuaacaguccccugccccauccc

SEQ ID NO: 133023 - RNA, 25 nt, Human
ccugaaauccaccuccuccuccaca

SEQ ID NO: 133024 - RNA, 24 nt, Human
ccugaccaacauggugaaacccca

SEQ ID NO: 133025 - RNA, 23 nt, Human
ccugaguagcugggacuacaggc

SEQ ID NO: 133026 - RNA, 24 nt, Human
ccugaguagcugggacuacaggca

SEQ ID NO: 133027 - RNA, 21 nt, Human
ccugccuuagccucccaaagc

SEQ ID NO: 133028 - RNA, 24 nt, Human
ccugccuuagccucccaaagcgcu

SEQ ID NO: 133029 - RNA, 21 nt, Human
ccugcgcugcagcggccgcag

SEQ ID NO: 133030 - RNA, 25 nt, Human
ccuugcccugccaugucucgccgga

SEQ ID NO: 133031 - RNA, 21 nt, Human
cgagacaaggucucuucuguc

SEQ ID NO: 133032 - RNA, 24 nt, Human
cgagacuagccugaccaacauggu

SEQ ID NO: 133033 - RNA, 24 nt, Human
cgcaccugguccuagcuacuuggg

SEQ ID NO: 133034 - RNA, 23 nt, Human
cgccgggcugccauccuugcccu

SEQ ID NO: 133035 - RNA, 20 nt, Human
cgcggguucgcgcuccucgc

SEQ ID NO: 133036 - RNA, 24 nt, Human
cgcugggauuacaggugugagcca

SEQ ID NO: 133037 - RNA, 22 nt, Human
cggccgcggguucgcgcuccuc

SEQ ID NO: 133038 - RNA, 19 nt, Human
cgggcggccucgcugccuc

SEQ ID NO: 133039 - RNA, 24 nt, Human
cucaagccgguaaucccagcacuu

SEQ ID NO: 133040 - RNA, 18 nt, Human
cucaagugaucugccugc

SEQ ID NO: 133041 - RNA, 20 nt, Human
cucaagugaucugccugccu

SEQ ID NO: 133042 - RNA, 20 nt, Human
cucaagugaucugccugccu

SEQ ID NO: 133043 - RNA, 25 nt, Human
cucccauauugucccagaguaguua

SEQ ID NO: 133044 - RNA, 19 nt, Human
cuccucgccgggcccugcc

SEQ ID NO: 133045 - RNA, 23 nt, Human
cucuucugucaccccggcuggag

SEQ ID NO: 133046 - RNA, 21 nt, Human
cugacaaccaaggaggggggc

SEQ ID NO: 133047 - RNA, 23 nt, Human
cugacaaccaaggaggggggcgg

SEQ ID NO: 133048 - RNA, 24 nt, Human
cugagccuccugaguagcugggac

SEQ ID NO: 133049 - RNA, 20 nt, Human
cugcagcggccgcagcgccc

SEQ ID NO: 133050 - RNA, 22 nt, Human
cugcggccgcggguucgcgcuc

SEQ ID NO: 133051 - RNA, 22 nt, Human
cugcugagccuccugaguagcu

SEQ ID NO: 133052 - RNA, 18 nt, Human
cuggacuauguuccgccc

SEQ ID NO: 133053 - RNA, 18 nt, Human
cugggacugggcagggcc

SEQ ID NO: 133054 - RNA, 26 nt, Human
cugggcccaaaaccaaagucaaacuc

SEQ ID NO: 133055 - RNA, 20 nt, Human
cuggucucaagugaucugcc

SEQ ID NO: 133056 - RNA, 18 nt, Human
cuguguacauacugcucc

SEQ ID NO: 133057 - RNA, 20 nt, Human
gaaggguauguggaucuuca

SEQ ID NO: 133058 - RNA, 18 nt, Human
gacuacaggcaugggcca

SEQ ID NO: 133059 - RNA, 19 nt, Human
gaggccccgcccccccgcc

SEQ ID NO: 133060 - RNA, 19 nt, Human
gagguugcaguaagccgag

SEQ ID NO: 133061 - RNA, 25 nt, Human
gaguagcugggacuacaggcauggg

SEQ ID NO: 133062 - RNA, 23 nt, Human
gaugugccgggugugguggcuca

SEQ ID NO: 133063 - RNA, 18 nt, Human
gauuacaggugugagcca

SEQ ID NO: 133064 - RNA, 21 nt, Human
gauuacaggugugagccacug

SEQ ID NO: 133065 - RNA, 24 nt, Human
gauuacaggugugagccacugugc

SEQ ID NO: 133066 - RNA, 21 nt, Human
gcagcggccgcagcgccccca

SEQ ID NO: 133067 - RNA, 23 nt, Human
gccacaugugauggguguggaau

SEQ ID NO: 133068 - RNA, 19 nt, Human
gccccaucccuccuaauuc

SEQ ID NO: 133069 - RNA, 18 nt, Human
gccgggugugguggcuca

SEQ ID NO: 133070 - RNA, 19 nt, Human
gcuggagugcaguggcaca

SEQ ID NO: 133071 - RNA, 23 nt, Human
gcuggucucaagugaucugccug

SEQ ID NO: 133072 - RNA, 21 nt, Human
ggaagcuuuugguauuuccac

SEQ ID NO: 133073 - RNA, 19 nt, Human
ggacuacaggcaugggcca

SEQ ID NO: 133074 - RNA, 18 nt, Human
ggagguugcaguaagccg

SEQ ID NO: 133075 - RNA, 24 nt, Human
ggagguugcaguaagccgagguca

SEQ ID NO: 133076 - RNA, 21 nt, Human
ggauaugacagaugaggauua

SEQ ID NO: 133077 - RNA, 24 nt, Human
ggucucaagugaucugccugccuu

SEQ ID NO: 133078 - RNA, 24 nt, Human
gguggcucaagccgguaaucccag

SEQ ID NO: 133079 - RNA, 23 nt, Human
ggugugguggcucaagccgguaa

SEQ ID NO: 133080 - RNA, 21 nt, Human
gguucaagcaaccaucauccc

SEQ ID NO: 133081 - RNA, 20 nt, Human
gguuuuuccaaauuauuguu

SEQ ID NO: 133082 - RNA, 19 nt, Human
guaggaagcuuuugguauu

SEQ ID NO: 133083 - RNA, 24 nt, Human
gucacaccauugcaugcuagccug

SEQ ID NO: 133084 - RNA, 24 nt, Human
gugaucugccugccuuagccuccc

SEQ ID NO: 133085 - RNA, 21 nt, Human
gugugcgccacaaugcccagc

SEQ ID NO: 133086 - RNA, 24 nt, Human
uaaaauacuucaaauaaaccaugu

SEQ ID NO: 133087 - RNA, 18 nt, Human
uaaagaaauagaugaaaa

SEQ ID NO: 133088 - RNA, 22 nt, Human
uaacucuuuuagcaaugucuuc

SEQ ID NO: 133089 - RNA, 25 nt, Human
uaagacagaaacauacucauuuucc

SEQ ID NO: 133090 - RNA, 24 nt, Human
uaagagaagggaucucacuaaggu

SEQ ID NO: 133091 - RNA, 26 nt, Human
uaagccgaggucacaccaaucaacgg

SEQ ID NO: 133092 - RNA, 24 nt, Human
uaauuuuuguguuuuuuguagaga

SEQ ID NO: 133093 - RNA, 20 nt, Human
uacaggcaugggccauucca

SEQ ID NO: 133094 - RNA, 22 nt, Human
uacaggugugagccacugugcc

SEQ ID NO: 133095 - RNA, 23 nt, Human
uacaggugugagccacugugccu

SEQ ID NO: 133096 - RNA, 23 nt, Human
uacuacaugcaacccuuugguuc

SEQ ID NO: 133097 - RNA, 20 nt, Human
uagaaugauugccuaaccaa

SEQ ID NO: 133098 - RNA, 22 nt, Human
uagagauggggcuuugccaugu

SEQ ID NO: 133099 - RNA, 22 nt, Human
uagcugggacuacaggcauggg

SEQ ID NO: 133100 - RNA, 19 nt, Human
ucaauuaauucuuccaucu

SEQ ID NO: 133101 - RNA, 23 nt, Human
ucacaccauugcaugcuagccug

SEQ ID NO: 133102 - RNA, 24 nt, Human
ucacugcagccuugaacucguggg

SEQ ID NO: 133103 - RNA, 19 nt, Human
ucacuguuacaaacaaggu

SEQ ID NO: 133104 - RNA, 21 nt, Human
ucauuucucaaaggcaucuga

SEQ ID NO: 133105 - RNA, 21 nt, Human
uccaaaugccccaaaucuggc

SEQ ID NO: 133106 - RNA, 23 nt, Human
uccagaggcaaauacuuuucauu

SEQ ID NO: 133107 - RNA, 22 nt, Human
uccagcucagccccugcgaggc

SEQ ID NO: 133108 - RNA, 24 nt, Human
uccaucagaauauccugcuacuua

SEQ ID NO: 133109 - RNA, 25 nt, Human
uccaucagaauauccugcuacuuau

SEQ ID NO: 133110 - RNA, 23 nt, Human
ucccaaagcgcugggauuacagg

SEQ ID NO: 133111 - RNA, 20 nt, Human
ucccgccccagcugccgccg

SEQ ID NO: 133112 - RNA, 25 nt, Human
uccucacauaacuuagucauuucau

SEQ ID NO: 133113 - RNA, 24 nt, Human
uccugaguagcugggacuacaggc

SEQ ID NO: 133114 - RNA, 25 nt, Human
ucgcuugaaucugggaaggcggagg

SEQ ID NO: 133115 - RNA, 19 nt, Human
ucuaagacagaaacauacu

SEQ ID NO: 133116 - RNA, 21 nt, Human
ucuacaaaccucuggauauac

SEQ ID NO: 133117 - RNA, 23 nt, Human
ucucuacuaaaaauacaaaauac

SEQ ID NO: 133118 - RNA, 23 nt, Human
ucucuucugucaccccggcugga

SEQ ID NO: 133119 - RNA, 21 nt, Human
ucuggaacucuugggcucaag

SEQ ID NO: 133120 - RNA, 23 nt, Human
ucuucugucaccccggcuggagu

SEQ ID NO: 133121 - RNA, 23 nt, Human
ucuucuguuuuuuuccucacaua

SEQ ID NO: 133122 - RNA, 21 nt, Human
ucuugggcucaagucguccug

SEQ ID NO: 133123 - RNA, 19 nt, Human
ugaaaacaacaguccugcc

SEQ ID NO: 133124 - RNA, 19 nt, Human
ugaaaccccaucucuacua

SEQ ID NO: 133125 - RNA, 19 nt, Human
ugaaauccaccuccuccuc

SEQ ID NO: 133126 - RNA, 24 nt, Human
ugaaucgcuugcggucacgaguuc

SEQ ID NO: 133127 - RNA, 25 nt, Human
ugaaucugggaaggcggagguugca

SEQ ID NO: 133128 - RNA, 24 nt, Human
ugaccaacauggugaaaccccauc

SEQ ID NO: 133129 - RNA, 20 nt, Human
ugaggcaggagaaucgcuug

SEQ ID NO: 133130 - RNA, 22 nt, Human
ugaggcaggagaaucgcuugaa

SEQ ID NO: 133131 - RNA, 24 nt, Human
ugaggcaggagaaucgcuugaauc

SEQ ID NO: 133132 - RNA, 24 nt, Human
ugaggugggugaaucgcuugcggu

SEQ ID NO: 133133 - RNA, 26 nt, Human
ugaggugggugaaucgcuugcgguca

SEQ ID NO: 133134 - RNA, 27 nt, Human
ugaggugggugaaucgcuugcgguuga

SEQ ID NO: 133135 - RNA, 22 nt, Human
ugauagagagaagaguaguggg

SEQ ID NO: 133136 - RNA, 24 nt, Human
ugauagagagaagaguagugggga

SEQ ID NO: 133137 - RNA, 19 nt, Human
ugcaugcuagccugggcaa

SEQ ID NO: 133138 - RNA, 24 nt, Human
ugccauguugcccaagcuggucuc

SEQ ID NO: 133139 - RNA, 24 nt, Human
ugccccaucccuccuaauucucca

SEQ ID NO: 133140 - RNA, 23 nt, Human
ugccgggugugguggcucaagcc

SEQ ID NO: 133141 - RNA, 24 nt, Human
ugccuuagccucccaaagcgcugg

SEQ ID NO: 133142 - RNA, 26 nt, Human
ugcugagccuccugaguagcugggac

SEQ ID NO: 133143 - RNA, 24 nt, Human
ugcuuuucuuaccuucucaguuca

SEQ ID NO: 133144 - RNA, 19 nt, Human
uggaauggcagcucacugu

SEQ ID NO: 133145 - RNA, 20 nt, Human
uggaauggcagcucacugua

SEQ ID NO: 133146 - RNA, 18 nt, Human
uggagugcaguggcacaa

SEQ ID NO: 133147 - RNA, 19 nt, Human
uggagugcaguggcacaau

SEQ ID NO: 133148 - RNA, 21 nt, Human
uggagugcaguggcacaauca

SEQ ID NO: 133149 - RNA, 18 nt, Human
uggauccuauuugcugga

SEQ ID NO: 133150 - RNA, 23 nt, Human
uggcacaaucacgacucacugca

SEQ ID NO: 133151 - RNA, 24 nt, Human
uggccaggcuggucuggaacucuu

SEQ ID NO: 133152 - RNA, 22 nt, Human
uggcgcgcaccugguccuagcu

SEQ ID NO: 133153 - RNA, 22 nt, Human
uggcucaagccgguaaucccag

SEQ ID NO: 133154 - RNA, 24 nt, Human
uggcucaagccgguaaucccagca

SEQ ID NO: 133155 - RNA, 22 nt, Human
uggcuccaaaagucuuacaaug

SEQ ID NO: 133156 - RNA, 22 nt, Human
ugggaauacaggugugcgccac

SEQ ID NO: 133157 - RNA, 18 nt, Human
ugggacuacaggcauggg

SEQ ID NO: 133158 - RNA, 21 nt, Human
ugggacuacaggcaugggcca

SEQ ID NO: 133159 - RNA, 21 nt, Human
ugggacuacaggcaugggcca

SEQ ID NO: 133160 - RNA, 22 nt, Human
ugggacuacaggcaugggccau

SEQ ID NO: 133161 - RNA, 26 nt, Human
ugggacuacaggcaugggccauucca

SEQ ID NO: 133162 - RNA, 19 nt, Human
ugggaggcugaggugggug

SEQ ID NO: 133163 - RNA, 24 nt, Human
ugggaggcugaggugggugaaucg

SEQ ID NO: 133164 - RNA, 21 nt, Human
ugggauuacaggugugagcca

SEQ ID NO: 133165 - RNA, 22 nt, Human
ugggauuacaggugugagccac

SEQ ID NO: 133166 - RNA, 22 nt, Human
ugggauuacaggugugagccac

SEQ ID NO: 133167 - RNA, 22 nt, Human
ugggauuacaggugugagccac

SEQ ID NO: 133168 - RNA, 24 nt, Human
ugggauuacaggugugagccacug

SEQ ID NO: 133169 - RNA, 24 nt, Human
uggguuuuuccaaauuauuguuuu

SEQ ID NO: 133170 - RNA, 20 nt, Human
uggucucaagugaucugccu

SEQ ID NO: 133171 - RNA, 24 nt, Human
uggucucaagugaucugccugccu

SEQ ID NO: 133172 - RNA, 20 nt, Human
ugguggcgcgcaccuggucc

SEQ ID NO: 133173 - RNA, 24 nt, Human
ugguggcucaagccgguaauccca

SEQ ID NO: 133174 - RNA, 24 nt, Human
uguagagauggggcuuugccaugu

SEQ ID NO: 133175 - RNA, 27 nt, Human
uguagcaggugcuggggacucaguugg

SEQ ID NO: 133176 - RNA, 21 nt, Human
ugucaccccggcuggagugca

SEQ ID NO: 133177 - RNA, 24 nt, Human
ugugcaggcgaggccccgcccccc

SEQ ID NO: 133178 - RNA, 20 nt, Human
uguguacauacugcuccuug

SEQ ID NO: 133179 - RNA, 24 nt, Human
uuacaccaucacaaucuucacuuu

SEQ ID NO: 133180 - RNA, 18 nt, Human
uuagccgggcgugguggc

SEQ ID NO: 133181 - RNA, 20 nt, Human
uuagccgggcgugguggcgc

SEQ ID NO: 133182 - RNA, 20 nt, Human
uuagccgggcgugguggcgc

SEQ ID NO: 133183 - RNA, 18 nt, Human
uucucucuacuucauuca

SEQ ID NO: 133184 - RNA, 25 nt, Human
uugaaucugggaaggcggagguugc

SEQ ID NO: 133185 - RNA, 20 nt, Human
uugcaguaagccgaggucac

SEQ ID NO: 133186 - RNA, 24 nt, Human
uugggaggcugaggugggugaauc

SEQ ID NO: 133187 - RNA, 24 nt, Human
uuguagagauggggcuuugccaug

SEQ ID NO: 133188 - RNA, 23 nt, Human
uuguggccgccccgcccccucgu

SEQ ID NO: 133189 - RNA, 21 nt, Human
uuguuuucaauuuuucacugu

SEQ ID NO: 133190 - RNA, 21 nt, Human
uuugcuggaguauuuucucca

SEQ ID NO: 133191 - RNA, 24 nt, Human
uuuguagagauggggcuuugccau

SEQ ID NO: 133192 - RNA, 23 nt, Human
uuuucuccaacagcuucccuaaa

SEQ ID NO: 133193 - RNA, 20 nt, Human
uuuuuguguuuuuuguagag

SEQ ID NO: 133194 - RNA, 24 nt, Human
uuuuuuguagagauggggcuuugc

SEQ ID NO: 133195 - RNA, 18 nt, Human
aaguaggggaggggcugg

SEQ ID NO: 133196 - RNA, 22 nt, Human
caaaaaguaggggaggggcugg

SEQ ID NO: 133197 - RNA, 23 nt, Human
cgggcuuacggcggcccagaaac

SEQ ID NO: 133198 - RNA, 22 nt, Human
ggccgggcuuacggcggcccag

SEQ ID NO: 133199 - RNA, 23 nt, Human
ucugcaaauuaauaaauagaaga

SEQ ID NO: 133200 - RNA, 23 nt, Human
uuacggcggcccagaaacgcguu

SEQ ID NO: 133201 - RNA, 22 nt, Human
uuuuuuuuuuuuaaggacuuca

SEQ ID NO: 133202 - RNA, 23 nt, Human
uuuuuuuuuuuuuuuuuuuaagg

SEQ ID NO: 133203 - RNA, 25 nt, Human
uuuuuuuuuuuuuuuuuuuuuaagg

SEQ ID NO: 133204 - RNA, 19 nt, Human
aagagcaccauauggccca

SEQ ID NO: 133205 - RNA, 19 nt, Human
aagagcaccauauggccca

SEQ ID NO: 133206 - RNA, 22 nt, Human
aaguuuuacuuuuuuuuuuucu

SEQ ID NO: 133207 - RNA, 18 nt, Human
acagaggaauaaauacau

SEQ ID NO: 133208 - RNA, 19 nt, Human
accccaaaacccugaggcg

SEQ ID NO: 133209 - RNA, 22 nt, Human
agacaagaggcacugcucagaa

SEQ ID NO: 133210 - RNA, 18 nt, Human
agacuccagggccaaccc

SEQ ID NO: 133211 - RNA, 20 nt, Human
aggacagggauggggcuggg

SEQ ID NO: 133212 - RNA, 23 nt, Human
aggcaggggaaccacaguucagg

SEQ ID NO: 133213 - RNA, 22 nt, Human
agggcguggggugcgcgggggc

SEQ ID NO: 133214 - RNA, 19 nt, Human
aggggcuccaggggaacug

SEQ ID NO: 133215 - RNA, 21 nt, Human
aggugauucaccagggcacgg

SEQ ID NO: 133216 - RNA, 18 nt, Human
agguggugaggccugggc

SEQ ID NO: 133217 - RNA, 21 nt, Human
auacaugugguugugggaguu

SEQ ID NO: 133218 - RNA, 22 nt, Human
caaaguuuuacuuuuuuuuuuu

SEQ ID NO: 133219 - RNA, 18 nt, Human
caagcucccggcuggcca

SEQ ID NO: 133220 - RNA, 23 nt, Human
caauacgcaagaggcuaacacaa

SEQ ID NO: 133221 - RNA, 22 nt, Human
cacucacagccgggcugggagg

SEQ ID NO: 133222 - RNA, 21 nt, Human
cagccguggcccaucugggac

SEQ ID NO: 133223 - RNA, 22 nt, Human
caggaccccaaaacccugaggc

SEQ ID NO: 133224 - RNA, 18 nt, Human
cagugggcugccaacccc

SEQ ID NO: 133225 - RNA, 21 nt, Human
cagugggcugccaacccccca

SEQ ID NO: 133226 - RNA, 21 nt, Human
caguucaggauggcagaccaa

SEQ ID NO: 133227 - RNA, 22 nt, Human
caucugggacacagcccugcuc

SEQ ID NO: 133228 - RNA, 21 nt, Human
ccagcccaggaccccaaaacc

SEQ ID NO: 133229 - RNA, 20 nt, Human
ccaucugggacacagcccug

SEQ ID NO: 133230 - RNA, 26 nt, Human
ccauggccagcccccucuucccacuc

SEQ ID NO: 133231 - RNA, 24 nt, Human
ccccagcccaggaccccaaaaccc

SEQ ID NO: 133232 - RNA, 19 nt, Human
cccccaagagggcuuucug

SEQ ID NO: 133233 - RNA, 18 nt, Human
cccugaggcgggaguggg

SEQ ID NO: 133234 - RNA, 21 nt, Human
cccugaggcgggagugggggu

SEQ ID NO: 133235 - RNA, 22 nt, Human
cccugggaccugcagcuuuggg

SEQ ID NO: 133236 - RNA, 21 nt, Human
ccugaggcggugcagugggcu

SEQ ID NO: 133237 - RNA, 21 nt, Human
ccugcagcuuugggccugcca

SEQ ID NO: 133238 - RNA, 22 nt, Human
ccugcagcuuugggccugccau

SEQ ID NO: 133239 - RNA, 21 nt, Human
cgggcugggaggcaggggaac

SEQ ID NO: 133240 - RNA, 19 nt, Human
cguggggugcgcgggggcg

SEQ ID NO: 133241 - RNA, 18 nt, Human
cucagccaggugauucac

SEQ ID NO: 133242 - RNA, 20 nt, Human
cugggggugagggaaggagg

SEQ ID NO: 133243 - RNA, 19 nt, Human
gaaaaagccaauacgcaag

SEQ ID NO: 133244 - RNA, 19 nt, Human
gacuccagggccaaccccu

SEQ ID NO: 133245 - RNA, 18 nt, Human
gagggaaggaggggacgg

SEQ ID NO: 133246 - RNA, 24 nt, Human
gcagaccaagcuccaauguuuucc

SEQ ID NO: 133247 - RNA, 18 nt, Human
gcccaggaccccaaaacc

SEQ ID NO: 133248 - RNA, 19 nt, Human
gcuggccagggcccugggg

SEQ ID NO: 133249 - RNA, 22 nt, Human
ggcagacuccagggccaacccc

SEQ ID NO: 133250 - RNA, 21 nt, Human
ggccaggcugaacccggggcc

SEQ ID NO: 133251 - RNA, 18 nt, Human
ggcccugaggcgggagug

SEQ ID NO: 133252 - RNA, 24 nt, Human
ggcguggggugcgcgggggcggug

SEQ ID NO: 133253 - RNA, 18 nt, Human
ggcuggaaggaaaugcug

SEQ ID NO: 133254 - RNA, 18 nt, Human
ggcuggggugggcccugg

SEQ ID NO: 133255 - RNA, 22 nt, Human
gggcgguggccgugugaccggu

SEQ ID NO: 133256 - RNA, 19 nt, Human
gggcguggggugcgcgggg

SEQ ID NO: 133257 - RNA, 20 nt, Human
gggcguggggugcgcggggg

SEQ ID NO: 133258 - RNA, 19 nt, Human
gggugcgcgggggcggugg

SEQ ID NO: 133259 - RNA, 22 nt, Human
gugggcccugggaccugcagcu

SEQ ID NO: 133260 - RNA, 25 nt, Human
gugucugcugacaucccgacuaugg

SEQ ID NO: 133261 - RNA, 24 nt, Human
gugugugggggguggacgaggggu

SEQ ID NO: 133262 - RNA, 23 nt, Human
uaacacaacuguagucuaaaggc

SEQ ID NO: 133263 - RNA, 19 nt, Human
uaggacagaggaauaaaua

SEQ ID NO: 133264 - RNA, 22 nt, Human
uccacggccgggaauggugggc

SEQ ID NO: 133265 - RNA, 19 nt, Human
ucccaguguggcuggcaga

SEQ ID NO: 133266 - RNA, 21 nt, Human
ucccccugugcugggggugag

SEQ ID NO: 133267 - RNA, 20 nt, Human
ucccgaaggggcuccagggg

SEQ ID NO: 133268 - RNA, 23 nt, Human
ucccggcuggccagggcccuggg

SEQ ID NO: 133269 - RNA, 23 nt, Human
ucgcugagcacucacagccgggc

SEQ ID NO: 133270 - RNA, 21 nt, Human
ugaaaaagccaauacgcaaga

SEQ ID NO: 133271 - RNA, 19 nt, Human
ugagggaaggaggggacgg

SEQ ID NO: 133272 - RNA, 18 nt, Human
ugcgauguggggagguga

SEQ ID NO: 133273 - RNA, 25 nt, Human
ugcucagaaucccccugugcugggg

SEQ ID NO: 133274 - RNA, 23 nt, Human
uggaaggaaaugcugagguucug

SEQ ID NO: 133275 - RNA, 20 nt, Human
uggcccaacugucagccugu

SEQ ID NO: 133276 - RNA, 19 nt, Human
uggcuggggugggcccugg

SEQ ID NO: 133277 - RNA, 24 nt, Human
ugggaagagcaccauauggcccaa

SEQ ID NO: 133278 - RNA, 21 nt, Human
ugggaccugcagcuuugggcc

SEQ ID NO: 133279 - RNA, 20 nt, Human
ugggcccugggaccugcagc

SEQ ID NO: 133280 - RNA, 23 nt, Human
ugggcccugggaccugcagcuuu

SEQ ID NO: 133281 - RNA, 19 nt, Human
ugggggugacaggcguggc

SEQ ID NO: 133282 - RNA, 24 nt, Human
ugggggugagggaaggaggggacg

SEQ ID NO: 133283 - RNA, 18 nt, Human
ugguaaggaccaguaagu

SEQ ID NO: 133284 - RNA, 25 nt, Human
ugugcugggggugagggaaggaggg

SEQ ID NO: 133285 - RNA, 19 nt, Human
ugugggggguggacgaggg

SEQ ID NO: 133286 - RNA, 22 nt, Human
aaaaaagaaauaaaccacagag

SEQ ID NO: 133287 - RNA, 18 nt, Human
aaaaaucugugaggaccc

SEQ ID NO: 133288 - RNA, 24 nt, Human
aaaagggacagagacagaaaaaaa

SEQ ID NO: 133289 - RNA, 25 nt, Human
aaaauaaggcaaguuuguaucugga

SEQ ID NO: 133290 - RNA, 24 nt, Human
aacaacaagauaauaaauuucuau

SEQ ID NO: 133291 - RNA, 21 nt, Human
aacauaagaaauauacaugua

SEQ ID NO: 133292 - RNA, 20 nt, Human
aacuagaaaauaaggcaagu

SEQ ID NO: 133293 - RNA, 21 nt, Human
aacuagaaaauaaggcaaguu

SEQ ID NO: 133294 - RNA, 21 nt, Human
aagaaacuggaagacacggga

SEQ ID NO: 133295 - RNA, 25 nt, Human
aagagcuacaggcccaaagggugga

SEQ ID NO: 133296 - RNA, 26 nt, Human
aagagcuacaggcccaaaggguggag

SEQ ID NO: 133297 - RNA, 20 nt, Human
aagcagaugaauccaucagc

SEQ ID NO: 133298 - RNA, 18 nt, Human
aagcugccgauuucaggc

SEQ ID NO: 133299 - RNA, 24 nt, Human
aagggaauccuugucauauagugg

SEQ ID NO: 133300 - RNA, 23 nt, Human
aaguguccuuauaagagagaggc

SEQ ID NO: 133301 - RNA, 23 nt, Human
aaucaucuaaaacaaaacugcaa

SEQ ID NO: 133302 - RNA, 21 nt, Human
aaugugugugugcaugugugu

SEQ ID NO: 133303 - RNA, 20 nt, Human
acaaaccaaggaaugauggc

SEQ ID NO: 133304 - RNA, 24 nt, Human
acaauagcuuuuagagacaaacuu

SEQ ID NO: 133305 - RNA, 19 nt, Human
acacaaucucccucaauac

SEQ ID NO: 133306 - RNA, 20 nt, Human
acacaaucucccucaauacc

SEQ ID NO: 133307 - RNA, 23 nt, Human
acacaaucucccucaauacccau

SEQ ID NO: 133308 - RNA, 18 nt, Human
acacauauuuacacauac

SEQ ID NO: 133309 - RNA, 20 nt, Human
acaccuguaauccggcacuu

SEQ ID NO: 133310 - RNA, 21 nt, Human
acagaaaaaaaugaaagaaga

SEQ ID NO: 133311 - RNA, 18 nt, Human
acagagcauaggaaucaa

SEQ ID NO: 133312 - RNA, 18 nt, Human
acagagugagaccucauc

SEQ ID NO: 133313 - RNA, 19 nt, Human
accacggucgccgccgccc

SEQ ID NO: 133314 - RNA, 20 nt, Human
accacggucgccgccgcccu

SEQ ID NO: 133315 - RNA, 22 nt, Human
acgccguugccacuacucggcg

SEQ ID NO: 133316 - RNA, 19 nt, Human
acuacacugcagccugggu

SEQ ID NO: 133317 - RNA, 24 nt, Human
acuacacugcagccugggugacag

SEQ ID NO: 133318 - RNA, 22 nt, Human
acuagggauuggaagcugacac

SEQ ID NO: 133319 - RNA, 24 nt, Human
acugcagccugggugacagaguga

SEQ ID NO: 133320 - RNA, 19 nt, Human
acuggaggcaaaggcagca

SEQ ID NO: 133321 - RNA, 23 nt, Human
acuggauaauucuuucuauucuu

SEQ ID NO: 133322 - RNA, 21 nt, Human
acuucauccagcuuaucuuga

SEQ ID NO: 133323 - RNA, 21 nt, Human
acuuggaaggcugaugcagga

SEQ ID NO: 133324 - RNA, 21 nt, Human
agaaacacuuccaacugggcc

SEQ ID NO: 133325 - RNA, 23 nt, Human
agaaagaagcaauagaaaaaaga

SEQ ID NO: 133326 - RNA, 26 nt, Human
agacagaaaaaaaugaaaggggaccc

SEQ ID NO: 133327 - RNA, 22 nt, Human
agacagaaaacagauacauuga

SEQ ID NO: 133328 - RNA, 27 nt, Human
agacagaaaacagauacauugacaaaa

SEQ ID NO: 133329 - RNA, 25 nt, Human
agacauagccacauccuaaucccca

SEQ ID NO: 133330 - RNA, 18 nt, Human
agacuagaagaauuuugg

SEQ ID NO: 133331 - RNA, 20 nt, Human
agacuagaagaauuuuggug

SEQ ID NO: 133332 - RNA, 21 nt, Human
agagauagguguuuauuccaa

SEQ ID NO: 133333 - RNA, 24 nt, Human
agagggccucaacacacgugauuc

SEQ ID NO: 133334 - RNA, 18 nt, Human
agagguagauuauauaua

SEQ ID NO: 133335 - RNA, 23 nt, Human
agauggguggauugcuugaggcu

SEQ ID NO: 133336 - RNA, 22 nt, Human
agcaguacuuucgugaauuucc

SEQ ID NO: 133337 - RNA, 21 nt, Human
agccaaaaaaugccaauagcc

SEQ ID NO: 133338 - RNA, 22 nt, Human
agccacaagaaacuggaagaca

SEQ ID NO: 133339 - RNA, 18 nt, Human
agccaggcauggugguau

SEQ ID NO: 133340 - RNA, 19 nt, Human
agccugggaguuugagguu

SEQ ID NO: 133341 - RNA, 23 nt, Human
agccugggugacagagugagacc

SEQ ID NO: 133342 - RNA, 24 nt, Human
agccugggugacagagugagaccu

SEQ ID NO: 133343 - RNA, 21 nt, Human
aggagacuccauuccaauuuc

SEQ ID NO: 133344 - RNA, 24 nt, Human
aggcacccccgacgcaaccacgcc

SEQ ID NO: 133345 - RNA, 19 nt, Human
aggcagaggcccaagugug

SEQ ID NO: 133346 - RNA, 25 nt, Human
aggcagaggcccaagugugggaaca

SEQ ID NO: 133347 - RNA, 22 nt, Human
aggcauaugcucccaaauuuua

SEQ ID NO: 133348 - RNA, 23 nt, Human
aggcauggugguaugcaccugua

SEQ ID NO: 133349 - RNA, 23 nt, Human
aggcauuuggucaaaggugucau

SEQ ID NO: 133350 - RNA, 18 nt, Human
aggcccccgggacuccag

SEQ ID NO: 133351 - RNA, 24 nt, Human
aggcugaugcaggaggaucccuug

SEQ ID NO: 133352 - RNA, 19 nt, Human
agggagcuauguuugcacc

SEQ ID NO: 133353 - RNA, 20 nt, Human
agggauuggaagcugacacu

SEQ ID NO: 133354 - RNA, 20 nt, Human
aggguuuucucaaaaauagc

SEQ ID NO: 133355 - RNA, 22 nt, Human
aguauuacaaaugcacacuacu

SEQ ID NO: 133356 - RNA, 18 nt, Human
auaagccaaaaaaugcca

SEQ ID NO: 133357 - RNA, 22 nt, Human
auaccuaaguaaggaugcacug

SEQ ID NO: 133358 - RNA, 21 nt, Human
auccggcacuuuaggaggcca

SEQ ID NO: 133359 - RNA, 18 nt, Human
augcaucuuaaaaaguga

SEQ ID NO: 133360 - RNA, 20 nt, Human
augcaucuuaaaaagugaaa

SEQ ID NO: 133361 - RNA, 19 nt, Human
auggguggauugcuugagg

SEQ ID NO: 133362 - RNA, 22 nt, Human
augugugugcauuuguguaugu

SEQ ID NO: 133363 - RNA, 21 nt, Human
augugugugugcaugugugug

SEQ ID NO: 133364 - RNA, 21 nt, Human
auuaacuuguggauuuauuug

SEQ ID NO: 133365 - RNA, 21 nt, Human
auucuuuuucuucucuuuugu

SEQ ID NO: 133366 - RNA, 25 nt, Human
auuuggagaagggggccuugcagau

SEQ ID NO: 133367 - RNA, 20 nt, Human
caaaaaaugccaauagccac

SEQ ID NO: 133368 - RNA, 19 nt, Human
caaaaugcaucauuuuguu

SEQ ID NO: 133369 - RNA, 19 nt, Human
caagauaaaggaagcacca

SEQ ID NO: 133370 - RNA, 22 nt, Human
caauagaaaaaagaaauaaacc

SEQ ID NO: 133371 - RNA, 25 nt, Human
caauagaaaaaagaaauaaaccaca

SEQ ID NO: 133372 - RNA, 24 nt, Human
cacaaaccaaggaaugauggcagc

SEQ ID NO: 133373 - RNA, 20 nt, Human
cacaaacuagaaaauaaggc

SEQ ID NO: 133374 - RNA, 20 nt, Human
cacaaauccacaguucuacu

SEQ ID NO: 133375 - RNA, 23 nt, Human
cacagcagaaagagaaauguggc

SEQ ID NO: 133376 - RNA, 20 nt, Human
caccaagaaugcaucuuaaa

SEQ ID NO: 133377 - RNA, 18 nt, Human
caccaucccgagagcaga

SEQ ID NO: 133378 - RNA, 20 nt, Human
cacccccgacgcaaccacgc

SEQ ID NO: 133379 - RNA, 22 nt, Human
caccucucccuuuaggugaggg

SEQ ID NO: 133380 - RNA, 26 nt, Human
caccuguaauccggcacuuuaggagg

SEQ ID NO: 133381 - RNA, 20 nt, Human
caccuguagacccagcuacu

SEQ ID NO: 133382 - RNA, 23 nt, Human
caccuguagacccagcuacuugg

SEQ ID NO: 133383 - RNA, 24 nt, Human
cacuacacugcagccugggugaca

SEQ ID NO: 133384 - RNA, 23 nt, Human
cacugcagccugggugacagagu

SEQ ID NO: 133385 - RNA, 24 nt, Human
cacugcagccugggugacagagug

SEQ ID NO: 133386 - RNA, 25 nt, Human
cacuuuguucuucucaaaaugcauc

SEQ ID NO: 133387 - RNA, 21 nt, Human
cagaaagagaaauguggccau

SEQ ID NO: 133388 - RNA, 18 nt, Human
cagaagccaagaauagag

SEQ ID NO: 133389 - RNA, 20 nt, Human
cagagcacagaguugggauc

SEQ ID NO: 133390 - RNA, 21 nt, Human
cagagcugcagguacagaggc

SEQ ID NO: 133391 - RNA, 22 nt, Human
cagaggcagauuagguauacag

SEQ ID NO: 133392 - RNA, 23 nt, Human
cagcacaaauccacaguucuacu

SEQ ID NO: 133393 - RNA, 23 nt, Human
cagcagccugugcagacaauagc

SEQ ID NO: 133394 - RNA, 21 nt, Human
cagcaguuugaaucauuauac

SEQ ID NO: 133395 - RNA, 22 nt, Human
cagccugggugacagagugaga

SEQ ID NO: 133396 - RNA, 24 nt, Human
caggagacuccauuccaauuucca

SEQ ID NO: 133397 - RNA, 19 nt, Human
caggcucccaggcaccccc

SEQ ID NO: 133398 - RNA, 24 nt, Human
cauaaauuuugggccaaagggcag

SEQ ID NO: 133399 - RNA, 21 nt, Human
cauagccacauccuaaucccc

SEQ ID NO: 133400 - RNA, 21 nt, Human
cauuuguucuucucucugaau

SEQ ID NO: 133401 - RNA, 22 nt, Human
ccaaaaaaugccaauagccacc

SEQ ID NO: 133402 - RNA, 26 nt, Human
ccaaaaaaugccaauagccaccaaaa

SEQ ID NO: 133403 - RNA, 23 nt, Human
ccaaucaucuaaaacaaaacugc

SEQ ID NO: 133404 - RNA, 21 nt, Human
ccacaguucuacugcaaguga

SEQ ID NO: 133405 - RNA, 22 nt, Human
ccacauccuaauccccaaaacc

SEQ ID NO: 133406 - RNA, 18 nt, Human
ccacgaagauuucagaaa

SEQ ID NO: 133407 - RNA, 24 nt, Human
ccacuacacugcagccugggugac

SEQ ID NO: 133408 - RNA, 20 nt, Human
ccagaagacguucagcccug

SEQ ID NO: 133409 - RNA, 23 nt, Human
ccaggcacccccgacgcaaccac

SEQ ID NO: 133410 - RNA, 19 nt, Human
ccaucccgagagcagagcu

SEQ ID NO: 133411 - RNA, 28 nt, Human
cccaaaaaagauauucaauauccuacuc

SEQ ID NO: 133412 - RNA, 23 nt, Human
cccaaaggguggagcccugagaa

SEQ ID NO: 133413 - RNA, 24 nt, Human
ccccaccucuccucaacugagaaa

SEQ ID NO: 133414 - RNA, 25 nt, Human
ccccaccucuccucaacugagaaag

SEQ ID NO: 133415 - RNA, 19 nt, Human
cccccgacgcaaccacgcc

SEQ ID NO: 133416 - RNA, 23 nt, Human
cccccgggacuccaggcucccag

SEQ ID NO: 133417 - RNA, 22 nt, Human
cccgggacuccaggcucccagg

SEQ ID NO: 133418 - RNA, 19 nt, Human
cccuaagucccgucacaag

SEQ ID NO: 133419 - RNA, 25 nt, Human
cccucaauacccauucaaagcaguc

SEQ ID NO: 133420 - RNA, 22 nt, Human
cccuguaaccccaccucuccuc

SEQ ID NO: 133421 - RNA, 20 nt, Human
cccuucaaaaauguaagcaa

SEQ ID NO: 133422 - RNA, 19 nt, Human
ccuacagacugauaagcug

SEQ ID NO: 133423 - RNA, 24 nt, Human
ccuaucucuuuaagagggccucaa

SEQ ID NO: 133424 - RNA, 19 nt, Human
ccucaacacacgugauucu

SEQ ID NO: 133425 - RNA, 21 nt, Human
ccugggugacagagugagacc

SEQ ID NO: 133426 - RNA, 21 nt, Human
ccuguagacccagcuacuugg

SEQ ID NO: 133427 - RNA, 18 nt, Human
cgccgccgcccucagggc

SEQ ID NO: 133428 - RNA, 20 nt, Human
cggcacuuuaggaggccaag

SEQ ID NO: 133429 - RNA, 26 nt, Human
cggcacuuuaggaggccaagaugggu

SEQ ID NO: 133430 - RNA, 19 nt, Human
cguaauagaauuuuccagg

SEQ ID NO: 133431 - RNA, 22 nt, Human
cuaaaagacauagccacauccu

SEQ ID NO: 133432 - RNA, 24 nt, Human
cuaaaagacauagccacauccuaa

SEQ ID NO: 133433 - RNA, 20 nt, Human
cuaaaauggaacacauuuug

SEQ ID NO: 133434 - RNA, 19 nt, Human
cuacaaaaaaaugcaaaaa

SEQ ID NO: 133435 - RNA, 23 nt, Human
cuacaggcccaaaggguggagcc

SEQ ID NO: 133436 - RNA, 19 nt, Human
cucaugaggugaggagauu

SEQ ID NO: 133437 - RNA, 22 nt, Human
cuccggcccugucaccugugcc

SEQ ID NO: 133438 - RNA, 22 nt, Human
cucuguagauaagcccaagggu

SEQ ID NO: 133439 - RNA, 21 nt, Human
cugagccugaauucacaaucu

SEQ ID NO: 133440 - RNA, 23 nt, Human
cugcaagugaaauacuucuucag

SEQ ID NO: 133441 - RNA, 21 nt, Human
cugggaaacaaaccuuuuaac

SEQ ID NO: 133442 - RNA, 23 nt, Human
cugggcaugguggcuuacaccug

SEQ ID NO: 133443 - RNA, 19 nt, Human
cuuagaacucuucaauuuc

SEQ ID NO: 133444 - RNA, 25 nt, Human
cuuucuauucuuuuucuucucuuuu

SEQ ID NO: 133445 - RNA, 24 nt, Human
cuuuuuccucucagguuuucuaga

SEQ ID NO: 133446 - RNA, 22 nt, Human
gaaaauaacuauauaaguggac

SEQ ID NO: 133447 - RNA, 18 nt, Human
gaaauuggaaagagagug

SEQ ID NO: 133448 - RNA, 22 nt, Human
gaaccuguuuucccugcuagac

SEQ ID NO: 133449 - RNA, 20 nt, Human
gaagacagaggagagggaga

SEQ ID NO: 133450 - RNA, 18 nt, Human
gaagacguucagcccugc

SEQ ID NO: 133451 - RNA, 19 nt, Human
gaagagcuacaggcccaaa

SEQ ID NO: 133452 - RNA, 22 nt, Human
gaauagagaugggguuguucag

SEQ ID NO: 133453 - RNA, 19 nt, Human
gacaaccuuuggcuagugc

SEQ ID NO: 133454 - RNA, 23 nt, Human
gacugauaagcugucaaaagaau

SEQ ID NO: 133455 - RNA, 18 nt, Human
gagcuauguuugcaccac

SEQ ID NO: 133456 - RNA, 18 nt, Human
gaggcagaggcagauuag

SEQ ID NO: 133457 - RNA, 19 nt, Human
gauauagcuuaguuucuuc

SEQ ID NO: 133458 - RNA, 24 nt, Human
gaucccuugagccugggaguuuga

SEQ ID NO: 133459 - RNA, 24 nt, Human
gauugcuugaggcuaggaguucga

SEQ ID NO: 133460 - RNA, 23 nt, Human
gcacacuuuguucuucucaaaau

SEQ ID NO: 133461 - RNA, 23 nt, Human
gcacuuuaggaggccaagauggg

SEQ ID NO: 133462 - RNA, 24 nt, Human
gcagagcugcagguacagaggcaa

SEQ ID NO: 133463 - RNA, 18 nt, Human
gcagauuaacuuuucugu

SEQ ID NO: 133464 - RNA, 23 nt, Human
gcaucuuaaaaagugaaaaauuc

SEQ ID NO: 133465 - RNA, 18 nt, Human
gcaugguggcuuacaccu

SEQ ID NO: 133466 - RNA, 18 nt, Human
gcauuuggucaaaggugu

SEQ ID NO: 133467 - RNA, 23 nt, Human
gccaaaaaaugccaauagccacc

SEQ ID NO: 133468 - RNA, 25 nt, Human
gcccauaguagcaaaaguaucaacc

SEQ ID NO: 133469 - RNA, 23 nt, Human
gcccccgggacuccaggcuccca

SEQ ID NO: 133470 - RNA, 25 nt, Human
ggcacagaggcagaggcccaaucca

SEQ ID NO: 133471 - RNA, 23 nt, Human
ggcacuuuaggaggccaagaugg

SEQ ID NO: 133472 - RNA, 18 nt, Human
ggcauaugcucccaaauu

SEQ ID NO: 133473 - RNA, 23 nt, Human
ggcaugguggcuuacaccuguaa

SEQ ID NO: 133474 - RNA, 21 nt, Human
ggccaaagggcagacucuggu

SEQ ID NO: 133475 - RNA, 18 nt, Human
gggcagacucuggugggc

SEQ ID NO: 133476 - RNA, 20 nt, Human
uaaaagacauagccacaucc

SEQ ID NO: 133477 - RNA, 27 nt, Human
uaaaauaauagacagacaaguuaagua

SEQ ID NO: 133478 - RNA, 19 nt, Human
uaaaauugcacuccagaga

SEQ ID NO: 133479 - RNA, 19 nt, Human
uaaacagaggcagaggcag

SEQ ID NO: 133480 - RNA, 22 nt, Human
uaaaugaugaacuuggauguuu

SEQ ID NO: 133481 - RNA, 18 nt, Human
uaaauuagaaccuaaacu

SEQ ID NO: 133482 - RNA, 23 nt, Human
uaagcaaauaaguuucuguugug

SEQ ID NO: 133483 - RNA, 18 nt, Human
uaagcugucaaaagaauu

SEQ ID NO: 133484 - RNA, 19 nt, Human
uaaguaaguagccauuaca

SEQ ID NO: 133485 - RNA, 22 nt, Human
uaauuuguuacagcagccaaag

SEQ ID NO: 133486 - RNA, 20 nt, Human
uaauuuguuacagcagccau

SEQ ID NO: 133487 - RNA, 24 nt, Human
uacacaucuuuacacuaaaaugga

SEQ ID NO: 133488 - RNA, 18 nt, Human
uacaccuguaauccggca

SEQ ID NO: 133489 - RNA, 18 nt, Human
uacacugcagccugggug

SEQ ID NO: 133490 - RNA, 19 nt, Human
uacacugcagccuggguga

SEQ ID NO: 133491 - RNA, 19 nt, Human
uacagggagcuauguuugc

SEQ ID NO: 133492 - RNA, 22 nt, Human
uacauguaagaaauuucuuaca

SEQ ID NO: 133493 - RNA, 26 nt, Human
uaccuaaguaaggaugcacuggaggc

SEQ ID NO: 133494 - RNA, 24 nt, Human
uacuagggauuggaagcugacacu

SEQ ID NO: 133495 - RNA, 23 nt, Human
uagaaaauaaggcaaguuuguau

SEQ ID NO: 133496 - RNA, 23 nt, Human
uagaagaauuuugguggauguga

SEQ ID NO: 133497 - RNA, 22 nt, Human
uaggaggccaagauggguggau

SEQ ID NO: 133498 - RNA, 24 nt, Human
uaggaggccaagauggguggauug

SEQ ID NO: 133499 - RNA, 20 nt, Human
uaggaguucgagagcagccu

SEQ ID NO: 133500 - RNA, 20 nt, Human
uaggguggagggaaaaguag

SEQ ID NO: 133501 - RNA, 19 nt, Human
uaggugagggauucacggu

SEQ ID NO: 133502 - RNA, 25 nt, Human
uaggugccuaucucuuuaagagggc

SEQ ID NO: 133503 - RNA, 22 nt, Human
uauaaguggacaaaaggaauca

SEQ ID NO: 133504 - RNA, 19 nt, Human
uauccuaugccuguuccca

SEQ ID NO: 133505 - RNA, 22 nt, Human
uaucuuauuuggagaagggggc

SEQ ID NO: 133506 - RNA, 19 nt, Human
uaugaugauaauugagaag

SEQ ID NO: 133507 - RNA, 23 nt, Human
uaugccuguucccaccauuguaa

SEQ ID NO: 133508 - RNA, 21 nt, Human
uauuuaagaaaaauguagaac

SEQ ID NO: 133509 - RNA, 24 nt, Human
ucaauauuugccuuugaaaucuaa

SEQ ID NO: 133510 - RNA, 24 nt, Human
ucacuuaguuggaauuauuguagc

SEQ ID NO: 133511 - RNA, 24 nt, Human
ucacuuguuuacuuuaucucagau

SEQ ID NO: 133512 - RNA, 22 nt, Human
ucagagguaguuuugugccugc

SEQ ID NO: 133513 - RNA, 20 nt, Human
ucaguauuucuaccuugacc

SEQ ID NO: 133514 - RNA, 21 nt, Human
ucauauaguggcaaaaaguuu

SEQ ID NO: 133515 - RNA, 23 nt, Human
uccauaguccaagaaagaagagc

SEQ ID NO: 133516 - RNA, 21 nt, Human
ucccaggcacccccgacgcaa

SEQ ID NO: 133517 - RNA, 18 nt, Human
ucccuugagccugggagu

SEQ ID NO: 133518 - RNA, 21 nt, Human
ucucaaaaugcaucauuuugu

SEQ ID NO: 133519 - RNA, 23 nt, Human
ucuccggcccugucaccugugcc

SEQ ID NO: 133520 - RNA, 23 nt, Human
ucucuacaaaaaaaugcaaaaaa

SEQ ID NO: 133521 - RNA, 23 nt, Human
ucucuuuuguuuuuggugggggu

SEQ ID NO: 133522 - RNA, 22 nt, Human
ucuguaacuguuauccuaugcc

SEQ ID NO: 133523 - RNA, 24 nt, Human
ucugugaggacccucuuuucugaa

SEQ ID NO: 133524 - RNA, 22 nt, Human
ugaagacacagcagaaagagaa

SEQ ID NO: 133525 - RNA, 19 nt, Human
ugagaaagaggauuacugc

SEQ ID NO: 133526 - RNA, 26 nt, Human
ugagaagaaguucacuuaguuggaag

SEQ ID NO: 133527 - RNA, 19 nt, Human
ugagccugggaguuugagg

SEQ ID NO: 133528 - RNA, 21 nt, Human
ugcaauaguauuacaaaugca

SEQ ID NO: 133529 - RNA, 21 nt, Human
ugcacacuacuucauccagcu

SEQ ID NO: 133530 - RNA, 21 nt, Human
ugcaccacuacacugcagccu

SEQ ID NO: 133531 - RNA, 24 nt, Human
ugcaccuguagacccagcuacuug

SEQ ID NO: 133532 - RNA, 24 nt, Human
ugcagccugggugacagagugaga

SEQ ID NO: 133533 - RNA, 20 nt, Human
ugcagucacaaaccaaggaa

SEQ ID NO: 133534 - RNA, 24 nt, Human
ugcauaaauggugcuucucaugug

SEQ ID NO: 133535 - RNA, 23 nt, Human
ugcucuguagauaagcccaaggg

SEQ ID NO: 133536 - RNA, 18 nt, Human
ugcugaagagguuaggca

SEQ ID NO: 133537 - RNA, 18 nt, Human
uggaacacauuuuguaau

SEQ ID NO: 133538 - RNA, 21 nt, Human
uggaagaaagggaauccuugu

SEQ ID NO: 133539 - RNA, 22 nt, Human
uggaagaaagggaauccuuguc

SEQ ID NO: 133540 - RNA, 25 nt, Human
uggaaugauuguaaaaaaaaaaaaa

SEQ ID NO: 133541 - RNA, 18 nt, Human
uggaggcaaaggcagcag

SEQ ID NO: 133542 - RNA, 20 nt, Human
uggaggcaaaggcagcaguu

SEQ ID NO: 133543 - RNA, 25 nt, Human
uggagggagccauggcuuugcugcc

SEQ ID NO: 133544 - RNA, 24 nt, Human
uggauugcuugaggcuaggaguuc

SEQ ID NO: 133545 - RNA, 20 nt, Human
uggcaaggaaagauucuccu

SEQ ID NO: 133546 - RNA, 23 nt, Human
uggcaguaauauggccaacaaaa

SEQ ID NO: 133547 - RNA, 19 nt, Human
uggcuuacaccuguaaucc

SEQ ID NO: 133548 - RNA, 23 nt, Human
uggcuuacaccuguaauccggca

SEQ ID NO: 133549 - RNA, 23 nt, Human
ugggaaacaaaccuuuuaacuca

SEQ ID NO: 133550 - RNA, 19 nt, Human
ugggcuaagaguggcuucc

SEQ ID NO: 133551 - RNA, 22 nt, Human
ugguaugcaccuguagacccag

SEQ ID NO: 133552 - RNA, 22 nt, Human
uguaacaaaugucuuaaaaugu

SEQ ID NO: 133553 - RNA, 21 nt, Human
uguaaccccaccucuccucaa

SEQ ID NO: 133554 - RNA, 23 nt, Human
uguaaccccaccucuccucaaag

SEQ ID NO: 133555 - RNA, 20 nt, Human
uguauaaaguagauaucugu

SEQ ID NO: 133556 - RNA, 24 nt, Human
ugugucuugacaaccuuuggcuag

SEQ ID NO: 133557 - RNA, 19 nt, Human
ugugugcaugugugugcau

SEQ ID NO: 133558 - RNA, 19 nt, Human
ugugugcaugugugugcau

SEQ ID NO: 133559 - RNA, 21 nt, Human
ugugugcaugugugugcauuu

SEQ ID NO: 133560 - RNA, 20 nt, Human
ugugugcauuuguguaugug

SEQ ID NO: 133561 - RNA, 22 nt, Human
ugugugugugcaugugugugca

SEQ ID NO: 133562 - RNA, 21 nt, Human
uuaacuuguggauuuauuuga

SEQ ID NO: 133563 - RNA, 19 nt, Human
uuacaaaugcacacuacuu

SEQ ID NO: 133564 - RNA, 18 nt, Human
uuacagcagccaaaggag

SEQ ID NO: 133565 - RNA, 21 nt, Human
uuaccacggucgccgccgccc

SEQ ID NO: 133566 - RNA, 21 nt, Human
uuacucccuaauuuauuuaag

SEQ ID NO: 133567 - RNA, 21 nt, Human
uuagaauaauugugggaggag

SEQ ID NO: 133568 - RNA, 24 nt, Human
uuagguauacagaggagggugaug

SEQ ID NO: 133569 - RNA, 20 nt, Human
uuaucuuauuuggagaaggg

SEQ ID NO: 133570 - RNA, 18 nt, Human
uucaaaguuuuccaacua

SEQ ID NO: 133571 - RNA, 25 nt, Human
uucaaaguuuuccaacuaggaaacu

SEQ ID NO: 133572 - RNA, 26 nt, Human
uucaagaucauucuccuaaccccuag

SEQ ID NO: 133573 - RNA, 20 nt, Human
uucuauuguagcagcuucag

SEQ ID NO: 133574 - RNA, 19 nt, Human
uucuguuguguuaagccau

SEQ ID NO: 133575 - RNA, 24 nt, Human
uucuguuucacugguucucagagg

SEQ ID NO: 133576 - RNA, 18 nt, Human
uucuucaggguggcuugg

SEQ ID NO: 133577 - RNA, 24 nt, Human
uugaauaaaugaugaacuuggaug

SEQ ID NO: 133578 - RNA, 18 nt, Human
uugaaugaguagaaacag

SEQ ID NO: 133579 - RNA, 19 nt, Human
uugccaagccagccauuug

SEQ ID NO: 133580 - RNA, 23 nt, Human
uugcuugaggcuaggaguucgag

SEQ ID NO: 133581 - RNA, 19 nt, Human
uuggccuccaaaacaacaa

SEQ ID NO: 133582 - RNA, 21 nt, Human
uugguggaugugauagaaaaa

SEQ ID NO: 133583 - RNA, 21 nt, Human
uuguaccaucaacccaauccu

SEQ ID NO: 133584 - RNA, 22 nt, Human
uuuaagaaaaauguagaaccug

SEQ ID NO: 133585 - RNA, 23 nt, Human
uuuccaaaauggcuucucuuaca

SEQ ID NO: 133586 - RNA, 18 nt, Human
uuuggacuuuuggccucc

SEQ ID NO: 133587 - RNA, 21 nt, Human
uuuguaauccugauaacugug

SEQ ID NO: 133588 - RNA, 24 nt, Human
aaaaagaauucggcacccuaugaa

SEQ ID NO: 133589 - RNA, 20 nt, Human
aggcgaugacuugcagggag

SEQ ID NO: 133590 - RNA, 20 nt, Human
ccuuuggggccacaggugug

SEQ ID NO: 133591 - RNA, 21 nt, Human
ggaaaaaagaauucggcaccc

SEQ ID NO: 133592 - RNA, 21 nt, Human
uuaacaagaugguuguccuuu

SEQ ID NO: 133593 - RNA, 19 nt, Human
aaaagccagcugggucuca

SEQ ID NO: 133594 - RNA, 24 nt, Human
aagucacagccguguguacuuuag

SEQ ID NO: 133595 - RNA, 24 nt, Human
acaacuggaauucuucccauaauu

SEQ ID NO: 133596 - RNA, 19 nt, Human
acugccuccuccuguuucu

SEQ ID NO: 133597 - RNA, 21 nt, Human
aggcuguggccaucauaaaca

SEQ ID NO: 133598 - RNA, 21 nt, Human
aguacucuccucuucccuggu

SEQ ID NO: 133599 - RNA, 22 nt, Human
caaaugaccauuaagagacuug

SEQ ID NO: 133600 - RNA, 20 nt, Human
cacaaaugagcuucugcaua

SEQ ID NO: 133601 - RNA, 23 nt, Human
cagagaaacagaauuucacaaau

SEQ ID NO: 133602 - RNA, 23 nt, Human
ccaacuccucaucucuuccuaac

SEQ ID NO: 133603 - RNA, 19 nt, Human
cucacccaucaucaccacc

SEQ ID NO: 133604 - RNA, 21 nt, Human
cuucccugguaaaauuaggga

SEQ ID NO: 133605 - RNA, 22 nt, Human
gaagcccucccguuggucaccu

SEQ ID NO: 133606 - RNA, 19 nt, Human
gaaugugaucuccaaagug

SEQ ID NO: 133607 - RNA, 21 nt, Human
gccuccuccuguuucuaaucc

SEQ ID NO: 133608 - RNA, 23 nt, Human
ggaaacucacccaucaucaccac

SEQ ID NO: 133609 - RNA, 24 nt, Human
gguaucagaguggcuggagagaga

SEQ ID NO: 133610 - RNA, 22 nt, Human
guacucuccucuucccugguaa

SEQ ID NO: 133611 - RNA, 21 nt, Human
uaacaacuggaauucuuccca

SEQ ID NO: 133612 - RNA, 22 nt, Human
uaaucccuccucuuccaacucc

SEQ ID NO: 133613 - RNA, 23 nt, Human
uagaugaauaccaauggcuaucc

SEQ ID NO: 133614 - RNA, 24 nt, Human
uaucagaguggcuggagagagauc

SEQ ID NO: 133615 - RNA, 22 nt, Human
uauguaaagacacagaguuaaa

SEQ ID NO: 133616 - RNA, 23 nt, Human
ucaaggguaaaagccagcugggu

SEQ ID NO: 133617 - RNA, 19 nt, Human
ucugcauaacugaaugacu

SEQ ID NO: 133618 - RNA, 19 nt, Human
ugaacagcucaaguguugc

SEQ ID NO: 133619 - RNA, 18 nt, Human
ugaaugacagcauugcug

SEQ ID NO: 133620 - RNA, 19 nt, Human
ugaaugacagcauugcugg

SEQ ID NO: 133621 - RNA, 24 nt, Human
ugagaagcccucccguuggucacc

SEQ ID NO: 133622 - RNA, 19 nt, Human
ugcaucuuauaacauuuuc

SEQ ID NO: 133623 - RNA, 21 nt, Human
ugccuauuguuugguuugguc

SEQ ID NO: 133624 - RNA, 23 nt, Human
ugcuucauuuucugauaauaaca

SEQ ID NO: 133625 - RNA, 19 nt, Human
ugggaagccaacccucccu

SEQ ID NO: 133626 - RNA, 21 nt, Human
ugggagcagugucaggcucua

SEQ ID NO: 133627 - RNA, 22 nt, Human
ugugccuguagagugcaacugc

SEQ ID NO: 133628 - RNA, 24 nt, Human
ugugccuguagagugcaacugcuc

SEQ ID NO: 133629 - RNA, 20 nt, Human
uguggccugcauuccucagc

SEQ ID NO: 133630 - RNA, 23 nt, Human
uguuucuaaucccuccucuucca

SEQ ID NO: 133631 - RNA, 20 nt, Human
uuaaaauagaugaauaccaa

SEQ ID NO: 133632 - RNA, 21 nt, Human
uucaggguacagagagcuaga

SEQ ID NO: 133633 - RNA, 23 nt, Human
uucuaaucccuccucuuccaacu

SEQ ID NO: 133634 - RNA, 19 nt, Human
uugaaaagugaggcuagug

SEQ ID NO: 133635 - RNA, 25 nt, Human
aaacccagagcacccucccccucaa

SEQ ID NO: 133636 - RNA, 21 nt, Human
aaagcacuuggcugagggcac

SEQ ID NO: 133637 - RNA, 22 nt, Human
aaauggccuucgaaucaggggc

SEQ ID NO: 133638 - RNA, 20 nt, Human
aacuacucugcccaccccuc

SEQ ID NO: 133639 - RNA, 26 nt, Human
aagcccccugggaccccucgcccucu

SEQ ID NO: 133640 - RNA, 20 nt, Human
acaguuacagaagcagaguc

SEQ ID NO: 133641 - RNA, 21 nt, Human
accccaacuucccucccauuu

SEQ ID NO: 133642 - RNA, 27 nt, Human
accgggccaaagcacuuggcugagggc

SEQ ID NO: 133643 - RNA, 18 nt, Human
agacacaaaagcaacagg

SEQ ID NO: 133644 - RNA, 18 nt, Human
agaccaguuagagauagu

SEQ ID NO: 133645 - RNA, 21 nt, Human
agcgggggaaacuacucugcc

SEQ ID NO: 133646 - RNA, 19 nt, Human
aggaaacagacacaaaagc

SEQ ID NO: 133647 - RNA, 20 nt, Human
aggaaauauuuccagcaaaa

SEQ ID NO: 133648 - RNA, 22 nt, Human
agggcacgcuggggagggggug

SEQ ID NO: 133649 - RNA, 25 nt, Human
aguuacagaagcagagucccaggaa

SEQ ID NO: 133650 - RNA, 22 nt, Human
caaaagcaacagggaacccccu

SEQ ID NO: 133651 - RNA, 21 nt, Human
caaagcagacaccccaacuuc

SEQ ID NO: 133652 - RNA, 18 nt, Human
caccaaccgcgacguggc

SEQ ID NO: 133653 - RNA, 18 nt, Human
caccaaguucagucaauu

SEQ ID NO: 133654 - RNA, 18 nt, Human
caccccaacgucauuccc

SEQ ID NO: 133655 - RNA, 20 nt, Human
caccucccagccccacaauc

SEQ ID NO: 133656 - RNA, 21 nt, Human
caccuccggcccggcccgccc

SEQ ID NO: 133657 - RNA, 22 nt, Human
caccucucuuuccccggacucc

SEQ ID NO: 133658 - RNA, 18 nt, Human
cacggaaacccagagcac

SEQ ID NO: 133659 - RNA, 30 nt, Human
cacggaaacccagagcacccucccccucaa

SEQ ID NO: 133660 - RNA, 26 nt, Human
cagcaaaacacucaccaaauggccuu

SEQ ID NO: 133661 - RNA, 25 nt, Human
cagcagugcagggaguucaauuuau

SEQ ID NO: 133662 - RNA, 22 nt, Human
caggaaacagacacaaaagcaa

SEQ ID NO: 133663 - RNA, 19 nt, Human
caggcccgaagcccccugg

SEQ ID NO: 133664 - RNA, 21 nt, Human
caggcucuccccccaccucuc

SEQ ID NO: 133665 - RNA, 19 nt, Human
cagggaacccccucuccgc

SEQ ID NO: 133666 - RNA, 21 nt, Human
caggggcccuccaccucccag

SEQ ID NO: 133667 - RNA, 25 nt, Human
caggggcccuccaccucccagcccc

SEQ ID NO: 133668 - RNA, 24 nt, Human
ccaaugccucucaagcuaucuucc

SEQ ID NO: 133669 - RNA, 26 nt, Human
ccagcaguguaaugagacaguuacag

SEQ ID NO: 133670 - RNA, 21 nt, Human
cccacaaucagcagcucugcc

SEQ ID NO: 133671 - RNA, 27 nt, Human
cccacaaucagcagcucugccuaggac

SEQ ID NO: 133672 - RNA, 19 nt, Human
ccccaacuucccucccauu

SEQ ID NO: 133673 - RNA, 24 nt, Human
cccccaccucucuuuccccggacu

SEQ ID NO: 133674 - RNA, 24 nt, Human
ccccccaccucucuuuccccggac

SEQ ID NO: 133675 - RNA, 18 nt, Human
ccccggacuccaucaccc

SEQ ID NO: 133676 - RNA, 18 nt, Human
ccccugggaccccucgcc

SEQ ID NO: 133677 - RNA, 21 nt, Human
ccccugggaccccucgccuug

SEQ ID NO: 133678 - RNA, 22 nt, Human
cccuccccauccacgacaucac

SEQ ID NO: 133679 - RNA, 21 nt, Human
cccucgcccucuccgaccacc

SEQ ID NO: 133680 - RNA, 21 nt, Human
cccuggggcgcugcgaaccuc

SEQ ID NO: 133681 - RNA, 21 nt, Human
ccucaagguuuaggugcugcu

SEQ ID NO: 133682 - RNA, 24 nt, Human
ccucacggaaacccagagcacccu

SEQ ID NO: 133683 - RNA, 19 nt, Human
ccuggaacccagcugcgcu

SEQ ID NO: 133684 - RNA, 20 nt, Human
ccuggaacccagcugcgcuc

SEQ ID NO: 133685 - RNA, 23 nt, Human
ccuggaacccagcugcgcucagg

SEQ ID NO: 133686 - RNA, 21 nt, Human
cgacaucacuuccccuaccag

SEQ ID NO: 133687 - RNA, 18 nt, Human
cggaagucacccagcagc

SEQ ID NO: 133688 - RNA, 25 nt, Human
cgggaagcaccgggccaaagcacuu

SEQ ID NO: 133689 - RNA, 20 nt, Human
cucccagccccacaaucagc

SEQ ID NO: 133690 - RNA, 24 nt, Human
cuccccccaccucucuuuccccgg

SEQ ID NO: 133691 - RNA, 19 nt, Human
cuccuggaacccagcugcg

SEQ ID NO: 133692 - RNA, 21 nt, Human
cuccuggaacccagcugcgcu

SEQ ID NO: 133693 - RNA, 19 nt, Human
cucugcccaccccucccca

SEQ ID NO: 133694 - RNA, 22 nt, Human
cucugcccaccccuccccaucc

SEQ ID NO: 133695 - RNA, 25 nt, Human
cucuggucccaaagcagacaccuua

SEQ ID NO: 133696 - RNA, 22 nt, Human
cugagagucuccuggaacccag

SEQ ID NO: 133697 - RNA, 20 nt, Human
gaaacagacacaaaagcaac

SEQ ID NO: 133698 - RNA, 22 nt, Human
gaaggcucgaaggcccagccca

SEQ ID NO: 133699 - RNA, 28 nt, Human
gacaggaaacagacacaaaagggacccc

SEQ ID NO: 133700 - RNA, 22 nt, Human
gagagucuccuggaacccagcu

SEQ ID NO: 133701 - RNA, 20 nt, Human
gagcacccucccccucaagg

SEQ ID NO: 133702 - RNA, 22 nt, Human
gagcccggaagucacccagcag

SEQ ID NO: 133703 - RNA, 22 nt, Human
gagucucagcuuuuucucucuc

SEQ ID NO: 133704 - RNA, 19 nt, Human
gcaguguaaugagacaguu

SEQ ID NO: 133705 - RNA, 18 nt, Human
gcccaccccuccccaucc

SEQ ID NO: 133706 - RNA, 21 nt, Human
gcccgaagcccccugggaccc

SEQ ID NO: 133707 - RNA, 19 nt, Human
gcucagcugagcugagagu

SEQ ID NO: 133708 - RNA, 20 nt, Human
ggacuccaucaccccaacgu

SEQ ID NO: 133709 - RNA, 19 nt, Human
gggagacuccaccuccggc

SEQ ID NO: 133710 - RNA, 18 nt, Human
ggggaggggguguaagaa

SEQ ID NO: 133711 - RNA, 18 nt, Human
ggugcagacucagucuga

SEQ ID NO: 133712 - RNA, 19 nt, Human
gguggcugcaggcccgaag

SEQ ID NO: 133713 - RNA, 22 nt, Human
gugcagcugcgggaagcaccgg

SEQ ID NO: 133714 - RNA, 19 nt, Human
uaagaaaaugcuguagagg

SEQ ID NO: 133715 - RNA, 19 nt, Human
uaagaaaaugcuguagagg

SEQ ID NO: 133716 - RNA, 19 nt, Human
uaggggagauuguucaugu

SEQ ID NO: 133717 - RNA, 21 nt, Human
ucaccaaauggccuucgaauc

SEQ ID NO: 133718 - RNA, 20 nt, Human
ucaccccaacgucauucccc

SEQ ID NO: 133719 - RNA, 22 nt, Human
ucacugggccgucccaagcgug

SEQ ID NO: 133720 - RNA, 18 nt, Human
ucaggcucuccccccacc

SEQ ID NO: 133721 - RNA, 21 nt, Human
ucuccccccaccucucuuucc

SEQ ID NO: 133722 - RNA, 25 nt, Human
ucugcccaccccuccccauccacga

SEQ ID NO: 133723 - RNA, 18 nt, Human
ugagacaguuacagaagc

SEQ ID NO: 133724 - RNA, 21 nt, Human
ugagacaguuacagaagcaga

SEQ ID NO: 133725 - RNA, 18 nt, Human
ugccuaggacuccccuca

SEQ ID NO: 133726 - RNA, 25 nt, Human
ugcuguagaggcaaaguccuggggg

SEQ ID NO: 133727 - RNA, 23 nt, Human
uggcgaggcaucugggcuucagc

SEQ ID NO: 133728 - RNA, 23 nt, Human
uggcugagggcacgcuggggagg

SEQ ID NO: 133729 - RNA, 24 nt, Human
ugggggcacacggacaagggcaag

SEQ ID NO: 133730 - RNA, 19 nt, Human
ugucacugggccgucccaa

SEQ ID NO: 133731 - RNA, 20 nt, Human
uuccagcaaaacacucacca

SEQ ID NO: 133732 - RNA, 18 nt, Human
uuggcugagggcacgcug

SEQ ID NO: 133733 - RNA, 19 nt, Human
uuugaggccccugcaauuc

SEQ ID NO: 133734 - RNA, 25 nt, Human
aacccccagcaagucccuccgcucc

SEQ ID NO: 133735 - RNA, 18 nt, Human
caacccccagcaaguccc

SEQ ID NO: 133736 - RNA, 24 nt, Human
caacccccagcaagucccuccgcu

SEQ ID NO: 133737 - RNA, 24 nt, Human
cagcaagucccuccgcuccagccu

SEQ ID NO: 133738 - RNA, 19 nt, Human
cagccaggacggcguccag

SEQ ID NO: 133739 - RNA, 18 nt, Human
cagucccccugcugcccu

SEQ ID NO: 133740 - RNA, 21 nt, Human
ccaugccagcggccccuccug

SEQ ID NO: 133741 - RNA, 21 nt, Human
ccgcuccagccuucagucccc

SEQ ID NO: 133742 - RNA, 18 nt, Human
cguccaggucccgagguc

SEQ ID NO: 133743 - RNA, 26 nt, Human
cuccagccuucagucccccugcugcc

SEQ ID NO: 133744 - RNA, 20 nt, Human
gagcaauccgggcgggcguc

SEQ ID NO: 133745 - RNA, 24 nt, Human
uaguccaugccagcggccccuccu

SEQ ID NO: 133746 - RNA, 18 nt, Human
uccacagcggucccgggg

SEQ ID NO: 133747 - RNA, 23 nt, Human
ucccccugcugcccugccagcaa

SEQ ID NO: 133748 - RNA, 20 nt, Human
ucccggggcucggggagcaa

SEQ ID NO: 133749 - RNA, 21 nt, Human
uuacccccaauccaaccccca

SEQ ID NO: 133750 - RNA, 20 nt, Human
uuacccccaauccaaccccu

SEQ ID NO: 133751 - RNA, 26 nt, Human
uuauuacccccaauccaacccccagc

SEQ ID NO: 133752 - RNA, 20 nt, Human
aaaaaggcuuaauugacuca

SEQ ID NO: 133753 - RNA, 19 nt, Human
aagcaaggaacuucacaug

SEQ ID NO: 133754 - RNA, 21 nt, Human
aagggcaagagaaacucugcc

SEQ ID NO: 133755 - RNA, 23 nt, Human
aaugcaggcuaacguaacuaccu

SEQ ID NO: 133756 - RNA, 23 nt, Human
acacucuauaaagaucuaccuga

SEQ ID NO: 133757 - RNA, 24 nt, Human
accucccaccaggccccuccucca

SEQ ID NO: 133758 - RNA, 24 nt, Human
acuucacauggugacuggagagaa

SEQ ID NO: 133759 - RNA, 19 nt, Human
acuuuaagggcaagagaaa

SEQ ID NO: 133760 - RNA, 26 nt, Human
agaaagauguguuagcuuaacaacug

SEQ ID NO: 133761 - RNA, 19 nt, Human
agauauugugagaacucac

SEQ ID NO: 133762 - RNA, 26 nt, Human
agauauuuuuauuuuaaugcaggcua

SEQ ID NO: 133763 - RNA, 19 nt, Human
agggacacaaauccaaacc

SEQ ID NO: 133764 - RNA, 21 nt, Human
agguuuuuaaaaguaaauguu

SEQ ID NO: 133765 - RNA, 24 nt, Human
caaacgaauaaagggagaugagca

SEQ ID NO: 133766 - RNA, 19 nt, Human
caaggaacuucacauggug

SEQ ID NO: 133767 - RNA, 23 nt, Human
cacaauuccacaggcuuaauaag

SEQ ID NO: 133768 - RNA, 22 nt, Human
caccaggccccuccuccaauuu

SEQ ID NO: 133769 - RNA, 24 nt, Human
caggcuuaauaagaagcaugacug

SEQ ID NO: 133770 - RNA, 18 nt, Human
caggguggguggucgggc

SEQ ID NO: 133771 - RNA, 18 nt, Human
cccaccaggccccuccuc

SEQ ID NO: 133772 - RNA, 21 nt, Human
ccucccaccaggccccuccuc

SEQ ID NO: 133773 - RNA, 19 nt, Human
gaacuucacauggugacug

SEQ ID NO: 133774 - RNA, 21 nt, Human
gacuuaucuaagaaucaagga

SEQ ID NO: 133775 - RNA, 24 nt, Human
gagaacagcaagggggaaauccgc

SEQ ID NO: 133776 - RNA, 23 nt, Human
gcauuagucuguuuucacacucu

SEQ ID NO: 133777 - RNA, 22 nt, Human
gggaagcaaggaacuucacaug

SEQ ID NO: 133778 - RNA, 23 nt, Human
ggugaugagaagcaaugccagaa

SEQ ID NO: 133779 - RNA, 19 nt, Human
gguggguggucgggcuguu

SEQ ID NO: 133780 - RNA, 24 nt, Human
gugagaacucacucacuaucauga

SEQ ID NO: 133781 - RNA, 22 nt, Human
gugaugagaagcaaugccagaa

SEQ ID NO: 133782 - RNA, 19 nt, Human
ucaggguggguggucgggc

SEQ ID NO: 133783 - RNA, 19 nt, Human
ucagucaaauauuucaaca

SEQ ID NO: 133784 - RNA, 19 nt, Human
ucccaccaggccccuccuc

SEQ ID NO: 133785 - RNA, 22 nt, Human
ucccaccaggccccuccuccaa

SEQ ID NO: 133786 - RNA, 22 nt, Human
ucugaauuuuuccuucugguga

SEQ ID NO: 133787 - RNA, 18 nt, Human
ucuuuuccaguuuuucuc

SEQ ID NO: 133788 - RNA, 22 nt, Human
ucuuuugaguaugaguacaaac

SEQ ID NO: 133789 - RNA, 24 nt, Human
ugaaagaaauucagaacaguuaag

SEQ ID NO: 133790 - RNA, 18 nt, Human
ugacuggagagaaagugc

SEQ ID NO: 133791 - RNA, 26 nt, Human
ugacuggagagaaagugcaagagggg

SEQ ID NO: 133792 - RNA, 22 nt, Human
ugauccaaucaccucccaccag

SEQ ID NO: 133793 - RNA, 21 nt, Human
ugcaagaggggaggugcacac

SEQ ID NO: 133794 - RNA, 20 nt, Human
uggaaaguaagacuuuaagg

SEQ ID NO: 133795 - RNA, 23 nt, Human
uggaggaaaacaucuuggaaggu

SEQ ID NO: 133796 - RNA, 20 nt, Human
ugggcagggacacaaaucca

SEQ ID NO: 133797 - RNA, 24 nt, Human
uguagugaggagaaagauguguua

SEQ ID NO: 133798 - RNA, 24 nt, Human
uguggagagaaauucaauagugau

SEQ ID NO: 133799 - RNA, 23 nt, Human
uuaaugucuuuuccaguuuuucu

SEQ ID NO: 133800 - RNA, 23 nt, Human
uuaauuugcucuacagcauauau

SEQ ID NO: 133801 - RNA, 23 nt, Human
uucacacucuauaaagaucuacc

SEQ ID NO: 133802 - RNA, 19 nt, Human
uuccuagaugaaagucagu

SEQ ID NO: 133803 - RNA, 23 nt, Human
aaaagcuguuaacuccagacucu

SEQ ID NO: 133804 - RNA, 23 nt, Human
aaacacuugggcuagugacgguu

SEQ ID NO: 133805 - RNA, 18 nt, Human
aaaccagccuuacugcag

SEQ ID NO: 133806 - RNA, 23 nt, Human
aaagguggcauaucacugggagg

SEQ ID NO: 133807 - RNA, 24 nt, Human
aaauacaucaugaccucacagaau

SEQ ID NO: 133808 - RNA, 24 nt, Human
aaauuuccauuguuguuguuuuga

SEQ ID NO: 133809 - RNA, 27 nt, Human
aacaaaaaguaaccuuaaugaagcaau

SEQ ID NO: 133810 - RNA, 19 nt, Human
aacacuugggcuagugacg

SEQ ID NO: 133811 - RNA, 20 nt, Human
aacacuugggcuagugacgg

SEQ ID NO: 133812 - RNA, 21 nt, Human
aacauggugaagcccugucuc

SEQ ID NO: 133813 - RNA, 20 nt, Human
aacaugguggcccaccuccc

SEQ ID NO: 133814 - RNA, 24 nt, Human
aagaaagucagcccagugucaggc

SEQ ID NO: 133815 - RNA, 20 nt, Human
aagaaauuuuugagugacau

SEQ ID NO: 133816 - RNA, 23 nt, Human
aagaugucuugugucugggaggc

SEQ ID NO: 133817 - RNA, 27 nt, Human
aagcagcccagcaggagccugaaaugc

SEQ ID NO: 133818 - RNA, 23 nt, Human
aagccgagguggggguggaucgc

SEQ ID NO: 133819 - RNA, 18 nt, Human
aagccucguuugccccag

SEQ ID NO: 133820 - RNA, 23 nt, Human
acagaagugcugcacagcaugga

SEQ ID NO: 133821 - RNA, 24 nt, Human
acagagagagacuccaucucaaaa

SEQ ID NO: 133822 - RNA, 23 nt, Human
accauuugaaagccagcauucca

SEQ ID NO: 133823 - RNA, 24 nt, Human
acugcacuccaacuugggugacag

SEQ ID NO: 133824 - RNA, 26 nt, Human
acugcacuccaacuugggugacagag

SEQ ID NO: 133825 - RNA, 19 nt, Human
acuucacugccuuacugaa

SEQ ID NO: 133826 - RNA, 23 nt, Human
acuugggugacagagagagacuc

SEQ ID NO: 133827 - RNA, 25 nt, Human
agaagcacaaacagaacaaccacug

SEQ ID NO: 133828 - RNA, 22 nt, Human
agagguugcagugagccgagau

SEQ ID NO: 133829 - RNA, 24 nt, Human
agagguugcagugagccgagauug

SEQ ID NO: 133830 - RNA, 20 nt, Human
agaucaggaugauggugggg

SEQ ID NO: 133831 - RNA, 19 nt, Human
agaugcaaucauugccaca

SEQ ID NO: 133832 - RNA, 18 nt, Human
agauugcggggccacugc

SEQ ID NO: 133833 - RNA, 21 nt, Human
agcacauucacauauugugcu

SEQ ID NO: 133834 - RNA, 24 nt, Human
agcacuuugggaagccgagguggg

SEQ ID NO: 133835 - RNA, 23 nt, Human
agcagaaggcaaauggcacagga

SEQ ID NO: 133836 - RNA, 22 nt, Human
agcagccccccggguccaaaca

SEQ ID NO: 133837 - RNA, 23 nt, Human
agccagaagaagcacgcuggccc

SEQ ID NO: 133838 - RNA, 19 nt, Human
agcucaacacucugcaaaa

SEQ ID NO: 133839 - RNA, 22 nt, Human
aggcaguagaauagcuugaacc

SEQ ID NO: 133840 - RNA, 24 nt, Human
aggcaguagaauagcuugaaccug

SEQ ID NO: 133841 - RNA, 24 nt, Human
aggcugaggcaguagaauagcuug

SEQ ID NO: 133842 - RNA, 21 nt, Human
agguagagguugcagugagcc

SEQ ID NO: 133843 - RNA, 24 nt, Human
agguagagguugcagugagccgag

SEQ ID NO: 133844 - RNA, 18 nt, Human
agugcacuuugggaagug

SEQ ID NO: 133845 - RNA, 21 nt, Human
aucacacuuacauucucauaa

SEQ ID NO: 133846 - RNA, 19 nt, Human
aucuacaaacaccuuccuu

SEQ ID NO: 133847 - RNA, 19 nt, Human
augaauaggaguuacauga

SEQ ID NO: 133848 - RNA, 23 nt, Human
auggaaggcugagcaaagcacca

SEQ ID NO: 133849 - RNA, 23 nt, Human
auggcaagggcuuagcaugguac

SEQ ID NO: 133850 - RNA, 22 nt, Human
auuacauauacaagaaggcauu

SEQ ID NO: 133851 - RNA, 22 nt, Human
caaaaaguaaccuuaaugaagc

SEQ ID NO: 133852 - RNA, 24 nt, Human
caacauggugaagcccugucucua

SEQ ID NO: 133853 - RNA, 21 nt, Human
cacaaacagaacaaccacugg

SEQ ID NO: 133854 - RNA, 24 nt, Human
cacaccuguaaucucagcacuuug

SEQ ID NO: 133855 - RNA, 21 nt, Human
cacacuuacauucucauaaaa

SEQ ID NO: 133856 - RNA, 19 nt, Human
caccccaacuucucucuaa

SEQ ID NO: 133857 - RNA, 23 nt, Human
caccuguaaucucagcacuuugg

SEQ ID NO: 133858 - RNA, 24 nt, Human
caccuguaaucucagcacuuuggg

SEQ ID NO: 133859 - RNA, 23 nt, Human
cacugcacuccaacuugggugac

SEQ ID NO: 133860 - RNA, 24 nt, Human
cacugcacuccaacuugggugaca

SEQ ID NO: 133861 - RNA, 21 nt, Human
cacugccuuacugaguacugc

SEQ ID NO: 133862 - RNA, 21 nt, Human
cacugccuuacugaguacugc

SEQ ID NO: 133863 - RNA, 24 nt, Human
cacuucugaaaaacaccaauugga

SEQ ID NO: 133864 - RNA, 20 nt, Human
cagaagcacaaacagaacaa

SEQ ID NO: 133865 - RNA, 21 nt, Human
cagaauucaccccaacuucuc

SEQ ID NO: 133866 - RNA, 24 nt, Human
cagagucuuaugcuugguuuccuu

SEQ ID NO: 133867 - RNA, 24 nt, Human
cagcaaggcagacaguauaauauc

SEQ ID NO: 133868 - RNA, 24 nt, Human
cagcacuuugggaagccgaggugg

SEQ ID NO: 133869 - RNA, 20 nt, Human
cagcauuccagcaaggcaga

SEQ ID NO: 133870 - RNA, 24 nt, Human
cagcuacuugggaggcugaggcag

SEQ ID NO: 133871 - RNA, 24 nt, Human
cagucaaaucagauucuaacucau

SEQ ID NO: 133872 - RNA, 22 nt, Human
caguggccaugaguucuuagcc

SEQ ID NO: 133873 - RNA, 20 nt, Human
cauaaaugagaacagaagca

SEQ ID NO: 133874 - RNA, 20 nt, Human
cauuuuaccagcucugugcc

SEQ ID NO: 133875 - RNA, 21 nt, Human
ccaacauggugaagcccuguc

SEQ ID NO: 133876 - RNA, 19 nt, Human
ccacgggaaaauggaacag

SEQ ID NO: 133877 - RNA, 20 nt, Human
ccacugcacuccaacuuggg

SEQ ID NO: 133878 - RNA, 24 nt, Human
ccacugcacuccaacuugggugac

SEQ ID NO: 133879 - RNA, 19 nt, Human
ccagucaaaucagauucua

SEQ ID NO: 133880 - RNA, 19 nt, Human
ccagugaaagaaaaauggg

SEQ ID NO: 133881 - RNA, 20 nt, Human
ccccgcugccagcuccuccc

SEQ ID NO: 133882 - RNA, 21 nt, Human
ccccgcugccagcuccucccg

SEQ ID NO: 133883 - RNA, 24 nt, Human
ccccggguccaaacaugguggccc

SEQ ID NO: 133884 - RNA, 23 nt, Human
cccugucucuacuaaaaauacaa

SEQ ID NO: 133885 - RNA, 25 nt, Human
ccgcuccgccugggcugccuccccc

SEQ ID NO: 133886 - RNA, 20 nt, Human
ccgcugccagcuccucccgc

SEQ ID NO: 133887 - RNA, 22 nt, Human
ccuagccaacauggugaagccc

SEQ ID NO: 133888 - RNA, 23 nt, Human
ccuagccaacauggugaagcccu

SEQ ID NO: 133889 - RNA, 24 nt, Human
ccuagccaacauggugaagcccug

SEQ ID NO: 133890 - RNA, 24 nt, Human
ccugaaaugcccuugcauuacuga

SEQ ID NO: 133891 - RNA, 23 nt, Human
ccugaguacugcacugccuaacu

SEQ ID NO: 133892 - RNA, 20 nt, Human
ccuggaccccagccaauugc

SEQ ID NO: 133893 - RNA, 18 nt, Human
ccuguaaccccagcuacu

SEQ ID NO: 133894 - RNA, 22 nt, Human
ccuguaaccccagcuacuuggg

SEQ ID NO: 133895 - RNA, 24 nt, Human
ccugucugagccuagacuucacag

SEQ ID NO: 133896 - RNA, 20 nt, Human
ccuuccucagugcacuuugg

SEQ ID NO: 133897 - RNA, 26 nt, Human
cgagguggggguggaucgccugaggu

SEQ ID NO: 133898 - RNA, 23 nt, Human
cgccugaggucaggaguuugaga

SEQ ID NO: 133899 - RNA, 21 nt, Human
cuaagaccaagcaaagacaac

SEQ ID NO: 133900 - RNA, 18 nt, Human
cuagacuucacagugagg

SEQ ID NO: 133901 - RNA, 22 nt, Human
cucacaccuguaaucucagcac

SEQ ID NO: 133902 - RNA, 24 nt, Human
cucacaccuguaaucucagcacuu

SEQ ID NO: 133903 - RNA, 19 nt, Human
cuccaucucaaaaaaaaaa

SEQ ID NO: 133904 - RNA, 20 nt, Human
cucccagggucaaaguggcu

SEQ ID NO: 133905 - RNA, 24 nt, Human
cucccucccccaucccgucacucc

SEQ ID NO: 133906 - RNA, 22 nt, Human
cuccucccgcuccgccugggcu

SEQ ID NO: 133907 - RNA, 22 nt, Human
cugaaaaacaccaauuggauga

SEQ ID NO: 133908 - RNA, 20 nt, Human
cugcacugccugaguacugu

SEQ ID NO: 133909 - RNA, 21 nt, Human
cuggcagugugggaagccucg

SEQ ID NO: 133910 - RNA, 19 nt, Human
cuucacagugaggcucccc

SEQ ID NO: 133911 - RNA, 19 nt, Human
gaacacaaucagcacauuc

SEQ ID NO: 133912 - RNA, 22 nt, Human
gaacaugaaccaccuuuccacu

SEQ ID NO: 133913 - RNA, 22 nt, Human
gaagagcagccccccgggucca

SEQ ID NO: 133914 - RNA, 21 nt, Human
gaccagagaggguacuccuuu

SEQ ID NO: 133915 - RNA, 21 nt, Human
gacuauuacugauagcauguc

SEQ ID NO: 133916 - RNA, 18 nt, Human
gauccuagugaaggcagg

SEQ ID NO: 133917 - RNA, 24 nt, Human
gaucgccugaggucaggaguuuga

SEQ ID NO: 133918 - RNA, 20 nt, Human
gcacugccugaguacuguau

SEQ ID NO: 133919 - RNA, 19 nt, Human
gcagaaggcaaauggcaca

SEQ ID NO: 133920 - RNA, 22 nt, Human
gcagaauuuucaaauacaucau

SEQ ID NO: 133921 - RNA, 24 nt, Human
gcagcagaaggcaaauggcacagg

SEQ ID NO: 133922 - RNA, 24 nt, Human
gccaacauggugaagcccugucuc

SEQ ID NO: 133923 - RNA, 24 nt, Human
gccacugcacuccaacuuggguga

SEQ ID NO: 133924 - RNA, 24 nt, Human
gccugaggucaggaguuugagacc

SEQ ID NO: 133925 - RNA, 19 nt, Human
gcuccccuggcaguguggg

SEQ ID NO: 133926 - RNA, 18 nt, Human
gcuguuaacuccagacuc

SEQ ID NO: 133927 - RNA, 20 nt, Human
gcuuuugcuuuguuuccugg

SEQ ID NO: 133928 - RNA, 20 nt, Human
ggaagccgaggugggggugg

SEQ ID NO: 133929 - RNA, 25 nt, Human
ggcccgguggcaaaugccuguaacc

SEQ ID NO: 133930 - RNA, 19 nt, Human
ggccgggugcgguggcuca

SEQ ID NO: 133931 - RNA, 18 nt, Human
ggcuuguccugagaaggu

SEQ ID NO: 133932 - RNA, 24 nt, Human
gggcccgguggcaaaugccuguaa

SEQ ID NO: 133933 - RNA, 20 nt, Human
ggggguggaucgccugaggu

SEQ ID NO: 133934 - RNA, 24 nt, Human
gggugcgguggcucacaccuguaa

SEQ ID NO: 133935 - RNA, 18 nt, Human
gguacuugaccagagagg

SEQ ID NO: 133936 - RNA, 23 nt, Human
gguggcucacaccuguaaucuca

SEQ ID NO: 133937 - RNA, 24 nt, Human
gguggcucacaccuguaaucucag

SEQ ID NO: 133938 - RNA, 24 nt, Human
gguucaucauugaaaaugaagucc

SEQ ID NO: 133939 - RNA, 21 nt, Human
gugaagcccugucucuacuaa

SEQ ID NO: 133940 - RNA, 23 nt, Human
gugcuuuugcuuguggucuuggc

SEQ ID NO: 133941 - RNA, 18 nt, Human
gugucaggcugugagugg

SEQ ID NO: 133942 - RNA, 23 nt, Human
guguuacugagcauugcauugcu

SEQ ID NO: 133943 - RNA, 21 nt, Human
guucaucauugaaaaugaagu

SEQ ID NO: 133944 - RNA, 19 nt, Human
guugcagugagccgagauu

SEQ ID NO: 133945 - RNA, 18 nt, Human
guuggccgggugcggugg

SEQ ID NO: 133946 - RNA, 24 nt, Human
guuggccgggugcgguggcucaca

SEQ ID NO: 133947 - RNA, 20 nt, Human
uaacaaaaaguaaccuuaau

SEQ ID NO: 133948 - RNA, 19 nt, Human
uaacuugcagaauuuucaa

SEQ ID NO: 133949 - RNA, 22 nt, Human
uacuacacuguuacugaguauu

SEQ ID NO: 133950 - RNA, 18 nt, Human
uacugaguacuucacugc

SEQ ID NO: 133951 - RNA, 19 nt, Human
uagccaacauggugaagcc

SEQ ID NO: 133952 - RNA, 23 nt, Human
uagccaacauggugaagcccugu

SEQ ID NO: 133953 - RNA, 21 nt, Human
uagccaggugaacaaguaagu

SEQ ID NO: 133954 - RNA, 21 nt, Human
uagcggacuuucugaaugaua

SEQ ID NO: 133955 - RNA, 19 nt, Human
uauuguguuacugaguacu

SEQ ID NO: 133956 - RNA, 21 nt, Human
ucagaaaguuggauggaacug

SEQ ID NO: 133957 - RNA, 19 nt, Human
ucagaguuuggacugggac

SEQ ID NO: 133958 - RNA, 20 nt, Human
uccaacuugggugacagaga

SEQ ID NO: 133959 - RNA, 23 nt, Human
uccacaguggccaugaguucuua

SEQ ID NO: 133960 - RNA, 18 nt, Human
ucccagggucaaaguggc

SEQ ID NO: 133961 - RNA, 24 nt, Human
uccuuuguuuagagagcuucucuu

SEQ ID NO: 133962 - RNA, 19 nt, Human
ucgccugaggucaggaguu

SEQ ID NO: 133963 - RNA, 21 nt, Human
ucucuacuaaaaauacaaaaa

SEQ ID NO: 133964 - RNA, 23 nt, Human
ucucuuggggccaccuuccucag

SEQ ID NO: 133965 - RNA, 22 nt, Human
ugaaaagacauaugucgaagua

SEQ ID NO: 133966 - RNA, 19 nt, Human
ugaaagaccucaaggcucu

SEQ ID NO: 133967 - RNA, 24 nt, Human
ugaaccugggagguagagguugca

SEQ ID NO: 133968 - RNA, 23 nt, Human
ugaauagguuuguugaugccugu

SEQ ID NO: 133969 - RNA, 18 nt, Human
ugacagagucuuaugcuu

SEQ ID NO: 133970 - RNA, 25 nt, Human
ugagaacagaagcacaaacagaaca

SEQ ID NO: 133971 - RNA, 30 nt, Human
ugagaacagaagcacaaacagaacaaccaa

SEQ ID NO: 133972 - RNA, 18 nt, Human
ugagaaugaacaugaacc

SEQ ID NO: 133973 - RNA, 22 nt, Human
ugagaaugaacaugaaccaccu

SEQ ID NO: 133974 - RNA, 24 nt, Human
ugagacccuccuagccaacauggu

SEQ ID NO: 133975 - RNA, 21 nt, Human
ugagaugaaacuauucucaaa

SEQ ID NO: 133976 - RNA, 22 nt, Human
ugaggaucuucaagaaagucag

SEQ ID NO: 133977 - RNA, 24 nt, Human
ugaggcaguagaauagcuugaacc

SEQ ID NO: 133978 - RNA, 25 nt, Human
ugaggcaguagaauagcuugaaccu

SEQ ID NO: 133979 - RNA, 22 nt, Human
ugaggcuccccuggcagugugg

SEQ ID NO: 133980 - RNA, 18 nt, Human
ugaggucaggaguuugag

SEQ ID NO: 133981 - RNA, 19 nt, Human
ugaugguggggugaauagg

SEQ ID NO: 133982 - RNA, 19 nt, Human
ugcaucaucuacaaacacc

SEQ ID NO: 133983 - RNA, 21 nt, Human
ugcauugugguucuccaagca

SEQ ID NO: 133984 - RNA, 20 nt, Human
ugccacaaaaggaaaauuga

SEQ ID NO: 133985 - RNA, 19 nt, Human
ugcccaaauacuucaaaau

SEQ ID NO: 133986 - RNA, 25 nt, Human
ugccuaauugaaaucagccuguuuu

SEQ ID NO: 133987 - RNA, 22 nt, Human
ugccugaguacuguauuguguu

SEQ ID NO: 133988 - RNA, 24 nt, Human
ugccuguaaccccagcuacuuggg

SEQ ID NO: 133989 - RNA, 19 nt, Human
ugccuuagaaaaagggaau

SEQ ID NO: 133990 - RNA, 22 nt, Human
ugcugcacagcauggaaggcug

SEQ ID NO: 133991 - RNA, 23 nt, Human
uggaacacuucugaaaaacacca

SEQ ID NO: 133992 - RNA, 18 nt, Human
uggaacaggcucaaacau

SEQ ID NO: 133993 - RNA, 22 nt, Human
uggaaggcugagcaaagcacca

SEQ ID NO: 133994 - RNA, 19 nt, Human
uggaucgccugaggucagg

SEQ ID NO: 133995 - RNA, 23 nt, Human
uggaucgccugaggucaggaguu

SEQ ID NO: 133996 - RNA, 24 nt, Human
uggaucgccugaggucaggaguuu

SEQ ID NO: 133997 - RNA, 19 nt, Human
uggcaaaugccuguaaccc

SEQ ID NO: 133998 - RNA, 23 nt, Human
uggcaaaugccuguaaccccagc

SEQ ID NO: 133999 - RNA, 21 nt, Human
uggcucacaccuguaaucuca

SEQ ID NO: 134000 - RNA, 24 nt, Human
uggcucacaccuguaaucucagca

SEQ ID NO: 134001 - RNA, 19 nt, Human
ugggaagccgagguggggg

SEQ ID NO: 134002 - RNA, 21 nt, Human
ugggaagccgaggugggggug

SEQ ID NO: 134003 - RNA, 25 nt, Human
ugggaagccgagguggggguggauc

SEQ ID NO: 134004 - RNA, 21 nt, Human
ugggaagugcugccccggggc

SEQ ID NO: 134005 - RNA, 18 nt, Human
ugggacuuccucagagaa

SEQ ID NO: 134006 - RNA, 29 nt, Human
ugggagguagagguugcagugacaacggu

SEQ ID NO: 134007 - RNA, 24 nt, Human
ugggagguagagguugcagugagc

SEQ ID NO: 134008 - RNA, 18 nt, Human
ugggccaaagaagcagcc

SEQ ID NO: 134009 - RNA, 19 nt, Human
ugguggggugaauagguuu

SEQ ID NO: 134010 - RNA, 24 nt, Human
ugguuagaucaggaugaugguggg

SEQ ID NO: 134011 - RNA, 19 nt, Human
uguagccagaagaagcacg

SEQ ID NO: 134012 - RNA, 18 nt, Human
ugucugggaggcuuuuug

SEQ ID NO: 134013 - RNA, 21 nt, Human
ugugucugggaggcuuuuuga

SEQ ID NO: 134014 - RNA, 21 nt, Human
uguuacugagcauugcauugc

SEQ ID NO: 134015 - RNA, 22 nt, Human
uguuacugaguacugcacugcc

SEQ ID NO: 134016 - RNA, 22 nt, Human
uguuacugaguacugcacugcc

SEQ ID NO: 134017 - RNA, 25 nt, Human
uuaaaauauguagaguguauuuugc

SEQ ID NO: 134018 - RNA, 21 nt, Human
uuacuauaaguucucucucag

SEQ ID NO: 134019 - RNA, 19 nt, Human
uuacugaguacugcacugu

SEQ ID NO: 134020 - RNA, 19 nt, Human
uuacugaguacugcacugu

SEQ ID NO: 134021 - RNA, 24 nt, Human
uuagaucacaggagaaguaaggug

SEQ ID NO: 134022 - RNA, 19 nt, Human
uuccucagugcacuuuggg

SEQ ID NO: 134023 - RNA, 24 nt, Human
uugaaccugggagguagagguugc

SEQ ID NO: 134024 - RNA, 19 nt, Human
uugcagugagccgagauug

SEQ ID NO: 134025 - RNA, 20 nt, Human
uugcagugagccgagauugc

SEQ ID NO: 134026 - RNA, 25 nt, Human
uuggauauuuuuauguuccccugau

SEQ ID NO: 134027 - RNA, 20 nt, Human
uuguuguuguuuugaugcuu

SEQ ID NO: 134028 - RNA, 19 nt, Human
uuucagaaaguuggaugga

SEQ ID NO: 134029 - RNA, 21 nt, Human
aaaacaggacaagaugggaug

SEQ ID NO: 134030 - RNA, 19 nt, Human
aaaauucagugacacucuu

SEQ ID NO: 134031 - RNA, 20 nt, Human
aaaguaaacgaggccuaaaa

SEQ ID NO: 134032 - RNA, 24 nt, Human
aacuaggacuacgauguuaagaca

SEQ ID NO: 134033 - RNA, 19 nt, Human
aaguaaacgaggccuaaaa

SEQ ID NO: 134034 - RNA, 24 nt, Human
acaagauggaaaacuaccaggccc

SEQ ID NO: 134035 - RNA, 21 nt, Human
accacccauauccuuaaaaca

SEQ ID NO: 134036 - RNA, 22 nt, Human
agagggcacaggaacaaguagg

SEQ ID NO: 134037 - RNA, 21 nt, Human
aggccagaacaagauggaaaa

SEQ ID NO: 134038 - RNA, 19 nt, Human
aggcccaucaggccuauaa

SEQ ID NO: 134039 - RNA, 21 nt, Human
aggcuuuaguuucuccuccag

SEQ ID NO: 134040 - RNA, 23 nt, Human
aggcuuuaguuucuccuccagcu

SEQ ID NO: 134041 - RNA, 24 nt, Human
caagaugggaugaccacaccaggu

SEQ ID NO: 134042 - RNA, 23 nt, Human
caaugaacaauuucauuuuuuaa

SEQ ID NO: 134043 - RNA, 19 nt, Human
caccagcauggacaaaacu

SEQ ID NO: 134044 - RNA, 21 nt, Human
cagauggauuuaggugagcac

SEQ ID NO: 134045 - RNA, 20 nt, Human
cagcauggacaaaacucagu

SEQ ID NO: 134046 - RNA, 18 nt, Human
ccacagccgagggaacga

SEQ ID NO: 134047 - RNA, 24 nt, Human
ccagaacaagauggaaaacuacca

SEQ ID NO: 134048 - RNA, 19 nt, Human
ccagacaccagcauggaca

SEQ ID NO: 134049 - RNA, 19 nt, Human
cccagacaccagcauggac

SEQ ID NO: 134050 - RNA, 24 nt, Human
ccgcagacucccgccgccuugguc

SEQ ID NO: 134051 - RNA, 22 nt, Human
ccgcgugcgugccgcccggucc

SEQ ID NO: 134052 - RNA, 19 nt, Human
ccuauaacccagacaccag

SEQ ID NO: 134053 - RNA, 25 nt, Human
ccugcaccgcgugcgugccgcccgg

SEQ ID NO: 134054 - RNA, 20 nt, Human
cuaggaccuauguuccacuc

SEQ ID NO: 134055 - RNA, 22 nt, Human
cuccuccagcuucaaguggccu

SEQ ID NO: 134056 - RNA, 18 nt, Human
cucucagcaacaaaagga

SEQ ID NO: 134057 - RNA, 21 nt, Human
cuuuaguuucuccuccagcuu

SEQ ID NO: 134058 - RNA, 20 nt, Human
gaaaacuaccaggcccauca

SEQ ID NO: 134059 - RNA, 22 nt, Human
gagaucaacaagaaaacccaac

SEQ ID NO: 134060 - RNA, 19 nt, Human
gauggauuuaggugagcac

SEQ ID NO: 134061 - RNA, 27 nt, Human
gccagaacaagauggaaaacuaccagg

SEQ ID NO: 134062 - RNA, 22 nt, Human
gccagaacucuucacccugucu

SEQ ID NO: 134063 - RNA, 22 nt, Human
gucuaggaccuauguuccacuc

SEQ ID NO: 134064 - RNA, 22 nt, Human
uaaaacaggacaagaugggaug

SEQ ID NO: 134065 - RNA, 24 nt, Human
uaacauguuuucucaauaaggcuu

SEQ ID NO: 134066 - RNA, 28 nt, Human
uaagacaaccacuagcagaaggucaucc

SEQ ID NO: 134067 - RNA, 21 nt, Human
uacagcauuucacugagcaga

SEQ ID NO: 134068 - RNA, 23 nt, Human
uacugggucugaaggugaggcuu

SEQ ID NO: 134069 - RNA, 19 nt, Human
ucaaaguagcagcuaaaau

SEQ ID NO: 134070 - RNA, 22 nt, Human
ucaccgaggucucaaaguagca

SEQ ID NO: 134071 - RNA, 19 nt, Human
ucacugagcagacuuaguu

SEQ ID NO: 134072 - RNA, 24 nt, Human
ucaggccuauaacccagacaccag

SEQ ID NO: 134073 - RNA, 27 nt, Human
uccacagccgagggaacgaccgcagac

SEQ ID NO: 134074 - RNA, 24 nt, Human
ucuaggccagaacaagauggaaaa

SEQ ID NO: 134075 - RNA, 18 nt, Human
ugaccacaccagguaaca

SEQ ID NO: 134076 - RNA, 19 nt, Human
ugagaucaacaagaaaacc

SEQ ID NO: 134077 - RNA, 26 nt, Human
ugagaucaacaagaaaacccaacagg

SEQ ID NO: 134078 - RNA, 24 nt, Human
ugccucuuucaucuuucaccaccc

SEQ ID NO: 134079 - RNA, 21 nt, Human
ugcggacaguuacugggucug

SEQ ID NO: 134080 - RNA, 19 nt, Human
uuuacaaaccuuuuaaaca

SEQ ID NO: 134081 - RNA, 23 nt, Human
aaaaauaggcagugcagcacccc

SEQ ID NO: 134082 - RNA, 18 nt, Human
aaggaguucacugcauuu

SEQ ID NO: 134083 - RNA, 24 nt, Human
aagugccacacugagaauuuacaa

SEQ ID NO: 134084 - RNA, 23 nt, Human
acaaagcucuuacacuccagguu

SEQ ID NO: 134085 - RNA, 24 nt, Human
auaacaagaggaaaaauaggcagu

SEQ ID NO: 134086 - RNA, 20 nt, Human
auaggcagugcagcaccuuu

SEQ ID NO: 134087 - RNA, 21 nt, Human
auguguacaaaaauuuacaua

SEQ ID NO: 134088 - RNA, 21 nt, Human
caagagggagaaagaaggaga

SEQ ID NO: 134089 - RNA, 20 nt, Human
cauaaagaaacaaagcucuu

SEQ ID NO: 134090 - RNA, 18 nt, Human
ccgugccgguucggcugc

SEQ ID NO: 134091 - RNA, 18 nt, Human
cucaagagggagaaagaa

SEQ ID NO: 134092 - RNA, 21 nt, Human
cucaagagggagaaagaagga

SEQ ID NO: 134093 - RNA, 20 nt, Human
cuccagguuuuuggaaggug

SEQ ID NO: 134094 - RNA, 25 nt, Human
cugaaaccacagaacuuguauaucc

SEQ ID NO: 134095 - RNA, 18 nt, Human
uaacaagaggaaaaauag

SEQ ID NO: 134096 - RNA, 24 nt, Human
uaauuaaaaguuucauugcauuua

SEQ ID NO: 134097 - RNA, 24 nt, Human
uagguaccuaucauuugucauucc

SEQ ID NO: 134098 - RNA, 30 nt, Human
ucaggguccgggagcccccugcgggguuuc

SEQ ID NO: 134099 - RNA, 23 nt, Human
ucauguuacauuuuagguaccua

SEQ ID NO: 134100 - RNA, 20 nt, Human
uccccaggaaaccgugccgg

SEQ ID NO: 134101 - RNA, 23 nt, Human
uccccaggaaaccgugccgguuc

SEQ ID NO: 134102 - RNA, 19 nt, Human
ugccacacugagaauuuac

SEQ ID NO: 134103 - RNA, 20 nt, Human
uuaacugaaaccacagaacu

SEQ ID NO: 134104 - RNA, 24 nt, Human
uuaacugaaaccacagaacuugua

SEQ ID NO: 134105 - RNA, 20 nt, Human
uuacugcaaucacaggggag

SEQ ID NO: 134106 - RNA, 20 nt, Human
aacccauucuucaaggacug

SEQ ID NO: 134107 - RNA, 22 nt, Human
aauugcuauagucaauuccuac

SEQ ID NO: 134108 - RNA, 21 nt, Human
agaacccauucuucaaggacu

SEQ ID NO: 134109 - RNA, 27 nt, Human
agacccucaacaaacaggaagcagcuu

SEQ ID NO: 134110 - RNA, 21 nt, Human
auggugguggaagcgguugcg

SEQ ID NO: 134111 - RNA, 22 nt, Human
caaaacuucuaaaaacaaacac

SEQ ID NO: 134112 - RNA, 19 nt, Human
caccauggugguggaagcg

SEQ ID NO: 134113 - RNA, 24 nt, Human
cagaacccauucuucaaggacugg

SEQ ID NO: 134114 - RNA, 20 nt, Human
ccccagaaagaaagcggggu

SEQ ID NO: 134115 - RNA, 18 nt, Human
cgccgcucccugccccuc

SEQ ID NO: 134116 - RNA, 22 nt, Human
cggcacccgagacgcgcgcccu

SEQ ID NO: 134117 - RNA, 22 nt, Human
cggccccagaaagaaagcgggg

SEQ ID NO: 134118 - RNA, 22 nt, Human
cggcgcuccugaugcggagagg

SEQ ID NO: 134119 - RNA, 23 nt, Human
cggcggcacccgagacgcgcgcc

SEQ ID NO: 134120 - RNA, 20 nt, Human
cggcuuccgcgucgggaccc

SEQ ID NO: 134121 - RNA, 22 nt, Human
uaaaaauguaucaaauugcuau

SEQ ID NO: 134122 - RNA, 19 nt, Human
uagucaauuccuacacucc

SEQ ID NO: 134123 - RNA, 20 nt, Human
ugaauacagacccucaacaa

SEQ ID NO: 134124 - RNA, 24 nt, Human
ugcggccauguccuggcugggagc

SEQ ID NO: 134125 - RNA, 19 nt, Human
uggugguggaagcgguugc

SEQ ID NO: 134126 - RNA, 18 nt, Human
uuuuuuuuuuuuuuuucg

SEQ ID NO: 134127 - RNA, 18 nt, Human
aauucaguccuagaaauu

SEQ ID NO: 134128 - RNA, 22 nt, Human
acuuuucuguaucagagaaaag

SEQ ID NO: 134129 - RNA, 22 nt, Human
agaauauccuguucaggaaugu

SEQ ID NO: 134130 - RNA, 24 nt, Human
agacauuugaaucauaucugaaug

SEQ ID NO: 134131 - RNA, 21 nt, Human
caccuccgcuggggcuccgcc

SEQ ID NO: 134132 - RNA, 19 nt, Human
cauaucaaauucuagcucc

SEQ ID NO: 134133 - RNA, 18 nt, Human
ccgcuggggcuccgccgu

SEQ ID NO: 134134 - RNA, 21 nt, Human
ccgcuggggcuccgccguccg

SEQ ID NO: 134135 - RNA, 23 nt, Human
ccucuucaacacaaaugcuaccc

SEQ ID NO: 134136 - RNA, 18 nt, Human
cuaccccuaaaaugaaag

SEQ ID NO: 134137 - RNA, 23 nt, Human
cuguauuuuccuuuccgccaaua

SEQ ID NO: 134138 - RNA, 20 nt, Human
cuucaaacacaacuguucac

SEQ ID NO: 134139 - RNA, 20 nt, Human
gaaauucuuggagcugugag

SEQ ID NO: 134140 - RNA, 20 nt, Human
gagaaaagagcuauuuaaau

SEQ ID NO: 134141 - RNA, 18 nt, Human
gaguugacggagauauuc

SEQ ID NO: 134142 - RNA, 24 nt, Human
uagaaauucuuggagcugugagaa

SEQ ID NO: 134143 - RNA, 25 nt, Human
uauaagaguauuccauuuuguccaa

SEQ ID NO: 134144 - RNA, 25 nt, Human
ucaggaaugugacuucuacaaaagc

SEQ ID NO: 134145 - RNA, 19 nt, Human
uccaaugugaaaaccaaau

SEQ ID NO: 134146 - RNA, 25 nt, Human
uccaaugugaaaaccaaauuaaaaa

SEQ ID NO: 134147 - RNA, 18 nt, Human
uccgccaaggucuccccu

SEQ ID NO: 134148 - RNA, 21 nt, Human
uccgccaaggucuccccuccc

SEQ ID NO: 134149 - RNA, 23 nt, Human
ucuuucaugaacagcaugaaaau

SEQ ID NO: 134150 - RNA, 26 nt, Human
ugaacagcaugaaaauaugaguugaa

SEQ ID NO: 134151 - RNA, 24 nt, Human
ugacugacuuguuuccaauguugu

SEQ ID NO: 134152 - RNA, 22 nt, Human
ugacuucuacaaaagcucccuc

SEQ ID NO: 134153 - RNA, 22 nt, Human
ugcuucaaacacaacuguucac

SEQ ID NO: 134154 - RNA, 21 nt, Human
ugguuuauagacauuugaauc

SEQ ID NO: 134155 - RNA, 21 nt, Human
uguccaaaccuauuaaauacc

SEQ ID NO: 134156 - RNA, 23 nt, Human
uucaguccuagaaauucuuggag

SEQ ID NO: 134157 - RNA, 25 nt, Human
aaaccugcaacgcgauggagguugg

SEQ ID NO: 134158 - RNA, 25 nt, Human
aaaccugcaacgcgauggagguugg

SEQ ID NO: 134159 - RNA, 22 nt, Human
aacaccaucucucucucuccac

SEQ ID NO: 134160 - RNA, 22 nt, Human
aacaccaucucucucucuccac

SEQ ID NO: 134161 - RNA, 20 nt, Human
aacauguaucucucaucaua

SEQ ID NO: 134162 - RNA, 22 nt, Human
aacccaacucagccaagugcug

SEQ ID NO: 134163 - RNA, 20 nt, Human
aagcagcuccuuucccgugg

SEQ ID NO: 134164 - RNA, 20 nt, Human
aagcagcuccuuucccgugg

SEQ ID NO: 134165 - RNA, 21 nt, Human
acaaaaugagcugcuucaccc

SEQ ID NO: 134166 - RNA, 20 nt, Human
acaccacugcguuccagcag

SEQ ID NO: 134167 - RNA, 22 nt, Human
acacccagagcggaggaagcca

SEQ ID NO: 134168 - RNA, 21 nt, Human
acagcccgcaggggcaccacc

SEQ ID NO: 134169 - RNA, 21 nt, Human
acagcccgcaggggcaccacc

SEQ ID NO: 134170 - RNA, 22 nt, Human
acagguggccggagggcacccc

SEQ ID NO: 134171 - RNA, 22 nt, Human
acagguggccggagggcacccc

SEQ ID NO: 134172 - RNA, 19 nt, Human
accgcaaaguccugcaggc

SEQ ID NO: 134173 - RNA, 19 nt, Human
acuaacaauggccccggag

SEQ ID NO: 134174 - RNA, 20 nt, Human
acucagcaccccagagcagg

SEQ ID NO: 134175 - RNA, 20 nt, Human
acucagcaccccagagcagg

SEQ ID NO: 134176 - RNA, 20 nt, Human
acucagcaccccagagcagg

SEQ ID NO: 134177 - RNA, 20 nt, Human
agacccugaaggccacagcg

SEQ ID NO: 134178 - RNA, 20 nt, Human
agacccugaaggccacagcg

SEQ ID NO: 134179 - RNA, 23 nt, Human
agagaaccuggaaagguucuacc

SEQ ID NO: 134180 - RNA, 23 nt, Human
agagaaccuggaaagguucuacc

SEQ ID NO: 134181 - RNA, 20 nt, Human
agccaggacucaggggccug

SEQ ID NO: 134182 - RNA, 27 nt, Human
agccucagggcuggugaggcaacaugu

SEQ ID NO: 134183 - RNA, 27 nt, Human
agccucagggcuggugaggcaacaugu

SEQ ID NO: 134184 - RNA, 18 nt, Human
agccuuggccccggagcc

SEQ ID NO: 134185 - RNA, 18 nt, Human
agccuuggccccggagcc

SEQ ID NO: 134186 - RNA, 20 nt, Human
agcggaggaagccagccaag

SEQ ID NO: 134187 - RNA, 24 nt, Human
agcugguggagagcugcagcucag

SEQ ID NO: 134188 - RNA, 24 nt, Human
agcugguggagagcugcagcucag

SEQ ID NO: 134189 - RNA, 18 nt, Human
aggaacacaggugggggg

SEQ ID NO: 134190 - RNA, 25 nt, Human
aggaauucuuccuccccuuagcccu

SEQ ID NO: 134191 - RNA, 18 nt, Human
aggaggugguccucaggg

SEQ ID NO: 134192 - RNA, 18 nt, Human
aggaggugguccucaggg

SEQ ID NO: 134193 - RNA, 23 nt, Human
aggcaaacacagugcccugaaaa

SEQ ID NO: 134194 - RNA, 25 nt, Human
aggcaaacacagugcccugaaaaca

SEQ ID NO: 134195 - RNA, 20 nt, Human
agggagggccagauggguca

SEQ ID NO: 134196 - RNA, 20 nt, Human
agggagggccagauggguca

SEQ ID NO: 134197 - RNA, 22 nt, Human
agggguaucagggcacacaagc

SEQ ID NO: 134198 - RNA, 22 nt, Human
agggguaucagggcacacaagc

SEQ ID NO: 134199 - RNA, 18 nt, Human
agguagagauuucuaacc

SEQ ID NO: 134200 - RNA, 18 nt, Human
agguagagauuucuaacc

SEQ ID NO: 134201 - RNA, 18 nt, Human
aguaggaggagugcccca

SEQ ID NO: 134202 - RNA, 22 nt, Human
aguaggaggagugccccaggcu

SEQ ID NO: 134203 - RNA, 21 nt, Human
agucgcugaucuucccccaca

SEQ ID NO: 134204 - RNA, 21 nt, Human
agucgcugaucuucccccaca

SEQ ID NO: 134205 - RNA, 23 nt, Human
auaaaacaccagcagcuccacca

SEQ ID NO: 134206 - RNA, 18 nt, Human
aucccaauguaguucucc

SEQ ID NO: 134207 - RNA, 21 nt, Human
augcgccauguggcugggagc

SEQ ID NO: 134208 - RNA, 24 nt, Human
auguuuuuucuccagcuggggccu

SEQ ID NO: 134209 - RNA, 22 nt, Human
auugaggaacacaggugggggg

SEQ ID NO: 134210 - RNA, 22 nt, Human
caaaaugagcugcuucacccug

SEQ ID NO: 134211 - RNA, 20 nt, Human
caaagccccucaacgugucc

SEQ ID NO: 134212 - RNA, 22 nt, Human
caacauguaucucucaucauaa

SEQ ID NO: 134213 - RNA, 19 nt, Human
caacgaggcagcuggaugc

SEQ ID NO: 134214 - RNA, 21 nt, Human
caagugcuggccugggcagga

SEQ ID NO: 134215 - RNA, 18 nt, Human
caauggccccggagcauc

SEQ ID NO: 134216 - RNA, 18 nt, Human
caaugugguggucucugc

SEQ ID NO: 134217 - RNA, 18 nt, Human
caaugugguggucucugc

SEQ ID NO: 134218 - RNA, 18 nt, Human
caaugugguggucucugc

SEQ ID NO: 134219 - RNA, 18 nt, Human
cacagcccgcaggggcac

SEQ ID NO: 134220 - RNA, 24 nt, Human
cacaucuuaaaagccuucuucaca

SEQ ID NO: 134221 - RNA, 24 nt, Human
cacaucuuaaaagccuucuucaca

SEQ ID NO: 134222 - RNA, 21 nt, Human
caccacagcccgcaggggcac

SEQ ID NO: 134223 - RNA, 18 nt, Human
caccaccugcuuggggcu

SEQ ID NO: 134224 - RNA, 18 nt, Human
caccaccugcuuggggcu

SEQ ID NO: 134225 - RNA, 22 nt, Human
caccagcucacucagcacccca

SEQ ID NO: 134226 - RNA, 22 nt, Human
caccagcucacucagcacccca

SEQ ID NO: 134227 - RNA, 22 nt, Human
caccagcucacucagcacccca

SEQ ID NO: 134228 - RNA, 19 nt, Human
caccauaggggugaaggag

SEQ ID NO: 134229 - RNA, 19 nt, Human
caccauaggggugaaggag

SEQ ID NO: 134230 - RNA, 18 nt, Human
caccaucucucucucucc

SEQ ID NO: 134231 - RNA, 18 nt, Human
caccaucucucucucucc

SEQ ID NO: 134232 - RNA, 18 nt, Human
cacccugcacaccaggug

SEQ ID NO: 134233 - RNA, 24 nt, Human
caccgagcacaccuuccaccacca

SEQ ID NO: 134234 - RNA, 24 nt, Human
caccgagcacaccuuccaccacca

SEQ ID NO: 134235 - RNA, 23 nt, Human
cagcggccuuggcuggcuccucc

SEQ ID NO: 134236 - RNA, 23 nt, Human
cagcggccuuggcuggcuccucc

SEQ ID NO: 134237 - RNA, 18 nt, Human
cagcucacucagcacccc

SEQ ID NO: 134238 - RNA, 22 nt, Human
cagcucaggcacggccaccaca

SEQ ID NO: 134239 - RNA, 22 nt, Human
cagcucaggcacggccaccaca

SEQ ID NO: 134240 - RNA, 18 nt, Human
cagcuccuuucccguggg

SEQ ID NO: 134241 - RNA, 18 nt, Human
cagcuccuuucccguggg

SEQ ID NO: 134242 - RNA, 19 nt, Human
caggagcucugugguccug

SEQ ID NO: 134243 - RNA, 19 nt, Human
caggagcucugugguccug

SEQ ID NO: 134244 - RNA, 20 nt, Human
caggggccugucucagcugg

SEQ ID NO: 134245 - RNA, 18 nt, Human
cagugcagggccuccaag

SEQ ID NO: 134246 - RNA, 18 nt, Human
cagugcagggccuccaag

SEQ ID NO: 134247 - RNA, 24 nt, Human
cauaaaacaccagcagcuccacca

SEQ ID NO: 134248 - RNA, 22 nt, Human
cauguggcugggagcuggcuga

SEQ ID NO: 134249 - RNA, 22 nt, Human
cauguggcugggagcuggcuga

SEQ ID NO: 134250 - RNA, 21 nt, Human
cauuccaggagcugcccagag

SEQ ID NO: 134251 - RNA, 21 nt, Human
cauuccaggagcugcccagag

SEQ ID NO: 134252 - RNA, 25 nt, Human
ccacccagcugguggagagcugcag

SEQ ID NO: 134253 - RNA, 25 nt, Human
ccacccagcugguggagagcugcag

SEQ ID NO: 134254 - RNA, 22 nt, Human
ccacccuauugcuggcacugga

SEQ ID NO: 134255 - RNA, 22 nt, Human
ccacccuauugcuggcacugga

SEQ ID NO: 134256 - RNA, 19 nt, Human
ccagcaggccauguuuggg

SEQ ID NO: 134257 - RNA, 19 nt, Human
ccagcaggccauguuuggg

SEQ ID NO: 134258 - RNA, 22 nt, Human
ccagccaagggucuugcugcag

SEQ ID NO: 134259 - RNA, 19 nt, Human
cccacagggcuucccucca

SEQ ID NO: 134260 - RNA, 19 nt, Human
cccaccgugcagaugaggu

SEQ ID NO: 134261 - RNA, 19 nt, Human
cccaccgugcagaugaggu

SEQ ID NO: 134262 - RNA, 24 nt, Human
cccagaaaugccuagaaccagggu

SEQ ID NO: 134263 - RNA, 24 nt, Human
cccagaaaugccuagaaccagggu

SEQ ID NO: 134264 - RNA, 22 nt, Human
cccagcuguggcuucaguguga

SEQ ID NO: 134265 - RNA, 18 nt, Human
cccaguacucgccccaca

SEQ ID NO: 134266 - RNA, 18 nt, Human
cccaguacucgccccaca

SEQ ID NO: 134267 - RNA, 24 nt, Human
ccccagagagugaagcuggccacu

SEQ ID NO: 134268 - RNA, 24 nt, Human
ccccagagagugaagcuggccacu

SEQ ID NO: 134269 - RNA, 20 nt, Human
ccccaggcggagcagaccaa

SEQ ID NO: 134270 - RNA, 20 nt, Human
ccccaggcggagcagaccaa

SEQ ID NO: 134271 - RNA, 18 nt, Human
ccccugugccgggcucca

SEQ ID NO: 134272 - RNA, 20 nt, Human
ccccugugccgggcuccacu

SEQ ID NO: 134273 - RNA, 20 nt, Human
ccccugugccgggcuccacu

SEQ ID NO: 134274 - RNA, 20 nt, Human
cccugcugccuccuucuucc

SEQ ID NO: 134275 - RNA, 21 nt, Human
cccugugccgggcuccacuuc

SEQ ID NO: 134276 - RNA, 21 nt, Human
cccugugccgggcuccacuuc

SEQ ID NO: 134277 - RNA, 20 nt, Human
cccuuuccaccuugcugucc

SEQ ID NO: 134278 - RNA, 20 nt, Human
cccuuuccaccuugcugucc

SEQ ID NO: 134279 - RNA, 23 nt, Human
ccggagcauccuuuucaugccca

SEQ ID NO: 134280 - RNA, 23 nt, Human
ccucacuugggcccagcaggcca

SEQ ID NO: 134281 - RNA, 22 nt, Human
ccucagcugcaaggcaaacaca

SEQ ID NO: 134282 - RNA, 18 nt, Human
ccuccuucuucccuuccu

SEQ ID NO: 134283 - RNA, 20 nt, Human
ccucggugggcccagcugug

SEQ ID NO: 134284 - RNA, 18 nt, Human
ccugcaccucacucucuc

SEQ ID NO: 134285 - RNA, 19 nt, Human
ccugugcuuggagcaccag

SEQ ID NO: 134286 - RNA, 23 nt, Human
ccuuccaccaccaucguggacuc

SEQ ID NO: 134287 - RNA, 23 nt, Human
ccuuccaccaccaucguggacuc

SEQ ID NO: 134288 - RNA, 23 nt, Human
ccuucugaaaacccaggguugcu

SEQ ID NO: 134289 - RNA, 23 nt, Human
ccuugugcaggaucucagggcug

SEQ ID NO: 134290 - RNA, 23 nt, Human
ccuugugcaggaucucagggcug

SEQ ID NO: 134291 - RNA, 19 nt, Human
cgaagcaccacacccuccc

SEQ ID NO: 134292 - RNA, 22 nt, Human
cgaagcaccacacccucccagg

SEQ ID NO: 134293 - RNA, 22 nt, Human
cgccccacauguuggcacagcc

SEQ ID NO: 134294 - RNA, 22 nt, Human
cgccccacauguuggcacagcc

SEQ ID NO: 134295 - RNA, 25 nt, Human
cgcugagccaaaguccaggcggagc

SEQ ID NO: 134296 - RNA, 22 nt, Human
cguggcccacagggcuucccuc

SEQ ID NO: 134297 - RNA, 21 nt, Human
cuagcaccaucuggagcacac

SEQ ID NO: 134298 - RNA, 21 nt, Human
cuagcaccaucuggagcacac

SEQ ID NO: 134299 - RNA, 19 nt, Human
cuccuccucacacuccugc

SEQ ID NO: 134300 - RNA, 19 nt, Human
cuccuccucacacuccugc

SEQ ID NO: 134301 - RNA, 18 nt, Human
cucgcacucugcugaaug

SEQ ID NO: 134302 - RNA, 18 nt, Human
cucgcacucugcugaaug

SEQ ID NO: 134303 - RNA, 22 nt, Human
cucuccauaaaauccagcugcu

SEQ ID NO: 134304 - RNA, 22 nt, Human
cucuccauaaaauccagcugcu

SEQ ID NO: 134305 - RNA, 25 nt, Human
cucucuccacucgcacucugcugaa

SEQ ID NO: 134306 - RNA, 25 nt, Human
cucucuccacucgcacucugcugaa

SEQ ID NO: 134307 - RNA, 18 nt, Human
cucugcugugguguggcc

SEQ ID NO: 134308 - RNA, 18 nt, Human
cucugcugugguguggcc

SEQ ID NO: 134309 - RNA, 18 nt, Human
cucugcugugguguggcc

SEQ ID NO: 134310 - RNA, 25 nt, Human
cucugugcugcaaucagagcucucc

SEQ ID NO: 134311 - RNA, 25 nt, Human
cucugugcugcaaucagagcucucc

SEQ ID NO: 134312 - RNA, 20 nt, Human
cugccuccuucuucccuucc

SEQ ID NO: 134313 - RNA, 21 nt, Human
cugcuccuaaucccugggcaa

SEQ ID NO: 134314 - RNA, 21 nt, Human
cugcuccuaaucccugggcaa

SEQ ID NO: 134315 - RNA, 23 nt, Human
cugcucuguagguacacaugggg

SEQ ID NO: 134316 - RNA, 23 nt, Human
cugcucuguagguacacaugggg

SEQ ID NO: 134317 - RNA, 26 nt, Human
cugggccugggugcaagaagcaaagg

SEQ ID NO: 134318 - RNA, 22 nt, Human
cuuaguggcugugguuuuuuuc

SEQ ID NO: 134319 - RNA, 21 nt, Human
cuucucaccgagcacaccuuc

SEQ ID NO: 134320 - RNA, 21 nt, Human
cuucucaccgagcacaccuuc

SEQ ID NO: 134321 - RNA, 22 nt, Human
cuuugugcugaagagcugcucc

SEQ ID NO: 134322 - RNA, 22 nt, Human
cuuugugcugaagagcugcucc

SEQ ID NO: 134323 - RNA, 19 nt, Human
gacaaagccccucaacgug

SEQ ID NO: 134324 - RNA, 22 nt, Human
gagaaacggagaagggccugga

SEQ ID NO: 134325 - RNA, 20 nt, Human
gaggaacacagguggggggu

SEQ ID NO: 134326 - RNA, 22 nt, Human
gaggaacacagguggggggucu

SEQ ID NO: 134327 - RNA, 22 nt, Human
gaggcugucuccuccucacacu

SEQ ID NO: 134328 - RNA, 22 nt, Human
gaggcugucuccuccucacacu

SEQ ID NO: 134329 - RNA, 19 nt, Human
gagggcuggggcggagccu

SEQ ID NO: 134330 - RNA, 19 nt, Human
gagggcuggggcggagccu

SEQ ID NO: 134331 - RNA, 21 nt, Human
gaguaggaggagugccccagg

SEQ ID NO: 134332 - RNA, 21 nt, Human
gaguaggaggagugccccagg

SEQ ID NO: 134333 - RNA, 19 nt, Human
gcaauguuuuuucuccagc

SEQ ID NO: 134334 - RNA, 19 nt, Human
gcaauguuuuuucuccagc

SEQ ID NO: 134335 - RNA, 20 nt, Human
gcaccauuuuccaccuccag

SEQ ID NO: 134336 - RNA, 20 nt, Human
gcaccauuuuccaccuccag

SEQ ID NO: 134337 - RNA, 20 nt, Human
gcagcccacuguuuggggag

SEQ ID NO: 134338 - RNA, 20 nt, Human
gcagcccacuguuuggggag

SEQ ID NO: 134339 - RNA, 24 nt, Human
gcaggaugacugagaugagcuucu

SEQ ID NO: 134340 - RNA, 24 nt, Human
gcaggaugacugagaugagcuucu

SEQ ID NO: 134341 - RNA, 18 nt, Human
gcauggcaggaauucuuc

SEQ ID NO: 134342 - RNA, 21 nt, Human
gccagcgcugugcuaaccugg

SEQ ID NO: 134343 - RNA, 22 nt, Human
gccccacauguuggcacagccu

SEQ ID NO: 134344 - RNA, 22 nt, Human
gccccacauguuggcacagccu

SEQ ID NO: 134345 - RNA, 20 nt, Human
gccuaggcugagaccauugu

SEQ ID NO: 134346 - RNA, 20 nt, Human
gccuaggcugagaccauugu

SEQ ID NO: 134347 - RNA, 20 nt, Human
gccugggcaggauagcaccu

SEQ ID NO: 134348 - RNA, 21 nt, Human
gccugggcaggauagcaccuc

SEQ ID NO: 134349 - RNA, 19 nt, Human
gcgccauguggcugggagc

SEQ ID NO: 134350 - RNA, 25 nt, Human
gcgugccauugauaagugugauggu

SEQ ID NO: 134351 - RNA, 25 nt, Human
gcgugccauugauaagugugauggu

SEQ ID NO: 134352 - RNA, 26 nt, Human
gcugcucuguagguacacauggggcc

SEQ ID NO: 134353 - RNA, 21 nt, Human
gcugucuccuccucacacucc

SEQ ID NO: 134354 - RNA, 21 nt, Human
gcugucuccuccucacacucc

SEQ ID NO: 134355 - RNA, 21 nt, Human
gcuguuuugggggcucccgaa

SEQ ID NO: 134356 - RNA, 21 nt, Human
gcuguuuugggggcucccgaa

SEQ ID NO: 134357 - RNA, 21 nt, Human
ggagacacccagagcggagga

SEQ ID NO: 134358 - RNA, 23 nt, Human
ggagugccccaggcucuccgcuu

SEQ ID NO: 134359 - RNA, 23 nt, Human
ggaugcugggaccagaggcagga

SEQ ID NO: 134360 - RNA, 20 nt, Human
ggcaccaccugaguggucug

SEQ ID NO: 134361 - RNA, 20 nt, Human
ggcaccaccugaguggucug

SEQ ID NO: 134362 - RNA, 20 nt, Human
ggcacccccucaugugccuu

SEQ ID NO: 134363 - RNA, 18 nt, Human
ggcaggaggcauguuggg

SEQ ID NO: 134364 - RNA, 18 nt, Human
ggcaggaggcauguuggg

SEQ ID NO: 134365 - RNA, 19 nt, Human
ggccagggccaggagcucu

SEQ ID NO: 134366 - RNA, 19 nt, Human
ggccagggccaggagcucu

SEQ ID NO: 134367 - RNA, 20 nt, Human
ggccagggccaggagcucug

SEQ ID NO: 134368 - RNA, 20 nt, Human
ggccagggccaggagcucug

SEQ ID NO: 134369 - RNA, 18 nt, Human
ggccuggggaccagagga

SEQ ID NO: 134370 - RNA, 18 nt, Human
ggccuggggaccagagga

SEQ ID NO: 134371 - RNA, 18 nt, Human
ggcuggaguuauucaggc

SEQ ID NO: 134372 - RNA, 18 nt, Human
ggcuggaguuauucaggc

SEQ ID NO: 134373 - RNA, 19 nt, Human
gggccagggacacccccag

SEQ ID NO: 134374 - RNA, 25 nt, Human
gggccuggggcugagggcuggggcg

SEQ ID NO: 134375 - RNA, 25 nt, Human
gggccuggggcugagggcuggggcg

SEQ ID NO: 134376 - RNA, 21 nt, Human
gggcuggggcggagccucagg

SEQ ID NO: 134377 - RNA, 21 nt, Human
gggcuggggcggagccucagg

SEQ ID NO: 134378 - RNA, 19 nt, Human
ggggccuggggcugagggc

SEQ ID NO: 134379 - RNA, 19 nt, Human
ggggccuggggcugagggc

SEQ ID NO: 134380 - RNA, 19 nt, Human
ggggcggagccucagggcu

SEQ ID NO: 134381 - RNA, 24 nt, Human
gguagggccccagcaugcccuggg

SEQ ID NO: 134382 - RNA, 24 nt, Human
gguagggccccagcaugcccuggg

SEQ ID NO: 134383 - RNA, 27 nt, Human
ggucaccagcucacucagcaccccaga

SEQ ID NO: 134384 - RNA, 27 nt, Human
ggucaccagcucacucagcaccccaga

SEQ ID NO: 134385 - RNA, 27 nt, Human
ggucaccagcucacucagcaccccaga

SEQ ID NO: 134386 - RNA, 21 nt, Human
ggucagcuucagguggugggu

SEQ ID NO: 134387 - RNA, 21 nt, Human
ggucagcuucagguggugggu

SEQ ID NO: 134388 - RNA, 21 nt, Human
ggucagcuucagguggugggu

SEQ ID NO: 134389 - RNA, 20 nt, Human
ggugcauuggcggaucgugc

SEQ ID NO: 134390 - RNA, 20 nt, Human
ggugcauuggcggaucgugc

SEQ ID NO: 134391 - RNA, 20 nt, Human
guagccaguacacuccaccu

SEQ ID NO: 134392 - RNA, 20 nt, Human
guagccaguacacuccaccu

SEQ ID NO: 134393 - RNA, 20 nt, Human
guccuggcuuguggggccag

SEQ ID NO: 134394 - RNA, 20 nt, Human
guccuggcuuguggggccag

SEQ ID NO: 134395 - RNA, 22 nt, Human
gugcaggaucucagggcugagc

SEQ ID NO: 134396 - RNA, 22 nt, Human
gugcaggaucucagggcugagc

SEQ ID NO: 134397 - RNA, 22 nt, Human
gugggcccagcuguggcuucag

SEQ ID NO: 134398 - RNA, 22 nt, Human
guguaggaggugguccucaggg

SEQ ID NO: 134399 - RNA, 23 nt, Human
guguaggaggugguccucaggga

SEQ ID NO: 134400 - RNA, 20 nt, Human
guguuggucagcuucaggug

SEQ ID NO: 134401 - RNA, 20 nt, Human
guguuggucagcuucaggug

SEQ ID NO: 134402 - RNA, 20 nt, Human
uaaaacaccagcagcuccac

SEQ ID NO: 134403 - RNA, 20 nt, Human
uaaaacaccagcagcuccac

SEQ ID NO: 134404 - RNA, 23 nt, Human
uaaauacaugauccaaccaugug

SEQ ID NO: 134405 - RNA, 19 nt, Human
uacuggucuucgcuaugca

SEQ ID NO: 134406 - RNA, 23 nt, Human
uagacaugugggagacacccaga

SEQ ID NO: 134407 - RNA, 20 nt, Human
uagcucugaggacaaaucau

SEQ ID NO: 134408 - RNA, 20 nt, Human
uagcucugaggacaaaucau

SEQ ID NO: 134409 - RNA, 20 nt, Human
uaggaggugguccucaggga

SEQ ID NO: 134410 - RNA, 20 nt, Human
uaggaggugguccucaggga

SEQ ID NO: 134411 - RNA, 19 nt, Human
uaucccaauguaguucucc

SEQ ID NO: 134412 - RNA, 23 nt, Human
uauuggggagcgauuggugagaa

SEQ ID NO: 134413 - RNA, 23 nt, Human
uauuggggagcgauuggugagaa

SEQ ID NO: 134414 - RNA, 23 nt, Human
ucagcucuuccuggguaugagca

SEQ ID NO: 134415 - RNA, 23 nt, Human
ucagcucuuccuggguaugagca

SEQ ID NO: 134416 - RNA, 20 nt, Human
ucagggagcugauggggcag

SEQ ID NO: 134417 - RNA, 20 nt, Human
ucagggagcugauggggcag

SEQ ID NO: 134418 - RNA, 20 nt, Human
uccaagcucaugaaacccag

SEQ ID NO: 134419 - RNA, 20 nt, Human
uccaagcucaugaaacccag

SEQ ID NO: 134420 - RNA, 23 nt, Human
uccacccugcacucccccagaga

SEQ ID NO: 134421 - RNA, 23 nt, Human
uccacccugcacucccccagaga

SEQ ID NO: 134422 - RNA, 19 nt, Human
uccauaaaauccagcugcu

SEQ ID NO: 134423 - RNA, 19 nt, Human
uccauaaaauccagcugcu

SEQ ID NO: 134424 - RNA, 21 nt, Human
ucccaaaguccacccagcugg

SEQ ID NO: 134425 - RNA, 21 nt, Human
ucccaaaguccacccagcugg

SEQ ID NO: 134426 - RNA, 20 nt, Human
ucccagaaaugccuagaacc

SEQ ID NO: 134427 - RNA, 20 nt, Human
ucccagaaaugccuagaacc

SEQ ID NO: 134428 - RNA, 22 nt, Human
ucccagaaaugccuagaaccag

SEQ ID NO: 134429 - RNA, 22 nt, Human
ucccagaaaugccuagaaccag

SEQ ID NO: 134430 - RNA, 23 nt, Human
uccccgaccucacugggcucuau

SEQ ID NO: 134431 - RNA, 21 nt, Human
uccguggaaucucccuuucca

SEQ ID NO: 134432 - RNA, 21 nt, Human
uccguggaaucucccuuucca

SEQ ID NO: 134433 - RNA, 24 nt, Human
uccucacuugggcccagcaggcca

SEQ ID NO: 134434 - RNA, 20 nt, Human
uccugugcuuggagcaccag

SEQ ID NO: 134435 - RNA, 19 nt, Human
uccuuaggaaaagugaagg

SEQ ID NO: 134436 - RNA, 25 nt, Human
uccuuuggguggccuggccacugcu

SEQ ID NO: 134437 - RNA, 25 nt, Human
uccuuuggguggccuggccacugcu

SEQ ID NO: 134438 - RNA, 23 nt, Human
ucgcugcuggcucacaaagcagg

SEQ ID NO: 134439 - RNA, 23 nt, Human
ucgcugcuggcucacaaagcagg

SEQ ID NO: 134440 - RNA, 21 nt, Human
ucuccagcuggggccuggggc

SEQ ID NO: 134441 - RNA, 21 nt, Human
ucuccagcuggggccuggggc

SEQ ID NO: 134442 - RNA, 23 nt, Human
ucucccuuuccaccuugcugucc

SEQ ID NO: 134443 - RNA, 22 nt, Human
ucuggagcacacugugaaaauc

SEQ ID NO: 134444 - RNA, 22 nt, Human
ucuggagcacacugugaaaauc

SEQ ID NO: 134445 - RNA, 24 nt, Human
ucuggccagggccaggagcucugu

SEQ ID NO: 134446 - RNA, 24 nt, Human
ucuggccagggccaggagcucugu

SEQ ID NO: 134447 - RNA, 24 nt, Human
ucuguaccucagcauacacaggaa

SEQ ID NO: 134448 - RNA, 24 nt, Human
ucuguaccucagcauacacaggaa

SEQ ID NO: 134449 - RNA, 24 nt, Human
ucuucgauuucacacagcaggucc

SEQ ID NO: 134450 - RNA, 24 nt, Human
ucuucgauuucacacagcaggucc

SEQ ID NO: 134451 - RNA, 21 nt, Human
ucuuuagcagggcaggaggcc

SEQ ID NO: 134452 - RNA, 21 nt, Human
ucuuuagcagggcaggaggcc

SEQ ID NO: 134453 - RNA, 21 nt, Human
ugaaaacaccacugcguucca

SEQ ID NO: 134454 - RNA, 20 nt, Human
ugacaagggagggccagaug

SEQ ID NO: 134455 - RNA, 20 nt, Human
ugacaagggagggccagaug

SEQ ID NO: 134456 - RNA, 23 nt, Human
ugacuuccggcagcaggucuccc

SEQ ID NO: 134457 - RNA, 23 nt, Human
ugacuuccggcagcaggucuccc

SEQ ID NO: 134458 - RNA, 18 nt, Human
ugaggacaaaucaugagg

SEQ ID NO: 134459 - RNA, 18 nt, Human
ugaggacaaaucaugagg

SEQ ID NO: 134460 - RNA, 21 nt, Human
ugaggucacuggccuggcacu

SEQ ID NO: 134461 - RNA, 21 nt, Human
ugaggucacuggccuggcacu

SEQ ID NO: 134462 - RNA, 21 nt, Human
ugaggucacuggccuggcacu

SEQ ID NO: 134463 - RNA, 21 nt, Human
ugaguaaacaccaucucucuc

SEQ ID NO: 134464 - RNA, 21 nt, Human
ugaguaaacaccaucucucuc

SEQ ID NO: 134465 - RNA, 21 nt, Human
ugauguccacccugcacuccc

SEQ ID NO: 134466 - RNA, 21 nt, Human
ugauguccacccugcacuccc

SEQ ID NO: 134467 - RNA, 20 nt, Human
ugcaagaagcaaaggccuuc

SEQ ID NO: 134468 - RNA, 19 nt, Human
ugcacagcugcugguaggg

SEQ ID NO: 134469 - RNA, 19 nt, Human
ugcacagcugcugguaggg

SEQ ID NO: 134470 - RNA, 24 nt, Human
ugccacccuauugcuggcacugga

SEQ ID NO: 134471 - RNA, 20 nt, Human
ugccuagaaccaguggcuuc

SEQ ID NO: 134472 - RNA, 20 nt, Human
ugccuagaaccaguggcuuc

SEQ ID NO: 134473 - RNA, 21 nt, Human
ugcucaggcuguuuugggggc

SEQ ID NO: 134474 - RNA, 22 nt, Human
ugcucgggaaugaggucacugg

SEQ ID NO: 134475 - RNA, 22 nt, Human
ugcucgggaaugaggucacugg

SEQ ID NO: 134476 - RNA, 22 nt, Human
ugcucgggaaugaggucacugg

SEQ ID NO: 134477 - RNA, 22 nt, Human
ugcucugugcugcaaucaggac

SEQ ID NO: 134478 - RNA, 22 nt, Human
ugcucugugcugcaaucaggac

SEQ ID NO: 134479 - RNA, 21 nt, Human
ugcugccuccuucuucccuuc

SEQ ID NO: 134480 - RNA, 19 nt, Human
ugcuucccugcugccuccu

SEQ ID NO: 134481 - RNA, 25 nt, Human
uggaacauaggucucccaauccagg

SEQ ID NO: 134482 - RNA, 25 nt, Human
uggaacauaggucucccaauccagg

SEQ ID NO: 134483 - RNA, 22 nt, Human
uggagaaggcuggggcauggca

SEQ ID NO: 134484 - RNA, 19 nt, Human
uggagggagacugggcucu

SEQ ID NO: 134485 - RNA, 19 nt, Human
uggagggagacugggcucu

SEQ ID NO: 134486 - RNA, 24 nt, Human
uggaguuuguggcuuucugcccca

SEQ ID NO: 134487 - RNA, 24 nt, Human
uggaguuuguggcuuucugcccca

SEQ ID NO: 134488 - RNA, 18 nt, Human
uggccagggccaggagcu

SEQ ID NO: 134489 - RNA, 18 nt, Human
uggccagggccaggagcu

SEQ ID NO: 134490 - RNA, 20 nt, Human
uggcccacagggcuucccuc

SEQ ID NO: 134491 - RNA, 19 nt, Human
uggccccggagccgcaggg

SEQ ID NO: 134492 - RNA, 19 nt, Human
uggccccggagccgcaggg

SEQ ID NO: 134493 - RNA, 22 nt, Human
uggcccucgggucccugcaccu

SEQ ID NO: 134494 - RNA, 19 nt, Human
uggccuggccacugcucug

SEQ ID NO: 134495 - RNA, 19 nt, Human
uggccuggccacugcucug

SEQ ID NO: 134496 - RNA, 18 nt, Human
uggcgagggcgagucuuc

SEQ ID NO: 134497 - RNA, 18 nt, Human
uggcgagggcgagucuuc

SEQ ID NO: 134498 - RNA, 18 nt, Human
ugggaaggcuggucuuuu

SEQ ID NO: 134499 - RNA, 21 nt, Human
ugggaaggcuggucuuuuugc

SEQ ID NO: 134500 - RNA, 21 nt, Human
ugggagcuucugauaggagag

SEQ ID NO: 134501 - RNA, 21 nt, Human
ugggagcuucugauaggagag

SEQ ID NO: 134502 - RNA, 21 nt, Human
ugggcccagcuguggcuucag

SEQ ID NO: 134503 - RNA, 20 nt, Human
ugggcucuaugaccccugug

SEQ ID NO: 134504 - RNA, 20 nt, Human
ugggcucuaugaccccugug

SEQ ID NO: 134505 - RNA, 22 nt, Human
uggggccagggacacccccagu

SEQ ID NO: 134506 - RNA, 24 nt, Human
uggggccuggggcugagggcuggg

SEQ ID NO: 134507 - RNA, 24 nt, Human
uggggccuggggcugagggcuggg

SEQ ID NO: 134508 - RNA, 22 nt, Human
uggggcuucuguaccucagcau

SEQ ID NO: 134509 - RNA, 22 nt, Human
uggggcuucuguaccucagcau

SEQ ID NO: 134510 - RNA, 19 nt, Human
uggguaggcaggagcgugc

SEQ ID NO: 134511 - RNA, 19 nt, Human
uggguaggcaggagcgugc

SEQ ID NO: 134512 - RNA, 18 nt, Human
ugggucagcucuuccugg

SEQ ID NO: 134513 - RNA, 18 nt, Human
ugggucagcucuuccugg

SEQ ID NO: 134514 - RNA, 25 nt, Human
ugggugacuugcuguuguuccacau

SEQ ID NO: 134515 - RNA, 25 nt, Human
ugggugacuugcuguuguuccacau

SEQ ID NO: 134516 - RNA, 24 nt, Human
ugguauggguggggaugguaaugu

SEQ ID NO: 134517 - RNA, 25 nt, Human
ugguauggguggggaugguaauguu

SEQ ID NO: 134518 - RNA, 24 nt, Human
uggugaggcaacauguaucucuca

SEQ ID NO: 134519 - RNA, 24 nt, Human
uggugaggcaacauguaucucuca

SEQ ID NO: 134520 - RNA, 18 nt, Human
ugugaaaaucccucagcu

SEQ ID NO: 134521 - RNA, 18 nt, Human
ugugcuuggagcaccagc

SEQ ID NO: 134522 - RNA, 18 nt, Human
ugugcuuggagcaccagc

SEQ ID NO: 134523 - RNA, 19 nt, Human
uguggcugggagcuggcug

SEQ ID NO: 134524 - RNA, 19 nt, Human
uguggcugggagcuggcug

SEQ ID NO: 134525 - RNA, 24 nt, Human
ugugguggucucugcuguggugug

SEQ ID NO: 134526 - RNA, 24 nt, Human
ugugguggucucugcuguggugug

SEQ ID NO: 134527 - RNA, 24 nt, Human
ugugguggucucugcuguggugug

SEQ ID NO: 134528 - RNA, 21 nt, Human
ugugucuuugugcugaagagc

SEQ ID NO: 134529 - RNA, 21 nt, Human
ugugucuuugugcugaagagc

SEQ ID NO: 134530 - RNA, 18 nt, Human
uguugggaaggcuggucu

SEQ ID NO: 134531 - RNA, 18 nt, Human
uguugggaaggcuggucu

SEQ ID NO: 134532 - RNA, 21 nt, Human
uuaguggcugugguuuuuuuc

SEQ ID NO: 134533 - RNA, 18 nt, Human
uucaccucgauuuccagg

SEQ ID NO: 134534 - RNA, 22 nt, Human
uucaucagguagaccucccgga

SEQ ID NO: 134535 - RNA, 22 nt, Human
uucaucagguagaccucccgga

SEQ ID NO: 134536 - RNA, 18 nt, Human
uuccauuccaggagcugc

SEQ ID NO: 134537 - RNA, 18 nt, Human
uuccauuccaggagcugc

SEQ ID NO: 134538 - RNA, 20 nt, Human
uucuaaccuccaccuggcug

SEQ ID NO: 134539 - RNA, 20 nt, Human
uucuaaccuccaccuggcug

SEQ ID NO: 134540 - RNA, 21 nt, Human
uugcucaggcuguuuuggggg

SEQ ID NO: 134541 - RNA, 21 nt, Human
uugcucaggcuguuuuggggg

SEQ ID NO: 134542 - RNA, 19 nt, Human
uugcuucccugcugccucc

SEQ ID NO: 134543 - RNA, 23 nt, Human
uuggccccggagccgcagggugc

SEQ ID NO: 134544 - RNA, 23 nt, Human
uuggccccggagccgcagggugc

SEQ ID NO: 134545 - RNA, 19 nt, Human
uuucaccucgauuuccagg

SEQ ID NO: 134546 - RNA, 19 nt, Human
uuucaccucgauuuccagg

SEQ ID NO: 134547 - RNA, 18 nt, Human
uuucuccagcuggggccu

SEQ ID NO: 134548 - RNA, 22 nt, Human
aaaacuguuauagaacaggaua

SEQ ID NO: 134549 - RNA, 25 nt, Human
aagcaaaaagggaaagaagggaccc

SEQ ID NO: 134550 - RNA, 25 nt, Human
aagcaaaaagggaaagaauggcugg

SEQ ID NO: 134551 - RNA, 24 nt, Human
aagggaaagaauggcuggcaaagg

SEQ ID NO: 134552 - RNA, 18 nt, Human
acugugugccaggcacug

SEQ ID NO: 134553 - RNA, 18 nt, Human
acugugugccaggcacug

SEQ ID NO: 134554 - RNA, 21 nt, Human
agaaagagaugaaauacaaag

SEQ ID NO: 134555 - RNA, 25 nt, Human
agaaagagaugaaauacaaagagaa

SEQ ID NO: 134556 - RNA, 19 nt, Human
agagaugaaauacaaagag

SEQ ID NO: 134557 - RNA, 18 nt, Human
aggaacacaaaauacaaa

SEQ ID NO: 134558 - RNA, 18 nt, Human
caaaaagggaaagaaugg

SEQ ID NO: 134559 - RNA, 20 nt, Human
caaccgaagaagcaaaggga

SEQ ID NO: 134560 - RNA, 23 nt, Human
caaccucuaaguucacuucaccu

SEQ ID NO: 134561 - RNA, 19 nt, Human
caacguagacuaaaugccu

SEQ ID NO: 134562 - RNA, 26 nt, Human
caccaaacaaaacuguuauagaacag

SEQ ID NO: 134563 - RNA, 21 nt, Human
ccccacaaccucuaaguucac

SEQ ID NO: 134564 - RNA, 24 nt, Human
ccuauguucagaacagaccggggc

SEQ ID NO: 134565 - RNA, 23 nt, Human
ccuccgcggcuuugcaaaagcug

SEQ ID NO: 134566 - RNA, 22 nt, Human
cgaccccucggccccacaaccu

SEQ ID NO: 134567 - RNA, 23 nt, Human
cgcuacacgcacgcgcaagaagc

SEQ ID NO: 134568 - RNA, 18 nt, Human
cucccaacguagacuaaa

SEQ ID NO: 134569 - RNA, 24 nt, Human
cugguagcuauaagacgaccccuc

SEQ ID NO: 134570 - RNA, 20 nt, Human
cugugugccaggcacuguuc

SEQ ID NO: 134571 - RNA, 18 nt, Human
gaccccucggccccacaa

SEQ ID NO: 134572 - RNA, 20 nt, Human
gaccccucggccccacaacc

SEQ ID NO: 134573 - RNA, 20 nt, Human
gaccccucggccccacaacu

SEQ ID NO: 134574 - RNA, 23 nt, Human
gcaaccgaagaagcaaagggaga

SEQ ID NO: 134575 - RNA, 21 nt, Human
gcgcuacacgcacgcgcagug

SEQ ID NO: 134576 - RNA, 21 nt, Human
ggacugcaaccgaagaagcaa

SEQ ID NO: 134577 - RNA, 21 nt, Human
uaaagacacagcaccaaacaa

SEQ ID NO: 134578 - RNA, 23 nt, Human
uaagacgaccccucggccccaca

SEQ ID NO: 134579 - RNA, 24 nt, Human
uaagacgaccccucggccccacaa

SEQ ID NO: 134580 - RNA, 20 nt, Human
uaagcaggacccguauuugu

SEQ ID NO: 134581 - RNA, 20 nt, Human
uacugugugccaggcacugu

SEQ ID NO: 134582 - RNA, 26 nt, Human
uagaaagagaugaaauacaaagagaa

SEQ ID NO: 134583 - RNA, 18 nt, Human
uagaacaggauaaggcag

SEQ ID NO: 134584 - RNA, 28 nt, Human
uagaacaggauaaggcaggucaucuccc

SEQ ID NO: 134585 - RNA, 18 nt, Human
uccaauauaaauacugca

SEQ ID NO: 134586 - RNA, 23 nt, Human
ucccaguugaggaguuuggaagc

SEQ ID NO: 134587 - RNA, 23 nt, Human
uccuuuuaucuucccaauggcua

SEQ ID NO: 134588 - RNA, 20 nt, Human
ucugucuccuuuuaucuucc

SEQ ID NO: 134589 - RNA, 18 nt, Human
ugaaauacaaagagaaag

SEQ ID NO: 134590 - RNA, 24 nt, Human
ugaaauacaaagagaaagagcuga

SEQ ID NO: 134591 - RNA, 21 nt, Human
ugaaugaacuuaugucccuau

SEQ ID NO: 134592 - RNA, 22 nt, Human
ugcaccacgaugauucugcgca

SEQ ID NO: 134593 - RNA, 19 nt, Human
ugggagaaacaugcuggaa

SEQ ID NO: 134594 - RNA, 25 nt, Human
uucuaaaugggagaaacaugcugga

SEQ ID NO: 134595 - RNA, 21 nt, Human
uuuucauucaucaaagauuua

SEQ ID NO: 134596 - RNA, 21 nt, Human
uuuuuuuuuuuuuuuuucauu

SEQ ID NO: 134597 - RNA, 19 nt, Human
aaauacuuacuagagccaa

SEQ ID NO: 134598 - RNA, 22 nt, Human
aagcuguaucucugaaaauguu

SEQ ID NO: 134599 - RNA, 23 nt, Human
aauaauacaaauaacaaggagau

SEQ ID NO: 134600 - RNA, 19 nt, Human
aauuccaugauuuauacau

SEQ ID NO: 134601 - RNA, 19 nt, Human
acaaaguaagaacauaaac

SEQ ID NO: 134602 - RNA, 19 nt, Human
acucucggacagguuaucc

SEQ ID NO: 134603 - RNA, 24 nt, Human
acuuacuagagccaaaucuaucuc

SEQ ID NO: 134604 - RNA, 22 nt, Human
agaaaaaaaaaagacauccgaa

SEQ ID NO: 134605 - RNA, 20 nt, Human
aguguaaaacuggcuuaaaa

SEQ ID NO: 134606 - RNA, 21 nt, Human
caaaagaaagauacagaauac

SEQ ID NO: 134607 - RNA, 19 nt, Human
cauuuucacacuuccagaa

SEQ ID NO: 134608 - RNA, 26 nt, Human
cuuagaaaaaaaaaagacauccgaaa

SEQ ID NO: 134609 - RNA, 25 nt, Human
gaaaaaaaaaagacauccgaaauac

SEQ ID NO: 134610 - RNA, 21 nt, Human
gaggaacauuuaguguaaaac

SEQ ID NO: 134611 - RNA, 22 nt, Human
uacaggucaaaaccgacugcgc

SEQ ID NO: 134612 - RNA, 27 nt, Human
uagcuccauaaguguaagcacucccga

SEQ ID NO: 134613 - RNA, 22 nt, Human
uaguguuacuauaagaagcugu

SEQ ID NO: 134614 - RNA, 24 nt, Human
uauaacuaaauacuuacuagagcc

SEQ ID NO: 134615 - RNA, 22 nt, Human
uauauaaauguuucaaaucuau

SEQ ID NO: 134616 - RNA, 18 nt, Human
ucaaaacacaagggucca

SEQ ID NO: 134617 - RNA, 19 nt, Human
ucaaaaccgacugcgccac

SEQ ID NO: 134618 - RNA, 23 nt, Human
ucaacaucuaacccuauagcaaa

SEQ ID NO: 134619 - RNA, 22 nt, Human
ucauugcuucauacuaaaaugg

SEQ ID NO: 134620 - RNA, 21 nt, Human
uccaaguaauuuuuggcgaaa

SEQ ID NO: 134621 - RNA, 18 nt, Human
ucucugcuacaggucaaa

SEQ ID NO: 134622 - RNA, 20 nt, Human
ucuucaguaccuaaacagua

SEQ ID NO: 134623 - RNA, 22 nt, Human
ugaggcuguucuccagaauugg

SEQ ID NO: 134624 - RNA, 21 nt, Human
ugcaagugauauaacuaaauc

SEQ ID NO: 134625 - RNA, 19 nt, Human
ugcauaaauuccaugauuu

SEQ ID NO: 134626 - RNA, 24 nt, Human
ugcccuuugcuccaaguaauuuuu

SEQ ID NO: 134627 - RNA, 23 nt, Human
uggaaacaggcaaacucuggggc

SEQ ID NO: 134628 - RNA, 19 nt, Human
uucaagcaguuggcauuuc

SEQ ID NO: 134629 - RNA, 23 nt, Human
uucuucaaaacacaaggguccaa

SEQ ID NO: 134630 - RNA, 21 nt, Human
uuuuuaguagaugggaaugua

SEQ ID NO: 134631 - RNA, 19 nt, Human
aagagaaacagagaaacau

SEQ ID NO: 134632 - RNA, 22 nt, Human
agggcacacaccuugcccuagc

SEQ ID NO: 134633 - RNA, 22 nt, Human
cagaaucaggaagagggcacac

SEQ ID NO: 134634 - RNA, 18 nt, Human
cagaggaaagggcaaaga

SEQ ID NO: 134635 - RNA, 22 nt, Human
ccaaagaaaauggaauugugga

SEQ ID NO: 134636 - RNA, 22 nt, Human
ccgcaguuccgaacuaaacgcg

SEQ ID NO: 134637 - RNA, 19 nt, Human
ccuugcccuagcccaccgg

SEQ ID NO: 134638 - RNA, 20 nt, Human
cgcacauaccgagacacccc

SEQ ID NO: 134639 - RNA, 19 nt, Human
cgccaggccgggaaggcuc

SEQ ID NO: 134640 - RNA, 24 nt, Human
cgugaccucgccuacaccagaucc

SEQ ID NO: 134641 - RNA, 22 nt, Human
gaaaauggaauuguggaaaaga

SEQ ID NO: 134642 - RNA, 22 nt, Human
gagaggcgugaccucgccuaca

SEQ ID NO: 134643 - RNA, 23 nt, Human
ggaaaagagaaacagagaaacau

SEQ ID NO: 134644 - RNA, 21 nt, Human
ggcaaagagaugccaaagaaa

SEQ ID NO: 134645 - RNA, 24 nt, Human
uagcccaccggcgucccgcaguuc

SEQ ID NO: 134646 - RNA, 24 nt, Human
ugccaaagaaaauggaauugugga

SEQ ID NO: 134647 - RNA, 19 nt, Human
acagcgcaagccccacaca

SEQ ID NO: 134648 - RNA, 22 nt, Human
acgauccugggcaugugcuacu

SEQ ID NO: 134649 - RNA, 24 nt, Human
agcuucucagcacagcgcaagccc

SEQ ID NO: 134650 - RNA, 23 nt, Human
caacaaaaacauaaaagccucca

SEQ ID NO: 134651 - RNA, 24 nt, Human
caacaaaaacauaaaagccuccaa

SEQ ID NO: 134652 - RNA, 19 nt, Human
caagccccacacacacgau

SEQ ID NO: 134653 - RNA, 18 nt, Human
cacacacacgauccuggg

SEQ ID NO: 134654 - RNA, 22 nt, Human
caguuugaaaaugcauugaucu

SEQ ID NO: 134655 - RNA, 22 nt, Human
cccacacacacgauccugggca

SEQ ID NO: 134656 - RNA, 23 nt, Human
ccccacacacacgauccugggca

SEQ ID NO: 134657 - RNA, 21 nt, Human
cgcaagccccacacacacgau

SEQ ID NO: 134658 - RNA, 18 nt, Human
cucagcacagcgcaagcc

SEQ ID NO: 134659 - RNA, 28 nt, Human
cuucauuggcuauauauagcauuaugcc

SEQ ID NO: 134660 - RNA, 19 nt, Human
gaaaguuaagaccucaguu

SEQ ID NO: 134661 - RNA, 21 nt, Human
uaaaugcaacaaaaacauaaa

SEQ ID NO: 134662 - RNA, 20 nt, Human
uaaggagcauauggaccggu

SEQ ID NO: 134663 - RNA, 21 nt, Human
uauguuauauauauuuuguuc

SEQ ID NO: 134664 - RNA, 21 nt, Human
ucauggcuucauacaguuugu

SEQ ID NO: 134665 - RNA, 18 nt, Human
ucugacuacaaaacgaca

SEQ ID NO: 134666 - RNA, 18 nt, Human
ucuguuuccuucauggcu

SEQ ID NO: 134667 - RNA, 26 nt, Human
ugcaaaaacauaaaugcaacaaaaac

SEQ ID NO: 134668 - RNA, 20 nt, Human
ugcaacaaaaacauaaaagc

SEQ ID NO: 134669 - RNA, 21 nt, Human
ugcaacaaaaacauaaaagcc

SEQ ID NO: 134670 - RNA, 24 nt, Human
uucucagcacagcgcaagccccac

SEQ ID NO: 134671 - RNA, 26 nt, Human
aaaaaaaaaaaagaacaggacuagaa

SEQ ID NO: 134672 - RNA, 22 nt, Human
aaaaaaaagaacaggacuagaa

SEQ ID NO: 134673 - RNA, 21 nt, Human
aaaaaagaacaggacuagaaa

SEQ ID NO: 134674 - RNA, 20 nt, Human
aagagggaggagggaagagg

SEQ ID NO: 134675 - RNA, 21 nt, Human
acaguagcauuuguucucccc

SEQ ID NO: 134676 - RNA, 21 nt, Human
agcccacgccggauuccacgc

SEQ ID NO: 134677 - RNA, 18 nt, Human
agggaggagggaagaggg

SEQ ID NO: 134678 - RNA, 20 nt, Human
caaaaaauaaacugaaacaa

SEQ ID NO: 134679 - RNA, 24 nt, Human
caaaaaauaaacugaaacaaacaa

SEQ ID NO: 134680 - RNA, 21 nt, Human
cacaagagaaugguuggaggg

SEQ ID NO: 134681 - RNA, 19 nt, Human
caccaccgccgccgccgcc

SEQ ID NO: 134682 - RNA, 20 nt, Human
caccgccgccgccgccgccg

SEQ ID NO: 134683 - RNA, 27 nt, Human
cacggugccccgcacccacggcucccc

SEQ ID NO: 134684 - RNA, 20 nt, Human
caggaaugaagagggaggag

SEQ ID NO: 134685 - RNA, 21 nt, Human
ccaccgccgccgccgccgccg

SEQ ID NO: 134686 - RNA, 19 nt, Human
ccacggugccccgcaccca

SEQ ID NO: 134687 - RNA, 23 nt, Human
cccaaaaaauaaacugaaacaaa

SEQ ID NO: 134688 - RNA, 18 nt, Human
ccccagcccacgccggau

SEQ ID NO: 134689 - RNA, 20 nt, Human
ccccgcggcucggacccccc

SEQ ID NO: 134690 - RNA, 18 nt, Human
cccgcacccacggcucca

SEQ ID NO: 134691 - RNA, 24 nt, Human
cccgggcugagcggggccuggggc

SEQ ID NO: 134692 - RNA, 28 nt, Human
ccgccaccaccgccgccgccgccgccgg

SEQ ID NO: 134693 - RNA, 21 nt, Human
ccgccgccaccaccgccgccg

SEQ ID NO: 134694 - RNA, 23 nt, Human
ccgccgccaccaccgccgccgcc

SEQ ID NO: 134695 - RNA, 24 nt, Human
ccgccgccaccaccgccgccgccg

SEQ ID NO: 134696 - RNA, 21 nt, Human
ccgccgccaccgccgccacca

SEQ ID NO: 134697 - RNA, 24 nt, Human
ccgccgccaccgccgccaccaccg

SEQ ID NO: 134698 - RNA, 18 nt, Human
ccgccgccgccgccgccg

SEQ ID NO: 134699 - RNA, 19 nt, Human
ccucuuuucucuucacuuc

SEQ ID NO: 134700 - RNA, 18 nt, Human
cggcucggaccccccagc

SEQ ID NO: 134701 - RNA, 20 nt, Human
cugaaacaaacaaaaacuua

SEQ ID NO: 134702 - RNA, 21 nt, Human
cuucacaagccgugcagcugu

SEQ ID NO: 134703 - RNA, 21 nt, Human
gaagagggaggagggaagagg

SEQ ID NO: 134704 - RNA, 20 nt, Human
gacauaucuaaaaaagggga

SEQ ID NO: 134705 - RNA, 22 nt, Human
gaggagggaagagggacuugau

SEQ ID NO: 134706 - RNA, 20 nt, Human
gcggggccuggggccgggcg

SEQ ID NO: 134707 - RNA, 26 nt, Human
gggccgggcgggcgucccggggccuc

SEQ ID NO: 134708 - RNA, 18 nt, Human
ggggccuggggccgggcg

SEQ ID NO: 134709 - RNA, 21 nt, Human
uaucuaaaaaaggggacaaga

SEQ ID NO: 134710 - RNA, 18 nt, Human
ucacaugaugaaugagau

SEQ ID NO: 134711 - RNA, 23 nt, Human
ucaguccuccucuuuucucuuca

SEQ ID NO: 134712 - RNA, 18 nt, Human
uccacgccgccgccaccg

SEQ ID NO: 134713 - RNA, 21 nt, Human
uccacgccgccgccaccgccg

SEQ ID NO: 134714 - RNA, 19 nt, Human
uccagagucugucuuucca

SEQ ID NO: 134715 - RNA, 19 nt, Human
uccccauggggacaggaau

SEQ ID NO: 134716 - RNA, 21 nt, Human
ucccuggcacacucacacugc

SEQ ID NO: 134717 - RNA, 22 nt, Human
ugaaacaaacaaaaacuuaaaa

SEQ ID NO: 134718 - RNA, 24 nt, Human
ugaagagggaggagggaagaggga

SEQ ID NO: 134719 - RNA, 24 nt, Human
ugcucggaccaagaaggggggggc

SEQ ID NO: 134720 - RNA, 25 nt, Human
uggcacacucacacugcucggacca

SEQ ID NO: 134721 - RNA, 21 nt, Human
uuucucuucacuucugcuugg

SEQ ID NO: 134722 - RNA, 19 nt, Human
aaaaagaagcugagcccag

SEQ ID NO: 134723 - RNA, 19 nt, Human
aaaaagggguagaaauugu

SEQ ID NO: 134724 - RNA, 18 nt, Human
aaagaagcugagcccagc

SEQ ID NO: 134725 - RNA, 19 nt, Human
aaccuagccacacucuccu

SEQ ID NO: 134726 - RNA, 19 nt, Human
aaggagcccagcucccccc

SEQ ID NO: 134727 - RNA, 24 nt, Human
aaggagcccagcucccccccagac

SEQ ID NO: 134728 - RNA, 21 nt, Human
aaggcaggggcccgcugcgga

SEQ ID NO: 134729 - RNA, 21 nt, Human
aauaagaaggggugggaggga

SEQ ID NO: 134730 - RNA, 24 nt, Human
accaagggcccaggugauggaggc

SEQ ID NO: 134731 - RNA, 22 nt, Human
accagcugucccauucccccag

SEQ ID NO: 134732 - RNA, 21 nt, Human
acccaucccucccuuuucccc

SEQ ID NO: 134733 - RNA, 23 nt, Human
acccaucccucccuuuuccccaa

SEQ ID NO: 134734 - RNA, 26 nt, Human
agaaaaaaaguggaaaaaagggaccc

SEQ ID NO: 134735 - RNA, 24 nt, Human
agaaaaaaauaaauaaauugcaga

SEQ ID NO: 134736 - RNA, 20 nt, Human
agaaaggaaauaaauaagaa

SEQ ID NO: 134737 - RNA, 20 nt, Human
agaagaaaaaaaguggaaaa

SEQ ID NO: 134738 - RNA, 19 nt, Human
agaagccagcaaagagggc

SEQ ID NO: 134739 - RNA, 20 nt, Human
agaaggggugggagggaggc

SEQ ID NO: 134740 - RNA, 22 nt, Human
agacagaagggaauguucagga

SEQ ID NO: 134741 - RNA, 25 nt, Human
agagaaguugggguuuuacggggga

SEQ ID NO: 134742 - RNA, 19 nt, Human
agaggcaggagaauuccug

SEQ ID NO: 134743 - RNA, 22 nt, Human
agagggcaaagacagaagggaa

SEQ ID NO: 134744 - RNA, 21 nt, Human
agcagcucaaaaagaagcuga

SEQ ID NO: 134745 - RNA, 21 nt, Human
agcccagcucucucuccuccu

SEQ ID NO: 134746 - RNA, 24 nt, Human
agcccagcucucucuccuccugac

SEQ ID NO: 134747 - RNA, 23 nt, Human
agcugcuucuccccacuaaauuc

SEQ ID NO: 134748 - RNA, 18 nt, Human
aggcaccagcaccgcacc

SEQ ID NO: 134749 - RNA, 23 nt, Human
aggcagggcgaguccaggccaag

SEQ ID NO: 134750 - RNA, 22 nt, Human
aggcuuuacuaagggaggggca

SEQ ID NO: 134751 - RNA, 25 nt, Human
agggaggggcagugaaucugggggg

SEQ ID NO: 134752 - RNA, 23 nt, Human
agguuccuggcguucaggagccc

SEQ ID NO: 134753 - RNA, 20 nt, Human
auccuaaggagcaagggcuc

SEQ ID NO: 134754 - RNA, 18 nt, Human
augaggcaggggugaccc

SEQ ID NO: 134755 - RNA, 24 nt, Human
cacacacccuggcccccucuuccc

SEQ ID NO: 134756 - RNA, 26 nt, Human
cacccucccucccgcauuucccacuu

SEQ ID NO: 134757 - RNA, 18 nt, Human
caccuccaucccucuggc

SEQ ID NO: 134758 - RNA, 23 nt, Human
cagcgggugcuccucgagggggc

SEQ ID NO: 134759 - RNA, 18 nt, Human
caggagcccaguucuggg

SEQ ID NO: 134760 - RNA, 22 nt, Human
cagggcgaguccaggccaagcc

SEQ ID NO: 134761 - RNA, 22 nt, Human
caucaguccaccuccaucccuc

SEQ ID NO: 134762 - RNA, 18 nt, Human
ccagcucccccccagacc

SEQ ID NO: 134763 - RNA, 23 nt, Human
ccaggaaaaaaaaaaaaaaagcc

SEQ ID NO: 134764 - RNA, 26 nt, Human
ccaggaaaaaaaaaaaaaaagccaca

SEQ ID NO: 134765 - RNA, 20 nt, Human
ccaucccucccuuuucccca

SEQ ID NO: 134766 - RNA, 21 nt, Human
cccaggaaaaaaaaaaaaaaa

SEQ ID NO: 134767 - RNA, 18 nt, Human
cccaucaguccaccucca

SEQ ID NO: 134768 - RNA, 24 nt, Human
cccaucccucccuuuuccccaaaa

SEQ ID NO: 134769 - RNA, 25 nt, Human
cccaucccucccuuuuccccaaaaa

SEQ ID NO: 134770 - RNA, 23 nt, Human
ccccaaaaaaauucccaggaaaa

SEQ ID NO: 134771 - RNA, 25 nt, Human
ccccaaaaaaccaccuuugagaaga

SEQ ID NO: 134772 - RNA, 21 nt, Human
ccccaaugagaauugcagaaa

SEQ ID NO: 134773 - RNA, 19 nt, Human
ccccaccacuguacccucc

SEQ ID NO: 134774 - RNA, 19 nt, Human
ccccacccucccucccgca

SEQ ID NO: 134775 - RNA, 21 nt, Human
ccccaccggagaagcccuccc

SEQ ID NO: 134776 - RNA, 19 nt, Human
cccccagaccccagguucc

SEQ ID NO: 134777 - RNA, 23 nt, Human
cccccaggucccaaggcaccagc

SEQ ID NO: 134778 - RNA, 22 nt, Human
ccccccagaccccagguuccug

SEQ ID NO: 134779 - RNA, 23 nt, Human
ccccccagaccccagguuccugg

SEQ ID NO: 134780 - RNA, 20 nt, Human
ccccccuccaacaggcugga

SEQ ID NO: 134781 - RNA, 20 nt, Human
ccccgaccccugccccaccc

SEQ ID NO: 134782 - RNA, 23 nt, Human
ccccgaccccugccccacccucc

SEQ ID NO: 134783 - RNA, 21 nt, Human
ccccugccccacccucccucc

SEQ ID NO: 134784 - RNA, 25 nt, Human
ccccugcuucuccccccaaaaaacc

SEQ ID NO: 134785 - RNA, 23 nt, Human
cccgaccccugccccacccuccc

SEQ ID NO: 134786 - RNA, 21 nt, Human
cccucccucccgcauuuccca

SEQ ID NO: 134787 - RNA, 23 nt, Human
cccugcaucccugcagcgggugc

SEQ ID NO: 134788 - RNA, 19 nt, Human
cccugccccacccucccuc

SEQ ID NO: 134789 - RNA, 18 nt, Human
cccuuuuccccaaaaaaa

SEQ ID NO: 134790 - RNA, 21 nt, Human
ccgagauagauaucaucagga

SEQ ID NO: 134791 - RNA, 20 nt, Human
ccuccaucccucuggcugca

SEQ ID NO: 134792 - RNA, 23 nt, Human
ccugggcacauagucucuggaag

SEQ ID NO: 134793 - RNA, 21 nt, Human
ccuuacacuucucuuucccua

SEQ ID NO: 134794 - RNA, 23 nt, Human
ccuuugagaagaaaaaaagugga

SEQ ID NO: 134795 - RNA, 19 nt, Human
cgacccccgaccccugccc

SEQ ID NO: 134796 - RNA, 20 nt, Human
cgacccccgaccccugcccc

SEQ ID NO: 134797 - RNA, 24 nt, Human
cgcaccaucuugcuccacacaccc

SEQ ID NO: 134798 - RNA, 22 nt, Human
cggacacccgacccccgacccc

SEQ ID NO: 134799 - RNA, 24 nt, Human
cuagacccaucccucccuuuuccc

SEQ ID NO: 134800 - RNA, 25 nt, Human
cuagacccaucccucccuuuucccc

SEQ ID NO: 134801 - RNA, 25 nt, Human
cuagccacacucuccugagaagcca

SEQ ID NO: 134802 - RNA, 23 nt, Human
cucaugcaaaccggcaaagaaaa

SEQ ID NO: 134803 - RNA, 28 nt, Human
cuccccccaaaaaaccaccuuugagaag

SEQ ID NO: 134804 - RNA, 19 nt, Human
cucccggacacccgacccc

SEQ ID NO: 134805 - RNA, 20 nt, Human
cucucuccuccugggccucc

SEQ ID NO: 134806 - RNA, 22 nt, Human
cucuuccuuucacucucucaaa

SEQ ID NO: 134807 - RNA, 18 nt, Human
cuuugagaagaaaaaaag

SEQ ID NO: 134808 - RNA, 23 nt, Human
gaaaaaaaaaaaaaaagccacau

SEQ ID NO: 134809 - RNA, 22 nt, Human
gaaaaaauaaaugagaaaucaa

SEQ ID NO: 134810 - RNA, 20 nt, Human
gaaauaaauaagaaggggug

SEQ ID NO: 134811 - RNA, 23 nt, Human
gaagcccucccaucaguccaccu

SEQ ID NO: 134812 - RNA, 23 nt, Human
gaagggaauguucaggaaggucu

SEQ ID NO: 134813 - RNA, 23 nt, Human
gaauacacuuaggguacucacac

SEQ ID NO: 134814 - RNA, 18 nt, Human
gaaucugggggggucuuc

SEQ ID NO: 134815 - RNA, 25 nt, Human
gaauugcagaaaaagggguagaaau

SEQ ID NO: 134816 - RNA, 25 nt, Human
gacccccgaccccugccccacccuc

SEQ ID NO: 134817 - RNA, 21 nt, Human
gaccccugccccacccucccu

SEQ ID NO: 134818 - RNA, 23 nt, Human
gagaagaaaaaaaguggaaaaaa

SEQ ID NO: 134819 - RNA, 19 nt, Human
gagccaagggcuugggcaa

SEQ ID NO: 134820 - RNA, 20 nt, Human
gaggggcagugaaucugggg

SEQ ID NO: 134821 - RNA, 24 nt, Human
gaguguccccccuccaacaggcug

SEQ ID NO: 134822 - RNA, 18 nt, Human
gcacauagucucuggaag

SEQ ID NO: 134823 - RNA, 19 nt, Human
gcagaggaguguccccccu

SEQ ID NO: 134824 - RNA, 26 nt, Human
gcagcgggugcuccucgagggggccc

SEQ ID NO: 134825 - RNA, 20 nt, Human
gcauugggggcagguggggg

SEQ ID NO: 134826 - RNA, 24 nt, Human
gcccagcucccccccagaccccag

SEQ ID NO: 134827 - RNA, 19 nt, Human
ggaaaaaaaaaaaaaaagc

SEQ ID NO: 134828 - RNA, 21 nt, Human
ggacacccgacccccgacccc

SEQ ID NO: 134829 - RNA, 22 nt, Human
gggagccaagggcuugggcaau

SEQ ID NO: 134830 - RNA, 18 nt, Human
gggggcauguggaaggca

SEQ ID NO: 134831 - RNA, 25 nt, Human
guccccccuccaacaggcuggaucc

SEQ ID NO: 134832 - RNA, 21 nt, Human
uaaaguaggccgucucugagc

SEQ ID NO: 134833 - RNA, 18 nt, Human
uaaccccaccggagaagc

SEQ ID NO: 134834 - RNA, 19 nt, Human
uaaccccaccggagaagcc

SEQ ID NO: 134835 - RNA, 23 nt, Human
uaaccccaccggagaagcccucc

SEQ ID NO: 134836 - RNA, 22 nt, Human
uaccuuacacuucucuuucccu

SEQ ID NO: 134837 - RNA, 19 nt, Human
uagcuugggugcccccacc

SEQ ID NO: 134838 - RNA, 19 nt, Human
uagcuugggugcccccacc

SEQ ID NO: 134839 - RNA, 20 nt, Human
ucaggaaggucucagaggcu

SEQ ID NO: 134840 - RNA, 21 nt, Human
ucccaaggcaccagcaccgca

SEQ ID NO: 134841 - RNA, 22 nt, Human
ucccacucccuagacccauccc

SEQ ID NO: 134842 - RNA, 24 nt, Human
uccccaaaaaaauucccaggaaaa

SEQ ID NO: 134843 - RNA, 21 nt, Human
uccccccuccaacaggcugga

SEQ ID NO: 134844 - RNA, 19 nt, Human
uccccugcuucucccccca

SEQ ID NO: 134845 - RNA, 20 nt, Human
uccccugcuucuccccccaa

SEQ ID NO: 134846 - RNA, 21 nt, Human
ucccggacacccgacccccga

SEQ ID NO: 134847 - RNA, 24 nt, Human
ucccggacacccgacccccgaccc

SEQ ID NO: 134848 - RNA, 24 nt, Human
ucccuacuuuucccuucuaacccc

SEQ ID NO: 134849 - RNA, 27 nt, Human
ucccuagacccaucccucccuuuuccc

SEQ ID NO: 134850 - RNA, 23 nt, Human
ucccucccuuuuccccaaaaaaa

SEQ ID NO: 134851 - RNA, 24 nt, Human
ucccucuggcugcagugacuuaag

SEQ ID NO: 134852 - RNA, 25 nt, Human
ucccuggcucccggacacccgaccc

SEQ ID NO: 134853 - RNA, 20 nt, Human
uccugggccuccucucaccc

SEQ ID NO: 134854 - RNA, 22 nt, Human
ucugucucuuccuuucacucuc

SEQ ID NO: 134855 - RNA, 22 nt, Human
ucuucccauaggcaggcagaac

SEQ ID NO: 134856 - RNA, 25 nt, Human
ucuucucucacuuuaaucucccuaa

SEQ ID NO: 134857 - RNA, 20 nt, Human
ucuugcuccacacacccugg

SEQ ID NO: 134858 - RNA, 18 nt, Human
ugaaacuguagcuguucc

SEQ ID NO: 134859 - RNA, 18 nt, Human
ugaccccagacccugccu

SEQ ID NO: 134860 - RNA, 18 nt, Human
ugagaagaaaaaaagugg

SEQ ID NO: 134861 - RNA, 19 nt, Human
ugagccgaccagcuguccc

SEQ ID NO: 134862 - RNA, 20 nt, Human
ugauggaggcagggcgaguc

SEQ ID NO: 134863 - RNA, 18 nt, Human
ugccccacccucccuccc

SEQ ID NO: 134864 - RNA, 20 nt, Human
ugccuuaggagagagcggag

SEQ ID NO: 134865 - RNA, 18 nt, Human
uggaaggaacagagggca

SEQ ID NO: 134866 - RNA, 23 nt, Human
uggcucccggacacccgaccccc

SEQ ID NO: 134867 - RNA, 23 nt, Human
ugggggagggcagguggcccccg

SEQ ID NO: 134868 - RNA, 21 nt, Human
ugggggcaggugggggcgggg

SEQ ID NO: 134869 - RNA, 22 nt, Human
ugucccauucccccagguccca

SEQ ID NO: 134870 - RNA, 20 nt, Human
ugugcauugggggcaggugg

SEQ ID NO: 134871 - RNA, 25 nt, Human
ugugcauugggggcaggugggggcg

SEQ ID NO: 134872 - RNA, 25 nt, Human
ugugggagaggaugggggagggcag

SEQ ID NO: 134873 - RNA, 18 nt, Human
uuacuaagggaggggcag

SEQ ID NO: 134874 - RNA, 20 nt, Human
uucaggaaggucucagaggc

SEQ ID NO: 134875 - RNA, 21 nt, Human
uuccugcccuagggcuagaga

SEQ ID NO: 134876 - RNA, 25 nt, Human
uugggacuuccugcccuagggcuag

SEQ ID NO: 134877 - RNA, 25 nt, Human
uuugagaagaaaaaaaguggaaaaa

SEQ ID NO: 134878 - RNA, 24 nt, Human
uuuuuuuuuuuuuuuuuuuucaag

SEQ ID NO: 134879 - RNA, 26 nt, Human
aaaaaaaaaaagcccccaaacgaaga

SEQ ID NO: 134880 - RNA, 19 nt, Human
aaaaaaaaagcccccaaac

SEQ ID NO: 134881 - RNA, 25 nt, Human
aaaaaagcccccaaacgaagacacc

SEQ ID NO: 134882 - RNA, 19 nt, Human
aaaaagaacugauguaccu

SEQ ID NO: 134883 - RNA, 24 nt, Human
aaaacagccccuacccccagaggg

SEQ ID NO: 134884 - RNA, 18 nt, Human
aaaccaacaccaaagcga

SEQ ID NO: 134885 - RNA, 21 nt, Human
aaaccuccucagggagagggc

SEQ ID NO: 134886 - RNA, 21 nt, Human
aaagcucuggucccaccaaca

SEQ ID NO: 134887 - RNA, 18 nt, Human
aaaggagcugcugccucc

SEQ ID NO: 134888 - RNA, 22 nt, Human
aaaggugggugcugaacccguc

SEQ ID NO: 134889 - RNA, 20 nt, Human
aaaugccaaaggcacugguu

SEQ ID NO: 134890 - RNA, 21 nt, Human
aaccccacaggggcccaccuc

SEQ ID NO: 134891 - RNA, 24 nt, Human
aaccgcugguucuccucccccagg

SEQ ID NO: 134892 - RNA, 20 nt, Human
aacgaaaccaacaccaaagc

SEQ ID NO: 134893 - RNA, 18 nt, Human
aagaaugccaaagucacc

SEQ ID NO: 134894 - RNA, 18 nt, Human
aagcagguagucuauuuu

SEQ ID NO: 134895 - RNA, 23 nt, Human
aagcgacaggggguugacagagg

SEQ ID NO: 134896 - RNA, 23 nt, Human
aaggagcugcugccuccuggggg

SEQ ID NO: 134897 - RNA, 19 nt, Human
acaaucuugucucgcuccu

SEQ ID NO: 134898 - RNA, 20 nt, Human
acacuguaccaucucagucc

SEQ ID NO: 134899 - RNA, 20 nt, Human
acagcugaacaccaccugga

SEQ ID NO: 134900 - RNA, 19 nt, Human
acauaaaccaccaaauacu

SEQ ID NO: 134901 - RNA, 24 nt, Human
acccagggacuuccuccgccgcac

SEQ ID NO: 134902 - RNA, 20 nt, Human
accccagugccuucaaguca

SEQ ID NO: 134903 - RNA, 22 nt, Human
accuguaaaacaaaggacagca

SEQ ID NO: 134904 - RNA, 22 nt, Human
acucagcaucuuaucagagucg

SEQ ID NO: 134905 - RNA, 24 nt, Human
acugggaugcaaacccugggggcc

SEQ ID NO: 134906 - RNA, 22 nt, Human
agaaaggagcugcugccuccug

SEQ ID NO: 134907 - RNA, 21 nt, Human
agaggcuguggaaggcaggag

SEQ ID NO: 134908 - RNA, 21 nt, Human
agcaagcuucggccgaaaacu

SEQ ID NO: 134909 - RNA, 18 nt, Human
agcacagcugaacaccac

SEQ ID NO: 134910 - RNA, 20 nt, Human
agcucacaguggugcugggg

SEQ ID NO: 134911 - RNA, 19 nt, Human
agcuccuggcacagagccu

SEQ ID NO: 134912 - RNA, 28 nt, Human
agcuggauggccgugucccucugcuggg

SEQ ID NO: 134913 - RNA, 23 nt, Human
aggcacugggacaggccuggggg

SEQ ID NO: 134914 - RNA, 20 nt, Human
aggcaggagagaaaggccga

SEQ ID NO: 134915 - RNA, 19 nt, Human
agggggcagggcgcucggg

SEQ ID NO: 134916 - RNA, 19 nt, Human
aggggguugacagagggga

SEQ ID NO: 134917 - RNA, 24 nt, Human
aguaauaagcacagauggaggaga

SEQ ID NO: 134918 - RNA, 22 nt, Human
agucaauauccuccgucucccu

SEQ ID NO: 134919 - RNA, 21 nt, Human
agucagucuccuuggccaccu

SEQ ID NO: 134920 - RNA, 23 nt, Human
agugagcaggcccaggaccugga

SEQ ID NO: 134921 - RNA, 22 nt, Human
agugcaaaaaaaaaaaaagccc

SEQ ID NO: 134922 - RNA, 21 nt, Human
aucgccucaaaccuccucagg

SEQ ID NO: 134923 - RNA, 22 nt, Human
augccacagucccccgggaaac

SEQ ID NO: 134924 - RNA, 21 nt, Human
auggagucgcuccuucuggga

SEQ ID NO: 134925 - RNA, 21 nt, Human
caaaaaaaaaaaaagccccca

SEQ ID NO: 134926 - RNA, 23 nt, Human
caaaaaaaaaaaaagcccccaaa

SEQ ID NO: 134927 - RNA, 20 nt, Human
caaaaagaacugauguaccu

SEQ ID NO: 134928 - RNA, 18 nt, Human
caaacgaagacacccaca

SEQ ID NO: 134929 - RNA, 23 nt, Human
caaagaauaaaaugaaaucaaag

SEQ ID NO: 134930 - RNA, 22 nt, Human
caaagccacgguccccagaggc

SEQ ID NO: 134931 - RNA, 22 nt, Human
caaagcucuggucccaccaaca

SEQ ID NO: 134932 - RNA, 20 nt, Human
caacaagaaccucccaaagc

SEQ ID NO: 134933 - RNA, 22 nt, Human
caauaaccauuaugcuuccccu

SEQ ID NO: 134934 - RNA, 21 nt, Human
cacacuguaccaucucagucc

SEQ ID NO: 134935 - RNA, 22 nt, Human
caccgcacggucccgcucccgc

SEQ ID NO: 134936 - RNA, 19 nt, Human
caccuccucacaccucuuc

SEQ ID NO: 134937 - RNA, 21 nt, Human
cacgugugacacgggcagagu

SEQ ID NO: 134938 - RNA, 23 nt, Human
cacuccauucuccagacugaugc

SEQ ID NO: 134939 - RNA, 24 nt, Human
cacugggaugcaaacccugggggc

SEQ ID NO: 134940 - RNA, 25 nt, Human
cacuguaccaucucagucccacucu

SEQ ID NO: 134941 - RNA, 18 nt, Human
cagagagcuucucaggca

SEQ ID NO: 134942 - RNA, 24 nt, Human
cagcacagcggcagcauacacucc

SEQ ID NO: 134943 - RNA, 22 nt, Human
cagcaguggccgccggccacgc

SEQ ID NO: 134944 - RNA, 18 nt, Human
cagcauccauugucaccg

SEQ ID NO: 134945 - RNA, 18 nt, Human
cagcccugcccacgcagc

SEQ ID NO: 134946 - RNA, 24 nt, Human
cagccguggcccucugucuacaaa

SEQ ID NO: 134947 - RNA, 18 nt, Human
cagcuccaucucccacug

SEQ ID NO: 134948 - RNA, 20 nt, Human
cagcuccaucucccacugca

SEQ ID NO: 134949 - RNA, 22 nt, Human
cagcugcccauucucccgccuc

SEQ ID NO: 134950 - RNA, 22 nt, Human
caggagccggcuguggagugug

SEQ ID NO: 134951 - RNA, 24 nt, Human
caggagccggcuguggagugugug

SEQ ID NO: 134952 - RNA, 20 nt, Human
cagucugucagcucaguacc

SEQ ID NO: 134953 - RNA, 18 nt, Human
cauagucaggauucagcc

SEQ ID NO: 134954 - RNA, 25 nt, Human
cauuaugcuuccccuaaaagcucuc

SEQ ID NO: 134955 - RNA, 22 nt, Human
ccaacaagaaccucccaaagca

SEQ ID NO: 134956 - RNA, 21 nt, Human
ccaaccccacaggggcccacc

SEQ ID NO: 134957 - RNA, 22 nt, Human
ccaccaacaagaaccucccaaa

SEQ ID NO: 134958 - RNA, 22 nt, Human
ccacccagggacuuccuccgcc

SEQ ID NO: 134959 - RNA, 25 nt, Human
ccacccucuaaaaaguuuaagaauu

SEQ ID NO: 134960 - RNA, 21 nt, Human
ccaccuucccacccagggacu

SEQ ID NO: 134961 - RNA, 20 nt, Human
ccacugucuuucuguccacu

SEQ ID NO: 134962 - RNA, 21 nt, Human
cccaaagcaaagcagccccca

SEQ ID NO: 134963 - RNA, 19 nt, Human
cccacagacggccugcuag

SEQ ID NO: 134964 - RNA, 22 nt, Human
cccacagacggccugcuagggu

SEQ ID NO: 134965 - RNA, 22 nt, Human
cccaccaacaagaaccucccaa

SEQ ID NO: 134966 - RNA, 23 nt, Human
cccaccaacaagaaccucccaaa

SEQ ID NO: 134967 - RNA, 24 nt, Human
cccacucugccuguaacuuagaaa

SEQ ID NO: 134968 - RNA, 19 nt, Human
cccccaaacgaagacaccc

SEQ ID NO: 134969 - RNA, 20 nt, Human
cccccaaacgaagacaccca

SEQ ID NO: 134970 - RNA, 23 nt, Human
ccccucaggcggccagcugcagu

SEQ ID NO: 134971 - RNA, 23 nt, Human
cccugcccacgcagcucucacgg

SEQ ID NO: 134972 - RNA, 22 nt, Human
ccgcagcagcugcccauucucc

SEQ ID NO: 134973 - RNA, 19 nt, Human
ccgccggccacgcacgucc

SEQ ID NO: 134974 - RNA, 27 nt, Human
ccgcucccgccucagguugucacacug

SEQ ID NO: 134975 - RNA, 27 nt, Human
ccugccacccucuaaaaaguuuaagaa

SEQ ID NO: 134976 - RNA, 22 nt, Human
ccugguuccggauccuuccccc

SEQ ID NO: 134977 - RNA, 21 nt, Human
ccuucagagucugccuugucc

SEQ ID NO: 134978 - RNA, 22 nt, Human
ccuucugggagguuuugggggu

SEQ ID NO: 134979 - RNA, 24 nt, Human
cgaccauguugauggcccccuccc

SEQ ID NO: 134980 - RNA, 23 nt, Human
cgagaggcuguggaaggcaggag

SEQ ID NO: 134981 - RNA, 24 nt, Human
cgagucuggucacucaggagccgg

SEQ ID NO: 134982 - RNA, 23 nt, Human
cgcaacgauccugucucccacag

SEQ ID NO: 134983 - RNA, 23 nt, Human
cgccuccaucuccucauuggccg

SEQ ID NO: 134984 - RNA, 27 nt, Human
cggaaccgggccuccuuuuccaacugg

SEQ ID NO: 134985 - RNA, 21 nt, Human
cgggaacgaaaccaacaccaa

SEQ ID NO: 134986 - RNA, 18 nt, Human
cgugugacacgggcagag

SEQ ID NO: 134987 - RNA, 20 nt, Human
cuagccucagaagugcaaaa

SEQ ID NO: 134988 - RNA, 26 nt, Human
cucaaguaauaagcacaggguacccc

SEQ ID NO: 134989 - RNA, 18 nt, Human
cucacaguggugcugggg

SEQ ID NO: 134990 - RNA, 23 nt, Human
cugaacaccaccuggaccccacu

SEQ ID NO: 134991 - RNA, 21 nt, Human
cugaacccgucuuuaguguua

SEQ ID NO: 134992 - RNA, 19 nt, Human
cugcagcagcuccaucucc

SEQ ID NO: 134993 - RNA, 19 nt, Human
cugcagcagguuucgcucc

SEQ ID NO: 134994 - RNA, 19 nt, Human
cugcagguccuuguucugc

SEQ ID NO: 134995 - RNA, 23 nt, Human
cugcugccuccuggggggccugg

SEQ ID NO: 134996 - RNA, 19 nt, Human
cuggcuccuuccugucuuc

SEQ ID NO: 134997 - RNA, 22 nt, Human
cuguaaucaagauuaaaaagac

SEQ ID NO: 134998 - RNA, 27 nt, Human
cuucagcaaccgcugguucuccucccc

SEQ ID NO: 134999 - RNA, 19 nt, Human
gaaaacagccccuaccccc

SEQ ID NO: 135000 - RNA, 19 nt, Human
gaacccgucuuuaguguua

SEQ ID NO: 135001 - RNA, 23 nt, Human
gacaauaaccauuaugcuucccc

SEQ ID NO: 135002 - RNA, 20 nt, Human
gagagacgaguuuguaagaa

SEQ ID NO: 135003 - RNA, 19 nt, Human
gagcggaaggagcucaggc

SEQ ID NO: 135004 - RNA, 21 nt, Human
gagcugcaggggccgacccug

SEQ ID NO: 135005 - RNA, 21 nt, Human
gagcugcccaccagaguggcu

SEQ ID NO: 135006 - RNA, 21 nt, Human
gaggccuccccaaccccacag

SEQ ID NO: 135007 - RNA, 21 nt, Human
gauggaggagaaacgagaggc

SEQ ID NO: 135008 - RNA, 22 nt, Human
gauggccugcuucuuguccuug

SEQ ID NO: 135009 - RNA, 25 nt, Human
gcagcacagcggcagcauacacucc

SEQ ID NO: 135010 - RNA, 20 nt, Human
gcagcaguggccgccggcca

SEQ ID NO: 135011 - RNA, 22 nt, Human
gccacgcacguccaccagccca

SEQ ID NO: 135012 - RNA, 22 nt, Human
gccagcaucucgggccgcaggu

SEQ ID NO: 135013 - RNA, 22 nt, Human
gccguggagcugagcauggccu

SEQ ID NO: 135014 - RNA, 18 nt, Human
gcggcagcauacacucca

SEQ ID NO: 135015 - RNA, 21 nt, Human
gcgggugucauccaggcugcg

SEQ ID NO: 135016 - RNA, 23 nt, Human
gcugccuccuggggggccuggcu

SEQ ID NO: 135017 - RNA, 20 nt, Human
gcugcucuugagcuuggacu

SEQ ID NO: 135018 - RNA, 19 nt, Human
gcuucuggguccugguucc

SEQ ID NO: 135019 - RNA, 18 nt, Human
ggacaggccugggggcag

SEQ ID NO: 135020 - RNA, 20 nt, Human
ggagagggcgcacuggugcu

SEQ ID NO: 135021 - RNA, 23 nt, Human
ggagcagacacaguccucaagua

SEQ ID NO: 135022 - RNA, 26 nt, Human
ggagccgcuucauguccucccaugac

SEQ ID NO: 135023 - RNA, 18 nt, Human
ggagcugugggccaucaa

SEQ ID NO: 135024 - RNA, 24 nt, Human
ggaggagaaacgagaggcuguggg

SEQ ID NO: 135025 - RNA, 18 nt, Human
ggaggccuccccaacccc

SEQ ID NO: 135026 - RNA, 19 nt, Human
ggagguuuuggggguguca

SEQ ID NO: 135027 - RNA, 22 nt, Human
ggccaugggcucgaaaacucag

SEQ ID NO: 135028 - RNA, 28 nt, Human
ggccaugggcucgaaaacucagcaucuu

SEQ ID NO: 135029 - RNA, 20 nt, Human
ggcccaggaccuggaagcag

SEQ ID NO: 135030 - RNA, 20 nt, Human
gggcagaccugcaagggucc

SEQ ID NO: 135031 - RNA, 21 nt, Human
gggcagagugugugggccugg

SEQ ID NO: 135032 - RNA, 19 nt, Human
gggccuggcuccuuccugu

SEQ ID NO: 135033 - RNA, 18 nt, Human
gggugucagaggccccgc

SEQ ID NO: 135034 - RNA, 24 nt, Human
ggugggugcugaacccgucuuuag

SEQ ID NO: 135035 - RNA, 20 nt, Human
ggugucauccaggcugcgca

SEQ ID NO: 135036 - RNA, 21 nt, Human
gucaccuuccccauuguggga

SEQ ID NO: 135037 - RNA, 23 nt, Human
gucauaguccuucuugaccaccu

SEQ ID NO: 135038 - RNA, 20 nt, Human
gucauugacccuuaagcggc

SEQ ID NO: 135039 - RNA, 22 nt, Human
gugcugggggucaaacuccggg

SEQ ID NO: 135040 - RNA, 21 nt, Human
guuguccagugcaaugccauu

SEQ ID NO: 135041 - RNA, 26 nt, Human
uaaaaugaaaucaaagauuucucgcu

SEQ ID NO: 135042 - RNA, 18 nt, Human
uaaacauaaaccaccaaa

SEQ ID NO: 135043 - RNA, 19 nt, Human
uaagaaugccaaagucacc

SEQ ID NO: 135044 - RNA, 19 nt, Human
uaagcggccaucagcaaug

SEQ ID NO: 135045 - RNA, 20 nt, Human
uaaggaggaaccacaucaaa

SEQ ID NO: 135046 - RNA, 23 nt, Human
uaaggugcccacuccuggagcuc

SEQ ID NO: 135047 - RNA, 26 nt, Human
uacaaagaauaaaaugaaaucaaaga

SEQ ID NO: 135048 - RNA, 19 nt, Human
uagaaaacagccccuaccc

SEQ ID NO: 135049 - RNA, 23 nt, Human
uagaaaacuuguaccuguaaaac

SEQ ID NO: 135050 - RNA, 18 nt, Human
uagaaaagagcugagucu

SEQ ID NO: 135051 - RNA, 22 nt, Human
uagaaaagagcugagucuggug

SEQ ID NO: 135052 - RNA, 31 nt, Human
uagaaaagagcugagucugguguccccucag

SEQ ID NO: 135053 - RNA, 24 nt, Human
uagaugggguuccgcaggauggag

SEQ ID NO: 135054 - RNA, 18 nt, Human
uaggguauagcggggggu

SEQ ID NO: 135055 - RNA, 18 nt, Human
uaguagcuggaagcaaug

SEQ ID NO: 135056 - RNA, 24 nt, Human
uagugacaaauaugccacaguccc

SEQ ID NO: 135057 - RNA, 24 nt, Human
uaugcagaaaggagcugcugccuc

SEQ ID NO: 135058 - RNA, 18 nt, Human
uauuuuggggggugucug

SEQ ID NO: 135059 - RNA, 21 nt, Human
ucaaagauggacuuucuuugc

SEQ ID NO: 135060 - RNA, 22 nt, Human
ucaaagcucuggucccaccaac

SEQ ID NO: 135061 - RNA, 19 nt, Human
ucaacaccugcugcugcug

SEQ ID NO: 135062 - RNA, 24 nt, Human
ucaccgaucuccuucugguccucc

SEQ ID NO: 135063 - RNA, 21 nt, Human
ucacucaggagccggcugugg

SEQ ID NO: 135064 - RNA, 19 nt, Human
ucagagucuuugauauuuu

SEQ ID NO: 135065 - RNA, 24 nt, Human
uccacuuuagugacaaauaugcca

SEQ ID NO: 135066 - RNA, 19 nt, Human
uccaggcucaggcgucccu

SEQ ID NO: 135067 - RNA, 23 nt, Human
uccagggaggccuccccaacccc

SEQ ID NO: 135068 - RNA, 23 nt, Human
ucccaugacugcugcagcagguu

SEQ ID NO: 135069 - RNA, 22 nt, Human
uccccagaggcaucugagcgga

SEQ ID NO: 135070 - RNA, 19 nt, Human
uccucguggagccgcuuca

SEQ ID NO: 135071 - RNA, 22 nt, Human
uccuggaaggcccagucccgcc

SEQ ID NO: 135072 - RNA, 23 nt, Human
uccuggggggccuggcuccuucc

SEQ ID NO: 135073 - RNA, 23 nt, Human
uccuucagcuccuggcacagagc

SEQ ID NO: 135074 - RNA, 27 nt, Human
uccuugagcuccuucagcucgcggcug

SEQ ID NO: 135075 - RNA, 20 nt, Human
uccuuguucugcgccguggg

SEQ ID NO: 135076 - RNA, 19 nt, Human
ucgcugucuucaccugcgu

SEQ ID NO: 135077 - RNA, 20 nt, Human
ucucugaucagcuggcuaaa

SEQ ID NO: 135078 - RNA, 24 nt, Human
ucuuuaguguuaucuguuuugugu

SEQ ID NO: 135079 - RNA, 25 nt, Human
ucuuuaguguuaucuguuuuguguu

SEQ ID NO: 135080 - RNA, 20 nt, Human
ugaagacgggaacgaaacca

SEQ ID NO: 135081 - RNA, 21 nt, Human
ugaagacgggaacgaaaccaa

SEQ ID NO: 135082 - RNA, 23 nt, Human
ugacagaggggacaggggcuggg

SEQ ID NO: 135083 - RNA, 22 nt, Human
ugagguccucaucacaggauuu

SEQ ID NO: 135084 - RNA, 23 nt, Human
ugcaaaaaaaaaaaaagccccca

SEQ ID NO: 135085 - RNA, 24 nt, Human
ugcaaaaaaaaaaaaagcccccaa

SEQ ID NO: 135086 - RNA, 21 nt, Human
ugcaaacccugggggccagca

SEQ ID NO: 135087 - RNA, 20 nt, Human
ugcaaugccauugaucgcaa

SEQ ID NO: 135088 - RNA, 18 nt, Human
ugcagaaaggagcugcug

SEQ ID NO: 135089 - RNA, 23 nt, Human
ugccccagcucauccaccuucug

SEQ ID NO: 135090 - RNA, 20 nt, Human
ugccgcagcgccuccaucuc

SEQ ID NO: 135091 - RNA, 19 nt, Human
ugccguggagcugagcaug

SEQ ID NO: 135092 - RNA, 24 nt, Human
ugccuguaacuuagaaaacagccc

SEQ ID NO: 135093 - RNA, 20 nt, Human
ugcgagggggugaugcgugc

SEQ ID NO: 135094 - RNA, 19 nt, Human
ugcugcugcugggcacgga

SEQ ID NO: 135095 - RNA, 18 nt, Human
ugcugcugggcacggagg

SEQ ID NO: 135096 - RNA, 18 nt, Human
ugcugggggucaaacucc

SEQ ID NO: 135097 - RNA, 18 nt, Human
ugcuuuggcuuuuuauaa

SEQ ID NO: 135098 - RNA, 22 nt, Human
uggaagcaaugcggacccuggc

SEQ ID NO: 135099 - RNA, 20 nt, Human
uggaagcagguagucuauuu

SEQ ID NO: 135100 - RNA, 26 nt, Human
uggaagcagguagucuauuuuggggg

SEQ ID NO: 135101 - RNA, 18 nt, Human
uggcagcugcgcagcaga

SEQ ID NO: 135102 - RNA, 20 nt, Human
uggcaggcaucagcacagcu

SEQ ID NO: 135103 - RNA, 21 nt, Human
uggcaggcaucagcacagcug

SEQ ID NO: 135104 - RNA, 20 nt, Human
uggccuugcgagggggugau

SEQ ID NO: 135105 - RNA, 18 nt, Human
uggcuaaagaaagguggg

SEQ ID NO: 135106 - RNA, 19 nt, Human
ugggaggaaaaugccaaag

SEQ ID NO: 135107 - RNA, 18 nt, Human
uggggagagugagcaggc

SEQ ID NO: 135108 - RNA, 23 nt, Human
uggggggccuggcuccuuccugu

SEQ ID NO: 135109 - RNA, 23 nt, Human
ugggugcugaacccgucuuuagu

SEQ ID NO: 135110 - RNA, 22 nt, Human
uggugugcugguucugcaggcu

SEQ ID NO: 135111 - RNA, 20 nt, Human
ugguuccggauccuuccccc

SEQ ID NO: 135112 - RNA, 24 nt, Human
ugguucuccucccccagcugcucc

SEQ ID NO: 135113 - RNA, 19 nt, Human
uguaccugccacccucuaa

SEQ ID NO: 135114 - RNA, 21 nt, Human
ugucauacaguuuguugagaa

SEQ ID NO: 135115 - RNA, 21 nt, Human
uuaaaauauagguccuacccc

SEQ ID NO: 135116 - RNA, 26 nt, Human
uuaagcggccaucagcaaugcuuccu

SEQ ID NO: 135117 - RNA, 24 nt, Human
uuagaaaacagccccuacccccag

SEQ ID NO: 135118 - RNA, 19 nt, Human
uuagaaaaggcuuguaaac

SEQ ID NO: 135119 - RNA, 20 nt, Human
uuccgcaggauggagcucac

SEQ ID NO: 135120 - RNA, 18 nt, Human
uugauggcccccucccca

SEQ ID NO: 135121 - RNA, 20 nt, Human
uugcagcaucucugaucagc

SEQ ID NO: 135122 - RNA, 20 nt, Human
uuggagccuucagagucugc

SEQ ID NO: 135123 - RNA, 22 nt, Human
uuggccggcaggugggaggagu

SEQ ID NO: 135124 - RNA, 22 nt, Human
uuguaagaaugccaaagucacc

SEQ ID NO: 135125 - RNA, 21 nt, Human
uuucgaaggauuucaaccucc

SEQ ID NO: 135126 - RNA, 19 nt, Human
uuugggggugucagaggcc

SEQ ID NO: 135127 - RNA, 24 nt, Human
uuuguuguacuaaagccuguuuaa

SEQ ID NO: 135128 - RNA, 24 nt, Human
uuuuccaacugggauuccaucugu

SEQ ID NO: 135129 - RNA, 19 nt, Human
aagagauagcgaacaccac

SEQ ID NO: 135130 - RNA, 18 nt, Human
acaaagauuaggacagac

SEQ ID NO: 135131 - RNA, 23 nt, Human
acaccacaaagauuaggacagac

SEQ ID NO: 135132 - RNA, 19 nt, Human
accgggcugcgcgcugcgc

SEQ ID NO: 135133 - RNA, 18 nt, Human
caagagauagcgaacacc

SEQ ID NO: 135134 - RNA, 20 nt, Human
caagagauagcgaacaccac

SEQ ID NO: 135135 - RNA, 20 nt, Human
cacaagagauagcgaacacc

SEQ ID NO: 135136 - RNA, 18 nt, Human
cccgggagcggugcgggc

SEQ ID NO: 135137 - RNA, 21 nt, Human
ccgcacugggcuucugguugc

SEQ ID NO: 135138 - RNA, 22 nt, Human
ccgggagcggugcgggcgcggg

SEQ ID NO: 135139 - RNA, 20 nt, Human
cgcgcagcgaggggaaagcc

SEQ ID NO: 135140 - RNA, 19 nt, Human
cggcuccuggcgccgcacu

SEQ ID NO: 135141 - RNA, 22 nt, Human
cggugcgggcgcggguccggcu

SEQ ID NO: 135142 - RNA, 18 nt, Human
cugcgcgcugcgcucucc

SEQ ID NO: 135143 - RNA, 22 nt, Human
gaggaacuccaagaaucuagag

SEQ ID NO: 135144 - RNA, 23 nt, Human
gcgcggguccggcuccuggcgcc

SEQ ID NO: 135145 - RNA, 19 nt, Human
gcggugcgggcgcgggucc

SEQ ID NO: 135146 - RNA, 20 nt, Human
gcugcaccgggcugcgcgcu

SEQ ID NO: 135147 - RNA, 19 nt, Human
ucacacagcagcacaaaga

SEQ ID NO: 135148 - RNA, 21 nt, Human
ucccgggagcggugcgggcgc

SEQ ID NO: 135149 - RNA, 20 nt, Human
ugcggacgcgaaagggggcg

SEQ ID NO: 135150 - RNA, 23 nt, Human
ugucacacagcagcacaaagaca

SEQ ID NO: 135151 - RNA, 23 nt, Human
uugcggacgcgaaagggggcgcg

SEQ ID NO: 135152 - RNA, 20 nt, Human
uuuuuuuuuuuuuaaagaug

SEQ ID NO: 135153 - RNA, 22 nt, Human
uuuuuuuuuuuuuuuuuuaaag

SEQ ID NO: 135154 - RNA, 23 nt, Human
aaaaccuuccagagacucuaccc

SEQ ID NO: 135155 - RNA, 23 nt, Human
aaaguaaguuagaacugaaaaug

SEQ ID NO: 135156 - RNA, 21 nt, Human
aagauggcagguagcucaaaa

SEQ ID NO: 135157 - RNA, 23 nt, Human
agaagauggcagguagcucaaaa

SEQ ID NO: 135158 - RNA, 19 nt, Human
uaagagggaugcaaaauag

SEQ ID NO: 135159 - RNA, 18 nt, Human
uccagagacucuacccaa

SEQ ID NO: 135160 - RNA, 23 nt, Human
ugaaaaugggcuuaaaaccuucc

SEQ ID NO: 135161 - RNA, 22 nt, Human
aaaagggcacucucuacuggcc

SEQ ID NO: 135162 - RNA, 19 nt, Human
aaacugccuccucagccca

SEQ ID NO: 135163 - RNA, 23 nt, Human
aaggccccgcuauaacgcaggaa

SEQ ID NO: 135164 - RNA, 18 nt, Human
aaggugccauugaagaag

SEQ ID NO: 135165 - RNA, 19 nt, Human
accccuuccccccuccccc

SEQ ID NO: 135166 - RNA, 23 nt, Human
agagcgugagggcaggccugggc

SEQ ID NO: 135167 - RNA, 18 nt, Human
agcaugugucugccuguc

SEQ ID NO: 135168 - RNA, 22 nt, Human
aggaacgccaagaaaagaccug

SEQ ID NO: 135169 - RNA, 18 nt, Human
aggaaggaacaaaaacug

SEQ ID NO: 135170 - RNA, 21 nt, Human
aggcugcucugagcuugggag

SEQ ID NO: 135171 - RNA, 21 nt, Human
aggugcuagaaugaggcccag

SEQ ID NO: 135172 - RNA, 21 nt, Human
agucagucuagaggagaccuc

SEQ ID NO: 135173 - RNA, 20 nt, Human
auccccuggccugugcuucc

SEQ ID NO: 135174 - RNA, 24 nt, Human
augacaacggagaaugaaggugcc

SEQ ID NO: 135175 - RNA, 21 nt, Human
auugaagaagcaaagcagcac

SEQ ID NO: 135176 - RNA, 27 nt, Human
caacuuaacugaaaagcucaaggcaau

SEQ ID NO: 135177 - RNA, 22 nt, Human
caacuuguaggguguguggguu

SEQ ID NO: 135178 - RNA, 20 nt, Human
caaugcaugaccucagggga

SEQ ID NO: 135179 - RNA, 21 nt, Human
cacacacccagauccccuggc

SEQ ID NO: 135180 - RNA, 21 nt, Human
cacacccagauccccuggccu

SEQ ID NO: 135181 - RNA, 24 nt, Human
cacagcauccuccuagaagucucu

SEQ ID NO: 135182 - RNA, 23 nt, Human
caccaggcuaacccgggacccau

SEQ ID NO: 135183 - RNA, 24 nt, Human
cacccagauccccuggccugugcu

SEQ ID NO: 135184 - RNA, 26 nt, Human
cacccccaggccucacuucuuggcuu

SEQ ID NO: 135185 - RNA, 20 nt, Human
caccccuuccccccuccccc

SEQ ID NO: 135186 - RNA, 18 nt, Human
cagauccccuggccugug

SEQ ID NO: 135187 - RNA, 21 nt, Human
cagcauccuccuagaagucuc

SEQ ID NO: 135188 - RNA, 21 nt, Human
cagcccaggugcuuacagcaa

SEQ ID NO: 135189 - RNA, 21 nt, Human
ccacacaaguggaaucaaggg

SEQ ID NO: 135190 - RNA, 18 nt, Human
ccagauccacgggcaaca

SEQ ID NO: 135191 - RNA, 18 nt, Human
ccagauccccuggccugu

SEQ ID NO: 135192 - RNA, 22 nt, Human
ccaguccacguccuccagaucu

SEQ ID NO: 135193 - RNA, 19 nt, Human
ccaugaaucccaguggcuc

SEQ ID NO: 135194 - RNA, 22 nt, Human
cccaccccuuccccccuccccc

SEQ ID NO: 135195 - RNA, 19 nt, Human
cccaugaggggacagggag

SEQ ID NO: 135196 - RNA, 18 nt, Human
cccccaggccucacuucu

SEQ ID NO: 135197 - RNA, 23 nt, Human
cccccaggccucacuucuuggcu

SEQ ID NO: 135198 - RNA, 22 nt, Human
ccccccucccccacccccaggc

SEQ ID NO: 135199 - RNA, 23 nt, Human
ccccccucccccacccccaggcc

SEQ ID NO: 135200 - RNA, 23 nt, Human
cccgggacccaugaggggacagg

SEQ ID NO: 135201 - RNA, 19 nt, Human
ccuaccccaguccacgucc

SEQ ID NO: 135202 - RNA, 23 nt, Human
ccuaugauggagagcgugagggc

SEQ ID NO: 135203 - RNA, 21 nt, Human
ccucccacucacacacccaga

SEQ ID NO: 135204 - RNA, 18 nt, Human
ccucugcccucuccuccc

SEQ ID NO: 135205 - RNA, 23 nt, Human
ccugucaccaggcuaacccggga

SEQ ID NO: 135206 - RNA, 24 nt, Human
ccugucaccaggcuaacccgggac

SEQ ID NO: 135207 - RNA, 21 nt, Human
cgccaagaaaagaccugugac

SEQ ID NO: 135208 - RNA, 19 nt, Human
cuagaagucucugcagaac

SEQ ID NO: 135209 - RNA, 21 nt, Human
cuagaaugaggcccagcaacc

SEQ ID NO: 135210 - RNA, 21 nt, Human
cucaggggaccucugcccucu

SEQ ID NO: 135211 - RNA, 19 nt, Human
cucccccacccccaggccu

SEQ ID NO: 135212 - RNA, 23 nt, Human
cucugcagaacaaacuuucaaaa

SEQ ID NO: 135213 - RNA, 18 nt, Human
cugcucugagcuugggag

SEQ ID NO: 135214 - RNA, 19 nt, Human
gacagaggcugcucugagc

SEQ ID NO: 135215 - RNA, 18 nt, Human
gacagggagaagacuggu

SEQ ID NO: 135216 - RNA, 19 nt, Human
gaccucccuucccuagucu

SEQ ID NO: 135217 - RNA, 25 nt, Human
gcagagagcugauggaagaaaggca

SEQ ID NO: 135218 - RNA, 20 nt, Human
gccaagaaaagaccugugac

SEQ ID NO: 135219 - RNA, 24 nt, Human
gcuaugagacaggugcagagaggg

SEQ ID NO: 135220 - RNA, 21 nt, Human
gcugcucugagcuugggaggc

SEQ ID NO: 135221 - RNA, 18 nt, Human
ggaaggaacaaaaacugc

SEQ ID NO: 135222 - RNA, 20 nt, Human
ggacccaugaggggacaggg

SEQ ID NO: 135223 - RNA, 24 nt, Human
ggcaacacaccuuagaaaugaccu

SEQ ID NO: 135224 - RNA, 28 nt, Human
ggcucccaccccuuccccccucccccac

SEQ ID NO: 135225 - RNA, 23 nt, Human
ggggacagggagaagacugguuu

SEQ ID NO: 135226 - RNA, 18 nt, Human
guggcuccaaggaauucc

SEQ ID NO: 135227 - RNA, 22 nt, Human
uaacgcaggaaggaacaaaaac

SEQ ID NO: 135228 - RNA, 23 nt, Human
uaagauacaaaagggcacucucu

SEQ ID NO: 135229 - RNA, 22 nt, Human
uaccagcacuagggagaagcaa

SEQ ID NO: 135230 - RNA, 24 nt, Human
uaccaggcucuggcccuuccucgg

SEQ ID NO: 135231 - RNA, 23 nt, Human
uagaaugaggcccagcaaccagc

SEQ ID NO: 135232 - RNA, 22 nt, Human
uagaggagaccucccuucccua

SEQ ID NO: 135233 - RNA, 19 nt, Human
uaguagaugcugcaggcac

SEQ ID NO: 135234 - RNA, 21 nt, Human
uauaacgcaggaaggaacaaa

SEQ ID NO: 135235 - RNA, 24 nt, Human
ucagcagccucaggccuggaugca

SEQ ID NO: 135236 - RNA, 20 nt, Human
ucccaccccuuccccccucc

SEQ ID NO: 135237 - RNA, 23 nt, Human
ucccaccccuuccccccuccccc

SEQ ID NO: 135238 - RNA, 24 nt, Human
ucccaccccuuccccccuccccca

SEQ ID NO: 135239 - RNA, 19 nt, Human
ucccacucacacacccaga

SEQ ID NO: 135240 - RNA, 18 nt, Human
uccccccucccccacccc

SEQ ID NO: 135241 - RNA, 20 nt, Human
uccccuggccugugcuuccu

SEQ ID NO: 135242 - RNA, 19 nt, Human
uccucccacucacacaccc

SEQ ID NO: 135243 - RNA, 19 nt, Human
uccucgggaccacgcuugg

SEQ ID NO: 135244 - RNA, 22 nt, Human
uccucgggaccacgcuuggucc

SEQ ID NO: 135245 - RNA, 20 nt, Human
ucgaggcuaugagacaggug

SEQ ID NO: 135246 - RNA, 20 nt, Human
ucugcccucuccucccacuc

SEQ ID NO: 135247 - RNA, 18 nt, Human
ugaagaagcaaagcagca

SEQ ID NO: 135248 - RNA, 23 nt, Human
ugaagacagaguaguagaugcug

SEQ ID NO: 135249 - RNA, 22 nt, Human
ugaaggugccauugaagaagca

SEQ ID NO: 135250 - RNA, 24 nt, Human
ugaggccaacagcaugugucugcc

SEQ ID NO: 135251 - RNA, 18 nt, Human
ugauggaagaaaggcagg

SEQ ID NO: 135252 - RNA, 21 nt, Human
ugcaugaccucaggggaccuc

SEQ ID NO: 135253 - RNA, 20 nt, Human
ugcccagauccacgggcaac

SEQ ID NO: 135254 - RNA, 21 nt, Human
ugccugucaccaggcuaaccc

SEQ ID NO: 135255 - RNA, 20 nt, Human
ugccuguguucaaucccucc

SEQ ID NO: 135256 - RNA, 22 nt, Human
uggaagaaaggcaggaauauga

SEQ ID NO: 135257 - RNA, 24 nt, Human
uggagagcgugagggcaggccugg

SEQ ID NO: 135258 - RNA, 21 nt, Human
uggcucccaccccuucccccc

SEQ ID NO: 135259 - RNA, 19 nt, Human
ugggaggcacagcauccuc

SEQ ID NO: 135260 - RNA, 20 nt, Human
uguccugcagaggaagagac

SEQ ID NO: 135261 - RNA, 18 nt, Human
uuccuggaagagguagaa

SEQ ID NO: 135262 - RNA, 19 nt, Human
uugaagaagcaaagcagca

SEQ ID NO: 135263 - RNA, 20 nt, Human
uuuuuuuuuuuuuuuuuugg

SEQ ID NO: 135264 - RNA, 27 nt, Human
aaacagccgagacccggggcucaggac

SEQ ID NO: 135265 - RNA, 23 nt, Human
aagauaauuuaaacacauuuuug

SEQ ID NO: 135266 - RNA, 20 nt, Human
aagcggcggggccgcccggg

SEQ ID NO: 135267 - RNA, 21 nt, Human
aagcggcggggccgcccgggu

SEQ ID NO: 135268 - RNA, 18 nt, Human
aaggaaaaaauaaaaagg

SEQ ID NO: 135269 - RNA, 22 nt, Human
acagacaccuuuauuuacaaac

SEQ ID NO: 135270 - RNA, 23 nt, Human
acucuguguccaaguccaggcua

SEQ ID NO: 135271 - RNA, 24 nt, Human
acugcaguuuucacaacugggggu

SEQ ID NO: 135272 - RNA, 22 nt, Human
agacccggggcucaggucagaa

SEQ ID NO: 135273 - RNA, 20 nt, Human
agagaggggcccguuuggug

SEQ ID NO: 135274 - RNA, 21 nt, Human
aggaaaaaauaaaaaggaggg

SEQ ID NO: 135275 - RNA, 20 nt, Human
aggaaggaaagaagcggcgg

SEQ ID NO: 135276 - RNA, 20 nt, Human
aggagggaaccccggcucgg

SEQ ID NO: 135277 - RNA, 23 nt, Human
aggcaccuaaacuuuuaaaaaaa

SEQ ID NO: 135278 - RNA, 18 nt, Human
agggaugggggcuccgag

SEQ ID NO: 135279 - RNA, 23 nt, Human
aggggcccguuugguggccccgg

SEQ ID NO: 135280 - RNA, 18 nt, Human
agguggguggcggcagcg

SEQ ID NO: 135281 - RNA, 20 nt, Human
caaguccaggcuaauaaucc

SEQ ID NO: 135282 - RNA, 23 nt, Human
caaguccgaggcggggcucgaaa

SEQ ID NO: 135283 - RNA, 25 nt, Human
cagcccggggcgaggaaggcgccag

SEQ ID NO: 135284 - RNA, 18 nt, Human
caggagagguggguggcg

SEQ ID NO: 135285 - RNA, 18 nt, Human
caggucagaaaugcggcc

SEQ ID NO: 135286 - RNA, 24 nt, Human
cccaaaauaccuuucauuucaaca

SEQ ID NO: 135287 - RNA, 19 nt, Human
cccccgagagaggggcccg

SEQ ID NO: 135288 - RNA, 18 nt, Human
ccccgagagaggggcccg

SEQ ID NO: 135289 - RNA, 21 nt, Human
cccgggacccagcucucagcc

SEQ ID NO: 135290 - RNA, 22 nt, Human
ccggggcgaggaaggcgccaga

SEQ ID NO: 135291 - RNA, 20 nt, Human
ccuuugccaagcugcugucc

SEQ ID NO: 135292 - RNA, 19 nt, Human
cgcgccugggaggcuucca

SEQ ID NO: 135293 - RNA, 23 nt, Human
cucccgggacccagcucucagcc

SEQ ID NO: 135294 - RNA, 25 nt, Human
cucccgggacccagcucucagccuu

SEQ ID NO: 135295 - RNA, 23 nt, Human
cugggaggcuuccaucucccggg

SEQ ID NO: 135296 - RNA, 18 nt, Human
gaaacagccgagacccgg

SEQ ID NO: 135297 - RNA, 26 nt, Human
gaaacagccgagacccggggcucagg

SEQ ID NO: 135298 - RNA, 21 nt, Human
gaaggaaagaagcggcggggc

SEQ ID NO: 135299 - RNA, 18 nt, Human
gagcgggcgaggagaaag

SEQ ID NO: 135300 - RNA, 21 nt, Human
gagcugagggagcgcuccugg

SEQ ID NO: 135301 - RNA, 19 nt, Human
gaggauaaguggucucugc

SEQ ID NO: 135302 - RNA, 28 nt, Human
gagguggguggcggcagcgacgacggcg

SEQ ID NO: 135303 - RNA, 18 nt, Human
gcagcgggccgggaggag

SEQ ID NO: 135304 - RNA, 19 nt, Human
gccccgggagugagcaggg

SEQ ID NO: 135305 - RNA, 23 nt, Human
gcggcagcgggccgggaggaggg

SEQ ID NO: 135306 - RNA, 21 nt, Human
ggaagccucgcgcgccuggga

SEQ ID NO: 135307 - RNA, 21 nt, Human
ggagggcgggcaggcgggacc

SEQ ID NO: 135308 - RNA, 21 nt, Human
ggaugaggagagagcugaggg

SEQ ID NO: 135309 - RNA, 23 nt, Human
ggccgggaggagggaaccccggc

SEQ ID NO: 135310 - RNA, 20 nt, Human
ggccugagacgggccacugc

SEQ ID NO: 135311 - RNA, 24 nt, Human
gggaacugcaggaaggaaagaagc

SEQ ID NO: 135312 - RNA, 25 nt, Human
gggggcuccgagggcugggaacugc

SEQ ID NO: 135313 - RNA, 20 nt, Human
ggguaagauaagggaugggg

SEQ ID NO: 135314 - RNA, 18 nt, Human
ggugauggaugaggagag

SEQ ID NO: 135315 - RNA, 21 nt, Human
guccgagcugagcccagggga

SEQ ID NO: 135316 - RNA, 18 nt, Human
ucacccggaggggaggga

SEQ ID NO: 135317 - RNA, 20 nt, Human
ucauccgcaaaggcaccuaa

SEQ ID NO: 135318 - RNA, 23 nt, Human
ucccgggacccagcucucagccc

SEQ ID NO: 135319 - RNA, 18 nt, Human
uccgagcugagcccaggg

SEQ ID NO: 135320 - RNA, 21 nt, Human
uccgaggcggggcucgaaaca

SEQ ID NO: 135321 - RNA, 18 nt, Human
ugaaauguuuuuaaagga

SEQ ID NO: 135322 - RNA, 18 nt, Human
ugaggauaaguggucucu

SEQ ID NO: 135323 - RNA, 19 nt, Human
ugauggaugaggagagagc

SEQ ID NO: 135324 - RNA, 20 nt, Human
ugcaggagagguggguggcg

SEQ ID NO: 135325 - RNA, 20 nt, Human
ugcaggucgcagccugcagg

SEQ ID NO: 135326 - RNA, 20 nt, Human
ugcggccuuuuagggaggcc

SEQ ID NO: 135327 - RNA, 19 nt, Human
uggcggcagcgggccggga

SEQ ID NO: 135328 - RNA, 19 nt, Human
ugggaacugcaggaaggaa

SEQ ID NO: 135329 - RNA, 20 nt, Human
aaagaaaaaaaaauacucaa

SEQ ID NO: 135330 - RNA, 19 nt, Human
aaagugucucucugagccu

SEQ ID NO: 135331 - RNA, 20 nt, Human
aaauggguugugcaaggcca

SEQ ID NO: 135332 - RNA, 22 nt, Human
aagaaaaaaaaauacucaaugu

SEQ ID NO: 135333 - RNA, 19 nt, Human
aagcgccgagggccacagc

SEQ ID NO: 135334 - RNA, 22 nt, Human
aagcgccgagggccacagccag

SEQ ID NO: 135335 - RNA, 19 nt, Human
aagugucucucugagccuc

SEQ ID NO: 135336 - RNA, 22 nt, Human
aauccaugggggcccccuccuc

SEQ ID NO: 135337 - RNA, 24 nt, Human
aauuccacauuucucugcaucucu

SEQ ID NO: 135338 - RNA, 22 nt, Human
acagccaggguaccgcggcgcc

SEQ ID NO: 135339 - RNA, 20 nt, Human
agaaggagugggggaguggc

SEQ ID NO: 135340 - RNA, 20 nt, Human
agcaaauagcaaaaagcgca

SEQ ID NO: 135341 - RNA, 22 nt, Human
agcgcagccaccaggaucgccc

SEQ ID NO: 135342 - RNA, 21 nt, Human
aggccaaaggcauacaaagaa

SEQ ID NO: 135343 - RNA, 21 nt, Human
agggaagaaggagugggggag

SEQ ID NO: 135344 - RNA, 22 nt, Human
agggagagagggaagaaggagu

SEQ ID NO: 135345 - RNA, 22 nt, Human
caaaggcauacaaagaaaaaaa

SEQ ID NO: 135346 - RNA, 22 nt, Human
caagaccaaggguucuggggac

SEQ ID NO: 135347 - RNA, 23 nt, Human
caauggcucucucuccagagucu

SEQ ID NO: 135348 - RNA, 23 nt, Human
cacaaauggguugugcaaggcca

SEQ ID NO: 135349 - RNA, 23 nt, Human
cacagccaggguaccgcggcgcc

SEQ ID NO: 135350 - RNA, 23 nt, Human
caccgcgccaggugauacaagac

SEQ ID NO: 135351 - RNA, 23 nt, Human
cagagaaaacccaucuggagcug

SEQ ID NO: 135352 - RNA, 23 nt, Human
cagccagcagcccccacacuuaa

SEQ ID NO: 135353 - RNA, 19 nt, Human
cagcggagaacgcgcgccu

SEQ ID NO: 135354 - RNA, 22 nt, Human
caggguaccgcggcgccugcgg

SEQ ID NO: 135355 - RNA, 18 nt, Human
ccccagccagcagccccc

SEQ ID NO: 135356 - RNA, 19 nt, Human
ccccaugacuuuccccucc

SEQ ID NO: 135357 - RNA, 25 nt, Human
ccccaugacuuuccccucccccccu

SEQ ID NO: 135358 - RNA, 23 nt, Human
cccccaugacuuuccccuccccc

SEQ ID NO: 135359 - RNA, 24 nt, Human
ccccuaaauccaugggggcccccu

SEQ ID NO: 135360 - RNA, 20 nt, Human
ccccucccccccuaaaucca

SEQ ID NO: 135361 - RNA, 20 nt, Human
ccccuuggccccugcccucu

SEQ ID NO: 135362 - RNA, 20 nt, Human
cccuaaauccaugggggccc

SEQ ID NO: 135363 - RNA, 18 nt, Human
ccuccagagaaaacccau

SEQ ID NO: 135364 - RNA, 18 nt, Human
ccucccagcccagaaggg

SEQ ID NO: 135365 - RNA, 20 nt, Human
ccuggguccugggcuuugca

SEQ ID NO: 135366 - RNA, 23 nt, Human
ccuggguccugggcuuugcagga

SEQ ID NO: 135367 - RNA, 20 nt, Human
cggcagcaaauagcaaaaag

SEQ ID NO: 135368 - RNA, 24 nt, Human
cgucggcagcaaauagcaaaagag

SEQ ID NO: 135369 - RNA, 21 nt, Human
cguggagcguuucaaccccca

SEQ ID NO: 135370 - RNA, 21 nt, Human
cguuucaacccccacguucac

SEQ ID NO: 135371 - RNA, 24 nt, Human
cucacaaauggguugugcaaggcc

SEQ ID NO: 135372 - RNA, 24 nt, Human
cugccuggguccugggcuuugcag

SEQ ID NO: 135373 - RNA, 25 nt, Human
cugcuccauuccuuuuucuccucua

SEQ ID NO: 135374 - RNA, 19 nt, Human
cugggugggugggagcuga

SEQ ID NO: 135375 - RNA, 25 nt, Human
cuguaguggcgauucaguccuuuuc

SEQ ID NO: 135376 - RNA, 19 nt, Human
gacccgcccuuccccagau

SEQ ID NO: 135377 - RNA, 19 nt, Human
gagagagggaagaaggagu

SEQ ID NO: 135378 - RNA, 21 nt, Human
gagagagggaagaaggagugg

SEQ ID NO: 135379 - RNA, 18 nt, Human
gaggagaaagggagagag

SEQ ID NO: 135380 - RNA, 22 nt, Human
gagggaagaaggagugggggag

SEQ ID NO: 135381 - RNA, 21 nt, Human
gcaaauagcaaaaagcgcagc

SEQ ID NO: 135382 - RNA, 19 nt, Human
gcuggagugaaggugucca

SEQ ID NO: 135383 - RNA, 19 nt, Human
ggagagagggaagaaggag

SEQ ID NO: 135384 - RNA, 24 nt, Human
ggcaagaccaaggguucuggggac

SEQ ID NO: 135385 - RNA, 18 nt, Human
ggcauacaaagaaaaaaa

SEQ ID NO: 135386 - RNA, 22 nt, Human
gggaaagggguuccgggggggu

SEQ ID NO: 135387 - RNA, 18 nt, Human
gggccccccagccagcag

SEQ ID NO: 135388 - RNA, 21 nt, Human
gggccccccagccagcagccc

SEQ ID NO: 135389 - RNA, 21 nt, Human
gggccggacgggccccccagc

SEQ ID NO: 135390 - RNA, 22 nt, Human
gggggaguggcaagaccaaggg

SEQ ID NO: 135391 - RNA, 20 nt, Human
gggggcccccuccucuccau

SEQ ID NO: 135392 - RNA, 23 nt, Human
guggcaagaccaaggguucuggg

SEQ ID NO: 135393 - RNA, 22 nt, Human
uacaaagaaaaaaaaauacuca

SEQ ID NO: 135394 - RNA, 23 nt, Human
uagcaaaaagcgcagccaccagg

SEQ ID NO: 135395 - RNA, 18 nt, Human
uaguccgcucccgcugcc

SEQ ID NO: 135396 - RNA, 21 nt, Human
uccaugggggcccccuccucu

SEQ ID NO: 135397 - RNA, 24 nt, Human
uccaugggggcccccuccucucca

SEQ ID NO: 135398 - RNA, 18 nt, Human
ucgcugggugggugggag

SEQ ID NO: 135399 - RNA, 18 nt, Human
ucucugagccucuuucag

SEQ ID NO: 135400 - RNA, 25 nt, Human
ugauggugguccacuucugcuuuug

SEQ ID NO: 135401 - RNA, 21 nt, Human
ugcaaggccaaaggcauacaa

SEQ ID NO: 135402 - RNA, 21 nt, Human
ugccuggguccugggcuuugc

SEQ ID NO: 135403 - RNA, 23 nt, Human
ugccuggguccugggcuuugcag

SEQ ID NO: 135404 - RNA, 24 nt, Human
ugcucccagggagcucccacucgu

SEQ ID NO: 135405 - RNA, 18 nt, Human
uggagugaagguguccag

SEQ ID NO: 135406 - RNA, 23 nt, Human
ugggaaagggguuccgggggggu

SEQ ID NO: 135407 - RNA, 23 nt, Human
ugggaaagggguuccgggggggu

SEQ ID NO: 135408 - RNA, 24 nt, Human
ugggggaguggcaagaccaagggu

SEQ ID NO: 135409 - RNA, 21 nt, Human
ugggugggagcugaugguggu

SEQ ID NO: 135410 - RNA, 21 nt, Human
uguccagcuggagugaaggug

SEQ ID NO: 135411 - RNA, 21 nt, Human
ugucucucugagccucuuuca

SEQ ID NO: 135412 - RNA, 18 nt, Human
ugugcaaggccaaaggca

SEQ ID NO: 135413 - RNA, 21 nt, Human
ugugcaaggccaaaggcauac

SEQ ID NO: 135414 - RNA, 19 nt, Human
uucaacccccacguucacc

SEQ ID NO: 135415 - RNA, 20 nt, Human
uuccgggggggugccccccc

SEQ ID NO: 135416 - RNA, 25 nt, Human
uucugcuuuugcucacaaauggguu

SEQ ID NO: 135417 - RNA, 24 nt, Human
uuguccagcuggagugaagguguc

SEQ ID NO: 135418 - RNA, 20 nt, Human
uuuugcucacaaauggguug

SEQ ID NO: 135419 - RNA, 22 nt, Human
aacccucucaacagugcuaaga

SEQ ID NO: 135420 - RNA, 21 nt, Human
caagaggaacaucccaagucc

SEQ ID NO: 135421 - RNA, 19 nt, Human
caccaagaggaacauccca

SEQ ID NO: 135422 - RNA, 25 nt, Human
caccaagaggaacaucccaaguccc

SEQ ID NO: 135423 - RNA, 23 nt, Human
cagugcuaagaaguaaguauuga

SEQ ID NO: 135424 - RNA, 19 nt, Human
caucccaaguccccgaguc

SEQ ID NO: 135425 - RNA, 19 nt, Human
ccaaguccccgagucaggg

SEQ ID NO: 135426 - RNA, 23 nt, Human
ccauccaggucagaacucucuug

SEQ ID NO: 135427 - RNA, 19 nt, Human
ccguaugaccaggugcagc

SEQ ID NO: 135428 - RNA, 19 nt, Human
cuccaaggaccaugagccu

SEQ ID NO: 135429 - RNA, 26 nt, Human
cuugaccucgcccugcaaccgguucc

SEQ ID NO: 135430 - RNA, 22 nt, Human
gcacaauguagggcucaaucug

SEQ ID NO: 135431 - RNA, 18 nt, Human
ggaacaucccaagucccc

SEQ ID NO: 135432 - RNA, 23 nt, Human
uaaaaggagguguguccucuagg

SEQ ID NO: 135433 - RNA, 19 nt, Human
uaacccucucaacagugcu

SEQ ID NO: 135434 - RNA, 18 nt, Human
uaaguaacccucucaaca

SEQ ID NO: 135435 - RNA, 21 nt, Human
uaaguaacccucucaacagug

SEQ ID NO: 135436 - RNA, 19 nt, Human
uccccgagucaggggucug

SEQ ID NO: 135437 - RNA, 20 nt, Human
ugacaccaagaggaacaucc

SEQ ID NO: 135438 - RNA, 19 nt, Human
ugagaagcauggauucugg

SEQ ID NO: 135439 - RNA, 22 nt, Human
ugcaacggguccuccaaggacc

SEQ ID NO: 135440 - RNA, 20 nt, Human
uggacauuuauagguaccua

SEQ ID NO: 135441 - RNA, 18 nt, Human
uuugcuggguucuucuca

SEQ ID NO: 135442 - RNA, 24 nt, Human
aaagugcugggauuacagguguga

SEQ ID NO: 135443 - RNA, 28 nt, Human
aacacacacacacacaaacauacauaua

SEQ ID NO: 135444 - RNA, 24 nt, Human
aagugauccaccugccucggccuc

SEQ ID NO: 135445 - RNA, 18 nt, Human
aagugcugggauuacagg

SEQ ID NO: 135446 - RNA, 19 nt, Human
aagugcugggauuacaggu

SEQ ID NO: 135447 - RNA, 26 nt, Human
aagugcugggauuacaggugugagcc

SEQ ID NO: 135448 - RNA, 23 nt, Human
acaaacacacacacacacaaaca

SEQ ID NO: 135449 - RNA, 24 nt, Human
acaaacauacauauacauaucccu

SEQ ID NO: 135450 - RNA, 25 nt, Human
acacaaacauacauauacauauccc

SEQ ID NO: 135451 - RNA, 26 nt, Human
acacaaacauacauauacauaucccu

SEQ ID NO: 135452 - RNA, 26 nt, Human
acacacacaaacacacacacacacaa

SEQ ID NO: 135453 - RNA, 25 nt, Human
acacacacacacaaacauacauaua

SEQ ID NO: 135454 - RNA, 23 nt, Human
acacacacacacacaaacauaca

SEQ ID NO: 135455 - RNA, 33 nt, Human
acacacacacacacaaacauacauauacauagu

SEQ ID NO: 135456 - RNA, 27 nt, Human
acauauacauaucccugaauuuacaua

SEQ ID NO: 135457 - RNA, 23 nt, Human
accuaggcuggagugcaguggug

SEQ ID NO: 135458 - RNA, 30 nt, Human
accucuauuucaagaugugaaauuggagag

SEQ ID NO: 135459 - RNA, 25 nt, Human
acucugucaccuaggcuggagugca

SEQ ID NO: 135460 - RNA, 18 nt, Human
agccuccaggguagcugg

SEQ ID NO: 135461 - RNA, 24 nt, Human
agcugggauuacaagcacaugcca

SEQ ID NO: 135462 - RNA, 25 nt, Human
aggcuggagugcaguggugccaucu

SEQ ID NO: 135463 - RNA, 22 nt, Human
aguagagaugggguuucuccau

SEQ ID NO: 135464 - RNA, 20 nt, Human
agugcaguggugccaucuug

SEQ ID NO: 135465 - RNA, 24 nt, Human
agugcaguggugccaucuuggcuc

SEQ ID NO: 135466 - RNA, 24 nt, Human
augggguuucuccauguuggccag

SEQ ID NO: 135467 - RNA, 24 nt, Human
auuuuuuuuuuuuuaguagagaug

SEQ ID NO: 135468 - RNA, 29 nt, Human
caaacacacacacacacaaacauacauag

SEQ ID NO: 135469 - RNA, 24 nt, Human
caaagugcugggauuacaggugug

SEQ ID NO: 135470 - RNA, 22 nt, Human
caagcaauucuccugccucagc

SEQ ID NO: 135471 - RNA, 27 nt, Human
caagcaauucuccugccucagccucca

SEQ ID NO: 135472 - RNA, 22 nt, Human
caagugauccaccugccucggc

SEQ ID NO: 135473 - RNA, 19 nt, Human
cacacaaacacacacacac

SEQ ID NO: 135474 - RNA, 24 nt, Human
cacacacaaacacacacacacaca

SEQ ID NO: 135475 - RNA, 19 nt, Human
cacacacaaacauacauau

SEQ ID NO: 135476 - RNA, 21 nt, Human
cacacacaaacauacauauac

SEQ ID NO: 135477 - RNA, 18 nt, Human
caccgcaaucucugccuc

SEQ ID NO: 135478 - RNA, 23 nt, Human
caccgcaaucucugccuccuggg

SEQ ID NO: 135479 - RNA, 24 nt, Human
caccuaggcuggagugcaguggug

SEQ ID NO: 135480 - RNA, 23 nt, Human
caccugccucggccucccaaagu

SEQ ID NO: 135481 - RNA, 19 nt, Human
cacuaagaagcaauuugca

SEQ ID NO: 135482 - RNA, 22 nt, Human
cacucugucaccuaggcuggag

SEQ ID NO: 135483 - RNA, 23 nt, Human
cacucugucaccuaggcuggagu

SEQ ID NO: 135484 - RNA, 23 nt, Human
cauguuggccaggcuggucuuga

SEQ ID NO: 135485 - RNA, 21 nt, Human
ccaaagugcugggauuacagg

SEQ ID NO: 135486 - RNA, 21 nt, Human
ccaaagugcugggauuacagg

SEQ ID NO: 135487 - RNA, 24 nt, Human
ccaaagugcugggauuacaggugu

SEQ ID NO: 135488 - RNA, 21 nt, Human
ccacgcccagccauaaauaca

SEQ ID NO: 135489 - RNA, 19 nt, Human
ccaggguagcugggauuac

SEQ ID NO: 135490 - RNA, 19 nt, Human
ccauguuggccaggcuggu

SEQ ID NO: 135491 - RNA, 21 nt, Human
ccauguuggccaggcuggucu

SEQ ID NO: 135492 - RNA, 21 nt, Human
ccauguuggccaggcuggucu

SEQ ID NO: 135493 - RNA, 26 nt, Human
ccucccuuaaauccucuuguggaaaa

SEQ ID NO: 135494 - RNA, 24 nt, Human
ccuccuggguucaagcaauucucc

SEQ ID NO: 135495 - RNA, 23 nt, Human
ccucuuguggaaaaacaucuagc

SEQ ID NO: 135496 - RNA, 21 nt, Human
ccugaccucaagugauccacc

SEQ ID NO: 135497 - RNA, 23 nt, Human
ccugaccucaagugauccaccug

SEQ ID NO: 135498 - RNA, 23 nt, Human
ccugaccucaagugauccaccug

SEQ ID NO: 135499 - RNA, 23 nt, Human
ccugccucagccuccaggguagc

SEQ ID NO: 135500 - RNA, 24 nt, Human
ccugccucggccucccaaagugcu

SEQ ID NO: 135501 - RNA, 23 nt, Human
ccuggguucaagcaauucuccug

SEQ ID NO: 135502 - RNA, 23 nt, Human
cucaagugauccaccugccucgg

SEQ ID NO: 135503 - RNA, 24 nt, Human
cucaccgcaaucucugccuccugg

SEQ ID NO: 135504 - RNA, 24 nt, Human
cucacucugucaccuaggcuggag

SEQ ID NO: 135505 - RNA, 22 nt, Human
cucacuuugaaaagugaaaggg

SEQ ID NO: 135506 - RNA, 24 nt, Human
cucagccuccaggguagcugggau

SEQ ID NO: 135507 - RNA, 21 nt, Human
cuccuggguucaagcaauucu

SEQ ID NO: 135508 - RNA, 23 nt, Human
cugccucagccuccaggguagcu

SEQ ID NO: 135509 - RNA, 22 nt, Human
gaaucacguacuccuuucccaa

SEQ ID NO: 135510 - RNA, 24 nt, Human
gaccucaagugauccaccugccuc

SEQ ID NO: 135511 - RNA, 18 nt, Human
gagaugggguuucuccau

SEQ ID NO: 135512 - RNA, 24 nt, Human
gagaugggguuucuccauguuggc

SEQ ID NO: 135513 - RNA, 23 nt, Human
gauuacaagcacaugccacugca

SEQ ID NO: 135514 - RNA, 18 nt, Human
gauuacaggugugagcca

SEQ ID NO: 135515 - RNA, 21 nt, Human
gauuacaggugugagccacca

SEQ ID NO: 135516 - RNA, 22 nt, Human
gauuacaggugugagccaccac

SEQ ID NO: 135517 - RNA, 21 nt, Human
gcucaccgcaaucucugccuc

SEQ ID NO: 135518 - RNA, 21 nt, Human
gcuggagugcaguggugccag

SEQ ID NO: 135519 - RNA, 23 nt, Human
gcuggucuugaccuccugaccuc

SEQ ID NO: 135520 - RNA, 20 nt, Human
ggaaaguccuuaggagaaug

SEQ ID NO: 135521 - RNA, 20 nt, Human
ggaaucacguacuccuuucc

SEQ ID NO: 135522 - RNA, 19 nt, Human
ggccaggcuggucuugacc

SEQ ID NO: 135523 - RNA, 24 nt, Human
ggcuggucuugaccuccugaccuc

SEQ ID NO: 135524 - RNA, 18 nt, Human
gggguuucuccauguugg

SEQ ID NO: 135525 - RNA, 22 nt, Human
gggguuucuccauguuggccag

SEQ ID NO: 135526 - RNA, 28 nt, Human
gguauacacacacaaacacacacacaca

SEQ ID NO: 135527 - RNA, 18 nt, Human
guagcugggauuacaagc

SEQ ID NO: 135528 - RNA, 22 nt, Human
guagcugggauuacaagcacau

SEQ ID NO: 135529 - RNA, 27 nt, Human
guauacacacacaaacacacacacaca

SEQ ID NO: 135530 - RNA, 24 nt, Human
gugauccaccugccucggccuccc

SEQ ID NO: 135531 - RNA, 25 nt, Human
guguguguguccuauaaacauuccu

SEQ ID NO: 135532 - RNA, 23 nt, Human
uaauuuuuuuuuuuuuaguagag

SEQ ID NO: 135533 - RNA, 24 nt, Human
uaauuuuuuuuuuuuuaguagaga

SEQ ID NO: 135534 - RNA, 21 nt, Human
uacaagcacaugccacugcac

SEQ ID NO: 135535 - RNA, 22 nt, Human
uacacacacaaacacacacaca

SEQ ID NO: 135536 - RNA, 24 nt, Human
uacaggugugagccaccacgccca

SEQ ID NO: 135537 - RNA, 24 nt, Human
uaguagagaugggguuucuccaug

SEQ ID NO: 135538 - RNA, 19 nt, Human
uauauacauacacagagug

SEQ ID NO: 135539 - RNA, 20 nt, Human
uauauacauacacagagugg

SEQ ID NO: 135540 - RNA, 23 nt, Human
uauauauacauacacagagugag

SEQ ID NO: 135541 - RNA, 25 nt, Human
uaugucagguauacacacacaaaca

SEQ ID NO: 135542 - RNA, 19 nt, Human
ucaagcaauucuccugccu

SEQ ID NO: 135543 - RNA, 21 nt, Human
ucaagugauccaccugccucg

SEQ ID NO: 135544 - RNA, 24 nt, Human
ucaccgcaaucucugccuccuggg

SEQ ID NO: 135545 - RNA, 25 nt, Human
ucaccgcaaucucugccuccugggu

SEQ ID NO: 135546 - RNA, 24 nt, Human
ucaccuaggcuggagugcaguggu

SEQ ID NO: 135547 - RNA, 24 nt, Human
ucacucugucaccuaggcuggagu

SEQ ID NO: 135548 - RNA, 23 nt, Human
ucccaaagugcugggauuacagg

SEQ ID NO: 135549 - RNA, 23 nt, Human
ucccaacaacuaguuuuccauag

SEQ ID NO: 135550 - RNA, 21 nt, Human
uccuggguucaagcaauucuc

SEQ ID NO: 135551 - RNA, 24 nt, Human
uccuggguucaagcaauucuccug

SEQ ID NO: 135552 - RNA, 18 nt, Human
ucggccucccaaagugcu

SEQ ID NO: 135553 - RNA, 23 nt, Human
ucucacucugucaccuaggcugg

SEQ ID NO: 135554 - RNA, 24 nt, Human
ucucacucugucaccuaggcugga

SEQ ID NO: 135555 - RNA, 24 nt, Human
ucuccugccucagccuccagggua

SEQ ID NO: 135556 - RNA, 24 nt, Human
ucugccuccuggguucaagcaauu

SEQ ID NO: 135557 - RNA, 24 nt, Human
ucugucaccuaggcuggagugcag

SEQ ID NO: 135558 - RNA, 21 nt, Human
ugaaaagugggcaacagaaaa

SEQ ID NO: 135559 - RNA, 21 nt, Human
ugaaagggagggaaucacgua

SEQ ID NO: 135560 - RNA, 24 nt, Human
ugaccucaagugauccaccugccu

SEQ ID NO: 135561 - RNA, 22 nt, Human
ugagacggagucucacucuguc

SEQ ID NO: 135562 - RNA, 24 nt, Human
ugccucagccuccaggguagcugg

SEQ ID NO: 135563 - RNA, 21 nt, Human
ugccucggccucccaaagugc

SEQ ID NO: 135564 - RNA, 24 nt, Human
ugccucggccucccaaagugcugg

SEQ ID NO: 135565 - RNA, 24 nt, Human
ugcugggauuacaggugugagcca

SEQ ID NO: 135566 - RNA, 28 nt, Human
uggagugcaguggugccauccuagcacg

SEQ ID NO: 135567 - RNA, 23 nt, Human
uggagugcaguggugccaucuug

SEQ ID NO: 135568 - RNA, 24 nt, Human
uggagugcaguggugccaucuugg

SEQ ID NO: 135569 - RNA, 24 nt, Human
uggccaggcuggucuugaccuccu

SEQ ID NO: 135570 - RNA, 21 nt, Human
ugggauuacaagcacaugcca

SEQ ID NO: 135571 - RNA, 22 nt, Human
ugggauuacaagcacaugccac

SEQ ID NO: 135572 - RNA, 22 nt, Human
ugggauuacaagcacaugccac

SEQ ID NO: 135573 - RNA, 24 nt, Human
ugggauuacaagcacaugccacug

SEQ ID NO: 135574 - RNA, 24 nt, Human
ugggauuacaagcacaugccacug

SEQ ID NO: 135575 - RNA, 18 nt, Human
ugggauuacaggugugag

SEQ ID NO: 135576 - RNA, 19 nt, Human
ugggauuacaggugugagc

SEQ ID NO: 135577 - RNA, 22 nt, Human
ugggauuacaggugugagccac

SEQ ID NO: 135578 - RNA, 23 nt, Human
ugggauuacaggugugagccacc

SEQ ID NO: 135579 - RNA, 24 nt, Human
ugggauuacaggugugagccacca

SEQ ID NO: 135580 - RNA, 24 nt, Human
ugggguuucuccauguuggccagg

SEQ ID NO: 135581 - RNA, 21 nt, Human
uggguucaagcaauucuccug

SEQ ID NO: 135582 - RNA, 23 nt, Human
uggguucaagcaauucuccugcc

SEQ ID NO: 135583 - RNA, 20 nt, Human
ugucaccuaggcuggagugc

SEQ ID NO: 135584 - RNA, 22 nt, Human
uguccuauaaacauuccucccu

SEQ ID NO: 135585 - RNA, 18 nt, Human
uguggaaaaacaucuagc

SEQ ID NO: 135586 - RNA, 25 nt, Human
uguguguguguccuauaaacauucc

SEQ ID NO: 135587 - RNA, 23 nt, Human
uuacaagcacaugccacugcacu

SEQ ID NO: 135588 - RNA, 18 nt, Human
uuaguagagaugggguuu

SEQ ID NO: 135589 - RNA, 24 nt, Human
uuaguagagaugggguuucuccau

SEQ ID NO: 135590 - RNA, 21 nt, Human
uucaagcaauucuccugccuc

SEQ ID NO: 135591 - RNA, 24 nt, Human
uucaagcaauucuccugccucagc

SEQ ID NO: 135592 - RNA, 22 nt, Human
uuccauagguauauauacauac

SEQ ID NO: 135593 - RNA, 22 nt, Human
uucuccugccucagccuccagg

SEQ ID NO: 135594 - RNA, 24 nt, Human
uuggccaggcuggucuugaccucc

SEQ ID NO: 135595 - RNA, 28 nt, Human
uuuccauagguauauauacauacacaga

SEQ ID NO: 135596 - RNA, 21 nt, Human
uuucuccauguuggccaggcu

SEQ ID NO: 135597 - RNA, 19 nt, Human
uuugaaaagugaaagggag

SEQ ID NO: 135598 - RNA, 23 nt, Human
uuuucuguugcuauaaaggugaa

SEQ ID NO: 135599 - RNA, 22 nt, Human
uuuuuaguagagaugggguuuc

SEQ ID NO: 135600 - RNA, 23 nt, Human
uuuuuuaguagagaugggguuuc

SEQ ID NO: 135601 - RNA, 26 nt, Human
uuuuuuuuuuuugagacggagucuca

SEQ ID NO: 135602 - RNA, 22 nt, Human
uuuuuuuuuuuuuugagacgga

SEQ ID NO: 135603 - RNA, 18 nt, Human
uuuuuuuuuuuuuuuuug

SEQ ID NO: 135604 - RNA, 23 nt, Human
aaaaaaagaaaaagccaugaaga

SEQ ID NO: 135605 - RNA, 24 nt, Human
aaaaaagcaacaaaaaccaaacca

SEQ ID NO: 135606 - RNA, 24 nt, Human
aaaaaagcaacaaaaaccaaacca

SEQ ID NO: 135607 - RNA, 18 nt, Human
aaaaacaaugagaaacca

SEQ ID NO: 135608 - RNA, 23 nt, Human
aaaaaccaaaccacccaguuccu

SEQ ID NO: 135609 - RNA, 23 nt, Human
aaaaaccaaaccacccaguuccu

SEQ ID NO: 135610 - RNA, 24 nt, Human
aaaaaccucuuucgguccccacgg

SEQ ID NO: 135611 - RNA, 20 nt, Human
aaaaagaaagaaauagaaga

SEQ ID NO: 135612 - RNA, 20 nt, Human
aaaaagaaagaaauagaaga

SEQ ID NO: 135613 - RNA, 18 nt, Human
aaaaagaaauaaaauggc

SEQ ID NO: 135614 - RNA, 18 nt, Human
aaaaagaaauaaaauggc

SEQ ID NO: 135615 - RNA, 19 nt, Human
aaaaagaaauaaaauggca

SEQ ID NO: 135616 - RNA, 21 nt, Human
aaaaagaaauaaaauggcaug

SEQ ID NO: 135617 - RNA, 21 nt, Human
aaaaagaaauaaaauggcaug

SEQ ID NO: 135618 - RNA, 20 nt, Human
aaaaagcaacaaaaaccaaa

SEQ ID NO: 135619 - RNA, 20 nt, Human
aaaaagcaacaaaaaccaaa

SEQ ID NO: 135620 - RNA, 24 nt, Human
aaaaagcaacaaaaaccaaaccac

SEQ ID NO: 135621 - RNA, 24 nt, Human
aaaaagcaacaaaaaccaaaccac

SEQ ID NO: 135622 - RNA, 21 nt, Human
aaacacacaaucuuuuugcac

SEQ ID NO: 135623 - RNA, 21 nt, Human
aaacagcaucuuucuccugau

SEQ ID NO: 135624 - RNA, 22 nt, Human
aaacccacucuccaaaagcuaa

SEQ ID NO: 135625 - RNA, 21 nt, Human
aaacgguuuaccgccuuccac

SEQ ID NO: 135626 - RNA, 26 nt, Human
aaagaaaaacaaaaagauuaaaacaa

SEQ ID NO: 135627 - RNA, 26 nt, Human
aaagaaaaacaaaaagauuaaaacaa

SEQ ID NO: 135628 - RNA, 20 nt, Human
aaagaacacaacacgaaaua

SEQ ID NO: 135629 - RNA, 20 nt, Human
aaagaacacaacacgaaaua

SEQ ID NO: 135630 - RNA, 18 nt, Human
aaaugcaguaaaacugaa

SEQ ID NO: 135631 - RNA, 18 nt, Human
aaaugcaguaaaacugaa

SEQ ID NO: 135632 - RNA, 20 nt, Human
aaaugcugcccuuuagacaa

SEQ ID NO: 135633 - RNA, 20 nt, Human
aaccaugcgggaaucaggag

SEQ ID NO: 135634 - RNA, 20 nt, Human
aaccaugcgggaaucaggag

SEQ ID NO: 135635 - RNA, 18 nt, Human
aacccacucuccaaaagc

SEQ ID NO: 135636 - RNA, 18 nt, Human
aacccacucuccaaaagc

SEQ ID NO: 135637 - RNA, 20 nt, Human
aacccacucuccaaaagcua

SEQ ID NO: 135638 - RNA, 20 nt, Human
aacccacucuccaaaagcua

SEQ ID NO: 135639 - RNA, 25 nt, Human
aagaaagaauuauaaaggaaaaaga

SEQ ID NO: 135640 - RNA, 25 nt, Human
aagaaagaauuauaaaggaaaaaga

SEQ ID NO: 135641 - RNA, 18 nt, Human
aagcaacaaaaaccaaac

SEQ ID NO: 135642 - RNA, 18 nt, Human
aagcaacaaaaaccaaac

SEQ ID NO: 135643 - RNA, 20 nt, Human
aagcaacaaaaaccaaacca

SEQ ID NO: 135644 - RNA, 20 nt, Human
aagcaacaaaaaccaaacca

SEQ ID NO: 135645 - RNA, 25 nt, Human
aagcaacaaaaaccaaaccacccag

SEQ ID NO: 135646 - RNA, 25 nt, Human
aagcaacaaaaaccaaaccacccag

SEQ ID NO: 135647 - RNA, 19 nt, Human
aagcagacaaacacacaag

SEQ ID NO: 135648 - RNA, 21 nt, Human
aaggucuucaagcuuuuuuuc

SEQ ID NO: 135649 - RNA, 23 nt, Human
aaguaaacgguuuaccgccuucc

SEQ ID NO: 135650 - RNA, 25 nt, Human
aaucaaccaaccaaccgauuacuca

SEQ ID NO: 135651 - RNA, 25 nt, Human
aaucaaccaaccaaccgauuacuca

SEQ ID NO: 135652 - RNA, 21 nt, Human
aauggacaaaacccacucucc

SEQ ID NO: 135653 - RNA, 21 nt, Human
aauggacaaaacccacucucc

SEQ ID NO: 135654 - RNA, 20 nt, Human
acaaaaaccaaaucuucaug

SEQ ID NO: 135655 - RNA, 20 nt, Human
acaaaaaccaaaucuucaug

SEQ ID NO: 135656 - RNA, 23 nt, Human
acacaacacgaaauaauguccaa

SEQ ID NO: 135657 - RNA, 23 nt, Human
acacaacacgaaauaauguccaa

SEQ ID NO: 135658 - RNA, 19 nt, Human
acacaagcauuuacugauu

SEQ ID NO: 135659 - RNA, 24 nt, Human
acacaaugagauacaaaaagacac

SEQ ID NO: 135660 - RNA, 21 nt, Human
acagguugugucaccagagua

SEQ ID NO: 135661 - RNA, 27 nt, Human
acauuaaggaaauaggcuggaaaaaaa

SEQ ID NO: 135662 - RNA, 20 nt, Human
accacacacaaugagauaca

SEQ ID NO: 135663 - RNA, 21 nt, Human
accacacaugagauacaaaga

SEQ ID NO: 135664 - RNA, 18 nt, Human
accacuacccuucacaaa

SEQ ID NO: 135665 - RNA, 19 nt, Human
accacuacccuucacaaaa

SEQ ID NO: 135666 - RNA, 19 nt, Human
accacuacccuucacaaaa

SEQ ID NO: 135667 - RNA, 24 nt, Human
accacuacccuucacaaaaauaua

SEQ ID NO: 135668 - RNA, 24 nt, Human
accacuacccuucacaaaaauaua

SEQ ID NO: 135669 - RNA, 18 nt, Human
accuguuucuuccacucc

SEQ ID NO: 135670 - RNA, 19 nt, Human
accuucauaggaaagcuuu

SEQ ID NO: 135671 - RNA, 21 nt, Human
acgccaaaaggaugcaaaaca

SEQ ID NO: 135672 - RNA, 21 nt, Human
acgccaaaaggaugcaaaaca

SEQ ID NO: 135673 - RNA, 20 nt, Human
acucuuguggauccuuuuuc

SEQ ID NO: 135674 - RNA, 24 nt, Human
acucuuguggauccuuuuucuuuu

SEQ ID NO: 135675 - RNA, 20 nt, Human
acuggcugaguggcugguuu

SEQ ID NO: 135676 - RNA, 20 nt, Human
acuuagaaaauugugcauuu

SEQ ID NO: 135677 - RNA, 20 nt, Human
acuuagaaaauugugcauuu

SEQ ID NO: 135678 - RNA, 22 nt, Human
acuugaugucagcccacucucc

SEQ ID NO: 135679 - RNA, 22 nt, Human
acuugaugucagcccacucucc

SEQ ID NO: 135680 - RNA, 19 nt, Human
agaaaaaaaaugugaagga

SEQ ID NO: 135681 - RNA, 18 nt, Human
agaacuagaaguuacucu

SEQ ID NO: 135682 - RNA, 18 nt, Human
agaaucucugaccagccu

SEQ ID NO: 135683 - RNA, 19 nt, Human
agcaacaaaaaccaaacca

SEQ ID NO: 135684 - RNA, 19 nt, Human
agcaacaaaaaccaaacca

SEQ ID NO: 135685 - RNA, 21 nt, Human
agcaacaaaaaccaaaccacc

SEQ ID NO: 135686 - RNA, 21 nt, Human
agcaacaaaaaccaaaccacc

SEQ ID NO: 135687 - RNA, 24 nt, Human
agcaacaaaaaccaaaccacccag

SEQ ID NO: 135688 - RNA, 24 nt, Human
agcaacaaaaaccaaaccacccag

SEQ ID NO: 135689 - RNA, 19 nt, Human
agcaauccugagaaaaccc

SEQ ID NO: 135690 - RNA, 18 nt, Human
agcagaugauuuaacugc

SEQ ID NO: 135691 - RNA, 22 nt, Human
agccagcaaugccuccgcacaa

SEQ ID NO: 135692 - RNA, 21 nt, Human
agcccacucuccaaaagcuaa

SEQ ID NO: 135693 - RNA, 18 nt, Human
agccugccccacucagcu

SEQ ID NO: 135694 - RNA, 18 nt, Human
agccugccccacucagcu

SEQ ID NO: 135695 - RNA, 24 nt, Human
agcgauaaaaaaaaccugguaaaa

SEQ ID NO: 135696 - RNA, 22 nt, Human
aggaaaaaaaugcaagacaaaa

SEQ ID NO: 135697 - RNA, 22 nt, Human
aggaaaaaaaugcaagacaaaa

SEQ ID NO: 135698 - RNA, 21 nt, Human
aggaacaccccaaaaccaaag

SEQ ID NO: 135699 - RNA, 21 nt, Human
aggaacaccccaaaaccaaag

SEQ ID NO: 135700 - RNA, 22 nt, Human
aggaagcugaauguaucaauca

SEQ ID NO: 135701 - RNA, 22 nt, Human
aggaagcugaauguaucaauca

SEQ ID NO: 135702 - RNA, 19 nt, Human
aggaggucuaggaggcgcc

SEQ ID NO: 135703 - RNA, 19 nt, Human
aggaggucuaggaggcgcc

SEQ ID NO: 135704 - RNA, 19 nt, Human
aggcacagaaucucugacc

SEQ ID NO: 135705 - RNA, 22 nt, Human
aguaaacgguuuaccgccuucc

SEQ ID NO: 135706 - RNA, 18 nt, Human
aguaaccccuuguuuuaa

SEQ ID NO: 135707 - RNA, 24 nt, Human
aguagacagugacuagauaugacc

SEQ ID NO: 135708 - RNA, 24 nt, Human
auaugcaaaaaaagaaaaagccuu

SEQ ID NO: 135709 - RNA, 24 nt, Human
auaugcaaaaaaagaaaaagccuu

SEQ ID NO: 135710 - RNA, 22 nt, Human
aucagcuuauuuuucucuuuuc

SEQ ID NO: 135711 - RNA, 22 nt, Human
auccuggaguuccuuaauaagg

SEQ ID NO: 135712 - RNA, 20 nt, Human
auccuguaggucacugaaga

SEQ ID NO: 135713 - RNA, 20 nt, Human
auccuguaggucacugaaga

SEQ ID NO: 135714 - RNA, 23 nt, Human
aucucugaccagccucacaaaag

SEQ ID NO: 135715 - RNA, 23 nt, Human
aucuuccugaaagcauucuauua

SEQ ID NO: 135716 - RNA, 23 nt, Human
aucuucuaacuuccucuucacug

SEQ ID NO: 135717 - RNA, 18 nt, Human
augagauacaaagacaca

SEQ ID NO: 135718 - RNA, 20 nt, Human
auguaaauaaaaagaaagaa

SEQ ID NO: 135719 - RNA, 18 nt, Human
augugugugugugugugu

SEQ ID NO: 135720 - RNA, 18 nt, Human
augugugugugugugugu

SEQ ID NO: 135721 - RNA, 22 nt, Human
auuaugaaggaaaaagaaagaa

SEQ ID NO: 135722 - RNA, 22 nt, Human
auuaugaaggaaaaagaaagaa

SEQ ID NO: 135723 - RNA, 22 nt, Human
auucguaucucuuuaucuauau

SEQ ID NO: 135724 - RNA, 22 nt, Human
auucguaucucuuuaucuauau

SEQ ID NO: 135725 - RNA, 22 nt, Human
auucugcuccuucuucaucugu

SEQ ID NO: 135726 - RNA, 18 nt, Human
auuguucugcaaaacccg

SEQ ID NO: 135727 - RNA, 20 nt, Human
caaaaagacacaagcauuua

SEQ ID NO: 135728 - RNA, 24 nt, Human
caaaacccacucuccaaaagcuaa

SEQ ID NO: 135729 - RNA, 24 nt, Human
caaaacccacucuccaaaagcuaa

SEQ ID NO: 135730 - RNA, 24 nt, Human
caaaacccgcagugccuuguugac

SEQ ID NO: 135731 - RNA, 24 nt, Human
caaaacccgcagugccuuguugac

SEQ ID NO: 135732 - RNA, 22 nt, Human
caacaaacuucagcagcuuuaa

SEQ ID NO: 135733 - RNA, 25 nt, Human
caacacugagugagucaacacagua

SEQ ID NO: 135734 - RNA, 25 nt, Human
caacucuuccaccaguaacuugacu

SEQ ID NO: 135735 - RNA, 20 nt, Human
caagacaaaaaccaaaucuu

SEQ ID NO: 135736 - RNA, 20 nt, Human
caagacaaaaaccaaaucuu

SEQ ID NO: 135737 - RNA, 21 nt, Human
caagacaaaaaccaaaucuuc

SEQ ID NO: 135738 - RNA, 21 nt, Human
caagacaaaaaccaaaucuuc

SEQ ID NO: 135739 - RNA, 21 nt, Human
caagugacuagauaugaccac

SEQ ID NO: 135740 - RNA, 22 nt, Human
caaugccuccgcacaaagcuuu

SEQ ID NO: 135741 - RNA, 26 nt, Human
caauuuuuguuuguuuguuuauauau

SEQ ID NO: 135742 - RNA, 26 nt, Human
caauuuuuguuuguuuguuuauauau

SEQ ID NO: 135743 - RNA, 18 nt, Human
cacaaaagcagacaaaca

SEQ ID NO: 135744 - RNA, 23 nt, Human
cacaaaagcagacaaacacacaa

SEQ ID NO: 135745 - RNA, 30 nt, Human
cacaauaucacguacauuaaggaaauaggg

SEQ ID NO: 135746 - RNA, 21 nt, Human
cacaguucaugggcuucuggg

SEQ ID NO: 135747 - RNA, 21 nt, Human
cacaguucaugggcuucuggg

SEQ ID NO: 135748 - RNA, 20 nt, Human
caccuguuucuuccacuccg

SEQ ID NO: 135749 - RNA, 18 nt, Human
cagaauaccuucugauug

SEQ ID NO: 135750 - RNA, 18 nt, Human
cagaauaccuucugauug

SEQ ID NO: 135751 - RNA, 21 nt, Human
cagagcucagaucuucuaacu

SEQ ID NO: 135752 - RNA, 25 nt, Human
cagcaaugccuccgcacaaagcuuu

SEQ ID NO: 135753 - RNA, 18 nt, Human
cagcagcuuuaaaaaaag

SEQ ID NO: 135754 - RNA, 19 nt, Human
cagcccacucuccaaaagc

SEQ ID NO: 135755 - RNA, 19 nt, Human
cagcccacucuccaaaagc

SEQ ID NO: 135756 - RNA, 19 nt, Human
cagcgauaaaaaaaaccug

SEQ ID NO: 135757 - RNA, 22 nt, Human
cagcugagaggaguucaaauau

SEQ ID NO: 135758 - RNA, 22 nt, Human
cagcuguuugcagaccuccugc

SEQ ID NO: 135759 - RNA, 18 nt, Human
caggaacaccccaaaacc

SEQ ID NO: 135760 - RNA, 18 nt, Human
caggaacaccccaaaacc

SEQ ID NO: 135761 - RNA, 23 nt, Human
caggaagcugaauguaucaauca

SEQ ID NO: 135762 - RNA, 23 nt, Human
caggaagcugaauguaucaauca

SEQ ID NO: 135763 - RNA, 18 nt, Human
caguaaaacugaaguuua

SEQ ID NO: 135764 - RNA, 18 nt, Human
caguaaaacugaaguuua

SEQ ID NO: 135765 - RNA, 21 nt, Human
caguaucacaaaugugauggg

SEQ ID NO: 135766 - RNA, 23 nt, Human
cauccuggaguuccuuaauaagg

SEQ ID NO: 135767 - RNA, 23 nt, Human
cauucuucugaauggcuguugau

SEQ ID NO: 135768 - RNA, 21 nt, Human
ccauagcccuccagcccuauc

SEQ ID NO: 135769 - RNA, 21 nt, Human
ccauagcccuccagcccuauc

SEQ ID NO: 135770 - RNA, 21 nt, Human
cccacaugggacaauaaaucu

SEQ ID NO: 135771 - RNA, 21 nt, Human
cccacaugggacaauaaaucu

SEQ ID NO: 135772 - RNA, 19 nt, Human
cccagagccgccgggcucc

SEQ ID NO: 135773 - RNA, 20 nt, Human
ccccaaaaccaaagugaggu

SEQ ID NO: 135774 - RNA, 20 nt, Human
ccccaaaaccaaagugaggu

SEQ ID NO: 135775 - RNA, 18 nt, Human
cccccugugagauaaagu

SEQ ID NO: 135776 - RNA, 22 nt, Human
ccuuggguaaagaaaaggucca

SEQ ID NO: 135777 - RNA, 22 nt, Human
ccuuggguaaagaaaaggucca

SEQ ID NO: 135778 - RNA, 20 nt, Human
cgcugccucaaaguuuugug

SEQ ID NO: 135779 - RNA, 23 nt, Human
cuagaaguuacucuaugugucag

SEQ ID NO: 135780 - RNA, 23 nt, Human
cucaucccacaugggacaauaaa

SEQ ID NO: 135781 - RNA, 23 nt, Human
cucaucccacaugggacaauaaa

SEQ ID NO: 135782 - RNA, 22 nt, Human
cuccccuuugaucuugagaauc

SEQ ID NO: 135783 - RNA, 19 nt, Human
cuccugauucugucaucuu

SEQ ID NO: 135784 - RNA, 18 nt, Human
cucuuucgguccccacgg

SEQ ID NO: 135785 - RNA, 20 nt, Human
cugaaagcauucuauuacug

SEQ ID NO: 135786 - RNA, 20 nt, Human
cugacaguucucaaaugagc

SEQ ID NO: 135787 - RNA, 20 nt, Human
cugacaguucucaaaugagc

SEQ ID NO: 135788 - RNA, 20 nt, Human
cuggagauuugucugcuuga

SEQ ID NO: 135789 - RNA, 18 nt, Human
cugucaucuuccugaaag

SEQ ID NO: 135790 - RNA, 22 nt, Human
cugucuuacaccuuuucccaaa

SEQ ID NO: 135791 - RNA, 22 nt, Human
cugucuuacaccuuuucccaaa

SEQ ID NO: 135792 - RNA, 22 nt, Human
cuguuugcagaccuccugccac

SEQ ID NO: 135793 - RNA, 20 nt, Human
cuuagaaacuacugaaaucu

SEQ ID NO: 135794 - RNA, 20 nt, Human
cuuagaaacuacugaaaucu

SEQ ID NO: 135795 - RNA, 18 nt, Human
cuucaagcuuuuuuucaa

SEQ ID NO: 135796 - RNA, 22 nt, Human
cuucccagagccgccgggcucc

SEQ ID NO: 135797 - RNA, 21 nt, Human
cuugaugucagcccacucucc

SEQ ID NO: 135798 - RNA, 21 nt, Human
cuugaugucagcccacucucc

SEQ ID NO: 135799 - RNA, 20 nt, Human
cuuugaucuugagaaucauu

SEQ ID NO: 135800 - RNA, 22 nt, Human
cuuuuguucuucuagccucuuu

SEQ ID NO: 135801 - RNA, 21 nt, Human
cuuuuucuuuuggcaguuuuu

SEQ ID NO: 135802 - RNA, 20 nt, Human
gaaaaauccauucuagacca

SEQ ID NO: 135803 - RNA, 20 nt, Human
gaaaaauccauucuagacca

SEQ ID NO: 135804 - RNA, 24 nt, Human
gaaagcaagugacuagauaugacc

SEQ ID NO: 135805 - RNA, 24 nt, Human
gaauaccuucugauugauuuccac

SEQ ID NO: 135806 - RNA, 24 nt, Human
gaauaccuucugauugauuuccac

SEQ ID NO: 135807 - RNA, 18 nt, Human
gacaaaacaugccaugug

SEQ ID NO: 135808 - RNA, 18 nt, Human
gacaaaacaugccaugug

SEQ ID NO: 135809 - RNA, 19 nt, Human
gagaauucccuggcgcagg

SEQ ID NO: 135810 - RNA, 21 nt, Human
gauccuguugcauagcaaucc

SEQ ID NO: 135811 - RNA, 20 nt, Human
gauugauuuccacugaagca

SEQ ID NO: 135812 - RNA, 20 nt, Human
gauugauuuccacugaagca

SEQ ID NO: 135813 - RNA, 22 nt, Human
gcaagacaaaaaccaaaucuuc

SEQ ID NO: 135814 - RNA, 22 nt, Human
gcaagacaaaaaccaaaucuuc

SEQ ID NO: 135815 - RNA, 23 nt, Human
gcauuugggagugaaaggagggu

SEQ ID NO: 135816 - RNA, 19 nt, Human
gccaaaaggaugcaaaaca

SEQ ID NO: 135817 - RNA, 19 nt, Human
gccaaaaggaugcaaaaca

SEQ ID NO: 135818 - RNA, 20 nt, Human
gccucccagaucugaguccu

SEQ ID NO: 135819 - RNA, 22 nt, Human
gcgcaggggcaacucuuccacc

SEQ ID NO: 135820 - RNA, 21 nt, Human
gcugacaguucucaaaugagc

SEQ ID NO: 135821 - RNA, 21 nt, Human
gcugacaguucucaaaugagc

SEQ ID NO: 135822 - RNA, 21 nt, Human
ggaaaaauccauucuagacca

SEQ ID NO: 135823 - RNA, 21 nt, Human
ggaaaaauccauucuagacca

SEQ ID NO: 135824 - RNA, 19 nt, Human
ggacaaaacccacucucca

SEQ ID NO: 135825 - RNA, 19 nt, Human
ggacaaaacccacucucca

SEQ ID NO: 135826 - RNA, 24 nt, Human
ggacaaaacccacucuccaaaagc

SEQ ID NO: 135827 - RNA, 24 nt, Human
ggacaaaacccacucuccaaaagc

SEQ ID NO: 135828 - RNA, 21 nt, Human
ggagauggcaguuuccuuagu

SEQ ID NO: 135829 - RNA, 21 nt, Human
ggaggcgccucccauccugua

SEQ ID NO: 135830 - RNA, 21 nt, Human
ggaggcgccucccauccugua

SEQ ID NO: 135831 - RNA, 23 nt, Human
ggcgcaggggcaacucuuccacc

SEQ ID NO: 135832 - RNA, 19 nt, Human
ggcuucuggguugauaccu

SEQ ID NO: 135833 - RNA, 19 nt, Human
ggcuucuggguugauaccu

SEQ ID NO: 135834 - RNA, 21 nt, Human
gggaaucaggaguuguaaaac

SEQ ID NO: 135835 - RNA, 18 nt, Human
gggcugggaauccauagc

SEQ ID NO: 135836 - RNA, 18 nt, Human
gggcugggaauccauagc

SEQ ID NO: 135837 - RNA, 20 nt, Human
gggcuucuggguugauaccu

SEQ ID NO: 135838 - RNA, 20 nt, Human
gggcuucuggguugauaccu

SEQ ID NO: 135839 - RNA, 19 nt, Human
ggugaagcugugaacucag

SEQ ID NO: 135840 - RNA, 19 nt, Human
ggugaagcugugaacucag

SEQ ID NO: 135841 - RNA, 24 nt, Human
gguuauaaagaacacaacacgaaa

SEQ ID NO: 135842 - RNA, 24 nt, Human
gguuauaaagaacacaacacgaaa

SEQ ID NO: 135843 - RNA, 20 nt, Human
guaaagcaguacuauaauac

SEQ ID NO: 135844 - RNA, 20 nt, Human
guaaagcaguacuauaauac

SEQ ID NO: 135845 - RNA, 24 nt, Human
guggauccuuuuucuuuuggcagu

SEQ ID NO: 135846 - RNA, 21 nt, Human
gugucuaaaagaaaaacaaaa

SEQ ID NO: 135847 - RNA, 21 nt, Human
gugucuaaaagaaaaacaaaa

SEQ ID NO: 135848 - RNA, 24 nt, Human
guguguguguguguguuuguuuug

SEQ ID NO: 135849 - RNA, 20 nt, Human
guguguguguguuuguuuug

SEQ ID NO: 135850 - RNA, 20 nt, Human
guguguguguguuuguuuug

SEQ ID NO: 135851 - RNA, 26 nt, Human
guguugugguuuuuuuuuuuuuuucc

SEQ ID NO: 135852 - RNA, 23 nt, Human
guuauaaagaacacaacacgaaa

SEQ ID NO: 135853 - RNA, 23 nt, Human
guuauaaagaacacaacacgaaa

SEQ ID NO: 135854 - RNA, 23 nt, Human
guuguuuaaaaugagaaacaucu

SEQ ID NO: 135855 - RNA, 23 nt, Human
guuguuuaaaaugagaaacaucu

SEQ ID NO: 135856 - RNA, 20 nt, Human
guuuugugugugugugugua

SEQ ID NO: 135857 - RNA, 20 nt, Human
guuuugugugugugugugua

SEQ ID NO: 135858 - RNA, 23 nt, Human
guuuuuuuuuuuuuuucccccug

SEQ ID NO: 135859 - RNA, 28 nt, Human
uaaaaacaaugagaaaccaacaaacuuc

SEQ ID NO: 135860 - RNA, 22 nt, Human
uaaaagaaaaacaaaaagauua

SEQ ID NO: 135861 - RNA, 23 nt, Human
uaaaagaaaaacaaaaagauuaa

SEQ ID NO: 135862 - RNA, 23 nt, Human
uaaaagaaaaacaaaaagauuaa

SEQ ID NO: 135863 - RNA, 21 nt, Human
uaaaaugagaaacaucuggag

SEQ ID NO: 135864 - RNA, 21 nt, Human
uaaaaugagaaacaucuggag

SEQ ID NO: 135865 - RNA, 26 nt, Human
uaaagaaauggcaaguuaaccgaacg

SEQ ID NO: 135866 - RNA, 26 nt, Human
uaaagaaauggcaaguuaaccgaacg

SEQ ID NO: 135867 - RNA, 25 nt, Human
uaaagaaauggcaaguuaaccgaag

SEQ ID NO: 135868 - RNA, 25 nt, Human
uaaagaaauggcaaguuaaccgaag

SEQ ID NO: 135869 - RNA, 21 nt, Human
uaaaguaaccccuuguuuuaa

SEQ ID NO: 135870 - RNA, 21 nt, Human
uaaaguaaccccuuguuuuaa

SEQ ID NO: 135871 - RNA, 22 nt, Human
uaaauuuccaacugauuccuaa

SEQ ID NO: 135872 - RNA, 23 nt, Human
uaaauuuccaacugauuccuaau

SEQ ID NO: 135873 - RNA, 23 nt, Human
uaacaaaacaauaacagacuuag

SEQ ID NO: 135874 - RNA, 23 nt, Human
uaacaaaacaauaacagacuuag

SEQ ID NO: 135875 - RNA, 18 nt, Human
uaacaugauucuuucagu

SEQ ID NO: 135876 - RNA, 22 nt, Human
uaagaacucaguaccugaaaac

SEQ ID NO: 135877 - RNA, 22 nt, Human
uaagaacucaguaccugaaaac

SEQ ID NO: 135878 - RNA, 21 nt, Human
uaagccuggaugacugacuag

SEQ ID NO: 135879 - RNA, 21 nt, Human
uaagccuggaugacugacuag

SEQ ID NO: 135880 - RNA, 22 nt, Human
uaauaccacuacccuucacaaa

SEQ ID NO: 135881 - RNA, 22 nt, Human
uaauaccacuacccuucacaaa

SEQ ID NO: 135882 - RNA, 24 nt, Human
uaauaccacuacccuucacaaaaa

SEQ ID NO: 135883 - RNA, 24 nt, Human
uaauaccacuacccuucacaaaaa

SEQ ID NO: 135884 - RNA, 25 nt, Human
uaauaccacuacccuucacaaaaau

SEQ ID NO: 135885 - RNA, 25 nt, Human
uaauaccacuacccuucacaaaaau

SEQ ID NO: 135886 - RNA, 18 nt, Human
uaauaggagauaaccaca

SEQ ID NO: 135887 - RNA, 22 nt, Human
uaauggacaaaacccacucucc

SEQ ID NO: 135888 - RNA, 22 nt, Human
uaauggacaaaacccacucucc

SEQ ID NO: 135889 - RNA, 18 nt, Human
uacauuaaggaaauaggc

SEQ ID NO: 135890 - RNA, 19 nt, Human
uacccuucacaaaaauaua

SEQ ID NO: 135891 - RNA, 19 nt, Human
uacccuucacaaaaauaua

SEQ ID NO: 135892 - RNA, 19 nt, Human
uaccgccuuccacucagag

SEQ ID NO: 135893 - RNA, 19 nt, Human
uaccugucaguaucacaaa

SEQ ID NO: 135894 - RNA, 19 nt, Human
uaccugucaguaucacaaa

SEQ ID NO: 135895 - RNA, 18 nt, Human
uacuuacaaaccugugug

SEQ ID NO: 135896 - RNA, 18 nt, Human
uacuuacaaaccugugug

SEQ ID NO: 135897 - RNA, 22 nt, Human
uacuuacuuacaaaccugugug

SEQ ID NO: 135898 - RNA, 22 nt, Human
uacuuacuuacaaaccugugug

SEQ ID NO: 135899 - RNA, 18 nt, Human
uagaagagacuguuugca

SEQ ID NO: 135900 - RNA, 21 nt, Human
uagaaugaaacuuacuuacuu

SEQ ID NO: 135901 - RNA, 21 nt, Human
uagaaugaaacuuacuuacuu

SEQ ID NO: 135902 - RNA, 19 nt, Human
uagacaaaaucucuuccac

SEQ ID NO: 135903 - RNA, 18 nt, Human
uagcuuuuccucuugagc

SEQ ID NO: 135904 - RNA, 18 nt, Human
uagcuuuuccucuugagc

SEQ ID NO: 135905 - RNA, 20 nt, Human
uaggagaggcuccaauagug

SEQ ID NO: 135906 - RNA, 24 nt, Human
uaggagauaaccacagcagcagau

SEQ ID NO: 135907 - RNA, 27 nt, Human
uaggcuuaaaaacaaugagaaaccaac

SEQ ID NO: 135908 - RNA, 20 nt, Human
uaguucagagcagccagcaa

SEQ ID NO: 135909 - RNA, 23 nt, Human
uauaaagaacacaacacgaaaua

SEQ ID NO: 135910 - RNA, 23 nt, Human
uauaaagaacacaacacgaaaua

SEQ ID NO: 135911 - RNA, 28 nt, Human
uauaaaggaaaaagaaaauaacgcaaug

SEQ ID NO: 135912 - RNA, 28 nt, Human
uauaaaggaaaaagaaaauaacgcaaug

SEQ ID NO: 135913 - RNA, 24 nt, Human
uauaucaaggcagcgauaaaaaaa

SEQ ID NO: 135914 - RNA, 23 nt, Human
uaucaaggcagcgauaaaaaaaa

SEQ ID NO: 135915 - RNA, 21 nt, Human
uaucuugcucuucugggcuua

SEQ ID NO: 135916 - RNA, 22 nt, Human
uaugaaggaaaaagaaagaauu

SEQ ID NO: 135917 - RNA, 22 nt, Human
uaugaaggaaaaagaaagaauu

SEQ ID NO: 135918 - RNA, 21 nt, Human
uaugcaaaaaaagaaaaagcc

SEQ ID NO: 135919 - RNA, 31 nt, Human
uaugcaaaaaaagaaaaagccaugaauuucc

SEQ ID NO: 135920 - RNA, 31 nt, Human; identical to SEQ ID NO: 135919

SEQ ID NO: 135921 - RNA, 18 nt, Human
uaugugugugugugugug

SEQ ID NO: 135922 - RNA, 18 nt, Human
uaugugugugugugugug

SEQ ID NO: 135923 - RNA, 22 nt, Human
uauucugcuccuucuucaucug

SEQ ID NO: 135924 - RNA, 23 nt, Human
uauucugcuccuucuucaucugu

SEQ ID NO: 135925 - RNA, 23 nt, Human
uauuguguugugguuuuuuuuuu

SEQ ID NO: 135926 - RNA, 25 nt, Human
uauuuagcuaucaagauuuuacaug

SEQ ID NO: 135927 - RNA, 25 nt, Human
uauuuagcuaucaagauuuuacaug

SEQ ID NO: 135928 - RNA, 20 nt, Human
uauuucuuccccaguugcau

SEQ ID NO: 135929 - RNA, 21 nt, Human
ucaaaaagaaauaaaauggca

SEQ ID NO: 135930 - RNA, 21 nt, Human
ucaaaaagaaauaaaauggca

SEQ ID NO: 135931 - RNA, 21 nt, Human
ucacagggaugggcugggaau

SEQ ID NO: 135932 - RNA, 21 nt, Human
ucacagggaugggcugggaau

SEQ ID NO: 135933 - RNA, 22 nt, Human
ucacgccaaaaggaugcaaaac

SEQ ID NO: 135934 - RNA, 22 nt, Human
ucacgccaaaaggaugcaaaac

SEQ ID NO: 135935 - RNA, 23 nt, Human
ucagagcucagaucuucuaacuu

SEQ ID NO: 135936 - RNA, 20 nt, Human
ucagcccacucuccaaaagc

SEQ ID NO: 135937 - RNA, 20 nt, Human
ucagcccacucuccaaaagc

SEQ ID NO: 135938 - RNA, 21 nt, Human
ucagcccacucuccaaaagcu

SEQ ID NO: 135939 - RNA, 21 nt, Human
ucagcccacucuccaaaagcu

SEQ ID NO: 135940 - RNA, 23 nt, Human
ucagcccacucuccaaaagcuaa

SEQ ID NO: 135941 - RNA, 23 nt, Human
ucagcccacucuccaaaagcuaa

SEQ ID NO: 135942 - RNA, 23 nt, Human
ucaggcuucccaauuuuuccugg

SEQ ID NO: 135943 - RNA, 22 nt, Human
ucaguaucacaaaugugauggg

SEQ ID NO: 135944 - RNA, 22 nt, Human
ucaguaucacaaaugugauggg

SEQ ID NO: 135945 - RNA, 24 nt, Human
ucauaggaaagcuuuuugcugauu

SEQ ID NO: 135946 - RNA, 19 nt, Human
uccccaguugcauucaaug

SEQ ID NO: 135947 - RNA, 23 nt, Human
ucccuguugguacuuuucucuua

SEQ ID NO: 135948 - RNA, 19 nt, Human
uccuggaguuccuuaauaa

SEQ ID NO: 135949 - RNA, 19 nt, Human
ucggugugguaaccacucu

SEQ ID NO: 135950 - RNA, 20 nt, Human
ucuaaaaaagcaacaaaaac

SEQ ID NO: 135951 - RNA, 20 nt, Human
ucuaaaaaagcaacaaaaac

SEQ ID NO: 135952 - RNA, 19 nt, Human
ucuaacuuccucuucacug

SEQ ID NO: 135953 - RNA, 21 nt, Human
ucuucacuggcugaguggcug

SEQ ID NO: 135954 - RNA, 18 nt, Human
ucuugcucuucugggcuu

SEQ ID NO: 135955 - RNA, 18 nt, Human
ucuuuguuguaugaauau

SEQ ID NO: 135956 - RNA, 18 nt, Human
ucuuuguuguaugaauau

SEQ ID NO: 135957 - RNA, 24 nt, Human
ucuuuuuugagcaauuuuuguuug

SEQ ID NO: 135958 - RNA, 24 nt, Human
ucuuuuuugagcaauuuuuguuug

SEQ ID NO: 135959 - RNA, 19 nt, Human
ugaaaaugcaguaaaacug

SEQ ID NO: 135960 - RNA, 19 nt, Human
ugaaaaugcaguaaaacug

SEQ ID NO: 135961 - RNA, 24 nt, Human
ugaaaugaaaacucaagccugccc

SEQ ID NO: 135962 - RNA, 24 nt, Human
ugaaaugaaaacucaagccugccc

SEQ ID NO: 135963 - RNA, 25 nt, Human
ugaaugaaugauuuaaaaaucaaaa

SEQ ID NO: 135964 - RNA, 25 nt, Human
ugaaugaaugauuuaaaaaucaaaa

SEQ ID NO: 135965 - RNA, 19 nt, Human
ugacaaaacaugccaugug

SEQ ID NO: 135966 - RNA, 19 nt, Human
ugacaaaacaugccaugug

SEQ ID NO: 135967 - RNA, 20 nt, Human
ugagaaaccaacaaacuuca

SEQ ID NO: 135968 - RNA, 20 nt, Human
ugagccagagcagcguuugc

SEQ ID NO: 135969 - RNA, 25 nt, Human
ugagccagagcagcguuugcauuua

SEQ ID NO: 135970 - RNA, 19 nt, Human
ugagcuuuucuccucuuuu

SEQ ID NO: 135971 - RNA, 19 nt, Human
ugagcuuuucuccucuuuu

SEQ ID NO: 135972 - RNA, 29 nt, Human
ugcaaaaaaagaaaaagccaugaauuucc

SEQ ID NO: 135973 - RNA, 29 nt, Human
ugcaaaaaaagaaaaagccaugaauuucc

SEQ ID NO: 135974 - RNA, 21 nt, Human
ugcaaaaaccucuuucggucc

SEQ ID NO: 135975 - RNA, 20 nt, Human
ugcaccuguuucuuccacuc

SEQ ID NO: 135976 - RNA, 23 nt, Human
ugcagaccuccugccaccgcaga

SEQ ID NO: 135977 - RNA, 28 nt, Human
ugcccucagcucuugaaguaaacgguuu

SEQ ID NO: 135978 - RNA, 22 nt, Human
ugcgcugccucaaaguuuugug

SEQ ID NO: 135979 - RNA, 22 nt, Human
ugcgcugccucaaaguuuugug

SEQ ID NO: 135980 - RNA, 23 nt, Human
ugcuccaguaggcuuaaaaacaa

SEQ ID NO: 135981 - RNA, 21 nt, Human
ugcuccuucuucaucugucau

SEQ ID NO: 135982 - RNA, 20 nt, Human
uggaaaaagaaauugucaag

SEQ ID NO: 135983 - RNA, 25 nt, Human
uggacaaaacccacucuccaaaagc

SEQ ID NO: 135984 - RNA, 25 nt, Human
uggacaaaacccacucuccaaaagc

SEQ ID NO: 135985 - RNA, 20 nt, Human
uggagauggcaguuuccuua

SEQ ID NO: 135986 - RNA, 19 nt, Human
uggcaugaaagaguaaagc

SEQ ID NO: 135987 - RNA, 19 nt, Human
uggcaugaaagaguaaagc

SEQ ID NO: 135988 - RNA, 18 nt, Human
uggcauuuaaaaacucau

SEQ ID NO: 135989 - RNA, 18 nt, Human
uggcauuuaaaaacucau

SEQ ID NO: 135990 - RNA, 23 nt, Human
uggcugaguggcugguuuuuccu

SEQ ID NO: 135991 - RNA, 24 nt, Human
uguaguuuccuccuggcuuccggc

SEQ ID NO: 135992 - RNA, 24 nt, Human
uguaguuuccuccuggcuuccggc

SEQ ID NO: 135993 - RNA, 21 nt, Human
ugucaagugacgugggaaagu

SEQ ID NO: 135994 - RNA, 18 nt, Human
ugucaguaucacaaaugu

SEQ ID NO: 135995 - RNA, 18 nt, Human
ugucaguaucacaaaugu

SEQ ID NO: 135996 - RNA, 20 nt, Human
ugucuaaaagaaaaacaaaa

SEQ ID NO: 135997 - RNA, 21 nt, Human
ugucuuacaccuuuucccaaa

SEQ ID NO: 135998 - RNA, 21 nt, Human
ugucuuacaccuuuucccaaa

SEQ ID NO: 135999 - RNA, 18 nt, Human
ugugauguuuaugcuuca

SEQ ID NO: 136000 - RNA, 18 nt, Human
ugugauguuuaugcuuca

SEQ ID NO: 136001 - RNA, 21 nt, Human
ugugauguuuaugcuucaguu

SEQ ID NO: 136002 - RNA, 21 nt, Human
ugugauguuuaugcuucaguu

SEQ ID NO: 136003 - RNA, 18 nt, Human
ugugcauuuacccauuuu

SEQ ID NO: 136004 - RNA, 18 nt, Human
ugugcauuuacccauuuu

SEQ ID NO: 136005 - RNA, 20 nt, Human
uguggcauuuaaaaacucau

SEQ ID NO: 136006 - RNA, 20 nt, Human
uguggcauuuaaaaacucau

SEQ ID NO: 136007 - RNA, 20 nt, Human
uguguaugugugugugugug

SEQ ID NO: 136008 - RNA, 20 nt, Human
uguguaugugugugugugug

SEQ ID NO: 136009 - RNA, 21 nt, Human
uguguaugugugugugugugu

SEQ ID NO: 136010 - RNA, 21 nt, Human
uguguaugugugugugugugu

SEQ ID NO: 136011 - RNA, 19 nt, Human
uguguguaugugugugugu

SEQ ID NO: 136012 - RNA, 19 nt, Human
uguguguaugugugugugu

SEQ ID NO: 136013 - RNA, 21 nt, Human
uguguguaugugugugugugu

SEQ ID NO: 136014 - RNA, 21 nt, Human
uguguguaugugugugugugu

SEQ ID NO: 136015 - RNA, 21 nt, Human
uguguguguaugugugugugu

SEQ ID NO: 136016 - RNA, 21 nt, Human
uguguguguaugugugugugu

SEQ ID NO: 136017 - RNA, 24 nt, Human
uguguguguaugugugugugugug

SEQ ID NO: 136018 - RNA, 24 nt, Human
uguguguguaugugugugugugug

SEQ ID NO: 136019 - RNA, 20 nt, Human
uguguguguguaugugugug

SEQ ID NO: 136020 - RNA, 20 nt, Human
uguguguguguaugugugug

SEQ ID NO: 136021 - RNA, 21 nt, Human
uguguguguguaugugugugu

SEQ ID NO: 136022 - RNA, 21 nt, Human
uguguguguguaugugugugu

SEQ ID NO: 136023 - RNA, 24 nt, Human
uguguguguguaugugugugugug

SEQ ID NO: 136024 - RNA, 24 nt, Human
uguguguguguaugugugugugug

SEQ ID NO: 136025 - RNA, 30 nt, Human
uguguguguguguaugugugugugugugug

SEQ ID NO: 136026 - RNA, 30 nt, Human; identical to SEQ ID NO: 136025

SEQ ID NO: 136027 - RNA, 19 nt, Human
uguguguguguguguaugu

SEQ ID NO: 136028 - RNA, 19 nt, Human
uguguguguguguguaugu

SEQ ID NO: 136029 - RNA, 19 nt, Human
uguguguguguguguaugu

SEQ ID NO: 136030 - RNA, 19 nt, Human
uguguguguguguguaugu

SEQ ID NO: 136031 - RNA, 21 nt, Human
uguguguguguguguaugugu

SEQ ID NO: 136032 - RNA, 21 nt, Human
uguguguguguguguaugugu

SEQ ID NO: 136033 - RNA, 21 nt, Human
uguguguguguguguaugugu

SEQ ID NO: 136034 - RNA, 21 nt, Human
uguguguguguguguaugugu

SEQ ID NO: 136035 - RNA, 30 nt, Human
uguguguguguguguaugugugugugugug

SEQ ID NO: 136036 - RNA, 30 nt, Human; identical to SEQ ID NO: 136035

SEQ ID NO: 136037 - RNA, 20 nt, Human
uguguguguguguguguuug

SEQ ID NO: 136038 - RNA, 20 nt, Human
uguguguguguguguguuug

SEQ ID NO: 136039 - RNA, 21 nt, Human
uguguguguguguguguuugu

SEQ ID NO: 136040 - RNA, 21 nt, Human
uguguguguguguguguuugu

SEQ ID NO: 136041 - RNA, 26 nt, Human
uguguguguuuguuuuguuuuuaauu

SEQ ID NO: 136042 - RNA, 19 nt, Human
uguguuuguuuuguuuuua

SEQ ID NO: 136043 - RNA, 19 nt, Human
uguguuuguuuuguuuuua

SEQ ID NO: 136044 - RNA, 19 nt, Human
uguucccuuuaaaaaaauc

SEQ ID NO: 136045 - RNA, 19 nt, Human
uguucccuuuaaaaaaauc

SEQ ID NO: 136046 - RNA, 25 nt, Human
uguugcauagcaauccugagaaaac

SEQ ID NO: 136047 - RNA, 21 nt, Human
uguuugcagaccuccugccac

SEQ ID NO: 136048 - RNA, 19 nt, Human
uguuuuguuuuuagggguu

SEQ ID NO: 136049 - RNA, 19 nt, Human
uguuuuguuuuuagggguu

SEQ ID NO: 136050 - RNA, 24 nt, Human
uguuuuguuuuuagggguuuuuau

SEQ ID NO: 136051 - RNA, 24 nt, Human
uguuuuguuuuuagggguuuuuau

SEQ ID NO: 136052 - RNA, 18 nt, Human
uuaaaaugagaaacaucu

SEQ ID NO: 136053 - RNA, 18 nt, Human
uuaaaaugagaaacaucu

SEQ ID NO: 136054 - RNA, 20 nt, Human
uuaguggcuguauuguguug

SEQ ID NO: 136055 - RNA, 24 nt, Human
uuaucaggaacaccccaaaaccaa

SEQ ID NO: 136056 - RNA, 24 nt, Human
uuaucaggaacaccccaaaaccaa

SEQ ID NO: 136057 - RNA, 20 nt, Human
uucuaacuuccucuucacug

SEQ ID NO: 136058 - RNA, 22 nt, Human
uucuccugauucugucaucuuc

SEQ ID NO: 136059 - RNA, 21 nt, Human
uucucuuucaucuuuagggaa

SEQ ID NO: 136060 - RNA, 20 nt, Human
uucuucugaauggcuguugg

SEQ ID NO: 136061 - RNA, 20 nt, Human
uugagcuuuucuccucuuuu

SEQ ID NO: 136062 - RNA, 20 nt, Human
uugagcuuuucuccucuuuu

SEQ ID NO: 136063 - RNA, 20 nt, Human
uugcagaccuccugccaccg

SEQ ID NO: 136064 - RNA, 21 nt, Human
uugcagaccuccugccaccgc

SEQ ID NO: 136065 - RNA, 30 nt, Human
uugcugaauuauuucuuccccaguugcauu

SEQ ID NO: 136066 - RNA, 20 nt, Human
uuguaauuacagagaacuuu

SEQ ID NO: 136067 - RNA, 20 nt, Human
uuguaauuacagagaacuuu

SEQ ID NO: 136068 - RNA, 24 nt, Human
uugugagagagaaaaucaaaauga

SEQ ID NO: 136069 - RNA, 27 nt, Human
uuguggauccuuuuucuuuuggcaguu

SEQ ID NO: 136070 - RNA, 23 nt, Human
uuguucagggcaugaacucuugu

SEQ ID NO: 136071 - RNA, 23 nt, Human
uuguucagggcaugaacucuugu

SEQ ID NO: 136072 - RNA, 20 nt, Human
uuuaaaaaauggaaaaaguc

SEQ ID NO: 136073 - RNA, 20 nt, Human
uuuaaaaaauggaaaaaguc

SEQ ID NO: 136074 - RNA, 24 nt, Human
uuuagaaugaaacuuacuuacuua

SEQ ID NO: 136075 - RNA, 24 nt, Human
uuuagaaugaaacuuacuuacuua

SEQ ID NO: 136076 - RNA, 19 nt, Human
uuuaugauuuccaucuacg

SEQ ID NO: 136077 - RNA, 19 nt, Human
uuuaugauuuccaucuacg

SEQ ID NO: 136078 - RNA, 19 nt, Human
uuuccugucacuccaucau

SEQ ID NO: 136079 - RNA, 20 nt, Human
uuugaucuugagaaucauua

SEQ ID NO: 136080 - RNA, 19 nt, Human
uuuggcaguuuuugcccug

SEQ ID NO: 136081 - RNA, 19 nt, Human
uuuggcaguuuuugcccug

SEQ ID NO: 136082 - RNA, 25 nt, Human
uuuguguguguguguguaugugugu

SEQ ID NO: 136083 - RNA, 25 nt, Human
uuuguguguguguguguaugugugu

SEQ ID NO: 136084 - RNA, 21 nt, Human
uuuugaacaucuucucuuuca

SEQ ID NO: 136085 - RNA, 21 nt, Human
uuuugaacaucuucucuuuca

SEQ ID NO: 136086 - RNA, 21 nt, Human
uuuugcaccuguuucuuccac

SEQ ID NO: 136087 - RNA, 18 nt, Human
uuuuuuuuuuuucccccu

SEQ ID NO: 136088 - RNA, 23 nt, Human
acgcuccggccucgccgcugccc

SEQ ID NO: 136089 - RNA, 23 nt, Human
cccuccugcccuggucuuguccc

SEQ ID NO: 136090 - RNA, 18 nt, Human
ccggccucgccgcugccc

SEQ ID NO: 136091 - RNA, 20 nt, Human
ccggcucccuccugcccugg

SEQ ID NO: 136092 - RNA, 21 nt, Human
ccuccugcccuggucuugucc

SEQ ID NO: 136093 - RNA, 23 nt, Human
cggcucccuccugcccuggucuu

SEQ ID NO: 136094 - RNA, 20 nt, Human
cgggguucucgcggcuggcc

SEQ ID NO: 136095 - RNA, 23 nt, Human
cucgcggcuggccggcucccucc

SEQ ID NO: 136096 - RNA, 18 nt, Human
cugcccuggucuuguccc

SEQ ID NO: 136097 - RNA, 23 nt, Human
uccggccucgccgcugccccgga

SEQ ID NO: 136098 - RNA, 23 nt, Human
ucgccgcugccccggaggcccgc

SEQ ID NO: 136099 - RNA, 21 nt, Human
ucuccgccgcgacgcuccggc

SEQ ID NO: 136100 - RNA, 19 nt, Human
ugcccuggucuugucccgg

SEQ ID NO: 136101 - RNA, 28 nt, Human
ugcccuggucuugucccggucucguccu

SEQ ID NO: 136102 - RNA, 19 nt, Human
uggccggcucccuccugcc

SEQ ID NO: 136103 - RNA, 23 nt, Human
aaaaaguaucuacguaaagagga

SEQ ID NO: 136104 - RNA, 22 nt, Human
aaccugcuuuacauucucaaca

SEQ ID NO: 136105 - RNA, 18 nt, Human
aaguccucccucguucuc

SEQ ID NO: 136106 - RNA, 23 nt, Human
acccuaaaaacaaguguaauuga

SEQ ID NO: 136107 - RNA, 26 nt, Human
acugugccauaauuucaaagugcuuu

SEQ ID NO: 136108 - RNA, 23 nt, Human
agaggaauuucuuucucccacuc

SEQ ID NO: 136109 - RNA, 19 nt, Human
agcaagaaacaagucuuaa

SEQ ID NO: 136110 - RNA, 19 nt, Human
aggacucagagaacaguuu

SEQ ID NO: 136111 - RNA, 23 nt, Human
caagaauagaauuccccggucuc

SEQ ID NO: 136112 - RNA, 21 nt, Human
cacuggccuuggcacucagcc

SEQ ID NO: 136113 - RNA, 19 nt, Human
ccccucuauacgcuccuca

SEQ ID NO: 136114 - RNA, 22 nt, Human
ccucugugaaaugaugacaccc

SEQ ID NO: 136115 - RNA, 27 nt, Human
cucuuuggcuguguuacuggugucacu

SEQ ID NO: 136116 - RNA, 23 nt, Human
cuuaaccugcuuuacauucucaa

SEQ ID NO: 136117 - RNA, 18 nt, Human
cuuauccaaaacaacuca

SEQ ID NO: 136118 - RNA, 19 nt, Human
gaaguccucccucguucuc

SEQ ID NO: 136119 - RNA, 23 nt, Human
gacccaauccuucuuaucaucac

SEQ ID NO: 136120 - RNA, 20 nt, Human
gcaagaaacaagucuuaacc

SEQ ID NO: 136121 - RNA, 21 nt, Human
guggguccccucuauacgcuc

SEQ ID NO: 136122 - RNA, 20 nt, Human
uaaaaacaaguguaaugucc

SEQ ID NO: 136123 - RNA, 21 nt, Human
uaccucuacccuccguaguuc

SEQ ID NO: 136124 - RNA, 24 nt, Human
uagcuuuguuuguuacguugauga

SEQ ID NO: 136125 - RNA, 19 nt, Human
uaugaaguccucccucguu

SEQ ID NO: 136126 - RNA, 18 nt, Human
ucaggagcaagaaacaag

SEQ ID NO: 136127 - RNA, 20 nt, Human
ucaguguccccagauugaua

SEQ ID NO: 136128 - RNA, 20 nt, Human
ucccacucuuccugacccaa

SEQ ID NO: 136129 - RNA, 24 nt, Human
ucugugaaaugaugacacccuaaa

SEQ ID NO: 136130 - RNA, 23 nt, Human
ugacacccuaaaaacaaguguaa

SEQ ID NO: 136131 - RNA, 22 nt, Human
ugggagaaaaagauuuucuuau

SEQ ID NO: 136132 - RNA, 24 nt, Human
ugggaguucuacaaaaaaaaaaaa

SEQ ID NO: 136133 - RNA, 19 nt, Human
ugugaaaugaugacacccu

SEQ ID NO: 136134 - RNA, 24 nt, Human
ugugacaacugcuucuuaggacag

SEQ ID NO: 136135 - RNA, 22 nt, Human
uucuuaucaucaccagugauua

SEQ ID NO: 136136 - RNA, 20 nt, Human
uucuuauccaaaacaacuca

SEQ ID NO: 136137 - RNA, 23 nt, Human
uuucucuuauacauaccccucug

SEQ ID NO: 136138 - RNA, 22 nt, Human
aagcuccagaacugggggcuag

SEQ ID NO: 136139 - RNA, 19 nt, Human
acaggcagcaccauggccc

SEQ ID NO: 136140 - RNA, 20 nt, Human
accugcugcccaaaggcugg

SEQ ID NO: 136141 - RNA, 20 nt, Human
acgcuccccagagcagggcc

SEQ ID NO: 136142 - RNA, 21 nt, Human
acguggauugggguuguuggg

SEQ ID NO: 136143 - RNA, 22 nt, Human
acguggauugggguuguugggg

SEQ ID NO: 136144 - RNA, 21 nt, Human
agaaagaaauggucugugauc

SEQ ID NO: 136145 - RNA, 23 nt, Human
agaguagggggaaugcauggaga

SEQ ID NO: 136146 - RNA, 20 nt, Human
agcagcgcaagugaggaggg

SEQ ID NO: 136147 - RNA, 27 nt, Human
aggcggugggcgcggcuucucgcgcgg

SEQ ID NO: 136148 - RNA, 24 nt, Human
aggcugggggaggaaaguggugga

SEQ ID NO: 136149 - RNA, 20 nt, Human
agggcgucaugcacaagaaa

SEQ ID NO: 136150 - RNA, 18 nt, Human
auccacgucagggccuca

SEQ ID NO: 136151 - RNA, 18 nt, Human
auggaacacggacggccc

SEQ ID NO: 136152 - RNA, 21 nt, Human
caaaccgccgaagcgggcgga

SEQ ID NO: 136153 - RNA, 22 nt, Human
caagccagccccccaagcuccc

SEQ ID NO: 136154 - RNA, 23 nt, Human
caagcucccuccuuccagggccc

SEQ ID NO: 136155 - RNA, 23 nt, Human
caauaaauauccaaaccgccgaa

SEQ ID NO: 136156 - RNA, 26 nt, Human
cacaagccagccccccaagcucccuc

SEQ ID NO: 136157 - RNA, 21 nt, Human
cacccccuugcucccgacaag

SEQ ID NO: 136158 - RNA, 23 nt, Human
cagcagcagcagcagcagcagca

SEQ ID NO: 136159 - RNA, 23 nt, Human
cagcagcagcagcagcagcagca

SEQ ID NO: 136160 - RNA, 23 nt, Human
cagcagcagcagcagcagcagca

SEQ ID NO: 136161 - RNA, 23 nt, Human
cagcagcagcagcagcagcagca

SEQ ID NO: 136162 - RNA, 23 nt, Human
cagcagcagcagcagcagcagca

SEQ ID NO: 136163 - RNA, 24 nt, Human
cagcagcagcagcagcagcauucc

SEQ ID NO: 136164 - RNA, 26 nt, Human
cagcagcagcagcagcauucccggcu

SEQ ID NO: 136165 - RNA, 21 nt, Human
cagccccccaagcucccuccu

SEQ ID NO: 136166 - RNA, 22 nt, Human
ccaccccuugguccagcccccc

SEQ ID NO: 136167 - RNA, 21 nt, Human
ccauccacgucagggccucag

SEQ ID NO: 136168 - RNA, 19 nt, Human
cccagccuuaaccccucac

SEQ ID NO: 136169 - RNA, 21 nt, Human
ccccccucccgccucccagcc

SEQ ID NO: 136170 - RNA, 30 nt, Human
ccccuucuccccaccccuugguccagcccc

SEQ ID NO: 136171 - RNA, 19 nt, Human
cccgguacacaggacugga

SEQ ID NO: 136172 - RNA, 18 nt, Human
cccucagagccugaacag

SEQ ID NO: 136173 - RNA, 27 nt, Human
cccucaggcucucugcuuuaaaccagc

SEQ ID NO: 136174 - RNA, 22 nt, Human
cccucccgccucccagccuuaa

SEQ ID NO: 136175 - RNA, 22 nt, Human
cccuguccaggcccuggagccc

SEQ ID NO: 136176 - RNA, 26 nt, Human
ccucccagccuuaaccccucacaagc

SEQ ID NO: 136177 - RNA, 21 nt, Human
ccugucccuggcuguccccug

SEQ ID NO: 136178 - RNA, 20 nt, Human
cggccccucccuccccggcc

SEQ ID NO: 136179 - RNA, 22 nt, Human
cggccccucccuccccggccgc

SEQ ID NO: 136180 - RNA, 20 nt, Human
cggcuucugugccgugcccc

SEQ ID NO: 136181 - RNA, 20 nt, Human
cgggcggagccggcuggggc

SEQ ID NO: 136182 - RNA, 21 nt, Human
cgggcggagccggcuggggcu

SEQ ID NO: 136183 - RNA, 19 nt, Human
cgggggcucgggguccucc

SEQ ID NO: 136184 - RNA, 23 nt, Human
cgggguccuccugucacagggcc

SEQ ID NO: 136185 - RNA, 24 nt, Human
cgguacacaggacuggagcugggc

SEQ ID NO: 136186 - RNA, 20 nt, Human
cuccuccccuucuccccacc

SEQ ID NO: 136187 - RNA, 18 nt, Human
cugagugacccaguagca

SEQ ID NO: 136188 - RNA, 19 nt, Human
cugcaugucugccuguccc

SEQ ID NO: 136189 - RNA, 20 nt, Human
cugccuucccaggccugcag

SEQ ID NO: 136190 - RNA, 23 nt, Human
gacuggagcugggcggagaccca

SEQ ID NO: 136191 - RNA, 21 nt, Human
gagcagcgcaagugaggaggg

SEQ ID NO: 136192 - RNA, 18 nt, Human
gagguggggaaggggugg

SEQ ID NO: 136193 - RNA, 22 nt, Human
gccagccccccaagcucccucc

SEQ ID NO: 136194 - RNA, 23 nt, Human
gcccuggagcccuggcugcaugu

SEQ ID NO: 136195 - RNA, 18 nt, Human
gccuccuccccuucuccc

SEQ ID NO: 136196 - RNA, 21 nt, Human
gcugggggaggaaaguggugg

SEQ ID NO: 136197 - RNA, 18 nt, Human
gcugggugggagaaaggg

SEQ ID NO: 136198 - RNA, 22 nt, Human
ggacaggcagcaccauggcccc

SEQ ID NO: 136199 - RNA, 20 nt, Human
ggaccaggagggggcacccc

SEQ ID NO: 136200 - RNA, 22 nt, Human
ggacccggccccucccuccccg

SEQ ID NO: 136201 - RNA, 25 nt, Human
ggagaaagggguugaggccugggaa

SEQ ID NO: 136202 - RNA, 23 nt, Human
ggccccggagucgaagacaguuc

SEQ ID NO: 136203 - RNA, 22 nt, Human
ggcugggugggagaaagggguu

SEQ ID NO: 136204 - RNA, 24 nt, Human
gggagaaagggguugaggccuggg

SEQ ID NO: 136205 - RNA, 24 nt, Human
gggcuggggguuggggcugggugg

SEQ ID NO: 136206 - RNA, 25 nt, Human
gggcuggggguuggggcuggguggg

SEQ ID NO: 136207 - RNA, 18 nt, Human
gggcugggugggagaaag

SEQ ID NO: 136208 - RNA, 20 nt, Human
gggcugggugggagaaaggg

SEQ ID NO: 136209 - RNA, 21 nt, Human
gggcugggugggagaaagggg

SEQ ID NO: 136210 - RNA, 21 nt, Human
gggcugggugggagaaagggg

SEQ ID NO: 136211 - RNA, 22 nt, Human
ggggcugggugggagaaagggg

SEQ ID NO: 136212 - RNA, 23 nt, Human
ggggguggggguccuaggugggg

SEQ ID NO: 136213 - RNA, 18 nt, Human
gguacacaggacuggagc

SEQ ID NO: 136214 - RNA, 24 nt, Human
ggucggggguggggguccuaggug

SEQ ID NO: 136215 - RNA, 22 nt, Human
ggucugugauccccccagcagc

SEQ ID NO: 136216 - RNA, 22 nt, Human
gguggugaggacaggaccagga

SEQ ID NO: 136217 - RNA, 24 nt, Human
ggugugaugaauuucaagaagaac

SEQ ID NO: 136218 - RNA, 20 nt, Human
gugaugaauuucaagaagaa

SEQ ID NO: 136219 - RNA, 24 nt, Human
uaaccccucacaagccagcccccc

SEQ ID NO: 136220 - RNA, 20 nt, Human
uacacaggacuggagcuggg

SEQ ID NO: 136221 - RNA, 18 nt, Human
uauccaaaccgccgaagc

SEQ ID NO: 136222 - RNA, 27 nt, Human
ucacacugucaccccaauaaaaaggua

SEQ ID NO: 136223 - RNA, 22 nt, Human
ucagcugucacacugucacccc

SEQ ID NO: 136224 - RNA, 19 nt, Human
uccagccccccucccgccu

SEQ ID NO: 136225 - RNA, 20 nt, Human
uccagggcccuucagaaccc

SEQ ID NO: 136226 - RNA, 25 nt, Human
ucccagccuuaaccccucacaagcc

SEQ ID NO: 136227 - RNA, 18 nt, Human
ucccaggccugcaguuug

SEQ ID NO: 136228 - RNA, 22 nt, Human
uccccaccccuugguccagccc

SEQ ID NO: 136229 - RNA, 22 nt, Human
uccccugggccucucuggccac

SEQ ID NO: 136230 - RNA, 18 nt, Human
uccccuucuccccacccc

SEQ ID NO: 136231 - RNA, 22 nt, Human
ucccgaguaagcaggcagagau

SEQ ID NO: 136232 - RNA, 18 nt, Human
ucccuggcuguccccugg

SEQ ID NO: 136233 - RNA, 23 nt, Human
ucccuggcuguccccugggccuc

SEQ ID NO: 136234 - RNA, 22 nt, Human
ugaacuggcaggcggugggcgc

SEQ ID NO: 136235 - RNA, 19 nt, Human
ugacccaguagcaaccacc

SEQ ID NO: 136236 - RNA, 22 nt, Human
ugaccugcugcccaaaggcugg

SEQ ID NO: 136237 - RNA, 19 nt, Human
ugaggaggggggcgcggga

SEQ ID NO: 136238 - RNA, 22 nt, Human
ugaggaggggggcgcgggaucc

SEQ ID NO: 136239 - RNA, 22 nt, Human
uggacaggcagcaccauggccc

SEQ ID NO: 136240 - RNA, 24 nt, Human
uggagggccuuuuauucgcgaggg

SEQ ID NO: 136241 - RNA, 24 nt, Human
uggcaggcggugggcgcggcuucu

SEQ ID NO: 136242 - RNA, 20 nt, Human
ugggagaaagggguugaggc

SEQ ID NO: 136243 - RNA, 20 nt, Human
uggggcugggugggagaaag

SEQ ID NO: 136244 - RNA, 30 nt, Human
uggggcugggugggagaaagggguugaggg

SEQ ID NO: 136245 - RNA, 18 nt, Human
ugggggaggaaaguggug

SEQ ID NO: 136246 - RNA, 25 nt, Human
ugggggcuagggggugagggcuggg

SEQ ID NO: 136247 - RNA, 22 nt, Human
ugguccagccccccucccgccu

SEQ ID NO: 136248 - RNA, 21 nt, Human
ugucugccugucccuggcugu

SEQ ID NO: 136249 - RNA, 24 nt, Human
uuccagggcccuucagaacccuuc

SEQ ID NO: 136250 - RNA, 21 nt, Human
uuuuuuuuuuuuuuuucccag

SEQ ID NO: 136251 - RNA, 23 nt, Human
uuuuuuuuuuuuuuuuucccagg

SEQ ID NO: 136252 - RNA, 23 nt, Human
uuuuuuuuuuuuuuuuuuuccca

SEQ ID NO: 136253 - RNA, 23 nt, Human
uuuuuuuuuuuuuuuuuuuuccc

SEQ ID NO: 136254 - RNA, 24 nt, Human
uuuuuuuuuuuuuuuuuuuuuccu

SEQ ID NO: 136255 - RNA, 20 nt, Human
aaaaaaaccccuaaggcacc

SEQ ID NO: 136256 - RNA, 20 nt, Human
aaccaaauacguucucaaca

SEQ ID NO: 136257 - RNA, 23 nt, Human
aaggucacuuuaaauugcacugu

SEQ ID NO: 136258 - RNA, 19 nt, Human
aaucaugaacucaaaucug

SEQ ID NO: 136259 - RNA, 21 nt, Human
aauuacacccuuuaccaaaaa

SEQ ID NO: 136260 - RNA, 20 nt, Human
acaauuuuuauuucagguaa

SEQ ID NO: 136261 - RNA, 18 nt, Human
acgcuccggaggaggagg

SEQ ID NO: 136262 - RNA, 20 nt, Human
agacuaguuucauuucagga

SEQ ID NO: 136263 - RNA, 24 nt, Human
agcaauuuuuuuuuacaggcuuua

SEQ ID NO: 136264 - RNA, 20 nt, Human
agcugcaacuaaguagaaca

SEQ ID NO: 136265 - RNA, 18 nt, Human
aggaggcgcaggagacgu

SEQ ID NO: 136266 - RNA, 25 nt, Human
auauaaaccaaauacguucucaaca

SEQ ID NO: 136267 - RNA, 22 nt, Human
cacaauauauccauuuagcaga

SEQ ID NO: 136268 - RNA, 21 nt, Human
cacacaauauauccauuuagc

SEQ ID NO: 136269 - RNA, 23 nt, Human
cagcaauuuuuuuuuacaggcuu

SEQ ID NO: 136270 - RNA, 19 nt, Human
cagcgacgcuccggaggag

SEQ ID NO: 136271 - RNA, 18 nt, Human
caugcagaugguagucac

SEQ ID NO: 136272 - RNA, 19 nt, Human
caugcagaugguagucacg

SEQ ID NO: 136273 - RNA, 19 nt, Human
ccccucucucgccuggaga

SEQ ID NO: 136274 - RNA, 24 nt, Human
cccgacggacagcgacgcuccgga

SEQ ID NO: 136275 - RNA, 19 nt, Human
cgacgcuccggaggaggag

SEQ ID NO: 136276 - RNA, 23 nt, Human
cgagcacucuggcccccucucuc

SEQ ID NO: 136277 - RNA, 21 nt, Human
cgcagcaauuuuuuuuuacag

SEQ ID NO: 136278 - RNA, 20 nt, Human
cuggcccccucucucgccug

SEQ ID NO: 136279 - RNA, 19 nt, Human
cuugaaaacuacaugaaac

SEQ ID NO: 136280 - RNA, 21 nt, Human
cuuuuauuucuugaaaacuac

SEQ ID NO: 136281 - RNA, 23 nt, Human
gaagugcgagcacucuggccccc

SEQ ID NO: 136282 - RNA, 21 nt, Human
gaguaaagcacuuaaaucaug

SEQ ID NO: 136283 - RNA, 20 nt, Human
gccucuggacuaaacucuaa

SEQ ID NO: 136284 - RNA, 20 nt, Human
gccuggagacugcugcgagg

SEQ ID NO: 136285 - RNA, 21 nt, Human
ggacagcgacgcuccggagga

SEQ ID NO: 136286 - RNA, 18 nt, Human
ggaggaugggguggggcu

SEQ ID NO: 136287 - RNA, 20 nt, Human
gguggggcuauuuccaacag

SEQ ID NO: 136288 - RNA, 20 nt, Human
gucauuaaaaaaaugaacac

SEQ ID NO: 136289 - RNA, 19 nt, Human
gugcgagcacucuggcccc

SEQ ID NO: 136290 - RNA, 19 nt, Human
uaaaucaugcagaugguag

SEQ ID NO: 136291 - RNA, 20 nt, Human
uacagcugcaacuaaguaga

SEQ ID NO: 136292 - RNA, 24 nt, Human
ucaaugcaaaauauuaacaaaccc

SEQ ID NO: 136293 - RNA, 18 nt, Human
ucagucaucaauaacaau

SEQ ID NO: 136294 - RNA, 19 nt, Human
ucuacaaacaccacucagg

SEQ ID NO: 136295 - RNA, 19 nt, Human
ucugcaucacuaaggucac

SEQ ID NO: 136296 - RNA, 19 nt, Human
ugaacccgacggacagcga

SEQ ID NO: 136297 - RNA, 26 nt, Human
ugaguaaagcacuuaaaucaugcaga

SEQ ID NO: 136298 - RNA, 19 nt, Human
ugccugcucuuuucuucuc

SEQ ID NO: 136299 - RNA, 18 nt, Human
uguuaaauuacacccuuu

SEQ ID NO: 136300 - RNA, 18 nt, Human
uuacaacaguccagacug

SEQ ID NO: 136301 - RNA, 20 nt, Human
uuacaacaguccagacugca

SEQ ID NO: 136302 - RNA, 18 nt, Human
uucacuugaaugaauucu

SEQ ID NO: 136303 - RNA, 21 nt, Human
uugccugcucuuuucuucuca

SEQ ID NO: 136304 - RNA, 23 nt, Human
uuggauugggaggaugggguggg

SEQ ID NO: 136305 - RNA, 20 nt, Human
aacagagcagcagcuugaga

SEQ ID NO: 136306 - RNA, 20 nt, Human
aacccagaagguaacagcaa

SEQ ID NO: 136307 - RNA, 19 nt, Human
aagagauuaacaucuacgg

SEQ ID NO: 136308 - RNA, 20 nt, Human
aaguggcagagggugccugg

SEQ ID NO: 136309 - RNA, 21 nt, Human
acggaauaaaaauguggaaac

SEQ ID NO: 136310 - RNA, 30 nt, Human
acuugggccaaacuaaaaaucuugaggacc

SEQ ID NO: 136311 - RNA, 19 nt, Human
agacaagacuauuuaucuu

SEQ ID NO: 136312 - RNA, 19 nt, Human
agacugcagaaaauccagc

SEQ ID NO: 136313 - RNA, 22 nt, Human
agccugaugacccugaagguca

SEQ ID NO: 136314 - RNA, 19 nt, Human
aggcagcaccagggaaccu

SEQ ID NO: 136315 - RNA, 24 nt, Human
aggcagcaccagggaaccuuccaa

SEQ ID NO: 136316 - RNA, 18 nt, Human
aggugguggcauuuagca

SEQ ID NO: 136317 - RNA, 23 nt, Human
auccugucacuaacugggggagg

SEQ ID NO: 136318 - RNA, 30 nt, Human
aucucccuuucuuuauauucucucuccagg

SEQ ID NO: 136319 - RNA, 24 nt, Human
augguuaaaucaaggccggggucc

SEQ ID NO: 136320 - RNA, 25 nt, Human
auuacagaaguccuugcuugguggu

SEQ ID NO: 136321 - RNA, 18 nt, Human
cagaaacagagcagcagc

SEQ ID NO: 136322 - RNA, 18 nt, Human
cagaagguaacagcaacc

SEQ ID NO: 136323 - RNA, 21 nt, Human
cagcaaaggcucuucuuuucc

SEQ ID NO: 136324 - RNA, 26 nt, Human
cagcaaccacuacagaucagcagaac

SEQ ID NO: 136325 - RNA, 19 nt, Human
caucaucuuuacauuagaa

SEQ ID NO: 136326 - RNA, 20 nt, Human
cauccuggacucgugcuccc

SEQ ID NO: 136327 - RNA, 19 nt, Human
ccacugggcuggggcugua

SEQ ID NO: 136328 - RNA, 21 nt, Human
ccagaagguaacagcaaccac

SEQ ID NO: 136329 - RNA, 20 nt, Human
ccagcuggccccaugcuuca

SEQ ID NO: 136330 - RNA, 21 nt, Human
cgauagccuacaagaagcaaa

SEQ ID NO: 136331 - RNA, 18 nt, Human
cuauaaugcucuaagacu

SEQ ID NO: 136332 - RNA, 21 nt, Human
cucauccugucacuaacuggg

SEQ ID NO: 136333 - RNA, 18 nt, Human
cuggaauggggcgauagc

SEQ ID NO: 136334 - RNA, 23 nt, Human
cuggccccaugcuucagggcuug

SEQ ID NO: 136335 - RNA, 19 nt, Human
cugggcuggggcuguaggc

SEQ ID NO: 136336 - RNA, 19 nt, Human
gaagcaaagauugcacaug

SEQ ID NO: 136337 - RNA, 18 nt, Human
gacccgauuugucaguaa

SEQ ID NO: 136338 - RNA, 20 nt, Human
gcccuugagcugccagggag

SEQ ID NO: 136339 - RNA, 19 nt, Human
gcggaccucucugggacag

SEQ ID NO: 136340 - RNA, 21 nt, Human
gcuauaaugcucuaagacugc

SEQ ID NO: 136341 - RNA, 23 nt, Human
ggaauggggcgauagccuacaag

SEQ ID NO: 136342 - RNA, 20 nt, Human
ggcagaaacagagcagcagc

SEQ ID NO: 136343 - RNA, 20 nt, Human
ggugguuccacugggcuggg

SEQ ID NO: 136344 - RNA, 22 nt, Human
gucccuccuacauaagucuccg

SEQ ID NO: 136345 - RNA, 25 nt, Human
uaaaaaauauaucuauaccuagagc

SEQ ID NO: 136346 - RNA, 20 nt, Human
uaacugggggagguagaggg

SEQ ID NO: 136347 - RNA, 25 nt, Human
uaagcagccuuucacugagagacac

SEQ ID NO: 136348 - RNA, 21 nt, Human
uacuucugguuguccuuaacu

SEQ ID NO: 136349 - RNA, 18 nt, Human
uagcaaauggcuauaaug

SEQ ID NO: 136350 - RNA, 19 nt, Human
uagccuacaagaagcaaag

SEQ ID NO: 136351 - RNA, 18 nt, Human
uauucucucuccagcaua

SEQ ID NO: 136352 - RNA, 18 nt, Human
ucacuaacugggggaggu

SEQ ID NO: 136353 - RNA, 18 nt, Human
ucaggagugugaggcagc

SEQ ID NO: 136354 - RNA, 23 nt, Human
ucucugggacagccugaugaccc

SEQ ID NO: 136355 - RNA, 24 nt, Human
ucuuguucuuguugcuugggucgg

SEQ ID NO: 136356 - RNA, 22 nt, Human
ucuuguucuuguugcuuguugu

SEQ ID NO: 136357 - RNA, 22 nt, Human
ugaaaugcuguguaaagugugg

SEQ ID NO: 136358 - RNA, 19 nt, Human
ugaacugaggugguggcau

SEQ ID NO: 136359 - RNA, 22 nt, Human
ugaggacaagggauacugucua

SEQ ID NO: 136360 - RNA, 24 nt, Human
ugcagaaaauccagcuuucuguuu

SEQ ID NO: 136361 - RNA, 18 nt, Human
ugcccuugagcugccagg

SEQ ID NO: 136362 - RNA, 19 nt, Human
uggaaacccagaagguaac

SEQ ID NO: 136363 - RNA, 21 nt, Human
uggaauggauuaugucuaagu

SEQ ID NO: 136364 - RNA, 22 nt, Human
uggaauggauuaugucuaagug

SEQ ID NO: 136365 - RNA, 18 nt, Human
ugggacagccugaugacc

SEQ ID NO: 136366 - RNA, 21 nt, Human
ugggagagaaauuccgucggg

SEQ ID NO: 136367 - RNA, 19 nt, Human
ugggggagguagagggaag

SEQ ID NO: 136368 - RNA, 20 nt, Human
ugucacuaacugggggaggu

SEQ ID NO: 136369 - RNA, 20 nt, Human
uguguaaagugugguacuuc

SEQ ID NO: 136370 - RNA, 23 nt, Human
uuaaaaaauauaucuauaccuag

SEQ ID NO: 136371 - RNA, 23 nt, Human
uuaauauucuucccaggcccccu

SEQ ID NO: 136372 - RNA, 24 nt, Human
uuaggggucucuucaaaggccucu

SEQ ID NO: 136373 - RNA, 20 nt, Human
uuccugggagggugaaagau

SEQ ID NO: 136374 - RNA, 22 nt, Human
uucuuuuccucauccugucacu

SEQ ID NO: 136375 - RNA, 20 nt, Human
uuggcuacaaaaaggucuuu

SEQ ID NO: 136376 - RNA, 20 nt, Human
uugggccaaacuaaaaaucu

SEQ ID NO: 136377 - RNA, 27 nt, Human
uuguuguucuuguucuuguugcuuguu

SEQ ID NO: 136378 - RNA, 24 nt, Human
uuuccucauccugucacuaacugg

SEQ ID NO: 136379 - RNA, 24 nt, Human
aaaaaacguauuuuuacuguggaa

SEQ ID NO: 136380 - RNA, 18 nt, Human
aaaacacaugaaaaacca

SEQ ID NO: 136381 - RNA, 21 nt, Human
aaaacaccuuuaacacuauga

SEQ ID NO: 136382 - RNA, 21 nt, Human
aaaacagacagaaacaggguu

SEQ ID NO: 136383 - RNA, 24 nt, Human
aaacagacagaaacaggguuagca

SEQ ID NO: 136384 - RNA, 26 nt, Human
aacaauacuauuguuugcaaugcugu

SEQ ID NO: 136385 - RNA, 23 nt, Human
aagguuuaguuuauuuucuauua

SEQ ID NO: 136386 - RNA, 18 nt, Human
aauugucccauaaacacu

SEQ ID NO: 136387 - RNA, 23 nt, Human
acacacacacacacacacacaca

SEQ ID NO: 136388 - RNA, 21 nt, Human
acacacacacacacacacgua

SEQ ID NO: 136389 - RNA, 23 nt, Human
acacacacacacacacacguaua

SEQ ID NO: 136390 - RNA, 25 nt, Human
acacacacacacacguauacauaca

SEQ ID NO: 136391 - RNA, 21 nt, Human
acacacacguauacauacaau

SEQ ID NO: 136392 - RNA, 23 nt, Human
acacacacguauacauacauaua

SEQ ID NO: 136393 - RNA, 20 nt, Human
acacuuagucccaucugccu

SEQ ID NO: 136394 - RNA, 23 nt, Human
acagaaacuuuauugccugcuaa

SEQ ID NO: 136395 - RNA, 19 nt, Human
acagcacaaaacagacaga

SEQ ID NO: 136396 - RNA, 22 nt, Human
acugcaacuugcucaacacauu

SEQ ID NO: 136397 - RNA, 21 nt, Human
agcacaaaacagacagaaaca

SEQ ID NO: 136398 - RNA, 18 nt, Human
aguaucuacuuaauuuga

SEQ ID NO: 136399 - RNA, 19 nt, Human
agugcaucaagggcaaagc

SEQ ID NO: 136400 - RNA, 26 nt, Human
caaaaaacguauuuuuacuguggaag

SEQ ID NO: 136401 - RNA, 24 nt, Human
caacauacuuuuaagauaaaagua

SEQ ID NO: 136402 - RNA, 23 nt, Human
caacggacaccgcauccagcuca

SEQ ID NO: 136403 - RNA, 18 nt, Human
cacacacacacacacaca

SEQ ID NO: 136404 - RNA, 20 nt, Human
cacacacacacacacacaca

SEQ ID NO: 136405 - RNA, 20 nt, Human
cacacacacacacacacaca

SEQ ID NO: 136406 - RNA, 25 nt, Human
cacacacacacacacacacguauac

SEQ ID NO: 136407 - RNA, 26 nt, Human
cacacacacacacacacguauacaua

SEQ ID NO: 136408 - RNA, 25 nt, Human
cacacacacacacacguauacauac

SEQ ID NO: 136409 - RNA, 19 nt, Human
cacauuuaaaauuguugaa

SEQ ID NO: 136410 - RNA, 23 nt, Human
cacauuuguuucugaaaacacug

SEQ ID NO: 136411 - RNA, 23 nt, Human
cagaauuuugagauuaaaagcac

SEQ ID NO: 136412 - RNA, 23 nt, Human
cagacagaaacaggguuagcaca

SEQ ID NO: 136413 - RNA, 21 nt, Human
cagcacaaaacagacagaaac

SEQ ID NO: 136414 - RNA, 19 nt, Human
cucaaugacaauuuuaaug

SEQ ID NO: 136415 - RNA, 20 nt, Human
cugcuuucacauuuguuucu

SEQ ID NO: 136416 - RNA, 21 nt, Human
gaaaagguacagcacaaaaca

SEQ ID NO: 136417 - RNA, 23 nt, Human
gcacaaaaacacaugaaaaacca

SEQ ID NO: 136418 - RNA, 21 nt, Human
gcacaaaacagacagaaacag

SEQ ID NO: 136419 - RNA, 31 nt, Human
guguaagauacacacacacacacacacacag

SEQ ID NO: 136420 - RNA, 21 nt, Human
uaaaaucaaguauuuaucaag

SEQ ID NO: 136421 - RNA, 24 nt, Human
uaaauauaaaaacaagaaagcauu

SEQ ID NO: 136422 - RNA, 20 nt, Human
uaacaacauacuuuuaagau

SEQ ID NO: 136423 - RNA, 21 nt, Human
uaacuuggguuccggagggua

SEQ ID NO: 136424 - RNA, 19 nt, Human
uaagagaagaguuugagau

SEQ ID NO: 136425 - RNA, 20 nt, Human
uaagauacacacacacacac

SEQ ID NO: 136426 - RNA, 23 nt, Human
uaagugaugaguauuauguacaa

SEQ ID NO: 136427 - RNA, 24 nt, Human
uaaguuaaaagcauugugcauuuu

SEQ ID NO: 136428 - RNA, 24 nt, Human
uaauaguaaauauuuuaucucauu

SEQ ID NO: 136429 - RNA, 26 nt, Human
uacacacacacacacacacacacacg

SEQ ID NO: 136430 - RNA, 25 nt, Human
uacacacacacacacacacacacag

SEQ ID NO: 136431 - RNA, 22 nt, Human
uacagcacaaaacagacagaaa

SEQ ID NO: 136432 - RNA, 20 nt, Human
uaggcaauguaaucuacuuc

SEQ ID NO: 136433 - RNA, 23 nt, Human
uauaauauacuaugauauguauu

SEQ ID NO: 136434 - RNA, 19 nt, Human
uauaugccaccacagaaac

SEQ ID NO: 136435 - RNA, 19 nt, Human
uauggcacaaaaacacaug

SEQ ID NO: 136436 - RNA, 27 nt, Human
uauuuuggucauauuuuauaauaaaau

SEQ ID NO: 136437 - RNA, 19 nt, Human
ucaaauaccuaucauuaau

SEQ ID NO: 136438 - RNA, 21 nt, Human
ucaaguuuucuauaauucuga

SEQ ID NO: 136439 - RNA, 18 nt, Human
uccauaaaauaaauauaa

SEQ ID NO: 136440 - RNA, 19 nt, Human
ucccauaaacacuuagucc

SEQ ID NO: 136441 - RNA, 21 nt, Human
ucccaucugccuguagucuca

SEQ ID NO: 136442 - RNA, 18 nt, Human
uccuauuaaacaaaauau

SEQ ID NO: 136443 - RNA, 23 nt, Human
ucuaaauaguaucuacuuaauuu

SEQ ID NO: 136444 - RNA, 22 nt, Human
ucuccauggcaaaauagucgca

SEQ ID NO: 136445 - RNA, 21 nt, Human
ucugaaugaccuuguuaauuu

SEQ ID NO: 136446 - RNA, 21 nt, Human
ucuuacaugauauaugccacc

SEQ ID NO: 136447 - RNA, 19 nt, Human
ugaaaaccuuacauauuga

SEQ ID NO: 136448 - RNA, 18 nt, Human
ugaaauacaauuuacaaa

SEQ ID NO: 136449 - RNA, 19 nt, Human
ugaaauacaauuuacaaaa

SEQ ID NO: 136450 - RNA, 20 nt, Human
ugauuugugaagaaauuacu

SEQ ID NO: 136451 - RNA, 24 nt, Human
ugcaacggacaccgcauccagcuc

SEQ ID NO: 136452 - RNA, 18 nt, Human
ugcauauaaacucucuac

SEQ ID NO: 136453 - RNA, 20 nt, Human
uggcaaaauagucgcauaug

SEQ ID NO: 136454 - RNA, 25 nt, Human
uguguaagauacacacacacacaca

SEQ ID NO: 136455 - RNA, 30 nt, Human
uguguaagauacacacacacacacacacag

SEQ ID NO: 136456 - RNA, 18 nt, Human
uucauuucuuugcuuuga

SEQ ID NO: 136457 - RNA, 18 nt, Human
uugacugcuuucacauuu

SEQ ID NO: 136458 - RNA, 21 nt, Human
uugacugcuuucacauuuguu

SEQ ID NO: 136459 - RNA, 24 nt, Human
uugguuaaaaucaaguauuuauca

SEQ ID NO: 136460 - RNA, 21 nt, Human
uuguuauggcacaaaaacaca

SEQ ID NO: 136461 - RNA, 22 nt, Human
uuuucagaauuuugagauuaaa

SEQ ID NO: 136462 - RNA, 22 nt, Human
uuuuggcaaaaauaaaauauaa

SEQ ID NO: 136463 - RNA, 20 nt, Human
aaaacaaaauuuguugcaaa

SEQ ID NO: 136464 - RNA, 18 nt, Human
aaacaaaaaaggaggaua

SEQ ID NO: 136465 - RNA, 23 nt, Human
aaacacaugagguagaaauaaaa

SEQ ID NO: 136466 - RNA, 18 nt, Human
aaagcugguaaaaauuua

SEQ ID NO: 136467 - RNA, 21 nt, Human
aaaucuacucuagaauacuga

SEQ ID NO: 136468 - RNA, 23 nt, Human
aacccauaaauucagacuuuuca

SEQ ID NO: 136469 - RNA, 24 nt, Human
aaguuaauccaucuucaaagcugg

SEQ ID NO: 136470 - RNA, 21 nt, Human
aauacugaaaacaaaaaagga

SEQ ID NO: 136471 - RNA, 21 nt, Human
acacaaaaaagggaaaacuga

SEQ ID NO: 136472 - RNA, 24 nt, Human
agacagaaaagacagcggaaccgg

SEQ ID NO: 136473 - RNA, 23 nt, Human
aggcaaaaaugcaugcauagaac

SEQ ID NO: 136474 - RNA, 26 nt, Human
aggcaaaaaugcaugcauagaaccca

SEQ ID NO: 136475 - RNA, 20 nt, Human
agguagaaauaaaaauuuua

SEQ ID NO: 136476 - RNA, 21 nt, Human
auagaacccauaaauucagac

SEQ ID NO: 136477 - RNA, 19 nt, Human
augaaaacaaaucaaaucc

SEQ ID NO: 136478 - RNA, 23 nt, Human
cacuuauguucucaucaucacaa

SEQ ID NO: 136479 - RNA, 24 nt, Human
cagaaaagacagcggaaccggggg

SEQ ID NO: 136480 - RNA, 21 nt, Human
cagaaagcuuagaaaagggaa

SEQ ID NO: 136481 - RNA, 21 nt, Human
cauagaacccauaaauucaga

SEQ ID NO: 136482 - RNA, 22 nt, Human
gaaaacacaucugauagcagaa

SEQ ID NO: 136483 - RNA, 21 nt, Human
gaggauaguaagggaggauag

SEQ ID NO: 136484 - RNA, 19 nt, Human
gccccagaagaaucuguua

SEQ ID NO: 136485 - RNA, 21 nt, Human
gcccuaguaugaaaaggcaag

SEQ ID NO: 136486 - RNA, 21 nt, Human
gcgagccugcgcaccucgcgc

SEQ ID NO: 136487 - RNA, 26 nt, Human
uaaaaaaaacccucaagagaaaugga

SEQ ID NO: 136488 - RNA, 20 nt, Human
uaaaaaaacacaugagguag

SEQ ID NO: 136489 - RNA, 22 nt, Human
uaacacucauuaaaaaaaaccc

SEQ ID NO: 136490 - RNA, 19 nt, Human
uacaccugugcuuuaaaac

SEQ ID NO: 136491 - RNA, 18 nt, Human
uaggcaaaaaugcaugca

SEQ ID NO: 136492 - RNA, 20 nt, Human
uauucagucuuucaaauaaa

SEQ ID NO: 136493 - RNA, 24 nt, Human
ucagucuuucaaauaaaguucuua

SEQ ID NO: 136494 - RNA, 20 nt, Human
ucugacuuaaaaguuuaaag

SEQ ID NO: 136495 - RNA, 20 nt, Human
ugaaaacacaucugauagca

SEQ ID NO: 136496 - RNA, 23 nt, Human
ugaaaacacaucugauagcagaa

SEQ ID NO: 136497 - RNA, 19 nt, Human
ugaaaugucugacuuaaaa

SEQ ID NO: 136498 - RNA, 19 nt, Human
uuauaucaaaaucuacucu

SEQ ID NO: 136499 - RNA, 23 nt, Human
uuauuaaauaaaaaacuucaagu

SEQ ID NO: 136500 - RNA, 23 nt, Human
uucacaguuuucgguacaccugu

SEQ ID NO: 136501 - RNA, 19 nt, Human
uuccaagccccagaagaau

SEQ ID NO: 136502 - RNA, 23 nt, Human
uuuaaagcucaaagucaaaaguu

SEQ ID NO: 136503 - RNA, 25 nt, Human
agaggcuagaggaaugccaguguua

SEQ ID NO: 136504 - RNA, 18 nt, Human
cacugcacuccagcagag

SEQ ID NO: 136505 - RNA, 19 nt, Human
cacugcacuccagcagagg

SEQ ID NO: 136506 - RNA, 19 nt, Human
cacugcacuccagcagagg

SEQ ID NO: 136507 - RNA, 20 nt, Human
cacugcacuccagcagaggc

SEQ ID NO: 136508 - RNA, 22 nt, Human
cagcaacaugcuagaaaauccu

SEQ ID NO: 136509 - RNA, 21 nt, Human
cagcagaggcuagaggaaugc

SEQ ID NO: 136510 - RNA, 18 nt, Human
ccucacugcacuccagca

SEQ ID NO: 136511 - RNA, 25 nt, Human
ccucacugcacuccagcagaggcug

SEQ ID NO: 136512 - RNA, 21 nt, Human
ucacugcacuccagcagaggc

SEQ ID NO: 136513 - RNA, 23 nt, Human
uggacaggcuggagucagcucuu

SEQ ID NO: 136514 - RNA, 23 nt, Human
aaccacagccacccugaccuuuc

SEQ ID NO: 136515 - RNA, 21 nt, Human
agcacuguuucucccaggaag

SEQ ID NO: 136516 - RNA, 18 nt, Human
agcagaaucugucuucca

SEQ ID NO: 136517 - RNA, 22 nt, Human
agcgacggggacgcggccagga

SEQ ID NO: 136518 - RNA, 21 nt, Human
aggcggaggagaggcgagaga

SEQ ID NO: 136519 - RNA, 22 nt, Human
aucucaucuuuuccucucuuua

SEQ ID NO: 136520 - RNA, 20 nt, Human
auuccuucagcucagccuca

SEQ ID NO: 136521 - RNA, 25 nt, Human
caccugucccucuaggcagccucca

SEQ ID NO: 136522 - RNA, 22 nt, Human
cagcagaaucugucuuccaguu

SEQ ID NO: 136523 - RNA, 23 nt, Human
cagcucagccucaccuuaggcac

SEQ ID NO: 136524 - RNA, 21 nt, Human
caggaaguucccagaggcgga

SEQ ID NO: 136525 - RNA, 21 nt, Human
caggguaauuuugaauccauu

SEQ ID NO: 136526 - RNA, 24 nt, Human
caucuuuuccucucuuuaugcucc

SEQ ID NO: 136527 - RNA, 21 nt, Human
cauuccuucagcucagccuca

SEQ ID NO: 136528 - RNA, 19 nt, Human
ccaaccacagccacccuga

SEQ ID NO: 136529 - RNA, 21 nt, Human
ccgugggaagaauaaccuucc

SEQ ID NO: 136530 - RNA, 27 nt, Human
ccucuaggcagccuccaagcccagcuu

SEQ ID NO: 136531 - RNA, 19 nt, Human
ccugucccucuaggcagcc

SEQ ID NO: 136532 - RNA, 18 nt, Human
cggcagcagucugcuugg

SEQ ID NO: 136533 - RNA, 18 nt, Human
cucagccucaccuuaggc

SEQ ID NO: 136534 - RNA, 22 nt, Human
cucccaggaaguucccagaggc

SEQ ID NO: 136535 - RNA, 18 nt, Human
cucgguggcucugcagga

SEQ ID NO: 136536 - RNA, 18 nt, Human
cucgguggcucugcagga

SEQ ID NO: 136537 - RNA, 21 nt, Human
cucuccaaguucccuagagga

SEQ ID NO: 136538 - RNA, 23 nt, Human
cuuugcccuuguacagccuuugg

SEQ ID NO: 136539 - RNA, 20 nt, Human
gcagccuccaagcccagcuu

SEQ ID NO: 136540 - RNA, 18 nt, Human
gcuggaguggggugcugg

SEQ ID NO: 136541 - RNA, 18 nt, Human
ggugcugguauccaagug

SEQ ID NO: 136542 - RNA, 24 nt, Human
guugauuuucacuucagucaccuu

SEQ ID NO: 136543 - RNA, 24 nt, Human
uaggcagccuccaagcccagcuuu

SEQ ID NO: 136544 - RNA, 18 nt, Human
uagugcucucgggccucg

SEQ ID NO: 136545 - RNA, 18 nt, Human
ucccucuaggcagccucc

SEQ ID NO: 136546 - RNA, 21 nt, Human
ucuaagugucuguggugaccc

SEQ ID NO: 136547 - RNA, 22 nt, Human
ugaggcccuggcagcugcuggc

SEQ ID NO: 136548 - RNA, 18 nt, Human
ugcuuggugaucucuagg

SEQ ID NO: 136549 - RNA, 19 nt, Human
uggcagacuguguaaaagc

SEQ ID NO: 136550 - RNA, 20 nt, Human
uguaaaaccauggcagacug

SEQ ID NO: 136551 - RNA, 21 nt, Human
uguaaaaccauggcagacugu

SEQ ID NO: 136552 - RNA, 22 nt, Human
uguaaaagcuuccucgaggcug

SEQ ID NO: 136553 - RNA, 22 nt, Human
uucacccaccugucccucuagg

SEQ ID NO: 136554 - RNA, 19 nt, Human
uucagcucagccucaccuu

SEQ ID NO: 136555 - RNA, 21 nt, Human
uuggugaucucuagguuuucc

SEQ ID NO: 136556 - RNA, 21 nt, Human
uuucucccaggaaguucccag

SEQ ID NO: 136557 - RNA, 22 nt, Human
uuuucucgguggcucugcagga

SEQ ID NO: 136558 - RNA, 20 nt, Human
uuuuuuuuuuuuuuuuuugg

SEQ ID NO: 136559 - RNA, 21 nt, Human
aacaagaagggaagaugcugg

SEQ ID NO: 136560 - RNA, 23 nt, Human
aagaugcugggaccugaucagga

SEQ ID NO: 136561 - RNA, 21 nt, Human
aaggugcugggaccuuaagga

SEQ ID NO: 136562 - RNA, 18 nt, Human
acaagaaaucuggacucu

SEQ ID NO: 136563 - RNA, 25 nt, Human
accuuaaggaacagaacaagaaggg

SEQ ID NO: 136564 - RNA, 21 nt, Human
agaugcugggaccugaucagg

SEQ ID NO: 136565 - RNA, 19 nt, Human
aggaacagaacaagaaggg

SEQ ID NO: 136566 - RNA, 21 nt, Human
aggcugggcuggguaccaggg

SEQ ID NO: 136567 - RNA, 19 nt, Human
ccugggguaaggugcuggg

SEQ ID NO: 136568 - RNA, 18 nt, Human
gaacagaacaagaaggga

SEQ ID NO: 136569 - RNA, 20 nt, Human
gcugggugcuaaggcugggc

SEQ ID NO: 136570 - RNA, 20 nt, Human
ggacagagacugaggccagc

SEQ ID NO: 136571 - RNA, 20 nt, Human
ggcugggcuggguaccaggg

SEQ ID NO: 136572 - RNA, 23 nt, Human
ggucacaugcugggagucaugga

SEQ ID NO: 136573 - RNA, 20 nt, Human
uaccagggucaagcccuagg

SEQ ID NO: 136574 - RNA, 21 nt, Human
ucaaccccuggagagccuaca

SEQ ID NO: 136575 - RNA, 23 nt, Human
ucaagcgaugggacagagacuga

SEQ ID NO: 136576 - RNA, 21 nt, Human
uccacuucaguuaccagucgc

SEQ ID NO: 136577 - RNA, 23 nt, Human
ucuuuagggacagccgucguugu

SEQ ID NO: 136578 - RNA, 18 nt, Human
ugugcaaaguuagagggg

SEQ ID NO: 136579 - RNA, 18 nt, Human
uuuuuuuuuuuuuuuuug

SEQ ID NO: 136580 - RNA, 20 nt, Human
uuuuuuuuuuuuuuuuuugu

SEQ ID NO: 136581 - RNA, 19 nt, Human
aagcaagggguggugggga

SEQ ID NO: 136582 - RNA, 21 nt, Human
aagcaaggggugguggggaga

SEQ ID NO: 136583 - RNA, 18 nt, Human
aaggucuucccgaggccc

SEQ ID NO: 136584 - RNA, 21 nt, Human
agcucgucccgcccguccccu

SEQ ID NO: 136585 - RNA, 25 nt, Human
agggaggguguggggugaccuucgg

SEQ ID NO: 136586 - RNA, 18 nt, Human
aggggugguggggagauc

SEQ ID NO: 136587 - RNA, 23 nt, Human
aggggugguggggagauccuagg

SEQ ID NO: 136588 - RNA, 23 nt, Human
caacuguaaucccagcacauugg

SEQ ID NO: 136589 - RNA, 24 nt, Human
caacuguaaucccagcacauuggg

SEQ ID NO: 136590 - RNA, 19 nt, Human
cagcagaacagccaagcuc

SEQ ID NO: 136591 - RNA, 21 nt, Human
caggugcagcagaacagccaa

SEQ ID NO: 136592 - RNA, 23 nt, Human
ccaccggccccuucccuaucucc

SEQ ID NO: 136593 - RNA, 20 nt, Human
ccggccccuucccuaucucc

SEQ ID NO: 136594 - RNA, 19 nt, Human
ccucccacauacuuggagg

SEQ ID NO: 136595 - RNA, 22 nt, Human
cgcauuaaaaaaaaauccugag

SEQ ID NO: 136596 - RNA, 24 nt, Human
cggcugcuggggggcagagggagg

SEQ ID NO: 136597 - RNA, 21 nt, Human
cgucccgcccguccccuccca

SEQ ID NO: 136598 - RNA, 20 nt, Human
cuauaugcuaagcauuaccc

SEQ ID NO: 136599 - RNA, 19 nt, Human
cuccacagguccugccagg

SEQ ID NO: 136600 - RNA, 22 nt, Human
cuggggggcagagggagggugu

SEQ ID NO: 136601 - RNA, 19 nt, Human
cugguuggggcaggaagca

SEQ ID NO: 136602 - RNA, 21 nt, Human
gaaacccuuccccacuccuga

SEQ ID NO: 136603 - RNA, 19 nt, Human
gaaggucuucccgaggccc

SEQ ID NO: 136604 - RNA, 20 nt, Human
gccaggacagcuccagguuc

SEQ ID NO: 136605 - RNA, 23 nt, Human
ggaaaggaaggcacacagggaua

SEQ ID NO: 136606 - RNA, 20 nt, Human
ggcagagggagggugugggg

SEQ ID NO: 136607 - RNA, 18 nt, Human
gggaggguguggggugag

SEQ ID NO: 136608 - RNA, 18 nt, Human
guccagaagcugcauccg

SEQ ID NO: 136609 - RNA, 18 nt, Human
uaggauaacagaaagcau

SEQ ID NO: 136610 - RNA, 23 nt, Human
ucaggugcagcagaacagccaag

SEQ ID NO: 136611 - RNA, 19 nt, Human
uccaaauggucagggagcu

SEQ ID NO: 136612 - RNA, 18 nt, Human
ucccgcccguccccuccc

SEQ ID NO: 136613 - RNA, 21 nt, Human
ucgaucauggaggagaaaccc

SEQ ID NO: 136614 - RNA, 19 nt, Human
ugacaacuguaaucccagc

SEQ ID NO: 136615 - RNA, 19 nt, Human
ugccaggacagcuccaggu

SEQ ID NO: 136616 - RNA, 18 nt, Human
uggggcaggaagcaaggg

SEQ ID NO: 136617 - RNA, 21 nt, Human
uggggggcagagggagggugu

SEQ ID NO: 136618 - RNA, 24 nt, Human
ugguugagggucaagaggugggaa

SEQ ID NO: 136619 - RNA, 24 nt, Human
uuucuguuccugauuuguaggugg

SEQ ID NO: 136620 - RNA, 24 nt, Human
uuuuuggcauuguuacgauucauu

SEQ ID NO: 136621 - RNA, 18 nt, Human
uuuuuuuuuuuuuuuuug

SEQ ID NO: 136622 - RNA, 18 nt, Human
uuuuuuuuuuuuuuuuug

SEQ ID NO: 136623 - RNA, 24 nt, Human
uuuuuuuuuuuuuuuuuggcauug

SEQ ID NO: 136624 - RNA, 22 nt, Human
uuuuuuuuuuuuuuuuuuuggc

SEQ ID NO: 136625 - RNA, 21 nt, Human
aaagcccucccugggcccucc

SEQ ID NO: 136626 - RNA, 26 nt, Human
aaagcccucccugggcccucccaccc

SEQ ID NO: 136627 - RNA, 26 nt, Human
aaaggucccuggucaguccuugggga

SEQ ID NO: 136628 - RNA, 24 nt, Human
aagagaagacagaauucuccagga

SEQ ID NO: 136629 - RNA, 26 nt, Human
aagagaagacagaauucuccaggaga

SEQ ID NO: 136630 - RNA, 25 nt, Human
aagcccucccugggcccucccaccc

SEQ ID NO: 136631 - RNA, 21 nt, Human
aaggaggaguguacagggucu

SEQ ID NO: 136632 - RNA, 21 nt, Human
acagggucugggaaucaagac

SEQ ID NO: 136633 - RNA, 24 nt, Human
acccccuccugcggcccgccgacc

SEQ ID NO: 136634 - RNA, 18 nt, Human
acccgcugucgccguccc

SEQ ID NO: 136635 - RNA, 21 nt, Human
acugguaagccccacgugugc

SEQ ID NO: 136636 - RNA, 22 nt, Human
agaagcccaaagacacagaggg

SEQ ID NO: 136637 - RNA, 22 nt, Human
agacacagagggaucaagucca

SEQ ID NO: 136638 - RNA, 24 nt, Human
agagaagacagaauucuccaggag

SEQ ID NO: 136639 - RNA, 24 nt, Human
agagagcacuggcugccggggaca

SEQ ID NO: 136640 - RNA, 21 nt, Human
agcaaagacccuuuuaucaaa

SEQ ID NO: 136641 - RNA, 20 nt, Human
aggaggaguguacagggucu

SEQ ID NO: 136642 - RNA, 21 nt, Human
agguccagaaauccuugagcu

SEQ ID NO: 136643 - RNA, 20 nt, Human
aucaaguccaucugcugguc

SEQ ID NO: 136644 - RNA, 23 nt, Human
auuuguuccaacuccccuucccu

SEQ ID NO: 136645 - RNA, 21 nt, Human
cagaucccuuugaaagagucc

SEQ ID NO: 136646 - RNA, 24 nt, Human
cagguugacauuaucuaccagcca

SEQ ID NO: 136647 - RNA, 22 nt, Human
caguggcaacuuacaaugaguc

SEQ ID NO: 136648 - RNA, 24 nt, Human
ccaacuccccuucccuccccaaga

SEQ ID NO: 136649 - RNA, 20 nt, Human
cccgggagggcugccagacc

SEQ ID NO: 136650 - RNA, 20 nt, Human
ccuauagcucgaaaaaccac

SEQ ID NO: 136651 - RNA, 19 nt, Human
ccugggcccucccacccuc

SEQ ID NO: 136652 - RNA, 22 nt, Human
cucaauuugagauggccaaaga

SEQ ID NO: 136653 - RNA, 22 nt, Human
cugaucacacaacagaaaagga

SEQ ID NO: 136654 - RNA, 21 nt, Human
cuggacuggccuccagggaac

SEQ ID NO: 136655 - RNA, 22 nt, Human
cugugcaaaauucaaaaggauc

SEQ ID NO: 136656 - RNA, 21 nt, Human
cuugcugaggccaggcuccca

SEQ ID NO: 136657 - RNA, 19 nt, Human
gaaaggucccuggucaguc

SEQ ID NO: 136658 - RNA, 19 nt, Human
gaugcccuauagcucgaaa

SEQ ID NO: 136659 - RNA, 21 nt, Human
gccccacgugugccaagauug

SEQ ID NO: 136660 - RNA, 21 nt, Human
gccccuugcugaggccaggcu

SEQ ID NO: 136661 - RNA, 21 nt, Human
gcccuauagcucgaaaaacca

SEQ ID NO: 136662 - RNA, 24 nt, Human
gcuccuguaaucagaagcaaagac

SEQ ID NO: 136663 - RNA, 23 nt, Human
ggacauucagcuucacuggagcc

SEQ ID NO: 136664 - RNA, 21 nt, Human
ggagccagaggucaggaaggc

SEQ ID NO: 136665 - RNA, 24 nt, Human
ggccagggacuggagguggaugug

SEQ ID NO: 136666 - RNA, 18 nt, Human
uaaaggucugagcacugg

SEQ ID NO: 136667 - RNA, 23 nt, Human
uaccugggccacugguaagcccc

SEQ ID NO: 136668 - RNA, 23 nt, Human
ucaaaaggaucagaucccuuuga

SEQ ID NO: 136669 - RNA, 25 nt, Human
uccaacuccccuucccuccccaaga

SEQ ID NO: 136670 - RNA, 21 nt, Human
uccaugaaacaaaaaauuacc

SEQ ID NO: 136671 - RNA, 21 nt, Human
ucccugggcccucccacccuc

SEQ ID NO: 136672 - RNA, 22 nt, Human
ucucauguuggcaguggcaacu

SEQ ID NO: 136673 - RNA, 23 nt, Human
ucucauguuggcaguggcaacuu

SEQ ID NO: 136674 - RNA, 19 nt, Human
ugagauggccaaagagaaa

SEQ ID NO: 136675 - RNA, 21 nt, Human
ugagcacuggacuggccucca

SEQ ID NO: 136676 - RNA, 18 nt, Human
ugcuggucugccucucac

SEQ ID NO: 136677 - RNA, 18 nt, Human
ugcuuguggacgccaacc

SEQ ID NO: 136678 - RNA, 26 nt, Human
uggaaaacauucagcaguacgaaagc

SEQ ID NO: 136679 - RNA, 21 nt, Human
uggcaguggcaacuuacaaug

SEQ ID NO: 136680 - RNA, 24 nt, Human
uggcugccggggacagguuuugag

SEQ ID NO: 136681 - RNA, 20 nt, Human
uguacaccaacuauacaugg

SEQ ID NO: 136682 - RNA, 23 nt, Human
ugugggcccaucccgggagggcu

SEQ ID NO: 136683 - RNA, 24 nt, Human
uuguggacgccaaccaggcaguuc

SEQ ID NO: 136684 - RNA, 21 nt, Human
uuugagauggccaaagagaag

SEQ ID NO: 136685 - RNA, 24 nt, Human
aaacacauaaauccauacuaagac

SEQ ID NO: 136686 - RNA, 20 nt, Human
aaacuacacacacacaaaca

SEQ ID NO: 136687 - RNA, 24 nt, Human
aaagaaauaugaaaaagcuaugua

SEQ ID NO: 136688 - RNA, 24 nt, Human
aaaucauuuuuaggcuggaaccaa

SEQ ID NO: 136689 - RNA, 28 nt, Human
aacaacuaagaaagaaauaugaaaaagc

SEQ ID NO: 136690 - RNA, 23 nt, Human
aagaaauaagucuauccgaaaac

SEQ ID NO: 136691 - RNA, 18 nt, Human
aagagugccaacaacuaa

SEQ ID NO: 136692 - RNA, 22 nt, Human
aagauaaugaggaagagucaac

SEQ ID NO: 136693 - RNA, 25 nt, Human
acacacacacaaacacauaaaucca

SEQ ID NO: 136694 - RNA, 22 nt, Human
acuacacacacacaaacacaua

SEQ ID NO: 136695 - RNA, 25 nt, Human
agagaaggaugguaagaaugcagua

SEQ ID NO: 136696 - RNA, 21 nt, Human
agcuaucaaaauuugugagag

SEQ ID NO: 136697 - RNA, 24 nt, Human
aggaaacaaauacaacaaaauuau

SEQ ID NO: 136698 - RNA, 25 nt, Human
aggaaacaaauacaacaaaauuaua

SEQ ID NO: 136699 - RNA, 21 nt, Human
aggcuggaaccaaacacauaa

SEQ ID NO: 136700 - RNA, 24 nt, Human
auaaaacaacaacgaauaucaggu

SEQ ID NO: 136701 - RNA, 22 nt, Human
caaaacuaguagauauaacuuc

SEQ ID NO: 136702 - RNA, 22 nt, Human
caaaagcacacauuucucagga

SEQ ID NO: 136703 - RNA, 24 nt, Human
cacaauuuaaaucuacaauuaacu

SEQ ID NO: 136704 - RNA, 18 nt, Human
ccauacuaagaccuaaga

SEQ ID NO: 136705 - RNA, 19 nt, Human
ccauaggauuaauacucau

SEQ ID NO: 136706 - RNA, 19 nt, Human
ccccaguucuacuguagaa

SEQ ID NO: 136707 - RNA, 23 nt, Human
cccggccccucaccgcggccucc

SEQ ID NO: 136708 - RNA, 24 nt, Human
cccuccgacuacugcugcuccucc

SEQ ID NO: 136709 - RNA, 22 nt, Human
ccuaggaaacaaauacaacaaa

SEQ ID NO: 136710 - RNA, 24 nt, Human
ccuccgacuacugcugcuccucca

SEQ ID NO: 136711 - RNA, 19 nt, Human
cgaccuagcgcuccuccuu

SEQ ID NO: 136712 - RNA, 21 nt, Human
cgccggcgcccaguccccucu

SEQ ID NO: 136713 - RNA, 21 nt, Human
cggcgcccaguccccucucag

SEQ ID NO: 136714 - RNA, 18 nt, Human
cucaccgcggccucccgg

SEQ ID NO: 136715 - RNA, 25 nt, Human
cucccggagcuggcacgcacccuaa

SEQ ID NO: 136716 - RNA, 21 nt, Human
cuccgacuacugcugcuccuc

SEQ ID NO: 136717 - RNA, 18 nt, Human
cucgggucggcagcuugg

SEQ ID NO: 136718 - RNA, 21 nt, Human
cucuuggcaauauuucguuaa

SEQ ID NO: 136719 - RNA, 18 nt, Human
cugcuccuccacagagcu

SEQ ID NO: 136720 - RNA, 20 nt, Human
cugcugcuccuccacagagc

SEQ ID NO: 136721 - RNA, 22 nt, Human
gaccuagcgcuccuccuucccc

SEQ ID NO: 136722 - RNA, 21 nt, Human
gagaaaaagcacuaggcaaaa

SEQ ID NO: 136723 - RNA, 19 nt, Human
gaggaaagaacuggcagca

SEQ ID NO: 136724 - RNA, 22 nt, Human
ggaaccaaacacauaacaaucu

SEQ ID NO: 136725 - RNA, 19 nt, Human
gguaaacucaauauuuucu

SEQ ID NO: 136726 - RNA, 19 nt, Human
guuuaaagugaaaucaugc

SEQ ID NO: 136727 - RNA, 26 nt, Human
uaaacuacacacacacaaacacauaa

SEQ ID NO: 136728 - RNA, 25 nt, Human
uaaguuuucaacuuuuuuccagccu

SEQ ID NO: 136729 - RNA, 18 nt, Human
uacaauguuguaugagac

SEQ ID NO: 136730 - RNA, 19 nt, Human
uacaauguuguaugagaca

SEQ ID NO: 136731 - RNA, 20 nt, Human
uacacacacacaaacacaua

SEQ ID NO: 136732 - RNA, 26 nt, Human
uacacacacacaaacacauaaaucca

SEQ ID NO: 136733 - RNA, 24 nt, Human
uacuguagaaaggcacagcgcugu

SEQ ID NO: 136734 - RNA, 23 nt, Human
uagaaaggcacagcgcuguggua

SEQ ID NO: 136735 - RNA, 19 nt, Human
uaguucacagaaaauuguu

SEQ ID NO: 136736 - RNA, 23 nt, Human
uauauuucucucacauacaaugu

SEQ ID NO: 136737 - RNA, 24 nt, Human
uaucaaaccauuccuuucucaacc

SEQ ID NO: 136738 - RNA, 21 nt, Human
uauccgaaaacaaaagcacac

SEQ ID NO: 136739 - RNA, 21 nt, Human
uaugaaaaagcuauguaagua

SEQ ID NO: 136740 - RNA, 19 nt, Human
uauuagugagcccaagggc

SEQ ID NO: 136741 - RNA, 24 nt, Human
uauuagugagcccaagggcaggua

SEQ ID NO: 136742 - RNA, 23 nt, Human
uccacagagcugaggcgcuggcg

SEQ ID NO: 136743 - RNA, 24 nt, Human
ucccauagcuuauaugcccucuau

SEQ ID NO: 136744 - RNA, 20 nt, Human
uccuuuaccccaguucuacu

SEQ ID NO: 136745 - RNA, 19 nt, Human
ucucaaccuuucaguagca

SEQ ID NO: 136746 - RNA, 19 nt, Human
ucugcaacgcaagucacag

SEQ ID NO: 136747 - RNA, 20 nt, Human
ugaaaucaugcacuugucaa

SEQ ID NO: 136748 - RNA, 21 nt, Human
ugaauuugucaaaaaaaaaaa

SEQ ID NO: 136749 - RNA, 21 nt, Human
ugacaaacaaaauccuaucag

SEQ ID NO: 136750 - RNA, 19 nt, Human
ugagagagaggauaaacua

SEQ ID NO: 136751 - RNA, 21 nt, Human
ugagagagaggauaaacuaca

SEQ ID NO: 136752 - RNA, 20 nt, Human
ugauuaagaaauacagcuuu

SEQ ID NO: 136753 - RNA, 24 nt, Human
uggaaaagugcagaacuaaagaaa

SEQ ID NO: 136754 - RNA, 22 nt, Human
uggcacgcacccuaaucucggu

SEQ ID NO: 136755 - RNA, 19 nt, Human
ugugaucagcauauguccc

SEQ ID NO: 136756 - RNA, 20 nt, Human
uguggaaaagugcagaacua

SEQ ID NO: 136757 - RNA, 20 nt, Human
uuacugaaugacucaauuau

SEQ ID NO: 136758 - RNA, 19 nt, Human
uucaacacuacaaaaucau

SEQ ID NO: 136759 - RNA, 22 nt, Human
uucaguagcaauuaaccaagaa

SEQ ID NO: 136760 - RNA, 25 nt, Human
uugaauuugucaaaaaaaaaaaacc

SEQ ID NO: 136761 - RNA, 21 nt, Human
uugcacagaaauuacuggcug

SEQ ID NO: 136762 - RNA, 20 nt, Human
uugucaaaaaaaaaaaaccc

SEQ ID NO: 136763 - RNA, 25 nt, Human
uuuacaaacagaaugagguaucagu

SEQ ID NO: 136764 - RNA, 20 nt, Human
uuucuugguaauaauacugg

SEQ ID NO: 136765 - RNA, 19 nt, Human
uuugaauuaguaaagguuu

SEQ ID NO: 136766 - RNA, 18 nt, Human
aacacaguaaauaacucc

SEQ ID NO: 136767 - RNA, 22 nt, Human
aacccagcagcugcccugucca

SEQ ID NO: 136768 - RNA, 22 nt, Human
acaaagggcuuaugaugauuuu

SEQ ID NO: 136769 - RNA, 19 nt, Human
agcaacccagcagcugccc

SEQ ID NO: 136770 - RNA, 19 nt, Human
agcaacccagcagcugccc

SEQ ID NO: 136771 - RNA, 23 nt, Human
aggaacacaguaaauaacuccca

SEQ ID NO: 136772 - RNA, 22 nt, Human
aguagcaacccagcagcugccc

SEQ ID NO: 136773 - RNA, 19 nt, Human
cagcagcugcccuguccag

SEQ ID NO: 136774 - RNA, 20 nt, Human
cagcagcugcccuguccagu

SEQ ID NO: 136775 - RNA, 18 nt, Human
gaguagcaacccagcagc

SEQ ID NO: 136776 - RNA, 21 nt, Human
guagcaacccagcagcugccc

SEQ ID NO: 136777 - RNA, 23 nt, Human
ucccaagugucuuguuggaaauu

SEQ ID NO: 136778 - RNA, 27 nt, Human
aagaggccaaagccacauccaaaggug

SEQ ID NO: 136779 - RNA, 24 nt, Human
aagcaguggugggggccugcagca

SEQ ID NO: 136780 - RNA, 26 nt, Human
acaaagaggccaaagccacauccaaa

SEQ ID NO: 136781 - RNA, 21 nt, Human
acaaggccaaagguuccuauc

SEQ ID NO: 136782 - RNA, 30 nt, Human
acccgaguguguguugggcuuuuuuucugg

SEQ ID NO: 136783 - RNA, 20 nt, Human
agacagggucucacacugug

SEQ ID NO: 136784 - RNA, 23 nt, Human
agagaugacgagaaugcugucaa

SEQ ID NO: 136785 - RNA, 19 nt, Human
agccuccugaguagcuaag

SEQ ID NO: 136786 - RNA, 18 nt, Human
agcgccguggggacagga

SEQ ID NO: 136787 - RNA, 18 nt, Human
agcuaaaggccaggccuc

SEQ ID NO: 136788 - RNA, 20 nt, Human
aggcagcugugaccuucccu

SEQ ID NO: 136789 - RNA, 20 nt, Human
aggcagugcgugucugggag

SEQ ID NO: 136790 - RNA, 29 nt, Human
aggcagugcgugucugggagucgagggcg

SEQ ID NO: 136791 - RNA, 23 nt, Human
aggcccaggggaucccgagugac

SEQ ID NO: 136792 - RNA, 19 nt, Human
aggcuggagugcaguggca

SEQ ID NO: 136793 - RNA, 20 nt, Human
agguaugugcgggagggugg

SEQ ID NO: 136794 - RNA, 20 nt, Human
agugaccaggucacaagggc

SEQ ID NO: 136795 - RNA, 20 nt, Human
agugcaguggcacaaucaug

SEQ ID NO: 136796 - RNA, 23 nt, Human
agugcaguggcacaaucauggcu

SEQ ID NO: 136797 - RNA, 18 nt, Human
agugcgugucugggaguu

SEQ ID NO: 136798 - RNA, 20 nt, Human
auccaaaggugcaaauggag

SEQ ID NO: 136799 - RNA, 24 nt, Human
caaagcccaccccaauugccagcc

SEQ ID NO: 136800 - RNA, 25 nt, Human
caaagcccaccccaauugccagcca

SEQ ID NO: 136801 - RNA, 21 nt, Human
caaaugugagccgucaccuga

SEQ ID NO: 136802 - RNA, 18 nt, Human
caaccgccagggcucaga

SEQ ID NO: 136803 - RNA, 22 nt, Human
caaccgccagggcucagauaau

SEQ ID NO: 136804 - RNA, 18 nt, Human
caacucugcaggaggcug

SEQ ID NO: 136805 - RNA, 20 nt, Human
caccugagagugcagaaaac

SEQ ID NO: 136806 - RNA, 23 nt, Human
cacuguguugccaaggcuggagu

SEQ ID NO: 136807 - RNA, 22 nt, Human
cacuuuggacaaagaggccaaa

SEQ ID NO: 136808 - RNA, 23 nt, Human
cagcagcuaaaggccaggccuca

SEQ ID NO: 136809 - RNA, 20 nt, Human
cagccuccugaguagcuaag

SEQ ID NO: 136810 - RNA, 26 nt, Human
caggauagggcagggaugggccaggu

SEQ ID NO: 136811 - RNA, 21 nt, Human
caguggcacaaucauggcuca

SEQ ID NO: 136812 - RNA, 22 nt, Human
ccaaagccacauccaaaggugc

SEQ ID NO: 136813 - RNA, 24 nt, Human
ccaaagccacauccaaaggugcaa

SEQ ID NO: 136814 - RNA, 23 nt, Human
cccaccccaauugccagccaagc

SEQ ID NO: 136815 - RNA, 18 nt, Human
cccccugguggcugacag

SEQ ID NO: 136816 - RNA, 18 nt, Human
ccucagagaugacgagaa

SEQ ID NO: 136817 - RNA, 22 nt, Human
ccucagccuccugaguagcuaa

SEQ ID NO: 136818 - RNA, 18 nt, Human
ccucccuccucagccucc

SEQ ID NO: 136819 - RNA, 24 nt, Human
ccucccuccucagccuccugagua

SEQ ID NO: 136820 - RNA, 23 nt, Human
ccuccucagccuccugaguagcu

SEQ ID NO: 136821 - RNA, 24 nt, Human
ccuguggcaggauggguccucucu

SEQ ID NO: 136822 - RNA, 19 nt, Human
cgagaaugcugucaagaau

SEQ ID NO: 136823 - RNA, 23 nt, Human
cggaacaagcaguggugggggcc

SEQ ID NO: 136824 - RNA, 22 nt, Human
cucccugucucuugucuggggg

SEQ ID NO: 136825 - RNA, 22 nt, Human
cugcaaagcccaccccaauugc

SEQ ID NO: 136826 - RNA, 19 nt, Human
cuguggcccaggacacgcc

SEQ ID NO: 136827 - RNA, 23 nt, Human
cuucaaggccuggcagugcugcu

SEQ ID NO: 136828 - RNA, 22 nt, Human
cuugagguagacaauaggcugg

SEQ ID NO: 136829 - RNA, 24 nt, Human
gacaggacagguggggccugcaaa

SEQ ID NO: 136830 - RNA, 22 nt, Human
gagcucggaacaagcaguggug

SEQ ID NO: 136831 - RNA, 20 nt, Human
gaggcugggggagcucggaa

SEQ ID NO: 136832 - RNA, 18 nt, Human
gaugacaauuuucuccuu

SEQ ID NO: 136833 - RNA, 23 nt, Human
gcaaagcccaccccaauugccag

SEQ ID NO: 136834 - RNA, 23 nt, Human
gcaguggugggggccugcagcac

SEQ ID NO: 136835 - RNA, 19 nt, Human
gcuggagugcaguggcaca

SEQ ID NO: 136836 - RNA, 18 nt, Human
ggcagggaugggccaggu

SEQ ID NO: 136837 - RNA, 22 nt, Human
gugggacugggcuccagucucc

SEQ ID NO: 136838 - RNA, 18 nt, Human
guggugggggccugcagc

SEQ ID NO: 136839 - RNA, 21 nt, Human
guguugccaaggcuggagugc

SEQ ID NO: 136840 - RNA, 22 nt, Human
uaauccucccuccucagccucc

SEQ ID NO: 136841 - RNA, 20 nt, Human
uccaaaggugcaaauggagc

SEQ ID NO: 136842 - RNA, 19 nt, Human
ucuaugaagaaaggucucu

SEQ ID NO: 136843 - RNA, 23 nt, Human
ucucacacuguguugccaaggcu

SEQ ID NO: 136844 - RNA, 24 nt, Human
ucucacacuguguugccaaggcug

SEQ ID NO: 136845 - RNA, 21 nt, Human
ucuguggcccaggacacgccu

SEQ ID NO: 136846 - RNA, 20 nt, Human
ucuugguucuuuuguuuugg

SEQ ID NO: 136847 - RNA, 22 nt, Human
ugagaugauggugauguccuca

SEQ ID NO: 136848 - RNA, 22 nt, Human
ugauggugauguccucagagau

SEQ ID NO: 136849 - RNA, 26 nt, Human
ugcagcaccagcgccguggcgccggc

SEQ ID NO: 136850 - RNA, 22 nt, Human
ugccaaggcuggagugcagugg

SEQ ID NO: 136851 - RNA, 24 nt, Human
ugccaaggcuggagugcaguggca

SEQ ID NO: 136852 - RNA, 22 nt, Human
ugcugcugggcuccggauccug

SEQ ID NO: 136853 - RNA, 20 nt, Human
uggacaaagaggccaaagcc

SEQ ID NO: 136854 - RNA, 21 nt, Human
uggagugcaguggcacaauca

SEQ ID NO: 136855 - RNA, 24 nt, Human
uggagugcaguggcacaaucaugg

SEQ ID NO: 136856 - RNA, 18 nt, Human
uggcacaaucauggcuca

SEQ ID NO: 136857 - RNA, 21 nt, Human
ugggcuccagucucccugucu

SEQ ID NO: 136858 - RNA, 23 nt, Human
ugggggccccaaggucacuuugg

SEQ ID NO: 136859 - RNA, 24 nt, Human
uguguugccaaggcuggagugcag

SEQ ID NO: 136860 - RNA, 20 nt, Human
uuccugcaguucaacuggug

SEQ ID NO: 136861 - RNA, 23 nt, Human
uucuugcugcuguaaaaacugcc

SEQ ID NO: 136862 - RNA, 23 nt, Human
uugagacagggucucacacugug

SEQ ID NO: 136863 - RNA, 21 nt, Human
uugguucuuuuguuuuggguu

SEQ ID NO: 136864 - RNA, 18 nt, Human
uuuuuucuggguccugug

SEQ ID NO: 136865 - RNA, 24 nt, Human
aaccaaagaacaagagccaaauca

SEQ ID NO: 136866 - RNA, 26 nt, Human
aaccaaagaacaagagccaaaucaaa

SEQ ID NO: 136867 - RNA, 19 nt, Human
accaaagaacaagagccaa

SEQ ID NO: 136868 - RNA, 23 nt, Human
accaaagaacaagagccaaauca

SEQ ID NO: 136869 - RNA, 22 nt, Human
acccagagcccacuuugucucc

SEQ ID NO: 136870 - RNA, 21 nt, Human
acgugguaauagaaggcugga

SEQ ID NO: 136871 - RNA, 19 nt, Human
agacccagggagcuggcag

SEQ ID NO: 136872 - RNA, 23 nt, Human
agagaggaggagacccagggagc

SEQ ID NO: 136873 - RNA, 22 nt, Human
agagcccacuuugucuccacuc

SEQ ID NO: 136874 - RNA, 23 nt, Human
agaggaggauggaagggaggggu

SEQ ID NO: 136875 - RNA, 24 nt, Human
agauguugccuugaccagccuugg

SEQ ID NO: 136876 - RNA, 24 nt, Human
agcacuuugggaggcugaggcggg

SEQ ID NO: 136877 - RNA, 23 nt, Human
agcaggagguggggcugaaucca

SEQ ID NO: 136878 - RNA, 22 nt, Human
agccaguguuuuuccugaccuc

SEQ ID NO: 136879 - RNA, 24 nt, Human
agccuguaccaacacagacuacag

SEQ ID NO: 136880 - RNA, 25 nt, Human
aggagacccagggagcuggcagucc

SEQ ID NO: 136881 - RNA, 21 nt, Human
aggagcuggaagucaugccuc

SEQ ID NO: 136882 - RNA, 22 nt, Human
aggaucugccccagagaggagg

SEQ ID NO: 136883 - RNA, 24 nt, Human
aggcacaagcccaaccaaagaaca

SEQ ID NO: 136884 - RNA, 22 nt, Human
aggcaggcagggguggacuaca

SEQ ID NO: 136885 - RNA, 22 nt, Human
aggcccuggggggguaggggga

SEQ ID NO: 136886 - RNA, 23 nt, Human
aggcggguggauacgaggucagg

SEQ ID NO: 136887 - RNA, 20 nt, Human
aggcugaggcggguggauac

SEQ ID NO: 136888 - RNA, 21 nt, Human
aggcugaggcggguggauacg

SEQ ID NO: 136889 - RNA, 19 nt, Human
augccuguaaucccagcac

SEQ ID NO: 136890 - RNA, 21 nt, Human
auggauucgacgugguaauag

SEQ ID NO: 136891 - RNA, 27 nt, Human
caagcccaaccaaagaacaagagccaa

SEQ ID NO: 136892 - RNA, 23 nt, Human
cacaagcccaaccaaagaacaag

SEQ ID NO: 136893 - RNA, 22 nt, Human
cacagacuacagcacccaggag

SEQ ID NO: 136894 - RNA, 20 nt, Human
cagaagagcagcuccugccu

SEQ ID NO: 136895 - RNA, 21 nt, Human
cagagcccacuuugucuccac

SEQ ID NO: 136896 - RNA, 24 nt, Human
cagcacuuugggaggcugaggcgg

SEQ ID NO: 136897 - RNA, 18 nt, Human
cagcucccggucuggguc

SEQ ID NO: 136898 - RNA, 22 nt, Human
caguaacuuuccuucuugucau

SEQ ID NO: 136899 - RNA, 19 nt, Human
cauuuugcuguguccugca

SEQ ID NO: 136900 - RNA, 20 nt, Human
ccacaauaaacauggcccau

SEQ ID NO: 136901 - RNA, 19 nt, Human
ccacuuugucuccacuccu

SEQ ID NO: 136902 - RNA, 25 nt, Human
ccagagcccacuuugucuccacucc

SEQ ID NO: 136903 - RNA, 23 nt, Human
ccaggcaugcagaagccuguacc

SEQ ID NO: 136904 - RNA, 21 nt, Human
cccaaccaaagaacaagagcc

SEQ ID NO: 136905 - RNA, 21 nt, Human
cccagagaggaggagacccag

SEQ ID NO: 136906 - RNA, 25 nt, Human
cccagccaguguuuuuccugaccuc

SEQ ID NO: 136907 - RNA, 19 nt, Human
ccccagagaggaggagacc

SEQ ID NO: 136908 - RNA, 21 nt, Human
ccccccagccccagggcugga

SEQ ID NO: 136909 - RNA, 20 nt, Human
ccccuaccccaacccagagc

SEQ ID NO: 136910 - RNA, 21 nt, Human
ccccuaccccaacccagagcc

SEQ ID NO: 136911 - RNA, 18 nt, Human
cccuggggggguaggggg

SEQ ID NO: 136912 - RNA, 20 nt, Human
ccuguaaucccagcacuuug

SEQ ID NO: 136913 - RNA, 22 nt, Human
ccuguaaucccagcacuuuggg

SEQ ID NO: 136914 - RNA, 20 nt, Human
cgcgauaccccagaagagca

SEQ ID NO: 136915 - RNA, 18 nt, Human
cuaaucuaggcacaagcc

SEQ ID NO: 136916 - RNA, 24 nt, Human
cucaugccuguaaucccagcacuu

SEQ ID NO: 136917 - RNA, 25 nt, Human
cuccuuguagcuauuggggcuuaau

SEQ ID NO: 136918 - RNA, 25 nt, Human
cugccucauccuuaaguggaucgcg

SEQ ID NO: 136919 - RNA, 18 nt, Human
cugguuucagggaaggag

SEQ ID NO: 136920 - RNA, 21 nt, Human
cuguaccaacacagacuacag

SEQ ID NO: 136921 - RNA, 18 nt, Human
cuuccccuaccccaaccc

SEQ ID NO: 136922 - RNA, 21 nt, Human
gaacccucccuuccccuaccc

SEQ ID NO: 136923 - RNA, 19 nt, Human
gaauagggcugugagucac

SEQ ID NO: 136924 - RNA, 23 nt, Human
gaggacugaggaucugccccaga

SEQ ID NO: 136925 - RNA, 23 nt, Human
gaggauggaagggagggguccgg

SEQ ID NO: 136926 - RNA, 20 nt, Human
gaggcugaggcggguggaua

SEQ ID NO: 136927 - RNA, 23 nt, Human
gcagauuuucuguguggagaugu

SEQ ID NO: 136928 - RNA, 22 nt, Human
gccuggggcaaggaggggcugg

SEQ ID NO: 136929 - RNA, 19 nt, Human
gcugggcgugguggcucau

SEQ ID NO: 136930 - RNA, 21 nt, Human
gcugggcgugguggcucaugc

SEQ ID NO: 136931 - RNA, 23 nt, Human
ggaagucaugccugaugccacga

SEQ ID NO: 136932 - RNA, 22 nt, Human
ggacaccuggguucacacagcu

SEQ ID NO: 136933 - RNA, 18 nt, Human
ggacgggggaggcugggg

SEQ ID NO: 136934 - RNA, 20 nt, Human
ggagacccagggagcuggca

SEQ ID NO: 136935 - RNA, 20 nt, Human
ggagaggaggauggaaggga

SEQ ID NO: 136936 - RNA, 21 nt, Human
ggagguggggcugaauccacu

SEQ ID NO: 136937 - RNA, 18 nt, Human
ggaucugccccagagagg

SEQ ID NO: 136938 - RNA, 25 nt, Human
ggccccuggcuuccucuccuaaucu

SEQ ID NO: 136939 - RNA, 19 nt, Human
ggcccuggggggguagggg

SEQ ID NO: 136940 - RNA, 23 nt, Human
ggcugggcgugguggcucaugcc

SEQ ID NO: 136941 - RNA, 21 nt, Human
ggcuggugccugagugagacc

SEQ ID NO: 136942 - RNA, 21 nt, Human
gggaaggaguuugauauagca

SEQ ID NO: 136943 - RNA, 18 nt, Human
gggcaaggaggggcuggu

SEQ ID NO: 136944 - RNA, 24 nt, Human
gggcgugguggcucaugccuguaa

SEQ ID NO: 136945 - RNA, 22 nt, Human
gggguccggcacgcugcuggca

SEQ ID NO: 136946 - RNA, 22 nt, Human
gguggauacgaggucaggcguu

SEQ ID NO: 136947 - RNA, 24 nt, Human
gguggcucaugccuguaaucccag

SEQ ID NO: 136948 - RNA, 21 nt, Human
gguucugagucccaguguggc

SEQ ID NO: 136949 - RNA, 23 nt, Human
guccugcagccccuuuccgggac

SEQ ID NO: 136950 - RNA, 20 nt, Human
uaacuggugcagauuuucug

SEQ ID NO: 136951 - RNA, 25 nt, Human
uaacuggugcagauuuucugugugg

SEQ ID NO: 136952 - RNA, 21 nt, Human
uaagucccaaaaggcagcagg

SEQ ID NO: 136953 - RNA, 19 nt, Human
uacagcacccaggaggugc

SEQ ID NO: 136954 - RNA, 21 nt, Human
uagcagauuaaccacccuccu

SEQ ID NO: 136955 - RNA, 21 nt, Human
uagcuauuggggcuuaauggu

SEQ ID NO: 136956 - RNA, 23 nt, Human
uaugggcugggcgugguggcuca

SEQ ID NO: 136957 - RNA, 25 nt, Human
uauuuuuuuuuuuaccuugggguga

SEQ ID NO: 136958 - RNA, 23 nt, Human
ucaccggauuauaaugagccaaa

SEQ ID NO: 136959 - RNA, 25 nt, Human
ucaugccugaugccacgagaccggg

SEQ ID NO: 136960 - RNA, 22 nt, Human
ucaugccuguaaucccagcacu

SEQ ID NO: 136961 - RNA, 19 nt, Human
ucccaaaaggcagcaggcc

SEQ ID NO: 136962 - RNA, 18 nt, Human
uccggcacgcugcuggca

SEQ ID NO: 136963 - RNA, 23 nt, Human
ucgccaggcccgucgcucagcuc

SEQ ID NO: 136964 - RNA, 19 nt, Human
ucugaacccucccuucccc

SEQ ID NO: 136965 - RNA, 22 nt, Human
ucuucugucccuguuguugggu

SEQ ID NO: 136966 - RNA, 20 nt, Human
ugaccucuguucuuuggaga

SEQ ID NO: 136967 - RNA, 23 nt, Human
ugaggcggguggauacgagguca

SEQ ID NO: 136968 - RNA, 19 nt, Human
ugcagggccccuggcuucc

SEQ ID NO: 136969 - RNA, 21 nt, Human
ugcagggccccuggcuuccuc

SEQ ID NO: 136970 - RNA, 19 nt, Human
ugccggggacaccccagga

SEQ ID NO: 136971 - RNA, 24 nt, Human
ugccugagugagaccccgagcuuc

SEQ ID NO: 136972 - RNA, 23 nt, Human
ugccuguaaucccagcacuuugg

SEQ ID NO: 136973 - RNA, 23 nt, Human
ugccuguaaucccagcacuuugg

SEQ ID NO: 136974 - RNA, 21 nt, Human
ugcuggggaaggcgcaggagc

SEQ ID NO: 136975 - RNA, 23 nt, Human
uggaagggagggguccggcacgc

SEQ ID NO: 136976 - RNA, 18 nt, Human
uggagacccaaagagagg

SEQ ID NO: 136977 - RNA, 23 nt, Human
uggagacccaaagagagggacag

SEQ ID NO: 136978 - RNA, 23 nt, Human
uggagaggaggauggaagggagg

SEQ ID NO: 136979 - RNA, 24 nt, Human
uggcucaugccuguaaucccagca

SEQ ID NO: 136980 - RNA, 20 nt, Human
ugggaggcugaggcgggugg

SEQ ID NO: 136981 - RNA, 22 nt, Human
ugggaggcugaggcggguggau

SEQ ID NO: 136982 - RNA, 21 nt, Human
ugggcugggcgugguggcuca

SEQ ID NO: 136983 - RNA, 23 nt, Human
uggguucugagucccaguguggc

SEQ ID NO: 136984 - RNA, 24 nt, Human
ugguggcucaugccuguaauccca

SEQ ID NO: 136985 - RNA, 19 nt, Human
ugugagcaggagguggggc

SEQ ID NO: 136986 - RNA, 22 nt, Human
ugugagucacucaagccugggg

SEQ ID NO: 136987 - RNA, 19 nt, Human
uuagguuuuuaauuaccuu

SEQ ID NO: 136988 - RNA, 21 nt, Human
uugcuggggaaggcgcaggag

SEQ ID NO: 136989 - RNA, 27 nt, Human
uuuccugaccucuguucuuuggagagg

SEQ ID NO: 136990 - RNA, 22 nt, Human
uuuccuggugauucuuacccau

SEQ ID NO: 136991 - RNA, 24 nt, Human
uuuuuuuuuuuuuuuuagguuuuu

SEQ ID NO: 136992 - RNA, 23 nt, Human
uuuuuuuuuuuuuuuuuuuuagg

SEQ ID NO: 136993 - RNA, 21 nt, Human
agagacauuuuauuuagaggc

SEQ ID NO: 136994 - RNA, 23 nt, Human
cucgaguuuuuuuuuuuuuuuuu

SEQ ID NO: 136995 - RNA, 19 nt, Human
cuggcuucaagacucugug

SEQ ID NO: 136996 - RNA, 20 nt, Human
gaguuuuuuuuuuuuuuuuu

SEQ ID NO: 136997 - RNA, 22 nt, Human
gaguuuuuuuuuuuuuuuuuuu

SEQ ID NO: 136998 - RNA, 21 nt, Human
ugagaagacagcagugcuugg

SEQ ID NO: 136999 - RNA, 19 nt, Human
ugcucuggcuucaagacuc

SEQ ID NO: 137000 - RNA, 20 nt, Human
uuuuuuuuuuuuuuuuuguu

SEQ ID NO: 137001 - RNA, 27 nt, Human
uuuuuuuuuuuuuuuuuuuuuuugggg

SEQ ID NO: 137002 - RNA, 20 nt, Human
aaacagagucuugcuaugug

SEQ ID NO: 137003 - RNA, 19 nt, Human
aaagugcugggauuacaua

SEQ ID NO: 137004 - RNA, 24 nt, Human
aaagugcugggauuacauacguga

SEQ ID NO: 137005 - RNA, 19 nt, Human
aaagugcugggguuacaga

SEQ ID NO: 137006 - RNA, 24 nt, Human
aaagugcugggguuacagauguga

SEQ ID NO: 137007 - RNA, 25 nt, Human
aaaucaaguccaaacugguuccuga

SEQ ID NO: 137008 - RNA, 20 nt, Human
aaccucugccucccgaguuc

SEQ ID NO: 137009 - RNA, 25 nt, Human
aagugauccucccuccuuggcuucc

SEQ ID NO: 137010 - RNA, 19 nt, Human
aagugcugggauuacauac

SEQ ID NO: 137011 - RNA, 26 nt, Human
aagugcugggauuacauacgugagcc

SEQ ID NO: 137012 - RNA, 26 nt, Human
aagugcugggguuacagaugugagcc

SEQ ID NO: 137013 - RNA, 21 nt, Human
acaggcauuuaucaccgugcc

SEQ ID NO: 137014 - RNA, 24 nt, Human
accauguuggccaggcuggucucg

SEQ ID NO: 137015 - RNA, 24 nt, Human
acccacccgucccccgcccccccu

SEQ ID NO: 137016 - RNA, 21 nt, Human
acgugagccacugcaccuggc

SEQ ID NO: 137017 - RNA, 24 nt, Human
acuauguagcccaggcuggucucg

SEQ ID NO: 137018 - RNA, 24 nt, Human
agcccaggcuggucucgaauuccu

SEQ ID NO: 137019 - RNA, 24 nt, Human
agcgauucuccugccucagccucc

SEQ ID NO: 137020 - RNA, 18 nt, Human
aggcugaagugccguggu

SEQ ID NO: 137021 - RNA, 25 nt, Human
agugauccucccuccuuggcuuccc

SEQ ID NO: 137022 - RNA, 18 nt, Human
augggguuucaccauguu

SEQ ID NO: 137023 - RNA, 22 nt, Human
augggguuucaccauguuggcc

SEQ ID NO: 137024 - RNA, 24 nt, Human
augggguuucaccauguuggccag

SEQ ID NO: 137025 - RNA, 27 nt, Human
auucugucacccaggcugaagugccgu

SEQ ID NO: 137026 - RNA, 19 nt, Human
caaaaucaaguccaaacug

SEQ ID NO: 137027 - RNA, 20 nt, Human
caaaaucaaguccaaacugg

SEQ ID NO: 137028 - RNA, 22 nt, Human
caaacugguuccugagcccuua

SEQ ID NO: 137029 - RNA, 24 nt, Human
caaacugguuccugagcccuuaga

SEQ ID NO: 137030 - RNA, 24 nt, Human
caaagugcugggauuacauacgug

SEQ ID NO: 137031 - RNA, 24 nt, Human
caaagugcugggguuacagaugug

SEQ ID NO: 137032 - RNA, 22 nt, Human
caagcgauucuccugccucagc

SEQ ID NO: 137033 - RNA, 25 nt, Human
cacacaaucaaggucauacagcuag

SEQ ID NO: 137034 - RNA, 18 nt, Human
caccaugucuggcuaauu

SEQ ID NO: 137035 - RNA, 22 nt, Human
caccaugucuggcuaauuuuua

SEQ ID NO: 137036 - RNA, 21 nt, Human
caccauguuggccaggcuggu

SEQ ID NO: 137037 - RNA, 24 nt, Human
caccauguuggccaggcuggucuc

SEQ ID NO: 137038 - RNA, 27 nt, Human
caccauguuggccaggcuggucucgaa

SEQ ID NO: 137039 - RNA, 18 nt, Human
cacccacccgucccccgc

SEQ ID NO: 137040 - RNA, 20 nt, Human
cacccaggcugaagugccgu

SEQ ID NO: 137041 - RNA, 21 nt, Human
cacuauguagcccaggcuggu

SEQ ID NO: 137042 - RNA, 24 nt, Human
cacuauguagcccaggcuggucuc

SEQ ID NO: 137043 - RNA, 22 nt, Human
cacugcacccacccgucccccg

SEQ ID NO: 137044 - RNA, 24 nt, Human
cagagucuugcuaugugacccagg

SEQ ID NO: 137045 - RNA, 22 nt, Human
cagccucccgaggagcuaggac

SEQ ID NO: 137046 - RNA, 27 nt, Human
caguggcugggacuacaggcauuuauc

SEQ ID NO: 137047 - RNA, 24 nt, Human
caucucagccucccaaagugcugg

SEQ ID NO: 137048 - RNA, 24 nt, Human
cauguuggccaggcuggucucgaa

SEQ ID NO: 137049 - RNA, 24 nt, Human
cauucugucacccaggcugaagug

SEQ ID NO: 137050 - RNA, 20 nt, Human
ccaaagugcugggauuacau

SEQ ID NO: 137051 - RNA, 22 nt, Human
ccaaagugcugggauuacauac

SEQ ID NO: 137052 - RNA, 24 nt, Human
ccaaagugcugggauuacauacgu

SEQ ID NO: 137053 - RNA, 21 nt, Human
ccaaagugcugggguuacaga

SEQ ID NO: 137054 - RNA, 22 nt, Human
ccaaagugcugggguuacagau

SEQ ID NO: 137055 - RNA, 24 nt, Human
ccaaagugcugggguuacagaugu

SEQ ID NO: 137056 - RNA, 25 nt, Human
ccaauuuccauuuauuuacuccuca

SEQ ID NO: 137057 - RNA, 20 nt, Human
ccacagacgcgugccaccau

SEQ ID NO: 137058 - RNA, 23 nt, Human
ccacugcacccacccgucccccg

SEQ ID NO: 137059 - RNA, 22 nt, Human
ccacugcaccuggccauaaggg

SEQ ID NO: 137060 - RNA, 19 nt, Human
cccacccgucccccgcccc

SEQ ID NO: 137061 - RNA, 20 nt, Human
cccgaguucaagcgauucuc

SEQ ID NO: 137062 - RNA, 23 nt, Human
cccgaguucaagcgauucuccug

SEQ ID NO: 137063 - RNA, 26 nt, Human
cccgucccccgcccccccuuuuuuuu

SEQ ID NO: 137064 - RNA, 24 nt, Human
ccucccgaguucaagcgauucucc

SEQ ID NO: 137065 - RNA, 20 nt, Human
ccucccuccuuggcuuccca

SEQ ID NO: 137066 - RNA, 23 nt, Human
ccugaccucaagugaucugccca

SEQ ID NO: 137067 - RNA, 20 nt, Human
ccugaguucaagugauccuc

SEQ ID NO: 137068 - RNA, 22 nt, Human
ccuuuuuuuuugaaacagaguc

SEQ ID NO: 137069 - RNA, 18 nt, Human
cuaggaccacagacgcgu

SEQ ID NO: 137070 - RNA, 25 nt, Human
cucaugacaaccucugccucccgag

SEQ ID NO: 137071 - RNA, 23 nt, Human
cugccucagccucccgaggagcu

SEQ ID NO: 137072 - RNA, 21 nt, Human
cuggcaccuggcgccuuucac

SEQ ID NO: 137073 - RNA, 24 nt, Human
cuucaguggcugggacuacaggca

SEQ ID NO: 137074 - RNA, 19 nt, Human
cuuuuuuuuugaaacagag

SEQ ID NO: 137075 - RNA, 24 nt, Human
gaccucaagugaucugcccaucuc

SEQ ID NO: 137076 - RNA, 20 nt, Human
gacuacaggcauuuaucacc

SEQ ID NO: 137077 - RNA, 18 nt, Human
gauuacauacgugagcca

SEQ ID NO: 137078 - RNA, 23 nt, Human
gauuacauacgugagccacugca

SEQ ID NO: 137079 - RNA, 22 nt, Human
gccucccgaguucaagcgauuc

SEQ ID NO: 137080 - RNA, 24 nt, Human
gcgauucuccugccucagccuccc

SEQ ID NO: 137081 - RNA, 21 nt, Human
gcugggauuacauacgugagc

SEQ ID NO: 137082 - RNA, 23 nt, Human
gcuggucucgaacuccugaccuc

SEQ ID NO: 137083 - RNA, 20 nt, Human
gcuucaguggcugggacuac

SEQ ID NO: 137084 - RNA, 24 nt, Human
gcuucaguggcugggacuacaggc

SEQ ID NO: 137085 - RNA, 22 nt, Human
ggaccacagacgcgugccacca

SEQ ID NO: 137086 - RNA, 24 nt, Human
ggcuggucucgaacuccugaccuc

SEQ ID NO: 137087 - RNA, 19 nt, Human
gggaugaacugggauucaa

SEQ ID NO: 137088 - RNA, 22 nt, Human
gggguuucaccauguuggccag

SEQ ID NO: 137089 - RNA, 18 nt, Human
ggguuucaccauguuggc

SEQ ID NO: 137090 - RNA, 22 nt, Human
ggucauacagcuaggaagggga

SEQ ID NO: 137091 - RNA, 19 nt, Human
ggucucgaacuccugaccu

SEQ ID NO: 137092 - RNA, 22 nt, Human
gguuacagaugugagccacugc

SEQ ID NO: 137093 - RNA, 24 nt, Human
gugaucugcccaucucagccuccc

SEQ ID NO: 137094 - RNA, 20 nt, Human
guggcugggacuacaggcau

SEQ ID NO: 137095 - RNA, 23 nt, Human
guucacugugaccaugaucuccc

SEQ ID NO: 137096 - RNA, 21 nt, Human
uaaggcacacaaucaagguca

SEQ ID NO: 137097 - RNA, 24 nt, Human
uaauggauaugggguuucaccaug

SEQ ID NO: 137098 - RNA, 24 nt, Human
uacagaugugagccacugcaccca

SEQ ID NO: 137099 - RNA, 24 nt, Human
uacauacgugagccacugcaccug

SEQ ID NO: 137100 - RNA, 22 nt, Human
uagagauguggucucacuaugu

SEQ ID NO: 137101 - RNA, 24 nt, Human
uaggaccacagacgcgugccacca

SEQ ID NO: 137102 - RNA, 19 nt, Human
uaguagagauguggucuca

SEQ ID NO: 137103 - RNA, 20 nt, Human
uaguagagauguggucucaa

SEQ ID NO: 137104 - RNA, 24 nt, Human
uaguagagauguggucucacuaug

SEQ ID NO: 137105 - RNA, 21 nt, Human
uauguagcccaggcuggucuc

SEQ ID NO: 137106 - RNA, 23 nt, Human
uauguagcccaggcuggucucga

SEQ ID NO: 137107 - RNA, 24 nt, Human
uauguagcccaggcuggucucgaa

SEQ ID NO: 137108 - RNA, 20 nt, Human
ucaccaauuuccauuuauuu

SEQ ID NO: 137109 - RNA, 20 nt, Human
ucagccucccaaagugcugg

SEQ ID NO: 137110 - RNA, 20 nt, Human
ucaguggcugggacuacagg

SEQ ID NO: 137111 - RNA, 21 nt, Human
ucaguggcugggacuacaggc

SEQ ID NO: 137112 - RNA, 18 nt, Human
ucaugacaaccucugccu

SEQ ID NO: 137113 - RNA, 20 nt, Human
uccaggaaucugugucggga

SEQ ID NO: 137114 - RNA, 18 nt, Human
ucccaaagugcugggauu

SEQ ID NO: 137115 - RNA, 21 nt, Human
ucccaaagugcugggauuaca

SEQ ID NO: 137116 - RNA, 23 nt, Human
ucccaaagugcugggguuacaga

SEQ ID NO: 137117 - RNA, 19 nt, Human
ucccgaggagcuaggacca

SEQ ID NO: 137118 - RNA, 21 nt, Human
ucccgaguucaagcgauucuc

SEQ ID NO: 137119 - RNA, 24 nt, Human
ucccgaguucaagcgauucuccug

SEQ ID NO: 137120 - RNA, 21 nt, Human
ucccuccuuggcuucccaaag

SEQ ID NO: 137121 - RNA, 21 nt, Human
uccugaguucaagugauccuc

SEQ ID NO: 137122 - RNA, 18 nt, Human
ucgauccucuggcuucag

SEQ ID NO: 137123 - RNA, 24 nt, Human
ucucacuauguagcccaggcuggu

SEQ ID NO: 137124 - RNA, 20 nt, Human
ucucagccucccaaagugcu

SEQ ID NO: 137125 - RNA, 19 nt, Human
ucucauucugucacccagg

SEQ ID NO: 137126 - RNA, 24 nt, Human
ucucauucugucacccaggcugaa

SEQ ID NO: 137127 - RNA, 25 nt, Human
ucuccugccucagccucccgaggag

SEQ ID NO: 137128 - RNA, 21 nt, Human
ucucgaacuccugaccucaag

SEQ ID NO: 137129 - RNA, 21 nt, Human
ucugugucgggacugcggggc

SEQ ID NO: 137130 - RNA, 23 nt, Human
ucuugcuaugugacccagguugg

SEQ ID NO: 137131 - RNA, 18 nt, Human
ugaccucaagugaucugc

SEQ ID NO: 137132 - RNA, 24 nt, Human
ugaucugcccaucucagccuccca

SEQ ID NO: 137133 - RNA, 22 nt, Human
ugcagacagguagacuguguca

SEQ ID NO: 137134 - RNA, 24 nt, Human
ugccucagccucccgaggagcuag

SEQ ID NO: 137135 - RNA, 24 nt, Human
ugcugggauuacauacgugagcca

SEQ ID NO: 137136 - RNA, 18 nt, Human
ugcugggguuacagaugu

SEQ ID NO: 137137 - RNA, 21 nt, Human
uggauaugggguuucaccaug

SEQ ID NO: 137138 - RNA, 22 nt, Human
uggcagguauuauguuucccau

SEQ ID NO: 137139 - RNA, 24 nt, Human
uggccaggcuggucucgaacuccu

SEQ ID NO: 137140 - RNA, 23 nt, Human
uggcguaaucauaguucacugug

SEQ ID NO: 137141 - RNA, 19 nt, Human
ugggacuacaggcauuuau

SEQ ID NO: 137142 - RNA, 21 nt, Human
ugggacuacaggcauuuauca

SEQ ID NO: 137143 - RNA, 24 nt, Human
ugggacuacaggcauuuaucaccg

SEQ ID NO: 137144 - RNA, 22 nt, Human
ugggauuacauacgugagccac

SEQ ID NO: 137145 - RNA, 22 nt, Human
ugggauuacauacgugagccac

SEQ ID NO: 137146 - RNA, 24 nt, Human
ugggauuacauacgugagccacug

SEQ ID NO: 137147 - RNA, 22 nt, Human
ugggguuacagaugugagccac

SEQ ID NO: 137148 - RNA, 22 nt, Human
ugggguuacagaugugagccac

SEQ ID NO: 137149 - RNA, 24 nt, Human
ugggguuacagaugugagccacug

SEQ ID NO: 137150 - RNA, 24 nt, Human
ugggguuucaccauguuggccagg

SEQ ID NO: 137151 - RNA, 20 nt, Human
ugugaccaugaucucccugg

SEQ ID NO: 137152 - RNA, 24 nt, Human
uguggucucacuauguagcccagg

SEQ ID NO: 137153 - RNA, 24 nt, Human
uuaauggauaugggguuucaccau

SEQ ID NO: 137154 - RNA, 21 nt, Human
uuacagaugugagccacugca

SEQ ID NO: 137155 - RNA, 21 nt, Human
uucaagcgauucuccugccuc

SEQ ID NO: 137156 - RNA, 23 nt, Human
uucaagcgauucuccugccucag

SEQ ID NO: 137157 - RNA, 24 nt, Human
uucaagcgauucuccugccucagc

SEQ ID NO: 137158 - RNA, 20 nt, Human
uucaagugauccucccuccu

SEQ ID NO: 137159 - RNA, 24 nt, Human
uucaagugauccucccuccuuggc

SEQ ID NO: 137160 - RNA, 24 nt, Human
uuucaccauguuggccaggcuggu

SEQ ID NO: 137161 - RNA, 24 nt, Human
uuuuuaauggauaugggguuucac

SEQ ID NO: 137162 - RNA, 23 nt, Human
uuuuuuuuuuuuuuuuucaccaa

SEQ ID NO: 137163 - RNA, 25 nt, Human
uuuuuuuuuuuuuuuuucaccaauu

SEQ ID NO: 137164 - RNA, 19 nt, Human
aacccauaacccccuucuc

SEQ ID NO: 137165 - RNA, 19 nt, Human
aagcacaaauuuaaccaga

SEQ ID NO: 137166 - RNA, 19 nt, Human
aagcacaaauuuaaccaga

SEQ ID NO: 137167 - RNA, 19 nt, Human
acaccacaucugcacccaa

SEQ ID NO: 137168 - RNA, 20 nt, Human
agaauacuuggagcaaagcu

SEQ ID NO: 137169 - RNA, 19 nt, Human
agccggcggcggcuccugg

SEQ ID NO: 137170 - RNA, 23 nt, Human
agcgaucacuuccucucucccag

SEQ ID NO: 137171 - RNA, 18 nt, Human
aggacacaaagguggggg

SEQ ID NO: 137172 - RNA, 26 nt, Human
auagaaaugcuguggugaauuuuggg

SEQ ID NO: 137173 - RNA, 24 nt, Human
auauaaccucaacagcagcagaga

SEQ ID NO: 137174 - RNA, 21 nt, Human
auucauaaugugagucaccau

SEQ ID NO: 137175 - RNA, 23 nt, Human
caaagcuggcacaauauggcacc

SEQ ID NO: 137176 - RNA, 23 nt, Human
caagucuuuggcccuguaccaua

SEQ ID NO: 137177 - RNA, 22 nt, Human
caccauguaaaacaccacgucu

SEQ ID NO: 137178 - RNA, 20 nt, Human
cacccaaaauaucacagcaa

SEQ ID NO: 137179 - RNA, 22 nt, Human
ccauaacccccuucucuucauu

SEQ ID NO: 137180 - RNA, 23 nt, Human
cccauaacccccuucucuucauu

SEQ ID NO: 137181 - RNA, 21 nt, Human
ccccgagccggcggcggcucc

SEQ ID NO: 137182 - RNA, 21 nt, Human
ccgggagcgaucacuuccucu

SEQ ID NO: 137183 - RNA, 21 nt, Human
ccuguaccauaauaugaggaa

SEQ ID NO: 137184 - RNA, 20 nt, Human
cuaaagauuucaugucuuca

SEQ ID NO: 137185 - RNA, 22 nt, Human
cucggcucgcgcuccuccggga

SEQ ID NO: 137186 - RNA, 18 nt, Human
cuucaguggaacuggcau

SEQ ID NO: 137187 - RNA, 20 nt, Human
gcgccggccgcucggcucgc

SEQ ID NO: 137188 - RNA, 26 nt, Human
gcggcggcuccugggcggcggcagcg

SEQ ID NO: 137189 - RNA, 23 nt, Human
ggacgcgcucggcagcggcggaa

SEQ ID NO: 137190 - RNA, 21 nt, Human
gggccggcgcgggcaggaugu

SEQ ID NO: 137191 - RNA, 22 nt, Human
uaaaguacccagaaauaauagg

SEQ ID NO: 137192 - RNA, 21 nt, Human
uaaccucaacagcagcagaga

SEQ ID NO: 137193 - RNA, 21 nt, Human
uaauaggacuaugccaggagu

SEQ ID NO: 137194 - RNA, 23 nt, Human
uaauauaaccucaacagcagcag

SEQ ID NO: 137195 - RNA, 23 nt, Human
uacaaaguaguuaaaaggcagca

SEQ ID NO: 137196 - RNA, 25 nt, Human
uacaauaaauaaggagcagcaaugu

SEQ ID NO: 137197 - RNA, 18 nt, Human
uacagcuacaaaguaguu

SEQ ID NO: 137198 - RNA, 19 nt, Human
uagcuucagugagaaguau

SEQ ID NO: 137199 - RNA, 23 nt, Human
uauaaagauagaaaugcuguggu

SEQ ID NO: 137200 - RNA, 23 nt, Human
uauaaccucaacagcagcagaga

SEQ ID NO: 137201 - RNA, 20 nt, Human
uaucacagcaauacugauac

SEQ ID NO: 137202 - RNA, 23 nt, Human
uaugccaggagugcauguaagca

SEQ ID NO: 137203 - RNA, 21 nt, Human
ucaagucuuuggcccuguacc

SEQ ID NO: 137204 - RNA, 27 nt, Human
ucaguggaaagcaugaugggacacauu

SEQ ID NO: 137205 - RNA, 22 nt, Human
uccaugcagcacacuacaauaa

SEQ ID NO: 137206 - RNA, 21 nt, Human
uccccgagccggcggcggcuc

SEQ ID NO: 137207 - RNA, 24 nt, Human
uccccgagccggcggcggcuccug

SEQ ID NO: 137208 - RNA, 26 nt, Human
ucggcagcggcggaacugggcucccc

SEQ ID NO: 137209 - RNA, 25 nt, Human
ucucacgcugcgccggccgcucggc

SEQ ID NO: 137210 - RNA, 18 nt, Human
ucugcacccaaucauauc

SEQ ID NO: 137211 - RNA, 20 nt, Human
ugacugcagacgcugagcuc

SEQ ID NO: 137212 - RNA, 20 nt, Human
ugagacagaaauauaaagau

SEQ ID NO: 137213 - RNA, 21 nt, Human
ugagacagaaauauaaagaua

SEQ ID NO: 137214 - RNA, 21 nt, Human
uggcacaauauggcacccaaa

SEQ ID NO: 137215 - RNA, 19 nt, Human
ugugagucaccauguaaaa

SEQ ID NO: 137216 - RNA, 20 nt, Human
uucauaaugugagucaccau

SEQ ID NO: 137217 - RNA, 26 nt, Human
uugagacagaaauauaaagauagaaa

SEQ ID NO: 137218 - RNA, 22 nt, Human
aaaaacagcuuucuccaagggc

SEQ ID NO: 137219 - RNA, 22 nt, Human
aaccuggaagugaggagagggc

SEQ ID NO: 137220 - RNA, 23 nt, Human
aagggcgacaaagugaacugaag

SEQ ID NO: 137221 - RNA, 19 nt, Human
agagggcgcuccggagcuc

SEQ ID NO: 137222 - RNA, 22 nt, Human
augacacagggagccaagagag

SEQ ID NO: 137223 - RNA, 18 nt, Human
caaagugaacugaagguc

SEQ ID NO: 137224 - RNA, 22 nt, Human
caaagugaacugaaggucagaa

SEQ ID NO: 137225 - RNA, 19 nt, Human
cagcuuucuccaagggcga

SEQ ID NO: 137226 - RNA, 18 nt, Human
ccagcccacacacgguca

SEQ ID NO: 137227 - RNA, 25 nt, Human
cccacacacggucacuggauuggug

SEQ ID NO: 137228 - RNA, 24 nt, Human
cuccaaaaccuggaagugaggaga

SEQ ID NO: 137229 - RNA, 24 nt, Human
cugcaagcucuugcuccaaaaccu

SEQ ID NO: 137230 - RNA, 25 nt, Human
cugcaagcucuugcuccaaaaccug

SEQ ID NO: 137231 - RNA, 26 nt, Human
cuuccugcaagcucuugcuccaaaag

SEQ ID NO: 137232 - RNA, 18 nt, Human
gaaaaacagcuuucucca

SEQ ID NO: 137233 - RNA, 21 nt, Human
gcuccaaaaccuggaagugag

SEQ ID NO: 137234 - RNA, 21 nt, Human
ucacuggauuggugugagugg

SEQ ID NO: 137235 - RNA, 22 nt, Human
uccugcaagcucuugcuccaaa

SEQ ID NO: 137236 - RNA, 19 nt, Human
ucuugcuccaaaaccugga

SEQ ID NO: 137237 - RNA, 22 nt, Human
ugacacagggagccaagagagu

SEQ ID NO: 137238 - RNA, 19 nt, Human
ugacauuaacauucuuggg

SEQ ID NO: 137239 - RNA, 22 nt, Human
ugcaagcucuugcuccaaaacc

SEQ ID NO: 137240 - RNA, 19 nt, Human
ugcgggcuuccugcaagcu

SEQ ID NO: 137241 - RNA, 19 nt, Human
ugcuccaaaaccuggaagu

SEQ ID NO: 137242 - RNA, 22 nt, Human
uggugugaguggguuccaagcc

SEQ ID NO: 137243 - RNA, 18 nt, Human
aagacuccacaaggauag

SEQ ID NO: 137244 - RNA, 19 nt, Human
acaggccgggcaugacaag

SEQ ID NO: 137245 - RNA, 19 nt, Human
aggcaggcuuggaaaggga

SEQ ID NO: 137246 - RNA, 19 nt, Human
aggcaggcuuggaaaggga

SEQ ID NO: 137247 - RNA, 22 nt, Human
aggcaggcuuggaaagggaggu

SEQ ID NO: 137248 - RNA, 20 nt, Human
aggggcacaaguuuucacca

SEQ ID NO: 137249 - RNA, 19 nt, Human
agggggugggagggauggc

SEQ ID NO: 137250 - RNA, 22 nt, Human
caaguuuucaccaacggucaca

SEQ ID NO: 137251 - RNA, 22 nt, Human
cacagcacccccaugcuuggua

SEQ ID NO: 137252 - RNA, 27 nt, Human
cacagugacugauucccagcgcuagag

SEQ ID NO: 137253 - RNA, 20 nt, Human
caccacuacaacagauuaag

SEQ ID NO: 137254 - RNA, 19 nt, Human
cauguguagguguguauau

SEQ ID NO: 137255 - RNA, 26 nt, Human
cuguccacaggccgggcaugacaagg

SEQ ID NO: 137256 - RNA, 23 nt, Human
gagggacagcaggacugguagaa

SEQ ID NO: 137257 - RNA, 20 nt, Human
gcgggggcuggcuguccaca

SEQ ID NO: 137258 - RNA, 20 nt, Human
gcucccggcuccgacuccgg

SEQ ID NO: 137259 - RNA, 19 nt, Human
gcuuuggggcugggggagc

SEQ ID NO: 137260 - RNA, 22 nt, Human
ggaggucuccgagaagaggagg

SEQ ID NO: 137261 - RNA, 24 nt, Human
ggccacacggcugccugcacagca

SEQ ID NO: 137262 - RNA, 20 nt, Human
ggcugggggagccacuguca

SEQ ID NO: 137263 - RNA, 21 nt, Human
gggaggucuccgagaagagga

SEQ ID NO: 137264 - RNA, 22 nt, Human
gggggcuggcuuuggggcuggg

SEQ ID NO: 137265 - RNA, 26 nt, Human
gggggugggagggauggcgggggcug

SEQ ID NO: 137266 - RNA, 23 nt, Human
gugacugauucccagcgcuagag

SEQ ID NO: 137267 - RNA, 26 nt, Human
uaccacagaaggggcacaaguuuuca

SEQ ID NO: 137268 - RNA, 18 nt, Human
ucacaccugaauguauca

SEQ ID NO: 137269 - RNA, 21 nt, Human
ucacaccugaauguaucagcu

SEQ ID NO: 137270 - RNA, 20 nt, Human
ucacuggagguggcacacuu

SEQ ID NO: 137271 - RNA, 21 nt, Human
ucucugguaguugggccacaa

SEQ ID NO: 137272 - RNA, 22 nt, Human
ugggagggauggcgggggcugg

SEQ ID NO: 137273 - RNA, 19 nt, Human
uguagguguguauauauau

SEQ ID NO: 137274 - RNA, 18 nt, Human
ugucaagucacagaacag

SEQ ID NO: 137275 - RNA, 18 nt, Human
uguguagguguguauaua

SEQ ID NO: 137276 - RNA, 19 nt, Human
aagaggccagggcugccca

SEQ ID NO: 137277 - RNA, 19 nt, Human
aagaggccagggcugccca

SEQ ID NO: 137278 - RNA, 20 nt, Human
accccugcaccccagcaagg

SEQ ID NO: 137279 - RNA, 23 nt, Human
acccugagacuccaucccccaaa

SEQ ID NO: 137280 - RNA, 21 nt, Human
acuccaucccccaaagugcaa

SEQ ID NO: 137281 - RNA, 25 nt, Human
agagugcaggcacuuacaguggucc

SEQ ID NO: 137282 - RNA, 24 nt, Human
agcauaggggcggcggagggcccc

SEQ ID NO: 137283 - RNA, 19 nt, Human
agcccaagcccagccaccc

SEQ ID NO: 137284 - RNA, 19 nt, Human
agccgaggcugggccaggc

SEQ ID NO: 137285 - RNA, 22 nt, Human
aggaggaggaggaggagaggaa

SEQ ID NO: 137286 - RNA, 21 nt, Human
aggauggugucaaggguucug

SEQ ID NO: 137287 - RNA, 21 nt, Human
agggcaaggccgggcaacggc

SEQ ID NO: 137288 - RNA, 21 nt, Human
agucccccccaggcuggaccc

SEQ ID NO: 137289 - RNA, 23 nt, Human
caaagugcaacaccccagcgccc

SEQ ID NO: 137290 - RNA, 27 nt, Human
caaagugcaacaccccagcgcccccug

SEQ ID NO: 137291 - RNA, 24 nt, Human
caagaccccccgccaccaccaccc

SEQ ID NO: 137292 - RNA, 21 nt, Human
caagaggccagggcugcccac

SEQ ID NO: 137293 - RNA, 19 nt, Human
cacauagcccaagcccagc

SEQ ID NO: 137294 - RNA, 23 nt, Human
cacauagcccaagcccagccacc

SEQ ID NO: 137295 - RNA, 21 nt, Human
caccaccacccacauagccca

SEQ ID NO: 137296 - RNA, 22 nt, Human
caccacccacauagcccaagcc

SEQ ID NO: 137297 - RNA, 18 nt, Human
caccccagcaaggccugg

SEQ ID NO: 137298 - RNA, 22 nt, Human
caccccagcgcccccugccugg

SEQ ID NO: 137299 - RNA, 21 nt, Human
caccucaggccugccagcugg

SEQ ID NO: 137300 - RNA, 22 nt, Human
cacugggccaggcuugccgcug

SEQ ID NO: 137301 - RNA, 22 nt, Human
cacuuacaguggucaaacugag

SEQ ID NO: 137302 - RNA, 26 nt, Human
cagagugcaggcacuuacagugguca

SEQ ID NO: 137303 - RNA, 20 nt, Human
cagcaaggccuggggaugua

SEQ ID NO: 137304 - RNA, 22 nt, Human
caggccugccagcugggcacuu

SEQ ID NO: 137305 - RNA, 19 nt, Human
ccaagaccccccgccacca

SEQ ID NO: 137306 - RNA, 19 nt, Human
ccaccacccacauagccca

SEQ ID NO: 137307 - RNA, 18 nt, Human
ccacugggccaggcuugc

SEQ ID NO: 137308 - RNA, 19 nt, Human
ccagcauaggggcggcgga

SEQ ID NO: 137309 - RNA, 24 nt, Human
ccagggcugcccacugggagccuu

SEQ ID NO: 137310 - RNA, 19 nt, Human
cccacauagcccaagccca

SEQ ID NO: 137311 - RNA, 25 nt, Human
cccacauagcccaagcccagccacc

SEQ ID NO: 137312 - RNA, 21 nt, Human
cccacugggagccugguccca

SEQ ID NO: 137313 - RNA, 21 nt, Human
cccacugggagccugguccca

SEQ ID NO: 137314 - RNA, 26 nt, Human
cccagccacccugggggacccaggag

SEQ ID NO: 137315 - RNA, 18 nt, Human
ccccagcgcccccugccc

SEQ ID NO: 137316 - RNA, 18 nt, Human
ccccagcgcccccugccu

SEQ ID NO: 137317 - RNA, 18 nt, Human
cccccaagaccccccgcc

SEQ ID NO: 137318 - RNA, 19 nt, Human
cccccaagaccccccgcca

SEQ ID NO: 137319 - RNA, 24 nt, Human
cccccaagaccccccgccaccacc

SEQ ID NO: 137320 - RNA, 18 nt, Human
ccccccaggcuggacccc

SEQ ID NO: 137321 - RNA, 21 nt, Human
cccccccaggcuggaccccuc

SEQ ID NO: 137322 - RNA, 23 nt, Human
cccccccgagagcacgccccccu

SEQ ID NO: 137323 - RNA, 19 nt, Human
ccccccgagagcacgcccc

SEQ ID NO: 137324 - RNA, 24 nt, Human
ccccccgagagcacgccccccucg

SEQ ID NO: 137325 - RNA, 25 nt, Human
ccccccgccaccaccacccacauag

SEQ ID NO: 137326 - RNA, 27 nt, Human
ccccccgccaccaccacccacauagcc

SEQ ID NO: 137327 - RNA, 21 nt, Human
ccccccucugccacccugaga

SEQ ID NO: 137328 - RNA, 25 nt, Human
ccccccucugccacccugagacucc

SEQ ID NO: 137329 - RNA, 22 nt, Human
cccccgagagcacgccccccuc

SEQ ID NO: 137330 - RNA, 18 nt, Human
cccccgccaccaccaccc

SEQ ID NO: 137331 - RNA, 24 nt, Human
cccccucugccacccugagacucc

SEQ ID NO: 137332 - RNA, 21 nt, Human
ccccgagagcacgccccccuc

SEQ ID NO: 137333 - RNA, 22 nt, Human
ccccgagagcacgccccccucg

SEQ ID NO: 137334 - RNA, 20 nt, Human
ccccgccaccaccacccaca

SEQ ID NO: 137335 - RNA, 23 nt, Human
ccgccaccaccacccacauagcc

SEQ ID NO: 137336 - RNA, 26 nt, Human
ccgccaccaccacccacauagcccaa

SEQ ID NO: 137337 - RNA, 19 nt, Human
ccgccgacccucaacgacc

SEQ ID NO: 137338 - RNA, 18 nt, Human
ccgcuggggagcuccugc

SEQ ID NO: 137339 - RNA, 18 nt, Human
ccggcccuggaccggggc

SEQ ID NO: 137340 - RNA, 24 nt, Human
ccucgcccgccgccgacccucaac

SEQ ID NO: 137341 - RNA, 21 nt, Human
ccugagacuccaucccccaaa

SEQ ID NO: 137342 - RNA, 22 nt, Human
ccugcgccgcgggugcgugagg

SEQ ID NO: 137343 - RNA, 18 nt, Human
cgagcgcccugcgcuccu

SEQ ID NO: 137344 - RNA, 22 nt, Human
cgccaccaccacccacauagcu

SEQ ID NO: 137345 - RNA, 22 nt, Human
cgccgccgacccucaacgaccu

SEQ ID NO: 137346 - RNA, 22 nt, Human
cggcccccggcccgagcgcccu

SEQ ID NO: 137347 - RNA, 23 nt, Human
cgggaaggacuauguacaccuca

SEQ ID NO: 137348 - RNA, 22 nt, Human
cuaccgagcccacugggccagg

SEQ ID NO: 137349 - RNA, 20 nt, Human
cucccggcucggccucacgg

SEQ ID NO: 137350 - RNA, 26 nt, Human
cuccucgcccgccgccgacccucaac

SEQ ID NO: 137351 - RNA, 19 nt, Human
cugcaccccagcaaggccu

SEQ ID NO: 137352 - RNA, 20 nt, Human
cugcgccgcgggugcgugag

SEQ ID NO: 137353 - RNA, 21 nt, Human
cuggggauguaggcgcccuug

SEQ ID NO: 137354 - RNA, 24 nt, Human
cugguccccccucugguccccugg

SEQ ID NO: 137355 - RNA, 18 nt, Human
cuuauagaaggccugccc

SEQ ID NO: 137356 - RNA, 19 nt, Human
cuugguagaguccccccca

SEQ ID NO: 137357 - RNA, 23 nt, Human
gaccccccgccaccaccacccac

SEQ ID NO: 137358 - RNA, 21 nt, Human
gacccucaacgaccuggcccc

SEQ ID NO: 137359 - RNA, 20 nt, Human
gagcacgccccccucgaggc

SEQ ID NO: 137360 - RNA, 23 nt, Human
gagucccccccaggcuggacccc

SEQ ID NO: 137361 - RNA, 20 nt, Human
gccaccaccacccacauagc

SEQ ID NO: 137362 - RNA, 23 nt, Human
gccaggcacaggggccggcccug

SEQ ID NO: 137363 - RNA, 23 nt, Human
gccccagaccacugaagcuccug

SEQ ID NO: 137364 - RNA, 19 nt, Human
gccuggucccagcauaggg

SEQ ID NO: 137365 - RNA, 20 nt, Human
gcgcccccugccuggagcuc

SEQ ID NO: 137366 - RNA, 22 nt, Human
ggaaggacuauguacaccucag

SEQ ID NO: 137367 - RNA, 25 nt, Human
ggaccggggccagcguuaaccaaga

SEQ ID NO: 137368 - RNA, 19 nt, Human
ggaggaggagaggaauagg

SEQ ID NO: 137369 - RNA, 21 nt, Human
ggccaggcuugccgcugggga

SEQ ID NO: 137370 - RNA, 19 nt, Human
ggcuggaccccucauucag

SEQ ID NO: 137371 - RNA, 22 nt, Human
gggccaggcuugccgcugggga

SEQ ID NO: 137372 - RNA, 19 nt, Human
gggggacccaggaggagga

SEQ ID NO: 137373 - RNA, 21 nt, Human
gguuaauauggccgggaagga

SEQ ID NO: 137374 - RNA, 19 nt, Human
guagagucccccccaggcu

SEQ ID NO: 137375 - RNA, 20 nt, Human
guagagucccccccaggcug

SEQ ID NO: 137376 - RNA, 18 nt, Human
gugcaacaccccagcgcc

SEQ ID NO: 137377 - RNA, 20 nt, Human
gugcaacaccccagcgcccc

SEQ ID NO: 137378 - RNA, 24 nt, Human
gugcaggcacuuacaguggucaaa

SEQ ID NO: 137379 - RNA, 24 nt, Human
uaccccugcaccccagcaaggccu

SEQ ID NO: 137380 - RNA, 19 nt, Human
uagccguugcucccgcccg

SEQ ID NO: 137381 - RNA, 18 nt, Human
ucagggaggcaugggcgg

SEQ ID NO: 137382 - RNA, 23 nt, Human
uccaucccccaaagugcaacacc

SEQ ID NO: 137383 - RNA, 21 nt, Human
ucccccaaagugcaacacccc

SEQ ID NO: 137384 - RNA, 21 nt, Human
ugagcgaggagugggugaggu

SEQ ID NO: 137385 - RNA, 18 nt, Human
ugaggucuccucagagag

SEQ ID NO: 137386 - RNA, 19 nt, Human
ugauauaccccugcacccc

SEQ ID NO: 137387 - RNA, 20 nt, Human
ugcaacaccccagcgccccc

SEQ ID NO: 137388 - RNA, 20 nt, Human
ugcgccgcgggugcgugagg

SEQ ID NO: 137389 - RNA, 20 nt, Human
uggcagccgaggcugggcca

SEQ ID NO: 137390 - RNA, 19 nt, Human
ugggggacccaggaggagg

SEQ ID NO: 137391 - RNA, 18 nt, Human
aacaggggugacgggagg

SEQ ID NO: 137392 - RNA, 22 nt, Human
aacauauaaaaacuacauaaag

SEQ ID NO: 137393 - RNA, 19 nt, Human
aaggccacaaacaccaugu

SEQ ID NO: 137394 - RNA, 18 nt, Human
acggacagauugacaugu

SEQ ID NO: 137395 - RNA, 22 nt, Human
agaggcgauacccugugcagaa

SEQ ID NO: 137396 - RNA, 19 nt, Human
agccaaggccacaaacacc

SEQ ID NO: 137397 - RNA, 18 nt, Human
aggauggaacggagccgg

SEQ ID NO: 137398 - RNA, 22 nt, Human
aggccacaaacaccauguacca

SEQ ID NO: 137399 - RNA, 22 nt, Human
aguccgggcgugggggaggagg

SEQ ID NO: 137400 - RNA, 21 nt, Human
auggggaggggcgaugagcgg

SEQ ID NO: 137401 - RNA, 25 nt, Human
auguuaaaaacacaacaucagugca

SEQ ID NO: 137402 - RNA, 24 nt, Human
caaggcgggcacacacccccccca

SEQ ID NO: 137403 - RNA, 24 nt, Human
cagcagacgcggcggcggcagcgc

SEQ ID NO: 137404 - RNA, 22 nt, Human
cagccaaggccacaaacaccau

SEQ ID NO: 137405 - RNA, 19 nt, Human
cagcgcaggcgccccggcu

SEQ ID NO: 137406 - RNA, 19 nt, Human
cagcgcaggcgccccggcu

SEQ ID NO: 137407 - RNA, 25 nt, Human
caugcccagggaacacgcaugcgca

SEQ ID NO: 137408 - RNA, 18 nt, Human
ccacacaugugaacggac

SEQ ID NO: 137409 - RNA, 18 nt, Human
ccaccccaguccgggcgu

SEQ ID NO: 137410 - RNA, 22 nt, Human
cgcaggcgccccggcuuuucgc

SEQ ID NO: 137411 - RNA, 21 nt, Human
cggcggcagcgcaggcgcccc

SEQ ID NO: 137412 - RNA, 22 nt, Human
cuggugccagaaacagggguga

SEQ ID NO: 137413 - RNA, 19 nt, Human
gaaacaggggugacgggag

SEQ ID NO: 137414 - RNA, 25 nt, Human
gcaaggcgggcacacacccccccca

SEQ ID NO: 137415 - RNA, 19 nt, Human
gcaugcgcaaggcgggcac

SEQ ID NO: 137416 - RNA, 19 nt, Human
gcauguuggggauuccugg

SEQ ID NO: 137417 - RNA, 20 nt, Human
gccaaggccacaaacaccau

SEQ ID NO: 137418 - RNA, 21 nt, Human
ggaacacgcaugcgcaaggcg

SEQ ID NO: 137419 - RNA, 22 nt, Human
gggauuccuggugccagaaaca

SEQ ID NO: 137420 - RNA, 27 nt, Human
ggggaggggcgaugagcggaggcgcgu

SEQ ID NO: 137421 - RNA, 20 nt, Human
uaaaaacacaacaucagugc

SEQ ID NO: 137422 - RNA, 24 nt, Human
uaagcgaaccucacacaacagcuu

SEQ ID NO: 137423 - RNA, 21 nt, Human
uacccugugcagaaggaugga

SEQ ID NO: 137424 - RNA, 18 nt, Human
uccagaaugcacaaagua

SEQ ID NO: 137425 - RNA, 23 nt, Human
ugacauguuaaaaacacaacauc

SEQ ID NO: 137426 - RNA, 19 nt, Human
uggaacggagccggccaug

SEQ ID NO: 137427 - RNA, 23 nt, Human
uggaacggagccggccaugccca

SEQ ID NO: 137428 - RNA, 18 nt, Human
ugugcagaaggauggaac

SEQ ID NO: 137429 - RNA, 23 nt, Human
uuccuggugccagaaacaggggu

SEQ ID NO: 137430 - RNA, 22 nt, Human
uugacauguuaaaaacacaaca

SEQ ID NO: 137431 - RNA, 23 nt, Human
uuuuuuuuuuuuuuuuuugguuu

SEQ ID NO: 137432 - RNA, 28 nt, Human
uuuuuuuuuuuuuuuuuuuuuuuggggg

SEQ ID NO: 137433 - RNA, 21 nt, Human
aaagaaauauuuacaggauug

SEQ ID NO: 137434 - RNA, 20 nt, Human
aaagaacaacuggggggagg

SEQ ID NO: 137435 - RNA, 23 nt, Human
aagacaaaaacaagcuuugauaa

SEQ ID NO: 137436 - RNA, 24 nt, Human
aagcauauagcagacauuccauaa

SEQ ID NO: 137437 - RNA, 18 nt, Human
aagucauaaaaguucauu

SEQ ID NO: 137438 - RNA, 21 nt, Human
aauuuccuuccugcggaaggc

SEQ ID NO: 137439 - RNA, 18 nt, Human
acacugguagauacaucu

SEQ ID NO: 137440 - RNA, 24 nt, Human
acagaaccuacaugaaagugugcc

SEQ ID NO: 137441 - RNA, 18 nt, Human
agaaacccuaauuccaag

SEQ ID NO: 137442 - RNA, 20 nt, Human
agcaaugcacaaacuuccaa

SEQ ID NO: 137443 - RNA, 21 nt, Human
auauacucuccauaaagcaua

SEQ ID NO: 137444 - RNA, 19 nt, Human
auccuccccauccaccucc

SEQ ID NO: 137445 - RNA, 22 nt, Human
caaaagcauauagcagacauuc

SEQ ID NO: 137446 - RNA, 24 nt, Human
caaccauccuccccauccaccucc

SEQ ID NO: 137447 - RNA, 21 nt, Human
caccagaauuaguucaaaaca

SEQ ID NO: 137448 - RNA, 18 nt, Human
caccgcauaugucagaau

SEQ ID NO: 137449 - RNA, 22 nt, Human
cacuaagcuacauucugucuac

SEQ ID NO: 137450 - RNA, 30 nt, Human
cagcugaaccauuuuacguucccacaagcc

SEQ ID NO: 137451 - RNA, 21 nt, Human
ccaccucuaaauagcugauuu

SEQ ID NO: 137452 - RNA, 23 nt, Human
ccacuaagcuacauucugucuac

SEQ ID NO: 137453 - RNA, 25 nt, Human
ccauccuccccauccaccuccagaa

SEQ ID NO: 137454 - RNA, 19 nt, Human
ccccggagcuaggccugcc

SEQ ID NO: 137455 - RNA, 19 nt, Human
cgccgcagccccggagcua

SEQ ID NO: 137456 - RNA, 20 nt, Human
cgccucagccgccgcagccc

SEQ ID NO: 137457 - RNA, 18 nt, Human
cguucccacaagcaaugc

SEQ ID NO: 137458 - RNA, 27 nt, Human
cuccauagcguuuuccaacagcagcug

SEQ ID NO: 137459 - RNA, 18 nt, Human
cucugucugaacacauau

SEQ ID NO: 137460 - RNA, 20 nt, Human
cugaaaucuuaacgucaugc

SEQ ID NO: 137461 - RNA, 19 nt, Human
cugauuuuuaagaagaaaa

SEQ ID NO: 137462 - RNA, 23 nt, Human
cugcauauuuucaauuaugaauu

SEQ ID NO: 137463 - RNA, 20 nt, Human
cuguucaagucccugcuuuc

SEQ ID NO: 137464 - RNA, 24 nt, Human
gaauaucauaugaccaucuuucag

SEQ ID NO: 137465 - RNA, 21 nt, Human
gacagagaaaguuaaaaguca

SEQ ID NO: 137466 - RNA, 23 nt, Human
gcagugaacagaaccuacaugaa

SEQ ID NO: 137467 - RNA, 21 nt, Human
gccgcagccccggagcuaggc

SEQ ID NO: 137468 - RNA, 24 nt, Human
gcgccucagccgccgcagccccgg

SEQ ID NO: 137469 - RNA, 19 nt, Human
ggcugguacuauuccacug

SEQ ID NO: 137470 - RNA, 19 nt, Human
gggcuggcuuacagcuucc

SEQ ID NO: 137471 - RNA, 25 nt, Human
guaaaacucuaaaccauuuuauuua

SEQ ID NO: 137472 - RNA, 18 nt, Human
uaaaauauacauaaugua

SEQ ID NO: 137473 - RNA, 18 nt, Human
uaaaaucuuguaauauga

SEQ ID NO: 137474 - RNA, 23 nt, Human
uaaaauuagaaauaaaaaacuuc

SEQ ID NO: 137475 - RNA, 24 nt, Human
uacaacauuauuaccaaaagcaua

SEQ ID NO: 137476 - RNA, 24 nt, Human
uacaguaauauaaauuugaugaaa

SEQ ID NO: 137477 - RNA, 22 nt, Human
uaccaguuuguaagcaaauguc

SEQ ID NO: 137478 - RNA, 21 nt, Human
uagccagagguggaaucgcug

SEQ ID NO: 137479 - RNA, 24 nt, Human
uaggguaauucuauguugaauuuu

SEQ ID NO: 137480 - RNA, 18 nt, Human
ucaaccgaaugugggaua

SEQ ID NO: 137481 - RNA, 21 nt, Human
ucauguagacacuaaagcucu

SEQ ID NO: 137482 - RNA, 20 nt, Human
uccaauuuauccaccucuaa

SEQ ID NO: 137483 - RNA, 22 nt, Human
uccaccuccagaacuuucucau

SEQ ID NO: 137484 - RNA, 18 nt, Human
uccacugcaugcacggaa

SEQ ID NO: 137485 - RNA, 19 nt, Human
ugacacugguagauacauc

SEQ ID NO: 137486 - RNA, 20 nt, Human
ugacacugguagauacaucu

SEQ ID NO: 137487 - RNA, 21 nt, Human
ugacacugguagauacaucuu

SEQ ID NO: 137488 - RNA, 26 nt, Human
ugcaguaaaauauacauaauguaaaa

SEQ ID NO: 137489 - RNA, 19 nt, Human
ugcucaaccgaauguggga

SEQ ID NO: 137490 - RNA, 19 nt, Human
ugcugaggaagagagacag

SEQ ID NO: 137491 - RNA, 21 nt, Human
uggggggaggggaguacuguc

SEQ ID NO: 137492 - RNA, 27 nt, Human
ugguguacaaauaucuguucaaguccc

SEQ ID NO: 137493 - RNA, 19 nt, Human
ugucugaacacauaugaaa

SEQ ID NO: 137494 - RNA, 24 nt, Human
uuaagaauuccacuaagcuacauu

SEQ ID NO: 137495 - RNA, 23 nt, Human
uucccauaauuuaagaauuccac

SEQ ID NO: 137496 - RNA, 20 nt, Human
uuucuguauaugggcuggcu

SEQ ID NO: 137497 - RNA, 19 nt, Human
uuucuuuucaucucucuuc

SEQ ID NO: 137498 - RNA, 18 nt, Human
uuuguaagcaaaugucuc

SEQ ID NO: 137499 - RNA, 23 nt, Human
uuuguuuauaaaauuguuuuuaa

SEQ ID NO: 137500 - RNA, 24 nt, Human
aaacauagaucccgguguugagcc

SEQ ID NO: 137501 - RNA, 21 nt, Human
aggcuggggcugcgcggggcu

SEQ ID NO: 137502 - RNA, 20 nt, Human
caccguauggccgguggggu

SEQ ID NO: 137503 - RNA, 21 nt, Human
caggcuggggcugcgcggggc

SEQ ID NO: 137504 - RNA, 22 nt, Human
ccgggaggcaggcuggggcugc

SEQ ID NO: 137505 - RNA, 19 nt, Human
cgccgggaggcaggcuggg

SEQ ID NO: 137506 - RNA, 18 nt, Human
gcaggcuggggcugcgcg

SEQ ID NO: 137507 - RNA, 18 nt, Human
ggcugcgcggggcugggg

SEQ ID NO: 137508 - RNA, 21 nt, Human
ggcuuuggggaaggaauuauc

SEQ ID NO: 137509 - RNA, 21 nt, Human
ggggcuggggggcugcugggc

SEQ ID NO: 137510 - RNA, 23 nt, Human
ugggcgccgggaggcaggcuggg

SEQ ID NO: 137511 - RNA, 26 nt, Human
ugggcuuuggggaaggaauuaucgug

SEQ ID NO: 137512 - RNA, 20 nt, Human
uggggcugcgcggggcuggg

SEQ ID NO: 137513 - RNA, 20 nt, Human
uggggcugcgcggggcuggg

SEQ ID NO: 137514 - RNA, 18 nt, Human
aaaaagaugagaaaugag

SEQ ID NO: 137515 - RNA, 27 nt, Human
aaaaauuagcaaaaacuguugaaacaa

SEQ ID NO: 137516 - RNA, 19 nt, Human
aaauagcccugaaugugau

SEQ ID NO: 137517 - RNA, 18 nt, Human
aagagggagauauggagg

SEQ ID NO: 137518 - RNA, 25 nt, Human
acagagcaguagccaguuuucaaaa

SEQ ID NO: 137519 - RNA, 21 nt, Human
acagcugaggaagagcagggc

SEQ ID NO: 137520 - RNA, 20 nt, Human
acuugggccacuuaacccca

SEQ ID NO: 137521 - RNA, 22 nt, Human
agacccaggaagggaaaaaaaa

SEQ ID NO: 137522 - RNA, 21 nt, Human
agagggaauggguuugagggg

SEQ ID NO: 137523 - RNA, 19 nt, Human
agcacaccccuuccugagc

SEQ ID NO: 137524 - RNA, 25 nt, Human
agcagacuucucaucuggggaccug

SEQ ID NO: 137525 - RNA, 20 nt, Human
agccuaaaaauuagcaaaaa

SEQ ID NO: 137526 - RNA, 18 nt, Human
aggaagggaaaaaaaaaa

SEQ ID NO: 137527 - RNA, 18 nt, Human
aggagaagaaaaaaugag

SEQ ID NO: 137528 - RNA, 22 nt, Human
aggcaaggggaaugugccgggu

SEQ ID NO: 137529 - RNA, 24 nt, Human
agggagccggucccguccgucggg

SEQ ID NO: 137530 - RNA, 24 nt, Human
auggaggagccauacuugucuaca

SEQ ID NO: 137531 - RNA, 18 nt, Human
caaaacuugucaacguug

SEQ ID NO: 137532 - RNA, 25 nt, Human
caagagggaacugagguacacggua

SEQ ID NO: 137533 - RNA, 22 nt, Human
cacacgucuguaaacacagagc

SEQ ID NO: 137534 - RNA, 20 nt, Human
cacgguaugacccacacagc

SEQ ID NO: 137535 - RNA, 20 nt, Human
cacgucuguaaacacagagc

SEQ ID NO: 137536 - RNA, 18 nt, Human
cacugagcaagagggaac

SEQ ID NO: 137537 - RNA, 21 nt, Human
cagccuaaaaauuagcaaaaa

SEQ ID NO: 137538 - RNA, 18 nt, Human
cagcugaggaagagcagg

SEQ ID NO: 137539 - RNA, 19 nt, Human
caggaagggaaaaaaaaaa

SEQ ID NO: 137540 - RNA, 19 nt, Human
cccacaaaacuugucaacg

SEQ ID NO: 137541 - RNA, 18 nt, Human
ccgugcagacuccagccc

SEQ ID NO: 137542 - RNA, 19 nt, Human
ccuaaaaauuagcaaaaac

SEQ ID NO: 137543 - RNA, 23 nt, Human
ccuugcuucacacuccucuccua

SEQ ID NO: 137544 - RNA, 18 nt, Human
cgcccgaccgccagggag

SEQ ID NO: 137545 - RNA, 20 nt, Human
cgcucggagcguccacgcgg

SEQ ID NO: 137546 - RNA, 21 nt, Human
cgggccggacggggcagcggg

SEQ ID NO: 137547 - RNA, 21 nt, Human
cucaggcuaccccugcaagag

SEQ ID NO: 137548 - RNA, 23 nt, Human
cuccaagcagccaggucugauuu

SEQ ID NO: 137549 - RNA, 20 nt, Human
cuccuugcuucacacuccuc

SEQ ID NO: 137550 - RNA, 19 nt, Human
cuggcucugccacacaccc

SEQ ID NO: 137551 - RNA, 18 nt, Human
cuggcuggggcgcggcug

SEQ ID NO: 137552 - RNA, 21 nt, Human
cuuaaccccagcgcugccggc

SEQ ID NO: 137553 - RNA, 19 nt, Human
cuucaggaaucacaccucc

SEQ ID NO: 137554 - RNA, 26 nt, Human
cuuccugagcuccccagaggguucua

SEQ ID NO: 137555 - RNA, 18 nt, Human
cuugggccacuuaacccc

SEQ ID NO: 137556 - RNA, 21 nt, Human
cuugggccacuuaaccccagc

SEQ ID NO: 137557 - RNA, 21 nt, Human
gacccaggaagggaaaaaaaa

SEQ ID NO: 137558 - RNA, 23 nt, Human
gagcaccgagcuuugcaguuuuc

SEQ ID NO: 137559 - RNA, 26 nt, Human
gagccgggagcagcugcugcgaggaa

SEQ ID NO: 137560 - RNA, 19 nt, Human
gcccgaccgccagggagcc

SEQ ID NO: 137561 - RNA, 18 nt, Human
gcccgcucgcccgaccgc

SEQ ID NO: 137562 - RNA, 24 nt, Human
gcccgcucgcccgaccgccgacuc

SEQ ID NO: 137563 - RNA, 19 nt, Human
gcgcggcugggcggcggag

SEQ ID NO: 137564 - RNA, 19 nt, Human
gcgggcugcggccgcggag

SEQ ID NO: 137565 - RNA, 19 nt, Human
ggaaaaaaaaaaagccacg

SEQ ID NO: 137566 - RNA, 18 nt, Human
ggccggcuggcggccgug

SEQ ID NO: 137567 - RNA, 18 nt, Human
ggcuccaguuacaaaaaa

SEQ ID NO: 137568 - RNA, 18 nt, Human
gggaauggguuugagggg

SEQ ID NO: 137569 - RNA, 20 nt, Human
gggccacuuaaccccagcgc

SEQ ID NO: 137570 - RNA, 18 nt, Human
gggccuggggaugccuuc

SEQ ID NO: 137571 - RNA, 18 nt, Human
gggcggcggagccgcggg

SEQ ID NO: 137572 - RNA, 19 nt, Human
gggcuuggggccuggcugg

SEQ ID NO: 137573 - RNA, 20 nt, Human
ggggaaaaaauagcccugaa

SEQ ID NO: 137574 - RNA, 28 nt, Human
ggggaaaaaauagcccugaaugugaugg

SEQ ID NO: 137575 - RNA, 19 nt, Human
ggggcgcggcugggcggcg

SEQ ID NO: 137576 - RNA, 20 nt, Human
ggugucuuaucuaagcuccu

SEQ ID NO: 137577 - RNA, 18 nt, Human
guacacgguaugacccac

SEQ ID NO: 137578 - RNA, 22 nt, Human
guccacgcgggcugcggccgcg

SEQ ID NO: 137579 - RNA, 18 nt, Human
gugggcuuggggccuggc

SEQ ID NO: 137580 - RNA, 23 nt, Human
guuuuaggagaagaaaaaaugag

SEQ ID NO: 137581 - RNA, 21 nt, Human
uaaaaaaucuccaaagggagc

SEQ ID NO: 137582 - RNA, 18 nt, Human
uaagaagaguaaaaggug

SEQ ID NO: 137583 - RNA, 22 nt, Human
ucaaaaauuaaacucuugcaau

SEQ ID NO: 137584 - RNA, 21 nt, Human
ucaucuggggaccugugccug

SEQ ID NO: 137585 - RNA, 19 nt, Human
uccacgcgggcugcggccg

SEQ ID NO: 137586 - RNA, 21 nt, Human
uccacgcgggcugcggccgcg

SEQ ID NO: 137587 - RNA, 24 nt, Human
ucccguucucccuaaaaacgacuu

SEQ ID NO: 137588 - RNA, 21 nt, Human
ucucucagauguggggaaggu

SEQ ID NO: 137589 - RNA, 21 nt, Human
ucugaauucccguucucccua

SEQ ID NO: 137590 - RNA, 21 nt, Human
ucugccacacaccccaguggg

SEQ ID NO: 137591 - RNA, 23 nt, Human
ucugcccccacugagcaagaggg

SEQ ID NO: 137592 - RNA, 19 nt, Human
ugaaaucaucaucauugug

SEQ ID NO: 137593 - RNA, 19 nt, Human
ugacugcugucacugccuc

SEQ ID NO: 137594 - RNA, 23 nt, Human
ugcagucacggggagggauuuag

SEQ ID NO: 137595 - RNA, 21 nt, Human
ugcccugggaaaaaacgaucc

SEQ ID NO: 137596 - RNA, 18 nt, Human
ugccuacaacugcacacg

SEQ ID NO: 137597 - RNA, 23 nt, Human
ugcgaggaagcggcgcgggccgg

SEQ ID NO: 137598 - RNA, 20 nt, Human
uggaggguaggucuccugga

SEQ ID NO: 137599 - RNA, 24 nt, Human
uggcgggaggccggcuggcggccg

SEQ ID NO: 137600 - RNA, 19 nt, Human
uggcuggggcgcggcuggg

SEQ ID NO: 137601 - RNA, 22 nt, Human
uguauaaaaagccccacaaaac

SEQ ID NO: 137602 - RNA, 21 nt, Human
ugucuuggaugauuuuucagc

SEQ ID NO: 137603 - RNA, 23 nt, Human
ugugccuguggaggguaggucuc

SEQ ID NO: 137604 - RNA, 18 nt, Human
ugugggggaaaaaauagc

SEQ ID NO: 137605 - RNA, 19 nt, Human
ugugguuuugguaucuuag

SEQ ID NO: 137606 - RNA, 23 nt, Human
uuaaaaauguccuguagcuacau

SEQ ID NO: 137607 - RNA, 19 nt, Human
uucacacuccucuccuagg

SEQ ID NO: 137608 - RNA, 20 nt, Human
uuccugccgcagggcuggcu

SEQ ID NO: 137609 - RNA, 22 nt, Human
uucucaucuggggaccugugcc

SEQ ID NO: 137610 - RNA, 23 nt, Human
uucucaucuggggaccugugccu

SEQ ID NO: 137611 - RNA, 19 nt, Human
uugcccugggaaaaaacga

SEQ ID NO: 137612 - RNA, 24 nt, Human
uuuacuugggccacuuaaccccag

SEQ ID NO: 137613 - RNA, 18 nt, Human
aaguugccuuuguucuag

SEQ ID NO: 137614 - RNA, 25 nt, Human
aggagcugcggggggucacuugggg

SEQ ID NO: 137615 - RNA, 21 nt, Human
aggguggagugaggggugggg

SEQ ID NO: 137616 - RNA, 24 nt, Human
agguuccagugguccggggcuucc

SEQ ID NO: 137617 - RNA, 20 nt, Human
aguggggagugggguucagg

SEQ ID NO: 137618 - RNA, 19 nt, Human
cacggcuccggguacagcc

SEQ ID NO: 137619 - RNA, 26 nt, Human
cagcugguggguucaagguuccagug

SEQ ID NO: 137620 - RNA, 26 nt, Human
ccagaggucaccaggcuaugggggca

SEQ ID NO: 137621 - RNA, 26 nt, Human
cgcgggggcggggaggggcgggggcg

SEQ ID NO: 137622 - RNA, 27 nt, Human
cggguacagccagcugguugcggggcg

SEQ ID NO: 137623 - RNA, 19 nt, Human
cuccggguacagccagcug

SEQ ID NO: 137624 - RNA, 21 nt, Human
cuuccaggcucaggguccccg

SEQ ID NO: 137625 - RNA, 21 nt, Human
gacugggccauggaacgaggg

SEQ ID NO: 137626 - RNA, 24 nt, Human
gaggagcugcggggggucacuugg

SEQ ID NO: 137627 - RNA, 18 nt, Human
gcggggggucacuugggg

SEQ ID NO: 137628 - RNA, 21 nt, Human
ggagugggguucaggggaggg

SEQ ID NO: 137629 - RNA, 24 nt, Human
ggcagggaaagggaacccucaggu

SEQ ID NO: 137630 - RNA, 18 nt, Human
ggcggggaggggcggggg

SEQ ID NO: 137631 - RNA, 21 nt, Human
ggcugggggauugggguucag

SEQ ID NO: 137632 - RNA, 20 nt, Human
gggaaagggaacccucaggu

SEQ ID NO: 137633 - RNA, 19 nt, Human
gggacagcggguggccaga

SEQ ID NO: 137634 - RNA, 20 nt, Human
gggcgaggagcugcgggggg

SEQ ID NO: 137635 - RNA, 19 nt, Human
gggcggggaggggcggggg

SEQ ID NO: 137636 - RNA, 22 nt, Human
gggcuuccaggcucaggguccc

SEQ ID NO: 137637 - RNA, 22 nt, Human
ggggagcuaggaagcuggggga

SEQ ID NO: 137638 - RNA, 20 nt, Human
ggggcggggaggggcggggg

SEQ ID NO: 137639 - RNA, 26 nt, Human
ggggcggggaggggcgggggcggggc

SEQ ID NO: 137640 - RNA, 19 nt, Human
ggguacagccagcuggugg

SEQ ID NO: 137641 - RNA, 22 nt, Human
ggguggagugaggggugggguu

SEQ ID NO: 137642 - RNA, 18 nt, Human
ggguggccagaggucacc

SEQ ID NO: 137643 - RNA, 24 nt, Human
guggagugaggggugggguuuggg

SEQ ID NO: 137644 - RNA, 19 nt, Human
ucaggguccccggggagga

SEQ ID NO: 137645 - RNA, 18 nt, Human
ucaguggggagugggguu

SEQ ID NO: 137646 - RNA, 23 nt, Human
ugagcuggaaggauccaggccca

SEQ ID NO: 137647 - RNA, 19 nt, Human
ugaggggugggguuugggg

SEQ ID NO: 137648 - RNA, 21 nt, Human
ugcggggggucacuuggggug

SEQ ID NO: 137649 - RNA, 22 nt, Human
ugcggggggucacuuggggugg

SEQ ID NO: 137650 - RNA, 19 nt, Human
uggccagaggucaccaggc

SEQ ID NO: 137651 - RNA, 20 nt, Human
ugggaggggcgaggagcugc

SEQ ID NO: 137652 - RNA, 22 nt, Human
uggggaccucaguggggaguga

SEQ ID NO: 137653 - RNA, 22 nt, Human
uggggaccucaguggggagugg

SEQ ID NO: 137654 - RNA, 22 nt, Human
uggggagugggguucaggggag

SEQ ID NO: 137655 - RNA, 19 nt, Human
uggggcugggggauugggg

SEQ ID NO: 137656 - RNA, 20 nt, Human
aaaguuauuuauuucuagua

SEQ ID NO: 137657 - RNA, 24 nt, Human
aagaauaggaaaaaaauguugaca

SEQ ID NO: 137658 - RNA, 20 nt, Human
aagaggcugcugcugccucu

SEQ ID NO: 137659 - RNA, 19 nt, Human
auaaccccaaacucuccua

SEQ ID NO: 137660 - RNA, 23 nt, Human
auggcaucuuuuacuaauaugaa

SEQ ID NO: 137661 - RNA, 20 nt, Human
caccuucccauguuuccaaa

SEQ ID NO: 137662 - RNA, 22 nt, Human
caccuucccauguuuccaaagu

SEQ ID NO: 137663 - RNA, 24 nt, Human
ccaguggcaccuucccauguuucc

SEQ ID NO: 137664 - RNA, 20 nt, Human
cccaaacucuccuauggcau

SEQ ID NO: 137665 - RNA, 25 nt, Human
ccuccuacacgaaggguuuugaugu

SEQ ID NO: 137666 - RNA, 22 nt, Human
ccuuacccauuaccaguggcac

SEQ ID NO: 137667 - RNA, 22 nt, Human
cuugaaaagaauaggaaaaaaa

SEQ ID NO: 137668 - RNA, 19 nt, Human
gcuacacugcgaacaaagu

SEQ ID NO: 137669 - RNA, 19 nt, Human
ggaagaggcugcugcugcc

SEQ ID NO: 137670 - RNA, 25 nt, Human
uauuagagauagacaguauuucagc

SEQ ID NO: 137671 - RNA, 25 nt, Human
ucaauaagaccuaaauaaccccaaa

SEQ ID NO: 137672 - RNA, 22 nt, Human
uccagaagggagggagacugcc

SEQ ID NO: 137673 - RNA, 19 nt, Human
ugaaaagaauaggaaaaaa

SEQ ID NO: 137674 - RNA, 27 nt, Human
ugaagcauaauuuauuuaacuugaaaa

SEQ ID NO: 137675 - RNA, 24 nt, Human
ugaauucuaugcaacagucauaaa

SEQ ID NO: 137676 - RNA, 22 nt, Human
ugcaacagucauaaacauggcc

SEQ ID NO: 137677 - RNA, 21 nt, Human
ugcgaacaaagugggcuuuga

SEQ ID NO: 137678 - RNA, 19 nt, Human
uuaccaguggcaccuuccc

SEQ ID NO: 137679 - RNA, 18 nt, Human
aacugccugcgccggggc

SEQ ID NO: 137680 - RNA, 18 nt, Human
acuugauuucuugaucaa

SEQ ID NO: 137681 - RNA, 19 nt, Human
caagugcagacuaaauauu

SEQ ID NO: 137682 - RNA, 23 nt, Human
caaguugcagucaaauuaaagug

SEQ ID NO: 137683 - RNA, 20 nt, Human
ccggggccgggcgggggccg

SEQ ID NO: 137684 - RNA, 23 nt, Human
cgauaugacuaugcaggcaacag

SEQ ID NO: 137685 - RNA, 18 nt, Human
cugccugcgccggggccg

SEQ ID NO: 137686 - RNA, 23 nt, Human
cuuucaggguggugacccuuuuc

SEQ ID NO: 137687 - RNA, 20 nt, Human
gaaaaugaaauacauaaaga

SEQ ID NO: 137688 - RNA, 20 nt, Human
gaacugccugcgccggggcc

SEQ ID NO: 137689 - RNA, 22 nt, Human
gcuccuucuccuccugagacuu

SEQ ID NO: 137690 - RNA, 21 nt, Human
ggccgggccggggccgcugua

SEQ ID NO: 137691 - RNA, 20 nt, Human
ucaggguggugacccuuuuc

SEQ ID NO: 137692 - RNA, 19 nt, Human
ucugaacugccugcgccgg

SEQ ID NO: 137693 - RNA, 21 nt, Human
ucugaacugccugcgccgggg

SEQ ID NO: 137694 - RNA, 21 nt, Human
uggugacccuuuucuccuuuu

SEQ ID NO: 137695 - RNA, 24 nt, Human
uggugacccuuuucuccuuuucuu

SEQ ID NO: 137696 - RNA, 19 nt, Human
uguaaaugaaaagauauac

SEQ ID NO: 137697 - RNA, 22 nt, Human
uucaugcacaaaccuucccaaa

SEQ ID NO: 137698 - RNA, 25 nt, Human
uuuauaauguuaaaguauuucacca

SEQ ID NO: 137699 - RNA, 25 nt, Human
aaaaauuaagaacacauauggauaa

SEQ ID NO: 137700 - RNA, 25 nt, Human
aaacagaaggaccacaaaaauuaaa

SEQ ID NO: 137701 - RNA, 21 nt, Human
aaacagcagacucaggggaca

SEQ ID NO: 137702 - RNA, 20 nt, Human
aacagcagacucaggggaca

SEQ ID NO: 137703 - RNA, 21 nt, Human
aacaucccaugacagugagga

SEQ ID NO: 137704 - RNA, 21 nt, Human
aagaaaaagcagucgcacgaa

SEQ ID NO: 137705 - RNA, 24 nt, Human
aaugcuguuuccaccccauaaauu

SEQ ID NO: 137706 - RNA, 25 nt, Human
acaaaaagaaagaauguuugggcaa

SEQ ID NO: 137707 - RNA, 23 nt, Human
acacagcuucccaagagugaugg

SEQ ID NO: 137708 - RNA, 24 nt, Human
acccauaucuaccucccagaccca

SEQ ID NO: 137709 - RNA, 24 nt, Human
accucaaccaacgaagucacacca

SEQ ID NO: 137710 - RNA, 21 nt, Human
accucccagacccaccuugcu

SEQ ID NO: 137711 - RNA, 24 nt, Human
acucacuccauggugagaacugaa

SEQ ID NO: 137712 - RNA, 20 nt, Human
aggaggggcuggauacaaca

SEQ ID NO: 137713 - RNA, 22 nt, Human
aggggacacagaaggagagggc

SEQ ID NO: 137714 - RNA, 25 nt, Human
augacagugaggaggauucuuauac

SEQ ID NO: 137715 - RNA, 23 nt, Human
auggagauggggaggggcagcac

SEQ ID NO: 137716 - RNA, 21 nt, Human
auucauuuguuuuuccauuug

SEQ ID NO: 137717 - RNA, 22 nt, Human
cacuccauggugagaacugaac

SEQ ID NO: 137718 - RNA, 26 nt, Human
cacuuccagcaguuaaaaauuaagaa

SEQ ID NO: 137719 - RNA, 19 nt, Human
cagaaggagagggcaugga

SEQ ID NO: 137720 - RNA, 19 nt, Human
cagaaugaggacaaaaaca

SEQ ID NO: 137721 - RNA, 18 nt, Human
cagacucaggggacacag

SEQ ID NO: 137722 - RNA, 19 nt, Human
cagacucucucagagccag

SEQ ID NO: 137723 - RNA, 23 nt, Human
cagcaguuaaaaauuaagaacac

SEQ ID NO: 137724 - RNA, 19 nt, Human
caucccggacccauaucua

SEQ ID NO: 137725 - RNA, 22 nt, Human
ccaacgaagucacaccaccggc

SEQ ID NO: 137726 - RNA, 21 nt, Human
cccaacucugguaacuacgau

SEQ ID NO: 137727 - RNA, 22 nt, Human
cccggacccauaucuaccuccc

SEQ ID NO: 137728 - RNA, 22 nt, Human
ccuugcuccaugacgcuaaagg

SEQ ID NO: 137729 - RNA, 23 nt, Human
cggcuggaacaaggaggggcugg

SEQ ID NO: 137730 - RNA, 20 nt, Human
cuccaugacgcuaaaggcca

SEQ ID NO: 137731 - RNA, 20 nt, Human
gacgcuaaaggccacucacu

SEQ ID NO: 137732 - RNA, 23 nt, Human
gagacacaccucaaccaacgaag

SEQ ID NO: 137733 - RNA, 19 nt, Human
gcccaaugagguaaacagc

SEQ ID NO: 137734 - RNA, 18 nt, Human
ggagauggggaggggcag

SEQ ID NO: 137735 - RNA, 21 nt, Human
gggcauggagauggggagggg

SEQ ID NO: 137736 - RNA, 21 nt, Human
uaaaacaaguucuaagaacca

SEQ ID NO: 137737 - RNA, 21 nt, Human
uaagaacacauauggauaauc

SEQ ID NO: 137738 - RNA, 22 nt, Human
uacaacaucccaugacagugag

SEQ ID NO: 137739 - RNA, 21 nt, Human
ucagaggcccccaacucuggu

SEQ ID NO: 137740 - RNA, 22 nt, Human
uccagcaguuaaaaauuaagaa

SEQ ID NO: 137741 - RNA, 27 nt, Human
uccauggugagaacugaaccggggucc

SEQ ID NO: 137742 - RNA, 21 nt, Human
ucccagacccaccuugcuccc

SEQ ID NO: 137743 - RNA, 21 nt, Human
ucuuuccagagagccuugcga

SEQ ID NO: 137744 - RNA, 23 nt, Human
ugaagaaaaagcagucgcacgaa

SEQ ID NO: 137745 - RNA, 19 nt, Human
ugaggaggauucuuauaca

SEQ ID NO: 137746 - RNA, 19 nt, Human
ugagguaaacagcagacuc

SEQ ID NO: 137747 - RNA, 18 nt, Human
uggagauggggaggggca

SEQ ID NO: 137748 - RNA, 22 nt, Human
uguguguguuuuaacacuucca

SEQ ID NO: 137749 - RNA, 24 nt, Human
uuaaaaccagcucuugugguacac

SEQ ID NO: 137750 - RNA, 23 nt, Human
uucccuggagggguugaacuuca

SEQ ID NO: 137751 - RNA, 20 nt, Human
uuggagacacaccucaacca

SEQ ID NO: 137752 - RNA, 20 nt, Human
uuuggcacaaaaagaaagaa

SEQ ID NO: 137753 - RNA, 19 nt, Human
aaguagggaagggauggcu

SEQ ID NO: 137754 - RNA, 24 nt, Human
acucucccaucccucugguccccu

SEQ ID NO: 137755 - RNA, 21 nt, Human
aguagggaagggauggcuuug

SEQ ID NO: 137756 - RNA, 19 nt, Human
caaagaacaaugcaggagu

SEQ ID NO: 137757 - RNA, 23 nt, Human
cagcauggccccucccacccucu

SEQ ID NO: 137758 - RNA, 23 nt, Human
caugcaccacuuuccacagaccu

SEQ ID NO: 137759 - RNA, 19 nt, Human
cauggccccucccacccuc

SEQ ID NO: 137760 - RNA, 20 nt, Human
ccccauggucccccuuagcc

SEQ ID NO: 137761 - RNA, 24 nt, Human
cccucaaacugcacccauucugac

SEQ ID NO: 137762 - RNA, 21 nt, Human
cccucuggcuucugcugguuc

SEQ ID NO: 137763 - RNA, 19 nt, Human
cucagccuugccguccuuc

SEQ ID NO: 137764 - RNA, 20 nt, Human
cucccacccucuggcuucug

SEQ ID NO: 137765 - RNA, 18 nt, Human
cucccaucccucuggucc

SEQ ID NO: 137766 - RNA, 20 nt, Human
cucuggcuucugcugguucu

SEQ ID NO: 137767 - RNA, 23 nt, Human
cuggucccacagccgucccuuca

SEQ ID NO: 137768 - RNA, 18 nt, Human
cuggucucacacagcaug

SEQ ID NO: 137769 - RNA, 21 nt, Human
gaggccuccacacaggccccu

SEQ ID NO: 137770 - RNA, 21 nt, Human
ggaagggauggcuuuggggga

SEQ ID NO: 137771 - RNA, 22 nt, Human
gggaagggauggcuuuggggga

SEQ ID NO: 137772 - RNA, 24 nt, Human
uaaccaucuucuuugaucccuagu

SEQ ID NO: 137773 - RNA, 24 nt, Human
uccacagaccuggucccacagccg

SEQ ID NO: 137774 - RNA, 21 nt, Human
ucccucugguccccuggucuc

SEQ ID NO: 137775 - RNA, 18 nt, Human
uccucagcccugccaucu

SEQ ID NO: 137776 - RNA, 26 nt, Human
uccucagcccugccaucugccccacu

SEQ ID NO: 137777 - RNA, 20 nt, Human
uccuucccuugacucuccca

SEQ ID NO: 137778 - RNA, 19 nt, Human
ucucccaucccucuggucc

SEQ ID NO: 137779 - RNA, 25 nt, Human
ugacucucccaucccucuggucccc

SEQ ID NO: 137780 - RNA, 23 nt, Human
ugcaggaguaaggauccaggcac

SEQ ID NO: 137781 - RNA, 19 nt, Human
uggcaaagaacaaugcagg

SEQ ID NO: 137782 - RNA, 20 nt, Human
uggcaaagaacaaugcagga

SEQ ID NO: 137783 - RNA, 25 nt, Human
uggcaaagaacaaugcaggaguaag

SEQ ID NO: 137784 - RNA, 21 nt, Human
ugguccccuggucucacacag

SEQ ID NO: 137785 - RNA, 22 nt, Human
uguccuucccuugacucuccca

SEQ ID NO: 137786 - RNA, 24 nt, Human
uucuuaggacuuccugggauuguc

SEQ ID NO: 137787 - RNA, 21 nt, Human
uuuaaugagaauuuuaaaauu

SEQ ID NO: 137788 - RNA, 20 nt, Human
uuuuuuuuuuuuuugacuuu

SEQ ID NO: 137789 - RNA, 24 nt, Human
uuuuuuuuuuuuuuuuuugacuuu

SEQ ID NO: 137790 - RNA, 21 nt, Human
uuuuuuuuuuuuuuuuuuugg

SEQ ID NO: 137791 - RNA, 20 nt, Human
aaagcuccccaacuuccacc

SEQ ID NO: 137792 - RNA, 21 nt, Human
aaagcuccccaacuuccaccu

SEQ ID NO: 137793 - RNA, 22 nt, Human
agcuaugacgucauggcaggca

SEQ ID NO: 137794 - RNA, 19 nt, Human
caaagcuccccaacuucca

SEQ ID NO: 137795 - RNA, 22 nt, Human
cagagauaugacugccucccuc

SEQ ID NO: 137796 - RNA, 19 nt, Human
ccccaacuuccaccuccgc

SEQ ID NO: 137797 - RNA, 24 nt, Human
cucaaagcuccccaacuuccaccu

SEQ ID NO: 137798 - RNA, 25 nt, Human
cucaaagcuccccaacuuccaccuc

SEQ ID NO: 137799 - RNA, 21 nt, Human
uccccaacuuccaccuccgca

SEQ ID NO: 137800 - RNA, 21 nt, Human
uggcaggcacgccagaggccg

SEQ ID NO: 137801 - RNA, 18 nt, Human
caaguucaguccugccac

SEQ ID NO: 137802 - RNA, 23 nt, Human
cagcuacagaacagccaccuccu

SEQ ID NO: 137803 - RNA, 24 nt, Human
cauccugccccccagguaagccca

SEQ ID NO: 137804 - RNA, 24 nt, Human
ccacccacggagcucuccagcuac

SEQ ID NO: 137805 - RNA, 24 nt, Human
cccaagucccagggagacagaccc

SEQ ID NO: 137806 - RNA, 24 nt, Human
cccacggagcucuccagcuacaga

SEQ ID NO: 137807 - RNA, 24 nt, Human
cccagggagacagacccgccuccu

SEQ ID NO: 137808 - RNA, 28 nt, Human
cccccagguaagcccaggcguccucuca

SEQ ID NO: 137809 - RNA, 23 nt, Human
cggcucagccacccaagucccag

SEQ ID NO: 137810 - RNA, 21 nt, Human
cgggacagggucccgaguacc

SEQ ID NO: 137811 - RNA, 23 nt, Human
cucugugcuggccuggcuggccc

SEQ ID NO: 137812 - RNA, 24 nt, Human
cugguccuugcaugugggcagcag

SEQ ID NO: 137813 - RNA, 20 nt, Human
cuggugccucugugcuggcc

SEQ ID NO: 137814 - RNA, 21 nt, Human
cuggugccucugugcuggccu

SEQ ID NO: 137815 - RNA, 21 nt, Human
cugugugcacugcugcccugg

SEQ ID NO: 137816 - RNA, 25 nt, Human
cuguguguguguccugaacuguccc

SEQ ID NO: 137817 - RNA, 23 nt, Human
gacagacccgccuccugccuccc

SEQ ID NO: 137818 - RNA, 21 nt, Human
gaccugugugcacugcugccc

SEQ ID NO: 137819 - RNA, 22 nt, Human
gggcuccuggcaucuggagucc

SEQ ID NO: 137820 - RNA, 18 nt, Human
ggggacucuggucuccca

SEQ ID NO: 137821 - RNA, 21 nt, Human
gugggcagcagggcuccuggc

SEQ ID NO: 137822 - RNA, 18 nt, Human
ucccgaguaccucggcuc

SEQ ID NO: 137823 - RNA, 20 nt, Human
ucucaggagaugcugguccu

SEQ ID NO: 137824 - RNA, 23 nt, Human
ugcaugugggcagcagggcuccu

SEQ ID NO: 137825 - RNA, 19 nt, Human
ugcccuggugccucugugc

SEQ ID NO: 137826 - RNA, 22 nt, Human
ugcccuggugccucugugcugg

SEQ ID NO: 137827 - RNA, 22 nt, Human
uggaguccugggaugggcgggu

SEQ ID NO: 137828 - RNA, 20 nt, Human
ugggaugggcgggucuuccc

SEQ ID NO: 137829 - RNA, 27 nt, Human
ugggguccccggggaccugugugcacu

SEQ ID NO: 137830 - RNA, 25 nt, Human
uguccugaacuguccccaggcaucc

SEQ ID NO: 137831 - RNA, 21 nt, Human
uuggggguuguuucugguguu

SEQ ID NO: 137832 - RNA, 18 nt, Human
aaacauggagcgaaggca

SEQ ID NO: 137833 - RNA, 18 nt, Human
aacccaaugccccgggga

SEQ ID NO: 137834 - RNA, 21 nt, Human
aagaacgcggagagcgcaggc

SEQ ID NO: 137835 - RNA, 19 nt, Human
aagggcugcuagcgcagcc

SEQ ID NO: 137836 - RNA, 18 nt, Human
acagcgcuggaagaacgc

SEQ ID NO: 137837 - RNA, 25 nt, Human
agacaccaagaggauaaaccguggg

SEQ ID NO: 137838 - RNA, 21 nt, Human
agacagcgcuggaagaacgcg

SEQ ID NO: 137839 - RNA, 22 nt, Human
agcagugaguggaggguccugg

SEQ ID NO: 137840 - RNA, 23 nt, Human
agccccuuggcugaaaccaagaa

SEQ ID NO: 137841 - RNA, 22 nt, Human
aggcaaugacaagggccuuugc

SEQ ID NO: 137842 - RNA, 18 nt, Human
aggcaggacccggauugc

SEQ ID NO: 137843 - RNA, 22 nt, Human
agggccgucucggcgcccugcu

SEQ ID NO: 137844 - RNA, 21 nt, Human
aguuggaaggcaggacccgga

SEQ ID NO: 137845 - RNA, 19 nt, Human
auggagcgaaggcaaugac

SEQ ID NO: 137846 - RNA, 21 nt, Human
auggucuuggggaucucaaag

SEQ ID NO: 137847 - RNA, 18 nt, Human
auguggcagucaccaugg

SEQ ID NO: 137848 - RNA, 25 nt, Human
caaccauauucauguuugcguuuuc

SEQ ID NO: 137849 - RNA, 20 nt, Human
caagaggauaaaccguggca

SEQ ID NO: 137850 - RNA, 25 nt, Human
caaggccaccuucuuggccugguac

SEQ ID NO: 137851 - RNA, 24 nt, Human
cacacucuccugagaggggaugac

SEQ ID NO: 137852 - RNA, 22 nt, Human
ccaaaaacauggagcgaaggca

SEQ ID NO: 137853 - RNA, 20 nt, Human
ccccaaaaacauggagcgaa

SEQ ID NO: 137854 - RNA, 19 nt, Human
ccccagccuguucagugcc

SEQ ID NO: 137855 - RNA, 25 nt, Human
ccccagccuguucagugccugugcc

SEQ ID NO: 137856 - RNA, 26 nt, Human
ccccagugauuccuccaggccccugc

SEQ ID NO: 137857 - RNA, 20 nt, Human
cccugcuccgcugccccgga

SEQ ID NO: 137858 - RNA, 23 nt, Human
cccuuggcugaaaccaagaaggc

SEQ ID NO: 137859 - RNA, 21 nt, Human
ccgaccucugccagggccguc

SEQ ID NO: 137860 - RNA, 24 nt, Human
ccugagaggggaugacuuugucag

SEQ ID NO: 137861 - RNA, 18 nt, Human
ccugcuccgcugccccgg

SEQ ID NO: 137862 - RNA, 21 nt, Human
ccugggcuuguuggauccucc

SEQ ID NO: 137863 - RNA, 19 nt, Human
cgaggggcccgaccucugc

SEQ ID NO: 137864 - RNA, 18 nt, Human
cucaagaauugauaguug

SEQ ID NO: 137865 - RNA, 24 nt, Human
cucuccaaccauauucauguuugc

SEQ ID NO: 137866 - RNA, 18 nt, Human
cugacgcuggggugcagc

SEQ ID NO: 137867 - RNA, 21 nt, Human
cuuucacucugcaaacugguc

SEQ ID NO: 137868 - RNA, 24 nt, Human
gaggguucuucaggaucucagggg

SEQ ID NO: 137869 - RNA, 19 nt, Human
gauccuccagauggucuug

SEQ ID NO: 137870 - RNA, 20 nt, Human
gauccuccagauggucuugg

SEQ ID NO: 137871 - RNA, 25 nt, Human
gaugacggaggcugccccuagagga

SEQ ID NO: 137872 - RNA, 20 nt, Human
gccccggggacagaaaccag

SEQ ID NO: 137873 - RNA, 24 nt, Human
gcgggcucuuccaaugcggagaaa

SEQ ID NO: 137874 - RNA, 26 nt, Human
gcggggaucgccugccuggcccaggg

SEQ ID NO: 137875 - RNA, 24 nt, Human
ggaagcggggaucgccugccuggc

SEQ ID NO: 137876 - RNA, 25 nt, Human
ggacagaaaccagacaccaagagga

SEQ ID NO: 137877 - RNA, 21 nt, Human
gggaucucaaaguuguaguug

SEQ ID NO: 137878 - RNA, 21 nt, Human
ggugcagcugcuggaaugaag

SEQ ID NO: 137879 - RNA, 25 nt, Human
guaguuggaaggcaggacccggauu

SEQ ID NO: 137880 - RNA, 19 nt, Human
gucucuuaacugguucugg

SEQ ID NO: 137881 - RNA, 22 nt, Human
gugagggugauggcuccgggaa

SEQ ID NO: 137882 - RNA, 19 nt, Human
uaaaaagacagcgcuggaa

SEQ ID NO: 137883 - RNA, 24 nt, Human
uaaaaagacagcgcuggaagaacg

SEQ ID NO: 137884 - RNA, 18 nt, Human
uaacugguucuggugagg

SEQ ID NO: 137885 - RNA, 23 nt, Human
uaggagcagagacauuucuugau

SEQ ID NO: 137886 - RNA, 22 nt, Human
ucaguacaggcagggcccuuau

SEQ ID NO: 137887 - RNA, 19 nt, Human
ucagugccugugccaccau

SEQ ID NO: 137888 - RNA, 20 nt, Human
ucaguguccccaaaaacaug

SEQ ID NO: 137889 - RNA, 23 nt, Human
uccauuaaggccuugugcucccc

SEQ ID NO: 137890 - RNA, 19 nt, Human
uccccaaaaacauggagcg

SEQ ID NO: 137891 - RNA, 18 nt, Human
ucucaggggggaucugau

SEQ ID NO: 137892 - RNA, 18 nt, Human
ucuuaacugguucuggug

SEQ ID NO: 137893 - RNA, 19 nt, Human
ugaaaccaagaaggccguc

SEQ ID NO: 137894 - RNA, 24 nt, Human
ugaacccaaugccccggggacaga

SEQ ID NO: 137895 - RNA, 24 nt, Human
ugagaggggaugacuuugucagug

SEQ ID NO: 137896 - RNA, 24 nt, Human
ugagggugauggcuccgggaaauu

SEQ ID NO: 137897 - RNA, 19 nt, Human
ugccccggauacgaccagc

SEQ ID NO: 137898 - RNA, 18 nt, Human
ugccccggggacagaaac

SEQ ID NO: 137899 - RNA, 18 nt, Human
ugccugugccaccauccc

SEQ ID NO: 137900 - RNA, 25 nt, Human
ugcuccgcugccccggauacgacca

SEQ ID NO: 137901 - RNA, 20 nt, Human
ugcuggaaugaaguggccac

SEQ ID NO: 137902 - RNA, 19 nt, Human
uggaaggcaggacccggau

SEQ ID NO: 137903 - RNA, 19 nt, Human
uggcccagggcacacacaa

SEQ ID NO: 137904 - RNA, 21 nt, Human
uggggugcagcugcuggaaug

SEQ ID NO: 137905 - RNA, 20 nt, Human
ugugcuccccuuuucuucag

SEQ ID NO: 137906 - RNA, 20 nt, Human
uguggcagucaccauggugc

SEQ ID NO: 137907 - RNA, 18 nt, Human
uuccuccaggccccugca

SEQ ID NO: 137908 - RNA, 19 nt, Human
uuggaaggcaggacccgga

SEQ ID NO: 137909 - RNA, 22 nt, Human
aacaaagaauuaucuggcccca

SEQ ID NO: 137910 - RNA, 20 nt, Human
acagccccacaacaaagaau

SEQ ID NO: 137911 - RNA, 26 nt, Human
accaacacuguccaaccaauagaacu

SEQ ID NO: 137912 - RNA, 22 nt, Human
accagacagccccacaacaaag

SEQ ID NO: 137913 - RNA, 21 nt, Human
acuggacagugcaggucuagc

SEQ ID NO: 137914 - RNA, 21 nt, Human
agacagccccacaacaaagaa

SEQ ID NO: 137915 - RNA, 18 nt, Human
aggcacagcuuggguggu

SEQ ID NO: 137916 - RNA, 19 nt, Human
agggggaugggagguuggu

SEQ ID NO: 137917 - RNA, 24 nt, Human
aggucuggagauauuuuugguugu

SEQ ID NO: 137918 - RNA, 19 nt, Human
agugguucucaauugaggg

SEQ ID NO: 137919 - RNA, 20 nt, Human
caacacuguccaaccaauag

SEQ ID NO: 137920 - RNA, 20 nt, Human
cacuguccaaccaauagaac

SEQ ID NO: 137921 - RNA, 21 nt, Human
cagccugggaacugggauugg

SEQ ID NO: 137922 - RNA, 21 nt, Human
cagcggggaccucccugggac

SEQ ID NO: 137923 - RNA, 24 nt, Human
cagcggggaccucccugggacagc

SEQ ID NO: 137924 - RNA, 18 nt, Human
cagggggucaaaaucgcc

SEQ ID NO: 137925 - RNA, 24 nt, Human
ccaaccaauagaacuuucugccau

SEQ ID NO: 137926 - RNA, 25 nt, Human
ccacaacaaagaauuaucuggcccc

SEQ ID NO: 137927 - RNA, 22 nt, Human
ccacagauaacauuugccaagg

SEQ ID NO: 137928 - RNA, 25 nt, Human
ccagacagccccacaacaaagaauu

SEQ ID NO: 137929 - RNA, 22 nt, Human
ccugcucucccuccuuccaggg

SEQ ID NO: 137930 - RNA, 19 nt, Human
ccuuguggggguaggggga

SEQ ID NO: 137931 - RNA, 20 nt, Human
cuagagcagcccucaggggg

SEQ ID NO: 137932 - RNA, 19 nt, Human
cucccuccuuccagggucc

SEQ ID NO: 137933 - RNA, 21 nt, Human
cucucccuccuuccagggucc

SEQ ID NO: 137934 - RNA, 18 nt, Human
gacaaggacagacccuca

SEQ ID NO: 137935 - RNA, 22 nt, Human
gcacuaaagguccuagcagcca

SEQ ID NO: 137936 - RNA, 23 nt, Human
ggacagcuucggggccugagucc

SEQ ID NO: 137937 - RNA, 19 nt, Human
gguccagaggccucaggga

SEQ ID NO: 137938 - RNA, 18 nt, Human
gugcugagcuugugccag

SEQ ID NO: 137939 - RNA, 21 nt, Human
uaaguccaucuaugucuccag

SEQ ID NO: 137940 - RNA, 23 nt, Human
uacuggacagugcaggucuagcu

SEQ ID NO: 137941 - RNA, 22 nt, Human
uagcuagaccagugguucucaa

SEQ ID NO: 137942 - RNA, 22 nt, Human
ucagccggugaguauccccuuc

SEQ ID NO: 137943 - RNA, 20 nt, Human
ucucccugagaaauaagagu

SEQ ID NO: 137944 - RNA, 25 nt, Human
ucugccaugauggcauauccuguag

SEQ ID NO: 137945 - RNA, 18 nt, Human
ugccagugccaggacagg

SEQ ID NO: 137946 - RNA, 20 nt, Human
ugccugcucucccuccuucc

SEQ ID NO: 137947 - RNA, 19 nt, Human
uggcagggggaugggaggu

SEQ ID NO: 137948 - RNA, 22 nt, Human
uggcagggggaugggagguugg

SEQ ID NO: 137949 - RNA, 18 nt, Human
uggccaaagguccugggc

SEQ ID NO: 137950 - RNA, 18 nt, Human
ugggagguuggugcaggg

SEQ ID NO: 137951 - RNA, 24 nt, Human
ugggagguuggugcagggagcacu

SEQ ID NO: 137952 - RNA, 22 nt, Human
ugggcugcccucaggaagacag

SEQ ID NO: 137953 - RNA, 18 nt, Human
ugucaaguacgaguuuga

SEQ ID NO: 137954 - RNA, 18 nt, Human
uuugacaaggacagaccc

SEQ ID NO: 137955 - RNA, 18 nt, Human
uuugccaaggucuggaga

SEQ ID NO: 137956 - RNA, 21 nt, Human
aaagaagagaacaacauuuga

SEQ ID NO: 137957 - RNA, 19 nt, Human
aacaaagguaaccuuaagu

SEQ ID NO: 137958 - RNA, 23 nt, Human
aagacacucaaagaaaugaaaua

SEQ ID NO: 137959 - RNA, 21 nt, Human
aagguaaccuuaaguuucuug

SEQ ID NO: 137960 - RNA, 22 nt, Human
acaucacugcccacaucuugcc

SEQ ID NO: 137961 - RNA, 19 nt, Human
agaaggagcgcaggcagaa

SEQ ID NO: 137962 - RNA, 24 nt, Human
agacacucaaagaaaugaaauaag

SEQ ID NO: 137963 - RNA, 23 nt, Human
agugagcguucagagaaggagcg

SEQ ID NO: 137964 - RNA, 19 nt, Human
augcuuggacuuggguucc

SEQ ID NO: 137965 - RNA, 18 nt, Human
caaagccuccauaaaaac

SEQ ID NO: 137966 - RNA, 23 nt, Human
cacaucucaguuucaagcugccu

SEQ ID NO: 137967 - RNA, 18 nt, Human
cagcucuucuccgagggg

SEQ ID NO: 137968 - RNA, 24 nt, Human
caucccuuuaaagaagagaacaac

SEQ ID NO: 137969 - RNA, 18 nt, Human
ccaguuagaaaaagauua

SEQ ID NO: 137970 - RNA, 23 nt, Human
ccaguuagaaaaagauuaaaauc

SEQ ID NO: 137971 - RNA, 21 nt, Human
cccugcuaucuucucucccua

SEQ ID NO: 137972 - RNA, 22 nt, Human
ccuauagccauaacuggcaccu

SEQ ID NO: 137973 - RNA, 20 nt, Human
ccugcaccgcugcuccgggc

SEQ ID NO: 137974 - RNA, 23 nt, Human
ccugggggccugcguugcuggca

SEQ ID NO: 137975 - RNA, 31 nt, Human
cuauagccauaacuggcaccugggggccugg

SEQ ID NO: 137976 - RNA, 19 nt, Human
cugcaccgcugcuccgggc

SEQ ID NO: 137977 - RNA, 21 nt, Human
cugucccugcccuagugacau

SEQ ID NO: 137978 - RNA, 18 nt, Human
cugugguuuuacuuagaa

SEQ ID NO: 137979 - RNA, 18 nt, Human
gaacaaagguaaccuuaa

SEQ ID NO: 137980 - RNA, 19 nt, Human
gagacuguuugaauagucu

SEQ ID NO: 137981 - RNA, 20 nt, Human
gccugcucguguugguaugc

SEQ ID NO: 137982 - RNA, 20 nt, Human
gcugugaacagcucuucucc

SEQ ID NO: 137983 - RNA, 24 nt, Human
guccaaggaaguuaaaauauucuu

SEQ ID NO: 137984 - RNA, 18 nt, Human
guuucaagcugccucuuu

SEQ ID NO: 137985 - RNA, 19 nt, Human
uaaaacccgaccggauaau

SEQ ID NO: 137986 - RNA, 18 nt, Human
uaaaaugaguccaaggaa

SEQ ID NO: 137987 - RNA, 21 nt, Human
uaaaaugaguccaaggaaguu

SEQ ID NO: 137988 - RNA, 25 nt, Human
uaaagaagagaacaacauuugaacc

SEQ ID NO: 137989 - RNA, 18 nt, Human
ucucucccuaaucccucu

SEQ ID NO: 137990 - RNA, 21 nt, Human
ucuguugugaagacagaaguu

SEQ ID NO: 137991 - RNA, 22 nt, Human
ugaaauuugggaacaaagguaa

SEQ ID NO: 137992 - RNA, 24 nt, Human
ugacaguagccugcucguguuggu

SEQ ID NO: 137993 - RNA, 19 nt, Human
ugccagucuggcugugaac

SEQ ID NO: 137994 - RNA, 27 nt, Human
uggguucccagccaugcccugcuaucu

SEQ ID NO: 137995 - RNA, 22 nt, Human
uguagaaugggaauaauaauac

SEQ ID NO: 137996 - RNA, 24 nt, Human
ugugauacaaauauuuucaucuuu

SEQ ID NO: 137997 - RNA, 19 nt, Human
uuaaagaagagaacaacau

SEQ ID NO: 137998 - RNA, 20 nt, Human
uuaaagaagagaacaacauu

SEQ ID NO: 137999 - RNA, 22 nt, Human
uuagaaaaagauuaaaauccug

SEQ ID NO: 138000 - RNA, 20 nt, Human
uugcauauuugauuuccuga

SEQ ID NO: 138001 - RNA, 21 nt, Human
uuuccugagacuguuugaaua

SEQ ID NO: 138002 - RNA, 19 nt, Human
uuuggagucuuuucaacug

SEQ ID NO: 138003 - RNA, 23 nt, Human
aaaaaaaaaaaaaggcggugggg

SEQ ID NO: 138004 - RNA, 20 nt, Human
aaacaaccccaugacggaga

SEQ ID NO: 138005 - RNA, 19 nt, Human
aaagagcuugauacgguac

SEQ ID NO: 138006 - RNA, 20 nt, Human
aaaggaaagggaaacaaggc

SEQ ID NO: 138007 - RNA, 19 nt, Human
aaggagcuuguuucccaag

SEQ ID NO: 138008 - RNA, 24 nt, Human
aaguagcaagcccauauaugaaca

SEQ ID NO: 138009 - RNA, 24 nt, Human
acagcaaaacaaccccaugacgga

SEQ ID NO: 138010 - RNA, 19 nt, Human
accccggggaaggagcuug

SEQ ID NO: 138011 - RNA, 20 nt, Human
accuugaggagggagcaguu

SEQ ID NO: 138012 - RNA, 20 nt, Human
acggagacaguggagcauca

SEQ ID NO: 138013 - RNA, 20 nt, Human
acugcgacgugagacagggu

SEQ ID NO: 138014 - RNA, 19 nt, Human
agacagggugugauguccc

SEQ ID NO: 138015 - RNA, 22 nt, Human
agacagggugugaugucccuaa

SEQ ID NO: 138016 - RNA, 25 nt, Human
aggaaguagcaagcccauauaugaa

SEQ ID NO: 138017 - RNA, 18 nt, Human
aggcagcagcagcagcag

SEQ ID NO: 138018 - RNA, 21 nt, Human
aggcccaaccccaaacagcaa

SEQ ID NO: 138019 - RNA, 26 nt, Human
aggcccaaccccaaacagcaaaacaa

SEQ ID NO: 138020 - RNA, 20 nt, Human
auagacagugcacaccuaca

SEQ ID NO: 138021 - RNA, 22 nt, Human
auuaaaaaaaaaaaaaggcggu

SEQ ID NO: 138022 - RNA, 21 nt, Human
caccuacagccaagcccuagc

SEQ ID NO: 138023 - RNA, 24 nt, Human
cagcaaaacaaccccaugacggag

SEQ ID NO: 138024 - RNA, 23 nt, Human
cagcagcagcagcagcaggcaag

SEQ ID NO: 138025 - RNA, 25 nt, Human
cagcagcagcagcaggcaagcccag

SEQ ID NO: 138026 - RNA, 26 nt, Human
ccaaccccaaacagcaaaacaacccc

SEQ ID NO: 138027 - RNA, 20 nt, Human
ccagauuaaaaaaaaaaaaa

SEQ ID NO: 138028 - RNA, 22 nt, Human
cccaaccccaaacagcaaaaca

SEQ ID NO: 138029 - RNA, 24 nt, Human
cccaaccccaaacagcaaaacaac

SEQ ID NO: 138030 - RNA, 22 nt, Human
ccccaccccgcuccagauuaaa

SEQ ID NO: 138031 - RNA, 24 nt, Human
ccccaccccgcuccagauuaaaaa

SEQ ID NO: 138032 - RNA, 21 nt, Human
ccccgccccgccccgccccuc

SEQ ID NO: 138033 - RNA, 18 nt, Human
cccgccccgccccgcccc

SEQ ID NO: 138034 - RNA, 18 nt, Human
ccgcgcuccugcuggcug

SEQ ID NO: 138035 - RNA, 20 nt, Human
ccggccccgccccgccccgc

SEQ ID NO: 138036 - RNA, 21 nt, Human
ccugcuggcugucuuuggggc

SEQ ID NO: 138037 - RNA, 19 nt, Human
cgguaccaaggaggacaag

SEQ ID NO: 138038 - RNA, 18 nt, Human
cucgcguggggccugcgg

SEQ ID NO: 138039 - RNA, 20 nt, Human
cugaagacaaccuugaggag

SEQ ID NO: 138040 - RNA, 23 nt, Human
cugcggccaccauccuuugcucu

SEQ ID NO: 138041 - RNA, 22 nt, Human
gaaacaaggcccaaccccaaac

SEQ ID NO: 138042 - RNA, 18 nt, Human
gagacacacaugcuaugg

SEQ ID NO: 138043 - RNA, 23 nt, Human
gaggcagcagcagcagcagcagg

SEQ ID NO: 138044 - RNA, 20 nt, Human
gaggggccguggcgugccgg

SEQ ID NO: 138045 - RNA, 24 nt, Human
gcccauauaugaacacgcacugcu

SEQ ID NO: 138046 - RNA, 18 nt, Human
gcgcaaagucuacacgug

SEQ ID NO: 138047 - RNA, 20 nt, Human
ggcccaaccccaaacagcaa

SEQ ID NO: 138048 - RNA, 20 nt, Human
gucugaagacaaccuugagg

SEQ ID NO: 138049 - RNA, 20 nt, Human
uaaauagacagugcacaccc

SEQ ID NO: 138050 - RNA, 21 nt, Human
uaaauagacagugcacaccua

SEQ ID NO: 138051 - RNA, 18 nt, Human
uaacugcugcguccaugg

SEQ ID NO: 138052 - RNA, 19 nt, Human
uaccaaggaggacaaggau

SEQ ID NO: 138053 - RNA, 20 nt, Human
uaccaaggaggacaaggaug

SEQ ID NO: 138054 - RNA, 20 nt, Human
uagaaagagccacguuugug

SEQ ID NO: 138055 - RNA, 23 nt, Human
uagacagugcacaccuacagcca

SEQ ID NO: 138056 - RNA, 21 nt, Human
uagguauuucuuuuaaugggu

SEQ ID NO: 138057 - RNA, 23 nt, Human
uauuuugcuuucucuccgguucc

SEQ ID NO: 138058 - RNA, 25 nt, Human
uauuuugcuuucucuccgguuccca

SEQ ID NO: 138059 - RNA, 22 nt, Human
uccagauuaaaaaaaaaaaaag

SEQ ID NO: 138060 - RNA, 23 nt, Human
ucccaagcaaaacugccuuccgc

SEQ ID NO: 138061 - RNA, 24 nt, Human
ucccacuccccaccccgcuccaga

SEQ ID NO: 138062 - RNA, 24 nt, Human
ucccuaacgggaacacagaggcug

SEQ ID NO: 138063 - RNA, 22 nt, Human
uccgguucccacuccccacccc

SEQ ID NO: 138064 - RNA, 21 nt, Human
uccugugggcucgcguggggc

SEQ ID NO: 138065 - RNA, 19 nt, Human
ucuccgguucccacucccc

SEQ ID NO: 138066 - RNA, 22 nt, Human
ucuccgguucccacuccccacc

SEQ ID NO: 138067 - RNA, 24 nt, Human
ugaagacaaccuugaggagggagc

SEQ ID NO: 138068 - RNA, 24 nt, Human
ugagugaugaccccggggaaggag

SEQ ID NO: 138069 - RNA, 31 nt, Human
ugcuucuucaucaagcgcaaagucuacacgg

SEQ ID NO: 138070 - RNA, 23 nt, Human
uggaggccgugagugaugacccc

SEQ ID NO: 138071 - RNA, 20 nt, Human
uggcacugcgacgugagaca

SEQ ID NO: 138072 - RNA, 22 nt, Human
ugggaaagagcuugauacggua

SEQ ID NO: 138073 - RNA, 23 nt, Human
ugggcgggucucaugcuuccgcu

SEQ ID NO: 138074 - RNA, 21 nt, Human
ugucuucccccucaguguuua

SEQ ID NO: 138075 - RNA, 23 nt, Human
ugugggcucgcguggggccugcg

SEQ ID NO: 138076 - RNA, 23 nt, Human
uugcucuguuccuugggggaggg

SEQ ID NO: 138077 - RNA, 24 nt, Human
uugcucuguuccuugggggagggg

SEQ ID NO: 138078 - RNA, 21 nt, Human
uuguagccccucaccauguug

SEQ ID NO: 138079 - RNA, 21 nt, Human
cacccagauuugguauguggc

SEQ ID NO: 138080 - RNA, 20 nt, Human
ccccuuuccuuucacccaga

SEQ ID NO: 138081 - RNA, 19 nt, Human
aaauauucucccuauccuc

SEQ ID NO: 138082 - RNA, 25 nt, Human
aacacuaaaacagagaguagucaaa

SEQ ID NO: 138083 - RNA, 18 nt, Human
aacagcuugccuaaccca

SEQ ID NO: 138084 - RNA, 21 nt, Human
acauaaacacuaaaacagaga

SEQ ID NO: 138085 - RNA, 22 nt, Human
accagucagagcccguaugugc

SEQ ID NO: 138086 - RNA, 18 nt, Human
agucagagcccguaugug

SEQ ID NO: 138087 - RNA, 21 nt, Human
agugaacauccaauuaacugc

SEQ ID NO: 138088 - RNA, 19 nt, Human
agugacauuugggguccag

SEQ ID NO: 138089 - RNA, 21 nt, Human
aguugcuauaaucaugaaggu

SEQ ID NO: 138090 - RNA, 24 nt, Human
auaagcaauuucagcgaaggggau

SEQ ID NO: 138091 - RNA, 23 nt, Human
auugaagaugccaugaagaggag

SEQ ID NO: 138092 - RNA, 18 nt, Human
cagaccugagacaguguu

SEQ ID NO: 138093 - RNA, 18 nt, Human
cagcauagggcaauuugg

SEQ ID NO: 138094 - RNA, 18 nt, Human
cauccaauuaacugccac

SEQ ID NO: 138095 - RNA, 22 nt, Human
cauuggcaccaccuuccuuugc

SEQ ID NO: 138096 - RNA, 19 nt, Human
ccucagaaaagaauuauuc

SEQ ID NO: 138097 - RNA, 18 nt, Human
cuauccaacaccaaaaau

SEQ ID NO: 138098 - RNA, 21 nt, Human
cugaacagcuugccuaaccca

SEQ ID NO: 138099 - RNA, 18 nt, Human
gaaucugaacagcuugcc

SEQ ID NO: 138100 - RNA, 23 nt, Human
gcaaaaaaaggaaucugaacagc

SEQ ID NO: 138101 - RNA, 21 nt, Human
gcuauaaucaugaaggugacu

SEQ ID NO: 138102 - RNA, 21 nt, Human
gcuuuaugauauuuuauuuga

SEQ ID NO: 138103 - RNA, 23 nt, Human
guugcuauaaucaugaaggugac

SEQ ID NO: 138104 - RNA, 20 nt, Human
uaaaagaggaugaguuugua

SEQ ID NO: 138105 - RNA, 20 nt, Human
uaauaauaacaaaaaauaua

SEQ ID NO: 138106 - RNA, 23 nt, Human
uaauauauauuaucaacauuaua

SEQ ID NO: 138107 - RNA, 23 nt, Human
uagaaacagcauuaaaauuaaag

SEQ ID NO: 138108 - RNA, 24 nt, Human
uagaaacagcauuaaaauuaaagg

SEQ ID NO: 138109 - RNA, 21 nt, Human
uaugugcacagcaaaagagug

SEQ ID NO: 138110 - RNA, 25 nt, Human
uauuaucaacauuauauuuuucauu

SEQ ID NO: 138111 - RNA, 20 nt, Human
uauucucccuauccucuauc

SEQ ID NO: 138112 - RNA, 21 nt, Human
ucaaacauuaguugcuauaau

SEQ ID NO: 138113 - RNA, 18 nt, Human
ucaauuuuaggcuuucuu

SEQ ID NO: 138114 - RNA, 22 nt, Human
ucuaaaagugcauaaugaaaca

SEQ ID NO: 138115 - RNA, 22 nt, Human
ucuacaaacucaauuuuaggcu

SEQ ID NO: 138116 - RNA, 20 nt, Human
ucuuagaaacagcauuaaaa

SEQ ID NO: 138117 - RNA, 21 nt, Human
ugaaaguucacagcaacuguu

SEQ ID NO: 138118 - RNA, 19 nt, Human
ugaauggucauugacauga

SEQ ID NO: 138119 - RNA, 19 nt, Human
ugacaugaaaguucacagc

SEQ ID NO: 138120 - RNA, 24 nt, Human
ugccauagcaaauaauuuuuugac

SEQ ID NO: 138121 - RNA, 24 nt, Human
uggaaagagcugaacacaaggauc

SEQ ID NO: 138122 - RNA, 20 nt, Human
uggcuguaacgccauuggca

SEQ ID NO: 138123 - RNA, 21 nt, Human
uguacacccaucucacgcaug

SEQ ID NO: 138124 - RNA, 19 nt, Human
uuaaaaccagucagagccc

SEQ ID NO: 138125 - RNA, 20 nt, Human
uuaaugauaaaauguuuccu

SEQ ID NO: 138126 - RNA, 22 nt, Human
uuacugauuaugaaaauagaga

SEQ ID NO: 138127 - RNA, 22 nt, Human
uucuagcucuugaauuugucau

SEQ ID NO: 138128 - RNA, 21 nt, Human
uugacuuucuucauuuguacu

SEQ ID NO: 138129 - RNA, 22 nt, Human
uugcauacuuugagcuuuguuc

SEQ ID NO: 138130 - RNA, 19 nt, Human
uugcuauaaucaugaaggu

SEQ ID NO: 138131 - RNA, 18 nt, Human
uuuacacuuacaaaugua

SEQ ID NO: 138132 - RNA, 22 nt, Human
uuucuuagaaacagcauuaaaa

SEQ ID NO: 138133 - RNA, 20 nt, Human
uuuuaggcuuucuuauccug

SEQ ID NO: 138134 - RNA, 25 nt, Human
aaaaaagaaacuauuuaaacaagaa

SEQ ID NO: 138135 - RNA, 26 nt, Human
aaaaaagaaacuauuuaaacaagaaa

SEQ ID NO: 138136 - RNA, 22 nt, Human
aaaacacagugagaaagacagc

SEQ ID NO: 138137 - RNA, 23 nt, Human
aaguaucaucaaugaauuuccac

SEQ ID NO: 138138 - RNA, 25 nt, Human
agcaacaaaaacacagugagaaaga

SEQ ID NO: 138139 - RNA, 18 nt, Human
aggggcuggguugggcgg

SEQ ID NO: 138140 - RNA, 18 nt, Human
agugagaaagacagcaau

SEQ ID NO: 138141 - RNA, 25 nt, Human
augcagcaacaaaaacacagugaga

SEQ ID NO: 138142 - RNA, 22 nt, Human
caaaaacacagugagaaagaca

SEQ ID NO: 138143 - RNA, 18 nt, Human
cagcccccgagcucugcc

SEQ ID NO: 138144 - RNA, 19 nt, Human
cagcccccgagcucugccu

SEQ ID NO: 138145 - RNA, 21 nt, Human
cagccuccuuuccucugauuu

SEQ ID NO: 138146 - RNA, 20 nt, Human
cccccgagcucugccucagg

SEQ ID NO: 138147 - RNA, 21 nt, Human
cgcgggguccuacucggcccg

SEQ ID NO: 138148 - RNA, 19 nt, Human
gaaagaaaaucaaagaagc

SEQ ID NO: 138149 - RNA, 19 nt, Human
gaguugaauaaggccugcu

SEQ ID NO: 138150 - RNA, 23 nt, Human
gcgggccgggcgggcuuggggug

SEQ ID NO: 138151 - RNA, 18 nt, Human
ggcccgggcugcgcgcag

SEQ ID NO: 138152 - RNA, 19 nt, Human
gggccgggcgggcuugggg

SEQ ID NO: 138153 - RNA, 18 nt, Human
gggcugcgcgcaggggcu

SEQ ID NO: 138154 - RNA, 21 nt, Human
ggguugggcgggccgggcggg

SEQ ID NO: 138155 - RNA, 18 nt, Human
uaaaguaucaucaaugaa

SEQ ID NO: 138156 - RNA, 18 nt, Human
uacaagcaaagaugacau

SEQ ID NO: 138157 - RNA, 23 nt, Human
uaccuucaaucuuaugcagcaac

SEQ ID NO: 138158 - RNA, 19 nt, Human
uaugcagcaacaaaaacac

SEQ ID NO: 138159 - RNA, 22 nt, Human
ucaaucuuaugcagcaacaaaa

SEQ ID NO: 138160 - RNA, 18 nt, Human
ucaaugaauuuccacaca

SEQ ID NO: 138161 - RNA, 23 nt, Human
uccccaccgacagcccccgagcu

SEQ ID NO: 138162 - RNA, 21 nt, Human
ucuccauggguugacaauguu

SEQ ID NO: 138163 - RNA, 19 nt, Human
ugagaaagacagcaauugc

SEQ ID NO: 138164 - RNA, 18 nt, Human
ugggcgggccgggcgggc

SEQ ID NO: 138165 - RNA, 21 nt, Human
uggguugggcgggccgggcgg

SEQ ID NO: 138166 - RNA, 23 nt, Human
uggugaauuuuuucuaaaggauc

SEQ ID NO: 138167 - RNA, 31 nt, Human
uuggcugugaagggaauggcagccuccuuuu

SEQ ID NO: 138168 - RNA, 21 nt, Human
aaaaacccaaaaccccaacca

SEQ ID NO: 138169 - RNA, 22 nt, Human
aaaaacccaaaaccccaaccag

SEQ ID NO: 138170 - RNA, 23 nt, Human
aaaaccccaaccagauccccaaa

SEQ ID NO: 138171 - RNA, 24 nt, Human
aaacaacaacaacaaaaaacccaa

SEQ ID NO: 138172 - RNA, 25 nt, Human
aaacaacaacaacaaaaaacccaaa

SEQ ID NO: 138173 - RNA, 19 nt, Human
aaacaaccaaaaauuacca

SEQ ID NO: 138174 - RNA, 22 nt, Human
aaacaaccaaaacaaccaaaaa

SEQ ID NO: 138175 - RNA, 23 nt, Human
aaacaaccaaaacaaccaaaaau

SEQ ID NO: 138176 - RNA, 23 nt, Human
aaacaccgucuccgagacaaggg

SEQ ID NO: 138177 - RNA, 22 nt, Human
aaaggagagggaaggauggaga

SEQ ID NO: 138178 - RNA, 21 nt, Human
aacaaaaaacccaaaacccca

SEQ ID NO: 138179 - RNA, 22 nt, Human
aacaaaaaacccaaaaccccaa

SEQ ID NO: 138180 - RNA, 23 nt, Human
aacaaaaaacccaaaaccccaac

SEQ ID NO: 138181 - RNA, 20 nt, Human
aacaaauaaacaacaacaac

SEQ ID NO: 138182 - RNA, 26 nt, Human
aacaacaacaaaaaacccaaaacccc

SEQ ID NO: 138183 - RNA, 24 nt, Human
aacaaccaaaacaaccaaaaauua

SEQ ID NO: 138184 - RNA, 23 nt, Human
aacaugcuuacacagccugcaga

SEQ ID NO: 138185 - RNA, 21 nt, Human
aaccaaaaauuaccaugaccc

SEQ ID NO: 138186 - RNA, 23 nt, Human
aaccaaaaauuaccaugacccgg

SEQ ID NO: 138187 - RNA, 24 nt, Human
aaccacccggaaucagcuggguga

SEQ ID NO: 138188 - RNA, 20 nt, Human
aagagaagagaauccucaaa

SEQ ID NO: 138189 - RNA, 21 nt, Human
aagcaagccaacagguaaaca

SEQ ID NO: 138190 - RNA, 23 nt, Human
aagggugcaaccgcuucgcuggu

SEQ ID NO: 138191 - RNA, 23 nt, Human
aauaacaaauaaacaacaacaac

SEQ ID NO: 138192 - RNA, 28 nt, Human
aauaacaaauaaacaacaacaacaaaaa

SEQ ID NO: 138193 - RNA, 22 nt, Human
aaugcaacacaagucagcaagg

SEQ ID NO: 138194 - RNA, 18 nt, Human
aaugguaaaagagaagag

SEQ ID NO: 138195 - RNA, 25 nt, Human
aauucacuuuaucuucccucccccc

SEQ ID NO: 138196 - RNA, 24 nt, Human
acaaaaaacccaaaaccccaacca

SEQ ID NO: 138197 - RNA, 23 nt, Human
acaaagcaagccaacagguaaac

SEQ ID NO: 138198 - RNA, 19 nt, Human
acaacaaaaaacccaaaac

SEQ ID NO: 138199 - RNA, 22 nt, Human
acaacaacaaaaaacccaaaac

SEQ ID NO: 138200 - RNA, 23 nt, Human
acaacaacaaaaaacccaaaacc

SEQ ID NO: 138201 - RNA, 24 nt, Human
acaacaacaaaaaacccaaaaccc

SEQ ID NO: 138202 - RNA, 19 nt, Human
acaacaacaacaaaaaacc

SEQ ID NO: 138203 - RNA, 19 nt, Human
acacacaaagcaagccaac

SEQ ID NO: 138204 - RNA, 24 nt, Human
acacagccugcagaaaucgucagg

SEQ ID NO: 138205 - RNA, 18 nt, Human
acagacaucaccuguggu

SEQ ID NO: 138206 - RNA, 24 nt, Human
acagugguuacaaaaaaaaaagua

SEQ ID NO: 138207 - RNA, 24 nt, Human
accacauuuugcuuuauuaggcgu

SEQ ID NO: 138208 - RNA, 24 nt, Human
acccaaaaccccaaccagaucccc

SEQ ID NO: 138209 - RNA, 22 nt, Human
accgugacuuuagccagagagc

SEQ ID NO: 138210 - RNA, 26 nt, Human
accuguggucucuaagggggccaugu

SEQ ID NO: 138211 - RNA, 25 nt, Human
acgcuuuacaaaaagcagauuuggu

SEQ ID NO: 138212 - RNA, 22 nt, Human
agaaaaaggcagcucugggcaa

SEQ ID NO: 138213 - RNA, 23 nt, Human
agaaaagaaaaaggcagcucugg

SEQ ID NO: 138214 - RNA, 24 nt, Human
agaaaagaaaaaggcagcucuggg

SEQ ID NO: 138215 - RNA, 20 nt, Human
agacagacacgaaaauauuc

SEQ ID NO: 138216 - RNA, 22 nt, Human
agagaagagaauccucaaagga

SEQ ID NO: 138217 - RNA, 19 nt, Human
agagagacagacacgaaaa

SEQ ID NO: 138218 - RNA, 19 nt, Human
agagagagacagacacgaa

SEQ ID NO: 138219 - RNA, 27 nt, Human
agagagagagagagagagagagaagga

SEQ ID NO: 138220 - RNA, 20 nt, Human
agcaaaaucuaggccaauaa

SEQ ID NO: 138221 - RNA, 21 nt, Human
aggaaaaacaggaagacucaa

SEQ ID NO: 138222 - RNA, 21 nt, Human
aggaagaaagaagucucagaa

SEQ ID NO: 138223 - RNA, 18 nt, Human
aggcggacccaacgacca

SEQ ID NO: 138224 - RNA, 19 nt, Human
auaacgcaagccugccccu

SEQ ID NO: 138225 - RNA, 18 nt, Human
aucaagucacugcaguua

SEQ ID NO: 138226 - RNA, 25 nt, Human
aucuaggccaauaacgcaagccugc

SEQ ID NO: 138227 - RNA, 22 nt, Human
auugcuuaagagaaccuguaaa

SEQ ID NO: 138228 - RNA, 22 nt, Human
caaaaaacccaaaaccccaacc

SEQ ID NO: 138229 - RNA, 25 nt, Human
caaaaaacccaaaaccccaaccaga

SEQ ID NO: 138230 - RNA, 19 nt, Human
caaaacaaccaaaaauuac

SEQ ID NO: 138231 - RNA, 21 nt, Human
caaaaccccaaccagaucccc

SEQ ID NO: 138232 - RNA, 22 nt, Human
caaaaccccaaccagaucccca

SEQ ID NO: 138233 - RNA, 18 nt, Human
caacaaaaaacccaaaac

SEQ ID NO: 138234 - RNA, 21 nt, Human
caacaaaaaacccaaaacccc

SEQ ID NO: 138235 - RNA, 25 nt, Human
caacaacaaaaaacccaaaacccca

SEQ ID NO: 138236 - RNA, 26 nt, Human
caacaacaaaaaacccaaaaccccaa

SEQ ID NO: 138237 - RNA, 18 nt, Human
caacaacaacaaaaaacc

SEQ ID NO: 138238 - RNA, 22 nt, Human
caacaacaacaaaaaacccaaa

SEQ ID NO: 138239 - RNA, 19 nt, Human
caagugaauacuagagcug

SEQ ID NO: 138240 - RNA, 20 nt, Human
caaugcaacacaagucagca

SEQ ID NO: 138241 - RNA, 19 nt, Human
cacaguaacuaucacaggc

SEQ ID NO: 138242 - RNA, 18 nt, Human
cacuaugcuugcaauggc

SEQ ID NO: 138243 - RNA, 25 nt, Human
cagaauguccucaggugucccaucc

SEQ ID NO: 138244 - RNA, 21 nt, Human
cagcaggcccucgggucagac

SEQ ID NO: 138245 - RNA, 19 nt, Human
cagccucauaccucuaaag

SEQ ID NO: 138246 - RNA, 25 nt, Human
cagccucauaccucuaaagcuucug

SEQ ID NO: 138247 - RNA, 24 nt, Human
cagcuagggcggaaaaaaaagaga

SEQ ID NO: 138248 - RNA, 18 nt, Human
caggaagcagcaggcccu

SEQ ID NO: 138249 - RNA, 22 nt, Human
caggugucccauccccaguccc

SEQ ID NO: 138250 - RNA, 25 nt, Human
caugacccgguacaggaaaaacagg

SEQ ID NO: 138251 - RNA, 26 nt, Human
cauuaggauguccaguucaaaccccu

SEQ ID NO: 138252 - RNA, 20 nt, Human
cauuguggagccucucagga

SEQ ID NO: 138253 - RNA, 23 nt, Human
ccaaaaccccaaccagaucccca

SEQ ID NO: 138254 - RNA, 23 nt, Human
ccaauaacgcaagccugccccuu

SEQ ID NO: 138255 - RNA, 34 nt, Human
ccaauuuaguauuuaaaaaaaaaaaaaaaaaaag

SEQ ID NO: 138256 - RNA, 24 nt, Human
ccaguccccaguggacgcacagcc

SEQ ID NO: 138257 - RNA, 20 nt, Human
cccaaaaccccaaccagauc

SEQ ID NO: 138258 - RNA, 21 nt, Human
cccaaaaccccaaccagaucc

SEQ ID NO: 138259 - RNA, 23 nt, Human
cccaaaaccccaaccagaucccc

SEQ ID NO: 138260 - RNA, 24 nt, Human
cccaaaaccccaaccagaucccca

SEQ ID NO: 138261 - RNA, 26 nt, Human
cccaaaaccccaaccagauccccaaa

SEQ ID NO: 138262 - RNA, 19 nt, Human
cccaaccagauccccaaag

SEQ ID NO: 138263 - RNA, 19 nt, Human
ccccaugaacuggcugcuc

SEQ ID NO: 138264 - RNA, 22 nt, Human
ccccuuuaucaacagcugaccc

SEQ ID NO: 138265 - RNA, 22 nt, Human
cccggaaucagcugggugauga

SEQ ID NO: 138266 - RNA, 24 nt, Human
cccugaccccggccccuccccagc

SEQ ID NO: 138267 - RNA, 18 nt, Human
cuagcacacauccucaug

SEQ ID NO: 138268 - RNA, 18 nt, Human
cuccuccaacacagcccc

SEQ ID NO: 138269 - RNA, 22 nt, Human
cucuccuccaacacagccccag

SEQ ID NO: 138270 - RNA, 19 nt, Human
cugacccugaagacuacag

SEQ ID NO: 138271 - RNA, 22 nt, Human
cugugggugagacggcauggcc

SEQ ID NO: 138272 - RNA, 20 nt, Human
cuucuuaaaauuuuuaaaaa

SEQ ID NO: 138273 - RNA, 27 nt, Human
gaaaguuccuccacucaugggucacaa

SEQ ID NO: 138274 - RNA, 21 nt, Human
gacccaacgaccaccaugaaa

SEQ ID NO: 138275 - RNA, 23 nt, Human
gaccccggccccuccccagcccc

SEQ ID NO: 138276 - RNA, 25 nt, Human
gaccccggccccuccccagccccac

SEQ ID NO: 138277 - RNA, 18 nt, Human
gagagagaaagagagagu

SEQ ID NO: 138278 - RNA, 19 nt, Human
gagcacugcacagaggaaa

SEQ ID NO: 138279 - RNA, 18 nt, Human
gagcugcaaguguuucuu

SEQ ID NO: 138280 - RNA, 22 nt, Human
gcaacacaagucagcaaggaca

SEQ ID NO: 138281 - RNA, 19 nt, Human
gcggacccaacgaccacca

SEQ ID NO: 138282 - RNA, 22 nt, Human
gcuagagagagaaagagagagu

SEQ ID NO: 138283 - RNA, 23 nt, Human
gcucuuaaaaaaaaaaacaaaaa

SEQ ID NO: 138284 - RNA, 18 nt, Human
gcuuacacagccugcaga

SEQ ID NO: 138285 - RNA, 19 nt, Human
gcuugguggguagucuugg

SEQ ID NO: 138286 - RNA, 20 nt, Human
ggaaaaacaggaagacucaa

SEQ ID NO: 138287 - RNA, 21 nt, Human
ggaaaaacaggaagacucaag

SEQ ID NO: 138288 - RNA, 21 nt, Human
ggaaguggaugagcaaaauca

SEQ ID NO: 138289 - RNA, 18 nt, Human
ggaauaauaaacacgaga

SEQ ID NO: 138290 - RNA, 21 nt, Human
ggugacagaaaaggagaggga

SEQ ID NO: 138291 - RNA, 25 nt, Human
ggugacagaaaaggagagggaagga

SEQ ID NO: 138292 - RNA, 24 nt, Human
gugcaggugagaaaaaaagcaaau

SEQ ID NO: 138293 - RNA, 27 nt, Human
uaaacaacaacaacaaaaaacccaaaa

SEQ ID NO: 138294 - RNA, 21 nt, Human
uaacacagaguucuuaaggaa

SEQ ID NO: 138295 - RNA, 24 nt, Human
uaacagacacacaaagcaagccaa

SEQ ID NO: 138296 - RNA, 22 nt, Human
uaagaaaacaaccaaaacaacc

SEQ ID NO: 138297 - RNA, 18 nt, Human
uaaguguugggugugguu

SEQ ID NO: 138298 - RNA, 24 nt, Human
uaauuauuuugccaucaagacagu

SEQ ID NO: 138299 - RNA, 18 nt, Human
uaccaugacccgguacag

SEQ ID NO: 138300 - RNA, 19 nt, Human
uaggauguccaguucaaac

SEQ ID NO: 138301 - RNA, 20 nt, Human
uaggcggacccaacgaccac

SEQ ID NO: 138302 - RNA, 23 nt, Human
uagggcggaaaaaaaagagagag

SEQ ID NO: 138303 - RNA, 20 nt, Human
uaucaacagcugacccugaa

SEQ ID NO: 138304 - RNA, 22 nt, Human
uaugacauucauuuaacagaca

SEQ ID NO: 138305 - RNA, 23 nt, Human
uaugacauucauuuaacagacac

SEQ ID NO: 138306 - RNA, 18 nt, Human
uauucagaaaagccugca

SEQ ID NO: 138307 - RNA, 21 nt, Human
ucacugcaguuauucaguucu

SEQ ID NO: 138308 - RNA, 26 nt, Human
ucagcaaggacagggguagguccaaa

SEQ ID NO: 138309 - RNA, 23 nt, Human
ucaggacagacacgaugaguuug

SEQ ID NO: 138310 - RNA, 18 nt, Human
uccacucaugggucacaa

SEQ ID NO: 138311 - RNA, 18 nt, Human
ucccauccccagucccca

SEQ ID NO: 138312 - RNA, 19 nt, Human
ucccauccccaguccccag

SEQ ID NO: 138313 - RNA, 20 nt, Human
ucccauccccaguccccagu

SEQ ID NO: 138314 - RNA, 20 nt, Human
uccccgaaaauaaaaagcuc

SEQ ID NO: 138315 - RNA, 23 nt, Human
uccccgaaaauaaaaagcuccca

SEQ ID NO: 138316 - RNA, 18 nt, Human
uccgagacaagggcugga

SEQ ID NO: 138317 - RNA, 24 nt, Human
uccugcacuuggccagggucccac

SEQ ID NO: 138318 - RNA, 20 nt, Human
ucucuuucuuccucuccucc

SEQ ID NO: 138319 - RNA, 20 nt, Human
ucugucucucuuucuuccuc

SEQ ID NO: 138320 - RNA, 24 nt, Human
ucuuaaauccuacacuguuuuaga

SEQ ID NO: 138321 - RNA, 21 nt, Human
ucuucccuccccccaugaaaa

SEQ ID NO: 138322 - RNA, 19 nt, Human
ucuucuggcuacacacuuu

SEQ ID NO: 138323 - RNA, 24 nt, Human
ucuuucuauguagugugucuuuag

SEQ ID NO: 138324 - RNA, 20 nt, Human
ugaaaugguagaccugggag

SEQ ID NO: 138325 - RNA, 22 nt, Human
ugaacuggugacuuugguuggu

SEQ ID NO: 138326 - RNA, 18 nt, Human
ugaaugcaauccucuguc

SEQ ID NO: 138327 - RNA, 21 nt, Human
ugacacagcacuaugcuugca

SEQ ID NO: 138328 - RNA, 22 nt, Human
ugacccgguacaggaaaaacag

SEQ ID NO: 138329 - RNA, 22 nt, Human
ugcaggugagaaaaaaagcaaa

SEQ ID NO: 138330 - RNA, 23 nt, Human
ugccgggaaggggacuuggguuu

SEQ ID NO: 138331 - RNA, 24 nt, Human
ugccgggaaggggacuuggguuuu

SEQ ID NO: 138332 - RNA, 22 nt, Human
ugcuauuaggaaauuucaagaa

SEQ ID NO: 138333 - RNA, 21 nt, Human
uggcaggugguuagcaccagu

SEQ ID NO: 138334 - RNA, 21 nt, Human
uggcgaugcgggugggcauug

SEQ ID NO: 138335 - RNA, 24 nt, Human
ugggaaaaaauuaauuucaagagg

SEQ ID NO: 138336 - RNA, 20 nt, Human
uggggccccaagggggaccc

SEQ ID NO: 138337 - RNA, 24 nt, Human
ugggugugguucccuguaugagcu

SEQ ID NO: 138338 - RNA, 19 nt, Human
ugguaaaagagaagagaau

SEQ ID NO: 138339 - RNA, 23 nt, Human
ugucucucuuucuuccucuccuc

SEQ ID NO: 138340 - RNA, 19 nt, Human
ugugauguuuuuacgcuuu

SEQ ID NO: 138341 - RNA, 21 nt, Human
ugugggugagacggcauggcc

SEQ ID NO: 138342 - RNA, 19 nt, Human
uguucgcaugucuaagugu

SEQ ID NO: 138343 - RNA, 21 nt, Human
uguuuuguuuuguuuuuuucc

SEQ ID NO: 138344 - RNA, 25 nt, Human
uguuuuguuuuguuuuuuuccuuug

SEQ ID NO: 138345 - RNA, 26 nt, Human
uuaaaaaccaucuauucuuaaauccu

SEQ ID NO: 138346 - RNA, 24 nt, Human
uuaacagacacacaaagcaagcca

SEQ ID NO: 138347 - RNA, 18 nt, Human
uuagcacuucugaacugg

SEQ ID NO: 138348 - RNA, 22 nt, Human
uucacuuuaucuucccuccccc

SEQ ID NO: 138349 - RNA, 22 nt, Human
uugccaucaagacagugguuac

SEQ ID NO: 138350 - RNA, 20 nt, Human
uuuauaagguuuccucccca

SEQ ID NO: 138351 - RNA, 21 nt, Human
uuugaguuuauagggccucuu

SEQ ID NO: 138352 - RNA, 21 nt, Human
uuuguuuuguuuuuuuccuuu

SEQ ID NO: 138353 - RNA, 23 nt, Human
aaacagaaaacaaagcaauauuc

SEQ ID NO: 138354 - RNA, 21 nt, Human
aaacgaaacaaaucugaauau

SEQ ID NO: 138355 - RNA, 19 nt, Human
aaagaaaagcacuacaaga

SEQ ID NO: 138356 - RNA, 18 nt, Human
aaagguucugguggaaug

SEQ ID NO: 138357 - RNA, 22 nt, Human
aaaucuugugcagaaucaaagg

SEQ ID NO: 138358 - RNA, 20 nt, Human
aacacaauauacaacacccc

SEQ ID NO: 138359 - RNA, 18 nt, Human
aagagcuuuaaaauagca

SEQ ID NO: 138360 - RNA, 23 nt, Human
aagaggcagggagggcaagagga

SEQ ID NO: 138361 - RNA, 24 nt, Human
aagaggccugagcaaacacuggca

SEQ ID NO: 138362 - RNA, 22 nt, Human
aagguggaaccagguccacaaa

SEQ ID NO: 138363 - RNA, 19 nt, Human
aauggaaggggaaacaggu

SEQ ID NO: 138364 - RNA, 26 nt, Human
aauuccuuuguagcccaguguguacu

SEQ ID NO: 138365 - RNA, 20 nt, Human
acacagaacugaacacccac

SEQ ID NO: 138366 - RNA, 26 nt, Human
accagacacagaacugaacacccagu

SEQ ID NO: 138367 - RNA, 19 nt, Human
acccacccaccucccuccu

SEQ ID NO: 138368 - RNA, 18 nt, Human
accgggauggauugccau

SEQ ID NO: 138369 - RNA, 18 nt, Human
accuaauaaaaccaacuu

SEQ ID NO: 138370 - RNA, 23 nt, Human
agaacugaacacccacacaccag

SEQ ID NO: 138371 - RNA, 21 nt, Human
agacacaaaguucccccagag

SEQ ID NO: 138372 - RNA, 20 nt, Human
agcucuucacguuccagagc

SEQ ID NO: 138373 - RNA, 23 nt, Human
aggaaagagaaggauuugaaagc

SEQ ID NO: 138374 - RNA, 19 nt, Human
aggaagagaagugucauuu

SEQ ID NO: 138375 - RNA, 25 nt, Human
agggaaagagauauucaacucugac

SEQ ID NO: 138376 - RNA, 22 nt, Human
aggugguuuggaauggaaaggu

SEQ ID NO: 138377 - RNA, 19 nt, Human
auaaacagaaaacaaagca

SEQ ID NO: 138378 - RNA, 22 nt, Human
augaguguaucugggacucaag

SEQ ID NO: 138379 - RNA, 20 nt, Human
caaagaacagaacccaaaga

SEQ ID NO: 138380 - RNA, 25 nt, Human
caacacaauauacaacaccccuucc

SEQ ID NO: 138381 - RNA, 22 nt, Human
caacaccccuuccacucaccug

SEQ ID NO: 138382 - RNA, 20 nt, Human
caagggaugagauggcaaag

SEQ ID NO: 138383 - RNA, 18 nt, Human
cacagaacugaacaccca

SEQ ID NO: 138384 - RNA, 27 nt, Human
caccagacacagaacugaacacccacu

SEQ ID NO: 138385 - RNA, 21 nt, Human
cacccacucaccccaaauaac

SEQ ID NO: 138386 - RNA, 18 nt, Human
caccccuuccacucaccu

SEQ ID NO: 138387 - RNA, 19 nt, Human
caccccuuccacucaccug

SEQ ID NO: 138388 - RNA, 28 nt, Human
caccccuuccacucaccugacccaguuu

SEQ ID NO: 138389 - RNA, 22 nt, Human
cacccuuuccacuacccaagga

SEQ ID NO: 138390 - RNA, 18 nt, Human
caccuaauaaaaccaacu

SEQ ID NO: 138391 - RNA, 26 nt, Human
caccugacccacccaccucccuccua

SEQ ID NO: 138392 - RNA, 28 nt, Human
caccuugcuccaggcucccaccacccac

SEQ ID NO: 138393 - RNA, 22 nt, Human
cacucaccccaaauaaccugcg

SEQ ID NO: 138394 - RNA, 18 nt, Human
cagccccucugcacccuc

SEQ ID NO: 138395 - RNA, 19 nt, Human
cagcugcuggcuuuuaaga

SEQ ID NO: 138396 - RNA, 22 nt, Human
caggacuugcuccaaaacugaa

SEQ ID NO: 138397 - RNA, 22 nt, Human
caggagauuacugucuguccau

SEQ ID NO: 138398 - RNA, 19 nt, Human
caggcucccaccacccacu

SEQ ID NO: 138399 - RNA, 21 nt, Human
caucugagcuaaaauccugac

SEQ ID NO: 138400 - RNA, 20 nt, Human
cauuaacagucacgugauga

SEQ ID NO: 138401 - RNA, 24 nt, Human
ccaaacacccuuuccacuacccaa

SEQ ID NO: 138402 - RNA, 21 nt, Human
ccacaaaaugugcucccucug

SEQ ID NO: 138403 - RNA, 20 nt, Human
ccaccacccacucaccccaa

SEQ ID NO: 138404 - RNA, 23 nt, Human
ccaccacccacucaccccaaaua

SEQ ID NO: 138405 - RNA, 19 nt, Human
ccacucaccugacccaccc

SEQ ID NO: 138406 - RNA, 22 nt, Human
ccagaagcaugccacucuucuc

SEQ ID NO: 138407 - RNA, 21 nt, Human
ccagacacagaacugaacacc

SEQ ID NO: 138408 - RNA, 21 nt, Human
cccaagcccguggcccucaga

SEQ ID NO: 138409 - RNA, 18 nt, Human
cccaccacccacucaccc

SEQ ID NO: 138410 - RNA, 22 nt, Human
cccaccacccacucaccccaaa

SEQ ID NO: 138411 - RNA, 24 nt, Human
cccaccacccacucaccccaaaua

SEQ ID NO: 138412 - RNA, 21 nt, Human
cccagccccucugcacccucc

SEQ ID NO: 138413 - RNA, 19 nt, Human
cccagcuugucuguccccu

SEQ ID NO: 138414 - RNA, 21 nt, Human
ccccuuccacucaccugaccc

SEQ ID NO: 138415 - RNA, 19 nt, Human
cccucccuccuucuucugc

SEQ ID NO: 138416 - RNA, 18 nt, Human
cccuccuucuucugcucc

SEQ ID NO: 138417 - RNA, 20 nt, Human
ccucaccacgugggccugug

SEQ ID NO: 138418 - RNA, 22 nt, Human
ccuccuacaugcccuaccccag

SEQ ID NO: 138419 - RNA, 21 nt, Human
cgacagcaacggcgacagcaa

SEQ ID NO: 138420 - RNA, 23 nt, Human
cgacagcaacggcgacagcaacg

SEQ ID NO: 138421 - RNA, 22 nt, Human
cgagagaaucaaacacaaacug

SEQ ID NO: 138422 - RNA, 24 nt, Human
cggcucgcccgcgccuuccucagc

SEQ ID NO: 138423 - RNA, 21 nt, Human
cgggauggauugccaucuggg

SEQ ID NO: 138424 - RNA, 21 nt, Human
cgggauggauugccaucuggg

SEQ ID NO: 138425 - RNA, 20 nt, Human
cuaaacucaaaacacaguuu

SEQ ID NO: 138426 - RNA, 21 nt, Human
cucaccugacccacccaccuc

SEQ ID NO: 138427 - RNA, 18 nt, Human
cucccaccacccacucac

SEQ ID NO: 138428 - RNA, 19 nt, Human
cucgcaauucccagggauu

SEQ ID NO: 138429 - RNA, 18 nt, Human
cucgcccgcgccuuccuc

SEQ ID NO: 138430 - RNA, 19 nt, Human
cugcacccuccaccuugcu

SEQ ID NO: 138431 - RNA, 21 nt, Human
cugcacccuccaccuugcucc

SEQ ID NO: 138432 - RNA, 21 nt, Human
cugcagcggcuggcucccucc

SEQ ID NO: 138433 - RNA, 21 nt, Human
cugccuggccuucccaaccca

SEQ ID NO: 138434 - RNA, 24 nt, Human
cugucccugccuggccuucccaac

SEQ ID NO: 138435 - RNA, 25 nt, Human
cuucuagaaaacuuagaaguacaag

SEQ ID NO: 138436 - RNA, 19 nt, Human
cuucuugcuucugccccuc

SEQ ID NO: 138437 - RNA, 21 nt, Human
cuuucaaaaacuccuauuuau

SEQ ID NO: 138438 - RNA, 21 nt, Human
gauggcaggggcauccucagg

SEQ ID NO: 138439 - RNA, 21 nt, Human
gauuugaaagcaacacuaaga

SEQ ID NO: 138440 - RNA, 19 nt, Human
gcagagcagagagugcaga

SEQ ID NO: 138441 - RNA, 18 nt, Human
gccagugaauucgaagag

SEQ ID NO: 138442 - RNA, 24 nt, Human
gcugugggugcccucaccacgugg

SEQ ID NO: 138443 - RNA, 20 nt, Human
ggagaaacauaaggcuugag

SEQ ID NO: 138444 - RNA, 22 nt, Human
ggcuguggcugguacugcaacc

SEQ ID NO: 138445 - RNA, 23 nt, Human
gggaaagagauauucaacucuga

SEQ ID NO: 138446 - RNA, 21 nt, Human
ggggagaaagccugggaagcu

SEQ ID NO: 138447 - RNA, 19 nt, Human
gguggaagaaaugguuggg

SEQ ID NO: 138448 - RNA, 23 nt, Human
gguguaccauuuuggcuucaaaa

SEQ ID NO: 138449 - RNA, 23 nt, Human
guauaggccuguuugaugugucu

SEQ ID NO: 138450 - RNA, 18 nt, Human
guuaguaaugguaaguga

SEQ ID NO: 138451 - RNA, 20 nt, Human
guuccagagcugccucacag

SEQ ID NO: 138452 - RNA, 20 nt, Human
uaaccagguuuacauuaaca

SEQ ID NO: 138453 - RNA, 18 nt, Human
uaagaaagaggccugagc

SEQ ID NO: 138454 - RNA, 23 nt, Human
uaagaaagaggccugagcaaaca

SEQ ID NO: 138455 - RNA, 19 nt, Human
uaagagcuacauuuucccu

SEQ ID NO: 138456 - RNA, 22 nt, Human
uaauaaccagguuuacauuaac

SEQ ID NO: 138457 - RNA, 18 nt, Human
uacaugcccuaccccagc

SEQ ID NO: 138458 - RNA, 18 nt, Human
uacugcaaccuaucccaa

SEQ ID NO: 138459 - RNA, 18 nt, Human
uagaaguacaagaaauag

SEQ ID NO: 138460 - RNA, 19 nt, Human
uaggcaagcgagcguaaca

SEQ ID NO: 138461 - RNA, 18 nt, Human
uaggggaaauccuguucc

SEQ ID NO: 138462 - RNA, 21 nt, Human
uaugaaacgaaacaaaucuga

SEQ ID NO: 138463 - RNA, 21 nt, Human
ucaaaacacaguuuuguucac

SEQ ID NO: 138464 - RNA, 21 nt, Human
ucaaagguucugguggaaugg

SEQ ID NO: 138465 - RNA, 22 nt, Human
ucaccugacccacccaccuccc

SEQ ID NO: 138466 - RNA, 22 nt, Human
uccaaauuccuuuguagcccag

SEQ ID NO: 138467 - RNA, 22 nt, Human
uccacuacccaagcccguggcc

SEQ ID NO: 138468 - RNA, 23 nt, Human
uccaggcucaggugucagcccuu

SEQ ID NO: 138469 - RNA, 23 nt, Human
ucccaagggcauuuggggguugu

SEQ ID NO: 138470 - RNA, 18 nt, Human
ucccagagcaaggaaauc

SEQ ID NO: 138471 - RNA, 20 nt, Human
ucccagguugaacauauuuc

SEQ ID NO: 138472 - RNA, 25 nt, Human
ucccagguugaacauauuucuucug

SEQ ID NO: 138473 - RNA, 18 nt, Human
ucccugacgucccagcuu

SEQ ID NO: 138474 - RNA, 19 nt, Human
ucccugccuggccuuccca

SEQ ID NO: 138475 - RNA, 18 nt, Human
uccugagcucauguuguu

SEQ ID NO: 138476 - RNA, 21 nt, Human
uccuuggcuaucuccaaauuc

SEQ ID NO: 138477 - RNA, 19 nt, Human
ucucggcagacccuaggga

SEQ ID NO: 138478 - RNA, 21 nt, Human
ucuuaaauaucgguguaccau

SEQ ID NO: 138479 - RNA, 19 nt, Human
ugaaagacccccacaucuu

SEQ ID NO: 138480 - RNA, 18 nt, Human
ugacaaagaacagaaccc

SEQ ID NO: 138481 - RNA, 21 nt, Human
ugacaaagaacagaacccaaa

SEQ ID NO: 138482 - RNA, 24 nt, Human
ugacccacccaccucccuccuaca

SEQ ID NO: 138483 - RNA, 19 nt, Human
ugagacacaaaguuccccc

SEQ ID NO: 138484 - RNA, 19 nt, Human
ugagauggcaaaggacagc

SEQ ID NO: 138485 - RNA, 21 nt, Human
ugagauggcaaaggacagcuu

SEQ ID NO: 138486 - RNA, 21 nt, Human
ugagauggcaaaggacagcuu

SEQ ID NO: 138487 - RNA, 24 nt, Human
ugagauggcaaaggacagcuuugg

SEQ ID NO: 138488 - RNA, 19 nt, Human
ugaggccugcucuucucuu

SEQ ID NO: 138489 - RNA, 24 nt, Human
ugaguaacagcagagcagagagug

SEQ ID NO: 138490 - RNA, 19 nt, Human
ugaugugacagcugccaca

SEQ ID NO: 138491 - RNA, 22 nt, Human
ugauuugaacagaagguagcuu

SEQ ID NO: 138492 - RNA, 23 nt, Human
ugcauaaacagaaaacaaagcaa

SEQ ID NO: 138493 - RNA, 20 nt, Human
ugcccagggcagcccaugag

SEQ ID NO: 138494 - RNA, 21 nt, Human
ugcuuggagaguuaguaaugg

SEQ ID NO: 138495 - RNA, 24 nt, Human
uggcaaaggacagcuuuggaauca

SEQ ID NO: 138496 - RNA, 19 nt, Human
uggcaggggcauccucagg

SEQ ID NO: 138497 - RNA, 21 nt, Human
uggcccucagagagaaccggg

SEQ ID NO: 138498 - RNA, 26 nt, Human
uggcucccucccuccuucuucugcuc

SEQ ID NO: 138499 - RNA, 20 nt, Human
uggcuucaaaacaaucucuu

SEQ ID NO: 138500 - RNA, 22 nt, Human
ugggaagcuuguggcaaggaag

SEQ ID NO: 138501 - RNA, 23 nt, Human
ugggaauugcccacccuacugga

SEQ ID NO: 138502 - RNA, 18 nt, Human
ugggacucaagcuggagu

SEQ ID NO: 138503 - RNA, 23 nt, Human
ugggccugugcuauguucucagc

SEQ ID NO: 138504 - RNA, 24 nt, Human
ugucuuaugaaacgaaacaaaucu

SEQ ID NO: 138505 - RNA, 21 nt, Human
ugugcagaaucaaagguucug

SEQ ID NO: 138506 - RNA, 23 nt, Human
uuacauuaacagucacgugauga

SEQ ID NO: 138507 - RNA, 21 nt, Human
uucaaaccugcagucagagac

SEQ ID NO: 138508 - RNA, 18 nt, Human
uucacguuccagagcugc

SEQ ID NO: 138509 - RNA, 21 nt, Human
uuuaacaauuucccaaacacc

SEQ ID NO: 138510 - RNA, 27 nt, Human
uuuaacaauuucccaaacacccuuucc

SEQ ID NO: 138511 - RNA, 21 nt, Human
uuuccucuaucugcuggcugu

SEQ ID NO: 138512 - RNA, 22 nt, Human
uuuggcuuucccaguuccccac

SEQ ID NO: 138513 - RNA, 19 nt, Human
aacacuguuuauugaucaa

SEQ ID NO: 138514 - RNA, 23 nt, Human
agacaucccuagaauaccaauga

SEQ ID NO: 138515 - RNA, 18 nt, Human
aggagcagcuggcuugag

SEQ ID NO: 138516 - RNA, 18 nt, Human
aggagcagcuggcuugag

SEQ ID NO: 138517 - RNA, 18 nt, Human
aggcugaggaggggaaag

SEQ ID NO: 138518 - RNA, 18 nt, Human
caccaagaugcauacaaa

SEQ ID NO: 138519 - RNA, 21 nt, Human
ccaaugacaaguccaccaaga

SEQ ID NO: 138520 - RNA, 23 nt, Human
ccaaugacaaguccaccaagaug

SEQ ID NO: 138521 - RNA, 18 nt, Human
cccaggcugaggagggga

SEQ ID NO: 138522 - RNA, 23 nt, Human
ccccgcugccgcugccgccgccg

SEQ ID NO: 138523 - RNA, 19 nt, Human
cccgcugccgcugccgccg

SEQ ID NO: 138524 - RNA, 22 nt, Human
ccgccgccgcugccgcugccgc

SEQ ID NO: 138525 - RNA, 22 nt, Human
ccgccgcugccgcugccgcugc

SEQ ID NO: 138526 - RNA, 22 nt, Human
ccgcugccgccgccgcugccgc

SEQ ID NO: 138527 - RNA, 21 nt, Human
ccgcugccgcugccgccgccg

SEQ ID NO: 138528 - RNA, 24 nt, Human
ccgcugccgcugccgccgccgcug

SEQ ID NO: 138529 - RNA, 21 nt, Human
ccgcugccgcugccgcugcug

SEQ ID NO: 138530 - RNA, 22 nt, Human
ccgcugccgcugcuggaacggc

SEQ ID NO: 138531 - RNA, 21 nt, Human
cgcugccgcugccgcugcugg

SEQ ID NO: 138532 - RNA, 19 nt, Human
cucaaaaagucgcccucgg

SEQ ID NO: 138533 - RNA, 22 nt, Human
cugaaccuuaaauuuucaauag

SEQ ID NO: 138534 - RNA, 19 nt, Human
cugccgcugccgccgccgc

SEQ ID NO: 138535 - RNA, 22 nt, Human
cuggaacggcgacggccgccuu

SEQ ID NO: 138536 - RNA, 20 nt, Human
gaaaaacauuuauagaagaa

SEQ ID NO: 138537 - RNA, 25 nt, Human
gaaaaugaacggaggagcagcuggc

SEQ ID NO: 138538 - RNA, 21 nt, Human
gaacuaauauggacagagcca

SEQ ID NO: 138539 - RNA, 22 nt, Human
gagagugaucccggggggugcu

SEQ ID NO: 138540 - RNA, 23 nt, Human
gagcagcuggcuugagggcuggg

SEQ ID NO: 138541 - RNA, 20 nt, Human
gaggaggggaaagcgcggug

SEQ ID NO: 138542 - RNA, 21 nt, Human
gcagggaaaaacauuuauaga

SEQ ID NO: 138543 - RNA, 19 nt, Human
gcccaggcugaggagggga

SEQ ID NO: 138544 - RNA, 22 nt, Human
gccgccgccgcugccgcugccg

SEQ ID NO: 138545 - RNA, 21 nt, Human
gccgcgguaccgggcggguac

SEQ ID NO: 138546 - RNA, 22 nt, Human
gccgcugccgccgccgcugccg

SEQ ID NO: 138547 - RNA, 21 nt, Human
ggagcagaggcaagauccagg

SEQ ID NO: 138548 - RNA, 24 nt, Human
ggaugaguuugggaagaaaguggg

SEQ ID NO: 138549 - RNA, 19 nt, Human
ggcuugagggcugggaaca

SEQ ID NO: 138550 - RNA, 20 nt, Human
gggaaaaacauuuauagaag

SEQ ID NO: 138551 - RNA, 22 nt, Human
gggcugggaacacucgcgugug

SEQ ID NO: 138552 - RNA, 21 nt, Human
gguaccgggcggguacccagc

SEQ ID NO: 138553 - RNA, 20 nt, Human
guccggaaauuugagcggcu

SEQ ID NO: 138554 - RNA, 24 nt, Human
guuugggaagaaagugggggcccg

SEQ ID NO: 138555 - RNA, 26 nt, Human
uaccaaugacaaguccaccaagaugc

SEQ ID NO: 138556 - RNA, 21 nt, Human
uauagcacacaauagaugaaa

SEQ ID NO: 138557 - RNA, 24 nt, Human
uaucuaaaauuucauaaacaccau

SEQ ID NO: 138558 - RNA, 20 nt, Human
ucuauagagcccgaggcccc

SEQ ID NO: 138559 - RNA, 21 nt, Human
ugaggaggggaaagcgcggug

SEQ ID NO: 138560 - RNA, 23 nt, Human
ugaguuugggaagaaaguggggg

SEQ ID NO: 138561 - RNA, 21 nt, Human
ugggaagaaagugggggcccg

SEQ ID NO: 138562 - RNA, 22 nt, Human
uucacuguuuuuguugugcagg

SEQ ID NO: 138563 - RNA, 25 nt, Human
uuuaaaaacuccccagcucuggucc

SEQ ID NO: 138564 - RNA, 19 nt, Human
uuucucaaaaagucgcccu

SEQ ID NO: 138565 - RNA, 23 nt, Human
aaagacaugucccuuauggcucc

SEQ ID NO: 138566 - RNA, 20 nt, Human
aaagccccugaauuccccaa

SEQ ID NO: 138567 - RNA, 19 nt, Human
aagccccugaauuccccaa

SEQ ID NO: 138568 - RNA, 24 nt, Human
aagccccuggcuccucagcagcuc

SEQ ID NO: 138569 - RNA, 20 nt, Human
aauagaaccaauaucaacaa

SEQ ID NO: 138570 - RNA, 23 nt, Human
acagagcagggccccgcgccucc

SEQ ID NO: 138571 - RNA, 20 nt, Human
acccaucucauuuucuuccc

SEQ ID NO: 138572 - RNA, 20 nt, Human
acuccuacuguaagccucaa

SEQ ID NO: 138573 - RNA, 20 nt, Human
acuuugcugggaacaguguu

SEQ ID NO: 138574 - RNA, 27 nt, Human
agagcuggagauuguucaaagggccga

SEQ ID NO: 138575 - RNA, 21 nt, Human
agcccagccagcugcgcgcag

SEQ ID NO: 138576 - RNA, 23 nt, Human
agccccuggcuccucagcagcuc

SEQ ID NO: 138577 - RNA, 19 nt, Human
caaaccccagagcaaucuc

SEQ ID NO: 138578 - RNA, 21 nt, Human
caaaccccagagcaaucuccu

SEQ ID NO: 138579 - RNA, 24 nt, Human
caacacagaaaauacacuggaaug

SEQ ID NO: 138580 - RNA, 21 nt, Human
cacuagaccccggcuaagggc

SEQ ID NO: 138581 - RNA, 23 nt, Human
cacuagaccccggcuaagggcuc

SEQ ID NO: 138582 - RNA, 22 nt, Human
cacuuccuugaagagcuggaga

SEQ ID NO: 138583 - RNA, 23 nt, Human
cagagcagggccccgcgccuccc

SEQ ID NO: 138584 - RNA, 21 nt, Human
cagagggcucuccugacaccu

SEQ ID NO: 138585 - RNA, 20 nt, Human
cagcaaacucaacccaucuc

SEQ ID NO: 138586 - RNA, 26 nt, Human
caggagauucuccccuucugagacuc

SEQ ID NO: 138587 - RNA, 18 nt, Human
caggagccuguggcaaug

SEQ ID NO: 138588 - RNA, 18 nt, Human
caugucccuuauggcucc

SEQ ID NO: 138589 - RNA, 18 nt, Human
cauuuagaaucucacaga

SEQ ID NO: 138590 - RNA, 23 nt, Human
cccaagagaggcggcggcagccc

SEQ ID NO: 138591 - RNA, 19 nt, Human
cccagagccuuggcgaacc

SEQ ID NO: 138592 - RNA, 20 nt, Human
ccccagagcaaucuccucua

SEQ ID NO: 138593 - RNA, 21 nt, Human
ccccugaauuccccaaauaaa

SEQ ID NO: 138594 - RNA, 20 nt, Human
cccgcaggcacugcccgcga

SEQ ID NO: 138595 - RNA, 18 nt, Human
cccuggcuccucagcagc

SEQ ID NO: 138596 - RNA, 20 nt, Human
ccucgggcggccuucagccc

SEQ ID NO: 138597 - RNA, 21 nt, Human
ccucgggcggccuucagcccu

SEQ ID NO: 138598 - RNA, 18 nt, Human
cgcgcagcagggguucgg

SEQ ID NO: 138599 - RNA, 19 nt, Human
cgcucggagcuuccuuggg

SEQ ID NO: 138600 - RNA, 22 nt, Human
cuaaaaacaauucugaagccaa

SEQ ID NO: 138601 - RNA, 22 nt, Human
cucacuccuacuguaagccuca

SEQ ID NO: 138602 - RNA, 25 nt, Human
cucccaggacuggucaccugggcag

SEQ ID NO: 138603 - RNA, 18 nt, Human
cuccugggccucugcucu

SEQ ID NO: 138604 - RNA, 18 nt, Human
gaauguggacuucgcugg

SEQ ID NO: 138605 - RNA, 23 nt, Human
gacaccucagagucucaccguac

SEQ ID NO: 138606 - RNA, 20 nt, Human
gaccucucaggagccugugg

SEQ ID NO: 138607 - RNA, 19 nt, Human
gagcccagagccuuggcga

SEQ ID NO: 138608 - RNA, 19 nt, Human
ggaagcgcgccugagccca

SEQ ID NO: 138609 - RNA, 25 nt, Human
ggacuucgcugggggcagcggcucc

SEQ ID NO: 138610 - RNA, 24 nt, Human
ggcuaagggcuccugggcgcucgg

SEQ ID NO: 138611 - RNA, 18 nt, Human
guauacagcaaacucaac

SEQ ID NO: 138612 - RNA, 22 nt, Human
guuuggggaaaggaucccaggc

SEQ ID NO: 138613 - RNA, 26 nt, Human
uaaaaacaauucugaagccaaagaca

SEQ ID NO: 138614 - RNA, 22 nt, Human
uaauagcaaaccccagagcaau

SEQ ID NO: 138615 - RNA, 19 nt, Human
uacaauaaauaaauagaac

SEQ ID NO: 138616 - RNA, 19 nt, Human
uacacuggaauguauuugg

SEQ ID NO: 138617 - RNA, 22 nt, Human
uagaaccaauaucaacaaaaca

SEQ ID NO: 138618 - RNA, 22 nt, Human
ucaacccaucucauuuucuucc

SEQ ID NO: 138619 - RNA, 21 nt, Human
ucagcagcucuccaaacgccu

SEQ ID NO: 138620 - RNA, 23 nt, Human
uccagugacuccugggccucugc

SEQ ID NO: 138621 - RNA, 22 nt, Human
uccccaaauaaagcacuggcuu

SEQ ID NO: 138622 - RNA, 19 nt, Human
uccccauguuuguaguguc

SEQ ID NO: 138623 - RNA, 22 nt, Human
ucgccggggugcguuuggggaa

SEQ ID NO: 138624 - RNA, 24 nt, Human
ucuaaaucaucaauccagugacuc

SEQ ID NO: 138625 - RNA, 20 nt, Human
ucuugggcaccagaaagccc

SEQ ID NO: 138626 - RNA, 19 nt, Human
ugaacaacacagaaaauac

SEQ ID NO: 138627 - RNA, 24 nt, Human
ugaacaacacagaaaauacacugg

SEQ ID NO: 138628 - RNA, 26 nt, Human
ugaacaacacagaaaauacacuggaa

SEQ ID NO: 138629 - RNA, 19 nt, Human
ugagacucagcugaaaaua

SEQ ID NO: 138630 - RNA, 19 nt, Human
ugauugacuaugaacaaca

SEQ ID NO: 138631 - RNA, 23 nt, Human
ugcaaucacauuucggggcuguu

SEQ ID NO: 138632 - RNA, 21 nt, Human
ugcccgcgaccucucaggagc

SEQ ID NO: 138633 - RNA, 21 nt, Human
ugcccuauuugguaaauccua

SEQ ID NO: 138634 - RNA, 18 nt, Human
uggaaaaaaauuucucac

SEQ ID NO: 138635 - RNA, 21 nt, Human
uggaaagcagcagagggcucu

SEQ ID NO: 138636 - RNA, 22 nt, Human
uggcuccucagcagcucuccaa

SEQ ID NO: 138637 - RNA, 19 nt, Human
uggcuuuuuagcauauucu

SEQ ID NO: 138638 - RNA, 18 nt, Human
ugggaugagcaugugugg

SEQ ID NO: 138639 - RNA, 21 nt, Human
ugggcagcuucuuuucuuggc

SEQ ID NO: 138640 - RNA, 20 nt, Human
ugggggcagcggcuccgaaa

SEQ ID NO: 138641 - RNA, 27 nt, Human
uuccuugggagagagcaacgaaauacc

SEQ ID NO: 138642 - RNA, 20 nt, Human
uucgcugggggcagcggcuc

SEQ ID NO: 138643 - RNA, 22 nt, Human
uucuccccuucugagacucagc

SEQ ID NO: 138644 - RNA, 21 nt, Human
uuggggaaaggaucccaggcc

SEQ ID NO: 138645 - RNA, 22 nt, Human
uuucgagagcccagagccuugg

SEQ ID NO: 138646 - RNA, 24 nt, Human
aaacaggagagaggaaaggccaga

SEQ ID NO: 138647 - RNA, 21 nt, Human
aagaggaggccgauccaccca

SEQ ID NO: 138648 - RNA, 23 nt, Human
aagggaaacaggagagaggaaag

SEQ ID NO: 138649 - RNA, 22 nt, Human
agaaaacucagccucugggccc

SEQ ID NO: 138650 - RNA, 21 nt, Human
agaggaaggucaaggaaggcg

SEQ ID NO: 138651 - RNA, 19 nt, Human
agccacuggguggccaggc

SEQ ID NO: 138652 - RNA, 19 nt, Human
agcugcagcuuccccuccu

SEQ ID NO: 138653 - RNA, 23 nt, Human
agcuggggggcccagccccaggg

SEQ ID NO: 138654 - RNA, 18 nt, Human
aggagaguggcggccccg

SEQ ID NO: 138655 - RNA, 18 nt, Human
aggauagggggacuggag

SEQ ID NO: 138656 - RNA, 23 nt, Human
aggcagucccucaaagaaccucu

SEQ ID NO: 138657 - RNA, 18 nt, Human
aggccccaggcuggccag

SEQ ID NO: 138658 - RNA, 22 nt, Human
aggcggcugcaucuuuggugcc

SEQ ID NO: 138659 - RNA, 21 nt, Human
agucccucaaagaaccucuga

SEQ ID NO: 138660 - RNA, 28 nt, Human
caaagaaccucugauguccccuagccca

SEQ ID NO: 138661 - RNA, 21 nt, Human
caagaugagggcuccucuucu

SEQ ID NO: 138662 - RNA, 25 nt, Human
caaggaguuccucuccccauagacc

SEQ ID NO: 138663 - RNA, 18 nt, Human
caccgccugcuccacgcc

SEQ ID NO: 138664 - RNA, 21 nt, Human
cagcuuccccuccuuccucag

SEQ ID NO: 138665 - RNA, 24 nt, Human
caggggcucucccaagcugcagcu

SEQ ID NO: 138666 - RNA, 22 nt, Human
caucggggugcgggagggagcu

SEQ ID NO: 138667 - RNA, 18 nt, Human
cauguggaaaccacuugg

SEQ ID NO: 138668 - RNA, 19 nt, Human
ccacccaggccuuccugcu

SEQ ID NO: 138669 - RNA, 19 nt, Human
ccacuggguggccaggcuc

SEQ ID NO: 138670 - RNA, 18 nt, Human
ccaggccaggccagaugg

SEQ ID NO: 138671 - RNA, 21 nt, Human
ccaggccaggccagaugguuu

SEQ ID NO: 138672 - RNA, 18 nt, Human
ccagggaccggccgagga

SEQ ID NO: 138673 - RNA, 19 nt, Human
ccccauagacccuccuggg

SEQ ID NO: 138674 - RNA, 23 nt, Human
cccgccgcauccacgcgcggccg

SEQ ID NO: 138675 - RNA, 25 nt, Human
ccuagagccccagaggaaggucaag

SEQ ID NO: 138676 - RNA, 22 nt, Human
ccucagggcagggccaggccag

SEQ ID NO: 138677 - RNA, 21 nt, Human
ccucccugccaggccccaggc

SEQ ID NO: 138678 - RNA, 24 nt, Human
ccucuccccauagacccuccuggg

SEQ ID NO: 138679 - RNA, 19 nt, Human
ccucugauguccccuagcc

SEQ ID NO: 138680 - RNA, 24 nt, Human
ccugcucacgguucgcaaggguug

SEQ ID NO: 138681 - RNA, 20 nt, Human
ccugugggccuugcagggug

SEQ ID NO: 138682 - RNA, 27 nt, Human
cgccaagccccacaaagagaaaacucc

SEQ ID NO: 138683 - RNA, 18 nt, Human
cgccccggggcagagacg

SEQ ID NO: 138684 - RNA, 19 nt, Human
cgccccggggcagagacgg

SEQ ID NO: 138685 - RNA, 21 nt, Human
cgguucgcaagggugaggcug

SEQ ID NO: 138686 - RNA, 23 nt, Human
cuaggccccaggggcucucccaa

SEQ ID NO: 138687 - RNA, 20 nt, Human
cucagccucugggcccugac

SEQ ID NO: 138688 - RNA, 19 nt, Human
cuccagcaacccuagagcc

SEQ ID NO: 138689 - RNA, 23 nt, Human
cuccagcaacccuagagccccag

SEQ ID NO: 138690 - RNA, 25 nt, Human
cuccugggcccuucaagaugagggc

SEQ ID NO: 138691 - RNA, 24 nt, Human
cucuccccauagacccuccugggc

SEQ ID NO: 138692 - RNA, 20 nt, Human
cuugcagggugugaacuguc

SEQ ID NO: 138693 - RNA, 20 nt, Human
cuugggaaucucuggggucc

SEQ ID NO: 138694 - RNA, 23 nt, Human
gaaggucaaggaaggcggcugca

SEQ ID NO: 138695 - RNA, 19 nt, Human
gagcauguggaaaccacuu

SEQ ID NO: 138696 - RNA, 23 nt, Human
gagccagggaccggccgaggaga

SEQ ID NO: 138697 - RNA, 18 nt, Human
gaggagcauggagccaag

SEQ ID NO: 138698 - RNA, 22 nt, Human
gagggugugcgggcagugagga

SEQ ID NO: 138699 - RNA, 18 nt, Human
gccacuggguggccaggc

SEQ ID NO: 138700 - RNA, 19 nt, Human
gccccggggcagagacggc

SEQ ID NO: 138701 - RNA, 22 nt, Human
gcugccccugagcuggggggcc

SEQ ID NO: 138702 - RNA, 24 nt, Human
gcuugccuccugugggccuugcag

SEQ ID NO: 138703 - RNA, 22 nt, Human
ggaaacaggagagaggaaaggc

SEQ ID NO: 138704 - RNA, 18 nt, Human
ggccagaugguuuucagc

SEQ ID NO: 138705 - RNA, 24 nt, Human
ggccagaugguuuucagcagccuc

SEQ ID NO: 138706 - RNA, 24 nt, Human
ggcccugacucaggcuccagcaac

SEQ ID NO: 138707 - RNA, 20 nt, Human
ggccgaggagaguggcggcc

SEQ ID NO: 138708 - RNA, 22 nt, Human
ggcgccggcugcuugaggcuuc

SEQ ID NO: 138709 - RNA, 18 nt, Human
ggggacuggaggugggag

SEQ ID NO: 138710 - RNA, 23 nt, Human
gugaacuguccaucucuccccac

SEQ ID NO: 138711 - RNA, 21 nt, Human
uaaggcagaggcaguggaagg

SEQ ID NO: 138712 - RNA, 21 nt, Human
uaccaugcccagcucacuagc

SEQ ID NO: 138713 - RNA, 19 nt, Human
uagaguuccagggccugac

SEQ ID NO: 138714 - RNA, 23 nt, Human
uagcacugcccuggcagagugag

SEQ ID NO: 138715 - RNA, 18 nt, Human
ucacuagcacugcccugg

SEQ ID NO: 138716 - RNA, 19 nt, Human
ucagaguguggcagaggca

SEQ ID NO: 138717 - RNA, 24 nt, Human
ucaggcuccagcaacccuagagcc

SEQ ID NO: 138718 - RNA, 23 nt, Human
uccacaucggggugcgggaggga

SEQ ID NO: 138719 - RNA, 22 nt, Human
uccacgccaagccccacaaaga

SEQ ID NO: 138720 - RNA, 22 nt, Human
uccacgcgcggccgccuccggg

SEQ ID NO: 138721 - RNA, 22 nt, Human
uccccauagacccuccugggcc

SEQ ID NO: 138722 - RNA, 21 nt, Human
ucucccaagcugcagcuuccc

SEQ ID NO: 138723 - RNA, 18 nt, Human
ugacucaggcuccagcaa

SEQ ID NO: 138724 - RNA, 24 nt, Human
ugacucaggcuccagcaacccuag

SEQ ID NO: 138725 - RNA, 19 nt, Human
ugagaagggauacauugca

SEQ ID NO: 138726 - RNA, 19 nt, Human
ugagcugccccugagcugg

SEQ ID NO: 138727 - RNA, 24 nt, Human
ugagcuggggggcccagccccagg

SEQ ID NO: 138728 - RNA, 23 nt, Human
ugcagcuuccccuccuuccucag

SEQ ID NO: 138729 - RNA, 20 nt, Human
uggaagggaagggaaacagg

SEQ ID NO: 138730 - RNA, 18 nt, Human
uggcagaggcagucccuc

SEQ ID NO: 138731 - RNA, 24 nt, Human
uggcagaggcagucccucaaagaa

SEQ ID NO: 138732 - RNA, 19 nt, Human
ugggcccuucaagaugagg

SEQ ID NO: 138733 - RNA, 24 nt, Human
uggggggcccagccccagggcugg

SEQ ID NO: 138734 - RNA, 20 nt, Human
ugguaccaugcccagcucac

SEQ ID NO: 138735 - RNA, 18 nt, Human
uuccagggccugaccucc

SEQ ID NO: 138736 - RNA, 23 nt, Human
uugcagggccgucagaaggcagc

SEQ ID NO: 138737 - RNA, 23 nt, Human
uugccuggcuccucggcaagaga

SEQ ID NO: 138738 - RNA, 20 nt, Human
uuuuuuuuuuuuuuacccag

SEQ ID NO: 138739 - RNA, 21 nt, Human
uuuuuuuuuuuuuuuacccag

SEQ ID NO: 138740 - RNA, 23 nt, Human
uuuuuuuuuuuuuuuacccaggg

SEQ ID NO: 138741 - RNA, 19 nt, Human
acaggaucuugaggaaggc

SEQ ID NO: 138742 - RNA, 19 nt, Human
acaggaucuugaggaaggc

SEQ ID NO: 138743 - RNA, 23 nt, Human
acccaagcaaagcaaacuuugcc

SEQ ID NO: 138744 - RNA, 21 nt, Human
agcaagacaggaucuugagga

SEQ ID NO: 138745 - RNA, 21 nt, Human
agcaagacaggaucuugagga

SEQ ID NO: 138746 - RNA, 22 nt, Human
agcagacaaugaaggccccaag

SEQ ID NO: 138747 - RNA, 21 nt, Human
aggcaguguccuggcagaugc

SEQ ID NO: 138748 - RNA, 23 nt, Human
augaaaugaacagaaagaaauca

SEQ ID NO: 138749 - RNA, 23 nt, Human
caacucuccuccucuuucuugga

SEQ ID NO: 138750 - RNA, 20 nt, Human
caaugaaggccccaagcaca

SEQ ID NO: 138751 - RNA, 21 nt, Human
cagacaaugaaggccccaagc

SEQ ID NO: 138752 - RNA, 18 nt, Human
cagacauacccaagcaaa

SEQ ID NO: 138753 - RNA, 18 nt, Human
cagcaagacaggaucuug

SEQ ID NO: 138754 - RNA, 18 nt, Human
cagcaagacaggaucuug

SEQ ID NO: 138755 - RNA, 19 nt, Human
cagcagacaaugaaggccc

SEQ ID NO: 138756 - RNA, 23 nt, Human
cagcagacauacccaagcaaagc

SEQ ID NO: 138757 - RNA, 23 nt, Human
caggggccccagcuucaaagaug

SEQ ID NO: 138758 - RNA, 22 nt, Human
cauuuuugccucuaaggugaaa

SEQ ID NO: 138759 - RNA, 22 nt, Human
ccaccauuuggguugccuucuu

SEQ ID NO: 138760 - RNA, 21 nt, Human
ccccaagcacaauggccacca

SEQ ID NO: 138761 - RNA, 18 nt, Human
cccgaaguggcacucccc

SEQ ID NO: 138762 - RNA, 22 nt, Human
ccgagucuucuccucucuuuuc

SEQ ID NO: 138763 - RNA, 26 nt, Human
ccugguccacccaaggcaguguccug

SEQ ID NO: 138764 - RNA, 21 nt, Human
cgagucuucuccucucuuuuc

SEQ ID NO: 138765 - RNA, 22 nt, Human
cuuugccuuucucaggacucag

SEQ ID NO: 138766 - RNA, 19 nt, Human
gaagggcagccagcagaca

SEQ ID NO: 138767 - RNA, 21 nt, Human
gacaaugaaggccccaagcac

SEQ ID NO: 138768 - RNA, 21 nt, Human
gacagcagacauacccaagca

SEQ ID NO: 138769 - RNA, 19 nt, Human
gaucacaggguugagggcg

SEQ ID NO: 138770 - RNA, 19 nt, Human
gaucacaggguugagggcg

SEQ ID NO: 138771 - RNA, 21 nt, Human
gcagacauacccaagcaaagc

SEQ ID NO: 138772 - RNA, 21 nt, Human
gccccaagcacaauggccacc

SEQ ID NO: 138773 - RNA, 27 nt, Human
gguauugagaacaugggucaagaagaa

SEQ ID NO: 138774 - RNA, 20 nt, Human
ggugggacucagggaauucc

SEQ ID NO: 138775 - RNA, 20 nt, Human
uagugcauguuucauagcug

SEQ ID NO: 138776 - RNA, 21 nt, Human
ucuaagcugagcuugggcgcu

SEQ ID NO: 138777 - RNA, 18 nt, Human
ucucaggacucagaaacu

SEQ ID NO: 138778 - RNA, 18 nt, Human
ugaaaugaacagaaagaa

SEQ ID NO: 138779 - RNA, 22 nt, Human
ugaaaugaacagaaagaaauca

SEQ ID NO: 138780 - RNA, 22 nt, Human
ugacagcagacauacccaagca

SEQ ID NO: 138781 - RNA, 25 nt, Human
ugacagcagacauacccaagcaaag

SEQ ID NO: 138782 - RNA, 18 nt, Human
ugaugccaaggggcuucc

SEQ ID NO: 138783 - RNA, 23 nt, Human
ugccuucuucucccgaaguggca

SEQ ID NO: 138784 - RNA, 21 nt, Human
uggcagaugcuguaguaacgc

SEQ ID NO: 138785 - RNA, 22 nt, Human
ugguccacccaaggcagugucc

SEQ ID NO: 138786 - RNA, 24 nt, Human
uggugggacucagggaauuccgag

SEQ ID NO: 138787 - RNA, 20 nt, Human
uucaacucuccuccucuuuc

SEQ ID NO: 138788 - RNA, 22 nt, Human
uucaacucuccuccucuuucuu

SEQ ID NO: 138789 - RNA, 21 nt, Human
uuucucaggacucagaaacua

SEQ ID NO: 138790 - RNA, 23 nt, Human
caaaagcgcccuccccaucuccu

SEQ ID NO: 138791 - RNA, 19 nt, Human
cuccccaucuccuuggucc

SEQ ID NO: 138792 - RNA, 19 nt, Human
cuccccaucuccuuggucc

SEQ ID NO: 138793 - RNA, 21 nt, Human
ucaggccggggggcguccggg

SEQ ID NO: 138794 - RNA, 18 nt, Human
uccccaucuccuuggucc

SEQ ID NO: 138795 - RNA, 23 nt, Human
uuggucccugaggccuggccauc

SEQ ID NO: 138796 - RNA, 21 nt, Human
aagaggcccccaccagcacag

SEQ ID NO: 138797 - RNA, 22 nt, Human
accacaucacugcacacacaca

SEQ ID NO: 138798 - RNA, 21 nt, Human
acugcacacacacacaaccug

SEQ ID NO: 138799 - RNA, 22 nt, Human
agugacugaacaagccauuugu

SEQ ID NO: 138800 - RNA, 24 nt, Human
agugacugaacaagccauuuguuu

SEQ ID NO: 138801 - RNA, 18 nt, Human
augauaaagggagcagca

SEQ ID NO: 138802 - RNA, 22 nt, Human
auugcaacugauucugccaauu

SEQ ID NO: 138803 - RNA, 21 nt, Human
caaacacaaacaagugacuga

SEQ ID NO: 138804 - RNA, 22 nt, Human
cagcacagagagaagaaaugac

SEQ ID NO: 138805 - RNA, 21 nt, Human
ccagcaccauacucucuucuc

SEQ ID NO: 138806 - RNA, 19 nt, Human
ccauuuguuuaaaaaggga

SEQ ID NO: 138807 - RNA, 22 nt, Human
cccaacuucagcccugccucgu

SEQ ID NO: 138808 - RNA, 20 nt, Human
cccaccacaucacugcacac

SEQ ID NO: 138809 - RNA, 22 nt, Human
cccaccacaucacugcacacac

SEQ ID NO: 138810 - RNA, 23 nt, Human
cccaccacaucacugcacacaca

SEQ ID NO: 138811 - RNA, 25 nt, Human
cccaccacaucacugcacacacaca

SEQ ID NO: 138812 - RNA, 22 nt, Human
gauaaagggagcagcacuggaa

SEQ ID NO: 138813 - RNA, 20 nt, Human
gcacagagagaagaaaugac

SEQ ID NO: 138814 - RNA, 21 nt, Human
gcauguauuugcgugugugug

SEQ ID NO: 138815 - RNA, 22 nt, Human
gcuggacugcaggggcggucug

SEQ ID NO: 138816 - RNA, 20 nt, Human
ggacugcaggggcggucugu

SEQ ID NO: 138817 - RNA, 23 nt, Human
gggaauccagacccaggaaagcu

SEQ ID NO: 138818 - RNA, 20 nt, Human
gguacauuugacugaguuua

SEQ ID NO: 138819 - RNA, 23 nt, Human
uagacaccagaauaaaucaggga

SEQ ID NO: 138820 - RNA, 19 nt, Human
ucaaacacaaacaagugac

SEQ ID NO: 138821 - RNA, 19 nt, Human
ucccaacuucagcccugcc

SEQ ID NO: 138822 - RNA, 20 nt, Human
ucccaacuucagcccugccu

SEQ ID NO: 138823 - RNA, 19 nt, Human
ugacugaacaagccauuug

SEQ ID NO: 138824 - RNA, 19 nt, Human
ugguaaagaggcccccacc

SEQ ID NO: 138825 - RNA, 21 nt, Human
ugugugcgugcuugucaguga

SEQ ID NO: 138826 - RNA, 19 nt, Human
uuuuuuuuuuuaaggaccc

SEQ ID NO: 138827 - RNA, 18 nt, Human
aaaacccccaugagaggg

SEQ ID NO: 138828 - RNA, 20 nt, Human
aaauagcagagacuugaggg

SEQ ID NO: 138829 - RNA, 24 nt, Human
acccaaacaggcccagcuaccagc

SEQ ID NO: 138830 - RNA, 24 nt, Human
acuacaaacucaaaacccccauga

SEQ ID NO: 138831 - RNA, 20 nt, Human
agcacuacaaacucaaaacc

SEQ ID NO: 138832 - RNA, 19 nt, Human
agcagccacagccuccagg

SEQ ID NO: 138833 - RNA, 18 nt, Human
agcugagggagugaggug

SEQ ID NO: 138834 - RNA, 22 nt, Human
aggcccuggcuggcgggcaugu

SEQ ID NO: 138835 - RNA, 23 nt, Human
aggcuguggagggugucagcugg

SEQ ID NO: 138836 - RNA, 21 nt, Human
aucugcuuuaggcccuggcug

SEQ ID NO: 138837 - RNA, 22 nt, Human
cacuacaaacucaaaaccccca

SEQ ID NO: 138838 - RNA, 18 nt, Human
cacugguucccaucaugg

SEQ ID NO: 138839 - RNA, 20 nt, Human
cagacagcgguggcggcggc

SEQ ID NO: 138840 - RNA, 24 nt, Human
cagacagcgguggcggcggcaccu

SEQ ID NO: 138841 - RNA, 25 nt, Human
cagcacuacaaacucaaaaccccca

SEQ ID NO: 138842 - RNA, 18 nt, Human
cagcagccacagccucca

SEQ ID NO: 138843 - RNA, 20 nt, Human
cagcagccacagccuccagg

SEQ ID NO: 138844 - RNA, 18 nt, Human
cagcugggccuuugaagc

SEQ ID NO: 138845 - RNA, 19 nt, Human
cagugcagggggcugggag

SEQ ID NO: 138846 - RNA, 19 nt, Human
caugugggcaacuugcucc

SEQ ID NO: 138847 - RNA, 22 nt, Human
ccaacacacucuucgucugccu

SEQ ID NO: 138848 - RNA, 18 nt, Human
ccagccuggcacugagca

SEQ ID NO: 138849 - RNA, 21 nt, Human
cccaaacaggcccagcuacca

SEQ ID NO: 138850 - RNA, 21 nt, Human
cccaaggggguuuccuccugg

SEQ ID NO: 138851 - RNA, 21 nt, Human
cccagugggaccaccucccca

SEQ ID NO: 138852 - RNA, 22 nt, Human
ccccaggcgugcagagccaggg

SEQ ID NO: 138853 - RNA, 21 nt, Human
cccccaugagagggcucaguc

SEQ ID NO: 138854 - RNA, 23 nt, Human
cccugggagggggaauacagggg

SEQ ID NO: 138855 - RNA, 24 nt, Human
cccugggagggggaauacaggggg

SEQ ID NO: 138856 - RNA, 23 nt, Human
ccuccaaccgagccccuuugccc

SEQ ID NO: 138857 - RNA, 18 nt, Human
ccuggcacugagcaugcc

SEQ ID NO: 138858 - RNA, 21 nt, Human
ccuguguggggcacccaaggg

SEQ ID NO: 138859 - RNA, 22 nt, Human
cucagcacuacaaacucaaaac

SEQ ID NO: 138860 - RNA, 23 nt, Human
cuccaaccgagccccuuugcccc

SEQ ID NO: 138861 - RNA, 24 nt, Human
cuccagggacccaaacaggcccag

SEQ ID NO: 138862 - RNA, 18 nt, Human
cugcccugggagggggaa

SEQ ID NO: 138863 - RNA, 21 nt, Human
cuuugccccaacacacucuuc

SEQ ID NO: 138864 - RNA, 18 nt, Human
gagagcccuguguggggc

SEQ ID NO: 138865 - RNA, 18 nt, Human
gcagagccaggguccugg

SEQ ID NO: 138866 - RNA, 18 nt, Human
ggagaacuggggacuuag

SEQ ID NO: 138867 - RNA, 19 nt, Human
ggcaagagcugagggagug

SEQ ID NO: 138868 - RNA, 19 nt, Human
gggaauacagggggaggcc

SEQ ID NO: 138869 - RNA, 20 nt, Human
gguagcagcagaggugggcg

SEQ ID NO: 138870 - RNA, 23 nt, Human
gugccaugacagcagccacagcc

SEQ ID NO: 138871 - RNA, 19 nt, Human
uacaaacucaaaaccccca

SEQ ID NO: 138872 - RNA, 18 nt, Human
ucagcacuacaaacucaa

SEQ ID NO: 138873 - RNA, 22 nt, Human
ucagucuuaugggaaaugccuc

SEQ ID NO: 138874 - RNA, 21 nt, Human
ucccagugggaccaccucccc

SEQ ID NO: 138875 - RNA, 21 nt, Human
uccuaaacucaaaagucccug

SEQ ID NO: 138876 - RNA, 21 nt, Human
ugagagggcucagucuuaugg

SEQ ID NO: 138877 - RNA, 20 nt, Human
ugagggagugaggugccaug

SEQ ID NO: 138878 - RNA, 21 nt, Human
ugaggugccaugacagcagcc

SEQ ID NO: 138879 - RNA, 18 nt, Human
ugccaugacagcagccac

SEQ ID NO: 138880 - RNA, 21 nt, Human
ugccaugacagcagccacagc

SEQ ID NO: 138881 - RNA, 26 nt, Human
ugccccaacacacucuucgucugccu

SEQ ID NO: 138882 - RNA, 22 nt, Human
ugcccugggagggggaauacag

SEQ ID NO: 138883 - RNA, 18 nt, Human
ugcugggcaggggcugcc

SEQ ID NO: 138884 - RNA, 23 nt, Human
uggaagggcccccaacccaagug

SEQ ID NO: 138885 - RNA, 23 nt, Human
uggagagcccuguguggggcacc

SEQ ID NO: 138886 - RNA, 20 nt, Human
uggcaagagcugagggagug

SEQ ID NO: 138887 - RNA, 24 nt, Human
ugggccuuugaagccacuaaccac

SEQ ID NO: 138888 - RNA, 18 nt, Human
ugggguuuugugcugggc

SEQ ID NO: 138889 - RNA, 21 nt, Human
uguguggggcacccaaggggg

SEQ ID NO: 138890 - RNA, 23 nt, Human
uucagaaaggagagccaggagaa

SEQ ID NO: 138891 - RNA, 23 nt, Human
uuccugggguacguguauuugua

SEQ ID NO: 138892 - RNA, 20 nt, Human
uugaagccacuaaccacugg

SEQ ID NO: 138893 - RNA, 19 nt, Human
aaagcaacaagaaaaaaac

SEQ ID NO: 138894 - RNA, 20 nt, Human
aagagaacuaaagcagacaa

SEQ ID NO: 138895 - RNA, 21 nt, Human
aagcagacaaaaaugaaaaca

SEQ ID NO: 138896 - RNA, 27 nt, Human
acaaaacccccgaaaccucuuaaaaac

SEQ ID NO: 138897 - RNA, 19 nt, Human
acaccagagccuucggucc

SEQ ID NO: 138898 - RNA, 22 nt, Human
acagagaaaaaaaaauuuccca

SEQ ID NO: 138899 - RNA, 21 nt, Human
accaccaccaccaccaccacc

SEQ ID NO: 138900 - RNA, 24 nt, Human
accaccaccaccaccaccaccacc

SEQ ID NO: 138901 - RNA, 21 nt, Human
accaccaccaccaccacgggc

SEQ ID NO: 138902 - RNA, 24 nt, Human
accaccaccaccaccacgggcgcu

SEQ ID NO: 138903 - RNA, 25 nt, Human
acccccgaaaccucuuaaaaacccu

SEQ ID NO: 138904 - RNA, 20 nt, Human
acguauauauauauauauaa

SEQ ID NO: 138905 - RNA, 22 nt, Human
agacaaaaaugaaaacacacag

SEQ ID NO: 138906 - RNA, 23 nt, Human
agagaaaaaaaaauuucccaaag

SEQ ID NO: 138907 - RNA, 25 nt, Human
aggaacacaaauauauagcuauaua

SEQ ID NO: 138908 - RNA, 20 nt, Human
agggggcccggccgcacugc

SEQ ID NO: 138909 - RNA, 18 nt, Human
agggggcgggggcggggg

SEQ ID NO: 138910 - RNA, 24 nt, Human
agggggcgggggcgggggccgccg

SEQ ID NO: 138911 - RNA, 21 nt, Human
aggguggcagggggcgggggc

SEQ ID NO: 138912 - RNA, 19 nt, Human
auauauauauauauauaua

SEQ ID NO: 138913 - RNA, 19 nt, Human
auauauauauauauauaua

SEQ ID NO: 138914 - RNA, 19 nt, Human
auauauauauauauauaua

SEQ ID NO: 138915 - RNA, 19 nt, Human
auauauauauauauauaua

SEQ ID NO: 138916 - RNA, 19 nt, Human
auauauauauauauauaua

SEQ ID NO: 138917 - RNA, 19 nt, Human
auauauauauauauauaua

SEQ ID NO: 138918 - RNA, 23 nt, Human
aucuuuuuucuuuucuuuuuggc

SEQ ID NO: 138919 - RNA, 18 nt, Human
caaaacccccgaaaccuc

SEQ ID NO: 138920 - RNA, 22 nt, Human
caaagcaacaagaaaaaaacaa

SEQ ID NO: 138921 - RNA, 25 nt, Human
caaagcaacaagaaaaaaacaaaaa

SEQ ID NO: 138922 - RNA, 19 nt, Human
caaauauauagcuauauag

SEQ ID NO: 138923 - RNA, 23 nt, Human
caacaagaaaaaaacaaaaauuc

SEQ ID NO: 138924 - RNA, 25 nt, Human
caagaaaaaaacaaaaauucaguga

SEQ ID NO: 138925 - RNA, 20 nt, Human
cacaacaaaacccccgaaac

SEQ ID NO: 138926 - RNA, 23 nt, Human
cacaacaaaacccccgaaaccuc

SEQ ID NO: 138927 - RNA, 19 nt, Human
cacacagugcagggaugua

SEQ ID NO: 138928 - RNA, 21 nt, Human
caccaccaccaccaccacggg

SEQ ID NO: 138929 - RNA, 22 nt, Human
caccaccaccaccaccacgggc

SEQ ID NO: 138930 - RNA, 21 nt, Human
cacgagaagcugggaguggug

SEQ ID NO: 138931 - RNA, 20 nt, Human
cacugcuguggggccaaacc

SEQ ID NO: 138932 - RNA, 20 nt, Human
cacuggacacgagaagcugg

SEQ ID NO: 138933 - RNA, 19 nt, Human
cagcuguggcuccuuucug

SEQ ID NO: 138934 - RNA, 25 nt, Human
ccaaagcaacaagaaaaaaacaaaa

SEQ ID NO: 138935 - RNA, 26 nt, Human
ccaaagcaacaagaaaaaaacaaaaa

SEQ ID NO: 138936 - RNA, 21 nt, Human
ccaccaccaccaccaccacca

SEQ ID NO: 138937 - RNA, 21 nt, Human
ccaccaccaccaccaccacca

SEQ ID NO: 138938 - RNA, 23 nt, Human
ccaccaccaccaccaccaccacc

SEQ ID NO: 138939 - RNA, 23 nt, Human
ccaccaccaccaccaccaccacc

SEQ ID NO: 138940 - RNA, 23 nt, Human
ccaccaccaccaccaccaccacc

SEQ ID NO: 138941 - RNA, 24 nt, Human
ccaccaccaccaccaccaccacgg

SEQ ID NO: 138942 - RNA, 20 nt, Human
ccaccaccaccaccacgggc

SEQ ID NO: 138943 - RNA, 18 nt, Human
ccaccuggacccccugcc

SEQ ID NO: 138944 - RNA, 21 nt, Human
cccaccuggacccccugccca

SEQ ID NO: 138945 - RNA, 19 nt, Human
cccccaagaauaaaauaga

SEQ ID NO: 138946 - RNA, 21 nt, Human
cccccgaaaccucuuaaaaac

SEQ ID NO: 138947 - RNA, 22 nt, Human
cccccgaaaccucuuaaaaacc

SEQ ID NO: 138948 - RNA, 23 nt, Human
cccccgaaaccucuuaaaaaccc

SEQ ID NO: 138949 - RNA, 19 nt, Human
ccccgaaaccucuuaaaaa

SEQ ID NO: 138950 - RNA, 22 nt, Human
ccccgaaaccucuuaaaaaccc

SEQ ID NO: 138951 - RNA, 21 nt, Human
cccuccccacccguaucuucc

SEQ ID NO: 138952 - RNA, 25 nt, Human
cccuccccacccguaucuuccgcca

SEQ ID NO: 138953 - RNA, 23 nt, Human
cccugcccaggccggcgggcucc

SEQ ID NO: 138954 - RNA, 20 nt, Human
cccugggaaacgucugccuc

SEQ ID NO: 138955 - RNA, 18 nt, Human
ccguaucuuccgccaucc

SEQ ID NO: 138956 - RNA, 26 nt, Human
ccugcggcccgggccaccaccaccac

SEQ ID NO: 138957 - RNA, 20 nt, Human
ccugcggggagggggcccgg

SEQ ID NO: 138958 - RNA, 22 nt, Human
cguauauauauauauauauaua

SEQ ID NO: 138959 - RNA, 22 nt, Human
cgugggggccgcgggggagccg

SEQ ID NO: 138960 - RNA, 25 nt, Human
cuaaagcagacaaaaaugaaaacac

SEQ ID NO: 138961 - RNA, 26 nt, Human
cuaaagcagacaaaaaugaaaacaca

SEQ ID NO: 138962 - RNA, 20 nt, Human
cuccaggguggguggcgggu

SEQ ID NO: 138963 - RNA, 20 nt, Human
cuccuuucuggauaucuucc

SEQ ID NO: 138964 - RNA, 24 nt, Human
cucucugaauguccaaaaccugag

SEQ ID NO: 138965 - RNA, 23 nt, Human
cugcagcgugggggccgcggggg

SEQ ID NO: 138966 - RNA, 18 nt, Human
cuggacccccugcccagg

SEQ ID NO: 138967 - RNA, 20 nt, Human
cuggacccccugcccaggcc

SEQ ID NO: 138968 - RNA, 25 nt, Human
cuggccccuguguggcccaccugga

SEQ ID NO: 138969 - RNA, 22 nt, Human
gaaaauaaaagagaacuaaagc

SEQ ID NO: 138970 - RNA, 18 nt, Human
gaacuaaagcagacaaaa

SEQ ID NO: 138971 - RNA, 21 nt, Human
gcagcgugggggccgcggggg

SEQ ID NO: 138972 - RNA, 20 nt, Human
gccucuuucuguuuuucuga

SEQ ID NO: 138973 - RNA, 19 nt, Human
ggaguggugaguguguggu

SEQ ID NO: 138974 - RNA, 20 nt, Human
ggcccgggccaccaccacca

SEQ ID NO: 138975 - RNA, 22 nt, Human
gggcagugcaggguggcagggg

SEQ ID NO: 138976 - RNA, 20 nt, Human
gggccaaaccagacaccaga

SEQ ID NO: 138977 - RNA, 18 nt, Human
gggcgcuaggggugggcg

SEQ ID NO: 138978 - RNA, 22 nt, Human
ggggcgggggccgccgggcuca

SEQ ID NO: 138979 - RNA, 22 nt, Human
ggugaauagaaaauaaaagaga

SEQ ID NO: 138980 - RNA, 22 nt, Human
gugaguguguggugaauagaaa

SEQ ID NO: 138981 - RNA, 22 nt, Human
guguggcccaccuggacccccu

SEQ ID NO: 138982 - RNA, 22 nt, Human
uaaaagagaacuaaagcagaca

SEQ ID NO: 138983 - RNA, 22 nt, Human
uacguauauauauauauauaua

SEQ ID NO: 138984 - RNA, 23 nt, Human
uagauauccuuuuccuaagguuu

SEQ ID NO: 138985 - RNA, 21 nt, Human
uaggggugggcggcgggggcg

SEQ ID NO: 138986 - RNA, 18 nt, Human
uauacguauauauauaua

SEQ ID NO: 138987 - RNA, 19 nt, Human
uauacguauauauauauau

SEQ ID NO: 138988 - RNA, 20 nt, Human
uauauauacguauauauaua

SEQ ID NO: 138989 - RNA, 20 nt, Human
uauauauacguauauauaua

SEQ ID NO: 138990 - RNA, 23 nt, Human
uauauauacguauauauauauau

SEQ ID NO: 138991 - RNA, 18 nt, Human
uauauauauacguauaua

SEQ ID NO: 138992 - RNA, 19 nt, Human
uauauauauauauauauau

SEQ ID NO: 138993 - RNA, 19 nt, Human
uauauauauauauauauau

SEQ ID NO: 138994 - RNA, 19 nt, Human
uauauauauauauauauau

SEQ ID NO: 138995 - RNA, 19 nt, Human
uauauauauauauauauau

SEQ ID NO: 138996 - RNA, 19 nt, Human
uauauauauauauauauau

SEQ ID NO: 138997 - RNA, 22 nt, Human
uauuuacacaacaaaacccccg

SEQ ID NO: 138998 - RNA, 18 nt, Human
ucgguccaucagggcugc

SEQ ID NO: 138999 - RNA, 20 nt, Human
ucucugaauguccaaaaccu

SEQ ID NO: 139000 - RNA, 21 nt, Human
ucucugaauguccaaaaccug

SEQ ID NO: 139001 - RNA, 21 nt, Human
ucugccucuuucuguuuuucu

SEQ ID NO: 139002 - RNA, 21 nt, Human
ucuggauaucuucccuccccc

SEQ ID NO: 139003 - RNA, 23 nt, Human
ucuuuuuucuuuucuuuuuggcg

SEQ ID NO: 139004 - RNA, 24 nt, Human
ugaaggaacacaaauauauagcua

SEQ ID NO: 139005 - RNA, 20 nt, Human
ugagguaaacaggaucggcc

SEQ ID NO: 139006 - RNA, 21 nt, Human
ugagguaaacaggaucggccc

SEQ ID NO: 139007 - RNA, 23 nt, Human
ugaucuugguucagggguuucac

SEQ ID NO: 139008 - RNA, 21 nt, Human
ugcaggguggcagggggcggg

SEQ ID NO: 139009 - RNA, 18 nt, Human
ugccugaacgcccuggga

SEQ ID NO: 139010 - RNA, 23 nt, Human
ugccugaacgcccugggaaacgu

SEQ ID NO: 139011 - RNA, 24 nt, Human
ugcggggagggggcccggccgcac

SEQ ID NO: 139012 - RNA, 18 nt, Human
uggauaucuucccucccc

SEQ ID NO: 139013 - RNA, 20 nt, Human
uggcccaccuggacccccug

SEQ ID NO: 139014 - RNA, 22 nt, Human
ugggaguggugaguguguggug

SEQ ID NO: 139015 - RNA, 21 nt, Human
ugggcggcgggggcggccccu

SEQ ID NO: 139016 - RNA, 24 nt, Human
ugggcggcgggggcggccccugcg

SEQ ID NO: 139017 - RNA, 18 nt, Human
uggugaguguguggugaa

SEQ ID NO: 139018 - RNA, 19 nt, Human
uguccaaaaccugagaaau

SEQ ID NO: 139019 - RNA, 20 nt, Human
uucccaaagcaacaagaaaa

SEQ ID NO: 139020 - RNA, 24 nt, Human
uucccaaagcaacaagaaaaaaac

SEQ ID NO: 139021 - RNA, 24 nt, Human
uuccuugguuuuccccuguuuuau

SEQ ID NO: 139022 - RNA, 20 nt, Human
uugcuuuuucaagaccaguu

SEQ ID NO: 139023 - RNA, 23 nt, Human
uuuacacaacaaaacccccgaaa

SEQ ID NO: 139024 - RNA, 22 nt, Human
uuuauauauauacguauauaua

SEQ ID NO: 139025 - RNA, 32 nt, Human
uuuauauauauacguauauauauauauauuau

SEQ ID NO: 139026 - RNA, 22 nt, Human
uuucuggauaucuucccucccc

SEQ ID NO: 139027 - RNA, 22 nt, Human
uuucuggauaucuucccucccc

SEQ ID NO: 139028 - RNA, 22 nt, Human
aaaccaaggcucauggggggga

SEQ ID NO: 139029 - RNA, 23 nt, Human
aaaggcuuugaccggaaccagga

SEQ ID NO: 139030 - RNA, 22 nt, Human
aagcaccucuuagcuuuguuga

SEQ ID NO: 139031 - RNA, 23 nt, Human
aagcaggcggcaguguaagcugg

SEQ ID NO: 139032 - RNA, 22 nt, Human
aaggcucaugggggggaugagg

SEQ ID NO: 139033 - RNA, 19 nt, Human
aaggcugaggaaaggcuuu

SEQ ID NO: 139034 - RNA, 21 nt, Human
aaggcugaggaaaggcuuuga

SEQ ID NO: 139035 - RNA, 21 nt, Human
acucucccucugucucuccca

SEQ ID NO: 139036 - RNA, 22 nt, Human
agaaagguacuuaaagggcuga

SEQ ID NO: 139037 - RNA, 24 nt, Human
agaagaaucaugccuccccuucuc

SEQ ID NO: 139038 - RNA, 20 nt, Human
agaucccugcugcugcccag

SEQ ID NO: 139039 - RNA, 23 nt, Human
aggcggcaguguaagcugggagg

SEQ ID NO: 139040 - RNA, 19 nt, Human
aucaugccuccccuucucc

SEQ ID NO: 139041 - RNA, 21 nt, Human
cagaagaaucaugccuccccu

SEQ ID NO: 139042 - RNA, 18 nt, Human
caugcaccucacauacca

SEQ ID NO: 139043 - RNA, 21 nt, Human
ccccuucucccaucacugccc

SEQ ID NO: 139044 - RNA, 19 nt, Human
ccggggcugggcugccucu

SEQ ID NO: 139045 - RNA, 23 nt, Human
ccucacauaccaccagaucccug

SEQ ID NO: 139046 - RNA, 18 nt, Human
ccugcugcugcccagagc

SEQ ID NO: 139047 - RNA, 23 nt, Human
cucaugggggggaugaggauagg

SEQ ID NO: 139048 - RNA, 19 nt, Human
gggaugaggauaggcagug

SEQ ID NO: 139049 - RNA, 19 nt, Human
uaccaccagaucccugcug

SEQ ID NO: 139050 - RNA, 18 nt, Human
ucaugggggggaugagga

SEQ ID NO: 139051 - RNA, 22 nt, Human
ucccucugucucucccacuucc

SEQ ID NO: 139052 - RNA, 18 nt, Human
ucugucucucccacuucc

SEQ ID NO: 139053 - RNA, 20 nt, Human
ugaggaaaggcuuugaccgg

SEQ ID NO: 139054 - RNA, 18 nt, Human
ugcccgcaugcaccucac

SEQ ID NO: 139055 - RNA, 21 nt, Human
ugcccgcaugcaccucacaua

SEQ ID NO: 139056 - RNA, 21 nt, Human
ugcuguaugcacacucucccu

SEQ ID NO: 139057 - RNA, 19 nt, Human
ugggaggccggggcugggc

SEQ ID NO: 139058 - RNA, 24 nt, Human
ugggcugccucugugaaucagcga

SEQ ID NO: 139059 - RNA, 24 nt, Human
aacugagcagcacccucuuggcuc

SEQ ID NO: 139060 - RNA, 21 nt, Human
aaguuccccacagcugugguc

SEQ ID NO: 139061 - RNA, 23 nt, Human
acaaggaagagagaccuggucca

SEQ ID NO: 139062 - RNA, 21 nt, Human
accugguccaagauucugugc

SEQ ID NO: 139063 - RNA, 24 nt, Human
acuuuugcaggaucuguuuucaau

SEQ ID NO: 139064 - RNA, 24 nt, Human
agcacccucuuggcucuggguggc

SEQ ID NO: 139065 - RNA, 19 nt, Human
agcagcacccucuuggcuc

SEQ ID NO: 139066 - RNA, 18 nt, Human
agcugcggaggcccugca

SEQ ID NO: 139067 - RNA, 22 nt, Human
agggaucggggaggggcagggg

SEQ ID NO: 139068 - RNA, 18 nt, Human
agggcacgguggggggag

SEQ ID NO: 139069 - RNA, 18 nt, Human
agggcacgguggggggag

SEQ ID NO: 139070 - RNA, 20 nt, Human
caaugaaaccugcugguagc

SEQ ID NO: 139071 - RNA, 23 nt, Human
cacagggguugggcaugggggag

SEQ ID NO: 139072 - RNA, 20 nt, Human
caccccaaguuccccacagc

SEQ ID NO: 139073 - RNA, 22 nt, Human
caggccaagggcacgguggggg

SEQ ID NO: 139074 - RNA, 20 nt, Human
cauauagauauuuauauaua

SEQ ID NO: 139075 - RNA, 21 nt, Human
ccaccuccccaccucugcaca

SEQ ID NO: 139076 - RNA, 21 nt, Human
ccccauccucgccaccucccc

SEQ ID NO: 139077 - RNA, 23 nt, Human
ccccauccucgccaccuccccac

SEQ ID NO: 139078 - RNA, 24 nt, Human
cccucccucccccacucucugucc

SEQ ID NO: 139079 - RNA, 24 nt, Human
ccucgccaccuccccaccucugca

SEQ ID NO: 139080 - RNA, 18 nt, Human
cggggaggggcaggggug

SEQ ID NO: 139081 - RNA, 21 nt, Human
cgguggggggagggugggggu

SEQ ID NO: 139082 - RNA, 22 nt, Human
cucccucccccacucucugucc

SEQ ID NO: 139083 - RNA, 18 nt, Human
cucuuggcucuggguggc

SEQ ID NO: 139084 - RNA, 20 nt, Human
cucuuggcucuggguggcag

SEQ ID NO: 139085 - RNA, 19 nt, Human
cuggcuggcuccgagcggg

SEQ ID NO: 139086 - RNA, 20 nt, Human
cugugcgcuuucugucccca

SEQ ID NO: 139087 - RNA, 24 nt, Human
gaccccauucuccucugccugggc

SEQ ID NO: 139088 - RNA, 25 nt, Human
gagaaaagcaggggggaccgguacc

SEQ ID NO: 139089 - RNA, 22 nt, Human
gauuccgggcuccggcgccucu

SEQ ID NO: 139090 - RNA, 24 nt, Human
gccaccuccccaccucugcacacc

SEQ ID NO: 139091 - RNA, 18 nt, Human
gcccugcaacugagcagc

SEQ ID NO: 139092 - RNA, 22 nt, Human
gcugaauacagaaacuucucug

SEQ ID NO: 139093 - RNA, 23 nt, Human
ggaagcaggaucuccaaguuucc

SEQ ID NO: 139094 - RNA, 23 nt, Human
ggagaccccauucuccucugccu

SEQ ID NO: 139095 - RNA, 20 nt, Human
ggagggugggggugcuccaa

SEQ ID NO: 139096 - RNA, 20 nt, Human
ggaucggggaggggcagggg

SEQ ID NO: 139097 - RNA, 18 nt, Human
gggaagcaggaucuccaa

SEQ ID NO: 139098 - RNA, 24 nt, Human
gggaagcaggaucuccaaguuucc

SEQ ID NO: 139099 - RNA, 20 nt, Human
ggggaggggcagggguggca

SEQ ID NO: 139100 - RNA, 18 nt, Human
ggggagggugggggugcu

SEQ ID NO: 139101 - RNA, 24 nt, Human
ggggagggugggggugcuccaagg

SEQ ID NO: 139102 - RNA, 19 nt, Human
guggggaaggggcaagggg

SEQ ID NO: 139103 - RNA, 21 nt, Human
uccagugugggcaccuggaac

SEQ ID NO: 139104 - RNA, 25 nt, Human
uccagugugggcaccuggaacuuuu

SEQ ID NO: 139105 - RNA, 21 nt, Human
uccccaccucugcacaccaca

SEQ ID NO: 139106 - RNA, 24 nt, Human
uccucgccaccuccccaccucugc

SEQ ID NO: 139107 - RNA, 28 nt, Human
ucgggacggcuggcuggcuccgagcggg

SEQ ID NO: 139108 - RNA, 23 nt, Human
ucuccucugccugggcagcugaa

SEQ ID NO: 139109 - RNA, 21 nt, Human
ucugcacaccacaucgggccu

SEQ ID NO: 139110 - RNA, 19 nt, Human
ucugcuccaccccaaguuc

SEQ ID NO: 139111 - RNA, 19 nt, Human
ucugucugucccucccucc

SEQ ID NO: 139112 - RNA, 21 nt, Human
ugagcagcacccucuuggcuc

SEQ ID NO: 139113 - RNA, 20 nt, Human
ugcacaccacaucgggccuu

SEQ ID NO: 139114 - RNA, 23 nt, Human
uggcacacgaugcuacgcaaaac

SEQ ID NO: 139115 - RNA, 19 nt, Human
uggcaggccaagggcacgg

SEQ ID NO: 139116 - RNA, 20 nt, Human
uggcuggcuccgagcgggau

SEQ ID NO: 139117 - RNA, 18 nt, Human
uggggggagggugggggu

SEQ ID NO: 139118 - RNA, 19 nt, Human
uggguggcaggccaagggc

SEQ ID NO: 139119 - RNA, 21 nt, Human
uguccccauccucgccaccuc

SEQ ID NO: 139120 - RNA, 21 nt, Human
uguggggaaggggcaaggggc

SEQ ID NO: 139121 - RNA, 23 nt, Human
uucucugcuccaccccaaguucc

SEQ ID NO: 139122 - RNA, 22 nt, Human
uucugucugucccucccucccc

SEQ ID NO: 139123 - RNA, 27 nt, Human
uucugucugucccucccucccccacuc

SEQ ID NO: 139124 - RNA, 25 nt, Human
aaaacugaagauugcacugaagaau

SEQ ID NO: 139125 - RNA, 25 nt, Human
aaaacugaagauugcacugaagaau

SEQ ID NO: 139126 - RNA, 22 nt, Human
aauauauacaugcauauaaaag

SEQ ID NO: 139127 - RNA, 23 nt, Human
acaaaaacauuagcagaugcugc

SEQ ID NO: 139128 - RNA, 23 nt, Human
acaaaaacauuagcagaugcugc

SEQ ID NO: 139129 - RNA, 22 nt, Human
acccuuaccuauacaugacaaa

SEQ ID NO: 139130 - RNA, 22 nt, Human
acccuuaccuauacaugacaaa

SEQ ID NO: 139131 - RNA, 21 nt, Human
acugagccggccagagaaccu

SEQ ID NO: 139132 - RNA, 24 nt, Human
agcgauucuccugccucagccucc

SEQ ID NO: 139133 - RNA, 24 nt, Human
agcgauucuccugccucagccucc

SEQ ID NO: 139134 - RNA, 22 nt, Human
aggcaagugauaaacaguagga

SEQ ID NO: 139135 - RNA, 23 nt, Human
aggcuggagugcaguggcaaucu

SEQ ID NO: 139136 - RNA, 23 nt, Human
aggcuggagugcaguggcaaucu

SEQ ID NO: 139137 - RNA, 20 nt, Human
agggcugcaauucuuucaug

SEQ ID NO: 139138 - RNA, 20 nt, Human
agggcugcaauucuuucaug

SEQ ID NO: 139139 - RNA, 22 nt, Human
agugcaguggcaaucucggcuc

SEQ ID NO: 139140 - RNA, 22 nt, Human
agugcaguggcaaucucggcuc

SEQ ID NO: 139141 - RNA, 21 nt, Human
auccugaaagaaaacaaugcu

SEQ ID NO: 139142 - RNA, 21 nt, Human
auccugaaagaaaacaaugcu

SEQ ID NO: 139143 - RNA, 20 nt, Human
augacaaaguuuaccuccau

SEQ ID NO: 139144 - RNA, 20 nt, Human
augacaaaguuuaccuccau

SEQ ID NO: 139145 - RNA, 21 nt, Human
augcaaagaggcuuuccuaca

SEQ ID NO: 139146 - RNA, 25 nt, Human
caacgggagaauuucuuucccccua

SEQ ID NO: 139147 - RNA, 22 nt, Human
caagcgauucuccugccucagc

SEQ ID NO: 139148 - RNA, 22 nt, Human
caagcgauucuccugccucagc

SEQ ID NO: 139149 - RNA, 19 nt, Human
cacagagcggcuaagaaga

SEQ ID NO: 139150 - RNA, 21 nt, Human
caccaacuauguucuaagaac

SEQ ID NO: 139151 - RNA, 21 nt, Human
caccaacuauguucuaagaac

SEQ ID NO: 139152 - RNA, 21 nt, Human
caccauguccggcuaauuucu

SEQ ID NO: 139153 - RNA, 21 nt, Human
caccauguccggcuaauuucu

SEQ ID NO: 139154 - RNA, 21 nt, Human
cacugcaaccuccgccuccug

SEQ ID NO: 139155 - RNA, 21 nt, Human
cacugcaaccuccgccuccug

SEQ ID NO: 139156 - RNA, 20 nt, Human
cagccuccugaguagcuggg

SEQ ID NO: 139157 - RNA, 20 nt, Human
cagccuccugaguagcuggg

SEQ ID NO: 139158 - RNA, 21 nt, Human
cagcuuucccaaaugcucuuc

SEQ ID NO: 139159 - RNA, 21 nt, Human
cagcuuucccaaaugcucuuc

SEQ ID NO: 139160 - RNA, 18 nt, Human
cagguggagagaaugcaa

SEQ ID NO: 139161 - RNA, 18 nt, Human
cagguggagagaaugcaa

SEQ ID NO: 139162 - RNA, 20 nt, Human
cagguggagagaaugcaauu

SEQ ID NO: 139163 - RNA, 20 nt, Human
cagguggagagaaugcaauu

SEQ ID NO: 139164 - RNA, 18 nt, Human
cagucccaauggccaggg

SEQ ID NO: 139165 - RNA, 21 nt, Human
ccacagauaaggcaggccuau

SEQ ID NO: 139166 - RNA, 21 nt, Human
ccacagauaaggcaggccuau

SEQ ID NO: 139167 - RNA, 24 nt, Human
ccgccuccuggauucaagcgauuc

SEQ ID NO: 139168 - RNA, 24 nt, Human
ccgccuccuggauucaagcgauuc

SEQ ID NO: 139169 - RNA, 26 nt, Human
ccuauacaugacaaaguuuaccucca

SEQ ID NO: 139170 - RNA, 26 nt, Human
ccuauacaugacaaaguuuaccucca

SEQ ID NO: 139171 - RNA, 25 nt, Human
ccuccauaaacaaaaacauuagcag

SEQ ID NO: 139172 - RNA, 25 nt, Human
ccuccauaaacaaaaacauuagcag

SEQ ID NO: 139173 - RNA, 24 nt, Human
ccuccuggauucaagcgauucucc

SEQ ID NO: 139174 - RNA, 24 nt, Human
ccuccuggauucaagcgauucucc

SEQ ID NO: 139175 - RNA, 19 nt, Human
ccucuauaauacccagcuu

SEQ ID NO: 139176 - RNA, 19 nt, Human
ccucuauaauacccagcuu

SEQ ID NO: 139177 - RNA, 22 nt, Human
ccugaguagcugggauuacagu

SEQ ID NO: 139178 - RNA, 22 nt, Human
ccugaguagcugggauuacagu

SEQ ID NO: 139179 - RNA, 23 nt, Human
ccugccucagccuccugaguagc

SEQ ID NO: 139180 - RNA, 23 nt, Human
ccugccucagccuccugaguagc

SEQ ID NO: 139181 - RNA, 24 nt, Human
ccugccucagccuccugaguagcu

SEQ ID NO: 139182 - RNA, 23 nt, Human
ccuggauucaagcgauucuccug

SEQ ID NO: 139183 - RNA, 23 nt, Human
ccuggauucaagcgauucuccug

SEQ ID NO: 139184 - RNA, 24 nt, Human
cgcucuuguugcccaggcuggagu

SEQ ID NO: 139185 - RNA, 24 nt, Human
cgcucuuguugcccaggcuggagu

SEQ ID NO: 139186 - RNA, 26 nt, Human
cuagaaacuccagucccucuucuucc

SEQ ID NO: 139187 - RNA, 22 nt, Human
cuauucccuggccagucuccuu

SEQ ID NO: 139188 - RNA, 24 nt, Human
cucacugcaaccuccgccuccugg

SEQ ID NO: 139189 - RNA, 24 nt, Human
cucacugcaaccuccgccuccugg

SEQ ID NO: 139190 - RNA, 24 nt, Human
cucagccuccugaguagcugggau

SEQ ID NO: 139191 - RNA, 24 nt, Human
cucagccuccugaguagcugggau

SEQ ID NO: 139192 - RNA, 21 nt, Human
cucuuguugcccaggcuggag

SEQ ID NO: 139193 - RNA, 22 nt, Human
cugaaagaaaacaaugcuggga

SEQ ID NO: 139194 - RNA, 22 nt, Human
cugaaagaaaacaaugcuggga

SEQ ID NO: 139195 - RNA, 23 nt, Human
cugcaaccuccgccuccuggauu

SEQ ID NO: 139196 - RNA, 23 nt, Human
cugcaaccuccgccuccuggauu

SEQ ID NO: 139197 - RNA, 24 nt, Human
cugcaaccuccgccuccuggauuc

SEQ ID NO: 139198 - RNA, 23 nt, Human
cugccucagccuccugaguagcu

SEQ ID NO: 139199 - RNA, 23 nt, Human
cuggagugcaguggcaaucucgg

SEQ ID NO: 139200 - RNA, 21 nt, Human
cugggagcacugcucugagga

SEQ ID NO: 139201 - RNA, 21 nt, Human
cugggagcacugcucugagga

SEQ ID NO: 139202 - RNA, 24 nt, Human
cuuguugcccaggcuggagugcag

SEQ ID NO: 139203 - RNA, 24 nt, Human
cuuguugcccaggcuggagugcag

SEQ ID NO: 139204 - RNA, 19 nt, Human
gaaaacaaugcugggagca

SEQ ID NO: 139205 - RNA, 19 nt, Human
gaaaacaaugcugggagca

SEQ ID NO: 139206 - RNA, 20 nt, Human
gaaaucuucucauguaaucu

SEQ ID NO: 139207 - RNA, 21 nt, Human
gaaaucuucucauguaaucuu

SEQ ID NO: 139208 - RNA, 18 nt, Human
gaacauauuuaauucgua

SEQ ID NO: 139209 - RNA, 18 nt, Human
gaacauauuuaauucgua

SEQ ID NO: 139210 - RNA, 21 nt, Human
gagcuuguucugguccuuauc

SEQ ID NO: 139211 - RNA, 21 nt, Human
gagcuuguucugguccuuauc

SEQ ID NO: 139212 - RNA, 25 nt, Human
gaguagcugggauuacagucauucg

SEQ ID NO: 139213 - RNA, 25 nt, Human
gaguagcugggauuacagucauucg

SEQ ID NO: 139214 - RNA, 21 nt, Human
gaguugcagccuaaugcauca

SEQ ID NO: 139215 - RNA, 21 nt, Human
gaguugcagccuaaugcauca

SEQ ID NO: 139216 - RNA, 20 nt, Human
gauaacagggcagccuggga

SEQ ID NO: 139217 - RNA, 22 nt, Human
gauuacagucauucgccaccau

SEQ ID NO: 139218 - RNA, 24 nt, Human
gauuacagucauucgccaccaugu

SEQ ID NO: 139219 - RNA, 22 nt, Human
gcaaccuccgccuccuggauuc

SEQ ID NO: 139220 - RNA, 22 nt, Human
gcacugaagaauacuuaaaagu

SEQ ID NO: 139221 - RNA, 22 nt, Human
gcacugaagaauacuuaaaagu

SEQ ID NO: 139222 - RNA, 20 nt, Human
gcagaugcugcuaacauucu

SEQ ID NO: 139223 - RNA, 19 nt, Human
gcccaggcuggagugcagu

SEQ ID NO: 139224 - RNA, 23 nt, Human
gcgauucuccugccucagccucc

SEQ ID NO: 139225 - RNA, 24 nt, Human
gcgauucuccugccucagccuccu

SEQ ID NO: 139226 - RNA, 24 nt, Human
gcucuuguugcccaggcuggagug

SEQ ID NO: 139227 - RNA, 21 nt, Human
gcugcaauucuuucauggaaa

SEQ ID NO: 139228 - RNA, 21 nt, Human
gcugcaauucuuucauggaaa

SEQ ID NO: 139229 - RNA, 22 nt, Human
gcuggagugcaguggcaaucuc

SEQ ID NO: 139230 - RNA, 22 nt, Human
gcuggagugcaguggcaaucuc

SEQ ID NO: 139231 - RNA, 19 nt, Human
ggcagccugggaugcacag

SEQ ID NO: 139232 - RNA, 18 nt, Human
ggccagagaaccuuugcc

SEQ ID NO: 139233 - RNA, 19 nt, Human
ggccagauaacagggcagc

SEQ ID NO: 139234 - RNA, 18 nt, Human
ggccucuauaauacccag

SEQ ID NO: 139235 - RNA, 18 nt, Human
ggccucuauaauacccag

SEQ ID NO: 139236 - RNA, 20 nt, Human
gggcagccugggaugcacag

SEQ ID NO: 139237 - RNA, 23 nt, Human
gucccuaauucugacugcccauu

SEQ ID NO: 139238 - RNA, 25 nt, Human
uaaaagagaauuaacaaacaaaacc

SEQ ID NO: 139239 - RNA, 25 nt, Human
uaaaagagaauuaacaaacaaaacc

SEQ ID NO: 139240 - RNA, 22 nt, Human
uaaaguaacuguaaauuuaggc

SEQ ID NO: 139241 - RNA, 22 nt, Human
uaaaguaacuguaaauuuaggc

SEQ ID NO: 139242 - RNA, 24 nt, Human
uaaaugcaaagaggcuuuccuaca

SEQ ID NO: 139243 - RNA, 24 nt, Human
uaauuucuuauauuuuuaguagag

SEQ ID NO: 139244 - RNA, 24 nt, Human
uaauuucuuauauuuuuaguagag

SEQ ID NO: 139245 - RNA, 19 nt, Human
uacccuuaccuauacauga

SEQ ID NO: 139246 - RNA, 19 nt, Human
uacccuuaccuauacauga

SEQ ID NO: 139247 - RNA, 19 nt, Human
uagcagaugcugcuaacau

SEQ ID NO: 139248 - RNA, 19 nt, Human
uagcagaugcugcuaacau

SEQ ID NO: 139249 - RNA, 22 nt, Human
uagcagaugcugcuaacauucu

SEQ ID NO: 139250 - RNA, 19 nt, Human
uaucuggcaccaacuaugu

SEQ ID NO: 139251 - RNA, 19 nt, Human
uaucuggcaccaacuaugu

SEQ ID NO: 139252 - RNA, 19 nt, Human
uauucugcugccaccuuga

SEQ ID NO: 139253 - RNA, 19 nt, Human
ucaagcgauucuccugccu

SEQ ID NO: 139254 - RNA, 19 nt, Human
ucaagcgauucuccugccu

SEQ ID NO: 139255 - RNA, 19 nt, Human
ucacugcaaccuccgccuc

SEQ ID NO: 139256 - RNA, 19 nt, Human
ucacugcaaccuccgccuc

SEQ ID NO: 139257 - RNA, 23 nt, Human
ucacugcaaccuccgccuccugg

SEQ ID NO: 139258 - RNA, 23 nt, Human
ucacugcaaccuccgccuccugg

SEQ ID NO: 139259 - RNA, 24 nt, Human
ucacugcaaccuccgccuccugga

SEQ ID NO: 139260 - RNA, 24 nt, Human
ucacugcaaccuccgccuccugga

SEQ ID NO: 139261 - RNA, 27 nt, Human
ucacugcaaccuccgccuccuggauuc

SEQ ID NO: 139262 - RNA, 27 nt, Human
ucacugcaaccuccgccuccuggauuc

SEQ ID NO: 139263 - RNA, 20 nt, Human
ucagccuccugaguagcugg

SEQ ID NO: 139264 - RNA, 20 nt, Human
ucagccuccugaguagcugg

SEQ ID NO: 139265 - RNA, 18 nt, Human
ucauucgccaccaugucc

SEQ ID NO: 139266 - RNA, 18 nt, Human
ucauucgccaccaugucc

SEQ ID NO: 139267 - RNA, 20 nt, Human
ucauuggccucuauaauacc

SEQ ID NO: 139268 - RNA, 20 nt, Human
ucauuggccucuauaauacc

SEQ ID NO: 139269 - RNA, 22 nt, Human
ucccuaauucugacugcccauu

SEQ ID NO: 139270 - RNA, 21 nt, Human
ucccuggccagucuccuuccu

SEQ ID NO: 139271 - RNA, 23 nt, Human
uccugaguagcugggauuacagu

SEQ ID NO: 139272 - RNA, 23 nt, Human
uccugaguagcugggauuacagu

SEQ ID NO: 139273 - RNA, 21 nt, Human
uccuggauucaagcgauucuc

SEQ ID NO: 139274 - RNA, 21 nt, Human
uccuggauucaagcgauucuc

SEQ ID NO: 139275 - RNA, 24 nt, Human
uccuggauucaagcgauucuccug

SEQ ID NO: 139276 - RNA, 24 nt, Human
uccuggauucaagcgauucuccug

SEQ ID NO: 139277 - RNA, 22 nt, Human
ucgcucuuguugcccaggcugg

SEQ ID NO: 139278 - RNA, 22 nt, Human
ucgcucuuguugcccaggcugg

SEQ ID NO: 139279 - RNA, 23 nt, Human
ucgcucuuguugcccaggcugga

SEQ ID NO: 139280 - RNA, 23 nt, Human
ucgcucuuguugcccaggcugga

SEQ ID NO: 139281 - RNA, 24 nt, Human
ucuccugccucagccuccugagua

SEQ ID NO: 139282 - RNA, 24 nt, Human
ucuccugccucagccuccugagua

SEQ ID NO: 139283 - RNA, 22 nt, Human
ucuuguugcccaggcuggagug

SEQ ID NO: 139284 - RNA, 22 nt, Human
ucuuguugcccaggcuggagug

SEQ ID NO: 139285 - RNA, 24 nt, Human
ugaaagaaaacaaugcugggagca

SEQ ID NO: 139286 - RNA, 24 nt, Human
ugaaagaaaacaaugcugggagca

SEQ ID NO: 139287 - RNA, 24 nt, Human
ugacaaaguuuaccuccauaaaca

SEQ ID NO: 139288 - RNA, 24 nt, Human
ugacaaaguuuaccuccauaaaca

SEQ ID NO: 139289 - RNA, 21 nt, Human
ugaccuaacaacaaauccaca

SEQ ID NO: 139290 - RNA, 21 nt, Human
ugaccuaacaacaaauccaca

SEQ ID NO: 139291 - RNA, 21 nt, Human
ugauaaacaguaggaggagca

SEQ ID NO: 139292 - RNA, 23 nt, Human
ugcaaagaggcuuuccuacaagu

SEQ ID NO: 139293 - RNA, 20 nt, Human
ugcaguggcaaucucggcuc

SEQ ID NO: 139294 - RNA, 20 nt, Human
ugcaugucuuugcuaauguc

SEQ ID NO: 139295 - RNA, 18 nt, Human
ugcccaggcuggagugca

SEQ ID NO: 139296 - RNA, 18 nt, Human
ugcccaggcuggagugca

SEQ ID NO: 139297 - RNA, 21 nt, Human
ugcccaggcuggagugcagug

SEQ ID NO: 139298 - RNA, 21 nt, Human
ugcccaggcuggagugcagug

SEQ ID NO: 139299 - RNA, 22 nt, Human
ugcccaggcuggagugcagugg

SEQ ID NO: 139300 - RNA, 22 nt, Human
ugcccaggcuggagugcagugg

SEQ ID NO: 139301 - RNA, 24 nt, Human
ugcccaggcuggagugcaguggca

SEQ ID NO: 139302 - RNA, 24 nt, Human
ugcccaggcuggagugcaguggca

SEQ ID NO: 139303 - RNA, 24 nt, Human
ugccucagccuccugaguagcugg

SEQ ID NO: 139304 - RNA, 24 nt, Human
ugccucagccuccugaguagcugg

SEQ ID NO: 139305 - RNA, 22 nt, Human
ugcuccucaucuuguccacaca

SEQ ID NO: 139306 - RNA, 19 nt, Human
ugcuuggagauggcaggug

SEQ ID NO: 139307 - RNA, 19 nt, Human
ugcuuggagauggcaggug

SEQ ID NO: 139308 - RNA, 24 nt, Human
uggaaaucuucucauguaaucuuc

SEQ ID NO: 139309 - RNA, 24 nt, Human
uggaaaucuucucauguaaucuuc

SEQ ID NO: 139310 - RNA, 21 nt, Human
uggaccucagggcugcaauuc

SEQ ID NO: 139311 - RNA, 21 nt, Human
uggaccucagggcugcaauuc

SEQ ID NO: 139312 - RNA, 20 nt, Human
uggagugcaguggcaaucuc

SEQ ID NO: 139313 - RNA, 20 nt, Human
uggagugcaguggcaaucuc

SEQ ID NO: 139314 - RNA, 22 nt, Human
uggagugcaguggcaaucucgg

SEQ ID NO: 139315 - RNA, 22 nt, Human
uggagugcaguggcaaucucgg

SEQ ID NO: 139316 - RNA, 24 nt, Human
uggauucaagcgauucuccugccu

SEQ ID NO: 139317 - RNA, 21 nt, Human
ugggauuacagucauucgcca

SEQ ID NO: 139318 - RNA, 21 nt, Human
ugggauuacagucauucgcca

SEQ ID NO: 139319 - RNA, 24 nt, Human
ugggauuacagucauucgccacca

SEQ ID NO: 139320 - RNA, 24 nt, Human
ugggauuacagucauucgccacca

SEQ ID NO: 139321 - RNA, 22 nt, Human
ugguuuggaagacaguccggag

SEQ ID NO: 139322 - RNA, 22 nt, Human
uguaaauuuaggcugagucuua

SEQ ID NO: 139323 - RNA, 22 nt, Human
uguaaauuuaggcugagucuua

SEQ ID NO: 139324 - RNA, 18 nt, Human
uuaguagaguggggguuu

SEQ ID NO: 139325 - RNA, 18 nt, Human
uuaguagaguggggguuu

SEQ ID NO: 139326 - RNA, 21 nt, Human
uucaagcgauucuccugccuc

SEQ ID NO: 139327 - RNA, 21 nt, Human
uucaagcgauucuccugccuc

SEQ ID NO: 139328 - RNA, 23 nt, Human
uucaagcgauucuccugccucag

SEQ ID NO: 139329 - RNA, 23 nt, Human
uucaagcgauucuccugccucag

SEQ ID NO: 139330 - RNA, 24 nt, Human
uucaagcgauucuccugccucagc

SEQ ID NO: 139331 - RNA, 24 nt, Human
uucaagcgauucuccugccucagc

SEQ ID NO: 139332 - RNA, 19 nt, Human
uuccugccgaucgcugcag

SEQ ID NO: 139333 - RNA, 24 nt, Human
uucgcucuuguugcccaggcugga

SEQ ID NO: 139334 - RNA, 24 nt, Human
uucgcucuuguugcccaggcugga

SEQ ID NO: 139335 - RNA, 21 nt, Human
uugaagaacauauuuaauucg

SEQ ID NO: 139336 - RNA, 21 nt, Human
uugaagaacauauuuaauucg

SEQ ID NO: 139337 - RNA, 24 nt, Human
uugcccaggcuggagugcaguggc

SEQ ID NO: 139338 - RNA, 24 nt, Human
uugcccaggcuggagugcaguggc

SEQ ID NO: 139339 - RNA, 20 nt, Human
uuggaagacaguccggaggc

SEQ ID NO: 139340 - RNA, 20 nt, Human
uuggccucuauaauacccag

SEQ ID NO: 139341 - RNA, 20 nt, Human
uuggccucuauaauacccag

SEQ ID NO: 139342 - RNA, 24 nt, Human
uuucgcucuuguugcccaggcugg

SEQ ID NO: 139343 - RNA, 24 nt, Human
uuucgcucuuguugcccaggcugg

SEQ ID NO: 139344 - RNA, 20 nt, Human
uuugcaaauaaaaggugcaa

SEQ ID NO: 139345 - RNA, 19 nt, Human
uuuuuaguagagugggggu

SEQ ID NO: 139346 - RNA, 25 nt, Human
uuuuuuuuuuuugagacggaguuuc

SEQ ID NO: 139347 - RNA, 25 nt, Human
uuuuuuuuuuuugagacggaguuuc

SEQ ID NO: 139348 - RNA, 22 nt, Human
uuuuuuuuuuuuuugagacgga

SEQ ID NO: 139349 - RNA, 22 nt, Human
uuuuuuuuuuuuuugagacgga

SEQ ID NO: 139350 - RNA, 18 nt, Human
uuuuuuuuuuuuuuuuug

SEQ ID NO: 139351 - RNA, 18 nt, Human
uuuuuuuuuuuuuuuuug

SEQ ID NO: 139352 - RNA, 20 nt, Human
aaaaggucacauuacaagaa

SEQ ID NO: 139353 - RNA, 20 nt, Human
aaaaggucacauuacaagaa

SEQ ID NO: 139354 - RNA, 21 nt, Human
aaauaaugagagaaaaacccc

SEQ ID NO: 139355 - RNA, 21 nt, Human
aaauaaugagagaaaaacccc

SEQ ID NO: 139356 - RNA, 22 nt, Human
aagcgccugccucucauccaag

SEQ ID NO: 139357 - RNA, 25 nt, Human
acagugaaaaggucacauuacaaga

SEQ ID NO: 139358 - RNA, 25 nt, Human
acagugaaaaggucacauuacaaga

SEQ ID NO: 139359 - RNA, 25 nt, Human
acucaucucuucaugcaugcuucug

SEQ ID NO: 139360 - RNA, 22 nt, Human
acugcaacaaccuacagaccca

SEQ ID NO: 139361 - RNA, 27 nt, Human
aggaaaacaacaguuuccaagcaccac

SEQ ID NO: 139362 - RNA, 27 nt, Human
aggaaaacaacaguuuccaagcaccac

SEQ ID NO: 139363 - RNA, 24 nt, Human
aucucuucaugcaugcuucugcua

SEQ ID NO: 139364 - RNA, 21 nt, Human
caaauaaugagagaaaaaccc

SEQ ID NO: 139365 - RNA, 21 nt, Human
caaauaaugagagaaaaaccc

SEQ ID NO: 139366 - RNA, 24 nt, Human
caacaaccuacagacccagccacc

SEQ ID NO: 139367 - RNA, 19 nt, Human
caagcaccacaugaacacu

SEQ ID NO: 139368 - RNA, 21 nt, Human
caagcaccacaugaacacuuu

SEQ ID NO: 139369 - RNA, 18 nt, Human
caggaggagcgcgaggcg

SEQ ID NO: 139370 - RNA, 22 nt, Human
cccgcugcucaggaggagcgcg

SEQ ID NO: 139371 - RNA, 19 nt, Human
ccuacagacccagccaccg

SEQ ID NO: 139372 - RNA, 22 nt, Human
cggagcgcagucugggcccgcu

SEQ ID NO: 139373 - RNA, 19 nt, Human
cuccaaauuauccaaaaau

SEQ ID NO: 139374 - RNA, 21 nt, Human
cugcaacaaccuacagaccca

SEQ ID NO: 139375 - RNA, 24 nt, Human
cuucuugucguucacugcaacaac

SEQ ID NO: 139376 - RNA, 23 nt, Human
gaaaaacccccacaaauagcauc

SEQ ID NO: 139377 - RNA, 23 nt, Human
gaaaaacccccacaaauagcauc

SEQ ID NO: 139378 - RNA, 19 nt, Human
gaaugcagucuacacacuu

SEQ ID NO: 139379 - RNA, 19 nt, Human
gaaugcagucuacacacuu

SEQ ID NO: 139380 - RNA, 24 nt, Human
gaggagguggggcgcgcggagagg

SEQ ID NO: 139381 - RNA, 19 nt, Human
gaggcggaggagguggggc

SEQ ID NO: 139382 - RNA, 22 nt, Human
gagggcuccgcggggcgagggc

SEQ ID NO: 139383 - RNA, 22 nt, Human
ggagcgcagucugggcccgcug

SEQ ID NO: 139384 - RNA, 25 nt, Human
ggcaugcuugugauuuuccucagag

SEQ ID NO: 139385 - RNA, 21 nt, Human
ggccggagcgcagucugggcc

SEQ ID NO: 139386 - RNA, 23 nt, Human
ggcucggggcaggucgcgggccg

SEQ ID NO: 139387 - RNA, 20 nt, Human
gggcucggggcaggucgcgg

SEQ ID NO: 139388 - RNA, 23 nt, Human
uaaggcagacuuuaauuucucug

SEQ ID NO: 139389 - RNA, 23 nt, Human
uaaggcagacuuuaauuucucug

SEQ ID NO: 139390 - RNA, 24 nt, Human
uacagacccagccaccgauccucu

SEQ ID NO: 139391 - RNA, 18 nt, Human
uagaacacacucaucucu

SEQ ID NO: 139392 - RNA, 18 nt, Human
uagaacacacucaucucu

SEQ ID NO: 139393 - RNA, 18 nt, Human
uccaaaaauucaagccca

SEQ ID NO: 139394 - RNA, 19 nt, Human
uccaaaaauucaagcccau

SEQ ID NO: 139395 - RNA, 21 nt, Human
uccauccaaauaaugagagaa

SEQ ID NO: 139396 - RNA, 21 nt, Human
uccauccaaauaaugagagaa

SEQ ID NO: 139397 - RNA, 24 nt, Human
ugaaaaggucacauuacaagaaua

SEQ ID NO: 139398 - RNA, 24 nt, Human
ugaaaaggucacauuacaagaaua

SEQ ID NO: 139399 - RNA, 21 nt, Human
ugaccaaagagauuccaucca

SEQ ID NO: 139400 - RNA, 21 nt, Human
ugaccaaagagauuccaucca

SEQ ID NO: 139401 - RNA, 22 nt, Human
ugaccaaagagauuccauccaa

SEQ ID NO: 139402 - RNA, 22 nt, Human
ugaccaaagagauuccauccaa

SEQ ID NO: 139403 - RNA, 24 nt, Human
ugggcuccaaauuauccaaaaauu

SEQ ID NO: 139404 - RNA, 24 nt, Human
aaaaaacaccucaucucuggaccc

SEQ ID NO: 139405 - RNA, 24 nt, Human
aaaaaacaccucaucucuggaccc

SEQ ID NO: 139406 - RNA, 23 nt, Human
aaaaacaccucaucucuggaccc

SEQ ID NO: 139407 - RNA, 23 nt, Human
aaaaacaccucaucucuggaccc

SEQ ID NO: 139408 - RNA, 19 nt, Human
aaaaccuggagucacuuaa

SEQ ID NO: 139409 - RNA, 19 nt, Human
aaaaccuggagucacuuaa

SEQ ID NO: 139410 - RNA, 25 nt, Human
aaaagaagacgacuuuaaacggaaa

SEQ ID NO: 139411 - RNA, 23 nt, Human
aaacggaaaacaaggccgggagc

SEQ ID NO: 139412 - RNA, 23 nt, Human
aaacggaaaacaaggccgggagc

SEQ ID NO: 139413 - RNA, 18 nt, Human
aaacugauuaaaaauuaa

SEQ ID NO: 139414 - RNA, 18 nt, Human
aaacugauuaaaaauuaa

SEQ ID NO: 139415 - RNA, 18 nt, Human
aaaugccuucagacucau

SEQ ID NO: 139416 - RNA, 18 nt, Human
aaaugccuucagacucau

SEQ ID NO: 139417 - RNA, 19 nt, Human
aacacagugaaaccccguc

SEQ ID NO: 139418 - RNA, 19 nt, Human
aacacagugaaaccccguc

SEQ ID NO: 139419 - RNA, 20 nt, Human
aacacagugaaaccccgucu

SEQ ID NO: 139420 - RNA, 20 nt, Human
aacacagugaaaccccgucu

SEQ ID NO: 139421 - RNA, 21 nt, Human
aacacagugaaaccccgucuc

SEQ ID NO: 139422 - RNA, 21 nt, Human
aacacagugaaaccccgucuc

SEQ ID NO: 139423 - RNA, 24 nt, Human
aacauugcaaaacaaaccccacug

SEQ ID NO: 139424 - RNA, 24 nt, Human
aacauugcaaaacaaaccccacug

SEQ ID NO: 139425 - RNA, 19 nt, Human
aaccccagcugcagcgagu

SEQ ID NO: 139426 - RNA, 19 nt, Human
aaccccagcugcagcgagu

SEQ ID NO: 139427 - RNA, 20 nt, Human
aaggaugguggaaaaccugg

SEQ ID NO: 139428 - RNA, 20 nt, Human
aaggaugguggaaaaccugg

SEQ ID NO: 139429 - RNA, 20 nt, Human
aagguaaguuuuaaaauguu

SEQ ID NO: 139430 - RNA, 20 nt, Human
aagguaaguuuuaaaauguu

SEQ ID NO: 139431 - RNA, 21 nt, Human
acaguggguguuucaguagcc

SEQ ID NO: 139432 - RNA, 21 nt, Human
acauugcaaaacaaaccccac

SEQ ID NO: 139433 - RNA, 21 nt, Human
acauugcaaaacaaaccccac

SEQ ID NO: 139434 - RNA, 24 nt, Human
accccgucucuauuaaaaauacaa

SEQ ID NO: 139435 - RNA, 24 nt, Human
accccgucucuauuaaaaauacaa

SEQ ID NO: 139436 - RNA, 23 nt, Human
acuccaaauaaggugagccauag

SEQ ID NO: 139437 - RNA, 23 nt, Human
acuccaaauaaggugagccauag

SEQ ID NO: 139438 - RNA, 24 nt, Human
acugcacuccagccugugcgucag

SEQ ID NO: 139439 - RNA, 24 nt, Human
acugcacuccagccugugcgucag

SEQ ID NO: 139440 - RNA, 26 nt, Human
acugcacuccagccugugcgucagag

SEQ ID NO: 139441 - RNA, 26 nt, Human
acugcacuccagccugugcgucagag

SEQ ID NO: 139442 - RNA, 19 nt, Human
acuuguggaugcagaaauc

SEQ ID NO: 139443 - RNA, 19 nt, Human
acuuguggaugcagaaauc

SEQ ID NO: 139444 - RNA, 21 nt, Human
agaaaacagaaaauguaggaa

SEQ ID NO: 139445 - RNA, 21 nt, Human
agaaaacagaaaauguaggaa

SEQ ID NO: 139446 - RNA, 23 nt, Human
agaauagaaacagcaauagagga

SEQ ID NO: 139447 - RNA, 20 nt, Human
agagaaaagaauuacaaauu

SEQ ID NO: 139448 - RNA, 20 nt, Human
agagaaaagaauuacaaauu

SEQ ID NO: 139449 - RNA, 24 nt, Human
agcacuuugggaggccgaggcagg

SEQ ID NO: 139450 - RNA, 24 nt, Human
agcacuuugggaggccgaggcagg

SEQ ID NO: 139451 - RNA, 23 nt, Human
agccgggcgugguggugggcgcc

SEQ ID NO: 139452 - RNA, 23 nt, Human
agccgggcgugguggugggcgcc

SEQ ID NO: 139453 - RNA, 25 nt, Human
agcucugucuccuugauuucucacu

SEQ ID NO: 139454 - RNA, 25 nt, Human
agcucugucuccuugauuucucacu

SEQ ID NO: 139455 - RNA, 20 nt, Human
aggaggacaugguuauuugg

SEQ ID NO: 139456 - RNA, 21 nt, Human
aggaggacaugguuauuuggg

SEQ ID NO: 139457 - RNA, 21 nt, Human
aggcaggagaauggcaugaac

SEQ ID NO: 139458 - RNA, 24 nt, Human
aggcaggagaauggcaugaacccg

SEQ ID NO: 139459 - RNA, 24 nt, Human
aggcaggagaauggcaugaacccg

SEQ ID NO: 139460 - RNA, 20 nt, Human
aggcaggcggaucacgaggu

SEQ ID NO: 139461 - RNA, 20 nt, Human
aggcaggcggaucacgaggu

SEQ ID NO: 139462 - RNA, 24 nt, Human
aggcaggcggaucacgaggucagg

SEQ ID NO: 139463 - RNA, 24 nt, Human
aggcaggcggaucacgaggucagg

SEQ ID NO: 139464 - RNA, 26 nt, Human
aggcaggcggaucacgaggucaggag

SEQ ID NO: 139465 - RNA, 26 nt, Human
aggcaggcggaucacgaggucaggag

SEQ ID NO: 139466 - RNA, 21 nt, Human
aggccgaggcaggcggaucac

SEQ ID NO: 139467 - RNA, 21 nt, Human
aggccgaggcaggcggaucac

SEQ ID NO: 139468 - RNA, 23 nt, Human
aggccgaggcaggcggaucacga

SEQ ID NO: 139469 - RNA, 22 nt, Human
aggcggaucacgaggucaggag

SEQ ID NO: 139470 - RNA, 24 nt, Human
aggcggaucacgaggucaggagau

SEQ ID NO: 139471 - RNA, 19 nt, Human
aggcugaggcaggagaaug

SEQ ID NO: 139472 - RNA, 19 nt, Human
aggcugaggcaggagaaug

SEQ ID NO: 139473 - RNA, 23 nt, Human
agggggggggggcaauaaaaagu

SEQ ID NO: 139474 - RNA, 23 nt, Human
agggggggggggcaauaaaaagu

SEQ ID NO: 139475 - RNA, 23 nt, Human
augaauuugguagugcaguaggg

SEQ ID NO: 139476 - RNA, 23 nt, Human
augaauuugguagugcaguaggg

SEQ ID NO: 139477 - RNA, 19 nt, Human
augccuguaaucccagcac

SEQ ID NO: 139478 - RNA, 19 nt, Human
augccuguaaucccagcac

SEQ ID NO: 139479 - RNA, 20 nt, Human
augguggaaaaccuggaguc

SEQ ID NO: 139480 - RNA, 20 nt, Human
augguggaaaaccuggaguc

SEQ ID NO: 139481 - RNA, 20 nt, Human
auuacaucgaugcaauuucu

SEQ ID NO: 139482 - RNA, 20 nt, Human
auuuaagagcccaggccuag

SEQ ID NO: 139483 - RNA, 18 nt, Human
caaaccccacugcauuuu

SEQ ID NO: 139484 - RNA, 18 nt, Human
caaaccccacugcauuuu

SEQ ID NO: 139485 - RNA, 20 nt, Human
cacacacacauuuauuucca

SEQ ID NO: 139486 - RNA, 20 nt, Human
cacacacacauuuauuucca

SEQ ID NO: 139487 - RNA, 22 nt, Human
cacaguggguguuucaguagcc

SEQ ID NO: 139488 - RNA, 23 nt, Human
caccuuacacauauaaggaaaua

SEQ ID NO: 139489 - RNA, 23 nt, Human
caccuuacacauauaaggaaaua

SEQ ID NO: 139490 - RNA, 23 nt, Human
cacuccagccugugcgucagagc

SEQ ID NO: 139491 - RNA, 23 nt, Human
cacuccagccugugcgucagagc

SEQ ID NO: 139492 - RNA, 24 nt, Human
cacuccagccugugcgucagagcg

SEQ ID NO: 139493 - RNA, 24 nt, Human
cacuccagccugugcgucagagcg

SEQ ID NO: 139494 - RNA, 19 nt, Human
cacugcacuccagccugug

SEQ ID NO: 139495 - RNA, 20 nt, Human
cacugcacuccagccugugc

SEQ ID NO: 139496 - RNA, 20 nt, Human
cacugcacuccagccugugc

SEQ ID NO: 139497 - RNA, 24 nt, Human
cacugcacuccagccugugcguca

SEQ ID NO: 139498 - RNA, 24 nt, Human
cacugcacuccagccugugcguca

SEQ ID NO: 139499 - RNA, 24 nt, Human
cacugcacuccagccugugcguca

SEQ ID NO: 139500 - RNA, 25 nt, Human
cacugcacuccagccugugcgucag

SEQ ID NO: 139501 - RNA, 18 nt, Human
cagaagaagggcagugag

SEQ ID NO: 139502 - RNA, 18 nt, Human
cagaagaagggcagugag

SEQ ID NO: 139503 - RNA, 24 nt, Human
cagaaggaauacaacaauucccau

SEQ ID NO: 139504 - RNA, 24 nt, Human
cagaaggaauacaacaauucccau

SEQ ID NO: 139505 - RNA, 22 nt, Human
cagaaugucugacaaagaccua

SEQ ID NO: 139506 - RNA, 19 nt, Human
cagagcgagacuccgucuc

SEQ ID NO: 139507 - RNA, 22 nt, Human
cagagcgagacuccgucucaaa

SEQ ID NO: 139508 - RNA, 22 nt, Human
cagagcgagacuccgucucaaa

SEQ ID NO: 139509 - RNA, 25 nt, Human
cagcaacuaggcuuacagagaauuc

SEQ ID NO: 139510 - RNA, 25 nt, Human
cagcaacuaggcuuacagagaauuc

SEQ ID NO: 139511 - RNA, 24 nt, Human
cagcacuuugggaggccgaggcag

SEQ ID NO: 139512 - RNA, 24 nt, Human
cagcacuuugggaggccgaggcag

SEQ ID NO: 139513 - RNA, 26 nt, Human
cagcacuuugggaggccgaggcaggc

SEQ ID NO: 139514 - RNA, 26 nt, Human
cagcacuuugggaggccgaggcaggc

SEQ ID NO: 139515 - RNA, 25 nt, Human
cagcaggaaauuucagcaacuaggc

SEQ ID NO: 139516 - RNA, 25 nt, Human
cagcaggaaauuucagcaacuaggc

SEQ ID NO: 139517 - RNA, 24 nt, Human
cagcuacucaggaggcugaggcag

SEQ ID NO: 139518 - RNA, 24 nt, Human
cagcuacucaggaggcugaggcag

SEQ ID NO: 139519 - RNA, 25 nt, Human
cagcugcagcgaguauuccccaguu

SEQ ID NO: 139520 - RNA, 25 nt, Human
cagcugcagcgaguauuccccaguu

SEQ ID NO: 139521 - RNA, 26 nt, Human
cagcugcuuccuuauaaaaguaagaa

SEQ ID NO: 139522 - RNA, 26 nt, Human
cagcugcuuccuuauaaaaguaagaa

SEQ ID NO: 139523 - RNA, 21 nt, Human
caugaacccgggaggcggagc

SEQ ID NO: 139524 - RNA, 21 nt, Human
caugaacccgggaggcggagc

SEQ ID NO: 139525 - RNA, 20 nt, Human
caugccuguaaucccagcac

SEQ ID NO: 139526 - RNA, 24 nt, Human
caugccuguaaucccagcacuuug

SEQ ID NO: 139527 - RNA, 24 nt, Human
caugccuguaaucccagcacuuug

SEQ ID NO: 139528 - RNA, 21 nt, Human
cauuuaagagcccaggccuag

SEQ ID NO: 139529 - RNA, 18 nt, Human
ccacugcacuccagccug

SEQ ID NO: 139530 - RNA, 18 nt, Human
ccacugcacuccagccug

SEQ ID NO: 139531 - RNA, 18 nt, Human
ccacugcacuccagccug

SEQ ID NO: 139532 - RNA, 18 nt, Human
ccacugcacuccagccug

SEQ ID NO: 139533 - RNA, 19 nt, Human
ccacugcacuccagccugu

SEQ ID NO: 139534 - RNA, 19 nt, Human
ccacugcacuccagccugu

SEQ ID NO: 139535 - RNA, 21 nt, Human
ccacugcacuccagccugugc

SEQ ID NO: 139536 - RNA, 21 nt, Human
ccacugcacuccagccugugc

SEQ ID NO: 139537 - RNA, 21 nt, Human
cccacugcauuuuagacagcu

SEQ ID NO: 139538 - RNA, 21 nt, Human
cccacugcauuuuagacagcu

SEQ ID NO: 139539 - RNA, 18 nt, Human
ccccagccucauuucaag

SEQ ID NO: 139540 - RNA, 18 nt, Human
ccccagccucauuucaag

SEQ ID NO: 139541 - RNA, 22 nt, Human
ccccuggcuucucgacugucuu

SEQ ID NO: 139542 - RNA, 22 nt, Human
ccccuggcuucucgacugucuu

SEQ ID NO: 139543 - RNA, 22 nt, Human
cccucuagccucuaaacucuag

SEQ ID NO: 139544 - RNA, 22 nt, Human
cccucuagccucuaaacucuag

SEQ ID NO: 139545 - RNA, 24 nt, Human
ccuaggaaaaaguaugaagcagac

SEQ ID NO: 139546 - RNA, 21 nt, Human
ccugcaaaugccuucagacuc

SEQ ID NO: 139547 - RNA, 21 nt, Human
ccugcaaaugccuucagacuc

SEQ ID NO: 139548 - RNA, 22 nt, Human
ccugcaaaugccuucagacuca

SEQ ID NO: 139549 - RNA, 22 nt, Human
ccugcaaaugccuucagacuca

SEQ ID NO: 139550 - RNA, 26 nt, Human
ccugcaaaugccuucagaggucguaa

SEQ ID NO: 139551 - RNA, 26 nt, Human
ccugcaaaugccuucagaggucguaa

SEQ ID NO: 139552 - RNA, 23 nt, Human
ccuggcuaacacagugaaacccc

SEQ ID NO: 139553 - RNA, 23 nt, Human
ccuggcuaacacagugaaacccc

SEQ ID NO: 139554 - RNA, 24 nt, Human
ccuggcuaacacagugaaaccccg

SEQ ID NO: 139555 - RNA, 24 nt, Human
ccuggcuaacacagugaaaccccg

SEQ ID NO: 139556 - RNA, 22 nt, Human
ccuguaaucccagcacuuuggg

SEQ ID NO: 139557 - RNA, 19 nt, Human
ccuguagucccagcuacuc

SEQ ID NO: 139558 - RNA, 21 nt, Human
ccuguagucccagcuacucag

SEQ ID NO: 139559 - RNA, 21 nt, Human
ccuguagucccagcuacucag

SEQ ID NO: 139560 - RNA, 22 nt, Human
ccuguagucccagcuacucagg

SEQ ID NO: 139561 - RNA, 21 nt, Human
ccuuguggccucuccuugccc

SEQ ID NO: 139562 - RNA, 24 nt, Human
cgagaccauccuggcuaacacagu

SEQ ID NO: 139563 - RNA, 24 nt, Human
cgagaccauccuggcuaacacagu

SEQ ID NO: 139564 - RNA, 24 nt, Human
cgaggcaggcggaucacgagguca

SEQ ID NO: 139565 - RNA, 24 nt, Human
cgaggcaggcggaucacgagguca

SEQ ID NO: 139566 - RNA, 24 nt, Human
cgccuguagucccagcuacucagg

SEQ ID NO: 139567 - RNA, 24 nt, Human
cgccuguagucccagcuacucagg

SEQ ID NO: 139568 - RNA, 19 nt, Human
cgggagggugccgagagcg

SEQ ID NO: 139569 - RNA, 20 nt, Human
cuaaaacucuguuuaaaaca

SEQ ID NO: 139570 - RNA, 20 nt, Human
cuaaaacucuguuuaaaaca

SEQ ID NO: 139571 - RNA, 22 nt, Human
cucaaaaaaaaagggggggggg

SEQ ID NO: 139572 - RNA, 18 nt, Human
cucccaaaguucccucug

SEQ ID NO: 139573 - RNA, 18 nt, Human
cucccaaaguucccucug

SEQ ID NO: 139574 - RNA, 20 nt, Human
cuccccgaaaaaaacaccuc

SEQ ID NO: 139575 - RNA, 19 nt, Human
cuccccucagcucccucua

SEQ ID NO: 139576 - RNA, 19 nt, Human
cuggacccuugcuaccaaa

SEQ ID NO: 139577 - RNA, 19 nt, Human
cuggacccuugcuaccaaa

SEQ ID NO: 139578 - RNA, 18 nt, Human
cuggcuaacacagugaaa

SEQ ID NO: 139579 - RNA, 18 nt, Human
cuggcuaacacagugaaa

SEQ ID NO: 139580 - RNA, 23 nt, Human
cuuacagagaauuccauucucag

SEQ ID NO: 139581 - RNA, 23 nt, Human
cuuacagagaauuccauucucag

SEQ ID NO: 139582 - RNA, 21 nt, Human
cuuguggaugcagaaaucuug

SEQ ID NO: 139583 - RNA, 21 nt, Human
cuuguggaugcagaaaucuug

SEQ ID NO: 139584 - RNA, 21 nt, Human
cuuguggccucuccuugcccu

SEQ ID NO: 139585 - RNA, 21 nt, Human
gaaaaaguaugaagcagacga

SEQ ID NO: 139586 - RNA, 21 nt, Human
gaaaaaguaugaagcagacga

SEQ ID NO: 139587 - RNA, 19 nt, Human
gaaagaagggggcccacaa

SEQ ID NO: 139588 - RNA, 19 nt, Human
gaaagaagggggcccacaa

SEQ ID NO: 139589 - RNA, 20 nt, Human
gaaugucugacaaagaccua

SEQ ID NO: 139590 - RNA, 20 nt, Human
gacaugguuauuuggaucua

SEQ ID NO: 139591 - RNA, 20 nt, Human
gacaugguuauuuggaucua

SEQ ID NO: 139592 - RNA, 20 nt, Human
gagaacgcgggcgccgggag

SEQ ID NO: 139593 - RNA, 24 nt, Human
gagaucggagccacugcacuccag

SEQ ID NO: 139594 - RNA, 24 nt, Human
gagaucggagccacugcacuccag

SEQ ID NO: 139595 - RNA, 24 nt, Human
gagcaaaacacaguggguguuuca

SEQ ID NO: 139596 - RNA, 24 nt, Human
gagcaaaacacaguggguguuuca

SEQ ID NO: 139597 - RNA, 23 nt, Human
gagguuuuauaaacagggaagug

SEQ ID NO: 139598 - RNA, 23 nt, Human
gagguuuuauaaacagggaagug

SEQ ID NO: 139599 - RNA, 21 nt, Human
gaucggugagugagggaguga

SEQ ID NO: 139600 - RNA, 23 nt, Human
gcaauaaaaagucuaagucuaaa

SEQ ID NO: 139601 - RNA, 24 nt, Human
gcacuccagccugugcgucagagc

SEQ ID NO: 139602 - RNA, 24 nt, Human
gcacuccagccugugcgucagagc

SEQ ID NO: 139603 - RNA, 23 nt, Human
gccuguagucccagcuacucagg

SEQ ID NO: 139604 - RNA, 21 nt, Human
gcuccccgaaaaaaacaccuc

SEQ ID NO: 139605 - RNA, 21 nt, Human
gcugcuuucucccaaaguucc

SEQ ID NO: 139606 - RNA, 22 nt, Human
ggaaaaaugaaagcuuuaaaaa

SEQ ID NO: 139607 - RNA, 22 nt, Human
ggaaaaaugaaagcuuuaaaaa

SEQ ID NO: 139608 - RNA, 24 nt, Human
ggaaaaggcagugccaagccuagg

SEQ ID NO: 139609 - RNA, 24 nt, Human
ggaaaaggcagugccaagccuagg

SEQ ID NO: 139610 - RNA, 22 nt, Human
ggaauacaacaauucccaugaa

SEQ ID NO: 139611 - RNA, 22 nt, Human
ggaauacaacaauucccaugaa

SEQ ID NO: 139612 - RNA, 21 nt, Human
ggaggcggagcuuucagugag

SEQ ID NO: 139613 - RNA, 21 nt, Human
ggaggcggagcuuucagugag

SEQ ID NO: 139614 - RNA, 22 nt, Human
ggcgugguggugggcgccugua

SEQ ID NO: 139615 - RNA, 23 nt, Human
ggcuuuccuugauucaggccaau

SEQ ID NO: 139616 - RNA, 23 nt, Human
ggcuuuccuugauucaggccaau

SEQ ID NO: 139617 - RNA, 26 nt, Human
gggaaaaaugaaagcuuuaaaaauau

SEQ ID NO: 139618 - RNA, 26 nt, Human
gggaaaaaugaaagcuuuaaaaauau

SEQ ID NO: 139619 - RNA, 24 nt, Human
gggagcggugggucaugccuguaa

SEQ ID NO: 139620 - RNA, 24 nt, Human
gggagcggugggucaugccuguaa

SEQ ID NO: 139621 - RNA, 18 nt, Human
gggagggugccgagagcg

SEQ ID NO: 139622 - RNA, 19 nt, Human
gggagugagcaaaacacag

SEQ ID NO: 139623 - RNA, 23 nt, Human
gggcagggccaggagaacgcggg

SEQ ID NO: 139624 - RNA, 24 nt, Human
gggcgugguggugggcgccuguag

SEQ ID NO: 139625 - RNA, 21 nt, Human
gggucaugccuguaaucccag

SEQ ID NO: 139626 - RNA, 23 nt, Human
ggugggucaugccuguaauccca

SEQ ID NO: 139627 - RNA, 23 nt, Human
ggugggucaugccuguaauccca

SEQ ID NO: 139628 - RNA, 24 nt, Human
ggugggucaugccuguaaucccag

SEQ ID NO: 139629 - RNA, 24 nt, Human
ggugggucaugccuguaaucccag

SEQ ID NO: 139630 - RNA, 24 nt, Human
gguggugggcgccuguagucccag

SEQ ID NO: 139631 - RNA, 18 nt, Human
guaaaaaaaaaaaagagc

SEQ ID NO: 139632 - RNA, 18 nt, Human
guaaaaaaaaaaaagagc

SEQ ID NO: 139633 - RNA, 19 nt, Human
guaggacaaacuauacccc

SEQ ID NO: 139634 - RNA, 19 nt, Human
guaggacaaacuauacccc

SEQ ID NO: 139635 - RNA, 21 nt, Human
gucagagcgagacuccgucuc

SEQ ID NO: 139636 - RNA, 25 nt, Human
gucaugccuguaaucccagcacuuu

SEQ ID NO: 139637 - RNA, 25 nt, Human
gucaugccuguaaucccagcacuuu

SEQ ID NO: 139638 - RNA, 21 nt, Human
gugaggacauaaucuugggau

SEQ ID NO: 139639 - RNA, 18 nt, Human
guggccucuccuugcccu

SEQ ID NO: 139640 - RNA, 23 nt, Human
guggugggcgccuguagucccag

SEQ ID NO: 139641 - RNA, 20 nt, Human
uaaaaaaaaaaaagagcaga

SEQ ID NO: 139642 - RNA, 20 nt, Human
uaaaaaaaaaaaagagcaga

SEQ ID NO: 139643 - RNA, 21 nt, Human
uaaaaaaaaaaaagagcagau

SEQ ID NO: 139644 - RNA, 19 nt, Human
uaaaacauugcaaaacaaa

SEQ ID NO: 139645 - RNA, 19 nt, Human
uaaaacauugcaaaacaaa

SEQ ID NO: 139646 - RNA, 23 nt, Human
uaaaaguaagaaaaaacauucug

SEQ ID NO: 139647 - RNA, 23 nt, Human
uaaaaguaagaaaaaacauucug

SEQ ID NO: 139648 - RNA, 24 nt, Human
uaacacagugaaaccccgucucua

SEQ ID NO: 139649 - RNA, 24 nt, Human
uaacacagugaaaccccgucucua

SEQ ID NO: 139650 - RNA, 22 nt, Human
uaagauccuccccucagcuccc

SEQ ID NO: 139651 - RNA, 22 nt, Human
uaagauccuccccucagcuccc

SEQ ID NO: 139652 - RNA, 19 nt, Human
uaagcaacaacuggcuuua

SEQ ID NO: 139653 - RNA, 19 nt, Human
uaagcaacaacuggcuuua

SEQ ID NO: 139654 - RNA, 22 nt, Human
uacaaauaaccuacuugggcug

SEQ ID NO: 139655 - RNA, 22 nt, Human
uacaaauaaccuacuugggcug

SEQ ID NO: 139656 - RNA, 21 nt, Human
uacagagaauuccauucucag

SEQ ID NO: 139657 - RNA, 21 nt, Human
uacagagaauuccauucucag

SEQ ID NO: 139658 - RNA, 22 nt, Human
uacuaaaacucuguuuaaaaca

SEQ ID NO: 139659 - RNA, 22 nt, Human
uacuaaaacucuguuuaaaaca

SEQ ID NO: 139660 - RNA, 22 nt, Human
uacucccacccauauuccuugu

SEQ ID NO: 139661 - RNA, 22 nt, Human
uacucccacccauauuccuugu

SEQ ID NO: 139662 - RNA, 21 nt, Human
uagaaaacagaaaauguagga

SEQ ID NO: 139663 - RNA, 21 nt, Human
uagaaaacagaaaauguagga

SEQ ID NO: 139664 - RNA, 19 nt, Human
uagugcaguaggggugagu

SEQ ID NO: 139665 - RNA, 23 nt, Human
uauaaugcagcauuuaagagccc

SEQ ID NO: 139666 - RNA, 23 nt, Human
uauaaugcagcauuuaagagccc

SEQ ID NO: 139667 - RNA, 18 nt, Human
uaugagcugcaacauuuu

SEQ ID NO: 139668 - RNA, 18 nt, Human
uaugagcugcaacauuuu

SEQ ID NO: 139669 - RNA, 22 nt, Human
ucaaguuuuuaccauuuuccuc

SEQ ID NO: 139670 - RNA, 22 nt, Human
ucaaguuuuuaccauuuuccuc

SEQ ID NO: 139671 - RNA, 18 nt, Human
ucacgaggucaggagauc

SEQ ID NO: 139672 - RNA, 18 nt, Human
ucacgaggucaggagauc

SEQ ID NO: 139673 - RNA, 24 nt, Human
ucacgaggucaggagaucgagacc

SEQ ID NO: 139674 - RNA, 24 nt, Human
ucacgaggucaggagaucgagacc

SEQ ID NO: 139675 - RNA, 19 nt, Human
ucacugcagcagcccacag

SEQ ID NO: 139676 - RNA, 20 nt, Human
ucagaauuuuagauaggcau

SEQ ID NO: 139677 - RNA, 20 nt, Human
ucagaauuuuagauaggcau

SEQ ID NO: 139678 - RNA, 20 nt, Human
ucagaccaauauuuugugcc

SEQ ID NO: 139679 - RNA, 20 nt, Human
ucagaccaauauuuugugcc

SEQ ID NO: 139680 - RNA, 24 nt, Human
ucagagcgagacuccgucucaaaa

SEQ ID NO: 139681 - RNA, 24 nt, Human
ucagagcgagacuccgucucaaaa

SEQ ID NO: 139682 - RNA, 22 nt, Human
ucaugccuguaaucccagcacu

SEQ ID NO: 139683 - RNA, 22 nt, Human
ucaugccuguaaucccagcacu

SEQ ID NO: 139684 - RNA, 23 nt, Human
ucaugccuguaaucccagcacuu

SEQ ID NO: 139685 - RNA, 23 nt, Human
ucaugccuguaaucccagcacuu

SEQ ID NO: 139686 - RNA, 21 nt, Human
uccaaagucaaaugaauuugg

SEQ ID NO: 139687 - RNA, 21 nt, Human
uccaaagucaaaugaauuugg

SEQ ID NO: 139688 - RNA, 23 nt, Human
uccagccugugcgucagagcgag

SEQ ID NO: 139689 - RNA, 23 nt, Human
uccagccugugcgucagagcgag

SEQ ID NO: 139690 - RNA, 24 nt, Human
uccagccugugcgucagagcgaga

SEQ ID NO: 139691 - RNA, 24 nt, Human
uccagccugugcgucagagcgaga

SEQ ID NO: 139692 - RNA, 24 nt, Human
uccccgaaaaaaacaccucaucuc

SEQ ID NO: 139693 - RNA, 24 nt, Human
uccccgaaaaaaacaccucaucuc

SEQ ID NO: 139694 - RNA, 23 nt, Human
ucccucuagccucuaaacucuag

SEQ ID NO: 139695 - RNA, 23 nt, Human
ucccucuagccucuaaacucuag

SEQ ID NO: 139696 - RNA, 18 nt, Human
uccuugauuucucacucc

SEQ ID NO: 139697 - RNA, 18 nt, Human
uccuugauuucucacucc

SEQ ID NO: 139698 - RNA, 24 nt, Human
ucggagccacugcacuccagccug

SEQ ID NO: 139699 - RNA, 24 nt, Human
ucggagccacugcacuccagccug

SEQ ID NO: 139700 - RNA, 24 nt, Human
ucucaaaaaaaaaggggggggggg

SEQ ID NO: 139701 - RNA, 24 nt, Human
ucucuauuaaaaauacaaaaaauu

SEQ ID NO: 139702 - RNA, 24 nt, Human
ucucuauuaaaaauacaaaaaauu

SEQ ID NO: 139703 - RNA, 22 nt, Human
ucugacaaagaccuaauuguag

SEQ ID NO: 139704 - RNA, 18 nt, Human
ugaaacagacugcaaagc

SEQ ID NO: 139705 - RNA, 18 nt, Human
ugaaacagacugcaaagc

SEQ ID NO: 139706 - RNA, 21 nt, Human
ugaaggccugcaucuuccugu

SEQ ID NO: 139707 - RNA, 21 nt, Human
ugaaggccugcaucuuccugu

SEQ ID NO: 139708 - RNA, 20 nt, Human
ugacaaagaccuaauuguag

SEQ ID NO: 139709 - RNA, 23 nt, Human
ugagagaaaagaauuacaaauuc

SEQ ID NO: 139710 - RNA, 23 nt, Human
ugagagaaaagaauuacaaauuc

SEQ ID NO: 139711 - RNA, 18 nt, Human
ugagcaaaacacaguggg

SEQ ID NO: 139712 - RNA, 18 nt, Human
ugagcaaaacacaguggg

SEQ ID NO: 139713 - RNA, 19 nt, Human
ugagccauagagaagaggu

SEQ ID NO: 139714 - RNA, 19 nt, Human
ugagccauagagaagaggu

SEQ ID NO: 139715 - RNA, 23 nt, Human
ugaggcaggagaauggcaugaac

SEQ ID NO: 139716 - RNA, 24 nt, Human
ugaggcaggagaauggcaugaacc

SEQ ID NO: 139717 - RNA, 24 nt, Human
ugaggcaggagaauggcaugaacc

SEQ ID NO: 139718 - RNA, 25 nt, Human
ugaggcaggagaauggcaugaaccc

SEQ ID NO: 139719 - RNA, 25 nt, Human
ugaggcaggagaauggcaugaaccc

SEQ ID NO: 139720 - RNA, 21 nt, Human
ugagggagugagcaaaacaca

SEQ ID NO: 139721 - RNA, 21 nt, Human
ugagggagugagcaaaacaca

SEQ ID NO: 139722 - RNA, 23 nt, Human
ugcacacucaaauaccauaaauu

SEQ ID NO: 139723 - RNA, 23 nt, Human
ugcacacucaaauaccauaaauu

SEQ ID NO: 139724 - RNA, 23 nt, Human
ugcagaaggaauacaacaauucc

SEQ ID NO: 139725 - RNA, 23 nt, Human
ugcagaaggaauacaacaauucc

SEQ ID NO: 139726 - RNA, 23 nt, Human
ugccuguaaucccagcacuuugg

SEQ ID NO: 139727 - RNA, 23 nt, Human
ugccuguaaucccagcacuuugg

SEQ ID NO: 139728 - RNA, 23 nt, Human
ugccuguaaucccagcacuuugg

SEQ ID NO: 139729 - RNA, 24 nt, Human
ugccuguaaucccagcacuuuggg

SEQ ID NO: 139730 - RNA, 21 nt, Human
ugccuuguuuguucugcacaa

SEQ ID NO: 139731 - RNA, 21 nt, Human
ugccuuguuuguucugcacaa

SEQ ID NO: 139732 - RNA, 20 nt, Human
ugcgucagagcgagacuccg

SEQ ID NO: 139733 - RNA, 20 nt, Human
ugcgucagagcgagacuccg

SEQ ID NO: 139734 - RNA, 22 nt, Human
uggaaaagauaagcaacaacug

SEQ ID NO: 139735 - RNA, 21 nt, Human
uggcugaucccucaccggacu

SEQ ID NO: 139736 - RNA, 21 nt, Human
uggcugaucccucaccggacu

SEQ ID NO: 139737 - RNA, 20 nt, Human
ugggaggccgaggcaggcgg

SEQ ID NO: 139738 - RNA, 20 nt, Human
ugggaggccgaggcaggcgg

SEQ ID NO: 139739 - RNA, 24 nt, Human
ugggaggccgaggcaggcggauca

SEQ ID NO: 139740 - RNA, 24 nt, Human
ugggaggccgaggcaggcggauca

SEQ ID NO: 139741 - RNA, 19 nt, Human
ugggagugagcaaaacaca

SEQ ID NO: 139742 - RNA, 24 nt, Human
ugggcugcuuucucccaaaguucc

SEQ ID NO: 139743 - RNA, 22 nt, Human
ugggucaugccuguaaucccag

SEQ ID NO: 139744 - RNA, 24 nt, Human
ugggucaugccuguaaucccagca

SEQ ID NO: 139745 - RNA, 24 nt, Human
ugggucaugccuguaaucccagca

SEQ ID NO: 139746 - RNA, 24 nt, Human
ugguggugggcgccuguaguccca

SEQ ID NO: 139747 - RNA, 24 nt, Human
ugguggugggcgccuguaguccca

SEQ ID NO: 139748 - RNA, 25 nt, Human
uguacaaauaaccuacuugggcugc

SEQ ID NO: 139749 - RNA, 25 nt, Human
uguacaaauaaccuacuugggcugc

SEQ ID NO: 139750 - RNA, 22 nt, Human
uguucuaaaaugacaacuugau

SEQ ID NO: 139751 - RNA, 22 nt, Human
uguucuaaaaugacaacuugau

SEQ ID NO: 139752 - RNA, 19 nt, Human
uguuuuauuacaucucccc

SEQ ID NO: 139753 - RNA, 19 nt, Human
uguuuuauuacaucucccc

SEQ ID NO: 139754 - RNA, 19 nt, Human
uguuuuauuacaucucccc

SEQ ID NO: 139755 - RNA, 19 nt, Human
uguuuuauuacaucucccc

SEQ ID NO: 139756 - RNA, 26 nt, Human
uuaaaaauauaaauuggugaguagca

SEQ ID NO: 139757 - RNA, 26 nt, Human
uuaaaaauauaaauuggugaguagca

SEQ ID NO: 139758 - RNA, 18 nt, Human
uuagccgggcgugguggu

SEQ ID NO: 139759 - RNA, 18 nt, Human
uuagccgggcgugguggu

SEQ ID NO: 139760 - RNA, 24 nt, Human
uuagccgggcgugguggugggcgc

SEQ ID NO: 139761 - RNA, 24 nt, Human
uuagccgggcgugguggugggcgc

SEQ ID NO: 139762 - RNA, 22 nt, Human
uucaacacauuuugccuccaaa

SEQ ID NO: 139763 - RNA, 22 nt, Human
uucaacacauuuugccuccaaa

SEQ ID NO: 139764 - RNA, 21 nt, Human
uucaguaagauccuccccuca

SEQ ID NO: 139765 - RNA, 21 nt, Human
uucaguaagauccuccccuca

SEQ ID NO: 139766 - RNA, 21 nt, Human
uuccuuauaaaaguaagaaaa

SEQ ID NO: 139767 - RNA, 21 nt, Human
uuccuuauaaaaguaagaaaa

SEQ ID NO: 139768 - RNA, 19 nt, Human
uuccuuguggccucuccuu

SEQ ID NO: 139769 - RNA, 19 nt, Human
uuccuuguggccucuccuu

SEQ ID NO: 139770 - RNA, 23 nt, Human
uuccuuguggccucuccuugccc

SEQ ID NO: 139771 - RNA, 24 nt, Human
uucucagaccaauauuuugugccc

SEQ ID NO: 139772 - RNA, 24 nt, Human
uucucagaccaauauuuugugccc

SEQ ID NO: 139773 - RNA, 25 nt, Human
uugggaggccgaggcaggcggauca

SEQ ID NO: 139774 - RNA, 25 nt, Human
uugggaggccgaggcaggcggauca

SEQ ID NO: 139775 - RNA, 24 nt, Human
uuguuuguucugcacaaccaguuc

SEQ ID NO: 139776 - RNA, 24 nt, Human
uuguuuguucugcacaaccaguuc

SEQ ID NO: 139777 - RNA, 19 nt, Human
uuuaaacaaauuacacaaa

SEQ ID NO: 139778 - RNA, 19 nt, Human
uuuaaacaaauuacacaaa

SEQ ID NO: 139779 - RNA, 21 nt, Human
uuucacugcagcagcccacag

SEQ ID NO: 139780 - RNA, 19 nt, Human
uuuccaacuauauuccuau

SEQ ID NO: 139781 - RNA, 19 nt, Human
uuuccaacuauauuccuau

SEQ ID NO: 139782 - RNA, 19 nt, Human
agcggccucccgugcgcca

SEQ ID NO: 139783 - RNA, 20 nt, Human
aggcagcaggcgggcgggca

SEQ ID NO: 139784 - RNA, 18 nt, Human
cagcaggcgggcgggcag

SEQ ID NO: 139785 - RNA, 22 nt, Human
cagcucagugggcccccggcag

SEQ ID NO: 139786 - RNA, 22 nt, Human
ccccacgcugcggccggagccc

SEQ ID NO: 139787 - RNA, 21 nt, Human
cccccgcgcuccgcccggccc

SEQ ID NO: 139788 - RNA, 25 nt, Human
cccgccgccgccgccgccgcugccu

SEQ ID NO: 139789 - RNA, 22 nt, Human
cccgcgagcgacgcgccggccu

SEQ ID NO: 139790 - RNA, 21 nt, Human
cccgggcacgcggcgcggccg

SEQ ID NO: 139791 - RNA, 19 nt, Human
ccgccgcccgcccgccgcc

SEQ ID NO: 139792 - RNA, 20 nt, Human
ccgccgcccgcccgccgccc

SEQ ID NO: 139793 - RNA, 24 nt, Human
ccgccgcccgccgccgccgccgcc

SEQ ID NO: 139794 - RNA, 25 nt, Human
ccgccgcccgccgccgccgccgccg

SEQ ID NO: 139795 - RNA, 26 nt, Human
ccgccgcccgccgccgccgccgccgg

SEQ ID NO: 139796 - RNA, 18 nt, Human
ccgccgccgccgccgccg

SEQ ID NO: 139797 - RNA, 18 nt, Human
ccgccgccgccgccgccg

SEQ ID NO: 139798 - RNA, 22 nt, Human
ccgccgccgccgccgccgcugc

SEQ ID NO: 139799 - RNA, 23 nt, Human
ccgccgccgccgccgccgcugcc

SEQ ID NO: 139800 - RNA, 19 nt, Human
ccgccgcugccuagccgcc

SEQ ID NO: 139801 - RNA, 20 nt, Human
ccgccgcugccuagccgccc

SEQ ID NO: 139802 - RNA, 21 nt, Human
ccgcgccccacgcugcggccg

SEQ ID NO: 139803 - RNA, 23 nt, Human
ccgcgccccacgcugcggccgga

SEQ ID NO: 139804 - RNA, 18 nt, Human
ccgcgcuccgcccggccc

SEQ ID NO: 139805 - RNA, 21 nt, Human
ccgcugccuagccgcccgggc

SEQ ID NO: 139806 - RNA, 23 nt, Human
ccgugcgccagcccucacccucc

SEQ ID NO: 139807 - RNA, 20 nt, Human
cgcccgcccgccgcccgccg

SEQ ID NO: 139808 - RNA, 25 nt, Human
cgccgccgccgccgcugccuagccg

SEQ ID NO: 139809 - RNA, 24 nt, Human
cgcgcgcugcgcuccugcacaccu

SEQ ID NO: 139810 - RNA, 26 nt, Human
cgcgcugcgcuccugcacaccugcuc

SEQ ID NO: 139811 - RNA, 19 nt, Human
cgcugcgcuccugcacacc

SEQ ID NO: 139812 - RNA, 22 nt, Human
cgcugcgcuccugcacaccugc

SEQ ID NO: 139813 - RNA, 23 nt, Human
cgggggccgccgcccgcccgccg

SEQ ID NO: 139814 - RNA, 18 nt, Human
cucaucuuugccgugcuc

SEQ ID NO: 139815 - RNA, 20 nt, Human
cuccgcccggcccggcuccc

SEQ ID NO: 139816 - RNA, 22 nt, Human
cuccgcucgccgcucggcaccu

SEQ ID NO: 139817 - RNA, 23 nt, Human
cuccggccucagucacauggauc

SEQ ID NO: 139818 - RNA, 23 nt, Human
cugcacaccugcucccgggcgcc

SEQ ID NO: 139819 - RNA, 20 nt, Human
cugccgcuccccggccuccc

SEQ ID NO: 139820 - RNA, 20 nt, Human
cugcgcucgccgcgcgcugc

SEQ ID NO: 139821 - RNA, 19 nt, Human
gcagcaggcgggcgggcag

SEQ ID NO: 139822 - RNA, 24 nt, Human
gccgccgcccgcccgccgcccgcc

SEQ ID NO: 139823 - RNA, 20 nt, Human
gccgcgccccacgcugcggc

SEQ ID NO: 139824 - RNA, 21 nt, Human
gcgacgcgccggccucgcccc

SEQ ID NO: 139825 - RNA, 18 nt, Human
gcgccggccucgcccccc

SEQ ID NO: 139826 - RNA, 19 nt, Human
gcgcggccgggcuccggag

SEQ ID NO: 139827 - RNA, 19 nt, Human
gcgcggccgggcuccggag

SEQ ID NO: 139828 - RNA, 18 nt, Human
gcgcucgccgcgcgcugc

SEQ ID NO: 139829 - RNA, 19 nt, Human
gcggccggagcccaggugc

SEQ ID NO: 139830 - RNA, 19 nt, Human
gggcacucggcgcccagaa

SEQ ID NO: 139831 - RNA, 21 nt, Human
gggcgugagcucaucccgggc

SEQ ID NO: 139832 - RNA, 19 nt, Human
uaaaaaaaagguagcuuug

SEQ ID NO: 139833 - RNA, 24 nt, Human
uaauauauuuuggcaauuuucuuu

SEQ ID NO: 139834 - RNA, 22 nt, Human
uccggagcgagggcugcgcucg

SEQ ID NO: 139835 - RNA, 19 nt, Human
ugcgcagccagcggccucc

SEQ ID NO: 139836 - RNA, 23 nt, Human
ugcggccggagcccaggugcgcc

SEQ ID NO: 139837 - RNA, 23 nt, Human
uuugaauuguauuuacaaccgcu

SEQ ID NO: 139838 - RNA, 23 nt, Human
aaaauauaauaccuauuuaccag

SEQ ID NO: 139839 - RNA, 19 nt, Human
aaaauuacaaauguuaacc

SEQ ID NO: 139840 - RNA, 26 nt, Human
aaacaacagaaacugagguccgaucc

SEQ ID NO: 139841 - RNA, 19 nt, Human
aaagaaacaacagaaacug

SEQ ID NO: 139842 - RNA, 23 nt, Human
aacaugagaacaugagggaagaa

SEQ ID NO: 139843 - RNA, 19 nt, Human
aagaauaaaaccaucuucc

SEQ ID NO: 139844 - RNA, 22 nt, Human
aaggaaacgcuacaauuuccac

SEQ ID NO: 139845 - RNA, 22 nt, Human
acagaaccuaccagaaaagaac

SEQ ID NO: 139846 - RNA, 21 nt, Human
accaccacauaaaagaaacaa

SEQ ID NO: 139847 - RNA, 23 nt, Human
acugccauacuuuucacccaagu

SEQ ID NO: 139848 - RNA, 20 nt, Human
agccucuccaguuuaaaagc

SEQ ID NO: 139849 - RNA, 21 nt, Human
augcacaaacaugagaacaug

SEQ ID NO: 139850 - RNA, 21 nt, Human
augggaacagcuuuuccuaca

SEQ ID NO: 139851 - RNA, 24 nt, Human
caaaagcacaaguuacacguugcc

SEQ ID NO: 139852 - RNA, 22 nt, Human
caaaccggcucccucuuaccaa

SEQ ID NO: 139853 - RNA, 23 nt, Human
caaagaauaaaaccaucuuccaa

SEQ ID NO: 139854 - RNA, 23 nt, Human
caaauguccuugugcgaucacca

SEQ ID NO: 139855 - RNA, 25 nt, Human
caacagaaacugagguccgauccca

SEQ ID NO: 139856 - RNA, 24 nt, Human
caacuaucucaaccaacaguuucc

SEQ ID NO: 139857 - RNA, 18 nt, Human
caccacauaaaagaaaca

SEQ ID NO: 139858 - RNA, 23 nt, Human
caccacauaaaagaaacaacaga

SEQ ID NO: 139859 - RNA, 27 nt, Human
caccacauaaaagaaacaacagaaacc

SEQ ID NO: 139860 - RNA, 18 nt, Human
caccccgaucucggcugc

SEQ ID NO: 139861 - RNA, 22 nt, Human
caccuaaacuaaaauuucucac

SEQ ID NO: 139862 - RNA, 24 nt, Human
cagacagaaccuaccagaaaagaa

SEQ ID NO: 139863 - RNA, 22 nt, Human
cagcauuagaacaaggggacac

SEQ ID NO: 139864 - RNA, 23 nt, Human
cagucgccgccgcccucguccgc

SEQ ID NO: 139865 - RNA, 24 nt, Human
cauauuugcuucucaaagaauaaa

SEQ ID NO: 139866 - RNA, 21 nt, Human
ccaaauuuccaaagcaugcau

SEQ ID NO: 139867 - RNA, 21 nt, Human
ccacaguaaaagauuccuccc

SEQ ID NO: 139868 - RNA, 18 nt, Human
ccaccacauaaaagaaac

SEQ ID NO: 139869 - RNA, 23 nt, Human
ccaccacauaaaagaaacaacag

SEQ ID NO: 139870 - RNA, 24 nt, Human
ccaccacauaaaagaaacaacaga

SEQ ID NO: 139871 - RNA, 18 nt, Human
ccaccccgaucucggcug

SEQ ID NO: 139872 - RNA, 18 nt, Human
ccaccuccacaguaaaag

SEQ ID NO: 139873 - RNA, 20 nt, Human
cccucguccgccucggccgc

SEQ ID NO: 139874 - RNA, 21 nt, Human
cccucguccgccucggccgcc

SEQ ID NO: 139875 - RNA, 18 nt, Human
ccgcccucguccgccucg

SEQ ID NO: 139876 - RNA, 20 nt, Human
ccgccucggccgcccccgcc

SEQ ID NO: 139877 - RNA, 24 nt, Human
ccuccgaagaagucgugaccagcc

SEQ ID NO: 139878 - RNA, 20 nt, Human
cgccgccgcccucguccgcc

SEQ ID NO: 139879 - RNA, 21 nt, Human
cgugaccagccaccuccacag

SEQ ID NO: 139880 - RNA, 18 nt, Human
cuagaaaaaaauuacaaa

SEQ ID NO: 139881 - RNA, 21 nt, Human
cuccugagcucacugaucaac

SEQ ID NO: 139882 - RNA, 19 nt, Human
cuggugugcagcauuagaa

SEQ ID NO: 139883 - RNA, 18 nt, Human
cuugaugucuucgugggg

SEQ ID NO: 139884 - RNA, 25 nt, Human
cuuggcacagacagaaccuaccaga

SEQ ID NO: 139885 - RNA, 21 nt, Human
gaacaaguacaaaacacuauc

SEQ ID NO: 139886 - RNA, 23 nt, Human
gaacaaguacaaaacacuaucau

SEQ ID NO: 139887 - RNA, 19 nt, Human
gaagcucucuccugagcuc

SEQ ID NO: 139888 - RNA, 18 nt, Human
gaguggccccugcaggcc

SEQ ID NO: 139889 - RNA, 18 nt, Human
gaucccaaacaccuaaac

SEQ ID NO: 139890 - RNA, 21 nt, Human
gaucccaaacaccuaaacuaa

SEQ ID NO: 139891 - RNA, 18 nt, Human
gaucucggcugccaccuc

SEQ ID NO: 139892 - RNA, 18 nt, Human
guuuuccaaacgcuuucc

SEQ ID NO: 139893 - RNA, 21 nt, Human
uaacaagaaacacuuggacag

SEQ ID NO: 139894 - RNA, 23 nt, Human
uaauaccuauuuaccagacauac

SEQ ID NO: 139895 - RNA, 23 nt, Human
uaauauacaugcacaaacauggu

SEQ ID NO: 139896 - RNA, 23 nt, Human
uacaaaacacuaucauuaucugu

SEQ ID NO: 139897 - RNA, 24 nt, Human
uacaacauaugauucacagguagg

SEQ ID NO: 139898 - RNA, 23 nt, Human
uacacguugcacgguuggggaug

SEQ ID NO: 139899 - RNA, 20 nt, Human
uacaugcacaaacaugagaa

SEQ ID NO: 139900 - RNA, 22 nt, Human
uaccagaaaagaacaaguacaa

SEQ ID NO: 139901 - RNA, 24 nt, Human
uaccagaaaagaacaaguacaaaa

SEQ ID NO: 139902 - RNA, 24 nt, Human
uaccagaaaagaacaaguacaaaa

SEQ ID NO: 139903 - RNA, 25 nt, Human
uaccagaaaagaacaaguacaaaac

SEQ ID NO: 139904 - RNA, 26 nt, Human
uaccagaaaagaacaaguacaaaaca

SEQ ID NO: 139905 - RNA, 23 nt, Human
uaccuauuuaccagacauacaca

SEQ ID NO: 139906 - RNA, 23 nt, Human
uagaaaaaaauuacaaauguuaa

SEQ ID NO: 139907 - RNA, 24 nt, Human
uagccucuccaguuuaaaagcacu

SEQ ID NO: 139908 - RNA, 19 nt, Human
uaucucaaccaacaguuuc

SEQ ID NO: 139909 - RNA, 20 nt, Human
uccaaacgcuuuccuggcuu

SEQ ID NO: 139910 - RNA, 23 nt, Human
ucccaaaccggcucccucuuacc

SEQ ID NO: 139911 - RNA, 19 nt, Human
ucccacugccauacuuuuc

SEQ ID NO: 139912 - RNA, 21 nt, Human
uccgaucccaaacaccuaaac

SEQ ID NO: 139913 - RNA, 19 nt, Human
ucgccgccgcccucguccg

SEQ ID NO: 139914 - RNA, 22 nt, Human
ucgccgccgcccucguccgccu

SEQ ID NO: 139915 - RNA, 22 nt, Human
ucuucugagcaacaugaacugg

SEQ ID NO: 139916 - RNA, 20 nt, Human
ugaccagccaccuccacagu

SEQ ID NO: 139917 - RNA, 18 nt, Human
ugagaacaugagggaaga

SEQ ID NO: 139918 - RNA, 19 nt, Human
ugagugaaugcauuccagg

SEQ ID NO: 139919 - RNA, 21 nt, Human
ugaucaaccugcccuuggcac

SEQ ID NO: 139920 - RNA, 21 nt, Human
ugcaauggucucucccaaacc

SEQ ID NO: 139921 - RNA, 24 nt, Human
ugcagcauuagaacaaggggacac

SEQ ID NO: 139922 - RNA, 19 nt, Human
ugcuguugcaaagagucga

SEQ ID NO: 139923 - RNA, 21 nt, Human
ugggaacagcuuuuccuacaa

SEQ ID NO: 139924 - RNA, 22 nt, Human
uguauagaaaccaccacauaaa

SEQ ID NO: 139925 - RNA, 18 nt, Human
uuccaaaaaaguuuuugg

SEQ ID NO: 139926 - RNA, 22 nt, Human
uucccaaaagauguaaaacaaa

SEQ ID NO: 139927 - RNA, 18 nt, Human
uucccgggugccaugaac

SEQ ID NO: 139928 - RNA, 22 nt, Human
uugcauugcugcuguuuucaca

SEQ ID NO: 139929 - RNA, 19 nt, Human
uuuggcuaugauucaugua

SEQ ID NO: 139930 - RNA, 24 nt, Human
uuuuuuucuguaaggagcauacug

SEQ ID NO: 139931 - RNA, 21 nt, Human
uuuuuuuuuuuucuguaagga

SEQ ID NO: 139932 - RNA, 18 nt, Human
uuuuuuuuuuuuuuucug

SEQ ID NO: 139933 - RNA, 23 nt, Human
uuuuuuuuuuuuuuucuguaagg

SEQ ID NO: 139934 - RNA, 20 nt, Human
aggcacagagcgccauggcc

SEQ ID NO: 139935 - RNA, 22 nt, Human
caccagggcagccgccucgcac

SEQ ID NO: 139936 - RNA, 23 nt, Human
ccauggccagagcccaccagggc

SEQ ID NO: 139937 - RNA, 19 nt, Human
ccgccucgcaccacaacca

SEQ ID NO: 139938 - RNA, 21 nt, Human
cucgcaccacaaccaagggcc

SEQ ID NO: 139939 - RNA, 20 nt, Human
uggccagagcccaccagggc

SEQ ID NO: 139940 - RNA, 24 nt, Human
cauucucaaaauauaucccccaaa

SEQ ID NO: 139941 - RNA, 25 nt, Human
ccgccccgugaccggcuggacacaa

SEQ ID NO: 139942 - RNA, 18 nt, Human
uaauauacacuacaaaac

SEQ ID NO: 139943 - RNA, 21 nt, Human
uaucccccaaaaguaaucuac

SEQ ID NO: 139944 - RNA, 20 nt, Human
uauuccguuucaucauucuc

SEQ ID NO: 139945 - RNA, 26 nt, Human
uuuuuuuuuuuuuuuuuuuaguuuuu

SEQ ID NO: 139946 - RNA, 22 nt, Human
aaaaacccuggcucaaaacagc

SEQ ID NO: 139947 - RNA, 21 nt, Human
aaaaaggaacagauaaggcaa

SEQ ID NO: 139948 - RNA, 18 nt, Human
aaacaaguauaugccgcu

SEQ ID NO: 139949 - RNA, 19 nt, Human
aaagcagcauggcuuauuu

SEQ ID NO: 139950 - RNA, 21 nt, Human
aaaggagauuauaaaccagaa

SEQ ID NO: 139951 - RNA, 21 nt, Human
aaaguuauaaugaaaaauguu

SEQ ID NO: 139952 - RNA, 20 nt, Human
aaauauauucugggaaacug

SEQ ID NO: 139953 - RNA, 22 nt, Human
aagacaggaggaucacuugagu

SEQ ID NO: 139954 - RNA, 21 nt, Human
aagauggugaagccccgucuc

SEQ ID NO: 139955 - RNA, 23 nt, Human
aagcagcauggcuuauuuugagg

SEQ ID NO: 139956 - RNA, 21 nt, Human
aaggagauuauaaaccagaaa

SEQ ID NO: 139957 - RNA, 23 nt, Human
aaggcgggugggucacgagguca

SEQ ID NO: 139958 - RNA, 20 nt, Human
aaguuucaagugacucagau

SEQ ID NO: 139959 - RNA, 21 nt, Human
acaaaagaaggcuagugugug

SEQ ID NO: 139960 - RNA, 24 nt, Human
acagacugagacuccgucucagaa

SEQ ID NO: 139961 - RNA, 24 nt, Human
acagaggcugggugugguggcuca

SEQ ID NO: 139962 - RNA, 23 nt, Human
accuguagucucagcuacucagg

SEQ ID NO: 139963 - RNA, 24 nt, Human
acuaaaaauacaaacauuagccgg

SEQ ID NO: 139964 - RNA, 23 nt, Human
acugcugggcacaguggcucaca

SEQ ID NO: 139965 - RNA, 19 nt, Human
agaaacaaaaccaaaaaac

SEQ ID NO: 139966 - RNA, 22 nt, Human
agaauagaguagggguggaggg

SEQ ID NO: 139967 - RNA, 18 nt, Human
agacaggaggaucacuug

SEQ ID NO: 139968 - RNA, 19 nt, Human
agacaggaggaucacuuga

SEQ ID NO: 139969 - RNA, 24 nt, Human
agacaggaggaucacuugagucua

SEQ ID NO: 139970 - RNA, 19 nt, Human
agaccaaauucaucaaguc

SEQ ID NO: 139971 - RNA, 21 nt, Human
agaggcugggugugguggcuc

SEQ ID NO: 139972 - RNA, 24 nt, Human
agcacuuugggaggccaaggcggg

SEQ ID NO: 139973 - RNA, 20 nt, Human
agccgggcacgguggcaguc

SEQ ID NO: 139974 - RNA, 24 nt, Human
agccuggccaagauggugaagccc

SEQ ID NO: 139975 - RNA, 24 nt, Human
agccugggcaacauagggagaccc

SEQ ID NO: 139976 - RNA, 24 nt, Human
agccugggugacagacugagacuc

SEQ ID NO: 139977 - RNA, 18 nt, Human
agcugagugugguggcac

SEQ ID NO: 139978 - RNA, 23 nt, Human
aggaaaguuaauuugagggucug

SEQ ID NO: 139979 - RNA, 22 nt, Human
aggaaaugcuggcuuuaggcca

SEQ ID NO: 139980 - RNA, 23 nt, Human
aggaguucaagaccagccugggc

SEQ ID NO: 139981 - RNA, 24 nt, Human
aggaucacuugagucuaggaguuc

SEQ ID NO: 139982 - RNA, 26 nt, Human
aggcagaccaaauucaucaagucaag

SEQ ID NO: 139983 - RNA, 22 nt, Human
aggcaggagagucgcuugaacc

SEQ ID NO: 139984 - RNA, 24 nt, Human
aggcaggagagucgcuugaaccug

SEQ ID NO: 139985 - RNA, 21 nt, Human
aggccaaggcgggugggucac

SEQ ID NO: 139986 - RNA, 24 nt, Human
aggcgggugggucacgaggucagg

SEQ ID NO: 139987 - RNA, 21 nt, Human
aggcugaggcaggagagucgc

SEQ ID NO: 139988 - RNA, 24 nt, Human
aggcugaggcaggagagucgcuug

SEQ ID NO: 139989 - RNA, 20 nt, Human
aggcugaggggagggaucgc

SEQ ID NO: 139990 - RNA, 20 nt, Human
aggcugggugugguggcuca

SEQ ID NO: 139991 - RNA, 18 nt, Human
agggagacccugucuaca

SEQ ID NO: 139992 - RNA, 24 nt, Human
agggagacugaggaaaugcuggcu

SEQ ID NO: 139993 - RNA, 20 nt, Human
agguggagguugcagugagc

SEQ ID NO: 139994 - RNA, 24 nt, Human
agguggagguugcagugagcugag

SEQ ID NO: 139995 - RNA, 27 nt, Human
agucuaggaguucaagaccagccuggg

SEQ ID NO: 139996 - RNA, 23 nt, Human
aguggcaggauuugaaggaagaa

SEQ ID NO: 139997 - RNA, 24 nt, Human
aguggcucacaccuguaaucucag

SEQ ID NO: 139998 - RNA, 19 nt, Human
aucacuccagccuggguga

SEQ ID NO: 139999 - RNA, 24 nt, Human
aucacuugagucuaggaguucaag

SEQ ID NO: 140000 - RNA, 22 nt, Human
aucccagcacuuugggaggcca

SEQ ID NO: 140001 - RNA, 18 nt, Human
caaaaaacccuggcucaa

SEQ ID NO: 140002 - RNA, 18 nt, Human
caaaaaacccuggcucaa

SEQ ID NO: 140003 - RNA, 22 nt, Human
caaaaaauuugaaaauuagcug

SEQ ID NO: 140004 - RNA, 24 nt, Human
caacuacucgggaggcugaggcag

SEQ ID NO: 140005 - RNA, 20 nt, Human
caagacaggaggaucacuug

SEQ ID NO: 140006 - RNA, 24 nt, Human
caagauggugaagccccgucucua

SEQ ID NO: 140007 - RNA, 25 nt, Human
caauaguccauauccuucgaaccac

SEQ ID NO: 140008 - RNA, 24 nt, Human
cacaccuguaaucccagcacuuug

SEQ ID NO: 140009 - RNA, 24 nt, Human
cacaccuguaaucucagcacuuug

SEQ ID NO: 140010 - RNA, 20 nt, Human
cacaguuuggaaaacugucu

SEQ ID NO: 140011 - RNA, 22 nt, Human
cacauggguuucugcuguucag

SEQ ID NO: 140012 - RNA, 23 nt, Human
caccuguaaucccaacuacucgg

SEQ ID NO: 140013 - RNA, 24 nt, Human
caccuguaaucccaacuacucggg

SEQ ID NO: 140014 - RNA, 23 nt, Human
caccuguaaucccagcacuuugg

SEQ ID NO: 140015 - RNA, 24 nt, Human
caccuguaaucccagcacuuuggg

SEQ ID NO: 140016 - RNA, 19 nt, Human
caccuguaaucucagcacu

SEQ ID NO: 140017 - RNA, 24 nt, Human
caccuguaaucucagcacuuuggg

SEQ ID NO: 140018 - RNA, 24 nt, Human
caccuguagucucagcuacucagg

SEQ ID NO: 140019 - RNA, 20 nt, Human
caccuugcggagaggggccu

SEQ ID NO: 140020 - RNA, 18 nt, Human
cacuccagccugggugac

SEQ ID NO: 140021 - RNA, 20 nt, Human
cacuccagccugggugacag

SEQ ID NO: 140022 - RNA, 21 nt, Human
cacuccagccugggugacaga

SEQ ID NO: 140023 - RNA, 24 nt, Human
cacuccagccugggugacagacug

SEQ ID NO: 140024 - RNA, 18 nt, Human
cacucuccagcaagcuca

SEQ ID NO: 140025 - RNA, 21 nt, Human
cagaaacaaaaccaaaaaacu

SEQ ID NO: 140026 - RNA, 22 nt, Human
cagaccaaauucaucaagucaa

SEQ ID NO: 140027 - RNA, 20 nt, Human
cagcacuuugggaggccaag

SEQ ID NO: 140028 - RNA, 22 nt, Human
cagcacuuugggaggccaaggc

SEQ ID NO: 140029 - RNA, 24 nt, Human
cagcacuuugggaggccaaggcgg

SEQ ID NO: 140030 - RNA, 23 nt, Human
caggagcaaacauacauguuuuc

SEQ ID NO: 140031 - RNA, 24 nt, Human
caguaacaacaggagcaaacauac

SEQ ID NO: 140032 - RNA, 26 nt, Human
caguucuugagacuucaaccuucugg

SEQ ID NO: 140033 - RNA, 21 nt, Human
caucaagucaaggaccuuuuc

SEQ ID NO: 140034 - RNA, 21 nt, Human
ccaaaaaacccuggcucaaaa

SEQ ID NO: 140035 - RNA, 22 nt, Human
cccauccagaaugaaaaguaca

SEQ ID NO: 140036 - RNA, 18 nt, Human
ccccaagagagcaaggaa

SEQ ID NO: 140037 - RNA, 24 nt, Human
ccccagggaaacaaggggcgccuc

SEQ ID NO: 140038 - RNA, 19 nt, Human
ccccaugaugccacucucc

SEQ ID NO: 140039 - RNA, 23 nt, Human
ccccgucucuacuaaaaauacaa

SEQ ID NO: 140040 - RNA, 18 nt, Human
ccccuuucccucucugcc

SEQ ID NO: 140041 - RNA, 20 nt, Human
ccgcagcagccgccacuucc

SEQ ID NO: 140042 - RNA, 23 nt, Human
ccuggccaagauggugaagcccc

SEQ ID NO: 140043 - RNA, 24 nt, Human
ccuggccaagauggugaagccccg

SEQ ID NO: 140044 - RNA, 21 nt, Human
ccugggagguggagguugcag

SEQ ID NO: 140045 - RNA, 22 nt, Human
ccugggcaacauagggagaccc

SEQ ID NO: 140046 - RNA, 22 nt, Human
ccugggugacagacugagacuc

SEQ ID NO: 140047 - RNA, 21 nt, Human
ccuguagucucagcuacucag

SEQ ID NO: 140048 - RNA, 20 nt, Human
ccuuccggcacaagagccgg

SEQ ID NO: 140049 - RNA, 21 nt, Human
cgaaccacaaagggagacuga

SEQ ID NO: 140050 - RNA, 21 nt, Human
cgcuugaaccugggaggugga

SEQ ID NO: 140051 - RNA, 22 nt, Human
cgggugggucacgaggucagga

SEQ ID NO: 140052 - RNA, 19 nt, Human
cgugaccccagggaaacaa

SEQ ID NO: 140053 - RNA, 26 nt, Human
cucaaaacagcuuccuccaguggcuc

SEQ ID NO: 140054 - RNA, 22 nt, Human
cucacaccuguaaucccagcac

SEQ ID NO: 140055 - RNA, 24 nt, Human
cucacaccuguaaucccagcacuu

SEQ ID NO: 140056 - RNA, 22 nt, Human
cucacaccuguaaucucagcac

SEQ ID NO: 140057 - RNA, 24 nt, Human
cucacaccuguaaucucagcacuu

SEQ ID NO: 140058 - RNA, 24 nt, Human
cugagaucacuccagccuggguga

SEQ ID NO: 140059 - RNA, 21 nt, Human
cuuccuccuuccggcacaaga

SEQ ID NO: 140060 - RNA, 21 nt, Human
cuucguucugggccccgcccc

SEQ ID NO: 140061 - RNA, 20 nt, Human
gaaugccccacgccuuccuc

SEQ ID NO: 140062 - RNA, 21 nt, Human
gacagacugagacuccgucuc

SEQ ID NO: 140063 - RNA, 24 nt, Human
gacagacugagacuccgucucaga

SEQ ID NO: 140064 - RNA, 18 nt, Human
gaggcugaggcaggagag

SEQ ID NO: 140065 - RNA, 24 nt, Human
gaggcugaggggagggaucgcuug

SEQ ID NO: 140066 - RNA, 22 nt, Human
gagguugcagugagcugagauc

SEQ ID NO: 140067 - RNA, 24 nt, Human
gaucacuugagucuaggaguucaa

SEQ ID NO: 140068 - RNA, 23 nt, Human
gauuuggauaaccagcuggauuu

SEQ ID NO: 140069 - RNA, 24 nt, Human
gccaagauggugaagccccgucuc

SEQ ID NO: 140070 - RNA, 19 nt, Human
gcugggugugguggcucac

SEQ ID NO: 140071 - RNA, 18 nt, Human
ggaagucaugcauuucca

SEQ ID NO: 140072 - RNA, 23 nt, Human
ggagcaaacauacauguuuuccc

SEQ ID NO: 140073 - RNA, 18 nt, Human
ggagguugcagugagcug

SEQ ID NO: 140074 - RNA, 22 nt, Human
ggagguugcagugagcugagau

SEQ ID NO: 140075 - RNA, 23 nt, Human
ggagguugcagugagcugagauc

SEQ ID NO: 140076 - RNA, 24 nt, Human
ggagguugcagugagcugagauca

SEQ ID NO: 140077 - RNA, 23 nt, Human
ggaucacuugagucuaggaguuc

SEQ ID NO: 140078 - RNA, 23 nt, Human
ggcacgguggcagucaccuguaa

SEQ ID NO: 140079 - RNA, 20 nt, Human
ggccaagauggugaagcccc

SEQ ID NO: 140080 - RNA, 19 nt, Human
gggagacugaggaaaugcu

SEQ ID NO: 140081 - RNA, 24 nt, Human
gggcacaguggcucacaccuguaa

SEQ ID NO: 140082 - RNA, 19 nt, Human
gggcacgguggcagucacc

SEQ ID NO: 140083 - RNA, 22 nt, Human
ggucacgaggucaggaguucaa

SEQ ID NO: 140084 - RNA, 24 nt, Human
ggucacgaggucaggaguucaaga

SEQ ID NO: 140085 - RNA, 19 nt, Human
gguggagguugcagugagc

SEQ ID NO: 140086 - RNA, 24 nt, Human
gguggcacucaccuguagucucag

SEQ ID NO: 140087 - RNA, 23 nt, Human
gguggcagucaccuguaauccca

SEQ ID NO: 140088 - RNA, 24 nt, Human
gguggcucacaccuguaaucccag

SEQ ID NO: 140089 - RNA, 23 nt, Human
ggugggucacgaggucaggaguu

SEQ ID NO: 140090 - RNA, 23 nt, Human
ggugugguggcucacaccuguaa

SEQ ID NO: 140091 - RNA, 21 nt, Human
gugaagccccgucucuacuaa

SEQ ID NO: 140092 - RNA, 19 nt, Human
gugacucagauaaguuuua

SEQ ID NO: 140093 - RNA, 20 nt, Human
guggagguugcagugagcug

SEQ ID NO: 140094 - RNA, 23 nt, Human
gugggucacgaggucaggaguuc

SEQ ID NO: 140095 - RNA, 18 nt, Human
gugugguggcucacaccu

SEQ ID NO: 140096 - RNA, 19 nt, Human
guugcagugagcugagauc

SEQ ID NO: 140097 - RNA, 21 nt, Human
uaaaaaggaacagauaaggca

SEQ ID NO: 140098 - RNA, 20 nt, Human
uaaaaauacaaacauuagcc

SEQ ID NO: 140099 - RNA, 24 nt, Human
uaaaaauacaaacauuagccgggc

SEQ ID NO: 140100 - RNA, 20 nt, Human
uaacaacaggagcaaacaua

SEQ ID NO: 140101 - RNA, 21 nt, Human
uacauagcaauauacauccca

SEQ ID NO: 140102 - RNA, 20 nt, Human
uacuaaaaauacaaacauua

SEQ ID NO: 140103 - RNA, 21 nt, Human
uagcaagucagagguuuccuu

SEQ ID NO: 140104 - RNA, 18 nt, Human
uagcaauauacaucccaa

SEQ ID NO: 140105 - RNA, 20 nt, Human
uagcaauauacaucccaaac

SEQ ID NO: 140106 - RNA, 21 nt, Human
uagcaauauacaucccaaacc

SEQ ID NO: 140107 - RNA, 20 nt, Human
ucaaggauagauaauuaaug

SEQ ID NO: 140108 - RNA, 18 nt, Human
ucacgaggucaggaguuc

SEQ ID NO: 140109 - RNA, 21 nt, Human
ucacgaggucaggaguucaag

SEQ ID NO: 140110 - RNA, 24 nt, Human
ucacgaggucaggaguucaagacc

SEQ ID NO: 140111 - RNA, 20 nt, Human
ucaguuuaaacacaucauca

SEQ ID NO: 140112 - RNA, 22 nt, Human
ucaucaagucaaggaccuuuuc

SEQ ID NO: 140113 - RNA, 24 nt, Human
uccagccugggugacagacugaga

SEQ ID NO: 140114 - RNA, 21 nt, Human
uccaguggcuagcacuuugcg

SEQ ID NO: 140115 - RNA, 19 nt, Human
ucccaaaccuuuucucaaa

SEQ ID NO: 140116 - RNA, 22 nt, Human
ucccagaaaguguggccucugu

SEQ ID NO: 140117 - RNA, 22 nt, Human
ucccuggcuacauccauuagca

SEQ ID NO: 140118 - RNA, 24 nt, Human
uccggcugcgcgugaccccaggga

SEQ ID NO: 140119 - RNA, 21 nt, Human
uccgucucagaaacaaaacca

SEQ ID NO: 140120 - RNA, 21 nt, Human
uccuccaguggcucagaggca

SEQ ID NO: 140121 - RNA, 22 nt, Human
ucgaaccacaaagggagacuga

SEQ ID NO: 140122 - RNA, 22 nt, Human
ucgcuugaaccugggaggugga

SEQ ID NO: 140123 - RNA, 24 nt, Human
ucgcuugaaccugggagguggagg

SEQ ID NO: 140124 - RNA, 24 nt, Human
ucgggaggcugaggcaggagaguc

SEQ ID NO: 140125 - RNA, 21 nt, Human
ucuccgcagcagccgccacuu

SEQ ID NO: 140126 - RNA, 19 nt, Human
ucucuacuaaaaauacaaa

SEQ ID NO: 140127 - RNA, 24 nt, Human
ugaaccugggagguggagguugca

SEQ ID NO: 140128 - RNA, 22 nt, Human
ugaaggaagaaauguauugcaa

SEQ ID NO: 140129 - RNA, 21 nt, Human
ugaauuucaaagaaaaggucu

SEQ ID NO: 140130 - RNA, 20 nt, Human
ugaccccagggaaacaaggg

SEQ ID NO: 140131 - RNA, 25 nt, Human
ugaccccagggaaacaaggggcgcc

SEQ ID NO: 140132 - RNA, 24 nt, Human
ugaggaaaugcuggcuuuaggcca

SEQ ID NO: 140133 - RNA, 24 nt, Human
ugaggcaggagagucgcuugaacc

SEQ ID NO: 140134 - RNA, 24 nt, Human
ugaggcaggagagucgcuugaacc

SEQ ID NO: 140135 - RNA, 18 nt, Human
ugaggggagggaucgcuu

SEQ ID NO: 140136 - RNA, 25 nt, Human
ugcaauaguccauauccuucgaacc

SEQ ID NO: 140137 - RNA, 25 nt, Human
uggaaguacauacagcuugggaggu

SEQ ID NO: 140138 - RNA, 21 nt, Human
uggccugagccuguuuuggcc

SEQ ID NO: 140139 - RNA, 21 nt, Human
uggcucacaccuguaauccca

SEQ ID NO: 140140 - RNA, 22 nt, Human
uggcucacaccuguaaucccag

SEQ ID NO: 140141 - RNA, 24 nt, Human
uggcucacaccuguaaucccagca

SEQ ID NO: 140142 - RNA, 21 nt, Human
uggcucacaccuguaaucuca

SEQ ID NO: 140143 - RNA, 24 nt, Human
uggcucacaccuguaaucucagca

SEQ ID NO: 140144 - RNA, 24 nt, Human
ugggaggccaagacaggaggauca

SEQ ID NO: 140145 - RNA, 22 nt, Human
ugggaggccaaggcgggugggu

SEQ ID NO: 140146 - RNA, 24 nt, Human
ugggaggccaaggcggguggguca

SEQ ID NO: 140147 - RNA, 18 nt, Human
ugggagguggagguugca

SEQ ID NO: 140148 - RNA, 29 nt, Human
ugggagguggagguugcagugacaacggu

SEQ ID NO: 140149 - RNA, 24 nt, Human
ugggagguggagguugcagugagc

SEQ ID NO: 140150 - RNA, 24 nt, Human
ugggcaacauagggagacccuguc

SEQ ID NO: 140151 - RNA, 22 nt, Human
ugggucacgaggucaggaguuc

SEQ ID NO: 140152 - RNA, 24 nt, Human
ugguggcacucaccuguagucuca

SEQ ID NO: 140153 - RNA, 24 nt, Human
ugguggcucacaccuguaauccca

SEQ ID NO: 140154 - RNA, 18 nt, Human
ugucaggugagcauaaaa

SEQ ID NO: 140155 - RNA, 22 nt, Human
uguuuuggccaagcccauccag

SEQ ID NO: 140156 - RNA, 18 nt, Human
uuagcugagugugguggc

SEQ ID NO: 140157 - RNA, 21 nt, Human
uuccaguggcuagcacuuugc

SEQ ID NO: 140158 - RNA, 22 nt, Human
uuccaguggcuagcacuuugcg

SEQ ID NO: 140159 - RNA, 24 nt, Human
uugaaccugggagguggagguugc

SEQ ID NO: 140160 - RNA, 21 nt, Human
uugagggucuguuucauuucu

SEQ ID NO: 140161 - RNA, 22 nt, Human
uugagucuaggaguucaagacc

SEQ ID NO: 140162 - RNA, 18 nt, Human
uugcagugagcugagauc

SEQ ID NO: 140163 - RNA, 19 nt, Human
uugcagugagcugagauca

SEQ ID NO: 140164 - RNA, 20 nt, Human
uugcagugagcugagaucac

SEQ ID NO: 140165 - RNA, 19 nt, Human
uuuggccaagcccauccag

SEQ ID NO: 140166 - RNA, 18 nt, Human
acuuccaugccccaaaga

SEQ ID NO: 140167 - RNA, 20 nt, Human
agcaguucucugugagucug

SEQ ID NO: 140168 - RNA, 21 nt, Human
aggcggaagaaaagagugagg

SEQ ID NO: 140169 - RNA, 22 nt, Human
augcugccauuauggcuguugu

SEQ ID NO: 140170 - RNA, 18 nt, Human
caaacccuuccacugcca

SEQ ID NO: 140171 - RNA, 24 nt, Human
cacgcacacccuucccaaaaaccc

SEQ ID NO: 140172 - RNA, 24 nt, Human
ccaaagacacgcacacccuuccca

SEQ ID NO: 140173 - RNA, 23 nt, Human
ccagcaguucucugugagucugg

SEQ ID NO: 140174 - RNA, 22 nt, Human
cccaaaaacccagcaguucucu

SEQ ID NO: 140175 - RNA, 23 nt, Human
cccaacuuccaugccccaaagac

SEQ ID NO: 140176 - RNA, 23 nt, Human
ccccaaagacacgcacacccuuc

SEQ ID NO: 140177 - RNA, 20 nt, Human
ccuuccacugccaugcugcc

SEQ ID NO: 140178 - RNA, 22 nt, Human
ccuuccacugccaugcugccau

SEQ ID NO: 140179 - RNA, 21 nt, Human
cgcacacccuucccaaaaacc

SEQ ID NO: 140180 - RNA, 23 nt, Human
cugagaaguagacacaagaauca

SEQ ID NO: 140181 - RNA, 21 nt, Human
gacacaagaaucagacagaug

SEQ ID NO: 140182 - RNA, 20 nt, Human
gaucaaaacgucagcuuugc

SEQ ID NO: 140183 - RNA, 19 nt, Human
gccccaaagacacgcacac

SEQ ID NO: 140184 - RNA, 22 nt, Human
gccugggcacaagacaaacccu

SEQ ID NO: 140185 - RNA, 19 nt, Human
gcuggaugugguuuaugcc

SEQ ID NO: 140186 - RNA, 18 nt, Human
ggacgacacugaugggau

SEQ ID NO: 140187 - RNA, 20 nt, Human
ggcuguuguuuuuccauaug

SEQ ID NO: 140188 - RNA, 18 nt, Human
gggaaaggcuggcccgug

SEQ ID NO: 140189 - RNA, 21 nt, Human
uacaaacuaauaccacacaga

SEQ ID NO: 140190 - RNA, 22 nt, Human
uauaaccccaacuuccaugccc

SEQ ID NO: 140191 - RNA, 26 nt, Human
ucaaaaucucucugccccaguccaca

SEQ ID NO: 140192 - RNA, 18 nt, Human
ucacauggccucucagca

SEQ ID NO: 140193 - RNA, 20 nt, Human
uccacaagaaacuugcauga

SEQ ID NO: 140194 - RNA, 21 nt, Human
uccacuauaaccccaacuucc

SEQ ID NO: 140195 - RNA, 23 nt, Human
ucccaaaaacccagcaguucucu

SEQ ID NO: 140196 - RNA, 18 nt, Human
uccucugggucuccacua

SEQ ID NO: 140197 - RNA, 18 nt, Human
ucucugccccaguccaca

SEQ ID NO: 140198 - RNA, 20 nt, Human
ugagaaguagacacaagaaa

SEQ ID NO: 140199 - RNA, 25 nt, Human
ugaggcagagaaguuuuccccgagg

SEQ ID NO: 140200 - RNA, 23 nt, Human
ugcaugaccgcaaggccugggca

SEQ ID NO: 140201 - RNA, 19 nt, Human
ugccaagaacuuuauaucu

SEQ ID NO: 140202 - RNA, 19 nt, Human
ugccccaaagacacgcaca

SEQ ID NO: 140203 - RNA, 31 nt, Human
ugccccaaagacacgcacacccuucccaaaa

SEQ ID NO: 140204 - RNA, 19 nt, Human
ugcugaggcagagaaguuu

SEQ ID NO: 140205 - RNA, 21 nt, Human
ugcugccauuauggcuguugu

SEQ ID NO: 140206 - RNA, 24 nt, Human
uggauacaaacuaauaccacacag

SEQ ID NO: 140207 - RNA, 18 nt, Human
ugggucuccacuauaacc

SEQ ID NO: 140208 - RNA, 24 nt, Human
uggucucacauggccucucagcag

SEQ ID NO: 140209 - RNA, 22 nt, Human
uguaaauaaagcucuuucuuuc

SEQ ID NO: 140210 - RNA, 24 nt, Human
uguuuuuccauauggucucacaug

SEQ ID NO: 140211 - RNA, 23 nt, Human
uucucugugagucugguagaaag

SEQ ID NO: 140212 - RNA, 20 nt, Human
uuucucauccucugggucuc

SEQ ID NO: 140213 - RNA, 22 nt, Human
uuucucauccucugggucucca

SEQ ID NO: 140214 - RNA, 23 nt, Human
uuuguggaccuacucagccuugg

SEQ ID NO: 140215 - RNA, 18 nt, Human
aaaccuccuaggcuagug

SEQ ID NO: 140216 - RNA, 25 nt, Human
aaauacgugcuugguguuacuaugg

SEQ ID NO: 140217 - RNA, 25 nt, Human
agccgcaguggggaagaggaaaacc

SEQ ID NO: 140218 - RNA, 19 nt, Human
auggucaaaauuauaaugg

SEQ ID NO: 140219 - RNA, 20 nt, Human
auucauuaacaauacuugaa

SEQ ID NO: 140220 - RNA, 24 nt, Human
auuuauggucaaaauuauaauggg

SEQ ID NO: 140221 - RNA, 22 nt, Human
auuuuugaagccaaauugggag

SEQ ID NO: 140222 - RNA, 23 nt, Human
cacacggaacacucagcaaacac

SEQ ID NO: 140223 - RNA, 21 nt, Human
cacgaccuccuuaagggcagg

SEQ ID NO: 140224 - RNA, 22 nt, Human
cagcaaacacgagaucccuuca

SEQ ID NO: 140225 - RNA, 25 nt, Human
cagcaaacacgagaucccuucagau

SEQ ID NO: 140226 - RNA, 18 nt, Human
cucagcgcugaguucucc

SEQ ID NO: 140227 - RNA, 26 nt, Human
cuggcaauggcgacggugaauuuucc

SEQ ID NO: 140228 - RNA, 20 nt, Human
cuuuagacaaucucagcgcu

SEQ ID NO: 140229 - RNA, 19 nt, Human
gcagggaccaggcuuuauc

SEQ ID NO: 140230 - RNA, 24 nt, Human
gcaguggggaagaggaaaaccuga

SEQ ID NO: 140231 - RNA, 18 nt, Human
ggggagccgcagugggga

SEQ ID NO: 140232 - RNA, 19 nt, Human
ggggagccgcaguggggaa

SEQ ID NO: 140233 - RNA, 24 nt, Human
guggggaagaggaaaaccugaggg

SEQ ID NO: 140234 - RNA, 23 nt, Human
uaaaaccuccuaggcuagugcug

SEQ ID NO: 140235 - RNA, 30 nt, Human
uauaauggcaaaaacuuauaaauaaauacc

SEQ ID NO: 140236 - RNA, 20 nt, Human
ucuauucauuaacaauacuu

SEQ ID NO: 140237 - RNA, 22 nt, Human
ugaguucuccgcgcaagcgccg

SEQ ID NO: 140238 - RNA, 22 nt, Human
ugucuccuccacaagaccacga

SEQ ID NO: 140239 - RNA, 26 nt, Human
uucauuaacaauacuugaacauuuac

SEQ ID NO: 140240 - RNA, 19 nt, Human
uuccuggggcuuuagacaa

SEQ ID NO: 140241 - RNA, 24 nt, Human
uuguagagacuaaaaccuccuagg

SEQ ID NO: 140242 - RNA, 24 nt, Human
aaaaaaaauuccccaaagcuuaag

SEQ ID NO: 140243 - RNA, 25 nt, Human
aaaauuccccaaagcuuaagcauac

SEQ ID NO: 140244 - RNA, 26 nt, Human
aaacacacacuagaaucagaagaauc

SEQ ID NO: 140245 - RNA, 20 nt, Human
aacagggcaucuggcacaca

SEQ ID NO: 140246 - RNA, 21 nt, Human
aaccagucuggauccccaccc

SEQ ID NO: 140247 - RNA, 19 nt, Human
aagcaaaacagagcaagga

SEQ ID NO: 140248 - RNA, 21 nt, Human
aagcaaaacagagcaaggaga

SEQ ID NO: 140249 - RNA, 21 nt, Human
acacuagaaucagaagaaucc

SEQ ID NO: 140250 - RNA, 19 nt, Human
acuaugaaaaagugagcug

SEQ ID NO: 140251 - RNA, 27 nt, Human
acuaugaaaaagugagcugggguccug

SEQ ID NO: 140252 - RNA, 18 nt, Human
agacgagugugauauucc

SEQ ID NO: 140253 - RNA, 26 nt, Human
agagaaaaguuuaugaaugcuaagga

SEQ ID NO: 140254 - RNA, 20 nt, Human
agggaaagacgagugugaua

SEQ ID NO: 140255 - RNA, 18 nt, Human
aucuaaaccacaaugacu

SEQ ID NO: 140256 - RNA, 19 nt, Human
caccaguaagcaauauucg

SEQ ID NO: 140257 - RNA, 24 nt, Human
caccuacuaaaaacaaaaccugaa

SEQ ID NO: 140258 - RNA, 21 nt, Human
cagagcaaggagaaugaugcc

SEQ ID NO: 140259 - RNA, 26 nt, Human
caguagauguucuuacaugcaggcuu

SEQ ID NO: 140260 - RNA, 18 nt, Human
cauccuauugccacucuc

SEQ ID NO: 140261 - RNA, 21 nt, Human
caugcaggcuuugagguguuu

SEQ ID NO: 140262 - RNA, 22 nt, Human
ccacagugguaaagggaaagac

SEQ ID NO: 140263 - RNA, 24 nt, Human
cccacccuaaaaacuugggcuggg

SEQ ID NO: 140264 - RNA, 19 nt, Human
cccaucugcuuacuuggaa

SEQ ID NO: 140265 - RNA, 19 nt, Human
ccccaaagcuuaagcauac

SEQ ID NO: 140266 - RNA, 21 nt, Human
ccccuuaaaaaaaaauucccc

SEQ ID NO: 140267 - RNA, 21 nt, Human
cgagugugauauuccucaacc

SEQ ID NO: 140268 - RNA, 23 nt, Human
cuaaaaacaaaaccugaaaacac

SEQ ID NO: 140269 - RNA, 20 nt, Human
cucauugugauuucucaccu

SEQ ID NO: 140270 - RNA, 18 nt, Human
cuccccuagcaguggugu

SEQ ID NO: 140271 - RNA, 22 nt, Human
cuccccuagcagugguguuucc

SEQ ID NO: 140272 - RNA, 19 nt, Human
cucuagugcaauaauuaag

SEQ ID NO: 140273 - RNA, 26 nt, Human
cucuguucuuuuccuuucucccacuc

SEQ ID NO: 140274 - RNA, 19 nt, Human
cugaagaaaccucauccua

SEQ ID NO: 140275 - RNA, 18 nt, Human
cuuugagguguuucugcc

SEQ ID NO: 140276 - RNA, 18 nt, Human
gaauaucaccuacuaaaa

SEQ ID NO: 140277 - RNA, 27 nt, Human
gacuacaucuaucacuaaacacacacu

SEQ ID NO: 140278 - RNA, 23 nt, Human
gauccccacccuaaaaacuuggg

SEQ ID NO: 140279 - RNA, 18 nt, Human
ggaaagacgagugugaua

SEQ ID NO: 140280 - RNA, 23 nt, Human
gguaggagugcuugauggcuugu

SEQ ID NO: 140281 - RNA, 19 nt, Human
guaauaaagagcuggauac

SEQ ID NO: 140282 - RNA, 28 nt, Human
uaaaaaaaaauuccccaaagcuuaagca

SEQ ID NO: 140283 - RNA, 21 nt, Human
uaaaaacauuuuuuuagaucc

SEQ ID NO: 140284 - RNA, 22 nt, Human
uaagcauacuacaagcugcugc

SEQ ID NO: 140285 - RNA, 27 nt, Human
uaauggaauuuuccuccuaggaaacac

SEQ ID NO: 140286 - RNA, 24 nt, Human
uacaucuaucacuaaacacacacu

SEQ ID NO: 140287 - RNA, 22 nt, Human
uagaaucagaagaauccuugac

SEQ ID NO: 140288 - RNA, 20 nt, Human
uagugaguuuugcuuucuuu

SEQ ID NO: 140289 - RNA, 23 nt, Human
uauuuuucucauugugauuucuc

SEQ ID NO: 140290 - RNA, 21 nt, Human
ucaccuacuaaaaacaaaacc

SEQ ID NO: 140291 - RNA, 21 nt, Human
uccaacuuucaccauuaaaca

SEQ ID NO: 140292 - RNA, 23 nt, Human
ucccacucagcuggugucugauu

SEQ ID NO: 140293 - RNA, 24 nt, Human
uccccaaagcuuaagcauacuaca

SEQ ID NO: 140294 - RNA, 24 nt, Human
uccuuucucccacucagcuggugu

SEQ ID NO: 140295 - RNA, 23 nt, Human
ucucuguucuuuuccuuucuccc

SEQ ID NO: 140296 - RNA, 23 nt, Human
ucugcuggauucucuuacaucca

SEQ ID NO: 140297 - RNA, 19 nt, Human
ucugugguugaauuuuuau

SEQ ID NO: 140298 - RNA, 19 nt, Human
ucugugguugaauuuuuau

SEQ ID NO: 140299 - RNA, 21 nt, Human
ucugugguugaauuuuuauuu

SEQ ID NO: 140300 - RNA, 21 nt, Human
ucuguucuuuuccuuucuccc

SEQ ID NO: 140301 - RNA, 21 nt, Human
ucuuuuuuuuuguccacagcu

SEQ ID NO: 140302 - RNA, 20 nt, Human
ugaaaacacaauucaguucc

SEQ ID NO: 140303 - RNA, 24 nt, Human
ugaaaacacaauucaguucccauc

SEQ ID NO: 140304 - RNA, 18 nt, Human
ugaaaccaacagggcauc

SEQ ID NO: 140305 - RNA, 22 nt, Human
ugacuccacagggauauuaacu

SEQ ID NO: 140306 - RNA, 20 nt, Human
uggaaaagcaaaacagagca

SEQ ID NO: 140307 - RNA, 20 nt, Human
uggaauuuauuuucucuagu

SEQ ID NO: 140308 - RNA, 21 nt, Human
uguucuucucuguucuuuucc

SEQ ID NO: 140309 - RNA, 23 nt, Human
uuaguccuaauauaagagaaaag

SEQ ID NO: 140310 - RNA, 23 nt, Human
uuccucaaccucaccaguaagca

SEQ ID NO: 140311 - RNA, 22 nt, Human
uucuuuuccuuucucccacuca

SEQ ID NO: 140312 - RNA, 24 nt, Human
uuuauguuaucugugaaaccaaca

SEQ ID NO: 140313 - RNA, 25 nt, Human
uuucucuagugcaauaauuaaggua

SEQ ID NO: 140314 - RNA, 21 nt, Human
agguacauuggaaacaugaaa

SEQ ID NO: 140315 - RNA, 19 nt, Human
ugaaaaaucagguacauug

SEQ ID NO: 140316 - RNA, 20 nt, Human
uguguaugugucucugugug

SEQ ID NO: 140317 - RNA, 25 nt, Human
aaagauccagauuuggucagugugg

SEQ ID NO: 140318 - RNA, 23 nt, Human
cagugagcuuugcuaugcuauuu

SEQ ID NO: 140319 - RNA, 23 nt, Human
ccgucugcaguuaaugucuaaga

SEQ ID NO: 140320 - RNA, 20 nt, Human
ggguaugaacccaaacauuu

SEQ ID NO: 140321 - RNA, 24 nt, Human
uauuuugaauacuuuaguccaaag

SEQ ID NO: 140322 - RNA, 22 nt, Human
ugacaacauauugcuuuugggg

SEQ ID NO: 140323 - RNA, 19 nt, Human
ugagagaagcuaauaagug

SEQ ID NO: 140324 - RNA, 19 nt, Human
uuagcccaauacagugagc

SEQ ID NO: 140325 - RNA, 22 nt, Human
aaaaagccagaacagccuuuac

SEQ ID NO: 140326 - RNA, 18 nt, Human
aaaauaaacagaaaacuu

SEQ ID NO: 140327 - RNA, 26 nt, Human
aaaauaaacagaaaacuuugaccaaa

SEQ ID NO: 140328 - RNA, 27 nt, Human
aaaauaaacagaaaacuuugaccaaag

SEQ ID NO: 140329 - RNA, 20 nt, Human
aaacacagaagagaagaaac

SEQ ID NO: 140330 - RNA, 18 nt, Human
aaacagaaaacuuugacc

SEQ ID NO: 140331 - RNA, 22 nt, Human
aaccaaacaaguacaucgaaga

SEQ ID NO: 140332 - RNA, 24 nt, Human
aaggagacucauuccaaaaugcuu

SEQ ID NO: 140333 - RNA, 21 nt, Human
aaucauggcuauauuuucugg

SEQ ID NO: 140334 - RNA, 24 nt, Human
acacagaagagaagaaacaaaucc

SEQ ID NO: 140335 - RNA, 24 nt, Human
accuuaaaguacaucgaauaugac

SEQ ID NO: 140336 - RNA, 24 nt, Human
agcaaaauaaacagaaaacuuuga

SEQ ID NO: 140337 - RNA, 20 nt, Human
agcgggaggaaagcuguggc

SEQ ID NO: 140338 - RNA, 18 nt, Human
aggcucgcgaggucgcug

SEQ ID NO: 140339 - RNA, 20 nt, Human
agugcggaaggcucgcgagg

SEQ ID NO: 140340 - RNA, 19 nt, Human
aucacucuacugcaagcac

SEQ ID NO: 140341 - RNA, 22 nt, Human
cagaaaacuuugaccaaagaaa

SEQ ID NO: 140342 - RNA, 20 nt, Human
cagcgccgaggcauaagcga

SEQ ID NO: 140343 - RNA, 22 nt, Human
cagucaaauuaauaccaaacca

SEQ ID NO: 140344 - RNA, 23 nt, Human
cagucaaauuaauaccaaaccaa

SEQ ID NO: 140345 - RNA, 19 nt, Human
ccuaauacagaauauggaa

SEQ ID NO: 140346 - RNA, 22 nt, Human
cgaaacacagaagagaagaaac

SEQ ID NO: 140347 - RNA, 23 nt, Human
cgaaacacagaagagaagaaaca

SEQ ID NO: 140348 - RNA, 18 nt, Human
gaagaaacaaauccuaag

SEQ ID NO: 140349 - RNA, 18 nt, Human
gacgcacugcauccaagu

SEQ ID NO: 140350 - RNA, 18 nt, Human
gagaaagcggagggggcc

SEQ ID NO: 140351 - RNA, 23 nt, Human
gagaaagcggagggggccaagga

SEQ ID NO: 140352 - RNA, 22 nt, Human
gaggagcugcgucggagcuggg

SEQ ID NO: 140353 - RNA, 21 nt, Human
gccggcgcggagaaagcggag

SEQ ID NO: 140354 - RNA, 21 nt, Human
gcgaggcgggccggcgcggag

SEQ ID NO: 140355 - RNA, 21 nt, Human
gcgcagaggagcugcgucgga

SEQ ID NO: 140356 - RNA, 19 nt, Human
gcucgcgaggucgcugcuc

SEQ ID NO: 140357 - RNA, 24 nt, Human
gcucgcuaccugggcccucccgag

SEQ ID NO: 140358 - RNA, 20 nt, Human
ggcggcaagggcgcagagga

SEQ ID NO: 140359 - RNA, 24 nt, Human
gggccgggggcaggagcgggagga

SEQ ID NO: 140360 - RNA, 21 nt, Human
uaagaagauaaaaagccagaa

SEQ ID NO: 140361 - RNA, 20 nt, Human
uaauaaaguggaaauucaua

SEQ ID NO: 140362 - RNA, 20 nt, Human
uacaauccacacucugaaac

SEQ ID NO: 140363 - RNA, 20 nt, Human
uacaucgaagaguauauggg

SEQ ID NO: 140364 - RNA, 18 nt, Human
uagaauguccuaucacuc

SEQ ID NO: 140365 - RNA, 25 nt, Human
uagcacuucagacgcacugcaucca

SEQ ID NO: 140366 - RNA, 19 nt, Human
uauaggcuuccaaaauuaa

SEQ ID NO: 140367 - RNA, 22 nt, Human
uauugccagaauagcaaacuuc

SEQ ID NO: 140368 - RNA, 27 nt, Human
ucagugauccauuuaauuuuuaucucc

SEQ ID NO: 140369 - RNA, 22 nt, Human
uccaaaauuaaagaauugauca

SEQ ID NO: 140370 - RNA, 21 nt, Human
ucuacugcaagcaccgggauu

SEQ ID NO: 140371 - RNA, 24 nt, Human
ucuauuauuuaauaaaguggaaau

SEQ ID NO: 140372 - RNA, 25 nt, Human
ugacaagcaaaauaaacagaaaacu

SEQ ID NO: 140373 - RNA, 21 nt, Human
ugagaagcagaaugacuaaaa

SEQ ID NO: 140374 - RNA, 22 nt, Human
ugagaggggggcuggugcuggg

SEQ ID NO: 140375 - RNA, 18 nt, Human
ugccagaauagcaaacuu

SEQ ID NO: 140376 - RNA, 22 nt, Human
ugcgucggagcuggguguuggu

SEQ ID NO: 140377 - RNA, 21 nt, Human
ugcuugguuuuggguuggggg

SEQ ID NO: 140378 - RNA, 18 nt, Human
uggcucggagggcggcaa

SEQ ID NO: 140379 - RNA, 25 nt, Human
uggggguuugagaggggggcuggug

SEQ ID NO: 140380 - RNA, 23 nt, Human
uggguuggggguuugagaggggg

SEQ ID NO: 140381 - RNA, 20 nt, Human
aaaguguucauuucaaaauu

SEQ ID NO: 140382 - RNA, 23 nt, Human
agaacacaaucucaaaguaucau

SEQ ID NO: 140383 - RNA, 20 nt, Human
agccaucguaaugcuaaccc

SEQ ID NO: 140384 - RNA, 23 nt, Human
aggaagagaaaaguuuaauuaaa

SEQ ID NO: 140385 - RNA, 19 nt, Human
agugaaaaaaaaaggaaga

SEQ ID NO: 140386 - RNA, 21 nt, Human
agugaaaaaaaaaggaagaga

SEQ ID NO: 140387 - RNA, 22 nt, Human
augaacuccuaaaacuugcaag

SEQ ID NO: 140388 - RNA, 18 nt, Human
caucucucagaacacaau

SEQ ID NO: 140389 - RNA, 19 nt, Human
gaaaaaaaaaggaagagaa

SEQ ID NO: 140390 - RNA, 24 nt, Human
gaacacaaucucaaaguaucaugc

SEQ ID NO: 140391 - RNA, 23 nt, Human
gagaaaaguuuaauuaaaaacau

SEQ ID NO: 140392 - RNA, 23 nt, Human
uaaacaugcuuuagugaaaaaaa

SEQ ID NO: 140393 - RNA, 19 nt, Human
ucaugcugaguuuuguuuu

SEQ ID NO: 140394 - RNA, 24 nt, Human
uccuuuggcucugaccugaugaaa

SEQ ID NO: 140395 - RNA, 21 nt, Human
ucucucagaacacaaucucaa

SEQ ID NO: 140396 - RNA, 21 nt, Human
ucugaccugaugaaauggcac

SEQ ID NO: 140397 - RNA, 20 nt, Human
uuagugaaaaaaaaaggaag

SEQ ID NO: 140398 - RNA, 21 nt, Human
uuagugaaaaaaaaaggaaga

SEQ ID NO: 140399 - RNA, 24 nt, Human
uuauuccuaacucaucugguguuu

SEQ ID NO: 140400 - RNA, 23 nt, Human
uucauuauaacauuuuuaauugu

SEQ ID NO: 140401 - RNA, 19 nt, Human
uuggcaaaaauaccuaaag

SEQ ID NO: 140402 - RNA, 22 nt, Human
uuuagugaaaaaaaaaggaaga

SEQ ID NO: 140403 - RNA, 26 nt, Human
uuuagugaaaaaaaaaggaagagaaa

SEQ ID NO: 140404 - RNA, 23 nt, Human
uuugccccugaccaauggcugug

SEQ ID NO: 140405 - RNA, 20 nt, Human
aaggcuucaaaaggauuuug

SEQ ID NO: 140406 - RNA, 22 nt, Human
aggaauaauaauaaucaauggc

SEQ ID NO: 140407 - RNA, 25 nt, Human
ccaacuguuugauuugauuccccca

SEQ ID NO: 140408 - RNA, 23 nt, Human
uaaucaauggcuuaaaaggcuuc

SEQ ID NO: 140409 - RNA, 22 nt, Human
uauguuuagauuuacacuuuua

SEQ ID NO: 140410 - RNA, 21 nt, Human
ucugcaggaguuaggucuugg

SEQ ID NO: 140411 - RNA, 20 nt, Human
ucuuucucuuugaagacuga

SEQ ID NO: 140412 - RNA, 18 nt, Human
ucuuugaagacugaaagu

SEQ ID NO: 140413 - RNA, 24 nt, Human
ugauuugauucccccaguuguuuu

SEQ ID NO: 140414 - RNA, 22 nt, Human
ugugugaaguauuaaagaauau

SEQ ID NO: 140415 - RNA, 21 nt, Human
uuaccaaacuuuucacaaaag

SEQ ID NO: 140416 - RNA, 19 nt, Human
uugguucugaauccaacug

SEQ ID NO: 140417 - RNA, 24 nt, Human
uuucacaaaaggaaucuuaugggu

SEQ ID NO: 140418 - RNA, 23 nt, Human
aaaaacacaaauaaauccaagca

SEQ ID NO: 140419 - RNA, 20 nt, Human
aaauaaauccaagcagauaa

SEQ ID NO: 140420 - RNA, 26 nt, Human
acgccaccgucacuaccgccuccgac

SEQ ID NO: 140421 - RNA, 18 nt, Human
caaaaacacaaauaaauc

SEQ ID NO: 140422 - RNA, 20 nt, Human
caaaaacacaaauaaaucca

SEQ ID NO: 140423 - RNA, 19 nt, Human
cacaaauaaauccaagcag

SEQ ID NO: 140424 - RNA, 22 nt, Human
ccaccgucacuaccgccuccga

SEQ ID NO: 140425 - RNA, 22 nt, Human
cgccaccgucacuaccgccucc

SEQ ID NO: 140426 - RNA, 19 nt, Human
cucaaggaaacgccaccgu

SEQ ID NO: 140427 - RNA, 18 nt, Human
uagagacuuggggaaaga

SEQ ID NO: 140428 - RNA, 22 nt, Human
uccaagcagauaaugaaauaaa

SEQ ID NO: 140429 - RNA, 24 nt, Human
uccgcgcccaacaccucccagaua

SEQ ID NO: 140430 - RNA, 22 nt, Human
aaaaaaguauguaaugacccuc

SEQ ID NO: 140431 - RNA, 22 nt, Human
aaaaaaguauguaaugacccuc

SEQ ID NO: 140432 - RNA, 19 nt, Human
aaaaagaagcaaauuagua

SEQ ID NO: 140433 - RNA, 28 nt, Human
aaaagcaaugagaaaaccgcaggucggc

SEQ ID NO: 140434 - RNA, 28 nt, Human
aaaagcaaugagaaaaccgcaggucggc

SEQ ID NO: 140435 - RNA, 20 nt, Human
aaacacacaccuaugcaccc

SEQ ID NO: 140436 - RNA, 23 nt, Human
aaacuuauaccucuggggaucua

SEQ ID NO: 140437 - RNA, 23 nt, Human
aaacuuauaccucuggggaucua

SEQ ID NO: 140438 - RNA, 19 nt, Human
aaaguauguaaugacccuc

SEQ ID NO: 140439 - RNA, 19 nt, Human
aaaguauguaaugacccuc

SEQ ID NO: 140440 - RNA, 18 nt, Human
aaauaaugugaaacuuuu

SEQ ID NO: 140441 - RNA, 20 nt, Human
aaauguguccagcauuuucc

SEQ ID NO: 140442 - RNA, 25 nt, Human
aacaugccccuuaauucuuccucug

SEQ ID NO: 140443 - RNA, 21 nt, Human
aaccaaaaaguuagcugcacu

SEQ ID NO: 140444 - RNA, 22 nt, Human
aagagauuacugucaaccaaca

SEQ ID NO: 140445 - RNA, 22 nt, Human
aagagauuacugucaaccaaca

SEQ ID NO: 140446 - RNA, 21 nt, Human
aagagccaaaaagaugggacg

SEQ ID NO: 140447 - RNA, 21 nt, Human
aagagccaaaaagaugggacg

SEQ ID NO: 140448 - RNA, 21 nt, Human
aagcugcuuuuauuuugcuuc

SEQ ID NO: 140449 - RNA, 22 nt, Human
aauaguagugauaguuauaaaa

SEQ ID NO: 140450 - RNA, 19 nt, Human
aaugaagggacagcaugaa

SEQ ID NO: 140451 - RNA, 22 nt, Human
aaugaauaauagaaaagagccg

SEQ ID NO: 140452 - RNA, 20 nt, Human
acacauuuccaaacaacucc

SEQ ID NO: 140453 - RNA, 20 nt, Human
acacuggguuccaacagaau

SEQ ID NO: 140454 - RNA, 18 nt, Human
acagaggauguagcugau

SEQ ID NO: 140455 - RNA, 22 nt, Human
acaugaaccucaggguaucucu

SEQ ID NO: 140456 - RNA, 22 nt, Human
acaugaaccucaggguaucucu

SEQ ID NO: 140457 - RNA, 21 nt, Human
acccucucgucucccggagcc

SEQ ID NO: 140458 - RNA, 21 nt, Human
acccucucgucucccggagcc

SEQ ID NO: 140459 - RNA, 21 nt, Human
acccucucgucucccggagcc

SEQ ID NO: 140460 - RNA, 18 nt, Human
accgcaggucggcaggcc

SEQ ID NO: 140461 - RNA, 18 nt, Human
accgcaggucggcaggcc

SEQ ID NO: 140462 - RNA, 21 nt, Human
acugaagcaugaacauacauu

SEQ ID NO: 140463 - RNA, 21 nt, Human
acugaagcaugaacauacauu

SEQ ID NO: 140464 - RNA, 22 nt, Human
acugguuugaaacuuauaccuc

SEQ ID NO: 140465 - RNA, 22 nt, Human
acugguuugaaacuuauaccuc

SEQ ID NO: 140466 - RNA, 19 nt, Human
agaaaagagcauacagaag

SEQ ID NO: 140467 - RNA, 21 nt, Human
agaaaagagcauacagaagaa

SEQ ID NO: 140468 - RNA, 22 nt, Human
agaauaaguaagagcacgcagu

SEQ ID NO: 140469 - RNA, 20 nt, Human
agagcaaaagcaaugagaaa

SEQ ID NO: 140470 - RNA, 21 nt, Human
agagcaaaagcaaugagaaaa

SEQ ID NO: 140471 - RNA, 21 nt, Human
agagcaaaagcaaugagaaaa

SEQ ID NO: 140472 - RNA, 18 nt, Human
agagccaaaaagauggga

SEQ ID NO: 140473 - RNA, 18 nt, Human
agagccaaaaagauggga

SEQ ID NO: 140474 - RNA, 23 nt, Human
agcagcauggguuuucagccugu

SEQ ID NO: 140475 - RNA, 20 nt, Human
aggagcugcuggguguggug

SEQ ID NO: 140476 - RNA, 20 nt, Human
aggagcugcuggguguggug

SEQ ID NO: 140477 - RNA, 23 nt, Human
aggggugggggucugucaggagc

SEQ ID NO: 140478 - RNA, 23 nt, Human
aggggugggggucugucaggagc

SEQ ID NO: 140479 - RNA, 22 nt, Human
auacagaagaaaugaaagauac

SEQ ID NO: 140480 - RNA, 18 nt, Human
aucaccaguuuucauguu

SEQ ID NO: 140481 - RNA, 18 nt, Human
aucaccaguuuucauguu

SEQ ID NO: 140482 - RNA, 18 nt, Human
aucuauauuccaagaagu

SEQ ID NO: 140483 - RNA, 26 nt, Human
augggaaugaaggguaaaaauguguc

SEQ ID NO: 140484 - RNA, 23 nt, Human
caaacaacuccaaaguaaccuuu

SEQ ID NO: 140485 - RNA, 19 nt, Human
caacagaauaaguaagagc

SEQ ID NO: 140486 - RNA, 22 nt, Human
caacuccaaaguaaccuuuaac

SEQ ID NO: 140487 - RNA, 25 nt, Human
caacuccaaaguaaccuuuaacuuc

SEQ ID NO: 140488 - RNA, 22 nt, Human
cacaaaauugagcacauuuugg

SEQ ID NO: 140489 - RNA, 22 nt, Human
cacaaaauugagcacauuuugg

SEQ ID NO: 140490 - RNA, 22 nt, Human
cacuacauugaaaaagaagcaa

SEQ ID NO: 140491 - RNA, 22 nt, Human
cacuacauugaaaaagaagcaa

SEQ ID NO: 140492 - RNA, 19 nt, Human
cacuggguuccaacagaau

SEQ ID NO: 140493 - RNA, 23 nt, Human
cagaauaaguaagagcacgcagu

SEQ ID NO: 140494 - RNA, 24 nt, Human
cagaccaugggaaugaaggguaaa

SEQ ID NO: 140495 - RNA, 18 nt, Human
cagcagcauggguuuuca

SEQ ID NO: 140496 - RNA, 21 nt, Human
cagcagcauggguuuucagcc

SEQ ID NO: 140497 - RNA, 25 nt, Human
cccucucgucucccggagccgaaag

SEQ ID NO: 140498 - RNA, 25 nt, Human
cccucucgucucccggagccgaaag

SEQ ID NO: 140499 - RNA, 18 nt, Human
ccgcaggucggcaggccc

SEQ ID NO: 140500 - RNA, 18 nt, Human
ccgcaggucggcaggccc

SEQ ID NO: 140501 - RNA, 20 nt, Human
ccuacaaaucugagaacaaa

SEQ ID NO: 140502 - RNA, 22 nt, Human
ccucuguguggccacagggcuc

SEQ ID NO: 140503 - RNA, 22 nt, Human
ccucuguguggccacagggcuc

SEQ ID NO: 140504 - RNA, 26 nt, Human
ccuuuaauucugccaccauccuugau

SEQ ID NO: 140505 - RNA, 27 nt, Human
ccuuuaauucugccaccauccuugaua

SEQ ID NO: 140506 - RNA, 24 nt, Human
cggugaggcugcugccaggcugcu

SEQ ID NO: 140507 - RNA, 24 nt, Human
cggugaggcugcugccaggcugcu

SEQ ID NO: 140508 - RNA, 23 nt, Human
cuaaggaaaaagcugagaguuac

SEQ ID NO: 140509 - RNA, 23 nt, Human
cuaaggaaaaagcugagaguuac

SEQ ID NO: 140510 - RNA, 20 nt, Human
cucagagcgggguucugaag

SEQ ID NO: 140511 - RNA, 19 nt, Human
cucccggagccgaaagcuc

SEQ ID NO: 140512 - RNA, 20 nt, Human
cucccggagccgaaaggcuc

SEQ ID NO: 140513 - RNA, 20 nt, Human
cucccggagccgaaaggcuc

SEQ ID NO: 140514 - RNA, 18 nt, Human
cuccucuguguggccaca

SEQ ID NO: 140515 - RNA, 18 nt, Human
cuccucuguguggccaca

SEQ ID NO: 140516 - RNA, 23 nt, Human
cucucgucucccggagccgaaag

SEQ ID NO: 140517 - RNA, 23 nt, Human
cucucgucucccggagccgaaag

SEQ ID NO: 140518 - RNA, 18 nt, Human
cugaauacucacagugug

SEQ ID NO: 140519 - RNA, 18 nt, Human
cugaauacucacagugug

SEQ ID NO: 140520 - RNA, 18 nt, Human
cugcucccccugcuggcu

SEQ ID NO: 140521 - RNA, 18 nt, Human
cugcucccccugcuggcu

SEQ ID NO: 140522 - RNA, 18 nt, Human
cugcucccccugcuggcu

SEQ ID NO: 140523 - RNA, 19 nt, Human
cugcucccccugcuggcuc

SEQ ID NO: 140524 - RNA, 19 nt, Human
cugcucccccugcuggcuc

SEQ ID NO: 140525 - RNA, 19 nt, Human
cugcucccccugcuggcuc

SEQ ID NO: 140526 - RNA, 19 nt, Human
cugcucccccugcuggcuc

SEQ ID NO: 140527 - RNA, 23 nt, Human
cugcuggguguggugguuccucu

SEQ ID NO: 140528 - RNA, 23 nt, Human
cugcuggguguggugguuccucu

SEQ ID NO: 140529 - RNA, 24 nt, Human
cugcuggguguggugguuccucuc

SEQ ID NO: 140530 - RNA, 24 nt, Human
cugcuggguguggugguuccucuc

SEQ ID NO: 140531 - RNA, 22 nt, Human
cuuuuuuuuuccuuccuugaaa

SEQ ID NO: 140532 - RNA, 21 nt, Human
gaaaagagcauacagaagaaa

SEQ ID NO: 140533 - RNA, 22 nt, Human
gaaaagggauuuaauugccuga

SEQ ID NO: 140534 - RNA, 22 nt, Human
gaaaagggauuuaauugccuga

SEQ ID NO: 140535 - RNA, 23 nt, Human
gaacauacauuagagcaaaagca

SEQ ID NO: 140536 - RNA, 23 nt, Human
gaacauacauuagagcaaaagca

SEQ ID NO: 140537 - RNA, 18 nt, Human
gaauaauagaaaagagca

SEQ ID NO: 140538 - RNA, 22 nt, Human
gauaguagugauaguuauaaaa

SEQ ID NO: 140539 - RNA, 22 nt, Human
gauaguagugauaguuauaaaa

SEQ ID NO: 140540 - RNA, 24 nt, Human
gcaccuacaaaucugagaacaaaa

SEQ ID NO: 140541 - RNA, 24 nt, Human
gcgggguucugaaggagagagcag

SEQ ID NO: 140542 - RNA, 20 nt, Human
ggagccgaaaggcucuggug

SEQ ID NO: 140543 - RNA, 20 nt, Human
ggagccgaaaggcucuggug

SEQ ID NO: 140544 - RNA, 22 nt, Human
ggcugcugccaggcugcugucu

SEQ ID NO: 140545 - RNA, 22 nt, Human
ggcugcugccaggcugcugucu

SEQ ID NO: 140546 - RNA, 19 nt, Human
gggaagagccaaaaagaug

SEQ ID NO: 140547 - RNA, 20 nt, Human
ggggaagagccaaaaagaug

SEQ ID NO: 140548 - RNA, 20 nt, Human
ggggaagagccaaaaagaug

SEQ ID NO: 140549 - RNA, 24 nt, Human
gguugugguucuaauugauccaug

SEQ ID NO: 140550 - RNA, 20 nt, Human
gucacacacucagacguccu

SEQ ID NO: 140551 - RNA, 22 nt, Human
gugggaggaagggggacugaaa

SEQ ID NO: 140552 - RNA, 20 nt, Human
gugugaguggguguagaggu

SEQ ID NO: 140553 - RNA, 20 nt, Human
gugugaguggguguagaggu

SEQ ID NO: 140554 - RNA, 20 nt, Human
guucuucuuuugauguggau

SEQ ID NO: 140555 - RNA, 23 nt, Human
uaacuuugaacagaaguccuagu

SEQ ID NO: 140556 - RNA, 19 nt, Human
uaaguaagagcacgcagua

SEQ ID NO: 140557 - RNA, 21 nt, Human
uacacacaaacacacauaaug

SEQ ID NO: 140558 - RNA, 19 nt, Human
uacagaccaugggaaugaa

SEQ ID NO: 140559 - RNA, 22 nt, Human
uacauugaaaaagaagcaaauu

SEQ ID NO: 140560 - RNA, 22 nt, Human
uagaaaagagcauacagaagaa

SEQ ID NO: 140561 - RNA, 18 nt, Human
uagaccugggauggaagg

SEQ ID NO: 140562 - RNA, 18 nt, Human
uaggguggagagugggag

SEQ ID NO: 140563 - RNA, 18 nt, Human
uauguuccagaagguccu

SEQ ID NO: 140564 - RNA, 22 nt, Human
uauuuccagaaaaaaaaaaaag

SEQ ID NO: 140565 - RNA, 22 nt, Human
uauuuccagaaaaaaaaaaaag

SEQ ID NO: 140566 - RNA, 22 nt, Human
uauuuccagaaaaaaaaaaaag

SEQ ID NO: 140567 - RNA, 21 nt, Human
ucauacauagcgugguacaug

SEQ ID NO: 140568 - RNA, 23 nt, Human
uccaacagaauaaguaagagcac

SEQ ID NO: 140569 - RNA, 19 nt, Human
uccaucaucaccaguuuuc

SEQ ID NO: 140570 - RNA, 19 nt, Human
uccaucaucaccaguuuuc

SEQ ID NO: 140571 - RNA, 19 nt, Human
ucucccggagccgaaaggc

SEQ ID NO: 140572 - RNA, 19 nt, Human
ucucccggagccgaaaggc

SEQ ID NO: 140573 - RNA, 23 nt, Human
ucuuuuuuuuuccuuccuugaaa

SEQ ID NO: 140574 - RNA, 19 nt, Human
ugaaaagggauuuaauugc

SEQ ID NO: 140575 - RNA, 19 nt, Human
ugaaaagggauuuaauugc

SEQ ID NO: 140576 - RNA, 23 nt, Human
ugaaaagggauuuaauugccuga

SEQ ID NO: 140577 - RNA, 23 nt, Human
ugaauagucaguuauggaguaca

SEQ ID NO: 140578 - RNA, 23 nt, Human
ugaauagucaguuauggaguaca

SEQ ID NO: 140579 - RNA, 23 nt, Human
ugacauuacagauugauuuuaca

SEQ ID NO: 140580 - RNA, 18 nt, Human
ugacuuuuuucucuuucc

SEQ ID NO: 140581 - RNA, 18 nt, Human
ugacuuuuuucucuuucc

SEQ ID NO: 140582 - RNA, 22 nt, Human
ugagaacaaaaaguuagcugca

SEQ ID NO: 140583 - RNA, 22 nt, Human
ugcaccuacaaaucugagaacc

SEQ ID NO: 140584 - RNA, 18 nt, Human
ugcuagugagugggauau

SEQ ID NO: 140585 - RNA, 23 nt, Human
ugcuuuuuaaccagggaugaacc

SEQ ID NO: 140586 - RNA, 25 nt, Human
uggacagguugugguucuaauugau

SEQ ID NO: 140587 - RNA, 20 nt, Human
uggagagugggaggaagggg

SEQ ID NO: 140588 - RNA, 20 nt, Human
ugggaggaagggggacugaa

SEQ ID NO: 140589 - RNA, 21 nt, Human
uggugcuaaggaaaaagcuga

SEQ ID NO: 140590 - RNA, 21 nt, Human
uggugcuaaggaaaaagcuga

SEQ ID NO: 140591 - RNA, 23 nt, Human
ugucauacauagcgugguacaug

SEQ ID NO: 140592 - RNA, 23 nt, Human
ugucuuccuccucuguguggcca

SEQ ID NO: 140593 - RNA, 23 nt, Human
ugucuuccuccucuguguggcca

SEQ ID NO: 140594 - RNA, 18 nt, Human
uguggugguuccucucuu

SEQ ID NO: 140595 - RNA, 18 nt, Human
uguggugguuccucucuu

SEQ ID NO: 140596 - RNA, 21 nt, Human
uguuacacacaaacacacaua

SEQ ID NO: 140597 - RNA, 19 nt, Human
uguuugcuuuuuaaccagg

SEQ ID NO: 140598 - RNA, 24 nt, Human
uucaagcacuacauugaaaaagaa

SEQ ID NO: 140599 - RNA, 24 nt, Human
uucaagcacuacauugaaaaagaa

SEQ ID NO: 140600 - RNA, 18 nt, Human
uuccaagaaguaacauag

SEQ ID NO: 140601 - RNA, 19 nt, Human
uuccucugaaguacuacau

SEQ ID NO: 140602 - RNA, 24 nt, Human
uucggugaggcugcugccaggcug

SEQ ID NO: 140603 - RNA, 24 nt, Human
uucggugaggcugcugccaggcug

SEQ ID NO: 140604 - RNA, 18 nt, Human
uucuucuuuugaugugga

SEQ ID NO: 140605 - RNA, 18 nt, Human
uucuucuuuugaugugga

SEQ ID NO: 140606 - RNA, 23 nt, Human
uugcugcucccccugcuggcucu

SEQ ID NO: 140607 - RNA, 23 nt, Human
uugcugcucccccugcuggcucu

SEQ ID NO: 140608 - RNA, 23 nt, Human
uugcugcucccccugcuggcucu

SEQ ID NO: 140609 - RNA, 24 nt, Human
uugcugcucccccugcuggcucuu

SEQ ID NO: 140610 - RNA, 24 nt, Human
uugcugcucccccugcuggcucuu

SEQ ID NO: 140611 - RNA, 23 nt, Human
uuguuugcuuuuuaaccagggau

SEQ ID NO: 140612 - RNA, 18 nt, Human
uuuguaguuaaaugcacc

SEQ ID NO: 140613 - RNA, 18 nt, Human
uuuuuuuuccuuccuuga

SEQ ID NO: 140614 - RNA, 26 nt, Human
aaaaaaaggcaaauuuuaaaaauuaa

SEQ ID NO: 140615 - RNA, 22 nt, Human
aaacaaacauaaaccucccccg

SEQ ID NO: 140616 - RNA, 24 nt, Human
aaacaaacauaaaccucccccgaa

SEQ ID NO: 140617 - RNA, 26 nt, Human
aaacaaacauaaaccucccccgaaca

SEQ ID NO: 140618 - RNA, 20 nt, Human
aaaccucccccgaacaccau

SEQ ID NO: 140619 - RNA, 21 nt, Human
aaacgaaaacucagcuucagc

SEQ ID NO: 140620 - RNA, 21 nt, Human
aacaaacauaaaccucccccg

SEQ ID NO: 140621 - RNA, 19 nt, Human
aacaacagagaaugaaaga

SEQ ID NO: 140622 - RNA, 19 nt, Human
aacagaaacaaacauaaac

SEQ ID NO: 140623 - RNA, 23 nt, Human
aacagagaaugaaagagcaggaa

SEQ ID NO: 140624 - RNA, 18 nt, Human
aaccuccaggugaauucc

SEQ ID NO: 140625 - RNA, 27 nt, Human
aagcaauuaaaaucacuccagacacac

SEQ ID NO: 140626 - RNA, 23 nt, Human
aagccugcaauugacuuucuuga

SEQ ID NO: 140627 - RNA, 23 nt, Human
aauugacuuucuugaguggguca

SEQ ID NO: 140628 - RNA, 21 nt, Human
accccagcacccugaaaguug

SEQ ID NO: 140629 - RNA, 20 nt, Human
acccugaaaguuguuucaag

SEQ ID NO: 140630 - RNA, 21 nt, Human
acccugaaaguuguuucaagc

SEQ ID NO: 140631 - RNA, 19 nt, Human
acgcuccggcccagccccc

SEQ ID NO: 140632 - RNA, 19 nt, Human
acgucuggcagccugcaag

SEQ ID NO: 140633 - RNA, 23 nt, Human
acguuuuguauuuaucucccaaa

SEQ ID NO: 140634 - RNA, 23 nt, Human
agccacacagcucagaaaaaccc

SEQ ID NO: 140635 - RNA, 18 nt, Human
agcuccgucuggaguagg

SEQ ID NO: 140636 - RNA, 18 nt, Human
agcugugccacgcagccc

SEQ ID NO: 140637 - RNA, 18 nt, Human
agcugugccacgcagccc

SEQ ID NO: 140638 - RNA, 19 nt, Human
agcuugcuccucguccucu

SEQ ID NO: 140639 - RNA, 24 nt, Human
aggcagcggcagcgccuacucagg

SEQ ID NO: 140640 - RNA, 24 nt, Human
aggccauuuuacaacaccaugggg

SEQ ID NO: 140641 - RNA, 20 nt, Human
caaccuccaggugaauuccu

SEQ ID NO: 140642 - RNA, 21 nt, Human
cacacagcucagaaaaacccg

SEQ ID NO: 140643 - RNA, 22 nt, Human
cagaaacaaacauaaaccuccc

SEQ ID NO: 140644 - RNA, 18 nt, Human
cagcccccucggcugagg

SEQ ID NO: 140645 - RNA, 21 nt, Human
cagcuuaaaaaaugugugcuu

SEQ ID NO: 140646 - RNA, 20 nt, Human
caggccccggagccaccccc

SEQ ID NO: 140647 - RNA, 23 nt, Human
caugcacauucauucaugacaug

SEQ ID NO: 140648 - RNA, 21 nt, Human
ccaccggcucuggcuccccuc

SEQ ID NO: 140649 - RNA, 24 nt, Human
ccacgcagccccuccccgcuuccc

SEQ ID NO: 140650 - RNA, 21 nt, Human
cccaaaggauaaaaaagcucc

SEQ ID NO: 140651 - RNA, 23 nt, Human
cccccgaacaccaugcaauagcc

SEQ ID NO: 140652 - RNA, 22 nt, Human
ccccggagccacccccgcggcg

SEQ ID NO: 140653 - RNA, 23 nt, Human
ccggagcaggggucgucgggaag

SEQ ID NO: 140654 - RNA, 24 nt, Human
ccuccgcacgcuccggcccagccc

SEQ ID NO: 140655 - RNA, 21 nt, Human
cggcccagcccccucggcuga

SEQ ID NO: 140656 - RNA, 19 nt, Human
cucagaaaaacccgagcuc

SEQ ID NO: 140657 - RNA, 21 nt, Human
cucagaaaaacccgagcuccg

SEQ ID NO: 140658 - RNA, 20 nt, Human
cucugugccugagcuuccuc

SEQ ID NO: 140659 - RNA, 18 nt, Human
cucuguguccggcuccuc

SEQ ID NO: 140660 - RNA, 22 nt, Human
cugaggcagcggcagcgccuac

SEQ ID NO: 140661 - RNA, 18 nt, Human
cuguagguugccuguuca

SEQ ID NO: 140662 - RNA, 22 nt, Human
gaaagagcaggaaaaugcaaug

SEQ ID NO: 140663 - RNA, 20 nt, Human
gaggggagugaugaaggugc

SEQ ID NO: 140664 - RNA, 21 nt, Human
gaguucuuuguagauucugga

SEQ ID NO: 140665 - RNA, 18 nt, Human
gcaagccugguccaggug

SEQ ID NO: 140666 - RNA, 19 nt, Human
gcccagcccccucggcuga

SEQ ID NO: 140667 - RNA, 18 nt, Human
gcgcacaacagaugggua

SEQ ID NO: 140668 - RNA, 22 nt, Human
ggagacggagucucggaaaaaa

SEQ ID NO: 140669 - RNA, 28 nt, Human
ggggagaaccgcugggggucaggagccu

SEQ ID NO: 140670 - RNA, 18 nt, Human
ggggagugaugaaggugc

SEQ ID NO: 140671 - RNA, 22 nt, Human
uaaaaucacuccagacacacaa

SEQ ID NO: 140672 - RNA, 21 nt, Human
uaaaccucccccgaacaccau

SEQ ID NO: 140673 - RNA, 23 nt, Human
uaaguaagaacaugcucuacugg

SEQ ID NO: 140674 - RNA, 21 nt, Human
uagauucuggauauuagcccu

SEQ ID NO: 140675 - RNA, 21 nt, Human
uaguacaugcagggcugugca

SEQ ID NO: 140676 - RNA, 23 nt, Human
uaucaggauaaacagaaacaaac

SEQ ID NO: 140677 - RNA, 19 nt, Human
ucagaaaaacccgagcucc

SEQ ID NO: 140678 - RNA, 18 nt, Human
ucauuuucaugcacauuc

SEQ ID NO: 140679 - RNA, 19 nt, Human
uccaagguaaacgaaaacu

SEQ ID NO: 140680 - RNA, 20 nt, Human
uccaagguaaacgaaaacuc

SEQ ID NO: 140681 - RNA, 22 nt, Human
uccagacacacaacaacagaga

SEQ ID NO: 140682 - RNA, 20 nt, Human
ucccaaaggauaaaaaagcu

SEQ ID NO: 140683 - RNA, 21 nt, Human
ucccaaaggauaaaaaagcuc

SEQ ID NO: 140684 - RNA, 23 nt, Human
ucccaccggcucuggcuccccuc

SEQ ID NO: 140685 - RNA, 18 nt, Human
uccccgccggagcagggg

SEQ ID NO: 140686 - RNA, 26 nt, Human
ucucggaaaaaaaaaaaaaggcaaau

SEQ ID NO: 140687 - RNA, 21 nt, Human
ucugugccugagcuuccucug

SEQ ID NO: 140688 - RNA, 25 nt, Human
ucuguguccggcuccucugacagug

SEQ ID NO: 140689 - RNA, 18 nt, Human
ugaaagagcaggaaaaug

SEQ ID NO: 140690 - RNA, 23 nt, Human
ugcaauagccacacagcucagaa

SEQ ID NO: 140691 - RNA, 23 nt, Human
ugcacauucauucaugacaugag

SEQ ID NO: 140692 - RNA, 19 nt, Human
ugcccugaggggagugaug

SEQ ID NO: 140693 - RNA, 21 nt, Human
ugccucugggggaagaccuug

SEQ ID NO: 140694 - RNA, 19 nt, Human
uggugcuuuuucuuuucuc

SEQ ID NO: 140695 - RNA, 26 nt, Human
uggugcuuuuucuuuucucuuuuuuc

SEQ ID NO: 140696 - RNA, 20 nt, Human
uuaaaggacaucuauaguua

SEQ ID NO: 140697 - RNA, 22 nt, Human
uuaggccauuuuacaacaccau

SEQ ID NO: 140698 - RNA, 19 nt, Human
uuccccgccggagcagggg

SEQ ID NO: 140699 - RNA, 19 nt, Human
uuccucuguguccggcucc

SEQ ID NO: 140700 - RNA, 24 nt, Human
uucuuuguagauucuggauauuag

SEQ ID NO: 140701 - RNA, 20 nt, Human
uugccuguucacucugaugg

SEQ ID NO: 140702 - RNA, 24 nt, Human
uuuuuuguuuguuuguuuuuggag

SEQ ID NO: 140703 - RNA, 18 nt, Human
uuuuuuuuuuuuuuuuug

SEQ ID NO: 140704 - RNA, 26 nt, Human
uuuuuuuuuuuuuuuuuggugcuuuu

SEQ ID NO: 140705 - RNA, 27 nt, Human
uuuuuuuuuuuuuuuuuggugcuuuuu

SEQ ID NO: 140706 - RNA, 22 nt, Human
uuuuuuuuuuuuuuuuuuguuu

SEQ ID NO: 140707 - RNA, 24 nt, Human
uuuuuuuuuuuuuuuuuuuuuggg

SEQ ID NO: 140708 - RNA, 19 nt, Human
aaccuggcuuuccaggugg

SEQ ID NO: 140709 - RNA, 22 nt, Human
acacuuuauuguuagcuguucu

SEQ ID NO: 140710 - RNA, 18 nt, Human
agacaacgcccauguccc

SEQ ID NO: 140711 - RNA, 23 nt, Human
ccaaccccgcgcugucaccgcgc

SEQ ID NO: 140712 - RNA, 20 nt, Human
ccccugggucccacgccgcc

SEQ ID NO: 140713 - RNA, 22 nt, Human
cccugggucccacgccgccaac

SEQ ID NO: 140714 - RNA, 19 nt, Human
ccgcgcugucaccgcgcgc

SEQ ID NO: 140715 - RNA, 20 nt, Human
cgcccccugggucccacgcc

SEQ ID NO: 140716 - RNA, 19 nt, Human
cuccucaggccucgggcug

SEQ ID NO: 140717 - RNA, 24 nt, Human
gccaaccccgcgcugucaccgcgc

SEQ ID NO: 140718 - RNA, 21 nt, Human
gccucgggcugcugcugccuc

SEQ ID NO: 140719 - RNA, 21 nt, Human
uggccagacaacgcccauguc

SEQ ID NO: 140720 - RNA, 25 nt, Human
uggccagacaacgcccaugucccaa

SEQ ID NO: 140721 - RNA, 19 nt, Human
aaaacacaaaugguagaca

SEQ ID NO: 140722 - RNA, 21 nt, Human
aaacaacaacaacaaaaauag

SEQ ID NO: 140723 - RNA, 21 nt, Human
aagguggguggcacuaagcca

SEQ ID NO: 140724 - RNA, 19 nt, Human
aauggcagaucccuuggug

SEQ ID NO: 140725 - RNA, 22 nt, Human
acagucagcuccaauguucccu

SEQ ID NO: 140726 - RNA, 25 nt, Human
accuucuccagacuguccucugcug

SEQ ID NO: 140727 - RNA, 21 nt, Human
agauuguggggaugaggagug

SEQ ID NO: 140728 - RNA, 20 nt, Human
agcuacaggcauggaagccc

SEQ ID NO: 140729 - RNA, 18 nt, Human
aggcauggaagcccaacc

SEQ ID NO: 140730 - RNA, 18 nt, Human
aggcccaauccuagacgg

SEQ ID NO: 140731 - RNA, 21 nt, Human
agguaaucaguuaccaagaac

SEQ ID NO: 140732 - RNA, 19 nt, Human
aggucaggccagccagcag

SEQ ID NO: 140733 - RNA, 21 nt, Human
aggugggugggauuauacaaa

SEQ ID NO: 140734 - RNA, 23 nt, Human
agucuaggcacuugaaauauuau

SEQ ID NO: 140735 - RNA, 18 nt, Human
aucaguuaccaagaacag

SEQ ID NO: 140736 - RNA, 18 nt, Human
augaggggaagugggguu

SEQ ID NO: 140737 - RNA, 21 nt, Human
caaaacacaaaugguagacaa

SEQ ID NO: 140738 - RNA, 23 nt, Human
caaaacacaaaugguagacaaaa

SEQ ID NO: 140739 - RNA, 19 nt, Human
caaagcaauuaugggaggc

SEQ ID NO: 140740 - RNA, 18 nt, Human
caaaguaacagucuaggc

SEQ ID NO: 140741 - RNA, 18 nt, Human
caccagagcugggcggcg

SEQ ID NO: 140742 - RNA, 20 nt, Human
cagaaaggaccaugacagca

SEQ ID NO: 140743 - RNA, 18 nt, Human
cagaucccuuggugguac

SEQ ID NO: 140744 - RNA, 23 nt, Human
cagcauaccuucaucguuuuggu

SEQ ID NO: 140745 - RNA, 20 nt, Human
cagucugaaaucaccuugug

SEQ ID NO: 140746 - RNA, 26 nt, Human
caguuaccaagaacagucagcuccaa

SEQ ID NO: 140747 - RNA, 21 nt, Human
caguucucaggcuugugguau

SEQ ID NO: 140748 - RNA, 24 nt, Human
caucagcaccuugggcuuucaaaa

SEQ ID NO: 140749 - RNA, 19 nt, Human
ccacgcuguggccuggggc

SEQ ID NO: 140750 - RNA, 18 nt, Human
ccagaaaggaccaugaca

SEQ ID NO: 140751 - RNA, 20 nt, Human
ccauccuagcuuuguggcaa

SEQ ID NO: 140752 - RNA, 22 nt, Human
ccccugcauggaguagcaccag

SEQ ID NO: 140753 - RNA, 21 nt, Human
cccgcgcgccuaggucaggcc

SEQ ID NO: 140754 - RNA, 19 nt, Human
cccgcgcggccgcccgacc

SEQ ID NO: 140755 - RNA, 22 nt, Human
cccgcgcggccgcccgaccccg

SEQ ID NO: 140756 - RNA, 19 nt, Human
ccgccgggcaccgucugcc

SEQ ID NO: 140757 - RNA, 18 nt, Human
ccugaccauacagagcuc

SEQ ID NO: 140758 - RNA, 18 nt, Human
ccuucuucuucuucuuuu

SEQ ID NO: 140759 - RNA, 24 nt, Human
cggcggccacugggcgcuggcacc

SEQ ID NO: 140760 - RNA, 19 nt, Human
cucuccuucuucuucuucu

SEQ ID NO: 140761 - RNA, 18 nt, Human
cugcacugaccccugcau

SEQ ID NO: 140762 - RNA, 18 nt, Human
cugcagucugaaaucacc

SEQ ID NO: 140763 - RNA, 19 nt, Human
cugcugcacugaccccugc

SEQ ID NO: 140764 - RNA, 22 nt, Human
cuguccucugcugcacugaccc

SEQ ID NO: 140765 - RNA, 23 nt, Human
cuguccucugcugcacugacccc

SEQ ID NO: 140766 - RNA, 22 nt, Human
cuguggccuggggccggggucc

SEQ ID NO: 140767 - RNA, 18 nt, Human
cuuccccaccuccaaccu

SEQ ID NO: 140768 - RNA, 20 nt, Human
cuuugugacuagauggaagu

SEQ ID NO: 140769 - RNA, 19 nt, Human
gaaaucaccuugugucuuc

SEQ ID NO: 140770 - RNA, 24 nt, Human
gaggcauuuacaaacaacaacaac

SEQ ID NO: 140771 - RNA, 24 nt, Human
gaguggcucugaccaaguuaaccc

SEQ ID NO: 140772 - RNA, 26 nt, Human
gcaccagaaacuuccagaaaggacca

SEQ ID NO: 140773 - RNA, 23 nt, Human
gccagccagcagcguggcccgcg

SEQ ID NO: 140774 - RNA, 18 nt, Human
gccgggacccaggcgcag

SEQ ID NO: 140775 - RNA, 22 nt, Human
gcggccacugggcgcuggcacc

SEQ ID NO: 140776 - RNA, 21 nt, Human
gcucuccuucuucuucuucuu

SEQ ID NO: 140777 - RNA, 24 nt, Human
ggcaccagaaacuuccagaaagga

SEQ ID NO: 140778 - RNA, 24 nt, Human
ggcacuaagccagauuguggggau

SEQ ID NO: 140779 - RNA, 22 nt, Human
gggaagugggguuugguggagg

SEQ ID NO: 140780 - RNA, 23 nt, Human
gggcgcuggcaccagagcugggc

SEQ ID NO: 140781 - RNA, 19 nt, Human
uaacauacauagaauaaaa

SEQ ID NO: 140782 - RNA, 19 nt, Human
uaaccccuacauccugacc

SEQ ID NO: 140783 - RNA, 19 nt, Human
uacauccugaccauacaga

SEQ ID NO: 140784 - RNA, 18 nt, Human
uacuacagaugggucaca

SEQ ID NO: 140785 - RNA, 19 nt, Human
uacuacagaugggucacag

SEQ ID NO: 140786 - RNA, 27 nt, Human
uagaagucccaaaauucaguucucagg

SEQ ID NO: 140787 - RNA, 20 nt, Human
ucagaagggcaugaaggucc

SEQ ID NO: 140788 - RNA, 24 nt, Human
ucagccuuuugcuuugcuaauacc

SEQ ID NO: 140789 - RNA, 18 nt, Human
uccagaaaggaccaugac

SEQ ID NO: 140790 - RNA, 21 nt, Human
ucccacgcuguggccuggggc

SEQ ID NO: 140791 - RNA, 20 nt, Human
uccccaccuccaaccuucuc

SEQ ID NO: 140792 - RNA, 21 nt, Human
ucugcagaaauguagacagac

SEQ ID NO: 140793 - RNA, 21 nt, Human
ucuuugugacuagauggaagu

SEQ ID NO: 140794 - RNA, 25 nt, Human
ugaccacggaagaucugcagaaaug

SEQ ID NO: 140795 - RNA, 22 nt, Human
ugaccauacagagcucccgcag

SEQ ID NO: 140796 - RNA, 23 nt, Human
ugagacuuggcagggagaggaca

SEQ ID NO: 140797 - RNA, 20 nt, Human
ugaggggaagugggguuugg

SEQ ID NO: 140798 - RNA, 20 nt, Human
ugaggugggugggauuauac

SEQ ID NO: 140799 - RNA, 26 nt, Human
ugaggugggugggauuauacaaagcc

SEQ ID NO: 140800 - RNA, 18 nt, Human
ugcacugaccccugcaug

SEQ ID NO: 140801 - RNA, 23 nt, Human
ugcauggaguagcaccagaagaa

SEQ ID NO: 140802 - RNA, 18 nt, Human
ugcugcacugaccccugc

SEQ ID NO: 140803 - RNA, 18 nt, Human
uggcaaagcaauuauggg

SEQ ID NO: 140804 - RNA, 24 nt, Human
uggggaugaggaguggagggcccc

SEQ ID NO: 140805 - RNA, 20 nt, Human
ugguggaggggaaucagaag

SEQ ID NO: 140806 - RNA, 18 nt, Human
uuauacaaagccuucccc

SEQ ID NO: 140807 - RNA, 22 nt, Human
uuauuuuuccaucuggguagaa

SEQ ID NO: 140808 - RNA, 19 nt, Human
uuccaguucacaaaucuuu

SEQ ID NO: 140809 - RNA, 18 nt, Human
uucuugagugucuugucu

SEQ ID NO: 140810 - RNA, 23 nt, Human
uuuacaaacaacaacaacaaaaa

SEQ ID NO: 140811 - RNA, 21 nt, Human
uuucacaguuaacucaucaaa

SEQ ID NO: 140812 - RNA, 20 nt, Human
uuugcuaauaccuucuccag

SEQ ID NO: 140813 - RNA, 23 nt, Human
uuuggcacuugaaggcucuggua

SEQ ID NO: 140814 - RNA, 21 nt, Human
uuuuucagucaaagauccugg

SEQ ID NO: 140815 - RNA, 18 nt, Human
aagcaagugucucucuua

SEQ ID NO: 140816 - RNA, 22 nt, Human
acugcgucccagacccugcgcc

SEQ ID NO: 140817 - RNA, 22 nt, Human
agaccccuucccuguagagccu

SEQ ID NO: 140818 - RNA, 23 nt, Human
aggaggccugggccacagccugc

SEQ ID NO: 140819 - RNA, 18 nt, Human
cacucccaacugcguccc

SEQ ID NO: 140820 - RNA, 18 nt, Human
cagcaggcggcaacuucc

SEQ ID NO: 140821 - RNA, 23 nt, Human
ccccagggggacagcaaggaccc

SEQ ID NO: 140822 - RNA, 18 nt, Human
ccugggccuggcagcagg

SEQ ID NO: 140823 - RNA, 23 nt, Human
cuccugggccuggcagcaggcgg

SEQ ID NO: 140824 - RNA, 19 nt, Human
cugcgucccagacccugcg

SEQ ID NO: 140825 - RNA, 22 nt, Human
cugcugcuccugcggcucucag

SEQ ID NO: 140826 - RNA, 25 nt, Human
cuggcagcaggcggcaacuuccucu

SEQ ID NO: 140827 - RNA, 21 nt, Human
gacagggccugucacccagga

SEQ ID NO: 140828 - RNA, 18 nt, Human
gcccagcuccuccugggc

SEQ ID NO: 140829 - RNA, 23 nt, Human
gcccagcuccuccugggccuggc

SEQ ID NO: 140830 - RNA, 20 nt, Human
ggcccagcuccuccugggcc

SEQ ID NO: 140831 - RNA, 21 nt, Human
ggcccccucggcuggcucagg

SEQ ID NO: 140832 - RNA, 22 nt, Human
gggacagcaaggaccgucuggc

SEQ ID NO: 140833 - RNA, 22 nt, Human
gguagggagugaggcagccgcc

SEQ ID NO: 140834 - RNA, 19 nt, Human
uagagaccuccguuaaagg

SEQ ID NO: 140835 - RNA, 22 nt, Human
ucccaacugcgucccagacccu

SEQ ID NO: 140836 - RNA, 22 nt, Human
ucccagacccugcgcccggcuu

SEQ ID NO: 140837 - RNA, 18 nt, Human
ucuccccagggggacagc

SEQ ID NO: 140838 - RNA, 21 nt, Human
ucucucugaggccuagagacc

SEQ ID NO: 140839 - RNA, 23 nt, Human
ugcgcccggcuucaguggggcuu

SEQ ID NO: 140840 - RNA, 24 nt, Human
uggcucagguagggagugaggcag

SEQ ID NO: 140841 - RNA, 20 nt, Human
uguagagccuucuccgauaa

SEQ ID NO: 140842 - RNA, 22 nt, Human
ugugggauggccauccaggcug

SEQ ID NO: 140843 - RNA, 20 nt, Human
uucccuguagagccuucucc

SEQ ID NO: 140844 - RNA, 21 nt, Human
uugcaggcccagcuccuccug

SEQ ID NO: 140845 - RNA, 22 nt, Human
aacgccccaacacacauacaga

SEQ ID NO: 140846 - RNA, 18 nt, Human
acacugcccccccaccau

SEQ ID NO: 140847 - RNA, 22 nt, Human
acagugggcagaacccccggga

SEQ ID NO: 140848 - RNA, 22 nt, Human
accuccugcaaggcauuugcca

SEQ ID NO: 140849 - RNA, 19 nt, Human
agcugcggccacggcguca

SEQ ID NO: 140850 - RNA, 20 nt, Human
aggcagccagaaauaggaag

SEQ ID NO: 140851 - RNA, 25 nt, Human
aggcagccagaaauaggaagaacag

SEQ ID NO: 140852 - RNA, 25 nt, Human
caaaagaggaggagguaugggagua

SEQ ID NO: 140853 - RNA, 30 nt, Human
caacacacauacagacaugcacacacauag

SEQ ID NO: 140854 - RNA, 24 nt, Human
caaucugauccuuguuuuccucuu

SEQ ID NO: 140855 - RNA, 22 nt, Human
cacacauacagacaugcacaca

SEQ ID NO: 140856 - RNA, 27 nt, Human
cagagcccgggacugcaacuccgaggg

SEQ ID NO: 140857 - RNA, 24 nt, Human
caggucagcuugucuucugagauu

SEQ ID NO: 140858 - RNA, 24 nt, Human
cauacagacaugcacacacauagu

SEQ ID NO: 140859 - RNA, 21 nt, Human
caugcacacacauaguacuug

SEQ ID NO: 140860 - RNA, 20 nt, Human
ccaacacacauacagacaug

SEQ ID NO: 140861 - RNA, 20 nt, Human
ccggccuggcugccagcugg

SEQ ID NO: 140862 - RNA, 18 nt, Human
ccuuacacucaacgcccc

SEQ ID NO: 140863 - RNA, 22 nt, Human
ccuuguuuuccucuuccagcug

SEQ ID NO: 140864 - RNA, 22 nt, Human
cuaagaugccagcauccaugcu

SEQ ID NO: 140865 - RNA, 21 nt, Human
cuccccuacuucucacucuag

SEQ ID NO: 140866 - RNA, 23 nt, Human
cugagcccacacauggugacuga

SEQ ID NO: 140867 - RNA, 21 nt, Human
gaagaacagaggugaggugug

SEQ ID NO: 140868 - RNA, 20 nt, Human
gagcccaaaagaggaggagg

SEQ ID NO: 140869 - RNA, 19 nt, Human
gccagaaauaggaagaaca

SEQ ID NO: 140870 - RNA, 18 nt, Human
ggaagaacagaggugagg

SEQ ID NO: 140871 - RNA, 20 nt, Human
ggagaagagggcugaggagc

SEQ ID NO: 140872 - RNA, 24 nt, Human
ggagacccuucauggacuuuaccu

SEQ ID NO: 140873 - RNA, 24 nt, Human
ggagcccucucucguccggugccu

SEQ ID NO: 140874 - RNA, 25 nt, Human
ggaggagguaugggaguagggaggg

SEQ ID NO: 140875 - RNA, 20 nt, Human
ggaguagggaggguucuaag

SEQ ID NO: 140876 - RNA, 21 nt, Human
ggggagcccaaaagaggagga

SEQ ID NO: 140877 - RNA, 22 nt, Human
guagcuccccuacuucucacuc

SEQ ID NO: 140878 - RNA, 23 nt, Human
uacagacaugcacacacauagua

SEQ ID NO: 140879 - RNA, 19 nt, Human
uagacacugcccccccacc

SEQ ID NO: 140880 - RNA, 21 nt, Human
uagacacugcccccccaccau

SEQ ID NO: 140881 - RNA, 21 nt, Human
uaggaagaacagaggugaggu

SEQ ID NO: 140882 - RNA, 19 nt, Human
uagucccuagacacugccc

SEQ ID NO: 140883 - RNA, 18 nt, Human
uaugggaguagggagggu

SEQ ID NO: 140884 - RNA, 19 nt, Human
uccccuacuucucacucua

SEQ ID NO: 140885 - RNA, 21 nt, Human
ucccuagacacugccccccca

SEQ ID NO: 140886 - RNA, 24 nt, Human
ucccugagcccacacauggugacu

SEQ ID NO: 140887 - RNA, 23 nt, Human
ucuccaaucugauccuuguuuuc

SEQ ID NO: 140888 - RNA, 19 nt, Human
ucucucguccggugccucu

SEQ ID NO: 140889 - RNA, 20 nt, Human
ucugacaguggggagcccaa

SEQ ID NO: 140890 - RNA, 19 nt, Human
ucugauccuuguuuuccuc

SEQ ID NO: 140891 - RNA, 27 nt, Human
ucuuccagcugcggccacggcgucacc

SEQ ID NO: 140892 - RNA, 21 nt, Human
ugacuauggccaccuggaaca

SEQ ID NO: 140893 - RNA, 22 nt, Human
ugagcccacacauggugacuga

SEQ ID NO: 140894 - RNA, 20 nt, Human
ugaugaaagaacgugcuuaa

SEQ ID NO: 140895 - RNA, 20 nt, Human
ugcucccacugcauccuuac

SEQ ID NO: 140896 - RNA, 19 nt, Human
uggagcagggagaagaggg

SEQ ID NO: 140897 - RNA, 24 nt, Human
uguuuuccucuuccagcugcggcc

SEQ ID NO: 140898 - RNA, 22 nt, Human
uuaaggcagaaaagugauuuau

SEQ ID NO: 140899 - RNA, 21 nt, Human
uuaggcagggcccugcuuggg

SEQ ID NO: 140900 - RNA, 25 nt, Human
uugcauacauagguauuggucagag

SEQ ID NO: 140901 - RNA, 22 nt, Human
uugugguguuagacuggggugc

SEQ ID NO: 140902 - RNA, 19 nt, Human
uuuggcccagcacucugca

SEQ ID NO: 140903 - RNA, 24 nt, Human
aaaaggaaaagaaaaguuaaagag

SEQ ID NO: 140904 - RNA, 25 nt, Human
aaacaacccaaacguccaucaacag

SEQ ID NO: 140905 - RNA, 21 nt, Human
aaacagguggacuuauaauca

SEQ ID NO: 140906 - RNA, 18 nt, Human
aaagaggccagucucaaa

SEQ ID NO: 140907 - RNA, 19 nt, Human
aagaauaaacaaacugugg

SEQ ID NO: 140908 - RNA, 21 nt, Human
aagagaaggcaggauacugga

SEQ ID NO: 140909 - RNA, 20 nt, Human
aagggcaggaagucuggagg

SEQ ID NO: 140910 - RNA, 20 nt, Human
aauuguagaacauagucucc

SEQ ID NO: 140911 - RNA, 22 nt, Human
acaacccaaacguccaucaaca

SEQ ID NO: 140912 - RNA, 22 nt, Human
accacuccaguagaugcagaga

SEQ ID NO: 140913 - RNA, 20 nt, Human
acgcaucgauuuuguggaag

SEQ ID NO: 140914 - RNA, 22 nt, Human
acucagcaaugaaaaggaacaa

SEQ ID NO: 140915 - RNA, 20 nt, Human
agagaggggccugcccaggg

SEQ ID NO: 140916 - RNA, 21 nt, Human
agcaaauaccaaagcaacgca

SEQ ID NO: 140917 - RNA, 22 nt, Human
aggaaagagcccgaugaaaaag

SEQ ID NO: 140918 - RNA, 23 nt, Human
aggaaagagcccgaugaaaaagg

SEQ ID NO: 140919 - RNA, 23 nt, Human
aggaucccagccuccuccucccu

SEQ ID NO: 140920 - RNA, 19 nt, Human
aggcaggauacuggaagca

SEQ ID NO: 140921 - RNA, 24 nt, Human
aggcaggauacuggaagcagcagc

SEQ ID NO: 140922 - RNA, 21 nt, Human
agguucuaagcaucacagcuu

SEQ ID NO: 140923 - RNA, 25 nt, Human
auagaauacuacucagcaaugaaaa

SEQ ID NO: 140924 - RNA, 22 nt, Human
aucccagccuccuccucccuca

SEQ ID NO: 140925 - RNA, 26 nt, Human
aucccagccuccuccucccucaaaug

SEQ ID NO: 140926 - RNA, 21 nt, Human
aucggagacaagcacuauugu

SEQ ID NO: 140927 - RNA, 22 nt, Human
caaaauuagaaacaacccaaac

SEQ ID NO: 140928 - RNA, 24 nt, Human
caaacguccaucaacagaagaaua

SEQ ID NO: 140929 - RNA, 18 nt, Human
caagcaaauaccaaagca

SEQ ID NO: 140930 - RNA, 22 nt, Human
caagcaaauaccaaagcaacgc

SEQ ID NO: 140931 - RNA, 23 nt, Human
caagcaaauaccaaagcaacgca

SEQ ID NO: 140932 - RNA, 22 nt, Human
caauagaauacuacucagcaau

SEQ ID NO: 140933 - RNA, 23 nt, Human
caccuuucucucuggguccuugg

SEQ ID NO: 140934 - RNA, 24 nt, Human
cagaagaauaaacaaacuguggua

SEQ ID NO: 140935 - RNA, 23 nt, Human
cagagcccagggaccacuccgag

SEQ ID NO: 140936 - RNA, 28 nt, Human
cagaggaucccagccuccuccucccuca

SEQ ID NO: 140937 - RNA, 28 nt, Human
cagaugucuucuuuccucuuaaaaucuu

SEQ ID NO: 140938 - RNA, 21 nt, Human
cagcagccagggaggacaggc

SEQ ID NO: 140939 - RNA, 18 nt, Human
cagcagggcugggcaacu

SEQ ID NO: 140940 - RNA, 20 nt, Human
cagccuccuccucccucaaa

SEQ ID NO: 140941 - RNA, 24 nt, Human
cagcuuuuuaggaaagagcccgau

SEQ ID NO: 140942 - RNA, 21 nt, Human
ccccagagcccagggaccacu

SEQ ID NO: 140943 - RNA, 22 nt, Human
ccccagagcccagggaccacuc

SEQ ID NO: 140944 - RNA, 19 nt, Human
cccuccagcugaggccuaa

SEQ ID NO: 140945 - RNA, 23 nt, Human
ccuccacacuugucacaagcagg

SEQ ID NO: 140946 - RNA, 18 nt, Human
ccuccuccucccucaaau

SEQ ID NO: 140947 - RNA, 24 nt, Human
ccugggcaaacuaggacagcuggu

SEQ ID NO: 140948 - RNA, 28 nt, Human
cgccgauccucagccuccccggcugcac

SEQ ID NO: 140949 - RNA, 23 nt, Human
cuaagcaucacagcuucugcacu

SEQ ID NO: 140950 - RNA, 24 nt, Human
cuaggacagcuggucacccaacuc

SEQ ID NO: 140951 - RNA, 18 nt, Human
cucacucuuccagcuccc

SEQ ID NO: 140952 - RNA, 20 nt, Human
cucacucuuccagcuccgcc

SEQ ID NO: 140953 - RNA, 18 nt, Human
cuccuccccacuuugcuu

SEQ ID NO: 140954 - RNA, 19 nt, Human
cugauacacacaacagcau

SEQ ID NO: 140955 - RNA, 20 nt, Human
cugcccaggggucagggcag

SEQ ID NO: 140956 - RNA, 19 nt, Human
cuggugcccuccucaaagu

SEQ ID NO: 140957 - RNA, 24 nt, Human
cuuccagcuccgccgauccuccuu

SEQ ID NO: 140958 - RNA, 20 nt, Human
cuuuggggacgggaaggggu

SEQ ID NO: 140959 - RNA, 19 nt, Human
gaaaagaaaaguuaaagag

SEQ ID NO: 140960 - RNA, 21 nt, Human
gaagcagcagccagggaggac

SEQ ID NO: 140961 - RNA, 22 nt, Human
gaagggguagaaguagggcugc

SEQ ID NO: 140962 - RNA, 22 nt, Human
gagcuaggggagacgaagugga

SEQ ID NO: 140963 - RNA, 22 nt, Human
gagcuggggugaggaguggucu

SEQ ID NO: 140964 - RNA, 24 nt, Human
gauacuggaagcagcagccaggga

SEQ ID NO: 140965 - RNA, 18 nt, Human
gcaguggguaucacuggu

SEQ ID NO: 140966 - RNA, 22 nt, Human
gccugggacugaugggguuucc

SEQ ID NO: 140967 - RNA, 25 nt, Human
ggaccaaaacuggauuugguagaaa

SEQ ID NO: 140968 - RNA, 23 nt, Human
ggagacagaguugaggcagucgg

SEQ ID NO: 140969 - RNA, 20 nt, Human
gggacugucuccuccccacu

SEQ ID NO: 140970 - RNA, 20 nt, Human
gggaggggcucugcagcccu

SEQ ID NO: 140971 - RNA, 24 nt, Human
gggcaggaagucuggagggcugca

SEQ ID NO: 140972 - RNA, 27 nt, Human
gggcaggaagucuggagggcugcagga

SEQ ID NO: 140973 - RNA, 18 nt, Human
gggcuggggaggcaucuu

SEQ ID NO: 140974 - RNA, 18 nt, Human
guggaaggggguacaagg

SEQ ID NO: 140975 - RNA, 21 nt, Human
uacaaggggaguuucuggggu

SEQ ID NO: 140976 - RNA, 19 nt, Human
uaccuuuucaccuccacac

SEQ ID NO: 140977 - RNA, 19 nt, Human
uagaaaucacaucaguggu

SEQ ID NO: 140978 - RNA, 18 nt, Human
uaucagggcuggggaggc

SEQ ID NO: 140979 - RNA, 19 nt, Human
uaucuggcagagaggcugg

SEQ ID NO: 140980 - RNA, 21 nt, Human
uauggugaguaaaagaggcca

SEQ ID NO: 140981 - RNA, 21 nt, Human
ucaacagaagaauaaacaaac

SEQ ID NO: 140982 - RNA, 21 nt, Human
ucaguccaagcaaauaccaaa

SEQ ID NO: 140983 - RNA, 20 nt, Human
uccaagcaaauaccaaaggg

SEQ ID NO: 140984 - RNA, 22 nt, Human
ucucuacaauagaauacuacuc

SEQ ID NO: 140985 - RNA, 21 nt, Human
ucugcacugggcucugaggag

SEQ ID NO: 140986 - RNA, 21 nt, Human
ucuugccuucacccucacucu

SEQ ID NO: 140987 - RNA, 24 nt, Human
ugaaaaaggaaaagaaaaguuaaa

SEQ ID NO: 140988 - RNA, 23 nt, Human
ugaaaaggaacaaacugcugaua

SEQ ID NO: 140989 - RNA, 18 nt, Human
ugagcuggggugaggagu

SEQ ID NO: 140990 - RNA, 19 nt, Human
ugauaaacagguggacuua

SEQ ID NO: 140991 - RNA, 23 nt, Human
ugauggagagauugccagcaggg

SEQ ID NO: 140992 - RNA, 25 nt, Human
ugcaauuguagaacauagucuccug

SEQ ID NO: 140993 - RNA, 18 nt, Human
ugccacgccugccauggc

SEQ ID NO: 140994 - RNA, 20 nt, Human
ugccacgccugccauggcuu

SEQ ID NO: 140995 - RNA, 24 nt, Human
ugccacgccugccauggcuugagc

SEQ ID NO: 140996 - RNA, 18 nt, Human
ugccauggcuugagcugg

SEQ ID NO: 140997 - RNA, 26 nt, Human
ugccuucacccucacucuuccagcuc

SEQ ID NO: 140998 - RNA, 21 nt, Human
ugcugauacacacaacagcau

SEQ ID NO: 140999 - RNA, 18 nt, Human
uggaagcagcagccaggg

SEQ ID NO: 141000 - RNA, 24 nt, Human
uggaauccuucagccccagagccc

SEQ ID NO: 141001 - RNA, 19 nt, Human
uggagacagaguugaggca

SEQ ID NO: 141002 - RNA, 18 nt, Human
uggggaggcaucuuuguu

SEQ ID NO: 141003 - RNA, 25 nt, Human
uggguccuuggucucgccacugugc

SEQ ID NO: 141004 - RNA, 23 nt, Human
ugguagaaaucacaucagugguu

SEQ ID NO: 141005 - RNA, 21 nt, Human
ugguugcuucuaggagcuagg

SEQ ID NO: 141006 - RNA, 18 nt, Human
uuaguaggaccaaaacug

SEQ ID NO: 141007 - RNA, 20 nt, Human
uuaucuucuuugggagaucc

SEQ ID NO: 141008 - RNA, 23 nt, Human
uucugugcucuacuucuugccuu

SEQ ID NO: 141009 - RNA, 25 nt, Human
uuuuuuuuuuuuacaagaacacuca

SEQ ID NO: 141010 - RNA, 23 nt, Human
uuuuuuuuuuuuuuuuuuacaag

SEQ ID NO: 141011 - RNA, 21 nt, Human
aaaaaacaggggcgagcaaaa

SEQ ID NO: 141012 - RNA, 24 nt, Human
aaaaacaggggcgagcaaaaagaa

SEQ ID NO: 141013 - RNA, 25 nt, Human
aaaaagaaaccggaucacacacuga

SEQ ID NO: 141014 - RNA, 21 nt, Human
aaacccagaggaacucgggug

SEQ ID NO: 141015 - RNA, 21 nt, Human
acgcggggcuccgggcuccuc

SEQ ID NO: 141016 - RNA, 22 nt, Human
acgcggggcuccgggcuccucg

SEQ ID NO: 141017 - RNA, 24 nt, Human
acugguauuuuccaucagugcuga

SEQ ID NO: 141018 - RNA, 23 nt, Human
agaaaugccauaauuuauuccau

SEQ ID NO: 141019 - RNA, 21 nt, Human
agcuagacccccgggucucuc

SEQ ID NO: 141020 - RNA, 23 nt, Human
agucaucaccauaacugcuuaga

SEQ ID NO: 141021 - RNA, 19 nt, Human
cacagcccaaauguccuuc

SEQ ID NO: 141022 - RNA, 23 nt, Human
caccauaacugcuuagaaaccca

SEQ ID NO: 141023 - RNA, 24 nt, Human
cacugaguccuuucucuucugccc

SEQ ID NO: 141024 - RNA, 24 nt, Human
cagcccaaauguccuucgcagcga

SEQ ID NO: 141025 - RNA, 22 nt, Human
cagcccucucgagccccuccca

SEQ ID NO: 141026 - RNA, 21 nt, Human
cagugcugaaaacaaaccugc

SEQ ID NO: 141027 - RNA, 20 nt, Human
cauaacugcuuagaaaccca

SEQ ID NO: 141028 - RNA, 19 nt, Human
caucagugcugaaaacaaa

SEQ ID NO: 141029 - RNA, 21 nt, Human
ccagcccucucgagccccucc

SEQ ID NO: 141030 - RNA, 24 nt, Human
ccgacugccccuccgacccgcguc

SEQ ID NO: 141031 - RNA, 21 nt, Human
cgacugccccuccgacccgcg

SEQ ID NO: 141032 - RNA, 21 nt, Human
cgaggaaaagcuagacccccg

SEQ ID NO: 141033 - RNA, 23 nt, Human
cgcacacacagcccaaauguccu

SEQ ID NO: 141034 - RNA, 26 nt, Human
cucucgagccccucccagaguuauug

SEQ ID NO: 141035 - RNA, 22 nt, Human
cucugcgccgaaccaaaagccc

SEQ ID NO: 141036 - RNA, 21 nt, Human
gccggccucagcgcccccagc

SEQ ID NO: 141037 - RNA, 22 nt, Human
gcgcuuuucgaggaaaagcuag

SEQ ID NO: 141038 - RNA, 23 nt, Human
gcggggcuccgggcuccucggcu

SEQ ID NO: 141039 - RNA, 21 nt, Human
gggccaagggcagggcggcgc

SEQ ID NO: 141040 - RNA, 26 nt, Human
gguagguaugucaagcaugaagagau

SEQ ID NO: 141041 - RNA, 21 nt, Human
gguucccccgacugccccucc

SEQ ID NO: 141042 - RNA, 25 nt, Human
guagguaugucaagcaugaagagau

SEQ ID NO: 141043 - RNA, 23 nt, Human
gucauccuuauguaacaaaaugu

SEQ ID NO: 141044 - RNA, 19 nt, Human
gucccaaugggaugugaag

SEQ ID NO: 141045 - RNA, 21 nt, Human
uaagauauauuuacaggauag

SEQ ID NO: 141046 - RNA, 22 nt, Human
uagacaaugacauuugugaagg

SEQ ID NO: 141047 - RNA, 21 nt, Human
uauuugguucuucuaggagua

SEQ ID NO: 141048 - RNA, 23 nt, Human
ugaaguuaaauaaauaaggacca

SEQ ID NO: 141049 - RNA, 21 nt, Human
ugaguccuuucucuucugccc

SEQ ID NO: 141050 - RNA, 19 nt, Human
ugccccuccgacccgcguc

SEQ ID NO: 141051 - RNA, 24 nt, Human
uggcaacuaaaaaaaaacccaaca

SEQ ID NO: 141052 - RNA, 23 nt, Human
ugucuguucucggggccaagggc

SEQ ID NO: 141053 - RNA, 19 nt, Human
ugugaagagccucaccucc

SEQ ID NO: 141054 - RNA, 19 nt, Human
ugugaagagccucaccucc

SEQ ID NO: 141055 - RNA, 20 nt, Human
ugugaagagccucaccuccc

SEQ ID NO: 141056 - RNA, 22 nt, Human
uucgaggaaaagcuagaccccc

SEQ ID NO: 141057 - RNA, 24 nt, Human
uucuucgcgguucccccgacugcc

SEQ ID NO: 141058 - RNA, 26 nt, Human
uugcauuucuccucucaaggagcaug

SEQ ID NO: 141059 - RNA, 23 nt, Human
aaagaaaccugauuagaccugaa

SEQ ID NO: 141060 - RNA, 21 nt, Human
aacagcaaugcaauuuuuccu

SEQ ID NO: 141061 - RNA, 20 nt, Human
aagaaaccugauuagaccug

SEQ ID NO: 141062 - RNA, 24 nt, Human
aagacccuaaacaggaaaagacuc

SEQ ID NO: 141063 - RNA, 22 nt, Human
acaauaaagaaaccugauuaga

SEQ ID NO: 141064 - RNA, 22 nt, Human
acagaacauaacaaaaacacua

SEQ ID NO: 141065 - RNA, 24 nt, Human
acccuaaacaggaaaagacucggc

SEQ ID NO: 141066 - RNA, 20 nt, Human
agaaagaaauacauagaaaa

SEQ ID NO: 141067 - RNA, 21 nt, Human
agaaagaaauacauagaaaaa

SEQ ID NO: 141068 - RNA, 18 nt, Human
agccggccaaaagcgcca

SEQ ID NO: 141069 - RNA, 27 nt, Human
agggaacaauaaagaaaccugauuaga

SEQ ID NO: 141070 - RNA, 23 nt, Human
agggaaguucucaaugcuucagu

SEQ ID NO: 141071 - RNA, 21 nt, Human
caagaagccgcccacccaaug

SEQ ID NO: 141072 - RNA, 23 nt, Human
caauaacagaacauaacaaaaac

SEQ ID NO: 141073 - RNA, 23 nt, Human
caaugccaggauaagacccuaaa

SEQ ID NO: 141074 - RNA, 21 nt, Human
cacccaaugccaagccggcca

SEQ ID NO: 141075 - RNA, 22 nt, Human
cacccaaugccaagccggccaa

SEQ ID NO: 141076 - RNA, 21 nt, Human
cagaaagaaauacauagaaaa

SEQ ID NO: 141077 - RNA, 19 nt, Human
ccaaugccaagccggccaa

SEQ ID NO: 141078 - RNA, 20 nt, Human
cccuaaacaggaaaagacuc

SEQ ID NO: 141079 - RNA, 30 nt, Human
ccuaaacaggaaaagacucggcagccaccu

SEQ ID NO: 141080 - RNA, 23 nt, Human
cgccaguccggcgcccucaaugc

SEQ ID NO: 141081 - RNA, 19 nt, Human
cucggcagccaccuacgcc

SEQ ID NO: 141082 - RNA, 24 nt, Human
cuggaauaacagauuguuuuuccu

SEQ ID NO: 141083 - RNA, 22 nt, Human
gaaaauaaagauggccuuuggg

SEQ ID NO: 141084 - RNA, 20 nt, Human
guuauagaaaauaaagaugg

SEQ ID NO: 141085 - RNA, 19 nt, Human
uaaaauauugucuucuuuu

SEQ ID NO: 141086 - RNA, 20 nt, Human
uaaacacacgcauaucacaa

SEQ ID NO: 141087 - RNA, 19 nt, Human
uaacagaacauaacaaaaa

SEQ ID NO: 141088 - RNA, 26 nt, Human
uaacagauuguuuuuccugcaaugcu

SEQ ID NO: 141089 - RNA, 23 nt, Human
uacauaaacacacgcauaucaca

SEQ ID NO: 141090 - RNA, 24 nt, Human
uacauagaaaaacaagauagaauu

SEQ ID NO: 141091 - RNA, 18 nt, Human
uagaaaaacaagauagaa

SEQ ID NO: 141092 - RNA, 25 nt, Human
uagauuuuaauauaaauuuugaaca

SEQ ID NO: 141093 - RNA, 22 nt, Human
ucagaaagaaauacauagaaaa

SEQ ID NO: 141094 - RNA, 22 nt, Human
ucuguacauaaacacacgcaua

SEQ ID NO: 141095 - RNA, 19 nt, Human
ugcuguaauuacugcaaau

SEQ ID NO: 141096 - RNA, 18 nt, Human
uuagaccugaacuaauua

SEQ ID NO: 141097 - RNA, 20 nt, Human
uuuuuuuuuucuaaagaaau

SEQ ID NO: 141098 - RNA, 19 nt, Human
uuuuuuuuuuuuuuucuaa

SEQ ID NO: 141099 - RNA, 21 nt, Human
aaagagcagacacacccuugg

SEQ ID NO: 141100 - RNA, 24 nt, Human
aaccccugcccacagggcuaggag

SEQ ID NO: 141101 - RNA, 18 nt, Human
aagggcuucaacauggug

SEQ ID NO: 141102 - RNA, 19 nt, Human
aaguguuaaaugucagcuu

SEQ ID NO: 141103 - RNA, 24 nt, Human
agagcagacacacccuugguuccc

SEQ ID NO: 141104 - RNA, 22 nt, Human
agcagaagagcaccaggucgga

SEQ ID NO: 141105 - RNA, 20 nt, Human
aggaggaagcgggggaggaa

SEQ ID NO: 141106 - RNA, 22 nt, Human
aggaggaagcgggggaggaagu

SEQ ID NO: 141107 - RNA, 22 nt, Human
aggcaggcagaggggcaccacc

SEQ ID NO: 141108 - RNA, 20 nt, Human
auaaauauaaagugcuaagu

SEQ ID NO: 141109 - RNA, 25 nt, Human
caacaugacacacccaucacuuccc

SEQ ID NO: 141110 - RNA, 23 nt, Human
caaguccccagcuuccccaggaa

SEQ ID NO: 141111 - RNA, 20 nt, Human
cacacgcaacaugacacacc

SEQ ID NO: 141112 - RNA, 23 nt, Human
cacccaucacuucccaagucccc

SEQ ID NO: 141113 - RNA, 23 nt, Human
caccggugccucuuccucuuccu

SEQ ID NO: 141114 - RNA, 22 nt, Human
cagaagagcaccaggucggaaa

SEQ ID NO: 141115 - RNA, 20 nt, Human
cagcacaguggggcaggcag

SEQ ID NO: 141116 - RNA, 23 nt, Human
cagccucagucccccagcagaag

SEQ ID NO: 141117 - RNA, 21 nt, Human
cagcgccagcacaggugugaa

SEQ ID NO: 141118 - RNA, 20 nt, Human
cagcugagcacaaauaauuu

SEQ ID NO: 141119 - RNA, 23 nt, Human
caggcaggcagaggggcaccacc

SEQ ID NO: 141120 - RNA, 22 nt, Human
cagggcuaggaggaagcggggg

SEQ ID NO: 141121 - RNA, 23 nt, Human
cagucccccagcagaagagcacc

SEQ ID NO: 141122 - RNA, 22 nt, Human
caugugggggcuucugaaacuc

SEQ ID NO: 141123 - RNA, 20 nt, Human
ccagaggauggggagggaaa

SEQ ID NO: 141124 - RNA, 23 nt, Human
ccaguccacagucagcuccugcc

SEQ ID NO: 141125 - RNA, 23 nt, Human
cccaaguccccagcuuccccagg

SEQ ID NO: 141126 - RNA, 18 nt, Human
cccacagacagggcuccu

SEQ ID NO: 141127 - RNA, 22 nt, Human
cccaucacuucccaagucccca

SEQ ID NO: 141128 - RNA, 20 nt, Human
ccccgaaugagggccagccu

SEQ ID NO: 141129 - RNA, 24 nt, Human
cuaaguuuccaaccccugcccaca

SEQ ID NO: 141130 - RNA, 23 nt, Human
cuucugaaacucugaggagguag

SEQ ID NO: 141131 - RNA, 21 nt, Human
cuuucggucuuucccgcgucc

SEQ ID NO: 141132 - RNA, 23 nt, Human
gaagagcaccaggucggaaagac

SEQ ID NO: 141133 - RNA, 24 nt, Human
gacgaacccacagacagggcuccu

SEQ ID NO: 141134 - RNA, 19 nt, Human
gauggggagggaaagagca

SEQ ID NO: 141135 - RNA, 21 nt, Human
gcccugccggaggugagggga

SEQ ID NO: 141136 - RNA, 23 nt, Human
gcuaaguuuccaaccccugccca

SEQ ID NO: 141137 - RNA, 21 nt, Human
ggaaagaccagcaugccggca

SEQ ID NO: 141138 - RNA, 21 nt, Human
ggaaagagcagacacacccuu

SEQ ID NO: 141139 - RNA, 21 nt, Human
gggcuaggaggaagcggggga

SEQ ID NO: 141140 - RNA, 22 nt, Human
gggcuccugguugucacagcuu

SEQ ID NO: 141141 - RNA, 24 nt, Human
uaaaugucagcugagcacaaauaa

SEQ ID NO: 141142 - RNA, 24 nt, Human
ucacagacagacacacgcaacaug

SEQ ID NO: 141143 - RNA, 22 nt, Human
uccccagcuuccccaggaacac

SEQ ID NO: 141144 - RNA, 21 nt, Human
uccccaggaacacagggcuug

SEQ ID NO: 141145 - RNA, 22 nt, Human
ucccccagcagaagagcaccag

SEQ ID NO: 141146 - RNA, 19 nt, Human
ucucaggcugccaagggcu

SEQ ID NO: 141147 - RNA, 20 nt, Human
ucucaggcugccaagggcuu

SEQ ID NO: 141148 - RNA, 19 nt, Human
ucucguggcggugcgcugc

SEQ ID NO: 141149 - RNA, 21 nt, Human
ucucguggcggugcgcugccc

SEQ ID NO: 141150 - RNA, 25 nt, Human
ugaaacucugaggagguagcagccc

SEQ ID NO: 141151 - RNA, 18 nt, Human
uggggagggaaagagcag

SEQ ID NO: 141152 - RNA, 21 nt, Human
ugucacagcuuguuccuugga

SEQ ID NO: 141153 - RNA, 23 nt, Human
uuccaaccccugcccacagggcu

SEQ ID NO: 141154 - RNA, 18 nt, Human
uuccuuggagcucucagg

SEQ ID NO: 141155 - RNA, 23 nt, Human
aaagacaucauaaguuacagaaa

SEQ ID NO: 141156 - RNA, 21 nt, Human
aacauggcagcucggacaccu

SEQ ID NO: 141157 - RNA, 23 nt, Human
aagugccuugugaugcugggagc

SEQ ID NO: 141158 - RNA, 19 nt, Human
acuuguagacaagugccuu

SEQ ID NO: 141159 - RNA, 23 nt, Human
cagaaacaggacaacuggggagc

SEQ ID NO: 141160 - RNA, 22 nt, Human
caucucagggaaaagacaucau

SEQ ID NO: 141161 - RNA, 18 nt, Human
ccccacggaccucucgag

SEQ ID NO: 141162 - RNA, 21 nt, Human
ccuugugaugcugggagcagg

SEQ ID NO: 141163 - RNA, 22 nt, Human
cggacaccuuucccacggccuc

SEQ ID NO: 141164 - RNA, 19 nt, Human
cucgagcagaggcgguggg

SEQ ID NO: 141165 - RNA, 28 nt, Human
gacaccuuucccacggccucccccacgg

SEQ ID NO: 141166 - RNA, 25 nt, Human
gacuguguugggacacacuuguaga

SEQ ID NO: 141167 - RNA, 18 nt, Human
gagcagaggcgguggggg

SEQ ID NO: 141168 - RNA, 23 nt, Human
gccuucccccucugagcccccau

SEQ ID NO: 141169 - RNA, 26 nt, Human
gggaaaguggcccaggacuguguugg

SEQ ID NO: 141170 - RNA, 21 nt, Human
uaaguuacagaaacaggacaa

SEQ ID NO: 141171 - RNA, 20 nt, Human
ucccacggccucccccacgg

SEQ ID NO: 141172 - RNA, 27 nt, Human
ucccccacggaccucucgagcagaggc

SEQ ID NO: 141173 - RNA, 21 nt, Human
uccuaaacauggcagcucgga

SEQ ID NO: 141174 - RNA, 20 nt, Human
ucgagcagaggcgguggggg

SEQ ID NO: 141175 - RNA, 25 nt, Human
ugcugggagcaggguacaguguguu

SEQ ID NO: 141176 - RNA, 21 nt, Human
uucccacggccucccccacgg

SEQ ID NO: 141177 - RNA, 23 nt, Human
aaaagaaagaaaaaucagcaaaa

SEQ ID NO: 141178 - RNA, 23 nt, Human
aaacugacacauaaaccaaacca

SEQ ID NO: 141179 - RNA, 23 nt, Human
aaacugacacauaaaccaaacca

SEQ ID NO: 141180 - RNA, 22 nt, Human
aaagggacaaguacacagaacc

SEQ ID NO: 141181 - RNA, 22 nt, Human
aacaaagccccccgcuguccgg

SEQ ID NO: 141182 - RNA, 19 nt, Human
aacaaagggacaaguaccc

SEQ ID NO: 141183 - RNA, 18 nt, Human
aacaacgacaacaaaggg

SEQ ID NO: 141184 - RNA, 19 nt, Human
aacaauggcgcggacgccc

SEQ ID NO: 141185 - RNA, 20 nt, Human
aacacaacaaaacaaaucca

SEQ ID NO: 141186 - RNA, 19 nt, Human
aaccaaaggucaacagcag

SEQ ID NO: 141187 - RNA, 18 nt, Human
aagagaagagaaccuggg

SEQ ID NO: 141188 - RNA, 21 nt, Human
aagcaaaacacaacaaaacaa

SEQ ID NO: 141189 - RNA, 23 nt, Human
aaggaaagcaaaacacaacaaaa

SEQ ID NO: 141190 - RNA, 21 nt, Human
aaggcgccugcgggggggagg

SEQ ID NO: 141191 - RNA, 19 nt, Human
aagggccgagguccuggag

SEQ ID NO: 141192 - RNA, 26 nt, Human
acaacaaagggacaaguacacagaag

SEQ ID NO: 141193 - RNA, 24 nt, Human
acaacaaagggacaaguacccaga

SEQ ID NO: 141194 - RNA, 22 nt, Human
acacaacaaaacaaauccagac

SEQ ID NO: 141195 - RNA, 22 nt, Human
acagcagcguuuccccagcagc

SEQ ID NO: 141196 - RNA, 21 nt, Human
acaucugucuuuaguuacuuu

SEQ ID NO: 141197 - RNA, 22 nt, Human
accuaauucuucccuuucuucc

SEQ ID NO: 141198 - RNA, 22 nt, Human
accuaauucuucccuuucuucc

SEQ ID NO: 141199 - RNA, 22 nt, Human
accuaauucuucccuuucuucc

SEQ ID NO: 141200 - RNA, 22 nt, Human
accuaauucuucccuuucuucc

SEQ ID NO: 141201 - RNA, 24 nt, Human
acgacaacaaagggacaaguaccc

SEQ ID NO: 141202 - RNA, 20 nt, Human
acgccugcagaaguggccgc

SEQ ID NO: 141203 - RNA, 19 nt, Human
agaaaugauggggaaggag

SEQ ID NO: 141204 - RNA, 19 nt, Human
agaaaugauggggaaggag

SEQ ID NO: 141205 - RNA, 20 nt, Human
agaagggagggggacugggc

SEQ ID NO: 141206 - RNA, 19 nt, Human
agagagagcaauggugggg

SEQ ID NO: 141207 - RNA, 20 nt, Human
agccaggaacugccucccgg

SEQ ID NO: 141208 - RNA, 21 nt, Human
agccuuggcaacauagugaga

SEQ ID NO: 141209 - RNA, 22 nt, Human
agccuuggcaacauagugagau

SEQ ID NO: 141210 - RNA, 18 nt, Human
agcggaaaggaaaggaag

SEQ ID NO: 141211 - RNA, 23 nt, Human
aggaaaggaagggagggaggcgg

SEQ ID NO: 141212 - RNA, 22 nt, Human
aggcgccgguggaggagagugu

SEQ ID NO: 141213 - RNA, 19 nt, Human
aggcugcagaaaggggcag

SEQ ID NO: 141214 - RNA, 19 nt, Human
agggagggaggcggcgaag

SEQ ID NO: 141215 - RNA, 26 nt, Human
agggagggggacugggcucauuugga

SEQ ID NO: 141216 - RNA, 24 nt, Human
auccaauguaaauggugucuaaca

SEQ ID NO: 141217 - RNA, 20 nt, Human
auucggaguccuuauugcca

SEQ ID NO: 141218 - RNA, 20 nt, Human
auucggaguccuuauugcca

SEQ ID NO: 141219 - RNA, 22 nt, Human
auuuguaagcagaaacuaccau

SEQ ID NO: 141220 - RNA, 19 nt, Human
caaaacacaacaaaacaaa

SEQ ID NO: 141221 - RNA, 22 nt, Human
caaagggacaaguacccagaac

SEQ ID NO: 141222 - RNA, 19 nt, Human
caacaaagggacaaguaca

SEQ ID NO: 141223 - RNA, 19 nt, Human
caacaacgacaacaaaggg

SEQ ID NO: 141224 - RNA, 21 nt, Human
caacagcagcguuuccccagc

SEQ ID NO: 141225 - RNA, 21 nt, Human
caacauagugagaugcugucu

SEQ ID NO: 141226 - RNA, 21 nt, Human
caacauagugagaugcugucu

SEQ ID NO: 141227 - RNA, 19 nt, Human
caacugcggggaacaaagc

SEQ ID NO: 141228 - RNA, 21 nt, Human
caagggccgagguccuggagc

SEQ ID NO: 141229 - RNA, 21 nt, Human
caaguacacagaaccaggcac

SEQ ID NO: 141230 - RNA, 19 nt, Human
caauuuacaccuacaucug

SEQ ID NO: 141231 - RNA, 19 nt, Human
cacauaucuacaagacacc

SEQ ID NO: 141232 - RNA, 19 nt, Human
cacauaucuacaagacacc

SEQ ID NO: 141233 - RNA, 19 nt, Human
cacccuuucucucucccuc

SEQ ID NO: 141234 - RNA, 23 nt, Human
caccuguaagaccuagcaacuua

SEQ ID NO: 141235 - RNA, 21 nt, Human
cagcugcucagucccaacuuu

SEQ ID NO: 141236 - RNA, 21 nt, Human
cagcugcucagucccaacuuu

SEQ ID NO: 141237 - RNA, 24 nt, Human
caggaaggaaagcaaaacacaaca

SEQ ID NO: 141238 - RNA, 21 nt, Human
caggauaagcccaaggaaguu

SEQ ID NO: 141239 - RNA, 25 nt, Human
caggcacuucugggaaacuugucuu

SEQ ID NO: 141240 - RNA, 21 nt, Human
cagggcucucgaaucggucug

SEQ ID NO: 141241 - RNA, 18 nt, Human
cagucggagcggccucgg

SEQ ID NO: 141242 - RNA, 22 nt, Human
ccaacccgccugcuucucaaga

SEQ ID NO: 141243 - RNA, 22 nt, Human
ccaacccgccugcuucucaaga

SEQ ID NO: 141244 - RNA, 19 nt, Human
ccagaaucuccagggcucu

SEQ ID NO: 141245 - RNA, 19 nt, Human
ccagcgccgacaagcucaa

SEQ ID NO: 141246 - RNA, 19 nt, Human
ccagcucccuuccucccgg

SEQ ID NO: 141247 - RNA, 21 nt, Human
ccagcucugguucuggggccc

SEQ ID NO: 141248 - RNA, 21 nt, Human
ccagcugcucagucccaacuu

SEQ ID NO: 141249 - RNA, 21 nt, Human
ccagcugcucagucccaacuu

SEQ ID NO: 141250 - RNA, 23 nt, Human
cccaccucuccuauaagcaccca

SEQ ID NO: 141251 - RNA, 23 nt, Human
ccccagcagcugacaggucaaau

SEQ ID NO: 141252 - RNA, 24 nt, Human
ccccccgcuguccggcaggggcug

SEQ ID NO: 141253 - RNA, 19 nt, Human
ccccgcucagccgccaggc

SEQ ID NO: 141254 - RNA, 20 nt, Human
ccccggccauucgaggggac

SEQ ID NO: 141255 - RNA, 18 nt, Human
ccccuuuccagcucccuu

SEQ ID NO: 141256 - RNA, 19 nt, Human
cccgcuguccggcaggggc

SEQ ID NO: 141257 - RNA, 22 nt, Human
cccggaagcccaagggccgagg

SEQ ID NO: 141258 - RNA, 22 nt, Human
cccguccuacccuugcugggag

SEQ ID NO: 141259 - RNA, 19 nt, Human
cccugguggccuaaccagg

SEQ ID NO: 141260 - RNA, 19 nt, Human
cccuuucuuccuccuccca

SEQ ID NO: 141261 - RNA, 19 nt, Human
cccuuucuuccuccuccca

SEQ ID NO: 141262 - RNA, 19 nt, Human
cccuuucuuccuccuccca

SEQ ID NO: 141263 - RNA, 19 nt, Human
cccuuucuuccuccuccca

SEQ ID NO: 141264 - RNA, 20 nt, Human
ccgccaggccuuccgggaca

SEQ ID NO: 141265 - RNA, 19 nt, Human
ccgcccccuuuccagcucc

SEQ ID NO: 141266 - RNA, 28 nt, Human
ccucaagggcucccgcgggagagccucu

SEQ ID NO: 141267 - RNA, 18 nt, Human
ccuccucccacccaaccc

SEQ ID NO: 141268 - RNA, 18 nt, Human
ccuccucccacccaaccc

SEQ ID NO: 141269 - RNA, 18 nt, Human
ccuccucccacccaaccc

SEQ ID NO: 141270 - RNA, 18 nt, Human
ccuccucccacccaaccc

SEQ ID NO: 141271 - RNA, 19 nt, Human
ccucgggcgcccagccggg

SEQ ID NO: 141272 - RNA, 19 nt, Human
ccugcuguguucuagcugg

SEQ ID NO: 141273 - RNA, 22 nt, Human
cgacaacaaagggacaaguacc

SEQ ID NO: 141274 - RNA, 22 nt, Human
cgacaacaaagggacaaguacc

SEQ ID NO: 141275 - RNA, 21 nt, Human
cgagggcagcgccgugcgggg

SEQ ID NO: 141276 - RNA, 18 nt, Human
cgcccacccugguggccu

SEQ ID NO: 141277 - RNA, 19 nt, Human
cgcccagaaucuccagggc

SEQ ID NO: 141278 - RNA, 21 nt, Human
cgcccagaaucuccagggcuc

SEQ ID NO: 141279 - RNA, 22 nt, Human
cgccuaggcugcagaaaggggc

SEQ ID NO: 141280 - RNA, 24 nt, Human
cgccugcuucucaagaugagccuu

SEQ ID NO: 141281 - RNA, 24 nt, Human
cgccugcuucucaagaugagccuu

SEQ ID NO: 141282 - RNA, 20 nt, Human
cgcgcggcuccugucgccgc

SEQ ID NO: 141283 - RNA, 23 nt, Human
cggccucgggcgcccagccgggc

SEQ ID NO: 141284 - RNA, 19 nt, Human
cgggacaagccccuuccug

SEQ ID NO: 141285 - RNA, 23 nt, Human
cgggcggcgcgcagagcggaggg

SEQ ID NO: 141286 - RNA, 22 nt, Human
cgggggggaggagcggcucuuu

SEQ ID NO: 141287 - RNA, 23 nt, Human
cguccuacccuugcugggagcca

SEQ ID NO: 141288 - RNA, 19 nt, Human
cucaucccuuugcccuccc

SEQ ID NO: 141289 - RNA, 19 nt, Human
cucaucccuuugcccuccc

SEQ ID NO: 141290 - RNA, 20 nt, Human
cuccuggggaacugaagaca

SEQ ID NO: 141291 - RNA, 24 nt, Human
cucgcggaaaaagaaagaaaaauc

SEQ ID NO: 141292 - RNA, 19 nt, Human
cuggggcccccagggcggc

SEQ ID NO: 141293 - RNA, 20 nt, Human
cuucauuguaaaaaaucacc

SEQ ID NO: 141294 - RNA, 21 nt, Human
cuucccuuucuuccuccuccc

SEQ ID NO: 141295 - RNA, 21 nt, Human
cuucccuuucuuccuccuccc

SEQ ID NO: 141296 - RNA, 21 nt, Human
cuucccuuucuuccuccuccc

SEQ ID NO: 141297 - RNA, 21 nt, Human
cuucccuuucuuccuccuccc

SEQ ID NO: 141298 - RNA, 22 nt, Human
cuucucaucccuuugcccuccc

SEQ ID NO: 141299 - RNA, 25 nt, Human
gaaaaagaaagaaaaaucagcaaaa

SEQ ID NO: 141300 - RNA, 20 nt, Human
gaacccagucccagcccugc

SEQ ID NO: 141301 - RNA, 21 nt, Human
gaauugcccucaucucuccca

SEQ ID NO: 141302 - RNA, 23 nt, Human
gaccuggccccgcucagccgcca

SEQ ID NO: 141303 - RNA, 19 nt, Human
gagccagcucugguucugg

SEQ ID NO: 141304 - RNA, 23 nt, Human
gcacugaacaguuuuguugugcu

SEQ ID NO: 141305 - RNA, 19 nt, Human
gcagagcggagggggaggc

SEQ ID NO: 141306 - RNA, 18 nt, Human
gccaaggagaaaugaugg

SEQ ID NO: 141307 - RNA, 18 nt, Human
gccaaggagaaaugaugg

SEQ ID NO: 141308 - RNA, 19 nt, Human
gcccaagggccgagguccu

SEQ ID NO: 141309 - RNA, 18 nt, Human
gcccagaaucuccagggc

SEQ ID NO: 141310 - RNA, 27 nt, Human
gcccucaucucucccaccagcgccgac

SEQ ID NO: 141311 - RNA, 22 nt, Human
gcccucgcggaaaaagaaagaa

SEQ ID NO: 141312 - RNA, 21 nt, Human
gccucgucguuggccaaggag

SEQ ID NO: 141313 - RNA, 21 nt, Human
gccucgucguuggccaaggag

SEQ ID NO: 141314 - RNA, 21 nt, Human
gcgaggaagagaagagaaccu

SEQ ID NO: 141315 - RNA, 18 nt, Human
gcgcgcagagcggagggg

SEQ ID NO: 141316 - RNA, 24 nt, Human
gcggacucuuuucggcgacggccu

SEQ ID NO: 141317 - RNA, 21 nt, Human
gcggcgaaggcgccugcgggg

SEQ ID NO: 141318 - RNA, 19 nt, Human
ggaaaggaaaggaagggag

SEQ ID NO: 141319 - RNA, 25 nt, Human
ggaaauggaggagguuggggaggga

SEQ ID NO: 141320 - RNA, 22 nt, Human
ggaauugcccucaucucuccca

SEQ ID NO: 141321 - RNA, 26 nt, Human
ggacaaguacacagaaccaggcacuu

SEQ ID NO: 141322 - RNA, 18 nt, Human
ggacaggucggaagagga

SEQ ID NO: 141323 - RNA, 18 nt, Human
ggaggacucucaacggga

SEQ ID NO: 141324 - RNA, 20 nt, Human
ggccgagguccuggagcugc

SEQ ID NO: 141325 - RNA, 21 nt, Human
ggcucucugguuucagauguu

SEQ ID NO: 141326 - RNA, 19 nt, Human
gggagggaggacucucaac

SEQ ID NO: 141327 - RNA, 20 nt, Human
gggcaggaaacaacugcggg

SEQ ID NO: 141328 - RNA, 21 nt, Human
gggccgagguccuggagcugc

SEQ ID NO: 141329 - RNA, 20 nt, Human
gggcggcgcgcagagcggag

SEQ ID NO: 141330 - RNA, 21 nt, Human
gggggacugggcucauuugga

SEQ ID NO: 141331 - RNA, 24 nt, Human
gguuucagauguucugauuuuuuu

SEQ ID NO: 141332 - RNA, 24 nt, Human
guauuacauuuguaagcagaaacu

SEQ ID NO: 141333 - RNA, 18 nt, Human
gucgccugcucccagcug

SEQ ID NO: 141334 - RNA, 18 nt, Human
guugugcuuuuuggaggg

SEQ ID NO: 141335 - RNA, 20 nt, Human
uaaaaaaaugagguaagaaa

SEQ ID NO: 141336 - RNA, 20 nt, Human
uaaaaaaaugagguaagaaa

SEQ ID NO: 141337 - RNA, 18 nt, Human
uaaaaaagcaauucaaac

SEQ ID NO: 141338 - RNA, 18 nt, Human
uaaaaaagcaauucaaac

SEQ ID NO: 141339 - RNA, 18 nt, Human
uaaaaaauaaucccucuc

SEQ ID NO: 141340 - RNA, 19 nt, Human
uaaauauauucuaaaucca

SEQ ID NO: 141341 - RNA, 19 nt, Human
uaaauauauucuaaaucca

SEQ ID NO: 141342 - RNA, 23 nt, Human
uaacuacaacaacgacaacaaag

SEQ ID NO: 141343 - RNA, 23 nt, Human
uaacuacaacaacgacaacaaag

SEQ ID NO: 141344 - RNA, 25 nt, Human
uaagcacccaggauaagcccaagga

SEQ ID NO: 141345 - RNA, 26 nt, Human
uaagcagaaacuaccauaaucaacgg

SEQ ID NO: 141346 - RNA, 19 nt, Human
uacacagaaccaggcacuu

SEQ ID NO: 141347 - RNA, 19 nt, Human
uacccagaaccaggcacuu

SEQ ID NO: 141348 - RNA, 18 nt, Human
uagaaaagguaugcaaua

SEQ ID NO: 141349 - RNA, 20 nt, Human
uaguuacuuuuguuaguugg

SEQ ID NO: 141350 - RNA, 22 nt, Human
uauaagcacccaggauaagccc

SEQ ID NO: 141351 - RNA, 20 nt, Human
uauugcucuaaguuggagug

SEQ ID NO: 141352 - RNA, 20 nt, Human
uauugcucuaaguuggagug

SEQ ID NO: 141353 - RNA, 22 nt, Human
ucagccgccaggccuuccggga

SEQ ID NO: 141354 - RNA, 20 nt, Human
ucagucccaacuuucugccc

SEQ ID NO: 141355 - RNA, 33 nt, Human
ucccagaggaauugcccucaucucucccacccc

SEQ ID NO: 141356 - RNA, 24 nt, Human
uccccgggagcggggccuaagugg

SEQ ID NO: 141357 - RNA, 18 nt, Human
ucccggccagccccggcc

SEQ ID NO: 141358 - RNA, 23 nt, Human
uccggcaggggcgaacccggcuc

SEQ ID NO: 141359 - RNA, 18 nt, Human
ucggucgccugcucccag

SEQ ID NO: 141360 - RNA, 22 nt, Human
ucggucgccugcucccagcugc

SEQ ID NO: 141361 - RNA, 22 nt, Human
ucggucgccugcucccagcugc

SEQ ID NO: 141362 - RNA, 21 nt, Human
ucucaguggcaacaaacucuu

SEQ ID NO: 141363 - RNA, 21 nt, Human
ucucaguggcaacaaacucuu

SEQ ID NO: 141364 - RNA, 24 nt, Human
ucuccuauaagcacccaggauaag

SEQ ID NO: 141365 - RNA, 23 nt, Human
ucuccuauaagcacccaggauug

SEQ ID NO: 141366 - RNA, 18 nt, Human
ucucuuggagcgcuuugg

SEQ ID NO: 141367 - RNA, 26 nt, Human
ucuucccuuucuuccuccucccaccc

SEQ ID NO: 141368 - RNA, 26 nt, Human
ucuucccuuucuuccuccucccaccc

SEQ ID NO: 141369 - RNA, 26 nt, Human
ucuucccuuucuuccuccucccaccc

SEQ ID NO: 141370 - RNA, 26 nt, Human
ucuucccuuucuuccuccucccaccc

SEQ ID NO: 141371 - RNA, 18 nt, Human
ugacggucuaaaggguca

SEQ ID NO: 141372 - RNA, 21 nt, Human
ugagaaaugaaaaccacaccu

SEQ ID NO: 141373 - RNA, 21 nt, Human
ugagaaaugaaaaccacaccu

SEQ ID NO: 141374 - RNA, 25 nt, Human
ugagaaaugaaaaccacaccuucga

SEQ ID NO: 141375 - RNA, 25 nt, Human
ugagaaaugaaaaccacaccuucga

SEQ ID NO: 141376 - RNA, 20 nt, Human
ugagaugcugucuuuuucuu

SEQ ID NO: 141377 - RNA, 20 nt, Human
ugagaugcugucuuuuucuu

SEQ ID NO: 141378 - RNA, 18 nt, Human
ugcacccccggaagccca

SEQ ID NO: 141379 - RNA, 19 nt, Human
ugcacccccggaagcccaa

SEQ ID NO: 141380 - RNA, 26 nt, Human
ugcacccccggaagcccaagggccga

SEQ ID NO: 141381 - RNA, 25 nt, Human
ugcccugccuacgcuccuccggcgc

SEQ ID NO: 141382 - RNA, 23 nt, Human
ugccuacgcuccuccggcgcuca

SEQ ID NO: 141383 - RNA, 18 nt, Human
ugcugggagccagcucug

SEQ ID NO: 141384 - RNA, 24 nt, Human
uggaacccagucccagcccugcug

SEQ ID NO: 141385 - RNA, 18 nt, Human
uggagcgcuuuggggaga

SEQ ID NO: 141386 - RNA, 24 nt, Human
uggaggagaguguguuuacgagag

SEQ ID NO: 141387 - RNA, 22 nt, Human
uggccaaggagaaaugaugggg

SEQ ID NO: 141388 - RNA, 22 nt, Human
uggccaaggagaaaugaugggg

SEQ ID NO: 141389 - RNA, 19 nt, Human
uggcugcacccccggaagc

SEQ ID NO: 141390 - RNA, 20 nt, Human
ugggagccagcucugguucu

SEQ ID NO: 141391 - RNA, 26 nt, Human
uggggaaauggaggagguuggggagg

SEQ ID NO: 141392 - RNA, 21 nt, Human
uggggcuggaacccaguccca

SEQ ID NO: 141393 - RNA, 21 nt, Human
uguggguggagcccaccucuc

SEQ ID NO: 141394 - RNA, 26 nt, Human
uguugugcuuuuuggaggggagaggu

SEQ ID NO: 141395 - RNA, 19 nt, Human
uucauuguaaaaaaucacc

SEQ ID NO: 141396 - RNA, 19 nt, Human
uuccccagcagcugacagg

SEQ ID NO: 141397 - RNA, 20 nt, Human
uuccccagcagcugacaggu

SEQ ID NO: 141398 - RNA, 20 nt, Human
uucccuggcugcugcggcac

SEQ ID NO: 141399 - RNA, 22 nt, Human
uucgaagauuucuuuuaaaaau

SEQ ID NO: 141400 - RNA, 20 nt, Human
uucgaggggacuugcguccc

SEQ ID NO: 141401 - RNA, 26 nt, Human
uucuuuuuuuuuuaaaaagcaauuca

SEQ ID NO: 141402 - RNA, 26 nt, Human
uucuuuuuuuuuuaaaaagcaauuca

SEQ ID NO: 141403 - RNA, 19 nt, Human
uuggacgccagcgaaggaa

SEQ ID NO: 141404 - RNA, 19 nt, Human
uuggaggagcaaaagacag

SEQ ID NO: 141405 - RNA, 20 nt, Human
uuggggagaagggaggggga

SEQ ID NO: 141406 - RNA, 21 nt, Human
uuuccagcucccuuccucccg

SEQ ID NO: 141407 - RNA, 23 nt, Human
uuuccagcucccuuccucccggg

SEQ ID NO: 141408 - RNA, 20 nt, Human
uuuggggagaagggaggggg

SEQ ID NO: 141409 - RNA, 18 nt, Human
uuuguaagcagaaacuac

SEQ ID NO: 141410 - RNA, 22 nt, Human
uuuguugugcuuuuuggagggg

SEQ ID NO: 141411 - RNA, 23 nt, Human
aaaaaaauccagaaaagccaaca

SEQ ID NO: 141412 - RNA, 20 nt, Human
aaaaaacaagaacaacaaca

SEQ ID NO: 141413 - RNA, 18 nt, Human
aaaauccagaaaagccaa

SEQ ID NO: 141414 - RNA, 21 nt, Human
aaacaagaacaacaacaacaa

SEQ ID NO: 141415 - RNA, 23 nt, Human
aacugccuuuucuccugguccag

SEQ ID NO: 141416 - RNA, 24 nt, Human
aagaacccauggcaaaaaaaaucc

SEQ ID NO: 141417 - RNA, 22 nt, Human
aauaacuaacagacaaaaagaa

SEQ ID NO: 141418 - RNA, 24 nt, Human
aaugaauuggcuucauaacugccu

SEQ ID NO: 141419 - RNA, 21 nt, Human
aauggcuuggccuuccuucag

SEQ ID NO: 141420 - RNA, 20 nt, Human
acaacaacaacaaccaguaa

SEQ ID NO: 141421 - RNA, 21 nt, Human
acaacaacaacaaccaguaac

SEQ ID NO: 141422 - RNA, 20 nt, Human
acaagaacaacaacaacaaa

SEQ ID NO: 141423 - RNA, 18 nt, Human
acaagagacauaagcaca

SEQ ID NO: 141424 - RNA, 19 nt, Human
acagguaugaaauguccau

SEQ ID NO: 141425 - RNA, 21 nt, Human
acccauggcaaaaaaaaucca

SEQ ID NO: 141426 - RNA, 21 nt, Human
acccgcggggcugcggccgcg

SEQ ID NO: 141427 - RNA, 19 nt, Human
agaaucaugccaaagucca

SEQ ID NO: 141428 - RNA, 26 nt, Human
agacaaaaagaaaaaaaaggggaccc

SEQ ID NO: 141429 - RNA, 19 nt, Human
agcgcccgcgccgcgcccc

SEQ ID NO: 141430 - RNA, 19 nt, Human
agucagcacaugcugugcu

SEQ ID NO: 141431 - RNA, 19 nt, Human
caaaucccagaaguccaca

SEQ ID NO: 141432 - RNA, 19 nt, Human
caacucccgguuccgcccc

SEQ ID NO: 141433 - RNA, 27 nt, Human
caagaacaacaacaacaacuggagacc

SEQ ID NO: 141434 - RNA, 22 nt, Human
caaggucagugaagaacccaug

SEQ ID NO: 141435 - RNA, 19 nt, Human
cacagguaugaaaugucca

SEQ ID NO: 141436 - RNA, 24 nt, Human
cacucacuaucucacuggggcagc

SEQ ID NO: 141437 - RNA, 19 nt, Human
cagacaaaaagaaaaaaaa

SEQ ID NO: 141438 - RNA, 21 nt, Human
cauauaaaaaacaagaacaac

SEQ ID NO: 141439 - RNA, 25 nt, Human
caucuugcuacuucaaccaacuacc

SEQ ID NO: 141440 - RNA, 18 nt, Human
caugacagaaugaggucu

SEQ ID NO: 141441 - RNA, 24 nt, Human
cauuugcaagccuggugaccacuc

SEQ ID NO: 141442 - RNA, 24 nt, Human
ccaaaggaagaguugcucugagaa

SEQ ID NO: 141443 - RNA, 22 nt, Human
ccauggcaaaaaaaauccagaa

SEQ ID NO: 141444 - RNA, 25 nt, Human
ccauggcaaaaaaaauccagaaaag

SEQ ID NO: 141445 - RNA, 21 nt, Human
ccccgcgggugcccacggcca

SEQ ID NO: 141446 - RNA, 21 nt, Human
cccgcgggugcccacggccag

SEQ ID NO: 141447 - RNA, 18 nt, Human
ccgccgccgccgccgcgc

SEQ ID NO: 141448 - RNA, 21 nt, Human
ccgccgccgccgccgcgcagc

SEQ ID NO: 141449 - RNA, 22 nt, Human
ccuuccuucagucccgagaacc

SEQ ID NO: 141450 - RNA, 24 nt, Human
cgaacucugaggugcaaggacugg

SEQ ID NO: 141451 - RNA, 22 nt, Human
cgccccgcucgcucgauagcca

SEQ ID NO: 141452 - RNA, 23 nt, Human
cgccccgcucgcucgauagccag

SEQ ID NO: 141453 - RNA, 24 nt, Human
cgccccgcucgcucgauagccagc

SEQ ID NO: 141454 - RNA, 21 nt, Human
cgccgcgccccgcgggugccc

SEQ ID NO: 141455 - RNA, 18 nt, Human
cgcggggcugcggccgcg

SEQ ID NO: 141456 - RNA, 19 nt, Human
cggccaggguguccacggc

SEQ ID NO: 141457 - RNA, 23 nt, Human
cuaacagacaaaaagaaaaaaaa

SEQ ID NO: 141458 - RNA, 24 nt, Human
cuccuggaaucuacugcuaccacc

SEQ ID NO: 141459 - RNA, 20 nt, Human
cugaggugcaaggacugggc

SEQ ID NO: 141460 - RNA, 20 nt, Human
gaagaacccauggcaaaaaa

SEQ ID NO: 141461 - RNA, 23 nt, Human
gagcccggcgcccgagcggcggc

SEQ ID NO: 141462 - RNA, 21 nt, Human
gcagcgcccgcgccgcgcccc

SEQ ID NO: 141463 - RNA, 20 nt, Human
gccaggguguccacggccag

SEQ ID NO: 141464 - RNA, 21 nt, Human
gcgcaacucccgguuccgccc

SEQ ID NO: 141465 - RNA, 21 nt, Human
gggcagucccaagagggcaac

SEQ ID NO: 141466 - RNA, 23 nt, Human
ggugaccacucacuaucucacug

SEQ ID NO: 141467 - RNA, 18 nt, Human
gugaucagcuuaugcccc

SEQ ID NO: 141468 - RNA, 21 nt, Human
uacuucaaccaacuaccucau

SEQ ID NO: 141469 - RNA, 30 nt, Human
uagcaaguacccuucuccuccuggaaucuu

SEQ ID NO: 141470 - RNA, 21 nt, Human
uaugccccgaagcaacagaga

SEQ ID NO: 141471 - RNA, 25 nt, Human
uaugccccgaagcaacagagacaga

SEQ ID NO: 141472 - RNA, 24 nt, Human
uauugcacagguaugaaaugucca

SEQ ID NO: 141473 - RNA, 19 nt, Human
uauuggcuuaugcuugaaa

SEQ ID NO: 141474 - RNA, 18 nt, Human
ucaguauugcacagguau

SEQ ID NO: 141475 - RNA, 21 nt, Human
ucauaacugccuuuucuccug

SEQ ID NO: 141476 - RNA, 19 nt, Human
uccaaggucagugaagaac

SEQ ID NO: 141477 - RNA, 21 nt, Human
uccaaggucagugaagaaccc

SEQ ID NO: 141478 - RNA, 28 nt, Human
uccacaguugaagacaaccuccaggggc

SEQ ID NO: 141479 - RNA, 19 nt, Human
uccaggggcagggaggaaa

SEQ ID NO: 141480 - RNA, 26 nt, Human
ucccuacaaacccuguagggugacuu

SEQ ID NO: 141481 - RNA, 24 nt, Human
uccgcgggcgaggcacgggagggc

SEQ ID NO: 141482 - RNA, 19 nt, Human
ucugaagaacucuuuuccc

SEQ ID NO: 141483 - RNA, 23 nt, Human
ugaaauguccaugagucuuaaaa

SEQ ID NO: 141484 - RNA, 23 nt, Human
ugaagaacccauggcaaaaaaaa

SEQ ID NO: 141485 - RNA, 20 nt, Human
ugaagacaaccuccaggggc

SEQ ID NO: 141486 - RNA, 18 nt, Human
ugacagaaugaggucuuc

SEQ ID NO: 141487 - RNA, 22 nt, Human
ugcaaaaucugcaaaucccaga

SEQ ID NO: 141488 - RNA, 20 nt, Human
ugccaaaguucaaaaaauaa

SEQ ID NO: 141489 - RNA, 22 nt, Human
ugccccgaagcaacagagacag

SEQ ID NO: 141490 - RNA, 19 nt, Human
ugccuuuucuccuggucca

SEQ ID NO: 141491 - RNA, 25 nt, Human
ugcggccgcgacggagcccggcgcc

SEQ ID NO: 141492 - RNA, 22 nt, Human
uggaaugagacaaguucaagua

SEQ ID NO: 141493 - RNA, 26 nt, Human
uggcaaaaaaaauccagaaaagccaa

SEQ ID NO: 141494 - RNA, 19 nt, Human
uggcuuggccuuccuucag

SEQ ID NO: 141495 - RNA, 25 nt, Human
uucaaaaugaauuggcuucauaacu

SEQ ID NO: 141496 - RNA, 20 nt, Human
uugcucugagaagaggugga

SEQ ID NO: 141497 - RNA, 20 nt, Human
uuugcaagccuggugaccac

SEQ ID NO: 141498 - RNA, 23 nt, Human
uuugcaccgccacugacccagga

SEQ ID NO: 141499 - RNA, 19 nt, Human
uuuuuggucuaugaucuga

SEQ ID NO: 141500 - RNA, 19 nt, Human
aaaaaacaaacacaauuca

SEQ ID NO: 141501 - RNA, 20 nt, Human
aaaaggaaacagccuuacaa

SEQ ID NO: 141502 - RNA, 21 nt, Human
aaaauacaugaaaaagacuaa

SEQ ID NO: 141503 - RNA, 24 nt, Human
aaacaaacacaauucaaacaaaca

SEQ ID NO: 141504 - RNA, 20 nt, Human
aaagaaagcagcccagcuga

SEQ ID NO: 141505 - RNA, 21 nt, Human
aagaacacaugcuccuacccu

SEQ ID NO: 141506 - RNA, 19 nt, Human
aagcugccgcucucggagc

SEQ ID NO: 141507 - RNA, 20 nt, Human
aagcugccgcucucggagcc

SEQ ID NO: 141508 - RNA, 19 nt, Human
aagugagcccaugauuugg

SEQ ID NO: 141509 - RNA, 20 nt, Human
agaaguaaagccggagguuc

SEQ ID NO: 141510 - RNA, 22 nt, Human
agcccaucaaaggaaaaaacaa

SEQ ID NO: 141511 - RNA, 18 nt, Human
agccgcuggcucuuagug

SEQ ID NO: 141512 - RNA, 24 nt, Human
aggaaaaaacaaacacaauucaaa

SEQ ID NO: 141513 - RNA, 19 nt, Human
aggaaaauacaugaaaaag

SEQ ID NO: 141514 - RNA, 19 nt, Human
aggcauagucaaacuacau

SEQ ID NO: 141515 - RNA, 21 nt, Human
auuauccccuuugcgacaaca

SEQ ID NO: 141516 - RNA, 21 nt, Human
caaggagggguguggggucuu

SEQ ID NO: 141517 - RNA, 22 nt, Human
caauucaaacaaacacugucaa

SEQ ID NO: 141518 - RNA, 26 nt, Human
cacaagcaaaaauauuuacaaaggua

SEQ ID NO: 141519 - RNA, 24 nt, Human
cacaauucaaacaaacacugucaa

SEQ ID NO: 141520 - RNA, 24 nt, Human
cagauaguuuuuguuccuccccag

SEQ ID NO: 141521 - RNA, 18 nt, Human
cagcaaggaggggugugg

SEQ ID NO: 141522 - RNA, 21 nt, Human
cagcccagcugaugcugccaa

SEQ ID NO: 141523 - RNA, 23 nt, Human
cagcugaugcugccaagagaaac

SEQ ID NO: 141524 - RNA, 24 nt, Human
cauacugcucuuucucccuuugga

SEQ ID NO: 141525 - RNA, 25 nt, Human
caucaaaggaaaaaacaaacacaau

SEQ ID NO: 141526 - RNA, 21 nt, Human
ccccucggggcaggcauaggc

SEQ ID NO: 141527 - RNA, 20 nt, Human
ccgcgcgcgaagcugccgcu

SEQ ID NO: 141528 - RNA, 22 nt, Human
ccgcgcgcgaagcugccgcucu

SEQ ID NO: 141529 - RNA, 18 nt, Human
ccucgaaucccagucccu

SEQ ID NO: 141530 - RNA, 22 nt, Human
cggagguucucucugcacccag

SEQ ID NO: 141531 - RNA, 21 nt, Human
cuaaucccucccuccaaggcu

SEQ ID NO: 141532 - RNA, 21 nt, Human
cuagcggcuucuaaucccucc

SEQ ID NO: 141533 - RNA, 20 nt, Human
cuggaaguccucgaauccca

SEQ ID NO: 141534 - RNA, 19 nt, Human
cuucuaaucccucccucca

SEQ ID NO: 141535 - RNA, 26 nt, Human
gaaaaaacaaacacaauucaaacaaa

SEQ ID NO: 141536 - RNA, 24 nt, Human
gaaucucucucaaugaagcugccc

SEQ ID NO: 141537 - RNA, 20 nt, Human
gagcugcgggagagggcggg

SEQ ID NO: 141538 - RNA, 28 nt, Human
gcagacgagacagaaguaaagccggagg

SEQ ID NO: 141539 - RNA, 20 nt, Human
gcagccgcuggcucuuagug

SEQ ID NO: 141540 - RNA, 26 nt, Human
gccucgccuuacccaagccgaggcua

SEQ ID NO: 141541 - RNA, 19 nt, Human
gcugaugcugccaagagaa

SEQ ID NO: 141542 - RNA, 23 nt, Human
gcuggugucauuuugacaccugg

SEQ ID NO: 141543 - RNA, 24 nt, Human
uaaagagaaaaaaucaugaggaaa

SEQ ID NO: 141544 - RNA, 21 nt, Human
uaaagucaagcaugcugcaaa

SEQ ID NO: 141545 - RNA, 19 nt, Human
uacaugaaaaagacuaaag

SEQ ID NO: 141546 - RNA, 23 nt, Human
uaccacaaauacagagcugaaau

SEQ ID NO: 141547 - RNA, 23 nt, Human
uagaaaagagcacaauuuucuuu

SEQ ID NO: 141548 - RNA, 21 nt, Human
uagcggcuucuaaucccuccc

SEQ ID NO: 141549 - RNA, 20 nt, Human
uagucuucauugaagacaau

SEQ ID NO: 141550 - RNA, 21 nt, Human
ucaaaggaaaaaacaaacaca

SEQ ID NO: 141551 - RNA, 21 nt, Human
uccaaagagaauggagcaaau

SEQ ID NO: 141552 - RNA, 19 nt, Human
uccccuuugcgacaacaca

SEQ ID NO: 141553 - RNA, 21 nt, Human
ucugcacccagcugcagccgc

SEQ ID NO: 141554 - RNA, 21 nt, Human
ugaaaaagacuaaagacuucg

SEQ ID NO: 141555 - RNA, 27 nt, Human
ugaaaaagacuaaagacuucgccauag

SEQ ID NO: 141556 - RNA, 21 nt, Human
ugagaggggaggaaaaaaagu

SEQ ID NO: 141557 - RNA, 22 nt, Human
ugauaccacaaauacagagcug

SEQ ID NO: 141558 - RNA, 24 nt, Human
ugauaccacaaauacagagcugaa

SEQ ID NO: 141559 - RNA, 18 nt, Human
ugcacccagcugcagccg

SEQ ID NO: 141560 - RNA, 21 nt, Human
ugcacccagcugcagccgcug

SEQ ID NO: 141561 - RNA, 19 nt, Human
ugccgcucucggagcgggg

SEQ ID NO: 141562 - RNA, 19 nt, Human
ugcgacaacacaagcaaaa

SEQ ID NO: 141563 - RNA, 20 nt, Human
uggagcaaaucucucuguua

SEQ ID NO: 141564 - RNA, 20 nt, Human
uggguacagagcaaaccuac

SEQ ID NO: 141565 - RNA, 20 nt, Human
ugucuaguacagacagcugg

SEQ ID NO: 141566 - RNA, 24 nt, Human
uuaaagugagcccaugauuuggug

SEQ ID NO: 141567 - RNA, 23 nt, Human
uuaguauuaaccaauuccgcacu

SEQ ID NO: 141568 - RNA, 22 nt, Human
uuagugucaaugaaucucucuc

SEQ ID NO: 141569 - RNA, 19 nt, Human
uuccagaugcaaaaggaaa

SEQ ID NO: 141570 - RNA, 18 nt, Human
uuuguuuuguucuguuuu

SEQ ID NO: 141571 - RNA, 19 nt, Human
aaaaaaaaaaaaaagaaaa

SEQ ID NO: 141572 - RNA, 21 nt, Human
aaaaaaaaaaaaagaaaaauc

SEQ ID NO: 141573 - RNA, 23 nt, Human
aaaaaaaaaagaaaaaucaagaa

SEQ ID NO: 141574 - RNA, 23 nt, Human
aaaaaaaagaaaaaucaagaaga

SEQ ID NO: 141575 - RNA, 18 nt, Human
aagaagagcucaaacacu

SEQ ID NO: 141576 - RNA, 21 nt, Human
aaguaaacucagguccgugga

SEQ ID NO: 141577 - RNA, 22 nt, Human
accccgcccgggugcccccagc

SEQ ID NO: 141578 - RNA, 23 nt, Human
agaaaaaucaagaagagcucaaa

SEQ ID NO: 141579 - RNA, 19 nt, Human
agagcucgugcggccggca

SEQ ID NO: 141580 - RNA, 20 nt, Human
agcagaaaggagcguccugg

SEQ ID NO: 141581 - RNA, 19 nt, Human
agcugcgcgcccgccgccc

SEQ ID NO: 141582 - RNA, 23 nt, Human
aggccagagguggcgggcuuggg

SEQ ID NO: 141583 - RNA, 21 nt, Human
caaagccacguguccaagagc

SEQ ID NO: 141584 - RNA, 30 nt, Human
caagaagagcucaaacacucuuuguggugg

SEQ ID NO: 141585 - RNA, 18 nt, Human
cagcagaaaggagcgucc

SEQ ID NO: 141586 - RNA, 19 nt, Human
cagccgccgccgcccccga

SEQ ID NO: 141587 - RNA, 18 nt, Human
caggaugaggcccuggug

SEQ ID NO: 141588 - RNA, 24 nt, Human
caggaugaggcccugguggacgcc

SEQ ID NO: 141589 - RNA, 22 nt, Human
cccaaagccacguguccaagag

SEQ ID NO: 141590 - RNA, 27 nt, Human
cccccagccgccgccgcccccgaaguc

SEQ ID NO: 141591 - RNA, 22 nt, Human
ccccgcaccgggcucggacccc

SEQ ID NO: 141592 - RNA, 18 nt, Human
ccccggccgcgcgggccc

SEQ ID NO: 141593 - RNA, 18 nt, Human
ccccggugccugcgccgg

SEQ ID NO: 141594 - RNA, 23 nt, Human
cccgcccgggugcccccagccgc

SEQ ID NO: 141595 - RNA, 21 nt, Human
cccggccgcgcgggccccagc

SEQ ID NO: 141596 - RNA, 18 nt, Human
cccggggccggggccggg

SEQ ID NO: 141597 - RNA, 25 nt, Human
cccugcccugggacggcgccccggc

SEQ ID NO: 141598 - RNA, 19 nt, Human
ccgcccgggugcccccagc

SEQ ID NO: 141599 - RNA, 19 nt, Human
ccgccgccgcccccgaagu

SEQ ID NO: 141600 - RNA, 18 nt, Human
ccgccgcgcgccuccagc

SEQ ID NO: 141601 - RNA, 19 nt, Human
ccgccgcgcgccuccagcu

SEQ ID NO: 141602 - RNA, 28 nt, Human
ccgccucccgccgagcugcgcgcccgcc

SEQ ID NO: 141603 - RNA, 19 nt, Human
ccgcgcgggccccagccgc

SEQ ID NO: 141604 - RNA, 21 nt, Human
ccgcggagcugguuuuucaug

SEQ ID NO: 141605 - RNA, 22 nt, Human
ccggaccccgaccccgcaccgg

SEQ ID NO: 141606 - RNA, 26 nt, Human
ccggaccccgaccccgcaccgguucc

SEQ ID NO: 141607 - RNA, 18 nt, Human
ccggcagucgagcagcag

SEQ ID NO: 141608 - RNA, 26 nt, Human
ccggccucccggccucccggccuccg

SEQ ID NO: 141609 - RNA, 23 nt, Human
ccggggccgggcagcccugcccu

SEQ ID NO: 141610 - RNA, 23 nt, Human
ccuccugcagccacucggcgcuc

SEQ ID NO: 141611 - RNA, 21 nt, Human
ccucuccagcaagcccugcag

SEQ ID NO: 141612 - RNA, 22 nt, Human
ccugccaaaaguaaaaaguaaa

SEQ ID NO: 141613 - RNA, 21 nt, Human
cgacucgaagagcucgugcgg

SEQ ID NO: 141614 - RNA, 25 nt, Human
cgcccaaagccacguguccaagagc

SEQ ID NO: 141615 - RNA, 18 nt, Human
cgccccggccucccggcc

SEQ ID NO: 141616 - RNA, 24 nt, Human
cgccccggccucccggccucccgg

SEQ ID NO: 141617 - RNA, 21 nt, Human
cgccgcgcccgccccggugcc

SEQ ID NO: 141618 - RNA, 21 nt, Human
cgccgcgcgccuccagcuccu

SEQ ID NO: 141619 - RNA, 24 nt, Human
cgccuccagcuccuccugcagcca

SEQ ID NO: 141620 - RNA, 22 nt, Human
cgcgcccgccgccccggccucc

SEQ ID NO: 141621 - RNA, 24 nt, Human
cggcccggggccggggccgggcag

SEQ ID NO: 141622 - RNA, 21 nt, Human
cggccucccggccuccguccc

SEQ ID NO: 141623 - RNA, 20 nt, Human
cgggcagcccugcccuggga

SEQ ID NO: 141624 - RNA, 23 nt, Human
cucccggccuccgucccgcccgc

SEQ ID NO: 141625 - RNA, 23 nt, Human
cugggacggcgccccggccgcgc

SEQ ID NO: 141626 - RNA, 18 nt, Human
gacaggaugaggcccugg

SEQ ID NO: 141627 - RNA, 22 nt, Human
gagcaggggccuggugccaugc

SEQ ID NO: 141628 - RNA, 19 nt, Human
gagcugguuuuucaugggg

SEQ ID NO: 141629 - RNA, 20 nt, Human
gcagaaaggagcguccugga

SEQ ID NO: 141630 - RNA, 21 nt, Human
gccagagguggcgggcuuggg

SEQ ID NO: 141631 - RNA, 23 nt, Human
gccccggccgcgcgggccccagc

SEQ ID NO: 141632 - RNA, 18 nt, Human
gccccggugccugcgccg

SEQ ID NO: 141633 - RNA, 19 nt, Human
gccgaggccucuccagcaa

SEQ ID NO: 141634 - RNA, 22 nt, Human
gccuccgucccgcccgcccgcc

SEQ ID NO: 141635 - RNA, 22 nt, Human
gccugcgccggaccccgacccc

SEQ ID NO: 141636 - RNA, 22 nt, Human
gcgccuccagcuccuccugcag

SEQ ID NO: 141637 - RNA, 21 nt, Human
gcggagcugguuuuucauggg

SEQ ID NO: 141638 - RNA, 23 nt, Human
gggagcuuggauuuaccugccaa

SEQ ID NO: 141639 - RNA, 18 nt, Human
gggcgcccgccucccgcc

SEQ ID NO: 141640 - RNA, 20 nt, Human
ggggccggggccgggcagcc

SEQ ID NO: 141641 - RNA, 24 nt, Human
ggugccaugccccccgugcaccag

SEQ ID NO: 141642 - RNA, 22 nt, Human
guuaaaaaaaaaaaaaaaaaaa

SEQ ID NO: 141643 - RNA, 18 nt, Human
uaaaaaacagccaaacug

SEQ ID NO: 141644 - RNA, 22 nt, Human
uaaaaaacagccaaacuggcug

SEQ ID NO: 141645 - RNA, 22 nt, Human
uacuggguuauacaauccacug

SEQ ID NO: 141646 - RNA, 23 nt, Human
ucaggccagagguggcgggcuug

SEQ ID NO: 141647 - RNA, 21 nt, Human
uccaagagccgaggccucucc

SEQ ID NO: 141648 - RNA, 23 nt, Human
ucgccgcgcccgccccggugccu

SEQ ID NO: 141649 - RNA, 21 nt, Human
ugaaauacuggguuauacaau

SEQ ID NO: 141650 - RNA, 19 nt, Human
uggcugggcugucagcaga

SEQ ID NO: 141651 - RNA, 26 nt, Human
ugggccucugggcacaggugacaucu

SEQ ID NO: 141652 - RNA, 21 nt, Human
ugggcucucccaccuagcccu

SEQ ID NO: 141653 - RNA, 22 nt, Human
uggggagcgcgggcggcccggg

SEQ ID NO: 141654 - RNA, 19 nt, Human
uggggggccgcggagcugg

SEQ ID NO: 141655 - RNA, 23 nt, Human
uuaaaaaaaaaaaaaaaaaagaa

SEQ ID NO: 141656 - RNA, 23 nt, Human
uucauggggagcgcgggcggccc

SEQ ID NO: 141657 - RNA, 23 nt, Human
aaaacaccaaaacacuugaagca

SEQ ID NO: 141658 - RNA, 23 nt, Human
aaacaccaaaacacuugaagcaa

SEQ ID NO: 141659 - RNA, 18 nt, Human
aaacacuugaagcaaaaa

SEQ ID NO: 141660 - RNA, 19 nt, Human
aaaccuaagugacacccaa

SEQ ID NO: 141661 - RNA, 22 nt, Human
aaacucguaacuacaacuagua

SEQ ID NO: 141662 - RNA, 19 nt, Human
aaagaaaggaaagcacacu

SEQ ID NO: 141663 - RNA, 18 nt, Human
aaagcaauuaaagcaaaa

SEQ ID NO: 141664 - RNA, 26 nt, Human
aacccacauccucaaaacgaugccug

SEQ ID NO: 141665 - RNA, 25 nt, Human
aagcaaaaacuuuuuuuuuuuuuuu

SEQ ID NO: 141666 - RNA, 19 nt, Human
aagugacacccaaaacccu

SEQ ID NO: 141667 - RNA, 23 nt, Human
aauagaggauuuaucaaaagaaa

SEQ ID NO: 141668 - RNA, 19 nt, Human
acaaaaccuaagugacacc

SEQ ID NO: 141669 - RNA, 25 nt, Human
acaaagcagauuuacauacaaccuu

SEQ ID NO: 141670 - RNA, 23 nt, Human
acagccuauugcuacuucacuga

SEQ ID NO: 141671 - RNA, 24 nt, Human
accacaaagcagauuuacauacaa

SEQ ID NO: 141672 - RNA, 18 nt, Human
accugguaugcaaaaaug

SEQ ID NO: 141673 - RNA, 23 nt, Human
agaagcacuccauguguauaacc

SEQ ID NO: 141674 - RNA, 24 nt, Human
agccacagaaucagucccauaucu

SEQ ID NO: 141675 - RNA, 21 nt, Human
aggaaucugagaaacauagua

SEQ ID NO: 141676 - RNA, 22 nt, Human
agggaacaaaccuaaaguaaca

SEQ ID NO: 141677 - RNA, 20 nt, Human
auguguauaacccacauccu

SEQ ID NO: 141678 - RNA, 25 nt, Human
caaaacaccaaaacacuugaagcaa

SEQ ID NO: 141679 - RNA, 20 nt, Human
caaaacacuugaagcaaaaa

SEQ ID NO: 141680 - RNA, 23 nt, Human
caaaacacuugaagcaaaaacuu

SEQ ID NO: 141681 - RNA, 22 nt, Human
caaaaccuaagugacacccaaa

SEQ ID NO: 141682 - RNA, 24 nt, Human
caauugcggaaaaacaaaguuucu

SEQ ID NO: 141683 - RNA, 22 nt, Human
cacaaagcagauuuacauacaa

SEQ ID NO: 141684 - RNA, 27 nt, Human
cacagaaucugauggacaaaggacauc

SEQ ID NO: 141685 - RNA, 25 nt, Human
ccacugaguugauuucauggcucac

SEQ ID NO: 141686 - RNA, 23 nt, Human
cuaagugacacccaaaacccuga

SEQ ID NO: 141687 - RNA, 22 nt, Human
cucacagaaucugauggacagc

SEQ ID NO: 141688 - RNA, 20 nt, Human
cucacccucaucacaaagaa

SEQ ID NO: 141689 - RNA, 19 nt, Human
cugguaugcaaaaaugcug

SEQ ID NO: 141690 - RNA, 21 nt, Human
cuucuuguuuucuguucuugg

SEQ ID NO: 141691 - RNA, 18 nt, Human
gaaucagucccauaucug

SEQ ID NO: 141692 - RNA, 26 nt, Human
gacacccaaaacccugauacaaagga

SEQ ID NO: 141693 - RNA, 23 nt, Human
gcaaaacaccaaaacacuugaag

SEQ ID NO: 141694 - RNA, 18 nt, Human
gugagacagaaaaaccug

SEQ ID NO: 141695 - RNA, 23 nt, Human
uaagaagacacuguuuacaucag

SEQ ID NO: 141696 - RNA, 23 nt, Human
uaagccacagaaucagucccaua

SEQ ID NO: 141697 - RNA, 21 nt, Human
uacaaaggaaucugagaaaca

SEQ ID NO: 141698 - RNA, 21 nt, Human
uacaugucuuucacaaacaua

SEQ ID NO: 141699 - RNA, 21 nt, Human
uaccuugugaaagaauuuguu

SEQ ID NO: 141700 - RNA, 21 nt, Human
uaguaaagaaaggaaagcaca

SEQ ID NO: 141701 - RNA, 19 nt, Human
uaguuccagaagcacucca

SEQ ID NO: 141702 - RNA, 21 nt, Human
uauuucauuuaucuuaucucu

SEQ ID NO: 141703 - RNA, 25 nt, Human
ucaaaacgaugccuggugucucaca

SEQ ID NO: 141704 - RNA, 27 nt, Human
uccccaaguuacaugucuuucacaaac

SEQ ID NO: 141705 - RNA, 19 nt, Human
ugaaaugugagccacagag

SEQ ID NO: 141706 - RNA, 23 nt, Human
ugaagcaaaaacuuuuuuuuuuu

SEQ ID NO: 141707 - RNA, 20 nt, Human
ugagaaacauaguaaagaaa

SEQ ID NO: 141708 - RNA, 25 nt, Human
ugagacagaaaaaccugguggcuga

SEQ ID NO: 141709 - RNA, 25 nt, Human
ugcaaaacaccaaaacacuugaagc

SEQ ID NO: 141710 - RNA, 19 nt, Human
ugcggaaaaacaaaguuuc

SEQ ID NO: 141711 - RNA, 23 nt, Human
ugcugaagggagaucauaugagu

SEQ ID NO: 141712 - RNA, 20 nt, Human
uggaaaaauaaacugaggau

SEQ ID NO: 141713 - RNA, 20 nt, Human
uggacaaaaccuaagugaca

SEQ ID NO: 141714 - RNA, 21 nt, Human
uugauccaaacacaaagaaaa

SEQ ID NO: 141715 - RNA, 24 nt, Human
uuguaccuugugaaagaauuuguu

SEQ ID NO: 141716 - RNA, 26 nt, Human
uuuguaccuugugaaagaauuuguuu

SEQ ID NO: 141717 - RNA, 20 nt, Human
uuuuuuuuuuuuagcaggaa

SEQ ID NO: 141718 - RNA, 25 nt, Human
aaaccgcccacucccugggccccgg

SEQ ID NO: 141719 - RNA, 21 nt, Human
aaagccacgcggaaaccaaaa

SEQ ID NO: 141720 - RNA, 20 nt, Human
caaagccacgcggaaaccaa

SEQ ID NO: 141721 - RNA, 23 nt, Human
caggccgccuugcggagggcaaa

SEQ ID NO: 141722 - RNA, 20 nt, Human
ccccguccguccccggcucc

SEQ ID NO: 141723 - RNA, 23 nt, Human
cccugccucccugccucccuccu

SEQ ID NO: 141724 - RNA, 25 nt, Human
cccugcgucgcucugucucucccuc

SEQ ID NO: 141725 - RNA, 18 nt, Human
ccucagcccgcgccggac

SEQ ID NO: 141726 - RNA, 24 nt, Human
ccuccccccguccguccccggcuc

SEQ ID NO: 141727 - RNA, 22 nt, Human
ccucccugccuuccuccccccg

SEQ ID NO: 141728 - RNA, 18 nt, Human
ccugggccccggaaccgg

SEQ ID NO: 141729 - RNA, 18 nt, Human
cguccccggcucccuccc

SEQ ID NO: 141730 - RNA, 24 nt, Human
cucccgcccgcccccagucccugc

SEQ ID NO: 141731 - RNA, 21 nt, Human
cucccuccuaacgucccuccg

SEQ ID NO: 141732 - RNA, 23 nt, Human
cugcguguggcuccuccguggcc

SEQ ID NO: 141733 - RNA, 21 nt, Human
gcagcgcgggggcggcccucg

SEQ ID NO: 141734 - RNA, 22 nt, Human
gcgggggcggcccucgcugccu

SEQ ID NO: 141735 - RNA, 22 nt, Human
gcuccuccguggccgggucugu

SEQ ID NO: 141736 - RNA, 19 nt, Human
ggccgggucugucggccuc

SEQ ID NO: 141737 - RNA, 20 nt, Human
ggccgggucugucggccucg

SEQ ID NO: 141738 - RNA, 24 nt, Human
ucccugccucccuccuaacguccc

SEQ ID NO: 141739 - RNA, 19 nt, Human
ucccugccucccugccucc

SEQ ID NO: 141740 - RNA, 19 nt, Human
ucccugccucccugccucc

SEQ ID NO: 141741 - RNA, 21 nt, Human
ucugucucucccuccguuccu

SEQ ID NO: 141742 - RNA, 25 nt, Human
ugaaaacccgacggcaacuggagac

SEQ ID NO: 141743 - RNA, 20 nt, Human
ugcagggcucagccugggga

SEQ ID NO: 141744 - RNA, 18 nt, Human
ugcggucugugaaccgcg

SEQ ID NO: 141745 - RNA, 24 nt, Human
ugggcccagcccucagcccgcgcc

SEQ ID NO: 141746 - RNA, 18 nt, Human
uuucccggagggcggggg

SEQ ID NO: 141747 - RNA, 22 nt, Human
acacgugggggccagagaagcc

SEQ ID NO: 141748 - RNA, 21 nt, Human
acccugccucccguccuggcc

SEQ ID NO: 141749 - RNA, 19 nt, Human
acccugggggccugggcac

SEQ ID NO: 141750 - RNA, 19 nt, Human
acgcgagcucugcaugcgg

SEQ ID NO: 141751 - RNA, 21 nt, Human
agagaagccaggaaggccgcg

SEQ ID NO: 141752 - RNA, 25 nt, Human
agccugccccccacccugccucccg

SEQ ID NO: 141753 - RNA, 18 nt, Human
aggaccgccagcucccca

SEQ ID NO: 141754 - RNA, 24 nt, Human
cacagcugugcaggaggugggggu

SEQ ID NO: 141755 - RNA, 21 nt, Human
cacgcgagcucugcaugcggc

SEQ ID NO: 141756 - RNA, 20 nt, Human
cagcagcaggugggacagau

SEQ ID NO: 141757 - RNA, 19 nt, Human
cagccugccccccacccug

SEQ ID NO: 141758 - RNA, 20 nt, Human
ccagagaagccaggaaggcc

SEQ ID NO: 141759 - RNA, 18 nt, Human
ccagcccucucucgucuu

SEQ ID NO: 141760 - RNA, 20 nt, Human
ccauggucccucccugcccu

SEQ ID NO: 141761 - RNA, 20 nt, Human
cccauaaaauuaaacgcuuu

SEQ ID NO: 141762 - RNA, 18 nt, Human
ccccaagaccucccuccc

SEQ ID NO: 141763 - RNA, 19 nt, Human
ccccaagaccucccucccu

SEQ ID NO: 141764 - RNA, 19 nt, Human
ccccaagaccucccucccu

SEQ ID NO: 141765 - RNA, 21 nt, Human
ccccacccugccucccguccu

SEQ ID NO: 141766 - RNA, 21 nt, Human
cccccacgaaggcaagcccac

SEQ ID NO: 141767 - RNA, 18 nt, Human
ccccccacccugccuccc

SEQ ID NO: 141768 - RNA, 26 nt, Human
ccccccacccugccucccguccuggc

SEQ ID NO: 141769 - RNA, 26 nt, Human
ccccuugacccugcgggccauggucc

SEQ ID NO: 141770 - RNA, 20 nt, Human
cccgcccgcccgccugcgcc

SEQ ID NO: 141771 - RNA, 22 nt, Human
cccgcccgccugcgccccgccc

SEQ ID NO: 141772 - RNA, 19 nt, Human
cccugccucccguccuggc

SEQ ID NO: 141773 - RNA, 22 nt, Human
cccuggcugggacacggugggc

SEQ ID NO: 141774 - RNA, 19 nt, Human
ccgcauggaccacccuggg

SEQ ID NO: 141775 - RNA, 24 nt, Human
ccgcccgcccgccugcgccccgcc

SEQ ID NO: 141776 - RNA, 24 nt, Human
ccucccguccuggcccccacgaag

SEQ ID NO: 141777 - RNA, 26 nt, Human
ccucccguccuggcccccacgaaggc

SEQ ID NO: 141778 - RNA, 20 nt, Human
ccuccucccccgagucaccg

SEQ ID NO: 141779 - RNA, 23 nt, Human
cgcccgcccgccugcgccccgcc

SEQ ID NO: 141780 - RNA, 19 nt, Human
cggcgcggagcccgcgcgc

SEQ ID NO: 141781 - RNA, 20 nt, Human
cggcgcggagcccgcgcgcu

SEQ ID NO: 141782 - RNA, 23 nt, Human
cuaaacgcugggacuuugauaca

SEQ ID NO: 141783 - RNA, 23 nt, Human
gacagaugacagggucgccuccu

SEQ ID NO: 141784 - RNA, 18 nt, Human
gagcuggagcagccaggc

SEQ ID NO: 141785 - RNA, 21 nt, Human
gcacagcugugcaggaggugg

SEQ ID NO: 141786 - RNA, 18 nt, Human
gcagcagcaggugggaca

SEQ ID NO: 141787 - RNA, 19 nt, Human
gcagcagcaggugggacag

SEQ ID NO: 141788 - RNA, 29 nt, Human
gcccgccugcgccccgcccggcccgcacc

SEQ ID NO: 141789 - RNA, 19 nt, Human
gcccggcccggggcucgga

SEQ ID NO: 141790 - RNA, 18 nt, Human
gccugccccccacccugc

SEQ ID NO: 141791 - RNA, 18 nt, Human
gccugccccccacccugc

SEQ ID NO: 141792 - RNA, 20 nt, Human
gccugggcacagcugugcag

SEQ ID NO: 141793 - RNA, 22 nt, Human
gcgcucagggcccggcccgggg

SEQ ID NO: 141794 - RNA, 20 nt, Human
gcggggcgcuacccgcccgc

SEQ ID NO: 141795 - RNA, 24 nt, Human
ggacagaugacagggucgccuccu

SEQ ID NO: 141796 - RNA, 20 nt, Human
ggcgcggcggcggcgcggag

SEQ ID NO: 141797 - RNA, 18 nt, Human
gggcagcagcagguggga

SEQ ID NO: 141798 - RNA, 21 nt, Human
gggcagcagcaggugggacag

SEQ ID NO: 141799 - RNA, 27 nt, Human
gggccauggucccucccugcccuggcu

SEQ ID NO: 141800 - RNA, 18 nt, Human
uacagcacagacacgugg

SEQ ID NO: 141801 - RNA, 20 nt, Human
uacaguaucuacagcacaga

SEQ ID NO: 141802 - RNA, 24 nt, Human
ucaccaaggacgggccaccugacu

SEQ ID NO: 141803 - RNA, 21 nt, Human
ucagccgagagcccgaggggg

SEQ ID NO: 141804 - RNA, 21 nt, Human
ucaggagcuggagcagccagg

SEQ ID NO: 141805 - RNA, 24 nt, Human
ucaggagcuggagcagccaggcug

SEQ ID NO: 141806 - RNA, 18 nt, Human
ucagggcccggcccgggg

SEQ ID NO: 141807 - RNA, 22 nt, Human
uccccaagaccucccucccugu

SEQ ID NO: 141808 - RNA, 26 nt, Human
ucccccgagucaccggccaggcaaua

SEQ ID NO: 141809 - RNA, 18 nt, Human
uccuccacguacuuucag

SEQ ID NO: 141810 - RNA, 24 nt, Human
ugaggggcagagagggagcgcccc

SEQ ID NO: 141811 - RNA, 18 nt, Human
ugcccuggcugggacacg

SEQ ID NO: 141812 - RNA, 21 nt, Human
ugcccuggcugggacacggug

SEQ ID NO: 141813 - RNA, 19 nt, Human
ugugcacucaccaaggacg

SEQ ID NO: 141814 - RNA, 18 nt, Human
ugugugcgcgcagugugu

SEQ ID NO: 141815 - RNA, 21 nt, Human
ugugugcgcgcagugugugca

SEQ ID NO: 141816 - RNA, 22 nt, Human
uguugccggaugggaggagaga

SEQ ID NO: 141817 - RNA, 18 nt, Human
uugccggaugggaggaga

SEQ ID NO: 141818 - RNA, 21 nt, Human
aaaaagacggacggauggaga

SEQ ID NO: 141819 - RNA, 19 nt, Human
aaagaggccccccuccccc

SEQ ID NO: 141820 - RNA, 19 nt, Human
aaagugcugggauuacaga

SEQ ID NO: 141821 - RNA, 24 nt, Human
aaagugcugggauuacagacguga

SEQ ID NO: 141822 - RNA, 23 nt, Human
aaauauggaagcccaggagagcc

SEQ ID NO: 141823 - RNA, 18 nt, Human
aaccuggagcuaagaacu

SEQ ID NO: 141824 - RNA, 23 nt, Human
aagaaagaaaagaaauguuucag

SEQ ID NO: 141825 - RNA, 18 nt, Human
aagcccaggagagccagg

SEQ ID NO: 141826 - RNA, 26 nt, Human
aagcgauucuugugccucagccuccu

SEQ ID NO: 141827 - RNA, 18 nt, Human
aaguccuggaagucuccu

SEQ ID NO: 141828 - RNA, 24 nt, Human
aagugauccaccugucucagccuc

SEQ ID NO: 141829 - RNA, 19 nt, Human
aagugcugggauuacagac

SEQ ID NO: 141830 - RNA, 26 nt, Human
aagugcugggauuacagacgugagcc

SEQ ID NO: 141831 - RNA, 23 nt, Human
acaaagcccucugcacaccaaaa

SEQ ID NO: 141832 - RNA, 23 nt, Human
acacauuccccggaucuggcugg

SEQ ID NO: 141833 - RNA, 18 nt, Human
acagacgugagccaccgc

SEQ ID NO: 141834 - RNA, 19 nt, Human
acaggcaggugccaaaacc

SEQ ID NO: 141835 - RNA, 18 nt, Human
acaggguuuugcuauguu

SEQ ID NO: 141836 - RNA, 23 nt, Human
acaggguuuugcuauguuggcca

SEQ ID NO: 141837 - RNA, 24 nt, Human
acaggguuuugcuauguuggccag

SEQ ID NO: 141838 - RNA, 18 nt, Human
accaccuaacuccaaauc

SEQ ID NO: 141839 - RNA, 21 nt, Human
accaggaaggggagaagggug

SEQ ID NO: 141840 - RNA, 22 nt, Human
accgcacccguccaaggaagua

SEQ ID NO: 141841 - RNA, 18 nt, Human
acgcagccggcuggggug

SEQ ID NO: 141842 - RNA, 19 nt, Human
acgugccccacccugcaag

SEQ ID NO: 141843 - RNA, 18 nt, Human
acucugucacccaggcug

SEQ ID NO: 141844 - RNA, 25 nt, Human
acucugucacccaggcuggagugcg

SEQ ID NO: 141845 - RNA, 22 nt, Human
agaaagaaaagaaauguuucag

SEQ ID NO: 141846 - RNA, 18 nt, Human
agacaggguuuugcuaug

SEQ ID NO: 141847 - RNA, 21 nt, Human
agagaacacauuccccggauc

SEQ ID NO: 141848 - RNA, 19 nt, Human
agaggaacgcagccggcug

SEQ ID NO: 141849 - RNA, 18 nt, Human
agaggggagagggagggc

SEQ ID NO: 141850 - RNA, 24 nt, Human
agcaccaacaagucuggucccuuc

SEQ ID NO: 141851 - RNA, 21 nt, Human
aggaaaaaagaaagaaaagaa

SEQ ID NO: 141852 - RNA, 21 nt, Human
aggaaacgaacuggggccaga

SEQ ID NO: 141853 - RNA, 22 nt, Human
aggaaagagaagugaaucaaag

SEQ ID NO: 141854 - RNA, 19 nt, Human
aggcacaggcagggauggc

SEQ ID NO: 141855 - RNA, 18 nt, Human
aggcagggauggcaugga

SEQ ID NO: 141856 - RNA, 29 nt, Human
aggcagggggaugguuaguagggaggacg

SEQ ID NO: 141857 - RNA, 25 nt, Human
aggcagguuagggggcugcagagcc

SEQ ID NO: 141858 - RNA, 22 nt, Human
aggccuggaggugagaugagcc

SEQ ID NO: 141859 - RNA, 18 nt, Human
aggggcugcugaagcagg

SEQ ID NO: 141860 - RNA, 22 nt, Human
agggggcugcagagccaaucgg

SEQ ID NO: 141861 - RNA, 21 nt, Human
aggggucugaaggaaccagca

SEQ ID NO: 141862 - RNA, 23 nt, Human
aguagagaggggagagggagggc

SEQ ID NO: 141863 - RNA, 23 nt, Human
aguagcugagauuacaggcaggu

SEQ ID NO: 141864 - RNA, 24 nt, Human
agucggacaagacagagucagaga

SEQ ID NO: 141865 - RNA, 24 nt, Human
agugauccaccugucucagccucc

SEQ ID NO: 141866 - RNA, 24 nt, Human
agugcugggauuacagacgugagc

SEQ ID NO: 141867 - RNA, 19 nt, Human
auccaggugagaaaaugcu

SEQ ID NO: 141868 - RNA, 18 nt, Human
aucucacucugucaccca

SEQ ID NO: 141869 - RNA, 22 nt, Human
auggagcugggggaggggcccu

SEQ ID NO: 141870 - RNA, 20 nt, Human
auguuggccaggcuggucuc

SEQ ID NO: 141871 - RNA, 21 nt, Human
auguuggccaggcuggucucg

SEQ ID NO: 141872 - RNA, 20 nt, Human
auugagcaccuacucuacug

SEQ ID NO: 141873 - RNA, 24 nt, Human
auugggggaggaaaaaagaaagaa

SEQ ID NO: 141874 - RNA, 24 nt, Human
auuuuuguauuuuuaguagagaca

SEQ ID NO: 141875 - RNA, 23 nt, Human
caaaaccaccuaacuccaaaucc

SEQ ID NO: 141876 - RNA, 22 nt, Human
caaacccaaaaccaccuaacuc

SEQ ID NO: 141877 - RNA, 22 nt, Human
caaagcccucugcacaccaaaa

SEQ ID NO: 141878 - RNA, 24 nt, Human
caaagugcugggauuacagacgug

SEQ ID NO: 141879 - RNA, 21 nt, Human
caacaaagcccucugcacacc

SEQ ID NO: 141880 - RNA, 27 nt, Human
caacucccaaaauggggguugcagagg

SEQ ID NO: 141881 - RNA, 22 nt, Human
caagugauccaccugucucagc

SEQ ID NO: 141882 - RNA, 22 nt, Human
cacaacaacccugugagguagg

SEQ ID NO: 141883 - RNA, 21 nt, Human
cacaaccaaaaauaguagagc

SEQ ID NO: 141884 - RNA, 23 nt, Human
cacaggcagggauggcauggaaa

SEQ ID NO: 141885 - RNA, 20 nt, Human
caccaaggucauugcugggg

SEQ ID NO: 141886 - RNA, 22 nt, Human
caccccagcccccaaaauaugg

SEQ ID NO: 141887 - RNA, 18 nt, Human
caccgcacccguccaagg

SEQ ID NO: 141888 - RNA, 23 nt, Human
caccugucucagccucccaaagu

SEQ ID NO: 141889 - RNA, 23 nt, Human
cacucugucacccaggcuggagu

SEQ ID NO: 141890 - RNA, 24 nt, Human
cacucugucacccaggcuggagug

SEQ ID NO: 141891 - RNA, 20 nt, Human
cacugugcuaggcacuuuuc

SEQ ID NO: 141892 - RNA, 22 nt, Human
cagcacgcagggcaggcauggg

SEQ ID NO: 141893 - RNA, 20 nt, Human
cagcccccaaaauauggaag

SEQ ID NO: 141894 - RNA, 21 nt, Human
cagcccccaaaauauggaagg

SEQ ID NO: 141895 - RNA, 20 nt, Human
cagccuccugaguagcugag

SEQ ID NO: 141896 - RNA, 21 nt, Human
cagcucggcggcugcuggcgg

SEQ ID NO: 141897 - RNA, 19 nt, Human
caggcagggauggcaugga

SEQ ID NO: 141898 - RNA, 22 nt, Human
caggggaccagccccacaaccu

SEQ ID NO: 141899 - RNA, 24 nt, Human
caggguuuugcuauguuggccagg

SEQ ID NO: 141900 - RNA, 18 nt, Human
cagguaccagacaaagua

SEQ ID NO: 141901 - RNA, 21 nt, Human
caggugagaaaaugcugggga

SEQ ID NO: 141902 - RNA, 20 nt, Human
cauuuuacauacgagggaac

SEQ ID NO: 141903 - RNA, 25 nt, Human
ccaaaaccaccuaacuccaaauccc

SEQ ID NO: 141904 - RNA, 22 nt, Human
ccaaagugcugggauuacagac

SEQ ID NO: 141905 - RNA, 24 nt, Human
ccaaagugcugggauuacagacgu

SEQ ID NO: 141906 - RNA, 19 nt, Human
ccaaccucaacuggccugu

SEQ ID NO: 141907 - RNA, 26 nt, Human
ccaccugucucagccucccaaagugc

SEQ ID NO: 141908 - RNA, 19 nt, Human
ccagccccacaaccuagga

SEQ ID NO: 141909 - RNA, 23 nt, Human
ccagcccugaggcuuaaaugaac

SEQ ID NO: 141910 - RNA, 22 nt, Human
ccagcucccuuguucuccgggg

SEQ ID NO: 141911 - RNA, 20 nt, Human
ccagcucggcggcugcuggc

SEQ ID NO: 141912 - RNA, 23 nt, Human
ccaggaaggggagaaggguguca

SEQ ID NO: 141913 - RNA, 19 nt, Human
ccauagagauguccaguag

SEQ ID NO: 141914 - RNA, 25 nt, Human
cccaaaaccaccuaacuccaaaucc

SEQ ID NO: 141915 - RNA, 25 nt, Human
cccagagacaaaagggguccuggga

SEQ ID NO: 141916 - RNA, 21 nt, Human
cccagcccccaaaauauggaa

SEQ ID NO: 141917 - RNA, 21 nt, Human
cccagcucggcggcugcuggc

SEQ ID NO: 141918 - RNA, 22 nt, Human
cccaugcuccaaugaauuaaag

SEQ ID NO: 141919 - RNA, 19 nt, Human
ccccaaaaccuggagcuaa

SEQ ID NO: 141920 - RNA, 19 nt, Human
ccccacccucgcagcaccc

SEQ ID NO: 141921 - RNA, 24 nt, Human
ccccacccucgcagcacccugcga

SEQ ID NO: 141922 - RNA, 18 nt, Human
ccccacccugcaagccca

SEQ ID NO: 141923 - RNA, 28 nt, Human
ccccagcccccaaaauauggaagccccu

SEQ ID NO: 141924 - RNA, 22 nt, Human
cccccaaaauauggaagcccag

SEQ ID NO: 141925 - RNA, 23 nt, Human
cccgaccucaagugauccaccug

SEQ ID NO: 141926 - RNA, 24 nt, Human
cccgaccucaagugauccaccugu

SEQ ID NO: 141927 - RNA, 22 nt, Human
ccgcccgccgccgccgcggccg

SEQ ID NO: 141928 - RNA, 24 nt, Human
ccgcccgccgccgccgcggccgcg

SEQ ID NO: 141929 - RNA, 22 nt, Human
ccgcggccgcgcuuccgcuccc

SEQ ID NO: 141930 - RNA, 21 nt, Human
ccucggaggcugggccucccc

SEQ ID NO: 141931 - RNA, 22 nt, Human
ccugagacccagcuuaugggcu

SEQ ID NO: 141932 - RNA, 19 nt, Human
ccugaguagcugagauuac

SEQ ID NO: 141933 - RNA, 23 nt, Human
ccugaguagcugagauuacaggc

SEQ ID NO: 141934 - RNA, 24 nt, Human
ccugaguagcugagauuacaggca

SEQ ID NO: 141935 - RNA, 18 nt, Human
ccuuugcugagcccagcc

SEQ ID NO: 141936 - RNA, 20 nt, Human
cgauucuugugccucagccu

SEQ ID NO: 141937 - RNA, 18 nt, Human
cgccgcccgccgccgccg

SEQ ID NO: 141938 - RNA, 26 nt, Human
cgccgcccgccgccgccgcggccgcg

SEQ ID NO: 141939 - RNA, 18 nt, Human
cggcgcggcccagcggcu

SEQ ID NO: 141940 - RNA, 20 nt, Human
cgguaggugcaccccacccu

SEQ ID NO: 141941 - RNA, 23 nt, Human
cucaagugauccaccugucucag

SEQ ID NO: 141942 - RNA, 21 nt, Human
cucacagaaagucaaacagcc

SEQ ID NO: 141943 - RNA, 24 nt, Human
cucacucugucacccaggcuggag

SEQ ID NO: 141944 - RNA, 28 nt, Human
cucacugcaaccuccgcuugcuuccugg

SEQ ID NO: 141945 - RNA, 20 nt, Human
cucacuuuugacaccccagc

SEQ ID NO: 141946 - RNA, 20 nt, Human
cucccagaaggcaggcaaga

SEQ ID NO: 141947 - RNA, 20 nt, Human
cuccgggggcuaccgggucc

SEQ ID NO: 141948 - RNA, 23 nt, Human
cucgcagcacccugcgagcaguu

SEQ ID NO: 141949 - RNA, 18 nt, Human
cugaguagcugagauuac

SEQ ID NO: 141950 - RNA, 23 nt, Human
cugaguagcugagauuacaggca

SEQ ID NO: 141951 - RNA, 23 nt, Human
cugauaagauaugggaagaagga

SEQ ID NO: 141952 - RNA, 22 nt, Human
cugcaaccuccgcuugcuuccu

SEQ ID NO: 141953 - RNA, 21 nt, Human
cugcaagcccacgccucuugc

SEQ ID NO: 141954 - RNA, 23 nt, Human
cugcaagcccacgccucuugcac

SEQ ID NO: 141955 - RNA, 23 nt, Human
cugcagagccaaucgguaggugc

SEQ ID NO: 141956 - RNA, 23 nt, Human
cugcuggcggcgccagcucccuu

SEQ ID NO: 141957 - RNA, 23 nt, Human
cuggaauucaaacccaaaaccac

SEQ ID NO: 141958 - RNA, 20 nt, Human
cuggcgaccgcgacucuucc

SEQ ID NO: 141959 - RNA, 18 nt, Human
cuggucccagagacaaaa

SEQ ID NO: 141960 - RNA, 23 nt, Human
cugucucagccucccaaagugcu

SEQ ID NO: 141961 - RNA, 24 nt, Human
cugucucagccucccaaagugcug

SEQ ID NO: 141962 - RNA, 22 nt, Human
cuugccgccgcgacuccucuug

SEQ ID NO: 141963 - RNA, 25 nt, Human
cuugugccucagccuccugaguagc

SEQ ID NO: 141964 - RNA, 20 nt, Human
gaaagucaaacagcccgaaa

SEQ ID NO: 141965 - RNA, 24 nt, Human
gaccucaagugauccaccugucuc

SEQ ID NO: 141966 - RNA, 20 nt, Human
gagagaacacauuccccgga

SEQ ID NO: 141967 - RNA, 24 nt, Human
gagaggaacgcagccggcuggggu

SEQ ID NO: 141968 - RNA, 18 nt, Human
gagcaguuagcgcaccug

SEQ ID NO: 141969 - RNA, 26 nt, Human
gaguagcugagauuacaggcaggugc

SEQ ID NO: 141970 - RNA, 22 nt, Human
gaugccauggugaaugugaaaa

SEQ ID NO: 141971 - RNA, 18 nt, Human
gauuacagacgugagcca

SEQ ID NO: 141972 - RNA, 23 nt, Human
gauuacagacgugagccaccgca

SEQ ID NO: 141973 - RNA, 21 nt, Human
gauucuugugccucagccucc

SEQ ID NO: 141974 - RNA, 29 nt, Human
gauuuaguuccuuuuauuucccuuucagg

SEQ ID NO: 141975 - RNA, 20 nt, Human
gcacaccaaaaccccaggaa

SEQ ID NO: 141976 - RNA, 23 nt, Human
gcagcacccugcgagcaguuagc

SEQ ID NO: 141977 - RNA, 20 nt, Human
gcagggcaggcauggggcag

SEQ ID NO: 141978 - RNA, 20 nt, Human
gcccugaggcuuaaaugaac

SEQ ID NO: 141979 - RNA, 24 nt, Human
gcgauucuugugccucagccuccu

SEQ ID NO: 141980 - RNA, 20 nt, Human
gcuauguuggccaggcuggu

SEQ ID NO: 141981 - RNA, 22 nt, Human
gcuauuggaggcgacuacagcu

SEQ ID NO: 141982 - RNA, 23 nt, Human
gcuggucucgaacucccgaccuc

SEQ ID NO: 141983 - RNA, 23 nt, Human
ggagacucacgggaaaguggacg

SEQ ID NO: 141984 - RNA, 18 nt, Human
ggagguuguguguggggg

SEQ ID NO: 141985 - RNA, 18 nt, Human
ggaugguuaguaggggca

SEQ ID NO: 141986 - RNA, 23 nt, Human
gggaagcccugaggggcugcuga

SEQ ID NO: 141987 - RNA, 22 nt, Human
gggaauggccugucgguugcaa

SEQ ID NO: 141988 - RNA, 21 nt, Human
gggcagggaccagcccugagg

SEQ ID NO: 141989 - RNA, 18 nt, Human
ggggaugguuaguagggg

SEQ ID NO: 141990 - RNA, 22 nt, Human
ggguuuugcuauguuggccagg

SEQ ID NO: 141991 - RNA, 19 nt, Human
gguagcaccaacaagucug

SEQ ID NO: 141992 - RNA, 19 nt, Human
gguugggcagaugaguuga

SEQ ID NO: 141993 - RNA, 23 nt, Human
guagagacaggguuuugcuaugu

SEQ ID NO: 141994 - RNA, 25 nt, Human
guagagcuggaauucaaacccaaaa

SEQ ID NO: 141995 - RNA, 18 nt, Human
gugauccaccugucucag

SEQ ID NO: 141996 - RNA, 24 nt, Human
gugauccaccugucucagccuccc

SEQ ID NO: 141997 - RNA, 22 nt, Human
gugccucagccuccugaguagc

SEQ ID NO: 141998 - RNA, 19 nt, Human
gugggcuccuguguccuug

SEQ ID NO: 141999 - RNA, 20 nt, Human
guugcagacugaggcagcag

SEQ ID NO: 142000 - RNA, 19 nt, Human
uaaauccucacaacaaccc

SEQ ID NO: 142001 - RNA, 22 nt, Human
uaaaugaacuugcauaggcacc

SEQ ID NO: 142002 - RNA, 24 nt, Human
uaauuuuuguauuuuuaguagaga

SEQ ID NO: 142003 - RNA, 23 nt, Human
uacagacgugagccaccgcaccc

SEQ ID NO: 142004 - RNA, 21 nt, Human
uacaggcaggugccaaaacac

SEQ ID NO: 142005 - RNA, 21 nt, Human
uaccgggucccagcgccgccc

SEQ ID NO: 142006 - RNA, 20 nt, Human
uacugugugccaggcacugu

SEQ ID NO: 142007 - RNA, 23 nt, Human
uacugugugccaggcacugugcu

SEQ ID NO: 142008 - RNA, 24 nt, Human
uacugugugccaggcacugugcua

SEQ ID NO: 142009 - RNA, 22 nt, Human
uagagacaggguuuugcuaugu

SEQ ID NO: 142010 - RNA, 24 nt, Human
uagagcuggaauucaaacccaaaa

SEQ ID NO: 142011 - RNA, 23 nt, Human
uagauugugaugaaguaaccagg

SEQ ID NO: 142012 - RNA, 24 nt, Human
uaguagagacaggguuuugcuaug

SEQ ID NO: 142013 - RNA, 24 nt, Human
uaguagagcuggaauucaaaccca

SEQ ID NO: 142014 - RNA, 21 nt, Human
uaguuugcuuuugagacagaa

SEQ ID NO: 142015 - RNA, 21 nt, Human
uauacggaacuguccauagag

SEQ ID NO: 142016 - RNA, 22 nt, Human
uauagcagaggcuuaaagagaa

SEQ ID NO: 142017 - RNA, 19 nt, Human
uaucagcagcaauugagga

SEQ ID NO: 142018 - RNA, 21 nt, Human
uauggaagcccaggagagcca

SEQ ID NO: 142019 - RNA, 21 nt, Human
uauguuggccaggcuggucuc

SEQ ID NO: 142020 - RNA, 24 nt, Human
uauguuggccaggcuggucucgaa

SEQ ID NO: 142021 - RNA, 23 nt, Human
ucaaacagcccgaaauucuuggc

SEQ ID NO: 142022 - RNA, 18 nt, Human
ucaagagagucggacaag

SEQ ID NO: 142023 - RNA, 22 nt, Human
ucaagugauccaccugucucag

SEQ ID NO: 142024 - RNA, 22 nt, Human
ucacccaggcuggagugcgauc

SEQ ID NO: 142025 - RNA, 24 nt, Human
ucacucugucacccaggcuggagu

SEQ ID NO: 142026 - RNA, 19 nt, Human
ucacugcaaccuccgcuug

SEQ ID NO: 142027 - RNA, 20 nt, Human
ucacugcaaccuccgcuugc

SEQ ID NO: 142028 - RNA, 26 nt, Human
ucacugcaaccuccgcuuggggcccu

SEQ ID NO: 142029 - RNA, 28 nt, Human
ucacugcaaccuccgcuuggggcccucc

SEQ ID NO: 142030 - RNA, 26 nt, Human
ucacugcaaccuccgcuugggguacu

SEQ ID NO: 142031 - RNA, 26 nt, Human
ucacugcaaccuccgcuugggguccu

SEQ ID NO: 142032 - RNA, 28 nt, Human
ucacugcaaccuccgcuugggguccucc

SEQ ID NO: 142033 - RNA, 25 nt, Human
ucacugcaaccuccgcuuggggucu

SEQ ID NO: 142034 - RNA, 20 nt, Human
ucccaaaauggggguugcag

SEQ ID NO: 142035 - RNA, 18 nt, Human
ucccaaagugcugggauu

SEQ ID NO: 142036 - RNA, 24 nt, Human
ucccaaagugcugggauuacagac

SEQ ID NO: 142037 - RNA, 21 nt, Human
ucccagagacaaaaggggucc

SEQ ID NO: 142038 - RNA, 23 nt, Human
uccccagaagccuagugacucau

SEQ ID NO: 142039 - RNA, 22 nt, Human
uccccagaagccuagugacucu

SEQ ID NO: 142040 - RNA, 23 nt, Human
ucccuggaagccaccagcugcuc

SEQ ID NO: 142041 - RNA, 24 nt, Human
uccugaguagcugagauuacaggc

SEQ ID NO: 142042 - RNA, 21 nt, Human
uccuggauucaagcgauucuu

SEQ ID NO: 142043 - RNA, 22 nt, Human
uccuggauucaagcgauucuug

SEQ ID NO: 142044 - RNA, 23 nt, Human
uccuugggaagcccugaggggcu

SEQ ID NO: 142045 - RNA, 20 nt, Human
ucgcugggggcucacagaaa

SEQ ID NO: 142046 - RNA, 19 nt, Human
ucggacaagacagagucag

SEQ ID NO: 142047 - RNA, 23 nt, Human
ucucacucugucacccaggcugg

SEQ ID NO: 142048 - RNA, 24 nt, Human
ucucacucugucacccaggcugga

SEQ ID NO: 142049 - RNA, 22 nt, Human
ucugcacaccaaaaccccagga

SEQ ID NO: 142050 - RNA, 24 nt, Human
ucugucacccaggcuggagugcga

SEQ ID NO: 142051 - RNA, 24 nt, Human
ugaaauaaaugccaaaauguuccu

SEQ ID NO: 142052 - RNA, 24 nt, Human
ugaaauggauaugauaugcugaua

SEQ ID NO: 142053 - RNA, 23 nt, Human
ugaauuaaaguagagaggggaga

SEQ ID NO: 142054 - RNA, 22 nt, Human
ugagacagaaucucacucuguc

SEQ ID NO: 142055 - RNA, 19 nt, Human
ugagagaacacauuccccg

SEQ ID NO: 142056 - RNA, 19 nt, Human
ugagauuacaggcaggugc

SEQ ID NO: 142057 - RNA, 21 nt, Human
ugagauuacaggcaggugcca

SEQ ID NO: 142058 - RNA, 19 nt, Human
ugagccugcugguuaguag

SEQ ID NO: 142059 - RNA, 19 nt, Human
ugagggagugagcgugcca

SEQ ID NO: 142060 - RNA, 22 nt, Human
ugagggagugagcgugccacca

SEQ ID NO: 142061 - RNA, 22 nt, Human
ugaguugagucuauacggaacu

SEQ ID NO: 142062 - RNA, 22 nt, Human
ugcaagcccacgccucuugcac

SEQ ID NO: 142063 - RNA, 21 nt, Human
ugcacacgugccugauggggu

SEQ ID NO: 142064 - RNA, 21 nt, Human
ugcacaucucaccuggguacu

SEQ ID NO: 142065 - RNA, 22 nt, Human
ugccucagccuccugaguagcu

SEQ ID NO: 142066 - RNA, 24 nt, Human
ugccucagccuccugaguagcuga

SEQ ID NO: 142067 - RNA, 22 nt, Human
ugcugagcccagccugagaccc

SEQ ID NO: 142068 - RNA, 24 nt, Human
ugcugggauuacagacgugagcca

SEQ ID NO: 142069 - RNA, 19 nt, Human
uggaagcacugauacugac

SEQ ID NO: 142070 - RNA, 20 nt, Human
uggaagcccaggagagccaa

SEQ ID NO: 142071 - RNA, 19 nt, Human
uggaauucaaacccaaaac

SEQ ID NO: 142072 - RNA, 21 nt, Human
uggaauucaaacccaaaacca

SEQ ID NO: 142073 - RNA, 22 nt, Human
uggagcuaagaacuucaucuca

SEQ ID NO: 142074 - RNA, 18 nt, Human
uggagcugggggaggggc

SEQ ID NO: 142075 - RNA, 23 nt, Human
uggccaggcuggucucgaacucc

SEQ ID NO: 142076 - RNA, 21 nt, Human
uggccugugggcuccuguguc

SEQ ID NO: 142077 - RNA, 23 nt, Human
uggccugugggcuccuguguccu

SEQ ID NO: 142078 - RNA, 20 nt, Human
uggcggcgccagcucccuug

SEQ ID NO: 142079 - RNA, 23 nt, Human
uggcuagaagccauggacugggu

SEQ ID NO: 142080 - RNA, 20 nt, Human
ugggagcggaauggagcugg

SEQ ID NO: 142081 - RNA, 21 nt, Human
ugggagcggaauggagcuggg

SEQ ID NO: 142082 - RNA, 19 nt, Human
ugggaugccauggugaaug

SEQ ID NO: 142083 - RNA, 22 nt, Human
ugggaugccauggugaauguga

SEQ ID NO: 142084 - RNA, 18 nt, Human
ugggauuacagacgugag

SEQ ID NO: 142085 - RNA, 19 nt, Human
ugggauuacagacgugagc

SEQ ID NO: 142086 - RNA, 21 nt, Human
ugggauuacagacgugagcca

SEQ ID NO: 142087 - RNA, 22 nt, Human
ugggauuacagacgugagccac

SEQ ID NO: 142088 - RNA, 23 nt, Human
ugggauuacagacgugagccacc

SEQ ID NO: 142089 - RNA, 24 nt, Human
ugggauuacagacgugagccaccg

SEQ ID NO: 142090 - RNA, 27 nt, Human
ugggcagaugaguugagucgaacguuu

SEQ ID NO: 142091 - RNA, 22 nt, Human
uggggccagaggcagguuaggg

SEQ ID NO: 142092 - RNA, 20 nt, Human
ugggggcucacagaaaguca

SEQ ID NO: 142093 - RNA, 19 nt, Human
ugggggugggaauggccug

SEQ ID NO: 142094 - RNA, 19 nt, Human
uggggguugcagaggggag

SEQ ID NO: 142095 - RNA, 20 nt, Human
ugggguaaagucaagagguu

SEQ ID NO: 142096 - RNA, 18 nt, Human
uggggugggagcggaaug

SEQ ID NO: 142097 - RNA, 23 nt, Human
uggggugggagcggaauggagcu

SEQ ID NO: 142098 - RNA, 19 nt, Human
uggucucgaacucccgacc

SEQ ID NO: 142099 - RNA, 19 nt, Human
ugguuucaguaaugugggg

SEQ ID NO: 142100 - RNA, 22 nt, Human
uguccaguagguaauaccaaua

SEQ ID NO: 142101 - RNA, 24 nt, Human
ugucucagccucccaaagugcugg

SEQ ID NO: 142102 - RNA, 21 nt, Human
ugucuggaaguccuggaaguc

SEQ ID NO: 142103 - RNA, 18 nt, Human
ugugcauguaugcauaca

SEQ ID NO: 142104 - RNA, 18 nt, Human
ugugggggcuggacaucc

SEQ ID NO: 142105 - RNA, 25 nt, Human
uuaaauaacucuaucacacaaccaa

SEQ ID NO: 142106 - RNA, 18 nt, Human
uuaguagagacaggguuu

SEQ ID NO: 142107 - RNA, 24 nt, Human
uuaguagagacaggguuuugcuau

SEQ ID NO: 142108 - RNA, 23 nt, Human
uucaagcgauucuugugccucag

SEQ ID NO: 142109 - RNA, 23 nt, Human
uuuugcuauguuggccaggcugg

SEQ ID NO: 142110 - RNA, 21 nt, Human
uuuuuaguagagacaggguuu

SEQ ID NO: 142111 - RNA, 21 nt, Human
uuuuuaguagagacaggguuu

SEQ ID NO: 142112 - RNA, 20 nt, Human
uuuuuguauuuuuaguagag

SEQ ID NO: 142113 - RNA, 18 nt, Human
aacaaggagugcucauca

SEQ ID NO: 142114 - RNA, 24 nt, Human
aacuccaaucucaggaggcuaaaa

SEQ ID NO: 142115 - RNA, 25 nt, Human
acauaucuacauacauaugcauaca

SEQ ID NO: 142116 - RNA, 23 nt, Human
acauguacauucacuuuaucaca

SEQ ID NO: 142117 - RNA, 22 nt, Human
agacugggacaaaccaacaugg

SEQ ID NO: 142118 - RNA, 21 nt, Human
agaugaggugggugacgggcu

SEQ ID NO: 142119 - RNA, 21 nt, Human
agcaguguggaccaugagagu

SEQ ID NO: 142120 - RNA, 20 nt, Human
agcauuaaaagugcagacau

SEQ ID NO: 142121 - RNA, 23 nt, Human
agggaaaugguaagauguuacaa

SEQ ID NO: 142122 - RNA, 22 nt, Human
aggugggugacgggcugcgggg

SEQ ID NO: 142123 - RNA, 23 nt, Human
aguauauauuuuacauauacaug

SEQ ID NO: 142124 - RNA, 23 nt, Human
auacaugcaugcauaugucuaca

SEQ ID NO: 142125 - RNA, 25 nt, Human
auauacaugcaugcauaugucuaca

SEQ ID NO: 142126 - RNA, 25 nt, Human
auauacaugcaugcauaugucuaca

SEQ ID NO: 142127 - RNA, 24 nt, Human
aucaaaaacaggacuuucccacuc

SEQ ID NO: 142128 - RNA, 18 nt, Human
augaggaaagauccagag

SEQ ID NO: 142129 - RNA, 24 nt, Human
caaauucuauuucuauccaaaaag

SEQ ID NO: 142130 - RNA, 19 nt, Human
caacaucaaucaauagcca

SEQ ID NO: 142131 - RNA, 22 nt, Human
caacaugggauggaaacuccaa

SEQ ID NO: 142132 - RNA, 23 nt, Human
caaggacaucaaagggcagaggc

SEQ ID NO: 142133 - RNA, 30 nt, Human
cauacauaugcauacauaaagcauauagug

SEQ ID NO: 142134 - RNA, 22 nt, Human
caucaaaaacaggacuuuccca

SEQ ID NO: 142135 - RNA, 23 nt, Human
ccaaaaguguuccugggcacuga

SEQ ID NO: 142136 - RNA, 24 nt, Human
ccccuaggaagggcugagccacaa

SEQ ID NO: 142137 - RNA, 21 nt, Human
cucaaggacaucaaagggcag

SEQ ID NO: 142138 - RNA, 20 nt, Human
cucaggaggcuaaaaucaca

SEQ ID NO: 142139 - RNA, 19 nt, Human
cuccaucagcuugacuucu

SEQ ID NO: 142140 - RNA, 20 nt, Human
gacugcaaaccaggcagaac

SEQ ID NO: 142141 - RNA, 21 nt, Human
gagcauuaaaagugcagacau

SEQ ID NO: 142142 - RNA, 21 nt, Human
gcaaaccaggcagaacuacca

SEQ ID NO: 142143 - RNA, 19 nt, Human
gcugggggcggaagacuga

SEQ ID NO: 142144 - RNA, 18 nt, Human
ggaaagauccagagacau

SEQ ID NO: 142145 - RNA, 23 nt, Human
ggcugggggcggaagacugaggc

SEQ ID NO: 142146 - RNA, 23 nt, Human
gggcggaagacugaggcccuccc

SEQ ID NO: 142147 - RNA, 28 nt, Human
gguguguguguauauacauguacauuuc

SEQ ID NO: 142148 - RNA, 21 nt, Human
guggaccaugagagugggcug

SEQ ID NO: 142149 - RNA, 20 nt, Human
uaagaggagcauuaaaagug

SEQ ID NO: 142150 - RNA, 22 nt, Human
uacauauacaugcaugcauaug

SEQ ID NO: 142151 - RNA, 20 nt, Human
uaccugcauauuaccaaacu

SEQ ID NO: 142152 - RNA, 22 nt, Human
uaggaagggcugagccacaaug

SEQ ID NO: 142153 - RNA, 28 nt, Human
uauaaacauaucuacauacauaugcaua

SEQ ID NO: 142154 - RNA, 24 nt, Human
uauauggagguguguguguauaua

SEQ ID NO: 142155 - RNA, 24 nt, Human
uaucuacauacauaugcauacaua

SEQ ID NO: 142156 - RNA, 27 nt, Human
ucaaaaacaggacuuucccacucagac

SEQ ID NO: 142157 - RNA, 23 nt, Human
ucaaugaggaaagauccagagac

SEQ ID NO: 142158 - RNA, 25 nt, Human
ucaaugucugauaaauuauuccaaa

SEQ ID NO: 142159 - RNA, 24 nt, Human
ucacuccaccacacgcacacauac

SEQ ID NO: 142160 - RNA, 21 nt, Human
uccaccacacgcacacauaca

SEQ ID NO: 142161 - RNA, 20 nt, Human
ucccacucagacugcaaacc

SEQ ID NO: 142162 - RNA, 22 nt, Human
ucccccagcaguguggaccaug

SEQ ID NO: 142163 - RNA, 19 nt, Human
ugagaugguaauucaaguu

SEQ ID NO: 142164 - RNA, 22 nt, Human
ugaggaaagauccagagacauu

SEQ ID NO: 142165 - RNA, 19 nt, Human
ugaguaaaucuauaaaagc

SEQ ID NO: 142166 - RNA, 24 nt, Human
ugauaaauuauuccaaaaguguuc

SEQ ID NO: 142167 - RNA, 19 nt, Human
ugauacacacauguauaua

SEQ ID NO: 142168 - RNA, 21 nt, Human
ugauacacacauguauauaug

SEQ ID NO: 142169 - RNA, 27 nt, Human
ugcauacauaaagcauauacuuauaug

SEQ ID NO: 142170 - RNA, 19 nt, Human
ugcauaugucuacauacau

SEQ ID NO: 142171 - RNA, 32 nt, Human
ugcaugcauaugucuacauacauaugcauggu

SEQ ID NO: 142172 - RNA, 23 nt, Human
uggcacagagucagucaaugagg

SEQ ID NO: 142173 - RNA, 19 nt, Human
ugggauugaagaguugcug

SEQ ID NO: 142174 - RNA, 19 nt, Human
ugggcugggggcggaagac

SEQ ID NO: 142175 - RNA, 20 nt, Human
ugggugacgggcugcggggg

SEQ ID NO: 142176 - RNA, 22 nt, Human
uguauauauggaggugugugug

SEQ ID NO: 142177 - RNA, 28 nt, Human
uguauauauggagguguguguguauaua

SEQ ID NO: 142178 - RNA, 22 nt, Human
ugucuacauacauaugcaugua

SEQ ID NO: 142179 - RNA, 19 nt, Human
uguguguauauacauguac

SEQ ID NO: 142180 - RNA, 20 nt, Human
uguguguauauacauguaca

SEQ ID NO: 142181 - RNA, 24 nt, Human
uuagggaaaugguaagauguuaca

SEQ ID NO: 142182 - RNA, 22 nt, Human
uuauaugcauacacaguuuaca

SEQ ID NO: 142183 - RNA, 23 nt, Human
uucacagacaaucacuccaccac

SEQ ID NO: 142184 - RNA, 19 nt, Human
uuccugggcacugagacuc

SEQ ID NO: 142185 - RNA, 20 nt, Human
aaaaguaccauccucccaca

SEQ ID NO: 142186 - RNA, 22 nt, Human
aaacagauuuaggauuuaagac

SEQ ID NO: 142187 - RNA, 18 nt, Human
aaagaguaaaagaagaaa

SEQ ID NO: 142188 - RNA, 20 nt, Human
aaauacauauguagucgaua

SEQ ID NO: 142189 - RNA, 23 nt, Human
aaauacauauguagucgauacaa

SEQ ID NO: 142190 - RNA, 20 nt, Human
aaauccuuccucuccuaccu

SEQ ID NO: 142191 - RNA, 19 nt, Human
aaccuauccuccuccauuu

SEQ ID NO: 142192 - RNA, 23 nt, Human
aaggacacaacaguucaccaaaa

SEQ ID NO: 142193 - RNA, 24 nt, Human
aauacaauugagucaugauagauu

SEQ ID NO: 142194 - RNA, 23 nt, Human
aauccuuccucuccuaccuaguu

SEQ ID NO: 142195 - RNA, 21 nt, Human
aaugauuccuuaucaccuaag

SEQ ID NO: 142196 - RNA, 23 nt, Human
acaacaguucaccaaaaaugauu

SEQ ID NO: 142197 - RNA, 20 nt, Human
acccaaaucucaucuugaag

SEQ ID NO: 142198 - RNA, 23 nt, Human
accuagugaauaaguggacauaa

SEQ ID NO: 142199 - RNA, 22 nt, Human
acucaacgccauuccgccacca

SEQ ID NO: 142200 - RNA, 21 nt, Human
agaaccuauccuccuccauuu

SEQ ID NO: 142201 - RNA, 21 nt, Human
agagauccgaugguuuuauaa

SEQ ID NO: 142202 - RNA, 23 nt, Human
agugugaaaauggacuaauacac

SEQ ID NO: 142203 - RNA, 18 nt, Human
auggaaccuaaguggugg

SEQ ID NO: 142204 - RNA, 23 nt, Human
auuaaauugguuugucucuaacu

SEQ ID NO: 142205 - RNA, 22 nt, Human
caaaaagaggccaucguuggug

SEQ ID NO: 142206 - RNA, 18 nt, Human
cacccaaaucucaucuug

SEQ ID NO: 142207 - RNA, 21 nt, Human
cacgucaagaucaugccacaa

SEQ ID NO: 142208 - RNA, 22 nt, Human
cagcagugugaaaauggacuaa

SEQ ID NO: 142209 - RNA, 19 nt, Human
ccagagcuacagggacaca

SEQ ID NO: 142210 - RNA, 21 nt, Human
cccaaagaaccuauccuccuc

SEQ ID NO: 142211 - RNA, 21 nt, Human
cccugcacaaguuuucuucuc

SEQ ID NO: 142212 - RNA, 24 nt, Human
cccugcacaaguuuucuucucuug

SEQ ID NO: 142213 - RNA, 18 nt, Human
ccgcgagccggcccagga

SEQ ID NO: 142214 - RNA, 24 nt, Human
cggcccaggaaaguccugcggcag

SEQ ID NO: 142215 - RNA, 23 nt, Human
cgucaagaucaugccacauauuc

SEQ ID NO: 142216 - RNA, 20 nt, Human
cuauccuccuccauuuuuuu

SEQ ID NO: 142217 - RNA, 22 nt, Human
cucaaauccuuccucuccuacc

SEQ ID NO: 142218 - RNA, 26 nt, Human
cucaagagauccgaugguuuuauaaa

SEQ ID NO: 142219 - RNA, 22 nt, Human
cucuccuaccuaguuccuucag

SEQ ID NO: 142220 - RNA, 21 nt, Human
gagaaccauaaaauugacuca

SEQ ID NO: 142221 - RNA, 23 nt, Human
gagaaucuauccacuucauguca

SEQ ID NO: 142222 - RNA, 20 nt, Human
gagccggcccaggaaagucc

SEQ ID NO: 142223 - RNA, 20 nt, Human
gagggacccagugggaggua

SEQ ID NO: 142224 - RNA, 24 nt, Human
gagguaacugaaucauggaggcag

SEQ ID NO: 142225 - RNA, 26 nt, Human
gcaaaaccucauaaaaaccgggacgu

SEQ ID NO: 142226 - RNA, 19 nt, Human
gcccauacacaaguccuca

SEQ ID NO: 142227 - RNA, 26 nt, Human
ggacuaauacacaaaccuuuguuccu

SEQ ID NO: 142228 - RNA, 18 nt, Human
ggcgagagagagagagag

SEQ ID NO: 142229 - RNA, 18 nt, Human
gucccuuuaaccagaugg

SEQ ID NO: 142230 - RNA, 27 nt, Human
uaaaaagaaaaguaccauccucccacu

SEQ ID NO: 142231 - RNA, 23 nt, Human
uaaaagaagaaaugcgugacaau

SEQ ID NO: 142232 - RNA, 25 nt, Human
uaaaggacacaacaguucaccaaaa

SEQ ID NO: 142233 - RNA, 22 nt, Human
uaaguaauaauucaaauauuaa

SEQ ID NO: 142234 - RNA, 23 nt, Human
uacaacgugauuuaaaaaugaga

SEQ ID NO: 142235 - RNA, 26 nt, Human
uaccuagugaauaaguggacauaaca

SEQ ID NO: 142236 - RNA, 18 nt, Human
uagaaacuuccaucaaaa

SEQ ID NO: 142237 - RNA, 19 nt, Human
uagcacaaugcagccccgg

SEQ ID NO: 142238 - RNA, 27 nt, Human
uagcacaaugcagccccgggacacuuc

SEQ ID NO: 142239 - RNA, 23 nt, Human
uaggcuucuggauaucugccccu

SEQ ID NO: 142240 - RNA, 19 nt, Human
ucaaaggaagggguaagga

SEQ ID NO: 142241 - RNA, 20 nt, Human
ucaauuuacccaaagaaccu

SEQ ID NO: 142242 - RNA, 22 nt, Human
ucacggaaacacccaugcuuca

SEQ ID NO: 142243 - RNA, 19 nt, Human
ucagaaaguaaaaaaccug

SEQ ID NO: 142244 - RNA, 19 nt, Human
ucagcagugugaaaaugga

SEQ ID NO: 142245 - RNA, 18 nt, Human
uccauggaaccuaagugg

SEQ ID NO: 142246 - RNA, 21 nt, Human
ucccacaauugccacacguug

SEQ ID NO: 142247 - RNA, 23 nt, Human
ucccugcacaaguuuucuucucu

SEQ ID NO: 142248 - RNA, 21 nt, Human
uccguguugaacgagucccuu

SEQ ID NO: 142249 - RNA, 24 nt, Human
ucgauacaagauacuucaaaaaag

SEQ ID NO: 142250 - RNA, 27 nt, Human
ucuccuaaacuggggugggguuuaggg

SEQ ID NO: 142251 - RNA, 26 nt, Human
ucuugucugcugccaugucgucgucg

SEQ ID NO: 142252 - RNA, 23 nt, Human
ugaaaugaucaaaggaaggggua

SEQ ID NO: 142253 - RNA, 22 nt, Human
ugaguugccuauuucucaaauc

SEQ ID NO: 142254 - RNA, 19 nt, Human
uggacuaauacacaaaccu

SEQ ID NO: 142255 - RNA, 18 nt, Human
ugggagggacccaguggg

SEQ ID NO: 142256 - RNA, 20 nt, Human
ugggagguaacugaaucaug

SEQ ID NO: 142257 - RNA, 20 nt, Human
uggggugggguuuaggggag

SEQ ID NO: 142258 - RNA, 23 nt, Human
uuaaaacugaaaauuuaccuagu

SEQ ID NO: 142259 - RNA, 24 nt, Human
uuaaaggacacaacaguucaccaa

SEQ ID NO: 142260 - RNA, 26 nt, Human
uuacuaggcuacuugguucuuugugu

SEQ ID NO: 142261 - RNA, 21 nt, Human
uucaaagaguaaaagaagaaa

SEQ ID NO: 142262 - RNA, 18 nt, Human
uucccaugcuauucucau

SEQ ID NO: 142263 - RNA, 25 nt, Human
uuccuucaguuccagagcuacaggg

SEQ ID NO: 142264 - RNA, 25 nt, Human
uuucucagcagugugaaaauggacu

SEQ ID NO: 142265 - RNA, 22 nt, Human
uuugcagcuuaaauuucuucaa

SEQ ID NO: 142266 - RNA, 20 nt, Human
uuugcauuauaaacuuuuau

SEQ ID NO: 142267 - RNA, 24 nt, Human
uuuggcuguguccccacccaaauc

SEQ ID NO: 142268 - RNA, 19 nt, Human
aaaacaaguuugcagccug

SEQ ID NO: 142269 - RNA, 18 nt, Human
aaacauuccaaguaaaaa

SEQ ID NO: 142270 - RNA, 21 nt, Human
aaagugaauguuuuugaagga

SEQ ID NO: 142271 - RNA, 21 nt, Human
aacagcuucuuaaaaaaacca

SEQ ID NO: 142272 - RNA, 20 nt, Human
aagcagacacagaaaucccc

SEQ ID NO: 142273 - RNA, 22 nt, Human
acacagccggacgacacggucu

SEQ ID NO: 142274 - RNA, 19 nt, Human
acagcuucuuaaaaaaacc

SEQ ID NO: 142275 - RNA, 23 nt, Human
accauaaaaaugcaaacuggaau

SEQ ID NO: 142276 - RNA, 23 nt, Human
agcgugguggcgcucacacagcc

SEQ ID NO: 142277 - RNA, 19 nt, Human
agcucggccuccugcagcc

SEQ ID NO: 142278 - RNA, 25 nt, Human
aggaaugcaggagaggaccgguacc

SEQ ID NO: 142279 - RNA, 19 nt, Human
aggcgugcuucuugugggg

SEQ ID NO: 142280 - RNA, 26 nt, Human
auccuuguaggcgugcuucuuguggg

SEQ ID NO: 142281 - RNA, 18 nt, Human
augcagcagcucugccau

SEQ ID NO: 142282 - RNA, 19 nt, Human
caagcucccgccgucccuc

SEQ ID NO: 142283 - RNA, 23 nt, Human
cacagccaugagguaaggacugg

SEQ ID NO: 142284 - RNA, 24 nt, Human
cacgcccagcucgucgugugugug

SEQ ID NO: 142285 - RNA, 19 nt, Human
cagacacagaaauccccgu

SEQ ID NO: 142286 - RNA, 23 nt, Human
cagcgcgcgcuccuucuccuccu

SEQ ID NO: 142287 - RNA, 20 nt, Human
cagcucgucguguguguggc

SEQ ID NO: 142288 - RNA, 22 nt, Human
cauuaaagcuaucggaucaagu

SEQ ID NO: 142289 - RNA, 25 nt, Human
ccaaguacgcugcggugguaaagac

SEQ ID NO: 142290 - RNA, 24 nt, Human
ccacacacacuaaccuuuacuaga

SEQ ID NO: 142291 - RNA, 22 nt, Human
ccagcgcgcgcuccuucuccuu

SEQ ID NO: 142292 - RNA, 18 nt, Human
ccagugugacuauggugg

SEQ ID NO: 142293 - RNA, 22 nt, Human
cccaaacugcacuuccugauca

SEQ ID NO: 142294 - RNA, 22 nt, Human
ccccuccgcucccggcuccgcu

SEQ ID NO: 142295 - RNA, 19 nt, Human
cccgccuggcccggcuccc

SEQ ID NO: 142296 - RNA, 18 nt, Human
cccggacaggccgugggg

SEQ ID NO: 142297 - RNA, 23 nt, Human
cccggccccggcccuugcugggc

SEQ ID NO: 142298 - RNA, 19 nt, Human
cccguagcuucacagccau

SEQ ID NO: 142299 - RNA, 20 nt, Human
cccgugcaccuccuaggccg

SEQ ID NO: 142300 - RNA, 22 nt, Human
cccgugcaccuccuaggccgug

SEQ ID NO: 142301 - RNA, 21 nt, Human
ccgccgccgccgcuggcccaa

SEQ ID NO: 142302 - RNA, 19 nt, Human
ccgccgccgcuccuccugc

SEQ ID NO: 142303 - RNA, 20 nt, Human
ccgccgccgcuggcccaagc

SEQ ID NO: 142304 - RNA, 18 nt, Human
ccgcuggcccaagcuccc

SEQ ID NO: 142305 - RNA, 24 nt, Human
ccuccacgcgccgcagcucggccu

SEQ ID NO: 142306 - RNA, 23 nt, Human
ccucccguccucccugcugcugg

SEQ ID NO: 142307 - RNA, 18 nt, Human
ccucccugcugcuggccc

SEQ ID NO: 142308 - RNA, 25 nt, Human
ccuccggugccugucuuugcugugg

SEQ ID NO: 142309 - RNA, 22 nt, Human
ccuccugcagccgccgccgcuc

SEQ ID NO: 142310 - RNA, 20 nt, Human
ccuccuucugcuccuguucc

SEQ ID NO: 142311 - RNA, 19 nt, Human
ccugaaaucuguuugaaac

SEQ ID NO: 142312 - RNA, 19 nt, Human
ccuugcauggggccuccuc

SEQ ID NO: 142313 - RNA, 21 nt, Human
cgcagcucggccuccugcagc

SEQ ID NO: 142314 - RNA, 18 nt, Human
cgccaagcagacacagaa

SEQ ID NO: 142315 - RNA, 18 nt, Human
cgccgcagcucggccucc

SEQ ID NO: 142316 - RNA, 19 nt, Human
cgcgcgcuccuucuccucc

SEQ ID NO: 142317 - RNA, 24 nt, Human
cgcucccguucacgcuuuugggag

SEQ ID NO: 142318 - RNA, 21 nt, Human
cgcugccccuccgcucccggc

SEQ ID NO: 142319 - RNA, 19 nt, Human
cgcuggcccaagcucccgc

SEQ ID NO: 142320 - RNA, 21 nt, Human
cgugugccacgcccagcucgu

SEQ ID NO: 142321 - RNA, 23 nt, Human
cuagaaaccaaagcuuuuaacca

SEQ ID NO: 142322 - RNA, 23 nt, Human
cuccccacauaccgacaccuuag

SEQ ID NO: 142323 - RNA, 18 nt, Human
cuccgguggcccggcccc

SEQ ID NO: 142324 - RNA, 24 nt, Human
cuccucggccacgcucccguucac

SEQ ID NO: 142325 - RNA, 19 nt, Human
cuccucucccgcuugugcc

SEQ ID NO: 142326 - RNA, 21 nt, Human
cucgcuucggcggcgguggcg

SEQ ID NO: 142327 - RNA, 19 nt, Human
cugcagccgccgccgcucc

SEQ ID NO: 142328 - RNA, 20 nt, Human
cugcgccggcgggggcuguc

SEQ ID NO: 142329 - RNA, 18 nt, Human
cuggagccucagcuucuc

SEQ ID NO: 142330 - RNA, 23 nt, Human
cugugggaccuccgggaccgggu

SEQ ID NO: 142331 - RNA, 28 nt, Human
cuucacagccaugagguaaggacugggc

SEQ ID NO: 142332 - RNA, 22 nt, Human
cuuccugcuggcgcugccccuc

SEQ ID NO: 142333 - RNA, 18 nt, Human
gaagugccaaguacgcug

SEQ ID NO: 142334 - RNA, 21 nt, Human
gaauaaacaccaucuuuccua

SEQ ID NO: 142335 - RNA, 19 nt, Human
gacaggccguggggaggcc

SEQ ID NO: 142336 - RNA, 21 nt, Human
gagagccauccucggggacca

SEQ ID NO: 142337 - RNA, 24 nt, Human
gagccucagcuucuccuccuucug

SEQ ID NO: 142338 - RNA, 21 nt, Human
gccccggcccuugcugggcuc

SEQ ID NO: 142339 - RNA, 21 nt, Human
gccgcgcucuccuugggggca

SEQ ID NO: 142340 - RNA, 21 nt, Human
gcgcggggcuccgccugcguc

SEQ ID NO: 142341 - RNA, 22 nt, Human
gcgucccaggccgccgccgccg

SEQ ID NO: 142342 - RNA, 18 nt, Human
gcucgagcagguccuggu

SEQ ID NO: 142343 - RNA, 23 nt, Human
ggaaagaaucaccagggcaacgc

SEQ ID NO: 142344 - RNA, 19 nt, Human
ggaccgggagcgcgaccgc

SEQ ID NO: 142345 - RNA, 21 nt, Human
ggcugucguccggcuucuugc

SEQ ID NO: 142346 - RNA, 20 nt, Human
ggggugcagcgugguggcgc

SEQ ID NO: 142347 - RNA, 25 nt, Human
gucagcacgacgauucggcauccca

SEQ ID NO: 142348 - RNA, 24 nt, Human
uaaagcauggugucuuccuuccug

SEQ ID NO: 142349 - RNA, 18 nt, Human
uaccacuccccacauacc

SEQ ID NO: 142350 - RNA, 19 nt, Human
uaccacuccccacauaccg

SEQ ID NO: 142351 - RNA, 20 nt, Human
uacugcggugccugcucggg

SEQ ID NO: 142352 - RNA, 24 nt, Human
uagcaaaacagcuucuuaaaaaaa

SEQ ID NO: 142353 - RNA, 30 nt, Human
uagcaaaacagcuucuuaaaaaaaccacaa

SEQ ID NO: 142354 - RNA, 25 nt, Human
ucaccagggcaacgcuuucuuuuca

SEQ ID NO: 142355 - RNA, 20 nt, Human
uccaggacgggcugcagcag

SEQ ID NO: 142356 - RNA, 19 nt, Human
uccccggacaggcgcggcc

SEQ ID NO: 142357 - RNA, 30 nt, Human
uccuaggccgugcacgcagggaggucgccu

SEQ ID NO: 142358 - RNA, 18 nt, Human
uccuccugcugcuggagc

SEQ ID NO: 142359 - RNA, 23 nt, Human
uccuccugcugcuggagccucag

SEQ ID NO: 142360 - RNA, 23 nt, Human
uccugcugcuggagccucagcuu

SEQ ID NO: 142361 - RNA, 21 nt, Human
uccuugcguggccucccgucc

SEQ ID NO: 142362 - RNA, 18 nt, Human
ucgcgcagcucccgcucu

SEQ ID NO: 142363 - RNA, 22 nt, Human
ucgcuucggcggcgguggcggc

SEQ ID NO: 142364 - RNA, 21 nt, Human
ucuccgguggcccggccccgg

SEQ ID NO: 142365 - RNA, 24 nt, Human
ucuccgguggcccggccccggccc

SEQ ID NO: 142366 - RNA, 18 nt, Human
ucucuggagagccauccu

SEQ ID NO: 142367 - RNA, 26 nt, Human
ucugugcaauuuuccugacugagaga

SEQ ID NO: 142368 - RNA, 18 nt, Human
ucuuguggggccgccgcu

SEQ ID NO: 142369 - RNA, 21 nt, Human
ucuuguggggccgccgcuccu

SEQ ID NO: 142370 - RNA, 22 nt, Human
ugacucaaugucagcacgacga

SEQ ID NO: 142371 - RNA, 19 nt, Human
ugagagaggaccggccgca

SEQ ID NO: 142372 - RNA, 23 nt, Human
ugcagccugaaaucuguuugaaa

SEQ ID NO: 142373 - RNA, 24 nt, Human
ugcaggauguccaggacgggcugc

SEQ ID NO: 142374 - RNA, 20 nt, Human
ugcccuugggcuguugguug

SEQ ID NO: 142375 - RNA, 21 nt, Human
ugcuggagccucagcuucucc

SEQ ID NO: 142376 - RNA, 23 nt, Human
uggaauaaacaccaucuuuccua

SEQ ID NO: 142377 - RNA, 19 nt, Human
uggaucucuaaagcauggu

SEQ ID NO: 142378 - RNA, 18 nt, Human
uggcccgccuggcccggc

SEQ ID NO: 142379 - RNA, 22 nt, Human
uggcccggcuccucucccgcuu

SEQ ID NO: 142380 - RNA, 20 nt, Human
ugggccugcgcggggcuccg

SEQ ID NO: 142381 - RNA, 21 nt, Human
uggggaggccgugcccgucau

SEQ ID NO: 142382 - RNA, 19 nt, Human
ugguggcccgugcaccucc

SEQ ID NO: 142383 - RNA, 22 nt, Human
ugucucagccucuugucaugcu

SEQ ID NO: 142384 - RNA, 24 nt, Human
uugcagccugaaaucuguuugaaa

SEQ ID NO: 142385 - RNA, 24 nt, Human
uuguaccacuccccacauaccgac

SEQ ID NO: 142386 - RNA, 18 nt, Human
uuuccgcugcaggcccag

SEQ ID NO: 142387 - RNA, 19 nt, Human
uuuccgcugcaggcccagc

SEQ ID NO: 142388 - RNA, 20 nt, Human
uuuugaucuuaaaggacuug

SEQ ID NO: 142389 - RNA, 23 nt, Human
aaaaaaaacaguuucaaaaugug

SEQ ID NO: 142390 - RNA, 22 nt, Human
aaaaaaacacccucauggggcc

SEQ ID NO: 142391 - RNA, 22 nt, Human
aaaaaaacacccucauggggcc

SEQ ID NO: 142392 - RNA, 26 nt, Human
aaaaaaacacccucauggggcccuuu

SEQ ID NO: 142393 - RNA, 26 nt, Human
aaaaaaacacccucauggggcccuuu

SEQ ID NO: 142394 - RNA, 18 nt, Human
aaaaacacacaagaaaca

SEQ ID NO: 142395 - RNA, 18 nt, Human
aaaaacacacaagaaaca

SEQ ID NO: 142396 - RNA, 24 nt, Human
aaaaacacccucauggggcccuuu

SEQ ID NO: 142397 - RNA, 18 nt, Human
aaaaacagcuuugguaca

SEQ ID NO: 142398 - RNA, 18 nt, Human
aaaaacagcuuugguaca

SEQ ID NO: 142399 - RNA, 22 nt, Human
aaaaacccaaauuucccacccu

SEQ ID NO: 142400 - RNA, 22 nt, Human
aaaaacccaaauuucccacccu

SEQ ID NO: 142401 - RNA, 21 nt, Human
aaaaagaaaaaaaaaaaacac

SEQ ID NO: 142402 - RNA, 21 nt, Human
aaaaagaaaaaaaaaaaacac

SEQ ID NO: 142403 - RNA, 21 nt, Human
aaaaagaaaauaaauuuuugu

SEQ ID NO: 142404 - RNA, 21 nt, Human
aaaaagaaaauaaauuuuugu

SEQ ID NO: 142405 - RNA, 24 nt, Human
aaaaagcaaaagaaaaaguaaaaa

SEQ ID NO: 142406 - RNA, 24 nt, Human
aaaacaaaacagaacaaaacaaaa

SEQ ID NO: 142407 - RNA, 22 nt, Human
aaaacaccacuucuauaaaaac

SEQ ID NO: 142408 - RNA, 22 nt, Human
aaaacaccacuucuauaaaaac

SEQ ID NO: 142409 - RNA, 23 nt, Human
aaaacagaacaaaacaaaaaaaa

SEQ ID NO: 142410 - RNA, 23 nt, Human
aaaacagaacaaaacaaaaaaaa

SEQ ID NO: 142411 - RNA, 25 nt, Human
aaaagaaaaaaaaaaaacacccuca

SEQ ID NO: 142412 - RNA, 25 nt, Human
aaaagaaaaaaaaaaaacacccuca

SEQ ID NO: 142413 - RNA, 24 nt, Human
aaaagcaaaagaaaaaguaaaaag

SEQ ID NO: 142414 - RNA, 24 nt, Human
aaaagcaaaagaaaaaguaaaaag

SEQ ID NO: 142415 - RNA, 25 nt, Human
aaacaaaacagaacaaaacaaagcc

SEQ ID NO: 142416 - RNA, 21 nt, Human
aaacacacaagaaacaaacuc

SEQ ID NO: 142417 - RNA, 21 nt, Human
aaacacacaagaaacaaacuc

SEQ ID NO: 142418 - RNA, 24 nt, Human
aaacacacaagaaacaaacucaag

SEQ ID NO: 142419 - RNA, 24 nt, Human
aaacacacaagaaacaaacucaag

SEQ ID NO: 142420 - RNA, 18 nt, Human
aaacagaacaaaacaaaa

SEQ ID NO: 142421 - RNA, 19 nt, Human
aaacagaacaaaacaaaaa

SEQ ID NO: 142422 - RNA, 19 nt, Human
aaacagaacaaaacaaaaa

SEQ ID NO: 142423 - RNA, 21 nt, Human
aaacagauuaugauaagagau

SEQ ID NO: 142424 - RNA, 19 nt, Human
aaacagcaguaacuacuga

SEQ ID NO: 142425 - RNA, 19 nt, Human
aaacagcaguaacuacuga

SEQ ID NO: 142426 - RNA, 21 nt, Human
aaacagcaguaacuacugaau

SEQ ID NO: 142427 - RNA, 21 nt, Human
aaacagcaguaacuacugaau

SEQ ID NO: 142428 - RNA, 21 nt, Human
aaagaaaccaacuggacuaaa

SEQ ID NO: 142429 - RNA, 22 nt, Human
aaagcaaaagaaaaaguaaaaa

SEQ ID NO: 142430 - RNA, 19 nt, Human
aaagugucacaccccaaaa

SEQ ID NO: 142431 - RNA, 19 nt, Human
aaagugucacaccccaaaa

SEQ ID NO: 142432 - RNA, 25 nt, Human
aaaguuacuuuauaggaaagacaac

SEQ ID NO: 142433 - RNA, 22 nt, Human
aacaaaacaaaaaaaaaggggg

SEQ ID NO: 142434 - RNA, 22 nt, Human
aacaaaacaaaaaaaaaggggg

SEQ ID NO: 142435 - RNA, 23 nt, Human
aacaaaacaaaaaaaaaggggga

SEQ ID NO: 142436 - RNA, 19 nt, Human
aacaaaacagaacaaaaca

SEQ ID NO: 142437 - RNA, 22 nt, Human
aacacacuuagaauguaacaga

SEQ ID NO: 142438 - RNA, 22 nt, Human
aacacacuuagaauguaacaga

SEQ ID NO: 142439 - RNA, 21 nt, Human
aacagaacaaaacaaaaaaaa

SEQ ID NO: 142440 - RNA, 21 nt, Human
aacagaacaaaacaaaaaaaa

SEQ ID NO: 142441 - RNA, 19 nt, Human
aaccgcucccccaagucca

SEQ ID NO: 142442 - RNA, 23 nt, Human
aagaaaaaaaaaaaacacccuca

SEQ ID NO: 142443 - RNA, 23 nt, Human
aagaaaaaaaaaaaacacccuca

SEQ ID NO: 142444 - RNA, 21 nt, Human
aagaaagaaaccaacuggacu

SEQ ID NO: 142445 - RNA, 24 nt, Human
aagaggaacacgaauucacuuuca

SEQ ID NO: 142446 - RNA, 21 nt, Human
aagcaggaagggacacagcug

SEQ ID NO: 142447 - RNA, 22 nt, Human
aagcaggaagggacacagcugu

SEQ ID NO: 142448 - RNA, 22 nt, Human
aauaaauuaucaaaaaagaaaa

SEQ ID NO: 142449 - RNA, 22 nt, Human
aauaaauuaucaaaaaagaaaa

SEQ ID NO: 142450 - RNA, 22 nt, Human
aaucaagaggaacacgaauuca

SEQ ID NO: 142451 - RNA, 18 nt, Human
aaugggggagcaaaaaga

SEQ ID NO: 142452 - RNA, 18 nt, Human
acaaaaagaaaaaaaaaa

SEQ ID NO: 142453 - RNA, 18 nt, Human
acaaaaagaaaaaaaaaa

SEQ ID NO: 142454 - RNA, 18 nt, Human
acaaaacagaacaaaaca

SEQ ID NO: 142455 - RNA, 20 nt, Human
acaaaauaaauauggauuuc

SEQ ID NO: 142456 - RNA, 20 nt, Human
acaaaauaaauauggauuuc

SEQ ID NO: 142457 - RNA, 26 nt, Human
acaaucccaaaacauaaagaauaaaa

SEQ ID NO: 142458 - RNA, 22 nt, Human
acagaaaaaaaaaaugaccuga

SEQ ID NO: 142459 - RNA, 19 nt, Human
acaggaacgucaugaaccu

SEQ ID NO: 142460 - RNA, 18 nt, Human
acaucuuugugcagaaga

SEQ ID NO: 142461 - RNA, 18 nt, Human
acaucuuugugcagaaga

SEQ ID NO: 142462 - RNA, 22 nt, Human
accaccacucagaccuccccag

SEQ ID NO: 142463 - RNA, 22 nt, Human
accaccacucagaccuccccag

SEQ ID NO: 142464 - RNA, 23 nt, Human
acccucccacccaaaacaaaaca

SEQ ID NO: 142465 - RNA, 24 nt, Human
acccucccacccaaaacaaaacag

SEQ ID NO: 142466 - RNA, 24 nt, Human
acccucccacccaaaacaaaacag

SEQ ID NO: 142467 - RNA, 22 nt, Human
accgcucaaaagugucacaccc

SEQ ID NO: 142468 - RNA, 22 nt, Human
accgcucaaaagugucacaccc

SEQ ID NO: 142469 - RNA, 18 nt, Human
accuguuaaauaccagcc

SEQ ID NO: 142470 - RNA, 18 nt, Human
accuguuaaauaccagcc

SEQ ID NO: 142471 - RNA, 22 nt, Human
acgaggcaccuguuaaauacca

SEQ ID NO: 142472 - RNA, 22 nt, Human
acgaggcaccuguuaaauacca

SEQ ID NO: 142473 - RNA, 19 nt, Human
acugcacuucagccgggac

SEQ ID NO: 142474 - RNA, 19 nt, Human
acugcacuucagccgggac

SEQ ID NO: 142475 - RNA, 20 nt, Human
acugcauuuccgugcccaag

SEQ ID NO: 142476 - RNA, 20 nt, Human
acugcauuuccgugcccaag

SEQ ID NO: 142477 - RNA, 23 nt, Human
agaaaaaaaaaaaacacccucau

SEQ ID NO: 142478 - RNA, 23 nt, Human
agaaaaaaaaaaaacacccucau

SEQ ID NO: 142479 - RNA, 20 nt, Human
agaaagacaaaaaaacccca

SEQ ID NO: 142480 - RNA, 20 nt, Human
agaaagacaaaaaaacccca

SEQ ID NO: 142481 - RNA, 23 nt, Human
agaaagacaaaaaaaccccacug

SEQ ID NO: 142482 - RNA, 23 nt, Human
agaagacaucuuugugcagaaga

SEQ ID NO: 142483 - RNA, 23 nt, Human
agaagacaucuuugugcagaaga

SEQ ID NO: 142484 - RNA, 22 nt, Human
agacaacaugucaaucuaccaa

SEQ ID NO: 142485 - RNA, 19 nt, Human
agacaggaacgucaugaac

SEQ ID NO: 142486 - RNA, 24 nt, Human
agaccaccacucagaccuccccag

SEQ ID NO: 142487 - RNA, 24 nt, Human
agaccaccacucagaccuccccag

SEQ ID NO: 142488 - RNA, 21 nt, Human
agagaaaaaaaaaacaguuuc

SEQ ID NO: 142489 - RNA, 23 nt, Human
agauaaugaugcaagacaauuac

SEQ ID NO: 142490 - RNA, 22 nt, Human
agcaaaaagaggauaccucuga

SEQ ID NO: 142491 - RNA, 18 nt, Human
agcagaaaauugguaugu

SEQ ID NO: 142492 - RNA, 24 nt, Human
agcuacuggggaggcugagguggg

SEQ ID NO: 142493 - RNA, 18 nt, Human
aggaaagacaacauguca

SEQ ID NO: 142494 - RNA, 18 nt, Human
aggcugaggugggaagac

SEQ ID NO: 142495 - RNA, 19 nt, Human
agggaagaguccagcggca

SEQ ID NO: 142496 - RNA, 19 nt, Human
agggaagaguccagcggca

SEQ ID NO: 142497 - RNA, 21 nt, Human
agggggaugggggggacaaaa

SEQ ID NO: 142498 - RNA, 21 nt, Human
agggggaugggggggacaaaa

SEQ ID NO: 142499 - RNA, 21 nt, Human
agggggaugggggggacaaaa

SEQ ID NO: 142500 - RNA, 21 nt, Human
agggggaugggggggacaaaa

SEQ ID NO: 142501 - RNA, 21 nt, Human
aguccaaauccauaaggccaa

SEQ ID NO: 142502 - RNA, 21 nt, Human
aguccaaauccauaaggccaa

SEQ ID NO: 142503 - RNA, 23 nt, Human
aguccuguaaccaaacuguguag

SEQ ID NO: 142504 - RNA, 23 nt, Human
aguccuguaaccaaacuguguag

SEQ ID NO: 142505 - RNA, 23 nt, Human
auaaggccaaagguuaucccaaa

SEQ ID NO: 142506 - RNA, 23 nt, Human
auaaggccaaagguuaucccaaa

SEQ ID NO: 142507 - RNA, 21 nt, Human
auccacaggcuugacaguuaa

SEQ ID NO: 142508 - RNA, 21 nt, Human
auccacaggcuugacaguuaa

SEQ ID NO: 142509 - RNA, 21 nt, Human
aucccaaagaccaccacucag

SEQ ID NO: 142510 - RNA, 21 nt, Human
aucccaaagaccaccacucag

SEQ ID NO: 142511 - RNA, 23 nt, Human
aucgugccacugcacuucagccg

SEQ ID NO: 142512 - RNA, 21 nt, Human
augaugcaagacaauuacccc

SEQ ID NO: 142513 - RNA, 19 nt, Human
auguuuacaaugcacagaa

SEQ ID NO: 142514 - RNA, 19 nt, Human
auguuuacaaugcacagaa

SEQ ID NO: 142515 - RNA, 18 nt, Human
auucaacaacaguuccag

SEQ ID NO: 142516 - RNA, 18 nt, Human
auucaacaacaguuccag

SEQ ID NO: 142517 - RNA, 21 nt, Human
caaaacaaaacagaacaaaac

SEQ ID NO: 142518 - RNA, 21 nt, Human
caaaacaaaacagaacaaaac

SEQ ID NO: 142519 - RNA, 26 nt, Human
caaaacaaaacagaacaaaacaaaaa

SEQ ID NO: 142520 - RNA, 23 nt, Human
caaaagaaaaaguaaaaagcagg

SEQ ID NO: 142521 - RNA, 20 nt, Human
caaagugcagaacugcuaca

SEQ ID NO: 142522 - RNA, 20 nt, Human
caaagugcagaacugcuaca

SEQ ID NO: 142523 - RNA, 19 nt, Human
caacugauaaucagcagaa

SEQ ID NO: 142524 - RNA, 21 nt, Human
caagacaauuaccccaacuga

SEQ ID NO: 142525 - RNA, 20 nt, Human
caagaggaacacgaauucac

SEQ ID NO: 142526 - RNA, 18 nt, Human
caagggcacuggggccgc

SEQ ID NO: 142527 - RNA, 19 nt, Human
caagggcacuggggccgcu

SEQ ID NO: 142528 - RNA, 24 nt, Human
caaguuccuaggucagccucauga

SEQ ID NO: 142529 - RNA, 20 nt, Human
caaucccaaaacauaaagag

SEQ ID NO: 142530 - RNA, 18 nt, Human
caaugcauucuguugagg

SEQ ID NO: 142531 - RNA, 23 nt, Human
caauucccaaugccuccaauucc

SEQ ID NO: 142532 - RNA, 20 nt, Human
cacaaccgcucccccaaguc

SEQ ID NO: 142533 - RNA, 24 nt, Human
cacaagaaacaaacucaaguuuca

SEQ ID NO: 142534 - RNA, 24 nt, Human
cacaagaaacaaacucaaguuuca

SEQ ID NO: 142535 - RNA, 23 nt, Human
cacaagcccucuugcucuccaag

SEQ ID NO: 142536 - RNA, 19 nt, Human
cacagaaaaaaaaaaugac

SEQ ID NO: 142537 - RNA, 19 nt, Human
cacagaaaaaaaaaaugac

SEQ ID NO: 142538 - RNA, 22 nt, Human
cacagcauaauugugaggcaaa

SEQ ID NO: 142539 - RNA, 22 nt, Human
cacagcauaauugugaggcaaa

SEQ ID NO: 142540 - RNA, 25 nt, Human
cacagcauaauugugaggcaaaaaa

SEQ ID NO: 142541 - RNA, 25 nt, Human
cacagcauaauugugaggcaaaaaa

SEQ ID NO: 142542 - RNA, 20 nt, Human
caccacaaccgucccuuuca

SEQ ID NO: 142543 - RNA, 20 nt, Human
caccacaaccgucccuuuca

SEQ ID NO: 142544 - RNA, 25 nt, Human
caccacaaccgucccuuucauacag

SEQ ID NO: 142545 - RNA, 25 nt, Human
caccacaaccgucccuuucauacag

SEQ ID NO: 142546 - RNA, 21 nt, Human
caccacucagaccuccccagg

SEQ ID NO: 142547 - RNA, 21 nt, Human
caccacucagaccuccccagg

SEQ ID NO: 142548 - RNA, 19 nt, Human
cacccucccacccaaaaca

SEQ ID NO: 142549 - RNA, 19 nt, Human
cacccucccacccaaaaca

SEQ ID NO: 142550 - RNA, 21 nt, Human
cacccucccacccaaaacaaa

SEQ ID NO: 142551 - RNA, 21 nt, Human
cacccucccacccaaaacaaa

SEQ ID NO: 142552 - RNA, 24 nt, Human
cacccucccacccaaaacaaaaca

SEQ ID NO: 142553 - RNA, 24 nt, Human
cacccucccacccaaaacaaaaca

SEQ ID NO: 142554 - RNA, 22 nt, Human
caccuaugaucgugccacugca

SEQ ID NO: 142555 - RNA, 19 nt, Human
caccuguuaaauaccagcc

SEQ ID NO: 142556 - RNA, 19 nt, Human
caccuguuaaauaccagcc

SEQ ID NO: 142557 - RNA, 18 nt, Human
cacugcacuucagccggg

SEQ ID NO: 142558 - RNA, 18 nt, Human
cacugcacuucagccggg

SEQ ID NO: 142559 - RNA, 20 nt, Human
cacugcacuucagccgggac

SEQ ID NO: 142560 - RNA, 21 nt, Human
cacuguaaucccagcuacugg

SEQ ID NO: 142561 - RNA, 19 nt, Human
cacuucacuggaaaagaac

SEQ ID NO: 142562 - RNA, 24 nt, Human
cacuucuauaaaaacacacaagaa

SEQ ID NO: 142563 - RNA, 24 nt, Human
cacuucuauaaaaacacacaagaa

SEQ ID NO: 142564 - RNA, 18 nt, Human
cagaaaaaaaauugaccu

SEQ ID NO: 142565 - RNA, 18 nt, Human
cagaaaaaaaauugaccu

SEQ ID NO: 142566 - RNA, 21 nt, Human
cagaaaaaaaauugaccuagu

SEQ ID NO: 142567 - RNA, 21 nt, Human
cagaaaaaaaauugaccuagu

SEQ ID NO: 142568 - RNA, 26 nt, Human
cagaagagguaaagacaaguacaagc

SEQ ID NO: 142569 - RNA, 23 nt, Human
cagcacagaaaaaaaaaaugacc

SEQ ID NO: 142570 - RNA, 21 nt, Human
cagcaguaacuacugaauucc

SEQ ID NO: 142571 - RNA, 21 nt, Human
cagcaguaacuacugaauucc

SEQ ID NO: 142572 - RNA, 18 nt, Human
cagcauuaaggacugucu

SEQ ID NO: 142573 - RNA, 22 nt, Human
cagcauuaaggacugucugcaa

SEQ ID NO: 142574 - RNA, 22 nt, Human
cagcauuaaggacugucugcaa

SEQ ID NO: 142575 - RNA, 18 nt, Human
cagccacugggcgauucu

SEQ ID NO: 142576 - RNA, 18 nt, Human
cagccgggacgauggcgg

SEQ ID NO: 142577 - RNA, 22 nt, Human
cagccucaugaaaacuacugac

SEQ ID NO: 142578 - RNA, 20 nt, Human
cagccucgggcucccgcgcc

SEQ ID NO: 142579 - RNA, 19 nt, Human
caggaucccauguaauugc

SEQ ID NO: 142580 - RNA, 19 nt, Human
caggaucccauguaauugc

SEQ ID NO: 142581 - RNA, 25 nt, Human
cauaaagaauaaaauuacuucaaau

SEQ ID NO: 142582 - RNA, 21 nt, Human
cauaacuacaaucccaaaaca

SEQ ID NO: 142583 - RNA, 21 nt, Human
cauuuuguaauuuucaucagu

SEQ ID NO: 142584 - RNA, 23 nt, Human
ccaaaacaaaacagaacaaaaca

SEQ ID NO: 142585 - RNA, 18 nt, Human
ccaaaagugauugcaucu

SEQ ID NO: 142586 - RNA, 18 nt, Human
ccaaaagugauugcaucu

SEQ ID NO: 142587 - RNA, 20 nt, Human
ccaacaucugaauauuaacu

SEQ ID NO: 142588 - RNA, 20 nt, Human
ccaacaucugaauauuaacu

SEQ ID NO: 142589 - RNA, 23 nt, Human
ccaaugccuccaauuccuaaauu

SEQ ID NO: 142590 - RNA, 18 nt, Human
ccacccaaaacaaaacag

SEQ ID NO: 142591 - RNA, 23 nt, Human
ccacccaaaacaaaacagaacaa

SEQ ID NO: 142592 - RNA, 23 nt, Human
ccacccaaaacaaaacagaacaa

SEQ ID NO: 142593 - RNA, 25 nt, Human
ccacccaaaacaaaacagaacaaaa

SEQ ID NO: 142594 - RNA, 25 nt, Human
ccacccaaaacaaaacagaacaaaa

SEQ ID NO: 142595 - RNA, 23 nt, Human
ccacgugccgagaaaaagcaaaa

SEQ ID NO: 142596 - RNA, 23 nt, Human
ccacgugccgagaaaaagcaaaa

SEQ ID NO: 142597 - RNA, 19 nt, Human
ccacugcacuucagccggg

SEQ ID NO: 142598 - RNA, 19 nt, Human
ccacugcacuucagccggg

SEQ ID NO: 142599 - RNA, 20 nt, Human
ccacugcacuucagccggga

SEQ ID NO: 142600 - RNA, 21 nt, Human
ccacugcacuucagccgggac

SEQ ID NO: 142601 - RNA, 22 nt, Human
ccagacaaauucuaaaauaagc

SEQ ID NO: 142602 - RNA, 19 nt, Human
ccauagcuucuggauccag

SEQ ID NO: 142603 - RNA, 19 nt, Human
ccauagcuucuggauccag

SEQ ID NO: 142604 - RNA, 27 nt, Human
cccaaagaccaccacucagaccucccc

SEQ ID NO: 142605 - RNA, 27 nt, Human
cccaaagaccaccacucagaccucccc

SEQ ID NO: 142606 - RNA, 23 nt, Human
cccaaauuucccacccucccacc

SEQ ID NO: 142607 - RNA, 24 nt, Human
cccacccucccacccaaaacaaaa

SEQ ID NO: 142608 - RNA, 24 nt, Human
cccacccucccacccaaaacaaaa

SEQ ID NO: 142609 - RNA, 19 nt, Human
cccagcuacuggggaggcu

SEQ ID NO: 142610 - RNA, 19 nt, Human
cccccaaguccacaagccc

SEQ ID NO: 142611 - RNA, 21 nt, Human
cccccaaguccacaagcccuc

SEQ ID NO: 142612 - RNA, 22 nt, Human
ccgcucaaaagugucacacccc

SEQ ID NO: 142613 - RNA, 22 nt, Human
ccgcucaaaagugucacacccc

SEQ ID NO: 142614 - RNA, 24 nt, Human
ccgggacgauggcggggcgcucuu

SEQ ID NO: 142615 - RNA, 19 nt, Human
ccuccggugagucucagcc

SEQ ID NO: 142616 - RNA, 20 nt, Human
ccugauaaacaacaaaaagu

SEQ ID NO: 142617 - RNA, 23 nt, Human
ccugauggggugggggaagggag

SEQ ID NO: 142618 - RNA, 18 nt, Human
ccuguauuagcagaaaau

SEQ ID NO: 142619 - RNA, 19 nt, Human
ccuuauauuccuaaacagc

SEQ ID NO: 142620 - RNA, 19 nt, Human
ccuuauauuccuaaacagc

SEQ ID NO: 142621 - RNA, 21 nt, Human
cgaggcaccuguuaaauacca

SEQ ID NO: 142622 - RNA, 21 nt, Human
cgcuuccuccggugagucuca

SEQ ID NO: 142623 - RNA, 23 nt, Human
cuacaaucccaaaacauaaagaa

SEQ ID NO: 142624 - RNA, 25 nt, Human
cuacaggacucuguugcacacaaag

SEQ ID NO: 142625 - RNA, 22 nt, Human
cucacaaccgcucccccaaguc

SEQ ID NO: 142626 - RNA, 18 nt, Human
cucauugucagauguccu

SEQ ID NO: 142627 - RNA, 22 nt, Human
cucugcaacgggagagccacag

SEQ ID NO: 142628 - RNA, 22 nt, Human
cucugcaacgggagagccacag

SEQ ID NO: 142629 - RNA, 18 nt, Human
cugaagaugguguuugug

SEQ ID NO: 142630 - RNA, 18 nt, Human
cugaagaugguguuugug

SEQ ID NO: 142631 - RNA, 19 nt, Human
cugaccaaccaagaggagc

SEQ ID NO: 142632 - RNA, 25 nt, Human
cugacccauaugauaucuuaaccuu

SEQ ID NO: 142633 - RNA, 25 nt, Human
cugacccauaugauaucuuaaccuu

SEQ ID NO: 142634 - RNA, 19 nt, Human
cugcugguuccauagcuuc

SEQ ID NO: 142635 - RNA, 19 nt, Human
cugcugguuccauagcuuc

SEQ ID NO: 142636 - RNA, 21 nt, Human
cuggaaaagaaccucagagac

SEQ ID NO: 142637 - RNA, 19 nt, Human
cuguguuuucagcauuaag

SEQ ID NO: 142638 - RNA, 19 nt, Human
cuguguuuucagcauuaag

SEQ ID NO: 142639 - RNA, 20 nt, Human
cuuaaaaacccaaauuuccc

SEQ ID NO: 142640 - RNA, 20 nt, Human
cuuaaaaacccaaauuuccc

SEQ ID NO: 142641 - RNA, 22 nt, Human
cuucacuggaaaagaaccucag

SEQ ID NO: 142642 - RNA, 22 nt, Human
cuucuauaaaaacacacaagaa

SEQ ID NO: 142643 - RNA, 24 nt, Human
cuuguagcgguucaguguguuaau

SEQ ID NO: 142644 - RNA, 24 nt, Human
cuuguagcgguucaguguguuaau

SEQ ID NO: 142645 - RNA, 19 nt, Human
cuuucaaguuuacaaguag

SEQ ID NO: 142646 - RNA, 19 nt, Human
cuuucaaguuuacaaguag

SEQ ID NO: 142647 - RNA, 25 nt, Human
gaaaaaaaaaacaguuucaaaaugu

SEQ ID NO: 142648 - RNA, 20 nt, Human
gaacuaccaaguucaaaaaa

SEQ ID NO: 142649 - RNA, 28 nt, Human
gaacuaccaaguucaaaaaaaucaucca

SEQ ID NO: 142650 - RNA, 28 nt, Human
gaacuaccaaguucaaaaaaaucaucca

SEQ ID NO: 142651 - RNA, 21 nt, Human
gaagaaaaacagauuaugaua

SEQ ID NO: 142652 - RNA, 18 nt, Human
gaaucugagacuguagug

SEQ ID NO: 142653 - RNA, 18 nt, Human
gagaaaaagcaaaagaaa

SEQ ID NO: 142654 - RNA, 18 nt, Human
gauugcuucucagugcac

SEQ ID NO: 142655 - RNA, 20 nt, Human
gcacagaaaaaaaaaaugac

SEQ ID NO: 142656 - RNA, 20 nt, Human
gcacagaaaaaaaaaaugac

SEQ ID NO: 142657 - RNA, 19 nt, Human
gcacagaaguccuguaacc

SEQ ID NO: 142658 - RNA, 19 nt, Human
gcacagaaguccuguaacc

SEQ ID NO: 142659 - RNA, 18 nt, Human
gcagaagaaaugguggag

SEQ ID NO: 142660 - RNA, 18 nt, Human
gcagaagaaaugguggag

SEQ ID NO: 142661 - RNA, 21 nt, Human
gcagaagagguaaagacaagu

SEQ ID NO: 142662 - RNA, 22 nt, Human
gccgagaaaaagcaaaagaaaa

SEQ ID NO: 142663 - RNA, 26 nt, Human
gcuacaagugggucauaauauagauu

SEQ ID NO: 142664 - RNA, 19 nt, Human
gcugaagaugguguuugug

SEQ ID NO: 142665 - RNA, 18 nt, Human
gcugaauagaaagacaaa

SEQ ID NO: 142666 - RNA, 26 nt, Human
ggaaaaaaaacaccacuucuauaaaa

SEQ ID NO: 142667 - RNA, 26 nt, Human
ggaaaaaaaacaccacuucuauaaaa

SEQ ID NO: 142668 - RNA, 25 nt, Human
ggcacuggggccgcugcagaagaaa

SEQ ID NO: 142669 - RNA, 18 nt, Human
gggaagaguccagcggca

SEQ ID NO: 142670 - RNA, 22 nt, Human
gggaugggggggacaaaaagaa

SEQ ID NO: 142671 - RNA, 20 nt, Human
ggggaugggggggacaaaaa

SEQ ID NO: 142672 - RNA, 20 nt, Human
ggggaugggggggacaaaaa

SEQ ID NO: 142673 - RNA, 19 nt, Human
gggggaagggagggaagag

SEQ ID NO: 142674 - RNA, 19 nt, Human
gggggaagggagggaagag

SEQ ID NO: 142675 - RNA, 19 nt, Human
gggggaagggagggaagag

SEQ ID NO: 142676 - RNA, 22 nt, Human
gggggaugggggggacaaaaag

SEQ ID NO: 142677 - RNA, 20 nt, Human
gggggggacaaaaagaaaaa

SEQ ID NO: 142678 - RNA, 20 nt, Human
gggggggacaaaaagaaaaa

SEQ ID NO: 142679 - RNA, 19 nt, Human
ggggugggggaagggaggg

SEQ ID NO: 142680 - RNA, 20 nt, Human
ggggugggggaagggaggga

SEQ ID NO: 142681 - RNA, 20 nt, Human
ggggugggggaagggaggga

SEQ ID NO: 142682 - RNA, 20 nt, Human
ggggugggggaagggaggga

SEQ ID NO: 142683 - RNA, 24 nt, Human
gggugggggaagggagggaagagu

SEQ ID NO: 142684 - RNA, 20 nt, Human
gguaagagaaagaaagaaac

SEQ ID NO: 142685 - RNA, 21 nt, Human
ggucaagggcacuggggccgc

SEQ ID NO: 142686 - RNA, 18 nt, Human
ggugguggugauggugau

SEQ ID NO: 142687 - RNA, 18 nt, Human
guaaagcacacaaaacug

SEQ ID NO: 142688 - RNA, 18 nt, Human
guaaagcacacaaaacug

SEQ ID NO: 142689 - RNA, 19 nt, Human
guaguaaagcacacaaaac

SEQ ID NO: 142690 - RNA, 19 nt, Human
guaguaaagcacacaaaac

SEQ ID NO: 142691 - RNA, 23 nt, Human
gucugcaaaagcauguccaaaag

SEQ ID NO: 142692 - RNA, 23 nt, Human
gucugcaaaagcauguccaaaag

SEQ ID NO: 142693 - RNA, 20 nt, Human
gugcccaaguguguuuagag

SEQ ID NO: 142694 - RNA, 20 nt, Human
gugcccaaguguguuuagag

SEQ ID NO: 142695 - RNA, 21 nt, Human
gugccgagaaaaagcaaaaga

SEQ ID NO: 142696 - RNA, 18 nt, Human
guggagauaccacgugcc

SEQ ID NO: 142697 - RNA, 18 nt, Human
guggagauaccacgugcc

SEQ ID NO: 142698 - RNA, 18 nt, Human
guuccauccuaucuuccu

SEQ ID NO: 142699 - RNA, 18 nt, Human
guuccauccuaucuuccu

SEQ ID NO: 142700 - RNA, 24 nt, Human
guuccuaggucagccucaugaaaa

SEQ ID NO: 142701 - RNA, 23 nt, Human
uaaaaacccaaauuucccacccu

SEQ ID NO: 142702 - RNA, 19 nt, Human
uaagagaaagaaagaaacc

SEQ ID NO: 142703 - RNA, 23 nt, Human
uaaguucugagacauuucucaca

SEQ ID NO: 142704 - RNA, 26 nt, Human
uaccagccugucugcucaggucacgc

SEQ ID NO: 142705 - RNA, 26 nt, Human
uaccagccugucugcucaggucacgc

SEQ ID NO: 142706 - RNA, 23 nt, Human
uacugcauuuccgugcccaagug

SEQ ID NO: 142707 - RNA, 22 nt, Human
uagaaagacaaaaaaaccccac

SEQ ID NO: 142708 - RNA, 22 nt, Human
uagaaagacaaaaaaaccccac

SEQ ID NO: 142709 - RNA, 24 nt, Human
uagaaagacaaaaaaaccccacug

SEQ ID NO: 142710 - RNA, 24 nt, Human
uagaaagacaaaaaaaccccacug

SEQ ID NO: 142711 - RNA, 25 nt, Human
uagaaagacaaaaaaaccccacugu

SEQ ID NO: 142712 - RNA, 25 nt, Human
uagaaagacaaaaaaaccccacugu

SEQ ID NO: 142713 - RNA, 24 nt, Human
uagaaugaaacgcgguguucugcu

SEQ ID NO: 142714 - RNA, 19 nt, Human
uagaauuccaaguggugcu

SEQ ID NO: 142715 - RNA, 22 nt, Human
uagcuucuggauccaguguccc

SEQ ID NO: 142716 - RNA, 22 nt, Human
uagcuucuggauccaguguccc

SEQ ID NO: 142717 - RNA, 20 nt, Human
uaggucagccucaugaaaac

SEQ ID NO: 142718 - RNA, 23 nt, Human
uaucccaaagaccaccacucaga

SEQ ID NO: 142719 - RNA, 23 nt, Human
uaucccaaagaccaccacucaga

SEQ ID NO: 142720 - RNA, 25 nt, Human
uaucccaaagaccaccacucagacc

SEQ ID NO: 142721 - RNA, 25 nt, Human
uaucccaaagaccaccacucagacc

SEQ ID NO: 142722 - RNA, 24 nt, Human
uaugaucgugccacugcacuucag

SEQ ID NO: 142723 - RNA, 21 nt, Human
ucaaaagugucacaccccaaa

SEQ ID NO: 142724 - RNA, 21 nt, Human
ucaaaagugucacaccccaaa

SEQ ID NO: 142725 - RNA, 23 nt, Human
ucaaauaaaccugaauauuccac

SEQ ID NO: 142726 - RNA, 18 nt, Human
ucagagaaaaaaaaaaca

SEQ ID NO: 142727 - RNA, 24 nt, Human
ucagauguccuucagucauguaau

SEQ ID NO: 142728 - RNA, 18 nt, Human
ucagccccuugccucauu

SEQ ID NO: 142729 - RNA, 21 nt, Human
ucagguaagagaaagaaagaa

SEQ ID NO: 142730 - RNA, 20 nt, Human
ucaguauaguucauuucagg

SEQ ID NO: 142731 - RNA, 20 nt, Human
ucagugccugaccaaccaag

SEQ ID NO: 142732 - RNA, 24 nt, Human
ucauaucauccugauggggugggg

SEQ ID NO: 142733 - RNA, 24 nt, Human
ucauaucauccugauggggugggg

SEQ ID NO: 142734 - RNA, 24 nt, Human
ucauaucauccugauggggugggg

SEQ ID NO: 142735 - RNA, 23 nt, Human
uccagcuaugccagucucuuggc

SEQ ID NO: 142736 - RNA, 19 nt, Human
uccauggugguggugaugg

SEQ ID NO: 142737 - RNA, 19 nt, Human
ucccaaaacauaaagaaua

SEQ ID NO: 142738 - RNA, 21 nt, Human
ucccaaagaccaccacucaga

SEQ ID NO: 142739 - RNA, 21 nt, Human
ucccaaagaccaccacucaga

SEQ ID NO: 142740 - RNA, 25 nt, Human
ucccacccaaaacaaaacagaacaa

SEQ ID NO: 142741 - RNA, 25 nt, Human
ucccacccaaaacaaaacagaacaa

SEQ ID NO: 142742 - RNA, 19 nt, Human
ucccacccucccacccaaa

SEQ ID NO: 142743 - RNA, 19 nt, Human
ucccacccucccacccaaa

SEQ ID NO: 142744 - RNA, 23 nt, Human
ucccacccucccacccaaaacaa

SEQ ID NO: 142745 - RNA, 23 nt, Human
ucccacccucccacccaaaacaa

SEQ ID NO: 142746 - RNA, 24 nt, Human
ucccacccucccacccaaaacaaa

SEQ ID NO: 142747 - RNA, 24 nt, Human
ucccacccucccacccaaaacaaa

SEQ ID NO: 142748 - RNA, 18 nt, Human
ucccccaaguccacaagc

SEQ ID NO: 142749 - RNA, 21 nt, Human
uccugauaaacaacaaaaagu

SEQ ID NO: 142750 - RNA, 21 nt, Human
uccugauaaacaacaaaaagu

SEQ ID NO: 142751 - RNA, 24 nt, Human
uccugauggggugggggaagggag

SEQ ID NO: 142752 - RNA, 24 nt, Human
uccugauggggugggggaagggag

SEQ ID NO: 142753 - RNA, 22 nt, Human
uccuggucaagggcacuggggc

SEQ ID NO: 142754 - RNA, 21 nt, Human
ugaacuaccaaguucaaaaaa

SEQ ID NO: 142755 - RNA, 21 nt, Human
ugaacuaccaaguucaaaaaa

SEQ ID NO: 142756 - RNA, 19 nt, Human
ugaccaagaccaacaucug

SEQ ID NO: 142757 - RNA, 19 nt, Human
ugaccaagaccaacaucug

SEQ ID NO: 142758 - RNA, 19 nt, Human
ugaccagaaaaauucauaa

SEQ ID NO: 142759 - RNA, 20 nt, Human
ugaccuagucagccacaugg

SEQ ID NO: 142760 - RNA, 20 nt, Human
ugaccuagucagccacaugg

SEQ ID NO: 142761 - RNA, 26 nt, Human
ugacuuacaggaaaaugaaaguaauc

SEQ ID NO: 142762 - RNA, 21 nt, Human
ugagcuauccaugaagauggg

SEQ ID NO: 142763 - RNA, 21 nt, Human
ugagcuauccaugaagauggg

SEQ ID NO: 142764 - RNA, 18 nt, Human
ugaggugggaagacugcu

SEQ ID NO: 142765 - RNA, 19 nt, Human
ugaugcaagacaauuaccc

SEQ ID NO: 142766 - RNA, 19 nt, Human
ugaugcaaugcauucuguu

SEQ ID NO: 142767 - RNA, 20 nt, Human
ugauggugaugggaacuguu

SEQ ID NO: 142768 - RNA, 22 nt, Human
ugauggugaugggaacuguuac

SEQ ID NO: 142769 - RNA, 20 nt, Human
ugcaaugcauucuguugagg

SEQ ID NO: 142770 - RNA, 23 nt, Human
ugcacagaaguccuguaaccaaa

SEQ ID NO: 142771 - RNA, 23 nt, Human
ugcacagaaguccuguaaccaaa

SEQ ID NO: 142772 - RNA, 20 nt, Human
ugcagaagaaaugguggaga

SEQ ID NO: 142773 - RNA, 20 nt, Human
ugcagaagaaaugguggaga

SEQ ID NO: 142774 - RNA, 18 nt, Human
ugccucaguauaguucau

SEQ ID NO: 142775 - RNA, 20 nt, Human
ugccucaguauaguucauuu

SEQ ID NO: 142776 - RNA, 23 nt, Human
ugccugacaaacuucaccacaac

SEQ ID NO: 142777 - RNA, 23 nt, Human
ugccugacaaacuucaccacaac

SEQ ID NO: 142778 - RNA, 20 nt, Human
ugcucaggucacgcaugaga

SEQ ID NO: 142779 - RNA, 20 nt, Human
ugcucaggucacgcaugaga

SEQ ID NO: 142780 - RNA, 23 nt, Human
uggaaaaaaaacaccacuucuau

SEQ ID NO: 142781 - RNA, 23 nt, Human
uggaaaaaaaacaccacuucuau

SEQ ID NO: 142782 - RNA, 19 nt, Human
uggaagcuggaggucccuc

SEQ ID NO: 142783 - RNA, 19 nt, Human
uggaagcuggaggucccuc

SEQ ID NO: 142784 - RNA, 22 nt, Human
uggccaaguuccuaggucagcc

SEQ ID NO: 142785 - RNA, 24 nt, Human
ugggauguggcaaguuaaaauggg

SEQ ID NO: 142786 - RNA, 24 nt, Human
ugggauguggcaaguuaaaauggg

SEQ ID NO: 142787 - RNA, 22 nt, Human
uggucaagggcacuggggccgc

SEQ ID NO: 142788 - RNA, 21 nt, Human
ugguuacagacaucuaugugc

SEQ ID NO: 142789 - RNA, 21 nt, Human
ugguuacagacaucuaugugc

SEQ ID NO: 142790 - RNA, 21 nt, Human
uguaacauaacacaguaugca

SEQ ID NO: 142791 - RNA, 21 nt, Human
uguaacauaacacaguaugca

SEQ ID NO: 142792 - RNA, 25 nt, Human
ugucagagaaaaaaaaaacaguuuc

SEQ ID NO: 142793 - RNA, 23 nt, Human
uguccauggugguggugauggug

SEQ ID NO: 142794 - RNA, 18 nt, Human
ugugcagaagaaaugguc

SEQ ID NO: 142795 - RNA, 18 nt, Human
ugugcagaagaaaugguc

SEQ ID NO: 142796 - RNA, 21 nt, Human
ugugcagaagaaaugguggag

SEQ ID NO: 142797 - RNA, 21 nt, Human
ugugcagaagaaaugguggag

SEQ ID NO: 142798 - RNA, 22 nt, Human
ugugccugacaaacuucaccac

SEQ ID NO: 142799 - RNA, 22 nt, Human
ugugccugacaaacuucaccac

SEQ ID NO: 142800 - RNA, 20 nt, Human
ugugugaagaaaaacagauu

SEQ ID NO: 142801 - RNA, 21 nt, Human
uuaaauaccagccugucugcu

SEQ ID NO: 142802 - RNA, 21 nt, Human
uuaaauaccagccugucugcu

SEQ ID NO: 142803 - RNA, 22 nt, Human
uuaagacagagguaaaguuacu

SEQ ID NO: 142804 - RNA, 22 nt, Human
uuacaauauacacagcaagucc

SEQ ID NO: 142805 - RNA, 22 nt, Human
uuacaauauacacagcaagucc

SEQ ID NO: 142806 - RNA, 21 nt, Human
uuacugcuucuuuucuaggcu

SEQ ID NO: 142807 - RNA, 21 nt, Human
uuacugcuucuuuucuaggcu

SEQ ID NO: 142808 - RNA, 20 nt, Human
uucaaguuaaaaaaaaaauc

SEQ ID NO: 142809 - RNA, 20 nt, Human
uucaaguuaaaaaaaaaauc

SEQ ID NO: 142810 - RNA, 19 nt, Human
uuccaaguggugcuacaag

SEQ ID NO: 142811 - RNA, 18 nt, Human
uuccgugcccaagugugu

SEQ ID NO: 142812 - RNA, 18 nt, Human
uuccgugcccaagugugu

SEQ ID NO: 142813 - RNA, 20 nt, Human
uucucuguguuuucagcauu

SEQ ID NO: 142814 - RNA, 20 nt, Human
uucucuguguuuucagcauu

SEQ ID NO: 142815 - RNA, 21 nt, Human
uugcaauaccuuacaauuagu

SEQ ID NO: 142816 - RNA, 21 nt, Human
uugcaauaccuuacaauuagu

SEQ ID NO: 142817 - RNA, 18 nt, Human
uugugcagaagaaauggu

SEQ ID NO: 142818 - RNA, 19 nt, Human
uugugcagaagaaaugguu

SEQ ID NO: 142819 - RNA, 19 nt, Human
uugugcagaagaaaugguu

SEQ ID NO: 142820 - RNA, 26 nt, Human
uuucccacccucccacccaaaacaaa

SEQ ID NO: 142821 - RNA, 26 nt, Human
uuucccacccucccacccaaaacaaa

SEQ ID NO: 142822 - RNA, 24 nt, Human
uuugcuccucaguagguucagaua

SEQ ID NO: 142823 - RNA, 24 nt, Human
uuugcuccucaguagguucagaua

SEQ ID NO: 142824 - RNA, 21 nt, Human
uuugcugaauagaaagacaaa

SEQ ID NO: 142825 - RNA, 23 nt, Human
uuuuuggaaaaaaaacaccacuu

SEQ ID NO: 142826 - RNA, 23 nt, Human
uuuuuggaaaaaaaacaccacuu

SEQ ID NO: 142827 - RNA, 27 nt, Human
aaaacccucuccuugaccccccugccc

SEQ ID NO: 142828 - RNA, 22 nt, Human
aacccucuccuugaccccccug

SEQ ID NO: 142829 - RNA, 21 nt, Human
aaccggcccccccacgcccug

SEQ ID NO: 142830 - RNA, 19 nt, Human
acaaaccggcccccccacg

SEQ ID NO: 142831 - RNA, 21 nt, Human
acaacaaaccggcccccccac

SEQ ID NO: 142832 - RNA, 20 nt, Human
accccccugccccaggcccc

SEQ ID NO: 142833 - RNA, 22 nt, Human
accccccugccccaggccccaa

SEQ ID NO: 142834 - RNA, 22 nt, Human
accugaaggagcgggcaagggg

SEQ ID NO: 142835 - RNA, 20 nt, Human
agaaaaaaagggggagaggg

SEQ ID NO: 142836 - RNA, 21 nt, Human
agaaaaaaagggggagagggg

SEQ ID NO: 142837 - RNA, 19 nt, Human
agaaagcucuuuacugggg

SEQ ID NO: 142838 - RNA, 19 nt, Human
aggagcgggcaaggggacu

SEQ ID NO: 142839 - RNA, 19 nt, Human
agggggagaggggcccaag

SEQ ID NO: 142840 - RNA, 22 nt, Human
agggggagaggggcccaagggu

SEQ ID NO: 142841 - RNA, 25 nt, Human
caacaaaccggcccccccacgcccu

SEQ ID NO: 142842 - RNA, 26 nt, Human
caacaaaccggcccccccacgcccug

SEQ ID NO: 142843 - RNA, 18 nt, Human
caggccucacccacccca

SEQ ID NO: 142844 - RNA, 23 nt, Human
ccacaacaaaccggcccccccac

SEQ ID NO: 142845 - RNA, 25 nt, Human
ccccaggccccaaucagugcaggcc

SEQ ID NO: 142846 - RNA, 27 nt, Human
ccccaggccccaaucagugcaggccuc

SEQ ID NO: 142847 - RNA, 22 nt, Human
cccccacccccuccuagggucc

SEQ ID NO: 142848 - RNA, 19 nt, Human
cccccacgcccuggacucc

SEQ ID NO: 142849 - RNA, 18 nt, Human
cccccugccccaggcccc

SEQ ID NO: 142850 - RNA, 22 nt, Human
cccccugccccaggccccaauc

SEQ ID NO: 142851 - RNA, 20 nt, Human
ccccuaccugcccccacccc

SEQ ID NO: 142852 - RNA, 24 nt, Human
cccuaccugcccccacccccuccu

SEQ ID NO: 142853 - RNA, 23 nt, Human
ccgcugagaccugaaggagcggg

SEQ ID NO: 142854 - RNA, 25 nt, Human
ccggcccccccacgcccuggacucc

SEQ ID NO: 142855 - RNA, 21 nt, Human
ccuaccugcccccacccccuc

SEQ ID NO: 142856 - RNA, 26 nt, Human
ccucacccaccccagcuggguagcag

SEQ ID NO: 142857 - RNA, 21 nt, Human
cucccccuaccugcccccacc

SEQ ID NO: 142858 - RNA, 22 nt, Human
cuucaggaggggccccagggag

SEQ ID NO: 142859 - RNA, 18 nt, Human
gaaaaaaagggggagagg

SEQ ID NO: 142860 - RNA, 18 nt, Human
gaggaugggagcccaggg

SEQ ID NO: 142861 - RNA, 21 nt, Human
gagggccgcaggggagcgagg

SEQ ID NO: 142862 - RNA, 23 nt, Human
gaggggccccagggagggggcag

SEQ ID NO: 142863 - RNA, 22 nt, Human
gagggggggucuucccuccacc

SEQ ID NO: 142864 - RNA, 24 nt, Human
gccaaaacccucuccuugacccuu

SEQ ID NO: 142865 - RNA, 21 nt, Human
gcccacuggcugaggguaucc

SEQ ID NO: 142866 - RNA, 19 nt, Human
gcucagagggccgcagggg

SEQ ID NO: 142867 - RNA, 19 nt, Human
ggcaaggggacucaaacug

SEQ ID NO: 142868 - RNA, 19 nt, Human
gggagcccggccggggggc

SEQ ID NO: 142869 - RNA, 23 nt, Human
gugggcucagagggccgcagggg

SEQ ID NO: 142870 - RNA, 22 nt, Human
uaccugcccccacccccuccua

SEQ ID NO: 142871 - RNA, 21 nt, Human
uagaaaaaaagggggagaggg

SEQ ID NO: 142872 - RNA, 21 nt, Human
ugaccccccugccccaggccc

SEQ ID NO: 142873 - RNA, 22 nt, Human
ugaccccccugccccaggcccc

SEQ ID NO: 142874 - RNA, 23 nt, Human
ugagggggggucuucccuccacc

SEQ ID NO: 142875 - RNA, 20 nt, Human
ugccccaggccccaaucagu

SEQ ID NO: 142876 - RNA, 21 nt, Human
ugcucggggagcccgagcuca

SEQ ID NO: 142877 - RNA, 22 nt, Human
uggggugagggggggucuuccc

SEQ ID NO: 142878 - RNA, 23 nt, Human
ugguacaauaaauagaaaaaaag

SEQ ID NO: 142879 - RNA, 24 nt, Human
ugugagaaagcucuuuacuggggg

SEQ ID NO: 142880 - RNA, 18 nt, Human
uuaguggggagggagcgg

SEQ ID NO: 142881 - RNA, 23 nt, Human
aaaauacugaaauuuucacugug

SEQ ID NO: 142882 - RNA, 18 nt, Human
aaacaggucugagcuacu

SEQ ID NO: 142883 - RNA, 28 nt, Human
aaagaacuuaaccggaaacuuucuuggc

SEQ ID NO: 142884 - RNA, 21 nt, Human
aaaguaaaauaaaauagagga

SEQ ID NO: 142885 - RNA, 24 nt, Human
aaccuuacaguggcaccugaaaag

SEQ ID NO: 142886 - RNA, 23 nt, Human
aacuaugaaauccccaccuuaag

SEQ ID NO: 142887 - RNA, 22 nt, Human
aagaagacaaacuaaaugcaag

SEQ ID NO: 142888 - RNA, 26 nt, Human
aagcagagaaaagggaggaacaguuc

SEQ ID NO: 142889 - RNA, 23 nt, Human
aaggaagaagacaaacuaaaugc

SEQ ID NO: 142890 - RNA, 23 nt, Human
aauccccaccuuaaguagcuagg

SEQ ID NO: 142891 - RNA, 20 nt, Human
acagccagacacacacaguc

SEQ ID NO: 142892 - RNA, 23 nt, Human
acaugcuacaccugugcauggac

SEQ ID NO: 142893 - RNA, 20 nt, Human
accauaaaaacauagugaau

SEQ ID NO: 142894 - RNA, 18 nt, Human
agaaccuuacaguggcac

SEQ ID NO: 142895 - RNA, 19 nt, Human
agacaaacuaaaugcaagc

SEQ ID NO: 142896 - RNA, 21 nt, Human
agacaaacuaaaugcaagccg

SEQ ID NO: 142897 - RNA, 21 nt, Human
agggaggaacaguucauggaa

SEQ ID NO: 142898 - RNA, 18 nt, Human
aggggcugucacccuggg

SEQ ID NO: 142899 - RNA, 19 nt, Human
aggggcugucacccugggg

SEQ ID NO: 142900 - RNA, 20 nt, Human
agucugggauacacagcuga

SEQ ID NO: 142901 - RNA, 23 nt, Human
auagaggaaugcuaucucugggg

SEQ ID NO: 142902 - RNA, 21 nt, Human
auagugaaugucuuugacacc

SEQ ID NO: 142903 - RNA, 23 nt, Human
caaacaggcagaaaucuuucuau

SEQ ID NO: 142904 - RNA, 21 nt, Human
caaacuaaaugcaagcaacag

SEQ ID NO: 142905 - RNA, 21 nt, Human
caacccaguaaggcucagcaa

SEQ ID NO: 142906 - RNA, 24 nt, Human
cacauacuaaaaaauuuuuuucac

SEQ ID NO: 142907 - RNA, 21 nt, Human
cagucugggauacacagcuga

SEQ ID NO: 142908 - RNA, 21 nt, Human
cauacuagaaaauuuggagga

SEQ ID NO: 142909 - RNA, 22 nt, Human
cauagugaaugucuuugacacc

SEQ ID NO: 142910 - RNA, 19 nt, Human
ccacuacccccaacaccca

SEQ ID NO: 142911 - RNA, 21 nt, Human
ccacuacccccaacacccaga

SEQ ID NO: 142912 - RNA, 23 nt, Human
cccacuacccccaacacccagau

SEQ ID NO: 142913 - RNA, 19 nt, Human
ccccucgcgcggguccccg

SEQ ID NO: 142914 - RNA, 19 nt, Human
ccgccgccgccgccucccg

SEQ ID NO: 142915 - RNA, 18 nt, Human
ccgccgccgccucccggc

SEQ ID NO: 142916 - RNA, 23 nt, Human
ccgccgccgccucccggccgccc

SEQ ID NO: 142917 - RNA, 22 nt, Human
ccgccgccucccggccgccccu

SEQ ID NO: 142918 - RNA, 21 nt, Human
ccggcuuuuagaaugucagaa

SEQ ID NO: 142919 - RNA, 24 nt, Human
ccucacuggggaccacgcuuuuaa

SEQ ID NO: 142920 - RNA, 21 nt, Human
ccuccucuaaacguguuguua

SEQ ID NO: 142921 - RNA, 20 nt, Human
cggcuuuuagaaugucagaa

SEQ ID NO: 142922 - RNA, 19 nt, Human
cgggagcggcggccgaagg

SEQ ID NO: 142923 - RNA, 18 nt, Human
cuacagccagacacacac

SEQ ID NO: 142924 - RNA, 19 nt, Human
cuacccccaacacccagau

SEQ ID NO: 142925 - RNA, 18 nt, Human
cucccggccgccccucgc

SEQ ID NO: 142926 - RNA, 18 nt, Human
cugaccguucuccuccca

SEQ ID NO: 142927 - RNA, 19 nt, Human
cugcugcuacuucuggcgg

SEQ ID NO: 142928 - RNA, 20 nt, Human
cugcugcuacuucuggcggc

SEQ ID NO: 142929 - RNA, 22 nt, Human
cuggcggccgccgccgccgccu

SEQ ID NO: 142930 - RNA, 20 nt, Human
gaaaaucucuaagguacagu

SEQ ID NO: 142931 - RNA, 23 nt, Human
gaggauuuucaacccucuuucuu

SEQ ID NO: 142932 - RNA, 18 nt, Human
gcggccgccgccgccgcc

SEQ ID NO: 142933 - RNA, 19 nt, Human
gcugccgucgccgccgccg

SEQ ID NO: 142934 - RNA, 18 nt, Human
ggaaaaggagggccuuaa

SEQ ID NO: 142935 - RNA, 18 nt, Human
ggagaaaagcagagaaaa

SEQ ID NO: 142936 - RNA, 18 nt, Human
guacaguuuuucuuagaa

SEQ ID NO: 142937 - RNA, 19 nt, Human
guuugagcacuagaggaaa

SEQ ID NO: 142938 - RNA, 24 nt, Human
uaaaauacugaaauuuucacugug

SEQ ID NO: 142939 - RNA, 25 nt, Human
uaacauuggccuuacugaacagcca

SEQ ID NO: 142940 - RNA, 22 nt, Human
uacagccagacacacacagucc

SEQ ID NO: 142941 - RNA, 23 nt, Human
uacauuagugauaaaauacugaa

SEQ ID NO: 142942 - RNA, 23 nt, Human
uacccaaaaccuauuguccaaac

SEQ ID NO: 142943 - RNA, 24 nt, Human
uacccccaacacccagauuaauuu

SEQ ID NO: 142944 - RNA, 19 nt, Human
uacuagaaaauuuggagga

SEQ ID NO: 142945 - RNA, 19 nt, Human
uagaaugucacuuugauuc

SEQ ID NO: 142946 - RNA, 22 nt, Human
uaggugcaaaagcaacucugua

SEQ ID NO: 142947 - RNA, 23 nt, Human
uauccuaaucuguacuacccaaa

SEQ ID NO: 142948 - RNA, 21 nt, Human
ucccacuacccccaacaccca

SEQ ID NO: 142949 - RNA, 23 nt, Human
uccucccacuacccccaacaccc

SEQ ID NO: 142950 - RNA, 22 nt, Human
uccuccucuaaacguguuguua

SEQ ID NO: 142951 - RNA, 19 nt, Human
uccugcugcuacuucuggc

SEQ ID NO: 142952 - RNA, 20 nt, Human
ucugcuaaaucuucuuugga

SEQ ID NO: 142953 - RNA, 20 nt, Human
ucuggcggccgccgccgccg

SEQ ID NO: 142954 - RNA, 18 nt, Human
ucuguaauaugaggcuuc

SEQ ID NO: 142955 - RNA, 19 nt, Human
ucuguauuaacagucuggg

SEQ ID NO: 142956 - RNA, 23 nt, Human
ugaaauuuucacugugaaaauaa

SEQ ID NO: 142957 - RNA, 19 nt, Human
ugaaccauaaaaacauagu

SEQ ID NO: 142958 - RNA, 23 nt, Human
ugagagaaccuuacaguggcacc

SEQ ID NO: 142959 - RNA, 24 nt, Human
ugauauagaucauugcucauacau

SEQ ID NO: 142960 - RNA, 20 nt, Human
ugauucugaccguucuccuc

SEQ ID NO: 142961 - RNA, 21 nt, Human
ugauucugaccguucuccucc

SEQ ID NO: 142962 - RNA, 19 nt, Human
uggagggaaaaggagggcc

SEQ ID NO: 142963 - RNA, 19 nt, Human
uggcagucaugaaguaauc

SEQ ID NO: 142964 - RNA, 26 nt, Human
uggggaccacgcuuuuaaguacuugu

SEQ ID NO: 142965 - RNA, 19 nt, Human
uguccaaacaggcagaaau

SEQ ID NO: 142966 - RNA, 22 nt, Human
ugugguauuaaaagaggaacag

SEQ ID NO: 142967 - RNA, 19 nt, Human
uguucuuuuuuuaauugga

SEQ ID NO: 142968 - RNA, 19 nt, Human
uuaagugcugaaaagauac

SEQ ID NO: 142969 - RNA, 19 nt, Human
uucaacccucuuucuuuuu

SEQ ID NO: 142970 - RNA, 23 nt, Human
uucccaggcugagagaaccuuac

SEQ ID NO: 142971 - RNA, 24 nt, Human
uucuguauuaacagucugggauac

SEQ ID NO: 142972 - RNA, 20 nt, Human
uuguauuuguuugagcacua

SEQ ID NO: 142973 - RNA, 22 nt, Human
uuucuuggccucacuggggacc

SEQ ID NO: 142974 - RNA, 22 nt, Human
uuuguuugagcacuagaggaaa

SEQ ID NO: 142975 - RNA, 21 nt, Human
aacaaaaacauccaccaaugg

SEQ ID NO: 142976 - RNA, 26 nt, Human
acauaugcaucucugggcauaucucu

SEQ ID NO: 142977 - RNA, 19 nt, Human
caacuccgcugcuggggcg

SEQ ID NO: 142978 - RNA, 26 nt, Human
caagcugguuagguaauuagcccuug

SEQ ID NO: 142979 - RNA, 21 nt, Human
cagacacugcagcucagcgca

SEQ ID NO: 142980 - RNA, 19 nt, Human
ccagauggccaauacaagc

SEQ ID NO: 142981 - RNA, 18 nt, Human
cccggccccaggcggccc

SEQ ID NO: 142982 - RNA, 21 nt, Human
ccgcauccuuccgcccaggcc

SEQ ID NO: 142983 - RNA, 18 nt, Human
ccgcugcuggggcgggag

SEQ ID NO: 142984 - RNA, 24 nt, Human
ccgcugcuggggcgggagcccggc

SEQ ID NO: 142985 - RNA, 18 nt, Human
ccuccgcggcgcgacgcu

SEQ ID NO: 142986 - RNA, 22 nt, Human
cuugaagaauucuuuuauaauc

SEQ ID NO: 142987 - RNA, 19 nt, Human
cuugcauuuuuuccauuug

SEQ ID NO: 142988 - RNA, 26 nt, Human
gccccaggcggccccgcauccuuccg

SEQ ID NO: 142989 - RNA, 20 nt, Human
uagcucgggaccccgcucgg

SEQ ID NO: 142990 - RNA, 19 nt, Human
uccgcugcuggggcgggag

SEQ ID NO: 142991 - RNA, 19 nt, Human
ucggccacgccaccuacgc

SEQ ID NO: 142992 - RNA, 21 nt, Human
ucggggagaggcgccaguugg

SEQ ID NO: 142993 - RNA, 23 nt, Human
uggccaauacaagcugguuaggu

SEQ ID NO: 142994 - RNA, 18 nt, Human
aggcaggccagucccaug

SEQ ID NO: 142995 - RNA, 21 nt, Human
auggaaguggggugaucucag

SEQ ID NO: 142996 - RNA, 23 nt, Human
cacccccgccgcccuucccgagc

SEQ ID NO: 142997 - RNA, 23 nt, Human
cacggcauuuugcaccuggcugg

SEQ ID NO: 142998 - RNA, 23 nt, Human
caggggcuucugcucaucuucca

SEQ ID NO: 142999 - RNA, 24 nt, Human
ccaaaaaagcguuggguuggggga

SEQ ID NO: 143000 - RNA, 21 nt, Human
ccccacggccccuucuacagg

SEQ ID NO: 143001 - RNA, 21 nt, Human
ccccgugcgcccagggcgcaa

SEQ ID NO: 143002 - RNA, 18 nt, Human
ccgccgcccuucccgagc

SEQ ID NO: 143003 - RNA, 20 nt, Human
ccgccgcccuucccgagcuc

SEQ ID NO: 143004 - RNA, 20 nt, Human
ccgugcgcccagggcgcaaa

SEQ ID NO: 143005 - RNA, 18 nt, Human
ccuggcuuagagcaguug

SEQ ID NO: 143006 - RNA, 25 nt, Human
cgagcugggcggaggaggcaggcca

SEQ ID NO: 143007 - RNA, 23 nt, Human
cgcccagggcgcaaagagggcuc

SEQ ID NO: 143008 - RNA, 21 nt, Human
cguguagggccccgugcgccc

SEQ ID NO: 143009 - RNA, 19 nt, Human
cucaucuuccacccccgcc

SEQ ID NO: 143010 - RNA, 21 nt, Human
cuuccacccccgccgcccuuc

SEQ ID NO: 143011 - RNA, 24 nt, Human
cuuguggguccccucgcuggagag

SEQ ID NO: 143012 - RNA, 20 nt, Human
gagcuccauguuagcaacuc

SEQ ID NO: 143013 - RNA, 18 nt, Human
gcucaucuuccacccccg

SEQ ID NO: 143014 - RNA, 21 nt, Human
gcuggcugggcgaggccggcu

SEQ ID NO: 143015 - RNA, 24 nt, Human
gcuggguccccgccccggcugcgc

SEQ ID NO: 143016 - RNA, 18 nt, Human
ggcaggacaaucaggccu

SEQ ID NO: 143017 - RNA, 22 nt, Human
ggcgaggccggcucgaaucucu

SEQ ID NO: 143018 - RNA, 20 nt, Human
ggcuggguccccgccccggc

SEQ ID NO: 143019 - RNA, 24 nt, Human
ggcuucugcucaucuuccaccccc

SEQ ID NO: 143020 - RNA, 18 nt, Human
gggcggaggaggcaggcc

SEQ ID NO: 143021 - RNA, 20 nt, Human
ggggaccccacggccccuuc

SEQ ID NO: 143022 - RNA, 19 nt, Human
gggggagaaggaaaugaug

SEQ ID NO: 143023 - RNA, 25 nt, Human
ggguugggggagaaggaaaugaugg

SEQ ID NO: 143024 - RNA, 24 nt, Human
guggguccccucgcuggagagggc

SEQ ID NO: 143025 - RNA, 19 nt, Human
ucagagcuccauguuagca

SEQ ID NO: 143026 - RNA, 22 nt, Human
uccacccccgccgcccuucccg

SEQ ID NO: 143027 - RNA, 18 nt, Human
uccagugggcuaggcugg

SEQ ID NO: 143028 - RNA, 19 nt, Human
uccauguuagcaacucugg

SEQ ID NO: 143029 - RNA, 25 nt, Human
ucggaaaggucgggagggccgaggc

SEQ ID NO: 143030 - RNA, 22 nt, Human
ucugcccacccuggcaggacaa

SEQ ID NO: 143031 - RNA, 22 nt, Human
ucuuccacccccgccgcccuuc

SEQ ID NO: 143032 - RNA, 22 nt, Human
ugacacggcauuuugcaccugg

SEQ ID NO: 143033 - RNA, 19 nt, Human
ugagcugauccaaaaaagc

SEQ ID NO: 143034 - RNA, 23 nt, Human
ugauggaaguggggugaucucag

SEQ ID NO: 143035 - RNA, 23 nt, Human
uggcaggacaaucaggccuagga

SEQ ID NO: 143036 - RNA, 22 nt, Human
ugggcggaggaggcaggccagu

SEQ ID NO: 143037 - RNA, 26 nt, Human
uggguugggggagaaggaaaugaugg

SEQ ID NO: 143038 - RNA, 21 nt, Human
uugugguuccaacuguuuuau

SEQ ID NO: 143039 - RNA, 22 nt, Human
uuugugguuccaacuguuuuau

SEQ ID NO: 143040 - RNA, 22 nt, Human
uuuuuugugguuccaacuguuu

SEQ ID NO: 143041 - RNA, 24 nt, Human
uuuuuuuuuuuuuuuuuugugguu

SEQ ID NO: 143042 - RNA, 23 nt, Human
uuuuuuuuuuuuuuuuuuugugg

SEQ ID NO: 143043 - RNA, 27 nt, Human
uuuuuuuuuuuuuuuuuuuuuuugggg

SEQ ID NO: 143044 - RNA, 22 nt, Human
aaaaaaacacacacacaaggcc

SEQ ID NO: 143045 - RNA, 24 nt, Human
aaaaaaacacacacacaaggccaa

SEQ ID NO: 143046 - RNA, 25 nt, Human
aaaaaaacacacacacaaggccaac

SEQ ID NO: 143047 - RNA, 20 nt, Human
aaaaaacacacacacaaggc

SEQ ID NO: 143048 - RNA, 22 nt, Human
aaacacacacacaaggccaaca

SEQ ID NO: 143049 - RNA, 22 nt, Human
aaaggagcuggggguggaagug

SEQ ID NO: 143050 - RNA, 18 nt, Human
accauccugggacagagc

SEQ ID NO: 143051 - RNA, 21 nt, Human
accuaaacacuucacugcccc

SEQ ID NO: 143052 - RNA, 22 nt, Human
aggaacauucacuggauuccuc

SEQ ID NO: 143053 - RNA, 21 nt, Human
aggcaccaggggguggaaaca

SEQ ID NO: 143054 - RNA, 20 nt, Human
auucacuggauuccucuucc

SEQ ID NO: 143055 - RNA, 21 nt, Human
auucacuggauuccucuucca

SEQ ID NO: 143056 - RNA, 24 nt, Human
auuuaauauggcaaaauucacaua

SEQ ID NO: 143057 - RNA, 21 nt, Human
caaaaucacucccacagcucc

SEQ ID NO: 143058 - RNA, 18 nt, Human
caaaugccaugcaugugu

SEQ ID NO: 143059 - RNA, 21 nt, Human
caacaacuuagaaucugagca

SEQ ID NO: 143060 - RNA, 19 nt, Human
cacuggauuccucuuccag

SEQ ID NO: 143061 - RNA, 22 nt, Human
cacuucacugccccuggcagca

SEQ ID NO: 143062 - RNA, 18 nt, Human
ccaggcagugacuccggc

SEQ ID NO: 143063 - RNA, 22 nt, Human
ccccuggcagcauccgcuggga

SEQ ID NO: 143064 - RNA, 18 nt, Human
cccguggucccugggugg

SEQ ID NO: 143065 - RNA, 19 nt, Human
cccugcgaugagugggcug

SEQ ID NO: 143066 - RNA, 19 nt, Human
ccuccuguucaggaacaaa

SEQ ID NO: 143067 - RNA, 23 nt, Human
cucaugcuccagccacaucccca

SEQ ID NO: 143068 - RNA, 19 nt, Human
cuggcagcauccgcuggga

SEQ ID NO: 143069 - RNA, 18 nt, Human
cuggcuccuuccuucugg

SEQ ID NO: 143070 - RNA, 21 nt, Human
cuuccuugaaacagaaacacu

SEQ ID NO: 143071 - RNA, 18 nt, Human
gagaacuuaaaaaaaaac

SEQ ID NO: 143072 - RNA, 20 nt, Human
gagaacuuaaaaaaaaacac

SEQ ID NO: 143073 - RNA, 22 nt, Human
gcagucucucauaauguuaaaa

SEQ ID NO: 143074 - RNA, 21 nt, Human
gcccugcgaugagugggcugg

SEQ ID NO: 143075 - RNA, 18 nt, Human
gggaaaggagcugggggu

SEQ ID NO: 143076 - RNA, 18 nt, Human
ggggguggaaguguggaa

SEQ ID NO: 143077 - RNA, 20 nt, Human
ggugaaaacccuuggagagg

SEQ ID NO: 143078 - RNA, 24 nt, Human
uaaaacgguagccauuugcauuua

SEQ ID NO: 143079 - RNA, 23 nt, Human
uaaggugaaaacccuuggagagg

SEQ ID NO: 143080 - RNA, 23 nt, Human
ucaccuaaacacuucacugcccc

SEQ ID NO: 143081 - RNA, 19 nt, Human
uccagccacauccccaggg

SEQ ID NO: 143082 - RNA, 22 nt, Human
ucccacagcucccauuguugcu

SEQ ID NO: 143083 - RNA, 23 nt, Human
ucccauuguugcuaaggugaaaa

SEQ ID NO: 143084 - RNA, 20 nt, Human
uccccagggaugcccuccug

SEQ ID NO: 143085 - RNA, 21 nt, Human
ucccuggguggccugcaggca

SEQ ID NO: 143086 - RNA, 19 nt, Human
ucuguggugccugaaggcg

SEQ ID NO: 143087 - RNA, 19 nt, Human
ugacuccggcugccaauca

SEQ ID NO: 143088 - RNA, 21 nt, Human
ugaggaagauuuaauauggca

SEQ ID NO: 143089 - RNA, 19 nt, Human
ugagugggcugggagcugg

SEQ ID NO: 143090 - RNA, 22 nt, Human
ugccaugcaugugugcuugggc

SEQ ID NO: 143091 - RNA, 18 nt, Human
ugcuaaggugaaaacccu

SEQ ID NO: 143092 - RNA, 23 nt, Human
ugcuuguucucgcgccgaccgcg

SEQ ID NO: 143093 - RNA, 19 nt, Human
uggcagcauccgcugggac

SEQ ID NO: 143094 - RNA, 20 nt, Human
uggcagcauccgcugggacu

SEQ ID NO: 143095 - RNA, 22 nt, Human
uggccugcaggcaccagggggu

SEQ ID NO: 143096 - RNA, 18 nt, Human
ugggacagagcuggcuca

SEQ ID NO: 143097 - RNA, 26 nt, Human
ugggacagagcuggcucaugcuccag

SEQ ID NO: 143098 - RNA, 18 nt, Human
uggugccugaaggcgucc

SEQ ID NO: 143099 - RNA, 22 nt, Human
ugguucuaacaaauguugacag

SEQ ID NO: 143100 - RNA, 21 nt, Human
uguaaaaaaucaugagcccug

SEQ ID NO: 143101 - RNA, 20 nt, Human
uguggaaggacugaguguug

SEQ ID NO: 143102 - RNA, 20 nt, Human
uucacuggauuccucuucca

SEQ ID NO: 143103 - RNA, 18 nt, Human
uuguaaaaaaucaugagc

SEQ ID NO: 143104 - RNA, 18 nt, Human
aaccccacaccccuccuc

SEQ ID NO: 143105 - RNA, 24 nt, Human
aacuggcccccuggagagggccca

SEQ ID NO: 143106 - RNA, 21 nt, Human
acacacacaugcucacacaca

SEQ ID NO: 143107 - RNA, 19 nt, Human
acacugcaggagggaccac

SEQ ID NO: 143108 - RNA, 26 nt, Human
acauggacucaugcacacacaugugg

SEQ ID NO: 143109 - RNA, 24 nt, Human
accccacaccccuccuccccuuug

SEQ ID NO: 143110 - RNA, 22 nt, Human
accccagagcuagaagcuucug

SEQ ID NO: 143111 - RNA, 22 nt, Human
agaaaaaaccuuuaagacagaa

SEQ ID NO: 143112 - RNA, 21 nt, Human
agagcccccccacgcgcacac

SEQ ID NO: 143113 - RNA, 19 nt, Human
aggagggaccacagggucu

SEQ ID NO: 143114 - RNA, 20 nt, Human
agggaccacagggucugggc

SEQ ID NO: 143115 - RNA, 25 nt, Human
aggucccccacucaccucucccauc

SEQ ID NO: 143116 - RNA, 19 nt, Human
aguauggggcagaagaaca

SEQ ID NO: 143117 - RNA, 18 nt, Human
auauccauccuggggggc

SEQ ID NO: 143118 - RNA, 23 nt, Human
augcacacacacaugcucacaca

SEQ ID NO: 143119 - RNA, 24 nt, Human
cacacacaugcucacacacauuca

SEQ ID NO: 143120 - RNA, 23 nt, Human
cacacauguggacacacuggggc

SEQ ID NO: 143121 - RNA, 23 nt, Human
cacacauucacccccgguacaca

SEQ ID NO: 143122 - RNA, 18 nt, Human
cacauacacaccacacag

SEQ ID NO: 143123 - RNA, 24 nt, Human
cacaugcucacacacauucacccc

SEQ ID NO: 143124 - RNA, 25 nt, Human
caccaaagaggccucgauaaauaaa

SEQ ID NO: 143125 - RNA, 18 nt, Human
caccccuccuccccuuug

SEQ ID NO: 143126 - RNA, 21 nt, Human
caccccuccugcccacaucag

SEQ ID NO: 143127 - RNA, 22 nt, Human
caccucucccaucucauaucca

SEQ ID NO: 143128 - RNA, 24 nt, Human
cacgcgcacacauggacucaugca

SEQ ID NO: 143129 - RNA, 23 nt, Human
cagaagaacagcucagggacccc

SEQ ID NO: 143130 - RNA, 24 nt, Human
cagaagaacagcucagggaccccu

SEQ ID NO: 143131 - RNA, 19 nt, Human
cagaccccagagcuagaag

SEQ ID NO: 143132 - RNA, 21 nt, Human
cagauucugggagcaggcacu

SEQ ID NO: 143133 - RNA, 24 nt, Human
caggcggcggcggcggcgcgggcc

SEQ ID NO: 143134 - RNA, 25 nt, Human
caggcggcggcggcggcgcgggccc

SEQ ID NO: 143135 - RNA, 24 nt, Human
caggcucaccaaagaggccucgau

SEQ ID NO: 143136 - RNA, 18 nt, Human
cagucagucugucucccu

SEQ ID NO: 143137 - RNA, 22 nt, Human
cagucugucucccucccucacu

SEQ ID NO: 143138 - RNA, 21 nt, Human
cauccuggggggcagcugggg

SEQ ID NO: 143139 - RNA, 22 nt, Human
caucucauauccauccuggggg

SEQ ID NO: 143140 - RNA, 19 nt, Human
ccaaagccuccccaccugg

SEQ ID NO: 143141 - RNA, 19 nt, Human
ccagagcaaaagggccgaa

SEQ ID NO: 143142 - RNA, 25 nt, Human
ccagccaaagccuccccaccuggcc

SEQ ID NO: 143143 - RNA, 25 nt, Human
ccagccagccaaagccuccccaccu

SEQ ID NO: 143144 - RNA, 19 nt, Human
cccacaccccuccuccccu

SEQ ID NO: 143145 - RNA, 23 nt, Human
ccccacucaccucucccaucuca

SEQ ID NO: 143146 - RNA, 24 nt, Human
ccccaggcucaccaaagaggccuc

SEQ ID NO: 143147 - RNA, 21 nt, Human
cccccggccgccgcugccugc

SEQ ID NO: 143148 - RNA, 24 nt, Human
ccccuccuccccuuugcugauucc

SEQ ID NO: 143149 - RNA, 23 nt, Human
cccuccuccccuuugcugauucc

SEQ ID NO: 143150 - RNA, 20 nt, Human
cccugggccuugugggaccc

SEQ ID NO: 143151 - RNA, 26 nt, Human
ccgcuccgcccccggccgccgcugcc

SEQ ID NO: 143152 - RNA, 21 nt, Human
ccugcccacaucagugaaggu

SEQ ID NO: 143153 - RNA, 20 nt, Human
ccugcccuugcucaagggua

SEQ ID NO: 143154 - RNA, 18 nt, Human
ccuggucccuccaagccc

SEQ ID NO: 143155 - RNA, 18 nt, Human
ccuucaguauggggcaga

SEQ ID NO: 143156 - RNA, 27 nt, Human
cgcgcacacauggacucaugcacacag

SEQ ID NO: 143157 - RNA, 22 nt, Human
cggcccgggugacaggcggcgg

SEQ ID NO: 143158 - RNA, 20 nt, Human
cgguacaugcacacacacag

SEQ ID NO: 143159 - RNA, 26 nt, Human
cgguacaugcacacacacaugcucac

SEQ ID NO: 143160 - RNA, 20 nt, Human
cucaccguccuacacgccca

SEQ ID NO: 143161 - RNA, 20 nt, Human
cucccucccucacuuuccca

SEQ ID NO: 143162 - RNA, 20 nt, Human
cugcagugcacacacagagg

SEQ ID NO: 143163 - RNA, 19 nt, Human
cuugugggacccccagagc

SEQ ID NO: 143164 - RNA, 19 nt, Human
gaccacagggucugggcug

SEQ ID NO: 143165 - RNA, 20 nt, Human
gauuccccaggcucaccaaa

SEQ ID NO: 143166 - RNA, 29 nt, Human
gcacacauggacucaugcacacacauggu

SEQ ID NO: 143167 - RNA, 23 nt, Human
gcccaccccaccaucugaccacc

SEQ ID NO: 143168 - RNA, 24 nt, Human
gcccugggccuugugggaccccca

SEQ ID NO: 143169 - RNA, 21 nt, Human
gcggcggcgcgggcccauggc

SEQ ID NO: 143170 - RNA, 21 nt, Human
gcggcggcggcggcgcgggcc

SEQ ID NO: 143171 - RNA, 24 nt, Human
ggacagggggcuccagggcugcaa

SEQ ID NO: 143172 - RNA, 18 nt, Human
ggagacagaggagagggg

SEQ ID NO: 143173 - RNA, 21 nt, Human
ggaggcaggcgcuucagacac

SEQ ID NO: 143174 - RNA, 22 nt, Human
ggccucgauaaauaaauaacgc

SEQ ID NO: 143175 - RNA, 24 nt, Human
ggcggcggcgcgggcccauggcgg

SEQ ID NO: 143176 - RNA, 22 nt, Human
gggacccccagagcaaaagggc

SEQ ID NO: 143177 - RNA, 18 nt, Human
gggcugggggaggccuuc

SEQ ID NO: 143178 - RNA, 18 nt, Human
ggggcagagcagugggga

SEQ ID NO: 143179 - RNA, 22 nt, Human
gggugacaggcggcggcggcgg

SEQ ID NO: 143180 - RNA, 18 nt, Human
gguagccagaccccagag

SEQ ID NO: 143181 - RNA, 21 nt, Human
ggucagagcaccagauucugg

SEQ ID NO: 143182 - RNA, 20 nt, Human
gguggggcagagcagugggg

SEQ ID NO: 143183 - RNA, 24 nt, Human
guacaugcacacacacaugcucac

SEQ ID NO: 143184 - RNA, 21 nt, Human
gugacaggcggcggcggcggc

SEQ ID NO: 143185 - RNA, 21 nt, Human
gugcacacacagagguguaug

SEQ ID NO: 143186 - RNA, 18 nt, Human
uaaauaaaucacccaggc

SEQ ID NO: 143187 - RNA, 19 nt, Human
uaaauaaaucacccaggcc

SEQ ID NO: 143188 - RNA, 22 nt, Human
uaaaucacccaggccucaguuc

SEQ ID NO: 143189 - RNA, 20 nt, Human
uacacaccacacagacuccu

SEQ ID NO: 143190 - RNA, 25 nt, Human
uagccagaccccagagcuagaagcu

SEQ ID NO: 143191 - RNA, 21 nt, Human
ucagaaaaaaccuuuaagaca

SEQ ID NO: 143192 - RNA, 19 nt, Human
ucucuggaaacccuggucc

SEQ ID NO: 143193 - RNA, 20 nt, Human
ucucuggaaacccugguccc

SEQ ID NO: 143194 - RNA, 19 nt, Human
ugcacacacagagguguau

SEQ ID NO: 143195 - RNA, 28 nt, Human
ugcagagacaaggugagcaucucuggaa

SEQ ID NO: 143196 - RNA, 21 nt, Human
ugcaugcacauacacaccaca

SEQ ID NO: 143197 - RNA, 25 nt, Human
ugcucagccuccuagcgguagccag

SEQ ID NO: 143198 - RNA, 20 nt, Human
uggagagggcccaccccacc

SEQ ID NO: 143199 - RNA, 23 nt, Human
ugggagcaggcacugcccugggc

SEQ ID NO: 143200 - RNA, 25 nt, Human
ugggagcaggcacugcccugggccc

SEQ ID NO: 143201 - RNA, 18 nt, Human
uggggaggcaggcgcuuc

SEQ ID NO: 143202 - RNA, 22 nt, Human
uggguguaggcugcaugcacau

SEQ ID NO: 143203 - RNA, 23 nt, Human
uguaggcugcaugcacauacaca

SEQ ID NO: 143204 - RNA, 24 nt, Human
uguggguguaggcugcaugcacau

SEQ ID NO: 143205 - RNA, 20 nt, Human
uuccccaggcucaccaaaga

SEQ ID NO: 143206 - RNA, 19 nt, Human
acugcaccgacuuccuugc

SEQ ID NO: 143207 - RNA, 19 nt, Human
agagagcagcgcuuagaga

SEQ ID NO: 143208 - RNA, 23 nt, Human
caccgcgacccgggacgccccgc

SEQ ID NO: 143209 - RNA, 21 nt, Human
caccugggguccggccggcuc

SEQ ID NO: 143210 - RNA, 25 nt, Human
cccgggacgccccgcgcuccccaag

SEQ ID NO: 143211 - RNA, 18 nt, Human
cccuccuggcccgcggcc

SEQ ID NO: 143212 - RNA, 18 nt, Human
ccgcggcauggcgcggag

SEQ ID NO: 143213 - RNA, 24 nt, Human
ccggcggcugcggugguggcacuu

SEQ ID NO: 143214 - RNA, 18 nt, Human
cgagcagagagcagcgcu

SEQ ID NO: 143215 - RNA, 23 nt, Human
cgagggcaccgcgacccgggacg

SEQ ID NO: 143216 - RNA, 19 nt, Human
cugccgccuuucacacggc

SEQ ID NO: 143217 - RNA, 18 nt, Human
cuggggagggguccccgg

SEQ ID NO: 143218 - RNA, 24 nt, Human
cugucucgucccgagggcaccgcg

SEQ ID NO: 143219 - RNA, 24 nt, Human
gacccgggacgccccgcgcucccc

SEQ ID NO: 143220 - RNA, 20 nt, Human
gcauggcgcggaggccgggg

SEQ ID NO: 143221 - RNA, 18 nt, Human
gccggcucuggggagggg

SEQ ID NO: 143222 - RNA, 22 nt, Human
ggcaccugggguccggccggcu

SEQ ID NO: 143223 - RNA, 18 nt, Human
ggcauggcgcggaggccg

SEQ ID NO: 143224 - RNA, 20 nt, Human
ggccgagcagagagcagcgc

SEQ ID NO: 143225 - RNA, 18 nt, Human
gggaggggggucucgacu

SEQ ID NO: 143226 - RNA, 21 nt, Human
gggauggggaggggggucucg

SEQ ID NO: 143227 - RNA, 26 nt, Human
ggguccggccggcucuggggaggggu

SEQ ID NO: 143228 - RNA, 18 nt, Human
gucccgagggcaccgcga

SEQ ID NO: 143229 - RNA, 21 nt, Human
uaaggcgcccccuacccaaaa

SEQ ID NO: 143230 - RNA, 22 nt, Human
uaaggcgcccccuacccaaaag

SEQ ID NO: 143231 - RNA, 22 nt, Human
ugcggugguggcacugccaggg

SEQ ID NO: 143232 - RNA, 24 nt, Human
ugcggugguggcacugccaggggc

SEQ ID NO: 143233 - RNA, 26 nt, Human
ugcggugguggcacugccaggggcug

SEQ ID NO: 143234 - RNA, 20 nt, Human
ugggguccggccggcucugg

SEQ ID NO: 143235 - RNA, 23 nt, Human
aaaacaagagccacaacaaagaa

SEQ ID NO: 143236 - RNA, 18 nt, Human
aaaagaaauucccacacc

SEQ ID NO: 143237 - RNA, 21 nt, Human
aaacaagagccacaacaaaga

SEQ ID NO: 143238 - RNA, 23 nt, Human
aaacauacacccacgcauaccca

SEQ ID NO: 143239 - RNA, 27 nt, Human
aaaccccacagugcauuuccaguaggc

SEQ ID NO: 143240 - RNA, 19 nt, Human
aaacugaauuaugacagua

SEQ ID NO: 143241 - RNA, 18 nt, Human
aaagaaauucccacaccc

SEQ ID NO: 143242 - RNA, 25 nt, Human
aaagacaugcauucugcggagaagg

SEQ ID NO: 143243 - RNA, 25 nt, Human
aaagcucccucucccucccccaccc

SEQ ID NO: 143244 - RNA, 25 nt, Human
aaagugcuggugucaucugucuuga

SEQ ID NO: 143245 - RNA, 18 nt, Human
aacuggaaacucacaaac

SEQ ID NO: 143246 - RNA, 20 nt, Human
aagagccacaacaaagaaca

SEQ ID NO: 143247 - RNA, 21 nt, Human
aagagccacaacaaagaacag

SEQ ID NO: 143248 - RNA, 24 nt, Human
aagcuaaacugauuaguaguuugc

SEQ ID NO: 143249 - RNA, 19 nt, Human
aaggauggagggacccaug

SEQ ID NO: 143250 - RNA, 20 nt, Human
aaguaggcauuugcuacaaa

SEQ ID NO: 143251 - RNA, 21 nt, Human
aaguggucucccugagugcgg

SEQ ID NO: 143252 - RNA, 18 nt, Human
acaaagcuggaagcagag

SEQ ID NO: 143253 - RNA, 20 nt, Human
acaaagcuggaagcagaggc

SEQ ID NO: 143254 - RNA, 28 nt, Human
acaacaaagaacagaaaaacaaaaacaa

SEQ ID NO: 143255 - RNA, 22 nt, Human
acaagagccacaacaaagaaca

SEQ ID NO: 143256 - RNA, 19 nt, Human
acacaaagcuggaagcaga

SEQ ID NO: 143257 - RNA, 21 nt, Human
acagcucauguguugcccuuu

SEQ ID NO: 143258 - RNA, 24 nt, Human
accacuuugcauauuguggaaauc

SEQ ID NO: 143259 - RNA, 19 nt, Human
acccacgcauacccacaca

SEQ ID NO: 143260 - RNA, 21 nt, Human
acccaugucagcaagccccag

SEQ ID NO: 143261 - RNA, 20 nt, Human
accccaaugcuucaucuagg

SEQ ID NO: 143262 - RNA, 19 nt, Human
accccacagugcauuucca

SEQ ID NO: 143263 - RNA, 18 nt, Human
acuaacccacuuugugug

SEQ ID NO: 143264 - RNA, 23 nt, Human
acucacacaauggggaugucuuu

SEQ ID NO: 143265 - RNA, 19 nt, Human
acugacucgcuccaagcuc

SEQ ID NO: 143266 - RNA, 18 nt, Human
acugggacacacaguuca

SEQ ID NO: 143267 - RNA, 21 nt, Human
agaaauccauuucauacuuuu

SEQ ID NO: 143268 - RNA, 23 nt, Human
agaaggcuguggagguuuucuug

SEQ ID NO: 143269 - RNA, 19 nt, Human
agaggaaggggaacggggu

SEQ ID NO: 143270 - RNA, 20 nt, Human
agaguuuaaagugcuggugu

SEQ ID NO: 143271 - RNA, 22 nt, Human
agcccauccgucaggcacagca

SEQ ID NO: 143272 - RNA, 18 nt, Human
agcugaagaaauccauuu

SEQ ID NO: 143273 - RNA, 18 nt, Human
agggagccugcaacugug

SEQ ID NO: 143274 - RNA, 23 nt, Human
agguaggaagggacaacacugca

SEQ ID NO: 143275 - RNA, 19 nt, Human
augaauuugcaaaaaccgc

SEQ ID NO: 143276 - RNA, 19 nt, Human
caaagcucccucucccucc

SEQ ID NO: 143277 - RNA, 25 nt, Human
caaugggccacccaugucagcaagc

SEQ ID NO: 143278 - RNA, 19 nt, Human
cacaaagcuggaagcagag

SEQ ID NO: 143279 - RNA, 23 nt, Human
cacaaagcuggaagcagaggcag

SEQ ID NO: 143280 - RNA, 25 nt, Human
cacaacaaagaacagaaaaacaaaa

SEQ ID NO: 143281 - RNA, 19 nt, Human
cacacagguuuagaugcuc

SEQ ID NO: 143282 - RNA, 21 nt, Human
cacagcaagccaauccgggga

SEQ ID NO: 143283 - RNA, 22 nt, Human
cacguacaacaaaaaugaaaac

SEQ ID NO: 143284 - RNA, 23 nt, Human
cacugcaugacagauguucuggu

SEQ ID NO: 143285 - RNA, 22 nt, Human
cagcaagccaauccggggagga

SEQ ID NO: 143286 - RNA, 19 nt, Human
cagggauggaggcugaaga

SEQ ID NO: 143287 - RNA, 23 nt, Human
caggggcccgggaagcccaagga

SEQ ID NO: 143288 - RNA, 23 nt, Human
caugccugcugcuccuuggggcu

SEQ ID NO: 143289 - RNA, 24 nt, Human
cauuucauacuuuugcaugacuuc

SEQ ID NO: 143290 - RNA, 21 nt, Human
ccacaaagaacuaaguaggca

SEQ ID NO: 143291 - RNA, 20 nt, Human
ccacacccugacaauugcca

SEQ ID NO: 143292 - RNA, 23 nt, Human
ccacaccgacauuuuguaccaag

SEQ ID NO: 143293 - RNA, 23 nt, Human
ccagcccccgacacagggcugcu

SEQ ID NO: 143294 - RNA, 18 nt, Human
cccaaggauggagggacc

SEQ ID NO: 143295 - RNA, 21 nt, Human
cccacacaaagaguuuaaagu

SEQ ID NO: 143296 - RNA, 22 nt, Human
cccacacccugacaauugccac

SEQ ID NO: 143297 - RNA, 18 nt, Human
cccagcaggccagguggc

SEQ ID NO: 143298 - RNA, 21 nt, Human
cccaugucagcaagccccagg

SEQ ID NO: 143299 - RNA, 19 nt, Human
ccccacagugcauuuccag

SEQ ID NO: 143300 - RNA, 22 nt, Human
ccccaggacugacucgcuccaa

SEQ ID NO: 143301 - RNA, 26 nt, Human
cccguaggaaaagaaauucccacacc

SEQ ID NO: 143302 - RNA, 25 nt, Human
cccugagugcgguguaagagagccc

SEQ ID NO: 143303 - RNA, 26 nt, Human
ccgacauuuuguaccaaguccagugu

SEQ ID NO: 143304 - RNA, 19 nt, Human
ccgcugccaccugcccgag

SEQ ID NO: 143305 - RNA, 19 nt, Human
ccuccaacuugggacacca

SEQ ID NO: 143306 - RNA, 21 nt, Human
ccugaagaguaaagcgggaga

SEQ ID NO: 143307 - RNA, 22 nt, Human
cgcauacccacacaaagaguuu

SEQ ID NO: 143308 - RNA, 26 nt, Human
cguacaacaaaaaugaaaacaagagc

SEQ ID NO: 143309 - RNA, 20 nt, Human
cuaacacuguuugacagcuc

SEQ ID NO: 143310 - RNA, 19 nt, Human
cuaccuggaguaaacuggc

SEQ ID NO: 143311 - RNA, 24 nt, Human
cuagaggucucuccaucugacccc

SEQ ID NO: 143312 - RNA, 19 nt, Human
cucccuagaggucucucca

SEQ ID NO: 143313 - RNA, 21 nt, Human
cucccucccccaccccaaugc

SEQ ID NO: 143314 - RNA, 22 nt, Human
cuccuaacacuguuugacagcu

SEQ ID NO: 143315 - RNA, 20 nt, Human
cucucccucccccaccccaa

SEQ ID NO: 143316 - RNA, 18 nt, Human
cugacucgcuccaagcuc

SEQ ID NO: 143317 - RNA, 20 nt, Human
gacaauugccacccgacuua

SEQ ID NO: 143318 - RNA, 18 nt, Human
gacauuuuguaccaaguc

SEQ ID NO: 143319 - RNA, 23 nt, Human
gaccugguucuccuuuccaaugg

SEQ ID NO: 143320 - RNA, 21 nt, Human
gacucgcuccaagcucccccu

SEQ ID NO: 143321 - RNA, 20 nt, Human
gagaaguggucucccugaga

SEQ ID NO: 143322 - RNA, 21 nt, Human
gagcccuuuccccugucacag

SEQ ID NO: 143323 - RNA, 18 nt, Human
gaggaagaagguaggaag

SEQ ID NO: 143324 - RNA, 19 nt, Human
gagugguucauggagacag

SEQ ID NO: 143325 - RNA, 20 nt, Human
gagugguucauggagacagg

SEQ ID NO: 143326 - RNA, 21 nt, Human
gauggaggcugaagaagaaaa

SEQ ID NO: 143327 - RNA, 20 nt, Human
gccacaggaaugcuuaaaug

SEQ ID NO: 143328 - RNA, 19 nt, Human
gccccaggacugacucgcu

SEQ ID NO: 143329 - RNA, 23 nt, Human
gcuggggcucuugugguuuuuug

SEQ ID NO: 143330 - RNA, 22 nt, Human
ggaaaauccacaacagcuuaga

SEQ ID NO: 143331 - RNA, 21 nt, Human
ggaaugggagugguucaugga

SEQ ID NO: 143332 - RNA, 18 nt, Human
ggacgggggaaugggagu

SEQ ID NO: 143333 - RNA, 18 nt, Human
ggagauggccgcugccac

SEQ ID NO: 143334 - RNA, 20 nt, Human
ggaugucuuucucccuagag

SEQ ID NO: 143335 - RNA, 18 nt, Human
ggcuggggcucuuguggu

SEQ ID NO: 143336 - RNA, 18 nt, Human
gggaauggaagcacgaug

SEQ ID NO: 143337 - RNA, 18 nt, Human
gggccacccaugucagca

SEQ ID NO: 143338 - RNA, 24 nt, Human
guacaacaaaaaugaaaacaagag

SEQ ID NO: 143339 - RNA, 20 nt, Human
gugcuggugucaucugucuu

SEQ ID NO: 143340 - RNA, 21 nt, Human
uaacacaaagcucccucuccc

SEQ ID NO: 143341 - RNA, 21 nt, Human
uacaacacaaagcuaaacuga

SEQ ID NO: 143342 - RNA, 23 nt, Human
uacacacgaguugucaugcacac

SEQ ID NO: 143343 - RNA, 22 nt, Human
uaccuggaguaaacuggcuggg

SEQ ID NO: 143344 - RNA, 23 nt, Human
uacucugcaagccaucuuccuuc

SEQ ID NO: 143345 - RNA, 23 nt, Human
uagaacaauccacaaagaacuaa

SEQ ID NO: 143346 - RNA, 22 nt, Human
uaggcacuuaacacaaagcucc

SEQ ID NO: 143347 - RNA, 23 nt, Human
ucauuuuauugauccuuuaccau

SEQ ID NO: 143348 - RNA, 22 nt, Human
uccaagcucccccuccugggaa

SEQ ID NO: 143349 - RNA, 22 nt, Human
uccacaacagcuuagaguggca

SEQ ID NO: 143350 - RNA, 19 nt, Human
ucccauacaggaaaaaacc

SEQ ID NO: 143351 - RNA, 22 nt, Human
ucccuugguccaacuuauuccu

SEQ ID NO: 143352 - RNA, 19 nt, Human
uccgucaggcacagcaagc

SEQ ID NO: 143353 - RNA, 19 nt, Human
ucugcaagccaucuuccuu

SEQ ID NO: 143354 - RNA, 19 nt, Human
ucuucccaaacauacaccc

SEQ ID NO: 143355 - RNA, 21 nt, Human
ugaccuccuacugggacacac

SEQ ID NO: 143356 - RNA, 22 nt, Human
ugacucgcuccaagcucccccu

SEQ ID NO: 143357 - RNA, 22 nt, Human
ugagaaguggucucccugagug

SEQ ID NO: 143358 - RNA, 24 nt, Human
ugagcucagucuuuagacuuugga

SEQ ID NO: 143359 - RNA, 19 nt, Human
ugagugccuacuaugugcc

SEQ ID NO: 143360 - RNA, 18 nt, Human
ugagugcgguguaagaga

SEQ ID NO: 143361 - RNA, 23 nt, Human
ugcaacaaguauauuugaaaaca

SEQ ID NO: 143362 - RNA, 23 nt, Human
ugcacauuuucucacuugcugac

SEQ ID NO: 143363 - RNA, 22 nt, Human
uggaaacucacaaacacauugg

SEQ ID NO: 143364 - RNA, 23 nt, Human
uggccagaccccauucuacagcc

SEQ ID NO: 143365 - RNA, 19 nt, Human
uggcuggggcucuuguggu

SEQ ID NO: 143366 - RNA, 19 nt, Human
ugggacaccauuccugaag

SEQ ID NO: 143367 - RNA, 19 nt, Human
ugguauauuaauguauugu

SEQ ID NO: 143368 - RNA, 23 nt, Human
uguauuguuuucaauuucuuuau

SEQ ID NO: 143369 - RNA, 19 nt, Human
ugucagcaagccccaggac

SEQ ID NO: 143370 - RNA, 21 nt, Human
ugugaggggaggaggccaggg

SEQ ID NO: 143371 - RNA, 22 nt, Human
ugugugaggggaggaggccagg

SEQ ID NO: 143372 - RNA, 21 nt, Human
ugugugugaggggaggaggcc

SEQ ID NO: 143373 - RNA, 26 nt, Human
uuaaaaaaaaucauuuuauugauccu

SEQ ID NO: 143374 - RNA, 22 nt, Human
uucuacagcccauccgucaggc

SEQ ID NO: 143375 - RNA, 23 nt, Human
uucucauacacacgaguugucau

SEQ ID NO: 143376 - RNA, 19 nt, Human
uucuuuaucugacucccuc

SEQ ID NO: 143377 - RNA, 19 nt, Human
uuuuuuuuuuuccuaaggg

SEQ ID NO: 143378 - RNA, 18 nt, Human
ccaggccaggcgcgccgc

SEQ ID NO: 143379 - RNA, 19 nt, Human
cccgcccgccgccuccccu

SEQ ID NO: 143380 - RNA, 20 nt, Human
cccgcccgccgccuccccuc

SEQ ID NO: 143381 - RNA, 21 nt, Human
ccgccuccccucagccaggcc

SEQ ID NO: 143382 - RNA, 19 nt, Human
ccucagccaggccaggcca

SEQ ID NO: 143383 - RNA, 26 nt, Human
gcgcccgcccgccgccuccccucagc

SEQ ID NO: 143384 - RNA, 24 nt, Human
aaacagaaggagugugaaauccgg

SEQ ID NO: 143385 - RNA, 19 nt, Human
aacaaaacagaaggagugu

SEQ ID NO: 143386 - RNA, 19 nt, Human
agaaggagugugaaauccg

SEQ ID NO: 143387 - RNA, 23 nt, Human
agcugggggcugcauccucugug

SEQ ID NO: 143388 - RNA, 22 nt, Human
cacccccguugccggcugggga

SEQ ID NO: 143389 - RNA, 21 nt, Human
caccuuccaugcagcuggggg

SEQ ID NO: 143390 - RNA, 19 nt, Human
cagacuuucggggaagccc

SEQ ID NO: 143391 - RNA, 21 nt, Human
ccaccuggaccuggucccaga

SEQ ID NO: 143392 - RNA, 21 nt, Human
ccggggauccacagggcuucu

SEQ ID NO: 143393 - RNA, 20 nt, Human
ccuuccaugcagcugggggc

SEQ ID NO: 143394 - RNA, 18 nt, Human
ggaaggaaaggcaugagg

SEQ ID NO: 143395 - RNA, 20 nt, Human
gggaagcccucagccugggg

SEQ ID NO: 143396 - RNA, 18 nt, Human
gggcuucuguccuccacc

SEQ ID NO: 143397 - RNA, 18 nt, Human
gugaaauccggggaucca

SEQ ID NO: 143398 - RNA, 19 nt, Human
uaaacggcaacaaaacaga

SEQ ID NO: 143399 - RNA, 23 nt, Human
ucauccucuguggggucuguggg

SEQ ID NO: 143400 - RNA, 23 nt, Human
uccuccaccuuccaugcagcugg

SEQ ID NO: 143401 - RNA, 21 nt, Human
uccucugugggguggcuucau

SEQ ID NO: 143402 - RNA, 19 nt, Human
ugggguggcuucauccucu

SEQ ID NO: 143403 - RNA, 25 nt, Human
agaguccucugcccugucccugccc

SEQ ID NO: 143404 - RNA, 18 nt, Human
aggcaggcaugggugggg

SEQ ID NO: 143405 - RNA, 23 nt, Human
auccugugccaucuucucuacca

SEQ ID NO: 143406 - RNA, 20 nt, Human
caacaagaaacucuuaugua

SEQ ID NO: 143407 - RNA, 20 nt, Human
ccauccugugccaucuucuc

SEQ ID NO: 143408 - RNA, 18 nt, Human
cccggccaggaccccgca

SEQ ID NO: 143409 - RNA, 23 nt, Human
cuuggggcgccuccauccugugc

SEQ ID NO: 143410 - RNA, 22 nt, Human
guaaagcaacaagaaacucuua

SEQ ID NO: 143411 - RNA, 19 nt, Human
uccucugcccugucccugc

SEQ ID NO: 143412 - RNA, 23 nt, Human
uuuuuuuuuuuugcagguucuca

SEQ ID NO: 143413 - RNA, 20 nt, Human
aaaaguccagaaugggucag

SEQ ID NO: 143414 - RNA, 26 nt, Human
aagacaggaaauggaaggacacaggg

SEQ ID NO: 143415 - RNA, 22 nt, Human
aagaggaaaugacgagccaaag

SEQ ID NO: 143416 - RNA, 21 nt, Human
aaguauaaaguuaagaccuac

SEQ ID NO: 143417 - RNA, 20 nt, Human
acaggggccuagguauguuu

SEQ ID NO: 143418 - RNA, 25 nt, Human
acaugcaaauacaugugguuucuuc

SEQ ID NO: 143419 - RNA, 20 nt, Human
agccugaagcccuucauccu

SEQ ID NO: 143420 - RNA, 20 nt, Human
agcuguaucuuguaaucagc

SEQ ID NO: 143421 - RNA, 19 nt, Human
aguuagagggcucaaugga

SEQ ID NO: 143422 - RNA, 26 nt, Human
caaugaaguucuuagagcugaagccc

SEQ ID NO: 143423 - RNA, 25 nt, Human
cacugcccccagccugaagcccuuc

SEQ ID NO: 143424 - RNA, 21 nt, Human
cagaaccagaauccagguauc

SEQ ID NO: 143425 - RNA, 21 nt, Human
cagugaagaauuugccagaga

SEQ ID NO: 143426 - RNA, 24 nt, Human
cauccuuccucuuagcacccucuc

SEQ ID NO: 143427 - RNA, 27 nt, Human
ccacugcccccagccugaagcccuuca

SEQ ID NO: 143428 - RNA, 21 nt, Human
cccucucaggggaacaggggc

SEQ ID NO: 143429 - RNA, 19 nt, Human
ccucuaugcacacguucag

SEQ ID NO: 143430 - RNA, 18 nt, Human
cgggaaagacaggaaaug

SEQ ID NO: 143431 - RNA, 23 nt, Human
cuagagcucagcaucugagcugc

SEQ ID NO: 143432 - RNA, 28 nt, Human
gagcaggaggcagagugggaggucgacc

SEQ ID NO: 143433 - RNA, 23 nt, Human
gagugggcagggguagguagggg

SEQ ID NO: 143434 - RNA, 20 nt, Human
gggcagggguagguaggggc

SEQ ID NO: 143435 - RNA, 18 nt, Human
ggggcuguccucuaggga

SEQ ID NO: 143436 - RNA, 23 nt, Human
gugcugcccugggggagcaggag

SEQ ID NO: 143437 - RNA, 25 nt, Human
uaggggcugucugauccccagggca

SEQ ID NO: 143438 - RNA, 21 nt, Human
uagguauguuuacaaaagucc

SEQ ID NO: 143439 - RNA, 22 nt, Human
uccacugcccccagccugaagc

SEQ ID NO: 143440 - RNA, 19 nt, Human
uccagaaugggucaguauu

SEQ ID NO: 143441 - RNA, 20 nt, Human
ucuccagaggagugggcagg

SEQ ID NO: 143442 - RNA, 19 nt, Human
ugaagcccuucauccuucc

SEQ ID NO: 143443 - RNA, 20 nt, Human
ugacaaguucucuaagacag

SEQ ID NO: 143444 - RNA, 18 nt, Human
ugcccugggggagcagga

SEQ ID NO: 143445 - RNA, 19 nt, Human
ugggggagcaggaggcaga

SEQ ID NO: 143446 - RNA, 20 nt, Human
ugggggagcaggaggcagag

SEQ ID NO: 143447 - RNA, 21 nt, Human
ugugugcauugcucagcugua

SEQ ID NO: 143448 - RNA, 24 nt, Human
uuccagacucagugaagaauuugc

SEQ ID NO: 143449 - RNA, 19 nt, Human
uuuacaaaaguccagaaug

SEQ ID NO: 143450 - RNA, 22 nt, Human
uuuacaaaaguccagaaugggu

SEQ ID NO: 143451 - RNA, 25 nt, Human
aaguugcuggagcuggauaccaggu

SEQ ID NO: 143452 - RNA, 18 nt, Human
aaucacuaagaguucaag

SEQ ID NO: 143453 - RNA, 21 nt, Human
acgcucuaaguugcuggagcu

SEQ ID NO: 143454 - RNA, 18 nt, Human
acuuugggagaaucgugg

SEQ ID NO: 143455 - RNA, 23 nt, Human
agaaaaacaggagcguuuucagg

SEQ ID NO: 143456 - RNA, 23 nt, Human
agcuggauaccaggugaacuggg

SEQ ID NO: 143457 - RNA, 23 nt, Human
aguugcuggagcuggauaccagg

SEQ ID NO: 143458 - RNA, 23 nt, Human
aucggccuggagagguacaaggc

SEQ ID NO: 143459 - RNA, 18 nt, Human
cacagcccagucucccac

SEQ ID NO: 143460 - RNA, 26 nt, Human
caccccagaggucacccugacccgga

SEQ ID NO: 143461 - RNA, 21 nt, Human
cacgccugggucccgcuccca

SEQ ID NO: 143462 - RNA, 20 nt, Human
cacugcacagaugagaaaaa

SEQ ID NO: 143463 - RNA, 19 nt, Human
cauggcgaaugcugcacgc

SEQ ID NO: 143464 - RNA, 21 nt, Human
ccagaggucacccugacccgg

SEQ ID NO: 143465 - RNA, 19 nt, Human
ccccagaggucacccugac

SEQ ID NO: 143466 - RNA, 24 nt, Human
ccucaccccagaggucacccugac

SEQ ID NO: 143467 - RNA, 23 nt, Human
cgguaccccacagcccagucucc

SEQ ID NO: 143468 - RNA, 18 nt, Human
cgugagcggagcauggcg

SEQ ID NO: 143469 - RNA, 18 nt, Human
gccuggagagguacaagg

SEQ ID NO: 143470 - RNA, 22 nt, Human
uaaauuguggaaaaaucggccu

SEQ ID NO: 143471 - RNA, 22 nt, Human
uaccccacagcccagucuccca

SEQ ID NO: 143472 - RNA, 19 nt, Human
ucccacgcgugagcggagc

SEQ ID NO: 143473 - RNA, 22 nt, Human
ucccagucgcaguuuccucacc

SEQ ID NO: 143474 - RNA, 26 nt, Human
ugagaaaaacaggagcguuuucaggu

SEQ ID NO: 143475 - RNA, 24 nt, Human
ugaucaauguauuaaaaucaagca

SEQ ID NO: 143476 - RNA, 24 nt, Human
ugcacagaugagaaaaacaggagc

SEQ ID NO: 143477 - RNA, 19 nt, Human
uggaggcugcgugcuuucc

SEQ ID NO: 143478 - RNA, 18 nt, Human
uugcuggagcuggauacc

SEQ ID NO: 143479 - RNA, 23 nt, Human
aaaaaaaaaagaaaaagaaaaag

SEQ ID NO: 143480 - RNA, 19 nt, Human
aaaaaaaagaaaaagaaaa

SEQ ID NO: 143481 - RNA, 19 nt, Human
aaaagaaaaagaaaaagug

SEQ ID NO: 143482 - RNA, 25 nt, Human
acagaauaaauauaucccccaaaua

SEQ ID NO: 143483 - RNA, 24 nt, Human
acugucugagcuaacuaccauuug

SEQ ID NO: 143484 - RNA, 20 nt, Human
acuugggagguacaacuuua

SEQ ID NO: 143485 - RNA, 18 nt, Human
agaaaaagaaaaagugga

SEQ ID NO: 143486 - RNA, 27 nt, Human
agauauugaaaaugcacugucugagcu

SEQ ID NO: 143487 - RNA, 25 nt, Human
auacaagcuuuuuuuuuuuuccuuu

SEQ ID NO: 143488 - RNA, 27 nt, Human
auuaagcuuaaaaaaaaaaaagaaaaa

SEQ ID NO: 143489 - RNA, 24 nt, Human
caacacccugcacuugcagauccc

SEQ ID NO: 143490 - RNA, 24 nt, Human
caauacagaauaaauauauccccc

SEQ ID NO: 143491 - RNA, 22 nt, Human
cacccugcacuugcagaucccu

SEQ ID NO: 143492 - RNA, 23 nt, Human
cacccugcacuugcagaucccuc

SEQ ID NO: 143493 - RNA, 22 nt, Human
caucauaaauuaaaacauggag

SEQ ID NO: 143494 - RNA, 24 nt, Human
cauguuaaguuagauauugaaaau

SEQ ID NO: 143495 - RNA, 19 nt, Human
cuaaaaaaucuaacuggca

SEQ ID NO: 143496 - RNA, 18 nt, Human
cucuguagcagaauccaa

SEQ ID NO: 143497 - RNA, 22 nt, Human
cuugcagaucccucuuccaauu

SEQ ID NO: 143498 - RNA, 26 nt, Human
gagguacaacuuuaaccaacacccug

SEQ ID NO: 143499 - RNA, 18 nt, Human
guaaauaucaccacuuca

SEQ ID NO: 143500 - RNA, 18 nt, Human
uacaacuuuaaccaacac

SEQ ID NO: 143501 - RNA, 21 nt, Human
uacaacuuuaaccaacacccu

SEQ ID NO: 143502 - RNA, 18 nt, Human
ugcacuugcagaucccuc

SEQ ID NO: 143503 - RNA, 23 nt, Human
uuaaaaaaaaaaaagaaaaagaa

SEQ ID NO: 143504 - RNA, 21 nt, Human
uuaaaaaggccugaguuaaaa

SEQ ID NO: 143505 - RNA, 19 nt, Human
uuccucuuaaaaaggccug

SEQ ID NO: 143506 - RNA, 22 nt, Human
uucuuccuuuacacagcuuuaa

SEQ ID NO: 143507 - RNA, 26 nt, Human
uuucuuuuuuuuuuuuuuuacuuuuu

SEQ ID NO: 143508 - RNA, 20 nt, Human
aaaacaaaacauugguguua

SEQ ID NO: 143509 - RNA, 22 nt, Human
aaagaauacuaauuggaagcug

SEQ ID NO: 143510 - RNA, 18 nt, Human
aagagcgccuccuuuugg

SEQ ID NO: 143511 - RNA, 22 nt, Human
acaaaacaaaacauugguguua

SEQ ID NO: 143512 - RNA, 19 nt, Human
acccagaacgaaacaaaac

SEQ ID NO: 143513 - RNA, 18 nt, Human
acgaaacaaaacaaaaca

SEQ ID NO: 143514 - RNA, 21 nt, Human
caguccuuucuagccauuugu

SEQ ID NO: 143515 - RNA, 26 nt, Human
cauacaguuuacgucacuauaaaccc

SEQ ID NO: 143516 - RNA, 23 nt, Human
ccagaacgaaacaaaacaaaaca

SEQ ID NO: 143517 - RNA, 33 nt, Human
cuggcaauauauaaucuauucaguccuuucuuu

SEQ ID NO: 143518 - RNA, 24 nt, Human
cuuaacaaaguuuuaugacccaga

SEQ ID NO: 143519 - RNA, 18 nt, Human
gaacgaaacaaaacaaaa

SEQ ID NO: 143520 - RNA, 18 nt, Human
guccugcaaaguuuguca

SEQ ID NO: 143521 - RNA, 22 nt, Human
guuuacaaauaaaaaugaaaau

SEQ ID NO: 143522 - RNA, 21 nt, Human
uaugacccagaacgaaacaaa

SEQ ID NO: 143523 - RNA, 21 nt, Human
uauguuguucucuugggcuua

SEQ ID NO: 143524 - RNA, 20 nt, Human
uauuccaaaagaguuccuua

SEQ ID NO: 143525 - RNA, 21 nt, Human
uauuuugcuuuauaagggaag

SEQ ID NO: 143526 - RNA, 21 nt, Human
ucucuugggcuuacuuccgag

SEQ ID NO: 143527 - RNA, 23 nt, Human
ugacccagaacgaaacaaaacaa

SEQ ID NO: 143528 - RNA, 21 nt, Human
ugcuuuauaagggaaguccug

SEQ ID NO: 143529 - RNA, 19 nt, Human
uguuggcaagaaauaauaa

SEQ ID NO: 143530 - RNA, 21 nt, Human
uguuguuugcuuuauguuguu

SEQ ID NO: 143531 - RNA, 18 nt, Human
aaagguaaaggagagagu

SEQ ID NO: 143532 - RNA, 21 nt, Human
acccaggugcugucuggaggc

SEQ ID NO: 143533 - RNA, 23 nt, Human
acugguuucgagcuccuggccuc

SEQ ID NO: 143534 - RNA, 23 nt, Human
agagauggggucuugcugugugg

SEQ ID NO: 143535 - RNA, 23 nt, Human
agcaaagcaaggacuccagccca

SEQ ID NO: 143536 - RNA, 22 nt, Human
auauuaauuuuuuagagauggg

SEQ ID NO: 143537 - RNA, 21 nt, Human
aucccauccgcccuccaacag

SEQ ID NO: 143538 - RNA, 23 nt, Human
auccgcccuccaacagguguccc

SEQ ID NO: 143539 - RNA, 22 nt, Human
caaagcaaggacuccagcccag

SEQ ID NO: 143540 - RNA, 19 nt, Human
caacaggugucccggggcu

SEQ ID NO: 143541 - RNA, 22 nt, Human
cagcagcagcaaagcaaggacu

SEQ ID NO: 143542 - RNA, 22 nt, Human
cagcucagcagcagcaaagcaa

SEQ ID NO: 143543 - RNA, 21 nt, Human
cagugacugggauuacaggug

SEQ ID NO: 143544 - RNA, 23 nt, Human
caucuccauuucucagcuagaga

SEQ ID NO: 143545 - RNA, 18 nt, Human
ccacugcgcccagcccaa

SEQ ID NO: 143546 - RNA, 18 nt, Human
ccacugcgcccagcccaa

SEQ ID NO: 143547 - RNA, 19 nt, Human
ccacugcgcccagcccaac

SEQ ID NO: 143548 - RNA, 18 nt, Human
cccagcccaacaacaauu

SEQ ID NO: 143549 - RNA, 24 nt, Human
ccugcacugugguaaagguaaagg

SEQ ID NO: 143550 - RNA, 20 nt, Human
ccuggccucaagcuacccuc

SEQ ID NO: 143551 - RNA, 22 nt, Human
ccuggccucaagcuacccuccc

SEQ ID NO: 143552 - RNA, 21 nt, Human
cgauccacugcgcccagccca

SEQ ID NO: 143553 - RNA, 20 nt, Human
cgcccuccaacagguguccc

SEQ ID NO: 143554 - RNA, 24 nt, Human
cucaagcuacccucccacgucggc

SEQ ID NO: 143555 - RNA, 22 nt, Human
cuggaggcagcgggaagcccuu

SEQ ID NO: 143556 - RNA, 19 nt, Human
cuguguggcccggacuggu

SEQ ID NO: 143557 - RNA, 22 nt, Human
gauuacaggugcgauccacugc

SEQ ID NO: 143558 - RNA, 24 nt, Human
gcccagcccaacaacaauucuuuu

SEQ ID NO: 143559 - RNA, 23 nt, Human
ggcccggacugguuuccccucug

SEQ ID NO: 143560 - RNA, 18 nt, Human
ggcgaggacccaggugcu

SEQ ID NO: 143561 - RNA, 18 nt, Human
guaaagguaaaggagaga

SEQ ID NO: 143562 - RNA, 23 nt, Human
uagagaaacugaggcucaaaggg

SEQ ID NO: 143563 - RNA, 22 nt, Human
ucccagugacugggauuacagg

SEQ ID NO: 143564 - RNA, 24 nt, Human
ucccagugacugggauuacaggug

SEQ ID NO: 143565 - RNA, 22 nt, Human
ucucagcuagagaaacugaggc

SEQ ID NO: 143566 - RNA, 18 nt, Human
ugagguugcccggcagcu

SEQ ID NO: 143567 - RNA, 19 nt, Human
ugcccggcagcucagcagc

SEQ ID NO: 143568 - RNA, 20 nt, Human
ugcgcccagcccaacaacaa

SEQ ID NO: 143569 - RNA, 23 nt, Human
ugcgcccagcccaacaacaauuc

SEQ ID NO: 143570 - RNA, 21 nt, Human
uggcccggacugguuucgagc

SEQ ID NO: 143571 - RNA, 20 nt, Human
uggccucaagcuacccuccc

SEQ ID NO: 143572 - RNA, 21 nt, Human
uggccucaagcuacccuccca

SEQ ID NO: 143573 - RNA, 18 nt, Human
ugggauuacaggugcgau

SEQ ID NO: 143574 - RNA, 21 nt, Human
ugggauuacaggugcgaucca

SEQ ID NO: 143575 - RNA, 22 nt, Human
ugggauuacaggugcgauccac

SEQ ID NO: 143576 - RNA, 22 nt, Human
ugggauuacaggugcgauccac

SEQ ID NO: 143577 - RNA, 24 nt, Human
ugggauuacaggugcgauccacug

SEQ ID NO: 143578 - RNA, 19 nt, Human
uuaauuuuuuagagauggg

SEQ ID NO: 143579 - RNA, 23 nt, Human
uuaggguggcgaggacccaggug

SEQ ID NO: 143580 - RNA, 24 nt, Human
aaaaaaaaaaaaaaaggaacagaa

SEQ ID NO: 143581 - RNA, 23 nt, Human
aaaaaaaaaaaaggaacagaaaa

SEQ ID NO: 143582 - RNA, 20 nt, Human
aaaaaccaaggcgcgcgacg

SEQ ID NO: 143583 - RNA, 19 nt, Human
agcggccucccacgcuggc

SEQ ID NO: 143584 - RNA, 29 nt, Human
aggcaggaaguuaaaaaaaaagggacccc

SEQ ID NO: 143585 - RNA, 23 nt, Human
auuagcuuugucccuccaaacug

SEQ ID NO: 143586 - RNA, 21 nt, Human
cagaaaaaccaaggcgcgcga

SEQ ID NO: 143587 - RNA, 19 nt, Human
cagugccuucacacagccc

SEQ ID NO: 143588 - RNA, 23 nt, Human
cccagcagugccuucacacagcc

SEQ ID NO: 143589 - RNA, 19 nt, Human
ccccuuuauuccccuucuu

SEQ ID NO: 143590 - RNA, 22 nt, Human
cccuccaaacugugggagcagg

SEQ ID NO: 143591 - RNA, 22 nt, Human
ccuggcuucucuuguaucugug

SEQ ID NO: 143592 - RNA, 20 nt, Human
cgcgacggcagcggccuccc

SEQ ID NO: 143593 - RNA, 23 nt, Human
cuggcaggcagagagcuccuccu

SEQ ID NO: 143594 - RNA, 21 nt, Human
cuuugugggcugauggcugcg

SEQ ID NO: 143595 - RNA, 28 nt, Human
gcaggaaguuaaaaaaaaaaaaaaaaaa

SEQ ID NO: 143596 - RNA, 25 nt, Human
uaggcaggaaguuaaaaaaaaaaaa

SEQ ID NO: 143597 - RNA, 21 nt, Human
ucccagcagugccuucacaca

SEQ ID NO: 143598 - RNA, 19 nt, Human
ucccuccaaacugugggag

SEQ ID NO: 143599 - RNA, 22 nt, Human
uccuccucggccaguguucgag

SEQ ID NO: 143600 - RNA, 21 nt, Human
ucuugugccugcccaugagcc

SEQ ID NO: 143601 - RNA, 20 nt, Human
ugccugcccaugagccugag

SEQ ID NO: 143602 - RNA, 19 nt, Human
uugugggcugauggcugcg

SEQ ID NO: 143603 - RNA, 18 nt, Human
uuuuuuuuuuuuagaguc

SEQ ID NO: 143604 - RNA, 18 nt, Human
cagccccuuccccuccuc

SEQ ID NO: 143605 - RNA, 19 nt, Human
cucagccccuuccccuccc

SEQ ID NO: 143606 - RNA, 20 nt, Human
gcccuggaggcuggaugggg

SEQ ID NO: 143607 - RNA, 23 nt, Human
ucucguccucagccccuuccccu

SEQ ID NO: 143608 - RNA, 25 nt, Human
uggaggcuggaugggggucucgucc

SEQ ID NO: 143609 - RNA, 23 nt, Human
uggccaagcgggcugagcaaugc

SEQ ID NO: 143610 - RNA, 20 nt, Human
acccugcuccaggccccucc

SEQ ID NO: 143611 - RNA, 25 nt, Human
agcagggggaccggguccuggaggg

SEQ ID NO: 143612 - RNA, 21 nt, Human
aggggcuggaaggcagguggu

SEQ ID NO: 143613 - RNA, 18 nt, Human
caauccagccuggcagag

SEQ ID NO: 143614 - RNA, 24 nt, Human
cacagccccccaaaguccagccuc

SEQ ID NO: 143615 - RNA, 18 nt, Human
cagcaagaacacagcgaa

SEQ ID NO: 143616 - RNA, 19 nt, Human
cagcaagaacacagcgaag

SEQ ID NO: 143617 - RNA, 21 nt, Human
ccagacuuugcagcaagaaca

SEQ ID NO: 143618 - RNA, 21 nt, Human
ccccuuagagcagaaucuggg

SEQ ID NO: 143619 - RNA, 24 nt, Human
ccccuuagagcagaaucuggggac

SEQ ID NO: 143620 - RNA, 19 nt, Human
cccugcuccaggccccucc

SEQ ID NO: 143621 - RNA, 21 nt, Human
cccugcuccaggccccuccug

SEQ ID NO: 143622 - RNA, 18 nt, Human
cccuggggccgcagccgg

SEQ ID NO: 143623 - RNA, 20 nt, Human
ccgggugcaugccugccccu

SEQ ID NO: 143624 - RNA, 22 nt, Human
ccugagccgcagcgcagccgag

SEQ ID NO: 143625 - RNA, 24 nt, Human
cucacagccccccaaaguccagcc

SEQ ID NO: 143626 - RNA, 21 nt, Human
gaccugggccaccugggcuac

SEQ ID NO: 143627 - RNA, 21 nt, Human
gagcagaaucuggggacccca

SEQ ID NO: 143628 - RNA, 20 nt, Human
gccccgguagccagcaggag

SEQ ID NO: 143629 - RNA, 22 nt, Human
gcccguacaauccagccuggca

SEQ ID NO: 143630 - RNA, 18 nt, Human
gcgcagccgagcgggcgu

SEQ ID NO: 143631 - RNA, 20 nt, Human
gcuggaaggcagguggugcc

SEQ ID NO: 143632 - RNA, 20 nt, Human
gcuggcaccgggugcaugcc

SEQ ID NO: 143633 - RNA, 21 nt, Human
ggaggggcuggaaggcaggug

SEQ ID NO: 143634 - RNA, 20 nt, Human
ggcccuggggccgcagccgg

SEQ ID NO: 143635 - RNA, 24 nt, Human
ggucuggcccccuuagagcagaau

SEQ ID NO: 143636 - RNA, 18 nt, Human
gugcgggggcaguggggg

SEQ ID NO: 143637 - RNA, 24 nt, Human
guggugcccagagcggggcuggca

SEQ ID NO: 143638 - RNA, 22 nt, Human
ucgggcccgagcgggggccuga

SEQ ID NO: 143639 - RNA, 19 nt, Human
ucgugcgggggcagugggg

SEQ ID NO: 143640 - RNA, 19 nt, Human
ugagccgcagcgcagccga

SEQ ID NO: 143641 - RNA, 22 nt, Human
uggaggggcuggaaggcaggug

SEQ ID NO: 143642 - RNA, 20 nt, Human
uggggccgcagccggcaggu

SEQ ID NO: 143643 - RNA, 25 nt, Human
uucccucacagccccccaaagucca

SEQ ID NO: 143644 - RNA, 23 nt, Human
acuuuaagcaaacacgugugggg

SEQ ID NO: 143645 - RNA, 19 nt, Human
agguggccuggcccggggc

SEQ ID NO: 143646 - RNA, 18 nt, Human
cacugccggcggcggggc

SEQ ID NO: 143647 - RNA, 21 nt, Human
ccagcccagguacccggccuc

SEQ ID NO: 143648 - RNA, 22 nt, Human
cgcuugcuccggaucccagccc

SEQ ID NO: 143649 - RNA, 23 nt, Human
gcccgcuugcuccggaucccagc

SEQ ID NO: 143650 - RNA, 19 nt, Human
gccugcuuagggcgcugcc

SEQ ID NO: 143651 - RNA, 20 nt, Human
guucgcgcacagcgguccac

SEQ ID NO: 143652 - RNA, 26 nt, Human
uuuaagcaaacacguguggggcccug

SEQ ID NO: 143653 - RNA, 24 nt, Human
aaaguuauaaacugggaaacuggg

SEQ ID NO: 143654 - RNA, 18 nt, Human
agcggagggggcgggcac

SEQ ID NO: 143655 - RNA, 21 nt, Human
cagaaauggacccuuugcccc

SEQ ID NO: 143656 - RNA, 18 nt, Human
ccccuggcuggggccugg

SEQ ID NO: 143657 - RNA, 22 nt, Human
ccgcaaccugacaggcaaugac

SEQ ID NO: 143658 - RNA, 22 nt, Human
cgagggcaccgaugccgcaacc

SEQ ID NO: 143659 - RNA, 20 nt, Human
cgagggcaccgaugccgcag

SEQ ID NO: 143660 - RNA, 25 nt, Human
cgcaaccugacaggcaaugacgccg

SEQ ID NO: 143661 - RNA, 27 nt, Human
cugacaggcaaugacgccguucuuucc

SEQ ID NO: 143662 - RNA, 20 nt, Human
ggccugggacgcgagggcuc

SEQ ID NO: 143663 - RNA, 18 nt, Human
uaacgugcccguuagcgg

SEQ ID NO: 143664 - RNA, 23 nt, Human
ugucauaaaguuauaaacuggga

SEQ ID NO: 143665 - RNA, 19 nt, Human
ugucaucgcccauccuccc

SEQ ID NO: 143666 - RNA, 21 nt, Human
acagcguuucccucagagcag

SEQ ID NO: 143667 - RNA, 26 nt, Human
acccucacaggcugggugacgaaggc

SEQ ID NO: 143668 - RNA, 19 nt, Human
agcggcagggacacaagga

SEQ ID NO: 143669 - RNA, 20 nt, Human
agggacacaaggacccgcag

SEQ ID NO: 143670 - RNA, 18 nt, Human
caagcagaggugugaagc

SEQ ID NO: 143671 - RNA, 20 nt, Human
cagcagacagcguuucccuc

SEQ ID NO: 143672 - RNA, 22 nt, Human
cagcagacagcguuucccucag

SEQ ID NO: 143673 - RNA, 21 nt, Human
cagcggcagggacacaaggac

SEQ ID NO: 143674 - RNA, 18 nt, Human
cagcguuucccucagagc

SEQ ID NO: 143675 - RNA, 18 nt, Human
cagcguuucccucagagc

SEQ ID NO: 143676 - RNA, 18 nt, Human
ccucgccuauagccuuuc

SEQ ID NO: 143677 - RNA, 24 nt, Human
ccucuccaagcagaggugugaagc

SEQ ID NO: 143678 - RNA, 21 nt, Human
cgggccacgaccacgcagcaa

SEQ ID NO: 143679 - RNA, 22 nt, Human
cguuucccucagagcagcccca

SEQ ID NO: 143680 - RNA, 18 nt, Human
cuaaaacugacaggcugc

SEQ ID NO: 143681 - RNA, 24 nt, Human
gcagcaauuggagaggaacugcac

SEQ ID NO: 143682 - RNA, 20 nt, Human
gcucuugaaaagaggaugau

SEQ ID NO: 143683 - RNA, 18 nt, Human
ggacccgcaggccccgcu

SEQ ID NO: 143684 - RNA, 24 nt, Human
guccgagcacagcaugcccagagg

SEQ ID NO: 143685 - RNA, 23 nt, Human
ucucuggacuccucgcccggccc

SEQ ID NO: 143686 - RNA, 18 nt, Human
ugcccagagggaccagcg

SEQ ID NO: 143687 - RNA, 19 nt, Human
ugcccagagggaccagcgg

SEQ ID NO: 143688 - RNA, 22 nt, Human
uucagcggcagggacacaagga

SEQ ID NO: 143689 - RNA, 18 nt, Human
caacugaccacuggacac

SEQ ID NO: 143690 - RNA, 23 nt, Human
caagucuggaugugaagggccgg

SEQ ID NO: 143691 - RNA, 21 nt, Human
cagggugggguuccccccauc

SEQ ID NO: 143692 - RNA, 18 nt, Human
gccacugaagcuugucug

SEQ ID NO: 143693 - RNA, 20 nt, Human
ggccacugaagcuugucugg

SEQ ID NO: 143694 - RNA, 23 nt, Human
ugacccucuagggcucuggggug

SEQ ID NO: 143695 - RNA, 22 nt, Human
ugaguguucagauggguggggc

SEQ ID NO: 143696 - RNA, 19 nt, Human
uggguggggcagggugggg

SEQ ID NO: 143697 - RNA, 24 nt, Human
aauauccuauucuagugagauggc

SEQ ID NO: 143698 - RNA, 20 nt, Human
aauggaagaaaugaaagcua

SEQ ID NO: 143699 - RNA, 21 nt, Human
agugaaucagguugacuagca

SEQ ID NO: 143700 - RNA, 27 nt, Human
auaaacagcaaaggaaaaccgguaccc

SEQ ID NO: 143701 - RNA, 20 nt, Human
augauuuucaaaaccaggaa

SEQ ID NO: 143702 - RNA, 26 nt, Human
ccccaauauucaguuauauuuauacc

SEQ ID NO: 143703 - RNA, 20 nt, Human
ccuucugccagcuuuccuua

SEQ ID NO: 143704 - RNA, 19 nt, Human
uaaaacuccuagagacuau

SEQ ID NO: 143705 - RNA, 24 nt, Human
uaaguaggcuuugcuuggugucau

SEQ ID NO: 143706 - RNA, 19 nt, Human
uaguaaagacauagcuuua

SEQ ID NO: 143707 - RNA, 23 nt, Human
ucaguaaauuaaggcaaaggaga

SEQ ID NO: 143708 - RNA, 26 nt, Human
uccaccagccaauuucuggagagggg

SEQ ID NO: 143709 - RNA, 22 nt, Human
ucucuuauuaaugacaaaugca

SEQ ID NO: 143710 - RNA, 22 nt, Human
ucuguguguuagugaaucaggu

SEQ ID NO: 143711 - RNA, 21 nt, Human
uggaagaaaugaaagcuaccc

SEQ ID NO: 143712 - RNA, 21 nt, Human
ugguagggccaauacauagua

SEQ ID NO: 143713 - RNA, 19 nt, Human
uuaugcacacccuucugcc

SEQ ID NO: 143714 - RNA, 24 nt, Human
uuuacuauuaauaaaacuccuaga

SEQ ID NO: 143715 - RNA, 28 nt, Human
uuuuuuguugucauuaugcuucuuaauu

SEQ ID NO: 143716 - RNA, 20 nt, Human
aaacagcuacaaacaucuug

SEQ ID NO: 143717 - RNA, 22 nt, Human
aagaaauaggaaauaaaaaugc

SEQ ID NO: 143718 - RNA, 19 nt, Human
aagauaucacacuuugaaa

SEQ ID NO: 143719 - RNA, 21 nt, Human
aagauuaguaaaacugauggc

SEQ ID NO: 143720 - RNA, 25 nt, Human
aagugcuaauuacaaguaccauuua

SEQ ID NO: 143721 - RNA, 18 nt, Human
agauuaguaaaacugaug

SEQ ID NO: 143722 - RNA, 22 nt, Human
agauucacagcaguauuuggca

SEQ ID NO: 143723 - RNA, 21 nt, Human
auagaaaacaaucuauaguca

SEQ ID NO: 143724 - RNA, 26 nt, Human
aucuccuuuaaauguuauucuuguua

SEQ ID NO: 143725 - RNA, 24 nt, Human
auuccacacacuaucaaacuaaau

SEQ ID NO: 143726 - RNA, 27 nt, Human
caaauagauucacagcaguauuuggca

SEQ ID NO: 143727 - RNA, 21 nt, Human
cacuuugaaacagcaaaugaa

SEQ ID NO: 143728 - RNA, 25 nt, Human
cuucaaacugcacaugugaaacaga

SEQ ID NO: 143729 - RNA, 20 nt, Human
gagaagaaaauaaacuguga

SEQ ID NO: 143730 - RNA, 20 nt, Human
uaaaacagaaacuugaaauu

SEQ ID NO: 143731 - RNA, 25 nt, Human
uaaaacagaaacuugaaauuuaagu

SEQ ID NO: 143732 - RNA, 23 nt, Human
uagauucacagcaguauuuggca

SEQ ID NO: 143733 - RNA, 25 nt, Human
uauuuauuuacaaaguucuuacuaa

SEQ ID NO: 143734 - RNA, 25 nt, Human
ucaaacugcacaugugaaacagacc

SEQ ID NO: 143735 - RNA, 19 nt, Human
ucauuuacuacucucagaa

SEQ ID NO: 143736 - RNA, 23 nt, Human
uccacaugcuagaucuugaaaac

SEQ ID NO: 143737 - RNA, 23 nt, Human
ucccauggucuuauccuucaaaa

SEQ ID NO: 143738 - RNA, 19 nt, Human
ucccuaaagaaauaggaaa

SEQ ID NO: 143739 - RNA, 25 nt, Human
ucccuaaagaaauaggaaauaaaaa

SEQ ID NO: 143740 - RNA, 20 nt, Human
uccuucaaaauaaaauucca

SEQ ID NO: 143741 - RNA, 22 nt, Human
ucuguccuuaucucaauuugca

SEQ ID NO: 143742 - RNA, 21 nt, Human
uggcauagaaaacaaucuaua

SEQ ID NO: 143743 - RNA, 22 nt, Human
uggcauagaaaacaaucuauag

SEQ ID NO: 143744 - RNA, 23 nt, Human
ugugaaacagacccacuauuuaa

SEQ ID NO: 143745 - RNA, 22 nt, Human
uuuaaaauccacaugcuagauc

SEQ ID NO: 143746 - RNA, 18 nt, Human
aaagggaggaggaggggc

SEQ ID NO: 143747 - RNA, 22 nt, Human
aaagggaggaggaggggcggga

SEQ ID NO: 143748 - RNA, 18 nt, Human
agggaggaggaggggcgg

SEQ ID NO: 143749 - RNA, 23 nt, Human
cucuacuccgaggggugggaaag

SEQ ID NO: 143750 - RNA, 21 nt, Human
gacccguuccugcgcgacagu

SEQ ID NO: 143751 - RNA, 21 nt, Human
gaggaggggcgggagagaggg

SEQ ID NO: 143752 - RNA, 22 nt, Human
ggaaagggaggaggaggggcgg

SEQ ID NO: 143753 - RNA, 25 nt, Human
ggaaagggaggaggaggggcgggag

SEQ ID NO: 143754 - RNA, 25 nt, Human
ggagacauccacucucuugaggccc

SEQ ID NO: 143755 - RNA, 22 nt, Human
ggaggaggggcgggagagaggg

SEQ ID NO: 143756 - RNA, 18 nt, Human
gugggaaagggaggagga

SEQ ID NO: 143757 - RNA, 22 nt, Human
uccugccaucggcugggggcug

SEQ ID NO: 143758 - RNA, 18 nt, Human
ucuugaggcccgggagcc

SEQ ID NO: 143759 - RNA, 20 nt, Human
ugaggcccgggagccgcugg

SEQ ID NO: 143760 - RNA, 19 nt, Human
uggcugggcgggacggagc

SEQ ID NO: 143761 - RNA, 22 nt, Human
ugggaaagggaggaggaggggc

SEQ ID NO: 143762 - RNA, 21 nt, Human
aaaaaguuauccuaaugaaac

SEQ ID NO: 143763 - RNA, 19 nt, Human
aaacagacacaguaaauga

SEQ ID NO: 143764 - RNA, 20 nt, Human
aaagcaccaggagcagagaa

SEQ ID NO: 143765 - RNA, 22 nt, Human
aagcaccaggagcagagaacag

SEQ ID NO: 143766 - RNA, 19 nt, Human
accccacucuuucgcugaa

SEQ ID NO: 143767 - RNA, 19 nt, Human
acuagccuggcuccugagc

SEQ ID NO: 143768 - RNA, 20 nt, Human
agaagaugggucuaugaaga

SEQ ID NO: 143769 - RNA, 27 nt, Human
agaagccagcucccucgacaccaagcc

SEQ ID NO: 143770 - RNA, 18 nt, Human
agaauucuaauaguguga

SEQ ID NO: 143771 - RNA, 22 nt, Human
agacaaggcccaagguggcaca

SEQ ID NO: 143772 - RNA, 18 nt, Human
agagccaauggaacauga

SEQ ID NO: 143773 - RNA, 22 nt, Human
agaggaaaagacaaggcccaag

SEQ ID NO: 143774 - RNA, 18 nt, Human
agaggcuggagcgggcac

SEQ ID NO: 143775 - RNA, 18 nt, Human
agcagagaacagccaccc

SEQ ID NO: 143776 - RNA, 20 nt, Human
agcagguacucuauguccuu

SEQ ID NO: 143777 - RNA, 18 nt, Human
agcuuguuugacgucuuc

SEQ ID NO: 143778 - RNA, 20 nt, Human
aggaaaagacaaggcccaaa

SEQ ID NO: 143779 - RNA, 21 nt, Human
aggaaaagacaaggcccaagg

SEQ ID NO: 143780 - RNA, 23 nt, Human
agugaguagauauuuacucugcc

SEQ ID NO: 143781 - RNA, 19 nt, Human
aguuauugugaaaaugcca

SEQ ID NO: 143782 - RNA, 18 nt, Human
auccuuggcuuguccugg

SEQ ID NO: 143783 - RNA, 23 nt, Human
augaggccaaagcaccaggagca

SEQ ID NO: 143784 - RNA, 20 nt, Human
caaagcaccaggagcagaga

SEQ ID NO: 143785 - RNA, 21 nt, Human
caaagcaccaggagcagagaa

SEQ ID NO: 143786 - RNA, 21 nt, Human
cacaccuggcucuucggccgu

SEQ ID NO: 143787 - RNA, 23 nt, Human
cacuguguugacuuccauagagc

SEQ ID NO: 143788 - RNA, 21 nt, Human
cagacacaguaaaugaugaua

SEQ ID NO: 143789 - RNA, 20 nt, Human
cagcagggcugccugggacc

SEQ ID NO: 143790 - RNA, 25 nt, Human
caggagcagagaacagccaccccac

SEQ ID NO: 143791 - RNA, 24 nt, Human
caggauggagucccagcuuugguc

SEQ ID NO: 143792 - RNA, 20 nt, Human
caguuuauuaacuuucugcc

SEQ ID NO: 143793 - RNA, 20 nt, Human
cccaagggcucaccuggcuu

SEQ ID NO: 143794 - RNA, 27 nt, Human
ccccacucuuucgcugaaaggucggac

SEQ ID NO: 143795 - RNA, 26 nt, Human
ccccacucuuucgcugaaaggucggc

SEQ ID NO: 143796 - RNA, 22 nt, Human
ccccuaaaaggucaaaucugcc

SEQ ID NO: 143797 - RNA, 24 nt, Human
ccccuaaagcauuuuuucagucau

SEQ ID NO: 143798 - RNA, 24 nt, Human
cccuaaaaauggcagguggagagc

SEQ ID NO: 143799 - RNA, 18 nt, Human
cccucgacaccaagccca

SEQ ID NO: 143800 - RNA, 20 nt, Human
ccgcucccugcccugucugc

SEQ ID NO: 143801 - RNA, 20 nt, Human
ccucauugcaaacucaccug

SEQ ID NO: 143802 - RNA, 25 nt, Human
ccugcccugucugcaaguuuggaaa

SEQ ID NO: 143803 - RNA, 21 nt, Human
ccuuaggggucagcagggcug

SEQ ID NO: 143804 - RNA, 20 nt, Human
ccuucugucuucuacuggag

SEQ ID NO: 143805 - RNA, 21 nt, Human
ccuugccgaggggcuuucccu

SEQ ID NO: 143806 - RNA, 18 nt, Human
cgagaaacugaggcagag

SEQ ID NO: 143807 - RNA, 19 nt, Human
cgagaaacugaggcagaga

SEQ ID NO: 143808 - RNA, 23 nt, Human
cgagaaacugaggcagagagagg

SEQ ID NO: 143809 - RNA, 23 nt, Human
cuagaggucucucccagcacugg

SEQ ID NO: 143810 - RNA, 19 nt, Human
cuccacacaaaaauggcag

SEQ ID NO: 143811 - RNA, 20 nt, Human
cuggccuuacagccccagaa

SEQ ID NO: 143812 - RNA, 24 nt, Human
cugucuaagggccacagaccuacc

SEQ ID NO: 143813 - RNA, 23 nt, Human
cugucuucuacuggagugcaaac

SEQ ID NO: 143814 - RNA, 22 nt, Human
cuucacugucuaagggccacag

SEQ ID NO: 143815 - RNA, 19 nt, Human
gaaaagacaaggcccaagg

SEQ ID NO: 143816 - RNA, 22 nt, Human
gaagcagguacucuauguccuu

SEQ ID NO: 143817 - RNA, 24 nt, Human
gacacuggcuggccuuacagcccc

SEQ ID NO: 143818 - RNA, 19 nt, Human
gagcgggcacguucagccc

SEQ ID NO: 143819 - RNA, 23 nt, Human
gaggggcuuucccucauugcaaa

SEQ ID NO: 143820 - RNA, 19 nt, Human
gaucacuagccuggcuccu

SEQ ID NO: 143821 - RNA, 19 nt, Human
gcagagaacagccacccca

SEQ ID NO: 143822 - RNA, 22 nt, Human
gcagucuaauuaaggggagacu

SEQ ID NO: 143823 - RNA, 22 nt, Human
gccaaagcaccaggagcagaga

SEQ ID NO: 143824 - RNA, 21 nt, Human
gccacagaccuacccuggggu

SEQ ID NO: 143825 - RNA, 22 nt, Human
gcccugcugccauaggucccug

SEQ ID NO: 143826 - RNA, 24 nt, Human
gcuccagagcccucguuggauccu

SEQ ID NO: 143827 - RNA, 28 nt, Human
ggaacucuuccuugaccgcucccugccc

SEQ ID NO: 143828 - RNA, 22 nt, Human
ggcuggugggcuggcuguauga

SEQ ID NO: 143829 - RNA, 26 nt, Human
guuggauccuuggcuuguccugggag

SEQ ID NO: 143830 - RNA, 19 nt, Human
uaaauuggaagacaggccu

SEQ ID NO: 143831 - RNA, 22 nt, Human
uaagcgccccuucauucagcuu

SEQ ID NO: 143832 - RNA, 21 nt, Human
uaauaugccaagaacaaugcc

SEQ ID NO: 143833 - RNA, 20 nt, Human
uacaauaauaugccaagaac

SEQ ID NO: 143834 - RNA, 22 nt, Human
uacaauaauaugccaagaacaa

SEQ ID NO: 143835 - RNA, 22 nt, Human
uaccuggagcagggugucugca

SEQ ID NO: 143836 - RNA, 23 nt, Human
uacugcacacauccaauugcuug

SEQ ID NO: 143837 - RNA, 22 nt, Human
uagagcaccucaaaggccuggc

SEQ ID NO: 143838 - RNA, 19 nt, Human
uagcuugcaggguaaacca

SEQ ID NO: 143839 - RNA, 23 nt, Human
uaggucccuggcacaccuggcuc

SEQ ID NO: 143840 - RNA, 18 nt, Human
uauaaaauauaauaaguu

SEQ ID NO: 143841 - RNA, 21 nt, Human
uaugaagaaagucagguacca

SEQ ID NO: 143842 - RNA, 23 nt, Human
ucagucccagcagaagauggguc

SEQ ID NO: 143843 - RNA, 19 nt, Human
ucaucucccgcuuagaacu

SEQ ID NO: 143844 - RNA, 24 nt, Human
uccaguucugggugacaggcuuca

SEQ ID NO: 143845 - RNA, 19 nt, Human
uccauagagcaccucaaag

SEQ ID NO: 143846 - RNA, 21 nt, Human
ucccugacuggcucagaaggc

SEQ ID NO: 143847 - RNA, 18 nt, Human
uccuuaggggucagcagg

SEQ ID NO: 143848 - RNA, 18 nt, Human
uccuuuccguuuaaaggg

SEQ ID NO: 143849 - RNA, 22 nt, Human
ucgaaaaacagcagcaaacaga

SEQ ID NO: 143850 - RNA, 19 nt, Human
ucgacaccaagcccaggcu

SEQ ID NO: 143851 - RNA, 18 nt, Human
ucugacacuagccccgcu

SEQ ID NO: 143852 - RNA, 19 nt, Human
ucugacacuagccccgcuu

SEQ ID NO: 143853 - RNA, 22 nt, Human
ucugucuucuacuggagugcaa

SEQ ID NO: 143854 - RNA, 21 nt, Human
ugaaaguaucccggcucuagu

SEQ ID NO: 143855 - RNA, 20 nt, Human
ugaaaugaggccaaagcacc

SEQ ID NO: 143856 - RNA, 18 nt, Human
ugaagugaaaacacagcc

SEQ ID NO: 143857 - RNA, 18 nt, Human
ugacacuagccccgcuuc

SEQ ID NO: 143858 - RNA, 26 nt, Human
ugacauaucacaaaagccuugauucu

SEQ ID NO: 143859 - RNA, 20 nt, Human
ugaccgcucccugcccuguc

SEQ ID NO: 143860 - RNA, 20 nt, Human
ugacuuccauagagcaccuc

SEQ ID NO: 143861 - RNA, 23 nt, Human
ugagugaguagauauuuacucug

SEQ ID NO: 143862 - RNA, 18 nt, Human
ugcaccaucuagaggucu

SEQ ID NO: 143863 - RNA, 24 nt, Human
ugcaccaucuagaggucucuccca

SEQ ID NO: 143864 - RNA, 22 nt, Human
ugccccuaaaaggucaaaucug

SEQ ID NO: 143865 - RNA, 23 nt, Human
ugccuaagacugaaguggaaggc

SEQ ID NO: 143866 - RNA, 18 nt, Human
ugccugggaccuggcaca

SEQ ID NO: 143867 - RNA, 20 nt, Human
ugccuggugagguacaggcg

SEQ ID NO: 143868 - RNA, 18 nt, Human
ugccuugcauauugguuu

SEQ ID NO: 143869 - RNA, 19 nt, Human
uggaacaugagcugacacu

SEQ ID NO: 143870 - RNA, 21 nt, Human
uggacaaacacaugccuugca

SEQ ID NO: 143871 - RNA, 19 nt, Human
uggauccuuggcuuguccu

SEQ ID NO: 143872 - RNA, 19 nt, Human
uggcagacgagaaacugag

SEQ ID NO: 143873 - RNA, 20 nt, Human
uggcagguggagagccaaug

SEQ ID NO: 143874 - RNA, 20 nt, Human
uggcauuuccuauagcucca

SEQ ID NO: 143875 - RNA, 21 nt, Human
uggcauuuccuauagcuccac

SEQ ID NO: 143876 - RNA, 24 nt, Human
uggcuccugagcucuuggcaguua

SEQ ID NO: 143877 - RNA, 20 nt, Human
ugggcuggugggcuggcugu

SEQ ID NO: 143878 - RNA, 23 nt, Human
ugguuuguaaacauacguuccuu

SEQ ID NO: 143879 - RNA, 20 nt, Human
ugugaaaugaggccaaagca

SEQ ID NO: 143880 - RNA, 23 nt, Human
uuaaauuggaagacaggccuuau

SEQ ID NO: 143881 - RNA, 23 nt, Human
uuauagaaucacuaacuaacauc

SEQ ID NO: 143882 - RNA, 18 nt, Human
uucacuucugucauuccc

SEQ ID NO: 143883 - RNA, 22 nt, Human
uugcagaauuaugaauaucucc

SEQ ID NO: 143884 - RNA, 22 nt, Human
uugcaggguaaaccaaauaggu

SEQ ID NO: 143885 - RNA, 23 nt, Human
uuggaagacaggccuuauuucgu

SEQ ID NO: 143886 - RNA, 23 nt, Human
uuuauucccauuuaaauggacaa

SEQ ID NO: 143887 - RNA, 20 nt, Human
acgcgccuggagcaaaccgu

SEQ ID NO: 143888 - RNA, 19 nt, Human
cccucccuucuucuucucc

SEQ ID NO: 143889 - RNA, 25 nt, Human
cccugcccuccuccgccuuccccuc

SEQ ID NO: 143890 - RNA, 18 nt, Human
cccuucuucuucuccucc

SEQ ID NO: 143891 - RNA, 21 nt, Human
cccuucuucuucuccuccuuc

SEQ ID NO: 143892 - RNA, 28 nt, Human
cggggcuggcaggccuccggggcgacga

SEQ ID NO: 143893 - RNA, 21 nt, Human
cucugcgcgccccugcccucc

SEQ ID NO: 143894 - RNA, 21 nt, Human
gaccacggggaugaaaagucc

SEQ ID NO: 143895 - RNA, 21 nt, Human
gccaaugaaggaagaagaaga

SEQ ID NO: 143896 - RNA, 20 nt, Human
gcccuccuccgccuuccccu

SEQ ID NO: 143897 - RNA, 18 nt, Human
gccuuccccucccuucuu

SEQ ID NO: 143898 - RNA, 22 nt, Human
gcuggcaggccuccggggcgcg

SEQ ID NO: 143899 - RNA, 20 nt, Human
ggaccacggggaugaaaagu

SEQ ID NO: 143900 - RNA, 19 nt, Human
ucccuucuucuucuccucc

SEQ ID NO: 143901 - RNA, 20 nt, Human
uccugcgguuccgacgcgcc

SEQ ID NO: 143902 - RNA, 23 nt, Human
ucuucuccuccuucgcuucuucc

SEQ ID NO: 143903 - RNA, 24 nt, Human
ucuucuucuccuccuucgcuucuc

SEQ ID NO: 143904 - RNA, 18 nt, Human
ugggaccacggggaugaa

SEQ ID NO: 143905 - RNA, 24 nt, Human
aggagcacccacaagucaucaggg

SEQ ID NO: 143906 - RNA, 22 nt, Human
gagccaggagcacccacaaguc

SEQ ID NO: 143907 - RNA, 20 nt, Human
uggguugagccaggagcacc

SEQ ID NO: 143908 - RNA, 19 nt, Human
agcccuacugaggcccaga

SEQ ID NO: 143909 - RNA, 18 nt, Human
aggagggccugccuggca

SEQ ID NO: 143910 - RNA, 21 nt, Human
aggcccagagaggggccggga

SEQ ID NO: 143911 - RNA, 20 nt, Human
caguccaccccuugcagccu

SEQ ID NO: 143912 - RNA, 23 nt, Human
caugaucgaacuucaauguugcc

SEQ ID NO: 143913 - RNA, 20 nt, Human
caugcaucccacaguccacc

SEQ ID NO: 143914 - RNA, 24 nt, Human
caugcaucccacaguccaccccuu

SEQ ID NO: 143915 - RNA, 19 nt, Human
cccagaaucacacagaagc

SEQ ID NO: 143916 - RNA, 23 nt, Human
ccccagaaucacacagaagcggg

SEQ ID NO: 143917 - RNA, 18 nt, Human
ccccuugcagccugggag

SEQ ID NO: 143918 - RNA, 18 nt, Human
cccuacugaggcccagag

SEQ ID NO: 143919 - RNA, 19 nt, Human
cgugcacacagcuuccugu

SEQ ID NO: 143920 - RNA, 18 nt, Human
cucucugcuccuacgggg

SEQ ID NO: 143921 - RNA, 19 nt, Human
cugucccguucccugcucc

SEQ ID NO: 143922 - RNA, 20 nt, Human
cugucccguucccugcuccc

SEQ ID NO: 143923 - RNA, 24 nt, Human
gaagccccgagaggccaccgggaa

SEQ ID NO: 143924 - RNA, 24 nt, Human
gcgggguuguggggaaccacucgc

SEQ ID NO: 143925 - RNA, 22 nt, Human
uccaccccuugcagccugggag

SEQ ID NO: 143926 - RNA, 23 nt, Human
uccuguaccccaggagggccugc

SEQ ID NO: 143927 - RNA, 21 nt, Human
ugaggcccagagaggggccgg

SEQ ID NO: 143928 - RNA, 22 nt, Human
ugaggcccagagaggggccggg

SEQ ID NO: 143929 - RNA, 23 nt, Human
ugcaccauccacacgcaagacug

SEQ ID NO: 143930 - RNA, 22 nt, Human
ugcgugcacacagcuuccugua

SEQ ID NO: 143931 - RNA, 20 nt, Human
ugucccguucccugcucccc

SEQ ID NO: 143932 - RNA, 22 nt, Human
uguggggaaccacucgccccca

SEQ ID NO: 143933 - RNA, 25 nt, Human
aaaaaaaaaagaaagaaagaaagaa

SEQ ID NO: 143934 - RNA, 25 nt, Human
aaagaaagaaaagaaaaauaaaaaa

SEQ ID NO: 143935 - RNA, 27 nt, Human
aaagaaagaaaagaaaaauaaaaaaga

SEQ ID NO: 143936 - RNA, 26 nt, Human
aagaaagaaaagaaaaauaaaaaaga

SEQ ID NO: 143937 - RNA, 22 nt, Human
aagaaagaaagaaagaaaagaa

SEQ ID NO: 143938 - RNA, 23 nt, Human
agaacaagucuguaaaacuuggg

SEQ ID NO: 143939 - RNA, 21 nt, Human
agaacacaugggcacauuuca

SEQ ID NO: 143940 - RNA, 18 nt, Human
agaacgucaauuccacga

SEQ ID NO: 143941 - RNA, 21 nt, Human
agaacgucaauuccacgaggg

SEQ ID NO: 143942 - RNA, 24 nt, Human
agagcacaagaucccaacucaaaa

SEQ ID NO: 143943 - RNA, 18 nt, Human
aggaguuccaggcugcag

SEQ ID NO: 143944 - RNA, 19 nt, Human
aggaguuccaggcugcagu

SEQ ID NO: 143945 - RNA, 19 nt, Human
auggaggccacaagacacc

SEQ ID NO: 143946 - RNA, 21 nt, Human
auugcacuccagccuggguga

SEQ ID NO: 143947 - RNA, 24 nt, Human
auugcacuccagccugggugacag

SEQ ID NO: 143948 - RNA, 19 nt, Human
caccaucaccaucucuguc

SEQ ID NO: 143949 - RNA, 27 nt, Human
cacccuuggcauuguccuugauaacuu

SEQ ID NO: 143950 - RNA, 22 nt, Human
caccgaguucuuuucuguguuc

SEQ ID NO: 143951 - RNA, 22 nt, Human
cacuccagccugggugacagag

SEQ ID NO: 143952 - RNA, 23 nt, Human
cacuccagccugggugacagagc

SEQ ID NO: 143953 - RNA, 22 nt, Human
cagagcaaaagcgaaguccucu

SEQ ID NO: 143954 - RNA, 24 nt, Human
cagagcaaaagcgaaguccucuau

SEQ ID NO: 143955 - RNA, 18 nt, Human
cagucgugggccgagggu

SEQ ID NO: 143956 - RNA, 19 nt, Human
cauugcacuccagccuggg

SEQ ID NO: 143957 - RNA, 21 nt, Human
cauugcacuccagccugggug

SEQ ID NO: 143958 - RNA, 22 nt, Human
cauugcacuccagccuggguga

SEQ ID NO: 143959 - RNA, 24 nt, Human
cauugcacuccagccugggugaca

SEQ ID NO: 143960 - RNA, 24 nt, Human
cauugcacuccagccugggugaca

SEQ ID NO: 143961 - RNA, 24 nt, Human
ccaacucaaaaaaaaaaaaaagaa

SEQ ID NO: 143962 - RNA, 26 nt, Human
ccaacucaaaaaaaaaaaaaagaaag

SEQ ID NO: 143963 - RNA, 24 nt, Human
ccaggacagaggucucagcucaca

SEQ ID NO: 143964 - RNA, 18 nt, Human
ccauugcacuccagccug

SEQ ID NO: 143965 - RNA, 20 nt, Human
ccauugcacuccagccuggg

SEQ ID NO: 143966 - RNA, 21 nt, Human
ccauugcacuccagccugggu

SEQ ID NO: 143967 - RNA, 22 nt, Human
ccauugcacuccagccugggug

SEQ ID NO: 143968 - RNA, 24 nt, Human
ccauugcacuccagccugggugac

SEQ ID NO: 143969 - RNA, 19 nt, Human
cccaacucaaaaaaaaaaa

SEQ ID NO: 143970 - RNA, 22 nt, Human
cccauugcacuccagccugggu

SEQ ID NO: 143971 - RNA, 24 nt, Human
cccauugcacuccagccuggguga

SEQ ID NO: 143972 - RNA, 19 nt, Human
ccgacugcaccuuuggcug

SEQ ID NO: 143973 - RNA, 21 nt, Human
ccgucccugcuccaggcacac

SEQ ID NO: 143974 - RNA, 21 nt, Human
ccucuaaaaucuaucuagagg

SEQ ID NO: 143975 - RNA, 18 nt, Human
ccuguagucccagcuacu

SEQ ID NO: 143976 - RNA, 22 nt, Human
ccuguagucccagcuacuaggg

SEQ ID NO: 143977 - RNA, 21 nt, Human
ccuucagcuccuugucuccgg

SEQ ID NO: 143978 - RNA, 18 nt, Human
cucaaaaaaaaaaaaaag

SEQ ID NO: 143979 - RNA, 22 nt, Human
cucacaucacaagucacuaccu

SEQ ID NO: 143980 - RNA, 18 nt, Human
cuccgucccugcuccagg

SEQ ID NO: 143981 - RNA, 23 nt, Human
cugaagcaggaacuccaggcuug

SEQ ID NO: 143982 - RNA, 22 nt, Human
cugcagugagcuauaauugugc

SEQ ID NO: 143983 - RNA, 21 nt, Human
cuugauaacuuuauuccacuc

SEQ ID NO: 143984 - RNA, 21 nt, Human
cuugucuccucccauucuccc

SEQ ID NO: 143985 - RNA, 19 nt, Human
gaaguccucuauaucaccc

SEQ ID NO: 143986 - RNA, 20 nt, Human
gaccaccaucaccaucucug

SEQ ID NO: 143987 - RNA, 24 nt, Human
gcacuccagccugggugacagagc

SEQ ID NO: 143988 - RNA, 22 nt, Human
gcagugagcuauaauugugccc

SEQ ID NO: 143989 - RNA, 26 nt, Human
gcccauugcacuccagccugggugac

SEQ ID NO: 143990 - RNA, 22 nt, Human
gccccaaggucugcgcccuggu

SEQ ID NO: 143991 - RNA, 18 nt, Human
gcucagugcagccccccu

SEQ ID NO: 143992 - RNA, 24 nt, Human
ggccgcgcgccccaaggucugcgc

SEQ ID NO: 143993 - RNA, 19 nt, Human
gggugccccacccuuggca

SEQ ID NO: 143994 - RNA, 19 nt, Human
gucacuggaaucaucucca

SEQ ID NO: 143995 - RNA, 21 nt, Human
guuccuguggcucagugcagc

SEQ ID NO: 143996 - RNA, 19 nt, Human
uaccucugcagagaggucu

SEQ ID NO: 143997 - RNA, 19 nt, Human
uacuagggaggcugaagca

SEQ ID NO: 143998 - RNA, 22 nt, Human
uagggcaagucccucuucugcu

SEQ ID NO: 143999 - RNA, 23 nt, Human
ucaccuucucugguuuucaaccu

SEQ ID NO: 144000 - RNA, 18 nt, Human
uccagccugggugacaga

SEQ ID NO: 144001 - RNA, 19 nt, Human
uccaggcacaccagcaucg

SEQ ID NO: 144002 - RNA, 24 nt, Human
ucccaacucaaaaaaaaaaaaaag

SEQ ID NO: 144003 - RNA, 19 nt, Human
ucccaggaguuccaggcug

SEQ ID NO: 144004 - RNA, 21 nt, Human
uccuucagcuccuugucuccu

SEQ ID NO: 144005 - RNA, 23 nt, Human
ucguuugucacuggaaucaucuc

SEQ ID NO: 144006 - RNA, 20 nt, Human
ucuauaucacccacaagguc

SEQ ID NO: 144007 - RNA, 19 nt, Human
ugaccaccaucaccaucuc

SEQ ID NO: 144008 - RNA, 22 nt, Human
ugcacuccagccugggugacag

SEQ ID NO: 144009 - RNA, 24 nt, Human
ugcacuccagccugggugacagag

SEQ ID NO: 144010 - RNA, 22 nt, Human
ugcagccccccuucaccuucuc

SEQ ID NO: 144011 - RNA, 23 nt, Human
ugccuguagucccagcuacuagg

SEQ ID NO: 144012 - RNA, 24 nt, Human
ugccuguagucccagcuacuaggg

SEQ ID NO: 144013 - RNA, 21 nt, Human
uggcugagucucccagaguca

SEQ ID NO: 144014 - RNA, 19 nt, Human
uggggugucgcugcauaaa

SEQ ID NO: 144015 - RNA, 18 nt, Human
uggugcaugccuguaguc

SEQ ID NO: 144016 - RNA, 24 nt, Human
ugguggugcaugccuguaguccca

SEQ ID NO: 144017 - RNA, 24 nt, Human
uuaacugggcaugguggugcaugc

SEQ ID NO: 144018 - RNA, 22 nt, Human
uucagccucagggccuuugcgc

SEQ ID NO: 144019 - RNA, 19 nt, Human
uucccaggacagaggucuc

SEQ ID NO: 144020 - RNA, 24 nt, Human
uuccuguggcucagugcagccccc

SEQ ID NO: 144021 - RNA, 24 nt, Human
uugcgcaugccauucccucauccu

SEQ ID NO: 144022 - RNA, 24 nt, Human
uugugcccauugcacuccagccug

SEQ ID NO: 144023 - RNA, 22 nt, Human
uuuccuacaaauuccuuuaugu

SEQ ID NO: 144024 - RNA, 27 nt, Human
uuuccuacaaauuccuuuauguaaaaa

SEQ ID NO: 144025 - RNA, 18 nt, Human
uuucuuuuggucuuccca

SEQ ID NO: 144026 - RNA, 19 nt, Human
aaaggaaaacgaagaaaaa

SEQ ID NO: 144027 - RNA, 19 nt, Human
aaccucccguucaaacuga

SEQ ID NO: 144028 - RNA, 22 nt, Human
aagagaccaaagcaguuaccac

SEQ ID NO: 144029 - RNA, 25 nt, Human
aagcgcugcggguuccucagaucuc

SEQ ID NO: 144030 - RNA, 18 nt, Human
accagcagaggaugcucc

SEQ ID NO: 144031 - RNA, 23 nt, Human
acccaaaggaaaacgaagaaaaa

SEQ ID NO: 144032 - RNA, 18 nt, Human
acuuuggaguuucucccc

SEQ ID NO: 144033 - RNA, 21 nt, Human
aggaaaacgaagaaaaacagc

SEQ ID NO: 144034 - RNA, 20 nt, Human
agucagacacaaacacuccc

SEQ ID NO: 144035 - RNA, 24 nt, Human
caaaggaaaacgaagaaaaacagc

SEQ ID NO: 144036 - RNA, 21 nt, Human
cacaaacacucccuuaggacc

SEQ ID NO: 144037 - RNA, 23 nt, Human
cagacacaaacacucccuuagga

SEQ ID NO: 144038 - RNA, 18 nt, Human
cagaggaugcuccugcuc

SEQ ID NO: 144039 - RNA, 18 nt, Human
cagagucggccacagggc

SEQ ID NO: 144040 - RNA, 22 nt, Human
cagcccaagugcccuuuaacgg

SEQ ID NO: 144041 - RNA, 24 nt, Human
cagcuucaggucccucaaagcgcu

SEQ ID NO: 144042 - RNA, 18 nt, Human
ccucccguucaaacugaa

SEQ ID NO: 144043 - RNA, 18 nt, Human
ccuuccucucucucucuc

SEQ ID NO: 144044 - RNA, 19 nt, Human
ccuuccucucucucucucc

SEQ ID NO: 144045 - RNA, 23 nt, Human
cgaagaaaaacagcuucaggucc

SEQ ID NO: 144046 - RNA, 20 nt, Human
cggccacagggcucuccgug

SEQ ID NO: 144047 - RNA, 19 nt, Human
cucccguucaaacugaacc

SEQ ID NO: 144048 - RNA, 20 nt, Human
cugagucagacacaaacacu

SEQ ID NO: 144049 - RNA, 20 nt, Human
cugccaggagagaaggcagc

SEQ ID NO: 144050 - RNA, 18 nt, Human
cugcggguuccucagauc

SEQ ID NO: 144051 - RNA, 22 nt, Human
gaacccaaaggaaaacgaagaa

SEQ ID NO: 144052 - RNA, 19 nt, Human
gaagaaaaacagcuucagg

SEQ ID NO: 144053 - RNA, 23 nt, Human
gagaccaaagcaguuaccacuga

SEQ ID NO: 144054 - RNA, 22 nt, Human
gagguccauugucauccccaga

SEQ ID NO: 144055 - RNA, 21 nt, Human
gccaggguggagagugcagag

SEQ ID NO: 144056 - RNA, 21 nt, Human
ggcagcgccugccaggagaga

SEQ ID NO: 144057 - RNA, 23 nt, Human
uauggcuucagacaggccccgaa

SEQ ID NO: 144058 - RNA, 24 nt, Human
ucaaaaaccucccguucaaacuga

SEQ ID NO: 144059 - RNA, 22 nt, Human
uccccagaugaaagaagagacc

SEQ ID NO: 144060 - RNA, 19 nt, Human
ucccugaaaugugccaggc

SEQ ID NO: 144061 - RNA, 23 nt, Human
ucccuuaggaccuucgucagaaa

SEQ ID NO: 144062 - RNA, 19 nt, Human
uccuuccucucucucucuc

SEQ ID NO: 144063 - RNA, 19 nt, Human
ucuccuuccucucucucuc

SEQ ID NO: 144064 - RNA, 26 nt, Human
ugaaaaaaagggaucaaaaaccuccc

SEQ ID NO: 144065 - RNA, 21 nt, Human
ugaaagaagagaccaaagcag

SEQ ID NO: 144066 - RNA, 30 nt, Human
ugcuccugcucugaucccagccaggguggg

SEQ ID NO: 144067 - RNA, 22 nt, Human
uggaagccagugaagaugguug

SEQ ID NO: 144068 - RNA, 19 nt, Human
uggaaucuccuuccucucu

SEQ ID NO: 144069 - RNA, 23 nt, Human
uucaaacugaacccaaaggaaaa

SEQ ID NO: 144070 - RNA, 19 nt, Human
uucagcccaagugcccuuu

SEQ ID NO: 144071 - RNA, 22 nt, Human
uuugaguguguuuucaauuugu

SEQ ID NO: 144072 - RNA, 18 nt, Human
aagcaggcagagagucca

SEQ ID NO: 144073 - RNA, 18 nt, Human
acagacaggaaaagcaga

SEQ ID NO: 144074 - RNA, 23 nt, Human
acaggacacuccucaggacgcag

SEQ ID NO: 144075 - RNA, 21 nt, Human
acucuggggagggaaagcugg

SEQ ID NO: 144076 - RNA, 24 nt, Human
agaacucuggggagggaaagcugg

SEQ ID NO: 144077 - RNA, 24 nt, Human
agagcugugggccagcagccagca

SEQ ID NO: 144078 - RNA, 18 nt, Human
agcacuggaggcugcucc

SEQ ID NO: 144079 - RNA, 25 nt, Human
agccagcacuggaggcugcuccgca

SEQ ID NO: 144080 - RNA, 19 nt, Human
agccagccaggaugccagc

SEQ ID NO: 144081 - RNA, 21 nt, Human
agcggcgguggagcgccaggc

SEQ ID NO: 144082 - RNA, 21 nt, Human
aggcugcuccgcagucuggag

SEQ ID NO: 144083 - RNA, 18 nt, Human
agggaaagcuggagagga

SEQ ID NO: 144084 - RNA, 24 nt, Human
cacuucucuccuccucucuccccg

SEQ ID NO: 144085 - RNA, 22 nt, Human
cagcagacaggacacuccucag

SEQ ID NO: 144086 - RNA, 18 nt, Human
cagcagccagcacuggag

SEQ ID NO: 144087 - RNA, 23 nt, Human
cagccuccagaugaauguacucc

SEQ ID NO: 144088 - RNA, 24 nt, Human
cagccuccagaugaauguacuccc

SEQ ID NO: 144089 - RNA, 23 nt, Human
cagggcuggcugaggcaugcgug

SEQ ID NO: 144090 - RNA, 18 nt, Human
ccagcacuggaggcugcu

SEQ ID NO: 144091 - RNA, 26 nt, Human
ccccaugcaguucuuccagcagagcu

SEQ ID NO: 144092 - RNA, 24 nt, Human
ccgcgggcuuccuucccaauguuc

SEQ ID NO: 144093 - RNA, 21 nt, Human
cgccaggcuggacuggagcag

SEQ ID NO: 144094 - RNA, 23 nt, Human
cuggaggcugcuccgcagucugg

SEQ ID NO: 144095 - RNA, 19 nt, Human
gaggcugcuccgcagucug

SEQ ID NO: 144096 - RNA, 23 nt, Human
gcagugcgaggacacagaacugc

SEQ ID NO: 144097 - RNA, 22 nt, Human
gcguguucguggcugcacgguu

SEQ ID NO: 144098 - RNA, 19 nt, Human
ggaagcaggcagagagucc

SEQ ID NO: 144099 - RNA, 20 nt, Human
gggagccauccagucuccag

SEQ ID NO: 144100 - RNA, 21 nt, Human
gggagggucccgagggaauga

SEQ ID NO: 144101 - RNA, 23 nt, Human
ggugcaagaacucuggggaggga

SEQ ID NO: 144102 - RNA, 24 nt, Human
guagcccagcagacaggacacucc

SEQ ID NO: 144103 - RNA, 24 nt, Human
uauaaacacaaguucgcagguaaa

SEQ ID NO: 144104 - RNA, 22 nt, Human
uccacaagcccuggccacuucu

SEQ ID NO: 144105 - RNA, 23 nt, Human
uccgcagucuggaggccgagggc

SEQ ID NO: 144106 - RNA, 18 nt, Human
uggccacuucucuccucc

SEQ ID NO: 144107 - RNA, 21 nt, Human
uggcugcacgguugcuccugg

SEQ ID NO: 144108 - RNA, 24 nt, Human
uguuuccucauuuauuauaaacac

SEQ ID NO: 144109 - RNA, 19 nt, Human
uuaaaauaaauaauuggga

SEQ ID NO: 144110 - RNA, 19 nt, Human
uucgcagguaaauagaggg

SEQ ID NO: 144111 - RNA, 24 nt, Human
uucucaaaguucuuagggcaaaua

SEQ ID NO: 144112 - RNA, 19 nt, Human
aaaaccaauuuccugcaug

SEQ ID NO: 144113 - RNA, 25 nt, Human
aaagauccacauuuacucaugaaag

SEQ ID NO: 144114 - RNA, 21 nt, Human
aaaucuaccuaccuaucuacc

SEQ ID NO: 144115 - RNA, 20 nt, Human
aaaugucucucuacggggcc

SEQ ID NO: 144116 - RNA, 18 nt, Human
aacaagauggacaugugu

SEQ ID NO: 144117 - RNA, 18 nt, Human
aacauuuggucaaggcca

SEQ ID NO: 144118 - RNA, 21 nt, Human
aagccgacgccucguggcccu

SEQ ID NO: 144119 - RNA, 19 nt, Human
agauccacauaaaggaguu

SEQ ID NO: 144120 - RNA, 19 nt, Human
agcaaaucagccacuuuca

SEQ ID NO: 144121 - RNA, 19 nt, Human
aggcgccggagcaccggac

SEQ ID NO: 144122 - RNA, 24 nt, Human
aggcgccggagcaccggaccagga

SEQ ID NO: 144123 - RNA, 24 nt, Human
auacacacagaggauuuaacauuu

SEQ ID NO: 144124 - RNA, 24 nt, Human
aucaggcgccggagcaccggacca

SEQ ID NO: 144125 - RNA, 22 nt, Human
caaaacucuccaaaaccaauuu

SEQ ID NO: 144126 - RNA, 24 nt, Human
caaacagcacauaugcauuuuaaa

SEQ ID NO: 144127 - RNA, 25 nt, Human
caagagaagucaugucaaaagccag

SEQ ID NO: 144128 - RNA, 23 nt, Human
caccaugcagccuauucuaggca

SEQ ID NO: 144129 - RNA, 23 nt, Human
caccggaccaggaggacggccgc

SEQ ID NO: 144130 - RNA, 19 nt, Human
cacugaacaggaacaagcu

SEQ ID NO: 144131 - RNA, 21 nt, Human
cagcugaaaauuucucugcca

SEQ ID NO: 144132 - RNA, 19 nt, Human
caggcgacuuuacauggug

SEQ ID NO: 144133 - RNA, 22 nt, Human
cagucggcuuccugcaaacaag

SEQ ID NO: 144134 - RNA, 22 nt, Human
caucuccacacucacaguaagc

SEQ ID NO: 144135 - RNA, 18 nt, Human
ccaaaacucuccaaaacc

SEQ ID NO: 144136 - RNA, 20 nt, Human
cccauaagcuucaaauucau

SEQ ID NO: 144137 - RNA, 18 nt, Human
ccugcaaacaaggccugg

SEQ ID NO: 144138 - RNA, 20 nt, Human
ccugcaaacaaggccuggga

SEQ ID NO: 144139 - RNA, 18 nt, Human
ccuugagcuggggcuguc

SEQ ID NO: 144140 - RNA, 21 nt, Human
cgcagcugaaagagauuuuga

SEQ ID NO: 144141 - RNA, 20 nt, Human
cguauauacagugacuacuu

SEQ ID NO: 144142 - RNA, 25 nt, Human
cuuccugcaaacaaggccugggaac

SEQ ID NO: 144143 - RNA, 18 nt, Human
cuugccaaaacucuccaa

SEQ ID NO: 144144 - RNA, 20 nt, Human
gaaagcaaauauucaaccua

SEQ ID NO: 144145 - RNA, 21 nt, Human
gagaacaguuucacaauaaau

SEQ ID NO: 144146 - RNA, 22 nt, Human
gagcaauugauggguuucucuc

SEQ ID NO: 144147 - RNA, 21 nt, Human
gaguuuguauucagaaugcaa

SEQ ID NO: 144148 - RNA, 18 nt, Human
gccaaaacucuccaaaac

SEQ ID NO: 144149 - RNA, 19 nt, Human
gcuuggaguccacuuauuc

SEQ ID NO: 144150 - RNA, 21 nt, Human
gcuuuugacaguacuuucuga

SEQ ID NO: 144151 - RNA, 20 nt, Human
ggccaggaguuggcugcggc

SEQ ID NO: 144152 - RNA, 27 nt, Human
ggccaggaguuggcugcggcggucaua

SEQ ID NO: 144153 - RNA, 20 nt, Human
ggccugggaacuccacugug

SEQ ID NO: 144154 - RNA, 20 nt, Human
gggcauuuugcauuuauuaa

SEQ ID NO: 144155 - RNA, 20 nt, Human
ggggcugucuuuacagucgg

SEQ ID NO: 144156 - RNA, 22 nt, Human
guucgaggccggccgaucgcuc

SEQ ID NO: 144157 - RNA, 18 nt, Human
uaacaagauggacaugug

SEQ ID NO: 144158 - RNA, 19 nt, Human
uacacacagaggauuuaac

SEQ ID NO: 144159 - RNA, 18 nt, Human
uagaucaggcgccggagc

SEQ ID NO: 144160 - RNA, 20 nt, Human
ucacaguaagcucggcucgg

SEQ ID NO: 144161 - RNA, 21 nt, Human
uccacauaaaggaguuggagu

SEQ ID NO: 144162 - RNA, 20 nt, Human
uccggccaggaguuggcugc

SEQ ID NO: 144163 - RNA, 19 nt, Human
uccugcaugaaauuggagc

SEQ ID NO: 144164 - RNA, 23 nt, Human
uccuuuuuucuucuuccuucauu

SEQ ID NO: 144165 - RNA, 22 nt, Human
ucggcucggugggaagagcgca

SEQ ID NO: 144166 - RNA, 18 nt, Human
ucuccacacucacaguaa

SEQ ID NO: 144167 - RNA, 25 nt, Human
ucucuauacguauauacagugacua

SEQ ID NO: 144168 - RNA, 24 nt, Human
ugaaagcaaauauucaaccuaaua

SEQ ID NO: 144169 - RNA, 18 nt, Human
ugaaauuggagcugcagg

SEQ ID NO: 144170 - RNA, 19 nt, Human
ugauaccaucuugccacgg

SEQ ID NO: 144171 - RNA, 19 nt, Human
ugccaaaacucuccaaaac

SEQ ID NO: 144172 - RNA, 18 nt, Human
ugccaaaaucccauaagc

SEQ ID NO: 144173 - RNA, 23 nt, Human
uggagaacaguuucacaauaaau

SEQ ID NO: 144174 - RNA, 21 nt, Human
ugggaagagcgcagcugaaag

SEQ ID NO: 144175 - RNA, 20 nt, Human
uggguaucaagcacagcuga

SEQ ID NO: 144176 - RNA, 22 nt, Human
ugguggguaucaagcacagcug

SEQ ID NO: 144177 - RNA, 20 nt, Human
ugucuauacagaauacagag

SEQ ID NO: 144178 - RNA, 18 nt, Human
uguggccgcgaaagggca

SEQ ID NO: 144179 - RNA, 18 nt, Human
uuaugaaauacacacaga

SEQ ID NO: 144180 - RNA, 20 nt, Human
uucauaaacuccuguagagc

SEQ ID NO: 144181 - RNA, 18 nt, Human
uugaacagauccacauaa

SEQ ID NO: 144182 - RNA, 25 nt, Human
uugaagccauuccccaaagauccac

SEQ ID NO: 144183 - RNA, 25 nt, Human
uuggcugcggcggucauaaacuuuc

SEQ ID NO: 144184 - RNA, 19 nt, Human
uuuaaaaucuaccuaccua

SEQ ID NO: 144185 - RNA, 27 nt, Human
uuuaaaaucuaccuaccuaucuaccuc

SEQ ID NO: 144186 - RNA, 20 nt, Human
uuuguauucagaaugcaauu

SEQ ID NO: 144187 - RNA, 23 nt, Human
uuuuucuucuuccuucauucuuu

SEQ ID NO: 144188 - RNA, 26 nt, Human
aaaaaaagacaauugucuaaacaaaa

SEQ ID NO: 144189 - RNA, 22 nt, Human
aaaaaauucuuugaguaacauc

SEQ ID NO: 144190 - RNA, 18 nt, Human
aaaaaugggcuaaaagaa

SEQ ID NO: 144191 - RNA, 18 nt, Human
aaaagugacuugagccca

SEQ ID NO: 144192 - RNA, 19 nt, Human
aaagaaacaaagcaucuug

SEQ ID NO: 144193 - RNA, 18 nt, Human
aaagaaguacgauucgua

SEQ ID NO: 144194 - RNA, 23 nt, Human
aaagggaaugaucaaaaaagacu

SEQ ID NO: 144195 - RNA, 18 nt, Human
aaaugcccagcaaaaguc

SEQ ID NO: 144196 - RNA, 22 nt, Human
aaauuaagagaauaggagguga

SEQ ID NO: 144197 - RNA, 25 nt, Human
aacaauaugaccccaaauacugcuu

SEQ ID NO: 144198 - RNA, 25 nt, Human
aagaaacaaagcaucuugaaaaaaa

SEQ ID NO: 144199 - RNA, 19 nt, Human
aagcaacuggaaccugaug

SEQ ID NO: 144200 - RNA, 23 nt, Human
aagcaucuugaaaaaaagacaau

SEQ ID NO: 144201 - RNA, 23 nt, Human
aaggaagaaggaucagagaagag

SEQ ID NO: 144202 - RNA, 18 nt, Human
aaucucuaaaguuucaug

SEQ ID NO: 144203 - RNA, 22 nt, Human
acacacaugcauauaucacaca

SEQ ID NO: 144204 - RNA, 26 nt, Human
acacacaugcauauaucacacacaca

SEQ ID NO: 144205 - RNA, 21 nt, Human
acaggaaacaauaugacccca

SEQ ID NO: 144206 - RNA, 22 nt, Human
acaguucuuaaaaaauucuuug

SEQ ID NO: 144207 - RNA, 23 nt, Human
accagcgggaugacuguacgcgc

SEQ ID NO: 144208 - RNA, 21 nt, Human
agauguaguaaagguagaaau

SEQ ID NO: 144209 - RNA, 20 nt, Human
auauguauauacauauauau

SEQ ID NO: 144210 - RNA, 24 nt, Human
auuaucuuaccuaauuuauuauca

SEQ ID NO: 144211 - RNA, 24 nt, Human
caaaaaagacuuacugccaguuaa

SEQ ID NO: 144212 - RNA, 20 nt, Human
caaaccaaccaaccaaacaa

SEQ ID NO: 144213 - RNA, 21 nt, Human
caccagaacugccauaaaagc

SEQ ID NO: 144214 - RNA, 18 nt, Human
cagaaaaccuccugggca

SEQ ID NO: 144215 - RNA, 23 nt, Human
cauauaucacacacacaaauaua

SEQ ID NO: 144216 - RNA, 25 nt, Human
caucacacacaugcauauaucacac

SEQ ID NO: 144217 - RNA, 21 nt, Human
ccaaacaaaacccuauauugc

SEQ ID NO: 144218 - RNA, 22 nt, Human
ccaauccccggcgacgaccggg

SEQ ID NO: 144219 - RNA, 19 nt, Human
ccagaacugccauaaaagc

SEQ ID NO: 144220 - RNA, 20 nt, Human
ccaguccauaaauaaaaugc

SEQ ID NO: 144221 - RNA, 22 nt, Human
ccaguuaacauuuuaagaaaaa

SEQ ID NO: 144222 - RNA, 24 nt, Human
cccaaagcuccagaccuuccacuc

SEQ ID NO: 144223 - RNA, 25 nt, Human
cccaaagcuccagaccuuccacucc

SEQ ID NO: 144224 - RNA, 29 nt, Human
cccaaauacugcuuuaucaaaccaaccaa

SEQ ID NO: 144225 - RNA, 22 nt, Human
ccccaaauacugcuuuaucaaa

SEQ ID NO: 144226 - RNA, 20 nt, Human
ccggcgcggcggcggcuucg

SEQ ID NO: 144227 - RNA, 23 nt, Human
ccggcgcggcggcggcuucggcu

SEQ ID NO: 144228 - RNA, 21 nt, Human
ccuccagucuguccuccccgu

SEQ ID NO: 144229 - RNA, 23 nt, Human
ccuccugggcacugcuucucccg

SEQ ID NO: 144230 - RNA, 19 nt, Human
ccuggcaauuucaucacca

SEQ ID NO: 144231 - RNA, 23 nt, Human
ccugggccagaggaagccggagc

SEQ ID NO: 144232 - RNA, 21 nt, Human
ccuguaguauuuguuguagcu

SEQ ID NO: 144233 - RNA, 22 nt, Human
ccuuccacuccacucugggacc

SEQ ID NO: 144234 - RNA, 21 nt, Human
cgaaaaagaaaacuccggagg

SEQ ID NO: 144235 - RNA, 18 nt, Human
cggaggguggccgguguc

SEQ ID NO: 144236 - RNA, 18 nt, Human
cggcgacgaccggguggg

SEQ ID NO: 144237 - RNA, 19 nt, Human
cggcgcggcggcggcuucg

SEQ ID NO: 144238 - RNA, 22 nt, Human
cggcgcggcggcggcuucggcu

SEQ ID NO: 144239 - RNA, 21 nt, Human
cuaauugcucaccugaauacu

SEQ ID NO: 144240 - RNA, 27 nt, Human
cuacagguuaaaauggacugaggcagg

SEQ ID NO: 144241 - RNA, 19 nt, Human
cuccugggcacugcuucuc

SEQ ID NO: 144242 - RNA, 22 nt, Human
cugccauaaaagcuagccaugu

SEQ ID NO: 144243 - RNA, 18 nt, Human
cugcuuuuacaccuucac

SEQ ID NO: 144244 - RNA, 21 nt, Human
gaaaaagaaaacuccggagga

SEQ ID NO: 144245 - RNA, 21 nt, Human
gaaaaccccaagaagugaaga

SEQ ID NO: 144246 - RNA, 18 nt, Human
gaaagucucaggcagagu

SEQ ID NO: 144247 - RNA, 22 nt, Human
gcacgaaaaagaaaacuccgga

SEQ ID NO: 144248 - RNA, 22 nt, Human
gccggugucccgggcuccggcg

SEQ ID NO: 144249 - RNA, 19 nt, Human
gccuugugauuuuuuucuc

SEQ ID NO: 144250 - RNA, 20 nt, Human
gcggcgccugggccagagga

SEQ ID NO: 144251 - RNA, 21 nt, Human
ggcacugcuucucccggggag

SEQ ID NO: 144252 - RNA, 21 nt, Human
ggcagaguuaaaugacacaua

SEQ ID NO: 144253 - RNA, 21 nt, Human
ggcccaacaaauuaucuuacc

SEQ ID NO: 144254 - RNA, 18 nt, Human
ggcuucagaaaaccuccu

SEQ ID NO: 144255 - RNA, 21 nt, Human
ggcuucagaaaaccuccuggg

SEQ ID NO: 144256 - RNA, 18 nt, Human
gggaccccaauccccggc

SEQ ID NO: 144257 - RNA, 23 nt, Human
gugaagaaucguaaguucuggug

SEQ ID NO: 144258 - RNA, 20 nt, Human
gugauauguauauacauaua

SEQ ID NO: 144259 - RNA, 19 nt, Human
uaaaaaauacuggcaccaa

SEQ ID NO: 144260 - RNA, 23 nt, Human
uaagaacaauauaauacuucaaa

SEQ ID NO: 144261 - RNA, 22 nt, Human
uaagggccuguaguauuuguug

SEQ ID NO: 144262 - RNA, 18 nt, Human
uaaguucaaauaaucaug

SEQ ID NO: 144263 - RNA, 27 nt, Human
uacauaccaucacacacaugcauauag

SEQ ID NO: 144264 - RNA, 20 nt, Human
uaccugaaugaaaauuucug

SEQ ID NO: 144265 - RNA, 25 nt, Human
uagaaaaaugggcuaaaagaaauuu

SEQ ID NO: 144266 - RNA, 22 nt, Human
uauauacacacacacacuagua

SEQ ID NO: 144267 - RNA, 18 nt, Human
uaucagcaaucugucugg

SEQ ID NO: 144268 - RNA, 22 nt, Human
uauggaaaagggaaugaucaaa

SEQ ID NO: 144269 - RNA, 20 nt, Human
uauguauauacauauauaug

SEQ ID NO: 144270 - RNA, 23 nt, Human
ucacacacaugcauauaucacac

SEQ ID NO: 144271 - RNA, 22 nt, Human
ucagggccuuggcuucuggcuc

SEQ ID NO: 144272 - RNA, 18 nt, Human
ucaucugaaaaauucgau

SEQ ID NO: 144273 - RNA, 24 nt, Human
ucaucuggccacuucaaaauuaug

SEQ ID NO: 144274 - RNA, 25 nt, Human
uccacagcucaucugcuuucacgcu

SEQ ID NO: 144275 - RNA, 18 nt, Human
uccaccgccucuccacaa

SEQ ID NO: 144276 - RNA, 21 nt, Human
uccacuccacucugggaccgc

SEQ ID NO: 144277 - RNA, 18 nt, Human
uccuccccgucuccuccc

SEQ ID NO: 144278 - RNA, 23 nt, Human
uccuucugguuucauuuaacagu

SEQ ID NO: 144279 - RNA, 18 nt, Human
ucgcacgaaaaagaaaac

SEQ ID NO: 144280 - RNA, 19 nt, Human
ucgcugggaccccaauccc

SEQ ID NO: 144281 - RNA, 20 nt, Human
ucugcuguacucacagucug

SEQ ID NO: 144282 - RNA, 18 nt, Human
ucuguccuccccgucucc

SEQ ID NO: 144283 - RNA, 26 nt, Human
ucuugggugugggaguggcgcccgcg

SEQ ID NO: 144284 - RNA, 19 nt, Human
ugaaaaacagauugaacuu

SEQ ID NO: 144285 - RNA, 18 nt, Human
ugaaaaagaacuaucuga

SEQ ID NO: 144286 - RNA, 23 nt, Human
ugaaaaccccaagaagugaagaa

SEQ ID NO: 144287 - RNA, 18 nt, Human
ugacaaugugggagggag

SEQ ID NO: 144288 - RNA, 25 nt, Human
ugacacauacauuaacauuuuggua

SEQ ID NO: 144289 - RNA, 23 nt, Human
ugacaugauaaacucaucuggcc

SEQ ID NO: 144290 - RNA, 21 nt, Human
ugauauguauauacauauaua

SEQ ID NO: 144291 - RNA, 19 nt, Human
ugcccagcaaaagucacug

SEQ ID NO: 144292 - RNA, 28 nt, Human
ugccggguccgcgcggcgccugggccag

SEQ ID NO: 144293 - RNA, 18 nt, Human
uggaaagcauuucuucuu

SEQ ID NO: 144294 - RNA, 20 nt, Human
uggaauaauagauuugacug

SEQ ID NO: 144295 - RNA, 23 nt, Human
uggcaauuucaucaccacauuga

SEQ ID NO: 144296 - RNA, 20 nt, Human
uggccacuucaaaauuaugu

SEQ ID NO: 144297 - RNA, 20 nt, Human
uggguaauuauuuuucacug

SEQ ID NO: 144298 - RNA, 24 nt, Human
ugguacuugacauugauuuuucau

SEQ ID NO: 144299 - RNA, 20 nt, Human
ugugaaaaagaacuaucuga

SEQ ID NO: 144300 - RNA, 25 nt, Human
ugugggagggagauguugggguggg

SEQ ID NO: 144301 - RNA, 19 nt, Human
ugugggagugaauuaagga

SEQ ID NO: 144302 - RNA, 19 nt, Human
uuacugccaguuaacauuu

SEQ ID NO: 144303 - RNA, 23 nt, Human
uucauacugaaaaccccaagaag

SEQ ID NO: 144304 - RNA, 24 nt, Human
uuugaaauggugacaaugugggag

SEQ ID NO: 144305 - RNA, 23 nt, Human
uuuuaagaaaaauuaagagaaua

SEQ ID NO: 144306 - RNA, 22 nt, Human
uuuuucauacaaaauuuacaug

SEQ ID NO: 144307 - RNA, 19 nt, Human
uuuuuuuucaaacuaugug

SEQ ID NO: 144308 - RNA, 22 nt, Human
aguauccacgcucaaaaguaac

SEQ ID NO: 144309 - RNA, 22 nt, Human
gagccuagagacaagcagagga

SEQ ID NO: 144310 - RNA, 22 nt, Human
gcagaggaaggaagacagacac

SEQ ID NO: 144311 - RNA, 25 nt, Human
guccgguggccgccgcaguuucaga

SEQ ID NO: 144312 - RNA, 26 nt, Human
uaaauagaauccauauggugugugaa

SEQ ID NO: 144313 - RNA, 25 nt, Human
uaacucaaguuugcgcgccaguggg

SEQ ID NO: 144314 - RNA, 24 nt, Human
ugcccgagccaagucgcugcaaac

SEQ ID NO: 144315 - RNA, 21 nt, Human
uuggggucagcugcccgagcc

SEQ ID NO: 144316 - RNA, 21 nt, Human
aaaagcaguagagucugagca

SEQ ID NO: 144317 - RNA, 21 nt, Human
acaaagaauguaaacaaugua

SEQ ID NO: 144318 - RNA, 21 nt, Human
agagucugagcaggaagacag

SEQ ID NO: 144319 - RNA, 20 nt, Human
caggaagacaguacaaagaa

SEQ ID NO: 144320 - RNA, 23 nt, Human
ccggcgcagucgacacuucccuc

SEQ ID NO: 144321 - RNA, 24 nt, Human
gacaguacaaagaauguaaacaau

SEQ ID NO: 144322 - RNA, 18 nt, Human
gauugaaugcugaaagac

SEQ ID NO: 144323 - RNA, 20 nt, Human
ggaagacaguacaaagaaug

SEQ ID NO: 144324 - RNA, 20 nt, Human
uaaaagcaguagagucugaa

SEQ ID NO: 144325 - RNA, 23 nt, Human
uaaacaauguaaacaucacuaca

SEQ ID NO: 144326 - RNA, 21 nt, Human
ucccgccggcgcagucgacac

SEQ ID NO: 144327 - RNA, 18 nt, Human
uugaaugcugaaagacaa

SEQ ID NO: 144328 - RNA, 24 nt, Human
aaaaaagaaaaccaaaguggucca

SEQ ID NO: 144329 - RNA, 24 nt, Human
aaaaaguacugauuuuaaaaacua

SEQ ID NO: 144330 - RNA, 18 nt, Human
aaacaaacaguucugaga

SEQ ID NO: 144331 - RNA, 20 nt, Human
aaagaaaaccaaaguggucc

SEQ ID NO: 144332 - RNA, 24 nt, Human
aacaguucugagaccguucuucca

SEQ ID NO: 144333 - RNA, 24 nt, Human
aagaaaaccaaagugguccacaaa

SEQ ID NO: 144334 - RNA, 26 nt, Human
agaaaaccaaagugguccacaaaaca

SEQ ID NO: 144335 - RNA, 25 nt, Human
cacgcaaaaaagaaaaccaaagugg

SEQ ID NO: 144336 - RNA, 21 nt, Human
ccaccacugauuaagaguggg

SEQ ID NO: 144337 - RNA, 23 nt, Human
gcaaaaaagaaaaccaaaguggu

SEQ ID NO: 144338 - RNA, 25 nt, Human
gucaaguuguuuccauuaaaaagua

SEQ ID NO: 144339 - RNA, 24 nt, Human
uaaugggucucaaaauucugugac

SEQ ID NO: 144340 - RNA, 25 nt, Human
uaaugggucucaaaauucugugaca

SEQ ID NO: 144341 - RNA, 23 nt, Human
uccacaaaacauucuccuuuccu

SEQ ID NO: 144342 - RNA, 23 nt, Human
ugcauuguuaucauuaaccaguc

SEQ ID NO: 144343 - RNA, 24 nt, Human
ugcauuguuaucauuaaccagucu

SEQ ID NO: 144344 - RNA, 23 nt, Human
ugccacacgcaaaaaagaaaacc

SEQ ID NO: 144345 - RNA, 22 nt, Human
uggcagguauuagggauaauau

SEQ ID NO: 144346 - RNA, 22 nt, Human
ugguccacaaaacauucuccuu

SEQ ID NO: 144347 - RNA, 24 nt, Human
uuaaauggccaauugaaacaaaca

SEQ ID NO: 144348 - RNA, 18 nt, Human
uuccaccacugauuaaga

SEQ ID NO: 144349 - RNA, 23 nt, Human
uucuccuuuccuucugaagguuu

SEQ ID NO: 144350 - RNA, 24 nt, Human
uuuaacuuuuuuaaugggucucaa

SEQ ID NO: 144351 - RNA, 26 nt, Human
uuuacuacuaaacuuaaaagguuuuc

SEQ ID NO: 144352 - RNA, 22 nt, Human
uuuuuuuuuuuuuuucucauuu

SEQ ID NO: 144353 - RNA, 18 nt, Human
aagccuggggcgggggcg

SEQ ID NO: 144354 - RNA, 21 nt, Human
aggggcuggcgggacccgggg

SEQ ID NO: 144355 - RNA, 22 nt, Human
ccggcgcgcggggcgggggcgg

SEQ ID NO: 144356 - RNA, 20 nt, Human
cgcggggcgggggcggggcg

SEQ ID NO: 144357 - RNA, 21 nt, Human
cggggcgggggcccgggcccg

SEQ ID NO: 144358 - RNA, 21 nt, Human
cugagcguggcgagcgcuggg

SEQ ID NO: 144359 - RNA, 22 nt, Human
cuggggcgggggcgccuuuccu

SEQ ID NO: 144360 - RNA, 22 nt, Human
cuugaagaacuuccacuggacc

SEQ ID NO: 144361 - RNA, 24 nt, Human
gagggucgcgccgcgggcgcccgc

SEQ ID NO: 144362 - RNA, 19 nt, Human
gccuggcgggggugcgggg

SEQ ID NO: 144363 - RNA, 20 nt, Human
gcgcggggcgggggcggggc

SEQ ID NO: 144364 - RNA, 21 nt, Human
gggcgcggaagccuggggcgg

SEQ ID NO: 144365 - RNA, 19 nt, Human
gggcgggggcccgggcccg

SEQ ID NO: 144366 - RNA, 21 nt, Human
gggcgggggcggggcgggggc

SEQ ID NO: 144367 - RNA, 19 nt, Human
ggggcggggcgggggcccg

SEQ ID NO: 144368 - RNA, 21 nt, Human
ggggcggggcgggggcccggg

SEQ ID NO: 144369 - RNA, 23 nt, Human
ucagggcgaggggggcugcagug

SEQ ID NO: 144370 - RNA, 23 nt, Human
ucgcucaguuuauugguaaaacg

SEQ ID NO: 144371 - RNA, 18 nt, Human
uggcgagcauccagucgc

SEQ ID NO: 144372 - RNA, 19 nt, Human
uggcgggacccggggugcu

SEQ ID NO: 144373 - RNA, 21 nt, Human
uggcucagggcgaggggggcu

SEQ ID NO: 144374 - RNA, 20 nt, Human
uugauggcgagcauccaguu

SEQ ID NO: 144375 - RNA, 21 nt, Human
uuugcugggagugugaggggc

SEQ ID NO: 144376 - RNA, 22 nt, Human
aaccagcccuagaagcgccgga

SEQ ID NO: 144377 - RNA, 18 nt, Human
aagcgccggagaugaccu

SEQ ID NO: 144378 - RNA, 19 nt, Human
acccgaagagaccggaaaa

SEQ ID NO: 144379 - RNA, 22 nt, Human
agaggaaaaaggacccgaagag

SEQ ID NO: 144380 - RNA, 20 nt, Human
caccgcgccggaccgaaggu

SEQ ID NO: 144381 - RNA, 25 nt, Human
cacuucuccacguacgaauuggggg

SEQ ID NO: 144382 - RNA, 23 nt, Human
cagcagaaagagagcgcgcaaau

SEQ ID NO: 144383 - RNA, 21 nt, Human
gaaaauuccuuauauagagac

SEQ ID NO: 144384 - RNA, 22 nt, Human
gaaccagcccuagaagcgccgg

SEQ ID NO: 144385 - RNA, 23 nt, Human
gaugacgggaaccagcccuagaa

SEQ ID NO: 144386 - RNA, 22 nt, Human
ggcgccccacgcugaagagagg

SEQ ID NO: 144387 - RNA, 28 nt, Human
gggagcagcagaaagagagccgguaccc

SEQ ID NO: 144388 - RNA, 21 nt, Human
gggggcccugaauuaaauggc

SEQ ID NO: 144389 - RNA, 22 nt, Human
ugacgggaaccagcccuagaag

SEQ ID NO: 144390 - RNA, 18 nt, Human
uggggagcagcagaaaga

SEQ ID NO: 144391 - RNA, 22 nt, Human
uguauccgagagcuggggagca

SEQ ID NO: 144392 - RNA, 22 nt, Human
uuccuuauauagagacggaggc

SEQ ID NO: 144393 - RNA, 21 nt, Human
aaaccucuuaaugcguuuguu

SEQ ID NO: 144394 - RNA, 19 nt, Human
agcuggaggugcucauggu

SEQ ID NO: 144395 - RNA, 19 nt, Human
aucccgccucccccucccc

SEQ ID NO: 144396 - RNA, 20 nt, Human
caccgcacaggacuuccugc

SEQ ID NO: 144397 - RNA, 24 nt, Human
ccaauggcacuaguacagcuggag

SEQ ID NO: 144398 - RNA, 21 nt, Human
ccuccggacucuggaaauaaa

SEQ ID NO: 144399 - RNA, 23 nt, Human
ccuccggacucuggaaauaaaua

SEQ ID NO: 144400 - RNA, 22 nt, Human
cgggccccagaaaccucucagg

SEQ ID NO: 144401 - RNA, 21 nt, Human
cuacccgcguguuccuuuccc

SEQ ID NO: 144402 - RNA, 19 nt, Human
cugcugccuccggacucug

SEQ ID NO: 144403 - RNA, 18 nt, Human
cuggggcaaaagccacug

SEQ ID NO: 144404 - RNA, 19 nt, Human
ggggagcgucgcugugucg

SEQ ID NO: 144405 - RNA, 19 nt, Human
ggugcugcgaguccccggg

SEQ ID NO: 144406 - RNA, 23 nt, Human
guugagugauggcacgcagcggg

SEQ ID NO: 144407 - RNA, 21 nt, Human
ucccaucccgccucccccucc

SEQ ID NO: 144408 - RNA, 26 nt, Human
ucccaucccgccucccccuccccgac

SEQ ID NO: 144409 - RNA, 19 nt, Human
uccccggggcggcaggcgc

SEQ ID NO: 144410 - RNA, 21 nt, Human
uccccuuucuggggcaaaagc

SEQ ID NO: 144411 - RNA, 18 nt, Human
ucccgccucccccucccc

SEQ ID NO: 144412 - RNA, 19 nt, Human
ugaagaaauggaaaaagug

SEQ ID NO: 144413 - RNA, 19 nt, Human
ugagugauggcacgcagcg

SEQ ID NO: 144414 - RNA, 27 nt, Human
ugccuccggacucuggaaauaaauauu

SEQ ID NO: 144415 - RNA, 18 nt, Human
uggaaaaaguguugggug

SEQ ID NO: 144416 - RNA, 19 nt, Human
ugucugcugccuccggacu

SEQ ID NO: 144417 - RNA, 24 nt, Human
ugucugcugccuccggacucugga

SEQ ID NO: 144418 - RNA, 24 nt, Human
uuccugccugcuagaaaucaucua

SEQ ID NO: 144419 - RNA, 23 nt, Human
aaaauacccuacagaaaccagca

SEQ ID NO: 144420 - RNA, 22 nt, Human
aaacaaccaccuuuaggcugga

SEQ ID NO: 144421 - RNA, 18 nt, Human
aagaauccaaguuucacc

SEQ ID NO: 144422 - RNA, 24 nt, Human
aauuuuaguuauaaauuagugaag

SEQ ID NO: 144423 - RNA, 21 nt, Human
acauauaguaauaaagacaaa

SEQ ID NO: 144424 - RNA, 19 nt, Human
aggaaagaauccaaguuuc

SEQ ID NO: 144425 - RNA, 25 nt, Human
auaguaauaaagacaaacuuugaau

SEQ ID NO: 144426 - RNA, 22 nt, Human
caaaaaaaaaacucggagagca

SEQ ID NO: 144427 - RNA, 19 nt, Human
cacagcacagcaaaaauac

SEQ ID NO: 144428 - RNA, 22 nt, Human
cacucuggaugccaggaauaaa

SEQ ID NO: 144429 - RNA, 19 nt, Human
cagaaaccagcauguugua

SEQ ID NO: 144430 - RNA, 19 nt, Human
caucaaaguaaagcaguca

SEQ ID NO: 144431 - RNA, 22 nt, Human
caucaaaguaaagcagucagau

SEQ ID NO: 144432 - RNA, 24 nt, Human
cauguacacaaagaaggccaugug

SEQ ID NO: 144433 - RNA, 22 nt, Human
ccaucaucauuuucuuccucug

SEQ ID NO: 144434 - RNA, 20 nt, Human
ccucugugagcaucaaguac

SEQ ID NO: 144435 - RNA, 25 nt, Human
ccucugugagcaucaaguacgaaga

SEQ ID NO: 144436 - RNA, 20 nt, Human
cucuggaugccaggaauaaa

SEQ ID NO: 144437 - RNA, 22 nt, Human
cuuuaugguguuuaacguuacu

SEQ ID NO: 144438 - RNA, 23 nt, Human
uaaaaaccaacacaaauauggca

SEQ ID NO: 144439 - RNA, 23 nt, Human
uaaaaauacccuacagaaaccag

SEQ ID NO: 144440 - RNA, 24 nt, Human
uaaaaauacccuacagaaaccagc

SEQ ID NO: 144441 - RNA, 31 nt, Human
uaaacaaccaccuuuaggcuggauaugaaaa

SEQ ID NO: 144442 - RNA, 20 nt, Human
uaacaaaauaacaaaaaaaa

SEQ ID NO: 144443 - RNA, 31 nt, Human
uaacaaaauaacaaaaaaaaaacucggagaa

SEQ ID NO: 144444 - RNA, 19 nt, Human
uagcucucuugaagaagac

SEQ ID NO: 144445 - RNA, 23 nt, Human
uaggaaagaauccaaguuucacc

SEQ ID NO: 144446 - RNA, 23 nt, Human
uaggaaagaauccaaguuucacc

SEQ ID NO: 144447 - RNA, 24 nt, Human
uaguaauaaagacaaacuuugaau

SEQ ID NO: 144448 - RNA, 25 nt, Human
uaguaauaaagacaaacuuugaauc

SEQ ID NO: 144449 - RNA, 22 nt, Human
uauaggaaagaauccaaguuuc

SEQ ID NO: 144450 - RNA, 23 nt, Human
uauucugcacucuauugguuuua

SEQ ID NO: 144451 - RNA, 23 nt, Human
ucaccagauaguguauacuuagc

SEQ ID NO: 144452 - RNA, 25 nt, Human
ucaccagauaguguauacuuagcuc

SEQ ID NO: 144453 - RNA, 18 nt, Human
uccaaguuucaccagaua

SEQ ID NO: 144454 - RNA, 20 nt, Human
ucggagagcaaucuuccagu

SEQ ID NO: 144455 - RNA, 22 nt, Human
ucuauugguuuuaucugcaugu

SEQ ID NO: 144456 - RNA, 22 nt, Human
ugaaauaccuuuuauccauuuu

SEQ ID NO: 144457 - RNA, 21 nt, Human
ugcuucuucaggucaguucca

SEQ ID NO: 144458 - RNA, 20 nt, Human
uggauaugaaaauaaaaacc

SEQ ID NO: 144459 - RNA, 20 nt, Human
uggcugacuuaaaugccugu

SEQ ID NO: 144460 - RNA, 23 nt, Human
uguuaguggagcucuaguaaguu

SEQ ID NO: 144461 - RNA, 19 nt, Human
uguuaugggugaguguaca

SEQ ID NO: 144462 - RNA, 28 nt, Human
uuaacaaaauaacaaaaaaaaaacucgg

SEQ ID NO: 144463 - RNA, 25 nt, Human
uuaacguuacuuacuugacuugagu

SEQ ID NO: 144464 - RNA, 22 nt, Human
uuauugaccuuuuccauuuucu

SEQ ID NO: 144465 - RNA, 22 nt, Human
uuuccaguuccuuacacccauu

SEQ ID NO: 144466 - RNA, 21 nt, Human
aaaaacaggcccagggaacua

SEQ ID NO: 144467 - RNA, 18 nt, Human
agaaaaacaggcccaggg

SEQ ID NO: 144468 - RNA, 28 nt, Human
cauucugccccucacaacaggcuccuca

SEQ ID NO: 144469 - RNA, 23 nt, Human
cccuccucguuaccuccucuccu

SEQ ID NO: 144470 - RNA, 18 nt, Human
cucguuaccuccucuccu

SEQ ID NO: 144471 - RNA, 23 nt, Human
cugcagggaggguggcucccucc

SEQ ID NO: 144472 - RNA, 19 nt, Human
cuuauccaaauguacaguu

SEQ ID NO: 144473 - RNA, 22 nt, Human
gcucgggcaaugccugcccucg

SEQ ID NO: 144474 - RNA, 26 nt, Human
gucaaugggggccccugggccuuucu

SEQ ID NO: 144475 - RNA, 18 nt, Human
uagcugcagggagggugg

SEQ ID NO: 144476 - RNA, 23 nt, Human
uccuggcgcuguccagaguggag

SEQ ID NO: 144477 - RNA, 18 nt, Human
ucucugggccggggccug

SEQ ID NO: 144478 - RNA, 18 nt, Human
uguccagaguggaguuuc

SEQ ID NO: 144479 - RNA, 20 nt, Human
uucucauucugccccucaca

SEQ ID NO: 144480 - RNA, 22 nt, Human
uugaggcagaguuaggaaugga

SEQ ID NO: 144481 - RNA, 21 nt, Human
aaaaccacgcagauucaauua

SEQ ID NO: 144482 - RNA, 18 nt, Human
aaagcaaauaugacaaaa

SEQ ID NO: 144483 - RNA, 20 nt, Human
aaagcaaauaugacaaaacu

SEQ ID NO: 144484 - RNA, 26 nt, Human
aaauaaacagacauauauaaaacaga

SEQ ID NO: 144485 - RNA, 24 nt, Human
aacaaauuauuauaugauaaacaa

SEQ ID NO: 144486 - RNA, 20 nt, Human
aagagcccgcuuccugggcu

SEQ ID NO: 144487 - RNA, 21 nt, Human
aagagcccgcuuccugggcuc

SEQ ID NO: 144488 - RNA, 22 nt, Human
aagcaaauaugacaaaacaaau

SEQ ID NO: 144489 - RNA, 23 nt, Human
aagcuccugaauaugaacaagaa

SEQ ID NO: 144490 - RNA, 22 nt, Human
acaaacaagaauaguauaugca

SEQ ID NO: 144491 - RNA, 24 nt, Human
acauuugucccuucauaaucucag

SEQ ID NO: 144492 - RNA, 22 nt, Human
acuccuaaaacagaggcaguua

SEQ ID NO: 144493 - RNA, 21 nt, Human
acuggaauccaucaaaguauc

SEQ ID NO: 144494 - RNA, 22 nt, Human
aggcaguuacaaauuugcagaa

SEQ ID NO: 144495 - RNA, 21 nt, Human
augauaaacaacccguuaaca

SEQ ID NO: 144496 - RNA, 19 nt, Human
augcgauucacuuucaagu

SEQ ID NO: 144497 - RNA, 23 nt, Human
auuuuuucagcuuuucucuaugu

SEQ ID NO: 144498 - RNA, 25 nt, Human
caaauuugcagaaaccacaaacuga

SEQ ID NO: 144499 - RNA, 18 nt, Human
caacagaaaagccugccc

SEQ ID NO: 144500 - RNA, 21 nt, Human
caacccguuaacaaaggaagg

SEQ ID NO: 144501 - RNA, 23 nt, Human
caaggaaguaauacuuauacucc

SEQ ID NO: 144502 - RNA, 22 nt, Human
caauagaguugagauagacaua

SEQ ID NO: 144503 - RNA, 22 nt, Human
cagaaaagccugcccauuaaug

SEQ ID NO: 144504 - RNA, 24 nt, Human
cagacauauauaaaacagagagaa

SEQ ID NO: 144505 - RNA, 20 nt, Human
cagccugaauuuauuccacu

SEQ ID NO: 144506 - RNA, 23 nt, Human
cagccugaauuuauuccacugga

SEQ ID NO: 144507 - RNA, 20 nt, Human
caucaaaguaucaaaaccac

SEQ ID NO: 144508 - RNA, 21 nt, Human
cucucuaugaagaacauacgg

SEQ ID NO: 144509 - RNA, 19 nt, Human
gaaaaacacucucuaugaa

SEQ ID NO: 144510 - RNA, 19 nt, Human
gaacugcuugggaaagccc

SEQ ID NO: 144511 - RNA, 23 nt, Human
gacauauauaaaacagagagaaa

SEQ ID NO: 144512 - RNA, 21 nt, Human
gauuuuuggaugaagcaauuc

SEQ ID NO: 144513 - RNA, 24 nt, Human
gcagaaaccacaaacugaaauaaa

SEQ ID NO: 144514 - RNA, 22 nt, Human
gucaguggccgccgcccuuaau

SEQ ID NO: 144515 - RNA, 21 nt, Human
uaaucucagugaauacaauau

SEQ ID NO: 144516 - RNA, 24 nt, Human
uaauucagcuggaaucucaccaua

SEQ ID NO: 144517 - RNA, 23 nt, Human
uauaaaacagagagaaauuuggc

SEQ ID NO: 144518 - RNA, 19 nt, Human
ucaccaagcuguucaucug

SEQ ID NO: 144519 - RNA, 22 nt, Human
uccaucaaaguaucaaaaccac

SEQ ID NO: 144520 - RNA, 26 nt, Human
ucccuucauaaucucagugaauacaa

SEQ ID NO: 144521 - RNA, 18 nt, Human
ucucuuuuccccuuaaau

SEQ ID NO: 144522 - RNA, 26 nt, Human
ucugaaaaacacucucuaugaagaac

SEQ ID NO: 144523 - RNA, 24 nt, Human
ucuucaacagaaaagccugcccau

SEQ ID NO: 144524 - RNA, 25 nt, Human
ugaaaaacacucucuaugaagaaca

SEQ ID NO: 144525 - RNA, 22 nt, Human
ugaaagcaaauaugacaaaaca

SEQ ID NO: 144526 - RNA, 20 nt, Human
ugaacacaaacaagaauagu

SEQ ID NO: 144527 - RNA, 21 nt, Human
ugaagaacauacggaauccag

SEQ ID NO: 144528 - RNA, 18 nt, Human
ugaauuggcaacacauuc

SEQ ID NO: 144529 - RNA, 27 nt, Human
ugcagaaaccacaaacugaaauaaaca

SEQ ID NO: 144530 - RNA, 19 nt, Human
uggaauccaucaaaguauc

SEQ ID NO: 144531 - RNA, 20 nt, Human
ugggcucagaauuucuuguu

SEQ ID NO: 144532 - RNA, 24 nt, Human
uuaacauuugucccuucauaaucu

SEQ ID NO: 144533 - RNA, 21 nt, Human
aaacaucaaagcacauuucuc

SEQ ID NO: 144534 - RNA, 27 nt, Human
aaacgaaaagaaaauaggcuuucuccg

SEQ ID NO: 144535 - RNA, 24 nt, Human
aaagugcugggauuacaggcguga

SEQ ID NO: 144536 - RNA, 27 nt, Human
aagcaggaggcgcgagccgcgccaaag

SEQ ID NO: 144537 - RNA, 18 nt, Human
aaggacacaaaagaaaca

SEQ ID NO: 144538 - RNA, 28 nt, Human
aaggacacaaaagaaacacaacuuugug

SEQ ID NO: 144539 - RNA, 19 nt, Human
aagugcugggauuacaggc

SEQ ID NO: 144540 - RNA, 19 nt, Human
aagugcugggauuacaggc

SEQ ID NO: 144541 - RNA, 26 nt, Human
aagugcugggauuacaggcgugagcc

SEQ ID NO: 144542 - RNA, 24 nt, Human
acugucucggccucccaaagugcu

SEQ ID NO: 144543 - RNA, 19 nt, Human
agaggccuggcaucuuucu

SEQ ID NO: 144544 - RNA, 22 nt, Human
agaggccuggcaucuuucuugu

SEQ ID NO: 144545 - RNA, 22 nt, Human
agcaugauucagguacaguggc

SEQ ID NO: 144546 - RNA, 24 nt, Human
caaagugcugggauuacaggcgug

SEQ ID NO: 144547 - RNA, 19 nt, Human
cagccuaggcaaaaggcaa

SEQ ID NO: 144548 - RNA, 18 nt, Human
cagggccucauagucucu

SEQ ID NO: 144549 - RNA, 22 nt, Human
ccaaagugcugggauuacaggc

SEQ ID NO: 144550 - RNA, 22 nt, Human
ccaaagugcugggauuacaggc

SEQ ID NO: 144551 - RNA, 24 nt, Human
ccaaagugcugggauuacaggcgu

SEQ ID NO: 144552 - RNA, 25 nt, Human
cccucuaucuuauuacauuuagagg

SEQ ID NO: 144553 - RNA, 21 nt, Human
ccgcugggcucuugaagcagg

SEQ ID NO: 144554 - RNA, 22 nt, Human
ccucauagucucuccacaguug

SEQ ID NO: 144555 - RNA, 18 nt, Human
cgccaaagucugcaacgg

SEQ ID NO: 144556 - RNA, 20 nt, Human
cuggcauuaggccgcgugcc

SEQ ID NO: 144557 - RNA, 19 nt, Human
cuuugugauaccacucuuc

SEQ ID NO: 144558 - RNA, 18 nt, Human
gauuacaggcgugagcca

SEQ ID NO: 144559 - RNA, 21 nt, Human
gauuacaggcgugagccacca

SEQ ID NO: 144560 - RNA, 24 nt, Human
gauuacaggcgugagccaccaugc

SEQ ID NO: 144561 - RNA, 24 nt, Human
ggauuacaggcgugagccaccaug

SEQ ID NO: 144562 - RNA, 23 nt, Human
uaaaauggguggcuccagugcca

SEQ ID NO: 144563 - RNA, 21 nt, Human
uaaggacacaaaagaaacaca

SEQ ID NO: 144564 - RNA, 26 nt, Human
uaaggacacaaaagaaacuggagacc

SEQ ID NO: 144565 - RNA, 22 nt, Human
uacaggcgugagccaccaugcc

SEQ ID NO: 144566 - RNA, 22 nt, Human
uacaggcgugagccaccaugcc

SEQ ID NO: 144567 - RNA, 23 nt, Human
uacaggcgugagccaccaugccu

SEQ ID NO: 144568 - RNA, 20 nt, Human
uagaggccuggcaucuuucu

SEQ ID NO: 144569 - RNA, 23 nt, Human
uagaggccuggcaucuuucuugu

SEQ ID NO: 144570 - RNA, 24 nt, Human
uagaugaacagcaugauucaggua

SEQ ID NO: 144571 - RNA, 25 nt, Human
uauuuuuauugauugaaccuuugac

SEQ ID NO: 144572 - RNA, 24 nt, Human
uccaaacuguuacugucucggccu

SEQ ID NO: 144573 - RNA, 24 nt, Human
ucccaaagugcugggauuacaggc

SEQ ID NO: 144574 - RNA, 21 nt, Human
ucucaccgcugggcucuugaa

SEQ ID NO: 144575 - RNA, 20 nt, Human
ucucggccucccaaagugcu

SEQ ID NO: 144576 - RNA, 19 nt, Human
ugaagcaggaggcgcgagc

SEQ ID NO: 144577 - RNA, 21 nt, Human
ugccacuaucaaagcuuaagu

SEQ ID NO: 144578 - RNA, 24 nt, Human
ugcugggauuacaggcgugagcca

SEQ ID NO: 144579 - RNA, 18 nt, Human
ugggauuacaggcgugag

SEQ ID NO: 144580 - RNA, 22 nt, Human
ugggauuacaggcgugagccac

SEQ ID NO: 144581 - RNA, 23 nt, Human
ugggauuacaggcgugagccacc

SEQ ID NO: 144582 - RNA, 24 nt, Human
ugggauuacaggcgugagccacca

SEQ ID NO: 144583 - RNA, 25 nt, Human
ugggauuacaggcgugagccaccau

SEQ ID NO: 144584 - RNA, 20 nt, Human
uuagaggccuggcaucuuuc

SEQ ID NO: 144585 - RNA, 18 nt, Human
uucucugaauguacugaa

SEQ ID NO: 144586 - RNA, 18 nt, Human
uuuuuuuuuuuuuuuuug

SEQ ID NO: 144587 - RNA, 20 nt, Human
aaaaaaacuccaguuguaga

SEQ ID NO: 144588 - RNA, 24 nt, Human
aacagguuggcacagccccccugc

SEQ ID NO: 144589 - RNA, 18 nt, Human
aaguggccccaagacagg

SEQ ID NO: 144590 - RNA, 21 nt, Human
agcucagcucccacugugccu

SEQ ID NO: 144591 - RNA, 19 nt, Human
agcuuaugccugugguggg

SEQ ID NO: 144592 - RNA, 21 nt, Human
aggaauggugggaaaggaccg

SEQ ID NO: 144593 - RNA, 18 nt, Human
aggcagaauguacacaug

SEQ ID NO: 144594 - RNA, 21 nt, Human
agggggcaucuuugacaagcu

SEQ ID NO: 144595 - RNA, 18 nt, Human
aggucuugcugggagaug

SEQ ID NO: 144596 - RNA, 21 nt, Human
auccacguggccccuuccagc

SEQ ID NO: 144597 - RNA, 18 nt, Human
augggagagaaugcagua

SEQ ID NO: 144598 - RNA, 22 nt, Human
cacagcaacuuauauacagaua

SEQ ID NO: 144599 - RNA, 23 nt, Human
cacagcucuggggagugcugccc

SEQ ID NO: 144600 - RNA, 19 nt, Human
cacaugggcacugcccuua

SEQ ID NO: 144601 - RNA, 18 nt, Human
cacugcccuuacagcuac

SEQ ID NO: 144602 - RNA, 22 nt, Human
cagcccaagcaugcugccucuc

SEQ ID NO: 144603 - RNA, 21 nt, Human
cagccccccugcuggcacagc

SEQ ID NO: 144604 - RNA, 19 nt, Human
ccacuucuuucuccguccc

SEQ ID NO: 144605 - RNA, 20 nt, Human
ccaggaugggagagaaugca

SEQ ID NO: 144606 - RNA, 22 nt, Human
ccaggaugggagagaaugcagu

SEQ ID NO: 144607 - RNA, 21 nt, Human
cccuuccagcucagcucccac

SEQ ID NO: 144608 - RNA, 19 nt, Human
ccuccgaggugaagguggg

SEQ ID NO: 144609 - RNA, 24 nt, Human
ccugcuggcacagcucuggggagu

SEQ ID NO: 144610 - RNA, 21 nt, Human
ccuggcucucuccuggagggg

SEQ ID NO: 144611 - RNA, 26 nt, Human
ccuguggugggagugguucccagggc

SEQ ID NO: 144612 - RNA, 22 nt, Human
cuccuguaccuggcuuccaagc

SEQ ID NO: 144613 - RNA, 21 nt, Human
cugcuaggugauagcuuaugc

SEQ ID NO: 144614 - RNA, 20 nt, Human
cuuaaaggcaggaauggugg

SEQ ID NO: 144615 - RNA, 18 nt, Human
gaacagguuggcacagcc

SEQ ID NO: 144616 - RNA, 22 nt, Human
gagggggcaucuuugacaagcu

SEQ ID NO: 144617 - RNA, 19 nt, Human
gcacagcucuggggagugc

SEQ ID NO: 144618 - RNA, 18 nt, Human
gcgggucuccuauggguc

SEQ ID NO: 144619 - RNA, 19 nt, Human
gcuacacucuaagaacagg

SEQ ID NO: 144620 - RNA, 29 nt, Human
gcuuugcccauccacguggccccuuccaa

SEQ ID NO: 144621 - RNA, 20 nt, Human
ggaccaugccugcacagcuu

SEQ ID NO: 144622 - RNA, 21 nt, Human
ggggcaucuuugacaagcuuu

SEQ ID NO: 144623 - RNA, 21 nt, Human
uaaggccagguguggcauaca

SEQ ID NO: 144624 - RNA, 23 nt, Human
uaaggccagguguggcauacacc

SEQ ID NO: 144625 - RNA, 21 nt, Human
uacacgugggcccugcccuuu

SEQ ID NO: 144626 - RNA, 21 nt, Human
uagaaaucaggacagacacac

SEQ ID NO: 144627 - RNA, 24 nt, Human
uauauacagauacuauacacgugg

SEQ ID NO: 144628 - RNA, 19 nt, Human
ucagcccaagcaugcugcc

SEQ ID NO: 144629 - RNA, 18 nt, Human
ucccagggcugggggcuc

SEQ ID NO: 144630 - RNA, 24 nt, Human
ucccuccgaggugaagguggggau

SEQ ID NO: 144631 - RNA, 18 nt, Human
uccgaggugaaggugggg

SEQ ID NO: 144632 - RNA, 22 nt, Human
uccuguaccuggcuuccaagca

SEQ ID NO: 144633 - RNA, 19 nt, Human
uccuuccgguugaaaaccu

SEQ ID NO: 144634 - RNA, 24 nt, Human
ucuccgucccuccgaggugaaggu

SEQ ID NO: 144635 - RNA, 19 nt, Human
ucuggggagugcugcccca

SEQ ID NO: 144636 - RNA, 23 nt, Human
ucuugcuuuuccuucagucaguu

SEQ ID NO: 144637 - RNA, 20 nt, Human
ucuuuaaggccagguguggc

SEQ ID NO: 144638 - RNA, 25 nt, Human
ugaaaguggccccaagacagguuug

SEQ ID NO: 144639 - RNA, 26 nt, Human
ugaaaguggccccaagacagguuugg

SEQ ID NO: 144640 - RNA, 23 nt, Human
ugagacaaagaacauuguauaaa

SEQ ID NO: 144641 - RNA, 21 nt, Human
ugccugcacagcuuguuucuu

SEQ ID NO: 144642 - RNA, 23 nt, Human
ugccugucccucucuucagccug

SEQ ID NO: 144643 - RNA, 23 nt, Human
ugccuuaagggaccaugccugca

SEQ ID NO: 144644 - RNA, 21 nt, Human
ugcugggagaugcugggucag

SEQ ID NO: 144645 - RNA, 21 nt, Human
uggcacagcucuggggagugc

SEQ ID NO: 144646 - RNA, 22 nt, Human
uggccccaagacagguuuggag

SEQ ID NO: 144647 - RNA, 21 nt, Human
ugggagaugcugggucagccc

SEQ ID NO: 144648 - RNA, 23 nt, Human
ugggagugguucccagggcuggg

SEQ ID NO: 144649 - RNA, 18 nt, Human
ugggggcucugaaagugg

SEQ ID NO: 144650 - RNA, 21 nt, Human
uggguucccacuggcuuucuc

SEQ ID NO: 144651 - RNA, 19 nt, Human
uguggugggagugguuccc

SEQ ID NO: 144652 - RNA, 23 nt, Human
uguggugggagugguucccaggg

SEQ ID NO: 144653 - RNA, 20 nt, Human
aaacauuaccagagccacaa

SEQ ID NO: 144654 - RNA, 24 nt, Human
aaagggagagggcaccaggaguca

SEQ ID NO: 144655 - RNA, 19 nt, Human
aaggggucugaagcugaag

SEQ ID NO: 144656 - RNA, 20 nt, Human
accacaauccuggaaguggg

SEQ ID NO: 144657 - RNA, 23 nt, Human
accagagccacaaggccgcccgg

SEQ ID NO: 144658 - RNA, 22 nt, Human
agucacagccaaagcacuugaa

SEQ ID NO: 144659 - RNA, 22 nt, Human
caaaagaggggccagggggucc

SEQ ID NO: 144660 - RNA, 18 nt, Human
caaacauuaccagagcca

SEQ ID NO: 144661 - RNA, 21 nt, Human
caaagcacuugaaaaaggccc

SEQ ID NO: 144662 - RNA, 21 nt, Human
caagaaaggucaggggguuaa

SEQ ID NO: 144663 - RNA, 23 nt, Human
cacagccaaagcacuugaaaaag

SEQ ID NO: 144664 - RNA, 19 nt, Human
caccccaaugcccaccccu

SEQ ID NO: 144665 - RNA, 22 nt, Human
cacuacagugcccuacgugggg

SEQ ID NO: 144666 - RNA, 18 nt, Human
cacuugaaaaaggcccag

SEQ ID NO: 144667 - RNA, 18 nt, Human
cagagccacaaggccgcc

SEQ ID NO: 144668 - RNA, 19 nt, Human
cagcaggcagugcugcccc

SEQ ID NO: 144669 - RNA, 20 nt, Human
ccacauagggugagcagggc

SEQ ID NO: 144670 - RNA, 24 nt, Human
cccaggggugucuacuugggcgca

SEQ ID NO: 144671 - RNA, 20 nt, Human
cccaucuaguccccucccca

SEQ ID NO: 144672 - RNA, 18 nt, Human
ccccaaugcccaccccuu

SEQ ID NO: 144673 - RNA, 20 nt, Human
ccccaucucuccccccccag

SEQ ID NO: 144674 - RNA, 21 nt, Human
cccccaaguuugguaccaaac

SEQ ID NO: 144675 - RNA, 25 nt, Human
cccccagguguggggggccuagccu

SEQ ID NO: 144676 - RNA, 22 nt, Human
ccccgacugagccccgcgcucc

SEQ ID NO: 144677 - RNA, 23 nt, Human
ccccgccccaucucucccccccc

SEQ ID NO: 144678 - RNA, 24 nt, Human
ccccgccccaucucucccccccca

SEQ ID NO: 144679 - RNA, 23 nt, Human
ccccgcgcucccggcuucuccgc

SEQ ID NO: 144680 - RNA, 19 nt, Human
ccccggagccgccgccgcc

SEQ ID NO: 144681 - RNA, 21 nt, Human
ccccuugccauccuuguccac

SEQ ID NO: 144682 - RNA, 18 nt, Human
cccuuuuuggcccccaag

SEQ ID NO: 144683 - RNA, 21 nt, Human
ccgcccgggacccauggcugu

SEQ ID NO: 144684 - RNA, 22 nt, Human
ccgccgccccccgacugagccc

SEQ ID NO: 144685 - RNA, 20 nt, Human
ccgccgccgccgccgccccc

SEQ ID NO: 144686 - RNA, 23 nt, Human
ccgccgccgccgccgccccccga

SEQ ID NO: 144687 - RNA, 21 nt, Human
ccggagccgccgccgccgccg

SEQ ID NO: 144688 - RNA, 22 nt, Human
ccuuguccacugcccgcccccc

SEQ ID NO: 144689 - RNA, 22 nt, Human
cgcccgggacccauggcugucc

SEQ ID NO: 144690 - RNA, 19 nt, Human
cuaggcccacuaggcuucc

SEQ ID NO: 144691 - RNA, 21 nt, Human
cuggggggacaaagggagagg

SEQ ID NO: 144692 - RNA, 25 nt, Human
cuggggggacaaagggagagggcac

SEQ ID NO: 144693 - RNA, 22 nt, Human
gaccacauagggugagcagggc

SEQ ID NO: 144694 - RNA, 22 nt, Human
gagcaaugggggugccucccac

SEQ ID NO: 144695 - RNA, 19 nt, Human
gagcagggcaagguccugg

SEQ ID NO: 144696 - RNA, 19 nt, Human
gagggcaccaggagucagg

SEQ ID NO: 144697 - RNA, 24 nt, Human
gccccgccccaucucucccccccc

SEQ ID NO: 144698 - RNA, 22 nt, Human
gccuagccugguggggaagggg

SEQ ID NO: 144699 - RNA, 20 nt, Human
ggcucagggcuggaagggag

SEQ ID NO: 144700 - RNA, 18 nt, Human
gggagugggggaggagga

SEQ ID NO: 144701 - RNA, 20 nt, Human
ggggaagggguagagggggc

SEQ ID NO: 144702 - RNA, 22 nt, Human
gggggacaaagggagagggcac

SEQ ID NO: 144703 - RNA, 18 nt, Human
gggggaggaggacgugcu

SEQ ID NO: 144704 - RNA, 18 nt, Human
ggggugccucccacgcuu

SEQ ID NO: 144705 - RNA, 21 nt, Human
gucaagaaaggucaggggguu

SEQ ID NO: 144706 - RNA, 18 nt, Human
guccacugcccgcccccc

SEQ ID NO: 144707 - RNA, 20 nt, Human
guccacugcccgccccccca

SEQ ID NO: 144708 - RNA, 18 nt, Human
gugcugccccuugcccau

SEQ ID NO: 144709 - RNA, 27 nt, Human
uaagagcagaguaugaaagucacagcc

SEQ ID NO: 144710 - RNA, 21 nt, Human
uagacuaagagcagaguauga

SEQ ID NO: 144711 - RNA, 22 nt, Human
uagggugagcagggcaaggucc

SEQ ID NO: 144712 - RNA, 21 nt, Human
uaggugggaccacauagggug

SEQ ID NO: 144713 - RNA, 24 nt, Human
uaguccccuccccauguucugccc

SEQ ID NO: 144714 - RNA, 19 nt, Human
ucugccccuggaggagagc

SEQ ID NO: 144715 - RNA, 20 nt, Human
ugcccuuuuuggcccccaag

SEQ ID NO: 144716 - RNA, 22 nt, Human
ugccuggcaccccaaugcccac

SEQ ID NO: 144717 - RNA, 19 nt, Human
ugcguugcauagguccugu

SEQ ID NO: 144718 - RNA, 24 nt, Human
ugggagaugguucccggcucaggg

SEQ ID NO: 144719 - RNA, 20 nt, Human
ugguggggaaggggucugaa

SEQ ID NO: 144720 - RNA, 22 nt, Human
uucacagaagacaaaagagggg

SEQ ID NO: 144721 - RNA, 21 nt, Human
uuccaagccccgccccaucuc

SEQ ID NO: 144722 - RNA, 24 nt, Human
agaguguccagggcugucuacugc

SEQ ID NO: 144723 - RNA, 21 nt, Human
aggcagggcuucuucuuugcc

SEQ ID NO: 144724 - RNA, 19 nt, Human
auaccaaauccaguccucc

SEQ ID NO: 144725 - RNA, 19 nt, Human
cagaguguccagggcuguc

SEQ ID NO: 144726 - RNA, 26 nt, Human
cagggauccuccuccuccaggggauc

SEQ ID NO: 144727 - RNA, 20 nt, Human
cucugcuucagaguguccag

SEQ ID NO: 144728 - RNA, 21 nt, Human
gagucaccucagacccucuga

SEQ ID NO: 144729 - RNA, 20 nt, Human
gcagggauccuccuccucca

SEQ ID NO: 144730 - RNA, 20 nt, Human
ggaucuugggaggacucugg

SEQ ID NO: 144731 - RNA, 24 nt, Human
ggcagggcuucuucuuugcccugg

SEQ ID NO: 144732 - RNA, 22 nt, Human
ucccaggucuucagccuggggc

SEQ ID NO: 144733 - RNA, 21 nt, Human
uccccuggggagggcaaggug

SEQ ID NO: 144734 - RNA, 19 nt, Human
ugagacccucagagcagcc

SEQ ID NO: 144735 - RNA, 19 nt, Human
ugagacccucagagcagcc

SEQ ID NO: 144736 - RNA, 24 nt, Human
ugaggauuugaucauaccaaaucc

SEQ ID NO: 144737 - RNA, 24 nt, Human
ugagugguuuauugaagguuuggu

SEQ ID NO: 144738 - RNA, 23 nt, Human
ugaucauaccaaauccaguccuc

SEQ ID NO: 144739 - RNA, 21 nt, Human
ugccucugcuucagagugucc

SEQ ID NO: 144740 - RNA, 24 nt, Human
uggcacccccagugcaggcagcag

SEQ ID NO: 144741 - RNA, 25 nt, Human
uggcaugaaauucaaccucaugaag

SEQ ID NO: 144742 - RNA, 19 nt, Human
ugugaugaggggacaggcu

SEQ ID NO: 144743 - RNA, 19 nt, Human
uuugcccugguccagcaau

SEQ ID NO: 144744 - RNA, 24 nt, Human
aaaaaacagaugaaaaugaguugg

SEQ ID NO: 144745 - RNA, 19 nt, Human
aaaaacagugaugauagcc

SEQ ID NO: 144746 - RNA, 21 nt, Human
aaaaagcaacaagaaaauaau

SEQ ID NO: 144747 - RNA, 20 nt, Human
aaaacccuuccgacugccac

SEQ ID NO: 144748 - RNA, 23 nt, Human
aaacaaaaacaaaaacccuuccg

SEQ ID NO: 144749 - RNA, 23 nt, Human
aaacaaaaacaaaaacccuuccg

SEQ ID NO: 144750 - RNA, 24 nt, Human
aaacaaaaacaaaaacccuuccga

SEQ ID NO: 144751 - RNA, 19 nt, Human
aacacaaaagcauuaaaaa

SEQ ID NO: 144752 - RNA, 21 nt, Human
aacacaaaagcauuaaaaaca

SEQ ID NO: 144753 - RNA, 21 nt, Human
aacagcccuggccugccccuu

SEQ ID NO: 144754 - RNA, 19 nt, Human
aacaggguggggggugggg

SEQ ID NO: 144755 - RNA, 20 nt, Human
aagaaguggggguuucccca

SEQ ID NO: 144756 - RNA, 23 nt, Human
aagagcauggggguuaggggcac

SEQ ID NO: 144757 - RNA, 24 nt, Human
aagcaacaagaaaauaauucagag

SEQ ID NO: 144758 - RNA, 25 nt, Human
aagcaccccccuccgaagcccaggg

SEQ ID NO: 144759 - RNA, 18 nt, Human
aagcccagggggcaggga

SEQ ID NO: 144760 - RNA, 23 nt, Human
acaaagccuggggaggggcugcc

SEQ ID NO: 144761 - RNA, 28 nt, Human
acacaaauggcaacagaaacaaaaacaa

SEQ ID NO: 144762 - RNA, 22 nt, Human
acagaaacaaaaacaaaaaccc

SEQ ID NO: 144763 - RNA, 18 nt, Human
acagcagcaggagcuggg

SEQ ID NO: 144764 - RNA, 21 nt, Human
acagcagcaggagcuggguug

SEQ ID NO: 144765 - RNA, 23 nt, Human
accacaucgugccccaggcccuc

SEQ ID NO: 144766 - RNA, 18 nt, Human
accccauugccaggauaa

SEQ ID NO: 144767 - RNA, 23 nt, Human
acccugggccucuguuuccccac

SEQ ID NO: 144768 - RNA, 23 nt, Human
accucaccucccuccacccccca

SEQ ID NO: 144769 - RNA, 26 nt, Human
accucaccucccuccaccccccauga

SEQ ID NO: 144770 - RNA, 19 nt, Human
agcccaagacugggacagc

SEQ ID NO: 144771 - RNA, 23 nt, Human
agcgggcuggcccagccccaggc

SEQ ID NO: 144772 - RNA, 20 nt, Human
agcucgccucgccuuccucu

SEQ ID NO: 144773 - RNA, 21 nt, Human
aggagcuggguuggguggggg

SEQ ID NO: 144774 - RNA, 19 nt, Human
aggagggucaggaggggag

SEQ ID NO: 144775 - RNA, 24 nt, Human
aggcagccucuuccucuuuccagg

SEQ ID NO: 144776 - RNA, 19 nt, Human
agggaggggcagggccagg

SEQ ID NO: 144777 - RNA, 20 nt, Human
agggaggggcagggccaggg

SEQ ID NO: 144778 - RNA, 30 nt, Human
agggauuuuugugugugugugugugugugg

SEQ ID NO: 144779 - RNA, 20 nt, Human
aggggagggggugugggggc

SEQ ID NO: 144780 - RNA, 23 nt, Human
aggggcagggccaggggacuguc

SEQ ID NO: 144781 - RNA, 21 nt, Human
agggggugugggggcgaaagg

SEQ ID NO: 144782 - RNA, 20 nt, Human
agggucaggaggggagggug

SEQ ID NO: 144783 - RNA, 27 nt, Human
agguaaggagagaacaggguggggggu

SEQ ID NO: 144784 - RNA, 20 nt, Human
agguggauggugugagggcc

SEQ ID NO: 144785 - RNA, 20 nt, Human
agugacuaccccauugccag

SEQ ID NO: 144786 - RNA, 25 nt, Human
auggcaacagaaacaaaaacaaaaa

SEQ ID NO: 144787 - RNA, 20 nt, Human
caaagcucgccucgccuucc

SEQ ID NO: 144788 - RNA, 25 nt, Human
caaagcucgccucgccuuccucugc

SEQ ID NO: 144789 - RNA, 18 nt, Human
caaauagccaccugggca

SEQ ID NO: 144790 - RNA, 23 nt, Human
caacagaaacaaaaacaaaaacc

SEQ ID NO: 144791 - RNA, 23 nt, Human
caacagaaacaaaaacaaaaacc

SEQ ID NO: 144792 - RNA, 20 nt, Human
caagaaacuacaaaacuaaa

SEQ ID NO: 144793 - RNA, 22 nt, Human
caaggggagggggugugggggc

SEQ ID NO: 144794 - RNA, 23 nt, Human
cacaaaagcauuaaaaacaguga

SEQ ID NO: 144795 - RNA, 20 nt, Human
cacaaaccucccacugcugu

SEQ ID NO: 144796 - RNA, 23 nt, Human
cacaagcaccccccuccgaagcc

SEQ ID NO: 144797 - RNA, 22 nt, Human
caccagaaauaccaaggaaucu

SEQ ID NO: 144798 - RNA, 19 nt, Human
caccuggaaggggcuggcu

SEQ ID NO: 144799 - RNA, 18 nt, Human
cagaaacaaaaacaaaaa

SEQ ID NO: 144800 - RNA, 20 nt, Human
cagaaacaaaaacaaaaacc

SEQ ID NO: 144801 - RNA, 22 nt, Human
cagcagcaggagcuggguuggg

SEQ ID NO: 144802 - RNA, 21 nt, Human
cagcaggagcuggguugggug

SEQ ID NO: 144803 - RNA, 24 nt, Human
cagccucuuccucuuuccaggccc

SEQ ID NO: 144804 - RNA, 18 nt, Human
cagcgggcuggcccagcc

SEQ ID NO: 144805 - RNA, 23 nt, Human
caggagaugcccaagaaucccac

SEQ ID NO: 144806 - RNA, 22 nt, Human
caggccaccuggucuuauaccc

SEQ ID NO: 144807 - RNA, 18 nt, Human
caggcccucuuguacugg

SEQ ID NO: 144808 - RNA, 21 nt, Human
cagggggcagggaaaaagggg

SEQ ID NO: 144809 - RNA, 18 nt, Human
cagggugggggguggggg

SEQ ID NO: 144810 - RNA, 20 nt, Human
cagugaugauagcggacaag

SEQ ID NO: 144811 - RNA, 21 nt, Human
caguguccagcccugccuucc

SEQ ID NO: 144812 - RNA, 20 nt, Human
cauccuaugcuuccuggcug

SEQ ID NO: 144813 - RNA, 21 nt, Human
ccaaaaagacuaguauuuaca

SEQ ID NO: 144814 - RNA, 22 nt, Human
ccacacugggacuccgggcuac

SEQ ID NO: 144815 - RNA, 22 nt, Human
ccaccuggaaggggcuggcugu

SEQ ID NO: 144816 - RNA, 22 nt, Human
ccaccuggucuuauacccgcuu

SEQ ID NO: 144817 - RNA, 18 nt, Human
ccacugcuguccagcucg

SEQ ID NO: 144818 - RNA, 19 nt, Human
ccagcccugccuuccaaga

SEQ ID NO: 144819 - RNA, 26 nt, Human
cccaagacugggacagcagcaggagc

SEQ ID NO: 144820 - RNA, 26 nt, Human
cccaccaggccaaaggaugccaaagg

SEQ ID NO: 144821 - RNA, 27 nt, Human
cccacugcuguccagcucgcauagacu

SEQ ID NO: 144822 - RNA, 20 nt, Human
cccagaggccuggccagagg

SEQ ID NO: 144823 - RNA, 25 nt, Human
cccagccccaggcagccucuuccuc

SEQ ID NO: 144824 - RNA, 18 nt, Human
cccauccuccgcagccgc

SEQ ID NO: 144825 - RNA, 23 nt, Human
ccccaggcccucuuguacuggcu

SEQ ID NO: 144826 - RNA, 27 nt, Human
ccccaggcccucuuguacuggcuuggg

SEQ ID NO: 144827 - RNA, 20 nt, Human
cccccacggagcccagaggc

SEQ ID NO: 144828 - RNA, 18 nt, Human
cccccgggugaucccgcc

SEQ ID NO: 144829 - RNA, 24 nt, Human
cccccgggugaucccgcccgauuc

SEQ ID NO: 144830 - RNA, 19 nt, Human
ccccgggcucccgacuggg

SEQ ID NO: 144831 - RNA, 21 nt, Human
cccggccggccaggaggacuc

SEQ ID NO: 144832 - RNA, 18 nt, Human
cccuccgcugccgcugug

SEQ ID NO: 144833 - RNA, 24 nt, Human
ccgaagccucggccggguagcccg

SEQ ID NO: 144834 - RNA, 21 nt, Human
ccgccccgacgccucgaccgu

SEQ ID NO: 144835 - RNA, 19 nt, Human
ccgcugccgcacgaggcgc

SEQ ID NO: 144836 - RNA, 19 nt, Human
ccugcagcagcucuccugu

SEQ ID NO: 144837 - RNA, 22 nt, Human
ccugcagcagcucuccuguucc

SEQ ID NO: 144838 - RNA, 20 nt, Human
ccuggggaggggcugccuuu

SEQ ID NO: 144839 - RNA, 19 nt, Human
ccugugcuagggcccagaa

SEQ ID NO: 144840 - RNA, 21 nt, Human
cgagggcucguucuccugggc

SEQ ID NO: 144841 - RNA, 24 nt, Human
cgcccccaacccgggcaugggcuu

SEQ ID NO: 144842 - RNA, 25 nt, Human
cgccuccucaccaaagcucgccucg

SEQ ID NO: 144843 - RNA, 23 nt, Human
cggcagccucgcgucgccgaguc

SEQ ID NO: 144844 - RNA, 20 nt, Human
cggugaccgccccgacgccu

SEQ ID NO: 144845 - RNA, 23 nt, Human
cgugccccaggcccucuuguacu

SEQ ID NO: 144846 - RNA, 22 nt, Human
cuaccccauugccaggauaagc

SEQ ID NO: 144847 - RNA, 19 nt, Human
cucacaaaccucccacugc

SEQ ID NO: 144848 - RNA, 24 nt, Human
cucacaaaccucccacugcugucc

SEQ ID NO: 144849 - RNA, 21 nt, Human
cucaccucccuccacccccca

SEQ ID NO: 144850 - RNA, 21 nt, Human
cucacugggcagccgccccca

SEQ ID NO: 144851 - RNA, 24 nt, Human
cucacugggcagccgcccccaacc

SEQ ID NO: 144852 - RNA, 20 nt, Human
cucauuuuuuucuaagaaaa

SEQ ID NO: 144853 - RNA, 25 nt, Human
cuccacccugggccucuguuucccc

SEQ ID NO: 144854 - RNA, 21 nt, Human
cugcgcgcccucuccccgacg

SEQ ID NO: 144855 - RNA, 23 nt, Human
cuggcccagccccaggcagccuc

SEQ ID NO: 144856 - RNA, 18 nt, Human
cugggccucuguuucccc

SEQ ID NO: 144857 - RNA, 23 nt, Human
cuucggggcugcgcgcccucucc

SEQ ID NO: 144858 - RNA, 24 nt, Human
cuucuccgcccggccggccaggag

SEQ ID NO: 144859 - RNA, 21 nt, Human
gaaauaccaaggaaucuauaa

SEQ ID NO: 144860 - RNA, 18 nt, Human
gacagcagcaggagcugg

SEQ ID NO: 144861 - RNA, 18 nt, Human
gagcaggccaccuggucu

SEQ ID NO: 144862 - RNA, 24 nt, Human
gagccagucccauuaguuugcgcc

SEQ ID NO: 144863 - RNA, 24 nt, Human
gagcuggguuggguggggguuacc

SEQ ID NO: 144864 - RNA, 22 nt, Human
gagggucaggaggggagggugg

SEQ ID NO: 144865 - RNA, 21 nt, Human
gaugccaaagguaaggagaga

SEQ ID NO: 144866 - RNA, 19 nt, Human
gauuauaaaagccaagaaa

SEQ ID NO: 144867 - RNA, 26 nt, Human
gcaccucaccucccuccaccccccau

SEQ ID NO: 144868 - RNA, 24 nt, Human
gcacuggggugggcagcuggccag

SEQ ID NO: 144869 - RNA, 21 nt, Human
gcagggaaaaagggggauuau

SEQ ID NO: 144870 - RNA, 19 nt, Human
gccuggggaggggcugccu

SEQ ID NO: 144871 - RNA, 19 nt, Human
gcgcccccgggugaucccg

SEQ ID NO: 144872 - RNA, 20 nt, Human
gcuagggcccagaaaaggag

SEQ ID NO: 144873 - RNA, 21 nt, Human
gcucccucucccaccuggcac

SEQ ID NO: 144874 - RNA, 21 nt, Human
ggaaaaagggggauuauaaaa

SEQ ID NO: 144875 - RNA, 20 nt, Human
ggagagaacagggugggggg

SEQ ID NO: 144876 - RNA, 19 nt, Human
ggagcccagaggccuggcc

SEQ ID NO: 144877 - RNA, 24 nt, Human
ggcacuggggugggcagcuggcca

SEQ ID NO: 144878 - RNA, 19 nt, Human
ggccaaaggaugccaaagg

SEQ ID NO: 144879 - RNA, 20 nt, Human
ggcuccguuccuccgggcca

SEQ ID NO: 144880 - RNA, 23 nt, Human
ggcugccuuuuacauuuuuccau

SEQ ID NO: 144881 - RNA, 23 nt, Human
gggauuuuugugugugugugugu

SEQ ID NO: 144882 - RNA, 19 nt, Human
gggcccagaaaaggagcag

SEQ ID NO: 144883 - RNA, 20 nt, Human
gggcgagggaggggcagggc

SEQ ID NO: 144884 - RNA, 21 nt, Human
gggcucccgacugggccgccc

SEQ ID NO: 144885 - RNA, 21 nt, Human
ggggcgagggaggggcagggc

SEQ ID NO: 144886 - RNA, 19 nt, Human
gggggcagggaaaaagggg

SEQ ID NO: 144887 - RNA, 20 nt, Human
gggggugaaacucccagcuc

SEQ ID NO: 144888 - RNA, 24 nt, Human
gggugugggggcgaaaggagaggu

SEQ ID NO: 144889 - RNA, 18 nt, Human
gguaaggagagaacaggg

SEQ ID NO: 144890 - RNA, 21 nt, Human
gguuaggggcacaagcacccc

SEQ ID NO: 144891 - RNA, 26 nt, Human
guccaucaguguccagcccugccuuc

SEQ ID NO: 144892 - RNA, 21 nt, Human
gugugugugugugugugugug

SEQ ID NO: 144893 - RNA, 20 nt, Human
uaaaagccaagaaacuacaa

SEQ ID NO: 144894 - RNA, 20 nt, Human
uagaagagcggggagaugcu

SEQ ID NO: 144895 - RNA, 19 nt, Human
uagccaccugggcaccuca

SEQ ID NO: 144896 - RNA, 20 nt, Human
uauaaaagccaagaaacuac

SEQ ID NO: 144897 - RNA, 24 nt, Human
ucacugggcagccgcccccaaccc

SEQ ID NO: 144898 - RNA, 21 nt, Human
ucaggcgcccauccuccgcag

SEQ ID NO: 144899 - RNA, 22 nt, Human
ucaucugccugcagcagcucuc

SEQ ID NO: 144900 - RNA, 19 nt, Human
uccaggccccagcccaaga

SEQ ID NO: 144901 - RNA, 24 nt, Human
uccaucaguguccagcccugccuu

SEQ ID NO: 144902 - RNA, 23 nt, Human
uccccacagcacaagcucggucc

SEQ ID NO: 144903 - RNA, 24 nt, Human
ucccgggggcagacugcacuucgg

SEQ ID NO: 144904 - RNA, 20 nt, Human
ucccuccgcugccgcugugc

SEQ ID NO: 144905 - RNA, 21 nt, Human
ucccuuggcgccuccucacca

SEQ ID NO: 144906 - RNA, 19 nt, Human
uccuccgggccacacuggg

SEQ ID NO: 144907 - RNA, 18 nt, Human
uccucugccgcgcugcgc

SEQ ID NO: 144908 - RNA, 25 nt, Human
uccuggcucccgggcgaucgagccc

SEQ ID NO: 144909 - RNA, 21 nt, Human
ucgggggccugaggccgugcc

SEQ ID NO: 144910 - RNA, 24 nt, Human
ucuaagaaaaaagcaacaagaaaa

SEQ ID NO: 144911 - RNA, 18 nt, Human
ucucccugccugcugucc

SEQ ID NO: 144912 - RNA, 24 nt, Human
ucuccugggcucuccgcugccgca

SEQ ID NO: 144913 - RNA, 23 nt, Human
ugaccacaucgugccccaggccc

SEQ ID NO: 144914 - RNA, 20 nt, Human
ugcccaguggcacuuuccuc

SEQ ID NO: 144915 - RNA, 19 nt, Human
ugccccaggcccucuugua

SEQ ID NO: 144916 - RNA, 22 nt, Human
ugcuguccaucaguguccagcc

SEQ ID NO: 144917 - RNA, 23 nt, Human
uggcaacagaaacaaaaacaaaa

SEQ ID NO: 144918 - RNA, 23 nt, Human
uggcacuggggugggcagcuggc

SEQ ID NO: 144919 - RNA, 21 nt, Human
ugggacagcagcaggagcugg

SEQ ID NO: 144920 - RNA, 23 nt, Human
ugggcagcuggccaggaggcagu

SEQ ID NO: 144921 - RNA, 21 nt, Human
ugggcgugaacagcccuggcc

SEQ ID NO: 144922 - RNA, 21 nt, Human
uggggugggcagcuggccagg

SEQ ID NO: 144923 - RNA, 22 nt, Human
ugugcuagggcccagaaaagga

SEQ ID NO: 144924 - RNA, 18 nt, Human
ugugugugugugugugug

SEQ ID NO: 144925 - RNA, 18 nt, Human
ugugugugugugugugug

SEQ ID NO: 144926 - RNA, 18 nt, Human
ugugugugugugugugug

SEQ ID NO: 144927 - RNA, 18 nt, Human
ugugugugugugugugug

SEQ ID NO: 144928 - RNA, 18 nt, Human
ugugugugugugugugug

SEQ ID NO: 144929 - RNA, 18 nt, Human
ugugugugugugugugug

SEQ ID NO: 144930 - RNA, 23 nt, Human
uguguguguguguguguggaagg

SEQ ID NO: 144931 - RNA, 21 nt, Human
ugugugugugugugugugugu

SEQ ID NO: 144932 - RNA, 21 nt, Human
ugugugugugugugugugugu

SEQ ID NO: 144933 - RNA, 21 nt, Human
ugugugugugugugugugugu

SEQ ID NO: 144934 - RNA, 21 nt, Human
ugugugugugugugugugugu

SEQ ID NO: 144935 - RNA, 21 nt, Human
ugugugugugugugugugugu

SEQ ID NO: 144936 - RNA, 21 nt, Human
ugugugugugugugugugugu

SEQ ID NO: 144937 - RNA, 21 nt, Human
ugugugugugugugugugugu

SEQ ID NO: 144938 - RNA, 21 nt, Human
ugugugugugugugugugugu

SEQ ID NO: 144939 - RNA, 21 nt, Human
ugugugugugugugugugugu

SEQ ID NO: 144940 - RNA, 21 nt, Human
ugugugugugugugugugugu

SEQ ID NO: 144941 - RNA, 22 nt, Human
ugugugugugugugugugugug

SEQ ID NO: 144942 - RNA, 22 nt, Human
ugugugugugugugugugugug

SEQ ID NO: 144943 - RNA, 22 nt, Human
ugugugugugugugugugugug

SEQ ID NO: 144944 - RNA, 18 nt, Human
uguucugcucccucuccc

SEQ ID NO: 144945 - RNA, 25 nt, Human
uguucugcucccucucccaccuggc

SEQ ID NO: 144946 - RNA, 19 nt, Human
uuagcagccgugcuggcaa

SEQ ID NO: 144947 - RNA, 19 nt, Human
uuccgcucgacuucccgag

SEQ ID NO: 144948 - RNA, 24 nt, Human
uuuccaaaaagacuaguauuuaca

SEQ ID NO: 144949 - RNA, 24 nt, Human
uuugugugugugugugugugugug

SEQ ID NO: 144950 - RNA, 22 nt, Human
aaauacguccuaucuuccuucu

SEQ ID NO: 144951 - RNA, 24 nt, Human
aacgaugaugauggaauuacagcc

SEQ ID NO: 144952 - RNA, 19 nt, Human
aagcuguccagcgcgacgg

SEQ ID NO: 144953 - RNA, 26 nt, Human
aaggaggaaccuggggggagggggau

SEQ ID NO: 144954 - RNA, 23 nt, Human
acccugcagcccuggcacccgga

SEQ ID NO: 144955 - RNA, 25 nt, Human
acuuccgucuuaaggacucuaagag

SEQ ID NO: 144956 - RNA, 22 nt, Human
agccagcccuuuccccagcccc

SEQ ID NO: 144957 - RNA, 23 nt, Human
auccaaagcagaccgacucuccu

SEQ ID NO: 144958 - RNA, 21 nt, Human
caaaugaauuucacaucuucu

SEQ ID NO: 144959 - RNA, 19 nt, Human
caccgggcgcugcaggcuc

SEQ ID NO: 144960 - RNA, 20 nt, Human
cacugugugugcugucgugu

SEQ ID NO: 144961 - RNA, 20 nt, Human
cagcagcagugagcugcaag

SEQ ID NO: 144962 - RNA, 19 nt, Human
cagccagcccuuuccccag

SEQ ID NO: 144963 - RNA, 23 nt, Human
caguaccgacccugcagcccugg

SEQ ID NO: 144964 - RNA, 23 nt, Human
cccaacgcagaaauaaacgccgg

SEQ ID NO: 144965 - RNA, 26 nt, Human
ccccuggacaucauaauuuacuuccg

SEQ ID NO: 144966 - RNA, 22 nt, Human
cccuucccuccaagccuguucc

SEQ ID NO: 144967 - RNA, 18 nt, Human
ccgacccugcagcccugg

SEQ ID NO: 144968 - RNA, 18 nt, Human
ccuacagcucggagcugu

SEQ ID NO: 144969 - RNA, 18 nt, Human
ccucugggaaagcacagg

SEQ ID NO: 144970 - RNA, 18 nt, Human
ccuggggcaccugccagg

SEQ ID NO: 144971 - RNA, 18 nt, Human
ccuguguuuaauaaaaug

SEQ ID NO: 144972 - RNA, 19 nt, Human
cgggacauuagguguccuc

SEQ ID NO: 144973 - RNA, 27 nt, Human
cguccuaucuuccuucucccccuggac

SEQ ID NO: 144974 - RNA, 21 nt, Human
cuacuuucucccuucccucca

SEQ ID NO: 144975 - RNA, 25 nt, Human
cucagcaaaaccaaagugcugugcu

SEQ ID NO: 144976 - RNA, 18 nt, Human
cucccccuggacaucaua

SEQ ID NO: 144977 - RNA, 22 nt, Human
cugaagcuguuguugccagcgg

SEQ ID NO: 144978 - RNA, 22 nt, Human
gacagcaccgcauaaaccaaag

SEQ ID NO: 144979 - RNA, 27 nt, Human
gaggggaaggaggaaccuggggggagg

SEQ ID NO: 144980 - RNA, 26 nt, Human
gauuuggcucucugcuauucuccuaa

SEQ ID NO: 144981 - RNA, 24 nt, Human
gcauaaaccaaagugucguaaggc

SEQ ID NO: 144982 - RNA, 20 nt, Human
gccagcccuuuccccagccc

SEQ ID NO: 144983 - RNA, 18 nt, Human
gcggcuggaggaggggac

SEQ ID NO: 144984 - RNA, 21 nt, Human
ggaaggaggaaccugggggga

SEQ ID NO: 144985 - RNA, 19 nt, Human
ggacauuagguguccucug

SEQ ID NO: 144986 - RNA, 18 nt, Human
ggaggaaccuggggggag

SEQ ID NO: 144987 - RNA, 21 nt, Human
ggaggaaccuggggggagggg

SEQ ID NO: 144988 - RNA, 21 nt, Human
ggcaccugccaggaugcucac

SEQ ID NO: 144989 - RNA, 20 nt, Human
ggcgcugcaggcuccaucag

SEQ ID NO: 144990 - RNA, 21 nt, Human
ggcuucgaggaggagacgugg

SEQ ID NO: 144991 - RNA, 22 nt, Human
gggaaggaggaaccugggggga

SEQ ID NO: 144992 - RNA, 25 nt, Human
gggaggggaaggaggaaccuggggg

SEQ ID NO: 144993 - RNA, 18 nt, Human
gguguccucugggaaagc

SEQ ID NO: 144994 - RNA, 23 nt, Human
guccuaucuuccuucucccccug

SEQ ID NO: 144995 - RNA, 21 nt, Human
uaaaaaaucauccaaagcaga

SEQ ID NO: 144996 - RNA, 21 nt, Human
uaaaaaaucauccaaagcaga

SEQ ID NO: 144997 - RNA, 21 nt, Human
uaauugccacaaaugaauuuc

SEQ ID NO: 144998 - RNA, 19 nt, Human
uaccacaacaguccugccc

SEQ ID NO: 144999 - RNA, 22 nt, Human
uagcccgagguccgugugacaa

SEQ ID NO: 145000 - RNA, 19 nt, Human
ucagcggccuacuuucucc

SEQ ID NO: 145001 - RNA, 19 nt, Human
ucccaacaauacccgucuu

SEQ ID NO: 145002 - RNA, 21 nt, Human
uccccaugcacuggaauccac

SEQ ID NO: 145003 - RNA, 25 nt, Human
uccccaugcacuggaauccacugug

SEQ ID NO: 145004 - RNA, 19 nt, Human
uccugcacaucgcuauuug

SEQ ID NO: 145005 - RNA, 22 nt, Human
uccugcacaucgcuauuugaua

SEQ ID NO: 145006 - RNA, 18 nt, Human
uccugcucuguggggcuc

SEQ ID NO: 145007 - RNA, 20 nt, Human
ucgaucucagcaaaaccaaa

SEQ ID NO: 145008 - RNA, 20 nt, Human
ucgggaggggaaggaggaac

SEQ ID NO: 145009 - RNA, 20 nt, Human
ucuagagaacacuucagccc

SEQ ID NO: 145010 - RNA, 23 nt, Human
ucuaugaacggauuacccaugga

SEQ ID NO: 145011 - RNA, 19 nt, Human
ugaacggauuacccaugga

SEQ ID NO: 145012 - RNA, 22 nt, Human
ugaccuaccuuuuauagauaag

SEQ ID NO: 145013 - RNA, 19 nt, Human
ugcugcagagcccugggua

SEQ ID NO: 145014 - RNA, 22 nt, Human
uggaguggaggucucaggugag

SEQ ID NO: 145015 - RNA, 18 nt, Human
uggcacccggacagcacc

SEQ ID NO: 145016 - RNA, 20 nt, Human
uggcucucugcuauucuccu

SEQ ID NO: 145017 - RNA, 23 nt, Human
uggcuucgaggaggagacguggg

SEQ ID NO: 145018 - RNA, 18 nt, Human
ugggacgcggcacagcag

SEQ ID NO: 145019 - RNA, 19 nt, Human
uggggggagggggaucuga

SEQ ID NO: 145020 - RNA, 22 nt, Human
uguguaucuuauugccaguacc

SEQ ID NO: 145021 - RNA, 18 nt, Human
uuccccagccccacuccc

SEQ ID NO: 145022 - RNA, 22 nt, Human
uuccgaggaggagugucccucu

SEQ ID NO: 145023 - RNA, 21 nt, Human
uuggcuucugcagaggccuga

SEQ ID NO: 145024 - RNA, 20 nt, Human
uuuccccagccccacucccu

SEQ ID NO: 145025 - RNA, 22 nt, Human
uuuuaagcgcugagcauuggga

SEQ ID NO: 145026 - RNA, 23 nt, Human
aaaauaaggccaucuaauucuga

SEQ ID NO: 145027 - RNA, 22 nt, Human
aaagaaaacagcuugauuuugc

SEQ ID NO: 145028 - RNA, 19 nt, Human
aaagagcaaacaaaagcac

SEQ ID NO: 145029 - RNA, 20 nt, Human
aaagcacuguugucccaauu

SEQ ID NO: 145030 - RNA, 18 nt, Human
aaaucaguuucuaaauua

SEQ ID NO: 145031 - RNA, 19 nt, Human
aacacaauuuacaaagcac

SEQ ID NO: 145032 - RNA, 20 nt, Human
aaccagugugacugucugcu

SEQ ID NO: 145033 - RNA, 22 nt, Human
aagauuucuuuaucuauguuuc

SEQ ID NO: 145034 - RNA, 18 nt, Human
acgauuccucucccaaca

SEQ ID NO: 145035 - RNA, 23 nt, Human
acuuuguaacugaccaaaccagu

SEQ ID NO: 145036 - RNA, 21 nt, Human
agaaaacagcuugauuuugau

SEQ ID NO: 145037 - RNA, 19 nt, Human
agaggaaaaagaaaggaag

SEQ ID NO: 145038 - RNA, 21 nt, Human
agaggaaaaagaaaggaagaa

SEQ ID NO: 145039 - RNA, 23 nt, Human
auugauucaucacaacucauuuu

SEQ ID NO: 145040 - RNA, 19 nt, Human
caaaagcacaacuacguau

SEQ ID NO: 145041 - RNA, 21 nt, Human
caaaaucaucagcauggacca

SEQ ID NO: 145042 - RNA, 21 nt, Human
caaacaaaagcacaacuacgu

SEQ ID NO: 145043 - RNA, 22 nt, Human
caaacaaaagcacaacuacgua

SEQ ID NO: 145044 - RNA, 24 nt, Human
caaauucugugcaaucacaccaag

SEQ ID NO: 145045 - RNA, 21 nt, Human
caguaagaaauaccugacacc

SEQ ID NO: 145046 - RNA, 23 nt, Human
caguaaugacuaagaaacuccga

SEQ ID NO: 145047 - RNA, 21 nt, Human
caucacaacucauuuuggcaa

SEQ ID NO: 145048 - RNA, 18 nt, Human
ccaaaccagugugacugg

SEQ ID NO: 145049 - RNA, 19 nt, Human
ccucagcccuggggcaucu

SEQ ID NO: 145050 - RNA, 23 nt, Human
cuccaagcucuuucuucaacuga

SEQ ID NO: 145051 - RNA, 22 nt, Human
cuuagagaggaaaaagaaagga

SEQ ID NO: 145052 - RNA, 25 nt, Human
gacaguaaugacuaagaaacuccga

SEQ ID NO: 145053 - RNA, 18 nt, Human
gagaggaaaaagaaagga

SEQ ID NO: 145054 - RNA, 23 nt, Human
gagaggaaaaagaaaggaagaac

SEQ ID NO: 145055 - RNA, 19 nt, Human
ggagauacgauuccucucc

SEQ ID NO: 145056 - RNA, 20 nt, Human
ggaggccucagcccuggggc

SEQ ID NO: 145057 - RNA, 18 nt, Human
guccuccaagcucuuucu

SEQ ID NO: 145058 - RNA, 19 nt, Human
guugugcuguuguccucca

SEQ ID NO: 145059 - RNA, 19 nt, Human
uaaaagagcaaacaaaagc

SEQ ID NO: 145060 - RNA, 20 nt, Human
uaaaagagcaaacaaaagca

SEQ ID NO: 145061 - RNA, 22 nt, Human
uaaaagagcaaacaaaagcaca

SEQ ID NO: 145062 - RNA, 25 nt, Human
uaaaugccuacacuguaucuuaacg

SEQ ID NO: 145063 - RNA, 18 nt, Human
uacauacaaauucugugc

SEQ ID NO: 145064 - RNA, 21 nt, Human
uagagaggaaaaagaaaggaa

SEQ ID NO: 145065 - RNA, 21 nt, Human
ucacaccaagagggaaaauuc

SEQ ID NO: 145066 - RNA, 20 nt, Human
ucacugugacagagcaaggc

SEQ ID NO: 145067 - RNA, 23 nt, Human
ucuauaaugaaaacaaaucaggc

SEQ ID NO: 145068 - RNA, 18 nt, Human
ucuauuuguauugacugc

SEQ ID NO: 145069 - RNA, 19 nt, Human
ucuccuguugugcuguugu

SEQ ID NO: 145070 - RNA, 22 nt, Human
ugaaagaagaaauauggagaua

SEQ ID NO: 145071 - RNA, 18 nt, Human
ugaacuuucaaaagaaaa

SEQ ID NO: 145072 - RNA, 24 nt, Human
ugaacuuucaaaagaaaacagcuu

SEQ ID NO: 145073 - RNA, 23 nt, Human
ugaagaaaucaguuucuaaauua

SEQ ID NO: 145074 - RNA, 18 nt, Human
ugacuaagaaacuccgaa

SEQ ID NO: 145075 - RNA, 21 nt, Human
ugagacugcuuaaaagagcaa

SEQ ID NO: 145076 - RNA, 30 nt, Human
ugccugagcggaggccucagcccuggggcc

SEQ ID NO: 145077 - RNA, 18 nt, Human
uggggcugcaggaacaac

SEQ ID NO: 145078 - RNA, 24 nt, Human
uguauugacugcugaagacaacac

SEQ ID NO: 145079 - RNA, 18 nt, Human
uguccagaucaaagaaau

SEQ ID NO: 145080 - RNA, 18 nt, Human
ugugacugucugcuuuaa

SEQ ID NO: 145081 - RNA, 19 nt, Human
uucaucguugucuauaaug

SEQ ID NO: 145082 - RNA, 20 nt, Human
uucuugacuuuccuuuuaau

SEQ ID NO: 145083 - RNA, 23 nt, Human
aaguguccuucucaguggucacc

SEQ ID NO: 145084 - RNA, 18 nt, Human
aaucccagccccgggauc

SEQ ID NO: 145085 - RNA, 18 nt, Human
agagccgcggggagagcg

SEQ ID NO: 145086 - RNA, 19 nt, Human
agcccgcaggagccugcag

SEQ ID NO: 145087 - RNA, 19 nt, Human
agcgggacuuccucagccc

SEQ ID NO: 145088 - RNA, 21 nt, Human
aggagaugacaggcagcuucc

SEQ ID NO: 145089 - RNA, 22 nt, Human
augugcaguggcccauaaauac

SEQ ID NO: 145090 - RNA, 20 nt, Human
cacagcccuccacggcccuc

SEQ ID NO: 145091 - RNA, 19 nt, Human
caccaaaggccaggguccc

SEQ ID NO: 145092 - RNA, 22 nt, Human
caccagccuccaagagcgacag

SEQ ID NO: 145093 - RNA, 26 nt, Human
caccuguccucaguccaacucagagc

SEQ ID NO: 145094 - RNA, 23 nt, Human
cagcccaggcccagagcgugccc

SEQ ID NO: 145095 - RNA, 19 nt, Human
cagccuccaagagcgacag

SEQ ID NO: 145096 - RNA, 22 nt, Human
cagggccuagcaccaaaaagcc

SEQ ID NO: 145097 - RNA, 19 nt, Human
caggguccccucuggcugg

SEQ ID NO: 145098 - RNA, 21 nt, Human
ccaaaggccaggguccccucu

SEQ ID NO: 145099 - RNA, 25 nt, Human
ccagcggccaugcgaggcuucccuc

SEQ ID NO: 145100 - RNA, 19 nt, Human
ccagcugaucccagggcug

SEQ ID NO: 145101 - RNA, 21 nt, Human
ccagcugaucccagggcugca

SEQ ID NO: 145102 - RNA, 25 nt, Human
ccagucccagggccuagcaccaaaa

SEQ ID NO: 145103 - RNA, 26 nt, Human
cccacaccuguccucaguccaacuca

SEQ ID NO: 145104 - RNA, 22 nt, Human
ccccucuggcugggacuggaga

SEQ ID NO: 145105 - RNA, 24 nt, Human
ccccucuggcugggacuggagagg

SEQ ID NO: 145106 - RNA, 19 nt, Human
cccgggauccgcuccgcuc

SEQ ID NO: 145107 - RNA, 21 nt, Human
ccgcuccgcucggcgccgccc

SEQ ID NO: 145108 - RNA, 21 nt, Human
ccggcggccgggcgacggggc

SEQ ID NO: 145109 - RNA, 22 nt, Human
ccucaaggccacaccagccucc

SEQ ID NO: 145110 - RNA, 23 nt, Human
ccucuggcugggacuggagaggc

SEQ ID NO: 145111 - RNA, 24 nt, Human
ccuuuaccuuccuagguuuacaug

SEQ ID NO: 145112 - RNA, 21 nt, Human
cgacuuccagucccagggccu

SEQ ID NO: 145113 - RNA, 19 nt, Human
cucaaggccacaccagccu

SEQ ID NO: 145114 - RNA, 21 nt, Human
cuggggauugggcaggagaug

SEQ ID NO: 145115 - RNA, 20 nt, Human
cuuccuagguuuacauggua

SEQ ID NO: 145116 - RNA, 21 nt, Human
gcaccaaaaagccugccugga

SEQ ID NO: 145117 - RNA, 19 nt, Human
gcccagagcgugccccugg

SEQ ID NO: 145118 - RNA, 18 nt, Human
gcccugugccugcaccug

SEQ ID NO: 145119 - RNA, 20 nt, Human
gccugcacccacacuggcgc

SEQ ID NO: 145120 - RNA, 22 nt, Human
gccugcacccacacuggcgccc

SEQ ID NO: 145121 - RNA, 20 nt, Human
gcgccgcccgggagccgcuc

SEQ ID NO: 145122 - RNA, 20 nt, Human
gcgggacuuccucagcccag

SEQ ID NO: 145123 - RNA, 19 nt, Human
gcucugggccgggcgcgcc

SEQ ID NO: 145124 - RNA, 20 nt, Human
gcugggacuggagaggcggg

SEQ ID NO: 145125 - RNA, 20 nt, Human
ggggagagcgggacuuccuc

SEQ ID NO: 145126 - RNA, 24 nt, Human
guggucaccaaaggccaggguccc

SEQ ID NO: 145127 - RNA, 23 nt, Human
uaccggagccagcagccugguga

SEQ ID NO: 145128 - RNA, 21 nt, Human
ucaggguuucuggggauuggg

SEQ ID NO: 145129 - RNA, 21 nt, Human
ucccagccccgggauccgcuc

SEQ ID NO: 145130 - RNA, 18 nt, Human
ucccagggccuagcacca

SEQ ID NO: 145131 - RNA, 21 nt, Human
uccucagcccaggcccagagc

SEQ ID NO: 145132 - RNA, 22 nt, Human
ucugggcccgugaaguguccuu

SEQ ID NO: 145133 - RNA, 24 nt, Human
ugcacccacacuggcgcccacacc

SEQ ID NO: 145134 - RNA, 25 nt, Human
ugcagaccugaaucaggguuucugg

SEQ ID NO: 145135 - RNA, 21 nt, Human
ugccuggaggacaguggcccu

SEQ ID NO: 145136 - RNA, 23 nt, Human
ugccuggaggacaguggcccugu

SEQ ID NO: 145137 - RNA, 25 nt, Human
uggcccauaaauaccuuuacauaaa

SEQ ID NO: 145138 - RNA, 18 nt, Human
ugggcaggagaugacagg

SEQ ID NO: 145139 - RNA, 25 nt, Human
uggguuccgggcgggcgcgcaaucc

SEQ ID NO: 145140 - RNA, 19 nt, Human
uucuggguuccgggcgggc

SEQ ID NO: 145141 - RNA, 23 nt, Human
aaacgccaggacguagcucagcg

SEQ ID NO: 145142 - RNA, 19 nt, Human
aaagugcuaggauuauagg

SEQ ID NO: 145143 - RNA, 24 nt, Human
aaagugcuaggauuauaggcauga

SEQ ID NO: 145144 - RNA, 19 nt, Human
aacaaaggaggccccaucu

SEQ ID NO: 145145 - RNA, 19 nt, Human
aacccacacacaguaggac

SEQ ID NO: 145146 - RNA, 19 nt, Human
aagaagacaaacaggucaa

SEQ ID NO: 145147 - RNA, 19 nt, Human
aagaagacaaacaggucaa

SEQ ID NO: 145148 - RNA, 24 nt, Human
aagaagcaggagaagaagacggag

SEQ ID NO: 145149 - RNA, 25 nt, Human
aagaagcaggagaagaagacggaga

SEQ ID NO: 145150 - RNA, 19 nt, Human
aagcaggaaccaccggccc

SEQ ID NO: 145151 - RNA, 22 nt, Human
aagcaggagaagaagacggaga

SEQ ID NO: 145152 - RNA, 23 nt, Human
aagccugcucccaccccagggcc

SEQ ID NO: 145153 - RNA, 19 nt, Human
aagcugccgggccggcauc

SEQ ID NO: 145154 - RNA, 25 nt, Human
acacaccauggccacaguccuccaa

SEQ ID NO: 145155 - RNA, 25 nt, Human
acaugugcauguguucaugugugua

SEQ ID NO: 145156 - RNA, 22 nt, Human
accccagggccucugccuuugc

SEQ ID NO: 145157 - RNA, 18 nt, Human
acccggggcggguguggg

SEQ ID NO: 145158 - RNA, 24 nt, Human
accuugugaucagcccaccuuggc

SEQ ID NO: 145159 - RNA, 19 nt, Human
acggcuccgucaccgucac

SEQ ID NO: 145160 - RNA, 19 nt, Human
acuacaagugugugccacc

SEQ ID NO: 145161 - RNA, 18 nt, Human
acugcacacaccauggcc

SEQ ID NO: 145162 - RNA, 20 nt, Human
acuugagggcauggugcucg

SEQ ID NO: 145163 - RNA, 18 nt, Human
agaacccugggcauguca

SEQ ID NO: 145164 - RNA, 19 nt, Human
agacagggccugaacagug

SEQ ID NO: 145165 - RNA, 23 nt, Human
agaggaagaggaagaagcaggag

SEQ ID NO: 145166 - RNA, 19 nt, Human
agcagacggugaccuuggc

SEQ ID NO: 145167 - RNA, 18 nt, Human
agcagcaguguggccacg

SEQ ID NO: 145168 - RNA, 23 nt, Human
agcagcccagacagggccugaac

SEQ ID NO: 145169 - RNA, 21 nt, Human
agccaccgcacccgacccucu

SEQ ID NO: 145170 - RNA, 23 nt, Human
agccauuggccucccagugcagc

SEQ ID NO: 145171 - RNA, 21 nt, Human
agcccugaggacaucggcaga

SEQ ID NO: 145172 - RNA, 24 nt, Human
agcgauucuucugccucagccucc

SEQ ID NO: 145173 - RNA, 22 nt, Human
aggaagaagcaggagaagaaga

SEQ ID NO: 145174 - RNA, 23 nt, Human
aggaggccccaucugggcaaccc

SEQ ID NO: 145175 - RNA, 20 nt, Human
aggcaugagccaccgcaccc

SEQ ID NO: 145176 - RNA, 21 nt, Human
aggcgggaggugggagcccag

SEQ ID NO: 145177 - RNA, 25 nt, Human
aggcguucucagucuagcuucuuug

SEQ ID NO: 145178 - RNA, 27 nt, Human
aggcugcgguccgacuggacaacacca

SEQ ID NO: 145179 - RNA, 20 nt, Human
agggggugguggagguggug

SEQ ID NO: 145180 - RNA, 23 nt, Human
agggggugguggagguggugggg

SEQ ID NO: 145181 - RNA, 20 nt, Human
agggucccgggagcacaggg

SEQ ID NO: 145182 - RNA, 24 nt, Human
aggugggagcccagccggcuucca

SEQ ID NO: 145183 - RNA, 25 nt, Human
agguuggagugcagugacgcaaucu

SEQ ID NO: 145184 - RNA, 19 nt, Human
aguaggacaggccaggccc

SEQ ID NO: 145185 - RNA, 19 nt, Human
agugcagugacgcaaucug

SEQ ID NO: 145186 - RNA, 22 nt, Human
agugugugccaccaugcccagc

SEQ ID NO: 145187 - RNA, 18 nt, Human
auccugucacuccccuuc

SEQ ID NO: 145188 - RNA, 18 nt, Human
augcccacugcccccagc

SEQ ID NO: 145189 - RNA, 18 nt, Human
augggguuucaccauauu

SEQ ID NO: 145190 - RNA, 24 nt, Human
augggguuucaccauauuggccag

SEQ ID NO: 145191 - RNA, 22 nt, Human
auugaagccccaggaugaggag

SEQ ID NO: 145192 - RNA, 19 nt, Human
caaacaggucaaugugggc

SEQ ID NO: 145193 - RNA, 26 nt, Human
caaacgccaggacguagcucagcgug

SEQ ID NO: 145194 - RNA, 20 nt, Human
caaagaggacagugcggccc

SEQ ID NO: 145195 - RNA, 23 nt, Human
caaagugcuaggauuauaggcau

SEQ ID NO: 145196 - RNA, 24 nt, Human
caaagugcuaggauuauaggcaug

SEQ ID NO: 145197 - RNA, 24 nt, Human
caacagucccuuccggcccgcacc

SEQ ID NO: 145198 - RNA, 21 nt, Human
caagccugcucccaccccagg

SEQ ID NO: 145199 - RNA, 22 nt, Human
caagcgauucuucugccucagc

SEQ ID NO: 145200 - RNA, 22 nt, Human
cacagugcuucucccucucuga

SEQ ID NO: 145201 - RNA, 22 nt, Human
cacauccucuggaggccucaca

SEQ ID NO: 145202 - RNA, 21 nt, Human
caccauauuggccaggcuggu

SEQ ID NO: 145203 - RNA, 22 nt, Human
caccauauuggccaggcugguc

SEQ ID NO: 145204 - RNA, 31 nt, Human
caccauauuggccaggcuggucacgaacucc

SEQ ID NO: 145205 - RNA, 24 nt, Human
caccaugcccagcuaauuuuugua

SEQ ID NO: 145206 - RNA, 23 nt, Human
caccauggccacaguccuccaag

SEQ ID NO: 145207 - RNA, 24 nt, Human
cacccagguuggagugcagugacg

SEQ ID NO: 145208 - RNA, 23 nt, Human
caccccaucgucccucacugcca

SEQ ID NO: 145209 - RNA, 24 nt, Human
cacccccaccacccccacaguacu

SEQ ID NO: 145210 - RNA, 18 nt, Human
caccggcccggggauccc

SEQ ID NO: 145211 - RNA, 21 nt, Human
cacugcaaccuccgccuccug

SEQ ID NO: 145212 - RNA, 23 nt, Human
cacugcaaccuccgccuccuggg

SEQ ID NO: 145213 - RNA, 22 nt, Human
cacugcacacaccauggccaca

SEQ ID NO: 145214 - RNA, 21 nt, Human
cacugcccccagcacccccac

SEQ ID NO: 145215 - RNA, 19 nt, Human
cagaacaaaggaggcccca

SEQ ID NO: 145216 - RNA, 19 nt, Human
cagaacaaaggaggcccca

SEQ ID NO: 145217 - RNA, 26 nt, Human
cagagcccaccgaagcauugaagccc

SEQ ID NO: 145218 - RNA, 23 nt, Human
cagagccugcuuggccuuccaga

SEQ ID NO: 145219 - RNA, 19 nt, Human
cagcacccccaccaccccc

SEQ ID NO: 145220 - RNA, 22 nt, Human
cagcagcagcagguagaagcgg

SEQ ID NO: 145221 - RNA, 24 nt, Human
cagcagcagcagguagaagcggcu

SEQ ID NO: 145222 - RNA, 24 nt, Human
cagcaggggugccaggaagggcuc

SEQ ID NO: 145223 - RNA, 18 nt, Human
cagccacagucccgggag

SEQ ID NO: 145224 - RNA, 21 nt, Human
cagcccugaggacaucggcag

SEQ ID NO: 145225 - RNA, 23 nt, Human
cagcucccggggcccccugaccc

SEQ ID NO: 145226 - RNA, 18 nt, Human
cagggcccaccggccccu

SEQ ID NO: 145227 - RNA, 19 nt, Human
cagggccucugccuuugcc

SEQ ID NO: 145228 - RNA, 20 nt, Human
cagggccugaacagugaggg

SEQ ID NO: 145229 - RNA, 18 nt, Human
cagggggugguggaggug

SEQ ID NO: 145230 - RNA, 20 nt, Human
caggucaaugugggccuggu

SEQ ID NO: 145231 - RNA, 24 nt, Human
cagugccugacagaguagguacuc

SEQ ID NO: 145232 - RNA, 24 nt, Human
caguggccgagacaacccacacac

SEQ ID NO: 145233 - RNA, 24 nt, Human
cagugggcacccucgguguggucc

SEQ ID NO: 145234 - RNA, 22 nt, Human
caguguccaggaagcgugggaa

SEQ ID NO: 145235 - RNA, 24 nt, Human
cauauuggccaggcuggucacgaa

SEQ ID NO: 145236 - RNA, 19 nt, Human
caugcccacugcccccagc

SEQ ID NO: 145237 - RNA, 22 nt, Human
cauugaagccccaggaugagga

SEQ ID NO: 145238 - RNA, 22 nt, Human
ccaaaacccuauguggggccca

SEQ ID NO: 145239 - RNA, 25 nt, Human
ccaaguagacaguguccaggggccc

SEQ ID NO: 145240 - RNA, 21 nt, Human
ccaccuggaggcagcagcccc

SEQ ID NO: 145241 - RNA, 22 nt, Human
ccacgcccagcagcagcaggua

SEQ ID NO: 145242 - RNA, 23 nt, Human
ccacugcccccagcacccccacc

SEQ ID NO: 145243 - RNA, 24 nt, Human
ccacugcccccagcacccccacca

SEQ ID NO: 145244 - RNA, 28 nt, Human
ccacugcccccagcacccccaccacccc

SEQ ID NO: 145245 - RNA, 25 nt, Human
ccacugcuggccccugcuccuccug

SEQ ID NO: 145246 - RNA, 24 nt, Human
ccagggccucugccuuugcuuccc

SEQ ID NO: 145247 - RNA, 22 nt, Human
ccagugccacugaggacacggu

SEQ ID NO: 145248 - RNA, 19 nt, Human
ccauggguccccagggccc

SEQ ID NO: 145249 - RNA, 23 nt, Human
cccacacacaguaggacaggcca

SEQ ID NO: 145250 - RNA, 26 nt, Human
cccacaguacucgugcagccugugcc

SEQ ID NO: 145251 - RNA, 22 nt, Human
cccacugcccccagcaccccca

SEQ ID NO: 145252 - RNA, 28 nt, Human
cccacugcuggccccugcuccuccugga

SEQ ID NO: 145253 - RNA, 22 nt, Human
cccagcacccccaccaccccca

SEQ ID NO: 145254 - RNA, 25 nt, Human
cccagcacccccaccacccccacag

SEQ ID NO: 145255 - RNA, 20 nt, Human
ccccaaguccagggcggccc

SEQ ID NO: 145256 - RNA, 22 nt, Human
ccccacacucccgaaagcagga

SEQ ID NO: 145257 - RNA, 19 nt, Human
ccccacaguacucgugcag

SEQ ID NO: 145258 - RNA, 21 nt, Human
ccccacaguacucgugcagcc

SEQ ID NO: 145259 - RNA, 20 nt, Human
ccccaccacccccacaguac

SEQ ID NO: 145260 - RNA, 21 nt, Human
ccccaccacccccacaguacu

SEQ ID NO: 145261 - RNA, 19 nt, Human
ccccagcacccccaccacc

SEQ ID NO: 145262 - RNA, 21 nt, Human
ccccagggcccaccggccccu

SEQ ID NO: 145263 - RNA, 18 nt, Human
ccccagggccucugccuu

SEQ ID NO: 145264 - RNA, 22 nt, Human
ccccauaauagccuggggagca

SEQ ID NO: 145265 - RNA, 21 nt, Human
ccccaucgucccucacugcca

SEQ ID NO: 145266 - RNA, 22 nt, Human
cccccacacucccgaaagcagg

SEQ ID NO: 145267 - RNA, 20 nt, Human
cccccagcacccccaccacc

SEQ ID NO: 145268 - RNA, 20 nt, Human
cccccucccaugggucccca

SEQ ID NO: 145269 - RNA, 21 nt, Human
ccccgcaccugcagcaccguc

SEQ ID NO: 145270 - RNA, 20 nt, Human
ccccugacuauccccagccu

SEQ ID NO: 145271 - RNA, 18 nt, Human
ccccugcuccuccuggau

SEQ ID NO: 145272 - RNA, 22 nt, Human
ccccugcuccuccuggaucccc

SEQ ID NO: 145273 - RNA, 22 nt, Human
cccggcccacugcuggccccug

SEQ ID NO: 145274 - RNA, 19 nt, Human
cccgggagcagcggggggc

SEQ ID NO: 145275 - RNA, 18 nt, Human
cccggggcggguguggga

SEQ ID NO: 145276 - RNA, 22 nt, Human
cccuagagccuguggcguugcc

SEQ ID NO: 145277 - RNA, 22 nt, Human
cccuauguggggcccacaaggc

SEQ ID NO: 145278 - RNA, 18 nt, Human
cccugggugauccagccc

SEQ ID NO: 145279 - RNA, 20 nt, Human
ccgaaagcaggaaccaccgg

SEQ ID NO: 145280 - RNA, 18 nt, Human
ccgaaggucacguccagc

SEQ ID NO: 145281 - RNA, 22 nt, Human
ccgccaggcagcuggagcagca

SEQ ID NO: 145282 - RNA, 24 nt, Human
ccgccuccuggguucaagcgauuc

SEQ ID NO: 145283 - RNA, 24 nt, Human
ccggggcccccugacccacagcgg

SEQ ID NO: 145284 - RNA, 21 nt, Human
ccuauguggggcccacaaggc

SEQ ID NO: 145285 - RNA, 19 nt, Human
ccucacugccacauccucu

SEQ ID NO: 145286 - RNA, 20 nt, Human
ccuccaagcacgugcgguuu

SEQ ID NO: 145287 - RNA, 19 nt, Human
ccuccgccuccuggguuca

SEQ ID NO: 145288 - RNA, 24 nt, Human
ccuccuggguucaagcgauucuuc

SEQ ID NO: 145289 - RNA, 21 nt, Human
ccugcagcaccguccuggggc

SEQ ID NO: 145290 - RNA, 19 nt, Human
ccugccgcugguccagagc

SEQ ID NO: 145291 - RNA, 20 nt, Human
ccugccgcugguccagagcc

SEQ ID NO: 145292 - RNA, 22 nt, Human
ccuggauccccagccccccggg

SEQ ID NO: 145293 - RNA, 23 nt, Human
ccuggguucaagcgauucuucug

SEQ ID NO: 145294 - RNA, 22 nt, Human
ccugugccgcagugugacgagg

SEQ ID NO: 145295 - RNA, 20 nt, Human
cgagcagcccagacagggcc

SEQ ID NO: 145296 - RNA, 21 nt, Human
cgccaggcagcuggagcagcg

SEQ ID NO: 145297 - RNA, 19 nt, Human
cgcgacccccacacucccg

SEQ ID NO: 145298 - RNA, 24 nt, Human
cgcucugucacccagguuggagug

SEQ ID NO: 145299 - RNA, 23 nt, Human
cggaagaagagcaggcccugcga

SEQ ID NO: 145300 - RNA, 20 nt, Human
cgggagcagcggggggcugg

SEQ ID NO: 145301 - RNA, 20 nt, Human
cggggcgggugugggagggg

SEQ ID NO: 145302 - RNA, 24 nt, Human
cucacugcaaccuccgccuccugg

SEQ ID NO: 145303 - RNA, 23 nt, Human
cucccagugcagcacgagcagcc

SEQ ID NO: 145304 - RNA, 21 nt, Human
cuccuggguucaagcgauucu

SEQ ID NO: 145305 - RNA, 24 nt, Human
cucgcucugucacccagguuggag

SEQ ID NO: 145306 - RNA, 23 nt, Human
cugcaaccuccgccuccuggguu

SEQ ID NO: 145307 - RNA, 20 nt, Human
cugcagggggugguggaggu

SEQ ID NO: 145308 - RNA, 23 nt, Human
cugccucagccucccgaguagcu

SEQ ID NO: 145309 - RNA, 18 nt, Human
cugcuccuccuggauccc

SEQ ID NO: 145310 - RNA, 27 nt, Human
cugcuccuccuggauccccagcccccc

SEQ ID NO: 145311 - RNA, 22 nt, Human
cuggauccccagccccccgggg

SEQ ID NO: 145312 - RNA, 21 nt, Human
cuggccccugcuccuccugga

SEQ ID NO: 145313 - RNA, 24 nt, Human
cuucccaaagcucuucccguagcu

SEQ ID NO: 145314 - RNA, 22 nt, Human
gaaagcaggaaccaccggcccg

SEQ ID NO: 145315 - RNA, 22 nt, Human
gaagcugcagccacagucccgg

SEQ ID NO: 145316 - RNA, 21 nt, Human
gaaugcagaacaaaggaggcc

SEQ ID NO: 145317 - RNA, 18 nt, Human
gacccccacacucccgaa

SEQ ID NO: 145318 - RNA, 21 nt, Human
gaccuugugaucagcccaccu

SEQ ID NO: 145319 - RNA, 24 nt, Human
gaccuugugaucagcccaccuugg

SEQ ID NO: 145320 - RNA, 18 nt, Human
gagaagaagacggagaag

SEQ ID NO: 145321 - RNA, 22 nt, Human
gagaagaagacggagaagaaga

SEQ ID NO: 145322 - RNA, 23 nt, Human
gagcccagugccacugaggacac

SEQ ID NO: 145323 - RNA, 19 nt, Human
gagcggcggaaggcgggag

SEQ ID NO: 145324 - RNA, 19 nt, Human
gagggucccgggagcacag

SEQ ID NO: 145325 - RNA, 21 nt, Human
gagguggagucucgcucuguc

SEQ ID NO: 145326 - RNA, 19 nt, Human
gaggugguggggcuggggg

SEQ ID NO: 145327 - RNA, 20 nt, Human
gauuauaggcaugagccacc

SEQ ID NO: 145328 - RNA, 23 nt, Human
gauuauaggcaugagccaccgca

SEQ ID NO: 145329 - RNA, 22 nt, Human
gcaaccuccgccuccuggguuc

SEQ ID NO: 145330 - RNA, 19 nt, Human
gcacgcauuccugggggac

SEQ ID NO: 145331 - RNA, 18 nt, Human
gcacugccgacggcuccg

SEQ ID NO: 145332 - RNA, 24 nt, Human
gccaccgcacccgacccucuuaaa

SEQ ID NO: 145333 - RNA, 22 nt, Human
gccagggccccgcuugcggcag

SEQ ID NO: 145334 - RNA, 23 nt, Human
gccagggccccgcuugcggcagu

SEQ ID NO: 145335 - RNA, 22 nt, Human
gcccagcuaauuuuuguauuuu

SEQ ID NO: 145336 - RNA, 22 nt, Human
gccccugacuauccccagccuc

SEQ ID NO: 145337 - RNA, 19 nt, Human
gcccugggugauccagccc

SEQ ID NO: 145338 - RNA, 21 nt, Human
gccguugggugcauggggccc

SEQ ID NO: 145339 - RNA, 24 nt, Human
gcgauucuucugccucagccuccc

SEQ ID NO: 145340 - RNA, 18 nt, Human
gcggacccggggcgggug

SEQ ID NO: 145341 - RNA, 20 nt, Human
gcggcuggccaucuugguca

SEQ ID NO: 145342 - RNA, 19 nt, Human
gcucugucacccagguugg

SEQ ID NO: 145343 - RNA, 23 nt, Human
ggacagcucccggggcccccuga

SEQ ID NO: 145344 - RNA, 25 nt, Human
ggacagugcggccggggccgggccc

SEQ ID NO: 145345 - RNA, 18 nt, Human
ggacccggggcgggugug

SEQ ID NO: 145346 - RNA, 18 nt, Human
ggacuacaagugugugcc

SEQ ID NO: 145347 - RNA, 22 nt, Human
ggacuacaagugugugccacca

SEQ ID NO: 145348 - RNA, 21 nt, Human
ggagggaccccaaguccaggg

SEQ ID NO: 145349 - RNA, 24 nt, Human
ggaggugggagcccagccggcuuc

SEQ ID NO: 145350 - RNA, 18 nt, Human
ggaggugguggggcuggg

SEQ ID NO: 145351 - RNA, 22 nt, Human
ggauuauaggcaugagccaccg

SEQ ID NO: 145352 - RNA, 25 nt, Human
ggcaguggcuguggaagcugcagcc

SEQ ID NO: 145353 - RNA, 20 nt, Human
ggcgaaggggcggcuggcca

SEQ ID NO: 145354 - RNA, 22 nt, Human
ggcucagagcggcggaaggcgg

SEQ ID NO: 145355 - RNA, 20 nt, Human
gggcaugucagagggacaug

SEQ ID NO: 145356 - RNA, 19 nt, Human
ggggagaaggugaggguga

SEQ ID NO: 145357 - RNA, 24 nt, Human
ggggcaguagggucaggugggaaa

SEQ ID NO: 145358 - RNA, 22 nt, Human
gggggacagagggucccgggag

SEQ ID NO: 145359 - RNA, 20 nt, Human
gggggcuggcggacccgggg

SEQ ID NO: 145360 - RNA, 25 nt, Human
gggggugguggaggugguggggcug

SEQ ID NO: 145361 - RNA, 19 nt, Human
ggggugguggagguggugg

SEQ ID NO: 145362 - RNA, 18 nt, Human
gggguuucaccauauugg

SEQ ID NO: 145363 - RNA, 22 nt, Human
gggguuucaccauauuggccag

SEQ ID NO: 145364 - RNA, 19 nt, Human
gggugguggaggugguggg

SEQ ID NO: 145365 - RNA, 22 nt, Human
ggguuucaccauauuggccagg

SEQ ID NO: 145366 - RNA, 26 nt, Human
ggugguggggcuggggguggcuggau

SEQ ID NO: 145367 - RNA, 18 nt, Human
ggugugguccuggcagaa

SEQ ID NO: 145368 - RNA, 20 nt, Human
guagcugguucuucucaggc

SEQ ID NO: 145369 - RNA, 20 nt, Human
guagguaaucaggccccgcg

SEQ ID NO: 145370 - RNA, 21 nt, Human
guccagagccugcuuggccuu

SEQ ID NO: 145371 - RNA, 18 nt, Human
gucccgggagcagcgggg

SEQ ID NO: 145372 - RNA, 21 nt, Human
guggcggggauggcugguggg

SEQ ID NO: 145373 - RNA, 21 nt, Human
gugugugcacaugugcaugug

SEQ ID NO: 145374 - RNA, 21 nt, Human
uaagucccaugagaucaggga

SEQ ID NO: 145375 - RNA, 22 nt, Human
uaauuuuuguauuuuuaguaga

SEQ ID NO: 145376 - RNA, 24 nt, Human
uagcuccucaguggccgagacaac

SEQ ID NO: 145377 - RNA, 18 nt, Human
uaggauuauaggcaugag

SEQ ID NO: 145378 - RNA, 22 nt, Human
uaggauuauaggcaugagccac

SEQ ID NO: 145379 - RNA, 23 nt, Human
uaggauuauaggcaugagccacc

SEQ ID NO: 145380 - RNA, 24 nt, Human
uaggauuauaggcaugagccaccg

SEQ ID NO: 145381 - RNA, 23 nt, Human
uaguagacaugggguuucaccau

SEQ ID NO: 145382 - RNA, 24 nt, Human
uaguagacaugggguuucaccaua

SEQ ID NO: 145383 - RNA, 23 nt, Human
ucaaaccauccaacagcuuccca

SEQ ID NO: 145384 - RNA, 24 nt, Human
ucaaagugcuaggauuauaggcau

SEQ ID NO: 145385 - RNA, 19 nt, Human
ucaagcgauucuucugccu

SEQ ID NO: 145386 - RNA, 24 nt, Human
ucacccagguuggagugcagugac

SEQ ID NO: 145387 - RNA, 23 nt, Human
ucacugcaaccuccgccuccugg

SEQ ID NO: 145388 - RNA, 24 nt, Human
ucacugcaaccuccgccuccuggg

SEQ ID NO: 145389 - RNA, 25 nt, Human
ucacugcaaccuccgccuccugggu

SEQ ID NO: 145390 - RNA, 27 nt, Human
ucacugcaaccuccgccuccuggguuc

SEQ ID NO: 145391 - RNA, 19 nt, Human
ucacugccacauccucugg

SEQ ID NO: 145392 - RNA, 20 nt, Human
ucagcccaccuuggccucuc

SEQ ID NO: 145393 - RNA, 23 nt, Human
ucaguggccgagacaacccacac

SEQ ID NO: 145394 - RNA, 20 nt, Human
ucauguguguaugcgugugg

SEQ ID NO: 145395 - RNA, 22 nt, Human
ucccaugcccacugcccccagc

SEQ ID NO: 145396 - RNA, 20 nt, Human
ucccauggguccccagggcc

SEQ ID NO: 145397 - RNA, 20 nt, Human
uccccagccccccggggccc

SEQ ID NO: 145398 - RNA, 30 nt, Human
uccccagccccccggggcccaccaucugcu

SEQ ID NO: 145399 - RNA, 23 nt, Human
uccccagggcccaccggccccug

SEQ ID NO: 145400 - RNA, 19 nt, Human
ucccgcacgccgcggacca

SEQ ID NO: 145401 - RNA, 23 nt, Human
ucccgcacgccgcggaccaccag

SEQ ID NO: 145402 - RNA, 20 nt, Human
ucccgggagcacagggcugu

SEQ ID NO: 145403 - RNA, 19 nt, Human
ucccucucugaagccaucu

SEQ ID NO: 145404 - RNA, 23 nt, Human
uccggcccgcaccagucccaugc

SEQ ID NO: 145405 - RNA, 21 nt, Human
uccuggguucaagcgauucuu

SEQ ID NO: 145406 - RNA, 24 nt, Human
uccuggguucaagcgauucuucug

SEQ ID NO: 145407 - RNA, 24 nt, Human
ucgcucugucacccagguuggagu

SEQ ID NO: 145408 - RNA, 24 nt, Human
ucucaaagugcuaggauuauaggc

SEQ ID NO: 145409 - RNA, 19 nt, Human
ucucgcucugucacccagg

SEQ ID NO: 145410 - RNA, 23 nt, Human
ucucgcucugucacccagguugg

SEQ ID NO: 145411 - RNA, 24 nt, Human
ucucgcucugucacccagguugga

SEQ ID NO: 145412 - RNA, 18 nt, Human
ucugaagccaucuuacuu

SEQ ID NO: 145413 - RNA, 24 nt, Human
ucugucacccagguuggagugcag

SEQ ID NO: 145414 - RNA, 23 nt, Human
ucuugcagccccgccaccuggaa

SEQ ID NO: 145415 - RNA, 24 nt, Human
ugacgcaaucugagcucacugcaa

SEQ ID NO: 145416 - RNA, 18 nt, Human
ugagaacccugggcaugu

SEQ ID NO: 145417 - RNA, 21 nt, Human
ugagaauaaaacccaaaaccc

SEQ ID NO: 145418 - RNA, 18 nt, Human
ugagaggaagaggaagaa

SEQ ID NO: 145419 - RNA, 23 nt, Human
ugagaggaagaggaagaagcagg

SEQ ID NO: 145420 - RNA, 25 nt, Human
ugagaggaagaggaagaagcaggag

SEQ ID NO: 145421 - RNA, 21 nt, Human
ugagccaccgcacccgacccu

SEQ ID NO: 145422 - RNA, 19 nt, Human
ugagccguuggcgccgggc

SEQ ID NO: 145423 - RNA, 19 nt, Human
ugaggacaucggcagagcc

SEQ ID NO: 145424 - RNA, 19 nt, Human
ugaggagggcgcgaccccc

SEQ ID NO: 145425 - RNA, 22 nt, Human
ugagguugucgcaguggccacg

SEQ ID NO: 145426 - RNA, 21 nt, Human
ugcauguguucauguguguau

SEQ ID NO: 145427 - RNA, 25 nt, Human
ugccucagccucccgaguagcucgg

SEQ ID NO: 145428 - RNA, 18 nt, Human
ugcuggccccugcuccuc

SEQ ID NO: 145429 - RNA, 22 nt, Human
uggaagcugcagccacaguccc

SEQ ID NO: 145430 - RNA, 22 nt, Human
uggaggugguggggcugggggu

SEQ ID NO: 145431 - RNA, 19 nt, Human
uggagugcagugacgcaau

SEQ ID NO: 145432 - RNA, 18 nt, Human
uggauccccagccccccg

SEQ ID NO: 145433 - RNA, 22 nt, Human
uggcagugggcacccucggugu

SEQ ID NO: 145434 - RNA, 21 nt, Human
uggccacaguccuccaagcac

SEQ ID NO: 145435 - RNA, 24 nt, Human
uggccaggcuggucacgaacucuu

SEQ ID NO: 145436 - RNA, 19 nt, Human
uggcggacccggggcgggu

SEQ ID NO: 145437 - RNA, 23 nt, Human
uggcuggugggcagcagcccccu

SEQ ID NO: 145438 - RNA, 19 nt, Human
ugggagggggcaggucuga

SEQ ID NO: 145439 - RNA, 21 nt, Human
ugggagggggcaggucugaug

SEQ ID NO: 145440 - RNA, 19 nt, Human
uggggcccacaaggcccug

SEQ ID NO: 145441 - RNA, 19 nt, Human
uggggcuggggguggcugg

SEQ ID NO: 145442 - RNA, 20 nt, Human
ugggggaagggggccagugg

SEQ ID NO: 145443 - RNA, 24 nt, Human
ugggguuucaccauauuggccagg

SEQ ID NO: 145444 - RNA, 21 nt, Human
uggguaggugaugaccagccg

SEQ ID NO: 145445 - RNA, 18 nt, Human
uggguccccgugcccguu

SEQ ID NO: 145446 - RNA, 23 nt, Human
ugggugcauggggcccgccaggc

SEQ ID NO: 145447 - RNA, 20 nt, Human
uggguucaagcgauucuucu

SEQ ID NO: 145448 - RNA, 23 nt, Human
uggguucaagcgauucuucugcc

SEQ ID NO: 145449 - RNA, 18 nt, Human
ugguggaggugguggggc

SEQ ID NO: 145450 - RNA, 21 nt, Human
ugguggcggggauggcuggug

SEQ ID NO: 145451 - RNA, 18 nt, Human
uguaugcguguggggugu

SEQ ID NO: 145452 - RNA, 23 nt, Human
uguaugcguguggggugugugca

SEQ ID NO: 145453 - RNA, 20 nt, Human
ugucagcagcaggggugcca

SEQ ID NO: 145454 - RNA, 18 nt, Human
uguccaggaagcguggga

SEQ ID NO: 145455 - RNA, 22 nt, Human
uguccuggcucaacagucccuu

SEQ ID NO: 145456 - RNA, 26 nt, Human
ugugcacaugugcauguguucaugug

SEQ ID NO: 145457 - RNA, 23 nt, Human
ugugcauguguucauguguguau

SEQ ID NO: 145458 - RNA, 26 nt, Human
ugugcauguguucauguguguaugcg

SEQ ID NO: 145459 - RNA, 18 nt, Human
uguggggcccacaaggcc

SEQ ID NO: 145460 - RNA, 19 nt, Human
ugugugcacaugugcaugu

SEQ ID NO: 145461 - RNA, 19 nt, Human
uguguucauguguguaugc

SEQ ID NO: 145462 - RNA, 18 nt, Human
uuaguagacaugggguuu

SEQ ID NO: 145463 - RNA, 22 nt, Human
uuaguagacaugggguuucacc

SEQ ID NO: 145464 - RNA, 24 nt, Human
uuaguagacaugggguuucaccau

SEQ ID NO: 145465 - RNA, 23 nt, Human
uucaagcgauucuucugccucag

SEQ ID NO: 145466 - RNA, 24 nt, Human
uucaagcgauucuucugccucagc

SEQ ID NO: 145467 - RNA, 20 nt, Human
uucaccccaucgucccucac

SEQ ID NO: 145468 - RNA, 20 nt, Human
uuccugggggacgggacagc

SEQ ID NO: 145469 - RNA, 18 nt, Human
uucgcagugcucccccca

SEQ ID NO: 145470 - RNA, 23 nt, Human
uugaaugcccagcugacuucacc

SEQ ID NO: 145471 - RNA, 23 nt, Human
uuguauuuuuaguagacaugggg

SEQ ID NO: 145472 - RNA, 24 nt, Human
uuucaccauauuggccaggcuggu

SEQ ID NO: 145473 - RNA, 24 nt, Human
uuuuuaguagacaugggguuucac

SEQ ID NO: 145474 - RNA, 18 nt, Human
uuuuuguauuuuuaguag

SEQ ID NO: 145475 - RNA, 21 nt, Human
uuuuuguauuuuuaguagaca

SEQ ID NO: 145476 - RNA, 26 nt, Human
aaaauauuucuauccuuuggaagacu

SEQ ID NO: 145477 - RNA, 27 nt, Human
aaacaacaaaucuacaauagguacaac

SEQ ID NO: 145478 - RNA, 18 nt, Human
aaacaucugcauugggaa

SEQ ID NO: 145479 - RNA, 19 nt, Human
aaagaggcauuggaaacca

SEQ ID NO: 145480 - RNA, 24 nt, Human
aaagugcugggauuacaggcguga

SEQ ID NO: 145481 - RNA, 19 nt, Human
aaauuucagcaauguccuc

SEQ ID NO: 145482 - RNA, 24 nt, Human
aaccuggccgacacucacacugcc

SEQ ID NO: 145483 - RNA, 21 nt, Human
aagaggcauuggaaaccaaaa

SEQ ID NO: 145484 - RNA, 19 nt, Human
aaggguggucggcgcgggu

SEQ ID NO: 145485 - RNA, 26 nt, Human
aaguagcugagacuacaggcacguac

SEQ ID NO: 145486 - RNA, 25 nt, Human
aagugauucuccugccucagccucc

SEQ ID NO: 145487 - RNA, 19 nt, Human
aagugcugggauuacaggc

SEQ ID NO: 145488 - RNA, 19 nt, Human
aagugcugggauuacaggc

SEQ ID NO: 145489 - RNA, 26 nt, Human
aagugcugggauuacaggcgugagcc

SEQ ID NO: 145490 - RNA, 21 nt, Human
aauauacuuuacuucaagucc

SEQ ID NO: 145491 - RNA, 19 nt, Human
aaugacacccacuuugcac

SEQ ID NO: 145492 - RNA, 23 nt, Human
aauggccaaauacgcaaagcacc

SEQ ID NO: 145493 - RNA, 22 nt, Human
aauguuucaggaauggagauga

SEQ ID NO: 145494 - RNA, 19 nt, Human
acauauagagccaaugaca

SEQ ID NO: 145495 - RNA, 24 nt, Human
accuugugauccacccgccucggc

SEQ ID NO: 145496 - RNA, 22 nt, Human
acgcugcuguugcugcugcugg

SEQ ID NO: 145497 - RNA, 18 nt, Human
acgggauuucgccauguu

SEQ ID NO: 145498 - RNA, 19 nt, Human
acgggauuucgccauguug

SEQ ID NO: 145499 - RNA, 24 nt, Human
acgggauuucgccauguugaccag

SEQ ID NO: 145500 - RNA, 23 nt, Human
acucgauuuuauagagcagcugc

SEQ ID NO: 145501 - RNA, 21 nt, Human
agaacccuaggggauagaggg

SEQ ID NO: 145502 - RNA, 18 nt, Human
agagaggacacacauaug

SEQ ID NO: 145503 - RNA, 26 nt, Human
agaguuagaggcccugauuccaagcc

SEQ ID NO: 145504 - RNA, 18 nt, Human
agaugccacaguuuaugg

SEQ ID NO: 145505 - RNA, 19 nt, Human
agccaccgcacccggccca

SEQ ID NO: 145506 - RNA, 18 nt, Human
agccuagaaacaagcuuu

SEQ ID NO: 145507 - RNA, 24 nt, Human
aggaaaaaaccaagcccuucugaa

SEQ ID NO: 145508 - RNA, 18 nt, Human
aggcaauuucugcauaua

SEQ ID NO: 145509 - RNA, 24 nt, Human
aggcaguucucacaccaaaaccca

SEQ ID NO: 145510 - RNA, 26 nt, Human
aggcauuggaaaccaaaaugguaaua

SEQ ID NO: 145511 - RNA, 28 nt, Human
aggcauuggaaaccaaaaugguagaacc

SEQ ID NO: 145512 - RNA, 22 nt, Human
agggguggucggcgaggggccg

SEQ ID NO: 145513 - RNA, 18 nt, Human
agguaaacuuucuuugug

SEQ ID NO: 145514 - RNA, 21 nt, Human
aggugguggaagaggguccag

SEQ ID NO: 145515 - RNA, 21 nt, Human
agguucaagugauucuccugc

SEQ ID NO: 145516 - RNA, 22 nt, Human
agguucaagugauucuccugcc

SEQ ID NO: 145517 - RNA, 23 nt, Human
aguaaacaacaaaucuacaauag

SEQ ID NO: 145518 - RNA, 18 nt, Human
agugcugggauuacaggc

SEQ ID NO: 145519 - RNA, 24 nt, Human
aguuauguaugggcgucgucaggg

SEQ ID NO: 145520 - RNA, 19 nt, Human
aucccauuagcagcaccac

SEQ ID NO: 145521 - RNA, 21 nt, Human
auccugaccuuuuuugggggg

SEQ ID NO: 145522 - RNA, 22 nt, Human
auggccaaauacgcaaagcacc

SEQ ID NO: 145523 - RNA, 19 nt, Human
auguucaccaagcauccua

SEQ ID NO: 145524 - RNA, 18 nt, Human
auucuccugccucagccu

SEQ ID NO: 145525 - RNA, 22 nt, Human
auuuagcuccucugugccucag

SEQ ID NO: 145526 - RNA, 24 nt, Human
auuuuuguguuuuuaguagagacg

SEQ ID NO: 145527 - RNA, 27 nt, Human
caaaauaaacuaguaggucagugagua

SEQ ID NO: 145528 - RNA, 23 nt, Human
caaaaugguagaaccuucaggug

SEQ ID NO: 145529 - RNA, 21 nt, Human
caaagaggcauuggaaaccaa

SEQ ID NO: 145530 - RNA, 24 nt, Human
caaagugcugggauuacaggcgug

SEQ ID NO: 145531 - RNA, 24 nt, Human
caacaaaucuacaauagguacaaa

SEQ ID NO: 145532 - RNA, 21 nt, Human
caaguaacaauuccuacccac

SEQ ID NO: 145533 - RNA, 22 nt, Human
caagugauucuccugccucagc

SEQ ID NO: 145534 - RNA, 22 nt, Human
caaugaugaugacugucaaaga

SEQ ID NO: 145535 - RNA, 23 nt, Human
cacaaacuggcaguuuuguuuuc

SEQ ID NO: 145536 - RNA, 24 nt, Human
cacaaaucccauuagcagcaccac

SEQ ID NO: 145537 - RNA, 23 nt, Human
cacccgccucggccucccaaagu

SEQ ID NO: 145538 - RNA, 18 nt, Human
caccuuuaauccugaccu

SEQ ID NO: 145539 - RNA, 20 nt, Human
cacuaagugcuucauagcug

SEQ ID NO: 145540 - RNA, 18 nt, Human
cacuguaaccucugccuc

SEQ ID NO: 145541 - RNA, 21 nt, Human
cacuguaaccucugccuccca

SEQ ID NO: 145542 - RNA, 19 nt, Human
cacuuugcacuggcauuuc

SEQ ID NO: 145543 - RNA, 23 nt, Human
cagaaucaaaaagcucgagacau

SEQ ID NO: 145544 - RNA, 24 nt, Human
cagagucuugcucugucgcccagg

SEQ ID NO: 145545 - RNA, 25 nt, Human
cagcaauguccucaagaaggacuaa

SEQ ID NO: 145546 - RNA, 22 nt, Human
cagcugcccauugggagccacu

SEQ ID NO: 145547 - RNA, 23 nt, Human
cagcugcccauugggagccacuu

SEQ ID NO: 145548 - RNA, 24 nt, Human
caggaauauuccuuauuuuuagac

SEQ ID NO: 145549 - RNA, 19 nt, Human
caggggugggcacugaugu

SEQ ID NO: 145550 - RNA, 27 nt, Human
caggguuguagggguaaaaguacuauu

SEQ ID NO: 145551 - RNA, 23 nt, Human
cagguuccaauucacucgauuuu

SEQ ID NO: 145552 - RNA, 20 nt, Human
cagucgcccaaagaggggug

SEQ ID NO: 145553 - RNA, 18 nt, Human
cauagcccaaaauauagg

SEQ ID NO: 145554 - RNA, 19 nt, Human
caucagcuaaagcugaagu

SEQ ID NO: 145555 - RNA, 23 nt, Human
caucagugcuaucuuauuuaaaa

SEQ ID NO: 145556 - RNA, 24 nt, Human
cauguugaccaggcuggucucgaa

SEQ ID NO: 145557 - RNA, 25 nt, Human
cauugccaucaucuuccaacaaucc

SEQ ID NO: 145558 - RNA, 23 nt, Human
cauuguauagccuugaacaagau

SEQ ID NO: 145559 - RNA, 21 nt, Human
ccaaaauaaacuaguaggucc

SEQ ID NO: 145560 - RNA, 22 nt, Human
ccaaagugcugggauuacaggc

SEQ ID NO: 145561 - RNA, 22 nt, Human
ccaaagugcugggauuacaggc

SEQ ID NO: 145562 - RNA, 24 nt, Human
ccaaagugcugggauuacaggcgu

SEQ ID NO: 145563 - RNA, 23 nt, Human
ccacacaaaaaaguaaacaacaa

SEQ ID NO: 145564 - RNA, 18 nt, Human
ccaccuuuaauccugacc

SEQ ID NO: 145565 - RNA, 21 nt, Human
ccagcagucuuuucccccucc

SEQ ID NO: 145566 - RNA, 24 nt, Human
ccaggagucuaucuggaggucaaa

SEQ ID NO: 145567 - RNA, 21 nt, Human
ccaggcuuugucuggcccagg

SEQ ID NO: 145568 - RNA, 19 nt, Human
ccaucagaaaugcauaggc

SEQ ID NO: 145569 - RNA, 22 nt, Human
ccauguugaccaggcuggucuc

SEQ ID NO: 145570 - RNA, 23 nt, Human
ccauguugaccaggcuggucucg

SEQ ID NO: 145571 - RNA, 20 nt, Human
cccaaagagggguggucucc

SEQ ID NO: 145572 - RNA, 24 nt, Human
cccaaguagcugagacuacaggca

SEQ ID NO: 145573 - RNA, 23 nt, Human
cccagguucaagugauucuccuc

SEQ ID NO: 145574 - RNA, 23 nt, Human
cccagguucaagugauucuccug

SEQ ID NO: 145575 - RNA, 25 nt, Human
cccauuagcagcaccacaacaauga

SEQ ID NO: 145576 - RNA, 19 nt, Human
ccccacaaaucccauuagc

SEQ ID NO: 145577 - RNA, 22 nt, Human
cccuccagaacaucaucuccaa

SEQ ID NO: 145578 - RNA, 20 nt, Human
ccgcacccggcccaaaauua

SEQ ID NO: 145579 - RNA, 19 nt, Human
ccuacccacauagcccaaa

SEQ ID NO: 145580 - RNA, 21 nt, Human
ccuacccacauagcccaaaau

SEQ ID NO: 145581 - RNA, 19 nt, Human
ccuauaaagggaugaccaa

SEQ ID NO: 145582 - RNA, 24 nt, Human
ccucccagguucaagugauucucc

SEQ ID NO: 145583 - RNA, 18 nt, Human
ccucucuccucucauccc

SEQ ID NO: 145584 - RNA, 20 nt, Human
ccugaccuugugauccaccc

SEQ ID NO: 145585 - RNA, 23 nt, Human
ccugccucagccucccaaguagc

SEQ ID NO: 145586 - RNA, 20 nt, Human
ccuuacacaaacauucuccc

SEQ ID NO: 145587 - RNA, 21 nt, Human
ccuugaacaagauauuuagcu

SEQ ID NO: 145588 - RNA, 19 nt, Human
ccuuuuuuuugagacagag

SEQ ID NO: 145589 - RNA, 21 nt, Human
cgaagagggggccucgguggc

SEQ ID NO: 145590 - RNA, 22 nt, Human
cgcaaagcacccucagauuacc

SEQ ID NO: 145591 - RNA, 24 nt, Human
cgccauguugaccaggcuggucuc

SEQ ID NO: 145592 - RNA, 27 nt, Human
cgccauguugaccaggcuggucucgaa

SEQ ID NO: 145593 - RNA, 18 nt, Human
cgccggagggguggucgg

SEQ ID NO: 145594 - RNA, 24 nt, Human
cgccucggccucccaaagugcugg

SEQ ID NO: 145595 - RNA, 21 nt, Human
cggacauacuuaacacuaccu

SEQ ID NO: 145596 - RNA, 24 nt, Human
cgggauuucgccauguugaccagg

SEQ ID NO: 145597 - RNA, 19 nt, Human
cuaaccaucagaaaugcau

SEQ ID NO: 145598 - RNA, 25 nt, Human
cuacaauagguacaaauuauauaca

SEQ ID NO: 145599 - RNA, 27 nt, Human
cuacagggguggucggcgccgggccag

SEQ ID NO: 145600 - RNA, 18 nt, Human
cuaggcaauuucugcaua

SEQ ID NO: 145601 - RNA, 19 nt, Human
cucacuguaaccucugccu

SEQ ID NO: 145602 - RNA, 24 nt, Human
cucacuguaaccucugccucccag

SEQ ID NO: 145603 - RNA, 24 nt, Human
cucacuguaaccucugccucccag

SEQ ID NO: 145604 - RNA, 21 nt, Human
cucccaaguagcugagacuac

SEQ ID NO: 145605 - RNA, 19 nt, Human
cucccagguucaagugauu

SEQ ID NO: 145606 - RNA, 21 nt, Human
cucccaugugguuugguacaa

SEQ ID NO: 145607 - RNA, 27 nt, Human
cucccuuagaagcuuauccugugcuuc

SEQ ID NO: 145608 - RNA, 24 nt, Human
cuccugaccuugugauccacccgc

SEQ ID NO: 145609 - RNA, 21 nt, Human
cucgguggcaggugggguggg

SEQ ID NO: 145610 - RNA, 20 nt, Human
cucugucgcccaggcuggag

SEQ ID NO: 145611 - RNA, 21 nt, Human
cugaccacacaaaaaaguaaa

SEQ ID NO: 145612 - RNA, 31 nt, Human
cugaccacacaaaaaaguaaacaacaaaucc

SEQ ID NO: 145613 - RNA, 23 nt, Human
cugccucagccucccaaguagcu

SEQ ID NO: 145614 - RNA, 20 nt, Human
cuggagaagucgcagccagg

SEQ ID NO: 145615 - RNA, 21 nt, Human
cuggcccaggggcugacucug

SEQ ID NO: 145616 - RNA, 24 nt, Human
cuguaaccucugccucccagguuc

SEQ ID NO: 145617 - RNA, 18 nt, Human
cuucacagugauuuccuu

SEQ ID NO: 145618 - RNA, 23 nt, Human
cuuucuacagaugcugucaaaau

SEQ ID NO: 145619 - RNA, 22 nt, Human
gaaaaaaccaagcccuucugaa

SEQ ID NO: 145620 - RNA, 24 nt, Human
gaccacacaaaaaaguaaacaaca

SEQ ID NO: 145621 - RNA, 22 nt, Human
gaccuugugauccacccgccuc

SEQ ID NO: 145622 - RNA, 22 nt, Human
gaccuugugauccacccgccuc

SEQ ID NO: 145623 - RNA, 24 nt, Human
gaccuugugauccacccgccucgg

SEQ ID NO: 145624 - RNA, 19 nt, Human
gagaaagacagguaugcca

SEQ ID NO: 145625 - RNA, 20 nt, Human
gagaaaggaaagaaagaaac

SEQ ID NO: 145626 - RNA, 20 nt, Human
gagaggggaguaagggagga

SEQ ID NO: 145627 - RNA, 19 nt, Human
gagcaagaauccugggagg

SEQ ID NO: 145628 - RNA, 19 nt, Human
gagcagcugccuguagaug

SEQ ID NO: 145629 - RNA, 24 nt, Human
gagcauauaacucuacuuuuagac

SEQ ID NO: 145630 - RNA, 20 nt, Human
gagcgagaggggaguaaggg

SEQ ID NO: 145631 - RNA, 21 nt, Human
gaggcauuggaaaccaaaaug

SEQ ID NO: 145632 - RNA, 24 nt, Human
gagggagcgagaggggaguaaggg

SEQ ID NO: 145633 - RNA, 23 nt, Human
gaucugaagcccugggcuuacuu

SEQ ID NO: 145634 - RNA, 18 nt, Human
gauuacaggcgugagcca

SEQ ID NO: 145635 - RNA, 20 nt, Human
gauuacaggcgugagccacc

SEQ ID NO: 145636 - RNA, 23 nt, Human
gauuacaggcgugagccaccgca

SEQ ID NO: 145637 - RNA, 21 nt, Human
gauucuccugccucagccucc

SEQ ID NO: 145638 - RNA, 23 nt, Human
gcaaagcacccucagauuaccag

SEQ ID NO: 145639 - RNA, 26 nt, Human
gcaaauuauuuccagaaucaaaaagc

SEQ ID NO: 145640 - RNA, 18 nt, Human
gcaugaaaacuacagauc

SEQ ID NO: 145641 - RNA, 18 nt, Human
gcccaaaauauaggaacc

SEQ ID NO: 145642 - RNA, 20 nt, Human
gcccaggcuggagugaaaug

SEQ ID NO: 145643 - RNA, 18 nt, Human
gccugaaaggugguggaa

SEQ ID NO: 145644 - RNA, 27 nt, Human
gcucugucgcccaggcuggagugaaau

SEQ ID NO: 145645 - RNA, 18 nt, Human
ggaaagcaaauuuucccu

SEQ ID NO: 145646 - RNA, 21 nt, Human
ggacugggcuggagaagucgc

SEQ ID NO: 145647 - RNA, 20 nt, Human
ggagaaugcauccuaugucc

SEQ ID NO: 145648 - RNA, 18 nt, Human
ggagaucgggggucgggg

SEQ ID NO: 145649 - RNA, 23 nt, Human
ggcuggucucgaacuccugaccu

SEQ ID NO: 145650 - RNA, 23 nt, Human
ggcuuugucuggcccaggggcug

SEQ ID NO: 145651 - RNA, 19 nt, Human
gggacugggcuggagaagu

SEQ ID NO: 145652 - RNA, 23 nt, Human
gggauuucgccauguugaccagg

SEQ ID NO: 145653 - RNA, 19 nt, Human
ggggaggacgcugcuguug

SEQ ID NO: 145654 - RNA, 19 nt, Human
ggggaggacgcugcuguug

SEQ ID NO: 145655 - RNA, 18 nt, Human
gggggggcagggggcggu

SEQ ID NO: 145656 - RNA, 20 nt, Human
gggggucgggguccggggag

SEQ ID NO: 145657 - RNA, 19 nt, Human
gggguggucggcgccgggc

SEQ ID NO: 145658 - RNA, 20 nt, Human
ggucucgaacuccugaccuu

SEQ ID NO: 145659 - RNA, 21 nt, Human
gguggucggcgaggggccgag

SEQ ID NO: 145660 - RNA, 22 nt, Human
gguggucggcgaggggccgagc

SEQ ID NO: 145661 - RNA, 24 nt, Human
gucaucuucuccucguugcaaucc

SEQ ID NO: 145662 - RNA, 24 nt, Human
gugauccacccgccucggccuccc

SEQ ID NO: 145663 - RNA, 24 nt, Human
gugauucuccugccucagccuccc

SEQ ID NO: 145664 - RNA, 19 nt, Human
guggacuacagucacaugg

SEQ ID NO: 145665 - RNA, 19 nt, Human
uaaaagaacccuaggggau

SEQ ID NO: 145666 - RNA, 21 nt, Human
uaaaauauuucuauccuuugg

SEQ ID NO: 145667 - RNA, 22 nt, Human
uaaaauccuucuuuacauucuu

SEQ ID NO: 145668 - RNA, 22 nt, Human
uaaacaagcaccugugagggca

SEQ ID NO: 145669 - RNA, 25 nt, Human
uaacaauuccuacccacauagccca

SEQ ID NO: 145670 - RNA, 19 nt, Human
uaagauucacaucagugcu

SEQ ID NO: 145671 - RNA, 24 nt, Human
uaauuuuuguguuuuuaguagaga

SEQ ID NO: 145672 - RNA, 27 nt, Human
uacaacaccauuaacugcuguacaaau

SEQ ID NO: 145673 - RNA, 24 nt, Human
uacacaaauuuagaaaugcaugau

SEQ ID NO: 145674 - RNA, 23 nt, Human
uacaggcgugagccaccgcaccc

SEQ ID NO: 145675 - RNA, 19 nt, Human
uaccccuguucuagaaaca

SEQ ID NO: 145676 - RNA, 18 nt, Human
uaccugaaaauuucagau

SEQ ID NO: 145677 - RNA, 23 nt, Human
uacucccuccagaacaucaucuc

SEQ ID NO: 145678 - RNA, 22 nt, Human
uacuuaacacuaccuagggcac

SEQ ID NO: 145679 - RNA, 19 nt, Human
uagaauugugcagucugua

SEQ ID NO: 145680 - RNA, 22 nt, Human
uagagacgggauuucgccaugu

SEQ ID NO: 145681 - RNA, 25 nt, Human
uaggcaguucucacaccaaaaccca

SEQ ID NO: 145682 - RNA, 24 nt, Human
uaguagagacgggauuucgccaug

SEQ ID NO: 145683 - RNA, 24 nt, Human
uauagaaaaacuaaauaauuuuca

SEQ ID NO: 145684 - RNA, 18 nt, Human
uaugauggcuuuucucuu

SEQ ID NO: 145685 - RNA, 22 nt, Human
ucaaaauccucuuagacuccaa

SEQ ID NO: 145686 - RNA, 19 nt, Human
ucaagugauucuccugccu

SEQ ID NO: 145687 - RNA, 19 nt, Human
ucacagugauuuccuuugc

SEQ ID NO: 145688 - RNA, 24 nt, Human
ucacuaagugcuucauagcuguau

SEQ ID NO: 145689 - RNA, 19 nt, Human
ucacugagcaagaauccug

SEQ ID NO: 145690 - RNA, 19 nt, Human
ucacuguaaccucugccuc

SEQ ID NO: 145691 - RNA, 24 nt, Human
ucacuguaaccucugccucccagg

SEQ ID NO: 145692 - RNA, 25 nt, Human
ucacuguaaccucugccucccaggu

SEQ ID NO: 145693 - RNA, 18 nt, Human
ucagccucccaaguagcu

SEQ ID NO: 145694 - RNA, 21 nt, Human
ucagccucccaaguagcugag

SEQ ID NO: 145695 - RNA, 25 nt, Human
ucaucuccaaacccugagaacaacu

SEQ ID NO: 145696 - RNA, 19 nt, Human
ucaucuuguuaccacuggc

SEQ ID NO: 145697 - RNA, 23 nt, Human
uccagaacaucaucuccaaaccc

SEQ ID NO: 145698 - RNA, 23 nt, Human
uccagaaucaaaaagcucgagac

SEQ ID NO: 145699 - RNA, 22 nt, Human
uccagcagucuuuucccccucc

SEQ ID NO: 145700 - RNA, 24 nt, Human
ucccaaagugcugggauuacaggc

SEQ ID NO: 145701 - RNA, 24 nt, Human
ucccaaguagcugagacuacaggc

SEQ ID NO: 145702 - RNA, 21 nt, Human
ucccagguucaagugauucuc

SEQ ID NO: 145703 - RNA, 24 nt, Human
ucccagguucaagugauucuccug

SEQ ID NO: 145704 - RNA, 26 nt, Human
ucccauuagcagcaccacaacaauga

SEQ ID NO: 145705 - RNA, 24 nt, Human
ucccuccagaacaucaucuccaaa

SEQ ID NO: 145706 - RNA, 20 nt, Human
uccgccgccggagggguggu

SEQ ID NO: 145707 - RNA, 19 nt, Human
uccuaaaaaguguaggacc

SEQ ID NO: 145708 - RNA, 22 nt, Human
ucgccauguugaccaggcuggu

SEQ ID NO: 145709 - RNA, 19 nt, Human
ucgcccaaagagggguggu

SEQ ID NO: 145710 - RNA, 21 nt, Human
ucgcccaggcuggagugaaau

SEQ ID NO: 145711 - RNA, 18 nt, Human
ucggccucccaaagugcu

SEQ ID NO: 145712 - RNA, 20 nt, Human
ucggcgaggggccgagcggc

SEQ ID NO: 145713 - RNA, 24 nt, Human
ucuaaaaaaccucucuccucucau

SEQ ID NO: 145714 - RNA, 19 nt, Human
ucuagggcugcugcugcag

SEQ ID NO: 145715 - RNA, 21 nt, Human
ucuauccuuuggaagacuauc

SEQ ID NO: 145716 - RNA, 26 nt, Human
ucuccugccucagccucccaaguagc

SEQ ID NO: 145717 - RNA, 21 nt, Human
ucuggaggaggcgaagagggg

SEQ ID NO: 145718 - RNA, 21 nt, Human
ucuuagacuccaacaaaccuc

SEQ ID NO: 145719 - RNA, 23 nt, Human
ucuuccaacaaucccgaaacauc

SEQ ID NO: 145720 - RNA, 22 nt, Human
ucuugcucugucgcccaggcug

SEQ ID NO: 145721 - RNA, 23 nt, Human
ucuugcucugucgcccaggcugg

SEQ ID NO: 145722 - RNA, 24 nt, Human
ucuugcucugucgcccaggcugga

SEQ ID NO: 145723 - RNA, 18 nt, Human
ugaaaaaacaugugcuuu

SEQ ID NO: 145724 - RNA, 19 nt, Human
ugaaaaaacaugugcuuua

SEQ ID NO: 145725 - RNA, 23 nt, Human
ugaaaguaaaugauccuuggcau

SEQ ID NO: 145726 - RNA, 20 nt, Human
ugaaauggcgccaucucggc

SEQ ID NO: 145727 - RNA, 25 nt, Human
ugaagcccugggcuuacuuucuagg

SEQ ID NO: 145728 - RNA, 19 nt, Human
ugaagucuuccagcagucu

SEQ ID NO: 145729 - RNA, 20 nt, Human
ugaagugggcugaaaguaaa

SEQ ID NO: 145730 - RNA, 19 nt, Human
ugacagugaacgcuucaga

SEQ ID NO: 145731 - RNA, 21 nt, Human
ugacauuggcacuuucuacag

SEQ ID NO: 145732 - RNA, 20 nt, Human
ugaccacacaaaaaaguaaa

SEQ ID NO: 145733 - RNA, 24 nt, Human
ugaccaggcuggucucgaacuccu

SEQ ID NO: 145734 - RNA, 18 nt, Human
ugagaaaggaaagaaaga

SEQ ID NO: 145735 - RNA, 22 nt, Human
ugagacagagucuugcucuguc

SEQ ID NO: 145736 - RNA, 19 nt, Human
ugagacuacaggcacguac

SEQ ID NO: 145737 - RNA, 20 nt, Human
ugagacuacaggcacguaca

SEQ ID NO: 145738 - RNA, 22 nt, Human
ugagacuacaggcacguacacc

SEQ ID NO: 145739 - RNA, 23 nt, Human
ugagacuacaggcacguacaccc

SEQ ID NO: 145740 - RNA, 22 nt, Human
ugaucuaauaaccccauuccaa

SEQ ID NO: 145741 - RNA, 22 nt, Human
ugcagcgauucacauucaggcu

SEQ ID NO: 145742 - RNA, 24 nt, Human
ugccucagccucccaaguagcuga

SEQ ID NO: 145743 - RNA, 18 nt, Human
ugcugcugcuggggagau

SEQ ID NO: 145744 - RNA, 21 nt, Human
ugcugcugcuggggagaucgg

SEQ ID NO: 145745 - RNA, 24 nt, Human
ugcugggauuacaggcgugagcca

SEQ ID NO: 145746 - RNA, 24 nt, Human
uggaaaagugcuuugcaaacuaca

SEQ ID NO: 145747 - RNA, 19 nt, Human
uggaggucaaagugguuuu

SEQ ID NO: 145748 - RNA, 26 nt, Human
uggcaguuuaaacaagcaccugugag

SEQ ID NO: 145749 - RNA, 18 nt, Human
uggcccuggauugcuccu

SEQ ID NO: 145750 - RNA, 24 nt, Human
ugggaaugcugucaugguagcugc

SEQ ID NO: 145751 - RNA, 19 nt, Human
ugggauuacaggcgugagc

SEQ ID NO: 145752 - RNA, 21 nt, Human
ugggauuacaggcgugagcca

SEQ ID NO: 145753 - RNA, 22 nt, Human
ugggauuacaggcgugagccac

SEQ ID NO: 145754 - RNA, 23 nt, Human
ugggauuacaggcgugagccacc

SEQ ID NO: 145755 - RNA, 24 nt, Human
ugggauuacaggcgugagccaccg

SEQ ID NO: 145756 - RNA, 18 nt, Human
ugggguggggaggacgcu

SEQ ID NO: 145757 - RNA, 24 nt, Human
ugguacucgcgguacauauauaca

SEQ ID NO: 145758 - RNA, 22 nt, Human
ugguugcagcgauucacauuca

SEQ ID NO: 145759 - RNA, 25 nt, Human
ugguuuugggcugcacuaugggguu

SEQ ID NO: 145760 - RNA, 23 nt, Human
uguaaccucugccucccagguuc

SEQ ID NO: 145761 - RNA, 19 nt, Human
ugucaugguagcugcugaa

SEQ ID NO: 145762 - RNA, 19 nt, Human
ugucaugguagcugcugaa

SEQ ID NO: 145763 - RNA, 19 nt, Human
ugucgcccaggcuggagug

SEQ ID NO: 145764 - RNA, 21 nt, Human
ugucgcccaggcuggagugaa

SEQ ID NO: 145765 - RNA, 19 nt, Human
ugucuggcccaggggcuga

SEQ ID NO: 145766 - RNA, 24 nt, Human
uuaaagguaaacuuucuuugugau

SEQ ID NO: 145767 - RNA, 19 nt, Human
uuaacuggguccacauggc

SEQ ID NO: 145768 - RNA, 18 nt, Human
uuaccagaaguagauuau

SEQ ID NO: 145769 - RNA, 18 nt, Human
uuaguagagacgggauuu

SEQ ID NO: 145770 - RNA, 24 nt, Human
uuaguagagacgggauuucgccau

SEQ ID NO: 145771 - RNA, 22 nt, Human
uuagugacauaaauacaaguuu

SEQ ID NO: 145772 - RNA, 22 nt, Human
uucaaaugucauuuuuuucucu

SEQ ID NO: 145773 - RNA, 19 nt, Human
uucaaggaauuucuacaug

SEQ ID NO: 145774 - RNA, 21 nt, Human
uucaagugauucuccugccuc

SEQ ID NO: 145775 - RNA, 23 nt, Human
uucaagugauucuccugccucag

SEQ ID NO: 145776 - RNA, 24 nt, Human
uucaagugauucuccugccucagc

SEQ ID NO: 145777 - RNA, 27 nt, Human
uucauugccaucaucuuccaacaaucc

SEQ ID NO: 145778 - RNA, 19 nt, Human
uucuuuacauucuucacag

SEQ ID NO: 145779 - RNA, 18 nt, Human
uugaacaagauauuuagc

SEQ ID NO: 145780 - RNA, 23 nt, Human
uugcaaacuacaaagggcuauag

SEQ ID NO: 145781 - RNA, 24 nt, Human
uugcucugucgcccaggcuggagu

SEQ ID NO: 145782 - RNA, 18 nt, Human
uuggggggggcagggggc

SEQ ID NO: 145783 - RNA, 20 nt, Human
uuggugaaugcuuccccagg

SEQ ID NO: 145784 - RNA, 19 nt, Human
uuuaaacaagcaccuguga

SEQ ID NO: 145785 - RNA, 18 nt, Human
uuucaggaauggagauga

SEQ ID NO: 145786 - RNA, 18 nt, Human
uuuccagaaucaaaaagc

SEQ ID NO: 145787 - RNA, 24 nt, Human
uuucgccauguugaccaggcuggu

SEQ ID NO: 145788 - RNA, 22 nt, Human
uuucuacagaugcugucaaaau

SEQ ID NO: 145789 - RNA, 21 nt, Human
uuucuagggcugcugcugcag

SEQ ID NO: 145790 - RNA, 22 nt, Human
uuugcaaacuacaaagggcuau

SEQ ID NO: 145791 - RNA, 19 nt, Human
uuugcuuguacucccucca

SEQ ID NO: 145792 - RNA, 21 nt, Human
uuuggaguuuuaacugggucc

SEQ ID NO: 145793 - RNA, 22 nt, Human
uuuuuaguagagacgggauuuc

SEQ ID NO: 145794 - RNA, 21 nt, Human
uuuuuggggggggcagggggc

SEQ ID NO: 145795 - RNA, 20 nt, Human
uuuuuguguuuuuaguagag

SEQ ID NO: 145796 - RNA, 26 nt, Human
aaaaaaccagggaacugacaguggga

SEQ ID NO: 145797 - RNA, 26 nt, Human
accgggugcugucccugcagucuggg

SEQ ID NO: 145798 - RNA, 26 nt, Human
agcaaauauuggcauaucuuauacaa

SEQ ID NO: 145799 - RNA, 24 nt, Human
agcuaagccacuuaggcaaaaguc

SEQ ID NO: 145800 - RNA, 20 nt, Human
aguaauucuaaaaugccaga

SEQ ID NO: 145801 - RNA, 24 nt, Human
aguuaaacauuucucugugcuuuu

SEQ ID NO: 145802 - RNA, 19 nt, Human
caaaaaaaccagggaacug

SEQ ID NO: 145803 - RNA, 25 nt, Human
cagaaaugacugagaagauacagug

SEQ ID NO: 145804 - RNA, 19 nt, Human
cagcuaagccgccgccucc

SEQ ID NO: 145805 - RNA, 21 nt, Human
caggggcgcucgcggccuggg

SEQ ID NO: 145806 - RNA, 25 nt, Human
ccccguagcagcuaagccgccgccu

SEQ ID NO: 145807 - RNA, 22 nt, Human
cccuggcuagccuggccgaggc

SEQ ID NO: 145808 - RNA, 22 nt, Human
ccugcagucugggaggggaggc

SEQ ID NO: 145809 - RNA, 23 nt, Human
cucgcacggguccuccuuccucc

SEQ ID NO: 145810 - RNA, 23 nt, Human
gccacuuaggcaaaagucuaucu

SEQ ID NO: 145811 - RNA, 21 nt, Human
gccgcucggguccuccgcucc

SEQ ID NO: 145812 - RNA, 20 nt, Human
gcggccuggggaggggcugg

SEQ ID NO: 145813 - RNA, 22 nt, Human
ggccuggggaggggcugggggc

SEQ ID NO: 145814 - RNA, 23 nt, Human
gggaggccaggcaccgcggcagg

SEQ ID NO: 145815 - RNA, 18 nt, Human
ggggaggggcugggggcg

SEQ ID NO: 145816 - RNA, 22 nt, Human
gggugcugucccugcagucugg

SEQ ID NO: 145817 - RNA, 18 nt, Human
gguccuccuuccuccucc

SEQ ID NO: 145818 - RNA, 22 nt, Human
uaaaaugccagagguccuauga

SEQ ID NO: 145819 - RNA, 22 nt, Human
uacaagaaaggcaucuuacaau

SEQ ID NO: 145820 - RNA, 23 nt, Human
uagcagcuaagccgccgccuccu

SEQ ID NO: 145821 - RNA, 22 nt, Human
uaucauaagagucaaacaguua

SEQ ID NO: 145822 - RNA, 19 nt, Human
uaugaaagacccagcuaag

SEQ ID NO: 145823 - RNA, 22 nt, Human
uaugaaagacccagcuaagcca

SEQ ID NO: 145824 - RNA, 22 nt, Human
ucgcggccuggggaggggcugg

SEQ ID NO: 145825 - RNA, 19 nt, Human
ucggguccuccgcuccacu

SEQ ID NO: 145826 - RNA, 20 nt, Human
ucuaaaaugccagagguccu

SEQ ID NO: 145827 - RNA, 18 nt, Human
ucucgcacggguccuccu

SEQ ID NO: 145828 - RNA, 23 nt, Human
ugagaagauacagugauaugaua

SEQ ID NO: 145829 - RNA, 23 nt, Human
uggcuagccuggccgaggcuccu

SEQ ID NO: 145830 - RNA, 22 nt, Human
ugggaggggaggccaggcaccc

SEQ ID NO: 145831 - RNA, 19 nt, Human
uuaaacauuucucugugcu

SEQ ID NO: 145832 - RNA, 25 nt, Human
uuaaagcaaauauuggcauaucuua

SEQ ID NO: 145833 - RNA, 21 nt, Human
uuuuucagcuaguaauucuaa

SEQ ID NO: 145834 - RNA, 18 nt, Human
uuuuuuuuuuuuuuuuug

SEQ ID NO: 145835 - RNA, 22 nt, Human
aaaugcugaugaauccaaugug

SEQ ID NO: 145836 - RNA, 24 nt, Human
aagacaaacaagucagucuaacgc

SEQ ID NO: 145837 - RNA, 22 nt, Human
aagcauuaucaauuucaaaccc

SEQ ID NO: 145838 - RNA, 19 nt, Human
aaggaacauuuuguaugug

SEQ ID NO: 145839 - RNA, 24 nt, Human
aaugcaacuucccaaaaugugccc

SEQ ID NO: 145840 - RNA, 24 nt, Human
agacaaaggaaugcaacuucccaa

SEQ ID NO: 145841 - RNA, 23 nt, Human
agcaaaaggaacauuuuguaugu

SEQ ID NO: 145842 - RNA, 19 nt, Human
agcucgcuccggcucuccc

SEQ ID NO: 145843 - RNA, 20 nt, Human
aggaaaaaaugggcuccuaa

SEQ ID NO: 145844 - RNA, 18 nt, Human
aggaagggacagaguggc

SEQ ID NO: 145845 - RNA, 22 nt, Human
agguggccugucguccggucug

SEQ ID NO: 145846 - RNA, 23 nt, Human
aguaaaaagcuuuugaagugaag

SEQ ID NO: 145847 - RNA, 23 nt, Human
aucaauuucaaacccuaguuuca

SEQ ID NO: 145848 - RNA, 23 nt, Human
augaacucaggguagcaagugcu

SEQ ID NO: 145849 - RNA, 20 nt, Human
augaauccaaugugggcugg

SEQ ID NO: 145850 - RNA, 21 nt, Human
augaauccaaugugggcugga

SEQ ID NO: 145851 - RNA, 21 nt, Human
cacaguuugaagacaaaggaa

SEQ ID NO: 145852 - RNA, 19 nt, Human
cacauauacuuuuuuuuuu

SEQ ID NO: 145853 - RNA, 23 nt, Human
cauucucagcugugggcuauugg

SEQ ID NO: 145854 - RNA, 20 nt, Human
ccaggaagggacagaguggc

SEQ ID NO: 145855 - RNA, 22 nt, Human
cccaggaagggacagaguggcu

SEQ ID NO: 145856 - RNA, 18 nt, Human
ccccgaagagcucgcucc

SEQ ID NO: 145857 - RNA, 21 nt, Human
cccuccguuucuucuuugccc

SEQ ID NO: 145858 - RNA, 21 nt, Human
ccucuggaagacuuguggcuu

SEQ ID NO: 145859 - RNA, 24 nt, Human
ccugccaugacuugauacaguacc

SEQ ID NO: 145860 - RNA, 23 nt, Human
cuguaggcugaaaauauuuucug

SEQ ID NO: 145861 - RNA, 21 nt, Human
gacuuguggcuugugcuccuu

SEQ ID NO: 145862 - RNA, 21 nt, Human
gaggaccugcuguggcuuggu

SEQ ID NO: 145863 - RNA, 23 nt, Human
gaguuucaaaacaauggaaugga

SEQ ID NO: 145864 - RNA, 20 nt, Human
gcaacuucccaaaaugugcc

SEQ ID NO: 145865 - RNA, 21 nt, Human
gccgugcgcggugguuguggc

SEQ ID NO: 145866 - RNA, 22 nt, Human
gcguaaggaggggguuuggggg

SEQ ID NO: 145867 - RNA, 21 nt, Human
gcuccuugcucacaguugggc

SEQ ID NO: 145868 - RNA, 22 nt, Human
gcugaaaauauuuucugaacca

SEQ ID NO: 145869 - RNA, 18 nt, Human
ggaagagcccauugaagu

SEQ ID NO: 145870 - RNA, 19 nt, Human
ggacauuuuuacaaaagua

SEQ ID NO: 145871 - RNA, 21 nt, Human
ggagauacguuuuugcgagaa

SEQ ID NO: 145872 - RNA, 18 nt, Human
ggcggcggcggcgccggg

SEQ ID NO: 145873 - RNA, 20 nt, Human
gggaacauauacucuuugag

SEQ ID NO: 145874 - RNA, 25 nt, Human
gggcggacgccgacgagguggccug

SEQ ID NO: 145875 - RNA, 20 nt, Human
gggcggcggcggcgccgggg

SEQ ID NO: 145876 - RNA, 18 nt, Human
gggugauggcuaaaggag

SEQ ID NO: 145877 - RNA, 20 nt, Human
gguguaaacguugcaaaacc

SEQ ID NO: 145878 - RNA, 24 nt, Human
guggccugucguccggucugggcg

SEQ ID NO: 145879 - RNA, 19 nt, Human
guggcguuggcggcgaggc

SEQ ID NO: 145880 - RNA, 24 nt, Human
uaacgcucaugacuggaaaccacu

SEQ ID NO: 145881 - RNA, 19 nt, Human
uaacuagcugaaucuucca

SEQ ID NO: 145882 - RNA, 23 nt, Human
uaccgauccggccugcuggggcc

SEQ ID NO: 145883 - RNA, 21 nt, Human
uacuuuuuuuuuuuuuuucaa

SEQ ID NO: 145884 - RNA, 22 nt, Human
uagcgacaaugaaaaacuccaa

SEQ ID NO: 145885 - RNA, 23 nt, Human
uagcgacaaugaaaaacuccaag

SEQ ID NO: 145886 - RNA, 20 nt, Human
uagcucgggacuccggcgca

SEQ ID NO: 145887 - RNA, 21 nt, Human
uagcugaaucuuccaaucuuc

SEQ ID NO: 145888 - RNA, 19 nt, Human
uagucgguguaaacguugc

SEQ ID NO: 145889 - RNA, 19 nt, Human
uauuccacauucucagcug

SEQ ID NO: 145890 - RNA, 21 nt, Human
ucaaggcagagacacuuuuug

SEQ ID NO: 145891 - RNA, 27 nt, Human
ucaauagcgacaaugaaaaacuccaag

SEQ ID NO: 145892 - RNA, 18 nt, Human
uccacauucucagcugug

SEQ ID NO: 145893 - RNA, 24 nt, Human
uccauaaguaacacaaacuaauuu

SEQ ID NO: 145894 - RNA, 18 nt, Human
ucccaaaaugugcccgag

SEQ ID NO: 145895 - RNA, 24 nt, Human
uccccgaagagcucgcuccggcuc

SEQ ID NO: 145896 - RNA, 18 nt, Human
uccguuucuucuuugccc

SEQ ID NO: 145897 - RNA, 19 nt, Human
uccucuggaagacuugugg

SEQ ID NO: 145898 - RNA, 24 nt, Human
uccuucuaaaacaucugcaaaugu

SEQ ID NO: 145899 - RNA, 18 nt, Human
uccuuguuggaagagccc

SEQ ID NO: 145900 - RNA, 19 nt, Human
ucugcaaauguugugaaag

SEQ ID NO: 145901 - RNA, 20 nt, Human
ucugcaaauguugugaaagc

SEQ ID NO: 145902 - RNA, 21 nt, Human
ucuuccuugauaaauuggaug

SEQ ID NO: 145903 - RNA, 18 nt, Human
ucuucuuugcccaggaag

SEQ ID NO: 145904 - RNA, 19 nt, Human
ucuuugcccaggaagggac

SEQ ID NO: 145905 - RNA, 18 nt, Human
ugaaaaacuccaagaucc

SEQ ID NO: 145906 - RNA, 22 nt, Human
ugaauagaugacucaaggcaga

SEQ ID NO: 145907 - RNA, 19 nt, Human
ugacucaaggcagagacac

SEQ ID NO: 145908 - RNA, 19 nt, Human
ugacuugauacaguaccga

SEQ ID NO: 145909 - RNA, 20 nt, Human
ugaguaaaaagcuuuugaag

SEQ ID NO: 145910 - RNA, 18 nt, Human
ugcaguggaagccuugaa

SEQ ID NO: 145911 - RNA, 20 nt, Human
ugcugaugaauccaaugugg

SEQ ID NO: 145912 - RNA, 20 nt, Human
uggaagagcccauugaagua

SEQ ID NO: 145913 - RNA, 21 nt, Human
ugggcggcggcggcgccgggg

SEQ ID NO: 145914 - RNA, 20 nt, Human
ugggcuccuaacuagcugaa

SEQ ID NO: 145915 - RNA, 24 nt, Human
uguaaaaugcccuguuguggccag

SEQ ID NO: 145916 - RNA, 19 nt, Human
ugugugacaaagcguaagg

SEQ ID NO: 145917 - RNA, 20 nt, Human
uguugggauggaggaccugc

SEQ ID NO: 145918 - RNA, 23 nt, Human
uucugaucuaugccccaaaggac

SEQ ID NO: 145919 - RNA, 18 nt, Human
uugcccaggaagggacag

SEQ ID NO: 145920 - RNA, 21 nt, Human
uuggcggcgaggcggggacuc

SEQ ID NO: 145921 - RNA, 25 nt, Human
uugguccuggguaucgaaagagucu

SEQ ID NO: 145922 - RNA, 21 nt, Human
uuugaugugucauccucucuu

SEQ ID NO: 145923 - RNA, 23 nt, Human
aaaaauccaaguuucuguaaaga

SEQ ID NO: 145924 - RNA, 22 nt, Human
aaauacaguaaaaugucauugu

SEQ ID NO: 145925 - RNA, 20 nt, Human
aaccuuugaaaucccgccga

SEQ ID NO: 145926 - RNA, 21 nt, Human
aagaagcccugaaaugguuaa

SEQ ID NO: 145927 - RNA, 24 nt, Human
aaggucacgcaaaacugggacuga

SEQ ID NO: 145928 - RNA, 23 nt, Human
aauuugcuauuucagucuguggu

SEQ ID NO: 145929 - RNA, 21 nt, Human
acaaguuaacaaauaguuaac

SEQ ID NO: 145930 - RNA, 25 nt, Human
acaaugcuaugaaguggguacuauu

SEQ ID NO: 145931 - RNA, 24 nt, Human
acaaugucaaaaaaaaagcagcaa

SEQ ID NO: 145932 - RNA, 20 nt, Human
acagaaaaaggaauugcuag

SEQ ID NO: 145933 - RNA, 23 nt, Human
agaauagauguccauaucaaaac

SEQ ID NO: 145934 - RNA, 18 nt, Human
agcggccuccucggggac

SEQ ID NO: 145935 - RNA, 22 nt, Human
aggaggaaacggaaauucagag

SEQ ID NO: 145936 - RNA, 19 nt, Human
aggccggcaccccacgccc

SEQ ID NO: 145937 - RNA, 23 nt, Human
auagauguccauaucaaaaccuu

SEQ ID NO: 145938 - RNA, 22 nt, Human
auauagccuuccaaacuuaaaa

SEQ ID NO: 145939 - RNA, 20 nt, Human
auccuacuuucccagagcuu

SEQ ID NO: 145940 - RNA, 20 nt, Human
auccucauuuugcagaggag

SEQ ID NO: 145941 - RNA, 18 nt, Human
aucuggcaaaauauaaga

SEQ ID NO: 145942 - RNA, 18 nt, Human
augaaugucccucccaau

SEQ ID NO: 145943 - RNA, 26 nt, Human
auuaucccaaauucaaacuugauaua

SEQ ID NO: 145944 - RNA, 21 nt, Human
auuuaaacuuuaacggaaggc

SEQ ID NO: 145945 - RNA, 23 nt, Human
cacagcagucaaaaucuucuguu

SEQ ID NO: 145946 - RNA, 22 nt, Human
caccacaccauaugcuggugaa

SEQ ID NO: 145947 - RNA, 22 nt, Human
cacggccccgcggcgacccggg

SEQ ID NO: 145948 - RNA, 21 nt, Human
cacguacaccacggccccgcg

SEQ ID NO: 145949 - RNA, 20 nt, Human
cacuauguggaaaguggggu

SEQ ID NO: 145950 - RNA, 24 nt, Human
cacuauguggaaaguggggugcua

SEQ ID NO: 145951 - RNA, 19 nt, Human
cacucggcggggccgggcc

SEQ ID NO: 145952 - RNA, 21 nt, Human
cagcaaucuuuaagaguucaa

SEQ ID NO: 145953 - RNA, 18 nt, Human
cagcgccuacaccugcug

SEQ ID NO: 145954 - RNA, 19 nt, Human
cagucaagguugcaaggug

SEQ ID NO: 145955 - RNA, 21 nt, Human
cauuaacgacucucacauuua

SEQ ID NO: 145956 - RNA, 22 nt, Human
ccacgcccucggcccggccgcu

SEQ ID NO: 145957 - RNA, 22 nt, Human
ccaugcacccgcuacccucgcc

SEQ ID NO: 145958 - RNA, 18 nt, Human
ccccacgcccucggcccg

SEQ ID NO: 145959 - RNA, 22 nt, Human
cccucggccgccgccgccgccu

SEQ ID NO: 145960 - RNA, 20 nt, Human
ccgccgaguucaaaacccca

SEQ ID NO: 145961 - RNA, 18 nt, Human
ccgccgccgccucagcgu

SEQ ID NO: 145962 - RNA, 20 nt, Human
ccggcagccgccucagcgcc

SEQ ID NO: 145963 - RNA, 22 nt, Human
ccuccuguaagcaaucacagau

SEQ ID NO: 145964 - RNA, 20 nt, Human
ccucggccgccgccgccgcc

SEQ ID NO: 145965 - RNA, 22 nt, Human
ccuuugaaaucccgccgaguuc

SEQ ID NO: 145966 - RNA, 21 nt, Human
cgagggcggagggggcggagg

SEQ ID NO: 145967 - RNA, 22 nt, Human
cgcaggcccgcgagcggcggaa

SEQ ID NO: 145968 - RNA, 21 nt, Human
cgccacuuacucagauguuau

SEQ ID NO: 145969 - RNA, 20 nt, Human
cggaaggcaacacaaaggaa

SEQ ID NO: 145970 - RNA, 23 nt, Human
cggaggugggucgcccgcuuucc

SEQ ID NO: 145971 - RNA, 20 nt, Human
cggcccggcccaggcugugg

SEQ ID NO: 145972 - RNA, 25 nt, Human
cggcgcgcgagggcggagggggcgg

SEQ ID NO: 145973 - RNA, 20 nt, Human
cggcggggccgggccucggc

SEQ ID NO: 145974 - RNA, 21 nt, Human
cggcggggccgggccucggcu

SEQ ID NO: 145975 - RNA, 22 nt, Human
cgggaccggacugggacgccga

SEQ ID NO: 145976 - RNA, 24 nt, Human
cgggcggcgcgcgagggcggaggg

SEQ ID NO: 145977 - RNA, 22 nt, Human
cuccaguagcauugucgcagcc

SEQ ID NO: 145978 - RNA, 20 nt, Human
cugccucggaggugggucgc

SEQ ID NO: 145979 - RNA, 21 nt, Human
cugcggcggccgagcaggagg

SEQ ID NO: 145980 - RNA, 19 nt, Human
cuguuauaaaauccugcug

SEQ ID NO: 145981 - RNA, 18 nt, Human
cuugaauccaaaaauaua

SEQ ID NO: 145982 - RNA, 20 nt, Human
gaggaaacggaaauucagag

SEQ ID NO: 145983 - RNA, 21 nt, Human
gcaaaacugggacugaaucca

SEQ ID NO: 145984 - RNA, 20 nt, Human
gccgccgccgccgccucagc

SEQ ID NO: 145985 - RNA, 24 nt, Human
gccucagcgucccgggcggcccgg

SEQ ID NO: 145986 - RNA, 22 nt, Human
gcggcgacggcgacugcggcgg

SEQ ID NO: 145987 - RNA, 21 nt, Human
gcggcggcggcggcgacggcg

SEQ ID NO: 145988 - RNA, 20 nt, Human
gcucugcacguacaccacgg

SEQ ID NO: 145989 - RNA, 18 nt, Human
gcuguggaggagcgcagg

SEQ ID NO: 145990 - RNA, 23 nt, Human
ggaaugggaacacagaaaaagga

SEQ ID NO: 145991 - RNA, 20 nt, Human
ggacucauuccacaaacacu

SEQ ID NO: 145992 - RNA, 19 nt, Human
ggagcgcaagaccggcccc

SEQ ID NO: 145993 - RNA, 24 nt, Human
ggaggcagguauguaaacaaggac

SEQ ID NO: 145994 - RNA, 21 nt, Human
ggccgaggggcgggggcugcc

SEQ ID NO: 145995 - RNA, 20 nt, Human
ggccggggggagggccgagg

SEQ ID NO: 145996 - RNA, 18 nt, Human
ggccucggcuucugccuc

SEQ ID NO: 145997 - RNA, 23 nt, Human
ggcggcggcggcgacggcgacug

SEQ ID NO: 145998 - RNA, 19 nt, Human
ggcggcggcggcggcggcg

SEQ ID NO: 145999 - RNA, 21 nt, Human
ggggagcgcaagaccggcccc

SEQ ID NO: 146000 - RNA, 20 nt, Human
ggggcugccugcgcuccucc

SEQ ID NO: 146001 - RNA, 24 nt, Human
guaaugaaauuugaggguuuuaaa

SEQ ID NO: 146002 - RNA, 27 nt, Human
uaaaaagaggcuugaauccaaaaauau

SEQ ID NO: 146003 - RNA, 19 nt, Human
uaaaaugucauuguugcag

SEQ ID NO: 146004 - RNA, 21 nt, Human
uaacagaucuggcaaaauaua

SEQ ID NO: 146005 - RNA, 24 nt, Human
uaauauagaaaaauuaucccaaau

SEQ ID NO: 146006 - RNA, 30 nt, Human
uaccaaguuaaauguaaucaaugcucauua

SEQ ID NO: 146007 - RNA, 25 nt, Human
uaguaugaacagguuuacaaaaaua

SEQ ID NO: 146008 - RNA, 22 nt, Human
uauaaaaaagggagagaugaaa

SEQ ID NO: 146009 - RNA, 24 nt, Human
uauuuauuuauuuauuuacuuauu

SEQ ID NO: 146010 - RNA, 19 nt, Human
ucaaugcucauuccaauau

SEQ ID NO: 146011 - RNA, 19 nt, Human
ucagagaaguaaaguaacu

SEQ ID NO: 146012 - RNA, 22 nt, Human
ucagcgccucaucgccgccgag

SEQ ID NO: 146013 - RNA, 20 nt, Human
ucaguuguaauuaaagugcu

SEQ ID NO: 146014 - RNA, 22 nt, Human
ucgcccgaggcuggggagcggg

SEQ ID NO: 146015 - RNA, 23 nt, Human
ucugcugcuauuugucuuaagaa

SEQ ID NO: 146016 - RNA, 26 nt, Human
ucuggcaaaauauaagaaugaaaaaa

SEQ ID NO: 146017 - RNA, 25 nt, Human
ucugugguguguccacaaauuauuu

SEQ ID NO: 146018 - RNA, 19 nt, Human
ucuuaggcuuccuuuugcu

SEQ ID NO: 146019 - RNA, 20 nt, Human
ugaaaaaaauucuacacagg

SEQ ID NO: 146020 - RNA, 21 nt, Human
ugaaaagugaauuuugauggu

SEQ ID NO: 146021 - RNA, 18 nt, Human
ugaaacaaauagagagug

SEQ ID NO: 146022 - RNA, 19 nt, Human
ugaaugucccucccaaucc

SEQ ID NO: 146023 - RNA, 27 nt, Human
ugacaaugucaaaaaaaaagcagcaau

SEQ ID NO: 146024 - RNA, 22 nt, Human
ugagagaauagggccugugcgg

SEQ ID NO: 146025 - RNA, 18 nt, Human
ugcacccgcuacccucgc

SEQ ID NO: 146026 - RNA, 23 nt, Human
ugcuauaguaauuauacaugagg

SEQ ID NO: 146027 - RNA, 22 nt, Human
ugcuggaggagggcgccagccg

SEQ ID NO: 146028 - RNA, 23 nt, Human
uggaaaguggggugcuaggcuug

SEQ ID NO: 146029 - RNA, 18 nt, Human
uggaggagggcgccagcc

SEQ ID NO: 146030 - RNA, 21 nt, Human
uggcaaaauauaagaaugaaa

SEQ ID NO: 146031 - RNA, 18 nt, Human
uggcaaccugggcucagg

SEQ ID NO: 146032 - RNA, 20 nt, Human
uggcaaccugggcucaggcg

SEQ ID NO: 146033 - RNA, 23 nt, Human
uggcuuacgaaaauaagcauuua

SEQ ID NO: 146034 - RNA, 25 nt, Human
ugggacugaauccaggaaucaggcu

SEQ ID NO: 146035 - RNA, 18 nt, Human
uggggagcgcaagaccgg

SEQ ID NO: 146036 - RNA, 22 nt, Human
uggggagcggggagagagauag

SEQ ID NO: 146037 - RNA, 19 nt, Human
uggggugcuaggcuugugu

SEQ ID NO: 146038 - RNA, 20 nt, Human
ugguaaaugagcaguacuac

SEQ ID NO: 146039 - RNA, 21 nt, Human
ugguaguaaauggugacuguu

SEQ ID NO: 146040 - RNA, 24 nt, Human
uguaaggaaggacugcaaaacaau

SEQ ID NO: 146041 - RNA, 18 nt, Human
uguaaucaaugcucauuc

SEQ ID NO: 146042 - RNA, 20 nt, Human
ugucuuauguguauccuacu

SEQ ID NO: 146043 - RNA, 22 nt, Human
uuaacuaauacucuggggcaaa

SEQ ID NO: 146044 - RNA, 24 nt, Human
uuacuaggaggacucauuccacag

SEQ ID NO: 146045 - RNA, 25 nt, Human
uucauauccagauguaaaaaccauu

SEQ ID NO: 146046 - RNA, 20 nt, Human
uuccuccaggccggcgcggg

SEQ ID NO: 146047 - RNA, 22 nt, Human
uuccuccuguaagcaaucacag

SEQ ID NO: 146048 - RNA, 22 nt, Human
uucuacacagggcacuuauuuc

SEQ ID NO: 146049 - RNA, 20 nt, Human
uuuugcagaggaggaaacgg

SEQ ID NO: 146050 - RNA, 22 nt, Human
aaaaaggggaggacuggcacaa

SEQ ID NO: 146051 - RNA, 21 nt, Human
aaaauacaaauucccaaccac

SEQ ID NO: 146052 - RNA, 19 nt, Human
aacagacagagcccuccac

SEQ ID NO: 146053 - RNA, 18 nt, Human
aaccggucaaagaguggc

SEQ ID NO: 146054 - RNA, 18 nt, Human
aagagcccacucccuccc

SEQ ID NO: 146055 - RNA, 24 nt, Human
aagauaaacauucacgaucaaaca

SEQ ID NO: 146056 - RNA, 20 nt, Human
aagauaccccaaaccccacc

SEQ ID NO: 146057 - RNA, 18 nt, Human
aagcagcagcgguggcag

SEQ ID NO: 146058 - RNA, 18 nt, Human
aagcagcagcgguggcag

SEQ ID NO: 146059 - RNA, 30 nt, Human
aagcagccaugaauuaccuauuuucccacu

SEQ ID NO: 146060 - RNA, 24 nt, Human
aaggagcagccagcacaggcccag

SEQ ID NO: 146061 - RNA, 24 nt, Human
aaggagcagccagcacaggcccag

SEQ ID NO: 146062 - RNA, 19 nt, Human
acaaaaaggggaggacugg

SEQ ID NO: 146063 - RNA, 21 nt, Human
acaacaggaugcuugccaagc

SEQ ID NO: 146064 - RNA, 24 nt, Human
acacccaugcuccuccuggcaccu

SEQ ID NO: 146065 - RNA, 18 nt, Human
acagugguaggaggggag

SEQ ID NO: 146066 - RNA, 18 nt, Human
accacaaggccucagcac

SEQ ID NO: 146067 - RNA, 18 nt, Human
accccaaaccccaccuca

SEQ ID NO: 146068 - RNA, 20 nt, Human
accccaaaccccaccucagc

SEQ ID NO: 146069 - RNA, 20 nt, Human
acucugcuccaugccucaac

SEQ ID NO: 146070 - RNA, 20 nt, Human
acugacuagagaugggcaag

SEQ ID NO: 146071 - RNA, 21 nt, Human
acuggccucaccacugccacu

SEQ ID NO: 146072 - RNA, 19 nt, Human
agaacauaacuugggaggu

SEQ ID NO: 146073 - RNA, 20 nt, Human
agacagucccaagauaaaca

SEQ ID NO: 146074 - RNA, 24 nt, Human
agagaaaggaaaaaaaaaaaggga

SEQ ID NO: 146075 - RNA, 18 nt, Human
agagaagcagccaugaau

SEQ ID NO: 146076 - RNA, 22 nt, Human
agagguaaaggaaauggcccag

SEQ ID NO: 146077 - RNA, 23 nt, Human
agcaacagacagagcccuccaca

SEQ ID NO: 146078 - RNA, 23 nt, Human
agcaacagacagagcccuccaca

SEQ ID NO: 146079 - RNA, 21 nt, Human
agcaaccaccucacugggaga

SEQ ID NO: 146080 - RNA, 22 nt, Human
agcacaggcugaaaugccauuu

SEQ ID NO: 146081 - RNA, 21 nt, Human
agcacagugccugccacaugg

SEQ ID NO: 146082 - RNA, 21 nt, Human
aggacagaggcaaagucagaa

SEQ ID NO: 146083 - RNA, 21 nt, Human
aggacagaggcaaagucagaa

SEQ ID NO: 146084 - RNA, 22 nt, Human
aggcaaagucagaagcagcagc

SEQ ID NO: 146085 - RNA, 22 nt, Human
aggcaaagucagaagcagcagc

SEQ ID NO: 146086 - RNA, 23 nt, Human
aggcaggacagaggcaaagucag

SEQ ID NO: 146087 - RNA, 23 nt, Human
aggcaggacagaggcaaagucag

SEQ ID NO: 146088 - RNA, 24 nt, Human
aggcaggacagaggcaaagucaga

SEQ ID NO: 146089 - RNA, 24 nt, Human
aggcaggacagaggcaaagucaga

SEQ ID NO: 146090 - RNA, 20 nt, Human
aggccccccagggaaaaccc

SEQ ID NO: 146091 - RNA, 18 nt, Human
aggccgugcgcccugggc

SEQ ID NO: 146092 - RNA, 21 nt, Human
agggacccuucaggguggcua

SEQ ID NO: 146093 - RNA, 26 nt, Human
agggagagccugacuuaggggcugcg

SEQ ID NO: 146094 - RNA, 22 nt, Human
agggcugccaccaucuacugcc

SEQ ID NO: 146095 - RNA, 20 nt, Human
aggggcauccccaccauccu

SEQ ID NO: 146096 - RNA, 20 nt, Human
agggguccagugcugcaccc

SEQ ID NO: 146097 - RNA, 18 nt, Human
agggguuggggagucacu

SEQ ID NO: 146098 - RNA, 18 nt, Human
agggguuggggagucacu

SEQ ID NO: 146099 - RNA, 24 nt, Human
aggucccugucccacccucugccc

SEQ ID NO: 146100 - RNA, 23 nt, Human
aggucucuucuccuccuuggucc

SEQ ID NO: 146101 - RNA, 20 nt, Human
aggugacaaccccagccccc

SEQ ID NO: 146102 - RNA, 19 nt, Human
agugcccagugcaguaccu

SEQ ID NO: 146103 - RNA, 22 nt, Human
aguugccacuccccugacccag

SEQ ID NO: 146104 - RNA, 18 nt, Human
auacaaauucccaaccac

SEQ ID NO: 146105 - RNA, 20 nt, Human
augaccagacaggguaggac

SEQ ID NO: 146106 - RNA, 20 nt, Human
augaccagacaggguaggac

SEQ ID NO: 146107 - RNA, 25 nt, Human
auuaccuauuuucccaccccuccuu

SEQ ID NO: 146108 - RNA, 21 nt, Human
auugcagggcuugguuucucu

SEQ ID NO: 146109 - RNA, 24 nt, Human
auuuucaggugugcaaggaggugg

SEQ ID NO: 146110 - RNA, 25 nt, Human
caaaauaccagacagugauggcgua

SEQ ID NO: 146111 - RNA, 26 nt, Human
caaaggucucuucuccuccuuggucc

SEQ ID NO: 146112 - RNA, 24 nt, Human
caaagugaaugacaacccagagac

SEQ ID NO: 146113 - RNA, 25 nt, Human
caacagacagagcccuccacaccag

SEQ ID NO: 146114 - RNA, 25 nt, Human
caacagacagagcccuccacaccag

SEQ ID NO: 146115 - RNA, 21 nt, Human
caaccccaaguccugcauccu

SEQ ID NO: 146116 - RNA, 21 nt, Human
caaccccaaguccugcauccu

SEQ ID NO: 146117 - RNA, 22 nt, Human
caacuucuccccagcccggacc

SEQ ID NO: 146118 - RNA, 19 nt, Human
caagacagucccaagauaa

SEQ ID NO: 146119 - RNA, 22 nt, Human
cacaacaggaugcuugccaagc

SEQ ID NO: 146120 - RNA, 24 nt, Human
cacacagcgccucccaccaagcac

SEQ ID NO: 146121 - RNA, 21 nt, Human
caccaagcacaugggacucac

SEQ ID NO: 146122 - RNA, 18 nt, Human
caccacaaggccucagca

SEQ ID NO: 146123 - RNA, 21 nt, Human
caccaggcaggacagaggcaa

SEQ ID NO: 146124 - RNA, 21 nt, Human
caccaggcaggacagaggcaa

SEQ ID NO: 146125 - RNA, 24 nt, Human
caccccucgggcucucaaagugaa

SEQ ID NO: 146126 - RNA, 25 nt, Human
cacccucccgcucugccaccacugg

SEQ ID NO: 146127 - RNA, 21 nt, Human
cacccucugcccaaagucacu

SEQ ID NO: 146128 - RNA, 20 nt, Human
cacccucuucccacaauuca

SEQ ID NO: 146129 - RNA, 18 nt, Human
cacgauauaguccagggc

SEQ ID NO: 146130 - RNA, 19 nt, Human
cacucccucccaacacaca

SEQ ID NO: 146131 - RNA, 18 nt, Human
cacucccucccaccccuc

SEQ ID NO: 146132 - RNA, 24 nt, Human
cacugggagaagaauugggccaug

SEQ ID NO: 146133 - RNA, 23 nt, Human
cacuucacauuccaggcuggagg

SEQ ID NO: 146134 - RNA, 23 nt, Human
cacuucacauuccaggcuggagg

SEQ ID NO: 146135 - RNA, 23 nt, Human
cagacagagcccuccacaccagg

SEQ ID NO: 146136 - RNA, 23 nt, Human
cagacagagcccuccacaccagg

SEQ ID NO: 146137 - RNA, 27 nt, Human
cagaggcaaagucagaagcagcagcgg

SEQ ID NO: 146138 - RNA, 27 nt, Human
cagaggcaaagucagaagcagcagcgg

SEQ ID NO: 146139 - RNA, 23 nt, Human
cagcaacagacagagcccuccac

SEQ ID NO: 146140 - RNA, 23 nt, Human
cagcaacagacagagcccuccac

SEQ ID NO: 146141 - RNA, 21 nt, Human
cagcaccagaguacaauuagu

SEQ ID NO: 146142 - RNA, 23 nt, Human
cagccaaaaucccauccccaagu

SEQ ID NO: 146143 - RNA, 23 nt, Human
cagccaaaaucccauccccaagu

SEQ ID NO: 146144 - RNA, 24 nt, Human
cagccaaaaucccauccccaaguc

SEQ ID NO: 146145 - RNA, 23 nt, Human
cagccucaaaggcccccaaccuc

SEQ ID NO: 146146 - RNA, 23 nt, Human
cagcuccugggccucaagagccc

SEQ ID NO: 146147 - RNA, 23 nt, Human
caggacagaggcaaagucagaag

SEQ ID NO: 146148 - RNA, 23 nt, Human
caggauucagagaccaaggguca

SEQ ID NO: 146149 - RNA, 21 nt, Human
cagggccaggcgcucgggcgc

SEQ ID NO: 146150 - RNA, 18 nt, Human
caggugacaaccccagcc

SEQ ID NO: 146151 - RNA, 18 nt, Human
caggugacaaccccagcc

SEQ ID NO: 146152 - RNA, 20 nt, Human
caucacucccucccaccccu

SEQ ID NO: 146153 - RNA, 23 nt, Human
cauccccacacagcagccagagc

SEQ ID NO: 146154 - RNA, 19 nt, Human
caucgccaccacaaggccu

SEQ ID NO: 146155 - RNA, 18 nt, Human
caugacucaccucaaccc

SEQ ID NO: 146156 - RNA, 18 nt, Human
caugacucaccucaaccc

SEQ ID NO: 146157 - RNA, 19 nt, Human
caugcagggcacgauauag

SEQ ID NO: 146158 - RNA, 24 nt, Human
cauuuccguuugggggccucaggc

SEQ ID NO: 146159 - RNA, 24 nt, Human
ccaacaccugaaugggccucaacu

SEQ ID NO: 146160 - RNA, 26 nt, Human
ccacacccaugcuccuccuggcaccu

SEQ ID NO: 146161 - RNA, 26 nt, Human
ccacacccaugcuccuccuggcaccu

SEQ ID NO: 146162 - RNA, 22 nt, Human
ccacagccucaaaggcccccaa

SEQ ID NO: 146163 - RNA, 23 nt, Human
ccacccaggcaaucuggucccca

SEQ ID NO: 146164 - RNA, 18 nt, Human
ccacugccacaacaggau

SEQ ID NO: 146165 - RNA, 20 nt, Human
ccaggcaaucugguccccac

SEQ ID NO: 146166 - RNA, 23 nt, Human
ccaggcucaggcuccaagggcuc

SEQ ID NO: 146167 - RNA, 22 nt, Human
ccaggugacaaccccagccccc

SEQ ID NO: 146168 - RNA, 21 nt, Human
ccaguccaaaaggugccugcc

SEQ ID NO: 146169 - RNA, 21 nt, Human
ccaguccaaaaggugccugcc

SEQ ID NO: 146170 - RNA, 19 nt, Human
ccagugcaguaccugcaga

SEQ ID NO: 146171 - RNA, 18 nt, Human
ccagugcugcccccagga

SEQ ID NO: 146172 - RNA, 19 nt, Human
ccauccugcccgccaaaac

SEQ ID NO: 146173 - RNA, 20 nt, Human
cccaaaccccaccucagcca

SEQ ID NO: 146174 - RNA, 20 nt, Human
cccaaccacagccucaaagg

SEQ ID NO: 146175 - RNA, 28 nt, Human
cccaaccacagccucaaaggcccccaac

SEQ ID NO: 146176 - RNA, 22 nt, Human
cccacacagcagccagagcccc

SEQ ID NO: 146177 - RNA, 24 nt, Human
cccaccccauugccagcaagaggc

SEQ ID NO: 146178 - RNA, 24 nt, Human
cccaccccauugccagcaagaggc

SEQ ID NO: 146179 - RNA, 18 nt, Human
cccacccucugcccaaag

SEQ ID NO: 146180 - RNA, 20 nt, Human
cccacggugccccgggagcc

SEQ ID NO: 146181 - RNA, 18 nt, Human
cccacucccugccgaggc

SEQ ID NO: 146182 - RNA, 20 nt, Human
cccagcacuggccucaccac

SEQ ID NO: 146183 - RNA, 21 nt, Human
cccaugcuccuccuggcaccu

SEQ ID NO: 146184 - RNA, 21 nt, Human
cccaugcuccuccuggcaccu

SEQ ID NO: 146185 - RNA, 22 nt, Human
cccaugcuccuccuggcaccuu

SEQ ID NO: 146186 - RNA, 22 nt, Human
cccaugcuccuccuggcaccuu

SEQ ID NO: 146187 - RNA, 20 nt, Human
cccauggugccacccuccuc

SEQ ID NO: 146188 - RNA, 18 nt, Human
ccccaaaagacuuucuuu

SEQ ID NO: 146189 - RNA, 21 nt, Human
ccccacacagcagccagagcc

SEQ ID NO: 146190 - RNA, 25 nt, Human
ccccaccauccucggcccauuuccg

SEQ ID NO: 146191 - RNA, 18 nt, Human
ccccgggagcccacuagg

SEQ ID NO: 146192 - RNA, 21 nt, Human
cccgggagcccacuaggaggc

SEQ ID NO: 146193 - RNA, 24 nt, Human
cccuaagggcuugggaagggaccc

SEQ ID NO: 146194 - RNA, 24 nt, Human
cccuaagggcuugggaagggaccc

SEQ ID NO: 146195 - RNA, 22 nt, Human
cccuccacaccaggcaggacag

SEQ ID NO: 146196 - RNA, 22 nt, Human
cccuccacaccaggcaggacag

SEQ ID NO: 146197 - RNA, 26 nt, Human
cccuccacaccaggcaggacagaggc

SEQ ID NO: 146198 - RNA, 22 nt, Human
cccuggacuacaaagaaucccc

SEQ ID NO: 146199 - RNA, 19 nt, Human
ccgcugccucccacggugc

SEQ ID NO: 146200 - RNA, 19 nt, Human
ccucaaaggcccccaaccu

SEQ ID NO: 146201 - RNA, 21 nt, Human
ccucaagagcccacucccucc

SEQ ID NO: 146202 - RNA, 25 nt, Human
ccuccacaccaggcaggacagaggc

SEQ ID NO: 146203 - RNA, 25 nt, Human
ccuccacaccaggcaggacagaggc

SEQ ID NO: 146204 - RNA, 23 nt, Human
ccuccacuugaugcagcuggggg

SEQ ID NO: 146205 - RNA, 23 nt, Human
ccuccacuugaugcagcuggggg

SEQ ID NO: 146206 - RNA, 22 nt, Human
ccucccacggugccccgggagc

SEQ ID NO: 146207 - RNA, 22 nt, Human
ccucccagcucuccauaccuaa

SEQ ID NO: 146208 - RNA, 22 nt, Human
ccucccagcucuccauaccuaa

SEQ ID NO: 146209 - RNA, 19 nt, Human
ccuccgccuccuccuccgc

SEQ ID NO: 146210 - RNA, 19 nt, Human
ccuccgccuccuccuccgc

SEQ ID NO: 146211 - RNA, 24 nt, Human
ccuccugguucucuugccuggccc

SEQ ID NO: 146212 - RNA, 18 nt, Human
ccucucugcccugguaca

SEQ ID NO: 146213 - RNA, 22 nt, Human
ccugauguguacagcaggggua

SEQ ID NO: 146214 - RNA, 21 nt, Human
ccugcccgccaaaaccguccc

SEQ ID NO: 146215 - RNA, 20 nt, Human
ccuggcacccagcuagggcc

SEQ ID NO: 146216 - RNA, 26 nt, Human
ccuggcaccuuuuacucugcccaagc

SEQ ID NO: 146217 - RNA, 26 nt, Human
ccuggcaccuuuuacucugcccaagc

SEQ ID NO: 146218 - RNA, 19 nt, Human
cgaccgcccagugcugccc

SEQ ID NO: 146219 - RNA, 19 nt, Human
cgcccgggcccauggugcc

SEQ ID NO: 146220 - RNA, 19 nt, Human
cgcccgggcccauggugcc

SEQ ID NO: 146221 - RNA, 21 nt, Human
cgcggcgggaucgcccucugg

SEQ ID NO: 146222 - RNA, 23 nt, Human
cggucaaagaguggcucgauguu

SEQ ID NO: 146223 - RNA, 20 nt, Human
cucaaccccaaguccugcau

SEQ ID NO: 146224 - RNA, 20 nt, Human
cucaaccccaaguccugcau

SEQ ID NO: 146225 - RNA, 23 nt, Human
cucauccaccagaccuugcccug

SEQ ID NO: 146226 - RNA, 21 nt, Human
cucaucgccaccacaaggccu

SEQ ID NO: 146227 - RNA, 18 nt, Human
cucccgcucugccuccug

SEQ ID NO: 146228 - RNA, 22 nt, Human
cuccuuggcaucaaaauaccag

SEQ ID NO: 146229 - RNA, 24 nt, Human
cucucuggcagcaccagaguacaa

SEQ ID NO: 146230 - RNA, 18 nt, Human
cucugcuggcguccauuc

SEQ ID NO: 146231 - RNA, 20 nt, Human
cucugggggucccacucccu

SEQ ID NO: 146232 - RNA, 20 nt, Human
cugaaugggccucaacugcc

SEQ ID NO: 146233 - RNA, 23 nt, Human
cugcaucacucccucccaccccu

SEQ ID NO: 146234 - RNA, 22 nt, Human
cugccaugcggcucugggacug

SEQ ID NO: 146235 - RNA, 22 nt, Human
cugccaugcggcucugggacug

SEQ ID NO: 146236 - RNA, 24 nt, Human
cugccauggccaaagggguugggg

SEQ ID NO: 146237 - RNA, 24 nt, Human
cugccauggccaaagggguugggg

SEQ ID NO: 146238 - RNA, 20 nt, Human
cugcggcuggcacgggcugu

SEQ ID NO: 146239 - RNA, 21 nt, Human
cugcucugcauuaaccaugug

SEQ ID NO: 146240 - RNA, 19 nt, Human
cugcugcccgcuccuuggc

SEQ ID NO: 146241 - RNA, 18 nt, Human
cugcugcccuggacuaca

SEQ ID NO: 146242 - RNA, 22 nt, Human
cugcuucaauccucacccuccc

SEQ ID NO: 146243 - RNA, 20 nt, Human
cuggacuacaaagaaucccc

SEQ ID NO: 146244 - RNA, 24 nt, Human
cuggcaccccuuggugaccagcgc

SEQ ID NO: 146245 - RNA, 20 nt, Human
cuggcaccuuuuacucugcc

SEQ ID NO: 146246 - RNA, 20 nt, Human
cuggcaccuuuuacucugcc

SEQ ID NO: 146247 - RNA, 20 nt, Human
cuggccucaccacugccacu

SEQ ID NO: 146248 - RNA, 24 nt, Human
cuggccucaccacugccacugcug

SEQ ID NO: 146249 - RNA, 18 nt, Human
cugggugaaggggcaucc

SEQ ID NO: 146250 - RNA, 21 nt, Human
cugucccauagaccuccgaac

SEQ ID NO: 146251 - RNA, 22 nt, Human
cuuucuuuuucagccaaaaucc

SEQ ID NO: 146252 - RNA, 22 nt, Human
gaacaagauaacaagugucugg

SEQ ID NO: 146253 - RNA, 18 nt, Human
gaagcagcagcgguggca

SEQ ID NO: 146254 - RNA, 23 nt, Human
gacagugguaggaggggagcagg

SEQ ID NO: 146255 - RNA, 26 nt, Human
gacccagcccuacaaugcuguggcca

SEQ ID NO: 146256 - RNA, 18 nt, Human
gagguucuggagccccaa

SEQ ID NO: 146257 - RNA, 20 nt, Human
gagguucuggagccccaacu

SEQ ID NO: 146258 - RNA, 23 nt, Human
gaugugagagaaacuagagacag

SEQ ID NO: 146259 - RNA, 21 nt, Human
gcaaaggucucuucuccuccu

SEQ ID NO: 146260 - RNA, 21 nt, Human
gcaaaggucucuucuccuccu

SEQ ID NO: 146261 - RNA, 21 nt, Human
gcaacagacagagcccuccac

SEQ ID NO: 146262 - RNA, 21 nt, Human
gcaacagacagagcccuccac

SEQ ID NO: 146263 - RNA, 19 nt, Human
gcagacacaauucccuggu

SEQ ID NO: 146264 - RNA, 22 nt, Human
gcagagggcagcgccuccucca

SEQ ID NO: 146265 - RNA, 19 nt, Human
gcagccacagggaagcccc

SEQ ID NO: 146266 - RNA, 23 nt, Human
gcagcgguggcagggaaggagca

SEQ ID NO: 146267 - RNA, 23 nt, Human
gcagcgguggcagggaaggagca

SEQ ID NO: 146268 - RNA, 21 nt, Human
gcagcugggggccaccgggcc

SEQ ID NO: 146269 - RNA, 21 nt, Human
gcagcugggggccaccgggcc

SEQ ID NO: 146270 - RNA, 24 nt, Human
gcaggacagaggcaaagucagaag

SEQ ID NO: 146271 - RNA, 24 nt, Human
gcaggacagaggcaaagucagaag

SEQ ID NO: 146272 - RNA, 23 nt, Human
gccauggccaaagggguugggga

SEQ ID NO: 146273 - RNA, 22 nt, Human
gcccacucccucccaacacaca

SEQ ID NO: 146274 - RNA, 19 nt, Human
gcccugcuauguuuccucc

SEQ ID NO: 146275 - RNA, 20 nt, Human
gcccugcuauguuuccuccu

SEQ ID NO: 146276 - RNA, 20 nt, Human
gcccuggacuacaaagaauc

SEQ ID NO: 146277 - RNA, 24 nt, Human
gcccuggggguugcuugcuggucc

SEQ ID NO: 146278 - RNA, 24 nt, Human
gcccuggggguugcuugcuggucc

SEQ ID NO: 146279 - RNA, 19 nt, Human
gccgcagcucaccaccauc

SEQ ID NO: 146280 - RNA, 22 nt, Human
gccgcagcucaccaccauccug

SEQ ID NO: 146281 - RNA, 18 nt, Human
gccuccuccuccgccucc

SEQ ID NO: 146282 - RNA, 20 nt, Human
gccuccuccuccgccuccac

SEQ ID NO: 146283 - RNA, 19 nt, Human
gcggaugacggcguccaca

SEQ ID NO: 146284 - RNA, 19 nt, Human
gcuccugggccucaagagc

SEQ ID NO: 146285 - RNA, 21 nt, Human
gcucugggggucccacucccu

SEQ ID NO: 146286 - RNA, 21 nt, Human
gcugcagcucaugccacccuu

SEQ ID NO: 146287 - RNA, 18 nt, Human
ggaaaacccuaauggcua

SEQ ID NO: 146288 - RNA, 21 nt, Human
ggaagugacaaugccuccucc

SEQ ID NO: 146289 - RNA, 21 nt, Human
ggaagugacaaugccuccucc

SEQ ID NO: 146290 - RNA, 22 nt, Human
ggacuggcacaaggacccuuca

SEQ ID NO: 146291 - RNA, 23 nt, Human
ggagcagccagcacaggcccagg

SEQ ID NO: 146292 - RNA, 23 nt, Human
ggagcagccagcacaggcccagg

SEQ ID NO: 146293 - RNA, 22 nt, Human
ggagggggcaccuucuuugcac

SEQ ID NO: 146294 - RNA, 20 nt, Human
ggagugcacugcucugggcc

SEQ ID NO: 146295 - RNA, 18 nt, Human
ggcagggaagggguccag

SEQ ID NO: 146296 - RNA, 23 nt, Human
ggccagggccccgggauguuugu

SEQ ID NO: 146297 - RNA, 19 nt, Human
ggccagguuggucucccca

SEQ ID NO: 146298 - RNA, 21 nt, Human
ggcucugggggucccacuccc

SEQ ID NO: 146299 - RNA, 19 nt, Human
ggcuguggcucuggggguc

SEQ ID NO: 146300 - RNA, 19 nt, Human
gggccaugguccaggaggc

SEQ ID NO: 146301 - RNA, 22 nt, Human
ggggagcucugagguucugaag

SEQ ID NO: 146302 - RNA, 19 nt, Human
gggguuggggagucacuuc

SEQ ID NO: 146303 - RNA, 22 nt, Human
ggguggcagggaagggguccag

SEQ ID NO: 146304 - RNA, 18 nt, Human
ggguuggggagucacuuc

SEQ ID NO: 146305 - RNA, 18 nt, Human
ggguuggggagucacuuc

SEQ ID NO: 146306 - RNA, 18 nt, Human
ggugccccgggagcccac

SEQ ID NO: 146307 - RNA, 19 nt, Human
guccacaugggccaugagg

SEQ ID NO: 146308 - RNA, 19 nt, Human
gucccuaagggcuugggaa

SEQ ID NO: 146309 - RNA, 19 nt, Human
gucccuaagggcuugggaa

SEQ ID NO: 146310 - RNA, 20 nt, Human
guggaguggagcccccuggg

SEQ ID NO: 146311 - RNA, 24 nt, Human
gugggaagugacaaugccuccucc

SEQ ID NO: 146312 - RNA, 24 nt, Human
gugggaagugacaaugccuccucc

SEQ ID NO: 146313 - RNA, 18 nt, Human
uaaaaggucccuguccca

SEQ ID NO: 146314 - RNA, 24 nt, Human
uaaaaggucccugucccacccucu

SEQ ID NO: 146315 - RNA, 19 nt, Human
uaacucuccacucccaucc

SEQ ID NO: 146316 - RNA, 20 nt, Human
uaaggaagggccugaaauug

SEQ ID NO: 146317 - RNA, 18 nt, Human
uacaaauucccaaccacg

SEQ ID NO: 146318 - RNA, 21 nt, Human
uacaaugcuguggccagggcc

SEQ ID NO: 146319 - RNA, 23 nt, Human
uacacugaugaugcacguggaug

SEQ ID NO: 146320 - RNA, 21 nt, Human
uaccccaaaccccaccucagc

SEQ ID NO: 146321 - RNA, 18 nt, Human
uaccuauuuucccacccc

SEQ ID NO: 146322 - RNA, 19 nt, Human
uacggccaggagccgcugc

SEQ ID NO: 146323 - RNA, 22 nt, Human
uagaccuccgaacaggagccaa

SEQ ID NO: 146324 - RNA, 22 nt, Human
uagagaugggcaagaccucccu

SEQ ID NO: 146325 - RNA, 25 nt, Human
uagcacacaaaaaggggaggacugg

SEQ ID NO: 146326 - RNA, 21 nt, Human
ucaaccccaaguccugcaucc

SEQ ID NO: 146327 - RNA, 21 nt, Human
ucaaccccaaguccugcaucc

SEQ ID NO: 146328 - RNA, 24 nt, Human
ucaagauaccccaaaccccaccuc

SEQ ID NO: 146329 - RNA, 19 nt, Human
ucacagcccuagaccagga

SEQ ID NO: 146330 - RNA, 20 nt, Human
ucacauuccaggcuggagga

SEQ ID NO: 146331 - RNA, 20 nt, Human
ucacauuccaggcuggagga

SEQ ID NO: 146332 - RNA, 21 nt, Human
ucacauuccaggcuggaggag

SEQ ID NO: 146333 - RNA, 21 nt, Human
ucacauuccaggcuggaggag

SEQ ID NO: 146334 - RNA, 18 nt, Human
ucaccucaaccccaaguc

SEQ ID NO: 146335 - RNA, 18 nt, Human
ucaccucaaccccaaguc

SEQ ID NO: 146336 - RNA, 25 nt, Human
ucacgaucaaacaucaguggccacu

SEQ ID NO: 146337 - RNA, 18 nt, Human
ucacugcaguggcaagau

SEQ ID NO: 146338 - RNA, 23 nt, Human
ucacugcaguggcaagaugaggu

SEQ ID NO: 146339 - RNA, 20 nt, Human
ucaggagggggcaccuucuu

SEQ ID NO: 146340 - RNA, 19 nt, Human
ucaggccgugcgcccuggg

SEQ ID NO: 146341 - RNA, 23 nt, Human
uccaacaccugaaugggccucaa

SEQ ID NO: 146342 - RNA, 21 nt, Human
uccaagcuccugccccaaaag

SEQ ID NO: 146343 - RNA, 22 nt, Human
uccacaccaggcaggacagagg

SEQ ID NO: 146344 - RNA, 22 nt, Human
uccacaccaggcaggacagagg

SEQ ID NO: 146345 - RNA, 22 nt, Human
uccacacccaugcuccuccugg

SEQ ID NO: 146346 - RNA, 22 nt, Human
uccacacccaugcuccuccugg

SEQ ID NO: 146347 - RNA, 20 nt, Human
uccacaugggccaugagggc

SEQ ID NO: 146348 - RNA, 24 nt, Human
uccacucccauccuggcccggcca

SEQ ID NO: 146349 - RNA, 23 nt, Human
uccaggcuggaggagugagagga

SEQ ID NO: 146350 - RNA, 23 nt, Human
uccaggcuggaggagugagagga

SEQ ID NO: 146351 - RNA, 21 nt, Human
uccaggugacaaccccagccc

SEQ ID NO: 146352 - RNA, 21 nt, Human
uccaggugacaaccccagccc

SEQ ID NO: 146353 - RNA, 27 nt, Human
uccauaccuaauggggucaugaccaga

SEQ ID NO: 146354 - RNA, 27 nt, Human
uccauaccuaauggggucaugaccaga

SEQ ID NO: 146355 - RNA, 23 nt, Human
ucccaaccacagccucaaaggcc

SEQ ID NO: 146356 - RNA, 21 nt, Human
ucccaagauaaacauucacga

SEQ ID NO: 146357 - RNA, 24 nt, Human
ucccaagauaaacauucacgaucc

SEQ ID NO: 146358 - RNA, 22 nt, Human
ucccaccccauugccagcaaga

SEQ ID NO: 146359 - RNA, 22 nt, Human
ucccaccccauugccagcaaga

SEQ ID NO: 146360 - RNA, 18 nt, Human
ucccaccccuccuugccc

SEQ ID NO: 146361 - RNA, 18 nt, Human
ucccacccucugcccaaa

SEQ ID NO: 146362 - RNA, 21 nt, Human
ucccacggugccccgggagcc

SEQ ID NO: 146363 - RNA, 24 nt, Human
ucccacggugccccgggagcccac

SEQ ID NO: 146364 - RNA, 20 nt, Human
ucccagggcucacccucugu

SEQ ID NO: 146365 - RNA, 19 nt, Human
uccccaagucuaucagaaa

SEQ ID NO: 146366 - RNA, 20 nt, Human
uccccacgaaugcucagcua

SEQ ID NO: 146367 - RNA, 21 nt, Human
uccccaggacgccucccaaca

SEQ ID NO: 146368 - RNA, 20 nt, Human
ucccgaagagggcuggcagu

SEQ ID NO: 146369 - RNA, 22 nt, Human
ucccgcucugccuccugguucu

SEQ ID NO: 146370 - RNA, 20 nt, Human
uccgccuccuccuccgccuc

SEQ ID NO: 146371 - RNA, 20 nt, Human
uccgccuccuccuccgccuc

SEQ ID NO: 146372 - RNA, 22 nt, Human
uccguuccacuccuagcaacau

SEQ ID NO: 146373 - RNA, 21 nt, Human
uccucccagcucuccauaccu

SEQ ID NO: 146374 - RNA, 21 nt, Human
uccucccagcucuccauaccu

SEQ ID NO: 146375 - RNA, 23 nt, Human
uccugccccaaaagacuuucuuu

SEQ ID NO: 146376 - RNA, 23 nt, Human
uccuggagaucuaacaggacuca

SEQ ID NO: 146377 - RNA, 19 nt, Human
uccugggccucaagagccc

SEQ ID NO: 146378 - RNA, 23 nt, Human
uccugggccucaagagcccacuc

SEQ ID NO: 146379 - RNA, 21 nt, Human
ucucacacagcgccucccacc

SEQ ID NO: 146380 - RNA, 19 nt, Human
ucucagguuccucauccau

SEQ ID NO: 146381 - RNA, 21 nt, Human
ucuccacucccauccuggccc

SEQ ID NO: 146382 - RNA, 22 nt, Human
ucuccaggucuucacuccaucc

SEQ ID NO: 146383 - RNA, 19 nt, Human
ucucugagaacauaacuug

SEQ ID NO: 146384 - RNA, 20 nt, Human
ucucuucuccuccuuggucc

SEQ ID NO: 146385 - RNA, 20 nt, Human
ucucuucuccuccuuggucc

SEQ ID NO: 146386 - RNA, 23 nt, Human
ucugagguucugaaguaccuggc

SEQ ID NO: 146387 - RNA, 20 nt, Human
ucugcuggcguccauucccc

SEQ ID NO: 146388 - RNA, 21 nt, Human
ucuggcagcaccagaguacaa

SEQ ID NO: 146389 - RNA, 24 nt, Human
ucugugguggauguuaagcugcuc

SEQ ID NO: 146390 - RNA, 21 nt, Human
ucuuccccaugacuccuuggg

SEQ ID NO: 146391 - RNA, 22 nt, Human
ucuuuguuauucaggauucaga

SEQ ID NO: 146392 - RNA, 23 nt, Human
ugaaauugguaaagcuucccagg

SEQ ID NO: 146393 - RNA, 19 nt, Human
ugaaguaccuggccuaagg

SEQ ID NO: 146394 - RNA, 23 nt, Human
ugacaaugccuccucccagcucu

SEQ ID NO: 146395 - RNA, 23 nt, Human
ugacaaugccuccucccagcucu

SEQ ID NO: 146396 - RNA, 23 nt, Human
ugaccagacaggguaggacccag

SEQ ID NO: 146397 - RNA, 23 nt, Human
ugaccagacaggguaggacccag

SEQ ID NO: 146398 - RNA, 23 nt, Human
ugacuuccuggucucagguuccu

SEQ ID NO: 146399 - RNA, 19 nt, Human
ugagaaaauacaaauuccc

SEQ ID NO: 146400 - RNA, 21 nt, Human
ugagagaaacuagagacaggc

SEQ ID NO: 146401 - RNA, 19 nt, Human
ugagagguaaaggaaaugg

SEQ ID NO: 146402 - RNA, 23 nt, Human
ugauacagguacuuggacaccuu

SEQ ID NO: 146403 - RNA, 24 nt, Human
ugaugcacguggauggguggcagg

SEQ ID NO: 146404 - RNA, 18 nt, Human
ugcaccucauccaccaga

SEQ ID NO: 146405 - RNA, 23 nt, Human
ugcacugcucugggccuccucug

SEQ ID NO: 146406 - RNA, 20 nt, Human
ugcagcucaugccacccucc

SEQ ID NO: 146407 - RNA, 23 nt, Human
ugccaugcggcucugggacuggc

SEQ ID NO: 146408 - RNA, 23 nt, Human
ugccaugcggcucugggacuggc

SEQ ID NO: 146409 - RNA, 24 nt, Human
ugccauggccaaagggguugggga

SEQ ID NO: 146410 - RNA, 24 nt, Human
ugccauggccaaagggguugggga

SEQ ID NO: 146411 - RNA, 21 nt, Human
ugcccagugcaguaccugcag

SEQ ID NO: 146412 - RNA, 22 nt, Human
ugcccuggggguugcuugcugg

SEQ ID NO: 146413 - RNA, 22 nt, Human
ugcccuggggguugcuugcugg

SEQ ID NO: 146414 - RNA, 21 nt, Human
ugccugcaucacucccuccca

SEQ ID NO: 146415 - RNA, 20 nt, Human
ugcugggugaaggggcaucc

SEQ ID NO: 146416 - RNA, 18 nt, Human
uggaaagagagggcugcc

SEQ ID NO: 146417 - RNA, 20 nt, Human
uggaaagagagggcugccac

SEQ ID NO: 146418 - RNA, 19 nt, Human
uggaguggagcccccuggg

SEQ ID NO: 146419 - RNA, 21 nt, Human
uggauggguggcagggaaggg

SEQ ID NO: 146420 - RNA, 22 nt, Human
uggcagcccaguccaaaaggug

SEQ ID NO: 146421 - RNA, 22 nt, Human
uggcagcccaguccaaaaggug

SEQ ID NO: 146422 - RNA, 21 nt, Human
uggcagugguagagguggcug

SEQ ID NO: 146423 - RNA, 19 nt, Human
uggcauaggcuggcuucac

SEQ ID NO: 146424 - RNA, 18 nt, Human
uggcccagccacuucugc

SEQ ID NO: 146425 - RNA, 19 nt, Human
uggcccggccaggcucagg

SEQ ID NO: 146426 - RNA, 20 nt, Human
uggccuccacggcugccccc

SEQ ID NO: 146427 - RNA, 20 nt, Human
uggccuccacggcugccccc

SEQ ID NO: 146428 - RNA, 23 nt, Human
uggcgagcuuuuuccuccggccc

SEQ ID NO: 146429 - RNA, 25 nt, Human
uggcuagagaaaggaaaaaaaaaaa

SEQ ID NO: 146430 - RNA, 18 nt, Human
uggcugacaggacuuccc

SEQ ID NO: 146431 - RNA, 18 nt, Human
uggcugacaggacuuccc

SEQ ID NO: 146432 - RNA, 26 nt, Human
ugggaagacagccagcacagugccug

SEQ ID NO: 146433 - RNA, 21 nt, Human
ugggaagggacccuucagggu

SEQ ID NO: 146434 - RNA, 21 nt, Human
ugggaagggacccuucagggu

SEQ ID NO: 146435 - RNA, 24 nt, Human
ugggaagggacccuucaggguggc

SEQ ID NO: 146436 - RNA, 24 nt, Human
ugggaagggacccuucaggguggc

SEQ ID NO: 146437 - RNA, 23 nt, Human
ugggagaagaauugggccauggu

SEQ ID NO: 146438 - RNA, 22 nt, Human
ugggagguucuggagccccaac

SEQ ID NO: 146439 - RNA, 20 nt, Human
ugggcaagaccuccccaauu

SEQ ID NO: 146440 - RNA, 19 nt, Human
uggggagucacuucacauu

SEQ ID NO: 146441 - RNA, 19 nt, Human
uggggagucacuucacauu

SEQ ID NO: 146442 - RNA, 18 nt, Human
uggggcagggugaggcag

SEQ ID NO: 146443 - RNA, 18 nt, Human
uggggcagggugaggcag

SEQ ID NO: 146444 - RNA, 23 nt, Human
uggggccagguuggucuccccag

SEQ ID NO: 146445 - RNA, 28 nt, Human
uggggguugcuugcuggucccgaccacg

SEQ ID NO: 146446 - RNA, 28 nt, Human
uggggguugcuugcuggucccgaccacg

SEQ ID NO: 146447 - RNA, 27 nt, Human
ugguagagguggcuguggcucuggggg

SEQ ID NO: 146448 - RNA, 18 nt, Human
ugguaggaggggagcagg

SEQ ID NO: 146449 - RNA, 20 nt, Human
ugguaggaggggagcagggg

SEQ ID NO: 146450 - RNA, 18 nt, Human
ugguggauguuaagcugc

SEQ ID NO: 146451 - RNA, 22 nt, Human
uguacauucucacacagcgccu

SEQ ID NO: 146452 - RNA, 24 nt, Human
ugucccacccucugcccaaaguca

SEQ ID NO: 146453 - RNA, 19 nt, Human
ugucugggaagacagccag

SEQ ID NO: 146454 - RNA, 26 nt, Human
ugugauacagguacuuggacaccuuu

SEQ ID NO: 146455 - RNA, 26 nt, Human
ugugauacagguacuuggacaccuuu

SEQ ID NO: 146456 - RNA, 24 nt, Human
ugugcaccucauccaccagaccuu

SEQ ID NO: 146457 - RNA, 19 nt, Human
uguggcucuggggguccca

SEQ ID NO: 146458 - RNA, 19 nt, Human
uucaagauaccccaaaccc

SEQ ID NO: 146459 - RNA, 21 nt, Human
uucacauuccaggcuggagga

SEQ ID NO: 146460 - RNA, 23 nt, Human
uucccaaccacagccucaaaggc

SEQ ID NO: 146461 - RNA, 19 nt, Human
uucccaccccuccuugccc

SEQ ID NO: 146462 - RNA, 21 nt, Human
uucccagguaauucuaccaug

SEQ ID NO: 146463 - RNA, 24 nt, Human
uuccucauccauggauccaaugga

SEQ ID NO: 146464 - RNA, 18 nt, Human
uucuuggcugacaggacu

SEQ ID NO: 146465 - RNA, 18 nt, Human
uucuuggcugacaggacu

SEQ ID NO: 146466 - RNA, 26 nt, Human
uugcuggguaacccuagccaguucca

SEQ ID NO: 146467 - RNA, 18 nt, Human
uugguccucagcaacaga

SEQ ID NO: 146468 - RNA, 18 nt, Human
uugguccucagcaacaga

SEQ ID NO: 146469 - RNA, 18 nt, Human
uuuuuuuuuuuuuuuuug

SEQ ID NO: 146470 - RNA, 19 nt, Human
uuuuuuuuuuuuuuuuugc

SEQ ID NO: 146471 - RNA, 21 nt, Human
uuuuuuuuuuuuuuuuugcag

SEQ ID NO: 146472 - RNA, 21 nt, Human
uuuuuuuuuuuuuuuuugcag

SEQ ID NO: 146473 - RNA, 23 nt, Human
uuuuuuuuuuuuuuuuugcagcu

SEQ ID NO: 146474 - RNA, 27 nt, Human
uuuuuuuuuuuuuuuuuuuuuuugggg

SEQ ID NO: 146475 - RNA, 23 nt, Human
aaaaaaaaaaaacaggaacaccc

SEQ ID NO: 146476 - RNA, 18 nt, Human
aaaaaaaacaggaacacc

SEQ ID NO: 146477 - RNA, 20 nt, Human
aaaaaacaggaacacccaca

SEQ ID NO: 146478 - RNA, 24 nt, Human
aaacaggaacacccacauuuccaa

SEQ ID NO: 146479 - RNA, 26 nt, Human
aaaccugcggcugccacgguacccga

SEQ ID NO: 146480 - RNA, 26 nt, Human
aaaccugcggcugccacgguacccga

SEQ ID NO: 146481 - RNA, 19 nt, Human
aacagcccuggauuaagac

SEQ ID NO: 146482 - RNA, 18 nt, Human
aagcaaccaaaacaacua

SEQ ID NO: 146483 - RNA, 29 nt, Human
aagcaaccaaaacaacuaauggugggcac

SEQ ID NO: 146484 - RNA, 21 nt, Human
aaggaaaauauuucuggcucu

SEQ ID NO: 146485 - RNA, 18 nt, Human
aaguaccacacacaagac

SEQ ID NO: 146486 - RNA, 24 nt, Human
aaguauuuacugagcccuuacuau

SEQ ID NO: 146487 - RNA, 23 nt, Human
aauauuucuggcucuuuaauguu

SEQ ID NO: 146488 - RNA, 22 nt, Human
acaagacaauaaacauaauaag

SEQ ID NO: 146489 - RNA, 20 nt, Human
acaugucuuaucuggaaauu

SEQ ID NO: 146490 - RNA, 20 nt, Human
acccacauuuccaacuccac

SEQ ID NO: 146491 - RNA, 19 nt, Human
acuccagagaaaggauaca

SEQ ID NO: 146492 - RNA, 21 nt, Human
acugccgcgacugcggccaga

SEQ ID NO: 146493 - RNA, 19 nt, Human
agacgagaacucaaauagc

SEQ ID NO: 146494 - RNA, 23 nt, Human
agagagggaacgaucuacacgag

SEQ ID NO: 146495 - RNA, 23 nt, Human
agagagggaacgaucuacacgag

SEQ ID NO: 146496 - RNA, 20 nt, Human
agcaaccaaaacaacuaaug

SEQ ID NO: 146497 - RNA, 19 nt, Human
agccgcugcagcgucgggg

SEQ ID NO: 146498 - RNA, 21 nt, Human
aggcagaaaauccagguugca

SEQ ID NO: 146499 - RNA, 21 nt, Human
agguugugauaauucuccaga

SEQ ID NO: 146500 - RNA, 18 nt, Human
aucuacacgagcgcgaag

SEQ ID NO: 146501 - RNA, 18 nt, Human
aucuacacgagcgcgaag

SEQ ID NO: 146502 - RNA, 24 nt, Human
auuagguugugauaauucuccaga

SEQ ID NO: 146503 - RNA, 22 nt, Human
auuuuuuucuuuucaaaccucc

SEQ ID NO: 146504 - RNA, 22 nt, Human
caaaaccagaagaggaaaaagu

SEQ ID NO: 146505 - RNA, 18 nt, Human
caaagcaaccaaaacaac

SEQ ID NO: 146506 - RNA, 19 nt, Human
caacaaagcaaccaaaaca

SEQ ID NO: 146507 - RNA, 23 nt, Human
caacaaagcaaccaaaacaacua

SEQ ID NO: 146508 - RNA, 25 nt, Human
caacaaagcaaccaaaacaacuaau

SEQ ID NO: 146509 - RNA, 20 nt, Human
caacaaguauuuacugagcc

SEQ ID NO: 146510 - RNA, 19 nt, Human
caacacagucuuggcaaga

SEQ ID NO: 146511 - RNA, 22 nt, Human
caacuccaccuccccucucaaa

SEQ ID NO: 146512 - RNA, 23 nt, Human
caagggaaaguuucucgcaacuc

SEQ ID NO: 146513 - RNA, 23 nt, Human
caagggaaaguuucucgcaacuc

SEQ ID NO: 146514 - RNA, 23 nt, Human
cacacauguuuauuguauaucag

SEQ ID NO: 146515 - RNA, 24 nt, Human
cagaaaccccaacagcccuggauu

SEQ ID NO: 146516 - RNA, 20 nt, Human
cagaaaccugcggcugccac

SEQ ID NO: 146517 - RNA, 20 nt, Human
cagaaaccugcggcugccac

SEQ ID NO: 146518 - RNA, 19 nt, Human
cagcaaaauggagcugagg

SEQ ID NO: 146519 - RNA, 21 nt, Human
cagcaaaauggagcugaggca

SEQ ID NO: 146520 - RNA, 22 nt, Human
cagcaaaauggagcugaggcag

SEQ ID NO: 146521 - RNA, 23 nt, Human
cagcaaaauggagcugaggcaga

SEQ ID NO: 146522 - RNA, 26 nt, Human
cagcgugcaaccagagagggaacgau

SEQ ID NO: 146523 - RNA, 26 nt, Human
cagcgugcaaccagagagggaacgau

SEQ ID NO: 146524 - RNA, 22 nt, Human
cauugugcuuacacuccagaga

SEQ ID NO: 146525 - RNA, 23 nt, Human
ccacauuuccaacuccaccuccc

SEQ ID NO: 146526 - RNA, 24 nt, Human
ccaccuccccucucaaauuguuca

SEQ ID NO: 146527 - RNA, 19 nt, Human
ccagguaagaacugaaaau

SEQ ID NO: 146528 - RNA, 19 nt, Human
ccgagccgcugcagcgucg

SEQ ID NO: 146529 - RNA, 19 nt, Human
ccgagccgcugcagcgucg

SEQ ID NO: 146530 - RNA, 20 nt, Human
cgaagccgaggcgcggggag

SEQ ID NO: 146531 - RNA, 23 nt, Human
cggcgagcagugcggcgcaagga

SEQ ID NO: 146532 - RNA, 24 nt, Human
cggcgagcagugcggcgcaaggag

SEQ ID NO: 146533 - RNA, 24 nt, Human
cggcgagcagugcggcgcaaggag

SEQ ID NO: 146534 - RNA, 20 nt, Human
cuaaaaaaaaaaaaaaaaaa

SEQ ID NO: 146535 - RNA, 21 nt, Human
cuaaaaugaacaaggccagca

SEQ ID NO: 146536 - RNA, 21 nt, Human
cuccagaaaccccaacagccc

SEQ ID NO: 146537 - RNA, 18 nt, Human
cugcaggaauuucuggag

SEQ ID NO: 146538 - RNA, 20 nt, Human
cuggaaauuuuccaaaaccg

SEQ ID NO: 146539 - RNA, 23 nt, Human
cuucuggggaauuagguucccag

SEQ ID NO: 146540 - RNA, 21 nt, Human
gaagaggccaucuuuggaucu

SEQ ID NO: 146541 - RNA, 20 nt, Human
gaaguaccacacacaagaca

SEQ ID NO: 146542 - RNA, 21 nt, Human
gauuaagaacaucuggaaauu

SEQ ID NO: 146543 - RNA, 20 nt, Human
gcaggacugggaaaaaagga

SEQ ID NO: 146544 - RNA, 18 nt, Human
gccgcugcagcgucgggg

SEQ ID NO: 146545 - RNA, 18 nt, Human
ggaugggaagccaccacu

SEQ ID NO: 146546 - RNA, 18 nt, Human
ggcccgggguucagaaac

SEQ ID NO: 146547 - RNA, 18 nt, Human
ggcccgggguucagaaac

SEQ ID NO: 146548 - RNA, 22 nt, Human
ggcgagcagugcggcgcaagga

SEQ ID NO: 146549 - RNA, 24 nt, Human
gggaucugccuucgggaaccagcg

SEQ ID NO: 146550 - RNA, 24 nt, Human
gggaucugccuucgggaaccagcg

SEQ ID NO: 146551 - RNA, 18 nt, Human
ggggaugggaagccacca

SEQ ID NO: 146552 - RNA, 19 nt, Human
ggugcggagcuccacgacc

SEQ ID NO: 146553 - RNA, 19 nt, Human
ggugcggagcuccacgacc

SEQ ID NO: 146554 - RNA, 23 nt, Human
gugacaugucuuaucuggaaauu

SEQ ID NO: 146555 - RNA, 18 nt, Human
uaaauuuaaauuccauuc

SEQ ID NO: 146556 - RNA, 23 nt, Human
uaacacaaaacuaccagggauau

SEQ ID NO: 146557 - RNA, 18 nt, Human
uagagagccaagugagcu

SEQ ID NO: 146558 - RNA, 27 nt, Human
uauaucaguagaccuagcucuuuccac

SEQ ID NO: 146559 - RNA, 20 nt, Human
ucaacacagucuuggcaaga

SEQ ID NO: 146560 - RNA, 19 nt, Human
ucacuaugacagcagcccu

SEQ ID NO: 146561 - RNA, 18 nt, Human
uccagaaaccccaacagc

SEQ ID NO: 146562 - RNA, 26 nt, Human
uccagagaaaggauacaagacaauaa

SEQ ID NO: 146563 - RNA, 18 nt, Human
uccguacauaacaaagga

SEQ ID NO: 146564 - RNA, 19 nt, Human
ucuuggcaagaaaacauga

SEQ ID NO: 146565 - RNA, 24 nt, Human
ugagcugaagaaagacugcuaggg

SEQ ID NO: 146566 - RNA, 21 nt, Human
ugaggcagugcgaucugugcu

SEQ ID NO: 146567 - RNA, 21 nt, Human
ugcacacauguuuauuguaua

SEQ ID NO: 146568 - RNA, 19 nt, Human
ugccaucuuuauucagaaa

SEQ ID NO: 146569 - RNA, 24 nt, Human
ugcuuuuuuuguguuaaaggguga

SEQ ID NO: 146570 - RNA, 18 nt, Human
uggagaaaaaauuguguu

SEQ ID NO: 146571 - RNA, 25 nt, Human
uggauuaagaacaucuggaaauugu

SEQ ID NO: 146572 - RNA, 19 nt, Human
uggucauacugccaaccac

SEQ ID NO: 146573 - RNA, 20 nt, Human
ugugaaggaugcaagaagua

SEQ ID NO: 146574 - RNA, 21 nt, Human
uuaacacaaaacuaccaggga

SEQ ID NO: 146575 - RNA, 25 nt, Human
uucagcaaaauggagcugaggcaga

SEQ ID NO: 146576 - RNA, 24 nt, Human
uuccaugauucuggucauacugcc

SEQ ID NO: 146577 - RNA, 24 nt, Human
uuccauuccaacaaagcaaccaaa

SEQ ID NO: 146578 - RNA, 20 nt, Human
uucuuuucaaaccuccuccu

SEQ ID NO: 146579 - RNA, 22 nt, Human
uugcaggacugggaaaaaagga

SEQ ID NO: 146580 - RNA, 24 nt, Human
uuucaaaccuccuccuuucaaauc

SEQ ID NO: 146581 - RNA, 22 nt, Human
uuuccacaguuaucagugguua

SEQ ID NO: 146582 - RNA, 19 nt, Human
uuuuggggaugggaagcca

SEQ ID NO: 146583 - RNA, 21 nt, Human
uuuuggggaugggaagccacc

SEQ ID NO: 146584 - RNA, 22 nt, Human
uuuuuuguguugccaucuuuau

SEQ ID NO: 146585 - RNA, 20 nt, Human
uuuuuuuuuuuuuuuuuugu

SEQ ID NO: 146586 - RNA, 24 nt, Human
uuuuuuuuuuuuuuuuuuuuuggg

SEQ ID NO: 146587 - RNA, 23 nt, Human
aaaaaaaaaaaagaaaaaccaaa

SEQ ID NO: 146588 - RNA, 27 nt, Human
aaaaaagaaaaaccaaaccauauuuug

SEQ ID NO: 146589 - RNA, 20 nt, Human
aaaaagaaaaaccaaaccau

SEQ ID NO: 146590 - RNA, 18 nt, Human
aaaccaaaaggacgaaga

SEQ ID NO: 146591 - RNA, 20 nt, Human
aaaccccauuuugccaacuc

SEQ ID NO: 146592 - RNA, 21 nt, Human
aaagggaauaguaauugggga

SEQ ID NO: 146593 - RNA, 21 nt, Human
aagaaaaacgaaauccauggc

SEQ ID NO: 146594 - RNA, 20 nt, Human
aagggugcagggcagggcuc

SEQ ID NO: 146595 - RNA, 24 nt, Human
acaaaauaaugaacugcauguucc

SEQ ID NO: 146596 - RNA, 23 nt, Human
acaccacauaucccaugggcaau

SEQ ID NO: 146597 - RNA, 26 nt, Human
acacuuucaaaaaaaaaaaagaaaaa

SEQ ID NO: 146598 - RNA, 19 nt, Human
accaaaccauauuuugcca

SEQ ID NO: 146599 - RNA, 21 nt, Human
acuacaacauuccaacuccug

SEQ ID NO: 146600 - RNA, 23 nt, Human
agaaaggauuguuggccaauaga

SEQ ID NO: 146601 - RNA, 18 nt, Human
agcaaggggcaucacaca

SEQ ID NO: 146602 - RNA, 23 nt, Human
agcaguauuuacaaaaagguuaa

SEQ ID NO: 146603 - RNA, 23 nt, Human
aggaacccuccucuccuauggcc

SEQ ID NO: 146604 - RNA, 18 nt, Human
agggcagggcucugaggg

SEQ ID NO: 146605 - RNA, 23 nt, Human
aggggccgguccugcggcggcgg

SEQ ID NO: 146606 - RNA, 21 nt, Human
aguaccccaagaaaaacgaaa

SEQ ID NO: 146607 - RNA, 22 nt, Human
auagaggugaagaacuuggaca

SEQ ID NO: 146608 - RNA, 19 nt, Human
aucacucccugccccccuu

SEQ ID NO: 146609 - RNA, 18 nt, Human
auuccaacuccugaauau

SEQ ID NO: 146610 - RNA, 23 nt, Human
caagaaaaacgaaauccauggca

SEQ ID NO: 146611 - RNA, 23 nt, Human
caagaguaccccaagaaaaacga

SEQ ID NO: 146612 - RNA, 21 nt, Human
caccacauaucccaugggcaa

SEQ ID NO: 146613 - RNA, 21 nt, Human
cacuguacaagggugcagggc

SEQ ID NO: 146614 - RNA, 22 nt, Human
cagcccggggcuggagcugcag

SEQ ID NO: 146615 - RNA, 19 nt, Human
caggcagcugaagucaaag

SEQ ID NO: 146616 - RNA, 20 nt, Human
caucacucccugccccccuu

SEQ ID NO: 146617 - RNA, 18 nt, Human
caucagcaaggggcauca

SEQ ID NO: 146618 - RNA, 22 nt, Human
ccaaaauccaugcaaaucaagu

SEQ ID NO: 146619 - RNA, 20 nt, Human
ccaaagccucccccaaauca

SEQ ID NO: 146620 - RNA, 19 nt, Human
cccaagaaaaacgaaaucc

SEQ ID NO: 146621 - RNA, 18 nt, Human
ccccaaaucaucacuccc

SEQ ID NO: 146622 - RNA, 19 nt, Human
ccccaaaucaucacucccu

SEQ ID NO: 146623 - RNA, 22 nt, Human
ccccaagaaaaacgaaauccau

SEQ ID NO: 146624 - RNA, 23 nt, Human
ccccaagugaggaccuaacucca

SEQ ID NO: 146625 - RNA, 24 nt, Human
cccccaaaucaucacucccugccc

SEQ ID NO: 146626 - RNA, 18 nt, Human
ccccuuaaggcuagaggu

SEQ ID NO: 146627 - RNA, 24 nt, Human
cccggggcuggagcugcaggggac

SEQ ID NO: 146628 - RNA, 18 nt, Human
cccugccccccuuaaggc

SEQ ID NO: 146629 - RNA, 20 nt, Human
cccuuaaggcuagaggugag

SEQ ID NO: 146630 - RNA, 20 nt, Human
cccuuucuuuccccuuuccc

SEQ ID NO: 146631 - RNA, 25 nt, Human
ccuauggccaucuccuccuccuguc

SEQ ID NO: 146632 - RNA, 24 nt, Human
ccucacaauugcacaugucaagcc

SEQ ID NO: 146633 - RNA, 23 nt, Human
ccuuuucccuuucuuuccccuuu

SEQ ID NO: 146634 - RNA, 24 nt, Human
cgaaauccauggcacagacacugu

SEQ ID NO: 146635 - RNA, 21 nt, Human
cgaccccgacucgcccugggc

SEQ ID NO: 146636 - RNA, 27 nt, Human
cggauggcggcggcggcuccccaaguu

SEQ ID NO: 146637 - RNA, 20 nt, Human
cgggggggugcagcccgggg

SEQ ID NO: 146638 - RNA, 18 nt, Human
cucccaaagccuccccca

SEQ ID NO: 146639 - RNA, 20 nt, Human
cucccaaagccucccccaaa

SEQ ID NO: 146640 - RNA, 20 nt, Human
cucccccaaaucaucacucc

SEQ ID NO: 146641 - RNA, 24 nt, Human
cuucacaucaagaguaccccaaga

SEQ ID NO: 146642 - RNA, 27 nt, Human
cuuucaaaaaaaaaaaagaaaaaccaa

SEQ ID NO: 146643 - RNA, 19 nt, Human
cuuuuucucccuuuucccu

SEQ ID NO: 146644 - RNA, 23 nt, Human
gaccccgacucgcccugggcgcg

SEQ ID NO: 146645 - RNA, 20 nt, Human
gagaguucagauuuuguuuu

SEQ ID NO: 146646 - RNA, 25 nt, Human
gcgaccccgacucgcccugggcgcg

SEQ ID NO: 146647 - RNA, 22 nt, Human
gcggaggcuggggcaggggccg

SEQ ID NO: 146648 - RNA, 22 nt, Human
gcggcggcggauggcggcggcg

SEQ ID NO: 146649 - RNA, 20 nt, Human
gcggcggcggcuccccaagu

SEQ ID NO: 146650 - RNA, 22 nt, Human
gcggggcgcggggaacacugag

SEQ ID NO: 146651 - RNA, 23 nt, Human
gcucagcucagcccucuuccuua

SEQ ID NO: 146652 - RNA, 19 nt, Human
gcucccaaagccuccccca

SEQ ID NO: 146653 - RNA, 23 nt, Human
gcucccaaagccucccccaaauc

SEQ ID NO: 146654 - RNA, 22 nt, Human
gcuggagcugcaggggacaccg

SEQ ID NO: 146655 - RNA, 23 nt, Human
gcuuggcuuuuuuuuuuuuuuuu

SEQ ID NO: 146656 - RNA, 22 nt, Human
ggacauggcuguuucaggcagc

SEQ ID NO: 146657 - RNA, 23 nt, Human
ggcgggggggugcagcccggggc

SEQ ID NO: 146658 - RNA, 24 nt, Human
gggaacacugagaagcgugcaggc

SEQ ID NO: 146659 - RNA, 24 nt, Human
gggaagugggcagaaaggauuguu

SEQ ID NO: 146660 - RNA, 19 nt, Human
gggaauaguaauuggggaa

SEQ ID NO: 146661 - RNA, 24 nt, Human
gggaauaguaauuggggaagggga

SEQ ID NO: 146662 - RNA, 23 nt, Human
gggcgggggggugcagcccgggg

SEQ ID NO: 146663 - RNA, 18 nt, Human
gggcuggagcugcagggg

SEQ ID NO: 146664 - RNA, 23 nt, Human
ggggaaggggaagugggcagaaa

SEQ ID NO: 146665 - RNA, 25 nt, Human
ggggcgggggggugcagcccggggc

SEQ ID NO: 146666 - RNA, 22 nt, Human
uaacauacaaaaaucgccgccu

SEQ ID NO: 146667 - RNA, 22 nt, Human
uacaacauuccaacuccugaau

SEQ ID NO: 146668 - RNA, 21 nt, Human
uacauuuucaguuaaaaaaau

SEQ ID NO: 146669 - RNA, 23 nt, Human
uagaaccacaaaauaaugaacug

SEQ ID NO: 146670 - RNA, 20 nt, Human
uagcauugaagggagcaagg

SEQ ID NO: 146671 - RNA, 19 nt, Human
uaucccaugggcaauaaag

SEQ ID NO: 146672 - RNA, 25 nt, Human
uauuuucguuuuaauuuuuuggaag

SEQ ID NO: 146673 - RNA, 25 nt, Human
uauuuugcucccaaagccuccccca

SEQ ID NO: 146674 - RNA, 27 nt, Human
uauuuugcucccaaagccucccccaaa

SEQ ID NO: 146675 - RNA, 23 nt, Human
ucacagcaucaucacaaaauaga

SEQ ID NO: 146676 - RNA, 20 nt, Human
ucaguagguaacuacaacau

SEQ ID NO: 146677 - RNA, 24 nt, Human
ucaguuaaaaaaauagacuuuuga

SEQ ID NO: 146678 - RNA, 18 nt, Human
ucccaugggcaauaaagc

SEQ ID NO: 146679 - RNA, 18 nt, Human
ucccccaaaucaucacuc

SEQ ID NO: 146680 - RNA, 19 nt, Human
ucuggagaaccgaagcuca

SEQ ID NO: 146681 - RNA, 19 nt, Human
ucuuguguuucuuuuucuc

SEQ ID NO: 146682 - RNA, 24 nt, Human
ucuuuuucucccuuuucccuuucu

SEQ ID NO: 146683 - RNA, 19 nt, Human
ugagaaccuccaucugacc

SEQ ID NO: 146684 - RNA, 19 nt, Human
ugagaagcgugcaggcggc

SEQ ID NO: 146685 - RNA, 19 nt, Human
ugagaauacugggacugcu

SEQ ID NO: 146686 - RNA, 19 nt, Human
ugcggcggcggaagcuggc

SEQ ID NO: 146687 - RNA, 20 nt, Human
ugcggcggcggaagcuggcu

SEQ ID NO: 146688 - RNA, 20 nt, Human
ugcucccaaagccuccccca

SEQ ID NO: 146689 - RNA, 19 nt, Human
uggagcugcaggggacacc

SEQ ID NO: 146690 - RNA, 23 nt, Human
uggccaucuccuccuccuguccu

SEQ ID NO: 146691 - RNA, 18 nt, Human
ugggcgcgggcgggcgug

SEQ ID NO: 146692 - RNA, 18 nt, Human
uggugucggggcgggggg

SEQ ID NO: 146693 - RNA, 30 nt, Human
ugguuugcuuggcuuuuuuuuuuuuuuuuc

SEQ ID NO: 146694 - RNA, 22 nt, Human
uuauugucacagcaucaucaca

SEQ ID NO: 146695 - RNA, 23 nt, Human
uucaaaaaaaaaaaagaaaaacc

SEQ ID NO: 146696 - RNA, 21 nt, Human
aaaagccguuuuggagagggg

SEQ ID NO: 146697 - RNA, 22 nt, Human
aaacaacccuuuaaagcagggu

SEQ ID NO: 146698 - RNA, 19 nt, Human
aaugucuauuugccacuga

SEQ ID NO: 146699 - RNA, 22 nt, Human
acaaagcauacaaaaauauacu

SEQ ID NO: 146700 - RNA, 24 nt, Human
acaauugcaugcauccuaguuuca

SEQ ID NO: 146701 - RNA, 22 nt, Human
acacaaaaucugaguggauaua

SEQ ID NO: 146702 - RNA, 19 nt, Human
acauccagggucaaaaacc

SEQ ID NO: 146703 - RNA, 22 nt, Human
accaagaaaaaaaaaucaacag

SEQ ID NO: 146704 - RNA, 23 nt, Human
accacacacaccaagaaaaaaaa

SEQ ID NO: 146705 - RNA, 21 nt, Human
accuaagagagacuagaaugg

SEQ ID NO: 146706 - RNA, 23 nt, Human
acuauagucacaaaccauccauu

SEQ ID NO: 146707 - RNA, 20 nt, Human
agaaaaaaaaaucaacagaa

SEQ ID NO: 146708 - RNA, 22 nt, Human
agaccucagcccucuuggccag

SEQ ID NO: 146709 - RNA, 23 nt, Human
agccaggaguugcugguguagug

SEQ ID NO: 146710 - RNA, 20 nt, Human
agccugggaugguaucuccu

SEQ ID NO: 146711 - RNA, 19 nt, Human
aggcauaaauauacagcca

SEQ ID NO: 146712 - RNA, 19 nt, Human
agggguuggacugagccug

SEQ ID NO: 146713 - RNA, 21 nt, Human
agggguuggacugagccuggg

SEQ ID NO: 146714 - RNA, 21 nt, Human
aucaacucugacauccagggu

SEQ ID NO: 146715 - RNA, 19 nt, Human
aucaauugcuccucgcuca

SEQ ID NO: 146716 - RNA, 24 nt, Human
caaacaacccuuuaaagcaggguc

SEQ ID NO: 146717 - RNA, 20 nt, Human
caacacaauugcaugcaucc

SEQ ID NO: 146718 - RNA, 22 nt, Human
caacagaaauaaaaguagcaaa

SEQ ID NO: 146719 - RNA, 21 nt, Human
caacccauuuacaugcagccu

SEQ ID NO: 146720 - RNA, 22 nt, Human
caaugucccccaaaucaguccc

SEQ ID NO: 146721 - RNA, 21 nt, Human
cacaaaacaaagcauacaaaa

SEQ ID NO: 146722 - RNA, 19 nt, Human
cacacacaccaagaaaaaa

SEQ ID NO: 146723 - RNA, 27 nt, Human
caccacacacaccaagaaaaaaaaauc

SEQ ID NO: 146724 - RNA, 21 nt, Human
cagcuccaguggacaaagggc

SEQ ID NO: 146725 - RNA, 25 nt, Human
cagugaguccccucgccgagcuauu

SEQ ID NO: 146726 - RNA, 22 nt, Human
cauugcacuucuguucucugag

SEQ ID NO: 146727 - RNA, 24 nt, Human
cauugcacuucuguucucugagua

SEQ ID NO: 146728 - RNA, 24 nt, Human
ccaagaaaaaaaaaucaacagaaa

SEQ ID NO: 146729 - RNA, 25 nt, Human
ccacacacaccaagaaaaaaaaauc

SEQ ID NO: 146730 - RNA, 18 nt, Human
cccaaaucagucccaagc

SEQ ID NO: 146731 - RNA, 18 nt, Human
ccggcugcugggaagcca

SEQ ID NO: 146732 - RNA, 21 nt, Human
ccucagcccucuuggccaggg

SEQ ID NO: 146733 - RNA, 24 nt, Human
ccugucuguguuccggcugcuggg

SEQ ID NO: 146734 - RNA, 23 nt, Human
cucagcccucuuggccaggggau

SEQ ID NO: 146735 - RNA, 21 nt, Human
cuccaccaaagcccuuugccc

SEQ ID NO: 146736 - RNA, 23 nt, Human
cuccugucuguguuccggcugcu

SEQ ID NO: 146737 - RNA, 23 nt, Human
cuccuuuugcccuccacacuuaa

SEQ ID NO: 146738 - RNA, 19 nt, Human
cucgcacaaccuggagacc

SEQ ID NO: 146739 - RNA, 19 nt, Human
cuuugcccaacaaagggag

SEQ ID NO: 146740 - RNA, 18 nt, Human
gaaaaaaaaaucaacaga

SEQ ID NO: 146741 - RNA, 21 nt, Human
gagcugguguaucagccugag

SEQ ID NO: 146742 - RNA, 18 nt, Human
gcacaaccuggagaccca

SEQ ID NO: 146743 - RNA, 21 nt, Human
gccacagaguguggcauaaag

SEQ ID NO: 146744 - RNA, 22 nt, Human
gcuugucuuuuugcugucccca

SEQ ID NO: 146745 - RNA, 21 nt, Human
ggacaggaaagggugguagug

SEQ ID NO: 146746 - RNA, 23 nt, Human
ggagcagauauugcuacguuccu

SEQ ID NO: 146747 - RNA, 18 nt, Human
gggaagccaggaguugcu

SEQ ID NO: 146748 - RNA, 22 nt, Human
gugcagcuccaguggacaaagg

SEQ ID NO: 146749 - RNA, 23 nt, Human
uaaagcagggucagaccucagcc

SEQ ID NO: 146750 - RNA, 21 nt, Human
uaagagagacuagaaugggcu

SEQ ID NO: 146751 - RNA, 20 nt, Human
uaaggcaacccauuuacaug

SEQ ID NO: 146752 - RNA, 20 nt, Human
uaagucacaaaacaaagcau

SEQ ID NO: 146753 - RNA, 26 nt, Human
uaagucacaaaacaaagcauacaaaa

SEQ ID NO: 146754 - RNA, 23 nt, Human
uagcaaaaccuagucaaacaacc

SEQ ID NO: 146755 - RNA, 22 nt, Human
uagucaaacaacccuuuaaagc

SEQ ID NO: 146756 - RNA, 21 nt, Human
uauuaagagcuaaugaccaaa

SEQ ID NO: 146757 - RNA, 25 nt, Human
ucaaaaaccugugaugggucaaaau

SEQ ID NO: 146758 - RNA, 19 nt, Human
ucaacagaaauaaaaguag

SEQ ID NO: 146759 - RNA, 24 nt, Human
ucaacagaaauaaaaguagcaaaa

SEQ ID NO: 146760 - RNA, 24 nt, Human
uccauaauaaggcaacccauuuac

SEQ ID NO: 146761 - RNA, 20 nt, Human
uccccacaccaccuccuucu

SEQ ID NO: 146762 - RNA, 18 nt, Human
ucuguguuccggcugcug

SEQ ID NO: 146763 - RNA, 18 nt, Human
ugaaaaaauagccuacau

SEQ ID NO: 146764 - RNA, 22 nt, Human
ugaaauuugacuacaaagguaa

SEQ ID NO: 146765 - RNA, 22 nt, Human
ugacauccagggucaaaaaccu

SEQ ID NO: 146766 - RNA, 22 nt, Human
ugagacaacuagauaugcucug

SEQ ID NO: 146767 - RNA, 19 nt, Human
ugaguauauaauacauauu

SEQ ID NO: 146768 - RNA, 22 nt, Human
uggcauaaaggcuauacuucac

SEQ ID NO: 146769 - RNA, 19 nt, Human
uggccaggggauccccaca

SEQ ID NO: 146770 - RNA, 21 nt, Human
ugggaagccaggaguugcugg

SEQ ID NO: 146771 - RNA, 22 nt, Human
uggguacaucaaaaauacacaa

SEQ ID NO: 146772 - RNA, 23 nt, Human
ugguuuugcguuagaauagauuu

SEQ ID NO: 146773 - RNA, 21 nt, Human
uguuuuuuaagaaauaagaaa

SEQ ID NO: 146774 - RNA, 26 nt, Human
uucugagccuccccuuugccuugggu

SEQ ID NO: 146775 - RNA, 21 nt, Human
aaaaaagaaaaaaguggaaaa

SEQ ID NO: 146776 - RNA, 26 nt, Human
aaaacaaaacaaaacaaaaaugguac

SEQ ID NO: 146777 - RNA, 19 nt, Human
aaacaaaacaaaacaaaaa

SEQ ID NO: 146778 - RNA, 22 nt, Human
aaaggagggguucugaggggcc

SEQ ID NO: 146779 - RNA, 21 nt, Human
aacaugcagacauauaaaaaa

SEQ ID NO: 146780 - RNA, 19 nt, Human
aagaaauaaaaacauccac

SEQ ID NO: 146781 - RNA, 22 nt, Human
aaggagugggagggcagggggc

SEQ ID NO: 146782 - RNA, 25 nt, Human
aaggcgccuccagcccuggccccug

SEQ ID NO: 146783 - RNA, 20 nt, Human
aaugguacuucuuuuucuua

SEQ ID NO: 146784 - RNA, 22 nt, Human
acaaaacaaaacaaaaauggua

SEQ ID NO: 146785 - RNA, 18 nt, Human
acaaagggcaaaagcaga

SEQ ID NO: 146786 - RNA, 23 nt, Human
acacacacacacucacacacaca

SEQ ID NO: 146787 - RNA, 21 nt, Human
accaaaaaucaaaacaaaaca

SEQ ID NO: 146788 - RNA, 24 nt, Human
accaccaaaaaucaaaacaaaaca

SEQ ID NO: 146789 - RNA, 18 nt, Human
acgcaggcgcgcgugcgu

SEQ ID NO: 146790 - RNA, 25 nt, Human
acucacacacacacauacacacaca

SEQ ID NO: 146791 - RNA, 24 nt, Human
acugcccugaggccuaagagggaa

SEQ ID NO: 146792 - RNA, 26 nt, Human
acugcccugaggccuaagagggaagc

SEQ ID NO: 146793 - RNA, 23 nt, Human
agaacaguuuuauuaaaacaaag

SEQ ID NO: 146794 - RNA, 22 nt, Human
agcuguggcagagagcaaccuu

SEQ ID NO: 146795 - RNA, 20 nt, Human
aggagaggggaucuucucuu

SEQ ID NO: 146796 - RNA, 25 nt, Human
aggagaggggaucuucucuuuuuug

SEQ ID NO: 146797 - RNA, 23 nt, Human
aggcacuggaggggaaaaguggg

SEQ ID NO: 146798 - RNA, 20 nt, Human
aggcaggcucagcgauggcu

SEQ ID NO: 146799 - RNA, 24 nt, Human
aggcugggucgugggggggguggg

SEQ ID NO: 146800 - RNA, 25 nt, Human
agggaagggaugggccaggagaggg

SEQ ID NO: 146801 - RNA, 21 nt, Human
aggggggagggaagaagggaa

SEQ ID NO: 146802 - RNA, 21 nt, Human
aggguuggaugggcuccgccu

SEQ ID NO: 146803 - RNA, 19 nt, Human
aggugagguagggugggga

SEQ ID NO: 146804 - RNA, 21 nt, Human
aguacauucagucaagaccau

SEQ ID NO: 146805 - RNA, 20 nt, Human
aguggcugguugaagccugc

SEQ ID NO: 146806 - RNA, 25 nt, Human
auacaaaagucuuucaaaaaauauc

SEQ ID NO: 146807 - RNA, 23 nt, Human
auauguguauauauguacacuca

SEQ ID NO: 146808 - RNA, 21 nt, Human
aucauuccccauagguuuucc

SEQ ID NO: 146809 - RNA, 24 nt, Human
auccacacacauaacacacguaug

SEQ ID NO: 146810 - RNA, 20 nt, Human
auggaagaccaccuccucca

SEQ ID NO: 146811 - RNA, 21 nt, Human
caaaacaaaacaaaacaaaaa

SEQ ID NO: 146812 - RNA, 24 nt, Human
caaaacaaaacaaaacaaaaaugg

SEQ ID NO: 146813 - RNA, 19 nt, Human
caaaagcagagccagcuuc

SEQ ID NO: 146814 - RNA, 24 nt, Human
caaaagucuuucaaaaaauaucau

SEQ ID NO: 146815 - RNA, 18 nt, Human
caaacccgaagcggcggc

SEQ ID NO: 146816 - RNA, 20 nt, Human
caaagcgggcuagacgccaa

SEQ ID NO: 146817 - RNA, 19 nt, Human
caagaaauaaaaacaucca

SEQ ID NO: 146818 - RNA, 20 nt, Human
caaguaccuggaaauucaca

SEQ ID NO: 146819 - RNA, 24 nt, Human
cacacacacacucacacacacaca

SEQ ID NO: 146820 - RNA, 25 nt, Human
cacacacacucacacacacacauac

SEQ ID NO: 146821 - RNA, 21 nt, Human
cacacacauaacacacguaug

SEQ ID NO: 146822 - RNA, 25 nt, Human
caccaaaaaucaaaacaaaacaaaa

SEQ ID NO: 146823 - RNA, 28 nt, Human
caccaaaaaucaaaacaaaacaaaacaa

SEQ ID NO: 146824 - RNA, 26 nt, Human
caccaccaaaaaucaaaacaaaacaa

SEQ ID NO: 146825 - RNA, 24 nt, Human
cacgcaggcgcgcgugcgugcggc

SEQ ID NO: 146826 - RNA, 19 nt, Human
cagagccagcuuccccaug

SEQ ID NO: 146827 - RNA, 22 nt, Human
cagcaaacacaauauauuuacu

SEQ ID NO: 146828 - RNA, 21 nt, Human
cagccacgugcggacccccag

SEQ ID NO: 146829 - RNA, 18 nt, Human
cagccgggaggcacugga

SEQ ID NO: 146830 - RNA, 21 nt, Human
cagcucaagagucuuaaacac

SEQ ID NO: 146831 - RNA, 22 nt, Human
cagucaagaccaugcugcaagc

SEQ ID NO: 146832 - RNA, 21 nt, Human
cauaaagugacuuuaaaaaca

SEQ ID NO: 146833 - RNA, 20 nt, Human
cauucuguaaacuccagacc

SEQ ID NO: 146834 - RNA, 20 nt, Human
cauuucaauauuucgguuuu

SEQ ID NO: 146835 - RNA, 18 nt, Human
cauuuucuuuuguugcuu

SEQ ID NO: 146836 - RNA, 24 nt, Human
ccaccaaaaaucaaaacaaaacaa

SEQ ID NO: 146837 - RNA, 22 nt, Human
ccaccgccgccaccgccgccgc

SEQ ID NO: 146838 - RNA, 24 nt, Human
ccaccgccgccaccgccgccgcuc

SEQ ID NO: 146839 - RNA, 26 nt, Human
cccacagaucaaacugcccugaggcc

SEQ ID NO: 146840 - RNA, 21 nt, Human
ccccccuuuccacuagagucc

SEQ ID NO: 146841 - RNA, 21 nt, Human
ccccccuuuccacuagagucc

SEQ ID NO: 146842 - RNA, 20 nt, Human
ccgccgccaccgccgccacc

SEQ ID NO: 146843 - RNA, 24 nt, Human
ccgccgccaccgccgccaccgccg

SEQ ID NO: 146844 - RNA, 20 nt, Human
ccgccgccaccgccgccgcu

SEQ ID NO: 146845 - RNA, 22 nt, Human
ccgccgccaccgccgccgcucg

SEQ ID NO: 146846 - RNA, 26 nt, Human
ccgccgccaccgccgccgcucgcucc

SEQ ID NO: 146847 - RNA, 23 nt, Human
ccgccgccgccaccgccgccacc

SEQ ID NO: 146848 - RNA, 18 nt, Human
ccgccgccgccgccaccg

SEQ ID NO: 146849 - RNA, 18 nt, Human
ccgcgaggggaaggcgcc

SEQ ID NO: 146850 - RNA, 22 nt, Human
ccgcgucggcggcauccgaggc

SEQ ID NO: 146851 - RNA, 22 nt, Human
ccuccagccacgugcggacccc

SEQ ID NO: 146852 - RNA, 27 nt, Human
ccuccguggcuggcuuucccgcugcuu

SEQ ID NO: 146853 - RNA, 21 nt, Human
ccuggaucaaggcgauccgaa

SEQ ID NO: 146854 - RNA, 21 nt, Human
ccuggccccugaccgcuggcc

SEQ ID NO: 146855 - RNA, 21 nt, Human
ccuuacccccucccccucucg

SEQ ID NO: 146856 - RNA, 22 nt, Human
cgaacugaacaaagcgggcuag

SEQ ID NO: 146857 - RNA, 22 nt, Human
cgaggcauuucucuaagaaaca

SEQ ID NO: 146858 - RNA, 23 nt, Human
cgagguggggaagaguuuggggu

SEQ ID NO: 146859 - RNA, 21 nt, Human
cgcucagaaaaggagggguuc

SEQ ID NO: 146860 - RNA, 23 nt, Human
cgugaaagguugggaaccggggg

SEQ ID NO: 146861 - RNA, 21 nt, Human
cucacacacacacauacacac

SEQ ID NO: 146862 - RNA, 21 nt, Human
cuccagcccuggccccugacc

SEQ ID NO: 146863 - RNA, 21 nt, Human
cucugcaaagaaagauuuuac

SEQ ID NO: 146864 - RNA, 18 nt, Human
cuggaucaaggcgauccg

SEQ ID NO: 146865 - RNA, 18 nt, Human
gaaaaguggggaucuggg

SEQ ID NO: 146866 - RNA, 18 nt, Human
gaaaaguggggaucuggg

SEQ ID NO: 146867 - RNA, 22 nt, Human
gaaccgggggcaucgaagggga

SEQ ID NO: 146868 - RNA, 18 nt, Human
gaagaagggaagggaugg

SEQ ID NO: 146869 - RNA, 20 nt, Human
gagggaagaagggaagggau

SEQ ID NO: 146870 - RNA, 21 nt, Human
gagggccccaggggguaaucc

SEQ ID NO: 146871 - RNA, 22 nt, Human
gagguggggaagaguuuggggu

SEQ ID NO: 146872 - RNA, 19 nt, Human
gcaaacucaggaacauaga

SEQ ID NO: 146873 - RNA, 25 nt, Human
gcagagagcaaccuucccuauuacu

SEQ ID NO: 146874 - RNA, 18 nt, Human
gcagcagcaccgcgucgg

SEQ ID NO: 146875 - RNA, 22 nt, Human
gcaugugcaucuuuauacacau

SEQ ID NO: 146876 - RNA, 22 nt, Human
gccgccgccgccgccaccgccg

SEQ ID NO: 146877 - RNA, 18 nt, Human
gcgcggccccuacgccuc

SEQ ID NO: 146878 - RNA, 18 nt, Human
ggaaaggagacaccucau

SEQ ID NO: 146879 - RNA, 22 nt, Human
ggaaauucacaacccccugcuc

SEQ ID NO: 146880 - RNA, 22 nt, Human
ggaagggaugggccaggagagg

SEQ ID NO: 146881 - RNA, 19 nt, Human
ggaggggggagggaagaag

SEQ ID NO: 146882 - RNA, 22 nt, Human
ggagggguucugaggggccaaa

SEQ ID NO: 146883 - RNA, 20 nt, Human
ggcgggagagggccccaggg

SEQ ID NO: 146884 - RNA, 18 nt, Human
gggaccgcgaggggaagg

SEQ ID NO: 146885 - RNA, 20 nt, Human
gggcagggggcaaacucagg

SEQ ID NO: 146886 - RNA, 24 nt, Human
gggcgggagagggccccagggggu

SEQ ID NO: 146887 - RNA, 21 nt, Human
ggggaccgcgaggggaaggcg

SEQ ID NO: 146888 - RNA, 18 nt, Human
ggggagaaggggaaggag

SEQ ID NO: 146889 - RNA, 22 nt, Human
ggggaggggggagggaagaagg

SEQ ID NO: 146890 - RNA, 22 nt, Human
gggggaccgcgaggggaaggcg

SEQ ID NO: 146891 - RNA, 18 nt, Human
gggggcgggagagggccc

SEQ ID NO: 146892 - RNA, 20 nt, Human
ggggggagggaagaagggaa

SEQ ID NO: 146893 - RNA, 23 nt, Human
ggggguauagagggagacguggg

SEQ ID NO: 146894 - RNA, 20 nt, Human
ggguauggaaaggagacacc

SEQ ID NO: 146895 - RNA, 21 nt, Human
gguaggguggggagaagguga

SEQ ID NO: 146896 - RNA, 20 nt, Human
ggugcgcuccuuacccccuc

SEQ ID NO: 146897 - RNA, 19 nt, Human
guggugcaggggaaaagca

SEQ ID NO: 146898 - RNA, 21 nt, Human
guguauauguguauauaugaa

SEQ ID NO: 146899 - RNA, 24 nt, Human
guucggggggaggggggagggaag

SEQ ID NO: 146900 - RNA, 19 nt, Human
uaaacacacacgcuugcgc

SEQ ID NO: 146901 - RNA, 22 nt, Human
uacacacacacgcgagcacgca

SEQ ID NO: 146902 - RNA, 25 nt, Human
uacacacgcacaccauauacuuaua

SEQ ID NO: 146903 - RNA, 27 nt, Human
uacacauacauacacacgcacaccaua

SEQ ID NO: 146904 - RNA, 22 nt, Human
uagcacaaccuuuuggcaacaa

SEQ ID NO: 146905 - RNA, 22 nt, Human
uauauguacacucacauguaua

SEQ ID NO: 146906 - RNA, 19 nt, Human
uauauguguauauauguac

SEQ ID NO: 146907 - RNA, 20 nt, Human
uauauguguauauauguaca

SEQ ID NO: 146908 - RNA, 19 nt, Human
uauguacacucacauguau

SEQ ID NO: 146909 - RNA, 21 nt, Human
uauguacacucacauguauau

SEQ ID NO: 146910 - RNA, 19 nt, Human
uauguauauguacgcaugu

SEQ ID NO: 146911 - RNA, 21 nt, Human
uauguuauguauauguacgca

SEQ ID NO: 146912 - RNA, 21 nt, Human
ucagucccuugcagguccuug

SEQ ID NO: 146913 - RNA, 22 nt, Human
uccaagaaauaaaaacauccac

SEQ ID NO: 146914 - RNA, 25 nt, Human
uccaagaaauaaaaacauccacaaa

SEQ ID NO: 146915 - RNA, 20 nt, Human
uccacacacauaacacacgg

SEQ ID NO: 146916 - RNA, 22 nt, Human
uccacacacauaacacacguau

SEQ ID NO: 146917 - RNA, 22 nt, Human
uccaccaccaaaaaucaaaaca

SEQ ID NO: 146918 - RNA, 22 nt, Human
uccaggcaagcggcauccgaga

SEQ ID NO: 146919 - RNA, 22 nt, Human
ucccgagcugccgccgccgccg

SEQ ID NO: 146920 - RNA, 18 nt, Human
uccgcccccacgccuugg

SEQ ID NO: 146921 - RNA, 21 nt, Human
uccguggugcaggggaaaagc

SEQ ID NO: 146922 - RNA, 19 nt, Human
ucuccuucuacaaaaaguc

SEQ ID NO: 146923 - RNA, 18 nt, Human
ucucuaagaaacaugauu

SEQ ID NO: 146924 - RNA, 18 nt, Human
ucucucuccuucuacaaa

SEQ ID NO: 146925 - RNA, 18 nt, Human
ucucugggcaacuuacug

SEQ ID NO: 146926 - RNA, 19 nt, Human
ucucugggcaacuuacuga

SEQ ID NO: 146927 - RNA, 18 nt, Human
ucuucuucucucuccuuc

SEQ ID NO: 146928 - RNA, 18 nt, Human
ucuugggugccucagcug

SEQ ID NO: 146929 - RNA, 22 nt, Human
ucuugggugccucagcuggugc

SEQ ID NO: 146930 - RNA, 21 nt, Human
ucuuugaggaaauuuuggaca

SEQ ID NO: 146931 - RNA, 18 nt, Human
ugaaagagaugggagaag

SEQ ID NO: 146932 - RNA, 18 nt, Human
ugacaaagggcaaaagca

SEQ ID NO: 146933 - RNA, 18 nt, Human
ugacaugcauauaccaga

SEQ ID NO: 146934 - RNA, 19 nt, Human
ugagacuggguauggaaag

SEQ ID NO: 146935 - RNA, 20 nt, Human
ugaggaaauuuuggacagag

SEQ ID NO: 146936 - RNA, 22 nt, Human
ugagguguuugggucgggcgag

SEQ ID NO: 146937 - RNA, 23 nt, Human
ugcaaagaaagauuuuacccuuc

SEQ ID NO: 146938 - RNA, 24 nt, Human
ugcagugacaugcauauaccagaa

SEQ ID NO: 146939 - RNA, 24 nt, Human
ugccucagcuggugcgguaugagg

SEQ ID NO: 146940 - RNA, 24 nt, Human
ugcugcaagcuguggcagagagca

SEQ ID NO: 146941 - RNA, 19 nt, Human
uggaaaggagacaccucau

SEQ ID NO: 146942 - RNA, 18 nt, Human
uggaaauucacaaccccc

SEQ ID NO: 146943 - RNA, 18 nt, Human
uggaggggaaaagugggg

SEQ ID NO: 146944 - RNA, 18 nt, Human
ugggaaaagauuuugaaa

SEQ ID NO: 146945 - RNA, 26 nt, Human
ugggagaagguuuagaggggagaagg

SEQ ID NO: 146946 - RNA, 26 nt, Human
ugggggaaacaaugagguguuugggu

SEQ ID NO: 146947 - RNA, 18 nt, Human
ugguacaacauuacacca

SEQ ID NO: 146948 - RNA, 20 nt, Human
uggugcgguaugaggcuggg

SEQ ID NO: 146949 - RNA, 25 nt, Human
uguaauugagagaagaccggggucc

SEQ ID NO: 146950 - RNA, 21 nt, Human
uguauacacacauauccauac

SEQ ID NO: 146951 - RNA, 21 nt, Human
uguauauguguauacacacau

SEQ ID NO: 146952 - RNA, 19 nt, Human
uguauauguguauauaugu

SEQ ID NO: 146953 - RNA, 22 nt, Human
ugugcaucuauauccacacaca

SEQ ID NO: 146954 - RNA, 29 nt, Human
ugugcaucuauauccacacacauaacaca

SEQ ID NO: 146955 - RNA, 23 nt, Human
uguguauauauguacacucacau

SEQ ID NO: 146956 - RNA, 26 nt, Human
uguguauauauguacacucacaugua

SEQ ID NO: 146957 - RNA, 24 nt, Human
uguguauauguguauacacacaua

SEQ ID NO: 146958 - RNA, 18 nt, Human
uguguauauguguauaua

SEQ ID NO: 146959 - RNA, 18 nt, Human
uguguauauguguauaua

SEQ ID NO: 146960 - RNA, 22 nt, Human
uguguauauguguauauaugua

SEQ ID NO: 146961 - RNA, 18 nt, Human
uguguauguuauguauau

SEQ ID NO: 146962 - RNA, 20 nt, Human
uguguguauguuauguauau

SEQ ID NO: 146963 - RNA, 24 nt, Human
uuaaaaacagacauucuguaaacu

SEQ ID NO: 146964 - RNA, 25 nt, Human
uuaaaaacagacauucuguaaacuc

SEQ ID NO: 146965 - RNA, 18 nt, Human
uuagaggggagaagggga

SEQ ID NO: 146966 - RNA, 23 nt, Human
uuagaggggagaaggggaaggag

SEQ ID NO: 146967 - RNA, 22 nt, Human
uuaguauuauuuauccaccacc

SEQ ID NO: 146968 - RNA, 20 nt, Human
uucacaacccccugcucuuc

SEQ ID NO: 146969 - RNA, 20 nt, Human
uucacauaaguuagagugca

SEQ ID NO: 146970 - RNA, 20 nt, Human
uucagagcggauggaagacc

SEQ ID NO: 146971 - RNA, 23 nt, Human
uucucuuuuuuggggggcgggag

SEQ ID NO: 146972 - RNA, 21 nt, Human
uugcuaggaauacauauugug

SEQ ID NO: 146973 - RNA, 21 nt, Human
uuggugaugacaaagggcaaa

SEQ ID NO: 146974 - RNA, 21 nt, Human
uuuagaggggagaaggggaag

SEQ ID NO: 146975 - RNA, 22 nt, Human
uuuauacaaaagucuuucaaaa

SEQ ID NO: 146976 - RNA, 18 nt, Human
uuucagagcggauggaag

SEQ ID NO: 146977 - RNA, 19 nt, Human
aaaaaacccaaagcaaaac

SEQ ID NO: 146978 - RNA, 20 nt, Human
aaaaaacccaaagcaaaacg

SEQ ID NO: 146979 - RNA, 20 nt, Human
aacaacaaaaggaaaaaaaa

SEQ ID NO: 146980 - RNA, 24 nt, Human
aagaagagcggggaggggaacggc

SEQ ID NO: 146981 - RNA, 25 nt, Human
acaacaaaaggaaaaaaaacccaaa

SEQ ID NO: 146982 - RNA, 25 nt, Human
acaacaacaaaaggaaaaaaaaccc

SEQ ID NO: 146983 - RNA, 21 nt, Human
agagcggggaggggaacggcc

SEQ ID NO: 146984 - RNA, 26 nt, Human
aggaaaaaaaacccaaagcaaaacgu

SEQ ID NO: 146985 - RNA, 23 nt, Human
caaaaggaaaaaaaacccaaagc

SEQ ID NO: 146986 - RNA, 21 nt, Human
caacccauaaacccaucucuu

SEQ ID NO: 146987 - RNA, 24 nt, Human
caccucugggaaaggagucgggga

SEQ ID NO: 146988 - RNA, 21 nt, Human
cacuggguggucucagaagac

SEQ ID NO: 146989 - RNA, 21 nt, Human
ccaaagcaaaacguuacaucc

SEQ ID NO: 146990 - RNA, 19 nt, Human
cccgcagcgcacagaccua

SEQ ID NO: 146991 - RNA, 22 nt, Human
cgaacggcggcgccccaaccca

SEQ ID NO: 146992 - RNA, 19 nt, Human
cgccccaacccauaaaccc

SEQ ID NO: 146993 - RNA, 21 nt, Human
cgccccaacccauaaacccau

SEQ ID NO: 146994 - RNA, 25 nt, Human
cgccgaacggcggcgccccaacccu

SEQ ID NO: 146995 - RNA, 23 nt, Human
cgccuggaccgcgggaacugucc

SEQ ID NO: 146996 - RNA, 21 nt, Human
cgccuuggccugccccagccu

SEQ ID NO: 146997 - RNA, 22 nt, Human
cgugugcggcgggcgcuucaag

SEQ ID NO: 146998 - RNA, 19 nt, Human
cucgugcgcgccgaacggc

SEQ ID NO: 146999 - RNA, 18 nt, Human
cuggaagcgggacggagg

SEQ ID NO: 147000 - RNA, 19 nt, Human
cuggcgguagggguucccc

SEQ ID NO: 147001 - RNA, 18 nt, Human
gaagcgggacggaggccg

SEQ ID NO: 147002 - RNA, 24 nt, Human
gcaaaaauaaacaguuuugucaac

SEQ ID NO: 147003 - RNA, 21 nt, Human
gccccgggcuccuggcuucgg

SEQ ID NO: 147004 - RNA, 20 nt, Human
gcccggggccucgcccgcug

SEQ ID NO: 147005 - RNA, 18 nt, Human
gccuuggccugccccagc

SEQ ID NO: 147006 - RNA, 25 nt, Human
gcgugcgaggaggaggaggacgacc

SEQ ID NO: 147007 - RNA, 23 nt, Human
gcuccuggcuucgggcacucacc

SEQ ID NO: 147008 - RNA, 18 nt, Human
ggaguuggaagaagagcg

SEQ ID NO: 147009 - RNA, 22 nt, Human
gggcuccuggcuucgggcacuc

SEQ ID NO: 147010 - RNA, 20 nt, Human
ggggaggcuggcgguagggg

SEQ ID NO: 147011 - RNA, 27 nt, Human
uacaaaaauuaacaacaacaaaaggaa

SEQ ID NO: 147012 - RNA, 24 nt, Human
uacaaaagacugucuugaauccca

SEQ ID NO: 147013 - RNA, 20 nt, Human
uaggcgccccgggcuccugg

SEQ ID NO: 147014 - RNA, 20 nt, Human
ucacuggguggucucagaag

SEQ ID NO: 147015 - RNA, 22 nt, Human
ucccccaaagcgcggcugacaa

SEQ ID NO: 147016 - RNA, 20 nt, Human
ugaauagggcgugugcggcg

SEQ ID NO: 147017 - RNA, 19 nt, Human
ugggaaaggagucggggag

SEQ ID NO: 147018 - RNA, 21 nt, Human
ugggaaaggagucggggagcc

SEQ ID NO: 147019 - RNA, 21 nt, Human
uggggguuauagaggaaggcg

SEQ ID NO: 147020 - RNA, 18 nt, Human
acagcccggacaguggcc

SEQ ID NO: 147021 - RNA, 20 nt, Human
accuggugcuccaccugccu

SEQ ID NO: 147022 - RNA, 24 nt, Human
acuccgagcagcgcuggggagaag

SEQ ID NO: 147023 - RNA, 25 nt, Human
aggcggggccggccggggcagggaa

SEQ ID NO: 147024 - RNA, 19 nt, Human
caccuaauacuguauggag

SEQ ID NO: 147025 - RNA, 18 nt, Human
cagacuccgagcagcgcu

SEQ ID NO: 147026 - RNA, 19 nt, Human
cagcccgucgaagcgcccu

SEQ ID NO: 147027 - RNA, 22 nt, Human
ccacugcaacuucaacagugac

SEQ ID NO: 147028 - RNA, 18 nt, Human
ccagcccgucgaagcgcc

SEQ ID NO: 147029 - RNA, 24 nt, Human
ccugcaaacgcgcccgggcccugg

SEQ ID NO: 147030 - RNA, 23 nt, Human
cgcgcccgggcccuggaggcugg

SEQ ID NO: 147031 - RNA, 18 nt, Human
cggcugagagcggggcga

SEQ ID NO: 147032 - RNA, 23 nt, Human
cggggcuggcugcugcggggcaa

SEQ ID NO: 147033 - RNA, 20 nt, Human
cucccugagacccccgcggg

SEQ ID NO: 147034 - RNA, 18 nt, Human
cugcgcaggcgcacagcc

SEQ ID NO: 147035 - RNA, 22 nt, Human
cuggugggaagcccagcugugu

SEQ ID NO: 147036 - RNA, 23 nt, Human
gaacaagccacugcaacuucaac

SEQ ID NO: 147037 - RNA, 19 nt, Human
gagaaagucuucacuucuc

SEQ ID NO: 147038 - RNA, 19 nt, Human
gagcggggcgagggugcgg

SEQ ID NO: 147039 - RNA, 19 nt, Human
gccgcggcgggggcagggc

SEQ ID NO: 147040 - RNA, 24 nt, Human
ggacagcgcccgcauccauccuca

SEQ ID NO: 147041 - RNA, 20 nt, Human
ggcgagggugcggagccgag

SEQ ID NO: 147042 - RNA, 21 nt, Human
gggaaagccuggugggaagcc

SEQ ID NO: 147043 - RNA, 19 nt, Human
uaccuggugcuccaccugc

SEQ ID NO: 147044 - RNA, 21 nt, Human
uaccuggugcuccaccugccu

SEQ ID NO: 147045 - RNA, 24 nt, Human
uaccuggugcuccaccugccuugg

SEQ ID NO: 147046 - RNA, 24 nt, Human
ucccacaggugugaacaagccacu

SEQ ID NO: 147047 - RNA, 19 nt, Human
ugcaaggagaaagucuuca

SEQ ID NO: 147048 - RNA, 20 nt, Human
ugcaaggagaaagucuucac

SEQ ID NO: 147049 - RNA, 20 nt, Human
ugccuuggugccaucacagc

SEQ ID NO: 147050 - RNA, 22 nt, Human
uuuaaugcaaggagaaagucuu

SEQ ID NO: 147051 - RNA, 18 nt, Human
aaaauuagcugggcgugg

SEQ ID NO: 147052 - RNA, 19 nt, Human
aacauggugaaaccccguc

SEQ ID NO: 147053 - RNA, 20 nt, Human
aacauggugaaaccccgucu

SEQ ID NO: 147054 - RNA, 21 nt, Human
aacauggugaaaccccgucuc

SEQ ID NO: 147055 - RNA, 19 nt, Human
aagaacccccucccccgcc

SEQ ID NO: 147056 - RNA, 19 nt, Human
aagaaggaaggaaggaaag

SEQ ID NO: 147057 - RNA, 19 nt, Human
aagaaggaaggaaggaaag

SEQ ID NO: 147058 - RNA, 22 nt, Human
aagccgggcacgguggcucaug

SEQ ID NO: 147059 - RNA, 23 nt, Human
aaggaaggaaagaaagaaaugga

SEQ ID NO: 147060 - RNA, 24 nt, Human
aaucacuucaacccaggaggugga

SEQ ID NO: 147061 - RNA, 20 nt, Human
aaugaaugacggauggaugg

SEQ ID NO: 147062 - RNA, 18 nt, Human
acagagcaagauucuauc

SEQ ID NO: 147063 - RNA, 22 nt, Human
accacugcacuccagccugggc

SEQ ID NO: 147064 - RNA, 24 nt, Human
acccaggagguggagguugcagug

SEQ ID NO: 147065 - RNA, 23 nt, Human
accccgucucuacucaaauacaa

SEQ ID NO: 147066 - RNA, 24 nt, Human
acugcacuccagccugggcgacag

SEQ ID NO: 147067 - RNA, 26 nt, Human
acugcacuccagccugggcgacagag

SEQ ID NO: 147068 - RNA, 19 nt, Human
agaaaagaaggaaggaagg

SEQ ID NO: 147069 - RNA, 19 nt, Human
agacccccgguccuuacag

SEQ ID NO: 147070 - RNA, 22 nt, Human
agccaggggaggggcugggggc

SEQ ID NO: 147071 - RNA, 23 nt, Human
agccaggggaggggcugggggcc

SEQ ID NO: 147072 - RNA, 23 nt, Human
agccgggcacgguggcucaugcc

SEQ ID NO: 147073 - RNA, 22 nt, Human
agccuggccaacauggugaaac

SEQ ID NO: 147074 - RNA, 24 nt, Human
agccuggccaacauggugaaaccc

SEQ ID NO: 147075 - RNA, 24 nt, Human
agccugggcgacagagcaagauuc

SEQ ID NO: 147076 - RNA, 23 nt, Human
agcugggcgugguggcgcgugcc

SEQ ID NO: 147077 - RNA, 21 nt, Human
aggaaagaaaagaaggaagga

SEQ ID NO: 147078 - RNA, 20 nt, Human
aggaaagaaagaaaugggua

SEQ ID NO: 147079 - RNA, 18 nt, Human
aggaaggaaggaaagaaa

SEQ ID NO: 147080 - RNA, 21 nt, Human
aggaaggaaggaaauaaaugg

SEQ ID NO: 147081 - RNA, 26 nt, Human
aggaggaagcggagcagaagggaccc

SEQ ID NO: 147082 - RNA, 22 nt, Human
aggcgagcagaucaccugagag

SEQ ID NO: 147083 - RNA, 19 nt, Human
agggaagggguguggacag

SEQ ID NO: 147084 - RNA, 20 nt, Human
agggguguggacagaacugg

SEQ ID NO: 147085 - RNA, 20 nt, Human
agguggagguugcagugagc

SEQ ID NO: 147086 - RNA, 24 nt, Human
agguggagguugcagugagcugag

SEQ ID NO: 147087 - RNA, 19 nt, Human
aucccagcgagcauccugg

SEQ ID NO: 147088 - RNA, 20 nt, Human
auccuuuuuaaagaaaugga

SEQ ID NO: 147089 - RNA, 24 nt, Human
aucucaccacugcacuccagccug

SEQ ID NO: 147090 - RNA, 19 nt, Human
augccuguaaucccaucac

SEQ ID NO: 147091 - RNA, 19 nt, Human
caaaaaagaaagaaagaaa

SEQ ID NO: 147092 - RNA, 19 nt, Human
caaaaaagaaggaaggaag

SEQ ID NO: 147093 - RNA, 20 nt, Human
caaaaacaaaaaagaaggaa

SEQ ID NO: 147094 - RNA, 20 nt, Human
caaaaacaaaaaagaaggaa

SEQ ID NO: 147095 - RNA, 24 nt, Human
caacauggugaaaccccgucucua

SEQ ID NO: 147096 - RNA, 23 nt, Human
caagaacccccucccccgcccac

SEQ ID NO: 147097 - RNA, 19 nt, Human
cacaguaucagaggagcag

SEQ ID NO: 147098 - RNA, 26 nt, Human
caccacugcacuccagccugggcgac

SEQ ID NO: 147099 - RNA, 19 nt, Human
cacugcacuccagccuggg

SEQ ID NO: 147100 - RNA, 21 nt, Human
cacugcacuccagccugggcg

SEQ ID NO: 147101 - RNA, 22 nt, Human
cacugcacuccagccugggcga

SEQ ID NO: 147102 - RNA, 23 nt, Human
cacugcacuccagccugggcgac

SEQ ID NO: 147103 - RNA, 24 nt, Human
cacugcacuccagccugggcgaca

SEQ ID NO: 147104 - RNA, 27 nt, Human
cacugcacuccagccugggcgacagag

SEQ ID NO: 147105 - RNA, 24 nt, Human
cagaagggggucuguuuaucugcu

SEQ ID NO: 147106 - RNA, 20 nt, Human
cagaauugggggcuuucccc

SEQ ID NO: 147107 - RNA, 24 nt, Human
cagaucaccugagaugcggaguuc

SEQ ID NO: 147108 - RNA, 21 nt, Human
cagcagggccaugggaggggg

SEQ ID NO: 147109 - RNA, 23 nt, Human
cagccaggggaggggcugggggc

SEQ ID NO: 147110 - RNA, 18 nt, Human
cagccgacuggagcuggg

SEQ ID NO: 147111 - RNA, 18 nt, Human
caggacaggaaagggaag

SEQ ID NO: 147112 - RNA, 24 nt, Human
caggaggcugaggcacgagaauca

SEQ ID NO: 147113 - RNA, 29 nt, Human
caggagguggagguugcagugacaacggu

SEQ ID NO: 147114 - RNA, 24 nt, Human
caggagguggagguugcagugagc

SEQ ID NO: 147115 - RNA, 20 nt, Human
caggcugggagagggugggg

SEQ ID NO: 147116 - RNA, 20 nt, Human
cagugccuagaacagggcug

SEQ ID NO: 147117 - RNA, 23 nt, Human
caucacuuugggaggccgaggcg

SEQ ID NO: 147118 - RNA, 20 nt, Human
caugccuguaaucccaucac

SEQ ID NO: 147119 - RNA, 24 nt, Human
caugccuguaaucccaucacuuug

SEQ ID NO: 147120 - RNA, 19 nt, Human
cauuucagccacagggcug

SEQ ID NO: 147121 - RNA, 19 nt, Human
ccacagacacgugggugga

SEQ ID NO: 147122 - RNA, 20 nt, Human
ccacugcacuccagccuggg

SEQ ID NO: 147123 - RNA, 20 nt, Human
ccacugcacuccagccuggg

SEQ ID NO: 147124 - RNA, 21 nt, Human
ccacugcacuccagccugggc

SEQ ID NO: 147125 - RNA, 21 nt, Human
ccacugcacuccagccugggc

SEQ ID NO: 147126 - RNA, 23 nt, Human
ccacugcacuccagccugggcga

SEQ ID NO: 147127 - RNA, 24 nt, Human
ccacugcacuccagccugggcgac

SEQ ID NO: 147128 - RNA, 19 nt, Human
ccaggggaggggcuggggg

SEQ ID NO: 147129 - RNA, 21 nt, Human
cccaggagguggagguugcag

SEQ ID NO: 147130 - RNA, 18 nt, Human
ccccauggucccgagacc

SEQ ID NO: 147131 - RNA, 19 nt, Human
cccgcccacgacaucccug

SEQ ID NO: 147132 - RNA, 22 nt, Human
cccgcccacgacaucccugaaa

SEQ ID NO: 147133 - RNA, 22 nt, Human
cccugaaaaggagacuaaaaua

SEQ ID NO: 147134 - RNA, 20 nt, Human
ccucugagccccccaugguc

SEQ ID NO: 147135 - RNA, 21 nt, Human
ccugcagucccagcuacucag

SEQ ID NO: 147136 - RNA, 22 nt, Human
ccugcagucccagcuacuccuc

SEQ ID NO: 147137 - RNA, 23 nt, Human
ccuggccaacauggugaaacccc

SEQ ID NO: 147138 - RNA, 24 nt, Human
ccuggccaacauggugaaaccccg

SEQ ID NO: 147139 - RNA, 22 nt, Human
ccugggcgacagagcaagauuc

SEQ ID NO: 147140 - RNA, 24 nt, Human
cgagaccagccuggccaacauggu

SEQ ID NO: 147141 - RNA, 24 nt, Human
cgagcagaucaccugagaugcgga

SEQ ID NO: 147142 - RNA, 20 nt, Human
cgaggcgagcagaucaccug

SEQ ID NO: 147143 - RNA, 21 nt, Human
cggccugugcucgcggucccg

SEQ ID NO: 147144 - RNA, 25 nt, Human
cuaaaauaaagccccggggccuuuc

SEQ ID NO: 147145 - RNA, 24 nt, Human
cucaugccuguaaucccaucacuu

SEQ ID NO: 147146 - RNA, 20 nt, Human
cuccauguauuuugcucuuc

SEQ ID NO: 147147 - RNA, 20 nt, Human
cucccccgcccacgacaucc

SEQ ID NO: 147148 - RNA, 22 nt, Human
cuccccucugagccccccaugg

SEQ ID NO: 147149 - RNA, 22 nt, Human
cucuaugguaaugcccagugcc

SEQ ID NO: 147150 - RNA, 19 nt, Human
cucuuccccaucuuuucca

SEQ ID NO: 147151 - RNA, 23 nt, Human
cuggcugggcaggaggaagcgga

SEQ ID NO: 147152 - RNA, 19 nt, Human
cugggcacauaguaggugc

SEQ ID NO: 147153 - RNA, 20 nt, Human
cuguguaggugcccucuccu

SEQ ID NO: 147154 - RNA, 22 nt, Human
gaaauaucuccaagggggcacu

SEQ ID NO: 147155 - RNA, 25 nt, Human
gaacagggcugggcacauaguaggu

SEQ ID NO: 147156 - RNA, 22 nt, Human
gaacccccucccccgcccacga

SEQ ID NO: 147157 - RNA, 23 nt, Human
gaaggaaagaaaagaaggaaggg

SEQ ID NO: 147158 - RNA, 19 nt, Human
gaaggaaagaaagaaaugg

SEQ ID NO: 147159 - RNA, 22 nt, Human
gagcagaucaccugagaugcgg

SEQ ID NO: 147160 - RNA, 20 nt, Human
gagcaggcugggcaguucca

SEQ ID NO: 147161 - RNA, 18 nt, Human
gaggggcccaucugagga

SEQ ID NO: 147162 - RNA, 19 nt, Human
gaggggcugggggcccugc

SEQ ID NO: 147163 - RNA, 20 nt, Human
gaggggcugggggcccugcc

SEQ ID NO: 147164 - RNA, 22 nt, Human
gagguugcagugagcugagauc

SEQ ID NO: 147165 - RNA, 24 nt, Human
gaucaccugagaugcggaguucga

SEQ ID NO: 147166 - RNA, 26 nt, Human
gcaaaaacaaaaaagaaggaaggaag

SEQ ID NO: 147167 - RNA, 24 nt, Human
gcacuccagccugggcgacagagc

SEQ ID NO: 147168 - RNA, 24 nt, Human
gccaacauggugaaaccccgucuc

SEQ ID NO: 147169 - RNA, 20 nt, Human
gcggagcagaagggggucug

SEQ ID NO: 147170 - RNA, 20 nt, Human
gcuuuccccgagcaagggaa

SEQ ID NO: 147171 - RNA, 22 nt, Human
ggaaagaaaagaaggaaggaag

SEQ ID NO: 147172 - RNA, 18 nt, Human
ggaaagggaaggggugug

SEQ ID NO: 147173 - RNA, 19 nt, Human
ggaaagggaaggggugugg

SEQ ID NO: 147174 - RNA, 24 nt, Human
ggaagcggagcagaagggggucug

SEQ ID NO: 147175 - RNA, 23 nt, Human
ggaaggggcugcggaggggccca

SEQ ID NO: 147176 - RNA, 22 nt, Human
ggagguugcagugagcugagau

SEQ ID NO: 147177 - RNA, 23 nt, Human
ggagguugcagugagcugagauc

SEQ ID NO: 147178 - RNA, 25 nt, Human
ggagguugcagugagcugagaucuc

SEQ ID NO: 147179 - RNA, 21 nt, Human
ggcaaaaacaaaaaagaagga

SEQ ID NO: 147180 - RNA, 18 nt, Human
ggccgaggcgagcagauc

SEQ ID NO: 147181 - RNA, 20 nt, Human
ggcucaugccuguaauccca

SEQ ID NO: 147182 - RNA, 24 nt, Human
gggcacgguggcucaugccuguaa

SEQ ID NO: 147183 - RNA, 18 nt, Human
gggcaggcugggagaggg

SEQ ID NO: 147184 - RNA, 20 nt, Human
gggcagggagggcaggcagg

SEQ ID NO: 147185 - RNA, 19 nt, Human
ggggccaggagcaggcugg

SEQ ID NO: 147186 - RNA, 21 nt, Human
gggggccaggagcaggcuggg

SEQ ID NO: 147187 - RNA, 21 nt, Human
gggguguggacagaacugggg

SEQ ID NO: 147188 - RNA, 21 nt, Human
ggucccgcgaggauccgaagc

SEQ ID NO: 147189 - RNA, 19 nt, Human
gguggagguugcagugagc

SEQ ID NO: 147190 - RNA, 23 nt, Human
gguggcucaugccuguaauccca

SEQ ID NO: 147191 - RNA, 20 nt, Human
gugaagggcggacagagaag

SEQ ID NO: 147192 - RNA, 19 nt, Human
gugcucaauaaauauuuga

SEQ ID NO: 147193 - RNA, 19 nt, Human
guugcagugagcugagauc

SEQ ID NO: 147194 - RNA, 19 nt, Human
uaaagccccggggccuuuc

SEQ ID NO: 147195 - RNA, 27 nt, Human
uaaguccagauuaccagcuguggggag

SEQ ID NO: 147196 - RNA, 23 nt, Human
uaauauguggugaaggcagcaaa

SEQ ID NO: 147197 - RNA, 20 nt, Human
uagggguggggagagggcug

SEQ ID NO: 147198 - RNA, 22 nt, Human
uaucaaaaaagaaagaaagaaa

SEQ ID NO: 147199 - RNA, 24 nt, Human
uauuuugcucuuccccaucuuuuc

SEQ ID NO: 147200 - RNA, 19 nt, Human
ucacgggguucacggagag

SEQ ID NO: 147201 - RNA, 20 nt, Human
ucagaggagcaggauggaag

SEQ ID NO: 147202 - RNA, 22 nt, Human
ucaugccuguaaucccaucacu

SEQ ID NO: 147203 - RNA, 24 nt, Human
ucaugccuguaaucccaucacuuu

SEQ ID NO: 147204 - RNA, 24 nt, Human
uccagccugggcgacagagcaaga

SEQ ID NO: 147205 - RNA, 19 nt, Human
uccccucugagccccccau

SEQ ID NO: 147206 - RNA, 23 nt, Human
ucccucccgugguccccucuaaa

SEQ ID NO: 147207 - RNA, 21 nt, Human
uccuuacagcugggcagggag

SEQ ID NO: 147208 - RNA, 23 nt, Human
ucuaucaaaaaagaaagaaagaa

SEQ ID NO: 147209 - RNA, 24 nt, Human
ucucuaugguaaugcccagugccu

SEQ ID NO: 147210 - RNA, 22 nt, Human
ugacggauggauggaugccugc

SEQ ID NO: 147211 - RNA, 24 nt, Human
ugagaucucaccacugcacuccag

SEQ ID NO: 147212 - RNA, 21 nt, Human
ugagccggagcaggggugugc

SEQ ID NO: 147213 - RNA, 23 nt, Human
ugaggagggagacccccgguccu

SEQ ID NO: 147214 - RNA, 19 nt, Human
ugaggcacgagaaucacuu

SEQ ID NO: 147215 - RNA, 24 nt, Human
ugaggcacgagaaucacuucaacc

SEQ ID NO: 147216 - RNA, 19 nt, Human
ugaggguguugccuggcug

SEQ ID NO: 147217 - RNA, 23 nt, Human
ugauggagccgguugaggguguu

SEQ ID NO: 147218 - RNA, 19 nt, Human
ugccuaagugaacgugagg

SEQ ID NO: 147219 - RNA, 19 nt, Human
ugccuaagugaacgugagg

SEQ ID NO: 147220 - RNA, 20 nt, Human
ugccuagaacagggcugggc

SEQ ID NO: 147221 - RNA, 24 nt, Human
ugccugcagucccagcuacucagg

SEQ ID NO: 147222 - RNA, 23 nt, Human
ugccuguaaucccaucacuuugg

SEQ ID NO: 147223 - RNA, 23 nt, Human
ugccuguaaucccaucacuuugg

SEQ ID NO: 147224 - RNA, 24 nt, Human
ugccuguaaucccaucacuuuggg

SEQ ID NO: 147225 - RNA, 22 nt, Human
ugcgugugccagugugugugug

SEQ ID NO: 147226 - RNA, 20 nt, Human
ugcucuuccccaucuuuucc

SEQ ID NO: 147227 - RNA, 23 nt, Human
uggaauggugguaggcagagagg

SEQ ID NO: 147228 - RNA, 18 nt, Human
uggagguugcagugagcu

SEQ ID NO: 147229 - RNA, 24 nt, Human
uggccaacauggugaaaccccguc

SEQ ID NO: 147230 - RNA, 24 nt, Human
uggcgcgugccugcagucccagcu

SEQ ID NO: 147231 - RNA, 21 nt, Human
uggcggcugcagcgggcuggg

SEQ ID NO: 147232 - RNA, 24 nt, Human
uggcucaugccuguaaucccauca

SEQ ID NO: 147233 - RNA, 21 nt, Human
uggcugggcaggaggaagcgg

SEQ ID NO: 147234 - RNA, 19 nt, Human
ugggaagaagccuuggcuu

SEQ ID NO: 147235 - RNA, 19 nt, Human
ugggagagggugggguccc

SEQ ID NO: 147236 - RNA, 25 nt, Human
ugggagaggguggggucccgcgagg

SEQ ID NO: 147237 - RNA, 24 nt, Human
ugggaggccgaggcgagcagauca

SEQ ID NO: 147238 - RNA, 25 nt, Human
ugggggcaaaaacaaaaaagaagga

SEQ ID NO: 147239 - RNA, 19 nt, Human
uggggugggggacaguggu

SEQ ID NO: 147240 - RNA, 25 nt, Human
uggguaugggcagaauugggggcaa

SEQ ID NO: 147241 - RNA, 24 nt, Human
ugguggcgcgugccugcaguccca

SEQ ID NO: 147242 - RNA, 26 nt, Human
ugugccagugugugugugaugugccu

SEQ ID NO: 147243 - RNA, 24 nt, Human
uguuccguucagaggccccuccca

SEQ ID NO: 147244 - RNA, 20 nt, Human
uuagcugggcgugguggcgc

SEQ ID NO: 147245 - RNA, 20 nt, Human
uuagcugggcgugguggcgc

SEQ ID NO: 147246 - RNA, 24 nt, Human
uuagcugggcgugguggcgcgugc

SEQ ID NO: 147247 - RNA, 24 nt, Human
uucaacccaggagguggagguugc

SEQ ID NO: 147248 - RNA, 21 nt, Human
uuccaugggguccccugccag

SEQ ID NO: 147249 - RNA, 18 nt, Human
uucuacguaggggcucca

SEQ ID NO: 147250 - RNA, 20 nt, Human
uucuaucaaaaaagaaagaa

SEQ ID NO: 147251 - RNA, 19 nt, Human
uugcagugagcugagaucu

SEQ ID NO: 147252 - RNA, 22 nt, Human
uugcagugagcugagaucucac

SEQ ID NO: 147253 - RNA, 21 nt, Human
uugcagugagcugagaucucc

SEQ ID NO: 147254 - RNA, 25 nt, Human
uugggaggccgaggcgagcagauca

SEQ ID NO: 147255 - RNA, 20 nt, Human
uuugggaagaagccuuggcu

SEQ ID NO: 147256 - RNA, 21 nt, Human
uuuuuuuuuuuuuuuuuuggg

SEQ ID NO: 147257 - RNA, 23 nt, Human
aaacaaguaucagcugcaaacau

SEQ ID NO: 147258 - RNA, 23 nt, Human
aagaagacagaggcuuagauuag

SEQ ID NO: 147259 - RNA, 19 nt, Human
aagccaaagcagauagggg

SEQ ID NO: 147260 - RNA, 24 nt, Human
aaggacacugcagagucccugggg

SEQ ID NO: 147261 - RNA, 19 nt, Human
aaguaugaacaucuaaaca

SEQ ID NO: 147262 - RNA, 28 nt, Human
acgcagccccaggggaagagggaacgcc

SEQ ID NO: 147263 - RNA, 23 nt, Human
acgcggcuaggagggccgggagc

SEQ ID NO: 147264 - RNA, 21 nt, Human
agacuaaugacaaaugcacug

SEQ ID NO: 147265 - RNA, 22 nt, Human
agaguucaaagcaagguuugcc

SEQ ID NO: 147266 - RNA, 18 nt, Human
agcccacucuccugcugg

SEQ ID NO: 147267 - RNA, 18 nt, Human
agcugggaugauucaggc

SEQ ID NO: 147268 - RNA, 18 nt, Human
aggcugcagggggccugc

SEQ ID NO: 147269 - RNA, 20 nt, Human
augugugugugcauguuugu

SEQ ID NO: 147270 - RNA, 19 nt, Human
caaagcaagguuugccgaa

SEQ ID NO: 147271 - RNA, 23 nt, Human
caaagcaagguuugccgaagaag

SEQ ID NO: 147272 - RNA, 22 nt, Human
cacccaagcgcggggcucagcc

SEQ ID NO: 147273 - RNA, 20 nt, Human
caccucuccucccugcagcu

SEQ ID NO: 147274 - RNA, 20 nt, Human
cacgucauagaugcauagaa

SEQ ID NO: 147275 - RNA, 23 nt, Human
cagcagcccaggccggagggagg

SEQ ID NO: 147276 - RNA, 21 nt, Human
cagccccaggggaagacuccu

SEQ ID NO: 147277 - RNA, 22 nt, Human
caguaguaagcacgucauagau

SEQ ID NO: 147278 - RNA, 24 nt, Human
cauguuugugugugugugugugag

SEQ ID NO: 147279 - RNA, 23 nt, Human
cauguuugugugugugugugugu

SEQ ID NO: 147280 - RNA, 21 nt, Human
ccaaagcagauaggggaagca

SEQ ID NO: 147281 - RNA, 25 nt, Human
ccaaugucucuagaagacgcuuccu

SEQ ID NO: 147282 - RNA, 19 nt, Human
ccagacugaugggccacca

SEQ ID NO: 147283 - RNA, 19 nt, Human
ccagcaggcuagcccacuc

SEQ ID NO: 147284 - RNA, 21 nt, Human
ccaggggaagacuccuccuca

SEQ ID NO: 147285 - RNA, 18 nt, Human
cccccggcacgcagcccc

SEQ ID NO: 147286 - RNA, 20 nt, Human
ccgaggagaggggaagagcg

SEQ ID NO: 147287 - RNA, 21 nt, Human
ccgccgggcuccgagccgcgc

SEQ ID NO: 147288 - RNA, 19 nt, Human
ccgcgccgccgccucaccc

SEQ ID NO: 147289 - RNA, 19 nt, Human
ccgucugaaugucccccca

SEQ ID NO: 147290 - RNA, 18 nt, Human
ccugggaggcugcagggg

SEQ ID NO: 147291 - RNA, 20 nt, Human
ccuuucucaccucuccuccc

SEQ ID NO: 147292 - RNA, 25 nt, Human
cgcucgcccccggcacgcagcccca

SEQ ID NO: 147293 - RNA, 21 nt, Human
cucccaucuccuccucuaaca

SEQ ID NO: 147294 - RNA, 21 nt, Human
cuccucccuugccagccuucc

SEQ ID NO: 147295 - RNA, 24 nt, Human
cuccugggaccaagcccagccgcu

SEQ ID NO: 147296 - RNA, 19 nt, Human
cucucaaguuagccuucug

SEQ ID NO: 147297 - RNA, 21 nt, Human
cugggauccugcauacaucau

SEQ ID NO: 147298 - RNA, 20 nt, Human
cugggcuugaggaggagggg

SEQ ID NO: 147299 - RNA, 24 nt, Human
cuguuggaugucuaugaugcuggg

SEQ ID NO: 147300 - RNA, 22 nt, Human
cuucugaggcuacucagccucc

SEQ ID NO: 147301 - RNA, 21 nt, Human
cuugccagccuguccugggag

SEQ ID NO: 147302 - RNA, 20 nt, Human
cuuucucaccucuccucccu

SEQ ID NO: 147303 - RNA, 23 nt, Human
gaacaucuaaacaucauaggcca

SEQ ID NO: 147304 - RNA, 19 nt, Human
gaagaagacagaggcuuag

SEQ ID NO: 147305 - RNA, 21 nt, Human
gacugguuuucaauagacuac

SEQ ID NO: 147306 - RNA, 19 nt, Human
gagaauguagggcauugag

SEQ ID NO: 147307 - RNA, 22 nt, Human
gagacaguggcugcaucugagc

SEQ ID NO: 147308 - RNA, 24 nt, Human
gcauguuuguguguguguguguug

SEQ ID NO: 147309 - RNA, 25 nt, Human
gccccaaaccucucaaguuagccuu

SEQ ID NO: 147310 - RNA, 21 nt, Human
gcccccggcacgcagccccag

SEQ ID NO: 147311 - RNA, 19 nt, Human
gccucacccaagcgcgggg

SEQ ID NO: 147312 - RNA, 19 nt, Human
gcucuuguccuucuaaucc

SEQ ID NO: 147313 - RNA, 23 nt, Human
gcugcaucugagcugggaugauu

SEQ ID NO: 147314 - RNA, 19 nt, Human
gcuuugaauccucucucca

SEQ ID NO: 147315 - RNA, 22 nt, Human
ggaagagcgauagagacuuagg

SEQ ID NO: 147316 - RNA, 19 nt, Human
ggacaggcacgaacagcau

SEQ ID NO: 147317 - RNA, 19 nt, Human
ggagaggggaagagcgaua

SEQ ID NO: 147318 - RNA, 20 nt, Human
gggaagacuccuccucaggg

SEQ ID NO: 147319 - RNA, 18 nt, Human
gggacaggcacgaacagc

SEQ ID NO: 147320 - RNA, 20 nt, Human
gucugaauauggauauaaaa

SEQ ID NO: 147321 - RNA, 18 nt, Human
gugugagggucugaggcc

SEQ ID NO: 147322 - RNA, 23 nt, Human
gugugugcauguuugugugugug

SEQ ID NO: 147323 - RNA, 21 nt, Human
gugugugugugugugugugug

SEQ ID NO: 147324 - RNA, 21 nt, Human
gugugugugugugugugugug

SEQ ID NO: 147325 - RNA, 19 nt, Human
uacaggacaauuuccucac

SEQ ID NO: 147326 - RNA, 23 nt, Human
uaccaaagaauaaauguacugua

SEQ ID NO: 147327 - RNA, 23 nt, Human
uagcccacucuccugcuggugcu

SEQ ID NO: 147328 - RNA, 21 nt, Human
uaggaaagaacagagcuccug

SEQ ID NO: 147329 - RNA, 24 nt, Human
uaggagggccgggagcgcacucuc

SEQ ID NO: 147330 - RNA, 18 nt, Human
uaguaagcacgucauaga

SEQ ID NO: 147331 - RNA, 20 nt, Human
uaugaacaucuaaacaucaa

SEQ ID NO: 147332 - RNA, 31 nt, Human
uaugugugugugcauguuugugugugugugu

SEQ ID NO: 147333 - RNA, 18 nt, Human
uccagcagcccaggccgg

SEQ ID NO: 147334 - RNA, 18 nt, Human
ucccugcagcugcccgcc

SEQ ID NO: 147335 - RNA, 19 nt, Human
ucccugcagcugcccgccu

SEQ ID NO: 147336 - RNA, 20 nt, Human
ucgcccccggcacgcagccc

SEQ ID NO: 147337 - RNA, 23 nt, Human
ucgcccccggcacgcagccccag

SEQ ID NO: 147338 - RNA, 18 nt, Human
ucugagaauaguaugagg

SEQ ID NO: 147339 - RNA, 18 nt, Human
ucugaggcuacucagccu

SEQ ID NO: 147340 - RNA, 18 nt, Human
ucugaggcuacucagccu

SEQ ID NO: 147341 - RNA, 24 nt, Human
ucuggggccugggagugcucuugu

SEQ ID NO: 147342 - RNA, 19 nt, Human
ucuuaucaauuuuuuucuc

SEQ ID NO: 147343 - RNA, 24 nt, Human
ugaagcaagccaggggagagacca

SEQ ID NO: 147344 - RNA, 18 nt, Human
ugaauugccucaggucug

SEQ ID NO: 147345 - RNA, 22 nt, Human
ugaggaggaggggugaaaucuu

SEQ ID NO: 147346 - RNA, 18 nt, Human
ugaggcccuggcuuugaa

SEQ ID NO: 147347 - RNA, 22 nt, Human
ugagggucugaggcccuggcuu

SEQ ID NO: 147348 - RNA, 18 nt, Human
ugaugggccaccaaaugc

SEQ ID NO: 147349 - RNA, 23 nt, Human
ugcauacaucauagcacagacaa

SEQ ID NO: 147350 - RNA, 21 nt, Human
ugcccucagaucuccuagcuc

SEQ ID NO: 147351 - RNA, 21 nt, Human
ugccuaacacagcuccuggua

SEQ ID NO: 147352 - RNA, 22 nt, Human
ugcuuguucuccauaguuuguc

SEQ ID NO: 147353 - RNA, 23 nt, Human
ugcuuguucuccauaguuuguca

SEQ ID NO: 147354 - RNA, 25 nt, Human
uggaagcacuggggaaucuggaggu

SEQ ID NO: 147355 - RNA, 26 nt, Human
uggaagcacuggggaaucuggaggug

SEQ ID NO: 147356 - RNA, 22 nt, Human
uggcaagugaauugccucaggu

SEQ ID NO: 147357 - RNA, 18 nt, Human
uggcagaguucaaagcaa

SEQ ID NO: 147358 - RNA, 23 nt, Human
uggcagaguucaaagcaagguuu

SEQ ID NO: 147359 - RNA, 20 nt, Human
ugggaccaagcccagccgcu

SEQ ID NO: 147360 - RNA, 27 nt, Human
uggggaacaaggccccaaaccucucaa

SEQ ID NO: 147361 - RNA, 22 nt, Human
uggggaguggccgaggagaggg

SEQ ID NO: 147362 - RNA, 19 nt, Human
uggggcgcagagccagaag

SEQ ID NO: 147363 - RNA, 21 nt, Human
ugguacgcaggaggggcuggg

SEQ ID NO: 147364 - RNA, 19 nt, Human
ugucaagauaugcauaugu

SEQ ID NO: 147365 - RNA, 22 nt, Human
ugucaagauaugcauaugugug

SEQ ID NO: 147366 - RNA, 19 nt, Human
ugugacgugacagauggcc

SEQ ID NO: 147367 - RNA, 21 nt, Human
ugugugagggucugaggcccu

SEQ ID NO: 147368 - RNA, 19 nt, Human
ugugugcauguuugugugu

SEQ ID NO: 147369 - RNA, 19 nt, Human
ugugugcauguuugugugu

SEQ ID NO: 147370 - RNA, 19 nt, Human
ugugugcauguuugugugu

SEQ ID NO: 147371 - RNA, 32 nt, Human
ugugugcauguuuguguguguguguguguggu

SEQ ID NO: 147372 - RNA, 21 nt, Human
ugugugugcauguuugugugu

SEQ ID NO: 147373 - RNA, 21 nt, Human
ugugugugcauguuugugugu

SEQ ID NO: 147374 - RNA, 27 nt, Human
ugugugugcauguuugugugugugugu

SEQ ID NO: 147375 - RNA, 22 nt, Human
ugugugugugcauguuugugug

SEQ ID NO: 147376 - RNA, 30 nt, Human
ugugugugugcauguuugugugugugugug

SEQ ID NO: 147377 - RNA, 18 nt, Human
uguguguguguguguagu

SEQ ID NO: 147378 - RNA, 19 nt, Human
uguguguguguguguguag

SEQ ID NO: 147379 - RNA, 18 nt, Human
ugugugugugugugugug

SEQ ID NO: 147380 - RNA, 18 nt, Human
ugugugugugugugugug

SEQ ID NO: 147381 - RNA, 18 nt, Human
ugugugugugugugugug

SEQ ID NO: 147382 - RNA, 18 nt, Human
ugugugugugugugugug

SEQ ID NO: 147383 - RNA, 18 nt, Human
ugugugugugugugugug

SEQ ID NO: 147384 - RNA, 18 nt, Human
ugugugugugugugugug

SEQ ID NO: 147385 - RNA, 18 nt, Human
ugugugugugugugugug

SEQ ID NO: 147386 - RNA, 18 nt, Human
ugugugugugugugugug

SEQ ID NO: 147387 - RNA, 22 nt, Human
ugugugugugugugugugugag

SEQ ID NO: 147388 - RNA, 21 nt, Human
ugugugugugugugugugugu

SEQ ID NO: 147389 - RNA, 21 nt, Human
ugugugugugugugugugugu

SEQ ID NO: 147390 - RNA, 21 nt, Human
ugugugugugugugugugugu

SEQ ID NO: 147391 - RNA, 21 nt, Human
ugugugugugugugugugugu

SEQ ID NO: 147392 - RNA, 21 nt, Human
ugugugugugugugugugugu

SEQ ID NO: 147393 - RNA, 21 nt, Human
ugugugugugugugugugugu

SEQ ID NO: 147394 - RNA, 21 nt, Human
ugugugugugugugugugugu

SEQ ID NO: 147395 - RNA, 21 nt, Human
ugugugugugugugugugugu

SEQ ID NO: 147396 - RNA, 21 nt, Human
ugugugugugugugugugugu

SEQ ID NO: 147397 - RNA, 21 nt, Human
ugugugugugugugugugugu

SEQ ID NO: 147398 - RNA, 21 nt, Human
ugugugugugugugugugugu

SEQ ID NO: 147399 - RNA, 21 nt, Human
ugugugugugugugugugugu

SEQ ID NO: 147400 - RNA, 22 nt, Human
ugugugugugugugugugugua

SEQ ID NO: 147401 - RNA, 22 nt, Human
ugugugugugugugugugugug

SEQ ID NO: 147402 - RNA, 22 nt, Human
ugugugugugugugugugugug

SEQ ID NO: 147403 - RNA, 22 nt, Human
ugugugugugugugugugugug

SEQ ID NO: 147404 - RNA, 22 nt, Human
ugugugugugugugugugugug

SEQ ID NO: 147405 - RNA, 22 nt, Human
uguguguguguguguguguguu

SEQ ID NO: 147406 - RNA, 25 nt, Human
uguuugugugugugugugugugugg

SEQ ID NO: 147407 - RNA, 23 nt, Human
uuggaugucuaugaugcugggaa

SEQ ID NO: 147408 - RNA, 22 nt, Human
uuucucuucucucucccgcucu

SEQ ID NO: 147409 - RNA, 24 nt, Human
aaaaaaaaaaacacaaaacccuag

SEQ ID NO: 147410 - RNA, 24 nt, Human
aaaaaaaaaacacaaaacccuaga

SEQ ID NO: 147411 - RNA, 24 nt, Human
aaaaaaaacacaaaacccuagaca

SEQ ID NO: 147412 - RNA, 25 nt, Human
aaacgggaaguuuugccaggggucg

SEQ ID NO: 147413 - RNA, 18 nt, Human
aaaggcuuuuauccugua

SEQ ID NO: 147414 - RNA, 23 nt, Human
acagggccgaagacacugcacac

SEQ ID NO: 147415 - RNA, 22 nt, Human
acagucuggagacagcagaaac

SEQ ID NO: 147416 - RNA, 19 nt, Human
agaaaagcuaaucuucagg

SEQ ID NO: 147417 - RNA, 20 nt, Human
agacagcagaaacccucugc

SEQ ID NO: 147418 - RNA, 20 nt, Human
agcucacuuccugugguucc

SEQ ID NO: 147419 - RNA, 19 nt, Human
aggcagccuggagacccag

SEQ ID NO: 147420 - RNA, 19 nt, Human
aggucccccaguucccacc

SEQ ID NO: 147421 - RNA, 22 nt, Human
aggugcccucugagggacagac

SEQ ID NO: 147422 - RNA, 22 nt, Human
agugguggagcaggccugaggc

SEQ ID NO: 147423 - RNA, 29 nt, Human
auagcagaaaacaaaauaaaagggacccc

SEQ ID NO: 147424 - RNA, 19 nt, Human
auccaccccccuaccccca

SEQ ID NO: 147425 - RNA, 19 nt, Human
auggauggcagauccacag

SEQ ID NO: 147426 - RNA, 23 nt, Human
caccccguucugcagcccacccc

SEQ ID NO: 147427 - RNA, 23 nt, Human
cacugcacacacuaggacaggau

SEQ ID NO: 147428 - RNA, 18 nt, Human
cagcccagggcagggcug

SEQ ID NO: 147429 - RNA, 20 nt, Human
cagcccagggcagggcuggg

SEQ ID NO: 147430 - RNA, 19 nt, Human
cagccuggagacccagcug

SEQ ID NO: 147431 - RNA, 22 nt, Human
caggaggcaucugucgccuucu

SEQ ID NO: 147432 - RNA, 20 nt, Human
caguaagaaaagcuaaucuu

SEQ ID NO: 147433 - RNA, 19 nt, Human
cagugccuugcccaagguc

SEQ ID NO: 147434 - RNA, 21 nt, Human
cagugccuugcccaaggucau

SEQ ID NO: 147435 - RNA, 23 nt, Human
cauucaccuguguccacagggcc

SEQ ID NO: 147436 - RNA, 18 nt, Human
ccaguguccacccucccc

SEQ ID NO: 147437 - RNA, 23 nt, Human
cccaggcagccuggagacccagc

SEQ ID NO: 147438 - RNA, 24 nt, Human
cccaggucccccaguucccacccc

SEQ ID NO: 147439 - RNA, 18 nt, Human
cccaugcgcauuucucca

SEQ ID NO: 147440 - RNA, 21 nt, Human
cccaugcgcauuucuccaggc

SEQ ID NO: 147441 - RNA, 22 nt, Human
cccaugcgcauuucuccaggca

SEQ ID NO: 147442 - RNA, 18 nt, Human
ccccaguucccaccccgu

SEQ ID NO: 147443 - RNA, 22 nt, Human
ccccaugcgcauuucuccaggc

SEQ ID NO: 147444 - RNA, 18 nt, Human
cccccaguucccaccccg

SEQ ID NO: 147445 - RNA, 22 nt, Human
cccucugcucuauuuuuuugcc

SEQ ID NO: 147446 - RNA, 23 nt, Human
cccugcuccggguucgacucucc

SEQ ID NO: 147447 - RNA, 25 nt, Human
ccuaauccaccccccuacccccaau

SEQ ID NO: 147448 - RNA, 23 nt, Human
ccuccccauucuacagaugggga

SEQ ID NO: 147449 - RNA, 24 nt, Human
ccuucaaucuccuaauccaccccc

SEQ ID NO: 147450 - RNA, 21 nt, Human
cgcuggggccugacugccugc

SEQ ID NO: 147451 - RNA, 21 nt, Human
cuccuaauccaccccccuacc

SEQ ID NO: 147452 - RNA, 18 nt, Human
cucuauuuuuuugccacu

SEQ ID NO: 147453 - RNA, 20 nt, Human
cucugggugagccuuagcuc

SEQ ID NO: 147454 - RNA, 21 nt, Human
cuggguggacugaucucuucu

SEQ ID NO: 147455 - RNA, 19 nt, Human
cuuaccaggcccaccccca

SEQ ID NO: 147456 - RNA, 21 nt, Human
gauccacagugcaucccccuu

SEQ ID NO: 147457 - RNA, 23 nt, Human
gcagugccuugcccaaggucauu

SEQ ID NO: 147458 - RNA, 19 nt, Human
gcucuauuuuuuugccacu

SEQ ID NO: 147459 - RNA, 21 nt, Human
ggagacagcagaaacccucug

SEQ ID NO: 147460 - RNA, 21 nt, Human
ggagcaggccugaggcccagg

SEQ ID NO: 147461 - RNA, 23 nt, Human
ggcagauccacagugcauccccc

SEQ ID NO: 147462 - RNA, 24 nt, Human
gggaaaccaaggcacagagagggc

SEQ ID NO: 147463 - RNA, 20 nt, Human
guggagcaggccugaggccc

SEQ ID NO: 147464 - RNA, 23 nt, Human
gugguuccugggacuuaccaggc

SEQ ID NO: 147465 - RNA, 22 nt, Human
guguccacagggccgaagacac

SEQ ID NO: 147466 - RNA, 21 nt, Human
uaaauccugccacccaccaag

SEQ ID NO: 147467 - RNA, 23 nt, Human
uaaauccugccacccaccaagga

SEQ ID NO: 147468 - RNA, 20 nt, Human
uagcagaaaacaaaauaaaa

SEQ ID NO: 147469 - RNA, 22 nt, Human
uauagcagaaaacaaaauaaaa

SEQ ID NO: 147470 - RNA, 21 nt, Human
uauaugaaagguuccauuuug

SEQ ID NO: 147471 - RNA, 18 nt, Human
ucauagaaacuaagggaa

SEQ ID NO: 147472 - RNA, 19 nt, Human
uccacgcucggaugggacc

SEQ ID NO: 147473 - RNA, 22 nt, Human
uccaguguccacccuucccaag

SEQ ID NO: 147474 - RNA, 22 nt, Human
ucucuucucaacagcccagggc

SEQ ID NO: 147475 - RNA, 19 nt, Human
ucuucaggcuucaauguga

SEQ ID NO: 147476 - RNA, 21 nt, Human
ugaggcccaggucccccagaa

SEQ ID NO: 147477 - RNA, 21 nt, Human
ugccacccaccaaggagaccu

SEQ ID NO: 147478 - RNA, 23 nt, Human
ugcucuauuuuuuugccacucua

SEQ ID NO: 147479 - RNA, 20 nt, Human
uggaagggagguugggaggg

SEQ ID NO: 147480 - RNA, 19 nt, Human
uggagacccagcugcucuc

SEQ ID NO: 147481 - RNA, 19 nt, Human
ugggagggcugaccagaug

SEQ ID NO: 147482 - RNA, 21 nt, Human
uuaccaggcccacccccaugc

SEQ ID NO: 147483 - RNA, 23 nt, Human
uuagcucacuuccugugguuccu

SEQ ID NO: 147484 - RNA, 19 nt, Human
uucaaugugauuugacaug

SEQ ID NO: 147485 - RNA, 21 nt, Human
uucccaccccguucugcagcc

SEQ ID NO: 147486 - RNA, 19 nt, Human
uuccugggacuuaccaggc

SEQ ID NO: 147487 - RNA, 19 nt, Human
uucuguauaaaggcuuuua

SEQ ID NO: 147488 - RNA, 20 nt, Human
uuuccaguguccacccuccc

SEQ ID NO: 147489 - RNA, 21 nt, Human
uuuggacaauuucucuuucuu

SEQ ID NO: 147490 - RNA, 21 nt, Human
uuuuggaggugaaagaaguca

SEQ ID NO: 147491 - RNA, 23 nt, Human
uuuuuuuuuuuuaaagaaaaggu

SEQ ID NO: 147492 - RNA, 19 nt, Human
uuuuuuuuuuuuuuuuuaa

SEQ ID NO: 147493 - RNA, 22 nt, Human
aaaucaugucacauacaaaaca

SEQ ID NO: 147494 - RNA, 23 nt, Human
aacaaaacaaaaaaaauuccucu

SEQ ID NO: 147495 - RNA, 21 nt, Human
aacaucuuacaaugcacagga

SEQ ID NO: 147496 - RNA, 25 nt, Human
aaccaucugagacccuggaauuuaa

SEQ ID NO: 147497 - RNA, 21 nt, Human
aacucuucagccauuuccaca

SEQ ID NO: 147498 - RNA, 23 nt, Human
aagaagcacaaggcuacaaaucc

SEQ ID NO: 147499 - RNA, 26 nt, Human
aagacaaaacaaaacaaaaaaaauuc

SEQ ID NO: 147500 - RNA, 24 nt, Human
aagcacuuggagcaaaaaagaacc

SEQ ID NO: 147501 - RNA, 18 nt, Human
aagcccucaccacaaaga

SEQ ID NO: 147502 - RNA, 19 nt, Human
acaaaacaaaaaaaauucc

SEQ ID NO: 147503 - RNA, 18 nt, Human
acaaaacaaaacaaaaaa

SEQ ID NO: 147504 - RNA, 19 nt, Human
acaaagaacacuccggcca

SEQ ID NO: 147505 - RNA, 19 nt, Human
acaaccacauacagcauca

SEQ ID NO: 147506 - RNA, 26 nt, Human
acaaugcacaggaaagcccucaccac

SEQ ID NO: 147507 - RNA, 18 nt, Human
acagcccuggcaucagau

SEQ ID NO: 147508 - RNA, 21 nt, Human
acaguaaacagauaauccaaa

SEQ ID NO: 147509 - RNA, 22 nt, Human
accugcaaagaggauuuucccu

SEQ ID NO: 147510 - RNA, 18 nt, Human
agaaaccuuggacuauag

SEQ ID NO: 147511 - RNA, 23 nt, Human
agaagacaaaacaaaacaaaaaa

SEQ ID NO: 147512 - RNA, 18 nt, Human
agacaaaacaaaacaaaa

SEQ ID NO: 147513 - RNA, 22 nt, Human
agacaaaacaaaacaaaaaaaa

SEQ ID NO: 147514 - RNA, 21 nt, Human
agacaguaaacagauaaucca

SEQ ID NO: 147515 - RNA, 21 nt, Human
agagaaaaguagucuuugaaa

SEQ ID NO: 147516 - RNA, 23 nt, Human
aggaagacagcccuggcaucaga

SEQ ID NO: 147517 - RNA, 19 nt, Human
aucacagcugggggguuuc

SEQ ID NO: 147518 - RNA, 22 nt, Human
aucaugucacauacaaaacauu

SEQ ID NO: 147519 - RNA, 20 nt, Human
caaaaaagaaccaagcuggg

SEQ ID NO: 147520 - RNA, 21 nt, Human
caaaacaaaaaaaauuccucu

SEQ ID NO: 147521 - RNA, 24 nt, Human
cacaaagaacacuccggccaaaaa

SEQ ID NO: 147522 - RNA, 19 nt, Human
cacaaccacauacagcauc

SEQ ID NO: 147523 - RNA, 18 nt, Human
caccacaaagaacacucc

SEQ ID NO: 147524 - RNA, 20 nt, Human
caccucccuugacgaagcca

SEQ ID NO: 147525 - RNA, 19 nt, Human
cagcaggcugcaaucucac

SEQ ID NO: 147526 - RNA, 24 nt, Human
caggaaagcccucaccacaaagaa

SEQ ID NO: 147527 - RNA, 23 nt, Human
ccaccgucuccuuuuuccaacuu

SEQ ID NO: 147528 - RNA, 23 nt, Human
cggccaaaaaugucaauugugca

SEQ ID NO: 147529 - RNA, 18 nt, Human
cuguguacguuuuuuccc

SEQ ID NO: 147530 - RNA, 27 nt, Human
cuuagaagacaaaacaaaacaaaaaaa

SEQ ID NO: 147531 - RNA, 27 nt, Human
gaaaagaagcuccucuaacuauuucaa

SEQ ID NO: 147532 - RNA, 20 nt, Human
gaacacuccggccaaaaaug

SEQ ID NO: 147533 - RNA, 20 nt, Human
gaaguccccauucuccacuc

SEQ ID NO: 147534 - RNA, 24 nt, Human
gacccuggaauuuaacucagcaac

SEQ ID NO: 147535 - RNA, 20 nt, Human
gauuuuguuuuucuuucucu

SEQ ID NO: 147536 - RNA, 21 nt, Human
gcaaagaggauuuucccugga

SEQ ID NO: 147537 - RNA, 19 nt, Human
gcacuuggagcaaaaaaga

SEQ ID NO: 147538 - RNA, 22 nt, Human
gcuaaacuggugguucucaauc

SEQ ID NO: 147539 - RNA, 21 nt, Human
ggaaagcccucaccacaaaga

SEQ ID NO: 147540 - RNA, 23 nt, Human
ggaagacagcccuggcaucagau

SEQ ID NO: 147541 - RNA, 19 nt, Human
gggugggaaauccaauagc

SEQ ID NO: 147542 - RNA, 19 nt, Human
guggauacugcugaacauc

SEQ ID NO: 147543 - RNA, 25 nt, Human
uaaacagauaauccaaaagacaaaa

SEQ ID NO: 147544 - RNA, 22 nt, Human
uagcuaaacuggugguucucaa

SEQ ID NO: 147545 - RNA, 22 nt, Human
uauuuuuuucauccuuucuuuc

SEQ ID NO: 147546 - RNA, 21 nt, Human
ucagagaaaaguagucuuuga

SEQ ID NO: 147547 - RNA, 20 nt, Human
uccaaaagacaaaaaauuau

SEQ ID NO: 147548 - RNA, 22 nt, Human
ucccuaacauuuaaaacauuaa

SEQ ID NO: 147549 - RNA, 22 nt, Human
uccugaaugaguauaaagaccc

SEQ ID NO: 147550 - RNA, 18 nt, Human
ucgacuguaguguuucuu

SEQ ID NO: 147551 - RNA, 20 nt, Human
ucucaaucaagggcaaauuu

SEQ ID NO: 147552 - RNA, 22 nt, Human
ugaaaaaaaaucacaaccacau

SEQ ID NO: 147553 - RNA, 21 nt, Human
ugaaaaagaauucacaauaga

SEQ ID NO: 147554 - RNA, 18 nt, Human
ugagcugaguuuucuguu

SEQ ID NO: 147555 - RNA, 18 nt, Human
ugaguacaaaucuaggca

SEQ ID NO: 147556 - RNA, 18 nt, Human
ugaguauaaagaccccac

SEQ ID NO: 147557 - RNA, 23 nt, Human
ugcaaagaggauuuucccuggaa

SEQ ID NO: 147558 - RNA, 24 nt, Human
ugcaaagaggauuuucccuggaaa

SEQ ID NO: 147559 - RNA, 19 nt, Human
ugggggguuucugguguca

SEQ ID NO: 147560 - RNA, 23 nt, Human
ugucuagagacauuuugcguuau

SEQ ID NO: 147561 - RNA, 18 nt, Human
ugugcagauugagaaacc

SEQ ID NO: 147562 - RNA, 21 nt, Human
ugugguugauggaggggaggc

SEQ ID NO: 147563 - RNA, 25 nt, Human
uguuuccuucuacaauauaauuuua

SEQ ID NO: 147564 - RNA, 20 nt, Human
uuaaauagcuagaagugagc

SEQ ID NO: 147565 - RNA, 18 nt, Human
uuaauaccugcaaagagg

SEQ ID NO: 147566 - RNA, 27 nt, Human
uuagaagacaaaacaaaacaaaaaaaa

SEQ ID NO: 147567 - RNA, 19 nt, Human
uuagaaguaguuucuuguu

SEQ ID NO: 147568 - RNA, 21 nt, Human
uucacaauagaggugaaaaaa

SEQ ID NO: 147569 - RNA, 22 nt, Human
uucaccucccuugacgaagcca

SEQ ID NO: 147570 - RNA, 21 nt, Human
uuccucugaguacaaaucuag

SEQ ID NO: 147571 - RNA, 20 nt, Human
uuucuuagaagacaaaacaa

SEQ ID NO: 147572 - RNA, 20 nt, Human
uuugaaauauuuacguccag

SEQ ID NO: 147573 - RNA, 21 nt, Human
uuuucauccuuucuuuccuuu

SEQ ID NO: 147574 - RNA, 25 nt, Human
aaaaagagaagaacucuuacaacaa

SEQ ID NO: 147575 - RNA, 25 nt, Human
aaacaauccuccugccucagccucc

SEQ ID NO: 147576 - RNA, 19 nt, Human
aaacagaagaggaaagacc

SEQ ID NO: 147577 - RNA, 19 nt, Human
aaacagaagaggaaagacc

SEQ ID NO: 147578 - RNA, 22 nt, Human
aaacagaagaggaaagaccaga

SEQ ID NO: 147579 - RNA, 23 nt, Human
aaacagaagaggaaagaccagaa

SEQ ID NO: 147580 - RNA, 24 nt, Human
aaagugcugggauuacagguguga

SEQ ID NO: 147581 - RNA, 19 nt, Human
aacaauccuccugccucag

SEQ ID NO: 147582 - RNA, 18 nt, Human
aagugcugggauuacagg

SEQ ID NO: 147583 - RNA, 19 nt, Human
aagugcugggauuacaggu

SEQ ID NO: 147584 - RNA, 26 nt, Human
aagugcugggauuacaggugugagcc

SEQ ID NO: 147585 - RNA, 21 nt, Human
aauccuguacuccccauucau

SEQ ID NO: 147586 - RNA, 20 nt, Human
aaugauaaaagcauuugaga

SEQ ID NO: 147587 - RNA, 24 nt, Human
acaaggcaaaaaguaaaaagagaa

SEQ ID NO: 147588 - RNA, 22 nt, Human
acaggaaaacuggugucauuac

SEQ ID NO: 147589 - RNA, 19 nt, Human
acaggguuuugcuauguug

SEQ ID NO: 147590 - RNA, 24 nt, Human
acaggguuuugcuauguugcccag

SEQ ID NO: 147591 - RNA, 21 nt, Human
accacaaugaaggauaacauc

SEQ ID NO: 147592 - RNA, 19 nt, Human
acucaguucccuuaccaau

SEQ ID NO: 147593 - RNA, 24 nt, Human
agaagaggaaagaccagaagagga

SEQ ID NO: 147594 - RNA, 18 nt, Human
agacaggguuuugcuaug

SEQ ID NO: 147595 - RNA, 23 nt, Human
agacaggguuuugcuauguugcc

SEQ ID NO: 147596 - RNA, 20 nt, Human
agaccagaagaggaaaggcu

SEQ ID NO: 147597 - RNA, 21 nt, Human
agcaugugaggcauaaucugg

SEQ ID NO: 147598 - RNA, 22 nt, Human
agcccauuuauuuacuaacacc

SEQ ID NO: 147599 - RNA, 24 nt, Human
aggaaagaccagaagaggaaagga

SEQ ID NO: 147600 - RNA, 22 nt, Human
aggcauaaucuggaagacugaa

SEQ ID NO: 147601 - RNA, 19 nt, Human
aucaauacuauguguguga

SEQ ID NO: 147602 - RNA, 25 nt, Human
aucacagaggcuugucaugacagga

SEQ ID NO: 147603 - RNA, 21 nt, Human
auccuccugccucagccuccc

SEQ ID NO: 147604 - RNA, 26 nt, Human
auggcugaauaauauaguccauugua

SEQ ID NO: 147605 - RNA, 26 nt, Human
auuauauucacacaaguucaugcauu

SEQ ID NO: 147606 - RNA, 20 nt, Human
caaaaugaauguaugacuua

SEQ ID NO: 147607 - RNA, 24 nt, Human
caaagugcugggauuacaggugug

SEQ ID NO: 147608 - RNA, 24 nt, Human
caaauuucuggccucaaacaaucc

SEQ ID NO: 147609 - RNA, 19 nt, Human
caacggaaaacuuauacuc

SEQ ID NO: 147610 - RNA, 26 nt, Human
caccacaaugaaggauaacaucuuca

SEQ ID NO: 147611 - RNA, 22 nt, Human
cacuaaccuaaguucccugugc

SEQ ID NO: 147612 - RNA, 24 nt, Human
caggguuuugcuauguugcccagg

SEQ ID NO: 147613 - RNA, 24 nt, Human
caggugugagccacugugccuggc

SEQ ID NO: 147614 - RNA, 22 nt, Human
cauucaucacccccaauucuag

SEQ ID NO: 147615 - RNA, 21 nt, Human
ccaaagugcugggauuacagg

SEQ ID NO: 147616 - RNA, 21 nt, Human
ccaaagugcugggauuacagg

SEQ ID NO: 147617 - RNA, 24 nt, Human
ccaaagugcugggauuacaggugu

SEQ ID NO: 147618 - RNA, 21 nt, Human
ccaaugauaaaagcauuugag

SEQ ID NO: 147619 - RNA, 24 nt, Human
ccagaagaggaaaggcuugccaca

SEQ ID NO: 147620 - RNA, 22 nt, Human
cccaauucuagccuuagguaac

SEQ ID NO: 147621 - RNA, 24 nt, Human
cucaaacaauccuccugccucagc

SEQ ID NO: 147622 - RNA, 23 nt, Human
cugccucagccucccaaagugcu

SEQ ID NO: 147623 - RNA, 24 nt, Human
cugccucagccucccaaagugcug

SEQ ID NO: 147624 - RNA, 18 nt, Human
cuggccucaaacaauccu

SEQ ID NO: 147625 - RNA, 19 nt, Human
gacaggguuuugcuauguu

SEQ ID NO: 147626 - RNA, 24 nt, Human
gaccauuaccacaauaaguuuaga

SEQ ID NO: 147627 - RNA, 18 nt, Human
gauuacaggugugagcca

SEQ ID NO: 147628 - RNA, 21 nt, Human
gauuacaggugugagccacug

SEQ ID NO: 147629 - RNA, 24 nt, Human
gauuacaggugugagccacugugc

SEQ ID NO: 147630 - RNA, 21 nt, Human
gauucagaggcauaggaagca

SEQ ID NO: 147631 - RNA, 19 nt, Human
gcuauguugcccaggcugg

SEQ ID NO: 147632 - RNA, 20 nt, Human
gcuauguugcccaggcuggu

SEQ ID NO: 147633 - RNA, 18 nt, Human
guagagacaggguuuugc

SEQ ID NO: 147634 - RNA, 24 nt, Human
guuugcuuuuuaacaacggaaaac

SEQ ID NO: 147635 - RNA, 24 nt, Human
guuuugcuauguugcccaggcugg

SEQ ID NO: 147636 - RNA, 24 nt, Human
uaaaauuaaguaguacacauuuca

SEQ ID NO: 147637 - RNA, 23 nt, Human
uaaacagaagaggaaagaccaga

SEQ ID NO: 147638 - RNA, 22 nt, Human
uacaggugugagccacugugcc

SEQ ID NO: 147639 - RNA, 22 nt, Human
uacaggugugagccacugugcc

SEQ ID NO: 147640 - RNA, 23 nt, Human
uacaggugugagccacugugccu

SEQ ID NO: 147641 - RNA, 24 nt, Human
uaccauauaauucacccacuuaaa

SEQ ID NO: 147642 - RNA, 24 nt, Human
uacuacuuucuauuauuucuccau

SEQ ID NO: 147643 - RNA, 22 nt, Human
uagagacaggguuuugcuaugu

SEQ ID NO: 147644 - RNA, 22 nt, Human
uagguaaccacuaauguacgga

SEQ ID NO: 147645 - RNA, 21 nt, Human
uaguucauagacauuuggguu

SEQ ID NO: 147646 - RNA, 22 nt, Human
uauauucacacaaguucaugca

SEQ ID NO: 147647 - RNA, 23 nt, Human
uauguugcccaggcuggucucaa

SEQ ID NO: 147648 - RNA, 24 nt, Human
uauguugcccaggcuggucucaaa

SEQ ID NO: 147649 - RNA, 21 nt, Human
uauugugaaaguucauuuaca

SEQ ID NO: 147650 - RNA, 20 nt, Human
ucaaugguuuucuaauauau

SEQ ID NO: 147651 - RNA, 19 nt, Human
ucagaacaaucuuacuuug

SEQ ID NO: 147652 - RNA, 24 nt, Human
ucagcccauuuauuuacuaacacc

SEQ ID NO: 147653 - RNA, 23 nt, Human
ucauuuuauuuggguucacagaa

SEQ ID NO: 147654 - RNA, 22 nt, Human
uccaacugucuuuuuccuacaa

SEQ ID NO: 147655 - RNA, 23 nt, Human
ucccaaagugcugggauuacagg

SEQ ID NO: 147656 - RNA, 23 nt, Human
ucccuuaccaauuuccaacuguc

SEQ ID NO: 147657 - RNA, 27 nt, Human
uccuccugccucagccucccaaagugc

SEQ ID NO: 147658 - RNA, 21 nt, Human
ucuaauauauuguuaugugac

SEQ ID NO: 147659 - RNA, 23 nt, Human
ucuccauaaacagaagaggaaag

SEQ ID NO: 147660 - RNA, 21 nt, Human
ucugauaaggacagauucaga

SEQ ID NO: 147661 - RNA, 21 nt, Human
ugaaaggagucaaaaugaaug

SEQ ID NO: 147662 - RNA, 26 nt, Human
ugaaccauaaagaaauccuguacccu

SEQ ID NO: 147663 - RNA, 23 nt, Human
ugaauguaugacuuagcugcauu

SEQ ID NO: 147664 - RNA, 21 nt, Human
ugacaggaaaacuggugucau

SEQ ID NO: 147665 - RNA, 22 nt, Human
ugacauugaaaggagucaaaau

SEQ ID NO: 147666 - RNA, 25 nt, Human
ugagauauaauucacauaccauaua

SEQ ID NO: 147667 - RNA, 26 nt, Human
ugagauauaauucacauaccauauaa

SEQ ID NO: 147668 - RNA, 24 nt, Human
ugcccaggcuggucucaaauuucu

SEQ ID NO: 147669 - RNA, 24 nt, Human
ugccucagccucccaaagugcugg

SEQ ID NO: 147670 - RNA, 24 nt, Human
ugcuauguugcccaggcuggucuc

SEQ ID NO: 147671 - RNA, 24 nt, Human
ugcugggauuacaggugugagcca

SEQ ID NO: 147672 - RNA, 24 nt, Human
uggccucaaacaauccuccugccu

SEQ ID NO: 147673 - RNA, 18 nt, Human
ugggauuacaggugugag

SEQ ID NO: 147674 - RNA, 21 nt, Human
ugggauuacaggugugagcca

SEQ ID NO: 147675 - RNA, 22 nt, Human
ugggauuacaggugugagccac

SEQ ID NO: 147676 - RNA, 22 nt, Human
ugggauuacaggugugagccac

SEQ ID NO: 147677 - RNA, 22 nt, Human
ugggauuacaggugugagccac

SEQ ID NO: 147678 - RNA, 24 nt, Human
ugggauuacaggugugagccacug

SEQ ID NO: 147679 - RNA, 20 nt, Human
uguacaaguuuuuguauuga

SEQ ID NO: 147680 - RNA, 24 nt, Human
uguagagacaggguuuugcuaugu

SEQ ID NO: 147681 - RNA, 21 nt, Human
ugugugugacauugaaaggag

SEQ ID NO: 147682 - RNA, 23 nt, Human
uguugguuuuuuguuugcuuuuu

SEQ ID NO: 147683 - RNA, 25 nt, Human
uuaacuacacaaggcaaaaaguaaa

SEQ ID NO: 147684 - RNA, 23 nt, Human
uugaaaggagucaaaaugaaugu

SEQ ID NO: 147685 - RNA, 22 nt, Human
uuggauuuuugauuuaauuuca

SEQ ID NO: 147686 - RNA, 24 nt, Human
uuguagagacaggguuuugcuaug

SEQ ID NO: 147687 - RNA, 21 nt, Human
uuucugaucaauacuaugugu

SEQ ID NO: 147688 - RNA, 25 nt, Human
uuucuggccucaaacaauccuccug

SEQ ID NO: 147689 - RNA, 21 nt, Human
uuucuggccucaaacaaucuu

SEQ ID NO: 147690 - RNA, 23 nt, Human
uuuggauuuuugauuuaauuuca

SEQ ID NO: 147691 - RNA, 21 nt, Human
uuuguagagacaggguuuugc

SEQ ID NO: 147692 - RNA, 24 nt, Human
uuuguagagacaggguuuugcuau

SEQ ID NO: 147693 - RNA, 22 nt, Human
uuuugcuauguugcccaggcug

SEQ ID NO: 147694 - RNA, 23 nt, Human
uuuugcuauguugcccaggcugg

SEQ ID NO: 147695 - RNA, 21 nt, Human
uuuuuuguagagacaggguuu

SEQ ID NO: 147696 - RNA, 24 nt, Human
uuuuuuguagagacaggguuuugc

SEQ ID NO: 147697 - RNA, 25 nt, Human
aaaaacaaaaacaaaaaacaaaaac

SEQ ID NO: 147698 - RNA, 19 nt, Human
aaaaacacaaagcagugug

SEQ ID NO: 147699 - RNA, 20 nt, Human
aaaaacacaaagcagugugc

SEQ ID NO: 147700 - RNA, 29 nt, Human
aaaacaaaaaacaaaaacaaaagggaccc

SEQ ID NO: 147701 - RNA, 26 nt, Human
aaaacaaaaacaaaaaacaaaaacaa

SEQ ID NO: 147702 - RNA, 21 nt, Human
aaaacacaaagcagugugcaa

SEQ ID NO: 147703 - RNA, 22 nt, Human
aaaagaaaugggaaauacagaa

SEQ ID NO: 147704 - RNA, 21 nt, Human
aaaagaacaaagugggcuuaa

SEQ ID NO: 147705 - RNA, 24 nt, Human
aaaauaaggguauaacauauucug

SEQ ID NO: 147706 - RNA, 24 nt, Human
aaacaaaaaacaaaaacaaaacca

SEQ ID NO: 147707 - RNA, 20 nt, Human
aaaccaacagccauuccuaa

SEQ ID NO: 147708 - RNA, 25 nt, Human
aacaaaaacaaaaaacaaaaacaaa

SEQ ID NO: 147709 - RNA, 18 nt, Human
aacaaaaaugcaacccaa

SEQ ID NO: 147710 - RNA, 18 nt, Human
aaccaaaaacacaaagca

SEQ ID NO: 147711 - RNA, 24 nt, Human
aaccaaaaauaucuuagaaacaaa

SEQ ID NO: 147712 - RNA, 24 nt, Human
aacccaaucaaaaucauuaguaag

SEQ ID NO: 147713 - RNA, 23 nt, Human
aagaaccugaagcugagacaagc

SEQ ID NO: 147714 - RNA, 26 nt, Human
aagcaaaaaacaaaaacaaaaaacaa

SEQ ID NO: 147715 - RNA, 23 nt, Human
aagcaaagauaaaaaggagggac

SEQ ID NO: 147716 - RNA, 27 nt, Human
aagcagcaaugcaugguuucccaguag

SEQ ID NO: 147717 - RNA, 26 nt, Human
aagcagcaaugcaugguuucccagug

SEQ ID NO: 147718 - RNA, 18 nt, Human
aagcuacaacuuuacccc

SEQ ID NO: 147719 - RNA, 21 nt, Human
aaguaggugcuggaggccagg

SEQ ID NO: 147720 - RNA, 21 nt, Human
aagugaaaagagcagacacug

SEQ ID NO: 147721 - RNA, 24 nt, Human
aauacaagcaaaaaacaaaaacaa

SEQ ID NO: 147722 - RNA, 21 nt, Human
aauguacaaauauacauucua

SEQ ID NO: 147723 - RNA, 20 nt, Human
aauuagcugucaugaaucua

SEQ ID NO: 147724 - RNA, 21 nt, Human
acaaaaacaaaaaacaaaaac

SEQ ID NO: 147725 - RNA, 26 nt, Human
acaaaaaugcaacccaaucaaaauca

SEQ ID NO: 147726 - RNA, 20 nt, Human
acaagcaaaaaacaaaaaca

SEQ ID NO: 147727 - RNA, 22 nt, Human
acccagcucuucagagauccgc

SEQ ID NO: 147728 - RNA, 20 nt, Human
agaaacuggagaccaucuuu

SEQ ID NO: 147729 - RNA, 18 nt, Human
agaaaugggaaauacaga

SEQ ID NO: 147730 - RNA, 19 nt, Human
agaagaauuccuccaagua

SEQ ID NO: 147731 - RNA, 20 nt, Human
agauuugcuuguuuuccuuu

SEQ ID NO: 147732 - RNA, 23 nt, Human
agcaaaaaacaaaaacaaaaaac

SEQ ID NO: 147733 - RNA, 21 nt, Human
agccacacuagugauaaaaca

SEQ ID NO: 147734 - RNA, 19 nt, Human
agcugugcuauuccuacca

SEQ ID NO: 147735 - RNA, 20 nt, Human
aggaaauuauaguaagagua

SEQ ID NO: 147736 - RNA, 22 nt, Human
agggauauguugaaaaaggcuu

SEQ ID NO: 147737 - RNA, 24 nt, Human
auaaggguauaacauauucugcag

SEQ ID NO: 147738 - RNA, 22 nt, Human
auacaaauuaguagaagaauuc

SEQ ID NO: 147739 - RNA, 21 nt, Human
auccaugcucuccccucucca

SEQ ID NO: 147740 - RNA, 18 nt, Human
aucucuucuuuuaauguu

SEQ ID NO: 147741 - RNA, 20 nt, Human
auggaucucuucuuuuaaug

SEQ ID NO: 147742 - RNA, 19 nt, Human
auuuuaaucuucuuuguca

SEQ ID NO: 147743 - RNA, 22 nt, Human
caaagacugcacgcaaaagaaa

SEQ ID NO: 147744 - RNA, 22 nt, Human
caaaugauuucuucaaaacacc

SEQ ID NO: 147745 - RNA, 22 nt, Human
caacugcagacuucugccuccc

SEQ ID NO: 147746 - RNA, 21 nt, Human
caagaggccagggcuuaauca

SEQ ID NO: 147747 - RNA, 18 nt, Human
caagugaaaagagcagac

SEQ ID NO: 147748 - RNA, 23 nt, Human
cacaaagcagugugcaaaaguuc

SEQ ID NO: 147749 - RNA, 18 nt, Human
cagaauacagaagacaug

SEQ ID NO: 147750 - RNA, 23 nt, Human
caggcaacgugcgcgggagaggc

SEQ ID NO: 147751 - RNA, 19 nt, Human
cagggcuaggaggggggaa

SEQ ID NO: 147752 - RNA, 18 nt, Human
caguucauucuauaccug

SEQ ID NO: 147753 - RNA, 18 nt, Human
ccaaagaguauaaauaaa

SEQ ID NO: 147754 - RNA, 22 nt, Human
ccacgcucggcggcagcaaaug

SEQ ID NO: 147755 - RNA, 18 nt, Human
ccaguggucaccugcagg

SEQ ID NO: 147756 - RNA, 25 nt, Human
ccaucuuuucacugaguuguuauuc

SEQ ID NO: 147757 - RNA, 25 nt, Human
ccccaggauccaugcucuccccucu

SEQ ID NO: 147758 - RNA, 22 nt, Human
cccuuagucucagaugcauucc

SEQ ID NO: 147759 - RNA, 25 nt, Human
ccugaagcugagacaagccgggguc

SEQ ID NO: 147760 - RNA, 19 nt, Human
cgcgggaccaaguaggugc

SEQ ID NO: 147761 - RNA, 23 nt, Human
cggcauuuuggaaaucuuuuuuu

SEQ ID NO: 147762 - RNA, 19 nt, Human
cgggaccaaguaggugcug

SEQ ID NO: 147763 - RNA, 21 nt, Human
cuaacuagcucagcccuaguu

SEQ ID NO: 147764 - RNA, 22 nt, Human
cuccgaggggcgacacgaggga

SEQ ID NO: 147765 - RNA, 24 nt, Human
cucgcggcgucucugacuucuuuc

SEQ ID NO: 147766 - RNA, 22 nt, Human
cugcaacuacuaagcuuacaaa

SEQ ID NO: 147767 - RNA, 21 nt, Human
cugcagacuucugccucccuc

SEQ ID NO: 147768 - RNA, 21 nt, Human
cugcuuuaacaaauugcauuc

SEQ ID NO: 147769 - RNA, 19 nt, Human
cugugcuauuccuaccagg

SEQ ID NO: 147770 - RNA, 23 nt, Human
cuuuucaacaaguauuuuauuuu

SEQ ID NO: 147771 - RNA, 25 nt, Human
gaagaaccugaagcugagacaagca

SEQ ID NO: 147772 - RNA, 20 nt, Human
gaagacaugcaccuucuauc

SEQ ID NO: 147773 - RNA, 19 nt, Human
gaagcugagacaagcagga

SEQ ID NO: 147774 - RNA, 18 nt, Human
gauuugcuuguuuuccuu

SEQ ID NO: 147775 - RNA, 19 nt, Human
gcagacuucugccucccuc

SEQ ID NO: 147776 - RNA, 22 nt, Human
gcagugugcaaaaguucauggg

SEQ ID NO: 147777 - RNA, 21 nt, Human
ggaggccaggcaacgugcgcg

SEQ ID NO: 147778 - RNA, 26 nt, Human
ggcauuuuggaaaucuuuuuuuuuuu

SEQ ID NO: 147779 - RNA, 18 nt, Human
ggcugcugcuccgagggg

SEQ ID NO: 147780 - RNA, 21 nt, Human
gguggcaaaauacgacuauga

SEQ ID NO: 147781 - RNA, 20 nt, Human
guaaaauaucuucaagcaaa

SEQ ID NO: 147782 - RNA, 18 nt, Human
gugcgcgggagaggcugg

SEQ ID NO: 147783 - RNA, 26 nt, Human
uaaaaaaaccaaaaauaucuuagaaa

SEQ ID NO: 147784 - RNA, 18 nt, Human
uaaaaacuaaauaaggaa

SEQ ID NO: 147785 - RNA, 23 nt, Human
uaaaagaaaagucaacaauugua

SEQ ID NO: 147786 - RNA, 19 nt, Human
uaaaauaauaugaaaggau

SEQ ID NO: 147787 - RNA, 24 nt, Human
uaagaaauauucaacaaacaauga

SEQ ID NO: 147788 - RNA, 20 nt, Human
uacaagcaaaaaacaaaaac

SEQ ID NO: 147789 - RNA, 21 nt, Human
uacaagcaaaaaacaaaaaca

SEQ ID NO: 147790 - RNA, 20 nt, Human
uacaaucaagaggccagggc

SEQ ID NO: 147791 - RNA, 20 nt, Human
uacacugccucacaaguacc

SEQ ID NO: 147792 - RNA, 21 nt, Human
uacacugccucacaaguaccu

SEQ ID NO: 147793 - RNA, 22 nt, Human
uaccuauuugauuacucagagu

SEQ ID NO: 147794 - RNA, 19 nt, Human
uacuaagcuuacaaauuca

SEQ ID NO: 147795 - RNA, 25 nt, Human
uacuuaaauaugacaaacagacuua

SEQ ID NO: 147796 - RNA, 19 nt, Human
uagaaacaaaucagucugc

SEQ ID NO: 147797 - RNA, 22 nt, Human
uagaauaaagauaagcauuuca

SEQ ID NO: 147798 - RNA, 24 nt, Human
uagaauaagaaauauaaaccauga

SEQ ID NO: 147799 - RNA, 18 nt, Human
uagaggagguaaguagaa

SEQ ID NO: 147800 - RNA, 24 nt, Human
uagcaaaaacacuuuuauguacag

SEQ ID NO: 147801 - RNA, 22 nt, Human
uagccacaggcuacuuaaauau

SEQ ID NO: 147802 - RNA, 19 nt, Human
uagccaugauuccacagau

SEQ ID NO: 147803 - RNA, 22 nt, Human
uagcuuacauguauaugacuuc

SEQ ID NO: 147804 - RNA, 22 nt, Human
uauaacauauucugcagcauga

SEQ ID NO: 147805 - RNA, 21 nt, Human
uaucuuagaaacaaaucaguc

SEQ ID NO: 147806 - RNA, 19 nt, Human
uaucuucaagcaaaugaga

SEQ ID NO: 147807 - RNA, 20 nt, Human
ucacauuuugcucuuuucug

SEQ ID NO: 147808 - RNA, 19 nt, Human
ucaucuguuagucuuaugc

SEQ ID NO: 147809 - RNA, 19 nt, Human
uccacagauguggugagua

SEQ ID NO: 147810 - RNA, 23 nt, Human
uccacagauguggugaguaaacc

SEQ ID NO: 147811 - RNA, 24 nt, Human
uccagacaaaccacguguuagagg

SEQ ID NO: 147812 - RNA, 19 nt, Human
uccagaguuugguguacac

SEQ ID NO: 147813 - RNA, 22 nt, Human
uccauaugaugggaaaggaaac

SEQ ID NO: 147814 - RNA, 21 nt, Human
uccuucuauuguacgaaucaa

SEQ ID NO: 147815 - RNA, 18 nt, Human
ucuuggagaccauuucca

SEQ ID NO: 147816 - RNA, 23 nt, Human
ugaaaaauaaaacuucuuggaga

SEQ ID NO: 147817 - RNA, 18 nt, Human
ugaaaagagcagacacug

SEQ ID NO: 147818 - RNA, 23 nt, Human
ugaagagaauuguuaauucuuca

SEQ ID NO: 147819 - RNA, 22 nt, Human
ugagagacuucaucuguuaguc

SEQ ID NO: 147820 - RNA, 21 nt, Human
ugaguaaaccaacagccauuc

SEQ ID NO: 147821 - RNA, 27 nt, Human
ugaguaaaccaacagccauuccuaaau

SEQ ID NO: 147822 - RNA, 20 nt, Human
uggaauauacacaaugacuc

SEQ ID NO: 147823 - RNA, 25 nt, Human
uggcgacccagcucuucagagaucc

SEQ ID NO: 147824 - RNA, 21 nt, Human
ugguaagaagcggucucuuua

SEQ ID NO: 147825 - RNA, 21 nt, Human
ugguaggaaaagcagcaaugc

SEQ ID NO: 147826 - RNA, 23 nt, Human
uguggugaguaaaccaacagcca

SEQ ID NO: 147827 - RNA, 28 nt, Human
uuagcaaaaacacuuuuauguacagaag

SEQ ID NO: 147828 - RNA, 18 nt, Human
uucaacuuaauguucuau

SEQ ID NO: 147829 - RNA, 22 nt, Human
uucacauaauaaaauauauccu

SEQ ID NO: 147830 - RNA, 24 nt, Human
uucccaauacaagcaaaaaacaaa

SEQ ID NO: 147831 - RNA, 22 nt, Human
uuccucuucccuuagcuuaggg

SEQ ID NO: 147832 - RNA, 20 nt, Human
uuccuuuugaagccauguga

SEQ ID NO: 147833 - RNA, 19 nt, Human
uucuucaaggcugguuucu

SEQ ID NO: 147834 - RNA, 23 nt, Human
uugcauauaagcuacaacuuuac

SEQ ID NO: 147835 - RNA, 21 nt, Human
uuugguguacacuuaggaaau

SEQ ID NO: 147836 - RNA, 24 nt, Human
uuuguaauuaguagacauggucuu

SEQ ID NO: 147837 - RNA, 20 nt, Human
uuuuuuuuuguaauuaguag

SEQ ID NO: 147838 - RNA, 18 nt, Human
aaaacaaaauggcacccc

SEQ ID NO: 147839 - RNA, 22 nt, Human
aauaacuuuugaaaacaaaaug

SEQ ID NO: 147840 - RNA, 18 nt, Human
aaugaauuucucuucuug

SEQ ID NO: 147841 - RNA, 21 nt, Human
aaugaauuucucuucuugguu

SEQ ID NO: 147842 - RNA, 24 nt, Human
acuuguucaugaaagccaaaacag

SEQ ID NO: 147843 - RNA, 18 nt, Human
aggugggugcgcagaaga

SEQ ID NO: 147844 - RNA, 18 nt, Human
cacacuuuaaaaacugua

SEQ ID NO: 147845 - RNA, 19 nt, Human
cagagcucucucauaaacu

SEQ ID NO: 147846 - RNA, 21 nt, Human
ccaaaaucccaacuguagaac

SEQ ID NO: 147847 - RNA, 19 nt, Human
cgacugaacuaagaugcag

SEQ ID NO: 147848 - RNA, 29 nt, Human
cgaggcacaaaggaugaaaaggauuuauu

SEQ ID NO: 147849 - RNA, 22 nt, Human
cuuauacauucuaaguuacuac

SEQ ID NO: 147850 - RNA, 25 nt, Human
gagaccucuuccgacuccuuucugg

SEQ ID NO: 147851 - RNA, 18 nt, Human
gaggcacaaaggaugaaa

SEQ ID NO: 147852 - RNA, 22 nt, Human
gauaaauaugaaaaauaugucc

SEQ ID NO: 147853 - RNA, 19 nt, Human
gcagaagaggcuggcuaca

SEQ ID NO: 147854 - RNA, 22 nt, Human
ggcuacagagcucucucauaaa

SEQ ID NO: 147855 - RNA, 20 nt, Human
guagaaccauccucagagaa

SEQ ID NO: 147856 - RNA, 18 nt, Human
guuacuacucuaagagcc

SEQ ID NO: 147857 - RNA, 21 nt, Human
uaagaugcagcaggugggugc

SEQ ID NO: 147858 - RNA, 20 nt, Human
uaucacaguaggaaaggcac

SEQ ID NO: 147859 - RNA, 20 nt, Human
uaugagaccaucuaaguaac

SEQ ID NO: 147860 - RNA, 25 nt, Human
uauucaaaauauccaauuacuugac

SEQ ID NO: 147861 - RNA, 18 nt, Human
ucauguaaaaacacuugg

SEQ ID NO: 147862 - RNA, 26 nt, Human
ugcagauuucugucuucaaauuguau

SEQ ID NO: 147863 - RNA, 21 nt, Human
uggaaguagggcuuauuagaa

SEQ ID NO: 147864 - RNA, 21 nt, Human
ugggugcgcagaagaggcugg

SEQ ID NO: 147865 - RNA, 18 nt, Human
uucuugguugaugauggc

SEQ ID NO: 147866 - RNA, 21 nt, Human
aaaaagcuguaaacccacccu

SEQ ID NO: 147867 - RNA, 24 nt, Human
aaacccacccuagaaccaucuaag

SEQ ID NO: 147868 - RNA, 22 nt, Human
aaagaacaaagauagcccuuuc

SEQ ID NO: 147869 - RNA, 22 nt, Human
aaauggugagggcuauaaagcu

SEQ ID NO: 147870 - RNA, 24 nt, Human
aaguaguccacaaaaaaauugagc

SEQ ID NO: 147871 - RNA, 22 nt, Human
acccuagaaccaucuaaggaau

SEQ ID NO: 147872 - RNA, 20 nt, Human
accuacaggauuacauauaa

SEQ ID NO: 147873 - RNA, 19 nt, Human
agaacaaagauagcccuuu

SEQ ID NO: 147874 - RNA, 20 nt, Human
agccaguuucaagagacuaa

SEQ ID NO: 147875 - RNA, 19 nt, Human
agggacccuacugccgccc

SEQ ID NO: 147876 - RNA, 24 nt, Human
caaaacucaggaguuggcucaaau

SEQ ID NO: 147877 - RNA, 27 nt, Human
caaacuuuccgcgcguuggcucucuca

SEQ ID NO: 147878 - RNA, 22 nt, Human
caaccaauuuacauaaaaagcu

SEQ ID NO: 147879 - RNA, 18 nt, Human
cagauuccuaauuuaccc

SEQ ID NO: 147880 - RNA, 19 nt, Human
cauaaacauauuuacagug

SEQ ID NO: 147881 - RNA, 22 nt, Human
cauguucccaggcuggccuuga

SEQ ID NO: 147882 - RNA, 19 nt, Human
cauuuucccuuuauuggag

SEQ ID NO: 147883 - RNA, 20 nt, Human
ccaaaacuagaccuuucaac

SEQ ID NO: 147884 - RNA, 21 nt, Human
ccccuggccacgucucagccc

SEQ ID NO: 147885 - RNA, 18 nt, Human
cccgccccgcgcgcaggc

SEQ ID NO: 147886 - RNA, 20 nt, Human
ccgccccgacggccuggaca

SEQ ID NO: 147887 - RNA, 24 nt, Human
ccuccuuaggcaaauggugagggc

SEQ ID NO: 147888 - RNA, 19 nt, Human
ccuugauggggaaggugga

SEQ ID NO: 147889 - RNA, 22 nt, Human
cgcgcgcaggcauggaggcgca

SEQ ID NO: 147890 - RNA, 19 nt, Human
cuacaaauaggacuauaaa

SEQ ID NO: 147891 - RNA, 19 nt, Human
cuacugccgccccgacggc

SEQ ID NO: 147892 - RNA, 18 nt, Human
cucacuauauauauauau

SEQ ID NO: 147893 - RNA, 26 nt, Human
cucccaaaacuagaccuuucaaccaa

SEQ ID NO: 147894 - RNA, 24 nt, Human
cugcauuauaaaaauauauccauu

SEQ ID NO: 147895 - RNA, 26 nt, Human
cuuacuacggcuuuuuuccucccaaa

SEQ ID NO: 147896 - RNA, 20 nt, Human
gacagccagccguguucccc

SEQ ID NO: 147897 - RNA, 24 nt, Human
gccccgacggccuggacagccagc

SEQ ID NO: 147898 - RNA, 26 nt, Human
gccucugccgcugccaccugagugac

SEQ ID NO: 147899 - RNA, 21 nt, Human
gcgcagccacugacgccugcc

SEQ ID NO: 147900 - RNA, 21 nt, Human
gcuuggagcucccaagaaggc

SEQ ID NO: 147901 - RNA, 18 nt, Human
ggaaguaccaaccuacag

SEQ ID NO: 147902 - RNA, 18 nt, Human
guuaccacacagggggac

SEQ ID NO: 147903 - RNA, 21 nt, Human
uaaaaaguccauaguugaaga

SEQ ID NO: 147904 - RNA, 22 nt, Human
uaaaacauaaacauauuuacag

SEQ ID NO: 147905 - RNA, 23 nt, Human
uaaaacuacggacauaaaccguu

SEQ ID NO: 147906 - RNA, 25 nt, Human
uaaaacuacggacauaaaccguuau

SEQ ID NO: 147907 - RNA, 21 nt, Human
uaaaugauuuagacuugaaag

SEQ ID NO: 147908 - RNA, 24 nt, Human
uaacaaagaacaaagauagcccuu

SEQ ID NO: 147909 - RNA, 22 nt, Human
uaagauuucauuaggcuuaaaa

SEQ ID NO: 147910 - RNA, 19 nt, Human
uacccgccagggacaaaaa

SEQ ID NO: 147911 - RNA, 18 nt, Human
uaccuauaaucaguuugg

SEQ ID NO: 147912 - RNA, 22 nt, Human
uacuacggcuuuuuuccuccca

SEQ ID NO: 147913 - RNA, 21 nt, Human
uaggcuuaaaaaguccauagu

SEQ ID NO: 147914 - RNA, 24 nt, Human
ucagcuuuuucuagaaaucaguuu

SEQ ID NO: 147915 - RNA, 24 nt, Human
uccccuggccacgucucagcccgg

SEQ ID NO: 147916 - RNA, 24 nt, Human
ucccgccccgcgcgcaggcaugga

SEQ ID NO: 147917 - RNA, 22 nt, Human
ucccuuuauuggagguaaaagu

SEQ ID NO: 147918 - RNA, 20 nt, Human
ucuguacaccaccaacccaa

SEQ ID NO: 147919 - RNA, 24 nt, Human
ugagcgaagaacaaacuuuucaag

SEQ ID NO: 147920 - RNA, 23 nt, Human
ugagggcuauaaagcuuggccag

SEQ ID NO: 147921 - RNA, 22 nt, Human
ugccacuccauguucccaggcc

SEQ ID NO: 147922 - RNA, 24 nt, Human
ugcccccaaauccagcuuaaauuu

SEQ ID NO: 147923 - RNA, 23 nt, Human
uggagcucccaagaaggcaagga

SEQ ID NO: 147924 - RNA, 24 nt, Human
uguacaccaccaacccaaauggau

SEQ ID NO: 147925 - RNA, 24 nt, Human
uucaagagacuaacaaagaacaaa

SEQ ID NO: 147926 - RNA, 18 nt, Human
uuucuagaacaauacagu

SEQ ID NO: 147927 - RNA, 23 nt, Human
aaacaucguuucugccuuccucg

SEQ ID NO: 147928 - RNA, 23 nt, Human
aaacugaaaaggaaaguuucuag

SEQ ID NO: 147929 - RNA, 18 nt, Human
aagcagugaaccaugcag

SEQ ID NO: 147930 - RNA, 26 nt, Human
acuuguauuucuggaaacugaaacaa

SEQ ID NO: 147931 - RNA, 25 nt, Human
agccagucugacagcgcgcugcaca

SEQ ID NO: 147932 - RNA, 19 nt, Human
agucuggagugcaggggag

SEQ ID NO: 147933 - RNA, 19 nt, Human
caccgcguguaacguccug

SEQ ID NO: 147934 - RNA, 22 nt, Human
cagaauacuguugcuaaacauc

SEQ ID NO: 147935 - RNA, 24 nt, Human
cagucugacagcgcgcugcacacc

SEQ ID NO: 147936 - RNA, 21 nt, Human
cccugccucaacuacguaagc

SEQ ID NO: 147937 - RNA, 21 nt, Human
ccugcgagccagucugacagc

SEQ ID NO: 147938 - RNA, 19 nt, Human
cuccccgcacuccacuucc

SEQ ID NO: 147939 - RNA, 19 nt, Human
cuuguauuucuggaaacug

SEQ ID NO: 147940 - RNA, 18 nt, Human
gaaaugaguaagaaaggu

SEQ ID NO: 147941 - RNA, 20 nt, Human
gccaauuaucuaacuuguau

SEQ ID NO: 147942 - RNA, 20 nt, Human
gcgcugcacaccuccgcacc

SEQ ID NO: 147943 - RNA, 22 nt, Human
gcgcugcacaccuccgcacccc

SEQ ID NO: 147944 - RNA, 24 nt, Human
ggaagccagaugcagauucagcaa

SEQ ID NO: 147945 - RNA, 24 nt, Human
guagccaauuaucuaacuuguauu

SEQ ID NO: 147946 - RNA, 23 nt, Human
uaaaaagcuguuuaggacccaaa

SEQ ID NO: 147947 - RNA, 22 nt, Human
uaagaacaauuuaaguugggau

SEQ ID NO: 147948 - RNA, 21 nt, Human
uacagaauuucaguuuacaaa

SEQ ID NO: 147949 - RNA, 21 nt, Human
uagaugggacugaaaugagua

SEQ ID NO: 147950 - RNA, 19 nt, Human
uauuugaaaagaugcugaa

SEQ ID NO: 147951 - RNA, 21 nt, Human
ucacuggggugucaagcagcu

SEQ ID NO: 147952 - RNA, 22 nt, Human
uccugcugcggagccccagggg

SEQ ID NO: 147953 - RNA, 20 nt, Human
ucugccuuccucguguucuc

SEQ ID NO: 147954 - RNA, 20 nt, Human
ucuuccggcgcacuccccgc

SEQ ID NO: 147955 - RNA, 22 nt, Human
ugaaaugaguaagaaagguucu

SEQ ID NO: 147956 - RNA, 24 nt, Human
ugaaaugaguaagaaagguucucc

SEQ ID NO: 147957 - RNA, 19 nt, Human
ugaagacagguggacuugg

SEQ ID NO: 147958 - RNA, 21 nt, Human
ugccucaacuacguaagcugc

SEQ ID NO: 147959 - RNA, 18 nt, Human
ugccucuuacaaggcacc

SEQ ID NO: 147960 - RNA, 24 nt, Human
uggcagagggguguggcugcuuuu

SEQ ID NO: 147961 - RNA, 21 nt, Human
uuggccugacucacuggggug

SEQ ID NO: 147962 - RNA, 26 nt, Human
uuuaaguccuuacuccauaaaucuuc

SEQ ID NO: 147963 - RNA, 21 nt, Human
uuuguggcagagggguguggc

SEQ ID NO: 147964 - RNA, 18 nt, Human
agacgcaaccaggucacu

SEQ ID NO: 147965 - RNA, 23 nt, Human
aguggcuuuuauugguagagccu

SEQ ID NO: 147966 - RNA, 24 nt, Human
caacaaguuaagcccugcugcucu

SEQ ID NO: 147967 - RNA, 25 nt, Human
caaccaggucacuaagaggcuccaa

SEQ ID NO: 147968 - RNA, 18 nt, Human
cacucccacauugcaagg

SEQ ID NO: 147969 - RNA, 27 nt, Human
caggcaacaguaucaaggauuuuuuuu

SEQ ID NO: 147970 - RNA, 19 nt, Human
uaagcaaucugcuuaggac

SEQ ID NO: 147971 - RNA, 19 nt, Human
uaagguagcugccuucagc

SEQ ID NO: 147972 - RNA, 21 nt, Human
uaaguuccugacacagacgca

SEQ ID NO: 147973 - RNA, 24 nt, Human
uaaguuccugacacagacgcaacc

SEQ ID NO: 147974 - RNA, 19 nt, Human
uaucccaguaagguauuca

SEQ ID NO: 147975 - RNA, 26 nt, Human
ucagcagcaacacucaagucuccucu

SEQ ID NO: 147976 - RNA, 25 nt, Human
ugacuaaaaaggcaggcaacaguau

SEQ ID NO: 147977 - RNA, 23 nt, Human
ugcuggaugugugcccuuguuac

SEQ ID NO: 147978 - RNA, 19 nt, Human
uggacuccugugcacuccc

SEQ ID NO: 147979 - RNA, 18 nt, Human
uguuauguuuaacacacu

SEQ ID NO: 147980 - RNA, 24 nt, Human
uuaacacacuacugaaccagaaag

SEQ ID NO: 147981 - RNA, 24 nt, Human
uuuaacacacuacugaaccagaaa

SEQ ID NO: 147982 - RNA, 22 nt, Human
uuuuuuuuuuuuuugaaccuuc

SEQ ID NO: 147983 - RNA, 18 nt, Human
uuuuuuuuuuuuuuuuug

SEQ ID NO: 147984 - RNA, 20 nt, Human
aacauauacaagcagcagaa

SEQ ID NO: 147985 - RNA, 23 nt, Human
aagcuguuccucuggccuuccuc

SEQ ID NO: 147986 - RNA, 23 nt, Human
acaaagcuguuccucuggccuuc

SEQ ID NO: 147987 - RNA, 21 nt, Human
acaagcagcagaaagagccaa

SEQ ID NO: 147988 - RNA, 20 nt, Human
acugcucucugcuguucccu

SEQ ID NO: 147989 - RNA, 21 nt, Human
acuuccacaucccaacuccac

SEQ ID NO: 147990 - RNA, 20 nt, Human
agaaagagccaacugcucuc

SEQ ID NO: 147991 - RNA, 18 nt, Human
agccuggaugguggucac

SEQ ID NO: 147992 - RNA, 22 nt, Human
aucacacccaaaggagcaggca

SEQ ID NO: 147993 - RNA, 20 nt, Human
cacucaucccucugcagcua

SEQ ID NO: 147994 - RNA, 21 nt, Human
cacuugucccagcccaggagc

SEQ ID NO: 147995 - RNA, 21 nt, Human
ccacuuccacaucccaacucc

SEQ ID NO: 147996 - RNA, 19 nt, Human
ccuccaacugccgggccug

SEQ ID NO: 147997 - RNA, 22 nt, Human
ccucccuaggcagaagcuuugu

SEQ ID NO: 147998 - RNA, 23 nt, Human
ccucugcagcuaguuccucacuu

SEQ ID NO: 147999 - RNA, 19 nt, Human
cucagccuggauggugguc

SEQ ID NO: 148000 - RNA, 18 nt, Human
cuccuuucagucucagcc

SEQ ID NO: 148001 - RNA, 18 nt, Human
cucugcagcuaguuccuc

SEQ ID NO: 148002 - RNA, 25 nt, Human
cuuccacaucccaacuccacaguca

SEQ ID NO: 148003 - RNA, 25 nt, Human
gccggagcacaaagcuguuccucug

SEQ ID NO: 148004 - RNA, 18 nt, Human
ggaggcacaugguugcua

SEQ ID NO: 148005 - RNA, 24 nt, Human
guuccagccccacuuccacauccc

SEQ ID NO: 148006 - RNA, 21 nt, Human
ucacacccaaaggagcaggca

SEQ ID NO: 148007 - RNA, 19 nt, Human
ucccucugcagcuaguucc

SEQ ID NO: 148008 - RNA, 23 nt, Human
uccucacuugucccagcccagga

SEQ ID NO: 148009 - RNA, 21 nt, Human
uccuccaacugccgggccugc

SEQ ID NO: 148010 - RNA, 23 nt, Human
uccucuggccuuccuccaacugc

SEQ ID NO: 148011 - RNA, 23 nt, Human
ucucucacggucaccacuuccgc

SEQ ID NO: 148012 - RNA, 22 nt, Human
ugggaggcacaugguugcuagc

SEQ ID NO: 148013 - RNA, 20 nt, Human
uuaacauauacaagcagcag

SEQ ID NO: 148014 - RNA, 20 nt, Human
uuaauauuaacauauacaag

SEQ ID NO: 148015 - RNA, 20 nt, Human
aaaaaaaaaguauccaaaaa

SEQ ID NO: 148016 - RNA, 22 nt, Human
aaaaagugcccugcauaucccu

SEQ ID NO: 148017 - RNA, 27 nt, Human
aaaagggaaaggaagccaggcaaagag

SEQ ID NO: 148018 - RNA, 20 nt, Human
aaaauaccuccuucccaauc

SEQ ID NO: 148019 - RNA, 20 nt, Human
aaacagcagccagaggcucu

SEQ ID NO: 148020 - RNA, 23 nt, Human
aaaccagcuccaaggaguggaca

SEQ ID NO: 148021 - RNA, 24 nt, Human
aaaccagcuccaaggaguggacag

SEQ ID NO: 148022 - RNA, 20 nt, Human
aaaggaagccaggcaaagag

SEQ ID NO: 148023 - RNA, 19 nt, Human
aaaggagagaacacaaacu

SEQ ID NO: 148024 - RNA, 20 nt, Human
aaagugcccugcauaucccu

SEQ ID NO: 148025 - RNA, 21 nt, Human
aaaugcuaugaaaguaacucc

SEQ ID NO: 148026 - RNA, 23 nt, Human
aacacucaaacccaggauaccca

SEQ ID NO: 148027 - RNA, 24 nt, Human
aacacucaaacccaggauacccaa

SEQ ID NO: 148028 - RNA, 19 nt, Human
aaccagcuuuugucugcag

SEQ ID NO: 148029 - RNA, 24 nt, Human
aagaacucauuucuugucauugcc

SEQ ID NO: 148030 - RNA, 20 nt, Human
aagagagaagaggaaaagga

SEQ ID NO: 148031 - RNA, 18 nt, Human
aagaugcacuugcaagaa

SEQ ID NO: 148032 - RNA, 24 nt, Human
aagcaggacacaaacacaaaucuc

SEQ ID NO: 148033 - RNA, 21 nt, Human
aagcccggccgcucgcgccgc

SEQ ID NO: 148034 - RNA, 19 nt, Human
aagccugacccugccagcu

SEQ ID NO: 148035 - RNA, 18 nt, Human
aagcuugcugccaacacc

SEQ ID NO: 148036 - RNA, 18 nt, Human
aaggccaacagagaccaa

SEQ ID NO: 148037 - RNA, 24 nt, Human
aagggaaaggaagccaggcaaaga

SEQ ID NO: 148038 - RNA, 23 nt, Human
aaggugggggguggcagcugggg

SEQ ID NO: 148039 - RNA, 19 nt, Human
aagugcccugcauaucccu

SEQ ID NO: 148040 - RNA, 20 nt, Human
acaauguagccaaccagaac

SEQ ID NO: 148041 - RNA, 21 nt, Human
acacucaaacccaggauaccc

SEQ ID NO: 148042 - RNA, 20 nt, Human
acacugcaaucuaggaugag

SEQ ID NO: 148043 - RNA, 20 nt, Human
acagccaaaccccaugucuc

SEQ ID NO: 148044 - RNA, 18 nt, Human
acaugauuccagguccaa

SEQ ID NO: 148045 - RNA, 23 nt, Human
accagauuuagaaaaagcaauga

SEQ ID NO: 148046 - RNA, 25 nt, Human
accccauuccccaaagaaagguaca

SEQ ID NO: 148047 - RNA, 20 nt, Human
accuccucucccacccccac

SEQ ID NO: 148048 - RNA, 22 nt, Human
acucaacaguccugaugcuuuc

SEQ ID NO: 148049 - RNA, 24 nt, Human
acuuucucaagccccucacuuucc

SEQ ID NO: 148050 - RNA, 23 nt, Human
agaagcaauagggagcagcaaaa

SEQ ID NO: 148051 - RNA, 23 nt, Human
agaagcaccacuuaaaccaaauc

SEQ ID NO: 148052 - RNA, 18 nt, Human
agaagccaagagugaaaa

SEQ ID NO: 148053 - RNA, 19 nt, Human
agacaggcaggcaggcagg

SEQ ID NO: 148054 - RNA, 20 nt, Human
agacaggcaggcaggcaggc

SEQ ID NO: 148055 - RNA, 20 nt, Human
agagagaagaggaaaaggaa

SEQ ID NO: 148056 - RNA, 20 nt, Human
agauggggugaggggugggg

SEQ ID NO: 148057 - RNA, 21 nt, Human
agaugugacaagaugggguga

SEQ ID NO: 148058 - RNA, 24 nt, Human
agcaagcaagcagagugaauagaa

SEQ ID NO: 148059 - RNA, 21 nt, Human
agccaaccagaacagaaccug

SEQ ID NO: 148060 - RNA, 19 nt, Human
agccucucucccugcccag

SEQ ID NO: 148061 - RNA, 18 nt, Human
agccuggaccccaucuug

SEQ ID NO: 148062 - RNA, 20 nt, Human
agcuaagccugacccugcca

SEQ ID NO: 148063 - RNA, 18 nt, Human
agcugccuccucccagag

SEQ ID NO: 148064 - RNA, 23 nt, Human
aggaaaaaaaugaacagucaagg

SEQ ID NO: 148065 - RNA, 18 nt, Human
aggaaagcgaaaaccaga

SEQ ID NO: 148066 - RNA, 20 nt, Human
aggagaaaaggaggcauaag

SEQ ID NO: 148067 - RNA, 29 nt, Human
aggcaaaacagugguacaaaggggacccc

SEQ ID NO: 148068 - RNA, 20 nt, Human
aggcagacaggcaggcaggc

SEQ ID NO: 148069 - RNA, 18 nt, Human
aggcaggcaggcaggcag

SEQ ID NO: 148070 - RNA, 18 nt, Human
aggcaggcaggcaggcag

SEQ ID NO: 148071 - RNA, 18 nt, Human
aggcaggcaggcaggcag

SEQ ID NO: 148072 - RNA, 18 nt, Human
aggcaggcaggcaggcag

SEQ ID NO: 148073 - RNA, 19 nt, Human
aggcaggcaggcaggcagg

SEQ ID NO: 148074 - RNA, 19 nt, Human
aggcaggcaggcaggcagg

SEQ ID NO: 148075 - RNA, 19 nt, Human
aggcaggcaggcaggcagg

SEQ ID NO: 148076 - RNA, 19 nt, Human
aggcaggcaggcaggcagg

SEQ ID NO: 148077 - RNA, 20 nt, Human
aggcaggcaggcaggccggc

SEQ ID NO: 148078 - RNA, 24 nt, Human
agggaaaggaagccaggcaaagag

SEQ ID NO: 148079 - RNA, 19 nt, Human
agggagaaaagaagccaag

SEQ ID NO: 148080 - RNA, 21 nt, Human
agggaggagaaguaagguggg

SEQ ID NO: 148081 - RNA, 18 nt, Human
aggggugggggacaugag

SEQ ID NO: 148082 - RNA, 21 nt, Human
aggggugggggacaugagguu

SEQ ID NO: 148083 - RNA, 22 nt, Human
aggguaaggugggggguggcag

SEQ ID NO: 148084 - RNA, 20 nt, Human
aggugggggguggcagcugg

SEQ ID NO: 148085 - RNA, 18 nt, Human
agucagugcacccuuggc

SEQ ID NO: 148086 - RNA, 21 nt, Human
agugcacccuuggcugcccau

SEQ ID NO: 148087 - RNA, 22 nt, Human
auagauccaagcccaggcuccu

SEQ ID NO: 148088 - RNA, 21 nt, Human
aucuuccuacaaacuggauuc

SEQ ID NO: 148089 - RNA, 18 nt, Human
augcaaacaaguacacag

SEQ ID NO: 148090 - RNA, 22 nt, Human
auucuguucuucagcugggcuc

SEQ ID NO: 148091 - RNA, 21 nt, Human
caaaauagcuggcuuucuggc

SEQ ID NO: 148092 - RNA, 19 nt, Human
caaaauuccccagccuguc

SEQ ID NO: 148093 - RNA, 18 nt, Human
caaacagcagccagaggc

SEQ ID NO: 148094 - RNA, 22 nt, Human
caaagcuugcugccaacaccac

SEQ ID NO: 148095 - RNA, 24 nt, Human
caaaugcaaacaaguacacagcug

SEQ ID NO: 148096 - RNA, 19 nt, Human
caacaguccugaugcuuuc

SEQ ID NO: 148097 - RNA, 23 nt, Human
caaccagaacagaaccugggaua

SEQ ID NO: 148098 - RNA, 18 nt, Human
caacuccccaucccaagc

SEQ ID NO: 148099 - RNA, 21 nt, Human
caagccccagcugaaaaccaa

SEQ ID NO: 148100 - RNA, 28 nt, Human
caaggcauccuacacuccucccuacccc

SEQ ID NO: 148101 - RNA, 19 nt, Human
cacacugcaaucuaggaug

SEQ ID NO: 148102 - RNA, 21 nt, Human
cacccacuuucucaagccccu

SEQ ID NO: 148103 - RNA, 20 nt, Human
caccccauuccccaaagaaa

SEQ ID NO: 148104 - RNA, 23 nt, Human
caccccauuccccaaagaaaggu

SEQ ID NO: 148105 - RNA, 25 nt, Human
cacccccaccccauuccccaaagaa

SEQ ID NO: 148106 - RNA, 21 nt, Human
cacuccucccuaccccaccuc

SEQ ID NO: 148107 - RNA, 25 nt, Human
cacugugagucacaugagacaccug

SEQ ID NO: 148108 - RNA, 22 nt, Human
cacuuguguaaggaauguaggc

SEQ ID NO: 148109 - RNA, 21 nt, Human
cacuuucucaagccccucacu

SEQ ID NO: 148110 - RNA, 19 nt, Human
cagaaaauaccuccuuccc

SEQ ID NO: 148111 - RNA, 19 nt, Human
cagagaccaagcuagaacc

SEQ ID NO: 148112 - RNA, 27 nt, Human
cagcaacaguagccccaggcuuauccc

SEQ ID NO: 148113 - RNA, 21 nt, Human
cagcagcuccgagacuuguca

SEQ ID NO: 148114 - RNA, 21 nt, Human
cagccagaggcucuaagucag

SEQ ID NO: 148115 - RNA, 18 nt, Human
cagccucucucccugccc

SEQ ID NO: 148116 - RNA, 21 nt, Human
cagcgugaggggccuagguac

SEQ ID NO: 148117 - RNA, 18 nt, Human
cagcucaaagcaggacac

SEQ ID NO: 148118 - RNA, 23 nt, Human
cagcuggccuccaagccugggcu

SEQ ID NO: 148119 - RNA, 18 nt, Human
caggacacacugcaaucu

SEQ ID NO: 148120 - RNA, 23 nt, Human
caggacacacugcaaucuaggau

SEQ ID NO: 148121 - RNA, 25 nt, Human
caggcaggcaggcaggcaggcaggc

SEQ ID NO: 148122 - RNA, 25 nt, Human
caggcaggcaggcaggcaggcaggc

SEQ ID NO: 148123 - RNA, 26 nt, Human
caggcaggcaggcaggcaggcaggcc

SEQ ID NO: 148124 - RNA, 23 nt, Human
cagguccaaaacugucccaccag

SEQ ID NO: 148125 - RNA, 24 nt, Human
caguccaggggaaggaaaaagaug

SEQ ID NO: 148126 - RNA, 21 nt, Human
cauccuacacuccucccuacc

SEQ ID NO: 148127 - RNA, 24 nt, Human
caucuugagguugugaucuuuuaa

SEQ ID NO: 148128 - RNA, 20 nt, Human
cauucuguucuucagcuggg

SEQ ID NO: 148129 - RNA, 20 nt, Human
cauuuuuguaaacagaagca

SEQ ID NO: 148130 - RNA, 19 nt, Human
ccaaaacugucccaccagc

SEQ ID NO: 148131 - RNA, 18 nt, Human
ccaacccagccucucucc

SEQ ID NO: 148132 - RNA, 19 nt, Human
ccaagcccggccgcucgcg

SEQ ID NO: 148133 - RNA, 23 nt, Human
ccagauuuagaaaaagcaaugag

SEQ ID NO: 148134 - RNA, 21 nt, Human
ccaggagaacuccccucccca

SEQ ID NO: 148135 - RNA, 19 nt, Human
ccaggcuuaucccuggagg

SEQ ID NO: 148136 - RNA, 20 nt, Human
ccagguggacaucucugggc

SEQ ID NO: 148137 - RNA, 22 nt, Human
ccaucugcaugcaccaccuuuc

SEQ ID NO: 148138 - RNA, 21 nt, Human
ccaugcuggacuugagaggga

SEQ ID NO: 148139 - RNA, 20 nt, Human
cccaaagggugacagaacac

SEQ ID NO: 148140 - RNA, 23 nt, Human
cccaccagccuuacagauauccu

SEQ ID NO: 148141 - RNA, 22 nt, Human
cccacccccaccccauucccca

SEQ ID NO: 148142 - RNA, 21 nt, Human
cccacugucccaggagaacuc

SEQ ID NO: 148143 - RNA, 19 nt, Human
cccagagcccuccauucug

SEQ ID NO: 148144 - RNA, 23 nt, Human
cccagcaacaguagccccaggcu

SEQ ID NO: 148145 - RNA, 19 nt, Human
cccaggagaacuccccucc

SEQ ID NO: 148146 - RNA, 25 nt, Human
cccaucccaagcaguggggcaggaa

SEQ ID NO: 148147 - RNA, 21 nt, Human
cccaucuaaaguaucaaaccc

SEQ ID NO: 148148 - RNA, 26 nt, Human
cccaucuaccuccucucccaccccca

SEQ ID NO: 148149 - RNA, 23 nt, Human
ccccaaagaaagguacaaaaggu

SEQ ID NO: 148150 - RNA, 19 nt, Human
ccccacacucucgcugcuc

SEQ ID NO: 148151 - RNA, 23 nt, Human
ccccaccccauuccccaaagaaa

SEQ ID NO: 148152 - RNA, 22 nt, Human
ccccagccuguccacaggacac

SEQ ID NO: 148153 - RNA, 18 nt, Human
cccgggccgggcucggcu

SEQ ID NO: 148154 - RNA, 21 nt, Human
cccuaccaagcccggccgcuc

SEQ ID NO: 148155 - RNA, 19 nt, Human
cccuaccccaccucccucc

SEQ ID NO: 148156 - RNA, 18 nt, Human
cccuuucccaccucauuc

SEQ ID NO: 148157 - RNA, 21 nt, Human
ccgccgcccccgcagccuccg

SEQ ID NO: 148158 - RNA, 22 nt, Human
ccggccgcucgcgccgccgccc

SEQ ID NO: 148159 - RNA, 22 nt, Human
ccguugccgccgccgcggagcc

SEQ ID NO: 148160 - RNA, 19 nt, Human
ccuaaaaaauccuucccuc

SEQ ID NO: 148161 - RNA, 25 nt, Human
ccuaacacucaaacccaggauaccc

SEQ ID NO: 148162 - RNA, 19 nt, Human
ccuccagcuggccuccaag

SEQ ID NO: 148163 - RNA, 19 nt, Human
ccuccaggaauagugcccu

SEQ ID NO: 148164 - RNA, 21 nt, Human
ccucccagagcccuccauucu

SEQ ID NO: 148165 - RNA, 20 nt, Human
ccucccuccuccuugcuucc

SEQ ID NO: 148166 - RNA, 18 nt, Human
ccuccucucccaccccca

SEQ ID NO: 148167 - RNA, 18 nt, Human
ccugcauaucccugccau

SEQ ID NO: 148168 - RNA, 19 nt, Human
ccuuucccaccuuuuauuc

SEQ ID NO: 148169 - RNA, 21 nt, Human
cgcucgcgccgccgcccccgc

SEQ ID NO: 148170 - RNA, 26 nt, Human
cgggaucccgggccgggcucggcucc

SEQ ID NO: 148171 - RNA, 20 nt, Human
cgggcucggcuccccuacca

SEQ ID NO: 148172 - RNA, 21 nt, Human
cgggguauuuuucaagucuca

SEQ ID NO: 148173 - RNA, 25 nt, Human
cguugccgccgccgcggagccugca

SEQ ID NO: 148174 - RNA, 18 nt, Human
cuaccuccucucccaccc

SEQ ID NO: 148175 - RNA, 21 nt, Human
cuacuacaccaagggacucag

SEQ ID NO: 148176 - RNA, 18 nt, Human
cuagaaccaccaccuucu

SEQ ID NO: 148177 - RNA, 18 nt, Human
cuccagugagcugccucc

SEQ ID NO: 148178 - RNA, 21 nt, Human
cucccacccccaccccauucc

SEQ ID NO: 148179 - RNA, 19 nt, Human
cucccuccuccuugcuucc

SEQ ID NO: 148180 - RNA, 20 nt, Human
cucccuuucccaccucauuc

SEQ ID NO: 148181 - RNA, 19 nt, Human
cuccucccuaccccaccuc

SEQ ID NO: 148182 - RNA, 21 nt, Human
cucugggcuuggggaacaggu

SEQ ID NO: 148183 - RNA, 21 nt, Human
cugauccuagccccaaaaugu

SEQ ID NO: 148184 - RNA, 23 nt, Human
cugggcuuggggaacagguucuu

SEQ ID NO: 148185 - RNA, 18 nt, Human
cuuuauguuaagccuaag

SEQ ID NO: 148186 - RNA, 21 nt, Human
cuuuauguuaagccuaaguuc

SEQ ID NO: 148187 - RNA, 24 nt, Human
cuuucucaagccccucacuuuccc

SEQ ID NO: 148188 - RNA, 21 nt, Human
gaaaggaagccaggcaaagag

SEQ ID NO: 148189 - RNA, 24 nt, Human
gaauugugcugcugcugcugcugc

SEQ ID NO: 148190 - RNA, 22 nt, Human
gacaagauggggugaggggugg

SEQ ID NO: 148191 - RNA, 21 nt, Human
gaccugggcggggcgggaggu

SEQ ID NO: 148192 - RNA, 20 nt, Human
gagaacuccccuccccaaag

SEQ ID NO: 148193 - RNA, 19 nt, Human
gagcugccuccucccagag

SEQ ID NO: 148194 - RNA, 24 nt, Human
gaggagaaguaagguggggcagaa

SEQ ID NO: 148195 - RNA, 20 nt, Human
gaggcugggggucccccaag

SEQ ID NO: 148196 - RNA, 20 nt, Human
gaguugcugaacaauguagc

SEQ ID NO: 148197 - RNA, 21 nt, Human
gcagcauuaccguuacaggga

SEQ ID NO: 148198 - RNA, 21 nt, Human
gcaggacagugcagaggaggg

SEQ ID NO: 148199 - RNA, 20 nt, Human
gccuccguugccgccgccgc

SEQ ID NO: 148200 - RNA, 22 nt, Human
gccuccucccagagcccuccau

SEQ ID NO: 148201 - RNA, 20 nt, Human
gcuaccauccuggauuggcc

SEQ ID NO: 148202 - RNA, 23 nt, Human
gcugccaccugcucccuauggac

SEQ ID NO: 148203 - RNA, 19 nt, Human
gcuugcuucagaaggaacu

SEQ ID NO: 148204 - RNA, 21 nt, Human
ggagaacuccccuccccaaag

SEQ ID NO: 148205 - RNA, 18 nt, Human
ggcaggggggaugcuugc

SEQ ID NO: 148206 - RNA, 21 nt, Human
ggccaaauaguaaaaagugcc

SEQ ID NO: 148207 - RNA, 22 nt, Human
ggccaggggccugucaucucag

SEQ ID NO: 148208 - RNA, 22 nt, Human
ggcucggcuccccuaccaagcc

SEQ ID NO: 148209 - RNA, 23 nt, Human
gggaggcuauagcaagaaaaagg

SEQ ID NO: 148210 - RNA, 18 nt, Human
gggguggcagcuggggga

SEQ ID NO: 148211 - RNA, 18 nt, Human
ggggugggggacaugagg

SEQ ID NO: 148212 - RNA, 19 nt, Human
gguggcagcugggggagga

SEQ ID NO: 148213 - RNA, 19 nt, Human
gucccccaauguaguuucc

SEQ ID NO: 148214 - RNA, 21 nt, Human
gugcugccccuuuugguccag

SEQ ID NO: 148215 - RNA, 20 nt, Human
gugcugcugcugcugcugcu

SEQ ID NO: 148216 - RNA, 24 nt, Human
guggggcagaaaauguggacagag

SEQ ID NO: 148217 - RNA, 21 nt, Human
uaaaaaauccuucccuccucc

SEQ ID NO: 148218 - RNA, 23 nt, Human
uaaaaaauccuucccuccuccca

SEQ ID NO: 148219 - RNA, 19 nt, Human
uaaaaauaacgucccccaa

SEQ ID NO: 148220 - RNA, 21 nt, Human
uaaaccaaauccacaugagcc

SEQ ID NO: 148221 - RNA, 24 nt, Human
uaaaccaaauccacaugagccaaa

SEQ ID NO: 148222 - RNA, 21 nt, Human
uaacauuuuguuuucucucuu

SEQ ID NO: 148223 - RNA, 19 nt, Human
uaagaagcaccacuuaaac

SEQ ID NO: 148224 - RNA, 19 nt, Human
uaagacaccccaguuaaga

SEQ ID NO: 148225 - RNA, 18 nt, Human
uaaggguaaggugggggg

SEQ ID NO: 148226 - RNA, 18 nt, Human
uaagucaguaugaguaga

SEQ ID NO: 148227 - RNA, 19 nt, Human
uaagugcaacaucacauac

SEQ ID NO: 148228 - RNA, 21 nt, Human
uaagugcaacaucacauacca

SEQ ID NO: 148229 - RNA, 20 nt, Human
uacacaguucauucugaugg

SEQ ID NO: 148230 - RNA, 24 nt, Human
uacaccaccucuauaggggaagcc

SEQ ID NO: 148231 - RNA, 22 nt, Human
uaccuccucucccacccccacc

SEQ ID NO: 148232 - RNA, 24 nt, Human
uacucaacaguccugaugcuuucu

SEQ ID NO: 148233 - RNA, 18 nt, Human
uagaagaaaagggaaagg

SEQ ID NO: 148234 - RNA, 23 nt, Human
uagcucauuccuuccccucccuu

SEQ ID NO: 148235 - RNA, 23 nt, Human
uagguaccccacacucucgcugc

SEQ ID NO: 148236 - RNA, 19 nt, Human
uaguauaagcuugagggca

SEQ ID NO: 148237 - RNA, 18 nt, Human
ucaaacccaaaccuaacc

SEQ ID NO: 148238 - RNA, 22 nt, Human
ucaaacccaaaccuaaccagcu

SEQ ID NO: 148239 - RNA, 22 nt, Human
ucaaacccaggauacccaaaua

SEQ ID NO: 148240 - RNA, 18 nt, Human
ucaaagcaggacacaaac

SEQ ID NO: 148241 - RNA, 23 nt, Human
ucaacccuaagacaaucucagaa

SEQ ID NO: 148242 - RNA, 23 nt, Human
ucaccagaucaggauagauccaa

SEQ ID NO: 148243 - RNA, 19 nt, Human
ucacucucuuuaggcacuu

SEQ ID NO: 148244 - RNA, 22 nt, Human
ucagggaggagaaguaaggugg

SEQ ID NO: 148245 - RNA, 24 nt, Human
ucagggaggagaaguaaggugggg

SEQ ID NO: 148246 - RNA, 23 nt, Human
ucauucugauggcucaauguuuc

SEQ ID NO: 148247 - RNA, 21 nt, Human
uccaaaaacacugcugcuuag

SEQ ID NO: 148248 - RNA, 18 nt, Human
uccaaaacugucccacca

SEQ ID NO: 148249 - RNA, 26 nt, Human
uccacaggacacacugcaaucuagga

SEQ ID NO: 148250 - RNA, 24 nt, Human
ucccaaucugcuuagaaggccaaa

SEQ ID NO: 148251 - RNA, 23 nt, Human
ucccaccagccuuacagauaucc

SEQ ID NO: 148252 - RNA, 19 nt, Human
ucccacccccaccccauuc

SEQ ID NO: 148253 - RNA, 21 nt, Human
uccccaaagaaagguacaaaa

SEQ ID NO: 148254 - RNA, 20 nt, Human
ucccuaccccaccucccucc

SEQ ID NO: 148255 - RNA, 19 nt, Human
uccucccacccacuuucuc

SEQ ID NO: 148256 - RNA, 21 nt, Human
uccucccagagcccuccauuc

SEQ ID NO: 148257 - RNA, 19 nt, Human
uccucucccacccccaccc

SEQ ID NO: 148258 - RNA, 19 nt, Human
uccuggggcuuggaaagcu

SEQ ID NO: 148259 - RNA, 19 nt, Human
uccuggggcuuggaaagcu

SEQ ID NO: 148260 - RNA, 22 nt, Human
uccuggggcuuggaaagcuuuc

SEQ ID NO: 148261 - RNA, 18 nt, Human
uccuugcuuccucuggau

SEQ ID NO: 148262 - RNA, 22 nt, Human
ucuacaggccaggauuuagacc

SEQ ID NO: 148263 - RNA, 24 nt, Human
ucucaagacaaaaaaaaaaaaaaa

SEQ ID NO: 148264 - RNA, 22 nt, Human
ucuccuuucccaccuuuuauuc

SEQ ID NO: 148265 - RNA, 19 nt, Human
ucuguucuucagcugggcu

SEQ ID NO: 148266 - RNA, 21 nt, Human
ucuuuuuucucauuuuagacc

SEQ ID NO: 148267 - RNA, 20 nt, Human
ugaauagaagaaaagggaaa

SEQ ID NO: 148268 - RNA, 21 nt, Human
ugaggggugggggacaugagg

SEQ ID NO: 148269 - RNA, 22 nt, Human
ugcaaacaaguacacagcugug

SEQ ID NO: 148270 - RNA, 21 nt, Human
ugcaugcaccaccuuucaaac

SEQ ID NO: 148271 - RNA, 22 nt, Human
ugcaugcaccaccuuucaaacu

SEQ ID NO: 148272 - RNA, 21 nt, Human
ugccuccucccagagcccucc

SEQ ID NO: 148273 - RNA, 25 nt, Human
ugccuuaaguauuacuaggggcugg

SEQ ID NO: 148274 - RNA, 23 nt, Human
ugcuacuacaccaagggacucuu

SEQ ID NO: 148275 - RNA, 18 nt, Human
ugcugccaacaccacuuc

SEQ ID NO: 148276 - RNA, 19 nt, Human
ugcugccccuuuuggucca

SEQ ID NO: 148277 - RNA, 18 nt, Human
ugcugcugcugcugaugu

SEQ ID NO: 148278 - RNA, 21 nt, Human
ugcugcugcugcugcugcugc

SEQ ID NO: 148279 - RNA, 18 nt, Human
ugcuggugaaugacugga

SEQ ID NO: 148280 - RNA, 21 nt, Human
ugcuucaaggccaacagagac

SEQ ID NO: 148281 - RNA, 22 nt, Human
uggaaaaugccagaaacccucc

SEQ ID NO: 148282 - RNA, 20 nt, Human
uggaaagcuuucuucuaucc

SEQ ID NO: 148283 - RNA, 18 nt, Human
uggaaaggccaggggccu

SEQ ID NO: 148284 - RNA, 20 nt, Human
uggacagagaggaauaaggg

SEQ ID NO: 148285 - RNA, 19 nt, Human
uggaucagguuggacugga

SEQ ID NO: 148286 - RNA, 18 nt, Human
uggcagcugggggaggag

SEQ ID NO: 148287 - RNA, 24 nt, Human
uggcuggagguuuguugggucugg

SEQ ID NO: 148288 - RNA, 22 nt, Human
ugggauaauuucacaauggacu

SEQ ID NO: 148289 - RNA, 24 nt, Human
ugggggaggagcaaccaaaaccau

SEQ ID NO: 148290 - RNA, 26 nt, Human
ugggggguggcagcugggggaggagc

SEQ ID NO: 148291 - RNA, 24 nt, Human
ugggucugggguauuucuucccca

SEQ ID NO: 148292 - RNA, 18 nt, Human
uguaguuuccaaaacugc

SEQ ID NO: 148293 - RNA, 20 nt, Human
ugucagggaggagaaguaag

SEQ ID NO: 148294 - RNA, 22 nt, Human
ugucagggaggagaaguaaggu

SEQ ID NO: 148295 - RNA, 24 nt, Human
uguugcugggaguagaggcugcca

SEQ ID NO: 148296 - RNA, 18 nt, Human
uuaaguauuacuaggggc

SEQ ID NO: 148297 - RNA, 22 nt, Human
uuagaaacuaaagugaaaacca

SEQ ID NO: 148298 - RNA, 18 nt, Human
uuaggagcuuuuuaggga

SEQ ID NO: 148299 - RNA, 24 nt, Human
uucaagccccagcugaaaaccaac

SEQ ID NO: 148300 - RNA, 25 nt, Human
uuccacacugaaguugcaacucccc

SEQ ID NO: 148301 - RNA, 21 nt, Human
uuccagcuaccauccuggauu

SEQ ID NO: 148302 - RNA, 19 nt, Human
uuccccagccuguccacag

SEQ ID NO: 148303 - RNA, 19 nt, Human
uuccucuggauuugggugg

SEQ ID NO: 148304 - RNA, 21 nt, Human
uucuucagcugggcuugugcc

SEQ ID NO: 148305 - RNA, 22 nt, Human
uuggaugcccaaacagcagcca

SEQ ID NO: 148306 - RNA, 21 nt, Human
uuucuuggaugcccaaacagc

SEQ ID NO: 148307 - RNA, 18 nt, Human
uuuguaaacagaagcaau

SEQ ID NO: 148308 - RNA, 23 nt, Human
aaaaaaaaaagagaauaaccuua

SEQ ID NO: 148309 - RNA, 23 nt, Human
aaaacaaaacaaaauuaaacaaa

SEQ ID NO: 148310 - RNA, 26 nt, Human
aaaacaaaacaaaauuaaacaaacaa

SEQ ID NO: 148311 - RNA, 22 nt, Human
aaacaaaaaaacagaacugcau

SEQ ID NO: 148312 - RNA, 24 nt, Human
aaacaacgcagaaaaaaaucucaa

SEQ ID NO: 148313 - RNA, 20 nt, Human
aacaugcugaaaccccgucu

SEQ ID NO: 148314 - RNA, 21 nt, Human
aacaugcugaaaccccgucuc

SEQ ID NO: 148315 - RNA, 24 nt, Human
aaucgcuugaacccggggggcaga

SEQ ID NO: 148316 - RNA, 26 nt, Human
acaaaacaaaauuaaacaaacaaaaa

SEQ ID NO: 148317 - RNA, 23 nt, Human
acaaacaaaaaaacagaacugca

SEQ ID NO: 148318 - RNA, 21 nt, Human
acagagccagacucaaaaaca

SEQ ID NO: 148319 - RNA, 20 nt, Human
accaaaaaaaaaaaaaaaga

SEQ ID NO: 148320 - RNA, 18 nt, Human
acccugaggucaggagag

SEQ ID NO: 148321 - RNA, 18 nt, Human
acgccacugcacuccagc

SEQ ID NO: 148322 - RNA, 22 nt, Human
acgccacugcacuccagccugg

SEQ ID NO: 148323 - RNA, 24 nt, Human
acugcacuccagccugggugacag

SEQ ID NO: 148324 - RNA, 26 nt, Human
acugcacuccagccugggugacagag

SEQ ID NO: 148325 - RNA, 24 nt, Human
agcacuuugugaggccgagguggg

SEQ ID NO: 148326 - RNA, 24 nt, Human
agccugggugacagagccagacuc

SEQ ID NO: 148327 - RNA, 21 nt, Human
aggaagacuuggauuucaggc

SEQ ID NO: 148328 - RNA, 24 nt, Human
aggcaggagaaucgcuugaacccg

SEQ ID NO: 148329 - RNA, 21 nt, Human
aggccgaggugggcugaucac

SEQ ID NO: 148330 - RNA, 20 nt, Human
aggcugaggcaggagaaucg

SEQ ID NO: 148331 - RNA, 24 nt, Human
aggcugaggcaggagaaucgcuug

SEQ ID NO: 148332 - RNA, 19 nt, Human
agucccuaaguuuucauaa

SEQ ID NO: 148333 - RNA, 24 nt, Human
aucacgccacugcacuccagccug

SEQ ID NO: 148334 - RNA, 25 nt, Human
caaaauuucaaagauaaagcaacau

SEQ ID NO: 148335 - RNA, 24 nt, Human
caacaugcugaaaccccgucucua

SEQ ID NO: 148336 - RNA, 19 nt, Human
caacgcagaaaaaaaucuc

SEQ ID NO: 148337 - RNA, 21 nt, Human
caccuguaaucucagcuacuc

SEQ ID NO: 148338 - RNA, 24 nt, Human
caccuguaaucucagcuacucggg

SEQ ID NO: 148339 - RNA, 24 nt, Human
cacgccuguaaucccagcacuuug

SEQ ID NO: 148340 - RNA, 22 nt, Human
cacuccagccugggugacagag

SEQ ID NO: 148341 - RNA, 19 nt, Human
cacugcacuccagccuggg

SEQ ID NO: 148342 - RNA, 19 nt, Human
cacugcacuccagccuggg

SEQ ID NO: 148343 - RNA, 22 nt, Human
cacugcacuccagccuggguga

SEQ ID NO: 148344 - RNA, 23 nt, Human
cacugcacuccagccugggugac

SEQ ID NO: 148345 - RNA, 24 nt, Human
cacugcacuccagccugggugaca

SEQ ID NO: 148346 - RNA, 25 nt, Human
cacugcacuccagccugggugacag

SEQ ID NO: 148347 - RNA, 20 nt, Human
cagaaaaaaaucucaaggca

SEQ ID NO: 148348 - RNA, 20 nt, Human
cagcaaaggcugguuguggc

SEQ ID NO: 148349 - RNA, 21 nt, Human
cagcaaaggcugguuguggca

SEQ ID NO: 148350 - RNA, 24 nt, Human
cagcacuuugugaggccgaggugg

SEQ ID NO: 148351 - RNA, 24 nt, Human
cagcuacucgggaggcugaggcag

SEQ ID NO: 148352 - RNA, 22 nt, Human
caggagagaccggccuagccaa

SEQ ID NO: 148353 - RNA, 23 nt, Human
cauaaccaaaaaaaaaaaaaaag

SEQ ID NO: 148354 - RNA, 28 nt, Human
ccaauuuuuauauuaauuuuagucccua

SEQ ID NO: 148355 - RNA, 20 nt, Human
ccacugcacuccagccuggg

SEQ ID NO: 148356 - RNA, 20 nt, Human
ccacugcacuccagccuggg

SEQ ID NO: 148357 - RNA, 20 nt, Human
ccacugcacuccagccuggg

SEQ ID NO: 148358 - RNA, 21 nt, Human
ccacugcacuccagccugggu

SEQ ID NO: 148359 - RNA, 21 nt, Human
ccacugcacuccagccugggu

SEQ ID NO: 148360 - RNA, 23 nt, Human
ccacugcacuccagccuggguga

SEQ ID NO: 148361 - RNA, 24 nt, Human
ccacugcacuccagccugggugac

SEQ ID NO: 148362 - RNA, 19 nt, Human
ccccuugguuguuaagagg

SEQ ID NO: 148363 - RNA, 21 nt, Human
cccuaaguuuucauaaccaaa

SEQ ID NO: 148364 - RNA, 23 nt, Human
ccuagccaacaugcugaaacccc

SEQ ID NO: 148365 - RNA, 24 nt, Human
ccuagccaacaugcugaaaccccg

SEQ ID NO: 148366 - RNA, 22 nt, Human
ccugggugacagagccagacuc

SEQ ID NO: 148367 - RNA, 21 nt, Human
ccuguaaucucagcuacucgg

SEQ ID NO: 148368 - RNA, 25 nt, Human
cgaggugggcugaucacccugaggu

SEQ ID NO: 148369 - RNA, 26 nt, Human
cgccacugcacuccagccugggugac

SEQ ID NO: 148370 - RNA, 18 nt, Human
cgccuguaaucccagcac

SEQ ID NO: 148371 - RNA, 22 nt, Human
cucacgccuguaaucccagcac

SEQ ID NO: 148372 - RNA, 24 nt, Human
cucacgccuguaaucccagcacuu

SEQ ID NO: 148373 - RNA, 21 nt, Human
cuguaaucucagcuacucggg

SEQ ID NO: 148374 - RNA, 23 nt, Human
cuugaccuuuugaaacauccaaa

SEQ ID NO: 148375 - RNA, 21 nt, Human
gaaggucuucaaggagaauuu

SEQ ID NO: 148376 - RNA, 23 nt, Human
gagaaucgcuugaacccgggggg

SEQ ID NO: 148377 - RNA, 19 nt, Human
gagcaaggggagaaaaaua

SEQ ID NO: 148378 - RNA, 26 nt, Human
gaggugggcugaucacccugagguca

SEQ ID NO: 148379 - RNA, 20 nt, Human
gaucacccugaggucaggaa

SEQ ID NO: 148380 - RNA, 21 nt, Human
gaucacccugaggucaggaga

SEQ ID NO: 148381 - RNA, 24 nt, Human
gcacuccagccugggugacagagc

SEQ ID NO: 148382 - RNA, 24 nt, Human
gcagaucacgccacugcacuccag

SEQ ID NO: 148383 - RNA, 22 nt, Human
gccaaaauguagauucaaucca

SEQ ID NO: 148384 - RNA, 24 nt, Human
gccaacaugcugaaaccccgucuc

SEQ ID NO: 148385 - RNA, 19 nt, Human
gccacugcacuccagccug

SEQ ID NO: 148386 - RNA, 24 nt, Human
gccacugcacuccagccuggguga

SEQ ID NO: 148387 - RNA, 23 nt, Human
ggcaagguggcucacgccuguaa

SEQ ID NO: 148388 - RNA, 18 nt, Human
gggaauguuuaacuucug

SEQ ID NO: 148389 - RNA, 23 nt, Human
ggugacagagccagacucaaaaa

SEQ ID NO: 148390 - RNA, 23 nt, Human
gguggcucacgccuguaauccca

SEQ ID NO: 148391 - RNA, 24 nt, Human
gguggcucacgccuguaaucccag

SEQ ID NO: 148392 - RNA, 18 nt, Human
gguuguggcaaaguuuca

SEQ ID NO: 148393 - RNA, 23 nt, Human
guggcucacgccuguaaucccag

SEQ ID NO: 148394 - RNA, 20 nt, Human
uaaaagggagaaggucuuca

SEQ ID NO: 148395 - RNA, 18 nt, Human
uaaaaugaaggccuaaaa

SEQ ID NO: 148396 - RNA, 25 nt, Human
uaaacaaacaaaaaaacagaacugc

SEQ ID NO: 148397 - RNA, 24 nt, Human
uaaccaaaaaaaaaaaaaaagaga

SEQ ID NO: 148398 - RNA, 20 nt, Human
uagccaacaugcugaaaccc

SEQ ID NO: 148399 - RNA, 19 nt, Human
uaugaugugggcugggcaa

SEQ ID NO: 148400 - RNA, 18 nt, Human
ucaauccaacauuaugcc

SEQ ID NO: 148401 - RNA, 23 nt, Human
ucacgccacugcacuccagccug

SEQ ID NO: 148402 - RNA, 18 nt, Human
ucaggcauuaaacaacgc

SEQ ID NO: 148403 - RNA, 19 nt, Human
ucaucuagaauuauuuggu

SEQ ID NO: 148404 - RNA, 20 nt, Human
ucaugaaaaagaaaaaaaac

SEQ ID NO: 148405 - RNA, 21 nt, Human
ucauucgaauccauucauuuc

SEQ ID NO: 148406 - RNA, 23 nt, Human
ucauuucaaacuguaugaugugg

SEQ ID NO: 148407 - RNA, 19 nt, Human
uccaacuuccaaauccauc

SEQ ID NO: 148408 - RNA, 24 nt, Human
uccagccugggugacagagccaga

SEQ ID NO: 148409 - RNA, 18 nt, Human
ucgcuugaacccgggggg

SEQ ID NO: 148410 - RNA, 24 nt, Human
ucgggaggcugaggcaggagaauc

SEQ ID NO: 148411 - RNA, 25 nt, Human
ugaaaaagaaaaaaaacuuuauuuc

SEQ ID NO: 148412 - RNA, 20 nt, Human
ugaggcaggagaaucgcuug

SEQ ID NO: 148413 - RNA, 24 nt, Human
ugaggcaggagaaucgcuugaacc

SEQ ID NO: 148414 - RNA, 25 nt, Human
ugaggcaggagaaucgcuugaaccc

SEQ ID NO: 148415 - RNA, 18 nt, Human
ugaggucaggagagaccg

SEQ ID NO: 148416 - RNA, 19 nt, Human
ugaucacccugaggucagg

SEQ ID NO: 148417 - RNA, 22 nt, Human
uggcgcgcaccuguaaucucag

SEQ ID NO: 148418 - RNA, 22 nt, Human
uggcucacgccuguaaucccag

SEQ ID NO: 148419 - RNA, 24 nt, Human
uggcucacgccuguaaucccagca

SEQ ID NO: 148420 - RNA, 24 nt, Human
ugguggcgcgcaccuguaaucuca

SEQ ID NO: 148421 - RNA, 20 nt, Human
ugugaggccgaggugggcug

SEQ ID NO: 148422 - RNA, 20 nt, Human
ugugcuacagcaaaggcugg

SEQ ID NO: 148423 - RNA, 23 nt, Human
ugugggcugggcaagguggcuca

SEQ ID NO: 148424 - RNA, 23 nt, Human
uucauaaccaaaaaaaaaaaaaa

SEQ ID NO: 148425 - RNA, 20 nt, Human
uuuugcuuucuaacaucuuu

SEQ ID NO: 148426 - RNA, 25 nt, Human
uuuuuuuuuuuuuuuugcuuucuaa

SEQ ID NO: 148427 - RNA, 18 nt, Human
uuuuuuuuuuuuuuuuug

SEQ ID NO: 148428 - RNA, 23 nt, Human
uuuuuuuuuuuuuuuuuugcuuu

SEQ ID NO: 148429 - RNA, 19 nt, Human
aaaagaaagaaaauuagga

SEQ ID NO: 148430 - RNA, 21 nt, Human
aaauuccagaaaauggcaugg

SEQ ID NO: 148431 - RNA, 18 nt, Human
aacacagucauuacuaca

SEQ ID NO: 148432 - RNA, 24 nt, Human
aagaaagaaaauuaggaaagagaa

SEQ ID NO: 148433 - RNA, 20 nt, Human
aagcacaaguauaauaaucc

SEQ ID NO: 148434 - RNA, 24 nt, Human
acagcagcaaguucuguguuggcu

SEQ ID NO: 148435 - RNA, 19 nt, Human
agaaaaaacacagcagcaa

SEQ ID NO: 148436 - RNA, 23 nt, Human
agaaagaaaauuaggaaagagaa

SEQ ID NO: 148437 - RNA, 22 nt, Human
agcguaaggucccacgcgccuc

SEQ ID NO: 148438 - RNA, 19 nt, Human
augaaauaaugcaacaccc

SEQ ID NO: 148439 - RNA, 23 nt, Human
caacacccuuaaauuccagaaaa

SEQ ID NO: 148440 - RNA, 25 nt, Human
caacauuaaagaauccaauuuagau

SEQ ID NO: 148441 - RNA, 23 nt, Human
caaguaaaaucuaaagaaaaccc

SEQ ID NO: 148442 - RNA, 23 nt, Human
cacaaguauaauaauccuugaau

SEQ ID NO: 148443 - RNA, 18 nt, Human
cacccuuaaauuccagaa

SEQ ID NO: 148444 - RNA, 20 nt, Human
cagaaaaaaacucagcgaua

SEQ ID NO: 148445 - RNA, 21 nt, Human
cagcgaacucucuaguggccc

SEQ ID NO: 148446 - RNA, 20 nt, Human
cauuaaagaauccaauuuag

SEQ ID NO: 148447 - RNA, 24 nt, Human
cauuacuacaaauuacuuguugaa

SEQ ID NO: 148448 - RNA, 18 nt, Human
cccacgcgccucgccagc

SEQ ID NO: 148449 - RNA, 19 nt, Human
cccacgcgccucgccagca

SEQ ID NO: 148450 - RNA, 19 nt, Human
cccgggccgggagaggaga

SEQ ID NO: 148451 - RNA, 20 nt, Human
ccggcgucagcgaacucucu

SEQ ID NO: 148452 - RNA, 21 nt, Human
ccucaaaauaccuaaaauagg

SEQ ID NO: 148453 - RNA, 21 nt, Human
cuauuggcaacagaaaaaaac

SEQ ID NO: 148454 - RNA, 19 nt, Human
gaaccagcguaagguccca

SEQ ID NO: 148455 - RNA, 24 nt, Human
gaugaaauaaugcaacacccuuaa

SEQ ID NO: 148456 - RNA, 20 nt, Human
ggugugaaaauuguuucagg

SEQ ID NO: 148457 - RNA, 19 nt, Human
uaaacgauuccuccaaacc

SEQ ID NO: 148458 - RNA, 19 nt, Human
uaaucuugucauuacaaca

SEQ ID NO: 148459 - RNA, 19 nt, Human
uaccugaagggucacauuu

SEQ ID NO: 148460 - RNA, 23 nt, Human
uaugguaaauaccucaaaauacc

SEQ ID NO: 148461 - RNA, 22 nt, Human
uccaaauuauuaucagauauuu

SEQ ID NO: 148462 - RNA, 23 nt, Human
ugaaaggcaugaauucuccauua

SEQ ID NO: 148463 - RNA, 20 nt, Human
ugaaauaaugcaacacccuu

SEQ ID NO: 148464 - RNA, 21 nt, Human
ugaagcacaaguauaauaauc

SEQ ID NO: 148465 - RNA, 22 nt, Human
ugugaucaaaccuauuuaagac

SEQ ID NO: 148466 - RNA, 25 nt, Human
ugugaucaaaccuauuuaagacacc

SEQ ID NO: 148467 - RNA, 18 nt, Human
uucaaaagaaagaaaauu

SEQ ID NO: 148468 - RNA, 22 nt, Human
uucaaaagaaagaaaauuagga

SEQ ID NO: 148469 - RNA, 24 nt, Human
uucaaaagaaagaaaauuaggaaa

SEQ ID NO: 148470 - RNA, 21 nt, Human
uucaucuuuaacauagcuacu

SEQ ID NO: 148471 - RNA, 21 nt, Human
uuccagaaaauggcaugguuu

SEQ ID NO: 148472 - RNA, 24 nt, Human
uuucaaaaucaaaaaaaaaguauc

SEQ ID NO: 148473 - RNA, 26 nt, Human
uuucuaaauuuaguuuaugguaaaua

SEQ ID NO: 148474 - RNA, 22 nt, Human
uuuucuuuuuugucaacaaaug

SEQ ID NO: 148475 - RNA, 18 nt, Human
uuuuucuuuuuugucaac

SEQ ID NO: 148476 - RNA, 19 nt, Human
aagcucacaaagcacuggu

SEQ ID NO: 148477 - RNA, 24 nt, Human
caggucaaaaaagcucacaaagca

SEQ ID NO: 148478 - RNA, 24 nt, Human
cccgcaggucaaaaaagcucacaa

SEQ ID NO: 148479 - RNA, 18 nt, Human
cccggcugugacgcgagg

SEQ ID NO: 148480 - RNA, 27 nt, Human
cgcaggucaaaaaagcucacaaagcac

SEQ ID NO: 148481 - RNA, 20 nt, Human
gggcucauuguugucaaucu

SEQ ID NO: 148482 - RNA, 21 nt, Human
gucaaaaaagcucacaaagca

SEQ ID NO: 148483 - RNA, 18 nt, Human
ucaaaaaagcucacaaag

SEQ ID NO: 148484 - RNA, 21 nt, Human
ucaaaaaagcucacaaagcac

SEQ ID NO: 148485 - RNA, 22 nt, Human
ugugacgcgaggaaggccgcaa

SEQ ID NO: 148486 - RNA, 24 nt, Human
caauaugcaaauauauuucuucca

SEQ ID NO: 148487 - RNA, 19 nt, Human
cauguuaacuucuuuucug

SEQ ID NO: 148488 - RNA, 18 nt, Human
cugugcuuuucaauaugc

SEQ ID NO: 148489 - RNA, 22 nt, Human
uagccaaaaucggcaaugacac

SEQ ID NO: 148490 - RNA, 20 nt, Human
ugacuucaagaguucauguu

SEQ ID NO: 148491 - RNA, 24 nt, Human
uucauguuaacuucuuuucuggaa

SEQ ID NO: 148492 - RNA, 24 nt, Human
uuuuuuuuuuuuuuuuuuuauuuu

SEQ ID NO: 148493 - RNA, 23 nt, Human
cuuugauaguuuuuuuuuucauc

SEQ ID NO: 148494 - RNA, 22 nt, Human
ucaauuuuauuccaauucuuca

SEQ ID NO: 148495 - RNA, 18 nt, Human
uccaaaauguaagucacc

SEQ ID NO: 148496 - RNA, 19 nt, Human
uuccaaaauguaagucacc

SEQ ID NO: 148497 - RNA, 22 nt, Human
ccccagagauugagcccuggcu

SEQ ID NO: 148498 - RNA, 25 nt, Human
cccuggcuggggcuggggagcucau

SEQ ID NO: 148499 - RNA, 19 nt, Human
cccuggcuggggcugggug

SEQ ID NO: 148500 - RNA, 18 nt, Human
cccuucccuccccccucc

SEQ ID NO: 148501 - RNA, 23 nt, Human
cccuucccuccccccuccugcug

SEQ ID NO: 148502 - RNA, 27 nt, Human
cucagcccccagagauugagcccuggc

SEQ ID NO: 148503 - RNA, 20 nt, Human
cuccccccuccugcugcucc

SEQ ID NO: 148504 - RNA, 21 nt, Human
cugcugcuccucagcccccag

SEQ ID NO: 148505 - RNA, 20 nt, Human
ucccuucccuccccccuccu

SEQ ID NO: 148506 - RNA, 19 nt, Human
ucccuuggcucccuucccu

SEQ ID NO: 148507 - RNA, 21 nt, Human
uggcucccuucccuccccccc

SEQ ID NO: 148508 - RNA, 18 nt, Human
aaacaaaaugcauucaaa

SEQ ID NO: 148509 - RNA, 19 nt, Human
aagaaagaagcacaaugca

SEQ ID NO: 148510 - RNA, 20 nt, Human
aagaagcacaaugcacguug

SEQ ID NO: 148511 - RNA, 18 nt, Human
acaaccauuucuacagaa

SEQ ID NO: 148512 - RNA, 18 nt, Human
acccaccccaacagucua

SEQ ID NO: 148513 - RNA, 18 nt, Human
acucuaaagaggauaaag

SEQ ID NO: 148514 - RNA, 28 nt, Human
agaaagaagcacaaugcacguugugauc

SEQ ID NO: 148515 - RNA, 19 nt, Human
auacaauuuauuuaacauu

SEQ ID NO: 148516 - RNA, 19 nt, Human
auagagaacaucuaauaca

SEQ ID NO: 148517 - RNA, 22 nt, Human
caacagucuaacucuaaagagg

SEQ ID NO: 148518 - RNA, 18 nt, Human
cacugcauccaaaacucu

SEQ ID NO: 148519 - RNA, 20 nt, Human
cacugcauccaaaacucuca

SEQ ID NO: 148520 - RNA, 20 nt, Human
ccaaagaaagaagcacaaug

SEQ ID NO: 148521 - RNA, 24 nt, Human
cccaaagaaagaagcacaaugcac

SEQ ID NO: 148522 - RNA, 18 nt, Human
ccccaacagucuaacucu

SEQ ID NO: 148523 - RNA, 21 nt, Human
cuauucagcaacagcgagcac

SEQ ID NO: 148524 - RNA, 21 nt, Human
gcgagcacugcauccaaaacu

SEQ ID NO: 148525 - RNA, 24 nt, Human
uaaaugauagagaacaucuaauac

SEQ ID NO: 148526 - RNA, 24 nt, Human
uaaaugauagagaacaucuaauac

SEQ ID NO: 148527 - RNA, 26 nt, Human
uaaaugauagagaacaucuaauacaa

SEQ ID NO: 148528 - RNA, 23 nt, Human
uaauacaaccauuucuacagaac

SEQ ID NO: 148529 - RNA, 22 nt, Human
uacccaccccaacagucuaacu

SEQ ID NO: 148530 - RNA, 23 nt, Human
ucaaaugcuuucuaaaaaaauuu

SEQ ID NO: 148531 - RNA, 19 nt, Human
ucccaaagaaagaagcaca

SEQ ID NO: 148532 - RNA, 21 nt, Human
ucccaaagaaagaagcacaau

SEQ ID NO: 148533 - RNA, 19 nt, Human
uccguuaugagcauugaga

SEQ ID NO: 148534 - RNA, 21 nt, Human
ucuaaaaaaauuuuaaaggcc

SEQ ID NO: 148535 - RNA, 27 nt, Human
ucuaagaaagaaagauuuuacagacua

SEQ ID NO: 148536 - RNA, 21 nt, Human
ugacaaacacaauaaaggcag

SEQ ID NO: 148537 - RNA, 25 nt, Human
uuaaaggccuuucuacucaggcuaa

SEQ ID NO: 148538 - RNA, 24 nt, Human
uugcuggggcuuagcaacaggguc

SEQ ID NO: 148539 - RNA, 22 nt, Human
uuucuacucaggcuaaugacaa

SEQ ID NO: 148540 - RNA, 26 nt, Human
aaaaaaaaaaaaaaaugaacacagaa

SEQ ID NO: 148541 - RNA, 25 nt, Human
aaaaaaaaaaaaaauuuaagcaaaa

SEQ ID NO: 148542 - RNA, 25 nt, Human
aaaaaaaugaacacagaaguacaag

SEQ ID NO: 148543 - RNA, 23 nt, Human
aaaaaacaaaaaaaauuaccaaa

SEQ ID NO: 148544 - RNA, 21 nt, Human
aaaaagaaacaaagaaaauug

SEQ ID NO: 148545 - RNA, 23 nt, Human
aaaacaaaaaaaauuaccaaaga

SEQ ID NO: 148546 - RNA, 24 nt, Human
aaaacaaaaaaaauuaccaaagaa

SEQ ID NO: 148547 - RNA, 19 nt, Human
aaaauacagcauaaagaua

SEQ ID NO: 148548 - RNA, 20 nt, Human
aaaauacagcauaaagauac

SEQ ID NO: 148549 - RNA, 22 nt, Human
aaaauacagcauaaagauacaa

SEQ ID NO: 148550 - RNA, 21 nt, Human
aaacaaaugaaaaacugaaau

SEQ ID NO: 148551 - RNA, 25 nt, Human
aaacaaaugaaaaacugaaaucaga

SEQ ID NO: 148552 - RNA, 18 nt, Human
aaaugccaaguuguuuuc

SEQ ID NO: 148553 - RNA, 25 nt, Human
aagaaaauugcuagaaaacuguaug

SEQ ID NO: 148554 - RNA, 26 nt, Human
acaaaaaacaaaaaaaauuaccaaag

SEQ ID NO: 148555 - RNA, 22 nt, Human
acaaaaacagacauacuaauuc

SEQ ID NO: 148556 - RNA, 24 nt, Human
acaaaugaaaaacugaaaucagaa

SEQ ID NO: 148557 - RNA, 18 nt, Human
agguaaaaucuguaugua

SEQ ID NO: 148558 - RNA, 26 nt, Human
auaugcuucugcauaaaauggaacaa

SEQ ID NO: 148559 - RNA, 18 nt, Human
caaagaaaauugcuagaa

SEQ ID NO: 148560 - RNA, 24 nt, Human
caaugcuguaaaaagaaacaaaga

SEQ ID NO: 148561 - RNA, 22 nt, Human
caccacaaaagaggacauaaua

SEQ ID NO: 148562 - RNA, 27 nt, Human
cagcaaagacaaugcuguaaaaagaaa

SEQ ID NO: 148563 - RNA, 18 nt, Human
cagcaagaguacagcaaa

SEQ ID NO: 148564 - RNA, 23 nt, Human
cccaaaucucgauugcuugacgc

SEQ ID NO: 148565 - RNA, 21 nt, Human
cuacuugagccauuuuuaacc

SEQ ID NO: 148566 - RNA, 18 nt, Human
cucuagccaaaaaaaaaa

SEQ ID NO: 148567 - RNA, 23 nt, Human
cucuagccaaaaaaaaaaaaaaa

SEQ ID NO: 148568 - RNA, 19 nt, Human
cuuugugucauauuccugg

SEQ ID NO: 148569 - RNA, 23 nt, Human
cuuugugucauauuccuggaucc

SEQ ID NO: 148570 - RNA, 20 nt, Human
gaacacagaaguacaagaca

SEQ ID NO: 148571 - RNA, 23 nt, Human
gacugcuuuucuacuugagccau

SEQ ID NO: 148572 - RNA, 18 nt, Human
gauggagaaauaaaagga

SEQ ID NO: 148573 - RNA, 23 nt, Human
gcaaaauaugcuucugcauaaaa

SEQ ID NO: 148574 - RNA, 19 nt, Human
gccaaaaaaaaaaaaaaaa

SEQ ID NO: 148575 - RNA, 20 nt, Human
guagcaaagcuuuguaguua

SEQ ID NO: 148576 - RNA, 19 nt, Human
guuuucugacuauugugga

SEQ ID NO: 148577 - RNA, 24 nt, Human
uaaaaagaaacaaagaaaauugcu

SEQ ID NO: 148578 - RNA, 21 nt, Human
uauaaagauggagaaauaaaa

SEQ ID NO: 148579 - RNA, 22 nt, Human
ucaaaccagcaaaauaugcuuc

SEQ ID NO: 148580 - RNA, 23 nt, Human
ucagcaagaguacagcaaagaca

SEQ ID NO: 148581 - RNA, 23 nt, Human
uccuucaccaauguuacaugagg

SEQ ID NO: 148582 - RNA, 25 nt, Human
ucuagccaaaaaaaaaaaaaaaaaa

SEQ ID NO: 148583 - RNA, 25 nt, Human
ucuccuaugagaauacucagaaggu

SEQ ID NO: 148584 - RNA, 22 nt, Human
ugaaaaacugaaaucagaauca

SEQ ID NO: 148585 - RNA, 20 nt, Human
ugaaaugcauaaauuuguag

SEQ ID NO: 148586 - RNA, 20 nt, Human
ugcaauaagaaguacaaauu

SEQ ID NO: 148587 - RNA, 23 nt, Human
ugcuccaaacuuaugcuguucac

SEQ ID NO: 148588 - RNA, 22 nt, Human
uggaagacaccacaaaagagga

SEQ ID NO: 148589 - RNA, 20 nt, Human
uggagaaauaaaaggacaaa

SEQ ID NO: 148590 - RNA, 21 nt, Human
uggauccuucaccaauguuag

SEQ ID NO: 148591 - RNA, 22 nt, Human
ugggccaggaacacauuuaugg

SEQ ID NO: 148592 - RNA, 22 nt, Human
uguaaaaagaaacaaagaaaau

SEQ ID NO: 148593 - RNA, 21 nt, Human
uguacuguaauucuuugauug

SEQ ID NO: 148594 - RNA, 20 nt, Human
uguagcaaagcuuuguaguu

SEQ ID NO: 148595 - RNA, 19 nt, Human
uguggauagguaaaaucug

SEQ ID NO: 148596 - RNA, 22 nt, Human
uguuaaaauacagcauaaagau

SEQ ID NO: 148597 - RNA, 22 nt, Human
uugugucauauuccuggauccu

SEQ ID NO: 148598 - RNA, 24 nt, Human
uuuaagcaaaacaaaugaaaaacu

SEQ ID NO: 148599 - RNA, 21 nt, Human
uuuccuguaaaguauagaaau

SEQ ID NO: 148600 - RNA, 20 nt, Human
agaggagggggcaggugccc

SEQ ID NO: 148601 - RNA, 20 nt, Human
aggagggggcaggugcccug

SEQ ID NO: 148602 - RNA, 20 nt, Human
agggagcuuucccaagcacc

SEQ ID NO: 148603 - RNA, 18 nt, Human
cagcagcgaggggcugga

SEQ ID NO: 148604 - RNA, 19 nt, Human
cagcagcgaggggcuggaa

SEQ ID NO: 148605 - RNA, 18 nt, Human
caguggaggcacaaggag

SEQ ID NO: 148606 - RNA, 19 nt, Human
ccaagcacaucaaccuaag

SEQ ID NO: 148607 - RNA, 21 nt, Human
ccaagcacaucaaccuaagga

SEQ ID NO: 148608 - RNA, 21 nt, Human
cccaagcacaucaaccuaagg

SEQ ID NO: 148609 - RNA, 20 nt, Human
ccccacgccaacgccugccc

SEQ ID NO: 148610 - RNA, 21 nt, Human
cccgcgaaccucucgcugccc

SEQ ID NO: 148611 - RNA, 20 nt, Human
cccugagugagggagaaagg

SEQ ID NO: 148612 - RNA, 20 nt, Human
ccugcccaguaugaucacuu

SEQ ID NO: 148613 - RNA, 23 nt, Human
ccuggcuggugggacuccuccca

SEQ ID NO: 148614 - RNA, 19 nt, Human
cgcugcccucccgcgccuc

SEQ ID NO: 148615 - RNA, 21 nt, Human
cucccgcgccuccagccucgc

SEQ ID NO: 148616 - RNA, 21 nt, Human
cuccucccaggaaggcccuga

SEQ ID NO: 148617 - RNA, 18 nt, Human
cuccugcaucaguggagg

SEQ ID NO: 148618 - RNA, 21 nt, Human
cucucgcugcccucccgcgcc

SEQ ID NO: 148619 - RNA, 24 nt, Human
cugcacccgcgaaccucucgcugc

SEQ ID NO: 148620 - RNA, 21 nt, Human
cuggcaggggucacuccccuu

SEQ ID NO: 148621 - RNA, 21 nt, Human
cuggcuggugggacuccuccc

SEQ ID NO: 148622 - RNA, 21 nt, Human
cuuucccaagcacaucaaccu

SEQ ID NO: 148623 - RNA, 18 nt, Human
gcgccuccagccucgcuc

SEQ ID NO: 148624 - RNA, 18 nt, Human
ggaaggagggggagggag

SEQ ID NO: 148625 - RNA, 19 nt, Human
ggagcuuucccaagcacau

SEQ ID NO: 148626 - RNA, 18 nt, Human
gggaaggagggggaggga

SEQ ID NO: 148627 - RNA, 24 nt, Human
ggugguugcgcccccagcagcgag

SEQ ID NO: 148628 - RNA, 23 nt, Human
ugagggagaaagggcuggggugu

SEQ ID NO: 148629 - RNA, 23 nt, Human
uggcaggggucacuccccuuggg

SEQ ID NO: 148630 - RNA, 24 nt, Human
uggcugcagggugugcuggcaggg

SEQ ID NO: 148631 - RNA, 21 nt, Human
uguccgaccccacgccaacgc

SEQ ID NO: 148632 - RNA, 26 nt, Human
uuuuuuuuuuuuuuuuuuccuagggg

SEQ ID NO: 148633 - RNA, 23 nt, Human
aaaacagaacaaaguucugcaga

SEQ ID NO: 148634 - RNA, 21 nt, Human
aaaacagugucacaggguaac

SEQ ID NO: 148635 - RNA, 22 nt, Human
aaaaucaacuucaaacucaaaa

SEQ ID NO: 148636 - RNA, 22 nt, Human
aaaauuacaggguaugagggug

SEQ ID NO: 148637 - RNA, 20 nt, Human
aaacaacuaggaaagucaga

SEQ ID NO: 148638 - RNA, 20 nt, Human
aaacaacuaggaaagucaga

SEQ ID NO: 148639 - RNA, 22 nt, Human
aaacagaacaaaguucugcaga

SEQ ID NO: 148640 - RNA, 19 nt, Human
aaagcgaaagggucacaga

SEQ ID NO: 148641 - RNA, 25 nt, Human
aaaucaacuucaaacucaaaacaua

SEQ ID NO: 148642 - RNA, 22 nt, Human
aaauggccugguagagaaaaag

SEQ ID NO: 148643 - RNA, 23 nt, Human
aaauggccugguagagaaaaagg

SEQ ID NO: 148644 - RNA, 23 nt, Human
aaccauaggugggauacagggag

SEQ ID NO: 148645 - RNA, 20 nt, Human
aacguucuucagcggucauu

SEQ ID NO: 148646 - RNA, 18 nt, Human
aaggaaguggaccucaaa

SEQ ID NO: 148647 - RNA, 19 nt, Human
aagugccucuauuacuugg

SEQ ID NO: 148648 - RNA, 20 nt, Human
aauaaaaaaacaacuaggaa

SEQ ID NO: 148649 - RNA, 25 nt, Human
aaugcaaaagcgaaagggucacaga

SEQ ID NO: 148650 - RNA, 21 nt, Human
acaaacuccaaacaugcacac

SEQ ID NO: 148651 - RNA, 21 nt, Human
acagggagaagaaauggucag

SEQ ID NO: 148652 - RNA, 24 nt, Human
accacccacuacaaacuccaaaca

SEQ ID NO: 148653 - RNA, 19 nt, Human
acccacuacaaacuccaaa

SEQ ID NO: 148654 - RNA, 25 nt, Human
accccaagcccagacucuugcaaca

SEQ ID NO: 148655 - RNA, 18 nt, Human
agaaaacagaacaaaguu

SEQ ID NO: 148656 - RNA, 22 nt, Human
agaaaggaaguggaccucaaaa

SEQ ID NO: 148657 - RNA, 21 nt, Human
agaaauacagcaagggccuuc

SEQ ID NO: 148658 - RNA, 22 nt, Human
agaagacauuccucccagagga

SEQ ID NO: 148659 - RNA, 18 nt, Human
agaauacuaugaucaggc

SEQ ID NO: 148660 - RNA, 19 nt, Human
agaauacuaugaucaggcc

SEQ ID NO: 148661 - RNA, 24 nt, Human
agacagaagacauuccucccagag

SEQ ID NO: 148662 - RNA, 20 nt, Human
agacagggagaagaaauggu

SEQ ID NO: 148663 - RNA, 19 nt, Human
agacggggagguggagacu

SEQ ID NO: 148664 - RNA, 19 nt, Human
agaggaagaaagugaggga

SEQ ID NO: 148665 - RNA, 26 nt, Human
agaggaagaaagugagggagguaggg

SEQ ID NO: 148666 - RNA, 18 nt, Human
agaggaagacggggaggu

SEQ ID NO: 148667 - RNA, 22 nt, Human
agcaacgagaugcaagcaggga

SEQ ID NO: 148668 - RNA, 18 nt, Human
agcaaggcagaauggucc

SEQ ID NO: 148669 - RNA, 22 nt, Human
agcgaaagggucacagaaaaga

SEQ ID NO: 148670 - RNA, 18 nt, Human
agggagaagaaaugguca

SEQ ID NO: 148671 - RNA, 24 nt, Human
agggaggagagacagaggguaagg

SEQ ID NO: 148672 - RNA, 19 nt, Human
agguggagacuguaauggg

SEQ ID NO: 148673 - RNA, 21 nt, Human
agugagggagguagggagaga

SEQ ID NO: 148674 - RNA, 24 nt, Human
caaaacagugucacaggguaacgc

SEQ ID NO: 148675 - RNA, 23 nt, Human
caaaguucugcagacauccuucc

SEQ ID NO: 148676 - RNA, 21 nt, Human
caaaugcacuaaguaaaagaa

SEQ ID NO: 148677 - RNA, 24 nt, Human
caacaggaaaggcaagaaaacugg

SEQ ID NO: 148678 - RNA, 18 nt, Human
caaccagaaauucccagg

SEQ ID NO: 148679 - RNA, 20 nt, Human
caacuaccacaaugcucacu

SEQ ID NO: 148680 - RNA, 19 nt, Human
cacaaaggaaaaaaaugca

SEQ ID NO: 148681 - RNA, 21 nt, Human
caccaagcucuguaucccuuc

SEQ ID NO: 148682 - RNA, 18 nt, Human
cacuuugcuuucuugaag

SEQ ID NO: 148683 - RNA, 23 nt, Human
cagaguacaacaggaaaggcaag

SEQ ID NO: 148684 - RNA, 21 nt, Human
cagcaacgagaugcaagcagg

SEQ ID NO: 148685 - RNA, 25 nt, Human
cauagaacagcagacuugccuauga

SEQ ID NO: 148686 - RNA, 27 nt, Human
cauccccaaaacauuggaagguccuuc

SEQ ID NO: 148687 - RNA, 21 nt, Human
ccaccaaguggaagcuaaagu

SEQ ID NO: 148688 - RNA, 25 nt, Human
ccagcaacgagaugcaagcagggag

SEQ ID NO: 148689 - RNA, 19 nt, Human
cccacuacaaacuccaaac

SEQ ID NO: 148690 - RNA, 18 nt, Human
cccaggacaccaguggcu

SEQ ID NO: 148691 - RNA, 25 nt, Human
ccccaaaacauuggagauccagcuu

SEQ ID NO: 148692 - RNA, 21 nt, Human
ccucaagguaaaagggaaagc

SEQ ID NO: 148693 - RNA, 24 nt, Human
cuaccagaguugcacaagcugugc

SEQ ID NO: 148694 - RNA, 25 nt, Human
cucaagguaaaagggaaagcagcuc

SEQ ID NO: 148695 - RNA, 20 nt, Human
cucccagaggaaagaaagga

SEQ ID NO: 148696 - RNA, 21 nt, Human
cucuaagggcugcuuagcucu

SEQ ID NO: 148697 - RNA, 21 nt, Human
cugaaaacauaucuaaaaaua

SEQ ID NO: 148698 - RNA, 24 nt, Human
cugcaaucuaagaacaacuaccac

SEQ ID NO: 148699 - RNA, 19 nt, Human
cuugaaguacaagaggacu

SEQ ID NO: 148700 - RNA, 23 nt, Human
gaaaaucaacuucaaacucaaaa

SEQ ID NO: 148701 - RNA, 18 nt, Human
gagguggagacuguaaug

SEQ ID NO: 148702 - RNA, 21 nt, Human
gcaaaacugguuaccaagggc

SEQ ID NO: 148703 - RNA, 20 nt, Human
gccaaaucaggugcacacaa

SEQ ID NO: 148704 - RNA, 20 nt, Human
ggaaagcagcucucuuuuua

SEQ ID NO: 148705 - RNA, 20 nt, Human
ggaaaggaaggagagaggaa

SEQ ID NO: 148706 - RNA, 24 nt, Human
ggaaggagagaggaagaaagugag

SEQ ID NO: 148707 - RNA, 20 nt, Human
ggagacagggagaagaaaug

SEQ ID NO: 148708 - RNA, 18 nt, Human
ggcagaaaacagaacaaa

SEQ ID NO: 148709 - RNA, 24 nt, Human
gggaacaggagacagggagaagaa

SEQ ID NO: 148710 - RNA, 21 nt, Human
gguagggagagaaauucagag

SEQ ID NO: 148711 - RNA, 21 nt, Human
gguaggugggaaggaggguga

SEQ ID NO: 148712 - RNA, 19 nt, Human
ggugacauagaacagcaga

SEQ ID NO: 148713 - RNA, 20 nt, Human
gguguuaggcccaccaagcu

SEQ ID NO: 148714 - RNA, 20 nt, Human
uaaagaccccaagcccagac

SEQ ID NO: 148715 - RNA, 21 nt, Human
uaacugggaaggggaacagga

SEQ ID NO: 148716 - RNA, 22 nt, Human
uaagaaacugcaaucuaagaac

SEQ ID NO: 148717 - RNA, 21 nt, Human
uaagaacaacuaccacaaugc

SEQ ID NO: 148718 - RNA, 23 nt, Human
uaaguaaaagaaugggaagauga

SEQ ID NO: 148719 - RNA, 19 nt, Human
uaauaccaaagacagaaga

SEQ ID NO: 148720 - RNA, 22 nt, Human
uacaaaccacccacuacaaacu

SEQ ID NO: 148721 - RNA, 22 nt, Human
uaccaaagacagaagacauucc

SEQ ID NO: 148722 - RNA, 25 nt, Human
uaccaacacuucagguaucuuugau

SEQ ID NO: 148723 - RNA, 24 nt, Human
uaccacaaugcucacuggacuuaa

SEQ ID NO: 148724 - RNA, 23 nt, Human
uaggugggauacagggaggagag

SEQ ID NO: 148725 - RNA, 23 nt, Human
uauggaccugcucuaggagcaga

SEQ ID NO: 148726 - RNA, 19 nt, Human
ucccagaggaaagaaagga

SEQ ID NO: 148727 - RNA, 20 nt, Human
ucccuuccccagacuuccca

SEQ ID NO: 148728 - RNA, 24 nt, Human
ucuacagaaauacagcaagggccu

SEQ ID NO: 148729 - RNA, 21 nt, Human
ucugcagacauccuuccucuc

SEQ ID NO: 148730 - RNA, 22 nt, Human
ucugucuuuucacuguugaucc

SEQ ID NO: 148731 - RNA, 21 nt, Human
ucuucccaucauuuggcaccc

SEQ ID NO: 148732 - RNA, 22 nt, Human
ucuucugucuuuucacuguuga

SEQ ID NO: 148733 - RNA, 21 nt, Human
ugccuaugaacguuucucaac

SEQ ID NO: 148734 - RNA, 19 nt, Human
uggcagaaaacagaacaaa

SEQ ID NO: 148735 - RNA, 20 nt, Human
uggcagaaaacagaacaaag

SEQ ID NO: 148736 - RNA, 21 nt, Human
uggcagaaaacagaacaaagu

SEQ ID NO: 148737 - RNA, 27 nt, Human
ugggaagaugaacuauaauaccaaaga

SEQ ID NO: 148738 - RNA, 18 nt, Human
ugguauggaccugcucua

SEQ ID NO: 148739 - RNA, 21 nt, Human
uuacucucacccugggaucug

SEQ ID NO: 148740 - RNA, 23 nt, Human
uucaaacucaaaacauaagaaac

SEQ ID NO: 148741 - RNA, 18 nt, Human
uucucaacuuccuaacac

SEQ ID NO: 148742 - RNA, 20 nt, Human
uucuucagcggucauucuua

SEQ ID NO: 148743 - RNA, 19 nt, Human
uuggagauccagcuuauuc

SEQ ID NO: 148744 - RNA, 24 nt, Human
uuuaaagaccccaagcccagacuc

SEQ ID NO: 148745 - RNA, 24 nt, Human
uuucauaguucaaaagaaaaacaa

SEQ ID NO: 148746 - RNA, 21 nt, Human
caacagaacaacagacuccga

SEQ ID NO: 148747 - RNA, 22 nt, Human
cacgccaacagaacaacagacu

SEQ ID NO: 148748 - RNA, 22 nt, Human
cagguagcacgccaacagaaca

SEQ ID NO: 148749 - RNA, 21 nt, Human
cuccgaugacgccagcuucaa

SEQ ID NO: 148750 - RNA, 19 nt, Human
gccuguucuuaaaacauaa

SEQ ID NO: 148751 - RNA, 23 nt, Human
uaaaacauaaaaugcucuuccaa

SEQ ID NO: 148752 - RNA, 22 nt, Human
uaaaaugcucuuccaauuccuc

SEQ ID NO: 148753 - RNA, 18 nt, Human
ucaaugauggugccaucc

SEQ ID NO: 148754 - RNA, 20 nt, Human
ucuuccaauuccucuugucc

SEQ ID NO: 148755 - RNA, 19 nt, Human
ugcgugucagccuguucuu

SEQ ID NO: 148756 - RNA, 25 nt, Human
uuagcaccauuuauuaagugaucuc

SEQ ID NO: 148757 - RNA, 18 nt, Human
uuuuuuuuuuuuuuuuug

SEQ ID NO: 148758 - RNA, 24 nt, Human
uuuuuuuuuuuuuuuuuugaguuu

SEQ ID NO: 148759 - RNA, 19 nt, Human
aaaaaggaccccaggggca

SEQ ID NO: 148760 - RNA, 22 nt, Human
aacagcaggggugguacagggg

SEQ ID NO: 148761 - RNA, 23 nt, Human
aacuccccaccccccagcgggaa

SEQ ID NO: 148762 - RNA, 21 nt, Human
aagagcccaccucuccacccu

SEQ ID NO: 148763 - RNA, 22 nt, Human
aagcagguagguaggugccaga

SEQ ID NO: 148764 - RNA, 23 nt, Human
aagcagguagguaggugccagaa

SEQ ID NO: 148765 - RNA, 19 nt, Human
acagagcagcccuguacau

SEQ ID NO: 148766 - RNA, 22 nt, Human
acagcaggggugguacaggggc

SEQ ID NO: 148767 - RNA, 18 nt, Human
acaucacaaugccccucc

SEQ ID NO: 148768 - RNA, 23 nt, Human
accaaauuucaaaauuuucaaga

SEQ ID NO: 148769 - RNA, 20 nt, Human
accagcaguccccaagucag

SEQ ID NO: 148770 - RNA, 20 nt, Human
accucuccacccugccccaa

SEQ ID NO: 148771 - RNA, 19 nt, Human
agaaaauaaaaaaaaggac

SEQ ID NO: 148772 - RNA, 21 nt, Human
agaaaauaaaaaaaaggaccc

SEQ ID NO: 148773 - RNA, 24 nt, Human
agagcccaccucuccacccugccc

SEQ ID NO: 148774 - RNA, 19 nt, Human
agcaggggugguacagggg

SEQ ID NO: 148775 - RNA, 20 nt, Human
agcagguagguaggugccag

SEQ ID NO: 148776 - RNA, 18 nt, Human
aggcaacagcaggggugg

SEQ ID NO: 148777 - RNA, 22 nt, Human
agguccccggccccaccagccc

SEQ ID NO: 148778 - RNA, 26 nt, Human
agguccccggccccaccagcccucag

SEQ ID NO: 148779 - RNA, 21 nt, Human
aggugccagaaaccccuugag

SEQ ID NO: 148780 - RNA, 25 nt, Human
auucauguuuaauaauuacaggcac

SEQ ID NO: 148781 - RNA, 19 nt, Human
caacagcaggggugguaca

SEQ ID NO: 148782 - RNA, 21 nt, Human
cacaaugccccucccucccuc

SEQ ID NO: 148783 - RNA, 19 nt, Human
caccagcaguccccaaguc

SEQ ID NO: 148784 - RNA, 22 nt, Human
cacccugccccaaucuuaagac

SEQ ID NO: 148785 - RNA, 23 nt, Human
cacccuggggcccaggaccccca

SEQ ID NO: 148786 - RNA, 23 nt, Human
caccgugcccccccuucccccug

SEQ ID NO: 148787 - RNA, 22 nt, Human
cacuacaggcacccacugccac

SEQ ID NO: 148788 - RNA, 18 nt, Human
cagccccaagccauccug

SEQ ID NO: 148789 - RNA, 25 nt, Human
cagcucccacccuuaagagaccccc

SEQ ID NO: 148790 - RNA, 19 nt, Human
caggaagagcccaccucuc

SEQ ID NO: 148791 - RNA, 23 nt, Human
caggaagagcccaccucuccacc

SEQ ID NO: 148792 - RNA, 24 nt, Human
cauccugccucuucagccacuuua

SEQ ID NO: 148793 - RNA, 23 nt, Human
cauccuggaggggggcccaggca

SEQ ID NO: 148794 - RNA, 18 nt, Human
ccaacuccccacccccca

SEQ ID NO: 148795 - RNA, 24 nt, Human
ccacccuuaagagacccuugaucu

SEQ ID NO: 148796 - RNA, 18 nt, Human
ccaccgccgcugcugccg

SEQ ID NO: 148797 - RNA, 20 nt, Human
ccacugccaccgccgcugcu

SEQ ID NO: 148798 - RNA, 24 nt, Human
ccacugccaccgccgcugcugccg

SEQ ID NO: 148799 - RNA, 25 nt, Human
ccagcagcgaggacggcaguccgag

SEQ ID NO: 148800 - RNA, 20 nt, Human
ccagcaguccccaagucagu

SEQ ID NO: 148801 - RNA, 21 nt, Human
ccaggcagccccaagccaucc

SEQ ID NO: 148802 - RNA, 22 nt, Human
cccaccucuccacccugcccca

SEQ ID NO: 148803 - RNA, 23 nt, Human
ccccaagccauccugccucuuca

SEQ ID NO: 148804 - RNA, 20 nt, Human
ccccaccagcaguccccaag

SEQ ID NO: 148805 - RNA, 19 nt, Human
ccccagcucccacccuuaa

SEQ ID NO: 148806 - RNA, 21 nt, Human
ccccagcucccacccuuaaga

SEQ ID NO: 148807 - RNA, 18 nt, Human
ccccaggggaggagaggg

SEQ ID NO: 148808 - RNA, 19 nt, Human
cccccccuucccccugccc

SEQ ID NO: 148809 - RNA, 22 nt, Human
ccccccuucccccugcccaggc

SEQ ID NO: 148810 - RNA, 19 nt, Human
cccucccucccucaucccu

SEQ ID NO: 148811 - RNA, 23 nt, Human
cccuguacaucacaaugccccuc

SEQ ID NO: 148812 - RNA, 20 nt, Human
ccgccgcugcugccgccccc

SEQ ID NO: 148813 - RNA, 21 nt, Human
ccgcugcugccgccccccugc

SEQ ID NO: 148814 - RNA, 19 nt, Human
ccgugcccccccuuccccc

SEQ ID NO: 148815 - RNA, 27 nt, Human
ccugcaguccaggcggcuagccggagc

SEQ ID NO: 148816 - RNA, 26 nt, Human
ccugccccagcucccacccuuaagag

SEQ ID NO: 148817 - RNA, 18 nt, Human
ccugccucuucagccacu

SEQ ID NO: 148818 - RNA, 22 nt, Human
cgggaagcagguagguaggugc

SEQ ID NO: 148819 - RNA, 23 nt, Human
cuccccaccccccagcgggaagc

SEQ ID NO: 148820 - RNA, 24 nt, Human
cugccaccgccgcugcugccgccc

SEQ ID NO: 148821 - RNA, 18 nt, Human
cuuaagacucugggccaa

SEQ ID NO: 148822 - RNA, 24 nt, Human
gaaagaaagcuauaagaugagugg

SEQ ID NO: 148823 - RNA, 19 nt, Human
gaagagcccaccucuccac

SEQ ID NO: 148824 - RNA, 23 nt, Human
gacacaucacacuacaggcaccc

SEQ ID NO: 148825 - RNA, 20 nt, Human
gacucugggccaacucccca

SEQ ID NO: 148826 - RNA, 22 nt, Human
gccaccgccgcugcugccgccc

SEQ ID NO: 148827 - RNA, 18 nt, Human
gcccaccucuccacccug

SEQ ID NO: 148828 - RNA, 19 nt, Human
gcccaccucuccacccugc

SEQ ID NO: 148829 - RNA, 21 nt, Human
gccgccccccugcaguccagg

SEQ ID NO: 148830 - RNA, 23 nt, Human
ggaagcagguagguaggugccag

SEQ ID NO: 148831 - RNA, 24 nt, Human
ggcauccuggaggggggcccaggc

SEQ ID NO: 148832 - RNA, 19 nt, Human
gggccaacuccccaccccc

SEQ ID NO: 148833 - RNA, 19 nt, Human
gggcuccagguccccggcc

SEQ ID NO: 148834 - RNA, 22 nt, Human
guacaggggcuggggcauaugc

SEQ ID NO: 148835 - RNA, 26 nt, Human
gugauuuucagaaaauaaaaaaaagg

SEQ ID NO: 148836 - RNA, 24 nt, Human
uaaaaaaaaggaccccaggggcag

SEQ ID NO: 148837 - RNA, 20 nt, Human
uaagagacccuugaucucac

SEQ ID NO: 148838 - RNA, 19 nt, Human
uaagaugagugggaagcag

SEQ ID NO: 148839 - RNA, 20 nt, Human
uaccccaccagcagucccca

SEQ ID NO: 148840 - RNA, 24 nt, Human
ucacacuacaggcacccacugcca

SEQ ID NO: 148841 - RNA, 22 nt, Human
uccauggggcuccagguccccg

SEQ ID NO: 148842 - RNA, 19 nt, Human
uccccggccccaccagccc

SEQ ID NO: 148843 - RNA, 21 nt, Human
ucccugccccagcucccaccc

SEQ ID NO: 148844 - RNA, 18 nt, Human
ugaucucacagagcagcc

SEQ ID NO: 148845 - RNA, 19 nt, Human
ugcccaggcaacagcaggg

SEQ ID NO: 148846 - RNA, 20 nt, Human
ugccccucccucccucaucc

SEQ ID NO: 148847 - RNA, 21 nt, Human
uggaggggggcccaggcagcc

SEQ ID NO: 148848 - RNA, 18 nt, Human
ugggccaacuccccaccc

SEQ ID NO: 148849 - RNA, 21 nt, Human
uguguccauggggcuccaggu

SEQ ID NO: 148850 - RNA, 18 nt, Human
uuccuccuugguuuggau

SEQ ID NO: 148851 - RNA, 21 nt, Human
uuccuccuugguuuggaucuc

SEQ ID NO: 148852 - RNA, 25 nt, Human
aaaagaauaauauuaauagaugggg

SEQ ID NO: 148853 - RNA, 18 nt, Human
aaaaucagggcaugaaca

SEQ ID NO: 148854 - RNA, 23 nt, Human
aacaaaaaaaagggggagggaag

SEQ ID NO: 148855 - RNA, 30 nt, Human
aaggggaacggaaaacaaaaaaaaggggga

SEQ ID NO: 148856 - RNA, 21 nt, Human
aagggggagggaagggggagg

SEQ ID NO: 148857 - RNA, 23 nt, Human
aauacuauaauaggagggaccaa

SEQ ID NO: 148858 - RNA, 20 nt, Human
aauggauaaucaaauauugc

SEQ ID NO: 148859 - RNA, 22 nt, Human
acgaucucucaaaacugaucag

SEQ ID NO: 148860 - RNA, 20 nt, Human
acugccucugcuugagaacu

SEQ ID NO: 148861 - RNA, 19 nt, Human
acuucaagggcauuaacga

SEQ ID NO: 148862 - RNA, 20 nt, Human
agaacucagcagcugccacc

SEQ ID NO: 148863 - RNA, 22 nt, Human
agaacucagcagcugccaccgc

SEQ ID NO: 148864 - RNA, 22 nt, Human
agcaacaguauguuuugcacaa

SEQ ID NO: 148865 - RNA, 19 nt, Human
agggaagggggaggaaggg

SEQ ID NO: 148866 - RNA, 19 nt, Human
agggggaggaaggagucgg

SEQ ID NO: 148867 - RNA, 20 nt, Human
agggggagggaagggggagg

SEQ ID NO: 148868 - RNA, 23 nt, Human
aguuuucuaacuuaaaacagccu

SEQ ID NO: 148869 - RNA, 21 nt, Human
auacaaguauauaaaaucagg

SEQ ID NO: 148870 - RNA, 23 nt, Human
augauaacuggcagcaaagaagg

SEQ ID NO: 148871 - RNA, 23 nt, Human
caacucaaguauuacugagcaag

SEQ ID NO: 148872 - RNA, 19 nt, Human
cagccuaugauaacuggca

SEQ ID NO: 148873 - RNA, 23 nt, Human
caggagaaaugaaauaccuucac

SEQ ID NO: 148874 - RNA, 23 nt, Human
ccaccuccauagagcuccgacuc

SEQ ID NO: 148875 - RNA, 21 nt, Human
ccaggcucaaggauauuaaaa

SEQ ID NO: 148876 - RNA, 22 nt, Human
cccaggcucaaggauauuaaaa

SEQ ID NO: 148877 - RNA, 21 nt, Human
cccauuacuagagguagaaau

SEQ ID NO: 148878 - RNA, 22 nt, Human
cucaaggauauuaaaaucuagc

SEQ ID NO: 148879 - RNA, 24 nt, Human
gaaaacaaaaaaaagggggaggga

SEQ ID NO: 148880 - RNA, 21 nt, Human
gaaggagucggggacggccuc

SEQ ID NO: 148881 - RNA, 21 nt, Human
gagggaagggggaggaaggag

SEQ ID NO: 148882 - RNA, 18 nt, Human
gcaaguaaaccauguuuc

SEQ ID NO: 148883 - RNA, 21 nt, Human
ggagggaagggggaggaagga

SEQ ID NO: 148884 - RNA, 22 nt, Human
ggcaauauacuauuacggcaac

SEQ ID NO: 148885 - RNA, 24 nt, Human
gggaagggggaggaaggagucggg

SEQ ID NO: 148886 - RNA, 20 nt, Human
gggagggaagggggaggaag

SEQ ID NO: 148887 - RNA, 25 nt, Human
gggagggaagggggaggaaggaguc

SEQ ID NO: 148888 - RNA, 19 nt, Human
gggguggggaggggagggg

SEQ ID NO: 148889 - RNA, 24 nt, Human
gggguggggaggggaggggacagg

SEQ ID NO: 148890 - RNA, 22 nt, Human
guugcuauucaguuuucuaacu

SEQ ID NO: 148891 - RNA, 24 nt, Human
uaaaacagccuaugauaacuggca

SEQ ID NO: 148892 - RNA, 22 nt, Human
uaagacauuacacuacaaaaaa

SEQ ID NO: 148893 - RNA, 21 nt, Human
uaauaggagggaccaauucaa

SEQ ID NO: 148894 - RNA, 19 nt, Human
uaauauacuaucuaaacau

SEQ ID NO: 148895 - RNA, 19 nt, Human
uaauauuaauagauggggu

SEQ ID NO: 148896 - RNA, 23 nt, Human
uacaaaaaaaccuuaugcagaag

SEQ ID NO: 148897 - RNA, 19 nt, Human
uacaucauagcaacaguau

SEQ ID NO: 148898 - RNA, 22 nt, Human
uagaaauacaggcaauauacua

SEQ ID NO: 148899 - RNA, 23 nt, Human
uagacuaugauuaagacauuaca

SEQ ID NO: 148900 - RNA, 21 nt, Human
uaucacaauguuuauugauag

SEQ ID NO: 148901 - RNA, 19 nt, Human
uauuacugagcaaagugca

SEQ ID NO: 148902 - RNA, 23 nt, Human
uauugugaaaacauuacagcgac

SEQ ID NO: 148903 - RNA, 21 nt, Human
ucaaggauauuaaaaucuagc

SEQ ID NO: 148904 - RNA, 18 nt, Human
ucacacccacaaaaacca

SEQ ID NO: 148905 - RNA, 24 nt, Human
ucagcagcugccaccgcagcugcc

SEQ ID NO: 148906 - RNA, 22 nt, Human
ucgcugcugcagccgccacucg

SEQ ID NO: 148907 - RNA, 20 nt, Human
ucuacaguauucaguguugc

SEQ ID NO: 148908 - RNA, 20 nt, Human
ugcaauagacugccucugcu

SEQ ID NO: 148909 - RNA, 19 nt, Human
ugcagaaggaaauccuaac

SEQ ID NO: 148910 - RNA, 19 nt, Human
uggggaggggaggggacag

SEQ ID NO: 148911 - RNA, 19 nt, Human
uggggaggggaggggacag

SEQ ID NO: 148912 - RNA, 20 nt, Human
uggggaggggaggggacagg

SEQ ID NO: 148913 - RNA, 23 nt, Human
uuaaauauugugaaaacauuaca

SEQ ID NO: 148914 - RNA, 23 nt, Human
uucaaaagaauaauauuaauaga

SEQ ID NO: 148915 - RNA, 22 nt, Human
uucuacaguauucaguguugcu

SEQ ID NO: 148916 - RNA, 20 nt, Human
uugaugguagacuaugauuc

SEQ ID NO: 148917 - RNA, 24 nt, Human
uuuuuuuuuuuuuuuuuuuucaag

SEQ ID NO: 148918 - RNA, 33 nt, Human
aaaaaaaaaaaaaaaagacuaaaccacaagccg

SEQ ID NO: 148919 - RNA, 27 nt, Human
aaaaaaagacuaaaccacaagcagcag

SEQ ID NO: 148920 - RNA, 20 nt, Human
aaaagacuaaaccacaagca

SEQ ID NO: 148921 - RNA, 20 nt, Human
aaccaaaauaaaacgucaaa

SEQ ID NO: 148922 - RNA, 22 nt, Human
aaccacaagcagcacccacccc

SEQ ID NO: 148923 - RNA, 22 nt, Human
aagaggcuucgauuccaacucg

SEQ ID NO: 148924 - RNA, 19 nt, Human
acccacccccuucuccccc

SEQ ID NO: 148925 - RNA, 19 nt, Human
accgccgccgccgcccucg

SEQ ID NO: 148926 - RNA, 20 nt, Human
aggcaggcgagggggcuggu

SEQ ID NO: 148927 - RNA, 21 nt, Human
aggcaggcgagggggcugguc

SEQ ID NO: 148928 - RNA, 21 nt, Human
agggcuaugggcaacagggga

SEQ ID NO: 148929 - RNA, 24 nt, Human
agucuguugggguggugcucaggg

SEQ ID NO: 148930 - RNA, 25 nt, Human
aucacugcugccaccaccgccaucc

SEQ ID NO: 148931 - RNA, 21 nt, Human
cacaagcagcacccacccccu

SEQ ID NO: 148932 - RNA, 19 nt, Human
caccagggcuguaguguga

SEQ ID NO: 148933 - RNA, 22 nt, Human
cacccccuucucccccaccagg

SEQ ID NO: 148934 - RNA, 23 nt, Human
cagcacccacccccuucuccccc

SEQ ID NO: 148935 - RNA, 22 nt, Human
cagguccccuccccucuccucc

SEQ ID NO: 148936 - RNA, 26 nt, Human
ccagagccaggccaggcucggggagg

SEQ ID NO: 148937 - RNA, 33 nt, Human
ccagauugaauuuaaaaaaaaaaaaaaaaaaaa

SEQ ID NO: 148938 - RNA, 24 nt, Human
ccaugggggcagggcccucccaga

SEQ ID NO: 148939 - RNA, 22 nt, Human
cccacccccuucucccccacca

SEQ ID NO: 148940 - RNA, 18 nt, Human
ccccucuccuccucuucc

SEQ ID NO: 148941 - RNA, 25 nt, Human
cccgcugccgccgccgccgccgccu

SEQ ID NO: 148942 - RNA, 18 nt, Human
ccgccgccgcccucgugc

SEQ ID NO: 148943 - RNA, 19 nt, Human
ccgccgccgcccucgugcc

SEQ ID NO: 148944 - RNA, 27 nt, Human
ccgccgccgccgccgccucuaccgccg

SEQ ID NO: 148945 - RNA, 27 nt, Human
ccgccgccgccgccucuaccgccgccg

SEQ ID NO: 148946 - RNA, 19 nt, Human
ccgccgccgccucuaccgc

SEQ ID NO: 148947 - RNA, 32 nt, Human
ccgccgccgccucuaccgccgccgccgccccc

SEQ ID NO: 148948 - RNA, 29 nt, Human
ccgccgccucuaccgccgccgccgccccc

SEQ ID NO: 148949 - RNA, 30 nt, Human
ccgccgccucuaccgccgccgccgcccuuc

SEQ ID NO: 148950 - RNA, 18 nt, Human
ccgcugccgccgccgccg

SEQ ID NO: 148951 - RNA, 23 nt, Human
ccgcugccgccgccgccgccgcc

SEQ ID NO: 148952 - RNA, 22 nt, Human
ccgcugccgccgccgccgccgg

SEQ ID NO: 148953 - RNA, 18 nt, Human
ccgggccagagccaggcc

SEQ ID NO: 148954 - RNA, 19 nt, Human
ccuccgagcccgcugccgc

SEQ ID NO: 148955 - RNA, 21 nt, Human
ccucuccuccucuucccuccc

SEQ ID NO: 148956 - RNA, 18 nt, Human
ccucuucccuccccaucu

SEQ ID NO: 148957 - RNA, 21 nt, Human
ccucuucccuccccaucuaaa

SEQ ID NO: 148958 - RNA, 21 nt, Human
cgccucuaccgccgccgccgc

SEQ ID NO: 148959 - RNA, 21 nt, Human
cucgccgcgagcccaaccgcu

SEQ ID NO: 148960 - RNA, 20 nt, Human
cugaggagggggcagguccc

SEQ ID NO: 148961 - RNA, 20 nt, Human
cugccgccgccgccgccgcc

SEQ ID NO: 148962 - RNA, 19 nt, Human
cuucucccccaccagggcu

SEQ ID NO: 148963 - RNA, 26 nt, Human
gaccagaccagggaugaguggggagg

SEQ ID NO: 148964 - RNA, 25 nt, Human
gagggcacaaggaccauuugccaga

SEQ ID NO: 148965 - RNA, 22 nt, Human
gaggggguggggaaaaccaaaa

SEQ ID NO: 148966 - RNA, 23 nt, Human
gcacccacccccuucucccccac

SEQ ID NO: 148967 - RNA, 18 nt, Human
gccaccaccgccauccug

SEQ ID NO: 148968 - RNA, 22 nt, Human
gcgaacgcacugacucgacccc

SEQ ID NO: 148969 - RNA, 20 nt, Human
ggagcuaggugaagggcagg

SEQ ID NO: 148970 - RNA, 26 nt, Human
ggagggcagcuucaccaaggccacaa

SEQ ID NO: 148971 - RNA, 20 nt, Human
ggcagggcccucccagaugc

SEQ ID NO: 148972 - RNA, 27 nt, Human
gggccagagccaggccaggcucgggga

SEQ ID NO: 148973 - RNA, 25 nt, Human
gggggcagggcccucccagaugccu

SEQ ID NO: 148974 - RNA, 25 nt, Human
guuuggggagagacacaggcaggcc

SEQ ID NO: 148975 - RNA, 21 nt, Human
uagugugaggggagaagagga

SEQ ID NO: 148976 - RNA, 23 nt, Human
uagugugaggggagaagaggagg

SEQ ID NO: 148977 - RNA, 23 nt, Human
ucuaccgccgccgccgcccucgu

SEQ ID NO: 148978 - RNA, 19 nt, Human
ucuccuccucuucccuccc

SEQ ID NO: 148979 - RNA, 23 nt, Human
ucugcagguucagaggaucacug

SEQ ID NO: 148980 - RNA, 25 nt, Human
ucugcagguucagaggaucacugcu

SEQ ID NO: 148981 - RNA, 23 nt, Human
ugaauuuaaaaaaaaaaaaaaag

SEQ ID NO: 148982 - RNA, 20 nt, Human
ugaggagggggcaggucccc

SEQ ID NO: 148983 - RNA, 20 nt, Human
ugaggggguggggaaaacca

SEQ ID NO: 148984 - RNA, 24 nt, Human
ugggggcagggcccucccagaugc

SEQ ID NO: 148985 - RNA, 23 nt, Human
uguaguuuuauucagguuugauu

SEQ ID NO: 148986 - RNA, 20 nt, Human
ugugaggggagaagaggagg

SEQ ID NO: 148987 - RNA, 20 nt, Human
uuaaaaaaaaaaaaaaaaaa

SEQ ID NO: 148988 - RNA, 21 nt, Human
aaaacccugguuuaucaucua

SEQ ID NO: 148989 - RNA, 21 nt, Human
aaacaacugagaaacaacuuu

SEQ ID NO: 148990 - RNA, 24 nt, Human
aaagcaaaaacaacugagaaacaa

SEQ ID NO: 148991 - RNA, 24 nt, Human
aaauuccaaagucaaauagcuacu

SEQ ID NO: 148992 - RNA, 23 nt, Human
aacccagcacaaucugaaaacaa

SEQ ID NO: 148993 - RNA, 20 nt, Human
aauugcuugcaaaacuaacc

SEQ ID NO: 148994 - RNA, 24 nt, Human
acaaauacaaacuuaggcuuccuc

SEQ ID NO: 148995 - RNA, 23 nt, Human
acaacugagaaacaacuuuucau

SEQ ID NO: 148996 - RNA, 24 nt, Human
acaaugaaaaaaaauuugacuaga

SEQ ID NO: 148997 - RNA, 24 nt, Human
acaggaaaaaauuauauuggaaca

SEQ ID NO: 148998 - RNA, 19 nt, Human
accaccauauaagguuaca

SEQ ID NO: 148999 - RNA, 19 nt, Human
acugucuuuugugucuucc

SEQ ID NO: 149000 - RNA, 20 nt, Human
agauuuaccaaaacaguuug

SEQ ID NO: 149001 - RNA, 21 nt, Human
agcaaaaggcacaaaaagccu

SEQ ID NO: 149002 - RNA, 22 nt, Human
agguaauacaaaguccaaaagc

SEQ ID NO: 149003 - RNA, 21 nt, Human
aguauaccucgaaugcaaaau

SEQ ID NO: 149004 - RNA, 18 nt, Human
aguggugugaucucagcu

SEQ ID NO: 149005 - RNA, 24 nt, Human
auaaaacauacagguaauacaaag

SEQ ID NO: 149006 - RNA, 22 nt, Human
auaguuggaaaacaagcauugc

SEQ ID NO: 149007 - RNA, 22 nt, Human
caaaguuaaaagcaaaaacaac

SEQ ID NO: 149008 - RNA, 23 nt, Human
caacuaaacgagaaaaagauuuc

SEQ ID NO: 149009 - RNA, 24 nt, Human
caauaccacuuuaugcuacauugu

SEQ ID NO: 149010 - RNA, 19 nt, Human
cacagagcaacuaaacgag

SEQ ID NO: 149011 - RNA, 22 nt, Human
cacaugguugcauguggccacc

SEQ ID NO: 149012 - RNA, 19 nt, Human
caccucuuuucccaacuca

SEQ ID NO: 149013 - RNA, 24 nt, Human
cagauaaacaagguacuguaugga

SEQ ID NO: 149014 - RNA, 21 nt, Human
cauaguaucauguaaagcaga

SEQ ID NO: 149015 - RNA, 20 nt, Human
caugguugcauguggccacc

SEQ ID NO: 149016 - RNA, 21 nt, Human
cauugcucugacuugaaagau

SEQ ID NO: 149017 - RNA, 27 nt, Human
ccacagagcaacuaaacgagaaaaaga

SEQ ID NO: 149018 - RNA, 23 nt, Human
cccggguucaagcaauucucaug

SEQ ID NO: 149019 - RNA, 19 nt, Human
ccuucugccaaccauaaga

SEQ ID NO: 149020 - RNA, 19 nt, Human
ccuucugcugucacuuucc

SEQ ID NO: 149021 - RNA, 18 nt, Human
cuaacuaaaacacaggaa

SEQ ID NO: 149022 - RNA, 19 nt, Human
cuagaauccuagccaucca

SEQ ID NO: 149023 - RNA, 18 nt, Human
cucaaaaaaaaaaaaaaa

SEQ ID NO: 149024 - RNA, 25 nt, Human
cucaaaaaaaaaaaaaaaaaaggaa

SEQ ID NO: 149025 - RNA, 22 nt, Human
cucacggcaaccuucacuuccc

SEQ ID NO: 149026 - RNA, 28 nt, Human
cucaugccucaaaaaaaaaaaaaaaaaa

SEQ ID NO: 149027 - RNA, 21 nt, Human
cugacuugaaagaugaacgua

SEQ ID NO: 149028 - RNA, 25 nt, Human
cuguuuuuuuuuuuguuuccaguuu

SEQ ID NO: 149029 - RNA, 18 nt, Human
cuugcaaaacuaacccag

SEQ ID NO: 149030 - RNA, 21 nt, Human
cuugcuaacuaacuuucaccc

SEQ ID NO: 149031 - RNA, 23 nt, Human
gaaugcaaaauuccaaagucaaa

SEQ ID NO: 149032 - RNA, 18 nt, Human
gacuagaggauggcauaa

SEQ ID NO: 149033 - RNA, 18 nt, Human
gacugacauacugaaaac

SEQ ID NO: 149034 - RNA, 26 nt, Human
gaguauuuacugauaaauauuacuau

SEQ ID NO: 149035 - RNA, 22 nt, Human
gaucugaguagacagagaaugu

SEQ ID NO: 149036 - RNA, 21 nt, Human
gcaguggugugaucucagcuc

SEQ ID NO: 149037 - RNA, 19 nt, Human
gccaccuucugcugucacu

SEQ ID NO: 149038 - RNA, 21 nt, Human
gggcaggggagaugguaguuu

SEQ ID NO: 149039 - RNA, 20 nt, Human
ggugugaucucagcucacgg

SEQ ID NO: 149040 - RNA, 21 nt, Human
guaaagcagaucacucccuuu

SEQ ID NO: 149041 - RNA, 24 nt, Human
uaaaagcaaaaacaacugagaaac

SEQ ID NO: 149042 - RNA, 18 nt, Human
uaagaagcagauaaacaa

SEQ ID NO: 149043 - RNA, 24 nt, Human
uaagagauuuaccaaaaccggggc

SEQ ID NO: 149044 - RNA, 24 nt, Human
uaauacaaaguccaaaagccuguc

SEQ ID NO: 149045 - RNA, 23 nt, Human
uacauuaagagauuuaccaaaac

SEQ ID NO: 149046 - RNA, 24 nt, Human
uacauuaagagauuuaccaaaaca

SEQ ID NO: 149047 - RNA, 22 nt, Human
uacuguauggaacgaucaaaac

SEQ ID NO: 149048 - RNA, 21 nt, Human
uauggcaguggugugaucuca

SEQ ID NO: 149049 - RNA, 21 nt, Human
ucaaaacuuggccugagcugu

SEQ ID NO: 149050 - RNA, 21 nt, Human
ucaacccucuuugccacuguc

SEQ ID NO: 149051 - RNA, 24 nt, Human
ucaugccucaaaaaaaaaaaaaaa

SEQ ID NO: 149052 - RNA, 20 nt, Human
ucccggguucaagcaauucu

SEQ ID NO: 149053 - RNA, 21 nt, Human
ucccggguucaagcaauucuc

SEQ ID NO: 149054 - RNA, 24 nt, Human
ucccggguucaagcaauucucaug

SEQ ID NO: 149055 - RNA, 18 nt, Human
uccgaucagaaaugccac

SEQ ID NO: 149056 - RNA, 22 nt, Human
ucgaaugcaaaauuccaaaguc

SEQ ID NO: 149057 - RNA, 24 nt, Human
ucucaugccucaaaaaaaaaaaaa

SEQ ID NO: 149058 - RNA, 21 nt, Human
ucuucugauaauuaauccuag

SEQ ID NO: 149059 - RNA, 22 nt, Human
ugaaaaaaaauuugacuagagg

SEQ ID NO: 149060 - RNA, 23 nt, Human
ugaaaaaaaauuugacuagagga

SEQ ID NO: 149061 - RNA, 22 nt, Human
ugaaagaugaacguauauauga

SEQ ID NO: 149062 - RNA, 18 nt, Human
ugacauacugaaaaccac

SEQ ID NO: 149063 - RNA, 18 nt, Human
ugcaaaacuaacccagca

SEQ ID NO: 149064 - RNA, 20 nt, Human
uggaaaacaagcauugcaua

SEQ ID NO: 149065 - RNA, 22 nt, Human
ugggcaggggagaugguaguuu

SEQ ID NO: 149066 - RNA, 24 nt, Human
uggugugaucucagcucacggcaa

SEQ ID NO: 149067 - RNA, 23 nt, Human
ugucauguuuauggcaguggugu

SEQ ID NO: 149068 - RNA, 18 nt, Human
uguuguccaaggacacaa

SEQ ID NO: 149069 - RNA, 21 nt, Human
uguuuauggcaguggugugau

SEQ ID NO: 149070 - RNA, 19 nt, Human
uuaaaacccugguuuauca

SEQ ID NO: 149071 - RNA, 22 nt, Human
uuaaaagcaaaaacaacugaga

SEQ ID NO: 149072 - RNA, 26 nt, Human
uuaaaagcaaaaacaacugagaaaca

SEQ ID NO: 149073 - RNA, 21 nt, Human
uucaagaaaugacaguauacc

SEQ ID NO: 149074 - RNA, 24 nt, Human
uucaagaaaugacaguauaccucg

SEQ ID NO: 149075 - RNA, 20 nt, Human
uucaauaccacuuuaugcua

SEQ ID NO: 149076 - RNA, 23 nt, Human
uucacccaacaguucagugcccu

SEQ ID NO: 149077 - RNA, 20 nt, Human
uuccaagaagaggcuguuuu

SEQ ID NO: 149078 - RNA, 24 nt, Human
uuuuuuuuuuuuuuuuuuuuuggg

SEQ ID NO: 149079 - RNA, 21 nt, Human
ccagaugcuggagaguguggg

SEQ ID NO: 149080 - RNA, 24 nt, Human
ccagaugcuggagagugugggugu

SEQ ID NO: 149081 - RNA, 23 nt, Human
cuggggcuccggggucucugccc

SEQ ID NO: 149082 - RNA, 18 nt, Human
ggggcuggggcuccgggg

SEQ ID NO: 149083 - RNA, 19 nt, Human
ggggcuggggcuccggggu

SEQ ID NO: 149084 - RNA, 19 nt, Human
uccggggucucugccccuc

SEQ ID NO: 149085 - RNA, 21 nt, Human
uggggcuggggcuccgggguc

SEQ ID NO: 149086 - RNA, 18 nt, Human
aaacugagaaagccgccg

SEQ ID NO: 149087 - RNA, 21 nt, Human
acgcccgcguuucccgugccc

SEQ ID NO: 149088 - RNA, 21 nt, Human
cgcccgcguuucccgugcccu

SEQ ID NO: 149089 - RNA, 23 nt, Human
cuugcuuccguguggcagccucc

SEQ ID NO: 149090 - RNA, 22 nt, Human
gacccacugauccuguuacucu

SEQ ID NO: 149091 - RNA, 20 nt, Human
gcccgucuccaccaaaacug

SEQ ID NO: 149092 - RNA, 21 nt, Human
gccuccugggggaccgugcuc

SEQ ID NO: 149093 - RNA, 19 nt, Human
ggagcccaagccucggcac

SEQ ID NO: 149094 - RNA, 19 nt, Human
ggagggcagauacgggugc

SEQ ID NO: 149095 - RNA, 23 nt, Human
uaaaaacugccuugaaaugaaau

SEQ ID NO: 149096 - RNA, 20 nt, Human
uaagucucggacacuuagac

SEQ ID NO: 149097 - RNA, 22 nt, Human
uaccagcaaggagggcagauac

SEQ ID NO: 149098 - RNA, 26 nt, Human
ucaaucuuuauugcagcugaaauacu

SEQ ID NO: 149099 - RNA, 18 nt, Human
uccaccaaaacugagaaa

SEQ ID NO: 149100 - RNA, 19 nt, Human
ucuccaccaaaacugagaa

SEQ ID NO: 149101 - RNA, 19 nt, Human
ucucuggugugcagggaau

SEQ ID NO: 149102 - RNA, 24 nt, Human
ugaaaugaaauuaguucaucugcu

SEQ ID NO: 149103 - RNA, 18 nt, Human
ugccuugaaaugaaauua

SEQ ID NO: 149104 - RNA, 23 nt, Human
uucaucugcuugcuuccgugugg

SEQ ID NO: 149105 - RNA, 22 nt, Human
uuccguguggcagccuccuggc

SEQ ID NO: 149106 - RNA, 18 nt, Human
uuuuuuuuuuuuuuuuug

SEQ ID NO: 149107 - RNA, 19 nt, Human
uuuuuuuuuuuuuuuuugc

SEQ ID NO: 149108 - RNA, 21 nt, Human
uuuuuuuuuuuuuuuuugcaa

SEQ ID NO: 149109 - RNA, 18 nt, Human
acaaaaaaagcaugagcg

SEQ ID NO: 149110 - RNA, 22 nt, Human
caaagacaaacacuugugaaaa

SEQ ID NO: 149111 - RNA, 18 nt, Human
cgggcgggaggcggcggc

SEQ ID NO: 149112 - RNA, 30 nt, Human
gcgggcccggggcugcuccggggcgggcgg

SEQ ID NO: 149113 - RNA, 19 nt, Human
ggaggcggcggcggcgcgg

SEQ ID NO: 149114 - RNA, 19 nt, Human
ggcgggaggcggcggcggc

SEQ ID NO: 149115 - RNA, 20 nt, Human
gggcccggggcugcuccggg

SEQ ID NO: 149116 - RNA, 23 nt, Human
gggcgggcgggaggcggcggcgg

SEQ ID NO: 149117 - RNA, 19 nt, Human
ucagacaaagacaaacacu

SEQ ID NO: 149118 - RNA, 23 nt, Human
ucggccucgguagcgguggcggc

SEQ ID NO: 149119 - RNA, 23 nt, Human
uguacacuaacaagaaaaguuuc

SEQ ID NO: 149120 - RNA, 22 nt, Human
uucaacuccuucacucuuaauu

SEQ ID NO: 149121 - RNA, 19 nt, Human
aaaaaaaagacacaaccaa

SEQ ID NO: 149122 - RNA, 23 nt, Human
aaaaaaaagacacaaccaacuga

SEQ ID NO: 149123 - RNA, 27 nt, Human
aaaaaaaagacacaaccaacugaagaa

SEQ ID NO: 149124 - RNA, 25 nt, Human
aaaaaggaaaaaggggggaaaaaaa

SEQ ID NO: 149125 - RNA, 21 nt, Human
aaaagaagcaaauaaaaagaa

SEQ ID NO: 149126 - RNA, 22 nt, Human
aaaaggggcaagaaaaacaaac

SEQ ID NO: 149127 - RNA, 21 nt, Human
aaacagacauaacagcaaugc

SEQ ID NO: 149128 - RNA, 20 nt, Human
aaagaagcaaauaaaaagaa

SEQ ID NO: 149129 - RNA, 19 nt, Human
aaagacacaaccaacugaa

SEQ ID NO: 149130 - RNA, 21 nt, Human
aaagacggagagacuacccuc

SEQ ID NO: 149131 - RNA, 22 nt, Human
aagaaaagagacgaaagaacgu

SEQ ID NO: 149132 - RNA, 20 nt, Human
aagaacagaaauagggggag

SEQ ID NO: 149133 - RNA, 20 nt, Human
aagaguuuaaaaagacggaa

SEQ ID NO: 149134 - RNA, 23 nt, Human
aaggggggaaaaaaaagacacaa

SEQ ID NO: 149135 - RNA, 22 nt, Human
acagguaaaacccuguaccucu

SEQ ID NO: 149136 - RNA, 21 nt, Human
acauaacagcaaugcuuuaaa

SEQ ID NO: 149137 - RNA, 21 nt, Human
agaaaaacaaaccaaggaaca

SEQ ID NO: 149138 - RNA, 23 nt, Human
agaaaaacaaaccaaggaacaaa

SEQ ID NO: 149139 - RNA, 26 nt, Human
agaaaaacaaaccaaggaacaaagaa

SEQ ID NO: 149140 - RNA, 19 nt, Human
agaaacgcuuucgaccccc

SEQ ID NO: 149141 - RNA, 18 nt, Human
agaaauagggggaggacc

SEQ ID NO: 149142 - RNA, 20 nt, Human
agacagcacgaaaccuaaac

SEQ ID NO: 149143 - RNA, 27 nt, Human
aggaacaaagaaaagagaccgguaccc

SEQ ID NO: 149144 - RNA, 18 nt, Human
caaaccaaggaacaaaga

SEQ ID NO: 149145 - RNA, 21 nt, Human
caacugaagaauuacaacaca

SEQ ID NO: 149146 - RNA, 18 nt, Human
caaggaacaaagaaaaga

SEQ ID NO: 149147 - RNA, 25 nt, Human
cagcaaugcuuuaaauguaaaccaa

SEQ ID NO: 149148 - RNA, 19 nt, Human
caggcucacaguaacuaug

SEQ ID NO: 149149 - RNA, 20 nt, Human
caucucuaacuaagaacaga

SEQ ID NO: 149150 - RNA, 19 nt, Human
ccccaaaguccaaagcuaa

SEQ ID NO: 149151 - RNA, 21 nt, Human
cccccccuuccccaacccaaa

SEQ ID NO: 149152 - RNA, 18 nt, Human
ccuguaccucuuguccau

SEQ ID NO: 149153 - RNA, 22 nt, Human
cuaaaagaaauggcccaaaaaa

SEQ ID NO: 149154 - RNA, 19 nt, Human
cucacagguucaaggcagu

SEQ ID NO: 149155 - RNA, 24 nt, Human
cucuuaagacagcacgaaaccuaa

SEQ ID NO: 149156 - RNA, 26 nt, Human
cugaagaauuacaacacaaagccuca

SEQ ID NO: 149157 - RNA, 24 nt, Human
cuguaccucuuguccauauucaac

SEQ ID NO: 149158 - RNA, 23 nt, Human
cuuguccauauucaacauaaaag

SEQ ID NO: 149159 - RNA, 25 nt, Human
cuuuaaauguaaaccaaacacaaag

SEQ ID NO: 149160 - RNA, 25 nt, Human
gaaaaaaaagacacaaccaacugaa

SEQ ID NO: 149161 - RNA, 29 nt, Human
gaaaaaaaagacacaaccaacugaagaag

SEQ ID NO: 149162 - RNA, 18 nt, Human
gacugaggacaagagcuc

SEQ ID NO: 149163 - RNA, 27 nt, Human
gcaagaaaaacaaaccaaggaacaaag

SEQ ID NO: 149164 - RNA, 18 nt, Human
gccuccuucaacugccuu
